United States Patent 7,691,997 (FUNCTIONAL AND HYPERFUNCTIONAL SIRNA) - sequence listing, part 8

SEQ ID NO: 290013 - RNA, 19 nt, Homo sapiens
caucuugugucuuauucaa

SEQ ID NO: 290014 - RNA, 19 nt, Homo sapiens
gugcaucgcggcuaauauu

SEQ ID NO: 290015 - RNA, 19 nt, Homo sapiens
uacuagggaucauguguuu

SEQ ID NO: 290016 - RNA, 19 nt, Homo sapiens
uguaugauguuucccauuc

SEQ ID NO: 290017 - RNA, 19 nt, Homo sapiens
uaaggaaugaggaaacaaa

SEQ ID NO: 290018 - RNA, 19 nt, Homo sapiens
gcacacuuucaucuaauuu

SEQ ID NO: 290019 - RNA, 19 nt, Homo sapiens
gagcugaagacaaagagaa

SEQ ID NO: 290020 - RNA, 19 nt, Homo sapiens
gugcgaugcuuucuucugu

SEQ ID NO: 290021 - RNA, 19 nt, Homo sapiens
uaaagcaguugaucagcau

SEQ ID NO: 290022 - RNA, 19 nt, Homo sapiens
caagaggcccuuugaacug

SEQ ID NO: 290023 - RNA, 19 nt, Homo sapiens
gcaggaggaccacgaggaa

SEQ ID NO: 290024 - RNA, 19 nt, Homo sapiens
caucacaacuuacaaugcu

SEQ ID NO: 290025 - RNA, 19 nt, Homo sapiens
aguaauaaauggagugcuu

SEQ ID NO: 290026 - RNA, 19 nt, Homo sapiens
cgacaaccuggaaagauuu

SEQ ID NO: 290027 - RNA, 19 nt, Homo sapiens
gcagaaggaccacuauguc

SEQ ID NO: 290028 - RNA, 19 nt, Homo sapiens
gggcacacuuucaucuaau

SEQ ID NO: 290029 - RNA, 19 nt, Homo sapiens
cggcuaauauuuugcuuua

SEQ ID NO: 290030 - RNA, 19 nt, Homo sapiens
gcucucaccaacagcaaua

SEQ ID NO: 290031 - RNA, 19 nt, Homo sapiens
caaacgaugugcgaugcuu

SEQ ID NO: 290032 - RNA, 19 nt, Homo sapiens
gccagcauuugucuucauu

SEQ ID NO: 290033 - RNA, 19 nt, Homo sapiens
gaagggcacacuuucaucu

SEQ ID NO: 290034 - RNA, 19 nt, Homo sapiens
ggcacacuuucaucuaauu

SEQ ID NO: 290035 - RNA, 19 nt, Homo sapiens
gaaugcaucacaacuuaca

SEQ ID NO: 290036 - RNA, 19 nt, Homo sapiens
uaacaagaggcccuuugaa

SEQ ID NO: 290037 - RNA, 19 nt, Homo sapiens
ggaaugaggaaacaaacca

SEQ ID NO: 290038 - RNA, 19 nt, Homo sapiens
uuaaagaugucuaguugcu

SEQ ID NO: 290039 - RNA, 19 nt, Homo sapiens
caguggaacuacaccuuug

SEQ ID NO: 290040 - RNA, 19 nt, Homo sapiens
ugaauaaagcaguugauca

SEQ ID NO: 290041 - RNA, 19 nt, Homo sapiens
ggacugauugagaauguuc

SEQ ID NO: 290042 - RNA, 19 nt, Homo sapiens
ccuuugaacugccuugugu

SEQ ID NO: 290043 - RNA, 19 nt, Homo sapiens
gaauggaauguaucucugu

SEQ ID NO: 290044 - RNA, 19 nt, Homo sapiens
caccagaagggcacacuuu

SEQ ID NO: 290045 - RNA, 19 nt, Homo sapiens
guacuagggaucauguguu

SEQ ID NO: 290046 - RNA, 19 nt, Homo sapiens
ugagaauguuccaauccaa

SEQ ID NO: 290047 - RNA, 19 nt, Homo sapiens
ucacaggaugucaguguuu

SEQ ID NO: 290048 - RNA, 19 nt, Homo sapiens
acaaacgccuguaaagacu

SEQ ID NO: 290049 - RNA, 19 nt, Homo sapiens
cuuccucuauuucauugua

SEQ ID NO: 290050 - RNA, 19 nt, Homo sapiens
ccaguggaacuacaccuuu

SEQ ID NO: 290051 - RNA, 19 nt, Homo sapiens
ugcaggaucuggcuacugu

SEQ ID NO: 290052 - RNA, 19 nt, Homo sapiens
caaaguaugccuccgaaaa

SEQ ID NO: 290053 - RNA, 19 nt, Homo sapiens
agggcacacuuucaucuaa

SEQ ID NO: 290054 - RNA, 19 nt, Homo sapiens
cagcauuugucuucauugg

SEQ ID NO: 290055 - RNA, 19 nt, Homo sapiens
gaauguuccaauccaaaug

SEQ ID NO: 290056 - RNA, 19 nt, Homo sapiens
ggaaggacugauugagaau

SEQ ID NO: 290057 - RNA, 19 nt, Homo sapiens
cuaacaagaggcccuuuga

SEQ ID NO: 290058 - RNA, 19 nt, Homo sapiens
guaugauguuucccauuca

SEQ ID NO: 290059 - RNA, 19 nt, Homo sapiens
gaauguaucucuguuuucu

SEQ ID NO: 290060 - RNA, 19 nt, Homo sapiens
guggaaggacugauugaga

SEQ ID NO: 290061 - RNA, 19 nt, Homo sapiens
gcccuuggcuuagcagaag

SEQ ID NO: 290062 - RNA, 19 nt, Homo sapiens
gaaggacugauugagaaug

SEQ ID NO: 290063 - RNA, 19 nt, Homo sapiens
uuucacugcuuguaugaug

SEQ ID NO: 290064 - RNA, 19 nt, Homo sapiens
uggcugcucucauuggaau

SEQ ID NO: 290065 - RNA, 19 nt, Homo sapiens
ccagaagggcacacuuuca

SEQ ID NO: 290066 - RNA, 19 nt, Homo sapiens
aaagaaaggcuacgaugac

SEQ ID NO: 290067 - RNA, 19 nt, Homo sapiens
cuccaaagaugaguacuag

SEQ ID NO: 290068 - RNA, 19 nt, Homo sapiens
acacuuucaucuaauuugg

SEQ ID NO: 290069 - RNA, 19 nt, Homo sapiens
guuccaauccaaaugaaug

SEQ ID NO: 290070 - RNA, 19 nt, Homo sapiens
uuuauaagaccaagaagga

SEQ ID NO: 290071 - RNA, 19 nt, Homo sapiens
uggagugcuuggaggcaua

SEQ ID NO: 290072 - RNA, 19 nt, Homo sapiens
ugaguacuaugagauucaa

SEQ ID NO: 290073 - RNA, 19 nt, Homo sapiens
gagguggccugcugaugcu

SEQ ID NO: 290074 - RNA, 19 nt, Homo sapiens
aaggacugauugagaaugu

SEQ ID NO: 290075 - RNA, 19 nt, Homo sapiens
uagaguggaaggacugauu

SEQ ID NO: 290076 - RNA, 19 nt, Homo sapiens
ucauacaccuauaaaucuc

SEQ ID NO: 290077 - RNA, 19 nt, Homo sapiens
cagaagggcacacuuucau

SEQ ID NO: 290078 - RNA, 19 nt, Homo sapiens
caaaugaaugcaucacaac

SEQ ID NO: 290079 - RNA, 19 nt, Homo sapiens
caggaugucaguguuuaaa

SEQ ID NO: 290080 - RNA, 19 nt, Homo sapiens
aauggaauguaucucuguu

SEQ ID NO: 290081 - RNA, 19 nt, Homo sapiens
ggguaucacugagcugaag

SEQ ID NO: 290082 - RNA, 19 nt, Homo sapiens
gaucagcaucauuggaaca

SEQ ID NO: 290083 - RNA, 19 nt, Homo sapiens
caaucuuccucuauuucau

SEQ ID NO: 290084 - RNA, 19 nt, Homo sapiens
aaaccuagcagaccaccau

SEQ ID NO: 290085 - RNA, 19 nt, Homo sapiens
caucgcggcuaauauuuug

SEQ ID NO: 290086 - RNA, 19 nt, Homo sapiens
ggacacaaauuacaaaugu

SEQ ID NO: 290087 - RNA, 19 nt, Homo sapiens
gaaacuggcuuuaccaauc

SEQ ID NO: 290088 - RNA, 19 nt, Homo sapiens
uagcugauguggcuuauua

SEQ ID NO: 290089 - RNA, 19 nt, Homo sapiens
ccacaagugucuuauauau

SEQ ID NO: 290090 - RNA, 19 nt, Homo sapiens
gaacaaugaugggcuuuau

SEQ ID NO: 290091 - RNA, 19 nt, Homo sapiens
guaaacugcuuugugaaua

SEQ ID NO: 290092 - RNA, 19 nt, Homo sapiens
ggaagaaugugucugugaa

SEQ ID NO: 290093 - RNA, 19 nt, Homo sapiens
ggaacucaaugcauaacua

SEQ ID NO: 290094 - RNA, 19 nt, Homo sapiens
gaacagacaaggacacuga

SEQ ID NO: 290095 - RNA, 19 nt, Homo sapiens
gaccacaagugucuuauau

SEQ ID NO: 290096 - RNA, 19 nt, Homo sapiens
gaagggaaauagcaaaugg

SEQ ID NO: 290097 - RNA, 19 nt, Homo sapiens
gaaagaagagaauggcaaa

SEQ ID NO: 290098 - RNA, 19 nt, Homo sapiens
agaagagaauggcaaagua

SEQ ID NO: 290099 - RNA, 19 nt, Homo sapiens
gucaugaguuuguuaguuu

SEQ ID NO: 290100 - RNA, 19 nt, Homo sapiens
gccguaaacugcuuuguga

SEQ ID NO: 290101 - RNA, 19 nt, Homo sapiens
auagggaacucaaugcaua

SEQ ID NO: 290102 - RNA, 19 nt, Homo sapiens
gaagagaauggcaaaguau

SEQ ID NO: 290103 - RNA, 19 nt, Homo sapiens
gaaauuugaccacaagugu

SEQ ID NO: 290104 - RNA, 19 nt, Homo sapiens
aaauggaccugacaguaaa

SEQ ID NO: 290105 - RNA, 19 nt, Homo sapiens
guuaucaacuggauccaaa

SEQ ID NO: 290106 - RNA, 19 nt, Homo sapiens
agacaaggacacugaaaua

SEQ ID NO: 290107 - RNA, 19 nt, Homo sapiens
agugaaaccuguacucaaa

SEQ ID NO: 290108 - RNA, 19 nt, Homo sapiens
ggucaugaguuuguuaguu

SEQ ID NO: 290109 - RNA, 19 nt, Homo sapiens
gaagaagggaaauagcaaa

SEQ ID NO: 290110 - RNA, 19 nt, Homo sapiens
ggaauuguugugcugguua

SEQ ID NO: 290111 - RNA, 19 nt, Homo sapiens
gaauaauaaucgucaaugc

SEQ ID NO: 290112 - RNA, 19 nt, Homo sapiens
gaaggucaugaguuuguua

SEQ ID NO: 290113 - RNA, 19 nt, Homo sapiens
gaacucaaugcauaacuau

SEQ ID NO: 290114 - RNA, 19 nt, Homo sapiens
uaaaggagaugggugagau

SEQ ID NO: 290115 - RNA, 19 nt, Homo sapiens
gaugaaggcagaaaugaau

SEQ ID NO: 290116 - RNA, 19 nt, Homo sapiens
gcaaauggacacaaauuac

SEQ ID NO: 290117 - RNA, 19 nt, Homo sapiens
ugagaaggcugagauaaag

SEQ ID NO: 290118 - RNA, 19 nt, Homo sapiens
gacaaggacacugaaauaa

SEQ ID NO: 290119 - RNA, 19 nt, Homo sapiens
acaagugucuuauauaugc

SEQ ID NO: 290120 - RNA, 19 nt, Homo sapiens
ucuaaaagcugguguuauu

SEQ ID NO: 290121 - RNA, 19 nt, Homo sapiens
gaagaaugugucugugaaa

SEQ ID NO: 290122 - RNA, 19 nt, Homo sapiens
gauuauagaagaagggaaa

SEQ ID NO: 290123 - RNA, 19 nt, Homo sapiens
gugagaaccuacuggauca

SEQ ID NO: 290124 - RNA, 19 nt, Homo sapiens
gaauuguugugcugguuau

SEQ ID NO: 290125 - RNA, 19 nt, Homo sapiens
gcaccugaauucucaaugc

SEQ ID NO: 290126 - RNA, 19 nt, Homo sapiens
aauagcaaauggacacaaa

SEQ ID NO: 290127 - RNA, 19 nt, Homo sapiens
gaucacaacgcguuaucaa

SEQ ID NO: 290128 - RNA, 19 nt, Homo sapiens
aaacacaaagcaagagaaa

SEQ ID NO: 290129 - RNA, 19 nt, Homo sapiens
cuuugaaggucaugaguuu

SEQ ID NO: 290130 - RNA, 19 nt, Homo sapiens
caaauggacacaaauuaca

SEQ ID NO: 290131 - RNA, 19 nt, Homo sapiens
gaaaauggaccugacagua

SEQ ID NO: 290132 - RNA, 19 nt, Homo sapiens
ccuacuggaucaucauuga

SEQ ID NO: 290133 - RNA, 19 nt, Homo sapiens
ucuauuuacuugagucuug

SEQ ID NO: 290134 - RNA, 19 nt, Homo sapiens
ggagaugggugagaugcau

SEQ ID NO: 290135 - RNA, 19 nt, Homo sapiens
ucaacuggauccaaaauuu

SEQ ID NO: 290136 - RNA, 19 nt, Homo sapiens
gauccugacugcgaugaga

SEQ ID NO: 290137 - RNA, 19 nt, Homo sapiens
acaaugaugggcuuuauga

SEQ ID NO: 290138 - RNA, 19 nt, Homo sapiens
acuacaagcuggccguaaa

SEQ ID NO: 290139 - RNA, 19 nt, Homo sapiens
caaggacacugaaauaacc

SEQ ID NO: 290140 - RNA, 19 nt, Homo sapiens
aaacuggcuuuaccaaucu

SEQ ID NO: 290141 - RNA, 19 nt, Homo sapiens
ucacgaguauuuuguauga

SEQ ID NO: 290142 - RNA, 19 nt, Homo sapiens
uagcaaauggacacaaauu

SEQ ID NO: 290143 - RNA, 19 nt, Homo sapiens
gaauggcaaaguaugagaa

SEQ ID NO: 290144 - RNA, 19 nt, Homo sapiens
aaucgucaaugccagugua

SEQ ID NO: 290145 - RNA, 19 nt, Homo sapiens
ggaucaucauugaacuaaa

SEQ ID NO: 290146 - RNA, 19 nt, Homo sapiens
caacuggauccaaaauuua

SEQ ID NO: 290147 - RNA, 19 nt, Homo sapiens
aaaagcaccugaauucuca

SEQ ID NO: 290148 - RNA, 19 nt, Homo sapiens
gcugauguggcuuauuauu

SEQ ID NO: 290149 - RNA, 19 nt, Homo sapiens
agaaaugaauggcucaaaa

SEQ ID NO: 290150 - RNA, 19 nt, Homo sapiens
uuacuugagucuuguacau

SEQ ID NO: 290151 - RNA, 19 nt, Homo sapiens
gaacacugcuggggucaga

SEQ ID NO: 290152 - RNA, 19 nt, Homo sapiens
gagaugggugagaugcaua

SEQ ID NO: 290153 - RNA, 19 nt, Homo sapiens
guaugagaaggcugagaua

SEQ ID NO: 290154 - RNA, 19 nt, Homo sapiens
ugaccacaagugucuuaua

SEQ ID NO: 290155 - RNA, 19 nt, Homo sapiens
ucacaacgcguuaucaacu

SEQ ID NO: 290156 - RNA, 19 nt, Homo sapiens
aaaauggaccugacaguaa

SEQ ID NO: 290157 - RNA, 19 nt, Homo sapiens
cugauguggcuuauuauuu

SEQ ID NO: 290158 - RNA, 19 nt, Homo sapiens
gaacuaaaacacaaagcaa

SEQ ID NO: 290159 - RNA, 19 nt, Homo sapiens
ggugaugaaggcagaaaug

SEQ ID NO: 290160 - RNA, 19 nt, Homo sapiens
ucaggaagaaugugucugu

SEQ ID NO: 290161 - RNA, 19 nt, Homo sapiens
agcaaauggacacaaauua

SEQ ID NO: 290162 - RNA, 19 nt, Homo sapiens
agagaauggcaaaguauga

SEQ ID NO: 290163 - RNA, 19 nt, Homo sapiens
uguuauugcuguuauugug

SEQ ID NO: 290164 - RNA, 19 nt, Homo sapiens
uauugugguuguggugaua

SEQ ID NO: 290165 - RNA, 19 nt, Homo sapiens
ccaguguacuucaguuggu

SEQ ID NO: 290166 - RNA, 19 nt, Homo sapiens
cguaaacugcuuugugaau

SEQ ID NO: 290167 - RNA, 19 nt, Homo sapiens
aaacuugggagaagagcaa

SEQ ID NO: 290168 - RNA, 19 nt, Homo sapiens
ugaaggucaugaguuuguu

SEQ ID NO: 290169 - RNA, 19 nt, Homo sapiens
gcucaaaacuugggagaag

SEQ ID NO: 290170 - RNA, 19 nt, Homo sapiens
uagaagaagggaaauagca

SEQ ID NO: 290171 - RNA, 19 nt, Homo sapiens
uauagaagaagggaaauag

SEQ ID NO: 290172 - RNA, 19 nt, Homo sapiens
uaugagaaggcugagauaa

SEQ ID NO: 290173 - RNA, 19 nt, Homo sapiens
gugaugaaggcagaaauga

SEQ ID NO: 290174 - RNA, 19 nt, Homo sapiens
gaaccuacuggaucaucau

SEQ ID NO: 290175 - RNA, 19 nt, Homo sapiens
ugccgcagcucaggaagaa

SEQ ID NO: 290176 - RNA, 19 nt, Homo sapiens
gagaagagcaaaaccugaa

SEQ ID NO: 290177 - RNA, 19 nt, Homo sapiens
aggcugagauaaaggagau

SEQ ID NO: 290178 - RNA, 19 nt, Homo sapiens
ugaugaaggcagaaaugaa

SEQ ID NO: 290179 - RNA, 19 nt, Homo sapiens
cacaacgcguuaucaacug

SEQ ID NO: 290180 - RNA, 19 nt, Homo sapiens
augagaaggcugagauaaa

SEQ ID NO: 290181 - RNA, 19 nt, Homo sapiens
gcaguuguugcuggaauug

SEQ ID NO: 290182 - RNA, 19 nt, Homo sapiens
ggagaucacaacgcguuau

SEQ ID NO: 290183 - RNA, 19 nt, Homo sapiens
cagacaaggacacugaaau

SEQ ID NO: 290184 - RNA, 19 nt, Homo sapiens
uguaauagugaaaccugua

SEQ ID NO: 290185 - RNA, 19 nt, Homo sapiens
gaaauagcaaauggacaca

SEQ ID NO: 290186 - RNA, 19 nt, Homo sapiens
ggacugaucuuucuuuaau

SEQ ID NO: 290187 - RNA, 19 nt, Homo sapiens
ggucuuaucuguccacaua

SEQ ID NO: 290188 - RNA, 19 nt, Homo sapiens
agaaagggaugaccauuua

SEQ ID NO: 290189 - RNA, 19 nt, Homo sapiens
gaaaugugccugcagcaua

SEQ ID NO: 290190 - RNA, 19 nt, Homo sapiens
caacgagacucacaucuuc

SEQ ID NO: 290191 - RNA, 19 nt, Homo sapiens
gcagauggcugugacuuug

SEQ ID NO: 290192 - RNA, 19 nt, Homo sapiens
ggacuguggucuuaucugu

SEQ ID NO: 290193 - RNA, 19 nt, Homo sapiens
ccaaaggaauggagcaguu

SEQ ID NO: 290194 - RNA, 19 nt, Homo sapiens
caaguacucucguuuaguc

SEQ ID NO: 290195 - RNA, 19 nt, Homo sapiens
guugauugcuuucauguug

SEQ ID NO: 290196 - RNA, 19 nt, Homo sapiens
acacauacaucuacaucuu

SEQ ID NO: 290197 - RNA, 19 nt, Homo sapiens
guaaagagucagagaaaga

SEQ ID NO: 290198 - RNA, 19 nt, Homo sapiens
caucacugguugcuguuua

SEQ ID NO: 290199 - RNA, 19 nt, Homo sapiens
caguguggguuccaucuua

SEQ ID NO: 290200 - RNA, 19 nt, Homo sapiens
caucuuacuugucacguuu

SEQ ID NO: 290201 - RNA, 19 nt, Homo sapiens
gcaaaguccaagauuguuu

SEQ ID NO: 290202 - RNA, 19 nt, Homo sapiens
gggcaggccuggugcaaau

SEQ ID NO: 290203 - RNA, 19 nt, Homo sapiens
gacaucagaaguuacaaua

SEQ ID NO: 290204 - RNA, 19 nt, Homo sapiens
gcuuccaucuuccuguuua

SEQ ID NO: 290205 - RNA, 19 nt, Homo sapiens
caaaaugccuauccagaaa

SEQ ID NO: 290206 - RNA, 19 nt, Homo sapiens
gugaugaucuccugcaauc

SEQ ID NO: 290207 - RNA, 19 nt, Homo sapiens
uauaguagccuccaugaga

SEQ ID NO: 290208 - RNA, 19 nt, Homo sapiens
gacacuggauuucuuuaau

SEQ ID NO: 290209 - RNA, 19 nt, Homo sapiens
caucucacccuuacuauug

SEQ ID NO: 290210 - RNA, 19 nt, Homo sapiens
auacaggguugauugcuuu

SEQ ID NO: 290211 - RNA, 19 nt, Homo sapiens
caucagaaguuacaauagg

SEQ ID NO: 290212 - RNA, 19 nt, Homo sapiens
ggacuggacugcuacuacu

SEQ ID NO: 290213 - RNA, 19 nt, Homo sapiens
uauaauagggccugugaaa

SEQ ID NO: 290214 - RNA, 19 nt, Homo sapiens
gaaguuacaauaggcauau

SEQ ID NO: 290215 - RNA, 19 nt, Homo sapiens
gaagaaagggaugaccauu

SEQ ID NO: 290216 - RNA, 19 nt, Homo sapiens
aaaugugccugcagcauau

SEQ ID NO: 290217 - RNA, 19 nt, Homo sapiens
cuaaacaugucgcacuuuc

SEQ ID NO: 290218 - RNA, 19 nt, Homo sapiens
ccaguucguuggaaaggaa

SEQ ID NO: 290219 - RNA, 19 nt, Homo sapiens
guacucucguuuagucuga

SEQ ID NO: 290220 - RNA, 19 nt, Homo sapiens
ccaugagaaucugguauuu

SEQ ID NO: 290221 - RNA, 19 nt, Homo sapiens
guagauugcacuuuauaug

SEQ ID NO: 290222 - RNA, 19 nt, Homo sapiens
ccacagggguuccagaaaa

SEQ ID NO: 290223 - RNA, 19 nt, Homo sapiens
gacuuugucugccguucua

SEQ ID NO: 290224 - RNA, 19 nt, Homo sapiens
gugggauccugaugucuuu

SEQ ID NO: 290225 - RNA, 19 nt, Homo sapiens
gaugaccauuuauuaccaa

SEQ ID NO: 290226 - RNA, 19 nt, Homo sapiens
ggguaaagagucagagaaa

SEQ ID NO: 290227 - RNA, 19 nt, Homo sapiens
aaacugccuucccuuuguu

SEQ ID NO: 290228 - RNA, 19 nt, Homo sapiens
ggaugaccauuuauuacca

SEQ ID NO: 290229 - RNA, 19 nt, Homo sapiens
ggauugggcuaaggacugu

SEQ ID NO: 290230 - RNA, 19 nt, Homo sapiens
cuaccaguauuucuaaaca

SEQ ID NO: 290231 - RNA, 19 nt, Homo sapiens
aagggaugaccauuuauua

SEQ ID NO: 290232 - RNA, 19 nt, Homo sapiens
guccaaguacucucguuua

SEQ ID NO: 290233 - RNA, 19 nt, Homo sapiens
guuauucuguacccuauag

SEQ ID NO: 290234 - RNA, 19 nt, Homo sapiens
gaaagggaugaccauuuau

SEQ ID NO: 290235 - RNA, 19 nt, Homo sapiens
aagaaagggaugaccauuu

SEQ ID NO: 290236 - RNA, 19 nt, Homo sapiens
guggcaaaguccaagauug

SEQ ID NO: 290237 - RNA, 19 nt, Homo sapiens
caaaggaauggagcaguuu

SEQ ID NO: 290238 - RNA, 19 nt, Homo sapiens
gaugaucuccugcaaucga

SEQ ID NO: 290239 - RNA, 19 nt, Homo sapiens
guucagacacauacaucua

SEQ ID NO: 290240 - RNA, 19 nt, Homo sapiens
gguaaagagucagagaaag

SEQ ID NO: 290241 - RNA, 19 nt, Homo sapiens
auaguagccuccaugagaa

SEQ ID NO: 290242 - RNA, 19 nt, Homo sapiens
gcucacuggccguuuguuu

SEQ ID NO: 290243 - RNA, 19 nt, Homo sapiens
ccucaucucacccuuacua

SEQ ID NO: 290244 - RNA, 19 nt, Homo sapiens
caacuccagucccucaucu

SEQ ID NO: 290245 - RNA, 19 nt, Homo sapiens
aaagggaugaccauuuauu

SEQ ID NO: 290246 - RNA, 19 nt, Homo sapiens
guucuaaaccucgaaaugu

SEQ ID NO: 290247 - RNA, 19 nt, Homo sapiens
aaagggaacggaagcagaa

SEQ ID NO: 290248 - RNA, 19 nt, Homo sapiens
ugucuuucauccauuugua

SEQ ID NO: 290249 - RNA, 19 nt, Homo sapiens
gacacgauguucccuuucu

SEQ ID NO: 290250 - RNA, 19 nt, Homo sapiens
ccaguuugcuuuugauuug

SEQ ID NO: 290251 - RNA, 19 nt, Homo sapiens
gagagaauccuggcagaca

SEQ ID NO: 290252 - RNA, 19 nt, Homo sapiens
gguuccaucuuacuuguca

SEQ ID NO: 290253 - RNA, 19 nt, Homo sapiens
gauuguuucuaccucuuug

SEQ ID NO: 290254 - RNA, 19 nt, Homo sapiens
cuggacugaucuuucuuua

SEQ ID NO: 290255 - RNA, 19 nt, Homo sapiens
gaaauuggggugacuguau

SEQ ID NO: 290256 - RNA, 19 nt, Homo sapiens
uauacaggguugauugcuu

SEQ ID NO: 290257 - RNA, 19 nt, Homo sapiens
gagacacuggauuucuuua

SEQ ID NO: 290258 - RNA, 19 nt, Homo sapiens
acacgauguucccuuucua

SEQ ID NO: 290259 - RNA, 19 nt, Homo sapiens
cuggaggacuggacugcua

SEQ ID NO: 290260 - RNA, 19 nt, Homo sapiens
ggaacgcuggccucugaaa

SEQ ID NO: 290261 - RNA, 19 nt, Homo sapiens
gguaccaucacaucauuug

SEQ ID NO: 290262 - RNA, 19 nt, Homo sapiens
aaacagaggcuuuugcauu

SEQ ID NO: 290263 - RNA, 19 nt, Homo sapiens
ggagcaguuuccccacuua

SEQ ID NO: 290264 - RNA, 19 nt, Homo sapiens
gauagcagccuggccuguu

SEQ ID NO: 290265 - RNA, 19 nt, Homo sapiens
caaaguccaagauuguuuc

SEQ ID NO: 290266 - RNA, 19 nt, Homo sapiens
acauacaucuacaucuuca

SEQ ID NO: 290267 - RNA, 19 nt, Homo sapiens
gggccaggguucagacaca

SEQ ID NO: 290268 - RNA, 19 nt, Homo sapiens
caauaggcauaugggcaaa

SEQ ID NO: 290269 - RNA, 19 nt, Homo sapiens
ucaacgagacucacaucuu

SEQ ID NO: 290270 - RNA, 19 nt, Homo sapiens
cuggagauguucuagacuu

SEQ ID NO: 290271 - RNA, 19 nt, Homo sapiens
ggaggagucagaagaaagg

SEQ ID NO: 290272 - RNA, 19 nt, Homo sapiens
gaagcuggcaaccacacuu

SEQ ID NO: 290273 - RNA, 19 nt, Homo sapiens
agacacuggauuucuuuaa

SEQ ID NO: 290274 - RNA, 19 nt, Homo sapiens
ugagacacuggauuucuuu

SEQ ID NO: 290275 - RNA, 19 nt, Homo sapiens
aagcuacacagccagauuu

SEQ ID NO: 290276 - RNA, 19 nt, Homo sapiens
guagugggagccaaaggaa

SEQ ID NO: 290277 - RNA, 19 nt, Homo sapiens
cugggccacugaagaguaa

SEQ ID NO: 290278 - RNA, 19 nt, Homo sapiens
acgacacgauguucccuuu

SEQ ID NO: 290279 - RNA, 19 nt, Homo sapiens
gcuuucauguuguuauucu

SEQ ID NO: 290280 - RNA, 19 nt, Homo sapiens
agauugcacuuuauauguc

SEQ ID NO: 290281 - RNA, 19 nt, Homo sapiens
gagaauccuggcagacaga

SEQ ID NO: 290282 - RNA, 19 nt, Homo sapiens
guuucuaccucuuugagau

SEQ ID NO: 290283 - RNA, 19 nt, Homo sapiens
guaaugggaaggagacagu

SEQ ID NO: 290284 - RNA, 19 nt, Homo sapiens
gaaaccuggacugaucuuu

SEQ ID NO: 290285 - RNA, 19 nt, Homo sapiens
ggugggauccugaugucuu

SEQ ID NO: 290286 - RNA, 19 nt, Homo sapiens
aaacagagcuucagcaaga

SEQ ID NO: 290287 - RNA, 19 nt, Homo sapiens
caacaaauaugggauguaa

SEQ ID NO: 290288 - RNA, 19 nt, Homo sapiens
caaaucagcccucgaguua

SEQ ID NO: 290289 - RNA, 19 nt, Homo sapiens
agaagaagcugaacagaaa

SEQ ID NO: 290290 - RNA, 19 nt, Homo sapiens
gggaaaggcuuaaucaaga

SEQ ID NO: 290291 - RNA, 19 nt, Homo sapiens
gacaugagcuugagguuga

SEQ ID NO: 290292 - RNA, 19 nt, Homo sapiens
gaaaaucucuaguggauaa

SEQ ID NO: 290293 - RNA, 19 nt, Homo sapiens
ucagaugcauaccaaauua

SEQ ID NO: 290294 - RNA, 19 nt, Homo sapiens
gaagaggaguugucauugu

SEQ ID NO: 290295 - RNA, 19 nt, Homo sapiens
aggguaagcuugaugauua

SEQ ID NO: 290296 - RNA, 19 nt, Homo sapiens
gcaaucagcccuauuacaa

SEQ ID NO: 290297 - RNA, 19 nt, Homo sapiens
caaacgguguucaauauga

SEQ ID NO: 290298 - RNA, 19 nt, Homo sapiens
ccaaacaacugugguuaaa

SEQ ID NO: 290299 - RNA, 19 nt, Homo sapiens
gcuagaggcuugaugaaug

SEQ ID NO: 290300 - RNA, 19 nt, Homo sapiens
gggagcagcuuaugagaga

SEQ ID NO: 290301 - RNA, 19 nt, Homo sapiens
gcaguggaaucaauguaaa

SEQ ID NO: 290302 - RNA, 19 nt, Homo sapiens
ccagaagaguuauuaucua

SEQ ID NO: 290303 - RNA, 19 nt, Homo sapiens
guagcaaucagcccuauua

SEQ ID NO: 290304 - RNA, 19 nt, Homo sapiens
ggacuacaauugucagcuu

SEQ ID NO: 290305 - RNA, 19 nt, Homo sapiens
guagaugaguggacaguug

SEQ ID NO: 290306 - RNA, 19 nt, Homo sapiens
caacagaguauguaaauag

SEQ ID NO: 290307 - RNA, 19 nt, Homo sapiens
ggaaccaauugaucagauu

SEQ ID NO: 290308 - RNA, 19 nt, Homo sapiens
gagaagaagcugaacagaa

SEQ ID NO: 290309 - RNA, 19 nt, Homo sapiens
gcaagugaauuaaucugau

SEQ ID NO: 290310 - RNA, 19 nt, Homo sapiens
gaagacagcgaguacaaga

SEQ ID NO: 290311 - RNA, 19 nt, Homo sapiens
gagguugaaugaacaguau

SEQ ID NO: 290312 - RNA, 19 nt, Homo sapiens
ggaaaggcuuaaucaagau

SEQ ID NO: 290313 - RNA, 19 nt, Homo sapiens
aaucagcccucgaguuauu

SEQ ID NO: 290314 - RNA, 19 nt, Homo sapiens
ggauuacucuggcuaucaa

SEQ ID NO: 290315 - RNA, 19 nt, Homo sapiens
gaacgggacaugagcuuga

SEQ ID NO: 290316 - RNA, 19 nt, Homo sapiens
gaauggagugccaauauug

SEQ ID NO: 290317 - RNA, 19 nt, Homo sapiens
ugaauggagugccaauauu

SEQ ID NO: 290318 - RNA, 19 nt, Homo sapiens
gauggccgcuucuguacuu

SEQ ID NO: 290319 - RNA, 19 nt, Homo sapiens
gcaaagugaaguugaauca

SEQ ID NO: 290320 - RNA, 19 nt, Homo sapiens
gaaaggcaccaguaugugu

SEQ ID NO: 290321 - RNA, 19 nt, Homo sapiens
ccuauaaaguucuaaagga

SEQ ID NO: 290322 - RNA, 19 nt, Homo sapiens
guacauugucugucacuaa

SEQ ID NO: 290323 - RNA, 19 nt, Homo sapiens
uauguuaccagaagaguua

SEQ ID NO: 290324 - RNA, 19 nt, Homo sapiens
aagaacagcuucaaacagu

SEQ ID NO: 290325 - RNA, 19 nt, Homo sapiens
gauaucagcagaauuucaa

SEQ ID NO: 290326 - RNA, 19 nt, Homo sapiens
gcaagaacagcuucaaaca

SEQ ID NO: 290327 - RNA, 19 nt, Homo sapiens
guaugaacaugccuccauu

SEQ ID NO: 290328 - RNA, 19 nt, Homo sapiens
guccuaaucacacauauaa

SEQ ID NO: 290329 - RNA, 19 nt, Homo sapiens
gaggcuugaugaauggaua

SEQ ID NO: 290330 - RNA, 19 nt, Homo sapiens
ggcacuaagucaagauauu

SEQ ID NO: 290331 - RNA, 19 nt, Homo sapiens
ugcaaacgguguucaauau

SEQ ID NO: 290332 - RNA, 19 nt, Homo sapiens
cgacacagguuccuuuggu

SEQ ID NO: 290333 - RNA, 19 nt, Homo sapiens
uagauugauuucccuguuu

SEQ ID NO: 290334 - RNA, 19 nt, Homo sapiens
ucuauuaccuggauaugga

SEQ ID NO: 290335 - RNA, 19 nt, Homo sapiens
gacacagguuccuuuggua

SEQ ID NO: 290336 - RNA, 19 nt, Homo sapiens
gagaagacagcgaguacaa

SEQ ID NO: 290337 - RNA, 19 nt, Homo sapiens
gaaauuguugagcguguuu

SEQ ID NO: 290338 - RNA, 19 nt, Homo sapiens
gcacgucgggagcagcuua

SEQ ID NO: 290339 - RNA, 19 nt, Homo sapiens
ggacaguaguuucaguucu

SEQ ID NO: 290340 - RNA, 19 nt, Homo sapiens
gaaaucacggacaguaguu

SEQ ID NO: 290341 - RNA, 19 nt, Homo sapiens
aagccaagaugcaaaauua

SEQ ID NO: 290342 - RNA, 19 nt, Homo sapiens
caacugcauuucacagcuu

SEQ ID NO: 290343 - RNA, 19 nt, Homo sapiens
ggauauggaaggaaacuau

SEQ ID NO: 290344 - RNA, 19 nt, Homo sapiens
aaagacaggacuacaauug

SEQ ID NO: 290345 - RNA, 19 nt, Homo sapiens
caagcaaaccuuuacauag

SEQ ID NO: 290346 - RNA, 19 nt, Homo sapiens
guauguaaauagacaguuc

SEQ ID NO: 290347 - RNA, 19 nt, Homo sapiens
caaauugggagaugaugaa

SEQ ID NO: 290348 - RNA, 19 nt, Homo sapiens
accaggaagucacaaauaa

SEQ ID NO: 290349 - RNA, 19 nt, Homo sapiens
uggaugccguuucuaagua

SEQ ID NO: 290350 - RNA, 19 nt, Homo sapiens
gacaguaguuucaguucug

SEQ ID NO: 290351 - RNA, 19 nt, Homo sapiens
acaagcaaaccuuuacaua

SEQ ID NO: 290352 - RNA, 19 nt, Homo sapiens
ccacagaaggaaccaauug

SEQ ID NO: 290353 - RNA, 19 nt, Homo sapiens
gcacuaagucaagauauuc

SEQ ID NO: 290354 - RNA, 19 nt, Homo sapiens
caggaagucacaaauaauu

SEQ ID NO: 290355 - RNA, 19 nt, Homo sapiens
ggaaauuguugagcguguu

SEQ ID NO: 290356 - RNA, 19 nt, Homo sapiens
ggauggauaucagcagaau

SEQ ID NO: 290357 - RNA, 19 nt, Homo sapiens
aggcaacaaucucuuuaaa

SEQ ID NO: 290358 - RNA, 19 nt, Homo sapiens
uaaucaaguuccuguacaa

SEQ ID NO: 290359 - RNA, 19 nt, Homo sapiens
ggaugaauucuauaagcua

SEQ ID NO: 290360 - RNA, 19 nt, Homo sapiens
aagaggaguugucauuguu

SEQ ID NO: 290361 - RNA, 19 nt, Homo sapiens
uauuugaaguggcuugaaa

SEQ ID NO: 290362 - RNA, 19 nt, Homo sapiens
gcaaaugaacacucagcaa

SEQ ID NO: 290363 - RNA, 19 nt, Homo sapiens
cagaguauguaaauagaca

SEQ ID NO: 290364 - RNA, 19 nt, Homo sapiens
gaaucaacagaguauguaa

SEQ ID NO: 290365 - RNA, 19 nt, Homo sapiens
ugagcaaagugaaguugaa

SEQ ID NO: 290366 - RNA, 19 nt, Homo sapiens
ggaaaucacggacaguagu

SEQ ID NO: 290367 - RNA, 19 nt, Homo sapiens
cuuaacaguuucuuugaga

SEQ ID NO: 290368 - RNA, 19 nt, Homo sapiens
acacuuaacaguuucuuug

SEQ ID NO: 290369 - RNA, 19 nt, Homo sapiens
gcacaugauacucagauuc

SEQ ID NO: 290370 - RNA, 19 nt, Homo sapiens
gacuacaauugucagcuuu

SEQ ID NO: 290371 - RNA, 19 nt, Homo sapiens
acagagggaugccgcaaau

SEQ ID NO: 290372 - RNA, 19 nt, Homo sapiens
gaggaggauaugaugguua

SEQ ID NO: 290373 - RNA, 19 nt, Homo sapiens
uuacauagcaguggaauca

SEQ ID NO: 290374 - RNA, 19 nt, Homo sapiens
cgguugaggugguaaauuc

SEQ ID NO: 290375 - RNA, 19 nt, Homo sapiens
ggacaaauugggagaugau

SEQ ID NO: 290376 - RNA, 19 nt, Homo sapiens
ggagugugguuuggcagaa

SEQ ID NO: 290377 - RNA, 19 nt, Homo sapiens
gcaaacgguguucaauaug

SEQ ID NO: 290378 - RNA, 19 nt, Homo sapiens
aagcaaaccuuuacauagc

SEQ ID NO: 290379 - RNA, 19 nt, Homo sapiens
aggauucaaugcuggauuu

SEQ ID NO: 290380 - RNA, 19 nt, Homo sapiens
ugaaacgguugagguggua

SEQ ID NO: 290381 - RNA, 19 nt, Homo sapiens
cagcagaagaguacacuga

SEQ ID NO: 290382 - RNA, 19 nt, Homo sapiens
cauaaagacaggacuacaa

SEQ ID NO: 290383 - RNA, 19 nt, Homo sapiens
ugaaugaacaguaugaaca

SEQ ID NO: 290384 - RNA, 19 nt, Homo sapiens
ccgaagaggaguugucauu

SEQ ID NO: 290385 - RNA, 19 nt, Homo sapiens
cuuaugacauguacauugu

SEQ ID NO: 290386 - RNA, 19 nt, Homo sapiens
gaaaagagcuuguccauga

SEQ ID NO: 290387 - RNA, 19 nt, Homo sapiens
ggagugaccuuguauuaaa

SEQ ID NO: 290388 - RNA, 19 nt, Homo sapiens
gacaauaccugcuacagua

SEQ ID NO: 290389 - RNA, 19 nt, Homo sapiens
gaaaaugacuuccagaaaa

SEQ ID NO: 290390 - RNA, 19 nt, Homo sapiens
gaaaugggauucugugaca

SEQ ID NO: 290391 - RNA, 19 nt, Homo sapiens
ggaguggauuuaccaguua

SEQ ID NO: 290392 - RNA, 19 nt, Homo sapiens
ggaagagugugcugauaaa

SEQ ID NO: 290393 - RNA, 19 nt, Homo sapiens
gaacguauacuucccauug

SEQ ID NO: 290394 - RNA, 19 nt, Homo sapiens
gaagagcuaugaccacuca

SEQ ID NO: 290395 - RNA, 19 nt, Homo sapiens
gcugaugacuucuuuaaug

SEQ ID NO: 290396 - RNA, 19 nt, Homo sapiens
agaaacagguugauaagaa

SEQ ID NO: 290397 - RNA, 19 nt, Homo sapiens
gaagagagcccugauaaca

SEQ ID NO: 290398 - RNA, 19 nt, Homo sapiens
gaagagguauccaucaaca

SEQ ID NO: 290399 - RNA, 19 nt, Homo sapiens
gaggaaggcugagaacauu

SEQ ID NO: 290400 - RNA, 19 nt, Homo sapiens
gacauuggaugaauaguau

SEQ ID NO: 290401 - RNA, 19 nt, Homo sapiens
gaggagugaccuuguauua

SEQ ID NO: 290402 - RNA, 19 nt, Homo sapiens
agaagccacuugcacauua

SEQ ID NO: 290403 - RNA, 19 nt, Homo sapiens
acacaaagcucaaguucau

SEQ ID NO: 290404 - RNA, 19 nt, Homo sapiens
ccugaaugcuacuuaaaua

SEQ ID NO: 290405 - RNA, 19 nt, Homo sapiens
auucaaagcuuucugguuu

SEQ ID NO: 290406 - RNA, 19 nt, Homo sapiens
aaggcaggcuccuaaauua

SEQ ID NO: 290407 - RNA, 19 nt, Homo sapiens
gaacaagugguuaacgaaa

SEQ ID NO: 290408 - RNA, 19 nt, Homo sapiens
aggaugagcucaaagauga

SEQ ID NO: 290409 - RNA, 19 nt, Homo sapiens
ggacccaguuuguguguga

SEQ ID NO: 290410 - RNA, 19 nt, Homo sapiens
gagaacaagugguuaacga

SEQ ID NO: 290411 - RNA, 19 nt, Homo sapiens
ggggauaucuguuaauuuu

SEQ ID NO: 290412 - RNA, 19 nt, Homo sapiens
ucacaaaggccagcaauuu

SEQ ID NO: 290413 - RNA, 19 nt, Homo sapiens
gaugagaauuugccugaug

SEQ ID NO: 290414 - RNA, 19 nt, Homo sapiens
gaggaagagugugcugaua

SEQ ID NO: 290415 - RNA, 19 nt, Homo sapiens
guaaacagcagacagaaga

SEQ ID NO: 290416 - RNA, 19 nt, Homo sapiens
caagcuaccuggagacguu

SEQ ID NO: 290417 - RNA, 19 nt, Homo sapiens
ggauuuaccaguuaccaua

SEQ ID NO: 290418 - RNA, 19 nt, Homo sapiens
gaaaugagaaggaggagau

SEQ ID NO: 290419 - RNA, 19 nt, Homo sapiens
uuaaagcacuuccugauuc

SEQ ID NO: 290420 - RNA, 19 nt, Homo sapiens
ccacaugacaguccuuuaa

SEQ ID NO: 290421 - RNA, 19 nt, Homo sapiens
agagagcccugauaacauu

SEQ ID NO: 290422 - RNA, 19 nt, Homo sapiens
guauagagcccaucguuga

SEQ ID NO: 290423 - RNA, 19 nt, Homo sapiens
ggaggaggaugagcucaaa

SEQ ID NO: 290424 - RNA, 19 nt, Homo sapiens
gcagauagaggaagagaau

SEQ ID NO: 290425 - RNA, 19 nt, Homo sapiens
cagaaguccuugcagauga

SEQ ID NO: 290426 - RNA, 19 nt, Homo sapiens
caguucagcuggcauauug

SEQ ID NO: 290427 - RNA, 19 nt, Homo sapiens
gggcugauaucgaagcuau

SEQ ID NO: 290428 - RNA, 19 nt, Homo sapiens
ccauaucgcugaggaagaa

SEQ ID NO: 290429 - RNA, 19 nt, Homo sapiens
gaagaaacaacguaaagca

SEQ ID NO: 290430 - RNA, 19 nt, Homo sapiens
gaaguccguucacagguau

SEQ ID NO: 290431 - RNA, 19 nt, Homo sapiens
guacagcucugcgcucuca

SEQ ID NO: 290432 - RNA, 19 nt, Homo sapiens
acaguaauccgaucccuua

SEQ ID NO: 290433 - RNA, 19 nt, Homo sapiens
gaaacagguugauaagaac

SEQ ID NO: 290434 - RNA, 19 nt, Homo sapiens
caucaacagucaaggagaa

SEQ ID NO: 290435 - RNA, 19 nt, Homo sapiens
gccaauaauuucugaagau

SEQ ID NO: 290436 - RNA, 19 nt, Homo sapiens
caaagucaguccucugcuu

SEQ ID NO: 290437 - RNA, 19 nt, Homo sapiens
acaugacaguccuuuaaua

SEQ ID NO: 290438 - RNA, 19 nt, Homo sapiens
uugagaagcuugaacagaa

SEQ ID NO: 290439 - RNA, 19 nt, Homo sapiens
gaaauaacacccagagcau

SEQ ID NO: 290440 - RNA, 19 nt, Homo sapiens
ccuuugagcuguuggauau

SEQ ID NO: 290441 - RNA, 19 nt, Homo sapiens
ucaaggagaauaugaagaa

SEQ ID NO: 290442 - RNA, 19 nt, Homo sapiens
gaagauaaguggaaaagag

SEQ ID NO: 290443 - RNA, 19 nt, Homo sapiens
gaagcuugaacagaaauua

SEQ ID NO: 290444 - RNA, 19 nt, Homo sapiens
ugaagaagcgcuuaagaug

SEQ ID NO: 290445 - RNA, 19 nt, Homo sapiens
gacuuuggcuuccacagaa

SEQ ID NO: 290446 - RNA, 19 nt, Homo sapiens
gcagaggucaaggaacuua

SEQ ID NO: 290447 - RNA, 19 nt, Homo sapiens
gagcacagcauaagugaca

SEQ ID NO: 290448 - RNA, 19 nt, Homo sapiens
aggaggagauuauccauau

SEQ ID NO: 290449 - RNA, 19 nt, Homo sapiens
ugagaagcuugaacagaaa

SEQ ID NO: 290450 - RNA, 19 nt, Homo sapiens
guauaacuccugaaugcua

SEQ ID NO: 290451 - RNA, 19 nt, Homo sapiens
gggaaaagauaguuaauag

SEQ ID NO: 290452 - RNA, 19 nt, Homo sapiens
gaguacaguuggugaagga

SEQ ID NO: 290453 - RNA, 19 nt, Homo sapiens
gaugacuucuuuaaugcuu

SEQ ID NO: 290454 - RNA, 19 nt, Homo sapiens
cauggugcauucaagagua

SEQ ID NO: 290455 - RNA, 19 nt, Homo sapiens
gcagacagaagagcuauga

SEQ ID NO: 290456 - RNA, 19 nt, Homo sapiens
ugacaguccuuuaauagag

SEQ ID NO: 290457 - RNA, 19 nt, Homo sapiens
gagaagaaacaacguaaag

SEQ ID NO: 290458 - RNA, 19 nt, Homo sapiens
gcaggcuccuaaauuaaug

SEQ ID NO: 290459 - RNA, 19 nt, Homo sapiens
caagggaaucuccgcauuu

SEQ ID NO: 290460 - RNA, 19 nt, Homo sapiens
caucaggacuuguaaacag

SEQ ID NO: 290461 - RNA, 19 nt, Homo sapiens
ccucgggucuggugcagua

SEQ ID NO: 290462 - RNA, 19 nt, Homo sapiens
caguauaacuccugaaugc

SEQ ID NO: 290463 - RNA, 19 nt, Homo sapiens
ggaagaggcagcugguguu

SEQ ID NO: 290464 - RNA, 19 nt, Homo sapiens
gaugaucuuuauucuguca

SEQ ID NO: 290465 - RNA, 19 nt, Homo sapiens
aaagacagcuuggugaagu

SEQ ID NO: 290466 - RNA, 19 nt, Homo sapiens
ugcaacaacugccaaagaa

SEQ ID NO: 290467 - RNA, 19 nt, Homo sapiens
gaaaugcugaugacuucuu

SEQ ID NO: 290468 - RNA, 19 nt, Homo sapiens
gggcagaucuuauuuuaca

SEQ ID NO: 290469 - RNA, 19 nt, Homo sapiens
ucaagggaaucuccgcauu

SEQ ID NO: 290470 - RNA, 19 nt, Homo sapiens
gacaguccuuuaauagaga

SEQ ID NO: 290471 - RNA, 19 nt, Homo sapiens
ccgaagagagcccugauaa

SEQ ID NO: 290472 - RNA, 19 nt, Homo sapiens
gugcagcauuuguggauga

SEQ ID NO: 290473 - RNA, 19 nt, Homo sapiens
aaaggcaggcuccuaaauu

SEQ ID NO: 290474 - RNA, 19 nt, Homo sapiens
gacauuaaccucggaaguu

SEQ ID NO: 290475 - RNA, 19 nt, Homo sapiens
ugaauaguaugaagacagu

SEQ ID NO: 290476 - RNA, 19 nt, Homo sapiens
ucaagaguauccaacuuca

SEQ ID NO: 290477 - RNA, 19 nt, Homo sapiens
accucaagcuucauaguua

SEQ ID NO: 290478 - RNA, 19 nt, Homo sapiens
guacagccaacgcuauuga

SEQ ID NO: 290479 - RNA, 19 nt, Homo sapiens
caacagucaaggagaauau

SEQ ID NO: 290480 - RNA, 19 nt, Homo sapiens
guugcgagcugagaagaaa

SEQ ID NO: 290481 - RNA, 19 nt, Homo sapiens
gaaggaagagguaacaaaa

SEQ ID NO: 290482 - RNA, 19 nt, Homo sapiens
gcaaaaggcaggcuccuaa

SEQ ID NO: 290483 - RNA, 19 nt, Homo sapiens
cagggcagaucuuauuuua

SEQ ID NO: 290484 - RNA, 19 nt, Homo sapiens
gggaaucuccgcauuucaa

SEQ ID NO: 290485 - RNA, 19 nt, Homo sapiens
agacauuggaugaauagua

SEQ ID NO: 290486 - RNA, 19 nt, Homo sapiens
gaaaagagcuuguccauga

SEQ ID NO: 290487 - RNA, 19 nt, Homo sapiens
ggagugaccuuguauuaaa

SEQ ID NO: 290488 - RNA, 19 nt, Homo sapiens
gacaauaccugcuacagua

SEQ ID NO: 290489 - RNA, 19 nt, Homo sapiens
gaaaaugacuuccagaaaa

SEQ ID NO: 290490 - RNA, 19 nt, Homo sapiens
gaaaugggauucugugaca

SEQ ID NO: 290491 - RNA, 19 nt, Homo sapiens
ggaguggauuuaccaguua

SEQ ID NO: 290492 - RNA, 19 nt, Homo sapiens
ggaagagugugcugauaaa

SEQ ID NO: 290493 - RNA, 19 nt, Homo sapiens
gaacguauacuucccauug

SEQ ID NO: 290494 - RNA, 19 nt, Homo sapiens
gaagagcuaugaccacuca

SEQ ID NO: 290495 - RNA, 19 nt, Homo sapiens
gcacaauucucacggaaau

SEQ ID NO: 290496 - RNA, 19 nt, Homo sapiens
gaacuacuauuuccaacau

SEQ ID NO: 290497 - RNA, 19 nt, Homo sapiens
gcugaugacuucuuuaaug

SEQ ID NO: 290498 - RNA, 19 nt, Homo sapiens
agaaacagguugauaagaa

SEQ ID NO: 290499 - RNA, 19 nt, Homo sapiens
gaagagagcccugauaaca

SEQ ID NO: 290500 - RNA, 19 nt, Homo sapiens
gaagagguauccaucaaca

SEQ ID NO: 290501 - RNA, 19 nt, Homo sapiens
gaggaaggcugagaacauu

SEQ ID NO: 290502 - RNA, 19 nt, Homo sapiens
gacauuggaugaauaguau

SEQ ID NO: 290503 - RNA, 19 nt, Homo sapiens
gaggagugaccuuguauua

SEQ ID NO: 290504 - RNA, 19 nt, Homo sapiens
agaagccacuugcacauua

SEQ ID NO: 290505 - RNA, 19 nt, Homo sapiens
cuuggaaacuguagucuua

SEQ ID NO: 290506 - RNA, 19 nt, Homo sapiens
acacaaagcucaaguucau

SEQ ID NO: 290507 - RNA, 19 nt, Homo sapiens
ccugaaugcuacuuaaaua

SEQ ID NO: 290508 - RNA, 19 nt, Homo sapiens
aaggcaggcuccuaaauua

SEQ ID NO: 290509 - RNA, 19 nt, Homo sapiens
auucaaagcuuucugguuu

SEQ ID NO: 290510 - RNA, 19 nt, Homo sapiens
gaacaagugguuaacgaaa

SEQ ID NO: 290511 - RNA, 19 nt, Homo sapiens
aggaugagcucaaagauga

SEQ ID NO: 290512 - RNA, 19 nt, Homo sapiens
ggacccaguuuguguguga

SEQ ID NO: 290513 - RNA, 19 nt, Homo sapiens
gagaacaagugguuaacga

SEQ ID NO: 290514 - RNA, 19 nt, Homo sapiens
ggggauaucuguuaauuuu

SEQ ID NO: 290515 - RNA, 19 nt, Homo sapiens
ucacaaaggccagcaauuu

SEQ ID NO: 290516 - RNA, 19 nt, Homo sapiens
gaugagaauuugccugaug

SEQ ID NO: 290517 - RNA, 19 nt, Homo sapiens
gaggaagagugugcugaua

SEQ ID NO: 290518 - RNA, 19 nt, Homo sapiens
guaaacagcagacagaaga

SEQ ID NO: 290519 - RNA, 19 nt, Homo sapiens
caagcuaccuggagacguu

SEQ ID NO: 290520 - RNA, 19 nt, Homo sapiens
ggauuuaccaguuaccaua

SEQ ID NO: 290521 - RNA, 19 nt, Homo sapiens
gaaaugagaaggaggagau

SEQ ID NO: 290522 - RNA, 19 nt, Homo sapiens
uuaaagcacuuccugauuc

SEQ ID NO: 290523 - RNA, 19 nt, Homo sapiens
ccacaugacaguccuuuaa

SEQ ID NO: 290524 - RNA, 19 nt, Homo sapiens
agagagcccugauaacauu

SEQ ID NO: 290525 - RNA, 19 nt, Homo sapiens
guauagagcccaucguuga

SEQ ID NO: 290526 - RNA, 19 nt, Homo sapiens
ggaggaggaugagcucaaa

SEQ ID NO: 290527 - RNA, 19 nt, Homo sapiens
gcagauagaggaagagaau

SEQ ID NO: 290528 - RNA, 19 nt, Homo sapiens
cagaaguccuugcagauga

SEQ ID NO: 290529 - RNA, 19 nt, Homo sapiens
caguucagcuggcauauug

SEQ ID NO: 290530 - RNA, 19 nt, Homo sapiens
guaauggauuggaguguug

SEQ ID NO: 290531 - RNA, 19 nt, Homo sapiens
uuaagaagaggucccauua

SEQ ID NO: 290532 - RNA, 19 nt, Homo sapiens
gggcugauaucgaagcuau

SEQ ID NO: 290533 - RNA, 19 nt, Homo sapiens
ccauaucgcugaggaagaa

SEQ ID NO: 290534 - RNA, 19 nt, Homo sapiens
gaagaaacaacguaaagca

SEQ ID NO: 290535 - RNA, 19 nt, Homo sapiens
gaaguccguucacagguau

SEQ ID NO: 290536 - RNA, 19 nt, Homo sapiens
guacagcucugcgcucuca

SEQ ID NO: 290537 - RNA, 19 nt, Homo sapiens
acaguaauccgaucccuua

SEQ ID NO: 290538 - RNA, 19 nt, Homo sapiens
gaaacagguugauaagaac

SEQ ID NO: 290539 - RNA, 19 nt, Homo sapiens
caucaacagucaaggagaa

SEQ ID NO: 290540 - RNA, 19 nt, Homo sapiens
gccaauaauuucugaagau

SEQ ID NO: 290541 - RNA, 19 nt, Homo sapiens
caaagucaguccucugcuu

SEQ ID NO: 290542 - RNA, 19 nt, Homo sapiens
acaugacaguccuuuaaua

SEQ ID NO: 290543 - RNA, 19 nt, Homo sapiens
uugagaagcuugaacagaa

SEQ ID NO: 290544 - RNA, 19 nt, Homo sapiens
ccaaagcagucuuaagaag

SEQ ID NO: 290545 - RNA, 19 nt, Homo sapiens
gaaauaacacccagagcau

SEQ ID NO: 290546 - RNA, 19 nt, Homo sapiens
ccuuugagcuguuggauau

SEQ ID NO: 290547 - RNA, 19 nt, Homo sapiens
ucaaggagaauaugaagaa

SEQ ID NO: 290548 - RNA, 19 nt, Homo sapiens
gaagauaaguggaaaagag

SEQ ID NO: 290549 - RNA, 19 nt, Homo sapiens
gaagcuugaacagaaauua

SEQ ID NO: 290550 - RNA, 19 nt, Homo sapiens
ugaagaagcgcuuaagaug

SEQ ID NO: 290551 - RNA, 19 nt, Homo sapiens
ggauuggaguguuguuaug

SEQ ID NO: 290552 - RNA, 19 nt, Homo sapiens
gacuuuggcuuccacagaa

SEQ ID NO: 290553 - RNA, 19 nt, Homo sapiens
gcagaggucaaggaacuua

SEQ ID NO: 290554 - RNA, 19 nt, Homo sapiens
guuauguucuccuaucuug

SEQ ID NO: 290555 - RNA, 19 nt, Homo sapiens
gagcacagcauaagugaca

SEQ ID NO: 290556 - RNA, 19 nt, Homo sapiens
aggaggagauuauccauau

SEQ ID NO: 290557 - RNA, 19 nt, Homo sapiens
ugagaagcuugaacagaaa

SEQ ID NO: 290558 - RNA, 19 nt, Homo sapiens
gagcagagacuaggccaaa

SEQ ID NO: 290559 - RNA, 19 nt, Homo sapiens
guauaacuccugaaugcua

SEQ ID NO: 290560 - RNA, 19 nt, Homo sapiens
gggaaaagauaguuaauag

SEQ ID NO: 290561 - RNA, 19 nt, Homo sapiens
gaguacaguuggugaagga

SEQ ID NO: 290562 - RNA, 19 nt, Homo sapiens
gaugacuucuuuaaugcuu

SEQ ID NO: 290563 - RNA, 19 nt, Homo sapiens
cauggugcauucaagagua

SEQ ID NO: 290564 - RNA, 19 nt, Homo sapiens
guccaaagcagucuuaaga

SEQ ID NO: 290565 - RNA, 19 nt, Homo sapiens
gcagacagaagagcuauga

SEQ ID NO: 290566 - RNA, 19 nt, Homo sapiens
ugacaguccuuuaauagag

SEQ ID NO: 290567 - RNA, 19 nt, Homo sapiens
gagaagaaacaacguaaag

SEQ ID NO: 290568 - RNA, 19 nt, Homo sapiens
gcaggcuccuaaauuaaug

SEQ ID NO: 290569 - RNA, 19 nt, Homo sapiens
caagggaaucuccgcauuu

SEQ ID NO: 290570 - RNA, 19 nt, Homo sapiens
caucaggacuuguaaacag

SEQ ID NO: 290571 - RNA, 19 nt, Homo sapiens
ccucgggucuggugcagua

SEQ ID NO: 290572 - RNA, 19 nt, Homo sapiens
caguauaacuccugaaugc

SEQ ID NO: 290573 - RNA, 19 nt, Homo sapiens
ggaagaggcagcugguguu

SEQ ID NO: 290574 - RNA, 19 nt, Homo sapiens
gaugaucuuuauucuguca

SEQ ID NO: 290575 - RNA, 19 nt, Homo sapiens
aaagacagcuuggugaagu

SEQ ID NO: 290576 - RNA, 19 nt, Homo sapiens
ugcaacaacugccaaagaa

SEQ ID NO: 290577 - RNA, 19 nt, Homo sapiens
gaaaugcugaugacuucuu

SEQ ID NO: 290578 - RNA, 19 nt, Homo sapiens
gggcagaucuuauuuuaca

SEQ ID NO: 290579 - RNA, 19 nt, Homo sapiens
ucaagggaaucuccgcauu

SEQ ID NO: 290580 - RNA, 19 nt, Homo sapiens
gacaguccuuuaauagaga

SEQ ID NO: 290581 - RNA, 19 nt, Homo sapiens
ccgaagagagcccugauaa

SEQ ID NO: 290582 - RNA, 19 nt, Homo sapiens
gugcagcauuuguggauga

SEQ ID NO: 290583 - RNA, 19 nt, Homo sapiens
gcuuauacaugucaacagu

SEQ ID NO: 290584 - RNA, 19 nt, Homo sapiens
aaaggcaggcuccuaaauu

SEQ ID NO: 290585 - RNA, 19 nt, Homo sapiens
gacauuaaccucggaaguu

SEQ ID NO: 290586 - RNA, 19 nt, Homo sapiens
gaaaagagcuuguccauga

SEQ ID NO: 290587 - RNA, 19 nt, Homo sapiens
ggagugaccuuguauuaaa

SEQ ID NO: 290588 - RNA, 19 nt, Homo sapiens
gacaauaccugcuacagua

SEQ ID NO: 290589 - RNA, 19 nt, Homo sapiens
gaaaaugacuuccagaaaa

SEQ ID NO: 290590 - RNA, 19 nt, Homo sapiens
gaaaugggauucugugaca

SEQ ID NO: 290591 - RNA, 19 nt, Homo sapiens
ggaguggauuuaccaguua

SEQ ID NO: 290592 - RNA, 19 nt, Homo sapiens
ggaagagugugcugauaaa

SEQ ID NO: 290593 - RNA, 19 nt, Homo sapiens
gaacguauacuucccauug

SEQ ID NO: 290594 - RNA, 19 nt, Homo sapiens
gaagagcuaugaccacuca

SEQ ID NO: 290595 - RNA, 19 nt, Homo sapiens
gcugaugacuucuuuaaug

SEQ ID NO: 290596 - RNA, 19 nt, Homo sapiens
agaaacagguugauaagaa

SEQ ID NO: 290597 - RNA, 19 nt, Homo sapiens
gaagagagcccugauaaca

SEQ ID NO: 290598 - RNA, 19 nt, Homo sapiens
gaagagguauccaucaaca

SEQ ID NO: 290599 - RNA, 19 nt, Homo sapiens
guacauaaccaccuuaaga

SEQ ID NO: 290600 - RNA, 19 nt, Homo sapiens
gaggaaggcugagaacauu

SEQ ID NO: 290601 - RNA, 19 nt, Homo sapiens
gacauuggaugaauaguau

SEQ ID NO: 290602 - RNA, 19 nt, Homo sapiens
gaggagugaccuuguauua

SEQ ID NO: 290603 - RNA, 19 nt, Homo sapiens
agaagccacuugcacauua

SEQ ID NO: 290604 - RNA, 19 nt, Homo sapiens
acacaaagcucaaguucau

SEQ ID NO: 290605 - RNA, 19 nt, Homo sapiens
ccugaaugcuacuuaaaua

SEQ ID NO: 290606 - RNA, 19 nt, Homo sapiens
aaggcaggcuccuaaauua

SEQ ID NO: 290607 - RNA, 19 nt, Homo sapiens
auucaaagcuuucugguuu

SEQ ID NO: 290608 - RNA, 19 nt, Homo sapiens
gaacaagugguuaacgaaa

SEQ ID NO: 290609 - RNA, 19 nt, Homo sapiens
aggaugagcucaaagauga

SEQ ID NO: 290610 - RNA, 19 nt, Homo sapiens
ggacccaguuuguguguga

SEQ ID NO: 290611 - RNA, 19 nt, Homo sapiens
gagaacaagugguuaacga

SEQ ID NO: 290612 - RNA, 19 nt, Homo sapiens
ggggauaucuguuaauuuu

SEQ ID NO: 290613 - RNA, 19 nt, Homo sapiens
ucacaaaggccagcaauuu

SEQ ID NO: 290614 - RNA, 19 nt, Homo sapiens
gaugagaauuugccugaug

SEQ ID NO: 290615 - RNA, 19 nt, Homo sapiens
ccaggccguucauuauuua

SEQ ID NO: 290616 - RNA, 19 nt, Homo sapiens
gaggaagagugugcugaua

SEQ ID NO: 290617 - RNA, 19 nt, Homo sapiens
guaaacagcagacagaaga

SEQ ID NO: 290618 - RNA, 19 nt, Homo sapiens
caagcuaccuggagacguu

SEQ ID NO: 290619 - RNA, 19 nt, Homo sapiens
ggauuuaccaguuaccaua

SEQ ID NO: 290620 - RNA, 19 nt, Homo sapiens
gaaaugagaaggaggagau

SEQ ID NO: 290621 - RNA, 19 nt, Homo sapiens
uuaaagcacuuccugauuc

SEQ ID NO: 290622 - RNA, 19 nt, Homo sapiens
ccacaugacaguccuuuaa

SEQ ID NO: 290623 - RNA, 19 nt, Homo sapiens
agagagcccugauaacauu

SEQ ID NO: 290624 - RNA, 19 nt, Homo sapiens
gguuauguauguacuugua

SEQ ID NO: 290625 - RNA, 19 nt, Homo sapiens
gccaggccguucauuauuu

SEQ ID NO: 290626 - RNA, 19 nt, Homo sapiens
guauagagcccaucguuga

SEQ ID NO: 290627 - RNA, 19 nt, Homo sapiens
ggaggaggaugagcucaaa

SEQ ID NO: 290628 - RNA, 19 nt, Homo sapiens
gcagauagaggaagagaau

SEQ ID NO: 290629 - RNA, 19 nt, Homo sapiens
cagaaguccuugcagauga

SEQ ID NO: 290630 - RNA, 19 nt, Homo sapiens
caguucagcuggcauauug

SEQ ID NO: 290631 - RNA, 19 nt, Homo sapiens
ccuuaagaauggugaaaua

SEQ ID NO: 290632 - RNA, 19 nt, Homo sapiens
uuaagaagaggucccauua

SEQ ID NO: 290633 - RNA, 19 nt, Homo sapiens
gggcugauaucgaagcuau

SEQ ID NO: 290634 - RNA, 19 nt, Homo sapiens
ccauaucgcugaggaagaa

SEQ ID NO: 290635 - RNA, 19 nt, Homo sapiens
gaagaaacaacguaaagca

SEQ ID NO: 290636 - RNA, 19 nt, Homo sapiens
gaaguccguucacagguau

SEQ ID NO: 290637 - RNA, 19 nt, Homo sapiens
guacagcucugcgcucuca

SEQ ID NO: 290638 - RNA, 19 nt, Homo sapiens
acaguaauccgaucccuua

SEQ ID NO: 290639 - RNA, 19 nt, Homo sapiens
gaaacagguugauaagaac

SEQ ID NO: 290640 - RNA, 19 nt, Homo sapiens
caucaacagucaaggagaa

SEQ ID NO: 290641 - RNA, 19 nt, Homo sapiens
gccaauaauuucugaagau

SEQ ID NO: 290642 - RNA, 19 nt, Homo sapiens
caaagucaguccucugcuu

SEQ ID NO: 290643 - RNA, 19 nt, Homo sapiens
ccaaagcagucuuaagaag

SEQ ID NO: 290644 - RNA, 19 nt, Homo sapiens
acaugacaguccuuuaaua

SEQ ID NO: 290645 - RNA, 19 nt, Homo sapiens
uugagaagcuugaacagaa

SEQ ID NO: 290646 - RNA, 19 nt, Homo sapiens
gaaauaacacccagagcau

SEQ ID NO: 290647 - RNA, 19 nt, Homo sapiens
ccuuugagcuguuggauau

SEQ ID NO: 290648 - RNA, 19 nt, Homo sapiens
ucaaggagaauaugaagaa

SEQ ID NO: 290649 - RNA, 19 nt, Homo sapiens
gaagauaaguggaaaagag

SEQ ID NO: 290650 - RNA, 19 nt, Homo sapiens
gaagcuugaacagaaauua

SEQ ID NO: 290651 - RNA, 19 nt, Homo sapiens
ugaagaagcgcuuaagaug

SEQ ID NO: 290652 - RNA, 19 nt, Homo sapiens
gacuuuggcuuccacagaa

SEQ ID NO: 290653 - RNA, 19 nt, Homo sapiens
gcagaggucaaggaacuua

SEQ ID NO: 290654 - RNA, 19 nt, Homo sapiens
gagcacagcauaagugaca

SEQ ID NO: 290655 - RNA, 19 nt, Homo sapiens
aggaggagauuauccauau

SEQ ID NO: 290656 - RNA, 19 nt, Homo sapiens
ugagaagcuugaacagaaa

SEQ ID NO: 290657 - RNA, 19 nt, Homo sapiens
guauaacuccugaaugcua

SEQ ID NO: 290658 - RNA, 19 nt, Homo sapiens
gggaaaagauaguuaauag

SEQ ID NO: 290659 - RNA, 19 nt, Homo sapiens
gaguacaguuggugaagga

SEQ ID NO: 290660 - RNA, 19 nt, Homo sapiens
gaugacuucuuuaaugcuu

SEQ ID NO: 290661 - RNA, 19 nt, Homo sapiens
cauggugcauucaagagua

SEQ ID NO: 290662 - RNA, 19 nt, Homo sapiens
gcagacagaagagcuauga

SEQ ID NO: 290663 - RNA, 19 nt, Homo sapiens
guccaaagcagucuuaaga

SEQ ID NO: 290664 - RNA, 19 nt, Homo sapiens
ugacaguccuuuaauagag

SEQ ID NO: 290665 - RNA, 19 nt, Homo sapiens
gagaagaaacaacguaaag

SEQ ID NO: 290666 - RNA, 19 nt, Homo sapiens
gcaggcuccuaaauuaaug

SEQ ID NO: 290667 - RNA, 19 nt, Homo sapiens
caagggaaucuccgcauuu

SEQ ID NO: 290668 - RNA, 19 nt, Homo sapiens
caucaggacuuguaaacag

SEQ ID NO: 290669 - RNA, 19 nt, Homo sapiens
ccucgggucuggugcagua

SEQ ID NO: 290670 - RNA, 19 nt, Homo sapiens
caguauaacuccugaaugc

SEQ ID NO: 290671 - RNA, 19 nt, Homo sapiens
ggaagaggcagcugguguu

SEQ ID NO: 290672 - RNA, 19 nt, Homo sapiens
gaugaucuuuauucuguca

SEQ ID NO: 290673 - RNA, 19 nt, Homo sapiens
aaagacagcuuggugaagu

SEQ ID NO: 290674 - RNA, 19 nt, Homo sapiens
ugcaacaacugccaaagaa

SEQ ID NO: 290675 - RNA, 19 nt, Homo sapiens
gaaaugcugaugacuucuu

SEQ ID NO: 290676 - RNA, 19 nt, Homo sapiens
gggcagaucuuauuuuaca

SEQ ID NO: 290677 - RNA, 19 nt, Homo sapiens
ucaagggaaucuccgcauu

SEQ ID NO: 290678 - RNA, 19 nt, Homo sapiens
gacaguccuuuaauagaga

SEQ ID NO: 290679 - RNA, 19 nt, Homo sapiens
ccgaagagagcccugauaa

SEQ ID NO: 290680 - RNA, 19 nt, Homo sapiens
gugcagcauuuguggauga

SEQ ID NO: 290681 - RNA, 19 nt, Homo sapiens
aaaggcaggcuccuaaauu

SEQ ID NO: 290682 - RNA, 19 nt, Homo sapiens
gacauuaaccucggaaguu

SEQ ID NO: 290683 - RNA, 19 nt, Homo sapiens
ugaauaguaugaagacagu

SEQ ID NO: 290684 - RNA, 19 nt, Homo sapiens
ucaagaguauccaacuuca

SEQ ID NO: 290685 - RNA, 19 nt, Homo sapiens
accucaagcuucauaguua

SEQ ID NO: 290686 - RNA, 19 nt, Homo sapiens
caaacaaucucuuccuuua

SEQ ID NO: 290687 - RNA, 19 nt, Homo sapiens
caaaguaguuuccgacgua

SEQ ID NO: 290688 - RNA, 19 nt, Homo sapiens
gaacuuagaucuguuucaa

SEQ ID NO: 290689 - RNA, 19 nt, Homo sapiens
gaacuuaaauugccauucu

SEQ ID NO: 290690 - RNA, 19 nt, Homo sapiens
gaaguuggcuccagcucua

SEQ ID NO: 290691 - RNA, 19 nt, Homo sapiens
caagagagauccugaccaa

SEQ ID NO: 290692 - RNA, 19 nt, Homo sapiens
ggacagucuuucacuuuaa

SEQ ID NO: 290693 - RNA, 19 nt, Homo sapiens
gaucucacauugucuuuga

SEQ ID NO: 290694 - RNA, 19 nt, Homo sapiens
ggaaaggggugcuuauuuu

SEQ ID NO: 290695 - RNA, 19 nt, Homo sapiens
guaaacuucuguucaauuc

SEQ ID NO: 290696 - RNA, 19 nt, Homo sapiens
ggaaaacgcugccaaacaa

SEQ ID NO: 290697 - RNA, 19 nt, Homo sapiens
cggcugggcucaaagauaa

SEQ ID NO: 290698 - RNA, 19 nt, Homo sapiens
cgaacacucugccuaacua

SEQ ID NO: 290699 - RNA, 19 nt, Homo sapiens
ugaagacucugguuuccua

SEQ ID NO: 290700 - RNA, 19 nt, Homo sapiens
ggccagcccuugaacaauu

SEQ ID NO: 290701 - RNA, 19 nt, Homo sapiens
aaacugagaauccgagaua

SEQ ID NO: 290702 - RNA, 19 nt, Homo sapiens
gcaaacaaucucuuccuuu

SEQ ID NO: 290703 - RNA, 19 nt, Homo sapiens
ggaaagcgcaaauaaauac

SEQ ID NO: 290704 - RNA, 19 nt, Homo sapiens
ucaagagccgaaauuauua

SEQ ID NO: 290705 - RNA, 19 nt, Homo sapiens
caaagccacuaguauuaga

SEQ ID NO: 290706 - RNA, 19 nt, Homo sapiens
gcaaauaaauacggaaagg

SEQ ID NO: 290707 - RNA, 19 nt, Homo sapiens
gggaaagcgcaaauaaaua

SEQ ID NO: 290708 - RNA, 19 nt, Homo sapiens
uaaauugccauucuggaua

SEQ ID NO: 290709 - RNA, 19 nt, Homo sapiens
gauaugccaucugaaagaa

SEQ ID NO: 290710 - RNA, 19 nt, Homo sapiens
gaaauuauuacccuucuca

SEQ ID NO: 290711 - RNA, 19 nt, Homo sapiens
gaggacagucuuucacuuu

SEQ ID NO: 290712 - RNA, 19 nt, Homo sapiens
ggaggacagucuuucacuu

SEQ ID NO: 290713 - RNA, 19 nt, Homo sapiens
gaacaauuaccauaugaag

SEQ ID NO: 290714 - RNA, 19 nt, Homo sapiens
acacaaugauuacgggaaa

SEQ ID NO: 290715 - RNA, 19 nt, Homo sapiens
ggauaugccaucugaaaga

SEQ ID NO: 290716 - RNA, 19 nt, Homo sapiens
gccagcccuugaacaauua

SEQ ID NO: 290717 - RNA, 19 nt, Homo sapiens
gaaguggugcuuuaucuca

SEQ ID NO: 290718 - RNA, 19 nt, Homo sapiens
gugaacagaacuuaaauug

SEQ ID NO: 290719 - RNA, 19 nt, Homo sapiens
gaacggcugggcucaaaga

SEQ ID NO: 290720 - RNA, 19 nt, Homo sapiens
guaaacacgauuuggauau

SEQ ID NO: 290721 - RNA, 19 nt, Homo sapiens
cccaaagccacuaguauua

SEQ ID NO: 290722 - RNA, 19 nt, Homo sapiens
aauuugaaguggugcuuua

SEQ ID NO: 290723 - RNA, 19 nt, Homo sapiens
ggaagucugcaaaguaguu

SEQ ID NO: 290724 - RNA, 19 nt, Homo sapiens
ggucuaccaucugaauaaa

SEQ ID NO: 290725 - RNA, 19 nt, Homo sapiens
uaaacacgauuuggauaug

SEQ ID NO: 290726 - RNA, 19 nt, Homo sapiens
gaaagcugccauugccaaa

SEQ ID NO: 290727 - RNA, 19 nt, Homo sapiens
aggacagucuuucacuuua

SEQ ID NO: 290728 - RNA, 19 nt, Homo sapiens
cauuggaucccacagcuua

SEQ ID NO: 290729 - RNA, 19 nt, Homo sapiens
gugcaucugucugugagua

SEQ ID NO: 290730 - RNA, 19 nt, Homo sapiens
cgggaaagcgcaaauaaau

SEQ ID NO: 290731 - RNA, 19 nt, Homo sapiens
gaagugaaacugagaaucc

SEQ ID NO: 290732 - RNA, 19 nt, Homo sapiens
ucaacgagauggacaaucg

SEQ ID NO: 290733 - RNA, 19 nt, Homo sapiens
gcugcacacacaaugauua

SEQ ID NO: 290734 - RNA, 19 nt, Homo sapiens
gaaagaagugccucuccau

SEQ ID NO: 290735 - RNA, 19 nt, Homo sapiens
gcaucugucugugaguaaa

SEQ ID NO: 290736 - RNA, 19 nt, Homo sapiens
cgggaagucugcaaaguag

SEQ ID NO: 290737 - RNA, 19 nt, Homo sapiens
caucugaaagaaacuguaa

SEQ ID NO: 290738 - RNA, 19 nt, Homo sapiens
agacgaacacucugccuaa

SEQ ID NO: 290739 - RNA, 19 nt, Homo sapiens
cuaccgaacuuagaucugu

SEQ ID NO: 290740 - RNA, 19 nt, Homo sapiens
gcagacaccagcgaaguga

SEQ ID NO: 290741 - RNA, 19 nt, Homo sapiens
ucacacaaggauucuuuaa

SEQ ID NO: 290742 - RNA, 19 nt, Homo sapiens
cauaugaagacucugguuu

SEQ ID NO: 290743 - RNA, 19 nt, Homo sapiens
gcggaagguuucaaucucu

SEQ ID NO: 290744 - RNA, 19 nt, Homo sapiens
ggucaaggcggaagguuuc

SEQ ID NO: 290745 - RNA, 19 nt, Homo sapiens
gcugcgcggugcugaaguu

SEQ ID NO: 290746 - RNA, 19 nt, Homo sapiens
aaccaacgcugcagcacuu

SEQ ID NO: 290747 - RNA, 19 nt, Homo sapiens
aagaacggcugggcucaaa

SEQ ID NO: 290748 - RNA, 19 nt, Homo sapiens
aguguaaacuucuguucaa

SEQ ID NO: 290749 - RNA, 19 nt, Homo sapiens
gcgcaaauaaauacggaaa

SEQ ID NO: 290750 - RNA, 19 nt, Homo sapiens
gccuaacuaucaaaggauu

SEQ ID NO: 290751 - RNA, 19 nt, Homo sapiens
cuucucaaaguccuuauua

SEQ ID NO: 290752 - RNA, 19 nt, Homo sapiens
gcgagacuccgguguacaa

SEQ ID NO: 290753 - RNA, 19 nt, Homo sapiens
gaguaaacacgauuuggau

SEQ ID NO: 290754 - RNA, 19 nt, Homo sapiens
gauuuccuaucucccuuga

SEQ ID NO: 290755 - RNA, 19 nt, Homo sapiens
aucaagagccgaaauuauu

SEQ ID NO: 290756 - RNA, 19 nt, Homo sapiens
gacagucuuucacuuuaag

SEQ ID NO: 290757 - RNA, 19 nt, Homo sapiens
ggugaacagaacuuaaauu

SEQ ID NO: 290758 - RNA, 19 nt, Homo sapiens
uuauuacccuucucaaagu

SEQ ID NO: 290759 - RNA, 19 nt, Homo sapiens
gaagucugcaaaguaguuu

SEQ ID NO: 290760 - RNA, 19 nt, Homo sapiens
gaacacucugccuaacuau

SEQ ID NO: 290761 - RNA, 19 nt, Homo sapiens
cuugaacaauuaccauaug

SEQ ID NO: 290762 - RNA, 19 nt, Homo sapiens
guuucaaucucuuguccaa

SEQ ID NO: 290763 - RNA, 19 nt, Homo sapiens
gcgcggugcugaaguugag

SEQ ID NO: 290764 - RNA, 19 nt, Homo sapiens
ccgggaagucugcaaagua

SEQ ID NO: 290765 - RNA, 19 nt, Homo sapiens
ugaguaaacacgauuugga

SEQ ID NO: 290766 - RNA, 19 nt, Homo sapiens
gcacacuuuuccuccauuu

SEQ ID NO: 290767 - RNA, 19 nt, Homo sapiens
aaacccaaagccacuagua

SEQ ID NO: 290768 - RNA, 19 nt, Homo sapiens
aaucaagagccgaaauuau

SEQ ID NO: 290769 - RNA, 19 nt, Homo sapiens
gaauuugaaguggugcuuu

SEQ ID NO: 290770 - RNA, 19 nt, Homo sapiens
cugccuaacuaucaaagga

SEQ ID NO: 290771 - RNA, 19 nt, Homo sapiens
gcacuuccgaaaggcauuu

SEQ ID NO: 290772 - RNA, 19 nt, Homo sapiens
cacacaaggauucuuuaaa

SEQ ID NO: 290773 - RNA, 19 nt, Homo sapiens
cuugaaauacacuggauaa

SEQ ID NO: 290774 - RNA, 19 nt, Homo sapiens
ggauguugguguuuuguga

SEQ ID NO: 290775 - RNA, 19 nt, Homo sapiens
gaaaggggugcuuauuuug

SEQ ID NO: 290776 - RNA, 19 nt, Homo sapiens
uuaaucaagagccgaaauu

SEQ ID NO: 290777 - RNA, 19 nt, Homo sapiens
gauccugaccaacccgaaa

SEQ ID NO: 290778 - RNA, 19 nt, Homo sapiens
ggaagguuucaaucucuug

SEQ ID NO: 290779 - RNA, 19 nt, Homo sapiens
acgcuugaauaucugaauu

SEQ ID NO: 290780 - RNA, 19 nt, Homo sapiens
ucucacacaaggauucuuu

SEQ ID NO: 290781 - RNA, 19 nt, Homo sapiens
acacucugccuaacuauca

SEQ ID NO: 290782 - RNA, 19 nt, Homo sapiens
ccaaagccacuaguauuag

SEQ ID NO: 290783 - RNA, 19 nt, Homo sapiens
ggcggaagguuucaaucuc

SEQ ID NO: 290784 - RNA, 19 nt, Homo sapiens
cucaagcgguagacaaaug

SEQ ID NO: 290785 - RNA, 19 nt, Homo sapiens
cugcagcacuuccgaaagg

SEQ ID NO: 290786 - RNA, 19 nt, Homo sapiens
gagaagcuuugaccaauuu

SEQ ID NO: 290787 - RNA, 19 nt, Homo sapiens
ggaguucauuuaaaccaua

SEQ ID NO: 290788 - RNA, 19 nt, Homo sapiens
gaucccaucucaaaucauu

SEQ ID NO: 290789 - RNA, 19 nt, Homo sapiens
ggagaagcuuugaccaauu

SEQ ID NO: 290790 - RNA, 19 nt, Homo sapiens
cauaggaacuuuucacuua

SEQ ID NO: 290791 - RNA, 19 nt, Homo sapiens
caucuugucuaucauguuu

SEQ ID NO: 290792 - RNA, 19 nt, Homo sapiens
caaccaagcugugauaagu

SEQ ID NO: 290793 - RNA, 19 nt, Homo sapiens
gcuauuaaacuccugcuua

SEQ ID NO: 290794 - RNA, 19 nt, Homo sapiens
gagauggaauguaacuuug

SEQ ID NO: 290795 - RNA, 19 nt, Homo sapiens
gcagucaucuuggaccuuu

SEQ ID NO: 290796 - RNA, 19 nt, Homo sapiens
gaucauagucuuaggaguu

SEQ ID NO: 290797 - RNA, 19 nt, Homo sapiens
aaauugaaguggugcauaa

SEQ ID NO: 290798 - RNA, 19 nt, Homo sapiens
ggacaugcccauauaugaa

SEQ ID NO: 290799 - RNA, 19 nt, Homo sapiens
guuuauugcugguuuauga

SEQ ID NO: 290800 - RNA, 19 nt, Homo sapiens
guggaaugguuacuguuua

SEQ ID NO: 290801 - RNA, 19 nt, Homo sapiens
acuuagagauggaauguaa

SEQ ID NO: 290802 - RNA, 19 nt, Homo sapiens
ccagucgucuuugagaaua

SEQ ID NO: 290803 - RNA, 19 nt, Homo sapiens
gaaauugaaguggugcaua

SEQ ID NO: 290804 - RNA, 19 nt, Homo sapiens
gcauaacauugccaaaaua

SEQ ID NO: 290805 - RNA, 19 nt, Homo sapiens
gcccauauaugaaggagau

SEQ ID NO: 290806 - RNA, 19 nt, Homo sapiens
uguagcaucuugucuauca

SEQ ID NO: 290807 - RNA, 19 nt, Homo sapiens
gagauaaucgaagaacuuu

SEQ ID NO: 290808 - RNA, 19 nt, Homo sapiens
ucuuggaucuguugaguuu

SEQ ID NO: 290809 - RNA, 19 nt, Homo sapiens
uaaguggaaugguuacugu

SEQ ID NO: 290810 - RNA, 19 nt, Homo sapiens
ucacuuaucucauguuagc

SEQ ID NO: 290811 - RNA, 19 nt, Homo sapiens
gaaguggugcauaacauug

SEQ ID NO: 290812 - RNA, 19 nt, Homo sapiens
aaagggauaucaaaugaag

SEQ ID NO: 290813 - RNA, 19 nt, Homo sapiens
ccagcaagguggaggagaa

SEQ ID NO: 290814 - RNA, 19 nt, Homo sapiens
aaacaccaauacccagauu

SEQ ID NO: 290815 - RNA, 19 nt, Homo sapiens
gugauaaguggaaugguua

SEQ ID NO: 290816 - RNA, 19 nt, Homo sapiens
aaacugcagucaucuugga

SEQ ID NO: 290817 - RNA, 19 nt, Homo sapiens
agucuuaggaguucauuua

SEQ ID NO: 290818 - RNA, 19 nt, Homo sapiens
caucucaaaucauucuguu

SEQ ID NO: 290819 - RNA, 19 nt, Homo sapiens
ugugauaaguggaaugguu

SEQ ID NO: 290820 - RNA, 19 nt, Homo sapiens
ucaagaagaacaagaagga

SEQ ID NO: 290821 - RNA, 19 nt, Homo sapiens
agagauggaauguaacuuu

SEQ ID NO: 290822 - RNA, 19 nt, Homo sapiens
agucagugauuaaguagaa

SEQ ID NO: 290823 - RNA, 19 nt, Homo sapiens
ggaaugguuacuguuuaua

SEQ ID NO: 290824 - RNA, 19 nt, Homo sapiens
gagcuuaaacaccuucuuc

SEQ ID NO: 290825 - RNA, 19 nt, Homo sapiens
gcuuaagguguucuaauuu

SEQ ID NO: 290826 - RNA, 19 nt, Homo sapiens
caagaaggaggcuggagaa

SEQ ID NO: 290827 - RNA, 19 nt, Homo sapiens
ugcuuaagguguucuaauu

SEQ ID NO: 290828 - RNA, 19 nt, Homo sapiens
uuacaacacuacaagucuu

SEQ ID NO: 290829 - RNA, 19 nt, Homo sapiens
guguaaacuuucuuuguca

SEQ ID NO: 290830 - RNA, 19 nt, Homo sapiens
ccaauuugacuuagagaug

SEQ ID NO: 290831 - RNA, 19 nt, Homo sapiens
uggagaagcuuugaccaau

SEQ ID NO: 290832 - RNA, 19 nt, Homo sapiens
uggaaugguuacuguuuau

SEQ ID NO: 290833 - RNA, 19 nt, Homo sapiens
cagaagcacaugaaguuug

SEQ ID NO: 290834 - RNA, 19 nt, Homo sapiens
ggagaugggugggucaaaa

SEQ ID NO: 290835 - RNA, 19 nt, Homo sapiens
ugagauaaucgaagaacuu

SEQ ID NO: 290836 - RNA, 19 nt, Homo sapiens
uggaauguaacuuugcuua

SEQ ID NO: 290837 - RNA, 19 nt, Homo sapiens
accagucagugauuaagua

SEQ ID NO: 290838 - RNA, 19 nt, Homo sapiens
cacuagaaaugguguaaag

SEQ ID NO: 290839 - RNA, 19 nt, Homo sapiens
ucgcaucaguauuaauguu

SEQ ID NO: 290840 - RNA, 19 nt, Homo sapiens
ugaccaauuugacuuagag

SEQ ID NO: 290841 - RNA, 19 nt, Homo sapiens
gaauggccacgugaaggua

SEQ ID NO: 290842 - RNA, 19 nt, Homo sapiens
gaaugguuacuguuuauac

SEQ ID NO: 290843 - RNA, 19 nt, Homo sapiens
cuuaggaguucauuuaaac

SEQ ID NO: 290844 - RNA, 19 nt, Homo sapiens
cuacaaccagggauugauu

SEQ ID NO: 290845 - RNA, 19 nt, Homo sapiens
gaagcuuugaccaauuuga

SEQ ID NO: 290846 - RNA, 19 nt, Homo sapiens
gcugguuuaugaccuuaau

SEQ ID NO: 290847 - RNA, 19 nt, Homo sapiens
ugaaguggugcauaacauu

SEQ ID NO: 290848 - RNA, 19 nt, Homo sapiens
gauggaauguaacuuugcu

SEQ ID NO: 290849 - RNA, 19 nt, Homo sapiens
uauccggaguguauuuaau

SEQ ID NO: 290850 - RNA, 19 nt, Homo sapiens
aguguaaacuuucuuuguc

SEQ ID NO: 290851 - RNA, 19 nt, Homo sapiens
ggagaauggccacgugaag

SEQ ID NO: 290852 - RNA, 19 nt, Homo sapiens
uguguagcaucuugucuau

SEQ ID NO: 290853 - RNA, 19 nt, Homo sapiens
uccagaagcacaugaaguu

SEQ ID NO: 290854 - RNA, 19 nt, Homo sapiens
aaccagggauugauuuuaa

SEQ ID NO: 290855 - RNA, 19 nt, Homo sapiens
cuguugaguuucuuuguug

SEQ ID NO: 290856 - RNA, 19 nt, Homo sapiens
uuugugagauaaucgaaga

SEQ ID NO: 290857 - RNA, 19 nt, Homo sapiens
ucuguugaguuucuuuguu

SEQ ID NO: 290858 - RNA, 19 nt, Homo sapiens
aaacucaaccaagcuguga

SEQ ID NO: 290859 - RNA, 19 nt, Homo sapiens
cuacagugcggcuacaaau

SEQ ID NO: 290860 - RNA, 19 nt, Homo sapiens
gaguucauuuaaaccauag

SEQ ID NO: 290861 - RNA, 19 nt, Homo sapiens
caaaucauucuguuaacca

SEQ ID NO: 290862 - RNA, 19 nt, Homo sapiens
uuuaaucgguucuguucug

SEQ ID NO: 290863 - RNA, 19 nt, Homo sapiens
agaagcacaugaaguuugc

SEQ ID NO: 290864 - RNA, 19 nt, Homo sapiens
ccagaagcacaugaaguuu

SEQ ID NO: 290865 - RNA, 19 nt, Homo sapiens
agagcaagcuuuugugaga

SEQ ID NO: 290866 - RNA, 19 nt, Homo sapiens
caucuuggaccuuuuaaaa

SEQ ID NO: 290867 - RNA, 19 nt, Homo sapiens
gaacuuuucacuuaucuca

SEQ ID NO: 290868 - RNA, 19 nt, Homo sapiens
gauaaucgaagaacuuuuc

SEQ ID NO: 290869 - RNA, 19 nt, Homo sapiens
gcaaugguuuuguguagca

SEQ ID NO: 290870 - RNA, 19 nt, Homo sapiens
gaucuguugaguuucuuug

SEQ ID NO: 290871 - RNA, 19 nt, Homo sapiens
gacaugcccauauaugaag

SEQ ID NO: 290872 - RNA, 19 nt, Homo sapiens
uggacaugcccauauauga

SEQ ID NO: 290873 - RNA, 19 nt, Homo sapiens
guauuuaaucgguucuguu

SEQ ID NO: 290874 - RNA, 19 nt, Homo sapiens
ugacuuagagauggaaugu

SEQ ID NO: 290875 - RNA, 19 nt, Homo sapiens
aacccgaggcucuuuguuu

SEQ ID NO: 290876 - RNA, 19 nt, Homo sapiens
uuugaucucuucgacuaaa

SEQ ID NO: 290877 - RNA, 19 nt, Homo sapiens
ugaggcagguuuacaacac

SEQ ID NO: 290878 - RNA, 19 nt, Homo sapiens
acucaaccaagcugugaua

SEQ ID NO: 290879 - RNA, 19 nt, Homo sapiens
acccgaggcucuuuguuuc

SEQ ID NO: 290880 - RNA, 19 nt, Homo sapiens
gauauccagaagcacauga

SEQ ID NO: 290881 - RNA, 19 nt, Homo sapiens
caaaucuugauauccagaa

SEQ ID NO: 290882 - RNA, 19 nt, Homo sapiens
gcuguaccagucagugauu

SEQ ID NO: 290883 - RNA, 19 nt, Homo sapiens
uauuuaaucgguucuguuc

SEQ ID NO: 290884 - RNA, 19 nt, Homo sapiens
gaggcagguuuacaacacu

SEQ ID NO: 290885 - RNA, 19 nt, Homo sapiens
cagucgucuuugagaauaa

SEQ ID NO: 290886 - RNA, 19 nt, Homo sapiens
ggacagagaugccuuaaaa

SEQ ID NO: 290887 - RNA, 19 nt, Homo sapiens
gagagaagcugaacauggu

SEQ ID NO: 290888 - RNA, 19 nt, Homo sapiens
gggaagaaaucgacguuga

SEQ ID NO: 290889 - RNA, 19 nt, Homo sapiens
acaaugaaauggagaagaa

SEQ ID NO: 290890 - RNA, 19 nt, Homo sapiens
gcagaucaacucacaauga

SEQ ID NO: 290891 - RNA, 19 nt, Homo sapiens
cagaucaacucacaaugaa

SEQ ID NO: 290892 - RNA, 19 nt, Homo sapiens
gauuguggguuucugauug

SEQ ID NO: 290893 - RNA, 19 nt, Homo sapiens
gcacauaaagaaacuugaa

SEQ ID NO: 290894 - RNA, 19 nt, Homo sapiens
ccaaauugcacauaaagaa

SEQ ID NO: 290895 - RNA, 19 nt, Homo sapiens
ucaaggaggugcuuaggau

SEQ ID NO: 290896 - RNA, 19 nt, Homo sapiens
gcaccagcaucaagagaau

SEQ ID NO: 290897 - RNA, 19 nt, Homo sapiens
gaucaacucacaaugaaau

SEQ ID NO: 290898 - RNA, 19 nt, Homo sapiens
uaacagcaguagcagauca

SEQ ID NO: 290899 - RNA, 19 nt, Homo sapiens
gaaaagccguucaccaaau

SEQ ID NO: 290900 - RNA, 19 nt, Homo sapiens
aaagccaaauugcacauaa

SEQ ID NO: 290901 - RNA, 19 nt, Homo sapiens
cugauuagguaacguauug

SEQ ID NO: 290902 - RNA, 19 nt, Homo sapiens
gagaagcugaacaugguua

SEQ ID NO: 290903 - RNA, 19 nt, Homo sapiens
acaacucccuugcacguaa

SEQ ID NO: 290904 - RNA, 19 nt, Homo sapiens
uggagaagcugggcauuga

SEQ ID NO: 290905 - RNA, 19 nt, Homo sapiens
ggagagagaagcugaacau

SEQ ID NO: 290906 - RNA, 19 nt, Homo sapiens
gaaucaagucgacacacua

SEQ ID NO: 290907 - RNA, 19 nt, Homo sapiens
gcuugugccuggagaaguu

SEQ ID NO: 290908 - RNA, 19 nt, Homo sapiens
caacucccuugcacguaaa

SEQ ID NO: 290909 - RNA, 19 nt, Homo sapiens
gcacugcggcugucuccuu

SEQ ID NO: 290910 - RNA, 19 nt, Homo sapiens
gagcagcgacaccugaaga

SEQ ID NO: 290911 - RNA, 19 nt, Homo sapiens
cacacuacguugaguuuau

SEQ ID NO: 290912 - RNA, 19 nt, Homo sapiens
gaauagacgggcucaucuu

SEQ ID NO: 290913 - RNA, 19 nt, Homo sapiens
acacuacguugaguuuauu

SEQ ID NO: 290914 - RNA, 19 nt, Homo sapiens
gagaagcugggcauugaga

SEQ ID NO: 290915 - RNA, 19 nt, Homo sapiens
ugaagaggcagcuggagaa

SEQ ID NO: 290916 - RNA, 19 nt, Homo sapiens
aagccaaauugcacauaaa

SEQ ID NO: 290917 - RNA, 19 nt, Homo sapiens
gagcacggacuaucucaca

SEQ ID NO: 290918 - RNA, 19 nt, Homo sapiens
gacacacuacguugaguuu

SEQ ID NO: 290919 - RNA, 19 nt, Homo sapiens
ccauguuaccauacaauaa

SEQ ID NO: 290920 - RNA, 19 nt, Homo sapiens
gguuaugccuccauguuac

SEQ ID NO: 290921 - RNA, 19 nt, Homo sapiens
cgaaucaagucgacacacu

SEQ ID NO: 290922 - RNA, 19 nt, Homo sapiens
gggcucaucuucgcuugug

SEQ ID NO: 290923 - RNA, 19 nt, Homo sapiens
caacucacaaugaaaugga

SEQ ID NO: 290924 - RNA, 19 nt, Homo sapiens
gcagugugagcgacucuga

SEQ ID NO: 290925 - RNA, 19 nt, Homo sapiens
aaucagcuuuguaacuguu

SEQ ID NO: 290926 - RNA, 19 nt, Homo sapiens
gcagugaugagggcuauuc

SEQ ID NO: 290927 - RNA, 19 nt, Homo sapiens
acuugaagauugugacaga

SEQ ID NO: 290928 - RNA, 19 nt, Homo sapiens
ggauuguggguuucugauu

SEQ ID NO: 290929 - RNA, 19 nt, Homo sapiens
guucugauuagguaacgua

SEQ ID NO: 290930 - RNA, 19 nt, Homo sapiens
gagagcagcgacaccugaa

SEQ ID NO: 290931 - RNA, 19 nt, Homo sapiens
acaauaacaaggacagaga

SEQ ID NO: 290932 - RNA, 19 nt, Homo sapiens
uagcagaucaacucacaau

SEQ ID NO: 290933 - RNA, 19 nt, Homo sapiens
aagaauaacagcaguagca

SEQ ID NO: 290934 - RNA, 19 nt, Homo sapiens
gaaauggagaagaauagac

SEQ ID NO: 290935 - RNA, 19 nt, Homo sapiens
caaggaggugcuuaggauu

SEQ ID NO: 290936 - RNA, 19 nt, Homo sapiens
aaaaucagcuuuguaacug

SEQ ID NO: 290937 - RNA, 19 nt, Homo sapiens
uguugguucugauuaggua

SEQ ID NO: 290938 - RNA, 19 nt, Homo sapiens
ggaagaaaucgacguugac

SEQ ID NO: 290939 - RNA, 19 nt, Homo sapiens
ugguuaugccuccauguua

SEQ ID NO: 290940 - RNA, 19 nt, Homo sapiens
cagaaaagccguucaccaa

SEQ ID NO: 290941 - RNA, 19 nt, Homo sapiens
uaccauacaauaacaagga

SEQ ID NO: 290942 - RNA, 19 nt, Homo sapiens
aguagcagaucaacucaca

SEQ ID NO: 290943 - RNA, 19 nt, Homo sapiens
caagucgacacacuacguu

SEQ ID NO: 290944 - RNA, 19 nt, Homo sapiens
aauaacagcaguagcagau

SEQ ID NO: 290945 - RNA, 19 nt, Homo sapiens
cgacacacuacguugaguu

SEQ ID NO: 290946 - RNA, 19 nt, Homo sapiens
uaaagcugcaggacaguca

SEQ ID NO: 290947 - RNA, 19 nt, Homo sapiens
guauuggaccugcccacaa

SEQ ID NO: 290948 - RNA, 19 nt, Homo sapiens
ggcgugucuuggucucuaa

SEQ ID NO: 290949 - RNA, 19 nt, Homo sapiens
uggagcagcagcaguguga

SEQ ID NO: 290950 - RNA, 19 nt, Homo sapiens
gcaguagcagaucaacuca

SEQ ID NO: 290951 - RNA, 19 nt, Homo sapiens
ugaaauggagaagaauaga

SEQ ID NO: 290952 - RNA, 19 nt, Homo sapiens
gauuagguaacguauugga

SEQ ID NO: 290953 - RNA, 19 nt, Homo sapiens
caauaacaaggacagagau

SEQ ID NO: 290954 - RNA, 19 nt, Homo sapiens
ugaagauugugacagaaaa

SEQ ID NO: 290955 - RNA, 19 nt, Homo sapiens
gccaaauugcacauaaaga

SEQ ID NO: 290956 - RNA, 19 nt, Homo sapiens
ugcuuaggauuguggguuu

SEQ ID NO: 290957 - RNA, 19 nt, Homo sapiens
uauuggaccugcccacaac

SEQ ID NO: 290958 - RNA, 19 nt, Homo sapiens
gaagaggcagcuggagaag

SEQ ID NO: 290959 - RNA, 19 nt, Homo sapiens
acacacuacguugaguuua

SEQ ID NO: 290960 - RNA, 19 nt, Homo sapiens
aaggaggugcuuaggauug

SEQ ID NO: 290961 - RNA, 19 nt, Homo sapiens
cugcggcugucuccuugaa

SEQ ID NO: 290962 - RNA, 19 nt, Homo sapiens
gagagagaagcugaacaug

SEQ ID NO: 290963 - RNA, 19 nt, Homo sapiens
ggaggugcuuaggauugug

SEQ ID NO: 290964 - RNA, 19 nt, Homo sapiens
aaaucagcuuuguaacugu

SEQ ID NO: 290965 - RNA, 19 nt, Homo sapiens
cuugaagguucucccuguu

SEQ ID NO: 290966 - RNA, 19 nt, Homo sapiens
aagaauagacgggcucauc

SEQ ID NO: 290967 - RNA, 19 nt, Homo sapiens
gaagcugaacaugguuaug

SEQ ID NO: 290968 - RNA, 19 nt, Homo sapiens
cggcagugaugagggcuau

SEQ ID NO: 290969 - RNA, 19 nt, Homo sapiens
cuccacagcgggcuccaua

SEQ ID NO: 290970 - RNA, 19 nt, Homo sapiens
uaacaaaagccaaauugca

SEQ ID NO: 290971 - RNA, 19 nt, Homo sapiens
ggacucaccuugcuuguaa

SEQ ID NO: 290972 - RNA, 19 nt, Homo sapiens
ggaaguuucuuguucauuu

SEQ ID NO: 290973 - RNA, 19 nt, Homo sapiens
guagggagauauuuaagua

SEQ ID NO: 290974 - RNA, 19 nt, Homo sapiens
gauaguaacuguagaugga

SEQ ID NO: 290975 - RNA, 19 nt, Homo sapiens
cauuugaucugcugauuua

SEQ ID NO: 290976 - RNA, 19 nt, Homo sapiens
ggaguuaacaucaugaauu

SEQ ID NO: 290977 - RNA, 19 nt, Homo sapiens
gaaagauggcaguuugaua

SEQ ID NO: 290978 - RNA, 19 nt, Homo sapiens
gcuagaugcuuuccuaaau

SEQ ID NO: 290979 - RNA, 19 nt, Homo sapiens
uaaauaaugugguggaaca

SEQ ID NO: 290980 - RNA, 19 nt, Homo sapiens
gauggcaguuugauauuga

SEQ ID NO: 290981 - RNA, 19 nt, Homo sapiens
gaaguuucuuguucauuug

SEQ ID NO: 290982 - RNA, 19 nt, Homo sapiens
caacaaaggaagucuaaau

SEQ ID NO: 290983 - RNA, 19 nt, Homo sapiens
caaguaguuugacucagua

SEQ ID NO: 290984 - RNA, 19 nt, Homo sapiens
uggaacaacugaaagauug

SEQ ID NO: 290985 - RNA, 19 nt, Homo sapiens
guuaagguccugaaaguaa

SEQ ID NO: 290986 - RNA, 19 nt, Homo sapiens
gaccuucauuucauguaua

SEQ ID NO: 290987 - RNA, 19 nt, Homo sapiens
ggagaaaaccaaaaugaua

SEQ ID NO: 290988 - RNA, 19 nt, Homo sapiens
gaccacaguuuauuaccaa

SEQ ID NO: 290989 - RNA, 19 nt, Homo sapiens
gaaauccguucagugauca

SEQ ID NO: 290990 - RNA, 19 nt, Homo sapiens
uuacucgagugcagaaaua

SEQ ID NO: 290991 - RNA, 19 nt, Homo sapiens
gaagauaguaacuguagau

SEQ ID NO: 290992 - RNA, 19 nt, Homo sapiens
aaagauggcaguuugauau

SEQ ID NO: 290993 - RNA, 19 nt, Homo sapiens
gauauugagugugacaaga

SEQ ID NO: 290994 - RNA, 19 nt, Homo sapiens
gaagcaauggauauuugua

SEQ ID NO: 290995 - RNA, 19 nt, Homo sapiens
gauacuuacugaacugugu

SEQ ID NO: 290996 - RNA, 19 nt, Homo sapiens
gcaguuugauauugagugu

SEQ ID NO: 290997 - RNA, 19 nt, Homo sapiens
caguauagguagggagaua

SEQ ID NO: 290998 - RNA, 19 nt, Homo sapiens
guguguaauuguuccuuua

SEQ ID NO: 290999 - RNA, 19 nt, Homo sapiens
ggaccacaguuuauuacca

SEQ ID NO: 291000 - RNA, 19 nt, Homo sapiens
uggcauauauccaucugaa

SEQ ID NO: 291001 - RNA, 19 nt, Homo sapiens
caauggauauuuguacugu

SEQ ID NO: 291002 - RNA, 19 nt, Homo sapiens
gaaagugaggaaauaaagu

SEQ ID NO: 291003 - RNA, 19 nt, Homo sapiens
ugaacuguguguaauuguu

SEQ ID NO: 291004 - RNA, 19 nt, Homo sapiens
cuacuacaauccacaaagu

SEQ ID NO: 291005 - RNA, 19 nt, Homo sapiens
gcugauuuauacagacaaa

SEQ ID NO: 291006 - RNA, 19 nt, Homo sapiens
cuggaaagauggcaguuug

SEQ ID NO: 291007 - RNA, 19 nt, Homo sapiens
cuacugaucuugagcucau

SEQ ID NO: 291008 - RNA, 19 nt, Homo sapiens
uagaugcuuuccuaaauca

SEQ ID NO: 291009 - RNA, 19 nt, Homo sapiens
gcacauuguucaaaaggaa

SEQ ID NO: 291010 - RNA, 19 nt, Homo sapiens
gcuuguaacuacugaucuu

SEQ ID NO: 291011 - RNA, 19 nt, Homo sapiens
aagugaaagugaggaaaua

SEQ ID NO: 291012 - RNA, 19 nt, Homo sapiens
ggaagucuaaauauucaga

SEQ ID NO: 291013 - RNA, 19 nt, Homo sapiens
gcauauauccaucugaaac

SEQ ID NO: 291014 - RNA, 19 nt, Homo sapiens
guaccuauuugacuuacca

SEQ ID NO: 291015 - RNA, 19 nt, Homo sapiens
guuggaaguuucuuguuca

SEQ ID NO: 291016 - RNA, 19 nt, Homo sapiens
cagcuacggugacauuucu

SEQ ID NO: 291017 - RNA, 19 nt, Homo sapiens
caacugaaagauugguuau

SEQ ID NO: 291018 - RNA, 19 nt, Homo sapiens
cuagaugcuuuccuaaauc

SEQ ID NO: 291019 - RNA, 19 nt, Homo sapiens
ugacuuaccauggaguuaa

SEQ ID NO: 291020 - RNA, 19 nt, Homo sapiens
cgccuucguucauuuacua

SEQ ID NO: 291021 - RNA, 19 nt, Homo sapiens
gugaggaaauaaaguuaag

SEQ ID NO: 291022 - RNA, 19 nt, Homo sapiens
ugacaagacugcaaaagau

SEQ ID NO: 291023 - RNA, 19 nt, Homo sapiens
ggaaagauggcaguuugau

SEQ ID NO: 291024 - RNA, 19 nt, Homo sapiens
gguuguaguuaucucaaau

SEQ ID NO: 291025 - RNA, 19 nt, Homo sapiens
caaguguucaguucagaaa

SEQ ID NO: 291026 - RNA, 19 nt, Homo sapiens
ucaccuugcuuguaacuac

SEQ ID NO: 291027 - RNA, 19 nt, Homo sapiens
ugaccuucauuucauguau

SEQ ID NO: 291028 - RNA, 19 nt, Homo sapiens
guaguuugacucaguauag

SEQ ID NO: 291029 - RNA, 19 nt, Homo sapiens
cacaguuuauuaccaauuc

SEQ ID NO: 291030 - RNA, 19 nt, Homo sapiens
gaaagauugguuauacaag

SEQ ID NO: 291031 - RNA, 19 nt, Homo sapiens
gaaccuaugaagcaaugga

SEQ ID NO: 291032 - RNA, 19 nt, Homo sapiens
gaaauauugcuguauagcu

SEQ ID NO: 291033 - RNA, 19 nt, Homo sapiens
guccugaaaguaacucaua

SEQ ID NO: 291034 - RNA, 19 nt, Homo sapiens
auagguagggagauauuua

SEQ ID NO: 291035 - RNA, 19 nt, Homo sapiens
cuauuugacuuaccaugga

SEQ ID NO: 291036 - RNA, 19 nt, Homo sapiens
ccaaaaugauacuuacuga

SEQ ID NO: 291037 - RNA, 19 nt, Homo sapiens
gugagguccuggaaagaug

SEQ ID NO: 291038 - RNA, 19 nt, Homo sapiens
gugaaagugaggaaauaaa

SEQ ID NO: 291039 - RNA, 19 nt, Homo sapiens
uaagugaaagugaggaaau

SEQ ID NO: 291040 - RNA, 19 nt, Homo sapiens
augaagcaauggauauuug

SEQ ID NO: 291041 - RNA, 19 nt, Homo sapiens
uggccgaguucuucucauu

SEQ ID NO: 291042 - RNA, 19 nt, Homo sapiens
gagucgggaccacaguuua

SEQ ID NO: 291043 - RNA, 19 nt, Homo sapiens
guggugagguccuggaaag

SEQ ID NO: 291044 - RNA, 19 nt, Homo sapiens
uuauacaaguguucaguuc

SEQ ID NO: 291045 - RNA, 19 nt, Homo sapiens
gacagugcacccagagaaa

SEQ ID NO: 291046 - RNA, 19 nt, Homo sapiens
gugcagaaauacggacuca

SEQ ID NO: 291047 - RNA, 19 nt, Homo sapiens
ugacagugcacccagagaa

SEQ ID NO: 291048 - RNA, 19 nt, Homo sapiens
acugaaagauugguuauac

SEQ ID NO: 291049 - RNA, 19 nt, Homo sapiens
guggaacaacugaaagauu

SEQ ID NO: 291050 - RNA, 19 nt, Homo sapiens
uauguaacuugaaccuaug

SEQ ID NO: 291051 - RNA, 19 nt, Homo sapiens
uagguagggagauauuuaa

SEQ ID NO: 291052 - RNA, 19 nt, Homo sapiens
guauagguagggagauauu

SEQ ID NO: 291053 - RNA, 19 nt, Homo sapiens
cuucguucauuuacuacua

SEQ ID NO: 291054 - RNA, 19 nt, Homo sapiens
aguuugauauugaguguga

SEQ ID NO: 291055 - RNA, 19 nt, Homo sapiens
gcaauggauauuuguacug

SEQ ID NO: 291056 - RNA, 19 nt, Homo sapiens
uacaacaaaggaagucuaa

SEQ ID NO: 291057 - RNA, 19 nt, Homo sapiens
cuacaauccacaaaguaaa

SEQ ID NO: 291058 - RNA, 19 nt, Homo sapiens
ugaaagugaggaaauaaag

SEQ ID NO: 291059 - RNA, 19 nt, Homo sapiens
gaugacaugaggaaaauaa

SEQ ID NO: 291060 - RNA, 19 nt, Homo sapiens
aagauugguuauacaagug

SEQ ID NO: 291061 - RNA, 19 nt, Homo sapiens
acaacugaaagauugguua

SEQ ID NO: 291062 - RNA, 19 nt, Homo sapiens
cgaaaucguggccgaguuc

SEQ ID NO: 291063 - RNA, 19 nt, Homo sapiens
gauguauauuccuuugaag

SEQ ID NO: 291064 - RNA, 19 nt, Homo sapiens
auauccaucugaaaccuuu

SEQ ID NO: 291065 - RNA, 19 nt, Homo sapiens
gaugcuuuccuaaaucaga

SEQ ID NO: 291066 - RNA, 19 nt, Homo sapiens
ugaagauaguaacuguaga

SEQ ID NO: 291067 - RNA, 19 nt, Homo sapiens
ugugauguauauuccuuug

SEQ ID NO: 291068 - RNA, 19 nt, Homo sapiens
acugaacuguguguaauug

SEQ ID NO: 291069 - RNA, 19 nt, Homo sapiens
acuacaauccacaaaguaa

SEQ ID NO: 291070 - RNA, 19 nt, Homo sapiens
ccacaguuuauuaccaauu

SEQ ID NO: 291071 - RNA, 19 nt, Homo sapiens
ccaagaauuugcucaguua

SEQ ID NO: 291072 - RNA, 19 nt, Homo sapiens
gggcugcucuccaauguua

SEQ ID NO: 291073 - RNA, 19 nt, Homo sapiens
caaauggguucaccucaua

SEQ ID NO: 291074 - RNA, 19 nt, Homo sapiens
gauaauacuugaccucugu

SEQ ID NO: 291075 - RNA, 19 nt, Homo sapiens
ggaagggacugccucaugu

SEQ ID NO: 291076 - RNA, 19 nt, Homo sapiens
ggauaaaguucuuacucaa

SEQ ID NO: 291077 - RNA, 19 nt, Homo sapiens
gaaacagggcgaugaagaa

SEQ ID NO: 291078 - RNA, 19 nt, Homo sapiens
caagacacagcgaauauaa

SEQ ID NO: 291079 - RNA, 19 nt, Homo sapiens
ggagacagcuuuauuucac

SEQ ID NO: 291080 - RNA, 19 nt, Homo sapiens
aaacacuggugcucuauug

SEQ ID NO: 291081 - RNA, 19 nt, Homo sapiens
gcucuauugucuacuauga

SEQ ID NO: 291082 - RNA, 19 nt, Homo sapiens
agaauuugcucaguuauug

SEQ ID NO: 291083 - RNA, 19 nt, Homo sapiens
ggaaacagggcgaugaaga

SEQ ID NO: 291084 - RNA, 19 nt, Homo sapiens
cuucuggacuucaaacuaa

SEQ ID NO: 291085 - RNA, 19 nt, Homo sapiens
guagaaagcccuguacuuc

SEQ ID NO: 291086 - RNA, 19 nt, Homo sapiens
gggacugccucaugucauu

SEQ ID NO: 291087 - RNA, 19 nt, Homo sapiens
ucacugauccuuccaacaa

SEQ ID NO: 291088 - RNA, 19 nt, Homo sapiens
gaguaacugugucaccauu

SEQ ID NO: 291089 - RNA, 19 nt, Homo sapiens
ccuaguggguguagucuga

SEQ ID NO: 291090 - RNA, 19 nt, Homo sapiens
uaaccggaauuccacuauu

SEQ ID NO: 291091 - RNA, 19 nt, Homo sapiens
gaaaucaacagaggagaug

SEQ ID NO: 291092 - RNA, 19 nt, Homo sapiens
acagggcgaugaagaagaa

SEQ ID NO: 291093 - RNA, 19 nt, Homo sapiens
uggauaaaguucuuacuca

SEQ ID NO: 291094 - RNA, 19 nt, Homo sapiens
gcaucaaucccuaccacua

SEQ ID NO: 291095 - RNA, 19 nt, Homo sapiens
uaacuagugcugucauuau

SEQ ID NO: 291096 - RNA, 19 nt, Homo sapiens
gaaaacaccaggcggcaua

SEQ ID NO: 291097 - RNA, 19 nt, Homo sapiens
ggugcucuauugucuacua

SEQ ID NO: 291098 - RNA, 19 nt, Homo sapiens
gaaggaggucugcaucaau

SEQ ID NO: 291099 - RNA, 19 nt, Homo sapiens
acuguuggauucagaaauu

SEQ ID NO: 291100 - RNA, 19 nt, Homo sapiens
gguguagucugaaaauuuu

SEQ ID NO: 291101 - RNA, 19 nt, Homo sapiens
ggagguguaugccgaaugc

SEQ ID NO: 291102 - RNA, 19 nt, Homo sapiens
acuaugagcucaacaaucg

SEQ ID NO: 291103 - RNA, 19 nt, Homo sapiens
gagaguagaaagcccugua

SEQ ID NO: 291104 - RNA, 19 nt, Homo sapiens
gaaugguaauuucuacucu

SEQ ID NO: 291105 - RNA, 19 nt, Homo sapiens
gagccuugauaauacuuga

SEQ ID NO: 291106 - RNA, 19 nt, Homo sapiens
ucaaauggguucaccucau

SEQ ID NO: 291107 - RNA, 19 nt, Homo sapiens
gaacugcaacuaccaucau

SEQ ID NO: 291108 - RNA, 19 nt, Homo sapiens
gcauuuggagacagcuuua

SEQ ID NO: 291109 - RNA, 19 nt, Homo sapiens
guacuugaaggauggauga

SEQ ID NO: 291110 - RNA, 19 nt, Homo sapiens
ccaagacacagcgaauaua

SEQ ID NO: 291111 - RNA, 19 nt, Homo sapiens
ccauauccaaggaguauaa

SEQ ID NO: 291112 - RNA, 19 nt, Homo sapiens
ggaguucaucuuuauuaug

SEQ ID NO: 291113 - RNA, 19 nt, Homo sapiens
ccacuggaaugcugugagu

SEQ ID NO: 291114 - RNA, 19 nt, Homo sapiens
auugagaacugacaaagga

SEQ ID NO: 291115 - RNA, 19 nt, Homo sapiens
ccaaaacacuggugcucua

SEQ ID NO: 291116 - RNA, 19 nt, Homo sapiens
gguaauuucuacucuucug

SEQ ID NO: 291117 - RNA, 19 nt, Homo sapiens
gaaaggugccauggaggaa

SEQ ID NO: 291118 - RNA, 19 nt, Homo sapiens
gaaggauggaugagucaga

SEQ ID NO: 291119 - RNA, 19 nt, Homo sapiens
ccaacaauaagaaccguuu

SEQ ID NO: 291120 - RNA, 19 nt, Homo sapiens
ggcgguugcuuaugaggaa

SEQ ID NO: 291121 - RNA, 19 nt, Homo sapiens
uuuccucacucucccaaua

SEQ ID NO: 291122 - RNA, 19 nt, Homo sapiens
agaaggaggucugcaucaa

SEQ ID NO: 291123 - RNA, 19 nt, Homo sapiens
ccaaggaguauaacuagug

SEQ ID NO: 291124 - RNA, 19 nt, Homo sapiens
aaccggaauuccacuauug

SEQ ID NO: 291125 - RNA, 19 nt, Homo sapiens
caacaaucgugugggugaa

SEQ ID NO: 291126 - RNA, 19 nt, Homo sapiens
caauagcaguuacccaaac

SEQ ID NO: 291127 - RNA, 19 nt, Homo sapiens
caucaaucccuaccacuau

SEQ ID NO: 291128 - RNA, 19 nt, Homo sapiens
ucagagccaccaugaacua

SEQ ID NO: 291129 - RNA, 19 nt, Homo sapiens
uauaacuagugcugucauu

SEQ ID NO: 291130 - RNA, 19 nt, Homo sapiens
acugauccuuccaacaaua

SEQ ID NO: 291131 - RNA, 19 nt, Homo sapiens
agacacagcgaauauaauc

SEQ ID NO: 291132 - RNA, 19 nt, Homo sapiens
uauccaaggaguauaacua

SEQ ID NO: 291133 - RNA, 19 nt, Homo sapiens
cagacacgauugagaacug

SEQ ID NO: 291134 - RNA, 19 nt, Homo sapiens
gauuucauccuacuacugu

SEQ ID NO: 291135 - RNA, 19 nt, Homo sapiens
ggaauuccacuauugaaaa

SEQ ID NO: 291136 - RNA, 19 nt, Homo sapiens
acacuaggaaugguaauuu

SEQ ID NO: 291137 - RNA, 19 nt, Homo sapiens
cuauugagccuugcaugua

SEQ ID NO: 291138 - RNA, 19 nt, Homo sapiens
cagcuuuauuucaccauau

SEQ ID NO: 291139 - RNA, 19 nt, Homo sapiens
uaaacacuaggaaugguaa

SEQ ID NO: 291140 - RNA, 19 nt, Homo sapiens
aaggaggucugcaucaauc

SEQ ID NO: 291141 - RNA, 19 nt, Homo sapiens
gagccaccaugaacuaaaa

SEQ ID NO: 291142 - RNA, 19 nt, Homo sapiens
ggaugagucagacacgauu

SEQ ID NO: 291143 - RNA, 19 nt, Homo sapiens
gaacuaaaaccacuggaau

SEQ ID NO: 291144 - RNA, 19 nt, Homo sapiens
guggaugguuucacugauc

SEQ ID NO: 291145 - RNA, 19 nt, Homo sapiens
ggaaugguaauuucuacuc

SEQ ID NO: 291146 - RNA, 19 nt, Homo sapiens
cuaagaaguuaaagagacu

SEQ ID NO: 291147 - RNA, 19 nt, Homo sapiens
gaaccauggauuugagaca

SEQ ID NO: 291148 - RNA, 19 nt, Homo sapiens
cuacuacuguuugcaagau

SEQ ID NO: 291149 - RNA, 19 nt, Homo sapiens
uucaggcgguugcuuauga

SEQ ID NO: 291150 - RNA, 19 nt, Homo sapiens
ccaauagcaguuacccaaa

SEQ ID NO: 291151 - RNA, 19 nt, Homo sapiens
acagcuuuauuucaccaua

SEQ ID NO: 291152 - RNA, 19 nt, Homo sapiens
gagccuugcauguacuuga

SEQ ID NO: 291153 - RNA, 19 nt, Homo sapiens
ggaacugcaacuaccauca

SEQ ID NO: 291154 - RNA, 19 nt, Homo sapiens
cuaggaaugguaauuucua

SEQ ID NO: 291155 - RNA, 19 nt, Homo sapiens
gacugccucaugucauuua

SEQ ID NO: 291156 - RNA, 19 nt, Homo sapiens
ggacugccucaugucauuu

SEQ ID NO: 291157 - RNA, 19 nt, Homo sapiens
guacuauacguaugagcuu

SEQ ID NO: 291158 - RNA, 19 nt, Homo sapiens
gacagucuaugagcuuaca

SEQ ID NO: 291159 - RNA, 19 nt, Homo sapiens
cacuaggaaugguaauuuc

SEQ ID NO: 291160 - RNA, 19 nt, Homo sapiens
uuucuacucuucuggacuu

SEQ ID NO: 291161 - RNA, 19 nt, Homo sapiens
accaagaauuugcucaguu

SEQ ID NO: 291162 - RNA, 19 nt, Homo sapiens
uagugacaguagcaucuuu

SEQ ID NO: 291163 - RNA, 19 nt, Homo sapiens
cggaauuccacuauugaaa

SEQ ID NO: 291164 - RNA, 19 nt, Homo sapiens
cuacucuucuggacuucaa

SEQ ID NO: 291165 - RNA, 19 nt, Homo sapiens
uuccguaacuuaggacaaa

SEQ ID NO: 291166 - RNA, 19 nt, Homo sapiens
ugaccucugugaccaacug

SEQ ID NO: 291167 - RNA, 19 nt, Homo sapiens
agacacgauugagaacuga

SEQ ID NO: 291168 - RNA, 19 nt, Homo sapiens
uuaaacacuaggaauggua

SEQ ID NO: 291169 - RNA, 19 nt, Homo sapiens
gugcugacuggguuacuuu

SEQ ID NO: 291170 - RNA, 19 nt, Homo sapiens
gauggacacaaacaugaug

SEQ ID NO: 291171 - RNA, 19 nt, Homo sapiens
gaaauacucucccauuaaa

SEQ ID NO: 291172 - RNA, 19 nt, Homo sapiens
uaacaacucuucugucaua

SEQ ID NO: 291173 - RNA, 19 nt, Homo sapiens
gaacaaaccaggucucuug

SEQ ID NO: 291174 - RNA, 19 nt, Homo sapiens
gcagaacuaucuccuacua

SEQ ID NO: 291175 - RNA, 19 nt, Homo sapiens
gaagaggagugcgcuuaua

SEQ ID NO: 291176 - RNA, 19 nt, Homo sapiens
guaguuauguguacaggua

SEQ ID NO: 291177 - RNA, 19 nt, Homo sapiens
uagaaauacucucccauua

SEQ ID NO: 291178 - RNA, 19 nt, Homo sapiens
gaauugagccacagaguaa

SEQ ID NO: 291179 - RNA, 19 nt, Homo sapiens
ggacugaguacaccaaaua

SEQ ID NO: 291180 - RNA, 19 nt, Homo sapiens
gaaaugacaagaaggcaua

SEQ ID NO: 291181 - RNA, 19 nt, Homo sapiens
gaacaugucguccaucuug

SEQ ID NO: 291182 - RNA, 19 nt, Homo sapiens
gguuuacucuccaauguua

SEQ ID NO: 291183 - RNA, 19 nt, Homo sapiens
caacaggccuuuacagcuu

SEQ ID NO: 291184 - RNA, 19 nt, Homo sapiens
ggagaaaccuuccaugcau

SEQ ID NO: 291185 - RNA, 19 nt, Homo sapiens
ccaccaggcuguaaucuga

SEQ ID NO: 291186 - RNA, 19 nt, Homo sapiens
gacaaaguauuaacucaga

SEQ ID NO: 291187 - RNA, 19 nt, Homo sapiens
ucauaaagcuucaccaauc

SEQ ID NO: 291188 - RNA, 19 nt, Homo sapiens
ggagugcgcuuauacuaca

SEQ ID NO: 291189 - RNA, 19 nt, Homo sapiens
ccaaucaagucccaugaaa

SEQ ID NO: 291190 - RNA, 19 nt, Homo sapiens
ggaauuugcugcucuucug

SEQ ID NO: 291191 - RNA, 19 nt, Homo sapiens
uaaagcaccuuguggaauc

SEQ ID NO: 291192 - RNA, 19 nt, Homo sapiens
ggaauugagccacagagua

SEQ ID NO: 291193 - RNA, 19 nt, Homo sapiens
caaaccaggucucuugaug

SEQ ID NO: 291194 - RNA, 19 nt, Homo sapiens
gaagaaaaguggugugaga

SEQ ID NO: 291195 - RNA, 19 nt, Homo sapiens
ugcaguaccuaaucuguua

SEQ ID NO: 291196 - RNA, 19 nt, Homo sapiens
gcucaagcaugucauaaag

SEQ ID NO: 291197 - RNA, 19 nt, Homo sapiens
gaagccgucuaucagcuaa

SEQ ID NO: 291198 - RNA, 19 nt, Homo sapiens
gagagguucugcuuagguu

SEQ ID NO: 291199 - RNA, 19 nt, Homo sapiens
ggccugaucuucacaguca

SEQ ID NO: 291200 - RNA, 19 nt, Homo sapiens
gcugagugccuaagugaua

SEQ ID NO: 291201 - RNA, 19 nt, Homo sapiens
gaaaugccacgguagaaau

SEQ ID NO: 291202 - RNA, 19 nt, Homo sapiens
ccuauggacuguuuacuau

SEQ ID NO: 291203 - RNA, 19 nt, Homo sapiens
gauccaguaucacaguauu

SEQ ID NO: 291204 - RNA, 19 nt, Homo sapiens
cauaaagcuucaccaauca

SEQ ID NO: 291205 - RNA, 19 nt, Homo sapiens
guaagaacaugucguccau

SEQ ID NO: 291206 - RNA, 19 nt, Homo sapiens
agaaauacucucccauuaa

SEQ ID NO: 291207 - RNA, 19 nt, Homo sapiens
uguaacaacucuucuguca

SEQ ID NO: 291208 - RNA, 19 nt, Homo sapiens
acuagaaugugcaccauaa

SEQ ID NO: 291209 - RNA, 19 nt, Homo sapiens
ccaauuguaaucagagaua

SEQ ID NO: 291210 - RNA, 19 nt, Homo sapiens
gagguucugcuuagguuua

SEQ ID NO: 291211 - RNA, 19 nt, Homo sapiens
gaagauggagaaacaagug

SEQ ID NO: 291212 - RNA, 19 nt, Homo sapiens
ugacuauacucacuccauu

SEQ ID NO: 291213 - RNA, 19 nt, Homo sapiens
acaccgagauccuaacaga

SEQ ID NO: 291214 - RNA, 19 nt, Homo sapiens
gaggagugcgcuuauacua

SEQ ID NO: 291215 - RNA, 19 nt, Homo sapiens
gcacuugcucugaaauuug

SEQ ID NO: 291216 - RNA, 19 nt, Homo sapiens
gaucuaggcaaaccuuuau

SEQ ID NO: 291217 - RNA, 19 nt, Homo sapiens
ccacagaguaauuauauuc

SEQ ID NO: 291218 - RNA, 19 nt, Homo sapiens
ugccacauguuauauauug

SEQ ID NO: 291219 - RNA, 19 nt, Homo sapiens
ugaaaagucuggugaagaa

SEQ ID NO: 291220 - RNA, 19 nt, Homo sapiens
gugguuggacaaaguauua

SEQ ID NO: 291221 - RNA, 19 nt, Homo sapiens
uuacagacccaucaaauuc

SEQ ID NO: 291222 - RNA, 19 nt, Homo sapiens
agaaagccaucaccacuca

SEQ ID NO: 291223 - RNA, 19 nt, Homo sapiens
caacucuucugucauagca

SEQ ID NO: 291224 - RNA, 19 nt, Homo sapiens
gaaggcagacgguaacaag

SEQ ID NO: 291225 - RNA, 19 nt, Homo sapiens
cagugaagauggagaaaca

SEQ ID NO: 291226 - RNA, 19 nt, Homo sapiens
gaaaaggauugccacaugu

SEQ ID NO: 291227 - RNA, 19 nt, Homo sapiens
gaucuucacagucaucaug

SEQ ID NO: 291228 - RNA, 19 nt, Homo sapiens
aaacaggacgauuagauga

SEQ ID NO: 291229 - RNA, 19 nt, Homo sapiens
aaagaaaacaggacgauua

SEQ ID NO: 291230 - RNA, 19 nt, Homo sapiens
ggaagaggagugcgcuuau

SEQ ID NO: 291231 - RNA, 19 nt, Homo sapiens
gacaagaaggcauauagga

SEQ ID NO: 291232 - RNA, 19 nt, Homo sapiens
gccaguuacuuacucagaa

SEQ ID NO: 291233 - RNA, 19 nt, Homo sapiens
ggauauaucagugaagaug

SEQ ID NO: 291234 - RNA, 19 nt, Homo sapiens
gguaauguaucaugaucca

SEQ ID NO: 291235 - RNA, 19 nt, Homo sapiens
gagccacagaguaauuaua

SEQ ID NO: 291236 - RNA, 19 nt, Homo sapiens
gaaugugcaccauaagaau

SEQ ID NO: 291237 - RNA, 19 nt, Homo sapiens
gcaacaguguguaaaauuc

SEQ ID NO: 291238 - RNA, 19 nt, Homo sapiens
cgacacaccgagauccuaa

SEQ ID NO: 291239 - RNA, 19 nt, Homo sapiens
cgaaaaggauugccacaug

SEQ ID NO: 291240 - RNA, 19 nt, Homo sapiens
uauucccacuucucuguua

SEQ ID NO: 291241 - RNA, 19 nt, Homo sapiens
cuagaaauacucucccauu

SEQ ID NO: 291242 - RNA, 19 nt, Homo sapiens
cacaggcucuccagcagaa

SEQ ID NO: 291243 - RNA, 19 nt, Homo sapiens
aaaggauugccacauguua

SEQ ID NO: 291244 - RNA, 19 nt, Homo sapiens
ugugugcgcugcuucuuga

SEQ ID NO: 291245 - RNA, 19 nt, Homo sapiens
aaacgccaccuccuggaua

SEQ ID NO: 291246 - RNA, 19 nt, Homo sapiens
gauugccacauguuauaua

SEQ ID NO: 291247 - RNA, 19 nt, Homo sapiens
gaguacaccaaauacgaua

SEQ ID NO: 291248 - RNA, 19 nt, Homo sapiens
gcauagaugaggugugugu

SEQ ID NO: 291249 - RNA, 19 nt, Homo sapiens
acaagaggcuguuuuccua

SEQ ID NO: 291250 - RNA, 19 nt, Homo sapiens
acaagaaggcauauaggaa

SEQ ID NO: 291251 - RNA, 19 nt, Homo sapiens
cgaaaugccacgguagaaa

SEQ ID NO: 291252 - RNA, 19 nt, Homo sapiens
aaguauguguaaacccuua

SEQ ID NO: 291253 - RNA, 19 nt, Homo sapiens
caccaaauacgauagauca

SEQ ID NO: 291254 - RNA, 19 nt, Homo sapiens
gauuagaugagcuugagaa

SEQ ID NO: 291255 - RNA, 19 nt, Homo sapiens
gaaaacaggacgauuagau

SEQ ID NO: 291256 - RNA, 19 nt, Homo sapiens
uaaagaggaagagaagauu

SEQ ID NO: 291257 - RNA, 19 nt, Homo sapiens
uagguuuacucuccaaugu

SEQ ID NO: 291258 - RNA, 19 nt, Homo sapiens
ggugaagaagcuaaagaaa

SEQ ID NO: 291259 - RNA, 19 nt, Homo sapiens
gugcagagccccaauugua

SEQ ID NO: 291260 - RNA, 19 nt, Homo sapiens
aagaaggcauauaggaaga

SEQ ID NO: 291261 - RNA, 19 nt, Homo sapiens
ucuccaauguuaaccgaaa

SEQ ID NO: 291262 - RNA, 19 nt, Homo sapiens
uuacucagaaccugcauuu

SEQ ID NO: 291263 - RNA, 19 nt, Homo sapiens
cagguaauguaucaugauc

SEQ ID NO: 291264 - RNA, 19 nt, Homo sapiens
gcgcuuauacuacauaggu

SEQ ID NO: 291265 - RNA, 19 nt, Homo sapiens
aaacaagugaccaacaguu

SEQ ID NO: 291266 - RNA, 19 nt, Homo sapiens
agaaacaagugaccaacag

SEQ ID NO: 291267 - RNA, 19 nt, Homo sapiens
gagaaacaagugaccaaca

SEQ ID NO: 291268 - RNA, 19 nt, Homo sapiens
gccacagaguaauuauauu

SEQ ID NO: 291269 - RNA, 19 nt, Homo sapiens
ugaagaagcuaaagaaaac

SEQ ID NO: 291270 - RNA, 19 nt, Homo sapiens
aaagaggaagagaagauuu

SEQ ID NO: 291271 - RNA, 19 nt, Homo sapiens
ccaaacacauuuacccuuu

SEQ ID NO: 291272 - RNA, 19 nt, Homo sapiens
ggauugagcugcaccugaa

SEQ ID NO: 291273 - RNA, 19 nt, Homo sapiens
gaacucuacucaacccauu

SEQ ID NO: 291274 - RNA, 19 nt, Homo sapiens
ucaagagccuggucaagaa

SEQ ID NO: 291275 - RNA, 19 nt, Homo sapiens
gaugagcgccaccucuuua

SEQ ID NO: 291276 - RNA, 19 nt, Homo sapiens
uaagugagcagaacaggua

SEQ ID NO: 291277 - RNA, 19 nt, Homo sapiens
guagucaguugcauucauu

SEQ ID NO: 291278 - RNA, 19 nt, Homo sapiens
gcauacggcuauauugguu

SEQ ID NO: 291279 - RNA, 19 nt, Homo sapiens
gagcagaacagguaguauu

SEQ ID NO: 291280 - RNA, 19 nt, Homo sapiens
cgucugcucugguggcuua

SEQ ID NO: 291281 - RNA, 19 nt, Homo sapiens
gaguucgccuucaauauga

SEQ ID NO: 291282 - RNA, 19 nt, Homo sapiens
gaugcaaccugaagaucuu

SEQ ID NO: 291283 - RNA, 19 nt, Homo sapiens
ucaagaaacucaagaagac

SEQ ID NO: 291284 - RNA, 19 nt, Homo sapiens
ggaagaagggcgagcagaa

SEQ ID NO: 291285 - RNA, 19 nt, Homo sapiens
gggcugcucuccaauguca

SEQ ID NO: 291286 - RNA, 19 nt, Homo sapiens
ggacgcagguucuccaaac

SEQ ID NO: 291287 - RNA, 19 nt, Homo sapiens
gacgguaaguguucucaug

SEQ ID NO: 291288 - RNA, 19 nt, Homo sapiens
gagauucgaaugacgguaa

SEQ ID NO: 291289 - RNA, 19 nt, Homo sapiens
cauaugcaauguauagugu

SEQ ID NO: 291290 - RNA, 19 nt, Homo sapiens
ggacugcaguguggaguuc

SEQ ID NO: 291291 - RNA, 19 nt, Homo sapiens
uuagagacaucaaguaugg

SEQ ID NO: 291292 - RNA, 19 nt, Homo sapiens
ccauggagcugugugaguu

SEQ ID NO: 291293 - RNA, 19 nt, Homo sapiens
cagaacagguaguauuaca

SEQ ID NO: 291294 - RNA, 19 nt, Homo sapiens
auacggcuauauugguuua

SEQ ID NO: 291295 - RNA, 19 nt, Homo sapiens
gcacccaccuguuuucuga

SEQ ID NO: 291296 - RNA, 19 nt, Homo sapiens
uaaguguucucaugaagca

SEQ ID NO: 291297 - RNA, 19 nt, Homo sapiens
gcagagugccucagugaca

SEQ ID NO: 291298 - RNA, 19 nt, Homo sapiens
guugugagcuggauagacu

SEQ ID NO: 291299 - RNA, 19 nt, Homo sapiens
gcacgaugcagaccucaug

SEQ ID NO: 291300 - RNA, 19 nt, Homo sapiens
ggagaaaauuggaacucua

SEQ ID NO: 291301 - RNA, 19 nt, Homo sapiens
ucaaagagauucgaaugac

SEQ ID NO: 291302 - RNA, 19 nt, Homo sapiens
ucacauuaaucucaaagag

SEQ ID NO: 291303 - RNA, 19 nt, Homo sapiens
ugaguucgccuucaauaug

SEQ ID NO: 291304 - RNA, 19 nt, Homo sapiens
gagaguagagacaccaguu

SEQ ID NO: 291305 - RNA, 19 nt, Homo sapiens
cgucuccagucaucuguaa

SEQ ID NO: 291306 - RNA, 19 nt, Homo sapiens
gguaaguguucucaugaag

SEQ ID NO: 291307 - RNA, 19 nt, Homo sapiens
gcuguuccagugugucuua

SEQ ID NO: 291308 - RNA, 19 nt, Homo sapiens
gaggcugucuaccaguuga

SEQ ID NO: 291309 - RNA, 19 nt, Homo sapiens
ggugcuccaucuccuacua

SEQ ID NO: 291310 - RNA, 19 nt, Homo sapiens
ggacgaggucugcgugaau

SEQ ID NO: 291311 - RNA, 19 nt, Homo sapiens
ggagaaauggugcgagaag

SEQ ID NO: 291312 - RNA, 19 nt, Homo sapiens
ucacuuacguuguccuuuu

SEQ ID NO: 291313 - RNA, 19 nt, Homo sapiens
gcaccugaaugggccuuug

SEQ ID NO: 291314 - RNA, 19 nt, Homo sapiens
uggaagggcguucuaggua

SEQ ID NO: 291315 - RNA, 19 nt, Homo sapiens
cgaaugacgguaaguguuc

SEQ ID NO: 291316 - RNA, 19 nt, Homo sapiens
gcauaugcaauguauagug

SEQ ID NO: 291317 - RNA, 19 nt, Homo sapiens
gaagagcccgcacgaugca

SEQ ID NO: 291318 - RNA, 19 nt, Homo sapiens
gaacgggcaggaggagaaa

SEQ ID NO: 291319 - RNA, 19 nt, Homo sapiens
acccagagguggauguuau

SEQ ID NO: 291320 - RNA, 19 nt, Homo sapiens
gucaagaaacucaagaaga

SEQ ID NO: 291321 - RNA, 19 nt, Homo sapiens
gagcugacacggagacaca

SEQ ID NO: 291322 - RNA, 19 nt, Homo sapiens
gccuagggcugcucuccaa

SEQ ID NO: 291323 - RNA, 19 nt, Homo sapiens
ccagugaccaccagaugaa

SEQ ID NO: 291324 - RNA, 19 nt, Homo sapiens
gcgugaaucccuaccacua

SEQ ID NO: 291325 - RNA, 19 nt, Homo sapiens
aaacacauuuacccuuugg

SEQ ID NO: 291326 - RNA, 19 nt, Homo sapiens
gagugaagauggagaaacc

SEQ ID NO: 291327 - RNA, 19 nt, Homo sapiens
gggauggcauuuggucuca

SEQ ID NO: 291328 - RNA, 19 nt, Homo sapiens
gucaagagccuggucaaga

SEQ ID NO: 291329 - RNA, 19 nt, Homo sapiens
caagagccuggucaagaaa

SEQ ID NO: 291330 - RNA, 19 nt, Homo sapiens
ugucguccauccugccuuu

SEQ ID NO: 291331 - RNA, 19 nt, Homo sapiens
ucuccaaugucaacaggaa

SEQ ID NO: 291332 - RNA, 19 nt, Homo sapiens
gacgaggucugcgugaauc

SEQ ID NO: 291333 - RNA, 19 nt, Homo sapiens
gcgagaaggcggucaagag

SEQ ID NO: 291334 - RNA, 19 nt, Homo sapiens
agcagaacagguaguauua

SEQ ID NO: 291335 - RNA, 19 nt, Homo sapiens
ccagcucucugacgcuugu

SEQ ID NO: 291336 - RNA, 19 nt, Homo sapiens
agagacaucaaguauggua

SEQ ID NO: 291337 - RNA, 19 nt, Homo sapiens
ggaugcaaccugaagaucu

SEQ ID NO: 291338 - RNA, 19 nt, Homo sapiens
gcugaggcccagugcauau

SEQ ID NO: 291339 - RNA, 19 nt, Homo sapiens
gaagaagggcgagcagaac

SEQ ID NO: 291340 - RNA, 19 nt, Homo sapiens
gaugcauacggcuauauug

SEQ ID NO: 291341 - RNA, 19 nt, Homo sapiens
cgguaaguguucucaugaa

SEQ ID NO: 291342 - RNA, 19 nt, Homo sapiens
ugacagcuuucugggaugu

SEQ ID NO: 291343 - RNA, 19 nt, Homo sapiens
gcucugguggcuuaaguga

SEQ ID NO: 291344 - RNA, 19 nt, Homo sapiens
gcaugagcuucgucaaagg

SEQ ID NO: 291345 - RNA, 19 nt, Homo sapiens
cgcaugagcuucgucaaag

SEQ ID NO: 291346 - RNA, 19 nt, Homo sapiens
ccgcaugagcuucgucaaa

SEQ ID NO: 291347 - RNA, 19 nt, Homo sapiens
gaaugacgguaaguguucu

SEQ ID NO: 291348 - RNA, 19 nt, Homo sapiens
agagguggauguuaugaac

SEQ ID NO: 291349 - RNA, 19 nt, Homo sapiens
ccauuguugucaaggaaga

SEQ ID NO: 291350 - RNA, 19 nt, Homo sapiens
acaagguccucacccagau

SEQ ID NO: 291351 - RNA, 19 nt, Homo sapiens
cgcagaacgucaacaccaa

SEQ ID NO: 291352 - RNA, 19 nt, Homo sapiens
uagggcugcucuccaaugu

SEQ ID NO: 291353 - RNA, 19 nt, Homo sapiens
cuaccugagugaagaugga

SEQ ID NO: 291354 - RNA, 19 nt, Homo sapiens
gcgugcggcucuacuacau

SEQ ID NO: 291355 - RNA, 19 nt, Homo sapiens
cccagcacauaauaacuug

SEQ ID NO: 291356 - RNA, 19 nt, Homo sapiens
caguugcauucauuaaauc

SEQ ID NO: 291357 - RNA, 19 nt, Homo sapiens
gucaguugcauucauuaaa

SEQ ID NO: 291358 - RNA, 19 nt, Homo sapiens
ugguuuauguagucaguug

SEQ ID NO: 291359 - RNA, 19 nt, Homo sapiens
ggcuauauugguuuaugua

SEQ ID NO: 291360 - RNA, 19 nt, Homo sapiens
cggcuauauugguuuaugu

SEQ ID NO: 291361 - RNA, 19 nt, Homo sapiens
ugugugaguucgccuucaa

SEQ ID NO: 291362 - RNA, 19 nt, Homo sapiens
gagcgccaccucuuuaaaa

SEQ ID NO: 291363 - RNA, 19 nt, Homo sapiens
cgaugagcgccaccucuuu

SEQ ID NO: 291364 - RNA, 19 nt, Homo sapiens
gugagcagaacagguagua

SEQ ID NO: 291365 - RNA, 19 nt, Homo sapiens
guuaugaacagcugugucu

SEQ ID NO: 291366 - RNA, 19 nt, Homo sapiens
ggucaagaaacucaagaag

SEQ ID NO: 291367 - RNA, 19 nt, Homo sapiens
cagcacauaauaacuugga

SEQ ID NO: 291368 - RNA, 19 nt, Homo sapiens
aguucuaccuccuguguug

SEQ ID NO: 291369 - RNA, 19 nt, Homo sapiens
guguggaguucaccuugga

SEQ ID NO: 291370 - RNA, 19 nt, Homo sapiens
ugucaaggaagaagaaauc

SEQ ID NO: 291371 - RNA, 19 nt, Homo sapiens
uaaagaagcugaaggagaa

SEQ ID NO: 291372 - RNA, 19 nt, Homo sapiens
gaauugaucucucaggauu

SEQ ID NO: 291373 - RNA, 19 nt, Homo sapiens
gcacaagguugguugcuaa

SEQ ID NO: 291374 - RNA, 19 nt, Homo sapiens
gggcaagacugcaaacuuu

SEQ ID NO: 291375 - RNA, 19 nt, Homo sapiens
gauuaacacugcagaguaa

SEQ ID NO: 291376 - RNA, 19 nt, Homo sapiens
ggaaacugcuaaauucuau

SEQ ID NO: 291377 - RNA, 19 nt, Homo sapiens
gaaggacauucaauucaaa

SEQ ID NO: 291378 - RNA, 19 nt, Homo sapiens
ggacauuacuggccuguuc

SEQ ID NO: 291379 - RNA, 19 nt, Homo sapiens
gaaguaggacugcaccaua

SEQ ID NO: 291380 - RNA, 19 nt, Homo sapiens
gaacaaauggacaauaugu

SEQ ID NO: 291381 - RNA, 19 nt, Homo sapiens
gcaaagguggcaaugcuua

SEQ ID NO: 291382 - RNA, 19 nt, Homo sapiens
gcaaaggugugcaguugga

SEQ ID NO: 291383 - RNA, 19 nt, Homo sapiens
gcagacagaaacuggauua

SEQ ID NO: 291384 - RNA, 19 nt, Homo sapiens
cauaagaucuacccaagug

SEQ ID NO: 291385 - RNA, 19 nt, Homo sapiens
gaaggacuguugcagauag

SEQ ID NO: 291386 - RNA, 19 nt, Homo sapiens
gacacaauauguaugcuuu

SEQ ID NO: 291387 - RNA, 19 nt, Homo sapiens
gaaacaccuugcuggauug

SEQ ID NO: 291388 - RNA, 19 nt, Homo sapiens
agacagagcaucaaagaaa

SEQ ID NO: 291389 - RNA, 19 nt, Homo sapiens
guaguuguauucuucugua

SEQ ID NO: 291390 - RNA, 19 nt, Homo sapiens
agaaacaccuugcuggauu

SEQ ID NO: 291391 - RNA, 19 nt, Homo sapiens
gcagauguauugacuguac

SEQ ID NO: 291392 - RNA, 19 nt, Homo sapiens
gacagaaacuggauuaaaa

SEQ ID NO: 291393 - RNA, 19 nt, Homo sapiens
guacagaguuacuacuuag

SEQ ID NO: 291394 - RNA, 19 nt, Homo sapiens
caagguugguugcuaagaa

SEQ ID NO: 291395 - RNA, 19 nt, Homo sapiens
gagaugcuguucauaagau

SEQ ID NO: 291396 - RNA, 19 nt, Homo sapiens
cauaauagguaguuuggau

SEQ ID NO: 291397 - RNA, 19 nt, Homo sapiens
gaugacuguugaugaagua

SEQ ID NO: 291398 - RNA, 19 nt, Homo sapiens
gaagaugguuucaauucag

SEQ ID NO: 291399 - RNA, 19 nt, Homo sapiens
uaccagcacugccaacuuu

SEQ ID NO: 291400 - RNA, 19 nt, Homo sapiens
cagauugucuugcaacuuc

SEQ ID NO: 291401 - RNA, 19 nt, Homo sapiens
gcaauugaaaguuugguaa

SEQ ID NO: 291402 - RNA, 19 nt, Homo sapiens
gaguauugguguuccauug

SEQ ID NO: 291403 - RNA, 19 nt, Homo sapiens
ggugaaggaugaauaugug

SEQ ID NO: 291404 - RNA, 19 nt, Homo sapiens
gcagaguaaugcuccauca

SEQ ID NO: 291405 - RNA, 19 nt, Homo sapiens
ggauuaacacugcagagua

SEQ ID NO: 291406 - RNA, 19 nt, Homo sapiens
gaauccauaucacuacgaa

SEQ ID NO: 291407 - RNA, 19 nt, Homo sapiens
cgaauacaccaacaaguaa

SEQ ID NO: 291408 - RNA, 19 nt, Homo sapiens
gcagugacuuuguauagag

SEQ ID NO: 291409 - RNA, 19 nt, Homo sapiens
cuacccaagugcauauaua

SEQ ID NO: 291410 - RNA, 19 nt, Homo sapiens
caagucagccugccaguau

SEQ ID NO: 291411 - RNA, 19 nt, Homo sapiens
caaguaugauggugaagga

SEQ ID NO: 291412 - RNA, 19 nt, Homo sapiens
uggcaaugcuuaaacuaaa

SEQ ID NO: 291413 - RNA, 19 nt, Homo sapiens
guggaugacuguugaugaa

SEQ ID NO: 291414 - RNA, 19 nt, Homo sapiens
caagacagagcaucaaaga

SEQ ID NO: 291415 - RNA, 19 nt, Homo sapiens
ucagguggcuggucggaaa

SEQ ID NO: 291416 - RNA, 19 nt, Homo sapiens
ucaagcugcccuauuguua

SEQ ID NO: 291417 - RNA, 19 nt, Homo sapiens
ccacagacacaauauguau

SEQ ID NO: 291418 - RNA, 19 nt, Homo sapiens
ggaaacauuacaguucaua

SEQ ID NO: 291419 - RNA, 19 nt, Homo sapiens
caaaguuaauucaccuaug

SEQ ID NO: 291420 - RNA, 19 nt, Homo sapiens
cugaauacaugucuaacaa

SEQ ID NO: 291421 - RNA, 19 nt, Homo sapiens
uguacagaguuacuacuua

SEQ ID NO: 291422 - RNA, 19 nt, Homo sapiens
gauagugucugugugaauc

SEQ ID NO: 291423 - RNA, 19 nt, Homo sapiens
gcuugaagauuaggagaaa

SEQ ID NO: 291424 - RNA, 19 nt, Homo sapiens
gacagaagccauugagaga

SEQ ID NO: 291425 - RNA, 19 nt, Homo sapiens
ggagagagugaaacauuug

SEQ ID NO: 291426 - RNA, 19 nt, Homo sapiens
gaguaaugcuccaucaagu

SEQ ID NO: 291427 - RNA, 19 nt, Homo sapiens
ucaguaugcguuugacuua

SEQ ID NO: 291428 - RNA, 19 nt, Homo sapiens
acaccuugcuggauugaaa

SEQ ID NO: 291429 - RNA, 19 nt, Homo sapiens
gugaaggacuguugcagau

SEQ ID NO: 291430 - RNA, 19 nt, Homo sapiens
guaaugcuccaucaaguau

SEQ ID NO: 291431 - RNA, 19 nt, Homo sapiens
ccuucaagcugcccuauug

SEQ ID NO: 291432 - RNA, 19 nt, Homo sapiens
caccauacacaccuaauuu

SEQ ID NO: 291433 - RNA, 19 nt, Homo sapiens
gaucaaaauugcuucagaa

SEQ ID NO: 291434 - RNA, 19 nt, Homo sapiens
guaugauggugaaggauga

SEQ ID NO: 291435 - RNA, 19 nt, Homo sapiens
uggagagagugaaacauuu

SEQ ID NO: 291436 - RNA, 19 nt, Homo sapiens
ccagcuacuuaccaucaua

SEQ ID NO: 291437 - RNA, 19 nt, Homo sapiens
cgaguuguaucaccuggaa

SEQ ID NO: 291438 - RNA, 19 nt, Homo sapiens
aaauggagcucauccuagu

SEQ ID NO: 291439 - RNA, 19 nt, Homo sapiens
uuuggaaacugcuaaauuc

SEQ ID NO: 291440 - RNA, 19 nt, Homo sapiens
ccuaguggaugacuguuga

SEQ ID NO: 291441 - RNA, 19 nt, Homo sapiens
gagaaucccuuaaaauuac

SEQ ID NO: 291442 - RNA, 19 nt, Homo sapiens
ccaugugggugaguuaauu

SEQ ID NO: 291443 - RNA, 19 nt, Homo sapiens
uuacuggccuguucacaau

SEQ ID NO: 291444 - RNA, 19 nt, Homo sapiens
gagcucauccuaguaaaug

SEQ ID NO: 291445 - RNA, 19 nt, Homo sapiens
cccacaaccuuuagacuga

SEQ ID NO: 291446 - RNA, 19 nt, Homo sapiens
acgaauacaccaacaagua

SEQ ID NO: 291447 - RNA, 19 nt, Homo sapiens
gguguuccauugcuuacuu

SEQ ID NO: 291448 - RNA, 19 nt, Homo sapiens
uaauuugccucaccaccaa

SEQ ID NO: 291449 - RNA, 19 nt, Homo sapiens
gcaccauacacaccuaauu

SEQ ID NO: 291450 - RNA, 19 nt, Homo sapiens
gugcaucgacagagacaua

SEQ ID NO: 291451 - RNA, 19 nt, Homo sapiens
uagaaaaguugcagaugua

SEQ ID NO: 291452 - RNA, 19 nt, Homo sapiens
cagcgucacucuaccuaau

SEQ ID NO: 291453 - RNA, 19 nt, Homo sapiens
ggaugacuguugaugaagu

SEQ ID NO: 291454 - RNA, 19 nt, Homo sapiens
cagcagccguggcaggaaa

SEQ ID NO: 291455 - RNA, 19 nt, Homo sapiens
gggcagccauagugaagga

SEQ ID NO: 291456 - RNA, 19 nt, Homo sapiens
gcuaagaagccuauaagag

SEQ ID NO: 291457 - RNA, 19 nt, Homo sapiens
cuucaccuguuauguauga

SEQ ID NO: 291458 - RNA, 19 nt, Homo sapiens
cauaaaggguugaaaaugu

SEQ ID NO: 291459 - RNA, 19 nt, Homo sapiens
gugcauauauaaaggucuu

SEQ ID NO: 291460 - RNA, 19 nt, Homo sapiens
ggagaugcuguucauaaga

SEQ ID NO: 291461 - RNA, 19 nt, Homo sapiens
ccacaggacagaagccauu

SEQ ID NO: 291462 - RNA, 19 nt, Homo sapiens
guagaaaaguugcagaugu

SEQ ID NO: 291463 - RNA, 19 nt, Homo sapiens
guggagagagugaaacauu

SEQ ID NO: 291464 - RNA, 19 nt, Homo sapiens
ggcagugacuuuguauaga

SEQ ID NO: 291465 - RNA, 19 nt, Homo sapiens
ggcaaugcuuaaacuaaau

SEQ ID NO: 291466 - RNA, 19 nt, Homo sapiens
agacagaaacuggauuaaa

SEQ ID NO: 291467 - RNA, 19 nt, Homo sapiens
gacagcagcagaauggauu

SEQ ID NO: 291468 - RNA, 19 nt, Homo sapiens
gacauucaauucaaaccau

SEQ ID NO: 291469 - RNA, 19 nt, Homo sapiens
ucacuacgaacgaguugua

SEQ ID NO: 291470 - RNA, 19 nt, Homo sapiens
caaagguggcaaugcuuaa

SEQ ID NO: 291471 - RNA, 19 nt, Homo sapiens
ucacagauccuucaaauaa

SEQ ID NO: 291472 - RNA, 19 nt, Homo sapiens
agucuuaccuccaguauua

SEQ ID NO: 291473 - RNA, 19 nt, Homo sapiens
gaucagaugggucaagaua

SEQ ID NO: 291474 - RNA, 19 nt, Homo sapiens
cauauacagugaagaguaa

SEQ ID NO: 291475 - RNA, 19 nt, Homo sapiens
gaguaaaugugucacuauu

SEQ ID NO: 291476 - RNA, 19 nt, Homo sapiens
gauaaaguccuuacucaga

SEQ ID NO: 291477 - RNA, 19 nt, Homo sapiens
gaaaagguguucaucugua

SEQ ID NO: 291478 - RNA, 19 nt, Homo sapiens
ggaacaugcuuuuacuuua

SEQ ID NO: 291479 - RNA, 19 nt, Homo sapiens
caacuuucaucauggcuuu

SEQ ID NO: 291480 - RNA, 19 nt, Homo sapiens
guagauggauucacagauc

SEQ ID NO: 291481 - RNA, 19 nt, Homo sapiens
cuaaagccguuggauauuu

SEQ ID NO: 291482 - RNA, 19 nt, Homo sapiens
gaggagaaaugggcagaaa

SEQ ID NO: 291483 - RNA, 19 nt, Homo sapiens
gagcuaaagccguuggaua

SEQ ID NO: 291484 - RNA, 19 nt, Homo sapiens
gugauuaacucuuagaagu

SEQ ID NO: 291485 - RNA, 19 nt, Homo sapiens
gcauauacagugaagagua

SEQ ID NO: 291486 - RNA, 19 nt, Homo sapiens
guucagaaauuuggcauug

SEQ ID NO: 291487 - RNA, 19 nt, Homo sapiens
guuaguagauggauucaca

SEQ ID NO: 291488 - RNA, 19 nt, Homo sapiens
ucagaugggucaagauaau

SEQ ID NO: 291489 - RNA, 19 nt, Homo sapiens
gaaccacacaugccacaaa

SEQ ID NO: 291490 - RNA, 19 nt, Homo sapiens
uaaagccguuggauauuug

SEQ ID NO: 291491 - RNA, 19 nt, Homo sapiens
gaaacuuugaguacagaua

SEQ ID NO: 291492 - RNA, 19 nt, Homo sapiens
gauggacgccugcagguuu

SEQ ID NO: 291493 - RNA, 19 nt, Homo sapiens
gauuaacucuuagaagugu

SEQ ID NO: 291494 - RNA, 19 nt, Homo sapiens
acugugagcuuacauugaa

SEQ ID NO: 291495 - RNA, 19 nt, Homo sapiens
gagaaacuuugaguacaga

SEQ ID NO: 291496 - RNA, 19 nt, Homo sapiens
guucaucuguacuauguug

SEQ ID NO: 291497 - RNA, 19 nt, Homo sapiens
cagauuaugcccaguauau

SEQ ID NO: 291498 - RNA, 19 nt, Homo sapiens
caacacuccuuuucccuua

SEQ ID NO: 291499 - RNA, 19 nt, Homo sapiens
uguaaaagaugcagaguaa

SEQ ID NO: 291500 - RNA, 19 nt, Homo sapiens
cauguuggauugagauuca

SEQ ID NO: 291501 - RNA, 19 nt, Homo sapiens
cagcauauuuguacagagu

SEQ ID NO: 291502 - RNA, 19 nt, Homo sapiens
ccacugacuuugaguuaca

SEQ ID NO: 291503 - RNA, 19 nt, Homo sapiens
uccagaagcuguacuuuua

SEQ ID NO: 291504 - RNA, 19 nt, Homo sapiens
uauaugagcucaccaaaau

SEQ ID NO: 291505 - RNA, 19 nt, Homo sapiens
gaaccugagccacaaugaa

SEQ ID NO: 291506 - RNA, 19 nt, Homo sapiens
gcuuaggaccuguguauga

SEQ ID NO: 291507 - RNA, 19 nt, Homo sapiens
gaaauuuggcauugaucuu

SEQ ID NO: 291508 - RNA, 19 nt, Homo sapiens
ucagaaauuuggcauugau

SEQ ID NO: 291509 - RNA, 19 nt, Homo sapiens
gaacugcaacuuucaucau

SEQ ID NO: 291510 - RNA, 19 nt, Homo sapiens
gaguaggaacugcaacuuu

SEQ ID NO: 291511 - RNA, 19 nt, Homo sapiens
guaaaugugucacuauucc

SEQ ID NO: 291512 - RNA, 19 nt, Homo sapiens
uuucaugcaucuucuacua

SEQ ID NO: 291513 - RNA, 19 nt, Homo sapiens
uaauuggaacuucugcuua

SEQ ID NO: 291514 - RNA, 19 nt, Homo sapiens
agaugcagaguaaguauua

SEQ ID NO: 291515 - RNA, 19 nt, Homo sapiens
ugugaugaaucuacauuug

SEQ ID NO: 291516 - RNA, 19 nt, Homo sapiens
uggauaaaguccuuacuca

SEQ ID NO: 291517 - RNA, 19 nt, Homo sapiens
ccucuucaguggcuggaua

SEQ ID NO: 291518 - RNA, 19 nt, Homo sapiens
augaagagccuaaacauug

SEQ ID NO: 291519 - RNA, 19 nt, Homo sapiens
aaauguuacuccucccuuu

SEQ ID NO: 291520 - RNA, 19 nt, Homo sapiens
gcacuugugaagauaaaug

SEQ ID NO: 291521 - RNA, 19 nt, Homo sapiens
gaucuuaaacuggaacaug

SEQ ID NO: 291522 - RNA, 19 nt, Homo sapiens
ccauaucuucuguuucaua

SEQ ID NO: 291523 - RNA, 19 nt, Homo sapiens
uaaaguccuuacucagaug

SEQ ID NO: 291524 - RNA, 19 nt, Homo sapiens
ggaccuguguaugacguuu

SEQ ID NO: 291525 - RNA, 19 nt, Homo sapiens
ugacagcagcauauuugua

SEQ ID NO: 291526 - RNA, 19 nt, Homo sapiens
guguucaucuguacuaugu

SEQ ID NO: 291527 - RNA, 19 nt, Homo sapiens
gucaauggccagcuuguuu

SEQ ID NO: 291528 - RNA, 19 nt, Homo sapiens
gcauauggcacuugugaag

SEQ ID NO: 291529 - RNA, 19 nt, Homo sapiens
ugaagagccuaaacauugg

SEQ ID NO: 291530 - RNA, 19 nt, Homo sapiens
guauuagugccucgucaua

SEQ ID NO: 291531 - RNA, 19 nt, Homo sapiens
gguuugaggcaguauauga

SEQ ID NO: 291532 - RNA, 19 nt, Homo sapiens
aguaggaacugcaacuuuc

SEQ ID NO: 291533 - RNA, 19 nt, Homo sapiens
gcauauuuguacagaguag

SEQ ID NO: 291534 - RNA, 19 nt, Homo sapiens
ccacguuuccagauucuuu

SEQ ID NO: 291535 - RNA, 19 nt, Homo sapiens
acagauccuucaaauaaca

SEQ ID NO: 291536 - RNA, 19 nt, Homo sapiens
ccgaguaaaugugucacua

SEQ ID NO: 291537 - RNA, 19 nt, Homo sapiens
ggacagccgaguaaaugug

SEQ ID NO: 291538 - RNA, 19 nt, Homo sapiens
uagagaaacuuugaguaca

SEQ ID NO: 291539 - RNA, 19 nt, Homo sapiens
ggaguuugcucagcuucug

SEQ ID NO: 291540 - RNA, 19 nt, Homo sapiens
gaaaacacuaggcgacaua

SEQ ID NO: 291541 - RNA, 19 nt, Homo sapiens
ggauacaagcaauaauaug

SEQ ID NO: 291542 - RNA, 19 nt, Homo sapiens
gagacuugacccaaugaaa

SEQ ID NO: 291543 - RNA, 19 nt, Homo sapiens
ugacgucaauggccagcuu

SEQ ID NO: 291544 - RNA, 19 nt, Homo sapiens
uaucaacccauaccacuau

SEQ ID NO: 291545 - RNA, 19 nt, Homo sapiens
gcuaaagccguuggauauu

SEQ ID NO: 291546 - RNA, 19 nt, Homo sapiens
gugaugaggaggagaaaug

SEQ ID NO: 291547 - RNA, 19 nt, Homo sapiens
auaaaguccuuacucagau

SEQ ID NO: 291548 - RNA, 19 nt, Homo sapiens
guaccauucggaugaguuu

SEQ ID NO: 291549 - RNA, 19 nt, Homo sapiens
ggccggauuugcagaguca

SEQ ID NO: 291550 - RNA, 19 nt, Homo sapiens
gacagcagcauauuuguac

SEQ ID NO: 291551 - RNA, 19 nt, Homo sapiens
auucacagauccuucaaau

SEQ ID NO: 291552 - RNA, 19 nt, Homo sapiens
gauaauucccagccuaugg

SEQ ID NO: 291553 - RNA, 19 nt, Homo sapiens
agaagcauauggcacuugu

SEQ ID NO: 291554 - RNA, 19 nt, Homo sapiens
caggacagccgaguaaaug

SEQ ID NO: 291555 - RNA, 19 nt, Homo sapiens
gacuugacccaaugaaaga

SEQ ID NO: 291556 - RNA, 19 nt, Homo sapiens
caccugugaucuguucuuu

SEQ ID NO: 291557 - RNA, 19 nt, Homo sapiens
uggcauugaucuuaaacug

SEQ ID NO: 291558 - RNA, 19 nt, Homo sapiens
gauacugugagcuuacauu

SEQ ID NO: 291559 - RNA, 19 nt, Homo sapiens
aagcauauggcacuuguga

SEQ ID NO: 291560 - RNA, 19 nt, Homo sapiens
ggaacugcaacuuucauca

SEQ ID NO: 291561 - RNA, 19 nt, Homo sapiens
uaugaagagccuaaacauu

SEQ ID NO: 291562 - RNA, 19 nt, Homo sapiens
aaguuuguaucaacccaua

SEQ ID NO: 291563 - RNA, 19 nt, Homo sapiens
guuuggcgcuggccggauu

SEQ ID NO: 291564 - RNA, 19 nt, Homo sapiens
gaaaaggcuuaccccaugu

SEQ ID NO: 291565 - RNA, 19 nt, Homo sapiens
aagagggcauauacaguga

SEQ ID NO: 291566 - RNA, 19 nt, Homo sapiens
ucauaaugcagaaguauuc

SEQ ID NO: 291567 - RNA, 19 nt, Homo sapiens
ggagagguguaugcggaau

SEQ ID NO: 291568 - RNA, 19 nt, Homo sapiens
gguagccacugacuuugag

SEQ ID NO: 291569 - RNA, 19 nt, Homo sapiens
ucacuauucccagaucuuu

SEQ ID NO: 291570 - RNA, 19 nt, Homo sapiens
gagggcauauacagugaag

SEQ ID NO: 291571 - RNA, 19 nt, Homo sapiens
caaaggauauuguauguuc

SEQ ID NO: 291572 - RNA, 19 nt, Homo sapiens
cagcagcucuuugggauuu

SEQ ID NO: 291573 - RNA, 19 nt, Homo sapiens
gcacuuuggcuuauaauuc

SEQ ID NO: 291574 - RNA, 19 nt, Homo sapiens
gccaaaggauauuguaugu

SEQ ID NO: 291575 - RNA, 19 nt, Homo sapiens
cagcagagcuagguggaaa

SEQ ID NO: 291576 - RNA, 19 nt, Homo sapiens
uaauaccagucacucgaua

SEQ ID NO: 291577 - RNA, 19 nt, Homo sapiens
gaaaagcccauguaguuaa

SEQ ID NO: 291578 - RNA, 19 nt, Homo sapiens
accagucacucgauaauaa

SEQ ID NO: 291579 - RNA, 19 nt, Homo sapiens
ggaccagccgcacaacuuu

SEQ ID NO: 291580 - RNA, 19 nt, Homo sapiens
gcuaccaacucccucauca

SEQ ID NO: 291581 - RNA, 19 nt, Homo sapiens
gagaaacucgcuccaagug

SEQ ID NO: 291582 - RNA, 19 nt, Homo sapiens
gggaaaagcccauguaguu

SEQ ID NO: 291583 - RNA, 19 nt, Homo sapiens
gucacucgauaauaaagua

SEQ ID NO: 291584 - RNA, 19 nt, Homo sapiens
gacgcacuuuggcuuauaa

SEQ ID NO: 291585 - RNA, 19 nt, Homo sapiens
cacauugucuuacacugaa

SEQ ID NO: 291586 - RNA, 19 nt, Homo sapiens
guaguuaagcgcuuugguu

SEQ ID NO: 291587 - RNA, 19 nt, Homo sapiens
ccacauugucuuacacuga

SEQ ID NO: 291588 - RNA, 19 nt, Homo sapiens
ggaaaagcccauguaguua

SEQ ID NO: 291589 - RNA, 19 nt, Homo sapiens
gagcugagccgagagaaag

SEQ ID NO: 291590 - RNA, 19 nt, Homo sapiens
ccaucaagguguucgacuu

SEQ ID NO: 291591 - RNA, 19 nt, Homo sapiens
gcagggcuuuccagacaca

SEQ ID NO: 291592 - RNA, 19 nt, Homo sapiens
agacgcacuuuggcuuaua

SEQ ID NO: 291593 - RNA, 19 nt, Homo sapiens
aggcagggcuuuccagaca

SEQ ID NO: 291594 - RNA, 19 nt, Homo sapiens
ggauuuagguuuuguuugg

SEQ ID NO: 291595 - RNA, 19 nt, Homo sapiens
gggcuuuccagacacauuu

SEQ ID NO: 291596 - RNA, 19 nt, Homo sapiens
uaguuaagcgcuuugguuu

SEQ ID NO: 291597 - RNA, 19 nt, Homo sapiens
gcuacuccaucaagguguu

SEQ ID NO: 291598 - RNA, 19 nt, Homo sapiens
ccgauuccacauugucuua

SEQ ID NO: 291599 - RNA, 19 nt, Homo sapiens
cacuggaucuguccgauuc

SEQ ID NO: 291600 - RNA, 19 nt, Homo sapiens
gauauuaaugcccagacaa

SEQ ID NO: 291601 - RNA, 19 nt, Homo sapiens
ggagcugagccgagagaaa

SEQ ID NO: 291602 - RNA, 19 nt, Homo sapiens
cacuuuggcuuauaauucu

SEQ ID NO: 291603 - RNA, 19 nt, Homo sapiens
aaacggaggcuaccaacuc

SEQ ID NO: 291604 - RNA, 19 nt, Homo sapiens
ggugaccugcugucucuuu

SEQ ID NO: 291605 - RNA, 19 nt, Homo sapiens
ccauguaguuaagcgcuuu

SEQ ID NO: 291606 - RNA, 19 nt, Homo sapiens
ggugcaauguguguauaug

SEQ ID NO: 291607 - RNA, 19 nt, Homo sapiens
ccagucacucgauaauaaa

SEQ ID NO: 291608 - RNA, 19 nt, Homo sapiens
uauguauggugcaaugugu

SEQ ID NO: 291609 - RNA, 19 nt, Homo sapiens
uggguuugguguaugguuu

SEQ ID NO: 291610 - RNA, 19 nt, Homo sapiens
aaacaagaaagacgcacuu

SEQ ID NO: 291611 - RNA, 19 nt, Homo sapiens
cagcaucuucuacgaccua

SEQ ID NO: 291612 - RNA, 19 nt, Homo sapiens
gauuccacauugucuuaca

SEQ ID NO: 291613 - RNA, 19 nt, Homo sapiens
uaucaacaagccugccuuu

SEQ ID NO: 291614 - RNA, 19 nt, Homo sapiens
ugcaauguguguauaugga

SEQ ID NO: 291615 - RNA, 19 nt, Homo sapiens
ucuguccgauuccacauug

SEQ ID NO: 291616 - RNA, 19 nt, Homo sapiens
ggccuuucgugcaugcaaa

SEQ ID NO: 291617 - RNA, 19 nt, Homo sapiens
ucaacaagccugccuuucg

SEQ ID NO: 291618 - RNA, 19 nt, Homo sapiens
caucaagguguucgacuuc

SEQ ID NO: 291619 - RNA, 19 nt, Homo sapiens
ggaaaagccuggguuuggu

SEQ ID NO: 291620 - RNA, 19 nt, Homo sapiens
ccacuggaucuguccgauu

SEQ ID NO: 291621 - RNA, 19 nt, Homo sapiens
gcguuggccuuucgugcau

SEQ ID NO: 291622 - RNA, 19 nt, Homo sapiens
cgccaaaggauauuguaug

SEQ ID NO: 291623 - RNA, 19 nt, Homo sapiens
gaccaggccgucagcaucu

SEQ ID NO: 291624 - RNA, 19 nt, Homo sapiens
ucacguacucgcugcugaa

SEQ ID NO: 291625 - RNA, 19 nt, Homo sapiens
gcuggagcaggaacucaaa

SEQ ID NO: 291626 - RNA, 19 nt, Homo sapiens
gcgccaaaggauauuguau

SEQ ID NO: 291627 - RNA, 19 nt, Homo sapiens
uaagcgcuuugguuuaaaa

SEQ ID NO: 291628 - RNA, 19 nt, Homo sapiens
uaccagucacucgauaaua

SEQ ID NO: 291629 - RNA, 19 nt, Homo sapiens
auauuaaugcccagacaaa

SEQ ID NO: 291630 - RNA, 19 nt, Homo sapiens
aagccuggguuugguguau

SEQ ID NO: 291631 - RNA, 19 nt, Homo sapiens
gagacggcguuggccuuuc

SEQ ID NO: 291632 - RNA, 19 nt, Homo sapiens
ccaaaggauauuguauguu

SEQ ID NO: 291633 - RNA, 19 nt, Homo sapiens
gaaacggaggcuaccaacu

SEQ ID NO: 291634 - RNA, 19 nt, Homo sapiens
guacaagccacuggaucug

SEQ ID NO: 291635 - RNA, 19 nt, Homo sapiens
acggugaccugcugucucu

SEQ ID NO: 291636 - RNA, 19 nt, Homo sapiens
cagcuuccacucauguguu

SEQ ID NO: 291637 - RNA, 19 nt, Homo sapiens
gaaccagaaccaauuauuu

SEQ ID NO: 291638 - RNA, 19 nt, Homo sapiens
guguuaagcucugcuauua

SEQ ID NO: 291639 - RNA, 19 nt, Homo sapiens
gcaaauaacaaaugccaaa

SEQ ID NO: 291640 - RNA, 19 nt, Homo sapiens
gagcauguuuagacuuuaa

SEQ ID NO: 291641 - RNA, 19 nt, Homo sapiens
ccagauacccgauggauuu

SEQ ID NO: 291642 - RNA, 19 nt, Homo sapiens
gaagcauucucauuggaaa

SEQ ID NO: 291643 - RNA, 19 nt, Homo sapiens
cuacuuugcugcuaauauu

SEQ ID NO: 291644 - RNA, 19 nt, Homo sapiens
gaugcacuuugcuuuaaua

SEQ ID NO: 291645 - RNA, 19 nt, Homo sapiens
caucaaggcuuucgacuac

SEQ ID NO: 291646 - RNA, 19 nt, Homo sapiens
caggagcccucucuggaua

SEQ ID NO: 291647 - RNA, 19 nt, Homo sapiens
caaaccaacugcagacugu

SEQ ID NO: 291648 - RNA, 19 nt, Homo sapiens
acaccuaacucuucuuuca

SEQ ID NO: 291649 - RNA, 19 nt, Homo sapiens
gcucccauccuguguguua

SEQ ID NO: 291650 - RNA, 19 nt, Homo sapiens
gagcaggccacacuucaaa

SEQ ID NO: 291651 - RNA, 19 nt, Homo sapiens
cauuggaaauuuagcauug

SEQ ID NO: 291652 - RNA, 19 nt, Homo sapiens
ccaaugaccacgaguuuau

SEQ ID NO: 291653 - RNA, 19 nt, Homo sapiens
agagucagcuggugcagaa

SEQ ID NO: 291654 - RNA, 19 nt, Homo sapiens
aagaugcacuuugcuuuaa

SEQ ID NO: 291655 - RNA, 19 nt, Homo sapiens
ggagacaacgugcucuuug

SEQ ID NO: 291656 - RNA, 19 nt, Homo sapiens
ucaccuagcugaauguuuu

SEQ ID NO: 291657 - RNA, 19 nt, Homo sapiens
gugcagaucagcuuuguga

SEQ ID NO: 291658 - RNA, 19 nt, Homo sapiens
cauuguagcgucuuucuuu

SEQ ID NO: 291659 - RNA, 19 nt, Homo sapiens
gcuaguggccgaaccagaa

SEQ ID NO: 291660 - RNA, 19 nt, Homo sapiens
gaaauuuagcauuguagug

SEQ ID NO: 291661 - RNA, 19 nt, Homo sapiens
guuaagcucugcuauuagg

SEQ ID NO: 291662 - RNA, 19 nt, Homo sapiens
ccaggacgcuguugguaca

SEQ ID NO: 291663 - RNA, 19 nt, Homo sapiens
cuggauaucuucuaugauc

SEQ ID NO: 291664 - RNA, 19 nt, Homo sapiens
aggaguuuauguuccauua

SEQ ID NO: 291665 - RNA, 19 nt, Homo sapiens
guuaucaccuagcugaaug

SEQ ID NO: 291666 - RNA, 19 nt, Homo sapiens
gcuuucagauucccaacuu

SEQ ID NO: 291667 - RNA, 19 nt, Homo sapiens
gcauuguagugcuuugaga

SEQ ID NO: 291668 - RNA, 19 nt, Homo sapiens
gcauucucauuggaaauuu

SEQ ID NO: 291669 - RNA, 19 nt, Homo sapiens
ggcuagaggucaucuucaa

SEQ ID NO: 291670 - RNA, 19 nt, Homo sapiens
ggauaucuucuaugaucua

SEQ ID NO: 291671 - RNA, 19 nt, Homo sapiens
uaugauacuucgacacugu

SEQ ID NO: 291672 - RNA, 19 nt, Homo sapiens
ccucguuuguguucuguuu

SEQ ID NO: 291673 - RNA, 19 nt, Homo sapiens
gcagaucagcuuugugaag

SEQ ID NO: 291674 - RNA, 19 nt, Homo sapiens
gcaauguguauaaacaaga

SEQ ID NO: 291675 - RNA, 19 nt, Homo sapiens
uaaaugaacaagagaagca

SEQ ID NO: 291676 - RNA, 19 nt, Homo sapiens
ggucaucauuucacuuguc

SEQ ID NO: 291677 - RNA, 19 nt, Homo sapiens
ggccggaucucaggcauuc

SEQ ID NO: 291678 - RNA, 19 nt, Homo sapiens
ucaaugagcauguuuagac

SEQ ID NO: 291679 - RNA, 19 nt, Homo sapiens
aaacuacuuugcugcuaau

SEQ ID NO: 291680 - RNA, 19 nt, Homo sapiens
ggacgcuguugguacacaa

SEQ ID NO: 291681 - RNA, 19 nt, Homo sapiens
ggccgaaccagaaccaauu

SEQ ID NO: 291682 - RNA, 19 nt, Homo sapiens
gcccaaugaccacgaguuu

SEQ ID NO: 291683 - RNA, 19 nt, Homo sapiens
ugacaccuaacucuucuuu

SEQ ID NO: 291684 - RNA, 19 nt, Homo sapiens
cgaaccagaaccaauuauu

SEQ ID NO: 291685 - RNA, 19 nt, Homo sapiens
ggaguuuauguuccauuaa

SEQ ID NO: 291686 - RNA, 19 nt, Homo sapiens
ccuaacucuucuuucauuu

SEQ ID NO: 291687 - RNA, 19 nt, Homo sapiens
augagcauguuuagacuuu

SEQ ID NO: 291688 - RNA, 19 nt, Homo sapiens
gccgaaccagaaccaauua

SEQ ID NO: 291689 - RNA, 19 nt, Homo sapiens
gaaauccaagcaccaccaa

SEQ ID NO: 291690 - RNA, 19 nt, Homo sapiens
gaagucaagaggcuguguu

SEQ ID NO: 291691 - RNA, 19 nt, Homo sapiens
gcugacaccuaacucuucu

SEQ ID NO: 291692 - RNA, 19 nt, Homo sapiens
gcggucaucauuucacuug

SEQ ID NO: 291693 - RNA, 19 nt, Homo sapiens
gagcugagcaggccacacu

SEQ ID NO: 291694 - RNA, 19 nt, Homo sapiens
ggugcgaggugccaaaggu

SEQ ID NO: 291695 - RNA, 19 nt, Homo sapiens
uuucauccuugucuuauuc

SEQ ID NO: 291696 - RNA, 19 nt, Homo sapiens
gaggcuguguugcugugaa

SEQ ID NO: 291697 - RNA, 19 nt, Homo sapiens
ggaagcagaaauccaagca

SEQ ID NO: 291698 - RNA, 19 nt, Homo sapiens
ccacacuucaaacuacuuu

SEQ ID NO: 291699 - RNA, 19 nt, Homo sapiens
ucaaggcuuucgacuacga

SEQ ID NO: 291700 - RNA, 19 nt, Homo sapiens
guagugcuuugagagagaa

SEQ ID NO: 291701 - RNA, 19 nt, Homo sapiens
caaugagcauguuuagacu

SEQ ID NO: 291702 - RNA, 19 nt, Homo sapiens
ggaaauuuagcauuguagu

SEQ ID NO: 291703 - RNA, 19 nt, Homo sapiens
ccuccugagugcuugcuuu

SEQ ID NO: 291704 - RNA, 19 nt, Homo sapiens
ccaucaaggcuuucgacua

SEQ ID NO: 291705 - RNA, 19 nt, Homo sapiens
ugagcauguuuagacuuua

SEQ ID NO: 291706 - RNA, 19 nt, Homo sapiens
accuaacucuucuuucauu

SEQ ID NO: 291707 - RNA, 19 nt, Homo sapiens
ugugcaauguguauaaaca

SEQ ID NO: 291708 - RNA, 19 nt, Homo sapiens
acacuguucuuagcucaau

SEQ ID NO: 291709 - RNA, 19 nt, Homo sapiens
gggagacaacgugcucuuu

SEQ ID NO: 291710 - RNA, 19 nt, Homo sapiens
ggagugugugugaguguga

SEQ ID NO: 291711 - RNA, 19 nt, Homo sapiens
uuguuucgcucuuugagaa

SEQ ID NO: 291712 - RNA, 19 nt, Homo sapiens
gaggucauguucgcuccuu

SEQ ID NO: 291713 - RNA, 19 nt, Homo sapiens
cucuggauaucuucuauga

SEQ ID NO: 291714 - RNA, 19 nt, Homo sapiens
ugccaaaggucaccaccau

SEQ ID NO: 291715 - RNA, 19 nt, Homo sapiens
gucaucauuucacuuguca

SEQ ID NO: 291716 - RNA, 19 nt, Homo sapiens
ccaagcaccaccaaacaca

SEQ ID NO: 291717 - RNA, 19 nt, Homo sapiens
gaagaaggggcagguauga

SEQ ID NO: 291718 - RNA, 19 nt, Homo sapiens
gggaggagaagacgagagu

SEQ ID NO: 291719 - RNA, 19 nt, Homo sapiens
uguagugcuuugagagaga

SEQ ID NO: 291720 - RNA, 19 nt, Homo sapiens
aacccaagguaccauccua

SEQ ID NO: 291721 - RNA, 19 nt, Homo sapiens
ggagcccucucuggauauc

SEQ ID NO: 291722 - RNA, 19 nt, Homo sapiens
aagauaaacacaagauugg

SEQ ID NO: 291723 - RNA, 19 nt, Homo sapiens
acucuucuuucauuucuuc

SEQ ID NO: 291724 - RNA, 19 nt, Homo sapiens
aggauuugguccgucauaa

SEQ ID NO: 291725 - RNA, 19 nt, Homo sapiens
gugcuacacccgccaguuc

SEQ ID NO: 291726 - RNA, 19 nt, Homo sapiens
uguacaaccgcagcaguua

SEQ ID NO: 291727 - RNA, 19 nt, Homo sapiens
gcagaaggugcggagcaaa

SEQ ID NO: 291728 - RNA, 19 nt, Homo sapiens
gauaucuucuaugaucuac

SEQ ID NO: 291729 - RNA, 19 nt, Homo sapiens
ccugggagggacaugcuua

SEQ ID NO: 291730 - RNA, 19 nt, Homo sapiens
guuucuccaucaaggcuuu

SEQ ID NO: 291731 - RNA, 19 nt, Homo sapiens
gccaucugcuccuggaucu

SEQ ID NO: 291732 - RNA, 19 nt, Homo sapiens
cuagaggucaucuucaaca

SEQ ID NO: 291733 - RNA, 19 nt, Homo sapiens
ucaauucggacaacaagag

SEQ ID NO: 291734 - RNA, 19 nt, Homo sapiens
gcucaauucggacaacaag

SEQ ID NO: 291735 - RNA, 19 nt, Homo sapiens
uacaacucauacacucgua

SEQ ID NO: 291736 - RNA, 19 nt, Homo sapiens
ggcaguaccugggcaagcu

SEQ ID NO: 291737 - RNA, 19 nt, Homo sapiens
gcaaggagaugaagaggaa

SEQ ID NO: 291738 - RNA, 19 nt, Homo sapiens
gaaagggugugcacuugua

SEQ ID NO: 291739 - RNA, 19 nt, Homo sapiens
gcaaauaucacucagauga

SEQ ID NO: 291740 - RNA, 19 nt, Homo sapiens
ggacuucuuucuaauguaa

SEQ ID NO: 291741 - RNA, 19 nt, Homo sapiens
cagaugggcucuccacaua

SEQ ID NO: 291742 - RNA, 19 nt, Homo sapiens
gggaguggcuuguaucauu

SEQ ID NO: 291743 - RNA, 19 nt, Homo sapiens
gcaguggacucucuaguga

SEQ ID NO: 291744 - RNA, 19 nt, Homo sapiens
gaaaauaccaggagacaua

SEQ ID NO: 291745 - RNA, 19 nt, Homo sapiens
ggaguggcuuguaucauuu

SEQ ID NO: 291746 - RNA, 19 nt, Homo sapiens
aaacagaaacucaacgaua

SEQ ID NO: 291747 - RNA, 19 nt, Homo sapiens
gugaagaaguuaaagaaga

SEQ ID NO: 291748 - RNA, 19 nt, Homo sapiens
gaaggguguuagcagaaua

SEQ ID NO: 291749 - RNA, 19 nt, Homo sapiens
gaacugaccaagaugugua

SEQ ID NO: 291750 - RNA, 19 nt, Homo sapiens
agaaagaagugugcauuaa

SEQ ID NO: 291751 - RNA, 19 nt, Homo sapiens
caagacacagugaauauaa

SEQ ID NO: 291752 - RNA, 19 nt, Homo sapiens
ucaccgacccuucaaauaa

SEQ ID NO: 291753 - RNA, 19 nt, Homo sapiens
gcuuugaagucguguauga

SEQ ID NO: 291754 - RNA, 19 nt, Homo sapiens
caaauaacaggaacagauu

SEQ ID NO: 291755 - RNA, 19 nt, Homo sapiens
gcauuaacccuuaccacua

SEQ ID NO: 291756 - RNA, 19 nt, Homo sapiens
ccaccuauccugacucuuu

SEQ ID NO: 291757 - RNA, 19 nt, Homo sapiens
cagaaagaagugugcauua

SEQ ID NO: 291758 - RNA, 19 nt, Homo sapiens
cagcaaaagucagguauua

SEQ ID NO: 291759 - RNA, 19 nt, Homo sapiens
cauagaauguauacuguuc

SEQ ID NO: 291760 - RNA, 19 nt, Homo sapiens
gcagugaaacccuacaguu

SEQ ID NO: 291761 - RNA, 19 nt, Homo sapiens
ucacucagaugaaacaaag

SEQ ID NO: 291762 - RNA, 19 nt, Homo sapiens
ucuuaacagucaugucuua

SEQ ID NO: 291763 - RNA, 19 nt, Homo sapiens
uguaugaacugaccaagau

SEQ ID NO: 291764 - RNA, 19 nt, Homo sapiens
ugaccaagauguguacuau

SEQ ID NO: 291765 - RNA, 19 nt, Homo sapiens
agucagccgugucauuaua

SEQ ID NO: 291766 - RNA, 19 nt, Homo sapiens
gcagaaagaagugugcauu

SEQ ID NO: 291767 - RNA, 19 nt, Homo sapiens
aagcaaauaucacucagau

SEQ ID NO: 291768 - RNA, 19 nt, Homo sapiens
uagcagcacuaaagcaaau

SEQ ID NO: 291769 - RNA, 19 nt, Homo sapiens
gcgauauugucaacaguau

SEQ ID NO: 291770 - RNA, 19 nt, Homo sapiens
gaaagaagugugcauuaac

SEQ ID NO: 291771 - RNA, 19 nt, Homo sapiens
gcaaaugcgucacgauucc

SEQ ID NO: 291772 - RNA, 19 nt, Homo sapiens
ucaaauaacaggaacagau

SEQ ID NO: 291773 - RNA, 19 nt, Homo sapiens
guacuauccggaugaguuu

SEQ ID NO: 291774 - RNA, 19 nt, Homo sapiens
gaagucguguaugaacuga

SEQ ID NO: 291775 - RNA, 19 nt, Homo sapiens
aacagaaacucaacgauag

SEQ ID NO: 291776 - RNA, 19 nt, Homo sapiens
ccaagacacagugaauaua

SEQ ID NO: 291777 - RNA, 19 nt, Homo sapiens
gucuuggacuucuuucuaa

SEQ ID NO: 291778 - RNA, 19 nt, Homo sapiens
ggugcucggucgccuacua

SEQ ID NO: 291779 - RNA, 19 nt, Homo sapiens
cagcaaaugcgucacgauu

SEQ ID NO: 291780 - RNA, 19 nt, Homo sapiens
uuagucagccgugucauua

SEQ ID NO: 291781 - RNA, 19 nt, Homo sapiens
gccaagacacagugaauau

SEQ ID NO: 291782 - RNA, 19 nt, Homo sapiens
gagaggcgauauugucaac

SEQ ID NO: 291783 - RNA, 19 nt, Homo sapiens
gcuauaagcagcagauuuu

SEQ ID NO: 291784 - RNA, 19 nt, Homo sapiens
gcuuguaucauuucagauu

SEQ ID NO: 291785 - RNA, 19 nt, Homo sapiens
gaugggcucuccacauaac

SEQ ID NO: 291786 - RNA, 19 nt, Homo sapiens
uaucaacacucagacuuuc

SEQ ID NO: 291787 - RNA, 19 nt, Homo sapiens
gagagucccuaucaacacu

SEQ ID NO: 291788 - RNA, 19 nt, Homo sapiens
caaauaucacucagaugaa

SEQ ID NO: 291789 - RNA, 19 nt, Homo sapiens
gaagcaaggagaugaagag

SEQ ID NO: 291790 - RNA, 19 nt, Homo sapiens
ccaguacagugcaauugga

SEQ ID NO: 291791 - RNA, 19 nt, Homo sapiens
uaacagucaugucuuaagc

SEQ ID NO: 291792 - RNA, 19 nt, Homo sapiens
gcugugaguucccauuugg

SEQ ID NO: 291793 - RNA, 19 nt, Homo sapiens
cauuaacccuuaccacuac

SEQ ID NO: 291794 - RNA, 19 nt, Homo sapiens
gaacugcaacuaucaacac

SEQ ID NO: 291795 - RNA, 19 nt, Homo sapiens
ggaaagggugugcacuugu

SEQ ID NO: 291796 - RNA, 19 nt, Homo sapiens
caggagacauauaggaaag

SEQ ID NO: 291797 - RNA, 19 nt, Homo sapiens
guaaacagaaacucaacga

SEQ ID NO: 291798 - RNA, 19 nt, Homo sapiens
aagugugcauuaacccuua

SEQ ID NO: 291799 - RNA, 19 nt, Homo sapiens
uggcuuguaucauuucaga

SEQ ID NO: 291800 - RNA, 19 nt, Homo sapiens
gaaggcaguggacucucua

SEQ ID NO: 291801 - RNA, 19 nt, Homo sapiens
cgaagugugcucauagaug

SEQ ID NO: 291802 - RNA, 19 nt, Homo sapiens
gaggcgauauugucaacag

SEQ ID NO: 291803 - RNA, 19 nt, Homo sapiens
gaaacucaacgauagaaaa

SEQ ID NO: 291804 - RNA, 19 nt, Homo sapiens
guuuugugcuuucuaguua

SEQ ID NO: 291805 - RNA, 19 nt, Homo sapiens
ccaggagacauauaggaaa

SEQ ID NO: 291806 - RNA, 19 nt, Homo sapiens
ggaagcaaggagaugaaga

SEQ ID NO: 291807 - RNA, 19 nt, Homo sapiens
gcuccaagcagaaagaagu

SEQ ID NO: 291808 - RNA, 19 nt, Homo sapiens
ucacagaaacauugaaacu

SEQ ID NO: 291809 - RNA, 19 nt, Homo sapiens
ugaaggguguuagcagaau

SEQ ID NO: 291810 - RNA, 19 nt, Homo sapiens
ugcaguggcuggacaaagu

SEQ ID NO: 291811 - RNA, 19 nt, Homo sapiens
gccucaaggucuucaacaa

SEQ ID NO: 291812 - RNA, 19 nt, Homo sapiens
gaugaaacaaagcagugaa

SEQ ID NO: 291813 - RNA, 19 nt, Homo sapiens
cuaaagcaaauaucacuca

SEQ ID NO: 291814 - RNA, 19 nt, Homo sapiens
ucagccgugucauuauaaa

SEQ ID NO: 291815 - RNA, 19 nt, Homo sapiens
agccugcuguggccucuua

SEQ ID NO: 291816 - RNA, 19 nt, Homo sapiens
uggacaaaguucugacuca

SEQ ID NO: 291817 - RNA, 19 nt, Homo sapiens
gccagagagucccuaucaa

SEQ ID NO: 291818 - RNA, 19 nt, Homo sapiens
uuuggugccugugcuauaa

SEQ ID NO: 291819 - RNA, 19 nt, Homo sapiens
gagccggaacugcaacuau

SEQ ID NO: 291820 - RNA, 19 nt, Homo sapiens
aggaaagggugugcacuug

SEQ ID NO: 291821 - RNA, 19 nt, Homo sapiens
uggacucucuagugaagaa

SEQ ID NO: 291822 - RNA, 19 nt, Homo sapiens
ucagcucccucuucuccuu

SEQ ID NO: 291823 - RNA, 19 nt, Homo sapiens
ggcgauauugucaacagua

SEQ ID NO: 291824 - RNA, 19 nt, Homo sapiens
ccacauaaccccauuucuu

SEQ ID NO: 291825 - RNA, 19 nt, Homo sapiens
aaagaagugugcauuaacc

SEQ ID NO: 291826 - RNA, 19 nt, Homo sapiens
gcagcacuaaagcaaauau

SEQ ID NO: 291827 - RNA, 19 nt, Homo sapiens
ccucacagaaacauugaaa

SEQ ID NO: 291828 - RNA, 19 nt, Homo sapiens
ccauuucuucagugucuua

SEQ ID NO: 291829 - RNA, 19 nt, Homo sapiens
gcaguggcuggacaaaguu

SEQ ID NO: 291830 - RNA, 19 nt, Homo sapiens
ugucuuggacuucuuucua

SEQ ID NO: 291831 - RNA, 19 nt, Homo sapiens
gcucggucgccuacuauga

SEQ ID NO: 291832 - RNA, 19 nt, Homo sapiens
cagagagucccuaucaaca

SEQ ID NO: 291833 - RNA, 19 nt, Homo sapiens
caccgacccuucaaauaac

SEQ ID NO: 291834 - RNA, 19 nt, Homo sapiens
gaaguuaaagaagaagaag

SEQ ID NO: 291835 - RNA, 19 nt, Homo sapiens
caguuuaaaugaugucacu

SEQ ID NO: 291836 - RNA, 19 nt, Homo sapiens
aagcugcauuuccauagga

SEQ ID NO: 291837 - RNA, 19 nt, Homo sapiens
cgagaagcaugaaguguua

SEQ ID NO: 291838 - RNA, 19 nt, Homo sapiens
ugugagagcuguacauuaa

SEQ ID NO: 291839 - RNA, 19 nt, Homo sapiens
gaagacuacuacuggauga

SEQ ID NO: 291840 - RNA, 19 nt, Homo sapiens
gaugaaguuugaagugaaa

SEQ ID NO: 291841 - RNA, 19 nt, Homo sapiens
gcaggagaauggcaucaga

SEQ ID NO: 291842 - RNA, 19 nt, Homo sapiens
ggagaaauacgagaaguug

SEQ ID NO: 291843 - RNA, 19 nt, Homo sapiens
ggaauauguuaaugacuuc

SEQ ID NO: 291844 - RNA, 19 nt, Homo sapiens
caucagaacuggcaaugag

SEQ ID NO: 291845 - RNA, 19 nt, Homo sapiens
gcagaaggcgcaccuggaa

SEQ ID NO: 291846 - RNA, 19 nt, Homo sapiens
gagaauggcaucagaacug

SEQ ID NO: 291847 - RNA, 19 nt, Homo sapiens
gcgagaagcaugaaguguu

SEQ ID NO: 291848 - RNA, 19 nt, Homo sapiens
ggacuucgcuauuuugcuu

SEQ ID NO: 291849 - RNA, 19 nt, Homo sapiens
gcaagucgaccaccucaag

SEQ ID NO: 291850 - RNA, 19 nt, Homo sapiens
ugaugaaguuugaagugaa

SEQ ID NO: 291851 - RNA, 19 nt, Homo sapiens
gaagaggcggacccugaaa

SEQ ID NO: 291852 - RNA, 19 nt, Homo sapiens
ggagagagaggaaagaaaa

SEQ ID NO: 291853 - RNA, 19 nt, Homo sapiens
uaaagagagccaagcagaa

SEQ ID NO: 291854 - RNA, 19 nt, Homo sapiens
ucgaggcgcucaucagcaa

SEQ ID NO: 291855 - RNA, 19 nt, Homo sapiens
gaagaggaggcgagaagca

SEQ ID NO: 291856 - RNA, 19 nt, Homo sapiens
ggagaccgaccgcaucauc

SEQ ID NO: 291857 - RNA, 19 nt, Homo sapiens
ggcgagcccuuccuuaugc

SEQ ID NO: 291858 - RNA, 19 nt, Homo sapiens
gaggaggcgagaagcauga

SEQ ID NO: 291859 - RNA, 19 nt, Homo sapiens
gcaagaaagaacuaaacuc

SEQ ID NO: 291860 - RNA, 19 nt, Homo sapiens
guacuuaccaguguguuca

SEQ ID NO: 291861 - RNA, 19 nt, Homo sapiens
aggcgcaccuggaagacua

SEQ ID NO: 291862 - RNA, 19 nt, Homo sapiens
ccauggaauauguuaauga

SEQ ID NO: 291863 - RNA, 19 nt, Homo sapiens
ugagcccacucgcaaguug

SEQ ID NO: 291864 - RNA, 19 nt, Homo sapiens
acgcguacaaggagaaaua

SEQ ID NO: 291865 - RNA, 19 nt, Homo sapiens
cauggaauauguuaaugac

SEQ ID NO: 291866 - RNA, 19 nt, Homo sapiens
ggccauggaauauguuaau

SEQ ID NO: 291867 - RNA, 19 nt, Homo sapiens
gugugagagcuguacauua

SEQ ID NO: 291868 - RNA, 19 nt, Homo sapiens
gaacuggcaaugagcaacu

SEQ ID NO: 291869 - RNA, 19 nt, Homo sapiens
gggagagagaggaaagaaa

SEQ ID NO: 291870 - RNA, 19 nt, Homo sapiens
ugagagcuguacauuaaaa

SEQ ID NO: 291871 - RNA, 19 nt, Homo sapiens
acaaggagaaauacgagaa

SEQ ID NO: 291872 - RNA, 19 nt, Homo sapiens
gccauggaauauguuaaug

SEQ ID NO: 291873 - RNA, 19 nt, Homo sapiens
agaaggcgcaccuggaaga

SEQ ID NO: 291874 - RNA, 19 nt, Homo sapiens
ugauccggcugaagcagaa

SEQ ID NO: 291875 - RNA, 19 nt, Homo sapiens
gcaccuggaagacuacuac

SEQ ID NO: 291876 - RNA, 19 nt, Homo sapiens
gcaccucugccuugcacuu

SEQ ID NO: 291877 - RNA, 19 nt, Homo sapiens
cagaagaggaggcgagaag

SEQ ID NO: 291878 - RNA, 19 nt, Homo sapiens
uauuugcagucauggagaa

SEQ ID NO: 291879 - RNA, 19 nt, Homo sapiens
aaagagagccaagcagaag

SEQ ID NO: 291880 - RNA, 19 nt, Homo sapiens
gcaaguuggagccaucagu

SEQ ID NO: 291881 - RNA, 19 nt, Homo sapiens
uaauaaagagagccaagca

SEQ ID NO: 291882 - RNA, 19 nt, Homo sapiens
gagaccgaccgcaucauca

SEQ ID NO: 291883 - RNA, 19 nt, Homo sapiens
cccguccucucccgaguuu

SEQ ID NO: 291884 - RNA, 19 nt, Homo sapiens
gcgagagggacgcguacaa

SEQ ID NO: 291885 - RNA, 19 nt, Homo sapiens
agaagaggcggacccugaa

SEQ ID NO: 291886 - RNA, 19 nt, Homo sapiens
gcaucagaacuggcaauga

SEQ ID NO: 291887 - RNA, 19 nt, Homo sapiens
gagcgagggagcacauugg

SEQ ID NO: 291888 - RNA, 19 nt, Homo sapiens
gacggcgagcccuuccuua

SEQ ID NO: 291889 - RNA, 19 nt, Homo sapiens
agaaauacgagaaguuggu

SEQ ID NO: 291890 - RNA, 19 nt, Homo sapiens
ggacgcguacaaggagaaa

SEQ ID NO: 291891 - RNA, 19 nt, Homo sapiens
gagcccuuccuuaugcaaa

SEQ ID NO: 291892 - RNA, 19 nt, Homo sapiens
gagaagcaugaaguguuaa

SEQ ID NO: 291893 - RNA, 19 nt, Homo sapiens
caaggagaaauacgagaag

SEQ ID NO: 291894 - RNA, 19 nt, Homo sapiens
agagggacgcguacaagga

SEQ ID NO: 291895 - RNA, 19 nt, Homo sapiens
caggagaauggcaucagaa

SEQ ID NO: 291896 - RNA, 19 nt, Homo sapiens
gaggcgagaagcaugaagu

SEQ ID NO: 291897 - RNA, 19 nt, Homo sapiens
ggagaauggcaucagaacu

SEQ ID NO: 291898 - RNA, 19 nt, Homo sapiens
cggcgagcccuuccuuaug

SEQ ID NO: 291899 - RNA, 19 nt, Homo sapiens
gcaccagccugacggauga

SEQ ID NO: 291900 - RNA, 19 nt, Homo sapiens
gaagaccauuugaccauau

SEQ ID NO: 291901 - RNA, 19 nt, Homo sapiens
gagaugggcucugcucuga

SEQ ID NO: 291902 - RNA, 19 nt, Homo sapiens
gaaggauucacucucuuua

SEQ ID NO: 291903 - RNA, 19 nt, Homo sapiens
gaugggcucugcucugaga

SEQ ID NO: 291904 - RNA, 19 nt, Homo sapiens
ggaaggauucacucucuuu

SEQ ID NO: 291905 - RNA, 19 nt, Homo sapiens
gaaaagggaagaaaguaua

SEQ ID NO: 291906 - RNA, 19 nt, Homo sapiens
gugguuauauagcccuuua

SEQ ID NO: 291907 - RNA, 19 nt, Homo sapiens
cuaggcacauggcgaauuu

SEQ ID NO: 291908 - RNA, 19 nt, Homo sapiens
uggagaagcuggccucaga

SEQ ID NO: 291909 - RNA, 19 nt, Homo sapiens
gagcugcagaguauuuaua

SEQ ID NO: 291910 - RNA, 19 nt, Homo sapiens
gggaagaaaguauaauaga

SEQ ID NO: 291911 - RNA, 19 nt, Homo sapiens
gcacugaacaagaccaaau

SEQ ID NO: 291912 - RNA, 19 nt, Homo sapiens
ugaccuauuugugugguua

SEQ ID NO: 291913 - RNA, 19 nt, Homo sapiens
ggaacggacuagagagagu

SEQ ID NO: 291914 - RNA, 19 nt, Homo sapiens
ucagagaacgccagcauga

SEQ ID NO: 291915 - RNA, 19 nt, Homo sapiens
aaagagcugcagaguauuu

SEQ ID NO: 291916 - RNA, 19 nt, Homo sapiens
cuguuuacaugaccuauuu

SEQ ID NO: 291917 - RNA, 19 nt, Homo sapiens
ggucccgugucacuguuua

SEQ ID NO: 291918 - RNA, 19 nt, Homo sapiens
agaagaccauuugaccaua

SEQ ID NO: 291919 - RNA, 19 nt, Homo sapiens
caagcaagaagaccauuug

SEQ ID NO: 291920 - RNA, 19 nt, Homo sapiens
uuacaugaccuauuugugu

SEQ ID NO: 291921 - RNA, 19 nt, Homo sapiens
ugaagcgggugacgcagaa

SEQ ID NO: 291922 - RNA, 19 nt, Homo sapiens
gcagugagggucccagugu

SEQ ID NO: 291923 - RNA, 19 nt, Homo sapiens
cugcaaagcacaaccugua

SEQ ID NO: 291924 - RNA, 19 nt, Homo sapiens
aggaggagcuggagaagca

SEQ ID NO: 291925 - RNA, 19 nt, Homo sapiens
gcugcagaguauuuauaaa

SEQ ID NO: 291926 - RNA, 19 nt, Homo sapiens
gguuauauagcccuuuauu

SEQ ID NO: 291927 - RNA, 19 nt, Homo sapiens
cagcuuagcccagcaugaa

SEQ ID NO: 291928 - RNA, 19 nt, Homo sapiens
gaagcuggccucagagaac

SEQ ID NO: 291929 - RNA, 19 nt, Homo sapiens
ccaccagcgucaucacaau

SEQ ID NO: 291930 - RNA, 19 nt, Homo sapiens
gagagaaguuccuuuuaca

SEQ ID NO: 291931 - RNA, 19 nt, Homo sapiens
gggaaggauucacucucuu

SEQ ID NO: 291932 - RNA, 19 nt, Homo sapiens
gaacggacuagagagaguu

SEQ ID NO: 291933 - RNA, 19 nt, Homo sapiens
ucacaauaguaaaguccaa

SEQ ID NO: 291934 - RNA, 19 nt, Homo sapiens
gagaagcuggccucagaga

SEQ ID NO: 291935 - RNA, 19 nt, Homo sapiens
gagaguugcgggagagaga

SEQ ID NO: 291936 - RNA, 19 nt, Homo sapiens
ccuuugaucuucgucauug

SEQ ID NO: 291937 - RNA, 19 nt, Homo sapiens
gagaaguuccuuuuacaaa

SEQ ID NO: 291938 - RNA, 19 nt, Homo sapiens
ucauugucgucguguguuu

SEQ ID NO: 291939 - RNA, 19 nt, Homo sapiens
caccagcgucaucacaaua

SEQ ID NO: 291940 - RNA, 19 nt, Homo sapiens
agaaggaggagcuggagaa

SEQ ID NO: 291941 - RNA, 19 nt, Homo sapiens
ccgugucacuguuuacaug

SEQ ID NO: 291942 - RNA, 19 nt, Homo sapiens
cuuuguggcuguuggaguu

SEQ ID NO: 291943 - RNA, 19 nt, Homo sapiens
ggaaaagggaagaaaguau

SEQ ID NO: 291944 - RNA, 19 nt, Homo sapiens
acgaggcgcugcagaccuu

SEQ ID NO: 291945 - RNA, 19 nt, Homo sapiens
cagcgucaucacaauagua

SEQ ID NO: 291946 - RNA, 19 nt, Homo sapiens
ugggaaggauucacucucu

SEQ ID NO: 291947 - RNA, 19 nt, Homo sapiens
gaccauuugaccauaugaa

SEQ ID NO: 291948 - RNA, 19 nt, Homo sapiens
agacggaugcccgaucgua

SEQ ID NO: 291949 - RNA, 19 nt, Homo sapiens
acaagcaagaagaccauuu

SEQ ID NO: 291950 - RNA, 19 nt, Homo sapiens
gcuuagcccagcaugaaga

SEQ ID NO: 291951 - RNA, 19 nt, Homo sapiens
cagugagggucccaguguu

SEQ ID NO: 291952 - RNA, 19 nt, Homo sapiens
aagaagaccauuugaccau

SEQ ID NO: 291953 - RNA, 19 nt, Homo sapiens
gaaggaggagcuggagaag

SEQ ID NO: 291954 - RNA, 19 nt, Homo sapiens
uuacggacaccucuuugug

SEQ ID NO: 291955 - RNA, 19 nt, Homo sapiens
ggagaucguccagcugaag

SEQ ID NO: 291956 - RNA, 19 nt, Homo sapiens
guuuccuucucuucucuuu

SEQ ID NO: 291957 - RNA, 19 nt, Homo sapiens
cgucaucacaauaguaaag

SEQ ID NO: 291958 - RNA, 19 nt, Homo sapiens
agagaacgccagcaugaag

SEQ ID NO: 291959 - RNA, 19 nt, Homo sapiens
aaucccuucuuguaaacuu

SEQ ID NO: 291960 - RNA, 19 nt, Homo sapiens
aaacaagcaagaagaccau

SEQ ID NO: 291961 - RNA, 19 nt, Homo sapiens
cagagaacgccagcaugaa

SEQ ID NO: 291962 - RNA, 19 nt, Homo sapiens
ugcgaugggucccguguca

SEQ ID NO: 291963 - RNA, 19 nt, Homo sapiens
gagcagaggugcagaagca

SEQ ID NO: 291964 - RNA, 19 nt, Homo sapiens
gccaucgucugcuacauua

SEQ ID NO: 291965 - RNA, 19 nt, Homo sapiens
gagcacagcguccuggaua

SEQ ID NO: 291966 - RNA, 19 nt, Homo sapiens
ggacaaugguggccguaga

SEQ ID NO: 291967 - RNA, 19 nt, Homo sapiens
cggaggagcuagcugagua

SEQ ID NO: 291968 - RNA, 19 nt, Homo sapiens
ggaaacggcccaccaagga

SEQ ID NO: 291969 - RNA, 19 nt, Homo sapiens
cauuacggcuccucucuaa

SEQ ID NO: 291970 - RNA, 19 nt, Homo sapiens
ccucuguucuggauuauga

SEQ ID NO: 291971 - RNA, 19 nt, Homo sapiens
gagcugccaucgcgcaaug

SEQ ID NO: 291972 - RNA, 19 nt, Homo sapiens
caaccugucuguggaguuc

SEQ ID NO: 291973 - RNA, 19 nt, Homo sapiens
cgacugaugugggccaaga

SEQ ID NO: 291974 - RNA, 19 nt, Homo sapiens
gagcaacccggacccuauu

SEQ ID NO: 291975 - RNA, 19 nt, Homo sapiens
gaaauccgggucaagugaa

SEQ ID NO: 291976 - RNA, 19 nt, Homo sapiens
ggugucugguacuucaaua

SEQ ID NO: 291977 - RNA, 19 nt, Homo sapiens
cauggugucugguacuuca

SEQ ID NO: 291978 - RNA, 19 nt, Homo sapiens
gcuuugacuucccggauga

SEQ ID NO: 291979 - RNA, 19 nt, Homo sapiens
cugccucuguucuggauua

SEQ ID NO: 291980 - RNA, 19 nt, Homo sapiens
gagauucagcgaucacuca

SEQ ID NO: 291981 - RNA, 19 nt, Homo sapiens
ggagcuagcugaguaugcu

SEQ ID NO: 291982 - RNA, 19 nt, Homo sapiens
gcaaugugaccgugaacga

SEQ ID NO: 291983 - RNA, 19 nt, Homo sapiens
ugaaauccgggucaaguga

SEQ ID NO: 291984 - RNA, 19 nt, Homo sapiens
caaaagggacaugaaauaa

SEQ ID NO: 291985 - RNA, 19 nt, Homo sapiens
ugauugccaucgucugcua

SEQ ID NO: 291986 - RNA, 19 nt, Homo sapiens
acaaaagggacaugaaaua

SEQ ID NO: 291987 - RNA, 19 nt, Homo sapiens
guacaaaagggacaugaaa

SEQ ID NO: 291988 - RNA, 19 nt, Homo sapiens
gcuccucucuaaccuccuu

SEQ ID NO: 291989 - RNA, 19 nt, Homo sapiens
caacaccacccugcaguuc

SEQ ID NO: 291990 - RNA, 19 nt, Homo sapiens
ugaaauaaaugccccaaag

SEQ ID NO: 291991 - RNA, 19 nt, Homo sapiens
ugucuguccguguuauuua

SEQ ID NO: 291992 - RNA, 19 nt, Homo sapiens
cgaggaugauggagaguac

SEQ ID NO: 291993 - RNA, 19 nt, Homo sapiens
gcacagcguccuggauauc

SEQ ID NO: 291994 - RNA, 19 nt, Homo sapiens
cagcauggacgucaaguac

SEQ ID NO: 291995 - RNA, 19 nt, Homo sapiens
gaccugggccugcgaaacu

SEQ ID NO: 291996 - RNA, 19 nt, Homo sapiens
cagaagcaacugaguccaa

SEQ ID NO: 291997 - RNA, 19 nt, Homo sapiens
gcuacaaccaguacaccuu

SEQ ID NO: 291998 - RNA, 19 nt, Homo sapiens
gcugaaauccgggucaagu

SEQ ID NO: 291999 - RNA, 19 nt, Homo sapiens
caagucgcgcacccaagua

SEQ ID NO: 292000 - RNA, 19 nt, Homo sapiens
gcucugucuguccguguua

SEQ ID NO: 292001 - RNA, 19 nt, Homo sapiens
gggcucccuuccucccaaa

SEQ ID NO: 292002 - RNA, 19 nt, Homo sapiens
ggaggagcuagcugaguau

SEQ ID NO: 292003 - RNA, 19 nt, Homo sapiens
gcauggugccggacaacug

SEQ ID NO: 292004 - RNA, 19 nt, Homo sapiens
ucaagucgcgcacccaagu

SEQ ID NO: 292005 - RNA, 19 nt, Homo sapiens
acaccacccugcaguucga

SEQ ID NO: 292006 - RNA, 19 nt, Homo sapiens
caaccaguacaccuucuca

SEQ ID NO: 292007 - RNA, 19 nt, Homo sapiens
uagcugaguaugcugaaau

SEQ ID NO: 292008 - RNA, 19 nt, Homo sapiens
acagugaacgggacaaugg

SEQ ID NO: 292009 - RNA, 19 nt, Homo sapiens
caacagugaacgggacaau

SEQ ID NO: 292010 - RNA, 19 nt, Homo sapiens
cucacucgcuguacagaau

SEQ ID NO: 292011 - RNA, 19 nt, Homo sapiens
gucuguccguguuauuuau

SEQ ID NO: 292012 - RNA, 19 nt, Homo sapiens
ucaccaucuucaaggagaa

SEQ ID NO: 292013 - RNA, 19 nt, Homo sapiens
ccuggaagccaacagugaa

SEQ ID NO: 292014 - RNA, 19 nt, Homo sapiens
agaggcgccugggaucuga

SEQ ID NO: 292015 - RNA, 19 nt, Homo sapiens
uguccacggucaucuacga

SEQ ID NO: 292016 - RNA, 19 nt, Homo sapiens
ccagcauggacgucaagua

SEQ ID NO: 292017 - RNA, 19 nt, Homo sapiens
ccaacaccacccugcaguu

SEQ ID NO: 292018 - RNA, 19 nt, Homo sapiens
uguucuggauuaugauuuc

SEQ ID NO: 292019 - RNA, 19 nt, Homo sapiens
gaggugcagaagcaacuga

SEQ ID NO: 292020 - RNA, 19 nt, Homo sapiens
gagcagaggugcagaagca

SEQ ID NO: 292021 - RNA, 19 nt, Homo sapiens
gccaucgucugcuacauua

SEQ ID NO: 292022 - RNA, 19 nt, Homo sapiens
gagcacagcguccuggaua

SEQ ID NO: 292023 - RNA, 19 nt, Homo sapiens
ggacaaugguggccguaga

SEQ ID NO: 292024 - RNA, 19 nt, Homo sapiens
cggaggagcuagcugagua

SEQ ID NO: 292025 - RNA, 19 nt, Homo sapiens
ggaaacggcccaccaagga

SEQ ID NO: 292026 - RNA, 19 nt, Homo sapiens
cauuacggcuccucucuaa

SEQ ID NO: 292027 - RNA, 19 nt, Homo sapiens
ccucuguucuggauuauga

SEQ ID NO: 292028 - RNA, 19 nt, Homo sapiens
gagcugccaucgcgcaaug

SEQ ID NO: 292029 - RNA, 19 nt, Homo sapiens
caaccugucuguggaguuc

SEQ ID NO: 292030 - RNA, 19 nt, Homo sapiens
cgacugaugugggccaaga

SEQ ID NO: 292031 - RNA, 19 nt, Homo sapiens
gagcaacccggacccuauu

SEQ ID NO: 292032 - RNA, 19 nt, Homo sapiens
gaaauccgggucaagugaa

SEQ ID NO: 292033 - RNA, 19 nt, Homo sapiens
gaaguacgaguccaaagag

SEQ ID NO: 292034 - RNA, 19 nt, Homo sapiens
guacgaguccaaagagguu

SEQ ID NO: 292035 - RNA, 19 nt, Homo sapiens
ggugucugguacuucaaua

SEQ ID NO: 292036 - RNA, 19 nt, Homo sapiens
cauggugucugguacuuca

SEQ ID NO: 292037 - RNA, 19 nt, Homo sapiens
gcuuugacuucccggauga

SEQ ID NO: 292038 - RNA, 19 nt, Homo sapiens
cugccucuguucuggauua

SEQ ID NO: 292039 - RNA, 19 nt, Homo sapiens
gagauucagcgaucacuca

SEQ ID NO: 292040 - RNA, 19 nt, Homo sapiens
ggagcuagcugaguaugcu

SEQ ID NO: 292041 - RNA, 19 nt, Homo sapiens
gcaaugugaccgugaacga

SEQ ID NO: 292042 - RNA, 19 nt, Homo sapiens
ugaaauccgggucaaguga

SEQ ID NO: 292043 - RNA, 19 nt, Homo sapiens
caaaagggacaugaaauaa

SEQ ID NO: 292044 - RNA, 19 nt, Homo sapiens
agaaguacgaguccaaaga

SEQ ID NO: 292045 - RNA, 19 nt, Homo sapiens
ugauugccaucgucugcua

SEQ ID NO: 292046 - RNA, 19 nt, Homo sapiens
acaaaagggacaugaaaua

SEQ ID NO: 292047 - RNA, 19 nt, Homo sapiens
guacaaaagggacaugaaa

SEQ ID NO: 292048 - RNA, 19 nt, Homo sapiens
gcuccucucuaaccuccuu

SEQ ID NO: 292049 - RNA, 19 nt, Homo sapiens
caacaccacccugcaguuc

SEQ ID NO: 292050 - RNA, 19 nt, Homo sapiens
ugaaauaaaugccccaaag

SEQ ID NO: 292051 - RNA, 19 nt, Homo sapiens
uuucuacccuggaaucuca

SEQ ID NO: 292052 - RNA, 19 nt, Homo sapiens
ugucuguccguguuauuua

SEQ ID NO: 292053 - RNA, 19 nt, Homo sapiens
cgaggaugauggagaguac

SEQ ID NO: 292054 - RNA, 19 nt, Homo sapiens
gcacagcguccuggauauc

SEQ ID NO: 292055 - RNA, 19 nt, Homo sapiens
cagcauggacgucaaguac

SEQ ID NO: 292056 - RNA, 19 nt, Homo sapiens
gaccugggccugcgaaacu

SEQ ID NO: 292057 - RNA, 19 nt, Homo sapiens
cagaagcaacugaguccaa

SEQ ID NO: 292058 - RNA, 19 nt, Homo sapiens
gcuacaaccaguacaccuu

SEQ ID NO: 292059 - RNA, 19 nt, Homo sapiens
gcugaaauccgggucaagu

SEQ ID NO: 292060 - RNA, 19 nt, Homo sapiens
caagucgcgcacccaagua

SEQ ID NO: 292061 - RNA, 19 nt, Homo sapiens
gcucugucuguccguguua

SEQ ID NO: 292062 - RNA, 19 nt, Homo sapiens
gggcucccuuccucccaaa

SEQ ID NO: 292063 - RNA, 19 nt, Homo sapiens
ggaggagcuagcugaguau

SEQ ID NO: 292064 - RNA, 19 nt, Homo sapiens
gcauggugccggacaacug

SEQ ID NO: 292065 - RNA, 19 nt, Homo sapiens
ucaagucgcgcacccaagu

SEQ ID NO: 292066 - RNA, 19 nt, Homo sapiens
agagguuucuacccuggaa

SEQ ID NO: 292067 - RNA, 19 nt, Homo sapiens
acaccacccugcaguucga

SEQ ID NO: 292068 - RNA, 19 nt, Homo sapiens
caaccaguacaccuucuca

SEQ ID NO: 292069 - RNA, 19 nt, Homo sapiens
cucacucgcuguacagaau

SEQ ID NO: 292070 - RNA, 19 nt, Homo sapiens
uagcugaguaugcugaaau

SEQ ID NO: 292071 - RNA, 19 nt, Homo sapiens
acagugaacgggacaaugg

SEQ ID NO: 292072 - RNA, 19 nt, Homo sapiens
caacagugaacgggacaau

SEQ ID NO: 292073 - RNA, 19 nt, Homo sapiens
gucuguccguguuauuuau

SEQ ID NO: 292074 - RNA, 19 nt, Homo sapiens
cagagaaguacgaguccaa

SEQ ID NO: 292075 - RNA, 19 nt, Homo sapiens
ucaccaucuucaaggagaa

SEQ ID NO: 292076 - RNA, 19 nt, Homo sapiens
ccuggaagccaacagugaa

SEQ ID NO: 292077 - RNA, 19 nt, Homo sapiens
agaggcgccugggaucuga

SEQ ID NO: 292078 - RNA, 19 nt, Homo sapiens
gagaaguacgaguccaaag

SEQ ID NO: 292079 - RNA, 19 nt, Homo sapiens
uguccacggucaucuacga

SEQ ID NO: 292080 - RNA, 19 nt, Homo sapiens
ccagcauggacgucaagua

SEQ ID NO: 292081 - RNA, 19 nt, Homo sapiens
ccaacaccacccugcaguu

SEQ ID NO: 292082 - RNA, 19 nt, Homo sapiens
gaggugcagaagcaacuga

SEQ ID NO: 292083 - RNA, 19 nt, Homo sapiens
uguucuggauuaugauuuc

SEQ ID NO: 292084 - RNA, 19 nt, Homo sapiens
gaagguggcugauuugguu

SEQ ID NO: 292085 - RNA, 19 nt, Homo sapiens
cuaagaagguggcugauuu

SEQ ID NO: 292086 - RNA, 19 nt, Homo sapiens
gaagagagcggucaguguu

SEQ ID NO: 292087 - RNA, 19 nt, Homo sapiens
guagguuucuguucuauug

SEQ ID NO: 292088 - RNA, 19 nt, Homo sapiens
gagcaguaaucacuaagaa

SEQ ID NO: 292089 - RNA, 19 nt, Homo sapiens
gauaauaacagcaguggaa

SEQ ID NO: 292090 - RNA, 19 nt, Homo sapiens
cauccaaguuuaugaauga

SEQ ID NO: 292091 - RNA, 19 nt, Homo sapiens
uaacagcaguggaauaagu

SEQ ID NO: 292092 - RNA, 19 nt, Homo sapiens
ugaaaguccuugaguaugu

SEQ ID NO: 292093 - RNA, 19 nt, Homo sapiens
ggaagcugcucacccaaga

SEQ ID NO: 292094 - RNA, 19 nt, Homo sapiens
guaguagguuucuguucua

SEQ ID NO: 292095 - RNA, 19 nt, Homo sapiens
ggauuuccuuggcuucuuu

SEQ ID NO: 292096 - RNA, 19 nt, Homo sapiens
cagaaaugcuggagagugu

SEQ ID NO: 292097 - RNA, 19 nt, Homo sapiens
gaaaccagcuaugugaaag

SEQ ID NO: 292098 - RNA, 19 nt, Homo sapiens
agucaauucuugccuuaua

SEQ ID NO: 292099 - RNA, 19 nt, Homo sapiens
ggaggaagagggagucuga

SEQ ID NO: 292100 - RNA, 19 nt, Homo sapiens
caaggucagugcaagaguu

SEQ ID NO: 292101 - RNA, 19 nt, Homo sapiens
gaaaguccuugaguaugug

SEQ ID NO: 292102 - RNA, 19 nt, Homo sapiens
gcuggagagugucaucaaa

SEQ ID NO: 292103 - RNA, 19 nt, Homo sapiens
ugggugacuuggagauuua

SEQ ID NO: 292104 - RNA, 19 nt, Homo sapiens
ccagggagccagucacaaa

SEQ ID NO: 292105 - RNA, 19 nt, Homo sapiens
gcauccaaguuuaugaaug

SEQ ID NO: 292106 - RNA, 19 nt, Homo sapiens
aauaacagcaguggaauaa

SEQ ID NO: 292107 - RNA, 19 nt, Homo sapiens
gacaugaggcccauucuuc

SEQ ID NO: 292108 - RNA, 19 nt, Homo sapiens
cagcuggucuuuggcauug

SEQ ID NO: 292109 - RNA, 19 nt, Homo sapiens
gggaggagcugagugugau

SEQ ID NO: 292110 - RNA, 19 nt, Homo sapiens
uaauaacagcaguggaaua

SEQ ID NO: 292111 - RNA, 19 nt, Homo sapiens
uuuaagggaugguugaaug

SEQ ID NO: 292112 - RNA, 19 nt, Homo sapiens
auagucaauucuugccuua

SEQ ID NO: 292113 - RNA, 19 nt, Homo sapiens
ugagugugauggaggugua

SEQ ID NO: 292114 - RNA, 19 nt, Homo sapiens
uggcugauuugguugguuu

SEQ ID NO: 292115 - RNA, 19 nt, Homo sapiens
gaagagggagucugagcau

SEQ ID NO: 292116 - RNA, 19 nt, Homo sapiens
gaucaaggucagugcaaga

SEQ ID NO: 292117 - RNA, 19 nt, Homo sapiens
ugaaaccagcuaugugaaa

SEQ ID NO: 292118 - RNA, 19 nt, Homo sapiens
gcaaagccucugaguccuu

SEQ ID NO: 292119 - RNA, 19 nt, Homo sapiens
gaaaugcuggagaguguca

SEQ ID NO: 292120 - RNA, 19 nt, Homo sapiens
ccuuauaccucagucuauu

SEQ ID NO: 292121 - RNA, 19 nt, Homo sapiens
gcacugcaagccugaggaa

SEQ ID NO: 292122 - RNA, 19 nt, Homo sapiens
uaagaagguggcugauuug

SEQ ID NO: 292123 - RNA, 19 nt, Homo sapiens
aaucagaucaugcccaaga

SEQ ID NO: 292124 - RNA, 19 nt, Homo sapiens
gauauaugcauaccuggau

SEQ ID NO: 292125 - RNA, 19 nt, Homo sapiens
ggcccauucuucacucuga

SEQ ID NO: 292126 - RNA, 19 nt, Homo sapiens
gcaccaaggagaagaucug

SEQ ID NO: 292127 - RNA, 19 nt, Homo sapiens
gacagaggcaacccaguga

SEQ ID NO: 292128 - RNA, 19 nt, Homo sapiens
uuccuuggcuucuuugaga

SEQ ID NO: 292129 - RNA, 19 nt, Homo sapiens
caacccagaggacaggauu

SEQ ID NO: 292130 - RNA, 19 nt, Homo sapiens
uaauuguccuggucaugau

SEQ ID NO: 292131 - RNA, 19 nt, Homo sapiens
gcaguaaaauagaugagau

SEQ ID NO: 292132 - RNA, 19 nt, Homo sapiens
cagcauccaaguuuaugaa

SEQ ID NO: 292133 - RNA, 19 nt, Homo sapiens
ggucaguguucucaguagu

SEQ ID NO: 292134 - RNA, 19 nt, Homo sapiens
ccugagaucuucggcaaag

SEQ ID NO: 292135 - RNA, 19 nt, Homo sapiens
aguaguagguuucuguucu

SEQ ID NO: 292136 - RNA, 19 nt, Homo sapiens
agagggagucugagcauga

SEQ ID NO: 292137 - RNA, 19 nt, Homo sapiens
ugugaaaguccuugaguau

SEQ ID NO: 292138 - RNA, 19 nt, Homo sapiens
gcagcuggucuuuggcauu

SEQ ID NO: 292139 - RNA, 19 nt, Homo sapiens
gcugcucacccaagauuug

SEQ ID NO: 292140 - RNA, 19 nt, Homo sapiens
caagauuuggugcaggaaa

SEQ ID NO: 292141 - RNA, 19 nt, Homo sapiens
ccacuccuauguccuuguc

SEQ ID NO: 292142 - RNA, 19 nt, Homo sapiens
auugggaaauccauucuau

SEQ ID NO: 292143 - RNA, 19 nt, Homo sapiens
uccgagcaguaaucacuaa

SEQ ID NO: 292144 - RNA, 19 nt, Homo sapiens
ggagucugagcaugaguug

SEQ ID NO: 292145 - RNA, 19 nt, Homo sapiens
gagggagucugagcaugag

SEQ ID NO: 292146 - RNA, 19 nt, Homo sapiens
gauaauuguccuggucaug

SEQ ID NO: 292147 - RNA, 19 nt, Homo sapiens
ucaguguucucaguaguag

SEQ ID NO: 292148 - RNA, 19 nt, Homo sapiens
gcggucaguguucucagua

SEQ ID NO: 292149 - RNA, 19 nt, Homo sapiens
auaccucagucuauucugu

SEQ ID NO: 292150 - RNA, 19 nt, Homo sapiens
ccacuaccaucaacuucac

SEQ ID NO: 292151 - RNA, 19 nt, Homo sapiens
uugggugacuuggagauuu

SEQ ID NO: 292152 - RNA, 19 nt, Homo sapiens
gagucaucaugucucuuga

SEQ ID NO: 292153 - RNA, 19 nt, Homo sapiens
uauaugcauaccuggauuu

SEQ ID NO: 292154 - RNA, 19 nt, Homo sapiens
ccacugcugggucaacaga

SEQ ID NO: 292155 - RNA, 19 nt, Homo sapiens
uaagggaugguugaaugaa

SEQ ID NO: 292156 - RNA, 19 nt, Homo sapiens
gucaguguucucaguagua

SEQ ID NO: 292157 - RNA, 19 nt, Homo sapiens
ugaagagagcggucagugu

SEQ ID NO: 292158 - RNA, 19 nt, Homo sapiens
gugaaaguccuugaguaug

SEQ ID NO: 292159 - RNA, 19 nt, Homo sapiens
auaauuguccuggucauga

SEQ ID NO: 292160 - RNA, 19 nt, Homo sapiens
ccuugcagcuggucuuugg

SEQ ID NO: 292161 - RNA, 19 nt, Homo sapiens
ucacaaaggcagaaaugcu

SEQ ID NO: 292162 - RNA, 19 nt, Homo sapiens
augugaaaguccuugagua

SEQ ID NO: 292163 - RNA, 19 nt, Homo sapiens
ccaccggccacuccuaugu

SEQ ID NO: 292164 - RNA, 19 nt, Homo sapiens
ugaauugggauaauaacag

SEQ ID NO: 292165 - RNA, 19 nt, Homo sapiens
uuaagggaugguugaauga

SEQ ID NO: 292166 - RNA, 19 nt, Homo sapiens
ugacaugaggcccauucuu

SEQ ID NO: 292167 - RNA, 19 nt, Homo sapiens
gggagucugagcaugaguu

SEQ ID NO: 292168 - RNA, 19 nt, Homo sapiens
aagcugcucacccaagauu

SEQ ID NO: 292169 - RNA, 19 nt, Homo sapiens
auauaugcauaccuggauu

SEQ ID NO: 292170 - RNA, 19 nt, Homo sapiens
gucaauucuugccuuauac

SEQ ID NO: 292171 - RNA, 19 nt, Homo sapiens
gcaggugccggacagugau

SEQ ID NO: 292172 - RNA, 19 nt, Homo sapiens
gauggccugcugggugaua

SEQ ID NO: 292173 - RNA, 19 nt, Homo sapiens
guuuucugcuccucaaaua

SEQ ID NO: 292174 - RNA, 19 nt, Homo sapiens
uaccucagucuauucugua

SEQ ID NO: 292175 - RNA, 19 nt, Homo sapiens
cgagcaguaaucacuaaga

SEQ ID NO: 292176 - RNA, 19 nt, Homo sapiens
gacgagagucaucaugucu

SEQ ID NO: 292177 - RNA, 19 nt, Homo sapiens
gaagagagcagucagcauu

SEQ ID NO: 292178 - RNA, 19 nt, Homo sapiens
uaacagcaguggaauaugu

SEQ ID NO: 292179 - RNA, 19 nt, Homo sapiens
guaggaagaugguugaguu

SEQ ID NO: 292180 - RNA, 19 nt, Homo sapiens
cauccaaguuuaugaauga

SEQ ID NO: 292181 - RNA, 19 nt, Homo sapiens
gagaguguccucagaaauu

SEQ ID NO: 292182 - RNA, 19 nt, Homo sapiens
gaagaugguugaguugguu

SEQ ID NO: 292183 - RNA, 19 nt, Homo sapiens
gggaggagcugaguauguu

SEQ ID NO: 292184 - RNA, 19 nt, Homo sapiens
uggaugacuuugagauuua

SEQ ID NO: 292185 - RNA, 19 nt, Homo sapiens
acaaggaacucaaaagaua

SEQ ID NO: 292186 - RNA, 19 nt, Homo sapiens
guauuugccuauauuguga

SEQ ID NO: 292187 - RNA, 19 nt, Homo sapiens
gcagugaguuucuguucug

SEQ ID NO: 292188 - RNA, 19 nt, Homo sapiens
cagaaaugcuggagagugu

SEQ ID NO: 292189 - RNA, 19 nt, Homo sapiens
gaaaccagcuaugugaaag

SEQ ID NO: 292190 - RNA, 19 nt, Homo sapiens
gaaauugccaggacuucuu

SEQ ID NO: 292191 - RNA, 19 nt, Homo sapiens
ccagggagccggucacaaa

SEQ ID NO: 292192 - RNA, 19 nt, Homo sapiens
cauaauaacagcaguggaa

SEQ ID NO: 292193 - RNA, 19 nt, Homo sapiens
gggacaggcugacaaguag

SEQ ID NO: 292194 - RNA, 19 nt, Homo sapiens
ucacacauagugcuguuua

SEQ ID NO: 292195 - RNA, 19 nt, Homo sapiens
gugaaaguccugcaccaua

SEQ ID NO: 292196 - RNA, 19 nt, Homo sapiens
gaggagcauugaaggagaa

SEQ ID NO: 292197 - RNA, 19 nt, Homo sapiens
gcagggaacucuggcaucu

SEQ ID NO: 292198 - RNA, 19 nt, Homo sapiens
ccaagggcccucauugaaa

SEQ ID NO: 292199 - RNA, 19 nt, Homo sapiens
ggacuucuuucccgugauc

SEQ ID NO: 292200 - RNA, 19 nt, Homo sapiens
gugaguuucuguucuguug

SEQ ID NO: 292201 - RNA, 19 nt, Homo sapiens
ggaagaugguugaguuggu

SEQ ID NO: 292202 - RNA, 19 nt, Homo sapiens
gcauccaaguuuaugaaug

SEQ ID NO: 292203 - RNA, 19 nt, Homo sapiens
gagaaccucacauuuccua

SEQ ID NO: 292204 - RNA, 19 nt, Homo sapiens
cagcaaagccuccgaguac

SEQ ID NO: 292205 - RNA, 19 nt, Homo sapiens
gggaguugaugaccuuguu

SEQ ID NO: 292206 - RNA, 19 nt, Homo sapiens
gcacugcaagccugaagaa

SEQ ID NO: 292207 - RNA, 19 nt, Homo sapiens
gcagucagcauucuuagca

SEQ ID NO: 292208 - RNA, 19 nt, Homo sapiens
gagagagggagaagaguga

SEQ ID NO: 292209 - RNA, 19 nt, Homo sapiens
caagggcccucauugaaac

SEQ ID NO: 292210 - RNA, 19 nt, Homo sapiens
gauaaucguccuggccaua

SEQ ID NO: 292211 - RNA, 19 nt, Homo sapiens
gcaaagccuccgaguacuu

SEQ ID NO: 292212 - RNA, 19 nt, Homo sapiens
gcagcaaucaguaggaaga

SEQ ID NO: 292213 - RNA, 19 nt, Homo sapiens
gugaacgaauuagcaguaa

SEQ ID NO: 292214 - RNA, 19 nt, Homo sapiens
ugaaaguccugcaccauac

SEQ ID NO: 292215 - RNA, 19 nt, Homo sapiens
acacauagugcuguuuaua

SEQ ID NO: 292216 - RNA, 19 nt, Homo sapiens
gaacgaauuagcaguaaaa

SEQ ID NO: 292217 - RNA, 19 nt, Homo sapiens
uaauaacagcaguggaaua

SEQ ID NO: 292218 - RNA, 19 nt, Homo sapiens
ucagggaguugaugaccuu

SEQ ID NO: 292219 - RNA, 19 nt, Homo sapiens
gcccauuccugccucuuug

SEQ ID NO: 292220 - RNA, 19 nt, Homo sapiens
uaacaaaugguuggaugaa

SEQ ID NO: 292221 - RNA, 19 nt, Homo sapiens
guggagaaccucacauuuc

SEQ ID NO: 292222 - RNA, 19 nt, Homo sapiens
ugguugaguugguucauuu

SEQ ID NO: 292223 - RNA, 19 nt, Homo sapiens
ccuauauugugaacgaauu

SEQ ID NO: 292224 - RNA, 19 nt, Homo sapiens
ggaugacuuugagauuuau

SEQ ID NO: 292225 - RNA, 19 nt, Homo sapiens
ugaaaccagcuaugugaaa

SEQ ID NO: 292226 - RNA, 19 nt, Homo sapiens
ccuuauaccucagucuauu

SEQ ID NO: 292227 - RNA, 19 nt, Homo sapiens
gaguuucuguucuguugga

SEQ ID NO: 292228 - RNA, 19 nt, Homo sapiens
gcuggagaguguccucaga

SEQ ID NO: 292229 - RNA, 19 nt, Homo sapiens
ggucacaaaggcagaaaug

SEQ ID NO: 292230 - RNA, 19 nt, Homo sapiens
ugaacgaauuagcaguaaa

SEQ ID NO: 292231 - RNA, 19 nt, Homo sapiens
uuggaugacuuugagauuu

SEQ ID NO: 292232 - RNA, 19 nt, Homo sapiens
gguggagaaccucacauuu

SEQ ID NO: 292233 - RNA, 19 nt, Homo sapiens
acaaaugguuggaugaacu

SEQ ID NO: 292234 - RNA, 19 nt, Homo sapiens
gucgacagaugcagugguu

SEQ ID NO: 292235 - RNA, 19 nt, Homo sapiens
uggagaguguccucagaaa

SEQ ID NO: 292236 - RNA, 19 nt, Homo sapiens
aauaacagcaguggaauau

SEQ ID NO: 292237 - RNA, 19 nt, Homo sapiens
gagcauugaaggagaagau

SEQ ID NO: 292238 - RNA, 19 nt, Homo sapiens
uggaauuguucaaauguuc

SEQ ID NO: 292239 - RNA, 19 nt, Homo sapiens
uccacugccucgugugaua

SEQ ID NO: 292240 - RNA, 19 nt, Homo sapiens
caaagccuccgaguacuug

SEQ ID NO: 292241 - RNA, 19 nt, Homo sapiens
agaguguccucagaaauug

SEQ ID NO: 292242 - RNA, 19 nt, Homo sapiens
ggagaguguccucagaaau

SEQ ID NO: 292243 - RNA, 19 nt, Homo sapiens
ucuaggaucugccaagcau

SEQ ID NO: 292244 - RNA, 19 nt, Homo sapiens
cacauagugcuguuuauau

SEQ ID NO: 292245 - RNA, 19 nt, Homo sapiens
agagcagucagcauucuua

SEQ ID NO: 292246 - RNA, 19 nt, Homo sapiens
accaucaacuacacucuuu

SEQ ID NO: 292247 - RNA, 19 nt, Homo sapiens
auaccucagucuauuaugu

SEQ ID NO: 292248 - RNA, 19 nt, Homo sapiens
guuaauucuugccuuauac

SEQ ID NO: 292249 - RNA, 19 nt, Homo sapiens
gcaugaacgggcuuugaga

SEQ ID NO: 292250 - RNA, 19 nt, Homo sapiens
aaagaucgguggagaaccu

SEQ ID NO: 292251 - RNA, 19 nt, Homo sapiens
gaaaguccugcaccauaca

SEQ ID NO: 292252 - RNA, 19 nt, Homo sapiens
cgaauuagcaguaaaauac

SEQ ID NO: 292253 - RNA, 19 nt, Homo sapiens
ggaguugaugaccuuguuu

SEQ ID NO: 292254 - RNA, 19 nt, Homo sapiens
caaaugguuggaugaacuu

SEQ ID NO: 292255 - RNA, 19 nt, Homo sapiens
uuucuguucuguuggauga

SEQ ID NO: 292256 - RNA, 19 nt, Homo sapiens
gguccaagggcccucauug

SEQ ID NO: 292257 - RNA, 19 nt, Homo sapiens
gggcgacaaucaggucaug

SEQ ID NO: 292258 - RNA, 19 nt, Homo sapiens
gccuccagcuucucgacua

SEQ ID NO: 292259 - RNA, 19 nt, Homo sapiens
gcaguaaaauacaugauac

SEQ ID NO: 292260 - RNA, 19 nt, Homo sapiens
cagcauccaaguuuaugaa

SEQ ID NO: 292261 - RNA, 19 nt, Homo sapiens
guacuugcagcuggucuuu

SEQ ID NO: 292262 - RNA, 19 nt, Homo sapiens
agggaacucuggcaucuca

SEQ ID NO: 292263 - RNA, 19 nt, Homo sapiens
cgacuaccaucaacuacac

SEQ ID NO: 292264 - RNA, 19 nt, Homo sapiens
guccaagggcccucauuga

SEQ ID NO: 292265 - RNA, 19 nt, Homo sapiens
gcacuggaggagcauugaa

SEQ ID NO: 292266 - RNA, 19 nt, Homo sapiens
aagcagcaaucaguaggaa

SEQ ID NO: 292267 - RNA, 19 nt, Homo sapiens
ucagcaaagccuccgagua

SEQ ID NO: 292268 - RNA, 19 nt, Homo sapiens
uaccucagucuauuaugua

SEQ ID NO: 292269 - RNA, 19 nt, Homo sapiens
ugugaacgaauuagcagua

SEQ ID NO: 292270 - RNA, 19 nt, Homo sapiens
uguuggaauuguucaaaug

SEQ ID NO: 292271 - RNA, 19 nt, Homo sapiens
cuuauaccucagucuauua

SEQ ID NO: 292272 - RNA, 19 nt, Homo sapiens
guggagagccugagguucu

SEQ ID NO: 292273 - RNA, 19 nt, Homo sapiens
gcaccauacacuaaagauc

SEQ ID NO: 292274 - RNA, 19 nt, Homo sapiens
guccugcaccauacacuaa

SEQ ID NO: 292275 - RNA, 19 nt, Homo sapiens
cccgugaucuucagcaaag

SEQ ID NO: 292276 - RNA, 19 nt, Homo sapiens
ucagcauucuuagcaguga

SEQ ID NO: 292277 - RNA, 19 nt, Homo sapiens
gcagucagcauucuuagua

SEQ ID NO: 292278 - RNA, 19 nt, Homo sapiens
caagcgaaauuaaaucuga

SEQ ID NO: 292279 - RNA, 19 nt, Homo sapiens
gcaauaacauacaugagau

SEQ ID NO: 292280 - RNA, 19 nt, Homo sapiens
gaggagcacugaaggagaa

SEQ ID NO: 292281 - RNA, 19 nt, Homo sapiens
guaggaagguggccgaguu

SEQ ID NO: 292282 - RNA, 19 nt, Homo sapiens
gagaaugcaagcgaaauua

SEQ ID NO: 292283 - RNA, 19 nt, Homo sapiens
ggauuuccuugacuucuuu

SEQ ID NO: 292284 - RNA, 19 nt, Homo sapiens
ugaaaguccugcaccauau

SEQ ID NO: 292285 - RNA, 19 nt, Homo sapiens
gaagcgagcagucagcauu

SEQ ID NO: 292286 - RNA, 19 nt, Homo sapiens
gaaaccagcuaugugaaag

SEQ ID NO: 292287 - RNA, 19 nt, Homo sapiens
gaaugcaagcgaaauuaaa

SEQ ID NO: 292288 - RNA, 19 nt, Homo sapiens
ccagggagccggucacaaa

SEQ ID NO: 292289 - RNA, 19 nt, Homo sapiens
cauccagguuuaugaauga

SEQ ID NO: 292290 - RNA, 19 nt, Homo sapiens
gggaggagcugaguguguu

SEQ ID NO: 292291 - RNA, 19 nt, Homo sapiens
gcauccagguuuaugaaug

SEQ ID NO: 292292 - RNA, 19 nt, Homo sapiens
guaccucaaucuauucugu

SEQ ID NO: 292293 - RNA, 19 nt, Homo sapiens
ucacacauagugcuguuua

SEQ ID NO: 292294 - RNA, 19 nt, Homo sapiens
gugaaaguccugcaccaua

SEQ ID NO: 292295 - RNA, 19 nt, Homo sapiens
gauccugcauguuaugaau

SEQ ID NO: 292296 - RNA, 19 nt, Homo sapiens
gaagguggccgaguugguu

SEQ ID NO: 292297 - RNA, 19 nt, Homo sapiens
uuggaugacuuugagauua

SEQ ID NO: 292298 - RNA, 19 nt, Homo sapiens
caguauuucuuuccuguga

SEQ ID NO: 292299 - RNA, 19 nt, Homo sapiens
gcacugcaagccugaagaa

SEQ ID NO: 292300 - RNA, 19 nt, Homo sapiens
cgaauuagcaauaacauac

SEQ ID NO: 292301 - RNA, 19 nt, Homo sapiens
gauaaucguccuggccaua

SEQ ID NO: 292302 - RNA, 19 nt, Homo sapiens
ggagugucgucggaaauug

SEQ ID NO: 292303 - RNA, 19 nt, Homo sapiens
ccuuguaccucaaucuauu

SEQ ID NO: 292304 - RNA, 19 nt, Homo sapiens
gcgaauuagcaauaacaua

SEQ ID NO: 292305 - RNA, 19 nt, Homo sapiens
guugaaaccagcuauguga

SEQ ID NO: 292306 - RNA, 19 nt, Homo sapiens
acacauagugcuguuuaua

SEQ ID NO: 292307 - RNA, 19 nt, Homo sapiens
cgagcagucagcauucuua

SEQ ID NO: 292308 - RNA, 19 nt, Homo sapiens
ggcccauucuucacucuuu

SEQ ID NO: 292309 - RNA, 19 nt, Homo sapiens
gugagcgaauuagcaauaa

SEQ ID NO: 292310 - RNA, 19 nt, Homo sapiens
ggaugacuuugagauuauu

SEQ ID NO: 292311 - RNA, 19 nt, Homo sapiens
caagggcccucguugaaac

SEQ ID NO: 292312 - RNA, 19 nt, Homo sapiens
uggccgaguugguucauuu

SEQ ID NO: 292313 - RNA, 19 nt, Homo sapiens
uggaugacuuugagauuau

SEQ ID NO: 292314 - RNA, 19 nt, Homo sapiens
gaaaguccugcaccauaug

SEQ ID NO: 292315 - RNA, 19 nt, Homo sapiens
caaauugggaaauccauuc

SEQ ID NO: 292316 - RNA, 19 nt, Homo sapiens
ugaaaccagcuaugugaaa

SEQ ID NO: 292317 - RNA, 19 nt, Homo sapiens
ccugugaucuucagcaaag

SEQ ID NO: 292318 - RNA, 19 nt, Homo sapiens
guggguuucuguucuguug

SEQ ID NO: 292319 - RNA, 19 nt, Homo sapiens
ggucacaaaggcagaaaug

SEQ ID NO: 292320 - RNA, 19 nt, Homo sapiens
gcgucagcauccagguuua

SEQ ID NO: 292321 - RNA, 19 nt, Homo sapiens
aagcagcacucaguaggaa

SEQ ID NO: 292322 - RNA, 19 nt, Homo sapiens
agaaugcaagcgaaauuaa

SEQ ID NO: 292323 - RNA, 19 nt, Homo sapiens
gagcgaauuagcaauaaca

SEQ ID NO: 292324 - RNA, 19 nt, Homo sapiens
guaguggguuucuguucug

SEQ ID NO: 292325 - RNA, 19 nt, Homo sapiens
ggaggagcugaguguguua

SEQ ID NO: 292326 - RNA, 19 nt, Homo sapiens
ugagaaugcaagcgaaauu

SEQ ID NO: 292327 - RNA, 19 nt, Homo sapiens
gacgugaggcccauucuuc

SEQ ID NO: 292328 - RNA, 19 nt, Homo sapiens
cgucggaaauuggcaguau

SEQ ID NO: 292329 - RNA, 19 nt, Homo sapiens
ggacuccagcaaccaagaa

SEQ ID NO: 292330 - RNA, 19 nt, Homo sapiens
ugugagcgaauuagcaaua

SEQ ID NO: 292331 - RNA, 19 nt, Homo sapiens
cacauagugcuguuuauau

SEQ ID NO: 292332 - RNA, 19 nt, Homo sapiens
uguuggaguuguucaaaug

SEQ ID NO: 292333 - RNA, 19 nt, Homo sapiens
ccaagggcccucguugaaa

SEQ ID NO: 292334 - RNA, 19 nt, Homo sapiens
gagauaacucaagaaauca

SEQ ID NO: 292335 - RNA, 19 nt, Homo sapiens
uuuaacggaugguugaaug

SEQ ID NO: 292336 - RNA, 19 nt, Homo sapiens
uuucuguucuguuggauga

SEQ ID NO: 292337 - RNA, 19 nt, Homo sapiens
uuacucaaauugggaaauc

SEQ ID NO: 292338 - RNA, 19 nt, Homo sapiens
gcacugaaggagaagaucu

SEQ ID NO: 292339 - RNA, 19 nt, Homo sapiens
guauuucuuuccugugauc

SEQ ID NO: 292340 - RNA, 19 nt, Homo sapiens
gggagugucgucggaaauu

SEQ ID NO: 292341 - RNA, 19 nt, Homo sapiens
caaauaugcaaaccaggau

SEQ ID NO: 292342 - RNA, 19 nt, Homo sapiens
cagcauccagguuuaugaa

SEQ ID NO: 292343 - RNA, 19 nt, Homo sapiens
gcccauucuucacucuuug

SEQ ID NO: 292344 - RNA, 19 nt, Homo sapiens
agaagcugcucacccaaca

SEQ ID NO: 292345 - RNA, 19 nt, Homo sapiens
gcaaagcuuccaguuccuu

SEQ ID NO: 292346 - RNA, 19 nt, Homo sapiens
ggguuucuguucuguugga

SEQ ID NO: 292347 - RNA, 19 nt, Homo sapiens
uuccuugacuucuuugaga

SEQ ID NO: 292348 - RNA, 19 nt, Homo sapiens
aauaugcaaaccaggauuu

SEQ ID NO: 292349 - RNA, 19 nt, Homo sapiens
gucggaaauuggcaguauu

SEQ ID NO: 292350 - RNA, 19 nt, Homo sapiens
agcaauaacauacaugaga

SEQ ID NO: 292351 - RNA, 19 nt, Homo sapiens
ucaaauugggaaauccauu

SEQ ID NO: 292352 - RNA, 19 nt, Homo sapiens
gagcgucagcauccagguu

SEQ ID NO: 292353 - RNA, 19 nt, Homo sapiens
gagauuauucuuuguuucc

SEQ ID NO: 292354 - RNA, 19 nt, Homo sapiens
gccagugggucuccauugc

SEQ ID NO: 292355 - RNA, 19 nt, Homo sapiens
cagugauccugcauguuau

SEQ ID NO: 292356 - RNA, 19 nt, Homo sapiens
ggagcugaguguguuagag

SEQ ID NO: 292357 - RNA, 19 nt, Homo sapiens
uaaucguccuggccauaau

SEQ ID NO: 292358 - RNA, 19 nt, Homo sapiens
gcaagcgaaauuaaaucug

SEQ ID NO: 292359 - RNA, 19 nt, Homo sapiens
uggaguuguucaaauguuc

SEQ ID NO: 292360 - RNA, 19 nt, Homo sapiens
caagcagcacucaguagga

SEQ ID NO: 292361 - RNA, 19 nt, Homo sapiens
gagcacugaaggagaagau

SEQ ID NO: 292362 - RNA, 19 nt, Homo sapiens
gacaguagucacacauagu

SEQ ID NO: 292363 - RNA, 19 nt, Homo sapiens
guuuaugaaugacaguagu

SEQ ID NO: 292364 - RNA, 19 nt, Homo sapiens
guuggaugacuuugagauu

SEQ ID NO: 292365 - RNA, 19 nt, Homo sapiens
uccaagggcccucguugaa

SEQ ID NO: 292366 - RNA, 19 nt, Homo sapiens
ccuugcagcuggucuuugg

SEQ ID NO: 292367 - RNA, 19 nt, Homo sapiens
ucacaaaggcagaaaugcu

SEQ ID NO: 292368 - RNA, 19 nt, Homo sapiens
ggaagguggccgaguuggu

SEQ ID NO: 292369 - RNA, 19 nt, Homo sapiens
ccucuucuacucuaguuga

SEQ ID NO: 292370 - RNA, 19 nt, Homo sapiens
gcugcucacccaacauuuc

SEQ ID NO: 292371 - RNA, 19 nt, Homo sapiens
aguugauucuugccuugua

SEQ ID NO: 292372 - RNA, 19 nt, Homo sapiens
cauagugcuguuuauauag

SEQ ID NO: 292373 - RNA, 19 nt, Homo sapiens
cacacauagugcuguuuau

SEQ ID NO: 292374 - RNA, 19 nt, Homo sapiens
gagucaucaugccucuuga

SEQ ID NO: 292375 - RNA, 19 nt, Homo sapiens
gaaugagcgucagcaucca

SEQ ID NO: 292376 - RNA, 19 nt, Homo sapiens
guuguucaaauguuccuuu

SEQ ID NO: 292377 - RNA, 19 nt, Homo sapiens
ccaaggagcuggucacaaa

SEQ ID NO: 292378 - RNA, 19 nt, Homo sapiens
ggaaacugcucacccaaga

SEQ ID NO: 292379 - RNA, 19 nt, Homo sapiens
guaacaagguggaugaguu

SEQ ID NO: 292380 - RNA, 19 nt, Homo sapiens
caagacaggccuucugaua

SEQ ID NO: 292381 - RNA, 19 nt, Homo sapiens
gagaagcacucaguaacaa

SEQ ID NO: 292382 - RNA, 19 nt, Homo sapiens
gcaguggaguaaguauuua

SEQ ID NO: 292383 - RNA, 19 nt, Homo sapiens
uaacagcaguggaguaagu

SEQ ID NO: 292384 - RNA, 19 nt, Homo sapiens
ucagggagccucugccuua

SEQ ID NO: 292385 - RNA, 19 nt, Homo sapiens
uggaugacuuggagauuua

SEQ ID NO: 292386 - RNA, 19 nt, Homo sapiens
gaguaaguauuuagaagug

SEQ ID NO: 292387 - RNA, 19 nt, Homo sapiens
agacaggccuucugauaau

SEQ ID NO: 292388 - RNA, 19 nt, Homo sapiens
gcagagucaucaugucuuc

SEQ ID NO: 292389 - RNA, 19 nt, Homo sapiens
gaaucguaguuaacguaua

SEQ ID NO: 292390 - RNA, 19 nt, Homo sapiens
gaaaccagcuaugugaaag

SEQ ID NO: 292391 - RNA, 19 nt, Homo sapiens
auacuuaauucccgccuua

SEQ ID NO: 292392 - RNA, 19 nt, Homo sapiens
ggaggaagagggagucuga

SEQ ID NO: 292393 - RNA, 19 nt, Homo sapiens
ggagggagcacacugucua

SEQ ID NO: 292394 - RNA, 19 nt, Homo sapiens
ugaaaguccuggagcaugu

SEQ ID NO: 292395 - RNA, 19 nt, Homo sapiens
gcauugacgugaaggaagu

SEQ ID NO: 292396 - RNA, 19 nt, Homo sapiens
gcaaguaucgagccaagga

SEQ ID NO: 292397 - RNA, 19 nt, Homo sapiens
cagaaaugcuggagagagu

SEQ ID NO: 292398 - RNA, 19 nt, Homo sapiens
gcagguacccggcaguaau

SEQ ID NO: 292399 - RNA, 19 nt, Homo sapiens
uaacaagguggaugaguug

SEQ ID NO: 292400 - RNA, 19 nt, Homo sapiens
ggaguaaguauuuagaagu

SEQ ID NO: 292401 - RNA, 19 nt, Homo sapiens
caagggcucuggcugaaac

SEQ ID NO: 292402 - RNA, 19 nt, Homo sapiens
gccugggccuuuccuauga

SEQ ID NO: 292403 - RNA, 19 nt, Homo sapiens
gugaauuugggacauaaua

SEQ ID NO: 292404 - RNA, 19 nt, Homo sapiens
aaacugcucacccaagauu

SEQ ID NO: 292405 - RNA, 19 nt, Homo sapiens
gggaggagcugggugugau

SEQ ID NO: 292406 - RNA, 19 nt, Homo sapiens
gcauccaaguuuaugaauc

SEQ ID NO: 292407 - RNA, 19 nt, Homo sapiens
gaagagggagucugagcau

SEQ ID NO: 292408 - RNA, 19 nt, Homo sapiens
ugaaaccagcuaugugaaa

SEQ ID NO: 292409 - RNA, 19 nt, Homo sapiens
aagacaggccuucugauaa

SEQ ID NO: 292410 - RNA, 19 nt, Homo sapiens
gaaaugcuggagagaguca

SEQ ID NO: 292411 - RNA, 19 nt, Homo sapiens
cauccaaguuuaugaaucg

SEQ ID NO: 292412 - RNA, 19 nt, Homo sapiens
ggucacaaaggcagaaaug

SEQ ID NO: 292413 - RNA, 19 nt, Homo sapiens
aauaacagcaguggaguaa

SEQ ID NO: 292414 - RNA, 19 nt, Homo sapiens
gaaaauagucaguguucuu

SEQ ID NO: 292415 - RNA, 19 nt, Homo sapiens
ggguaauaaucagaucuuu

SEQ ID NO: 292416 - RNA, 19 nt, Homo sapiens
gcacugcaagccugaggaa

SEQ ID NO: 292417 - RNA, 19 nt, Homo sapiens
cagggucaaugcaagaguu

SEQ ID NO: 292418 - RNA, 19 nt, Homo sapiens
gagcagagucaucaugucu

SEQ ID NO: 292419 - RNA, 19 nt, Homo sapiens
uuggaugacuuggagauuu

SEQ ID NO: 292420 - RNA, 19 nt, Homo sapiens
guaauaaucagaucuuucc

SEQ ID NO: 292421 - RNA, 19 nt, Homo sapiens
uaauaacagcaguggagua

SEQ ID NO: 292422 - RNA, 19 nt, Homo sapiens
gaaauguuccuuuuaaugg

SEQ ID NO: 292423 - RNA, 19 nt, Homo sapiens
gcaccaaggagaagaucug

SEQ ID NO: 292424 - RNA, 19 nt, Homo sapiens
caagauugggugcaggaaa

SEQ ID NO: 292425 - RNA, 19 nt, Homo sapiens
gguaauaaucagaucuuuc

SEQ ID NO: 292426 - RNA, 19 nt, Homo sapiens
ccgagucccugaagaugau

SEQ ID NO: 292427 - RNA, 19 nt, Homo sapiens
cgagaagcacucaguaaca

SEQ ID NO: 292428 - RNA, 19 nt, Homo sapiens
gcuggaggcaacccaauga

SEQ ID NO: 292429 - RNA, 19 nt, Homo sapiens
cuucgugaauguaagagaa

SEQ ID NO: 292430 - RNA, 19 nt, Homo sapiens
guaguggguuucuauuuug

SEQ ID NO: 292431 - RNA, 19 nt, Homo sapiens
ucaguaacaagguggauga

SEQ ID NO: 292432 - RNA, 19 nt, Homo sapiens
gccucagucuauucuguaa

SEQ ID NO: 292433 - RNA, 19 nt, Homo sapiens
gaauuugggacauaauaac

SEQ ID NO: 292434 - RNA, 19 nt, Homo sapiens
uaacaugaggcccauucuu

SEQ ID NO: 292435 - RNA, 19 nt, Homo sapiens
gagucaucaugucuucuga

SEQ ID NO: 292436 - RNA, 19 nt, Homo sapiens
guuaacguauauugcuguu

SEQ ID NO: 292437 - RNA, 19 nt, Homo sapiens
cagcauccaaguuuaugaa

SEQ ID NO: 292438 - RNA, 19 nt, Homo sapiens
gaauuaacuucagcaucca

SEQ ID NO: 292439 - RNA, 19 nt, Homo sapiens
aauagucaguguucuuagu

SEQ ID NO: 292440 - RNA, 19 nt, Homo sapiens
agagggagucugagcauga

SEQ ID NO: 292441 - RNA, 19 nt, Homo sapiens
gaugaucuuuggcauugac

SEQ ID NO: 292442 - RNA, 19 nt, Homo sapiens
gcgcugcuuuccugugauc

SEQ ID NO: 292443 - RNA, 19 nt, Homo sapiens
uggaguaaguauuuagaag

SEQ ID NO: 292444 - RNA, 19 nt, Homo sapiens
ggucagggucaaugcaaga

SEQ ID NO: 292445 - RNA, 19 nt, Homo sapiens
gauggccugcuggguaaua

SEQ ID NO: 292446 - RNA, 19 nt, Homo sapiens
augauggccugcuggguaa

SEQ ID NO: 292447 - RNA, 19 nt, Homo sapiens
gcguugaggcccaagaaga

SEQ ID NO: 292448 - RNA, 19 nt, Homo sapiens
guaguuaacguauauugcu

SEQ ID NO: 292449 - RNA, 19 nt, Homo sapiens
guaauccugcgcgcuauga

SEQ ID NO: 292450 - RNA, 19 nt, Homo sapiens
ugacgcagaguccuuguuc

SEQ ID NO: 292451 - RNA, 19 nt, Homo sapiens
ccuuaugccucagucuauu

SEQ ID NO: 292452 - RNA, 19 nt, Homo sapiens
cgugaaauaggugagauaa

SEQ ID NO: 292453 - RNA, 19 nt, Homo sapiens
uaguaguggguuucuauuu

SEQ ID NO: 292454 - RNA, 19 nt, Homo sapiens
ucccuugccucguguaaca

SEQ ID NO: 292455 - RNA, 19 nt, Homo sapiens
ggagucugagcaugaguug

SEQ ID NO: 292456 - RNA, 19 nt, Homo sapiens
gagggagucugagcaugag

SEQ ID NO: 292457 - RNA, 19 nt, Homo sapiens
gaaacugcucacccaagau

SEQ ID NO: 292458 - RNA, 19 nt, Homo sapiens
gacaggccuucugauaauc

SEQ ID NO: 292459 - RNA, 19 nt, Homo sapiens
gaccagcagcuugggauug

SEQ ID NO: 292460 - RNA, 19 nt, Homo sapiens
gugaaauaggugagauaaa

SEQ ID NO: 292461 - RNA, 19 nt, Homo sapiens
ggcccauucuucacucugu

SEQ ID NO: 292462 - RNA, 19 nt, Homo sapiens
cagcaguggaguaaguauu

SEQ ID NO: 292463 - RNA, 19 nt, Homo sapiens
uuugugaauuugggacaua

SEQ ID NO: 292464 - RNA, 19 nt, Homo sapiens
aguaguggguuucuauuuu

SEQ ID NO: 292465 - RNA, 19 nt, Homo sapiens
ugaagaaaauagucagugu

SEQ ID NO: 292466 - RNA, 19 nt, Homo sapiens
gggagcacacugucuaugg

SEQ ID NO: 292467 - RNA, 19 nt, Homo sapiens
uauaugcauaccuggauuu

SEQ ID NO: 292468 - RNA, 19 nt, Homo sapiens
gcccugagcagagucauca

SEQ ID NO: 292469 - RNA, 19 nt, Homo sapiens
gccucugccuuacccacua

SEQ ID NO: 292470 - RNA, 19 nt, Homo sapiens
gaagaaaauagucaguguu

SEQ ID NO: 292471 - RNA, 19 nt, Homo sapiens
gagggagcacacugucuau

SEQ ID NO: 292472 - RNA, 19 nt, Homo sapiens
ccugugaucuucggcaaag

SEQ ID NO: 292473 - RNA, 19 nt, Homo sapiens
gcuggagagagucaucaaa

SEQ ID NO: 292474 - RNA, 19 nt, Homo sapiens
ucacaaaggcagaaaugcu

SEQ ID NO: 292475 - RNA, 19 nt, Homo sapiens
auagucaguguucuuagua

SEQ ID NO: 292476 - RNA, 19 nt, Homo sapiens
gcccauucuucacucuguu

SEQ ID NO: 292477 - RNA, 19 nt, Homo sapiens
gaagagagcagucaacauu

SEQ ID NO: 292478 - RNA, 19 nt, Homo sapiens
caagaguucucauuuccua

SEQ ID NO: 292479 - RNA, 19 nt, Homo sapiens
gagcagcacucaguaagaa

SEQ ID NO: 292480 - RNA, 19 nt, Homo sapiens
gaacuucagcauucaaauu

SEQ ID NO: 292481 - RNA, 19 nt, Homo sapiens
gcagucaacauucuuagua

SEQ ID NO: 292482 - RNA, 19 nt, Homo sapiens
gaaaugugaaugagcagua

SEQ ID NO: 292483 - RNA, 19 nt, Homo sapiens
ggaagcugcucacccaaga

SEQ ID NO: 292484 - RNA, 19 nt, Homo sapiens
ccaggaagcuccagaggau

SEQ ID NO: 292485 - RNA, 19 nt, Homo sapiens
ggauuuccuuggcuucuuu

SEQ ID NO: 292486 - RNA, 19 nt, Homo sapiens
guaguggguuucuguucua

SEQ ID NO: 292487 - RNA, 19 nt, Homo sapiens
ggaggaagagggagucuga

SEQ ID NO: 292488 - RNA, 19 nt, Homo sapiens
gcccagcagugaucccaua

SEQ ID NO: 292489 - RNA, 19 nt, Homo sapiens
caagacgggccuccugaua

SEQ ID NO: 292490 - RNA, 19 nt, Homo sapiens
ucacacauagugcuguuua

SEQ ID NO: 292491 - RNA, 19 nt, Homo sapiens
uggcugacuugauucauuu

SEQ ID NO: 292492 - RNA, 19 nt, Homo sapiens
guggguuucuguucuauug

SEQ ID NO: 292493 - RNA, 19 nt, Homo sapiens
uuacagcaguggaauaagu

SEQ ID NO: 292494 - RNA, 19 nt, Homo sapiens
gacaugaggcccauucuuc

SEQ ID NO: 292495 - RNA, 19 nt, Homo sapiens
ugaccaggaucaccaggaa

SEQ ID NO: 292496 - RNA, 19 nt, Homo sapiens
agacgggccuccugauaau

SEQ ID NO: 292497 - RNA, 19 nt, Homo sapiens
ucaugucucuugagcagaa

SEQ ID NO: 292498 - RNA, 19 nt, Homo sapiens
acacauagugcuguuuaua

SEQ ID NO: 292499 - RNA, 19 nt, Homo sapiens
ggcccauucuucucucuuu

SEQ ID NO: 292500 - RNA, 19 nt, Homo sapiens
uggaugacuuugagauuug

SEQ ID NO: 292501 - RNA, 19 nt, Homo sapiens
gggacaggcugaccaggau

SEQ ID NO: 292502 - RNA, 19 nt, Homo sapiens
guggcugacuugauucauu

SEQ ID NO: 292503 - RNA, 19 nt, Homo sapiens
uuuaaugggugguugaaug

SEQ ID NO: 292504 - RNA, 19 nt, Homo sapiens
aaaugugaaugagcaguaa

SEQ ID NO: 292505 - RNA, 19 nt, Homo sapiens
ccucaaguauuaagucaag

SEQ ID NO: 292506 - RNA, 19 nt, Homo sapiens
gaagagggagucugagcau

SEQ ID NO: 292507 - RNA, 19 nt, Homo sapiens
gaggagcaccaaaggagaa

SEQ ID NO: 292508 - RNA, 19 nt, Homo sapiens
gugaauugggacauaguua

SEQ ID NO: 292509 - RNA, 19 nt, Homo sapiens
ggucacaaaggcagaaaug

SEQ ID NO: 292510 - RNA, 19 nt, Homo sapiens
ugagauuugucuuuguuuc

SEQ ID NO: 292511 - RNA, 19 nt, Homo sapiens
uuggaugacuuugagauuu

SEQ ID NO: 292512 - RNA, 19 nt, Homo sapiens
gcacugcaagccugaggaa

SEQ ID NO: 292513 - RNA, 19 nt, Homo sapiens
gugcauaccuggauuuccu

SEQ ID NO: 292514 - RNA, 19 nt, Homo sapiens
gaauugggacauaguuaca

SEQ ID NO: 292515 - RNA, 19 nt, Homo sapiens
cagggucaaugcaagaguu

SEQ ID NO: 292516 - RNA, 19 nt, Homo sapiens
aaucagaucaugcccaaga

SEQ ID NO: 292517 - RNA, 19 nt, Homo sapiens
gcaaagccuccgaguccuu

SEQ ID NO: 292518 - RNA, 19 nt, Homo sapiens
ugccaucgauuucacucua

SEQ ID NO: 292519 - RNA, 19 nt, Homo sapiens
ggcacucgcugcuugaaag

SEQ ID NO: 292520 - RNA, 19 nt, Homo sapiens
cacauagugcuguuuauau

SEQ ID NO: 292521 - RNA, 19 nt, Homo sapiens
ggaauuguucaaauguuuc

SEQ ID NO: 292522 - RNA, 19 nt, Homo sapiens
gaccagagucgucaugucu

SEQ ID NO: 292523 - RNA, 19 nt, Homo sapiens
gugaugaagguguauguug

SEQ ID NO: 292524 - RNA, 19 nt, Homo sapiens
aagacgggccuccugauaa

SEQ ID NO: 292525 - RNA, 19 nt, Homo sapiens
uuccuuggcuucuuugaga

SEQ ID NO: 292526 - RNA, 19 nt, Homo sapiens
agagagcagucaacauucu

SEQ ID NO: 292527 - RNA, 19 nt, Homo sapiens
ccauucuucucucuuugaa

SEQ ID NO: 292528 - RNA, 19 nt, Homo sapiens
ggaugacuuugagauuugu

SEQ ID NO: 292529 - RNA, 19 nt, Homo sapiens
ggguuucuguucuauugga

SEQ ID NO: 292530 - RNA, 19 nt, Homo sapiens
ccugagaucuucggcaaag

SEQ ID NO: 292531 - RNA, 19 nt, Homo sapiens
uuaaugggugguugaauga

SEQ ID NO: 292532 - RNA, 19 nt, Homo sapiens
cagucaacauucuuaguag

SEQ ID NO: 292533 - RNA, 19 nt, Homo sapiens
agagggagucugagcauga

SEQ ID NO: 292534 - RNA, 19 nt, Homo sapiens
gcgcugcuuuccugagauc

SEQ ID NO: 292535 - RNA, 19 nt, Homo sapiens
gccaucgauuucacucuau

SEQ ID NO: 292536 - RNA, 19 nt, Homo sapiens
gcccauucuucucucuuug

SEQ ID NO: 292537 - RNA, 19 nt, Homo sapiens
ggucagggucaaugcaaga

SEQ ID NO: 292538 - RNA, 19 nt, Homo sapiens
gcugcucacccaagauuug

SEQ ID NO: 292539 - RNA, 19 nt, Homo sapiens
auaaucgucuugggcauga

SEQ ID NO: 292540 - RNA, 19 nt, Homo sapiens
gccugggacuccuaugaug

SEQ ID NO: 292541 - RNA, 19 nt, Homo sapiens
gcuggagagcgucaucaaa

SEQ ID NO: 292542 - RNA, 19 nt, Homo sapiens
aaaugugcauaccuggauu

SEQ ID NO: 292543 - RNA, 19 nt, Homo sapiens
ucuauuggaugacuuugag

SEQ ID NO: 292544 - RNA, 19 nt, Homo sapiens
caagauuuggugcaggaaa

SEQ ID NO: 292545 - RNA, 19 nt, Homo sapiens
agagcagucaacauucuua

SEQ ID NO: 292546 - RNA, 19 nt, Homo sapiens
gcuuauacucagucuauuc

SEQ ID NO: 292547 - RNA, 19 nt, Homo sapiens
gacuuugagauuugucuuu

SEQ ID NO: 292548 - RNA, 19 nt, Homo sapiens
gagagcagucaacauucuu

SEQ ID NO: 292549 - RNA, 19 nt, Homo sapiens
gagcaccaaaggagaagau

SEQ ID NO: 292550 - RNA, 19 nt, Homo sapiens
gagggagucugagcaugag

SEQ ID NO: 292551 - RNA, 19 nt, Homo sapiens
augcaagaguucucauuuc

SEQ ID NO: 292552 - RNA, 19 nt, Homo sapiens
uuucuguucuauuggauga

SEQ ID NO: 292553 - RNA, 19 nt, Homo sapiens
gccagugggucuccauugc

SEQ ID NO: 292554 - RNA, 19 nt, Homo sapiens
uacagcaguggaauaagua

SEQ ID NO: 292555 - RNA, 19 nt, Homo sapiens
ccaucgauuucacucuaug

SEQ ID NO: 292556 - RNA, 19 nt, Homo sapiens
gacaguagucacacauagu

SEQ ID NO: 292557 - RNA, 19 nt, Homo sapiens
gauuugucuuuguuuccuu

SEQ ID NO: 292558 - RNA, 19 nt, Homo sapiens
ucacaaaggcagaaaugcu

SEQ ID NO: 292559 - RNA, 19 nt, Homo sapiens
uugcuuauacucagucuau

SEQ ID NO: 292560 - RNA, 19 nt, Homo sapiens
cgagcagcacucaguaaga

SEQ ID NO: 292561 - RNA, 19 nt, Homo sapiens
cauagugcuguuuauauag

SEQ ID NO: 292562 - RNA, 19 nt, Homo sapiens
cacacauagugcuguuuau

SEQ ID NO: 292563 - RNA, 19 nt, Homo sapiens
gagucgucaugucucuuga

SEQ ID NO: 292564 - RNA, 19 nt, Homo sapiens
gagcagucaacauucuuag

SEQ ID NO: 292565 - RNA, 19 nt, Homo sapiens
ugacaugaggcccauucuu

SEQ ID NO: 292566 - RNA, 19 nt, Homo sapiens
uaagggcuccagcaaccaa

SEQ ID NO: 292567 - RNA, 19 nt, Homo sapiens
aagcugcucacccaagauu

SEQ ID NO: 292568 - RNA, 19 nt, Homo sapiens
ccacugccaucgauuucac

SEQ ID NO: 292569 - RNA, 19 nt, Homo sapiens
gcaccaaaggagaagaucu

SEQ ID NO: 292570 - RNA, 19 nt, Homo sapiens
ucaaguauuaagucaagga

SEQ ID NO: 292571 - RNA, 19 nt, Homo sapiens
cauaguuacagcaguggaa

SEQ ID NO: 292572 - RNA, 19 nt, Homo sapiens
acaguagucacacauagug

SEQ ID NO: 292573 - RNA, 19 nt, Homo sapiens
acuuugagauuugucuuug

SEQ ID NO: 292574 - RNA, 19 nt, Homo sapiens
ccauuaagggcuccagcaa

SEQ ID NO: 292575 - RNA, 19 nt, Homo sapiens
caccaaaggagaagaucug

SEQ ID NO: 292576 - RNA, 19 nt, Homo sapiens
gggcacucgcugcuugaaa

SEQ ID NO: 292577 - RNA, 19 nt, Homo sapiens
gcagucagcauucuuagua

SEQ ID NO: 292578 - RNA, 19 nt, Homo sapiens
guaggaagguggccaaguu

SEQ ID NO: 292579 - RNA, 19 nt, Homo sapiens
caagcgaaauuaaaucuga

SEQ ID NO: 292580 - RNA, 19 nt, Homo sapiens
gcaauaacauacaugagau

SEQ ID NO: 292581 - RNA, 19 nt, Homo sapiens
gaggagcacugaaggagaa

SEQ ID NO: 292582 - RNA, 19 nt, Homo sapiens
gaaauuggcaguacuucuu

SEQ ID NO: 292583 - RNA, 19 nt, Homo sapiens
gagaaugcaagcgaaauua

SEQ ID NO: 292584 - RNA, 19 nt, Homo sapiens
ggauuuccuugacuucuuu

SEQ ID NO: 292585 - RNA, 19 nt, Homo sapiens
ugaaaguccugcaccauau

SEQ ID NO: 292586 - RNA, 19 nt, Homo sapiens
gaagcgagcagucagcauu

SEQ ID NO: 292587 - RNA, 19 nt, Homo sapiens
gaaaccagcuaugugaaag

SEQ ID NO: 292588 - RNA, 19 nt, Homo sapiens
agaagcugcucacccaaua

SEQ ID NO: 292589 - RNA, 19 nt, Homo sapiens
gaaugcaagcgaaauuaaa

SEQ ID NO: 292590 - RNA, 19 nt, Homo sapiens
ccagggagccggucacaaa

SEQ ID NO: 292591 - RNA, 19 nt, Homo sapiens
cauccagguuuaugaauga

SEQ ID NO: 292592 - RNA, 19 nt, Homo sapiens
gggaggagcugaguguguu

SEQ ID NO: 292593 - RNA, 19 nt, Homo sapiens
gcauccagguuuaugaaug

SEQ ID NO: 292594 - RNA, 19 nt, Homo sapiens
cagcaaagcuuccgauucc

SEQ ID NO: 292595 - RNA, 19 nt, Homo sapiens
guaccucaaucuauucugu

SEQ ID NO: 292596 - RNA, 19 nt, Homo sapiens
ucacacauagugcuguuua

SEQ ID NO: 292597 - RNA, 19 nt, Homo sapiens
gugaaaguccugcaccaua

SEQ ID NO: 292598 - RNA, 19 nt, Homo sapiens
ccaagggcccucauugaaa

SEQ ID NO: 292599 - RNA, 19 nt, Homo sapiens
uuggaugacuuugagauua

SEQ ID NO: 292600 - RNA, 19 nt, Homo sapiens
gcacugcaagccugaagaa

SEQ ID NO: 292601 - RNA, 19 nt, Homo sapiens
cgaauuagcaauaacauac

SEQ ID NO: 292602 - RNA, 19 nt, Homo sapiens
caagggcccucauugaaac

SEQ ID NO: 292603 - RNA, 19 nt, Homo sapiens
guacuucuuuccugugauc

SEQ ID NO: 292604 - RNA, 19 nt, Homo sapiens
ggagugucgucggaaauug

SEQ ID NO: 292605 - RNA, 19 nt, Homo sapiens
ccuuguaccucaaucuauu

SEQ ID NO: 292606 - RNA, 19 nt, Homo sapiens
gcgaauuagcaauaacaua

SEQ ID NO: 292607 - RNA, 19 nt, Homo sapiens
acacauagugcuguuuaua

SEQ ID NO: 292608 - RNA, 19 nt, Homo sapiens
cgagcagucagcauucuua

SEQ ID NO: 292609 - RNA, 19 nt, Homo sapiens
ggcccauucuucacucuuu

SEQ ID NO: 292610 - RNA, 19 nt, Homo sapiens
gugagcgaauuagcaauaa

SEQ ID NO: 292611 - RNA, 19 nt, Homo sapiens
ggaugacuuugagauuauu

SEQ ID NO: 292612 - RNA, 19 nt, Homo sapiens
gcaaagcuuccgauuccuu

SEQ ID NO: 292613 - RNA, 19 nt, Homo sapiens
ucccugaccuggagucuga

SEQ ID NO: 292614 - RNA, 19 nt, Homo sapiens
uggaugacuuugagauuau

SEQ ID NO: 292615 - RNA, 19 nt, Homo sapiens
gaaaguccugcaccauaug

SEQ ID NO: 292616 - RNA, 19 nt, Homo sapiens
ugaaaccagcuaugugaaa

SEQ ID NO: 292617 - RNA, 19 nt, Homo sapiens
gauccugcaugcuaugagu

SEQ ID NO: 292618 - RNA, 19 nt, Homo sapiens
gauaaucauccuggccaua

SEQ ID NO: 292619 - RNA, 19 nt, Homo sapiens
ccugugaucuucagcaaag

SEQ ID NO: 292620 - RNA, 19 nt, Homo sapiens
guggguuucuguucuguug

SEQ ID NO: 292621 - RNA, 19 nt, Homo sapiens
ggucacaaaggcagaaaug

SEQ ID NO: 292622 - RNA, 19 nt, Homo sapiens
gcgucagcauccagguuua

SEQ ID NO: 292623 - RNA, 19 nt, Homo sapiens
aagcagcacucaguaggaa

SEQ ID NO: 292624 - RNA, 19 nt, Homo sapiens
agaaugcaagcgaaauuaa

SEQ ID NO: 292625 - RNA, 19 nt, Homo sapiens
gagcgaauuagcaauaaca

SEQ ID NO: 292626 - RNA, 19 nt, Homo sapiens
guaguggguuucuguucug

SEQ ID NO: 292627 - RNA, 19 nt, Homo sapiens
ggaggagcugaguguguua

SEQ ID NO: 292628 - RNA, 19 nt, Homo sapiens
aaucagaucaugcccaaga

SEQ ID NO: 292629 - RNA, 19 nt, Homo sapiens
ugagaaugcaagcgaaauu

SEQ ID NO: 292630 - RNA, 19 nt, Homo sapiens
gacgugaggcccauucuuc

SEQ ID NO: 292631 - RNA, 19 nt, Homo sapiens
caguacuucuuuccuguga

SEQ ID NO: 292632 - RNA, 19 nt, Homo sapiens
ggacuccagcaaccaagaa

SEQ ID NO: 292633 - RNA, 19 nt, Homo sapiens
ugugagcgaauuagcaaua

SEQ ID NO: 292634 - RNA, 19 nt, Homo sapiens
cacauagugcuguuuauau

SEQ ID NO: 292635 - RNA, 19 nt, Homo sapiens
uguuggaguuguucaaaug

SEQ ID NO: 292636 - RNA, 19 nt, Homo sapiens
gagauaacucaagaaauca

SEQ ID NO: 292637 - RNA, 19 nt, Homo sapiens
uuuaacggaugguugaaug

SEQ ID NO: 292638 - RNA, 19 nt, Homo sapiens
uuucuguucuguuggauga

SEQ ID NO: 292639 - RNA, 19 nt, Homo sapiens
gguccaagggcccucauug

SEQ ID NO: 292640 - RNA, 19 nt, Homo sapiens
gaagcugcucacccaauau

SEQ ID NO: 292641 - RNA, 19 nt, Homo sapiens
gcacugaaggagaagaucu

SEQ ID NO: 292642 - RNA, 19 nt, Homo sapiens
gggagugucgucggaaauu

SEQ ID NO: 292643 - RNA, 19 nt, Homo sapiens
ccuacccacuccugcauga

SEQ ID NO: 292644 - RNA, 19 nt, Homo sapiens
guccaagggcccucauuga

SEQ ID NO: 292645 - RNA, 19 nt, Homo sapiens
ggaaauuggcaguacuucu

SEQ ID NO: 292646 - RNA, 19 nt, Homo sapiens
caaauaugcaaaccaggau

SEQ ID NO: 292647 - RNA, 19 nt, Homo sapiens
cagcauccagguuuaugaa

SEQ ID NO: 292648 - RNA, 19 nt, Homo sapiens
gcccauucuucacucuuug

SEQ ID NO: 292649 - RNA, 19 nt, Homo sapiens
auaaucauccuggccauaa

SEQ ID NO: 292650 - RNA, 19 nt, Homo sapiens
ggguuucuguucuguugga

SEQ ID NO: 292651 - RNA, 19 nt, Homo sapiens
uaaucauccuggccauaau

SEQ ID NO: 292652 - RNA, 19 nt, Homo sapiens
uuccuugacuucuuugaga

SEQ ID NO: 292653 - RNA, 19 nt, Homo sapiens
ggccacguguacaucuuug

SEQ ID NO: 292654 - RNA, 19 nt, Homo sapiens
aaauuggcaguacuucuuu

SEQ ID NO: 292655 - RNA, 19 nt, Homo sapiens
aauaugcaaaccaggauuu

SEQ ID NO: 292656 - RNA, 19 nt, Homo sapiens
uccaagggcccucauugaa

SEQ ID NO: 292657 - RNA, 19 nt, Homo sapiens
agcaauaacauacaugaga

SEQ ID NO: 292658 - RNA, 19 nt, Homo sapiens
gccagugggucuccauugc

SEQ ID NO: 292659 - RNA, 19 nt, Homo sapiens
gagcgucagcauccagguu

SEQ ID NO: 292660 - RNA, 19 nt, Homo sapiens
gagauuauucuuuguuucc

SEQ ID NO: 292661 - RNA, 19 nt, Homo sapiens
gcugcucacccaauauuuc

SEQ ID NO: 292662 - RNA, 19 nt, Homo sapiens
ggagcugaguguguuagag

SEQ ID NO: 292663 - RNA, 19 nt, Homo sapiens
gcaagcgaaauuaaaucug

SEQ ID NO: 292664 - RNA, 19 nt, Homo sapiens
caagcagcacucaguagga

SEQ ID NO: 292665 - RNA, 19 nt, Homo sapiens
uggaguuguucaaauguuc

SEQ ID NO: 292666 - RNA, 19 nt, Homo sapiens
cugcaugagugggcuuuga

SEQ ID NO: 292667 - RNA, 19 nt, Homo sapiens
gacaguagucacacauagu

SEQ ID NO: 292668 - RNA, 19 nt, Homo sapiens
guuuaugaaugacaguagu

SEQ ID NO: 292669 - RNA, 19 nt, Homo sapiens
guuggaugacuuugagauu

SEQ ID NO: 292670 - RNA, 19 nt, Homo sapiens
gagcacugaaggagaagau

SEQ ID NO: 292671 - RNA, 19 nt, Homo sapiens
gcaugagugggcuuugaga

SEQ ID NO: 292672 - RNA, 19 nt, Homo sapiens
cagugauccugcaugcuau

SEQ ID NO: 292673 - RNA, 19 nt, Homo sapiens
aagcugcucacccaauauu

SEQ ID NO: 292674 - RNA, 19 nt, Homo sapiens
ccuugcagcuggucuuugg

SEQ ID NO: 292675 - RNA, 19 nt, Homo sapiens
ucacaaaggcagaaaugcu

SEQ ID NO: 292676 - RNA, 19 nt, Homo sapiens
ccucuucuacucuaguuga

SEQ ID NO: 292677 - RNA, 19 nt, Homo sapiens
gaaaguggcugaguuaguu

SEQ ID NO: 292678 - RNA, 19 nt, Homo sapiens
gaagagagcagucacaguu

SEQ ID NO: 292679 - RNA, 19 nt, Homo sapiens
gaaacaacauagcaguaaa

SEQ ID NO: 292680 - RNA, 19 nt, Homo sapiens
gggaagcacuugaugagaa

SEQ ID NO: 292681 - RNA, 19 nt, Homo sapiens
ggaagcacuugaugagaaa

SEQ ID NO: 292682 - RNA, 19 nt, Homo sapiens
gaauuugcuuggcuucuuu

SEQ ID NO: 292683 - RNA, 19 nt, Homo sapiens
gagcagaggauuaagguuu

SEQ ID NO: 292684 - RNA, 19 nt, Homo sapiens
aagaaccacuuuccugaua

SEQ ID NO: 292685 - RNA, 19 nt, Homo sapiens
ggaagcugcucacccaaga

SEQ ID NO: 292686 - RNA, 19 nt, Homo sapiens
gagaagcacugaagaagac

SEQ ID NO: 292687 - RNA, 19 nt, Homo sapiens
guuccaauguuccuucuaa

SEQ ID NO: 292688 - RNA, 19 nt, Homo sapiens
cagaaaugcuugagagugu

SEQ ID NO: 292689 - RNA, 19 nt, Homo sapiens
ucuaauggaugguguaaug

SEQ ID NO: 292690 - RNA, 19 nt, Homo sapiens
ugagaaaguggcugaguua

SEQ ID NO: 292691 - RNA, 19 nt, Homo sapiens
gaaaccagcuaugugaaag

SEQ ID NO: 292692 - RNA, 19 nt, Homo sapiens
ccacuuuccugauaucuuc

SEQ ID NO: 292693 - RNA, 19 nt, Homo sapiens
caccagggcuuauggaugu

SEQ ID NO: 292694 - RNA, 19 nt, Homo sapiens
aaacccauguuauuucuug

SEQ ID NO: 292695 - RNA, 19 nt, Homo sapiens
gcauugaugugaaggaagu

SEQ ID NO: 292696 - RNA, 19 nt, Homo sapiens
uuaaggagccggucacaaa

SEQ ID NO: 292697 - RNA, 19 nt, Homo sapiens
caagaccggccuccugaua

SEQ ID NO: 292698 - RNA, 19 nt, Homo sapiens
gaaccacuuuccugauauc

SEQ ID NO: 292699 - RNA, 19 nt, Homo sapiens
ccgcaaauaucaaauuaag

SEQ ID NO: 292700 - RNA, 19 nt, Homo sapiens
uagacagacuuacugcuuu

SEQ ID NO: 292701 - RNA, 19 nt, Homo sapiens
cacuuucccugcucuguua

SEQ ID NO: 292702 - RNA, 19 nt, Homo sapiens
ugaaaguccuggagcaugu

SEQ ID NO: 292703 - RNA, 19 nt, Homo sapiens
caggugaucuuuggcauug

SEQ ID NO: 292704 - RNA, 19 nt, Homo sapiens
cuacaagagcagaggauua

SEQ ID NO: 292705 - RNA, 19 nt, Homo sapiens
ggagguuuaucuuuguuuc

SEQ ID NO: 292706 - RNA, 19 nt, Homo sapiens
caacauagcaguaaaauac

SEQ ID NO: 292707 - RNA, 19 nt, Homo sapiens
ugaaacaacauagcaguaa

SEQ ID NO: 292708 - RNA, 19 nt, Homo sapiens
gcaugcaggugaucuuugg

SEQ ID NO: 292709 - RNA, 19 nt, Homo sapiens
gaauucagacacuacaaga

SEQ ID NO: 292710 - RNA, 19 nt, Homo sapiens
gcagucacaguucucagua

SEQ ID NO: 292711 - RNA, 19 nt, Homo sapiens
gcuuauggaugugcagauu

SEQ ID NO: 292712 - RNA, 19 nt, Homo sapiens
ggagaggcaccagggcuua

SEQ ID NO: 292713 - RNA, 19 nt, Homo sapiens
guagacagacuuacugcuu

SEQ ID NO: 292714 - RNA, 19 nt, Homo sapiens
cuccgcaaauaucaaauua

SEQ ID NO: 292715 - RNA, 19 nt, Homo sapiens
caauguuccuucuaaugga

SEQ ID NO: 292716 - RNA, 19 nt, Homo sapiens
uugcuuggcuucuuugaga

SEQ ID NO: 292717 - RNA, 19 nt, Homo sapiens
uacaagagcagaggauuaa

SEQ ID NO: 292718 - RNA, 19 nt, Homo sapiens
ccagagaagcacugaagaa

SEQ ID NO: 292719 - RNA, 19 nt, Homo sapiens
gagucuugcuuuucauuua

SEQ ID NO: 292720 - RNA, 19 nt, Homo sapiens
gaggcaagguucgcagaga

SEQ ID NO: 292721 - RNA, 19 nt, Homo sapiens
caagaguucgcauuuccua

SEQ ID NO: 292722 - RNA, 19 nt, Homo sapiens
ggagggagcacagugucua

SEQ ID NO: 292723 - RNA, 19 nt, Homo sapiens
gagaagcgagggccugguu

SEQ ID NO: 292724 - RNA, 19 nt, Homo sapiens
ugaauuugcuuggcuucuu

SEQ ID NO: 292725 - RNA, 19 nt, Homo sapiens
gggagcauguuggguguga

SEQ ID NO: 292726 - RNA, 19 nt, Homo sapiens
ugaaaccagcuaugugaaa

SEQ ID NO: 292727 - RNA, 19 nt, Homo sapiens
gccugggccucuccuauga

SEQ ID NO: 292728 - RNA, 19 nt, Homo sapiens
uggcugaguuaguucguuu

SEQ ID NO: 292729 - RNA, 19 nt, Homo sapiens
ucccugcucuguuacauga

SEQ ID NO: 292730 - RNA, 19 nt, Homo sapiens
aagagugggugcaggagaa

SEQ ID NO: 292731 - RNA, 19 nt, Homo sapiens
ggagcacagugucuauugg

SEQ ID NO: 292732 - RNA, 19 nt, Homo sapiens
ggucacaaaggcagaaaug

SEQ ID NO: 292733 - RNA, 19 nt, Homo sapiens
uugaggaggugacugauuc

SEQ ID NO: 292734 - RNA, 19 nt, Homo sapiens
gugaaacaacauagcagua

SEQ ID NO: 292735 - RNA, 19 nt, Homo sapiens
gauuuggagguuuaucuuu

SEQ ID NO: 292736 - RNA, 19 nt, Homo sapiens
cagggucaaugcaagaguu

SEQ ID NO: 292737 - RNA, 19 nt, Homo sapiens
ucucucaguuccuguucua

SEQ ID NO: 292738 - RNA, 19 nt, Homo sapiens
ccaauguuccuucuaaugg

SEQ ID NO: 292739 - RNA, 19 nt, Homo sapiens
gagcacagugucuauugga

SEQ ID NO: 292740 - RNA, 19 nt, Homo sapiens
gggagcacagugucuauug

SEQ ID NO: 292741 - RNA, 19 nt, Homo sapiens
agaccggccuccugauaau

SEQ ID NO: 292742 - RNA, 19 nt, Homo sapiens
ggugaucuuuggcauugau

SEQ ID NO: 292743 - RNA, 19 nt, Homo sapiens
gcaggugaucuuuggcauu

SEQ ID NO: 292744 - RNA, 19 nt, Homo sapiens
gaaaugcuugagaguguca

SEQ ID NO: 292745 - RNA, 19 nt, Homo sapiens
ugagucaucaugcuucuug

SEQ ID NO: 292746 - RNA, 19 nt, Homo sapiens
agaaccacuuuccugauau

SEQ ID NO: 292747 - RNA, 19 nt, Homo sapiens
gcuccgcaaauaucaaauu

SEQ ID NO: 292748 - RNA, 19 nt, Homo sapiens
gcaguaaaauacaugagau

SEQ ID NO: 292749 - RNA, 19 nt, Homo sapiens
cucaguuccuguucuauug

SEQ ID NO: 292750 - RNA, 19 nt, Homo sapiens
ggagaggagaaaggaguuu

SEQ ID NO: 292751 - RNA, 19 nt, Homo sapiens
acccaucccugcaugaaga

SEQ ID NO: 292752 - RNA, 19 nt, Homo sapiens
cacaaaggcagaaaugcuu

SEQ ID NO: 292753 - RNA, 19 nt, Homo sapiens
gauucugggucaccaaguc

SEQ ID NO: 292754 - RNA, 19 nt, Homo sapiens
uacccuauguaccugaauu

SEQ ID NO: 292755 - RNA, 19 nt, Homo sapiens
uaauggaugguguaaugaa

SEQ ID NO: 292756 - RNA, 19 nt, Homo sapiens
ugggcgauuuggagguuua

SEQ ID NO: 292757 - RNA, 19 nt, Homo sapiens
guccugggcaugaucuuaa

SEQ ID NO: 292758 - RNA, 19 nt, Homo sapiens
gcaaagccucugagugcau

SEQ ID NO: 292759 - RNA, 19 nt, Homo sapiens
caagaaccacuuuccugau

SEQ ID NO: 292760 - RNA, 19 nt, Homo sapiens
ccacagcugaggagcagaa

SEQ ID NO: 292761 - RNA, 19 nt, Homo sapiens
aggcaagguucgcagagaa

SEQ ID NO: 292762 - RNA, 19 nt, Homo sapiens
ggucagggucaaugcaaga

SEQ ID NO: 292763 - RNA, 19 nt, Homo sapiens
caaaggcagaaaugcuuga

SEQ ID NO: 292764 - RNA, 19 nt, Homo sapiens
uacaugaggcccauucuuc

SEQ ID NO: 292765 - RNA, 19 nt, Homo sapiens
cuauguaccugaauuugcu

SEQ ID NO: 292766 - RNA, 19 nt, Homo sapiens
ugccuuaccuguaccucuu

SEQ ID NO: 292767 - RNA, 19 nt, Homo sapiens
agagaagcacugaagaaga

SEQ ID NO: 292768 - RNA, 19 nt, Homo sapiens
gagaggagaaaggaguuug

SEQ ID NO: 292769 - RNA, 19 nt, Homo sapiens
gaagagucagcgcuacaag

SEQ ID NO: 292770 - RNA, 19 nt, Homo sapiens
augagaaaguggcugaguu

SEQ ID NO: 292771 - RNA, 19 nt, Homo sapiens
caagagcagaggauuaagg

SEQ ID NO: 292772 - RNA, 19 nt, Homo sapiens
uggaugguguaaugaacuu

SEQ ID NO: 292773 - RNA, 19 nt, Homo sapiens
ggcccauucuucacucugu

SEQ ID NO: 292774 - RNA, 19 nt, Homo sapiens
ccacuuucccugcucuguu

SEQ ID NO: 292775 - RNA, 19 nt, Homo sapiens
uggcauugaugugaaggaa

SEQ ID NO: 292776 - RNA, 19 nt, Homo sapiens
accuguaccucuuagugua

SEQ ID NO: 292777 - RNA, 19 nt, Homo sapiens
uaacauagcagaggaauua

SEQ ID NO: 292778 - RNA, 19 nt, Homo sapiens
ucacacauauugcuguuua

SEQ ID NO: 292779 - RNA, 19 nt, Homo sapiens
guaguuaauucuugccuua

SEQ ID NO: 292780 - RNA, 19 nt, Homo sapiens
caagagagcccaucugcua

SEQ ID NO: 292781 - RNA, 19 nt, Homo sapiens
gaagguggcugaguugguu

SEQ ID NO: 292782 - RNA, 19 nt, Homo sapiens
caucgaaguuaaugaauga

SEQ ID NO: 292783 - RNA, 19 nt, Homo sapiens
gaagagagcaaucaguguu

SEQ ID NO: 292784 - RNA, 19 nt, Homo sapiens
ccacaaauaucgagucaag

SEQ ID NO: 292785 - RNA, 19 nt, Homo sapiens
ggaagcugcucacccaaga

SEQ ID NO: 292786 - RNA, 19 nt, Homo sapiens
ucaaggagccggucacaaa

SEQ ID NO: 292787 - RNA, 19 nt, Homo sapiens
aagaagcacugaaauugaa

SEQ ID NO: 292788 - RNA, 19 nt, Homo sapiens
ggauuugcuuggcuucuuu

SEQ ID NO: 292789 - RNA, 19 nt, Homo sapiens
gaacuuagcagcaaaauag

SEQ ID NO: 292790 - RNA, 19 nt, Homo sapiens
cauagcagaggaauuaaua

SEQ ID NO: 292791 - RNA, 19 nt, Homo sapiens
ccaagaagcacugaaauug

SEQ ID NO: 292792 - RNA, 19 nt, Homo sapiens
caagaagcacugaaauuga

SEQ ID NO: 292793 - RNA, 19 nt, Homo sapiens
uggcugaguugguucauuu

SEQ ID NO: 292794 - RNA, 19 nt, Homo sapiens
gagcagcacugacgaagac

SEQ ID NO: 292795 - RNA, 19 nt, Homo sapiens
gagcauguaagagaaauaa

SEQ ID NO: 292796 - RNA, 19 nt, Homo sapiens
ugggugauuuggagauuua

SEQ ID NO: 292797 - RNA, 19 nt, Homo sapiens
gcucauaaagaaauaguga

SEQ ID NO: 292798 - RNA, 19 nt, Homo sapiens
gacaugaggcccauucuuc

SEQ ID NO: 292799 - RNA, 19 nt, Homo sapiens
cggcaaagccuccgaguuc

SEQ ID NO: 292800 - RNA, 19 nt, Homo sapiens
gggacaagauaacauagca

SEQ ID NO: 292801 - RNA, 19 nt, Homo sapiens
ggagcaagagggagucuga

SEQ ID NO: 292802 - RNA, 19 nt, Homo sapiens
ccaucgaaguuaaugaaug

SEQ ID NO: 292803 - RNA, 19 nt, Homo sapiens
gacaguagucacacauauu

SEQ ID NO: 292804 - RNA, 19 nt, Homo sapiens
guuaaugaaugacaguagu

SEQ ID NO: 292805 - RNA, 19 nt, Homo sapiens
acaaauaucgagucaagga

SEQ ID NO: 292806 - RNA, 19 nt, Homo sapiens
gcacugcaagccugaugaa

SEQ ID NO: 292807 - RNA, 19 nt, Homo sapiens
ggucacaaaggcagaaaug

SEQ ID NO: 292808 - RNA, 19 nt, Homo sapiens
caaaauagagcucauaaag

SEQ ID NO: 292809 - RNA, 19 nt, Homo sapiens
acccaucccuuuaugaaga

SEQ ID NO: 292810 - RNA, 19 nt, Homo sapiens
acaguagucacacauauug

SEQ ID NO: 292811 - RNA, 19 nt, Homo sapiens
ggugugauccuaaccaaag

SEQ ID NO: 292812 - RNA, 19 nt, Homo sapiens
aauugaagguggcugaguu

SEQ ID NO: 292813 - RNA, 19 nt, Homo sapiens
ggaguucauguuccaagaa

SEQ ID NO: 292814 - RNA, 19 nt, Homo sapiens
uggaauuguucaaauguuc

SEQ ID NO: 292815 - RNA, 19 nt, Homo sapiens
ugggaagcguugaguguga

SEQ ID NO: 292816 - RNA, 19 nt, Homo sapiens
gaguucauguuccaagaag

SEQ ID NO: 292817 - RNA, 19 nt, Homo sapiens
caagauugggugcaggaaa

SEQ ID NO: 292818 - RNA, 19 nt, Homo sapiens
guuaauucuugccuuauac

SEQ ID NO: 292819 - RNA, 19 nt, Homo sapiens
gaaguuaaugaaugacagu

SEQ ID NO: 292820 - RNA, 19 nt, Homo sapiens
ggcaaagccuccgaguuca

SEQ ID NO: 292821 - RNA, 19 nt, Homo sapiens
gcgcuacuuuccugugauc

SEQ ID NO: 292822 - RNA, 19 nt, Homo sapiens
cuacuuuccugugaucuuc

SEQ ID NO: 292823 - RNA, 19 nt, Homo sapiens
guuccaagaagcacugaaa

SEQ ID NO: 292824 - RNA, 19 nt, Homo sapiens
gaauugggacaagauaaca

SEQ ID NO: 292825 - RNA, 19 nt, Homo sapiens
caccaucgaaguuaaugaa

SEQ ID NO: 292826 - RNA, 19 nt, Homo sapiens
cuggguuccuugucuauug

SEQ ID NO: 292827 - RNA, 19 nt, Homo sapiens
ggcgcuuccuccuccauuu

SEQ ID NO: 292828 - RNA, 19 nt, Homo sapiens
gcugcugggucaucaaguc

SEQ ID NO: 292829 - RNA, 19 nt, Homo sapiens
gugaauugggacaagauaa

SEQ ID NO: 292830 - RNA, 19 nt, Homo sapiens
cuacccaucccuuuaugaa

SEQ ID NO: 292831 - RNA, 19 nt, Homo sapiens
ucaugcaggugaucuuugg

SEQ ID NO: 292832 - RNA, 19 nt, Homo sapiens
gcaaagccuccgaguucau

SEQ ID NO: 292833 - RNA, 19 nt, Homo sapiens
aagcgcuacuuuccuguga

SEQ ID NO: 292834 - RNA, 19 nt, Homo sapiens
gcuggagagcgucaucaaa

SEQ ID NO: 292835 - RNA, 19 nt, Homo sapiens
ucucucuccuguaaaauua

SEQ ID NO: 292836 - RNA, 19 nt, Homo sapiens
ugucaucucuggguuccuu

SEQ ID NO: 292837 - RNA, 19 nt, Homo sapiens
gauccuaaccaaagacaac

SEQ ID NO: 292838 - RNA, 19 nt, Homo sapiens
caaagccuccgaguucaug

SEQ ID NO: 292839 - RNA, 19 nt, Homo sapiens
ucucuggguuccuugucua

SEQ ID NO: 292840 - RNA, 19 nt, Homo sapiens
gaccagagucaucaugucu

SEQ ID NO: 292841 - RNA, 19 nt, Homo sapiens
aaauuacaagcgcuacuuu

SEQ ID NO: 292842 - RNA, 19 nt, Homo sapiens
uccaagaagcacugaaauu

SEQ ID NO: 292843 - RNA, 19 nt, Homo sapiens
cucuuucucucuccuguaa

SEQ ID NO: 292844 - RNA, 19 nt, Homo sapiens
gaggagacccaggcagugu

SEQ ID NO: 292845 - RNA, 19 nt, Homo sapiens
gggaagcguugagugugau

SEQ ID NO: 292846 - RNA, 19 nt, Homo sapiens
ggugaucuuuggcacugau

SEQ ID NO: 292847 - RNA, 19 nt, Homo sapiens
ggcaggccuuggucugaga

SEQ ID NO: 292848 - RNA, 19 nt, Homo sapiens
cugcaagccugaugaagac

SEQ ID NO: 292849 - RNA, 19 nt, Homo sapiens
gagcacacuguaugucauc

SEQ ID NO: 292850 - RNA, 19 nt, Homo sapiens
caagccugaugaagaccuu

SEQ ID NO: 292851 - RNA, 19 nt, Homo sapiens
gcagucaagaagaggaaga

SEQ ID NO: 292852 - RNA, 19 nt, Homo sapiens
gauagcaugcugggugaug

SEQ ID NO: 292853 - RNA, 19 nt, Homo sapiens
cuuggccucucgugcgaua

SEQ ID NO: 292854 - RNA, 19 nt, Homo sapiens
guucaugcaggugaucuuu

SEQ ID NO: 292855 - RNA, 19 nt, Homo sapiens
gagaggacuugggccugau

SEQ ID NO: 292856 - RNA, 19 nt, Homo sapiens
gcgaggaggaggagacuac

SEQ ID NO: 292857 - RNA, 19 nt, Homo sapiens
ggagacccaggcaguguca

SEQ ID NO: 292858 - RNA, 19 nt, Homo sapiens
gcaaaauagagcucauaaa

SEQ ID NO: 292859 - RNA, 19 nt, Homo sapiens
gauaacauagcagaggaau

SEQ ID NO: 292860 - RNA, 19 nt, Homo sapiens
ggucaugcucaaugcaaga

SEQ ID NO: 292861 - RNA, 19 nt, Homo sapiens
ccugugaucuucggcaaag

SEQ ID NO: 292862 - RNA, 19 nt, Homo sapiens
ucacaaaggcagaaaugcu

SEQ ID NO: 292863 - RNA, 19 nt, Homo sapiens
caaggagccggucacaaag

SEQ ID NO: 292864 - RNA, 19 nt, Homo sapiens
ccuguuauuuugugaauug

SEQ ID NO: 292865 - RNA, 19 nt, Homo sapiens
ggaauuguucaaauguucu

SEQ ID NO: 292866 - RNA, 19 nt, Homo sapiens
auucuucgcucuguguuug

SEQ ID NO: 292867 - RNA, 19 nt, Homo sapiens
gugugauccuaaccaaaga

SEQ ID NO: 292868 - RNA, 19 nt, Homo sapiens
agucacacauauugcuguu

SEQ ID NO: 292869 - RNA, 19 nt, Homo sapiens
gugagcacacuguauguca

SEQ ID NO: 292870 - RNA, 19 nt, Homo sapiens
ugacaugaggcccauucuu

SEQ ID NO: 292871 - RNA, 19 nt, Homo sapiens
ucugcuacccaucccuuua

SEQ ID NO: 292872 - RNA, 19 nt, Homo sapiens
aagauugggugcaggaaaa

SEQ ID NO: 292873 - RNA, 19 nt, Homo sapiens
aagcugcucacccaagauu

SEQ ID NO: 292874 - RNA, 19 nt, Homo sapiens
gaucuuuggcacugaugug

SEQ ID NO: 292875 - RNA, 19 nt, Homo sapiens
ccuccuccauuuccgucua

SEQ ID NO: 292876 - RNA, 19 nt, Homo sapiens
ccagagcagcacugacgaa

SEQ ID NO: 292877 - RNA, 19 nt, Homo sapiens
gaagaugagucuccugaaa

SEQ ID NO: 292878 - RNA, 19 nt, Homo sapiens
ggauggagcaccucauuua

SEQ ID NO: 292879 - RNA, 19 nt, Homo sapiens
gagcagcacugaaggagaa

SEQ ID NO: 292880 - RNA, 19 nt, Homo sapiens
gaucacaaaggcagaaaua

SEQ ID NO: 292881 - RNA, 19 nt, Homo sapiens
ccacuucccuuuguuguuu

SEQ ID NO: 292882 - RNA, 19 nt, Homo sapiens
ugaaggagccgaucacaaa

SEQ ID NO: 292883 - RNA, 19 nt, Homo sapiens
acucauauguggaaucuaa

SEQ ID NO: 292884 - RNA, 19 nt, Homo sapiens
gaagugagauagaugaaaa

SEQ ID NO: 292885 - RNA, 19 nt, Homo sapiens
ggaagcugcucacccaaga

SEQ ID NO: 292886 - RNA, 19 nt, Homo sapiens
gggaagcacugaauaugau

SEQ ID NO: 292887 - RNA, 19 nt, Homo sapiens
gaucuucaaucccaaagug

SEQ ID NO: 292888 - RNA, 19 nt, Homo sapiens
caagucaaauaccacauga

SEQ ID NO: 292889 - RNA, 19 nt, Homo sapiens
agaugagucuccugaaauu

SEQ ID NO: 292890 - RNA, 19 nt, Homo sapiens
gaaagaugaggaagagaga

SEQ ID NO: 292891 - RNA, 19 nt, Homo sapiens
cagaaauacuggagagugu

SEQ ID NO: 292892 - RNA, 19 nt, Homo sapiens
ggagguuucugcugaugau

SEQ ID NO: 292893 - RNA, 19 nt, Homo sapiens
gaauugccaccacagauga

SEQ ID NO: 292894 - RNA, 19 nt, Homo sapiens
ccacagagcagcacugaag

SEQ ID NO: 292895 - RNA, 19 nt, Homo sapiens
ccaagauccuucccacugu

SEQ ID NO: 292896 - RNA, 19 nt, Homo sapiens
gcauugauguaaaggaagu

SEQ ID NO: 292897 - RNA, 19 nt, Homo sapiens
gcaagucaaauaccacaug

SEQ ID NO: 292898 - RNA, 19 nt, Homo sapiens
gguaugaggaggcuuugaa

SEQ ID NO: 292899 - RNA, 19 nt, Homo sapiens
gaaauacuggagaguguca

SEQ ID NO: 292900 - RNA, 19 nt, Homo sapiens
uggcauugauguaaaggaa

SEQ ID NO: 292901 - RNA, 19 nt, Homo sapiens
cuccugcuauccucuaaua

SEQ ID NO: 292902 - RNA, 19 nt, Homo sapiens
caagacuggcauucucaua

SEQ ID NO: 292903 - RNA, 19 nt, Homo sapiens
ucaaguaucaaaugaagga

SEQ ID NO: 292904 - RNA, 19 nt, Homo sapiens
cugcaugccugaagaagau

SEQ ID NO: 292905 - RNA, 19 nt, Homo sapiens
gaugggaugcugagugaug

SEQ ID NO: 292906 - RNA, 19 nt, Homo sapiens
gcugaaauuaggaagauga

SEQ ID NO: 292907 - RNA, 19 nt, Homo sapiens
uccaagggcucaugcugaa

SEQ ID NO: 292908 - RNA, 19 nt, Homo sapiens
agucaaauaccacaugauu

SEQ ID NO: 292909 - RNA, 19 nt, Homo sapiens
uggagcaccucauuuaugg

SEQ ID NO: 292910 - RNA, 19 nt, Homo sapiens
gauggagcaccucauuuau

SEQ ID NO: 292911 - RNA, 19 nt, Homo sapiens
ccagaagugagauagauga

SEQ ID NO: 292912 - RNA, 19 nt, Homo sapiens
caagguaaaugggagugau

SEQ ID NO: 292913 - RNA, 19 nt, Homo sapiens
ugacaagaguccagguucu

SEQ ID NO: 292914 - RNA, 19 nt, Homo sapiens
gcucuucaaguaucaaaug

SEQ ID NO: 292915 - RNA, 19 nt, Homo sapiens
aaaugggagugauccaaga

SEQ ID NO: 292916 - RNA, 19 nt, Homo sapiens
guccagagcaugcccaaga

SEQ ID NO: 292917 - RNA, 19 nt, Homo sapiens
cgcaggaucugacaagagu

SEQ ID NO: 292918 - RNA, 19 nt, Homo sapiens
caaaugaaggagccgauca

SEQ ID NO: 292919 - RNA, 19 nt, Homo sapiens
agagagagcccaggacaga

SEQ ID NO: 292920 - RNA, 19 nt, Homo sapiens
ggaagaugagucuccugaa

SEQ ID NO: 292921 - RNA, 19 nt, Homo sapiens
caagggcucaugcugaaau

SEQ ID NO: 292922 - RNA, 19 nt, Homo sapiens
caagauugggugcaggaaa

SEQ ID NO: 292923 - RNA, 19 nt, Homo sapiens
gcccaagacuggcauucuc

SEQ ID NO: 292924 - RNA, 19 nt, Homo sapiens
gcaugcugcuggucuuugg

SEQ ID NO: 292925 - RNA, 19 nt, Homo sapiens
gaugaugagacaccaaauc

SEQ ID NO: 292926 - RNA, 19 nt, Homo sapiens
gaggagguuucugcugaug

SEQ ID NO: 292927 - RNA, 19 nt, Homo sapiens
aaaggcaagucaaauacca

SEQ ID NO: 292928 - RNA, 19 nt, Homo sapiens
guaugaggaggcuuugaaa

SEQ ID NO: 292929 - RNA, 19 nt, Homo sapiens
gggauggagcaccucauuu

SEQ ID NO: 292930 - RNA, 19 nt, Homo sapiens
ugagugauguccagagcau

SEQ ID NO: 292931 - RNA, 19 nt, Homo sapiens
ggucuuuggcauugaugua

SEQ ID NO: 292932 - RNA, 19 nt, Homo sapiens
uugcuucccuuccauuaga

SEQ ID NO: 292933 - RNA, 19 nt, Homo sapiens
ucacaaaggcagaaauacu

SEQ ID NO: 292934 - RNA, 19 nt, Homo sapiens
augaaaaggugacugauuu

SEQ ID NO: 292935 - RNA, 19 nt, Homo sapiens
ggucguugcuucccuucca

SEQ ID NO: 292936 - RNA, 19 nt, Homo sapiens
guaaaugggagugauccaa

SEQ ID NO: 292937 - RNA, 19 nt, Homo sapiens
gaugagucuccugaaauuu

SEQ ID NO: 292938 - RNA, 19 nt, Homo sapiens
cacaaaggcagaaauacug

SEQ ID NO: 292939 - RNA, 19 nt, Homo sapiens
gaaggagccgaucacaaag

SEQ ID NO: 292940 - RNA, 19 nt, Homo sapiens
augaugggaugcugaguga

SEQ ID NO: 292941 - RNA, 19 nt, Homo sapiens
caccacagaugauacuacu

SEQ ID NO: 292942 - RNA, 19 nt, Homo sapiens
gggcucaugcugaaauuag

SEQ ID NO: 292943 - RNA, 19 nt, Homo sapiens
ugggaagcacugaauauga

SEQ ID NO: 292944 - RNA, 19 nt, Homo sapiens
ccacuggccacuccuuugu

SEQ ID NO: 292945 - RNA, 19 nt, Homo sapiens
cugaauaaaguaagacaga

SEQ ID NO: 292946 - RNA, 19 nt, Homo sapiens
ggaagcacugaauaugaug

SEQ ID NO: 292947 - RNA, 19 nt, Homo sapiens
cugcuggucuuuggcauug

SEQ ID NO: 292948 - RNA, 19 nt, Homo sapiens
aguuucugcucuucaagua

SEQ ID NO: 292949 - RNA, 19 nt, Homo sapiens
uuacucauauguggaaucu

SEQ ID NO: 292950 - RNA, 19 nt, Homo sapiens
cagauucuucacuguguuu

SEQ ID NO: 292951 - RNA, 19 nt, Homo sapiens
cuccuacccugaauaaagu

SEQ ID NO: 292952 - RNA, 19 nt, Homo sapiens
gagagcccaggacagaauu

SEQ ID NO: 292953 - RNA, 19 nt, Homo sapiens
agaauugccaccacagaug

SEQ ID NO: 292954 - RNA, 19 nt, Homo sapiens
aagaugagucuccugaaau

SEQ ID NO: 292955 - RNA, 19 nt, Homo sapiens
gacuggcauucucauacuu

SEQ ID NO: 292956 - RNA, 19 nt, Homo sapiens
agacuggcauucucauacu

SEQ ID NO: 292957 - RNA, 19 nt, Homo sapiens
cccugggccucaccuauga

SEQ ID NO: 292958 - RNA, 19 nt, Homo sapiens
gaugaaaaggugacugauu

SEQ ID NO: 292959 - RNA, 19 nt, Homo sapiens
uacccugaauaaaguaaga

SEQ ID NO: 292960 - RNA, 19 nt, Homo sapiens
uagcuucuccuacccugaa

SEQ ID NO: 292961 - RNA, 19 nt, Homo sapiens
gcuggucuuuggcauugau

SEQ ID NO: 292962 - RNA, 19 nt, Homo sapiens
cugcuacccugaucagagu

SEQ ID NO: 292963 - RNA, 19 nt, Homo sapiens
gagagagcccaggacagaa

SEQ ID NO: 292964 - RNA, 19 nt, Homo sapiens
cagaauugccaccacagau

SEQ ID NO: 292965 - RNA, 19 nt, Homo sapiens
gaaccccucuuuucuacag

SEQ ID NO: 292966 - RNA, 19 nt, Homo sapiens
caucugggaagcacugaau

SEQ ID NO: 292967 - RNA, 19 nt, Homo sapiens
ucccuuuguuguuuaguga

SEQ ID NO: 292968 - RNA, 19 nt, Homo sapiens
uuucugcucuucaaguauc

SEQ ID NO: 292969 - RNA, 19 nt, Homo sapiens
ucuccuacccugaauaaag

SEQ ID NO: 292970 - RNA, 19 nt, Homo sapiens
aagauugggugcaggaaaa

SEQ ID NO: 292971 - RNA, 19 nt, Homo sapiens
aagcugcucacccaagauu

SEQ ID NO: 292972 - RNA, 19 nt, Homo sapiens
ucuuuggcauugauguaaa

SEQ ID NO: 292973 - RNA, 19 nt, Homo sapiens
gcugcaugccugaagaaga

SEQ ID NO: 292974 - RNA, 19 nt, Homo sapiens
cacuucccuuuguuguuua

SEQ ID NO: 292975 - RNA, 19 nt, Homo sapiens
cuucuccuacccugaauaa

SEQ ID NO: 292976 - RNA, 19 nt, Homo sapiens
uuugaaagaugaggaagag

SEQ ID NO: 292977 - RNA, 19 nt, Homo sapiens
ggagggaucccacuucuua

SEQ ID NO: 292978 - RNA, 19 nt, Homo sapiens
ggacuacuuuccugagaua

SEQ ID NO: 292979 - RNA, 19 nt, Homo sapiens
gaagggaacacauuguaua

SEQ ID NO: 292980 - RNA, 19 nt, Homo sapiens
gcacugauccugcaugcua

SEQ ID NO: 292981 - RNA, 19 nt, Homo sapiens
gaaaguucuugaguacaua

SEQ ID NO: 292982 - RNA, 19 nt, Homo sapiens
gaggaucacuggaggagaa

SEQ ID NO: 292983 - RNA, 19 nt, Homo sapiens
gaaaucaggcccauucuuc

SEQ ID NO: 292984 - RNA, 19 nt, Homo sapiens
guaugaagaugcuuugaga

SEQ ID NO: 292985 - RNA, 19 nt, Homo sapiens
caacugcucuuuggcauug

SEQ ID NO: 292986 - RNA, 19 nt, Homo sapiens
gaugaaaguucuugaguac

SEQ ID NO: 292987 - RNA, 19 nt, Homo sapiens
gauagacccugaguccuuu

SEQ ID NO: 292988 - RNA, 19 nt, Homo sapiens
guacauagccaaugccaau

SEQ ID NO: 292989 - RNA, 19 nt, Homo sapiens
ccagauauuucccacaguu

SEQ ID NO: 292990 - RNA, 19 nt, Homo sapiens
ggaacugcaucccugaaga

SEQ ID NO: 292991 - RNA, 19 nt, Homo sapiens
caucaugccucuugagcaa

SEQ ID NO: 292992 - RNA, 19 nt, Homo sapiens
gaagucaguguucucagua

SEQ ID NO: 292993 - RNA, 19 nt, Homo sapiens
cuacuuuccugagauauuu

SEQ ID NO: 292994 - RNA, 19 nt, Homo sapiens
uuaguuagcuucaacaucu

SEQ ID NO: 292995 - RNA, 19 nt, Homo sapiens
gggaacacauuguauacug

SEQ ID NO: 292996 - RNA, 19 nt, Homo sapiens
gcauugaugugaaggaagu

SEQ ID NO: 292997 - RNA, 19 nt, Homo sapiens
ggaggacucaggagacuuu

SEQ ID NO: 292998 - RNA, 19 nt, Homo sapiens
caagauauacuacaugaca

SEQ ID NO: 292999 - RNA, 19 nt, Homo sapiens
agaugaaaguucuugagua

SEQ ID NO: 293000 - RNA, 19 nt, Homo sapiens
gagcagagcaugcccaagu

SEQ ID NO: 293001 - RNA, 19 nt, Homo sapiens
ggagggagagggagucuga

SEQ ID NO: 293002 - RNA, 19 nt, Homo sapiens
ugaaaguucuugaguacau

SEQ ID NO: 293003 - RNA, 19 nt, Homo sapiens
gcagggaaaugggccaaug

SEQ ID NO: 293004 - RNA, 19 nt, Homo sapiens
gauaauaguccugggugua

SEQ ID NO: 293005 - RNA, 19 nt, Homo sapiens
gcaugcaacugcucuuugg

SEQ ID NO: 293006 - RNA, 19 nt, Homo sapiens
gaucacaaaggcagaaaug

SEQ ID NO: 293007 - RNA, 19 nt, Homo sapiens
cccaagauauacuacauga

SEQ ID NO: 293008 - RNA, 19 nt, Homo sapiens
ggaagggaacacauuguau

SEQ ID NO: 293009 - RNA, 19 nt, Homo sapiens
gaugagagaagucaguguu

SEQ ID NO: 293010 - RNA, 19 nt, Homo sapiens
gggaaguccugagcauuau

SEQ ID NO: 293011 - RNA, 19 nt, Homo sapiens
cuacaugacaagauaauug

SEQ ID NO: 293012 - RNA, 19 nt, Homo sapiens
aagcugaacugguguugug

SEQ ID NO: 293013 - RNA, 19 nt, Homo sapiens
ugggaaguccugagcauua

SEQ ID NO: 293014 - RNA, 19 nt, Homo sapiens
ucaaggggcugaucacaaa

SEQ ID NO: 293015 - RNA, 19 nt, Homo sapiens
gcuucaacaucuaagugua

SEQ ID NO: 293016 - RNA, 19 nt, Homo sapiens
gaaggcacagugaauggaa

SEQ ID NO: 293017 - RNA, 19 nt, Homo sapiens
gcaucaagaggaagaagaa

SEQ ID NO: 293018 - RNA, 19 nt, Homo sapiens
ggaugauacugaccacaca

SEQ ID NO: 293019 - RNA, 19 nt, Homo sapiens
uaccucgccugaccugaua

SEQ ID NO: 293020 - RNA, 19 nt, Homo sapiens
gaaaaggaggggccaagua

SEQ ID NO: 293021 - RNA, 19 nt, Homo sapiens
ggacucaggagacuuugga

SEQ ID NO: 293022 - RNA, 19 nt, Homo sapiens
aaaauugggugcaggaaaa

SEQ ID NO: 293023 - RNA, 19 nt, Homo sapiens
cugcaucccugaagagguu

SEQ ID NO: 293024 - RNA, 19 nt, Homo sapiens
guauacugccuuuagguuu

SEQ ID NO: 293025 - RNA, 19 nt, Homo sapiens
ccagcaagaugaaaguucu

SEQ ID NO: 293026 - RNA, 19 nt, Homo sapiens
gauccugcaugcuaugagu

SEQ ID NO: 293027 - RNA, 19 nt, Homo sapiens
gcugugauuugcaauaggu

SEQ ID NO: 293028 - RNA, 19 nt, Homo sapiens
uauacugccuuuagguuuc

SEQ ID NO: 293029 - RNA, 19 nt, Homo sapiens
cacauuguauacugccuuu

SEQ ID NO: 293030 - RNA, 19 nt, Homo sapiens
ccacuagccacuccuaugu

SEQ ID NO: 293031 - RNA, 19 nt, Homo sapiens
gcacugcaagccugaggaa

SEQ ID NO: 293032 - RNA, 19 nt, Homo sapiens
gaccacacauguuguuuug

SEQ ID NO: 293033 - RNA, 19 nt, Homo sapiens
guagaaggcacagugaaug

SEQ ID NO: 293034 - RNA, 19 nt, Homo sapiens
gaacugcaucccugaagag

SEQ ID NO: 293035 - RNA, 19 nt, Homo sapiens
caagucuggccuccugaua

SEQ ID NO: 293036 - RNA, 19 nt, Homo sapiens
gacaggagucccaggagaa

SEQ ID NO: 293037 - RNA, 19 nt, Homo sapiens
auacugaccacacauguug

SEQ ID NO: 293038 - RNA, 19 nt, Homo sapiens
gauacugaccacacauguu

SEQ ID NO: 293039 - RNA, 19 nt, Homo sapiens
acccaucccuguaugaaga

SEQ ID NO: 293040 - RNA, 19 nt, Homo sapiens
cccauaugguccacaacua

SEQ ID NO: 293041 - RNA, 19 nt, Homo sapiens
cccucaaccucucuuauga

SEQ ID NO: 293042 - RNA, 19 nt, Homo sapiens
gaagaagagggaggacuca

SEQ ID NO: 293043 - RNA, 19 nt, Homo sapiens
ugauagacccugaguccuu

SEQ ID NO: 293044 - RNA, 19 nt, Homo sapiens
cccaggaucugccaagagu

SEQ ID NO: 293045 - RNA, 19 nt, Homo sapiens
ucgggugacuuggagauuu

SEQ ID NO: 293046 - RNA, 19 nt, Homo sapiens
uggaagggaacacauugua

SEQ ID NO: 293047 - RNA, 19 nt, Homo sapiens
guaguagaaggcacaguga

SEQ ID NO: 293048 - RNA, 19 nt, Homo sapiens
caguuucccuguccugugu

SEQ ID NO: 293049 - RNA, 19 nt, Homo sapiens
agggagcacuuccucuuug

SEQ ID NO: 293050 - RNA, 19 nt, Homo sapiens
gcaacugcucuuuggcauu

SEQ ID NO: 293051 - RNA, 19 nt, Homo sapiens
ccgcaaguaucgagucaag

SEQ ID NO: 293052 - RNA, 19 nt, Homo sapiens
cugaacugguguugugaaa

SEQ ID NO: 293053 - RNA, 19 nt, Homo sapiens
ggacuccaggugagcacua

SEQ ID NO: 293054 - RNA, 19 nt, Homo sapiens
agagggagucugagcauga

SEQ ID NO: 293055 - RNA, 19 nt, Homo sapiens
agucuggccuccugauaau

SEQ ID NO: 293056 - RNA, 19 nt, Homo sapiens
aaagaagucagcacugcaa

SEQ ID NO: 293057 - RNA, 19 nt, Homo sapiens
caacaucuaaguguaugga

SEQ ID NO: 293058 - RNA, 19 nt, Homo sapiens
ggagagggagucugagcau

SEQ ID NO: 293059 - RNA, 19 nt, Homo sapiens
gaaguccugagcauuaugg

SEQ ID NO: 293060 - RNA, 19 nt, Homo sapiens
auaauaguccuggguguaa

SEQ ID NO: 293061 - RNA, 19 nt, Homo sapiens
cucaaccucucuuaugaug

SEQ ID NO: 293062 - RNA, 19 nt, Homo sapiens
ccacuccuauguccuuguc

SEQ ID NO: 293063 - RNA, 19 nt, Homo sapiens
uagggaagccucuguaugc

SEQ ID NO: 293064 - RNA, 19 nt, Homo sapiens
gaccuaaccagagucauca

SEQ ID NO: 293065 - RNA, 19 nt, Homo sapiens
gaucacuggaggagaacaa

SEQ ID NO: 293066 - RNA, 19 nt, Homo sapiens
gggagcacuuccucuuugg

SEQ ID NO: 293067 - RNA, 19 nt, Homo sapiens
gauauacuacaugacaaga

SEQ ID NO: 293068 - RNA, 19 nt, Homo sapiens
guaccucgccugaccugau

SEQ ID NO: 293069 - RNA, 19 nt, Homo sapiens
gaaugugggcacucuagag

SEQ ID NO: 293070 - RNA, 19 nt, Homo sapiens
uaacaauaaagcugaacug

SEQ ID NO: 293071 - RNA, 19 nt, Homo sapiens
cauuucaagugcaaguguu

SEQ ID NO: 293072 - RNA, 19 nt, Homo sapiens
cgggugacuuggagauuuc

SEQ ID NO: 293073 - RNA, 19 nt, Homo sapiens
gagggagucugagcaugag

SEQ ID NO: 293074 - RNA, 19 nt, Homo sapiens
uaauaguccuggguguaau

SEQ ID NO: 293075 - RNA, 19 nt, Homo sapiens
ucaguguucucaguaguag

SEQ ID NO: 293076 - RNA, 19 nt, Homo sapiens
uggcauugaugugaaggaa

SEQ ID NO: 293077 - RNA, 19 nt, Homo sapiens
gaagauggcugaguugguu

SEQ ID NO: 293078 - RNA, 19 nt, Homo sapiens
gaagagagcagucaguauu

SEQ ID NO: 293079 - RNA, 19 nt, Homo sapiens
auaaagaccucaagaaguu

SEQ ID NO: 293080 - RNA, 19 nt, Homo sapiens
gagacgagcuuccaaguag

SEQ ID NO: 293081 - RNA, 19 nt, Homo sapiens
ugaaaguccugcaccauuu

SEQ ID NO: 293082 - RNA, 19 nt, Homo sapiens
guagugaguuucuguucua

SEQ ID NO: 293083 - RNA, 19 nt, Homo sapiens
guaggaagauggcugaguu

SEQ ID NO: 293084 - RNA, 19 nt, Homo sapiens
cauccaaguuuaugaauga

SEQ ID NO: 293085 - RNA, 19 nt, Homo sapiens
ggauauccuuggcuucuuu

SEQ ID NO: 293086 - RNA, 19 nt, Homo sapiens
uggaugacuuugagauuua

SEQ ID NO: 293087 - RNA, 19 nt, Homo sapiens
ggaagcugcucacccaaga

SEQ ID NO: 293088 - RNA, 19 nt, Homo sapiens
ggagugucaucagaaauuu

SEQ ID NO: 293089 - RNA, 19 nt, Homo sapiens
gugaguuucuguucuauug

SEQ ID NO: 293090 - RNA, 19 nt, Homo sapiens
gugaaagaauuagcaguaa

SEQ ID NO: 293091 - RNA, 19 nt, Homo sapiens
gaaaccagcuaugugaaag

SEQ ID NO: 293092 - RNA, 19 nt, Homo sapiens
gauaaagaccucaagaagu

SEQ ID NO: 293093 - RNA, 19 nt, Homo sapiens
uggcugaguugguucauuu

SEQ ID NO: 293094 - RNA, 19 nt, Homo sapiens
gagauaaagaccucaagaa

SEQ ID NO: 293095 - RNA, 19 nt, Homo sapiens
gggaggagcugaguguguu

SEQ ID NO: 293096 - RNA, 19 nt, Homo sapiens
ggagacgagcuuccaagua

SEQ ID NO: 293097 - RNA, 19 nt, Homo sapiens
ggacuucuuuccugugauc

SEQ ID NO: 293098 - RNA, 19 nt, Homo sapiens
ccacuaccaucaacuauac

SEQ ID NO: 293099 - RNA, 19 nt, Homo sapiens
aagcauggauaccuggaua

SEQ ID NO: 293100 - RNA, 19 nt, Homo sapiens
ccuuauaccucacucuauu

SEQ ID NO: 293101 - RNA, 19 nt, Homo sapiens
ucacacauagugcuguuua

SEQ ID NO: 293102 - RNA, 19 nt, Homo sapiens
ccagggagccauucacaaa

SEQ ID NO: 293103 - RNA, 19 nt, Homo sapiens
acaaauaacagcaguggaa

SEQ ID NO: 293104 - RNA, 19 nt, Homo sapiens
gggagugucaucagaaauu

SEQ ID NO: 293105 - RNA, 19 nt, Homo sapiens
gcauccaaguuuaugaaug

SEQ ID NO: 293106 - RNA, 19 nt, Homo sapiens
gaaaguccugcaccauuug

SEQ ID NO: 293107 - RNA, 19 nt, Homo sapiens
cagcaaagccuccgaguac

SEQ ID NO: 293108 - RNA, 19 nt, Homo sapiens
ucagaaauuuccaggacuu

SEQ ID NO: 293109 - RNA, 19 nt, Homo sapiens
gacaugaggcccauucuuc

SEQ ID NO: 293110 - RNA, 19 nt, Homo sapiens
gaaauuuccaggacuucuu

SEQ ID NO: 293111 - RNA, 19 nt, Homo sapiens
gauaaucguccuggccaua

SEQ ID NO: 293112 - RNA, 19 nt, Homo sapiens
gcaaagccuccgaguacuu

SEQ ID NO: 293113 - RNA, 19 nt, Homo sapiens
gcuuagaauugugaaagaa

SEQ ID NO: 293114 - RNA, 19 nt, Homo sapiens
guugaaaccagcuauguga

SEQ ID NO: 293115 - RNA, 19 nt, Homo sapiens
gcaucgaggugguggaagu

SEQ ID NO: 293116 - RNA, 19 nt, Homo sapiens
gaacaggaagggccaagca

SEQ ID NO: 293117 - RNA, 19 nt, Homo sapiens
acacauagugcuguuuaua

SEQ ID NO: 293118 - RNA, 19 nt, Homo sapiens
ggcccauucuucacucuuu

SEQ ID NO: 293119 - RNA, 19 nt, Homo sapiens
gcaagguucugaggagaca

SEQ ID NO: 293120 - RNA, 19 nt, Homo sapiens
gcagucaguauuguuagua

SEQ ID NO: 293121 - RNA, 19 nt, Homo sapiens
caagggcccucguugaaac

SEQ ID NO: 293122 - RNA, 19 nt, Homo sapiens
gaguuucuguucuauugga

SEQ ID NO: 293123 - RNA, 19 nt, Homo sapiens
ugugaaagaauuagcagua

SEQ ID NO: 293124 - RNA, 19 nt, Homo sapiens
gugaaaguccugcaccauu

SEQ ID NO: 293125 - RNA, 19 nt, Homo sapiens
ggaugacuuugagauuuau

SEQ ID NO: 293126 - RNA, 19 nt, Homo sapiens
ugaaaccagcuaugugaaa

SEQ ID NO: 293127 - RNA, 19 nt, Homo sapiens
ccugugaucuucagcaaag

SEQ ID NO: 293128 - RNA, 19 nt, Homo sapiens
caaauaacagcaguggaaa

SEQ ID NO: 293129 - RNA, 19 nt, Homo sapiens
gcacugcaagccugaggaa

SEQ ID NO: 293130 - RNA, 19 nt, Homo sapiens
uuggaugacuuugagauuu

SEQ ID NO: 293131 - RNA, 19 nt, Homo sapiens
uaaagaccucaagaaguua

SEQ ID NO: 293132 - RNA, 19 nt, Homo sapiens
agagcagucaguauuguua

SEQ ID NO: 293133 - RNA, 19 nt, Homo sapiens
caaguagcacucaguagga

SEQ ID NO: 293134 - RNA, 19 nt, Homo sapiens
ggaguaagaguguuguuuu

SEQ ID NO: 293135 - RNA, 19 nt, Homo sapiens
auaccucacucuauucugu

SEQ ID NO: 293136 - RNA, 19 nt, Homo sapiens
uggaauuguucaaauguuc

SEQ ID NO: 293137 - RNA, 19 nt, Homo sapiens
aaucagaucgugcccaaga

SEQ ID NO: 293138 - RNA, 19 nt, Homo sapiens
cagcaacgaagaacaggaa

SEQ ID NO: 293139 - RNA, 19 nt, Homo sapiens
caaagccuccgaguacuug

SEQ ID NO: 293140 - RNA, 19 nt, Homo sapiens
cacauagugcuguuuauau

SEQ ID NO: 293141 - RNA, 19 nt, Homo sapiens
ccaagggcccucguugaaa

SEQ ID NO: 293142 - RNA, 19 nt, Homo sapiens
gagagcagucaguauuguu

SEQ ID NO: 293143 - RNA, 19 nt, Homo sapiens
uuuaacggaugguugaaug

SEQ ID NO: 293144 - RNA, 19 nt, Homo sapiens
gcaguaaaauacaugagau

SEQ ID NO: 293145 - RNA, 19 nt, Homo sapiens
cagcauccaaguuuaugaa

SEQ ID NO: 293146 - RNA, 19 nt, Homo sapiens
uaacggaugguugaaugaa

SEQ ID NO: 293147 - RNA, 19 nt, Homo sapiens
ucaguauuguuaguaguga

SEQ ID NO: 293148 - RNA, 19 nt, Homo sapiens
guacuugcagcuggucuuu

SEQ ID NO: 293149 - RNA, 19 nt, Homo sapiens
aaagaccucaagaaguuaa

SEQ ID NO: 293150 - RNA, 19 nt, Homo sapiens
gcccauucuucacucuuug

SEQ ID NO: 293151 - RNA, 19 nt, Homo sapiens
gcugcucacccaagauuug

SEQ ID NO: 293152 - RNA, 19 nt, Homo sapiens
ucagcaaagccuccgagua

SEQ ID NO: 293153 - RNA, 19 nt, Homo sapiens
agauaaagaccucaagaag

SEQ ID NO: 293154 - RNA, 19 nt, Homo sapiens
uguuggaauuguucaaaug

SEQ ID NO: 293155 - RNA, 19 nt, Homo sapiens
ucuauuggaugacuuugag

SEQ ID NO: 293156 - RNA, 19 nt, Homo sapiens
ccucuacucuaguggaagu

SEQ ID NO: 293157 - RNA, 19 nt, Homo sapiens
ggaagauggcugaguuggu

SEQ ID NO: 293158 - RNA, 19 nt, Homo sapiens
caagauuuggugcaggaaa

SEQ ID NO: 293159 - RNA, 19 nt, Homo sapiens
auccuuggcuucuuugaga

SEQ ID NO: 293160 - RNA, 19 nt, Homo sapiens
agagagcagucaguauugu

SEQ ID NO: 293161 - RNA, 19 nt, Homo sapiens
aaauuuccaggacuucuuu

SEQ ID NO: 293162 - RNA, 19 nt, Homo sapiens
aaguaugugcuuagaauug

SEQ ID NO: 293163 - RNA, 19 nt, Homo sapiens
uuucuguucuauuggauga

SEQ ID NO: 293164 - RNA, 19 nt, Homo sapiens
ugaagagagcagucaguau

SEQ ID NO: 293165 - RNA, 19 nt, Homo sapiens
guagcacucaguaggaaga

SEQ ID NO: 293166 - RNA, 19 nt, Homo sapiens
cugcaccauuugcuaaaga

SEQ ID NO: 293167 - RNA, 19 nt, Homo sapiens
uaaucguccuggccauaau

SEQ ID NO: 293168 - RNA, 19 nt, Homo sapiens
agagucaucaugccacuug

SEQ ID NO: 293169 - RNA, 19 nt, Homo sapiens
aaguagcacucaguaggaa

SEQ ID NO: 293170 - RNA, 19 nt, Homo sapiens
aguaugugcuuagaauugu

SEQ ID NO: 293171 - RNA, 19 nt, Homo sapiens
gacaguagucacacauagu

SEQ ID NO: 293172 - RNA, 19 nt, Homo sapiens
guuuaugaaugacaguagu

SEQ ID NO: 293173 - RNA, 19 nt, Homo sapiens
cccacuaccaucaacuaua

SEQ ID NO: 293174 - RNA, 19 nt, Homo sapiens
uccaagggcccucguugaa

SEQ ID NO: 293175 - RNA, 19 nt, Homo sapiens
ucacaaaggcagaaaugcu

SEQ ID NO: 293176 - RNA, 19 nt, Homo sapiens
gagcagucaguauuguuag

SEQ ID NO: 293177 - RNA, 19 nt, Homo sapiens
caacauaauuggagucuua

SEQ ID NO: 293178 - RNA, 19 nt, Homo sapiens
gaagagaucuggaaauuca

SEQ ID NO: 293179 - RNA, 19 nt, Homo sapiens
gaaagaaccucacacaaca

SEQ ID NO: 293180 - RNA, 19 nt, Homo sapiens
cgacauggaucacacauuu

SEQ ID NO: 293181 - RNA, 19 nt, Homo sapiens
cuagagagaucaucauaua

SEQ ID NO: 293182 - RNA, 19 nt, Homo sapiens
caaguccgauccaguguua

SEQ ID NO: 293183 - RNA, 19 nt, Homo sapiens
guagugagcagccaagaua

SEQ ID NO: 293184 - RNA, 19 nt, Homo sapiens
gaagaggcuuugagagaug

SEQ ID NO: 293185 - RNA, 19 nt, Homo sapiens
gagaggagcacuuaaucua

SEQ ID NO: 293186 - RNA, 19 nt, Homo sapiens
gaugaaaguccucgaguuu

SEQ ID NO: 293187 - RNA, 19 nt, Homo sapiens
gaggagcacuuaaucuaug

SEQ ID NO: 293188 - RNA, 19 nt, Homo sapiens
gcagauuguucacuuuguu

SEQ ID NO: 293189 - RNA, 19 nt, Homo sapiens
ugagagagcccauuaugaa

SEQ ID NO: 293190 - RNA, 19 nt, Homo sapiens
gcacuacugccacgacuuu

SEQ ID NO: 293191 - RNA, 19 nt, Homo sapiens
caaaaggacugugaucaua

SEQ ID NO: 293192 - RNA, 19 nt, Homo sapiens
ucagaaaugugugaaagaa

SEQ ID NO: 293193 - RNA, 19 nt, Homo sapiens
guacaaggaucacuucacu

SEQ ID NO: 293194 - RNA, 19 nt, Homo sapiens
ggacugugaucauaugaag

SEQ ID NO: 293195 - RNA, 19 nt, Homo sapiens
ugaagaagaagaaagcaua

SEQ ID NO: 293196 - RNA, 19 nt, Homo sapiens
ggugugaucuucuuaaagg

SEQ ID NO: 293197 - RNA, 19 nt, Homo sapiens
aggaagagaucuggaaauu

SEQ ID NO: 293198 - RNA, 19 nt, Homo sapiens
gcugaagguuguugaugaa

SEQ ID NO: 293199 - RNA, 19 nt, Homo sapiens
aagcaaagcaugucaaguu

SEQ ID NO: 293200 - RNA, 19 nt, Homo sapiens
gauggaaaccugagcaaug

SEQ ID NO: 293201 - RNA, 19 nt, Homo sapiens
ugacgaaggugccaaaugc

SEQ ID NO: 293202 - RNA, 19 nt, Homo sapiens
gcugaaaccaccaagauga

SEQ ID NO: 293203 - RNA, 19 nt, Homo sapiens
gaaccucacacaacauaau

SEQ ID NO: 293204 - RNA, 19 nt, Homo sapiens
gaguugggaucuaugucua

SEQ ID NO: 293205 - RNA, 19 nt, Homo sapiens
guaaguucaucacccaaga

SEQ ID NO: 293206 - RNA, 19 nt, Homo sapiens
gcuccgugcucgugagaaa

SEQ ID NO: 293207 - RNA, 19 nt, Homo sapiens
caagauauggcuagagaga

SEQ ID NO: 293208 - RNA, 19 nt, Homo sapiens
ugaagaucauccaggagua

SEQ ID NO: 293209 - RNA, 19 nt, Homo sapiens
ggaaaccugagcaaugauu

SEQ ID NO: 293210 - RNA, 19 nt, Homo sapiens
ccuacacccucgucaguaa

SEQ ID NO: 293211 - RNA, 19 nt, Homo sapiens
gcuuggagcucgucuuugg

SEQ ID NO: 293212 - RNA, 19 nt, Homo sapiens
ugaagaggcuuugagagau

SEQ ID NO: 293213 - RNA, 19 nt, Homo sapiens
aaaggacugugaucauaug

SEQ ID NO: 293214 - RNA, 19 nt, Homo sapiens
aaggaucacuucacugaga

SEQ ID NO: 293215 - RNA, 19 nt, Homo sapiens
gcacuucauucuacguaag

SEQ ID NO: 293216 - RNA, 19 nt, Homo sapiens
aaacaggaccuugauguga

SEQ ID NO: 293217 - RNA, 19 nt, Homo sapiens
acaaggaucacuucacuga

SEQ ID NO: 293218 - RNA, 19 nt, Homo sapiens
cagauaugcugaagguugu

SEQ ID NO: 293219 - RNA, 19 nt, Homo sapiens
caggaaugcugaugcacuu

SEQ ID NO: 293220 - RNA, 19 nt, Homo sapiens
guacaacucgaaauucuca

SEQ ID NO: 293221 - RNA, 19 nt, Homo sapiens
auacauaccugguuguuuu

SEQ ID NO: 293222 - RNA, 19 nt, Homo sapiens
ucaggcagauuguucacuu

SEQ ID NO: 293223 - RNA, 19 nt, Homo sapiens
gaaggcagauaugcugaag

SEQ ID NO: 293224 - RNA, 19 nt, Homo sapiens
ugaaagaaccucacacaac

SEQ ID NO: 293225 - RNA, 19 nt, Homo sapiens
gaagaagaagaaagcauag

SEQ ID NO: 293226 - RNA, 19 nt, Homo sapiens
caacugggccuggcauguu

SEQ ID NO: 293227 - RNA, 19 nt, Homo sapiens
gaaggaagacaacccuagu

SEQ ID NO: 293228 - RNA, 19 nt, Homo sapiens
ugccacaucuccugccuuu

SEQ ID NO: 293229 - RNA, 19 nt, Homo sapiens
agcuaaaccucaccaauga

SEQ ID NO: 293230 - RNA, 19 nt, Homo sapiens
agcaaagcaugucaaguuu

SEQ ID NO: 293231 - RNA, 19 nt, Homo sapiens
gacauggaucacacauuua

SEQ ID NO: 293232 - RNA, 19 nt, Homo sapiens
caaagauacauaccugguu

SEQ ID NO: 293233 - RNA, 19 nt, Homo sapiens
gccacaacauccacugaga

SEQ ID NO: 293234 - RNA, 19 nt, Homo sapiens
gcugaugcacuucauucua

SEQ ID NO: 293235 - RNA, 19 nt, Homo sapiens
uaccgaaucugacgaaggu

SEQ ID NO: 293236 - RNA, 19 nt, Homo sapiens
ccacaucuccugccuuucu

SEQ ID NO: 293237 - RNA, 19 nt, Homo sapiens
agauauggcuagagagauc

SEQ ID NO: 293238 - RNA, 19 nt, Homo sapiens
gaggagcagguucagguaa

SEQ ID NO: 293239 - RNA, 19 nt, Homo sapiens
gaaaacaggaccuugaugu

SEQ ID NO: 293240 - RNA, 19 nt, Homo sapiens
gcauagcuuuagaauagag

SEQ ID NO: 293241 - RNA, 19 nt, Homo sapiens
agaugaaaguccucgaguu

SEQ ID NO: 293242 - RNA, 19 nt, Homo sapiens
caagaucuggugcaggaaa

SEQ ID NO: 293243 - RNA, 19 nt, Homo sapiens
ggaagagaucuggaaauuc

SEQ ID NO: 293244 - RNA, 19 nt, Homo sapiens
auggaaaccugagcaauga

SEQ ID NO: 293245 - RNA, 19 nt, Homo sapiens
aagcuaaaccucaccaaug

SEQ ID NO: 293246 - RNA, 19 nt, Homo sapiens
aagaaccucacacaacaua

SEQ ID NO: 293247 - RNA, 19 nt, Homo sapiens
ugacuucccaucccauuau

SEQ ID NO: 293248 - RNA, 19 nt, Homo sapiens
caaaugccaaggugaggaa

SEQ ID NO: 293249 - RNA, 19 nt, Homo sapiens
gagucaaggugccacaucu

SEQ ID NO: 293250 - RNA, 19 nt, Homo sapiens
gauacauaccugguuguuu

SEQ ID NO: 293251 - RNA, 19 nt, Homo sapiens
ggagaggagcacuuaaucu

SEQ ID NO: 293252 - RNA, 19 nt, Homo sapiens
guugggagccuaugaugga

SEQ ID NO: 293253 - RNA, 19 nt, Homo sapiens
ggcuagagagaucaucaua

SEQ ID NO: 293254 - RNA, 19 nt, Homo sapiens
caggcagauuguucacuuu

SEQ ID NO: 293255 - RNA, 19 nt, Homo sapiens
gaaaccaccaagaugaaag

SEQ ID NO: 293256 - RNA, 19 nt, Homo sapiens
ggaaugcugaugcacuuca

SEQ ID NO: 293257 - RNA, 19 nt, Homo sapiens
aggagcagguucagguaaa

SEQ ID NO: 293258 - RNA, 19 nt, Homo sapiens
gcuagagagaucaucauau

SEQ ID NO: 293259 - RNA, 19 nt, Homo sapiens
gcagguucagguaaacaaa

SEQ ID NO: 293260 - RNA, 19 nt, Homo sapiens
ugauggagaggagcacuua

SEQ ID NO: 293261 - RNA, 19 nt, Homo sapiens
ugcugaagguuguugauga

SEQ ID NO: 293262 - RNA, 19 nt, Homo sapiens
aggcagauaugcugaaggu

SEQ ID NO: 293263 - RNA, 19 nt, Homo sapiens
gagagagcccauuaugaag

SEQ ID NO: 293264 - RNA, 19 nt, Homo sapiens
gaaugcugaugcacuucau

SEQ ID NO: 293265 - RNA, 19 nt, Homo sapiens
gagagaugaggaagagaga

SEQ ID NO: 293266 - RNA, 19 nt, Homo sapiens
gaggaagagaucuggaaau

SEQ ID NO: 293267 - RNA, 19 nt, Homo sapiens
ugggugugaucuucuuaaa

SEQ ID NO: 293268 - RNA, 19 nt, Homo sapiens
ucucagaaaugugugaaag

SEQ ID NO: 293269 - RNA, 19 nt, Homo sapiens
cgaggaagagaucuggaaa

SEQ ID NO: 293270 - RNA, 19 nt, Homo sapiens
gaagguuguugaugaaaag

SEQ ID NO: 293271 - RNA, 19 nt, Homo sapiens
cugaugcacuucauucuac

SEQ ID NO: 293272 - RNA, 19 nt, Homo sapiens
ugucauguaccgaaucuga

SEQ ID NO: 293273 - RNA, 19 nt, Homo sapiens
cagauuguucacuuuguuu

SEQ ID NO: 293274 - RNA, 19 nt, Homo sapiens
ggcagauuguucacuuugu

SEQ ID NO: 293275 - RNA, 19 nt, Homo sapiens
ggaagagagagcccaaguc

SEQ ID NO: 293276 - RNA, 19 nt, Homo sapiens
ucuuuggccuugauuugaa

SEQ ID NO: 293277 - RNA, 19 nt, Homo sapiens
ggugugaucuucuuaaaug

SEQ ID NO: 293278 - RNA, 19 nt, Homo sapiens
auacauaccuggauuuguu

SEQ ID NO: 293279 - RNA, 19 nt, Homo sapiens
gcagauucuuuacuuugua

SEQ ID NO: 293280 - RNA, 19 nt, Homo sapiens
aaagauacauaccuggauu

SEQ ID NO: 293281 - RNA, 19 nt, Homo sapiens
gaagagaucugggaauucc

SEQ ID NO: 293282 - RNA, 19 nt, Homo sapiens
ggucuuaggcagauucuuu

SEQ ID NO: 293283 - RNA, 19 nt, Homo sapiens
ggaagcucaucaccaaaga

SEQ ID NO: 293284 - RNA, 19 nt, Homo sapiens
gaggagcacucagucuuug

SEQ ID NO: 293285 - RNA, 19 nt, Homo sapiens
ugaaauauuugggaucaga

SEQ ID NO: 293286 - RNA, 19 nt, Homo sapiens
gaguagaaauaucuuugga

SEQ ID NO: 293287 - RNA, 19 nt, Homo sapiens
gaugaaaguccuggaguuu

SEQ ID NO: 293288 - RNA, 19 nt, Homo sapiens
gccuugagcugaauaaagu

SEQ ID NO: 293289 - RNA, 19 nt, Homo sapiens
gauauagaucacccuguua

SEQ ID NO: 293290 - RNA, 19 nt, Homo sapiens
gggccucaguguugucuuu

SEQ ID NO: 293291 - RNA, 19 nt, Homo sapiens
gagaaaugcugaaaauugu

SEQ ID NO: 293292 - RNA, 19 nt, Homo sapiens
ccuggaagcucaucaccaa

SEQ ID NO: 293293 - RNA, 19 nt, Homo sapiens
ggagaaaugcugaaaauug

SEQ ID NO: 293294 - RNA, 19 nt, Homo sapiens
ucaagaaugugugagaaau

SEQ ID NO: 293295 - RNA, 19 nt, Homo sapiens
guggucaauucuugguuua

SEQ ID NO: 293296 - RNA, 19 nt, Homo sapiens
uaaaaguggucaauucuug

SEQ ID NO: 293297 - RNA, 19 nt, Homo sapiens
uuaggcagauucuuuacuu

SEQ ID NO: 293298 - RNA, 19 nt, Homo sapiens
aggaagagaucugggaauu

SEQ ID NO: 293299 - RNA, 19 nt, Homo sapiens
caagaaugugugagaaauu

SEQ ID NO: 293300 - RNA, 19 nt, Homo sapiens
gagaggagcacucagucuu

SEQ ID NO: 293301 - RNA, 19 nt, Homo sapiens
uuacgaagaagcuuugaaa

SEQ ID NO: 293302 - RNA, 19 nt, Homo sapiens
gcauuagaguagaaauauc

SEQ ID NO: 293303 - RNA, 19 nt, Homo sapiens
ggcagauucuuuacuuugu

SEQ ID NO: 293304 - RNA, 19 nt, Homo sapiens
gaaaccagcaagaugaaag

SEQ ID NO: 293305 - RNA, 19 nt, Homo sapiens
gaauauguugggagucuau

SEQ ID NO: 293306 - RNA, 19 nt, Homo sapiens
cuucuuaaauggcaacuca

SEQ ID NO: 293307 - RNA, 19 nt, Homo sapiens
gaaauauuugggaucagaa

SEQ ID NO: 293308 - RNA, 19 nt, Homo sapiens
gaaagaccccauagugaaa

SEQ ID NO: 293309 - RNA, 19 nt, Homo sapiens
gccaaucaaucucccaaag

SEQ ID NO: 293310 - RNA, 19 nt, Homo sapiens
aggaaucccugcucaguuc

SEQ ID NO: 293311 - RNA, 19 nt, Homo sapiens
gaaaauuguuggcaaaagg

SEQ ID NO: 293312 - RNA, 19 nt, Homo sapiens
cuacugccauagccaauca

SEQ ID NO: 293313 - RNA, 19 nt, Homo sapiens
gugagaaauuaaaccauag

SEQ ID NO: 293314 - RNA, 19 nt, Homo sapiens
ggcauuagaguagaaauau

SEQ ID NO: 293315 - RNA, 19 nt, Homo sapiens
guuaaccuuuguucuuguu

SEQ ID NO: 293316 - RNA, 19 nt, Homo sapiens
agaugaaaguccuggaguu

SEQ ID NO: 293317 - RNA, 19 nt, Homo sapiens
uuaaauggcaacucagcua

SEQ ID NO: 293318 - RNA, 19 nt, Homo sapiens
gaggaaucccugcucaguu

SEQ ID NO: 293319 - RNA, 19 nt, Homo sapiens
gcucaguuccugggacuuu

SEQ ID NO: 293320 - RNA, 19 nt, Homo sapiens
ggaagagaucugggaauuc

SEQ ID NO: 293321 - RNA, 19 nt, Homo sapiens
uaggcagauucuuuacuuu

SEQ ID NO: 293322 - RNA, 19 nt, Homo sapiens
gccuugcacuacugccaua

SEQ ID NO: 293323 - RNA, 19 nt, Homo sapiens
cccaacccauuacgaagaa

SEQ ID NO: 293324 - RNA, 19 nt, Homo sapiens
uaccuggauuuguuuaugu

SEQ ID NO: 293325 - RNA, 19 nt, Homo sapiens
ggucaauucuugguuuacu

SEQ ID NO: 293326 - RNA, 19 nt, Homo sapiens
ggguaaaaguggucaauuc

SEQ ID NO: 293327 - RNA, 19 nt, Homo sapiens
ugggugugaucuucuuaaa

SEQ ID NO: 293328 - RNA, 19 nt, Homo sapiens
cagggucguuggugcaguu

SEQ ID NO: 293329 - RNA, 19 nt, Homo sapiens
ucacugaagcagaggaaga

SEQ ID NO: 293330 - RNA, 19 nt, Homo sapiens
uggcauuagaguagaaaua

SEQ ID NO: 293331 - RNA, 19 nt, Homo sapiens
gcugaaaauuguuggcaaa

SEQ ID NO: 293332 - RNA, 19 nt, Homo sapiens
aguggucaauucuugguuu

SEQ ID NO: 293333 - RNA, 19 nt, Homo sapiens
ccuguuaaccuuuguucuu

SEQ ID NO: 293334 - RNA, 19 nt, Homo sapiens
guagccaggccuugcacua

SEQ ID NO: 293335 - RNA, 19 nt, Homo sapiens
gcuccgugcccgugagaaa

SEQ ID NO: 293336 - RNA, 19 nt, Homo sapiens
agugaaauauuugggauca

SEQ ID NO: 293337 - RNA, 19 nt, Homo sapiens
auagaucacccuguuauug

SEQ ID NO: 293338 - RNA, 19 nt, Homo sapiens
cuguuaaccuuuguucuug

SEQ ID NO: 293339 - RNA, 19 nt, Homo sapiens
gucuuaggcagauucuuua

SEQ ID NO: 293340 - RNA, 19 nt, Homo sapiens
ccgagagccuaugcugaaa

SEQ ID NO: 293341 - RNA, 19 nt, Homo sapiens
gcucaucaccaaagaucug

SEQ ID NO: 293342 - RNA, 19 nt, Homo sapiens
agaggagcacucagucuuu

SEQ ID NO: 293343 - RNA, 19 nt, Homo sapiens
augcaugaauaacuuguug

SEQ ID NO: 293344 - RNA, 19 nt, Homo sapiens
aaagaucuggugcaggaaa

SEQ ID NO: 293345 - RNA, 19 nt, Homo sapiens
uaaagauacauaccuggau

SEQ ID NO: 293346 - RNA, 19 nt, Homo sapiens
gucaauucuugguuuacuu

SEQ ID NO: 293347 - RNA, 19 nt, Homo sapiens
gcggguguuucauccacaa

SEQ ID NO: 293348 - RNA, 19 nt, Homo sapiens
ugccauagccaaucaaucu

SEQ ID NO: 293349 - RNA, 19 nt, Homo sapiens
gaaaugcugaaaauuguug

SEQ ID NO: 293350 - RNA, 19 nt, Homo sapiens
aagcgaagauccucuaacc

SEQ ID NO: 293351 - RNA, 19 nt, Homo sapiens
ugaaagaccccauagugaa

SEQ ID NO: 293352 - RNA, 19 nt, Homo sapiens
uaagagcccaagcgaagau

SEQ ID NO: 293353 - RNA, 19 nt, Homo sapiens
ugaauauguugggagucua

SEQ ID NO: 293354 - RNA, 19 nt, Homo sapiens
auaccuggauuuguuuaug

SEQ ID NO: 293355 - RNA, 19 nt, Homo sapiens
uguaauccaggacaagaaa

SEQ ID NO: 293356 - RNA, 19 nt, Homo sapiens
cagggacaguagaaagugu

SEQ ID NO: 293357 - RNA, 19 nt, Homo sapiens
ggagaggagcacucagucu

SEQ ID NO: 293358 - RNA, 19 nt, Homo sapiens
acacuuacaccuucaucga

SEQ ID NO: 293359 - RNA, 19 nt, Homo sapiens
uggugcaguuccuguugua

SEQ ID NO: 293360 - RNA, 19 nt, Homo sapiens
ugcaguuccuguuguacaa

SEQ ID NO: 293361 - RNA, 19 nt, Homo sapiens
aaugaggucuuaggcagau

SEQ ID NO: 293362 - RNA, 19 nt, Homo sapiens
gugccuucccaacccauua

SEQ ID NO: 293363 - RNA, 19 nt, Homo sapiens
uccgagagccuaugcugaa

SEQ ID NO: 293364 - RNA, 19 nt, Homo sapiens
ccaagcgaagauccucuaa

SEQ ID NO: 293365 - RNA, 19 nt, Homo sapiens
gaggaagagaucugggaau

SEQ ID NO: 293366 - RNA, 19 nt, Homo sapiens
aaagggagaaaugcugaaa

SEQ ID NO: 293367 - RNA, 19 nt, Homo sapiens
caaagggagaaaugcugaa

SEQ ID NO: 293368 - RNA, 19 nt, Homo sapiens
ucaauucuugguuuacuuc

SEQ ID NO: 293369 - RNA, 19 nt, Homo sapiens
gggacaguagaaaguguuu

SEQ ID NO: 293370 - RNA, 19 nt, Homo sapiens
uauagaucacccuguuauu

SEQ ID NO: 293371 - RNA, 19 nt, Homo sapiens
ccauuacgaagaagcuuug

SEQ ID NO: 293372 - RNA, 19 nt, Homo sapiens
gagagccuaugcugaaacc

SEQ ID NO: 293373 - RNA, 19 nt, Homo sapiens
gaagcucaucaccaaagau

SEQ ID NO: 293374 - RNA, 19 nt, Homo sapiens
cugaauauguugggagucu

SEQ ID NO: 293375 - RNA, 19 nt, Homo sapiens
aggcagauucuuuacuuug

SEQ ID NO: 293376 - RNA, 19 nt, Homo sapiens
ugaagcagaggaagaagag

SEQ ID NO: 293377 - RNA, 19 nt, Homo sapiens
gaauaagcauuuccuugaa

SEQ ID NO: 293378 - RNA, 19 nt, Homo sapiens
ggucacauuuguuguuuaa

SEQ ID NO: 293379 - RNA, 19 nt, Homo sapiens
guaagauggucaauauuug

SEQ ID NO: 293380 - RNA, 19 nt, Homo sapiens
gggaacacacuguauaaua

SEQ ID NO: 293381 - RNA, 19 nt, Homo sapiens
gaagaggcuuugagagaug

SEQ ID NO: 293382 - RNA, 19 nt, Homo sapiens
ggagggaacacacuguaua

SEQ ID NO: 293383 - RNA, 19 nt, Homo sapiens
gacaagugcccaacaguaa

SEQ ID NO: 293384 - RNA, 19 nt, Homo sapiens
gauggucaauauuugguuu

SEQ ID NO: 293385 - RNA, 19 nt, Homo sapiens
gcucaucacccaagauuug

SEQ ID NO: 293386 - RNA, 19 nt, Homo sapiens
uuagugaucuguugcaaga

SEQ ID NO: 293387 - RNA, 19 nt, Homo sapiens
gaaagcucaucacccaaga

SEQ ID NO: 293388 - RNA, 19 nt, Homo sapiens
caaauauguuggugcaguu

SEQ ID NO: 293389 - RNA, 19 nt, Homo sapiens
gcugguaggucacguagug

SEQ ID NO: 293390 - RNA, 19 nt, Homo sapiens
gagggaacacacuguauaa

SEQ ID NO: 293391 - RNA, 19 nt, Homo sapiens
agaauaagcauuuccuuga

SEQ ID NO: 293392 - RNA, 19 nt, Homo sapiens
caagggagccaacagcaaa

SEQ ID NO: 293393 - RNA, 19 nt, Homo sapiens
gucaauauuugguuuccua

SEQ ID NO: 293394 - RNA, 19 nt, Homo sapiens
aguguaagauggucaauau

SEQ ID NO: 293395 - RNA, 19 nt, Homo sapiens
gauugauacuggucacauu

SEQ ID NO: 293396 - RNA, 19 nt, Homo sapiens
cuagugaaguugaagcaaa

SEQ ID NO: 293397 - RNA, 19 nt, Homo sapiens
cgacaagugcccaacagua

SEQ ID NO: 293398 - RNA, 19 nt, Homo sapiens
gaauauaugaugggaagaa

SEQ ID NO: 293399 - RNA, 19 nt, Homo sapiens
aagaauugcuucccugaga

SEQ ID NO: 293400 - RNA, 19 nt, Homo sapiens
ggaaauguacaagaugaaa

SEQ ID NO: 293401 - RNA, 19 nt, Homo sapiens
gagaagaucugggaauucc

SEQ ID NO: 293402 - RNA, 19 nt, Homo sapiens
gcucagaucacugcaacua

SEQ ID NO: 293403 - RNA, 19 nt, Homo sapiens
cugcagcuaugcucaauga

SEQ ID NO: 293404 - RNA, 19 nt, Homo sapiens
caagauuuggugaagcuua

SEQ ID NO: 293405 - RNA, 19 nt, Homo sapiens
ugaagaggcuuugagagau

SEQ ID NO: 293406 - RNA, 19 nt, Homo sapiens
aagauuuggugaagcuuaa

SEQ ID NO: 293407 - RNA, 19 nt, Homo sapiens
ugauggaaauguacaagau

SEQ ID NO: 293408 - RNA, 19 nt, Homo sapiens
gcagcuaugcucaaugaug

SEQ ID NO: 293409 - RNA, 19 nt, Homo sapiens
agaugaagguccuggaguu

SEQ ID NO: 293410 - RNA, 19 nt, Homo sapiens
ucacugcaacuaacaagaa

SEQ ID NO: 293411 - RNA, 19 nt, Homo sapiens
auauaugucuggcuuacuu

SEQ ID NO: 293412 - RNA, 19 nt, Homo sapiens
agagaaagaguguaagaug

SEQ ID NO: 293413 - RNA, 19 nt, Homo sapiens
gcucaaugauggcaguagu

SEQ ID NO: 293414 - RNA, 19 nt, Homo sapiens
gagagaugaggaagaaaga

SEQ ID NO: 293415 - RNA, 19 nt, Homo sapiens
gaugaagguccuggaguuu

SEQ ID NO: 293416 - RNA, 19 nt, Homo sapiens
agaaacacuucauauuugg

SEQ ID NO: 293417 - RNA, 19 nt, Homo sapiens
gaaauagagaaagagugua

SEQ ID NO: 293418 - RNA, 19 nt, Homo sapiens
ucagaucacugcaacuaac

SEQ ID NO: 293419 - RNA, 19 nt, Homo sapiens
agaaauagagaaagagugu

SEQ ID NO: 293420 - RNA, 19 nt, Homo sapiens
aggagaagaucugggaauu

SEQ ID NO: 293421 - RNA, 19 nt, Homo sapiens
uuugagagaugaggaagaa

SEQ ID NO: 293422 - RNA, 19 nt, Homo sapiens
guaugaagaggcuuugaga

SEQ ID NO: 293423 - RNA, 19 nt, Homo sapiens
uagugaaguugaagcaaau

SEQ ID NO: 293424 - RNA, 19 nt, Homo sapiens
gagaugaggaagaaagagu

SEQ ID NO: 293425 - RNA, 19 nt, Homo sapiens
ggagaagaucugggaauuc

SEQ ID NO: 293426 - RNA, 19 nt, Homo sapiens
gguguugauuuaaagaaag

SEQ ID NO: 293427 - RNA, 19 nt, Homo sapiens
caugaagacaaauauguug

SEQ ID NO: 293428 - RNA, 19 nt, Homo sapiens
gaguguaagauggucaaua

SEQ ID NO: 293429 - RNA, 19 nt, Homo sapiens
ggaagaaagaguccaagcu

SEQ ID NO: 293430 - RNA, 19 nt, Homo sapiens
gaggagaagaucugggaau

SEQ ID NO: 293431 - RNA, 19 nt, Homo sapiens
gaagaguacgcuccaugca

SEQ ID NO: 293432 - RNA, 19 nt, Homo sapiens
gauggaaauguacaagaug

SEQ ID NO: 293433 - RNA, 19 nt, Homo sapiens
ucacguagugcucucaaga

SEQ ID NO: 293434 - RNA, 19 nt, Homo sapiens
cacugcaacuaacaagaaa

SEQ ID NO: 293435 - RNA, 19 nt, Homo sapiens
caguaauccugcacgcuau

SEQ ID NO: 293436 - RNA, 19 nt, Homo sapiens
cuuauuuagugaucuguug

SEQ ID NO: 293437 - RNA, 19 nt, Homo sapiens
uccaagagcccaugcugaa

SEQ ID NO: 293438 - RNA, 19 nt, Homo sapiens
ccuauguccuugucagcaa

SEQ ID NO: 293439 - RNA, 19 nt, Homo sapiens
auggaaauguacaagauga

SEQ ID NO: 293440 - RNA, 19 nt, Homo sapiens
gcacuauccaccacuacau

SEQ ID NO: 293441 - RNA, 19 nt, Homo sapiens
ccacugaggagaagaucug

SEQ ID NO: 293442 - RNA, 19 nt, Homo sapiens
uauaugaugggaagaaaca

SEQ ID NO: 293443 - RNA, 19 nt, Homo sapiens
agagcacuauccaccacua

SEQ ID NO: 293444 - RNA, 19 nt, Homo sapiens
ccauauaugucuggcuuac

SEQ ID NO: 293445 - RNA, 19 nt, Homo sapiens
auacuggucacauuuguug

SEQ ID NO: 293446 - RNA, 19 nt, Homo sapiens
ugauacuggucacauuugu

SEQ ID NO: 293447 - RNA, 19 nt, Homo sapiens
gugaaguugaagcaaauuu

SEQ ID NO: 293448 - RNA, 19 nt, Homo sapiens
ccagugcguuccaguucug

SEQ ID NO: 293449 - RNA, 19 nt, Homo sapiens
ccaagagcccaugcugaaa

SEQ ID NO: 293450 - RNA, 19 nt, Homo sapiens
caagugcccaacaguaauc

SEQ ID NO: 293451 - RNA, 19 nt, Homo sapiens
uaagauggucaauauuugg

SEQ ID NO: 293452 - RNA, 19 nt, Homo sapiens
gauacuggucacauuuguu

SEQ ID NO: 293453 - RNA, 19 nt, Homo sapiens
gugaaggacuggguguuac

SEQ ID NO: 293454 - RNA, 19 nt, Homo sapiens
gcucuucccacgccuagug

SEQ ID NO: 293455 - RNA, 19 nt, Homo sapiens
gcuccaugcacgugagaaa

SEQ ID NO: 293456 - RNA, 19 nt, Homo sapiens
caagagcccaugcugaaac

SEQ ID NO: 293457 - RNA, 19 nt, Homo sapiens
aaauggaucuccccaacaa

SEQ ID NO: 293458 - RNA, 19 nt, Homo sapiens
agaauugcuucccugagau

SEQ ID NO: 293459 - RNA, 19 nt, Homo sapiens
aagcuucucucagggucua

SEQ ID NO: 293460 - RNA, 19 nt, Homo sapiens
augaagaggcuuugagaga

SEQ ID NO: 293461 - RNA, 19 nt, Homo sapiens
gaauugcuucccugagauc

SEQ ID NO: 293462 - RNA, 19 nt, Homo sapiens
ggcauuaagaaauagagaa

SEQ ID NO: 293463 - RNA, 19 nt, Homo sapiens
uguaucaccugcccuucug

SEQ ID NO: 293464 - RNA, 19 nt, Homo sapiens
agugaaggacuggguguua

SEQ ID NO: 293465 - RNA, 19 nt, Homo sapiens
gccaugggcagaaaguguu

SEQ ID NO: 293466 - RNA, 19 nt, Homo sapiens
aagcucaucacccaagauu

SEQ ID NO: 293467 - RNA, 19 nt, Homo sapiens
uauaugucuggcuuacuua

SEQ ID NO: 293468 - RNA, 19 nt, Homo sapiens
cuggucacauuuguuguuu

SEQ ID NO: 293469 - RNA, 19 nt, Homo sapiens
ugagagaugaggaagaaag

SEQ ID NO: 293470 - RNA, 19 nt, Homo sapiens
ugaagguccuggaguuuug

SEQ ID NO: 293471 - RNA, 19 nt, Homo sapiens
aagcuucuuucaacaugga

SEQ ID NO: 293472 - RNA, 19 nt, Homo sapiens
agaaagaguguaagauggu

SEQ ID NO: 293473 - RNA, 19 nt, Homo sapiens
cacauuuguuguuuaagag

SEQ ID NO: 293474 - RNA, 19 nt, Homo sapiens
ucccacgccuagugaaguu

SEQ ID NO: 293475 - RNA, 19 nt, Homo sapiens
uggugaagcuuaaauaccu

SEQ ID NO: 293476 - RNA, 19 nt, Homo sapiens
acacacucauucuccaagu

SEQ ID NO: 293477 - RNA, 19 nt, Homo sapiens
gcacggagcuggucuuugg

SEQ ID NO: 293478 - RNA, 19 nt, Homo sapiens
ugaaagagcccacuacaaa

SEQ ID NO: 293479 - RNA, 19 nt, Homo sapiens
gagaagacuuuaagagaug

SEQ ID NO: 293480 - RNA, 19 nt, Homo sapiens
ggaaauuaccuugcaauaa

SEQ ID NO: 293481 - RNA, 19 nt, Homo sapiens
gcagaaaccagcaagauga

SEQ ID NO: 293482 - RNA, 19 nt, Homo sapiens
gaagaggcuuugagagaug

SEQ ID NO: 293483 - RNA, 19 nt, Homo sapiens
uuacauaccugguuugcuu

SEQ ID NO: 293484 - RNA, 19 nt, Homo sapiens
gcacuucccugagaucuuc

SEQ ID NO: 293485 - RNA, 19 nt, Homo sapiens
gcagaaaugcugaagauca

SEQ ID NO: 293486 - RNA, 19 nt, Homo sapiens
ggaaagaggcaccuuaucu

SEQ ID NO: 293487 - RNA, 19 nt, Homo sapiens
ucagguugguuuagugaua

SEQ ID NO: 293488 - RNA, 19 nt, Homo sapiens
uccaagagcucaugcagaa

SEQ ID NO: 293489 - RNA, 19 nt, Homo sapiens
agagaucacucaaagauuc

SEQ ID NO: 293490 - RNA, 19 nt, Homo sapiens
aaaguuacauaccugguuu

SEQ ID NO: 293491 - RNA, 19 nt, Homo sapiens
gaagauagaaagggaagaa

SEQ ID NO: 293492 - RNA, 19 nt, Homo sapiens
gaaagcucaucacccaaga

SEQ ID NO: 293493 - RNA, 19 nt, Homo sapiens
gcauuggaauauggaauuu

SEQ ID NO: 293494 - RNA, 19 nt, Homo sapiens
gaucuaaggcaaauuguuc

SEQ ID NO: 293495 - RNA, 19 nt, Homo sapiens
caacccaugugagaucuaa

SEQ ID NO: 293496 - RNA, 19 nt, Homo sapiens
agucugagguauauucuuu

SEQ ID NO: 293497 - RNA, 19 nt, Homo sapiens
uggcaugcaucacacauuu

SEQ ID NO: 293498 - RNA, 19 nt, Homo sapiens
gaugaaaguccuggaguuu

SEQ ID NO: 293499 - RNA, 19 nt, Homo sapiens
agagaagacuuuaagagau

SEQ ID NO: 293500 - RNA, 19 nt, Homo sapiens
gauggaaagaggcaccuua

SEQ ID NO: 293501 - RNA, 19 nt, Homo sapiens
agugugaucuucuuaaaug

SEQ ID NO: 293502 - RNA, 19 nt, Homo sapiens
ugagugugaucuucuuaaa

SEQ ID NO: 293503 - RNA, 19 nt, Homo sapiens
gauaauauggcauuggaau

SEQ ID NO: 293504 - RNA, 19 nt, Homo sapiens
uaaggcaaauuguucacuu

SEQ ID NO: 293505 - RNA, 19 nt, Homo sapiens
gaaagagcccacuacaaag

SEQ ID NO: 293506 - RNA, 19 nt, Homo sapiens
gaaaacacuuaaccuucua

SEQ ID NO: 293507 - RNA, 19 nt, Homo sapiens
cagaaaugcugaagaucau

SEQ ID NO: 293508 - RNA, 19 nt, Homo sapiens
ggaccaggaaguagagaaa

SEQ ID NO: 293509 - RNA, 19 nt, Homo sapiens
gguuggagagugagaauuu

SEQ ID NO: 293510 - RNA, 19 nt, Homo sapiens
ggagagagagccagagaca

SEQ ID NO: 293511 - RNA, 19 nt, Homo sapiens
gugggaacaccauguauaa

SEQ ID NO: 293512 - RNA, 19 nt, Homo sapiens
ugaagaggcuuugagagau

SEQ ID NO: 293513 - RNA, 19 nt, Homo sapiens
uaacacggcaugggaguaa

SEQ ID NO: 293514 - RNA, 19 nt, Homo sapiens
ccaggaagacgaagauguu

SEQ ID NO: 293515 - RNA, 19 nt, Homo sapiens
gacccaggaucucaagguu

SEQ ID NO: 293516 - RNA, 19 nt, Homo sapiens
aagauaauauggcauugga

SEQ ID NO: 293517 - RNA, 19 nt, Homo sapiens
gcacuacagccaugacuag

SEQ ID NO: 293518 - RNA, 19 nt, Homo sapiens
gaaaugcugaagaucauca

SEQ ID NO: 293519 - RNA, 19 nt, Homo sapiens
caacauccacugagagauc

SEQ ID NO: 293520 - RNA, 19 nt, Homo sapiens
gggaacaccauguauaaca

SEQ ID NO: 293521 - RNA, 19 nt, Homo sapiens
caacugggccuggcauguu

SEQ ID NO: 293522 - RNA, 19 nt, Homo sapiens
cagguugguuuagugauaa

SEQ ID NO: 293523 - RNA, 19 nt, Homo sapiens
gcaugcaucacacauuuau

SEQ ID NO: 293524 - RNA, 19 nt, Homo sapiens
gaaaccagcaagaugaaag

SEQ ID NO: 293525 - RNA, 19 nt, Homo sapiens
gaagaggaaaucugggaau

SEQ ID NO: 293526 - RNA, 19 nt, Homo sapiens
ggaagacgaagauguuagu

SEQ ID NO: 293527 - RNA, 19 nt, Homo sapiens
ugugaagucugagguauau

SEQ ID NO: 293528 - RNA, 19 nt, Homo sapiens
aagagaagacuuuaagaga

SEQ ID NO: 293529 - RNA, 19 nt, Homo sapiens
cggcaugggaguaagguua

SEQ ID NO: 293530 - RNA, 19 nt, Homo sapiens
aaggagcacuucccugaga

SEQ ID NO: 293531 - RNA, 19 nt, Homo sapiens
aggcagaaaugcugaagau

SEQ ID NO: 293532 - RNA, 19 nt, Homo sapiens
gagagaucacucaaagauu

SEQ ID NO: 293533 - RNA, 19 nt, Homo sapiens
ucugugaucuagaacaaga

SEQ ID NO: 293534 - RNA, 19 nt, Homo sapiens
aagaggaaaucugggaauu

SEQ ID NO: 293535 - RNA, 19 nt, Homo sapiens
aagauucucuaaccaggaa

SEQ ID NO: 293536 - RNA, 19 nt, Homo sapiens
ggaagaaaaguaaaaguug

SEQ ID NO: 293537 - RNA, 19 nt, Homo sapiens
ucacacauuuauugcuguu

SEQ ID NO: 293538 - RNA, 19 nt, Homo sapiens
ugagaucuaaggcaaauug

SEQ ID NO: 293539 - RNA, 19 nt, Homo sapiens
cuucuuaaauggcaacugu

SEQ ID NO: 293540 - RNA, 19 nt, Homo sapiens
uaagagaagacuuuaagag

SEQ ID NO: 293541 - RNA, 19 nt, Homo sapiens
agaaauggcaugcaucaca

SEQ ID NO: 293542 - RNA, 19 nt, Homo sapiens
aaggcaaauuguucacuuu

SEQ ID NO: 293543 - RNA, 19 nt, Homo sapiens
agaugaaaguccuggaguu

SEQ ID NO: 293544 - RNA, 19 nt, Homo sapiens
guuuaugaauggcaugaau

SEQ ID NO: 293545 - RNA, 19 nt, Homo sapiens
caacugugcccgugaagag

SEQ ID NO: 293546 - RNA, 19 nt, Homo sapiens
cgaagauguuagugcaguu

SEQ ID NO: 293547 - RNA, 19 nt, Homo sapiens
gcgacgagagccaagauga

SEQ ID NO: 293548 - RNA, 19 nt, Homo sapiens
ggcauuggaauauggaauu

SEQ ID NO: 293549 - RNA, 19 nt, Homo sapiens
cuuacucaguucagucuuu

SEQ ID NO: 293550 - RNA, 19 nt, Homo sapiens
gcucaucacccaagaucug

SEQ ID NO: 293551 - RNA, 19 nt, Homo sapiens
agaggcaccuuaucuuugg

SEQ ID NO: 293552 - RNA, 19 nt, Homo sapiens
uuugagagaugaagaagag

SEQ ID NO: 293553 - RNA, 19 nt, Homo sapiens
ccaaggaaugggcuucuga

SEQ ID NO: 293554 - RNA, 19 nt, Homo sapiens
ucacucaaagauucucuaa

SEQ ID NO: 293555 - RNA, 19 nt, Homo sapiens
gagagaugaagaagagaga

SEQ ID NO: 293556 - RNA, 19 nt, Homo sapiens
ggaauauggaauuugugaa

SEQ ID NO: 293557 - RNA, 19 nt, Homo sapiens
ugaagucugagguauauuc

SEQ ID NO: 293558 - RNA, 19 nt, Homo sapiens
caggaagacgaagauguua

SEQ ID NO: 293559 - RNA, 19 nt, Homo sapiens
gcacuggaucugauaaagg

SEQ ID NO: 293560 - RNA, 19 nt, Homo sapiens
ccauuaagagaagacuuua

SEQ ID NO: 293561 - RNA, 19 nt, Homo sapiens
uaccugguuugcuuagauu

SEQ ID NO: 293562 - RNA, 19 nt, Homo sapiens
ucugaugccucuacugagu

SEQ ID NO: 293563 - RNA, 19 nt, Homo sapiens
acucaaagauucucuaacc

SEQ ID NO: 293564 - RNA, 19 nt, Homo sapiens
cccaggagccucagagaga

SEQ ID NO: 293565 - RNA, 19 nt, Homo sapiens
agagagagccagagacagu

SEQ ID NO: 293566 - RNA, 19 nt, Homo sapiens
gcuaugucaugcacuggau

SEQ ID NO: 293567 - RNA, 19 nt, Homo sapiens
ggcaugcaucacacauuua

SEQ ID NO: 293568 - RNA, 19 nt, Homo sapiens
gagccaagaugaggaaaau

SEQ ID NO: 293569 - RNA, 19 nt, Homo sapiens
ccacaucaccugcccuucu

SEQ ID NO: 293570 - RNA, 19 nt, Homo sapiens
gaagauguuagugcaguuc

SEQ ID NO: 293571 - RNA, 19 nt, Homo sapiens
gcuccgugcccgugagaaa

SEQ ID NO: 293572 - RNA, 19 nt, Homo sapiens
ugguuugucuuacucaguu

SEQ ID NO: 293573 - RNA, 19 nt, Homo sapiens
uuccugugaugcaugaaua

SEQ ID NO: 293574 - RNA, 19 nt, Homo sapiens
ugugagaucuaaggcaaau

SEQ ID NO: 293575 - RNA, 19 nt, Homo sapiens
cagaaaccagcaagaugaa

SEQ ID NO: 293576 - RNA, 19 nt, Homo sapiens
caagagcucaugcagaaac

SEQ ID NO: 293577 - RNA, 19 nt, Homo sapiens
ggauuacacuucaagauua

SEQ ID NO: 293578 - RNA, 19 nt, Homo sapiens
caaagaggaugaugcauug

SEQ ID NO: 293579 - RNA, 19 nt, Homo sapiens
gaacugaagagaauaauug

SEQ ID NO: 293580 - RNA, 19 nt, Homo sapiens
ccagaaggcuuacgaguau

SEQ ID NO: 293581 - RNA, 19 nt, Homo sapiens
caacagcaauuacaagaau

SEQ ID NO: 293582 - RNA, 19 nt, Homo sapiens
gagaugaacacauuucuuu

SEQ ID NO: 293583 - RNA, 19 nt, Homo sapiens
gagaauaauugacgacagu

SEQ ID NO: 293584 - RNA, 19 nt, Homo sapiens
acagugaaauuaccaaaga

SEQ ID NO: 293585 - RNA, 19 nt, Homo sapiens
auaaagaccugaacaugug

SEQ ID NO: 293586 - RNA, 19 nt, Homo sapiens
cauuggagaugaacacauu

SEQ ID NO: 293587 - RNA, 19 nt, Homo sapiens
gcaauuacaagaaugaugu

SEQ ID NO: 293588 - RNA, 19 nt, Homo sapiens
ccaaagaggaugaugcauu

SEQ ID NO: 293589 - RNA, 19 nt, Homo sapiens
aaaccaaucuagacugaau

SEQ ID NO: 293590 - RNA, 19 nt, Homo sapiens
gaauauugguguggacaug

SEQ ID NO: 293591 - RNA, 19 nt, Homo sapiens
gacgggaaguuaagauaug

SEQ ID NO: 293592 - RNA, 19 nt, Homo sapiens
uguuuggucuucagucuua

SEQ ID NO: 293593 - RNA, 19 nt, Homo sapiens
uuaaaccaaucuagacuga

SEQ ID NO: 293594 - RNA, 19 nt, Homo sapiens
uggaggaacugaagagaau

SEQ ID NO: 293595 - RNA, 19 nt, Homo sapiens
ggucuucagucuuauugga

SEQ ID NO: 293596 - RNA, 19 nt, Homo sapiens
ggacgggaaguuaagauau

SEQ ID NO: 293597 - RNA, 19 nt, Homo sapiens
gaggaacugaagagaauaa

SEQ ID NO: 293598 - RNA, 19 nt, Homo sapiens
guuaagauaugccaacaac

SEQ ID NO: 293599 - RNA, 19 nt, Homo sapiens
guauaucagggcaguauuu

SEQ ID NO: 293600 - RNA, 19 nt, Homo sapiens
gaaaagaggcuuauguaca

SEQ ID NO: 293601 - RNA, 19 nt, Homo sapiens
ggcaggagcuugaaaucgu

SEQ ID NO: 293602 - RNA, 19 nt, Homo sapiens
uauaaagaccugaacaugu

SEQ ID NO: 293603 - RNA, 19 nt, Homo sapiens
caaggauccagaaggcuua

SEQ ID NO: 293604 - RNA, 19 nt, Homo sapiens
ggaacugaagagaauaauu

SEQ ID NO: 293605 - RNA, 19 nt, Homo sapiens
aaucuagacugaauauugg

SEQ ID NO: 293606 - RNA, 19 nt, Homo sapiens
aaaauugguucccuuauug

SEQ ID NO: 293607 - RNA, 19 nt, Homo sapiens
gaauaauugacgacaguga

SEQ ID NO: 293608 - RNA, 19 nt, Homo sapiens
gaaaucgucauuggagaug

SEQ ID NO: 293609 - RNA, 19 nt, Homo sapiens
ggagaugaacacauuucuu

SEQ ID NO: 293610 - RNA, 19 nt, Homo sapiens
caaguucggccacgaguuc

SEQ ID NO: 293611 - RNA, 19 nt, Homo sapiens
aaaagaggcuuauguacau

SEQ ID NO: 293612 - RNA, 19 nt, Homo sapiens
caacaacagcaauuacaag

SEQ ID NO: 293613 - RNA, 19 nt, Homo sapiens
uggauuacacuucaagauu

SEQ ID NO: 293614 - RNA, 19 nt, Homo sapiens
cuuauuggauuacacuuca

SEQ ID NO: 293615 - RNA, 19 nt, Homo sapiens
cuucagucuuauuggauua

SEQ ID NO: 293616 - RNA, 19 nt, Homo sapiens
gcagugcggcuugcucuug

SEQ ID NO: 293617 - RNA, 19 nt, Homo sapiens
uaagauaugccaacaacag

SEQ ID NO: 293618 - RNA, 19 nt, Homo sapiens
gccacgaguuccuggaguu

SEQ ID NO: 293619 - RNA, 19 nt, Homo sapiens
ccaacaacagcaauuacaa

SEQ ID NO: 293620 - RNA, 19 nt, Homo sapiens
ugggagccauggagaguga

SEQ ID NO: 293621 - RNA, 19 nt, Homo sapiens
ggaggaacugaagagaaua

SEQ ID NO: 293622 - RNA, 19 nt, Homo sapiens
uccagaaggcuuacgagua

SEQ ID NO: 293623 - RNA, 19 nt, Homo sapiens
cagaaaagaggcuuaugua

SEQ ID NO: 293624 - RNA, 19 nt, Homo sapiens
gaaguucaggcucgguugu

SEQ ID NO: 293625 - RNA, 19 nt, Homo sapiens
agaaggcuuacgaguauuu

SEQ ID NO: 293626 - RNA, 19 nt, Homo sapiens
cgaccggacgggaaguuaa

SEQ ID NO: 293627 - RNA, 19 nt, Homo sapiens
acgaguuccuggaguuuga

SEQ ID NO: 293628 - RNA, 19 nt, Homo sapiens
cgacagugaaauuaccaaa

SEQ ID NO: 293629 - RNA, 19 nt, Homo sapiens
gauaugccaacaacagcaa

SEQ ID NO: 293630 - RNA, 19 nt, Homo sapiens
guuccuggaguuugaguuu

SEQ ID NO: 293631 - RNA, 19 nt, Homo sapiens
gagcuugaaaucgucauug

SEQ ID NO: 293632 - RNA, 19 nt, Homo sapiens
gccaacaacagcaauuaca

SEQ ID NO: 293633 - RNA, 19 nt, Homo sapiens
gcggcuugcucuuggaagu

SEQ ID NO: 293634 - RNA, 19 nt, Homo sapiens
gcaaguucggccacgaguu

SEQ ID NO: 293635 - RNA, 19 nt, Homo sapiens
uugguucccuuauugaugu

SEQ ID NO: 293636 - RNA, 19 nt, Homo sapiens
ugaaauuaccaaagaggau

SEQ ID NO: 293637 - RNA, 19 nt, Homo sapiens
ccauggagagugacuuuua

SEQ ID NO: 293638 - RNA, 19 nt, Homo sapiens
cggacgggaaguuaagaua

SEQ ID NO: 293639 - RNA, 19 nt, Homo sapiens
uaaagaccugaacauguga

SEQ ID NO: 293640 - RNA, 19 nt, Homo sapiens
ccacgaguuccuggaguuu

SEQ ID NO: 293641 - RNA, 19 nt, Homo sapiens
ugaaaucgucauuggagau

SEQ ID NO: 293642 - RNA, 19 nt, Homo sapiens
uuauaaagaccugaacaug

SEQ ID NO: 293643 - RNA, 19 nt, Homo sapiens
ucuucagucuuauuggauu

SEQ ID NO: 293644 - RNA, 19 nt, Homo sapiens
cagaaggcuuacgaguauu

SEQ ID NO: 293645 - RNA, 19 nt, Homo sapiens
aacaacagcaauuacaaga

SEQ ID NO: 293646 - RNA, 19 nt, Homo sapiens
auaauugacgacagugaaa

SEQ ID NO: 293647 - RNA, 19 nt, Homo sapiens
aauaauugacgacagugaa

SEQ ID NO: 293648 - RNA, 19 nt, Homo sapiens
aaauugguucccuuauuga

SEQ ID NO: 293649 - RNA, 19 nt, Homo sapiens
ggagcuugaaaucgucauu

SEQ ID NO: 293650 - RNA, 19 nt, Homo sapiens
gauggaggaacugaagaga

SEQ ID NO: 293651 - RNA, 19 nt, Homo sapiens
acagcaauuacaagaauga

SEQ ID NO: 293652 - RNA, 19 nt, Homo sapiens
acaacagcaauuacaagaa

SEQ ID NO: 293653 - RNA, 19 nt, Homo sapiens
caaaucaucuggaaucaaa

SEQ ID NO: 293654 - RNA, 19 nt, Homo sapiens
gaauauaccuggaacacaa

SEQ ID NO: 293655 - RNA, 19 nt, Homo sapiens
gaaagaaguuaucagagaa

SEQ ID NO: 293656 - RNA, 19 nt, Homo sapiens
gaaguuaagucucugaaga

SEQ ID NO: 293657 - RNA, 19 nt, Homo sapiens
gguaggauguuacaaagua

SEQ ID NO: 293658 - RNA, 19 nt, Homo sapiens
caggaaaucuuggaaguua

SEQ ID NO: 293659 - RNA, 19 nt, Homo sapiens
gccaaaguaugaaguauuu

SEQ ID NO: 293660 - RNA, 19 nt, Homo sapiens
ugaaagaaguuaucagaga

SEQ ID NO: 293661 - RNA, 19 nt, Homo sapiens
uaucauggcugaacucuau

SEQ ID NO: 293662 - RNA, 19 nt, Homo sapiens
gggcagaacuugcuuucaa

SEQ ID NO: 293663 - RNA, 19 nt, Homo sapiens
caccaugccuggcuaauuu

SEQ ID NO: 293664 - RNA, 19 nt, Homo sapiens
ggagauagcugggaagagu

SEQ ID NO: 293665 - RNA, 19 nt, Homo sapiens
caagugaggucgaugaaau

SEQ ID NO: 293666 - RNA, 19 nt, Homo sapiens
ggaaaugucuacaaauguc

SEQ ID NO: 293667 - RNA, 19 nt, Homo sapiens
ggacguacuuauaauccua

SEQ ID NO: 293668 - RNA, 19 nt, Homo sapiens
gggaagaguuggaggacua

SEQ ID NO: 293669 - RNA, 19 nt, Homo sapiens
gaugguaauuucaaucuug

SEQ ID NO: 293670 - RNA, 19 nt, Homo sapiens
gcugaacucuauauguuaa

SEQ ID NO: 293671 - RNA, 19 nt, Homo sapiens
gaucuucaguuuauaguuc

SEQ ID NO: 293672 - RNA, 19 nt, Homo sapiens
ugaggucgaugaaaucuuu

SEQ ID NO: 293673 - RNA, 19 nt, Homo sapiens
gaagaaauaugcaaaagug

SEQ ID NO: 293674 - RNA, 19 nt, Homo sapiens
ucaaguuggucagguauua

SEQ ID NO: 293675 - RNA, 19 nt, Homo sapiens
ugaccgaaauguugaauug

SEQ ID NO: 293676 - RNA, 19 nt, Homo sapiens
gggcuacucuguuuaaauc

SEQ ID NO: 293677 - RNA, 19 nt, Homo sapiens
gaaucagucaucagaaaua

SEQ ID NO: 293678 - RNA, 19 nt, Homo sapiens
uguaauaagugucaucuug

SEQ ID NO: 293679 - RNA, 19 nt, Homo sapiens
ccagaaaacuugcuuugua

SEQ ID NO: 293680 - RNA, 19 nt, Homo sapiens
gaagucauuucaaucaaca

SEQ ID NO: 293681 - RNA, 19 nt, Homo sapiens
gagcuuaccugcuguuacu

SEQ ID NO: 293682 - RNA, 19 nt, Homo sapiens
ggacaucauuaagaaaguu

SEQ ID NO: 293683 - RNA, 19 nt, Homo sapiens
caacugcuccaaccucuaa

SEQ ID NO: 293684 - RNA, 19 nt, Homo sapiens
gcucaugaccgaaauguug

SEQ ID NO: 293685 - RNA, 19 nt, Homo sapiens
ggagagacuauauuuaaug

SEQ ID NO: 293686 - RNA, 19 nt, Homo sapiens
gacagaaagauugcaauua

SEQ ID NO: 293687 - RNA, 19 nt, Homo sapiens
gugaaacccuacagcauug

SEQ ID NO: 293688 - RNA, 19 nt, Homo sapiens
gggagagacuauauuuaau

SEQ ID NO: 293689 - RNA, 19 nt, Homo sapiens
acaaggaagucauuucaau

SEQ ID NO: 293690 - RNA, 19 nt, Homo sapiens
guacaguucccaugaauuc

SEQ ID NO: 293691 - RNA, 19 nt, Homo sapiens
gcaacggcuucagaauaua

SEQ ID NO: 293692 - RNA, 19 nt, Homo sapiens
cagcuggcauccucuauga

SEQ ID NO: 293693 - RNA, 19 nt, Homo sapiens
uggcugaacucuauauguu

SEQ ID NO: 293694 - RNA, 19 nt, Homo sapiens
caacaaggaagucauuuca

SEQ ID NO: 293695 - RNA, 19 nt, Homo sapiens
ccaaaugguuuaguaguuc

SEQ ID NO: 293696 - RNA, 19 nt, Homo sapiens
cagacuggguggccaagua

SEQ ID NO: 293697 - RNA, 19 nt, Homo sapiens
ggacaagugaggucgauga

SEQ ID NO: 293698 - RNA, 19 nt, Homo sapiens
gaaacuuaaucaugccaau

SEQ ID NO: 293699 - RNA, 19 nt, Homo sapiens
caacuucugcugcauuauu

SEQ ID NO: 293700 - RNA, 19 nt, Homo sapiens
auaagcagcugcaaccauu

SEQ ID NO: 293701 - RNA, 19 nt, Homo sapiens
guuuauaguucucccauug

SEQ ID NO: 293702 - RNA, 19 nt, Homo sapiens
gugguuggcuuaagagguu

SEQ ID NO: 293703 - RNA, 19 nt, Homo sapiens
ccacuuagcaccucucaau

SEQ ID NO: 293704 - RNA, 19 nt, Homo sapiens
ggcagaacuugcuuucaaa

SEQ ID NO: 293705 - RNA, 19 nt, Homo sapiens
gcuccaaccucuaaacagu

SEQ ID NO: 293706 - RNA, 19 nt, Homo sapiens
gcaacagagucaggagaaa

SEQ ID NO: 293707 - RNA, 19 nt, Homo sapiens
gaaagacagaaacaaguug

SEQ ID NO: 293708 - RNA, 19 nt, Homo sapiens
ggacuggaccuuaguacug

SEQ ID NO: 293709 - RNA, 19 nt, Homo sapiens
ugggaaaugucuacaaaug

SEQ ID NO: 293710 - RNA, 19 nt, Homo sapiens
guuaccaacugcugagauu

SEQ ID NO: 293711 - RNA, 19 nt, Homo sapiens
guuuaaaucugccacuuuc

SEQ ID NO: 293712 - RNA, 19 nt, Homo sapiens
aauagacacuucgaacuuu

SEQ ID NO: 293713 - RNA, 19 nt, Homo sapiens
cagcugugguucuuauuug

SEQ ID NO: 293714 - RNA, 19 nt, Homo sapiens
gugcccaaaugguuuagua

SEQ ID NO: 293715 - RNA, 19 nt, Homo sapiens
ccacaguguugauauaugg

SEQ ID NO: 293716 - RNA, 19 nt, Homo sapiens
gauagccaguggaaaggaa

SEQ ID NO: 293717 - RNA, 19 nt, Homo sapiens
ucaaaaggaugaagagaaa

SEQ ID NO: 293718 - RNA, 19 nt, Homo sapiens
ccgaguagcugggauuaga

SEQ ID NO: 293719 - RNA, 19 nt, Homo sapiens
ugcaacggcuucagaauau

SEQ ID NO: 293720 - RNA, 19 nt, Homo sapiens
ggaagucauuucaaucaac

SEQ ID NO: 293721 - RNA, 19 nt, Homo sapiens
gagcgaugguaauuucaau

SEQ ID NO: 293722 - RNA, 19 nt, Homo sapiens
ccugggaaaugucuacaaa

SEQ ID NO: 293723 - RNA, 19 nt, Homo sapiens
ccagcaaccuccaaagcaa

SEQ ID NO: 293724 - RNA, 19 nt, Homo sapiens
uauaaucgaucagguuguu

SEQ ID NO: 293725 - RNA, 19 nt, Homo sapiens
aacaacuucugcugcauua

SEQ ID NO: 293726 - RNA, 19 nt, Homo sapiens
guucagauguaagauguug

SEQ ID NO: 293727 - RNA, 19 nt, Homo sapiens
agucaacuguucagaugua

SEQ ID NO: 293728 - RNA, 19 nt, Homo sapiens
agagucaacuguucagaug

SEQ ID NO: 293729 - RNA, 19 nt, Homo sapiens
uaauaagugucaucuugug

SEQ ID NO: 293730 - RNA, 19 nt, Homo sapiens
cccaauggcuugaugacuu

SEQ ID NO: 293731 - RNA, 19 nt, Homo sapiens
ggauauaaucgaucagguu

SEQ ID NO: 293732 - RNA, 19 nt, Homo sapiens
cauugaaacacccauauuu

SEQ ID NO: 293733 - RNA, 19 nt, Homo sapiens
caacuguucagauguaaga

SEQ ID NO: 293734 - RNA, 19 nt, Homo sapiens
ccaguacaguucccaugaa

SEQ ID NO: 293735 - RNA, 19 nt, Homo sapiens
agacaggguuucaccaugu

SEQ ID NO: 293736 - RNA, 19 nt, Homo sapiens
uacaaucagucaggauaua

SEQ ID NO: 293737 - RNA, 19 nt, Homo sapiens
ggaaaucuuggaaguuaug

SEQ ID NO: 293738 - RNA, 19 nt, Homo sapiens
ggacuugcaagagaauuaa

SEQ ID NO: 293739 - RNA, 19 nt, Homo sapiens
gaugaaugcaugaacuuga

SEQ ID NO: 293740 - RNA, 19 nt, Homo sapiens
caacaacuucugcugcauu

SEQ ID NO: 293741 - RNA, 19 nt, Homo sapiens
ggaccuuaguacuguaaau

SEQ ID NO: 293742 - RNA, 19 nt, Homo sapiens
ccaauggcuugaugacuuc

SEQ ID NO: 293743 - RNA, 19 nt, Homo sapiens
guaggagucuaugguguga

SEQ ID NO: 293744 - RNA, 19 nt, Homo sapiens
gagaaaaugaccaucuuua

SEQ ID NO: 293745 - RNA, 19 nt, Homo sapiens
gaacuuugggcuacucugu

SEQ ID NO: 293746 - RNA, 19 nt, Homo sapiens
gaucuugaccaguacaguu

SEQ ID NO: 293747 - RNA, 19 nt, Homo sapiens
uuuccaagaugaaccgaua

SEQ ID NO: 293748 - RNA, 19 nt, Homo sapiens
cuaagccucugccggauau

SEQ ID NO: 293749 - RNA, 19 nt, Homo sapiens
guguguuccuauaaacuua

SEQ ID NO: 293750 - RNA, 19 nt, Homo sapiens
ggcuggacaucauuaagaa

SEQ ID NO: 293751 - RNA, 19 nt, Homo sapiens
gaauucaaggugacaauca

SEQ ID NO: 293752 - RNA, 19 nt, Homo sapiens
ugacagaaagauugcaauu

SEQ ID NO: 293753 - RNA, 19 nt, Homo sapiens
gcucgugggugcuguguuu

SEQ ID NO: 293754 - RNA, 19 nt, Homo sapiens
aaacagaaaugcccuugau

SEQ ID NO: 293755 - RNA, 19 nt, Homo sapiens
gguguucucuuuaaucaga

SEQ ID NO: 293756 - RNA, 19 nt, Homo sapiens
ucauaaagccgcaguagaa

SEQ ID NO: 293757 - RNA, 19 nt, Homo sapiens
acgauaacccugugaaaua

SEQ ID NO: 293758 - RNA, 19 nt, Homo sapiens
caagacggcuucaccuaca

SEQ ID NO: 293759 - RNA, 19 nt, Homo sapiens
caguagaacuugagcugaa

SEQ ID NO: 293760 - RNA, 19 nt, Homo sapiens
gaucauccuguacauaauu

SEQ ID NO: 293761 - RNA, 19 nt, Homo sapiens
gcacuaccaugaaaacauu

SEQ ID NO: 293762 - RNA, 19 nt, Homo sapiens
gaccugagaaggaaagaaa

SEQ ID NO: 293763 - RNA, 19 nt, Homo sapiens
gcgguguucucuuuaauca

SEQ ID NO: 293764 - RNA, 19 nt, Homo sapiens
cugcaccgcugcccucuuu

SEQ ID NO: 293765 - RNA, 19 nt, Homo sapiens
ccaccuugaucauccugua

SEQ ID NO: 293766 - RNA, 19 nt, Homo sapiens
gacuugcucuucaucuuug

SEQ ID NO: 293767 - RNA, 19 nt, Homo sapiens
caugcgguguucucuuuaa

SEQ ID NO: 293768 - RNA, 19 nt, Homo sapiens
gcucuucaucuuugaguuu

SEQ ID NO: 293769 - RNA, 19 nt, Homo sapiens
cgacuugcucuucaucuuu

SEQ ID NO: 293770 - RNA, 19 nt, Homo sapiens
uccaugcgguguucucuuu

SEQ ID NO: 293771 - RNA, 19 nt, Homo sapiens
cgauaacccugugaaauac

SEQ ID NO: 293772 - RNA, 19 nt, Homo sapiens
uuaaucagauggaagucuu

SEQ ID NO: 293773 - RNA, 19 nt, Homo sapiens
uaaagccgcaguagaacuu

SEQ ID NO: 293774 - RNA, 19 nt, Homo sapiens
uacaggcacuaccaugaaa

SEQ ID NO: 293775 - RNA, 19 nt, Homo sapiens
gacgauaacccugugaaau

SEQ ID NO: 293776 - RNA, 19 nt, Homo sapiens
gaccgugaccugagaagga

SEQ ID NO: 293777 - RNA, 19 nt, Homo sapiens
aaacccagaugguguuaac

SEQ ID NO: 293778 - RNA, 19 nt, Homo sapiens
uugaucauccuguacauaa

SEQ ID NO: 293779 - RNA, 19 nt, Homo sapiens
cuacaggcacuaccaugaa

SEQ ID NO: 293780 - RNA, 19 nt, Homo sapiens
gaagacgauaacccuguga

SEQ ID NO: 293781 - RNA, 19 nt, Homo sapiens
cuucauggauguucugcau

SEQ ID NO: 293782 - RNA, 19 nt, Homo sapiens
gugguguucuccuacauag

SEQ ID NO: 293783 - RNA, 19 nt, Homo sapiens
gcaccgcugcccucuuuua

SEQ ID NO: 293784 - RNA, 19 nt, Homo sapiens
ccgacuugcucuucaucuu

SEQ ID NO: 293785 - RNA, 19 nt, Homo sapiens
gacuaaaacucacccaaca

SEQ ID NO: 293786 - RNA, 19 nt, Homo sapiens
ccacuuuccggcauaacuu

SEQ ID NO: 293787 - RNA, 19 nt, Homo sapiens
gauguucgugucuguguuc

SEQ ID NO: 293788 - RNA, 19 nt, Homo sapiens
caucuugugccauguuuua

SEQ ID NO: 293789 - RNA, 19 nt, Homo sapiens
cagaaaugcccuugauggu

SEQ ID NO: 293790 - RNA, 19 nt, Homo sapiens
aguagaacuugagcugaaa

SEQ ID NO: 293791 - RNA, 19 nt, Homo sapiens
ccuacaggcacuaccauga

SEQ ID NO: 293792 - RNA, 19 nt, Homo sapiens
caucuuugaguuuaucuuc

SEQ ID NO: 293793 - RNA, 19 nt, Homo sapiens
aaacucacccaacagaucu

SEQ ID NO: 293794 - RNA, 19 nt, Homo sapiens
ugaucauccuguacauaau

SEQ ID NO: 293795 - RNA, 19 nt, Homo sapiens
uggcgaccgugaccugaga

SEQ ID NO: 293796 - RNA, 19 nt, Homo sapiens
gcuagggucaccuccuguu

SEQ ID NO: 293797 - RNA, 19 nt, Homo sapiens
gggagcuugcugugucuaa

SEQ ID NO: 293798 - RNA, 19 nt, Homo sapiens
gaaaacccagaugguguua

SEQ ID NO: 293799 - RNA, 19 nt, Homo sapiens
agacgauaacccugugaaa

SEQ ID NO: 293800 - RNA, 19 nt, Homo sapiens
cucuucaucuuugaguuua

SEQ ID NO: 293801 - RNA, 19 nt, Homo sapiens
ccugagaaggaaagaaaga

SEQ ID NO: 293802 - RNA, 19 nt, Homo sapiens
agggucaccuccuguuugu

SEQ ID NO: 293803 - RNA, 19 nt, Homo sapiens
auaacccugugaaauacuu

SEQ ID NO: 293804 - RNA, 19 nt, Homo sapiens
uagggucaccuccuguuug

SEQ ID NO: 293805 - RNA, 19 nt, Homo sapiens
ggagcuugcugugucuaac

SEQ ID NO: 293806 - RNA, 19 nt, Homo sapiens
uagccacucugcucuacgu

SEQ ID NO: 293807 - RNA, 19 nt, Homo sapiens
cauagccacucugcucuac

SEQ ID NO: 293808 - RNA, 19 nt, Homo sapiens
gcucgugggugcuguguuu

SEQ ID NO: 293809 - RNA, 19 nt, Homo sapiens
aaacagaaaugcccuugau

SEQ ID NO: 293810 - RNA, 19 nt, Homo sapiens
gguguucucuuuaaucaga

SEQ ID NO: 293811 - RNA, 19 nt, Homo sapiens
ucauaaagccgcaguagaa

SEQ ID NO: 293812 - RNA, 19 nt, Homo sapiens
acgauaacccugugaaaua

SEQ ID NO: 293813 - RNA, 19 nt, Homo sapiens
caguagaacuugagcugaa

SEQ ID NO: 293814 - RNA, 19 nt, Homo sapiens
gaucauccuguacauaauu

SEQ ID NO: 293815 - RNA, 19 nt, Homo sapiens
gaccugagaaggaaagaaa

SEQ ID NO: 293816 - RNA, 19 nt, Homo sapiens
gcgguguucucuuuaauca

SEQ ID NO: 293817 - RNA, 19 nt, Homo sapiens
ccaccuugaucauccugua

SEQ ID NO: 293818 - RNA, 19 nt, Homo sapiens
gacuugcucuucaucuuug

SEQ ID NO: 293819 - RNA, 19 nt, Homo sapiens
caugcgguguucucuuuaa

SEQ ID NO: 293820 - RNA, 19 nt, Homo sapiens
gcucuucaucuuugaguuu

SEQ ID NO: 293821 - RNA, 19 nt, Homo sapiens
cgacuugcucuucaucuuu

SEQ ID NO: 293822 - RNA, 19 nt, Homo sapiens
uccaugcgguguucucuuu

SEQ ID NO: 293823 - RNA, 19 nt, Homo sapiens
cgauaacccugugaaauac

SEQ ID NO: 293824 - RNA, 19 nt, Homo sapiens
uuaaucagauggaagucuu

SEQ ID NO: 293825 - RNA, 19 nt, Homo sapiens
uaaagccgcaguagaacuu

SEQ ID NO: 293826 - RNA, 19 nt, Homo sapiens
gacgauaacccugugaaau

SEQ ID NO: 293827 - RNA, 19 nt, Homo sapiens
aaacccagaugguguuaac

SEQ ID NO: 293828 - RNA, 19 nt, Homo sapiens
uugaucauccuguacauaa

SEQ ID NO: 293829 - RNA, 19 nt, Homo sapiens
gaagacgauaacccuguga

SEQ ID NO: 293830 - RNA, 19 nt, Homo sapiens
cuucauggauguucugcau

SEQ ID NO: 293831 - RNA, 19 nt, Homo sapiens
ccgacuugcucuucaucuu

SEQ ID NO: 293832 - RNA, 19 nt, Homo sapiens
gacuaaaacucacccaaca

SEQ ID NO: 293833 - RNA, 19 nt, Homo sapiens
ccacuuuccggcauaacuu

SEQ ID NO: 293834 - RNA, 19 nt, Homo sapiens
caucuugugccauguuuua

SEQ ID NO: 293835 - RNA, 19 nt, Homo sapiens
cagaaaugcccuugauggu

SEQ ID NO: 293836 - RNA, 19 nt, Homo sapiens
gauguucgugucuguguuc

SEQ ID NO: 293837 - RNA, 19 nt, Homo sapiens
caucuuugaguuuaucuuc

SEQ ID NO: 293838 - RNA, 19 nt, Homo sapiens
aguagaacuugagcugaaa

SEQ ID NO: 293839 - RNA, 19 nt, Homo sapiens
aaacucacccaacagaucu

SEQ ID NO: 293840 - RNA, 19 nt, Homo sapiens
ugaucauccuguacauaau

SEQ ID NO: 293841 - RNA, 19 nt, Homo sapiens
caccgugaccugagaagga

SEQ ID NO: 293842 - RNA, 19 nt, Homo sapiens
gcuagggucaccuccuguu

SEQ ID NO: 293843 - RNA, 19 nt, Homo sapiens
gggagcuugcugugucuaa

SEQ ID NO: 293844 - RNA, 19 nt, Homo sapiens
gaaaacccagaugguguua

SEQ ID NO: 293845 - RNA, 19 nt, Homo sapiens
cucuucaucuuugaguuua

SEQ ID NO: 293846 - RNA, 19 nt, Homo sapiens
agacgauaacccugugaaa

SEQ ID NO: 293847 - RNA, 19 nt, Homo sapiens
ccugagaaggaaagaaaga

SEQ ID NO: 293848 - RNA, 19 nt, Homo sapiens
agggucaccuccuguuugu

SEQ ID NO: 293849 - RNA, 19 nt, Homo sapiens
auaacccugugaaauacuu

SEQ ID NO: 293850 - RNA, 19 nt, Homo sapiens
uagggucaccuccuguuug

SEQ ID NO: 293851 - RNA, 19 nt, Homo sapiens
ggagcuugcugugucuaac

SEQ ID NO: 293852 - RNA, 19 nt, Homo sapiens
uagccacucugcucuacgu

SEQ ID NO: 293853 - RNA, 19 nt, Homo sapiens
cauagccacucugcucuac

SEQ ID NO: 293854 - RNA, 19 nt, Homo sapiens
gcucgugggugcuguguuu

SEQ ID NO: 293855 - RNA, 19 nt, Homo sapiens
aaacagaaaugcccuugau

SEQ ID NO: 293856 - RNA, 19 nt, Homo sapiens
gguguucucuuuaaucaga

SEQ ID NO: 293857 - RNA, 19 nt, Homo sapiens
ucauaaagccgcaguagaa

SEQ ID NO: 293858 - RNA, 19 nt, Homo sapiens
acgauaacccugugaaaua

SEQ ID NO: 293859 - RNA, 19 nt, Homo sapiens
caagacggcuucaccuaca

SEQ ID NO: 293860 - RNA, 19 nt, Homo sapiens
caguagaacuugagcugaa

SEQ ID NO: 293861 - RNA, 19 nt, Homo sapiens
gcacuaccaugaaaacauu

SEQ ID NO: 293862 - RNA, 19 nt, Homo sapiens
gaccugagaaggaaagaaa

SEQ ID NO: 293863 - RNA, 19 nt, Homo sapiens
gcgguguucucuuuaauca

SEQ ID NO: 293864 - RNA, 19 nt, Homo sapiens
cugcaccgcugcccucuuu

SEQ ID NO: 293865 - RNA, 19 nt, Homo sapiens
gacuugcucuucaucuuug

SEQ ID NO: 293866 - RNA, 19 nt, Homo sapiens
caugcgguguucucuuuaa

SEQ ID NO: 293867 - RNA, 19 nt, Homo sapiens
gcucuucaucuuugaguuu

SEQ ID NO: 293868 - RNA, 19 nt, Homo sapiens
cgacuugcucuucaucuuu

SEQ ID NO: 293869 - RNA, 19 nt, Homo sapiens
uccaugcgguguucucuuu

SEQ ID NO: 293870 - RNA, 19 nt, Homo sapiens
cgauaacccugugaaauac

SEQ ID NO: 293871 - RNA, 19 nt, Homo sapiens
uuaaucagauggaagucuu

SEQ ID NO: 293872 - RNA, 19 nt, Homo sapiens
uaaagccgcaguagaacuu

SEQ ID NO: 293873 - RNA, 19 nt, Homo sapiens
uacaggcacuaccaugaaa

SEQ ID NO: 293874 - RNA, 19 nt, Homo sapiens
gacgauaacccugugaaau

SEQ ID NO: 293875 - RNA, 19 nt, Homo sapiens
aaacccagaugguguuaac

SEQ ID NO: 293876 - RNA, 19 nt, Homo sapiens
cuacaggcacuaccaugaa

SEQ ID NO: 293877 - RNA, 19 nt, Homo sapiens
gaagacgauaacccuguga

SEQ ID NO: 293878 - RNA, 19 nt, Homo sapiens
cuucauggauguucugcau

SEQ ID NO: 293879 - RNA, 19 nt, Homo sapiens
gugguguucuccuacauag

SEQ ID NO: 293880 - RNA, 19 nt, Homo sapiens
gcaccgcugcccucuuuua

SEQ ID NO: 293881 - RNA, 19 nt, Homo sapiens
ccgacuugcucuucaucuu

SEQ ID NO: 293882 - RNA, 19 nt, Homo sapiens
gacuaaaacucacccaaca

SEQ ID NO: 293883 - RNA, 19 nt, Homo sapiens
ccacuuuccggcauaacuu

SEQ ID NO: 293884 - RNA, 19 nt, Homo sapiens
caucuugugccauguuuua

SEQ ID NO: 293885 - RNA, 19 nt, Homo sapiens
cagaaaugcccuugauggu

SEQ ID NO: 293886 - RNA, 19 nt, Homo sapiens
aguagaacuugagcugaaa

SEQ ID NO: 293887 - RNA, 19 nt, Homo sapiens
ccuacaggcacuaccauga

SEQ ID NO: 293888 - RNA, 19 nt, Homo sapiens
aaacucacccaacagaucu

SEQ ID NO: 293889 - RNA, 19 nt, Homo sapiens
caccgugaccugagaagga

SEQ ID NO: 293890 - RNA, 19 nt, Homo sapiens
gcuagggucaccuccuguu

SEQ ID NO: 293891 - RNA, 19 nt, Homo sapiens
gggagcuugcugugucuaa

SEQ ID NO: 293892 - RNA, 19 nt, Homo sapiens
gaaaacccagaugguguua

SEQ ID NO: 293893 - RNA, 19 nt, Homo sapiens
agacgauaacccugugaaa

SEQ ID NO: 293894 - RNA, 19 nt, Homo sapiens
ccugagaaggaaagaaaga

SEQ ID NO: 293895 - RNA, 19 nt, Homo sapiens
agggucaccuccuguuugu

SEQ ID NO: 293896 - RNA, 19 nt, Homo sapiens
auaacccugugaaauacuu

SEQ ID NO: 293897 - RNA, 19 nt, Homo sapiens
uagggucaccuccuguuug

SEQ ID NO: 293898 - RNA, 19 nt, Homo sapiens
ggagcuugcugugucuaac

SEQ ID NO: 293899 - RNA, 19 nt, Homo sapiens
uagccacucugcucuacgu

SEQ ID NO: 293900 - RNA, 19 nt, Homo sapiens
cauagccacucugcucuac

SEQ ID NO: 293901 - RNA, 19 nt, Homo sapiens
gcucgugggugcuguguuu

SEQ ID NO: 293902 - RNA, 19 nt, Homo sapiens
aaacagaaaugcccuugau

SEQ ID NO: 293903 - RNA, 19 nt, Homo sapiens
gguguucucuuuaaucaga

SEQ ID NO: 293904 - RNA, 19 nt, Homo sapiens
ucauaaagccgcaguagaa

SEQ ID NO: 293905 - RNA, 19 nt, Homo sapiens
acgauaacccugugaaaua

SEQ ID NO: 293906 - RNA, 19 nt, Homo sapiens
caguagaacuugagcugaa

SEQ ID NO: 293907 - RNA, 19 nt, Homo sapiens
gaccugagaaggaaagaaa

SEQ ID NO: 293908 - RNA, 19 nt, Homo sapiens
gcgguguucucuuuaauca

SEQ ID NO: 293909 - RNA, 19 nt, Homo sapiens
gacuugcucuucaucuuug

SEQ ID NO: 293910 - RNA, 19 nt, Homo sapiens
caugcgguguucucuuuaa

SEQ ID NO: 293911 - RNA, 19 nt, Homo sapiens
gcucuucaucuuugaguuu

SEQ ID NO: 293912 - RNA, 19 nt, Homo sapiens
cgacuugcucuucaucuuu

SEQ ID NO: 293913 - RNA, 19 nt, Homo sapiens
uccaugcgguguucucuuu

SEQ ID NO: 293914 - RNA, 19 nt, Homo sapiens
cgauaacccugugaaauac

SEQ ID NO: 293915 - RNA, 19 nt, Homo sapiens
uuaaucagauggaagucuu

SEQ ID NO: 293916 - RNA, 19 nt, Homo sapiens
uaaagccgcaguagaacuu

SEQ ID NO: 293917 - RNA, 19 nt, Homo sapiens
gacgauaacccugugaaau

SEQ ID NO: 293918 - RNA, 19 nt, Homo sapiens
aaacccagaugguguuaac

SEQ ID NO: 293919 - RNA, 19 nt, Homo sapiens
gaguuuguguucuccuaca

SEQ ID NO: 293920 - RNA, 19 nt, Homo sapiens
gaagacgauaacccuguga

SEQ ID NO: 293921 - RNA, 19 nt, Homo sapiens
cuucauggauguucugcau

SEQ ID NO: 293922 - RNA, 19 nt, Homo sapiens
ccgacuugcucuucaucuu

SEQ ID NO: 293923 - RNA, 19 nt, Homo sapiens
gacuaaaacucacccaaca

SEQ ID NO: 293924 - RNA, 19 nt, Homo sapiens
ccacuuuccggcauaacuu

SEQ ID NO: 293925 - RNA, 19 nt, Homo sapiens
caucuugugccauguuuua

SEQ ID NO: 293926 - RNA, 19 nt, Homo sapiens
cagaaaugcccuugauggu

SEQ ID NO: 293927 - RNA, 19 nt, Homo sapiens
aguagaacuugagcugaaa

SEQ ID NO: 293928 - RNA, 19 nt, Homo sapiens
aaacucacccaacagaucu

SEQ ID NO: 293929 - RNA, 19 nt, Homo sapiens
caccgugaccugagaagga

SEQ ID NO: 293930 - RNA, 19 nt, Homo sapiens
gcuagggucaccuccuguu

SEQ ID NO: 293931 - RNA, 19 nt, Homo sapiens
gggagcuugcugugucuaa

SEQ ID NO: 293932 - RNA, 19 nt, Homo sapiens
gaaaacccagaugguguua

SEQ ID NO: 293933 - RNA, 19 nt, Homo sapiens
agacgauaacccugugaaa

SEQ ID NO: 293934 - RNA, 19 nt, Homo sapiens
caucuuugaguuuguguuc

SEQ ID NO: 293935 - RNA, 19 nt, Homo sapiens
ccugagaaggaaagaaaga

SEQ ID NO: 293936 - RNA, 19 nt, Homo sapiens
agggucaccuccuguuugu

SEQ ID NO: 293937 - RNA, 19 nt, Homo sapiens
auaacccugugaaauacuu

SEQ ID NO: 293938 - RNA, 19 nt, Homo sapiens
uagggucaccuccuguuug

SEQ ID NO: 293939 - RNA, 19 nt, Homo sapiens
ggagcuugcugugucuaac

SEQ ID NO: 293940 - RNA, 19 nt, Homo sapiens
uagccacucugcucuacgu

SEQ ID NO: 293941 - RNA, 19 nt, Homo sapiens
cauagccacucugcucuac

SEQ ID NO: 293942 - RNA, 19 nt, Homo sapiens
gaggugagcuuucaaauuu

SEQ ID NO: 293943 - RNA, 19 nt, Homo sapiens
acacagagaucacaacuua

SEQ ID NO: 293944 - RNA, 19 nt, Homo sapiens
gaauagauuuggugugaua

SEQ ID NO: 293945 - RNA, 19 nt, Homo sapiens
gcagagacauugaaauauu

SEQ ID NO: 293946 - RNA, 19 nt, Homo sapiens
agacagaucuggaagcuaa

SEQ ID NO: 293947 - RNA, 19 nt, Homo sapiens
ucaaagagaugaugaaaca

SEQ ID NO: 293948 - RNA, 19 nt, Homo sapiens
ggauuaggcugaaacauau

SEQ ID NO: 293949 - RNA, 19 nt, Homo sapiens
gaucacaacuuagaagaaa

SEQ ID NO: 293950 - RNA, 19 nt, Homo sapiens
ggaccuaaauuccuuauca

SEQ ID NO: 293951 - RNA, 19 nt, Homo sapiens
ggagacagcuucuaugagu

SEQ ID NO: 293952 - RNA, 19 nt, Homo sapiens
gaaauugggucugucuaaa

SEQ ID NO: 293953 - RNA, 19 nt, Homo sapiens
caucggaacugcaguauau

SEQ ID NO: 293954 - RNA, 19 nt, Homo sapiens
gaacaguacugaacaaacu

SEQ ID NO: 293955 - RNA, 19 nt, Homo sapiens
caaaggagcaacuauagua

SEQ ID NO: 293956 - RNA, 19 nt, Homo sapiens
gggauuaaaugaacucaaa

SEQ ID NO: 293957 - RNA, 19 nt, Homo sapiens
gagaugaugucugcuuuaa

SEQ ID NO: 293958 - RNA, 19 nt, Homo sapiens
gcaggucuaucauuauuug

SEQ ID NO: 293959 - RNA, 19 nt, Homo sapiens
guaaauauacgcuuuguug

SEQ ID NO: 293960 - RNA, 19 nt, Homo sapiens
guucagauuucucagauuu

SEQ ID NO: 293961 - RNA, 19 nt, Homo sapiens
gggcaaagaucaaagagau

SEQ ID NO: 293962 - RNA, 19 nt, Homo sapiens
gggcauugcugaauaugaa

SEQ ID NO: 293963 - RNA, 19 nt, Homo sapiens
gcaaggacuuugaccaugu

SEQ ID NO: 293964 - RNA, 19 nt, Homo sapiens
aaagagaggguauuucaua

SEQ ID NO: 293965 - RNA, 19 nt, Homo sapiens
ccacaaggccuuuauccua

SEQ ID NO: 293966 - RNA, 19 nt, Homo sapiens
gaaagaggcagcagucuca

SEQ ID NO: 293967 - RNA, 19 nt, Homo sapiens
gaaacaugcuuggaauaau

SEQ ID NO: 293968 - RNA, 19 nt, Homo sapiens
gaugaaacaugcuuggaau

SEQ ID NO: 293969 - RNA, 19 nt, Homo sapiens
gcagcggacuaacuuauau

SEQ ID NO: 293970 - RNA, 19 nt, Homo sapiens
cacaaggccuuuauccuaa

SEQ ID NO: 293971 - RNA, 19 nt, Homo sapiens
ucaagcaguuuguuuggua

SEQ ID NO: 293972 - RNA, 19 nt, Homo sapiens
cauaugaaauugcugcauu

SEQ ID NO: 293973 - RNA, 19 nt, Homo sapiens
ccacaguccuggaguaaau

SEQ ID NO: 293974 - RNA, 19 nt, Homo sapiens
ggguuuaacugaauauaug

SEQ ID NO: 293975 - RNA, 19 nt, Homo sapiens
guaggucugugauuaaguu

SEQ ID NO: 293976 - RNA, 19 nt, Homo sapiens
accagaagcuuucagauuu

SEQ ID NO: 293977 - RNA, 19 nt, Homo sapiens
aagaauagauuugguguga

SEQ ID NO: 293978 - RNA, 19 nt, Homo sapiens
ggauuugacucugaaagaa

SEQ ID NO: 293979 - RNA, 19 nt, Homo sapiens
aaaggaaguugaaaucaga

SEQ ID NO: 293980 - RNA, 19 nt, Homo sapiens
gcucugcuaucacugaauu

SEQ ID NO: 293981 - RNA, 19 nt, Homo sapiens
auacuucacucacauugua

SEQ ID NO: 293982 - RNA, 19 nt, Homo sapiens
uuaugcaggucuaucauua

SEQ ID NO: 293983 - RNA, 19 nt, Homo sapiens
gaacucaaaccuauaucaa

SEQ ID NO: 293984 - RNA, 19 nt, Homo sapiens
gcaaagaucaaagagauga

SEQ ID NO: 293985 - RNA, 19 nt, Homo sapiens
gacaggaccaucuuuauga

SEQ ID NO: 293986 - RNA, 19 nt, Homo sapiens
gcugaaacauaugaaauug

SEQ ID NO: 293987 - RNA, 19 nt, Homo sapiens
gagaggguauuucauaugg

SEQ ID NO: 293988 - RNA, 19 nt, Homo sapiens
caucaaaggagcaacuaua

SEQ ID NO: 293989 - RNA, 19 nt, Homo sapiens
ggacaggaccaucuuuaug

SEQ ID NO: 293990 - RNA, 19 nt, Homo sapiens
guagauauacuuccaugaa

SEQ ID NO: 293991 - RNA, 19 nt, Homo sapiens
gaccagaagcuuucagauu

SEQ ID NO: 293992 - RNA, 19 nt, Homo sapiens
gaugaacuuugauuaguag

SEQ ID NO: 293993 - RNA, 19 nt, Homo sapiens
uggcagagacauugaaaua

SEQ ID NO: 293994 - RNA, 19 nt, Homo sapiens
gaaauugcccguacuuguc

SEQ ID NO: 293995 - RNA, 19 nt, Homo sapiens
gcacuugagccacuuauca

SEQ ID NO: 293996 - RNA, 19 nt, Homo sapiens
ucacucacauuguaauuca

SEQ ID NO: 293997 - RNA, 19 nt, Homo sapiens
ccagaagcuuucagauuug

SEQ ID NO: 293998 - RNA, 19 nt, Homo sapiens
gagacagcuucuaugagua

SEQ ID NO: 293999 - RNA, 19 nt, Homo sapiens
ggagaugaugucugcuuua

SEQ ID NO: 294000 - RNA, 19 nt, Homo sapiens
ccgaggagauccaaagaga

SEQ ID NO: 294001 - RNA, 19 nt, Homo sapiens
uggauuaggcugaaacaua

SEQ ID NO: 294002 - RNA, 19 nt, Homo sapiens
uauggagacuuacauguau

SEQ ID NO: 294003 - RNA, 19 nt, Homo sapiens
gauaccuuguguuugcuua

SEQ ID NO: 294004 - RNA, 19 nt, Homo sapiens
gauccaaaguacaggaaau

SEQ ID NO: 294005 - RNA, 19 nt, Homo sapiens
uggaauaccuugggcauug

SEQ ID NO: 294006 - RNA, 19 nt, Homo sapiens
gaaguaaauauacgcuuug

SEQ ID NO: 294007 - RNA, 19 nt, Homo sapiens
ugaaacaugcuuggaauaa

SEQ ID NO: 294008 - RNA, 19 nt, Homo sapiens
uacauuggcccacuauaua

SEQ ID NO: 294009 - RNA, 19 nt, Homo sapiens
ggugugauaccuuguguuu

SEQ ID NO: 294010 - RNA, 19 nt, Homo sapiens
auuaguaggucugugauua

SEQ ID NO: 294011 - RNA, 19 nt, Homo sapiens
gaaaucagagaggaauaaa

SEQ ID NO: 294012 - RNA, 19 nt, Homo sapiens
gguaaugaauauucgaaca

SEQ ID NO: 294013 - RNA, 19 nt, Homo sapiens
gaaagcaggauuugacucu

SEQ ID NO: 294014 - RNA, 19 nt, Homo sapiens
ccaaggagacccugcagaa

SEQ ID NO: 294015 - RNA, 19 nt, Homo sapiens
uauaguagaugcccuggau

SEQ ID NO: 294016 - RNA, 19 nt, Homo sapiens
caagcaguuuguuugguaa

SEQ ID NO: 294017 - RNA, 19 nt, Homo sapiens
gggcuaauacgaugcauau

SEQ ID NO: 294018 - RNA, 19 nt, Homo sapiens
ucagauuucucagauuuga

SEQ ID NO: 294019 - RNA, 19 nt, Homo sapiens
ccuauuaucucuggauuuc

SEQ ID NO: 294020 - RNA, 19 nt, Homo sapiens
guacugaacaaacuggaaa

SEQ ID NO: 294021 - RNA, 19 nt, Homo sapiens
ugguguaugucaaagaaua

SEQ ID NO: 294022 - RNA, 19 nt, Homo sapiens
cuaaagagaggguauuuca

SEQ ID NO: 294023 - RNA, 19 nt, Homo sapiens
gaaaaccauugcagaguga

SEQ ID NO: 294024 - RNA, 19 nt, Homo sapiens
uaucgagacucauuugauc

SEQ ID NO: 294025 - RNA, 19 nt, Homo sapiens
cugaaggccugguuaaugu

SEQ ID NO: 294026 - RNA, 19 nt, Homo sapiens
ggucugugauuaaguucuu

SEQ ID NO: 294027 - RNA, 19 nt, Homo sapiens
cauaugguuccaccuaaua

SEQ ID NO: 294028 - RNA, 19 nt, Homo sapiens
gaaagucauuccaaaagga

SEQ ID NO: 294029 - RNA, 19 nt, Homo sapiens
ccaaagagacauccuacug

SEQ ID NO: 294030 - RNA, 19 nt, Homo sapiens
ggcccacuauauauacaua

SEQ ID NO: 294031 - RNA, 19 nt, Homo sapiens
acagagaggugagcuuuca

SEQ ID NO: 294032 - RNA, 19 nt, Homo sapiens
gcugaaauuucugucuuug

SEQ ID NO: 294033 - RNA, 19 nt, Homo sapiens
gcuaauacgaugcauauac

SEQ ID NO: 294034 - RNA, 19 nt, Homo sapiens
gaggagauccaaagagaca

SEQ ID NO: 294035 - RNA, 19 nt, Homo sapiens
gaauuuggaacccugcauu

SEQ ID NO: 294036 - RNA, 19 nt, Homo sapiens
gggcgaaguugacgagucu

SEQ ID NO: 294037 - RNA, 19 nt, Homo sapiens
uuuaugaccugcuuucugu

SEQ ID NO: 294038 - RNA, 19 nt, Homo sapiens
aagagaggguauuucauau

SEQ ID NO: 294039 - RNA, 19 nt, Homo sapiens
gaagaaauugggucugucu

SEQ ID NO: 294040 - RNA, 19 nt, Homo sapiens
uggauuagcuuuuggguuu

SEQ ID NO: 294041 - RNA, 19 nt, Homo sapiens
ucaugaagguguaauaucg

SEQ ID NO: 294042 - RNA, 19 nt, Homo sapiens
caagggcucuuucuuauua

SEQ ID NO: 294043 - RNA, 19 nt, Homo sapiens
caacagcacugacgucuau

SEQ ID NO: 294044 - RNA, 19 nt, Homo sapiens
ggagaugacuuccgauaug

SEQ ID NO: 294045 - RNA, 19 nt, Homo sapiens
ccacaggcauucccauuaa

SEQ ID NO: 294046 - RNA, 19 nt, Homo sapiens
gcagugagguccaagauag

SEQ ID NO: 294047 - RNA, 19 nt, Homo sapiens
caacagugauggcauucua

SEQ ID NO: 294048 - RNA, 19 nt, Homo sapiens
gcacugacgucuauuugga

SEQ ID NO: 294049 - RNA, 19 nt, Homo sapiens
ggaauccugugguuaugua

SEQ ID NO: 294050 - RNA, 19 nt, Homo sapiens
gaaaguucauucacagaga

SEQ ID NO: 294051 - RNA, 19 nt, Homo sapiens
ggagaccgcacucaucuua

SEQ ID NO: 294052 - RNA, 19 nt, Homo sapiens
gaaacacccuaaucuagau

SEQ ID NO: 294053 - RNA, 19 nt, Homo sapiens
gaaagaaacacccuaaucu

SEQ ID NO: 294054 - RNA, 19 nt, Homo sapiens
ucaauagcauggugucuaa

SEQ ID NO: 294055 - RNA, 19 nt, Homo sapiens
caagaucugcugccaauuu

SEQ ID NO: 294056 - RNA, 19 nt, Homo sapiens
gggcagaggucuccuucuu

SEQ ID NO: 294057 - RNA, 19 nt, Homo sapiens
cggaggagcugccguuuga

SEQ ID NO: 294058 - RNA, 19 nt, Homo sapiens
gaggagaaccaugagauua

SEQ ID NO: 294059 - RNA, 19 nt, Homo sapiens
gagaugacuuccgauauga

SEQ ID NO: 294060 - RNA, 19 nt, Homo sapiens
gagauuaucagccauauca

SEQ ID NO: 294061 - RNA, 19 nt, Homo sapiens
aaacagggauauagaagug

SEQ ID NO: 294062 - RNA, 19 nt, Homo sapiens
gaaaggaaagccuccaaga

SEQ ID NO: 294063 - RNA, 19 nt, Homo sapiens
ggucugcgcucauuucauc

SEQ ID NO: 294064 - RNA, 19 nt, Homo sapiens
ggaaagaaacacccuaauc

SEQ ID NO: 294065 - RNA, 19 nt, Homo sapiens
gcacuuggccuauguacug

SEQ ID NO: 294066 - RNA, 19 nt, Homo sapiens
gagacugccucuuaacaug

SEQ ID NO: 294067 - RNA, 19 nt, Homo sapiens
gcacauccauacagacauc

SEQ ID NO: 294068 - RNA, 19 nt, Homo sapiens
ggaacauaaggaagaauua

SEQ ID NO: 294069 - RNA, 19 nt, Homo sapiens
gaaggacucgcuagagauu

SEQ ID NO: 294070 - RNA, 19 nt, Homo sapiens
caaggagaccuaccacuuu

SEQ ID NO: 294071 - RNA, 19 nt, Homo sapiens
guagaaggaaucacuguuu

SEQ ID NO: 294072 - RNA, 19 nt, Homo sapiens
ggaugacacucgcuuaagu

SEQ ID NO: 294073 - RNA, 19 nt, Homo sapiens
gccaagggcucaaggacaa

SEQ ID NO: 294074 - RNA, 19 nt, Homo sapiens
ccacuacuuugcauugauu

SEQ ID NO: 294075 - RNA, 19 nt, Homo sapiens
caacacauccucaauagca

SEQ ID NO: 294076 - RNA, 19 nt, Homo sapiens
gguacccacugucugauuu

SEQ ID NO: 294077 - RNA, 19 nt, Homo sapiens
caacaagccagaugaggaa

SEQ ID NO: 294078 - RNA, 19 nt, Homo sapiens
gaagcagacagaagaggua

SEQ ID NO: 294079 - RNA, 19 nt, Homo sapiens
aaagaaacacccuaaucua

SEQ ID NO: 294080 - RNA, 19 nt, Homo sapiens
ugugauggcuuugcaguaa

SEQ ID NO: 294081 - RNA, 19 nt, Homo sapiens
gaagaagucccagcuguuc

SEQ ID NO: 294082 - RNA, 19 nt, Homo sapiens
ccauuaaagucagaaacua

SEQ ID NO: 294083 - RNA, 19 nt, Homo sapiens
ggauggagcaguagaagga

SEQ ID NO: 294084 - RNA, 19 nt, Homo sapiens
ggacaagccacacggguau

SEQ ID NO: 294085 - RNA, 19 nt, Homo sapiens
cccaagggcucuuucuuau

SEQ ID NO: 294086 - RNA, 19 nt, Homo sapiens
ggaagaagucccagcuguu

SEQ ID NO: 294087 - RNA, 19 nt, Homo sapiens
ggagaaccaugagauuauc

SEQ ID NO: 294088 - RNA, 19 nt, Homo sapiens
gauugguccuacuuucuuu

SEQ ID NO: 294089 - RNA, 19 nt, Homo sapiens
gggacuacgucaacaagga

SEQ ID NO: 294090 - RNA, 19 nt, Homo sapiens
ccauggagauugcuaccuu

SEQ ID NO: 294091 - RNA, 19 nt, Homo sapiens
caagauagccacucuacca

SEQ ID NO: 294092 - RNA, 19 nt, Homo sapiens
cagaggugguugcguacua

SEQ ID NO: 294093 - RNA, 19 nt, Homo sapiens
ggaggagaaccaugagauu

SEQ ID NO: 294094 - RNA, 19 nt, Homo sapiens
cuaacaggcugcagaaugg

SEQ ID NO: 294095 - RNA, 19 nt, Homo sapiens
ccuugaagccucaccuuua

SEQ ID NO: 294096 - RNA, 19 nt, Homo sapiens
gcuaacaggcugcagaaug

SEQ ID NO: 294097 - RNA, 19 nt, Homo sapiens
gaguggagccuaccucuuc

SEQ ID NO: 294098 - RNA, 19 nt, Homo sapiens
gcaggagccuucauuucag

SEQ ID NO: 294099 - RNA, 19 nt, Homo sapiens
cugaaggccucgcugcuuu

SEQ ID NO: 294100 - RNA, 19 nt, Homo sapiens
gccacaggcauucccauua

SEQ ID NO: 294101 - RNA, 19 nt, Homo sapiens
uagucuaucugcagaggua

SEQ ID NO: 294102 - RNA, 19 nt, Homo sapiens
uagaaggaaucacuguuuc

SEQ ID NO: 294103 - RNA, 19 nt, Homo sapiens
gcacucuuucugacuauuu

SEQ ID NO: 294104 - RNA, 19 nt, Homo sapiens
gguggaagcagacagaaga

SEQ ID NO: 294105 - RNA, 19 nt, Homo sapiens
gacgguaucugaagaagcu

SEQ ID NO: 294106 - RNA, 19 nt, Homo sapiens
gaaacgggcagcuggagau

SEQ ID NO: 294107 - RNA, 19 nt, Homo sapiens
gggaagaauuuaugauagc

SEQ ID NO: 294108 - RNA, 19 nt, Homo sapiens
cugcagagguauucaguuc

SEQ ID NO: 294109 - RNA, 19 nt, Homo sapiens
aagagaaaguucauucaca

SEQ ID NO: 294110 - RNA, 19 nt, Homo sapiens
aaggagaccuaccacuuug

SEQ ID NO: 294111 - RNA, 19 nt, Homo sapiens
gggcugccaucuucugugu

SEQ ID NO: 294112 - RNA, 19 nt, Homo sapiens
cccaagaucugcugccaau

SEQ ID NO: 294113 - RNA, 19 nt, Homo sapiens
ggccaauucccacuacuuu

SEQ ID NO: 294114 - RNA, 19 nt, Homo sapiens
agaaacacccuaaucuaga

SEQ ID NO: 294115 - RNA, 19 nt, Homo sapiens
gcucaggcacccauccuuu

SEQ ID NO: 294116 - RNA, 19 nt, Homo sapiens
aggaaggacucgcuagaga

SEQ ID NO: 294117 - RNA, 19 nt, Homo sapiens
gcaggaaggacucgcuaga

SEQ ID NO: 294118 - RNA, 19 nt, Homo sapiens
ggaaucacuguuucuccua

SEQ ID NO: 294119 - RNA, 19 nt, Homo sapiens
ggauauagaagugguggaa

SEQ ID NO: 294120 - RNA, 19 nt, Homo sapiens
gcucaaggacaacaagaga

SEQ ID NO: 294121 - RNA, 19 nt, Homo sapiens
ggacaggcuauuacacuuc

SEQ ID NO: 294122 - RNA, 19 nt, Homo sapiens
caacggcucuuugacuucu

SEQ ID NO: 294123 - RNA, 19 nt, Homo sapiens
acacagagcagacccaaca

SEQ ID NO: 294124 - RNA, 19 nt, Homo sapiens
cgacugggaugcugaagac

SEQ ID NO: 294125 - RNA, 19 nt, Homo sapiens
gggcauguagaguauauga

SEQ ID NO: 294126 - RNA, 19 nt, Homo sapiens
uaucaucccugguggacau

SEQ ID NO: 294127 - RNA, 19 nt, Homo sapiens
ugaggaacauaaggaagaa

SEQ ID NO: 294128 - RNA, 19 nt, Homo sapiens
ggauugguccuacuuucuu

SEQ ID NO: 294129 - RNA, 19 nt, Homo sapiens
ggaaggacucgcuagagau

SEQ ID NO: 294130 - RNA, 19 nt, Homo sapiens
gggugucucuagccucaaa

SEQ ID NO: 294131 - RNA, 19 nt, Homo sapiens
cuucugcgcucccuuguca

SEQ ID NO: 294132 - RNA, 19 nt, Homo sapiens
aagaucugcugccaauuug

SEQ ID NO: 294133 - RNA, 19 nt, Homo sapiens
gcacuaugccaucaagaag

SEQ ID NO: 294134 - RNA, 19 nt, Homo sapiens
cauggagauugcuaccuuu

SEQ ID NO: 294135 - RNA, 19 nt, Homo sapiens
cccaacacauccucaauag

SEQ ID NO: 294136 - RNA, 19 nt, Homo sapiens
caagggcaagcuauuauuc

SEQ ID NO: 294137 - RNA, 19 nt, Homo sapiens
ggaagaauuuaugauagcu

SEQ ID NO: 294138 - RNA, 19 nt, Homo sapiens
gagaaaguucauucacaga

SEQ ID NO: 294139 - RNA, 19 nt, Homo sapiens
caagaccuuugacaaguac

SEQ ID NO: 294140 - RNA, 19 nt, Homo sapiens
uauagaugcugaaaaggua

SEQ ID NO: 294141 - RNA, 19 nt, Homo sapiens
ccgccaugcugcccuacua

SEQ ID NO: 294142 - RNA, 19 nt, Homo sapiens
gaaccaguuugugcuauuu

SEQ ID NO: 294143 - RNA, 19 nt, Homo sapiens
ggacugggcucgauuugag

SEQ ID NO: 294144 - RNA, 19 nt, Homo sapiens
ggaaagugauggagaaggu

SEQ ID NO: 294145 - RNA, 19 nt, Homo sapiens
caaagagacugugaggaaa

SEQ ID NO: 294146 - RNA, 19 nt, Homo sapiens
ggaauuuggugaacuccuu

SEQ ID NO: 294147 - RNA, 19 nt, Homo sapiens
ggaaccaguuugugcuauu

SEQ ID NO: 294148 - RNA, 19 nt, Homo sapiens
ccacagugccuuccucuuu

SEQ ID NO: 294149 - RNA, 19 nt, Homo sapiens
ucaaagagacugugaggaa

SEQ ID NO: 294150 - RNA, 19 nt, Homo sapiens
gaagccaugugccauuaug

SEQ ID NO: 294151 - RNA, 19 nt, Homo sapiens
gaagaugugcucugaguuc

SEQ ID NO: 294152 - RNA, 19 nt, Homo sapiens
gggcugagcuagcuguguu

SEQ ID NO: 294153 - RNA, 19 nt, Homo sapiens
guacacagccaaucagaug

SEQ ID NO: 294154 - RNA, 19 nt, Homo sapiens
gggaagaugugcucugagu

SEQ ID NO: 294155 - RNA, 19 nt, Homo sapiens
ggacaccuuuggcuacuca

SEQ ID NO: 294156 - RNA, 19 nt, Homo sapiens
cgaccuacccacuacaaua

SEQ ID NO: 294157 - RNA, 19 nt, Homo sapiens
caagggcucuuuccaggau

SEQ ID NO: 294158 - RNA, 19 nt, Homo sapiens
gcucaacgacugcaaguau

SEQ ID NO: 294159 - RNA, 19 nt, Homo sapiens
gcagugcccaguuccuaua

SEQ ID NO: 294160 - RNA, 19 nt, Homo sapiens
ccagcuauguccugacuga

SEQ ID NO: 294161 - RNA, 19 nt, Homo sapiens
ggaagcggaucgaagugau

SEQ ID NO: 294162 - RNA, 19 nt, Homo sapiens
cugaagcgccugagcaaua

SEQ ID NO: 294163 - RNA, 19 nt, Homo sapiens
gccaggaaguucaccuuug

SEQ ID NO: 294164 - RNA, 19 nt, Homo sapiens
gcaugaggcccacaaguuc

SEQ ID NO: 294165 - RNA, 19 nt, Homo sapiens
ucaacacacugcccuggaa

SEQ ID NO: 294166 - RNA, 19 nt, Homo sapiens
ccaaucagauggugaacgu

SEQ ID NO: 294167 - RNA, 19 nt, Homo sapiens
ccuaugagauccaguuugg

SEQ ID NO: 294168 - RNA, 19 nt, Homo sapiens
ugaagaccguggccaacaa

SEQ ID NO: 294169 - RNA, 19 nt, Homo sapiens
gggaagggaagcaugauug

SEQ ID NO: 294170 - RNA, 19 nt, Homo sapiens
gcagcgaccuacccacuac

SEQ ID NO: 294171 - RNA, 19 nt, Homo sapiens
ccacuugacuucgggacaa

SEQ ID NO: 294172 - RNA, 19 nt, Homo sapiens
gugcagcuaucuucuccaa

SEQ ID NO: 294173 - RNA, 19 nt, Homo sapiens
cacagugccuuccucuuug

SEQ ID NO: 294174 - RNA, 19 nt, Homo sapiens
caucaucagugacgucgau

SEQ ID NO: 294175 - RNA, 19 nt, Homo sapiens
ggucugguguggcgugaug

SEQ ID NO: 294176 - RNA, 19 nt, Homo sapiens
ggcaugaggcccacaaguu

SEQ ID NO: 294177 - RNA, 19 nt, Homo sapiens
aggaagccaugugccauua

SEQ ID NO: 294178 - RNA, 19 nt, Homo sapiens
ggaguucccaggccaccua

SEQ ID NO: 294179 - RNA, 19 nt, Homo sapiens
aagcgcacaucaucaguga

SEQ ID NO: 294180 - RNA, 19 nt, Homo sapiens
gaggaagccaugugccauu

SEQ ID NO: 294181 - RNA, 19 nt, Homo sapiens
guucaccuaugcacugaug

SEQ ID NO: 294182 - RNA, 19 nt, Homo sapiens
ccagcagccuguguucgua

SEQ ID NO: 294183 - RNA, 19 nt, Homo sapiens
gaaagccaacacaccauuc

SEQ ID NO: 294184 - RNA, 19 nt, Homo sapiens
ugacgucgaucacgaugca

SEQ ID NO: 294185 - RNA, 19 nt, Homo sapiens
gguguggcgugauggagaa

SEQ ID NO: 294186 - RNA, 19 nt, Homo sapiens
gaguucaccuaugcacuga

SEQ ID NO: 294187 - RNA, 19 nt, Homo sapiens
gcaaguauggcgcgucagu

SEQ ID NO: 294188 - RNA, 19 nt, Homo sapiens
ccaggaaguucaccuuugc

SEQ ID NO: 294189 - RNA, 19 nt, Homo sapiens
ucuuggagcugcacaaugg

SEQ ID NO: 294190 - RNA, 19 nt, Homo sapiens
gcaggaguuugggaagaug

SEQ ID NO: 294191 - RNA, 19 nt, Homo sapiens
gaccagcuauguccugacu

SEQ ID NO: 294192 - RNA, 19 nt, Homo sapiens
ccaaagagggugagaagac

SEQ ID NO: 294193 - RNA, 19 nt, Homo sapiens
gggaaccaguuugugcuau

SEQ ID NO: 294194 - RNA, 19 nt, Homo sapiens
gcacugccacauugauaca

SEQ ID NO: 294195 - RNA, 19 nt, Homo sapiens
gcuggaauuuggugaacuc

SEQ ID NO: 294196 - RNA, 19 nt, Homo sapiens
ggaagaugugcucugaguu

SEQ ID NO: 294197 - RNA, 19 nt, Homo sapiens
ugaaagccaacacaccauu

SEQ ID NO: 294198 - RNA, 19 nt, Homo sapiens
guucaccuuugcugggaaa

SEQ ID NO: 294199 - RNA, 19 nt, Homo sapiens
gugagaagaccagcuaugu

SEQ ID NO: 294200 - RNA, 19 nt, Homo sapiens
gaccuacccacuacaauac

SEQ ID NO: 294201 - RNA, 19 nt, Homo sapiens
guucccaggccaccuauga

SEQ ID NO: 294202 - RNA, 19 nt, Homo sapiens
gaagcggaucgaagugaug

SEQ ID NO: 294203 - RNA, 19 nt, Homo sapiens
gagcuggaauuuggugaac

SEQ ID NO: 294204 - RNA, 19 nt, Homo sapiens
cagcuggaaugggugaaga

SEQ ID NO: 294205 - RNA, 19 nt, Homo sapiens
cccgaagccucacucucua

SEQ ID NO: 294206 - RNA, 19 nt, Homo sapiens
cugggaaagugauggagaa

SEQ ID NO: 294207 - RNA, 19 nt, Homo sapiens
agacccugcuggccacuug

SEQ ID NO: 294208 - RNA, 19 nt, Homo sapiens
ugaagcgccugagcaauac

SEQ ID NO: 294209 - RNA, 19 nt, Homo sapiens
ggauggcucccguguacug

SEQ ID NO: 294210 - RNA, 19 nt, Homo sapiens
ggacugcuggcugcacuug

SEQ ID NO: 294211 - RNA, 19 nt, Homo sapiens
ggccaggaaguucaccuuu

SEQ ID NO: 294212 - RNA, 19 nt, Homo sapiens
ccaccuaugagauccaguu

SEQ ID NO: 294213 - RNA, 19 nt, Homo sapiens
caugggcuaugcuccuguu

SEQ ID NO: 294214 - RNA, 19 nt, Homo sapiens
cggagagacuucccuacca

SEQ ID NO: 294215 - RNA, 19 nt, Homo sapiens
cuggauggcucccguguac

SEQ ID NO: 294216 - RNA, 19 nt, Homo sapiens
ccagcaagcgcacaucauc

SEQ ID NO: 294217 - RNA, 19 nt, Homo sapiens
aagagacugugaggaaaug

SEQ ID NO: 294218 - RNA, 19 nt, Homo sapiens
uccaagugcugucccuguu

SEQ ID NO: 294219 - RNA, 19 nt, Homo sapiens
gccacgaguucaccuaugc

SEQ ID NO: 294220 - RNA, 19 nt, Homo sapiens
ggaagccaugugccauuau

SEQ ID NO: 294221 - RNA, 19 nt, Homo sapiens
uggaggaggugcugaagac

SEQ ID NO: 294222 - RNA, 19 nt, Homo sapiens
aaagagacugugaggaaau

SEQ ID NO: 294223 - RNA, 19 nt, Homo sapiens
aagccucacucucuaugug

SEQ ID NO: 294224 - RNA, 19 nt, Homo sapiens
ggcaucaggcgcuuucuca

SEQ ID NO: 294225 - RNA, 19 nt, Homo sapiens
gggcugggguuuuguuugu

SEQ ID NO: 294226 - RNA, 19 nt, Homo sapiens
gccuagcccuggugacagu

SEQ ID NO: 294227 - RNA, 19 nt, Homo sapiens
ccaugugccauuaugaaga

SEQ ID NO: 294228 - RNA, 19 nt, Homo sapiens
uugggaagaugugcucuga

SEQ ID NO: 294229 - RNA, 19 nt, Homo sapiens
ggugagaagaccagcuaug

SEQ ID NO: 294230 - RNA, 19 nt, Homo sapiens
ggacuaccaccuggagaca

SEQ ID NO: 294231 - RNA, 19 nt, Homo sapiens
caugugccauuaugaagac

SEQ ID NO: 294232 - RNA, 19 nt, Homo sapiens
ccagaugguggcagaggaa

SEQ ID NO: 294233 - RNA, 19 nt, Homo sapiens
ggaagggaagcaugauugc

SEQ ID NO: 294234 - RNA, 19 nt, Homo sapiens
gaagccucacucucuaugu

SEQ ID NO: 294235 - RNA, 19 nt, Homo sapiens
cagccaaucagauggugaa

SEQ ID NO: 294236 - RNA, 19 nt, Homo sapiens
gaagggaagcaugauugca

SEQ ID NO: 294237 - RNA, 19 nt, Homo sapiens
cagcgccguucuugaagca

SEQ ID NO: 294238 - RNA, 19 nt, Homo sapiens
gccugguucuugcuacaga

SEQ ID NO: 294239 - RNA, 19 nt, Homo sapiens
gcgccugguucuugcuaca

SEQ ID NO: 294240 - RNA, 19 nt, Homo sapiens
aguuugugcuauuugauga

SEQ ID NO: 294241 - RNA, 19 nt, Homo sapiens
ccgugacucuggacaaugg

SEQ ID NO: 294242 - RNA, 19 nt, Homo sapiens
gaacaugaauucugugauu

SEQ ID NO: 294243 - RNA, 19 nt, Homo sapiens
gaagaaggaugcuguuaaa

SEQ ID NO: 294244 - RNA, 19 nt, Homo sapiens
gaaccugacuuucacauuu

SEQ ID NO: 294245 - RNA, 19 nt, Homo sapiens
ggaaugggauuuacaguuu

SEQ ID NO: 294246 - RNA, 19 nt, Homo sapiens
gcaaaugucuaucccauga

SEQ ID NO: 294247 - RNA, 19 nt, Homo sapiens
cuagagaacuccuuuguuu

SEQ ID NO: 294248 - RNA, 19 nt, Homo sapiens
ggaaagauauugguacaga

SEQ ID NO: 294249 - RNA, 19 nt, Homo sapiens
gagacaagcucacaaauac

SEQ ID NO: 294250 - RNA, 19 nt, Homo sapiens
gaaugggauuuacaguuua

SEQ ID NO: 294251 - RNA, 19 nt, Homo sapiens
ggacaucaguggcuggaaa

SEQ ID NO: 294252 - RNA, 19 nt, Homo sapiens
gcaauaaagaagcacauua

SEQ ID NO: 294253 - RNA, 19 nt, Homo sapiens
gaaugacacugagcaaauu

SEQ ID NO: 294254 - RNA, 19 nt, Homo sapiens
ucaaaguggugggauauua

SEQ ID NO: 294255 - RNA, 19 nt, Homo sapiens
gcaaugggcacuccaauga

SEQ ID NO: 294256 - RNA, 19 nt, Homo sapiens
gcucacaaauacaagauaa

SEQ ID NO: 294257 - RNA, 19 nt, Homo sapiens
ugaagcaaaugaugacuaa

SEQ ID NO: 294258 - RNA, 19 nt, Homo sapiens
ggagauggauuugaaacaa

SEQ ID NO: 294259 - RNA, 19 nt, Homo sapiens
ugaagaagguauaacacua

SEQ ID NO: 294260 - RNA, 19 nt, Homo sapiens
caaauugccucuucaagca

SEQ ID NO: 294261 - RNA, 19 nt, Homo sapiens
gcgcugagcuugcgaucaa

SEQ ID NO: 294262 - RNA, 19 nt, Homo sapiens
aagcaaggauuugacauua

SEQ ID NO: 294263 - RNA, 19 nt, Homo sapiens
gaaagauauugguacagaa

SEQ ID NO: 294264 - RNA, 19 nt, Homo sapiens
gauaaauacugaagaaggu

SEQ ID NO: 294265 - RNA, 19 nt, Homo sapiens
ggacugaaaguguauaaga

SEQ ID NO: 294266 - RNA, 19 nt, Homo sapiens
uuuaagggcugcugaaauu

SEQ ID NO: 294267 - RNA, 19 nt, Homo sapiens
gagacaagacucaguauau

SEQ ID NO: 294268 - RNA, 19 nt, Homo sapiens
gcagugcgaucuucugugu

SEQ ID NO: 294269 - RNA, 19 nt, Homo sapiens
ucugagaucucuuaccuuu

SEQ ID NO: 294270 - RNA, 19 nt, Homo sapiens
ugagaucucuuaccuuuca

SEQ ID NO: 294271 - RNA, 19 nt, Homo sapiens
gaagcaaggauuugacauu

SEQ ID NO: 294272 - RNA, 19 nt, Homo sapiens
ggacuuaugaagcaaauga

SEQ ID NO: 294273 - RNA, 19 nt, Homo sapiens
gaucaaacuggacuuauga

SEQ ID NO: 294274 - RNA, 19 nt, Homo sapiens
aacaauggcuuaucuucua

SEQ ID NO: 294275 - RNA, 19 nt, Homo sapiens
agacaagacucaguauauu

SEQ ID NO: 294276 - RNA, 19 nt, Homo sapiens
gugcagauguuggauguuu

SEQ ID NO: 294277 - RNA, 19 nt, Homo sapiens
uaaagaagaugguaaacac

SEQ ID NO: 294278 - RNA, 19 nt, Homo sapiens
guaaacaccaugaaguaaa

SEQ ID NO: 294279 - RNA, 19 nt, Homo sapiens
aaacuggacuuaugaagca

SEQ ID NO: 294280 - RNA, 19 nt, Homo sapiens
gaagguauaacacuagaga

SEQ ID NO: 294281 - RNA, 19 nt, Homo sapiens
gagcacauauaccgccauu

SEQ ID NO: 294282 - RNA, 19 nt, Homo sapiens
ggaaguuuauuuggucuga

SEQ ID NO: 294283 - RNA, 19 nt, Homo sapiens
gacaagacucaguauauuu

SEQ ID NO: 294284 - RNA, 19 nt, Homo sapiens
gaaguuaagccgccaguuc

SEQ ID NO: 294285 - RNA, 19 nt, Homo sapiens
gaauaguggucagauugaa

SEQ ID NO: 294286 - RNA, 19 nt, Homo sapiens
ugacaucccucacacuugu

SEQ ID NO: 294287 - RNA, 19 nt, Homo sapiens
gcaaggauuugacauuacu

SEQ ID NO: 294288 - RNA, 19 nt, Homo sapiens
gauguuggauguuuacagu

SEQ ID NO: 294289 - RNA, 19 nt, Homo sapiens
gaauauaagugagaucaac

SEQ ID NO: 294290 - RNA, 19 nt, Homo sapiens
ucucacaccuucaucacua

SEQ ID NO: 294291 - RNA, 19 nt, Homo sapiens
gaaguuaucauggaucgaa

SEQ ID NO: 294292 - RNA, 19 nt, Homo sapiens
ccacauacagggaauagaa

SEQ ID NO: 294293 - RNA, 19 nt, Homo sapiens
gcacauauaccgccauugg

SEQ ID NO: 294294 - RNA, 19 nt, Homo sapiens
gaaacaauacauccuggaa

SEQ ID NO: 294295 - RNA, 19 nt, Homo sapiens
caaaguggaagucacaauu

SEQ ID NO: 294296 - RNA, 19 nt, Homo sapiens
gaaaagaagucggucaguu

SEQ ID NO: 294297 - RNA, 19 nt, Homo sapiens
cagcuaaucuauuucgaau

SEQ ID NO: 294298 - RNA, 19 nt, Homo sapiens
caaccuagaaugacacuga

SEQ ID NO: 294299 - RNA, 19 nt, Homo sapiens
gaucuucuguguggugauu

SEQ ID NO: 294300 - RNA, 19 nt, Homo sapiens
gaagauagcggaauuuuca

SEQ ID NO: 294301 - RNA, 19 nt, Homo sapiens
cugcugaaauucuuuacua

SEQ ID NO: 294302 - RNA, 19 nt, Homo sapiens
ggauaaagcagaugaaacu

SEQ ID NO: 294303 - RNA, 19 nt, Homo sapiens
ugagaacaauacagucaaa

SEQ ID NO: 294304 - RNA, 19 nt, Homo sapiens
cuaaauggguaccagauuc

SEQ ID NO: 294305 - RNA, 19 nt, Homo sapiens
ggaaucagcaaguucaaau

SEQ ID NO: 294306 - RNA, 19 nt, Homo sapiens
cauggaaucucauuuaagg

SEQ ID NO: 294307 - RNA, 19 nt, Homo sapiens
gagaguucauuaugcaguu

SEQ ID NO: 294308 - RNA, 19 nt, Homo sapiens
ucacggaggaaguuuauuu

SEQ ID NO: 294309 - RNA, 19 nt, Homo sapiens
gacuuucaaugacuacuuu

SEQ ID NO: 294310 - RNA, 19 nt, Homo sapiens
ucacuauccuugaugcauu

SEQ ID NO: 294311 - RNA, 19 nt, Homo sapiens
gaacaauacagucaaaggu

SEQ ID NO: 294312 - RNA, 19 nt, Homo sapiens
gauaacaagauuacagcua

SEQ ID NO: 294313 - RNA, 19 nt, Homo sapiens
gcucucugcucagucuuua

SEQ ID NO: 294314 - RNA, 19 nt, Homo sapiens
gaagaagguauaacacuag

SEQ ID NO: 294315 - RNA, 19 nt, Homo sapiens
gaaggaauuugggacuguu

SEQ ID NO: 294316 - RNA, 19 nt, Homo sapiens
ccagagaguucauuaugca

SEQ ID NO: 294317 - RNA, 19 nt, Homo sapiens
gaagcuacuccacauuauu

SEQ ID NO: 294318 - RNA, 19 nt, Homo sapiens
cagguugguugaagacuuu

SEQ ID NO: 294319 - RNA, 19 nt, Homo sapiens
gguauggaaccacaauuaa

SEQ ID NO: 294320 - RNA, 19 nt, Homo sapiens
ugaccacaauggccuauau

SEQ ID NO: 294321 - RNA, 19 nt, Homo sapiens
guauauaaccgugagauug

SEQ ID NO: 294322 - RNA, 19 nt, Homo sapiens
caguccaaguuuaaaguua

SEQ ID NO: 294323 - RNA, 19 nt, Homo sapiens
gaaggaugcuguuaaaagu

SEQ ID NO: 294324 - RNA, 19 nt, Homo sapiens
acaauuaucccucucaguu

SEQ ID NO: 294325 - RNA, 19 nt, Homo sapiens
uggagaagauaauuggaaa

SEQ ID NO: 294326 - RNA, 19 nt, Homo sapiens
ugaauucucuccauuacag

SEQ ID NO: 294327 - RNA, 19 nt, Homo sapiens
cuucuucucucaugaauca

SEQ ID NO: 294328 - RNA, 19 nt, Homo sapiens
cauaacuucuucucucaug

SEQ ID NO: 294329 - RNA, 19 nt, Homo sapiens
gaaccacaauuaaaagaga

SEQ ID NO: 294330 - RNA, 19 nt, Homo sapiens
guauggaaccacaauuaaa

SEQ ID NO: 294331 - RNA, 19 nt, Homo sapiens
gguaaacaccaugaaguaa

SEQ ID NO: 294332 - RNA, 19 nt, Homo sapiens
gcaaaugaugacuaaagaa

SEQ ID NO: 294333 - RNA, 19 nt, Homo sapiens
ggugcuggcucacaucuuc

SEQ ID NO: 294334 - RNA, 19 nt, Homo sapiens
gacugaaaguguauaagau

SEQ ID NO: 294335 - RNA, 19 nt, Homo sapiens
agaaacagccuaugagauc

SEQ ID NO: 294336 - RNA, 19 nt, Homo sapiens
gacaagcucacaaauacaa

SEQ ID NO: 294337 - RNA, 19 nt, Homo sapiens
uaaaauaugcugccaguuu

SEQ ID NO: 294338 - RNA, 19 nt, Homo sapiens
uccuaaagcugaaagaaga

SEQ ID NO: 294339 - RNA, 19 nt, Homo sapiens
gaaagucucacaccuucau

SEQ ID NO: 294340 - RNA, 19 nt, Homo sapiens
ugaucaaacuggacuuaug

SEQ ID NO: 294341 - RNA, 19 nt, Homo sapiens
gaaacagccuaugagaucu

SEQ ID NO: 294342 - RNA, 19 nt, Homo sapiens
ccaaggagcuggucgauua

SEQ ID NO: 294343 - RNA, 19 nt, Homo sapiens
ggaaggagguggaugguua

SEQ ID NO: 294344 - RNA, 19 nt, Homo sapiens
gaaggugaauuggauggua

SEQ ID NO: 294345 - RNA, 19 nt, Homo sapiens
gagcaggccucgcuguuug

SEQ ID NO: 294346 - RNA, 19 nt, Homo sapiens
gcucggacuuccaauauga

SEQ ID NO: 294347 - RNA, 19 nt, Homo sapiens
gcccagcgaugugguaaua

SEQ ID NO: 294348 - RNA, 19 nt, Homo sapiens
acacaccgcuggagacaaa

SEQ ID NO: 294349 - RNA, 19 nt, Homo sapiens
gaacaugaaucagcaacuc

SEQ ID NO: 294350 - RNA, 19 nt, Homo sapiens
ggaaacuacuauccaguca

SEQ ID NO: 294351 - RNA, 19 nt, Homo sapiens
cgacccaccuggaaacuga

SEQ ID NO: 294352 - RNA, 19 nt, Homo sapiens
caguauaggugacaacgaa

SEQ ID NO: 294353 - RNA, 19 nt, Homo sapiens
gcuggucgauuacuuccua

SEQ ID NO: 294354 - RNA, 19 nt, Homo sapiens
gcucagaggcuucaaagau

SEQ ID NO: 294355 - RNA, 19 nt, Homo sapiens
ccagcgaugugguaauauu

SEQ ID NO: 294356 - RNA, 19 nt, Homo sapiens
gcacuuuccuggccucagu

SEQ ID NO: 294357 - RNA, 19 nt, Homo sapiens
ggagaggauuccggacgua

SEQ ID NO: 294358 - RNA, 19 nt, Homo sapiens
gcacauccgggcaacguuu

SEQ ID NO: 294359 - RNA, 19 nt, Homo sapiens
gccaacaugugguucaaga

SEQ ID NO: 294360 - RNA, 19 nt, Homo sapiens
gcuuccaggucaucguuua

SEQ ID NO: 294361 - RNA, 19 nt, Homo sapiens
gaaacaugacgacuucuuc

SEQ ID NO: 294362 - RNA, 19 nt, Homo sapiens
uaaaugcgcagcaggcaaa

SEQ ID NO: 294363 - RNA, 19 nt, Homo sapiens
guacaacgccaguauaggu

SEQ ID NO: 294364 - RNA, 19 nt, Homo sapiens
ucaaagaucacuucaccuu

SEQ ID NO: 294365 - RNA, 19 nt, Homo sapiens
ugauggagauuaugaacau

SEQ ID NO: 294366 - RNA, 19 nt, Homo sapiens
ccauggaaauccgcacuuu

SEQ ID NO: 294367 - RNA, 19 nt, Homo sapiens
gcaccaguuugccguagga

SEQ ID NO: 294368 - RNA, 19 nt, Homo sapiens
guucuggaccgguuacuuu

SEQ ID NO: 294369 - RNA, 19 nt, Homo sapiens
gcugggugaugaacgauga

SEQ ID NO: 294370 - RNA, 19 nt, Homo sapiens
gaaacaugcagcugacugu

SEQ ID NO: 294371 - RNA, 19 nt, Homo sapiens
gcugggaugugcugugugu

SEQ ID NO: 294372 - RNA, 19 nt, Homo sapiens
ggacuuccaauaugagaau

SEQ ID NO: 294373 - RNA, 19 nt, Homo sapiens
ucgauuacuuccuaaaugu

SEQ ID NO: 294374 - RNA, 19 nt, Homo sapiens
ggagcaggccucgcuguuu

SEQ ID NO: 294375 - RNA, 19 nt, Homo sapiens
gcgagguucuucugagcaa

SEQ ID NO: 294376 - RNA, 19 nt, Homo sapiens
gcacguggccaacgacuac

SEQ ID NO: 294377 - RNA, 19 nt, Homo sapiens
gucgauuacuuccuaaaug

SEQ ID NO: 294378 - RNA, 19 nt, Homo sapiens
cccguuaccuugaacuuga

SEQ ID NO: 294379 - RNA, 19 nt, Homo sapiens
gcgcuuggagcaccaguuu

SEQ ID NO: 294380 - RNA, 19 nt, Homo sapiens
ggacgauggacgcggagua

SEQ ID NO: 294381 - RNA, 19 nt, Homo sapiens
ggacagugcccagcgaugu

SEQ ID NO: 294382 - RNA, 19 nt, Homo sapiens
ucagaggcuucaaagauca

SEQ ID NO: 294383 - RNA, 19 nt, Homo sapiens
gaagcaguguccauguucu

SEQ ID NO: 294384 - RNA, 19 nt, Homo sapiens
ugcagaagcuggagaugga

SEQ ID NO: 294385 - RNA, 19 nt, Homo sapiens
gcucccgccucucugcuuu

SEQ ID NO: 294386 - RNA, 19 nt, Homo sapiens
ccagucaacacccggauuu

SEQ ID NO: 294387 - RNA, 19 nt, Homo sapiens
cuucagcaccuauucagua

SEQ ID NO: 294388 - RNA, 19 nt, Homo sapiens
ggcggaaggugaauuggau

SEQ ID NO: 294389 - RNA, 19 nt, Homo sapiens
gcuacgagcgccucagcua

SEQ ID NO: 294390 - RNA, 19 nt, Homo sapiens
ggaagcaguguccauguuc

SEQ ID NO: 294391 - RNA, 19 nt, Homo sapiens
aaacuacuauccagucaac

SEQ ID NO: 294392 - RNA, 19 nt, Homo sapiens
gaggcauuccgucuucaua

SEQ ID NO: 294393 - RNA, 19 nt, Homo sapiens
ccacccgucgcuucauuua

SEQ ID NO: 294394 - RNA, 19 nt, Homo sapiens
gaccuguucuccaccuuca

SEQ ID NO: 294395 - RNA, 19 nt, Homo sapiens
ggacgcuucuacacagaca

SEQ ID NO: 294396 - RNA, 19 nt, Homo sapiens
gggcucggacuuccaauau

SEQ ID NO: 294397 - RNA, 19 nt, Homo sapiens
ccucuucacuggugugcuu

SEQ ID NO: 294398 - RNA, 19 nt, Homo sapiens
gacaaaugccacacaggaa

SEQ ID NO: 294399 - RNA, 19 nt, Homo sapiens
gacucugacucuccucuug

SEQ ID NO: 294400 - RNA, 19 nt, Homo sapiens
agugaaacaugacgacuuc

SEQ ID NO: 294401 - RNA, 19 nt, Homo sapiens
ccuggucagugaaacauga

SEQ ID NO: 294402 - RNA, 19 nt, Homo sapiens
ucaaaaccguggaccagua

SEQ ID NO: 294403 - RNA, 19 nt, Homo sapiens
agacgccagugucaccuuu

SEQ ID NO: 294404 - RNA, 19 nt, Homo sapiens
cagaaaccgcugccuguga

SEQ ID NO: 294405 - RNA, 19 nt, Homo sapiens
gccaacagcuaaacaucag

SEQ ID NO: 294406 - RNA, 19 nt, Homo sapiens
ggccucaggugccuacauc

SEQ ID NO: 294407 - RNA, 19 nt, Homo sapiens
ggaggacacauuuggcaau

SEQ ID NO: 294408 - RNA, 19 nt, Homo sapiens
aaugguggcugggugauga

SEQ ID NO: 294409 - RNA, 19 nt, Homo sapiens
ggcagcagccugagagaug

SEQ ID NO: 294410 - RNA, 19 nt, Homo sapiens
gaaacuacuauccagucaa

SEQ ID NO: 294411 - RNA, 19 nt, Homo sapiens
uccaggucaucguuuauaa

SEQ ID NO: 294412 - RNA, 19 nt, Homo sapiens
gaccaguacuuuuauggaa

SEQ ID NO: 294413 - RNA, 19 nt, Homo sapiens
ggaauuccggcauuaagag

SEQ ID NO: 294414 - RNA, 19 nt, Homo sapiens
gagaggauuccggacguaa

SEQ ID NO: 294415 - RNA, 19 nt, Homo sapiens
uaucggagccacuaaugga

SEQ ID NO: 294416 - RNA, 19 nt, Homo sapiens
ucaggugccuacaucuuca

SEQ ID NO: 294417 - RNA, 19 nt, Homo sapiens
gacgugggcuggcucaaaa

SEQ ID NO: 294418 - RNA, 19 nt, Homo sapiens
gggcuucgacggcuucuuc

SEQ ID NO: 294419 - RNA, 19 nt, Homo sapiens
gcauuaaaacguacuacua

SEQ ID NO: 294420 - RNA, 19 nt, Homo sapiens
gagaggaggcgggauuauc

SEQ ID NO: 294421 - RNA, 19 nt, Homo sapiens
cagcgaugugguaauauuu

SEQ ID NO: 294422 - RNA, 19 nt, Homo sapiens
aggaagcaguguccauguu

SEQ ID NO: 294423 - RNA, 19 nt, Homo sapiens
guuacaacccgccaaggaa

SEQ ID NO: 294424 - RNA, 19 nt, Homo sapiens
gaaggagguggaugguuag

SEQ ID NO: 294425 - RNA, 19 nt, Homo sapiens
gcaguguccauguucucua

SEQ ID NO: 294426 - RNA, 19 nt, Homo sapiens
ggagcuggucgauuacuuc

SEQ ID NO: 294427 - RNA, 19 nt, Homo sapiens
ggaagucgugcgagaccuu

SEQ ID NO: 294428 - RNA, 19 nt, Homo sapiens
accgaaggcugcugaagga

SEQ ID NO: 294429 - RNA, 19 nt, Homo sapiens
cagcuaaacaucagcaucu

SEQ ID NO: 294430 - RNA, 19 nt, Homo sapiens
cucagaggcuucaaagauc

SEQ ID NO: 294431 - RNA, 19 nt, Homo sapiens
ggucgauuacuuccuaaau

SEQ ID NO: 294432 - RNA, 19 nt, Homo sapiens
cuucgacggcuucuucuuu

SEQ ID NO: 294433 - RNA, 19 nt, Homo sapiens
caacuccugcugccuguuc

SEQ ID NO: 294434 - RNA, 19 nt, Homo sapiens
uggagauuaugaacaugaa

SEQ ID NO: 294435 - RNA, 19 nt, Homo sapiens
gugcugggaugugcugugu

SEQ ID NO: 294436 - RNA, 19 nt, Homo sapiens
cggagccacuaauggagaa

SEQ ID NO: 294437 - RNA, 19 nt, Homo sapiens
gacaaagggacgcuucuac

SEQ ID NO: 294438 - RNA, 19 nt, Homo sapiens
ucuuggaauuccggcauua

SEQ ID NO: 294439 - RNA, 19 nt, Homo sapiens
ggcuguugauggagauuau

SEQ ID NO: 294440 - RNA, 19 nt, Homo sapiens
caggucaucguuuauaauc

SEQ ID NO: 294441 - RNA, 19 nt, Homo sapiens
ccacagugcagccgaacau

SEQ ID NO: 294442 - RNA, 19 nt, Homo sapiens
gauggaggcuuaaauauug

SEQ ID NO: 294443 - RNA, 19 nt, Homo sapiens
ggaaagauguuagaauuga

SEQ ID NO: 294444 - RNA, 19 nt, Homo sapiens
gcaagaauauuacuguaga

SEQ ID NO: 294445 - RNA, 19 nt, Homo sapiens
caacagacauacagcauug

SEQ ID NO: 294446 - RNA, 19 nt, Homo sapiens
gaaauuagcaaauggcaaa

SEQ ID NO: 294447 - RNA, 19 nt, Homo sapiens
gaagacacgaacuauauua

SEQ ID NO: 294448 - RNA, 19 nt, Homo sapiens
ucacgaaggugguaacaaa

SEQ ID NO: 294449 - RNA, 19 nt, Homo sapiens
gaaggaaucuagguuguau

SEQ ID NO: 294450 - RNA, 19 nt, Homo sapiens
gaauggcgauugaaauguu

SEQ ID NO: 294451 - RNA, 19 nt, Homo sapiens
gagaagacacgaacuauau

SEQ ID NO: 294452 - RNA, 19 nt, Homo sapiens
ucagcaaggugacauauuu

SEQ ID NO: 294453 - RNA, 19 nt, Homo sapiens
ggaguggaaucuggaaaua

SEQ ID NO: 294454 - RNA, 19 nt, Homo sapiens
ccaaagcacagauccauua

SEQ ID NO: 294455 - RNA, 19 nt, Homo sapiens
ggacaugaaccaguuauaa

SEQ ID NO: 294456 - RNA, 19 nt, Homo sapiens
gugaagaguuguacacuga

SEQ ID NO: 294457 - RNA, 19 nt, Homo sapiens
gaaguugccuaccagauca

SEQ ID NO: 294458 - RNA, 19 nt, Homo sapiens
gacaaugguuuccucauga

SEQ ID NO: 294459 - RNA, 19 nt, Homo sapiens
gaucuucacucggauuauu

SEQ ID NO: 294460 - RNA, 19 nt, Homo sapiens
gagcaauguuccuuuaguu

SEQ ID NO: 294461 - RNA, 19 nt, Homo sapiens
gaggacuggucuuucaaua

SEQ ID NO: 294462 - RNA, 19 nt, Homo sapiens
ugaaugccaugucaacuuu

SEQ ID NO: 294463 - RNA, 19 nt, Homo sapiens
gggaauaaagcauuucuaa

SEQ ID NO: 294464 - RNA, 19 nt, Homo sapiens
gaacuaggaauaaugguau

SEQ ID NO: 294465 - RNA, 19 nt, Homo sapiens
ugaacuggauggaggcuua

SEQ ID NO: 294466 - RNA, 19 nt, Homo sapiens
ggauggaggcuuaaauauu

SEQ ID NO: 294467 - RNA, 19 nt, Homo sapiens
gaaacuugguggccucaug

SEQ ID NO: 294468 - RNA, 19 nt, Homo sapiens
gauauuuacugaaggaauc

SEQ ID NO: 294469 - RNA, 19 nt, Homo sapiens
caaggugacauauuuguuu

SEQ ID NO: 294470 - RNA, 19 nt, Homo sapiens
cuggaaagauguuagaauu

SEQ ID NO: 294471 - RNA, 19 nt, Homo sapiens
gaaaacacguucuauaucu

SEQ ID NO: 294472 - RNA, 19 nt, Homo sapiens
gaauugguaucauaucagu

SEQ ID NO: 294473 - RNA, 19 nt, Homo sapiens
ccagggagauuuagugaca

SEQ ID NO: 294474 - RNA, 19 nt, Homo sapiens
ggauuucccauauuucuaa

SEQ ID NO: 294475 - RNA, 19 nt, Homo sapiens
cgggaaagcugugugguuu

SEQ ID NO: 294476 - RNA, 19 nt, Homo sapiens
gcagcgagauaguggauca

SEQ ID NO: 294477 - RNA, 19 nt, Homo sapiens
ggacuggucuuucaauagc

SEQ ID NO: 294478 - RNA, 19 nt, Homo sapiens
gaaaaggauuguugagcua

SEQ ID NO: 294479 - RNA, 19 nt, Homo sapiens
cagacaauauguucaauag

SEQ ID NO: 294480 - RNA, 19 nt, Homo sapiens
ugacaaugguuuccucaug

SEQ ID NO: 294481 - RNA, 19 nt, Homo sapiens
gaauuuaugagcaggauga

SEQ ID NO: 294482 - RNA, 19 nt, Homo sapiens
uuggauaacuggaccuaua

SEQ ID NO: 294483 - RNA, 19 nt, Homo sapiens
caaucuacaucaaggacua

SEQ ID NO: 294484 - RNA, 19 nt, Homo sapiens
caguggaacuuauagaaga

SEQ ID NO: 294485 - RNA, 19 nt, Homo sapiens
ggaccuauagcaaagaauu

SEQ ID NO: 294486 - RNA, 19 nt, Homo sapiens
uaacuggaccuauagcaaa

SEQ ID NO: 294487 - RNA, 19 nt, Homo sapiens
ggaauacggaauacucaaa

SEQ ID NO: 294488 - RNA, 19 nt, Homo sapiens
ugaacucugugaugaacua

SEQ ID NO: 294489 - RNA, 19 nt, Homo sapiens
ugaauucuaugaacucugu

SEQ ID NO: 294490 - RNA, 19 nt, Homo sapiens
ggagcaauguuccuuuagu

SEQ ID NO: 294491 - RNA, 19 nt, Homo sapiens
ccaguaggcuuugagaaug

SEQ ID NO: 294492 - RNA, 19 nt, Homo sapiens
gcacuuuauuggcaguuga

SEQ ID NO: 294493 - RNA, 19 nt, Homo sapiens
ggaauacucaaauaaagug

SEQ ID NO: 294494 - RNA, 19 nt, Homo sapiens
guaaagguauauggguauu

SEQ ID NO: 294495 - RNA, 19 nt, Homo sapiens
acagaggacuggucuuuca

SEQ ID NO: 294496 - RNA, 19 nt, Homo sapiens
ugaaaucucauccuucuau

SEQ ID NO: 294497 - RNA, 19 nt, Homo sapiens
agacugaaaucucauccuu

SEQ ID NO: 294498 - RNA, 19 nt, Homo sapiens
ucuaugaacucugugauga

SEQ ID NO: 294499 - RNA, 19 nt, Homo sapiens
gguuugaguuucuauuuca

SEQ ID NO: 294500 - RNA, 19 nt, Homo sapiens
gaaaaggucucgucuacag

SEQ ID NO: 294501 - RNA, 19 nt, Homo sapiens
ccaggauucuuacuacaga

SEQ ID NO: 294502 - RNA, 19 nt, Homo sapiens
gggaauggcgauugaaaug

SEQ ID NO: 294503 - RNA, 19 nt, Homo sapiens
cagagggaauggcgauuga

SEQ ID NO: 294504 - RNA, 19 nt, Homo sapiens
caggaucuauggaaccaaa

SEQ ID NO: 294505 - RNA, 19 nt, Homo sapiens
agaugggucucuuuggaua

SEQ ID NO: 294506 - RNA, 19 nt, Homo sapiens
caacagagacaaggagaga

SEQ ID NO: 294507 - RNA, 19 nt, Homo sapiens
agaaugaguuggagcaauc

SEQ ID NO: 294508 - RNA, 19 nt, Homo sapiens
gauccauuacgcacauuua

SEQ ID NO: 294509 - RNA, 19 nt, Homo sapiens
gaaaucucauccuucuauc

SEQ ID NO: 294510 - RNA, 19 nt, Homo sapiens
ugagcaggaugaauucuau

SEQ ID NO: 294511 - RNA, 19 nt, Homo sapiens
ugaauacucuucggguuug

SEQ ID NO: 294512 - RNA, 19 nt, Homo sapiens
ggagagaagccgagagaca

SEQ ID NO: 294513 - RNA, 19 nt, Homo sapiens
gaaucuagguuguauuuuc

SEQ ID NO: 294514 - RNA, 19 nt, Homo sapiens
ugagaagacacgaacuaua

SEQ ID NO: 294515 - RNA, 19 nt, Homo sapiens
ucacugccaucaucucuca

SEQ ID NO: 294516 - RNA, 19 nt, Homo sapiens
gguaacaaacaaaugcuuu

SEQ ID NO: 294517 - RNA, 19 nt, Homo sapiens
gaccaacuaccacuucuug

SEQ ID NO: 294518 - RNA, 19 nt, Homo sapiens
ggcugaaacuguugcagaa

SEQ ID NO: 294519 - RNA, 19 nt, Homo sapiens
cauauggaguggcaauaau

SEQ ID NO: 294520 - RNA, 19 nt, Homo sapiens
acagaugggucucuuugga

SEQ ID NO: 294521 - RNA, 19 nt, Homo sapiens
gaaggugguaacaaacaaa

SEQ ID NO: 294522 - RNA, 19 nt, Homo sapiens
cgaaggugguaacaaacaa

SEQ ID NO: 294523 - RNA, 19 nt, Homo sapiens
gacaagagucguccuuuua

SEQ ID NO: 294524 - RNA, 19 nt, Homo sapiens
cagcagaaguugccuacca

SEQ ID NO: 294525 - RNA, 19 nt, Homo sapiens
cuacagauuuaaugaccuu

SEQ ID NO: 294526 - RNA, 19 nt, Homo sapiens
gagcuauuugugaacauua

SEQ ID NO: 294527 - RNA, 19 nt, Homo sapiens
cuauuuggguaaagguaua

SEQ ID NO: 294528 - RNA, 19 nt, Homo sapiens
gaauacggaauacucaaau

SEQ ID NO: 294529 - RNA, 19 nt, Homo sapiens
cgaguaaccucugaguugu

SEQ ID NO: 294530 - RNA, 19 nt, Homo sapiens
gacaguggaacuuauagaa

SEQ ID NO: 294531 - RNA, 19 nt, Homo sapiens
acagauauuuacugaagga

SEQ ID NO: 294532 - RNA, 19 nt, Homo sapiens
gcaaggugacauauuuguu

SEQ ID NO: 294533 - RNA, 19 nt, Homo sapiens
caguaggcuuugagaauga

SEQ ID NO: 294534 - RNA, 19 nt, Homo sapiens
gaggaggcgcugaugauga

SEQ ID NO: 294535 - RNA, 19 nt, Homo sapiens
gaguggauacgguuucaaa

SEQ ID NO: 294536 - RNA, 19 nt, Homo sapiens
ccgaguaaccucugaguug

SEQ ID NO: 294537 - RNA, 19 nt, Homo sapiens
aguggaaucuggaaauaga

SEQ ID NO: 294538 - RNA, 19 nt, Homo sapiens
gagggaauggcgauugaaa

SEQ ID NO: 294539 - RNA, 19 nt, Homo sapiens
gcagcugguuacaagaaug

SEQ ID NO: 294540 - RNA, 19 nt, Homo sapiens
gaagaguuguacacugaac

SEQ ID NO: 294541 - RNA, 19 nt, Homo sapiens
caacaucacgaagguggua

SEQ ID NO: 294542 - RNA, 19 nt, Homo sapiens
ggaaugagcauguugauua

SEQ ID NO: 294543 - RNA, 19 nt, Homo sapiens
ugaaagagcucauugacaa

SEQ ID NO: 294544 - RNA, 19 nt, Homo sapiens
ggaaucccauugcauauuu

SEQ ID NO: 294545 - RNA, 19 nt, Homo sapiens
gcacagagacugccacaaa

SEQ ID NO: 294546 - RNA, 19 nt, Homo sapiens
gaauauggcguuaguguuu

SEQ ID NO: 294547 - RNA, 19 nt, Homo sapiens
gaucaugacucaauaugga

SEQ ID NO: 294548 - RNA, 19 nt, Homo sapiens
gcaaauacguaauuaaugc

SEQ ID NO: 294549 - RNA, 19 nt, Homo sapiens
gaucggagguggcauuuca

SEQ ID NO: 294550 - RNA, 19 nt, Homo sapiens
gaucaacucauguuaauug

SEQ ID NO: 294551 - RNA, 19 nt, Homo sapiens
ggacaggguuggaggaaga

SEQ ID NO: 294552 - RNA, 19 nt, Homo sapiens
gaauaaagccuugugauca

SEQ ID NO: 294553 - RNA, 19 nt, Homo sapiens
ggaggaagaacauauacua

SEQ ID NO: 294554 - RNA, 19 nt, Homo sapiens
gauauucucugucaccaau

SEQ ID NO: 294555 - RNA, 19 nt, Homo sapiens
ccaagaagcuuuacaucca

SEQ ID NO: 294556 - RNA, 19 nt, Homo sapiens
uagagacgcugaaccauga

SEQ ID NO: 294557 - RNA, 19 nt, Homo sapiens
gagagaaaccaguuaauuc

SEQ ID NO: 294558 - RNA, 19 nt, Homo sapiens
caagugagcgaacggauaa

SEQ ID NO: 294559 - RNA, 19 nt, Homo sapiens
gcagagagaaaccaguuaa

SEQ ID NO: 294560 - RNA, 19 nt, Homo sapiens
gcugaaccaugaacauuau

SEQ ID NO: 294561 - RNA, 19 nt, Homo sapiens
gccaaacucuugacugaau

SEQ ID NO: 294562 - RNA, 19 nt, Homo sapiens
caucuuauuugucagugua

SEQ ID NO: 294563 - RNA, 19 nt, Homo sapiens
acaagaaccugaaucaaag

SEQ ID NO: 294564 - RNA, 19 nt, Homo sapiens
gugagcgucucguucaaua

SEQ ID NO: 294565 - RNA, 19 nt, Homo sapiens
aaaggaaccugcccucugu

SEQ ID NO: 294566 - RNA, 19 nt, Homo sapiens
ccggaaagcugaucgacuu

SEQ ID NO: 294567 - RNA, 19 nt, Homo sapiens
ggaagaagaaggauuacug

SEQ ID NO: 294568 - RNA, 19 nt, Homo sapiens
gagugcaaauacguaauua

SEQ ID NO: 294569 - RNA, 19 nt, Homo sapiens
cuaaggagcugggcauaga

SEQ ID NO: 294570 - RNA, 19 nt, Homo sapiens
guagaucaacucauguuaa

SEQ ID NO: 294571 - RNA, 19 nt, Homo sapiens
agaugaagaugcuccaauu

SEQ ID NO: 294572 - RNA, 19 nt, Homo sapiens
gaaugagcauguugauuac

SEQ ID NO: 294573 - RNA, 19 nt, Homo sapiens
gccaaagcauggagaauca

SEQ ID NO: 294574 - RNA, 19 nt, Homo sapiens
ccaaacucuugacugaaua

SEQ ID NO: 294575 - RNA, 19 nt, Homo sapiens
gcucucugcucacugguuu

SEQ ID NO: 294576 - RNA, 19 nt, Homo sapiens
uacaagaaccugaaucaaa

SEQ ID NO: 294577 - RNA, 19 nt, Homo sapiens
gaagaagaaggauuacugu

SEQ ID NO: 294578 - RNA, 19 nt, Homo sapiens
ggaaauaaggaagaagaaa

SEQ ID NO: 294579 - RNA, 19 nt, Homo sapiens
ucaauaaccuuggaugaca

SEQ ID NO: 294580 - RNA, 19 nt, Homo sapiens
gaaagagcucauugacaaa

SEQ ID NO: 294581 - RNA, 19 nt, Homo sapiens
ggaaggugaccgagaaaga

SEQ ID NO: 294582 - RNA, 19 nt, Homo sapiens
cuagggaggucuuaaaugg

SEQ ID NO: 294583 - RNA, 19 nt, Homo sapiens
gggcauagagacuuacaaa

SEQ ID NO: 294584 - RNA, 19 nt, Homo sapiens
gaucaagcuccaucuuauu

SEQ ID NO: 294585 - RNA, 19 nt, Homo sapiens
gaaaaucugugagcucuau

SEQ ID NO: 294586 - RNA, 19 nt, Homo sapiens
gcauguugauuacguagau

SEQ ID NO: 294587 - RNA, 19 nt, Homo sapiens
gaaguucuguucuuaugcu

SEQ ID NO: 294588 - RNA, 19 nt, Homo sapiens
caguguagaucaacucaug

SEQ ID NO: 294589 - RNA, 19 nt, Homo sapiens
gaagaugcuccaauuucaa

SEQ ID NO: 294590 - RNA, 19 nt, Homo sapiens
gaugaagaugcuccaauuu

SEQ ID NO: 294591 - RNA, 19 nt, Homo sapiens
gacaacaucaucauagaga

SEQ ID NO: 294592 - RNA, 19 nt, Homo sapiens
gcauggagaaucaagagaa

SEQ ID NO: 294593 - RNA, 19 nt, Homo sapiens
caagcuccaucuuauuugu

SEQ ID NO: 294594 - RNA, 19 nt, Homo sapiens
gugacaacaucaucauaga

SEQ ID NO: 294595 - RNA, 19 nt, Homo sapiens
gggcaccacucggauauuc

SEQ ID NO: 294596 - RNA, 19 nt, Homo sapiens
gaaggagauuccaacugau

SEQ ID NO: 294597 - RNA, 19 nt, Homo sapiens
uggcuuaauuccaaucauu

SEQ ID NO: 294598 - RNA, 19 nt, Homo sapiens
uuuaaaggcugugucauug

SEQ ID NO: 294599 - RNA, 19 nt, Homo sapiens
uugcuaagcuacauaagga

SEQ ID NO: 294600 - RNA, 19 nt, Homo sapiens
gacaaaaucugcuggacaa

SEQ ID NO: 294601 - RNA, 19 nt, Homo sapiens
ucaacaugcugacaaaugg

SEQ ID NO: 294602 - RNA, 19 nt, Homo sapiens
cugccaaacucuugacuga

SEQ ID NO: 294603 - RNA, 19 nt, Homo sapiens
gaaccugcccucuguuucu

SEQ ID NO: 294604 - RNA, 19 nt, Homo sapiens
gagaccaagugaagcugaa

SEQ ID NO: 294605 - RNA, 19 nt, Homo sapiens
guuuaaguguacuggauuu

SEQ ID NO: 294606 - RNA, 19 nt, Homo sapiens
guuuaaaggcugugucauu

SEQ ID NO: 294607 - RNA, 19 nt, Homo sapiens
uaaauggucucgggaaggu

SEQ ID NO: 294608 - RNA, 19 nt, Homo sapiens
gaugcuccaauuucaauaa

SEQ ID NO: 294609 - RNA, 19 nt, Homo sapiens
ucuggaagaagaaggauua

SEQ ID NO: 294610 - RNA, 19 nt, Homo sapiens
gaaucccauugcauauuug

SEQ ID NO: 294611 - RNA, 19 nt, Homo sapiens
gagcgucucguucaauaug

SEQ ID NO: 294612 - RNA, 19 nt, Homo sapiens
gaggaagaacauauacuau

SEQ ID NO: 294613 - RNA, 19 nt, Homo sapiens
agagaaaccaguuaauuca

SEQ ID NO: 294614 - RNA, 19 nt, Homo sapiens
gaaucuuacgcuugucuaa

SEQ ID NO: 294615 - RNA, 19 nt, Homo sapiens
ucuugaaguucuguucuua

SEQ ID NO: 294616 - RNA, 19 nt, Homo sapiens
gaaaucacccacaccuucu

SEQ ID NO: 294617 - RNA, 19 nt, Homo sapiens
gguacaagaaccugaauca

SEQ ID NO: 294618 - RNA, 19 nt, Homo sapiens
ccacucggauauucucugu

SEQ ID NO: 294619 - RNA, 19 nt, Homo sapiens
agagagaaaccaguuaauu

SEQ ID NO: 294620 - RNA, 19 nt, Homo sapiens
ucaagugagcgaacggaua

SEQ ID NO: 294621 - RNA, 19 nt, Homo sapiens
uauaaggaaugagcauguu

SEQ ID NO: 294622 - RNA, 19 nt, Homo sapiens
gaaagcugaucgacuugcu

SEQ ID NO: 294623 - RNA, 19 nt, Homo sapiens
aacagaaucuuacgcuugu

SEQ ID NO: 294624 - RNA, 19 nt, Homo sapiens
uaaguguacuggauuuaac

SEQ ID NO: 294625 - RNA, 19 nt, Homo sapiens
uacauccagugcauuauga

SEQ ID NO: 294626 - RNA, 19 nt, Homo sapiens
gcuaagcuacauaaggaaa

SEQ ID NO: 294627 - RNA, 19 nt, Homo sapiens
caucaugggcuucauucuu

SEQ ID NO: 294628 - RNA, 19 nt, Homo sapiens
caauuucaauaaccuugga

SEQ ID NO: 294629 - RNA, 19 nt, Homo sapiens
uaacuaccuuuggcuuaau

SEQ ID NO: 294630 - RNA, 19 nt, Homo sapiens
uaaggaaugagcauguuga

SEQ ID NO: 294631 - RNA, 19 nt, Homo sapiens
gucauugggccauguuuaa

SEQ ID NO: 294632 - RNA, 19 nt, Homo sapiens
guuggaggaagaacauaua

SEQ ID NO: 294633 - RNA, 19 nt, Homo sapiens
aggacuaucugcugccaaa

SEQ ID NO: 294634 - RNA, 19 nt, Homo sapiens
acucggauauucucuguca

SEQ ID NO: 294635 - RNA, 19 nt, Homo sapiens
gcuaggcgguuugcuuauc

SEQ ID NO: 294636 - RNA, 19 nt, Homo sapiens
ugagcauguugauuacgua

SEQ ID NO: 294637 - RNA, 19 nt, Homo sapiens
ggaagaagaaaaucuguga

SEQ ID NO: 294638 - RNA, 19 nt, Homo sapiens
cauaaggaaauaaggaaga

SEQ ID NO: 294639 - RNA, 19 nt, Homo sapiens
cuacauaaggaaauaagga

SEQ ID NO: 294640 - RNA, 19 nt, Homo sapiens
gcugcaugaucauugaaga

SEQ ID NO: 294641 - RNA, 19 nt, Homo sapiens
cagcagagagaaaccaguu

SEQ ID NO: 294642 - RNA, 19 nt, Homo sapiens
ggaaagaguugcaaguaaa

SEQ ID NO: 294643 - RNA, 19 nt, Homo sapiens
guacacacuuggguaauua

SEQ ID NO: 294644 - RNA, 19 nt, Homo sapiens
ccucaaaucuuuagaauag

SEQ ID NO: 294645 - RNA, 19 nt, Homo sapiens
gggaaagaguugcaaguaa

SEQ ID NO: 294646 - RNA, 19 nt, Homo sapiens
uaaucacacucucuucuua

SEQ ID NO: 294647 - RNA, 19 nt, Homo sapiens
gaagaaacuuugugaacuc

SEQ ID NO: 294648 - RNA, 19 nt, Homo sapiens
gaaacuuugugaacucuau

SEQ ID NO: 294649 - RNA, 19 nt, Homo sapiens
gaggaaagguugaagaaac

SEQ ID NO: 294650 - RNA, 19 nt, Homo sapiens
ccaauuaccuacuuagauc

SEQ ID NO: 294651 - RNA, 19 nt, Homo sapiens
ggaauccaauuaccuacuu

SEQ ID NO: 294652 - RNA, 19 nt, Homo sapiens
ggacuuacacucuuaggaa

SEQ ID NO: 294653 - RNA, 19 nt, Homo sapiens
gggcggaucuggucaagug

SEQ ID NO: 294654 - RNA, 19 nt, Homo sapiens
gaauccaauuaccuacuua

SEQ ID NO: 294655 - RNA, 19 nt, Homo sapiens
cagccaaacuucugcauga

SEQ ID NO: 294656 - RNA, 19 nt, Homo sapiens
gaaugugguuguucuggaa

SEQ ID NO: 294657 - RNA, 19 nt, Homo sapiens
gauuauugauggagaagaa

SEQ ID NO: 294658 - RNA, 19 nt, Homo sapiens
ggcgagagauuccgaguga

SEQ ID NO: 294659 - RNA, 19 nt, Homo sapiens
ugaaggagcuacuggacaa

SEQ ID NO: 294660 - RNA, 19 nt, Homo sapiens
caaguaaaguuccaugaag

SEQ ID NO: 294661 - RNA, 19 nt, Homo sapiens
gaggcuaaauaugugauua

SEQ ID NO: 294662 - RNA, 19 nt, Homo sapiens
ggaccaacccagaaucgua

SEQ ID NO: 294663 - RNA, 19 nt, Homo sapiens
gggacuagaacacaaauaa

SEQ ID NO: 294664 - RNA, 19 nt, Homo sapiens
gcaugacucuggacugaau

SEQ ID NO: 294665 - RNA, 19 nt, Homo sapiens
gcaaguaaaguuccaugaa

SEQ ID NO: 294666 - RNA, 19 nt, Homo sapiens
agaaucaucucgacaacaa

SEQ ID NO: 294667 - RNA, 19 nt, Homo sapiens
cuuagguacuguauuguua

SEQ ID NO: 294668 - RNA, 19 nt, Homo sapiens
aaaguuccaugaagacaaa

SEQ ID NO: 294669 - RNA, 19 nt, Homo sapiens
gagagagggugucuguaau

SEQ ID NO: 294670 - RNA, 19 nt, Homo sapiens
gauccugacucaauaugga

SEQ ID NO: 294671 - RNA, 19 nt, Homo sapiens
gaaagacaguaaagaccau

SEQ ID NO: 294672 - RNA, 19 nt, Homo sapiens
ggacaggauuuacuuugca

SEQ ID NO: 294673 - RNA, 19 nt, Homo sapiens
ggcaggacuuacacucuua

SEQ ID NO: 294674 - RNA, 19 nt, Homo sapiens
guccuuagguacuguauug

SEQ ID NO: 294675 - RNA, 19 nt, Homo sapiens
ggacaggagaggaaauuug

SEQ ID NO: 294676 - RNA, 19 nt, Homo sapiens
gagggugucuguaaucaca

SEQ ID NO: 294677 - RNA, 19 nt, Homo sapiens
gggacaacaugacaaugaa

SEQ ID NO: 294678 - RNA, 19 nt, Homo sapiens
cuacuuagaucauaacaac

SEQ ID NO: 294679 - RNA, 19 nt, Homo sapiens
guggaaccaugauuauuga

SEQ ID NO: 294680 - RNA, 19 nt, Homo sapiens
gucaucaaguguauaguuu

SEQ ID NO: 294681 - RNA, 19 nt, Homo sapiens
uuauugcccucaaaucuuu

SEQ ID NO: 294682 - RNA, 19 nt, Homo sapiens
gccagugcauuaugaagaa

SEQ ID NO: 294683 - RNA, 19 nt, Homo sapiens
gauaauggaccuccuugga

SEQ ID NO: 294684 - RNA, 19 nt, Homo sapiens
gagagggugucuguaauca

SEQ ID NO: 294685 - RNA, 19 nt, Homo sapiens
ggagaggccugugaucuac

SEQ ID NO: 294686 - RNA, 19 nt, Homo sapiens
guaugaggcuaaauaugug

SEQ ID NO: 294687 - RNA, 19 nt, Homo sapiens
agagagagggugucuguaa

SEQ ID NO: 294688 - RNA, 19 nt, Homo sapiens
caaguuuauugcccucaaa

SEQ ID NO: 294689 - RNA, 19 nt, Homo sapiens
uaccuaagagccacaauaa

SEQ ID NO: 294690 - RNA, 19 nt, Homo sapiens
gugagagucuaaagagaga

SEQ ID NO: 294691 - RNA, 19 nt, Homo sapiens
guucagucaucaaguguau

SEQ ID NO: 294692 - RNA, 19 nt, Homo sapiens
gaucuacauugaccagaca

SEQ ID NO: 294693 - RNA, 19 nt, Homo sapiens
ggccugugaucuacauuga

SEQ ID NO: 294694 - RNA, 19 nt, Homo sapiens
gaagagugggacaacauga

SEQ ID NO: 294695 - RNA, 19 nt, Homo sapiens
ggacuagaacacaaauaau

SEQ ID NO: 294696 - RNA, 19 nt, Homo sapiens
gguggaacuuaauuaccua

SEQ ID NO: 294697 - RNA, 19 nt, Homo sapiens
gagagcagcccgagagauc

SEQ ID NO: 294698 - RNA, 19 nt, Homo sapiens
ugaagaaacuuugugaacu

SEQ ID NO: 294699 - RNA, 19 nt, Homo sapiens
ucaagugagugagcggaua

SEQ ID NO: 294700 - RNA, 19 nt, Homo sapiens
gcagaagagugggacaaca

SEQ ID NO: 294701 - RNA, 19 nt, Homo sapiens
ggaggacaauggaugacau

SEQ ID NO: 294702 - RNA, 19 nt, Homo sapiens
gcccucaaaucuuuagaau

SEQ ID NO: 294703 - RNA, 19 nt, Homo sapiens
gaaagaguugcaaguaaag

SEQ ID NO: 294704 - RNA, 19 nt, Homo sapiens
guauuugggauaugaguuu

SEQ ID NO: 294705 - RNA, 19 nt, Homo sapiens
ggacugaaucugcaaagca

SEQ ID NO: 294706 - RNA, 19 nt, Homo sapiens
gacaaauaguguggaguga

SEQ ID NO: 294707 - RNA, 19 nt, Homo sapiens
gcaccgagacugccacaca

SEQ ID NO: 294708 - RNA, 19 nt, Homo sapiens
cgucugauccaccauguaa

SEQ ID NO: 294709 - RNA, 19 nt, Homo sapiens
aaaggacaguacacacuug

SEQ ID NO: 294710 - RNA, 19 nt, Homo sapiens
caaaggacaguacacacuu

SEQ ID NO: 294711 - RNA, 19 nt, Homo sapiens
aaguaaaguuccaugaaga

SEQ ID NO: 294712 - RNA, 19 nt, Homo sapiens
uguaugaggcuaaauaugu

SEQ ID NO: 294713 - RNA, 19 nt, Homo sapiens
caagugagugagcggauaa

SEQ ID NO: 294714 - RNA, 19 nt, Homo sapiens
ccaauuauccuccuucacu

SEQ ID NO: 294715 - RNA, 19 nt, Homo sapiens
ugaacucuaugccaagguu

SEQ ID NO: 294716 - RNA, 19 nt, Homo sapiens
uaaaccaugagauguauga

SEQ ID NO: 294717 - RNA, 19 nt, Homo sapiens
gauuggagaccuacaaagu

SEQ ID NO: 294718 - RNA, 19 nt, Homo sapiens
gaucuggucaagugaguga

SEQ ID NO: 294719 - RNA, 19 nt, Homo sapiens
uuggagaccuacaaaguga

SEQ ID NO: 294720 - RNA, 19 nt, Homo sapiens
gacaggagaggaaauuugu

SEQ ID NO: 294721 - RNA, 19 nt, Homo sapiens
gcagcuugccacucucuuu

SEQ ID NO: 294722 - RNA, 19 nt, Homo sapiens
cagagguggaacuuaauua

SEQ ID NO: 294723 - RNA, 19 nt, Homo sapiens
gugcuuguucuuccucuua

SEQ ID NO: 294724 - RNA, 19 nt, Homo sapiens
gcugcuacacaacuuauuu

SEQ ID NO: 294725 - RNA, 19 nt, Homo sapiens
gauguaugaggcuaaauau

SEQ ID NO: 294726 - RNA, 19 nt, Homo sapiens
ugagauguaugaggcuaaa

SEQ ID NO: 294727 - RNA, 19 nt, Homo sapiens
ccuaaaccaugagauguau

SEQ ID NO: 294728 - RNA, 19 nt, Homo sapiens
aaagagagagggugucugu

SEQ ID NO: 294729 - RNA, 19 nt, Homo sapiens
uggagacccuaaaccauga

SEQ ID NO: 294730 - RNA, 19 nt, Homo sapiens
gaggacaggagaggaaauu

SEQ ID NO: 294731 - RNA, 19 nt, Homo sapiens
ggaggcacaacaagaauca

SEQ ID NO: 294732 - RNA, 19 nt, Homo sapiens
guccucaccuucuguuuua

SEQ ID NO: 294733 - RNA, 19 nt, Homo sapiens
guaaucacacucucuucuu

SEQ ID NO: 294734 - RNA, 19 nt, Homo sapiens
gaagauuccagaggaugaa

SEQ ID NO: 294735 - RNA, 19 nt, Homo sapiens
ggaaccaugauuauugaug

SEQ ID NO: 294736 - RNA, 19 nt, Homo sapiens
agauguaugaggcuaaaua

SEQ ID NO: 294737 - RNA, 19 nt, Homo sapiens
gaccaacccagaaucguau

SEQ ID NO: 294738 - RNA, 19 nt, Homo sapiens
ccagaaucguaucuugaga

SEQ ID NO: 294739 - RNA, 19 nt, Homo sapiens
gguuaaauauguggaccuu

SEQ ID NO: 294740 - RNA, 19 nt, Homo sapiens
ugagugagcggauaaugga

SEQ ID NO: 294741 - RNA, 19 nt, Homo sapiens
caagaaucaucucgacaac

SEQ ID NO: 294742 - RNA, 19 nt, Homo sapiens
ggaaagagcucaagaagga

SEQ ID NO: 294743 - RNA, 19 nt, Homo sapiens
gcaauagucuuugagauua

SEQ ID NO: 294744 - RNA, 19 nt, Homo sapiens
ggaagcaccugucaacauu

SEQ ID NO: 294745 - RNA, 19 nt, Homo sapiens
gagagaagcuuucaguaug

SEQ ID NO: 294746 - RNA, 19 nt, Homo sapiens
ggauaaggcuuuagaacaa

SEQ ID NO: 294747 - RNA, 19 nt, Homo sapiens
ggagggagaugucuuguug

SEQ ID NO: 294748 - RNA, 19 nt, Homo sapiens
gauaaagacuuggaacaaa

SEQ ID NO: 294749 - RNA, 19 nt, Homo sapiens
ccacugagcaugucucuua

SEQ ID NO: 294750 - RNA, 19 nt, Homo sapiens
gcccagagcugcacccuuu

SEQ ID NO: 294751 - RNA, 19 nt, Homo sapiens
gaagaaggaugccaagaag

SEQ ID NO: 294752 - RNA, 19 nt, Homo sapiens
gaagagaggagagaucaua

SEQ ID NO: 294753 - RNA, 19 nt, Homo sapiens
gaagacacccagucacuuu

SEQ ID NO: 294754 - RNA, 19 nt, Homo sapiens
ugacaaacuuucuuccuuu

SEQ ID NO: 294755 - RNA, 19 nt, Homo sapiens
gaagaucccagaagagaaa

SEQ ID NO: 294756 - RNA, 19 nt, Homo sapiens
gacaaagacuuagaagaaa

SEQ ID NO: 294757 - RNA, 19 nt, Homo sapiens
gaaacugaggcacauguua

SEQ ID NO: 294758 - RNA, 19 nt, Homo sapiens
ccaagagccuccagucuga

SEQ ID NO: 294759 - RNA, 19 nt, Homo sapiens
gacaaagccuuagaucaaa

SEQ ID NO: 294760 - RNA, 19 nt, Homo sapiens
gacaaagccuuagaacaaa

SEQ ID NO: 294761 - RNA, 19 nt, Homo sapiens
gaagagggcacacuagaga

SEQ ID NO: 294762 - RNA, 19 nt, Homo sapiens
gaaggaaggaggagaagaa

SEQ ID NO: 294763 - RNA, 19 nt, Homo sapiens
agacaaagccuuagaacaa

SEQ ID NO: 294764 - RNA, 19 nt, Homo sapiens
ggaaagugaaccugaagua

SEQ ID NO: 294765 - RNA, 19 nt, Homo sapiens
agacaaagacuuagaagaa

SEQ ID NO: 294766 - RNA, 19 nt, Homo sapiens
gggaggaggugguagaaga

SEQ ID NO: 294767 - RNA, 19 nt, Homo sapiens
gaacagaaggauaagauuc

SEQ ID NO: 294768 - RNA, 19 nt, Homo sapiens
ccacacagcucccaugucu

SEQ ID NO: 294769 - RNA, 19 nt, Homo sapiens
gacaaucccuggcuacuca

SEQ ID NO: 294770 - RNA, 19 nt, Homo sapiens
gaaagugaaccugaaguaa

SEQ ID NO: 294771 - RNA, 19 nt, Homo sapiens
gauaagccauucccucuag

SEQ ID NO: 294772 - RNA, 19 nt, Homo sapiens
gaaagcugaucaaagacaa

SEQ ID NO: 294773 - RNA, 19 nt, Homo sapiens
gaagcucuuuagaccaaua

SEQ ID NO: 294774 - RNA, 19 nt, Homo sapiens
gaaggaaccugagccaaag

SEQ ID NO: 294775 - RNA, 19 nt, Homo sapiens
caauagagacccugggaua

SEQ ID NO: 294776 - RNA, 19 nt, Homo sapiens
ggaaugacccugccaaugg

SEQ ID NO: 294777 - RNA, 19 nt, Homo sapiens
gaaagacaaagccuuagaa

SEQ ID NO: 294778 - RNA, 19 nt, Homo sapiens
aaacacaucugcagagaag

SEQ ID NO: 294779 - RNA, 19 nt, Homo sapiens
ccucagacuucaaggauuu

SEQ ID NO: 294780 - RNA, 19 nt, Homo sapiens
gcaaaccucagaaagauga

SEQ ID NO: 294781 - RNA, 19 nt, Homo sapiens
gaggagaagaggaaagaua

SEQ ID NO: 294782 - RNA, 19 nt, Homo sapiens
uaucaaagcuggaagaaaa

SEQ ID NO: 294783 - RNA, 19 nt, Homo sapiens
caagaaacaucuccuacca

SEQ ID NO: 294784 - RNA, 19 nt, Homo sapiens
gauaaggcuuuagaacaaa

SEQ ID NO: 294785 - RNA, 19 nt, Homo sapiens
gagaaacuuugcagucaau

SEQ ID NO: 294786 - RNA, 19 nt, Homo sapiens
aaagauaccugggaggaaa

SEQ ID NO: 294787 - RNA, 19 nt, Homo sapiens
agacaaagccuuagaucaa

SEQ ID NO: 294788 - RNA, 19 nt, Homo sapiens
gcagaggagcggugccuua

SEQ ID NO: 294789 - RNA, 19 nt, Homo sapiens
gaacaguaccuacacaaag

SEQ ID NO: 294790 - RNA, 19 nt, Homo sapiens
gcucugagguucaucaucu

SEQ ID NO: 294791 - RNA, 19 nt, Homo sapiens
ggaaggaggagaagaagga

SEQ ID NO: 294792 - RNA, 19 nt, Homo sapiens
cgacucagaugaagaugga

SEQ ID NO: 294793 - RNA, 19 nt, Homo sapiens
ggacagagaccuagaacag

SEQ ID NO: 294794 - RNA, 19 nt, Homo sapiens
gccaaaggaugaaguuuua

SEQ ID NO: 294795 - RNA, 19 nt, Homo sapiens
gacagaaccucagaacaga

SEQ ID NO: 294796 - RNA, 19 nt, Homo sapiens
gccauaaagugggaagaua

SEQ ID NO: 294797 - RNA, 19 nt, Homo sapiens
aagcagcucucuccagaaa

SEQ ID NO: 294798 - RNA, 19 nt, Homo sapiens
gagaagaucccagaagaga

SEQ ID NO: 294799 - RNA, 19 nt, Homo sapiens
ccacccagauuucauacaa

SEQ ID NO: 294800 - RNA, 19 nt, Homo sapiens
gaagaggaaagauaccaaa

SEQ ID NO: 294801 - RNA, 19 nt, Homo sapiens
ugacagcacuagugacuca

SEQ ID NO: 294802 - RNA, 19 nt, Homo sapiens
gaagagaaccaccaaacuc

SEQ ID NO: 294803 - RNA, 19 nt, Homo sapiens
agagaaagacaaagccuua

SEQ ID NO: 294804 - RNA, 19 nt, Homo sapiens
agagaaagacaaagccuua

SEQ ID NO: 294805 - RNA, 19 nt, Homo sapiens
guaagacccucuauaaagc

SEQ ID NO: 294806 - RNA, 19 nt, Homo sapiens
agaauaggauagcaucuga

SEQ ID NO: 294807 - RNA, 19 nt, Homo sapiens
cucaucagcuuauaaacua

SEQ ID NO: 294808 - RNA, 19 nt, Homo sapiens
gaaggagaccucguuauuc

SEQ ID NO: 294809 - RNA, 19 nt, Homo sapiens
acacaggacuaggagauaa

SEQ ID NO: 294810 - RNA, 19 nt, Homo sapiens
guacguaagacccucuaua

SEQ ID NO: 294811 - RNA, 19 nt, Homo sapiens
agcgaaagcugaucaaaga

SEQ ID NO: 294812 - RNA, 19 nt, Homo sapiens
ugaggaaguucggcuagua

SEQ ID NO: 294813 - RNA, 19 nt, Homo sapiens
ggaggagacagcaaacgua

SEQ ID NO: 294814 - RNA, 19 nt, Homo sapiens
uaaaggaggaugugauaga

SEQ ID NO: 294815 - RNA, 19 nt, Homo sapiens
aaagugaaccugaaguaaa

SEQ ID NO: 294816 - RNA, 19 nt, Homo sapiens
gcagagaggcucccagaca

SEQ ID NO: 294817 - RNA, 19 nt, Homo sapiens
auagggaccucucaacuga

SEQ ID NO: 294818 - RNA, 19 nt, Homo sapiens
gaaagacaaagccuuagau

SEQ ID NO: 294819 - RNA, 19 nt, Homo sapiens
acacagcccuagaacagaa

SEQ ID NO: 294820 - RNA, 19 nt, Homo sapiens
aaacagaggaagagaaaga

SEQ ID NO: 294821 - RNA, 19 nt, Homo sapiens
ggacaagaagaacauguga

SEQ ID NO: 294822 - RNA, 19 nt, Homo sapiens
ccacugcuauacuguucua

SEQ ID NO: 294823 - RNA, 19 nt, Homo sapiens
gauaaagucucagaaaaga

SEQ ID NO: 294824 - RNA, 19 nt, Homo sapiens
acaaggcccuggaaccaaa

SEQ ID NO: 294825 - RNA, 19 nt, Homo sapiens
auacagcccuggaacagaa

SEQ ID NO: 294826 - RNA, 19 nt, Homo sapiens
acaaggcccuggaacagaa

SEQ ID NO: 294827 - RNA, 19 nt, Homo sapiens
acaaggcccuggaaccaaa

SEQ ID NO: 294828 - RNA, 19 nt, Homo sapiens
gggcagagacuuagagcaa

SEQ ID NO: 294829 - RNA, 19 nt, Homo sapiens
gugacaaacuuucuuccuu

SEQ ID NO: 294830 - RNA, 19 nt, Homo sapiens
ugaaacagaggaagagaaa

SEQ ID NO: 294831 - RNA, 19 nt, Homo sapiens
aaccugagcucaagaagau

SEQ ID NO: 294832 - RNA, 19 nt, Homo sapiens
gagcccaccuuguguucuu

SEQ ID NO: 294833 - RNA, 19 nt, Homo sapiens
cgaaacacaucugcagaga

SEQ ID NO: 294834 - RNA, 19 nt, Homo sapiens
aggauaagauuccagaaga

SEQ ID NO: 294835 - RNA, 19 nt, Homo sapiens
gauagcuccuucuccaaga

SEQ ID NO: 294836 - RNA, 19 nt, Homo sapiens
gaacucaccuaccccacua

SEQ ID NO: 294837 - RNA, 19 nt, Homo sapiens
ugaaggugcuggcccauuc

SEQ ID NO: 294838 - RNA, 19 nt, Homo sapiens
agaaggagaccucguuauu

SEQ ID NO: 294839 - RNA, 19 nt, Homo sapiens
aaaggaggaugugauagaa

SEQ ID NO: 294840 - RNA, 19 nt, Homo sapiens
ggaaagggaagaagaaggu

SEQ ID NO: 294841 - RNA, 19 nt, Homo sapiens
gaaggacagagaccuagaa

SEQ ID NO: 294842 - RNA, 19 nt, Homo sapiens
gggcaaagcucuaaagaaa

SEQ ID NO: 294843 - RNA, 19 nt, Homo sapiens
uuaagucgcugaacaauua

SEQ ID NO: 294844 - RNA, 19 nt, Homo sapiens
gcaaagcucuaaagaaaga

SEQ ID NO: 294845 - RNA, 19 nt, Homo sapiens
ggaagagucugucaagaaa

SEQ ID NO: 294846 - RNA, 19 nt, Homo sapiens
gaacaaguguacagaagaa

SEQ ID NO: 294847 - RNA, 19 nt, Homo sapiens
gcucaaacaucuagacuuu

SEQ ID NO: 294848 - RNA, 19 nt, Homo sapiens
gaagacacguacucucaua

SEQ ID NO: 294849 - RNA, 19 nt, Homo sapiens
ccagagauauguccuuaua

SEQ ID NO: 294850 - RNA, 19 nt, Homo sapiens
ggaaggacuuucugaguuu

SEQ ID NO: 294851 - RNA, 19 nt, Homo sapiens
gaacaguccucaaugucua

SEQ ID NO: 294852 - RNA, 19 nt, Homo sapiens
agaaagagguuaagaaaga

SEQ ID NO: 294853 - RNA, 19 nt, Homo sapiens
gaagagccaucuccaguga

SEQ ID NO: 294854 - RNA, 19 nt, Homo sapiens
agacaaggcugaauucauu

SEQ ID NO: 294855 - RNA, 19 nt, Homo sapiens
ccaauuaacugaagcaaau

SEQ ID NO: 294856 - RNA, 19 nt, Homo sapiens
agaaagaucugaaagagaa

SEQ ID NO: 294857 - RNA, 19 nt, Homo sapiens
gaaaggaaauuaggagaug

SEQ ID NO: 294858 - RNA, 19 nt, Homo sapiens
gcaaagaaaucaucuacuc

SEQ ID NO: 294859 - RNA, 19 nt, Homo sapiens
uuaagaagcucccuaaaga

SEQ ID NO: 294860 - RNA, 19 nt, Homo sapiens
gcaaacaccuaccacauuc

SEQ ID NO: 294861 - RNA, 19 nt, Homo sapiens
uaacuucagucucaucuuu

SEQ ID NO: 294862 - RNA, 19 nt, Homo sapiens
caauucagcuucuaucuug

SEQ ID NO: 294863 - RNA, 19 nt, Homo sapiens
uaauuaagcuccuucaguu

SEQ ID NO: 294864 - RNA, 19 nt, Homo sapiens
gaaccugcaucuucaauuc

SEQ ID NO: 294865 - RNA, 19 nt, Homo sapiens
caaaggaagucaagaagga

SEQ ID NO: 294866 - RNA, 19 nt, Homo sapiens
acacaaaccugauugaaug

SEQ ID NO: 294867 - RNA, 19 nt, Homo sapiens
gcacagugguuaugcaaga

SEQ ID NO: 294868 - RNA, 19 nt, Homo sapiens
gaagaaagaaucuguggaa

SEQ ID NO: 294869 - RNA, 19 nt, Homo sapiens
gaagagaaacugaaggaaa

SEQ ID NO: 294870 - RNA, 19 nt, Homo sapiens
caaggacuuugaagaguua

SEQ ID NO: 294871 - RNA, 19 nt, Homo sapiens
ugaaauggcuucuaugauc

SEQ ID NO: 294872 - RNA, 19 nt, Homo sapiens
gaaauggcuucuaugauca

SEQ ID NO: 294873 - RNA, 19 nt, Homo sapiens
gaagacaaauucagcagau

SEQ ID NO: 294874 - RNA, 19 nt, Homo sapiens
gauagcaucucagcuguuu

SEQ ID NO: 294875 - RNA, 19 nt, Homo sapiens
ggacaagacucuggaagug

SEQ ID NO: 294876 - RNA, 19 nt, Homo sapiens
gaagagaagcauagaagaa

SEQ ID NO: 294877 - RNA, 19 nt, Homo sapiens
gaacuccaaucuugacaga

SEQ ID NO: 294878 - RNA, 19 nt, Homo sapiens
gguagaggcauuugucuua

SEQ ID NO: 294879 - RNA, 19 nt, Homo sapiens
gaauguugauguggaauuu

SEQ ID NO: 294880 - RNA, 19 nt, Homo sapiens
gcugagaggucccuuaugu

SEQ ID NO: 294881 - RNA, 19 nt, Homo sapiens
caagaaagagguuaagaaa

SEQ ID NO: 294882 - RNA, 19 nt, Homo sapiens
gaaccucuguuuagaagug

SEQ ID NO: 294883 - RNA, 19 nt, Homo sapiens
gaggugcgcuuaaugauca

SEQ ID NO: 294884 - RNA, 19 nt, Homo sapiens
gagaaagaaugagaaagaa

SEQ ID NO: 294885 - RNA, 19 nt, Homo sapiens
ccaagaaucuccugagcaa

SEQ ID NO: 294886 - RNA, 19 nt, Homo sapiens
agaaaugucuccaucuaaa

SEQ ID NO: 294887 - RNA, 19 nt, Homo sapiens
gaaaggagaggcugaacaa

SEQ ID NO: 294888 - RNA, 19 nt, Homo sapiens
gaaagagguuaagaaagaa

SEQ ID NO: 294889 - RNA, 19 nt, Homo sapiens
cuacuuaacuucagucuca

SEQ ID NO: 294890 - RNA, 19 nt, Homo sapiens
uagguaaacuugagaugua

SEQ ID NO: 294891 - RNA, 19 nt, Homo sapiens
gaaggacuuucugaguuua

SEQ ID NO: 294892 - RNA, 19 nt, Homo sapiens
gcacagacuuugcaccaau

SEQ ID NO: 294893 - RNA, 19 nt, Homo sapiens
cagcaaguguacaguauuu

SEQ ID NO: 294894 - RNA, 19 nt, Homo sapiens
ggaguuguauuucucaaug

SEQ ID NO: 294895 - RNA, 19 nt, Homo sapiens
ugacuuaggaguuguauuu

SEQ ID NO: 294896 - RNA, 19 nt, Homo sapiens
uuucacagcuucuuuacua

SEQ ID NO: 294897 - RNA, 19 nt, Homo sapiens
acuagaagcugaucugauu

SEQ ID NO: 294898 - RNA, 19 nt, Homo sapiens
acacuaagauguccauuuc

SEQ ID NO: 294899 - RNA, 19 nt, Homo sapiens
ucacacaccuuacuaucaa

SEQ ID NO: 294900 - RNA, 19 nt, Homo sapiens
gaagucugauauugcagua

SEQ ID NO: 294901 - RNA, 19 nt, Homo sapiens
ugacuugaauguacaaaga

SEQ ID NO: 294902 - RNA, 19 nt, Homo sapiens
uaugagacaucuacaaaga

SEQ ID NO: 294903 - RNA, 19 nt, Homo sapiens
ggacacccguucaagauca

SEQ ID NO: 294904 - RNA, 19 nt, Homo sapiens
caagaccgaugucaauuuc

SEQ ID NO: 294905 - RNA, 19 nt, Homo sapiens
agaaguagaucucccgauu

SEQ ID NO: 294906 - RNA, 19 nt, Homo sapiens
gaaaaggaaugcaagagaa

SEQ ID NO: 294907 - RNA, 19 nt, Homo sapiens
guacaaagaccaagucauc

SEQ ID NO: 294908 - RNA, 19 nt, Homo sapiens
aauggaagcugaagacuau

SEQ ID NO: 294909 - RNA, 19 nt, Homo sapiens
gaaggaaguuaagaaggaa

SEQ ID NO: 294910 - RNA, 19 nt, Homo sapiens
ccacugauggcaaggauua

SEQ ID NO: 294911 - RNA, 19 nt, Homo sapiens
ggagagagaagucaccaaa

SEQ ID NO: 294912 - RNA, 19 nt, Homo sapiens
caaagaacccuagcacaaa

SEQ ID NO: 294913 - RNA, 19 nt, Homo sapiens
agacugaaauggcuucuau

SEQ ID NO: 294914 - RNA, 19 nt, Homo sapiens
gauacuugaugcacuuauu

SEQ ID NO: 294915 - RNA, 19 nt, Homo sapiens
agagaguucuggugagaua

SEQ ID NO: 294916 - RNA, 19 nt, Homo sapiens
acagaaaugucuccaucua

SEQ ID NO: 294917 - RNA, 19 nt, Homo sapiens
uuacugcucugaagugaaa

SEQ ID NO: 294918 - RNA, 19 nt, Homo sapiens
gguaaagccugaagacaag

SEQ ID NO: 294919 - RNA, 19 nt, Homo sapiens
gggcgauucugccuuguuu

SEQ ID NO: 294920 - RNA, 19 nt, Homo sapiens
gaucccaacucaugacuca

SEQ ID NO: 294921 - RNA, 19 nt, Homo sapiens
ccagagaggaggaauauga

SEQ ID NO: 294922 - RNA, 19 nt, Homo sapiens
gaccaaaccuucagugacu

SEQ ID NO: 294923 - RNA, 19 nt, Homo sapiens
ugagacagcaaguuuauaa

SEQ ID NO: 294924 - RNA, 19 nt, Homo sapiens
agaaggagauguaaugaca

SEQ ID NO: 294925 - RNA, 19 nt, Homo sapiens
ggagagagagagagaaaga

SEQ ID NO: 294926 - RNA, 19 nt, Homo sapiens
cuacgagacuucagaccua

SEQ ID NO: 294927 - RNA, 19 nt, Homo sapiens
ugaaaugacuucuacuagu

SEQ ID NO: 294928 - RNA, 19 nt, Homo sapiens
ccaaggacuuugaagaguu

SEQ ID NO: 294929 - RNA, 19 nt, Homo sapiens
agaaggaaguuaagaagga

SEQ ID NO: 294930 - RNA, 19 nt, Homo sapiens
gcaaauccgugcgcaagga

SEQ ID NO: 294931 - RNA, 19 nt, Homo sapiens
gcaagauucucuccugaag

SEQ ID NO: 294932 - RNA, 19 nt, Homo sapiens
ucaauaugcucaucaaugg

SEQ ID NO: 294933 - RNA, 19 nt, Homo sapiens
gcauuuguccacccacuua

SEQ ID NO: 294934 - RNA, 19 nt, Homo sapiens
caaguuggcuagaagaaag

SEQ ID NO: 294935 - RNA, 19 nt, Homo sapiens
gaccaagaacucaaacuuu

SEQ ID NO: 294936 - RNA, 19 nt, Homo sapiens
caaaugcuauacuguguca

SEQ ID NO: 294937 - RNA, 19 nt, Homo sapiens
uuacgagacugcagagaaa

SEQ ID NO: 294938 - RNA, 19 nt, Homo sapiens
caagucagcuacuccuguu

SEQ ID NO: 294939 - RNA, 19 nt, Homo sapiens
caucucagcuguuucaagu

SEQ ID NO: 294940 - RNA, 19 nt, Homo sapiens
gugaugagaccaacaauga

SEQ ID NO: 294941 - RNA, 19 nt, Homo sapiens
gaaguagaucucccgauuu

SEQ ID NO: 294942 - RNA, 19 nt, Homo sapiens
gggcaaagcucuaaagaaa

SEQ ID NO: 294943 - RNA, 19 nt, Homo sapiens
uuaagucgcugaacaauua

SEQ ID NO: 294944 - RNA, 19 nt, Homo sapiens
gcaaagcucuaaagaaaga

SEQ ID NO: 294945 - RNA, 19 nt, Homo sapiens
ggaagagucugucaagaaa

SEQ ID NO: 294946 - RNA, 19 nt, Homo sapiens
gaacaaguguacagaagaa

SEQ ID NO: 294947 - RNA, 19 nt, Homo sapiens
gcucaaacaucuagacuuu

SEQ ID NO: 294948 - RNA, 19 nt, Homo sapiens
gaagacacguacucucaua

SEQ ID NO: 294949 - RNA, 19 nt, Homo sapiens
ccagagauauguccuuaua

SEQ ID NO: 294950 - RNA, 19 nt, Homo sapiens
ggaaggacuuucugaguuu

SEQ ID NO: 294951 - RNA, 19 nt, Homo sapiens
gaacaguccucaaugucua

SEQ ID NO: 294952 - RNA, 19 nt, Homo sapiens
agaaagagguuaagaaaga

SEQ ID NO: 294953 - RNA, 19 nt, Homo sapiens
gaagagccaucuccaguga

SEQ ID NO: 294954 - RNA, 19 nt, Homo sapiens
agacaaggcugaauucauu

SEQ ID NO: 294955 - RNA, 19 nt, Homo sapiens
ccaauuaacugaagcaaau

SEQ ID NO: 294956 - RNA, 19 nt, Homo sapiens
agaaagaucugaaagagaa

SEQ ID NO: 294957 - RNA, 19 nt, Homo sapiens
gaaaggaaauuaggagaug

SEQ ID NO: 294958 - RNA, 19 nt, Homo sapiens
gcaaagaaaucaucuacuc

SEQ ID NO: 294959 - RNA, 19 nt, Homo sapiens
uuaagaagcucccuaaaga

SEQ ID NO: 294960 - RNA, 19 nt, Homo sapiens
gcaaacaccuaccacauuc

SEQ ID NO: 294961 - RNA, 19 nt, Homo sapiens
uaacuucagucucaucuuu

SEQ ID NO: 294962 - RNA, 19 nt, Homo sapiens
caauucagcuucuaucuug

SEQ ID NO: 294963 - RNA, 19 nt, Homo sapiens
uaauuaagcuccuucaguu

SEQ ID NO: 294964 - RNA, 19 nt, Homo sapiens
gaaccugcaucuucaauuc

SEQ ID NO: 294965 - RNA, 19 nt, Homo sapiens
caaaggaagucaagaagga

SEQ ID NO: 294966 - RNA, 19 nt, Homo sapiens
gcacagugguuaugcaaga

SEQ ID NO: 294967 - RNA, 19 nt, Homo sapiens
gaagaaagaaucuguggaa

SEQ ID NO: 294968 - RNA, 19 nt, Homo sapiens
gaagagaaacugaaggaaa

SEQ ID NO: 294969 - RNA, 19 nt, Homo sapiens
caaggacuuugaagaguua

SEQ ID NO: 294970 - RNA, 19 nt, Homo sapiens
ugaaauggcuucuaugauc

SEQ ID NO: 294971 - RNA, 19 nt, Homo sapiens
gaaauggcuucuaugauca

SEQ ID NO: 294972 - RNA, 19 nt, Homo sapiens
gaagacaaauucagcagau

SEQ ID NO: 294973 - RNA, 19 nt, Homo sapiens
gauagcaucucagcuguuu

SEQ ID NO: 294974 - RNA, 19 nt, Homo sapiens
ggacaagacucuggaagug

SEQ ID NO: 294975 - RNA, 19 nt, Homo sapiens
gaagagaagcauagaagaa

SEQ ID NO: 294976 - RNA, 19 nt, Homo sapiens
gaacuccaaucuugacaga

SEQ ID NO: 294977 - RNA, 19 nt, Homo sapiens
gguagaggcauuugucuua

SEQ ID NO: 294978 - RNA, 19 nt, Homo sapiens
gaauguugauguggaauuu

SEQ ID NO: 294979 - RNA, 19 nt, Homo sapiens
gcugagaggucccuuaugu

SEQ ID NO: 294980 - RNA, 19 nt, Homo sapiens
caagaaagagguuaagaaa

SEQ ID NO: 294981 - RNA, 19 nt, Homo sapiens
gaaccucuguuuagaagug

SEQ ID NO: 294982 - RNA, 19 nt, Homo sapiens
gaggugcgcuuaaugauca

SEQ ID NO: 294983 - RNA, 19 nt, Homo sapiens
gagaaagaaugagaaagaa

SEQ ID NO: 294984 - RNA, 19 nt, Homo sapiens
ccaagaaucuccugagcaa

SEQ ID NO: 294985 - RNA, 19 nt, Homo sapiens
agaaaugucuccaucuaaa

SEQ ID NO: 294986 - RNA, 19 nt, Homo sapiens
gaaaggagaggcugaacaa

SEQ ID NO: 294987 - RNA, 19 nt, Homo sapiens
gaaagagguuaagaaagaa

SEQ ID NO: 294988 - RNA, 19 nt, Homo sapiens
cuacuuaacuucagucuca

SEQ ID NO: 294989 - RNA, 19 nt, Homo sapiens
uagguaaacuugagaugua

SEQ ID NO: 294990 - RNA, 19 nt, Homo sapiens
gaaggacuuucugaguuua

SEQ ID NO: 294991 - RNA, 19 nt, Homo sapiens
gcacagacuuugcaccaau

SEQ ID NO: 294992 - RNA, 19 nt, Homo sapiens
cagcaaguguacaguauuu

SEQ ID NO: 294993 - RNA, 19 nt, Homo sapiens
ggaguuguauuucucaaug

SEQ ID NO: 294994 - RNA, 19 nt, Homo sapiens
ugacuuaggaguuguauuu

SEQ ID NO: 294995 - RNA, 19 nt, Homo sapiens
uuucacagcuucuuuacua

SEQ ID NO: 294996 - RNA, 19 nt, Homo sapiens
acuagaagcugaucugauu

SEQ ID NO: 294997 - RNA, 19 nt, Homo sapiens
acacuaagauguccauuuc

SEQ ID NO: 294998 - RNA, 19 nt, Homo sapiens
ucacacaccuuacuaucaa

SEQ ID NO: 294999 - RNA, 19 nt, Homo sapiens
gaagucugauauugcagua

SEQ ID NO: 295000 - RNA, 19 nt, Homo sapiens
ugacuugaauguacaaaga

SEQ ID NO: 295001 - RNA, 19 nt, Homo sapiens
uaugagacaucuacaaaga

SEQ ID NO: 295002 - RNA, 19 nt, Homo sapiens
ggacacccguucaagauca

SEQ ID NO: 295003 - RNA, 19 nt, Homo sapiens
caagaccgaugucaauuuc

SEQ ID NO: 295004 - RNA, 19 nt, Homo sapiens
agaaguagaucucccgauu

SEQ ID NO: 295005 - RNA, 19 nt, Homo sapiens
gaaaaggaaugcaagagaa

SEQ ID NO: 295006 - RNA, 19 nt, Homo sapiens
guacaaagaccaagucauc

SEQ ID NO: 295007 - RNA, 19 nt, Homo sapiens
aauggaagcugaagacuau

SEQ ID NO: 295008 - RNA, 19 nt, Homo sapiens
gaaggaaguuaagaaggaa

SEQ ID NO: 295009 - RNA, 19 nt, Homo sapiens
ccacugauggcaaggauua

SEQ ID NO: 295010 - RNA, 19 nt, Homo sapiens
ggagagagaagucaccaaa

SEQ ID NO: 295011 - RNA, 19 nt, Homo sapiens
caaagaacccuagcacaaa

SEQ ID NO: 295012 - RNA, 19 nt, Homo sapiens
agacugaaauggcuucuau

SEQ ID NO: 295013 - RNA, 19 nt, Homo sapiens
gauacuugaugcacuuauu

SEQ ID NO: 295014 - RNA, 19 nt, Homo sapiens
agagaguucuggugagaua

SEQ ID NO: 295015 - RNA, 19 nt, Homo sapiens
acagaaaugucuccaucua

SEQ ID NO: 295016 - RNA, 19 nt, Homo sapiens
uuacugcucugaagugaaa

SEQ ID NO: 295017 - RNA, 19 nt, Homo sapiens
gguaaagccugaagacaag

SEQ ID NO: 295018 - RNA, 19 nt, Homo sapiens
gggcgauucugccuuguuu

SEQ ID NO: 295019 - RNA, 19 nt, Homo sapiens
gaucccaacucaugacuca

SEQ ID NO: 295020 - RNA, 19 nt, Homo sapiens
ccagagaggaggaauauga

SEQ ID NO: 295021 - RNA, 19 nt, Homo sapiens
gaccaaaccuucagugacu

SEQ ID NO: 295022 - RNA, 19 nt, Homo sapiens
ugagacagcaaguuuauaa

SEQ ID NO: 295023 - RNA, 19 nt, Homo sapiens
agaaggagauguaaugaca

SEQ ID NO: 295024 - RNA, 19 nt, Homo sapiens
ggagagagagagagaaaga

SEQ ID NO: 295025 - RNA, 19 nt, Homo sapiens
cuacgagacuucagaccua

SEQ ID NO: 295026 - RNA, 19 nt, Homo sapiens
ugaaaugacuucuacuagu

SEQ ID NO: 295027 - RNA, 19 nt, Homo sapiens
ccaaggacuuugaagaguu

SEQ ID NO: 295028 - RNA, 19 nt, Homo sapiens
ccaauuguguuucccaaga

SEQ ID NO: 295029 - RNA, 19 nt, Homo sapiens
agaaggaaguuaagaagga

SEQ ID NO: 295030 - RNA, 19 nt, Homo sapiens
gcaaauccgugcgcaagga

SEQ ID NO: 295031 - RNA, 19 nt, Homo sapiens
ucaauaugcucaucaaugg

SEQ ID NO: 295032 - RNA, 19 nt, Homo sapiens
gcauuuguccacccacuua

SEQ ID NO: 295033 - RNA, 19 nt, Homo sapiens
caaguuggcuagaagaaag

SEQ ID NO: 295034 - RNA, 19 nt, Homo sapiens
caaaugcuauacuguguca

SEQ ID NO: 295035 - RNA, 19 nt, Homo sapiens
uuacgagacugcagagaaa

SEQ ID NO: 295036 - RNA, 19 nt, Homo sapiens
caagucagcuacuccuguu

SEQ ID NO: 295037 - RNA, 19 nt, Homo sapiens
caucucagcuguuucaagu

SEQ ID NO: 295038 - RNA, 19 nt, Homo sapiens
gugaugagaccaacaauga

SEQ ID NO: 295039 - RNA, 19 nt, Homo sapiens
gaaguagaucucccgauuu

SEQ ID NO: 295040 - RNA, 19 nt, Homo sapiens
ggacugguaccaacaaaga

SEQ ID NO: 295041 - RNA, 19 nt, Homo sapiens
cuccaagacuucaucaaua

SEQ ID NO: 295042 - RNA, 19 nt, Homo sapiens
gaaagaagcucaacauaaa

SEQ ID NO: 295043 - RNA, 19 nt, Homo sapiens
gaaagaauguucacuauug

SEQ ID NO: 295044 - RNA, 19 nt, Homo sapiens
ggaaacaucuccagaauca

SEQ ID NO: 295045 - RNA, 19 nt, Homo sapiens
gaagaaagcuaaugauagg

SEQ ID NO: 295046 - RNA, 19 nt, Homo sapiens
gaagauaaaucaggaaugu

SEQ ID NO: 295047 - RNA, 19 nt, Homo sapiens
ggacaggaaccuauacuua

SEQ ID NO: 295048 - RNA, 19 nt, Homo sapiens
caacagacaacaucaaaua

SEQ ID NO: 295049 - RNA, 19 nt, Homo sapiens
caaagucucugacggagua

SEQ ID NO: 295050 - RNA, 19 nt, Homo sapiens
gaacagauagagaaaguaa

SEQ ID NO: 295051 - RNA, 19 nt, Homo sapiens
gcauaucucuggugacaaa

SEQ ID NO: 295052 - RNA, 19 nt, Homo sapiens
gcaaugaccuuacccaaag

SEQ ID NO: 295053 - RNA, 19 nt, Homo sapiens
ggaggugucugcaaggaua

SEQ ID NO: 295054 - RNA, 19 nt, Homo sapiens
gagaagagguugcacuuuc

SEQ ID NO: 295055 - RNA, 19 nt, Homo sapiens
cagcagagauucagaguga

SEQ ID NO: 295056 - RNA, 19 nt, Homo sapiens
gaaagaaggcacuaaaguu

SEQ ID NO: 295057 - RNA, 19 nt, Homo sapiens
gaagagauuuggccacaga

SEQ ID NO: 295058 - RNA, 19 nt, Homo sapiens
ugaaacaucugccuugaaa

SEQ ID NO: 295059 - RNA, 19 nt, Homo sapiens
gaaauaggcauaauucaga

SEQ ID NO: 295060 - RNA, 19 nt, Homo sapiens
gcauugaccucccuaaaga

SEQ ID NO: 295061 - RNA, 19 nt, Homo sapiens
gaagugguguuuagaaugu

SEQ ID NO: 295062 - RNA, 19 nt, Homo sapiens
ggaaaucagucccaucaga

SEQ ID NO: 295063 - RNA, 19 nt, Homo sapiens
ggaggaagauuuacuuaca

SEQ ID NO: 295064 - RNA, 19 nt, Homo sapiens
gcagagccauugcaugaaa

SEQ ID NO: 295065 - RNA, 19 nt, Homo sapiens
gagaagaaagcuaaugaua

SEQ ID NO: 295066 - RNA, 19 nt, Homo sapiens
aaagggaccuccacaguaa

SEQ ID NO: 295067 - RNA, 19 nt, Homo sapiens
gaagaaggucgccaucaua

SEQ ID NO: 295068 - RNA, 19 nt, Homo sapiens
caaagaagcaugucaauca

SEQ ID NO: 295069 - RNA, 19 nt, Homo sapiens
gaagaaauaggcauaauuc

SEQ ID NO: 295070 - RNA, 19 nt, Homo sapiens
aaagaaggcacuaaaguua

SEQ ID NO: 295071 - RNA, 19 nt, Homo sapiens
cgaaggcacugaugauaaa

SEQ ID NO: 295072 - RNA, 19 nt, Homo sapiens
gaaccuauacuuacugaaa

SEQ ID NO: 295073 - RNA, 19 nt, Homo sapiens
gaagagcauguaagaaaua

SEQ ID NO: 295074 - RNA, 19 nt, Homo sapiens
ggagaaagcugaaaaggaa

SEQ ID NO: 295075 - RNA, 19 nt, Homo sapiens
cgaaccaucugcauuaauu

SEQ ID NO: 295076 - RNA, 19 nt, Homo sapiens
guaaggaguuugaccaaga

SEQ ID NO: 295077 - RNA, 19 nt, Homo sapiens
gggaagaaagauucaauua

SEQ ID NO: 295078 - RNA, 19 nt, Homo sapiens
ggaagagcauguaagaaau

SEQ ID NO: 295079 - RNA, 19 nt, Homo sapiens
gggaagagcauguaagaaa

SEQ ID NO: 295080 - RNA, 19 nt, Homo sapiens
ggaagacacuggcuuuaca

SEQ ID NO: 295081 - RNA, 19 nt, Homo sapiens
caacucaucucuccugugu

SEQ ID NO: 295082 - RNA, 19 nt, Homo sapiens
acucaucucuccuguguua

SEQ ID NO: 295083 - RNA, 19 nt, Homo sapiens
ggaggcagaugcauuuaug

SEQ ID NO: 295084 - RNA, 19 nt, Homo sapiens
gaacaaagaagcaugucaa

SEQ ID NO: 295085 - RNA, 19 nt, Homo sapiens
gaaauaacaaggcauugaa

SEQ ID NO: 295086 - RNA, 19 nt, Homo sapiens
uuugggaccuggauaauua

SEQ ID NO: 295087 - RNA, 19 nt, Homo sapiens
aaaguugguucucuugaua

SEQ ID NO: 295088 - RNA, 19 nt, Homo sapiens
caacagagcuaaaacuuga

SEQ ID NO: 295089 - RNA, 19 nt, Homo sapiens
agagauagcugagguagaa

SEQ ID NO: 295090 - RNA, 19 nt, Homo sapiens
ugaagaggcuggugaugaa

SEQ ID NO: 295091 - RNA, 19 nt, Homo sapiens
gcuacuguguguucaauaa

SEQ ID NO: 295092 - RNA, 19 nt, Homo sapiens
gaccucagcugacagagaa

SEQ ID NO: 295093 - RNA, 19 nt, Homo sapiens
gaagaagaguuugaaguag

SEQ ID NO: 295094 - RNA, 19 nt, Homo sapiens
gaaggaaacaucuccagaa

SEQ ID NO: 295095 - RNA, 19 nt, Homo sapiens
agacagaagucaaacagaa

SEQ ID NO: 295096 - RNA, 19 nt, Homo sapiens
ccacagaccuuucacugau

SEQ ID NO: 295097 - RNA, 19 nt, Homo sapiens
caaagaggaagaacagaua

SEQ ID NO: 295098 - RNA, 19 nt, Homo sapiens
caagaaagaauguucacua

SEQ ID NO: 295099 - RNA, 19 nt, Homo sapiens
gaccgaaccaucugcauua

SEQ ID NO: 295100 - RNA, 19 nt, Homo sapiens
gaaagaagccagaaaauau

SEQ ID NO: 295101 - RNA, 19 nt, Homo sapiens
caucaugacagaacaguua

SEQ ID NO: 295102 - RNA, 19 nt, Homo sapiens
ugaagaagaguuugaagua

SEQ ID NO: 295103 - RNA, 19 nt, Homo sapiens
ucaagacagugagaauuua

SEQ ID NO: 295104 - RNA, 19 nt, Homo sapiens
aagcuucacucuuccuuua

SEQ ID NO: 295105 - RNA, 19 nt, Homo sapiens
uaaacaugcugccuuaguu

SEQ ID NO: 295106 - RNA, 19 nt, Homo sapiens
ggaauugacucccucuaca

SEQ ID NO: 295107 - RNA, 19 nt, Homo sapiens
caaauugucaguggaaaua

SEQ ID NO: 295108 - RNA, 19 nt, Homo sapiens
gcaggaggcagaugcauuu

SEQ ID NO: 295109 - RNA, 19 nt, Homo sapiens
agaaagaagcucaacauaa

SEQ ID NO: 295110 - RNA, 19 nt, Homo sapiens
gagaaagaagcucaacaua

SEQ ID NO: 295111 - RNA, 19 nt, Homo sapiens
gcucgaaucuccucagcuu

SEQ ID NO: 295112 - RNA, 19 nt, Homo sapiens
gggcugagaucauuacaca

SEQ ID NO: 295113 - RNA, 19 nt, Homo sapiens
aaagaugaguucaguguug

SEQ ID NO: 295114 - RNA, 19 nt, Homo sapiens
aaucaggaauguccaagua

SEQ ID NO: 295115 - RNA, 19 nt, Homo sapiens
guccaugagucuauugaua

SEQ ID NO: 295116 - RNA, 19 nt, Homo sapiens
ugaagaaugucaaauccaa

SEQ ID NO: 295117 - RNA, 19 nt, Homo sapiens
gggagaauaugauaaacug

SEQ ID NO: 295118 - RNA, 19 nt, Homo sapiens
gcaagcaguuacagauuca

SEQ ID NO: 295119 - RNA, 19 nt, Homo sapiens
cauaugcgcugauucuuca

SEQ ID NO: 295120 - RNA, 19 nt, Homo sapiens
gagaugaagugagaaggaa

SEQ ID NO: 295121 - RNA, 19 nt, Homo sapiens
gaaaggugaacaagagaaa

SEQ ID NO: 295122 - RNA, 19 nt, Homo sapiens
gaguaugucaguccaauaa

SEQ ID NO: 295123 - RNA, 19 nt, Homo sapiens
gcagagaagggucuuaguu

SEQ ID NO: 295124 - RNA, 19 nt, Homo sapiens
gagaguugaugacaaagau

SEQ ID NO: 295125 - RNA, 19 nt, Homo sapiens
caaagaagcugugccaaaa

SEQ ID NO: 295126 - RNA, 19 nt, Homo sapiens
cgacacaacgaacuuuaua

SEQ ID NO: 295127 - RNA, 19 nt, Homo sapiens
ccauagcccuuggauuuaa

SEQ ID NO: 295128 - RNA, 19 nt, Homo sapiens
aaugagaguugaugacaaa

SEQ ID NO: 295129 - RNA, 19 nt, Homo sapiens
ccuuaaacaugcugccuua

SEQ ID NO: 295130 - RNA, 19 nt, Homo sapiens
ggagaaauaacaaggcauu

SEQ ID NO: 295131 - RNA, 19 nt, Homo sapiens
gaagagugguaccucaaca

SEQ ID NO: 295132 - RNA, 19 nt, Homo sapiens
aaaggaagcucggagauca

SEQ ID NO: 295133 - RNA, 19 nt, Homo sapiens
ucagacacccuucagauaa

SEQ ID NO: 295134 - RNA, 19 nt, Homo sapiens
agaagcaugucaaucaauu

SEQ ID NO: 295135 - RNA, 19 nt, Homo sapiens
aaauguggcucucugaaga

SEQ ID NO: 295136 - RNA, 19 nt, Homo sapiens
ccacuuccuugaauaguug

SEQ ID NO: 295137 - RNA, 19 nt, Homo sapiens
gcgcauaucucuggugaca

SEQ ID NO: 295138 - RNA, 19 nt, Homo sapiens
gcaccugaccuuccugaaa

SEQ ID NO: 295139 - RNA, 19 nt, Homo sapiens
ggaagaacagauagagaaa

SEQ ID NO: 295140 - RNA, 19 nt, Homo sapiens
caccugagauuaaggauca

SEQ ID NO: 295141 - RNA, 19 nt, Homo sapiens
gaacacaaaggagugauug

SEQ ID NO: 295142 - RNA, 19 nt, Homo sapiens
gaaagaagcucaacauaaa

SEQ ID NO: 295143 - RNA, 19 nt, Homo sapiens
caacagacaacaucaaaua

SEQ ID NO: 295144 - RNA, 19 nt, Homo sapiens
caaagucucugacggagua

SEQ ID NO: 295145 - RNA, 19 nt, Homo sapiens
ggaggugucugcaaggaua

SEQ ID NO: 295146 - RNA, 19 nt, Homo sapiens
gaagugguguuuagaaugu

SEQ ID NO: 295147 - RNA, 19 nt, Homo sapiens
gaagaaggucgccaucaua

SEQ ID NO: 295148 - RNA, 19 nt, Homo sapiens
gaagagcauguaagaaaua

SEQ ID NO: 295149 - RNA, 19 nt, Homo sapiens
gggaagaaagauucaauua

SEQ ID NO: 295150 - RNA, 19 nt, Homo sapiens
ggaagagcauguaagaaau

SEQ ID NO: 295151 - RNA, 19 nt, Homo sapiens
gggaagagcauguaagaaa

SEQ ID NO: 295152 - RNA, 19 nt, Homo sapiens
ggaagacacuggcuuuaca

SEQ ID NO: 295153 - RNA, 19 nt, Homo sapiens
gaaauaacaaggcauugaa

SEQ ID NO: 295154 - RNA, 19 nt, Homo sapiens
uuugggaccuggauaauua

SEQ ID NO: 295155 - RNA, 19 nt, Homo sapiens
aaaguugguucucuugaua

SEQ ID NO: 295156 - RNA, 19 nt, Homo sapiens
gaccucagcugacagagaa

SEQ ID NO: 295157 - RNA, 19 nt, Homo sapiens
gaaagaagccagaaaauau

SEQ ID NO: 295158 - RNA, 19 nt, Homo sapiens
agaaagaagcucaacauaa

SEQ ID NO: 295159 - RNA, 19 nt, Homo sapiens
gagaaagaagcucaacaua

SEQ ID NO: 295160 - RNA, 19 nt, Homo sapiens
gcucgaaucuccucagcuu

SEQ ID NO: 295161 - RNA, 19 nt, Homo sapiens
gggcugagaucauuacaca

SEQ ID NO: 295162 - RNA, 19 nt, Homo sapiens
ugaagaaugucaaauccaa

SEQ ID NO: 295163 - RNA, 19 nt, Homo sapiens
gaaaggugaacaagagaaa

SEQ ID NO: 295164 - RNA, 19 nt, Homo sapiens
cauaugcgcugauucuuca

SEQ ID NO: 295165 - RNA, 19 nt, Homo sapiens
gaguaugucaguccaauaa

SEQ ID NO: 295166 - RNA, 19 nt, Homo sapiens
cgacacaacgaacuuuaua

SEQ ID NO: 295167 - RNA, 19 nt, Homo sapiens
ggagaaauaacaaggcauu

SEQ ID NO: 295168 - RNA, 19 nt, Homo sapiens
gaagagugguaccucaaca

SEQ ID NO: 295169 - RNA, 19 nt, Homo sapiens
aaauguggcucucugaaga

SEQ ID NO: 295170 - RNA, 19 nt, Homo sapiens
caccugagauuaaggauca

SEQ ID NO: 295171 - RNA, 19 nt, Homo sapiens
ccacuuccuugaauaguug

SEQ ID NO: 295172 - RNA, 19 nt, Homo sapiens
aauccaagcugcucauuuc

SEQ ID NO: 295173 - RNA, 19 nt, Homo sapiens
gcuauccacuacauucuga

SEQ ID NO: 295174 - RNA, 19 nt, Homo sapiens
uuacauggguucaauugga

SEQ ID NO: 295175 - RNA, 19 nt, Homo sapiens
ugagugguauugcugcaua

SEQ ID NO: 295176 - RNA, 19 nt, Homo sapiens
ugggauacuuccucauaua

SEQ ID NO: 295177 - RNA, 19 nt, Homo sapiens
gcaucaaccugcucgaauc

SEQ ID NO: 295178 - RNA, 19 nt, Homo sapiens
cccaagaccuuccuccauu

SEQ ID NO: 295179 - RNA, 19 nt, Homo sapiens
gcaaggauaguucaaguag

SEQ ID NO: 295180 - RNA, 19 nt, Homo sapiens
guaugucaguccaauaaau

SEQ ID NO: 295181 - RNA, 19 nt, Homo sapiens
ugccagaccugaagaaugu

SEQ ID NO: 295182 - RNA, 19 nt, Homo sapiens
uaaaguugguucucuugau

SEQ ID NO: 295183 - RNA, 19 nt, Homo sapiens
ucacauccaccugagauua

SEQ ID NO: 295184 - RNA, 19 nt, Homo sapiens
guauaaaugggaagaaaga

SEQ ID NO: 295185 - RNA, 19 nt, Homo sapiens
gcagggcuugugaauauuu

SEQ ID NO: 295186 - RNA, 19 nt, Homo sapiens
ugaagagggugccuuugga

SEQ ID NO: 295187 - RNA, 19 nt, Homo sapiens
ggaugaagagggugccuuu

SEQ ID NO: 295188 - RNA, 19 nt, Homo sapiens
ggaagggaagagcauguaa

SEQ ID NO: 295189 - RNA, 19 nt, Homo sapiens
gagcaguuguuauauucau

SEQ ID NO: 295190 - RNA, 19 nt, Homo sapiens
gaagaaugucaaauccaaa

SEQ ID NO: 295191 - RNA, 19 nt, Homo sapiens
caacaguucuaucucuucu

SEQ ID NO: 295192 - RNA, 19 nt, Homo sapiens
uaacaaggcauugaagaau

SEQ ID NO: 295193 - RNA, 19 nt, Homo sapiens
ggaagugguguuuagaaug

SEQ ID NO: 295194 - RNA, 19 nt, Homo sapiens
uaaaugggaagaaagauuc

SEQ ID NO: 295195 - RNA, 19 nt, Homo sapiens
cuccucagcuugccacuuu

SEQ ID NO: 295196 - RNA, 19 nt, Homo sapiens
aggcuagacuugaguggua

SEQ ID NO: 295197 - RNA, 19 nt, Homo sapiens
caaaggacaaagucucuga

SEQ ID NO: 295198 - RNA, 19 nt, Homo sapiens
ccugaaaggugaacaagag

SEQ ID NO: 295199 - RNA, 19 nt, Homo sapiens
gagcauguaagaaauaagu

SEQ ID NO: 295200 - RNA, 19 nt, Homo sapiens
gagcugugguugaggaagu

SEQ ID NO: 295201 - RNA, 19 nt, Homo sapiens
gaauaguacaugcagaaau

SEQ ID NO: 295202 - RNA, 19 nt, Homo sapiens
ucugagcaguuguuauauu

SEQ ID NO: 295203 - RNA, 19 nt, Homo sapiens
aauaguugcaggagaaaua

SEQ ID NO: 295204 - RNA, 19 nt, Homo sapiens
uugaauaguugcaggagaa

SEQ ID NO: 295205 - RNA, 19 nt, Homo sapiens
gaggaagugguguuuagaa

SEQ ID NO: 295206 - RNA, 19 nt, Homo sapiens
agaagaaggucgccaucau

SEQ ID NO: 295207 - RNA, 19 nt, Homo sapiens
ccaagaccuuccuccauuc

SEQ ID NO: 295208 - RNA, 19 nt, Homo sapiens
uuuagcagcugaagaaaca

SEQ ID NO: 295209 - RNA, 19 nt, Homo sapiens
ucaaauaccagccuaaagg

SEQ ID NO: 295210 - RNA, 19 nt, Homo sapiens
ggucacagggcaccuauuc

SEQ ID NO: 295211 - RNA, 19 nt, Homo sapiens
gggagcuacucauucagaa

SEQ ID NO: 295212 - RNA, 19 nt, Homo sapiens
gauacuuccucauauacuc

SEQ ID NO: 295213 - RNA, 19 nt, Homo sapiens
gcauaugcgcugauucuuc

SEQ ID NO: 295214 - RNA, 19 nt, Homo sapiens
aaaccaaggagucugauug

SEQ ID NO: 295215 - RNA, 19 nt, Homo sapiens
gaaggucgccaucauacgu

SEQ ID NO: 295216 - RNA, 19 nt, Homo sapiens
aaggauaguucaaguaguc

SEQ ID NO: 295217 - RNA, 19 nt, Homo sapiens
gaggaggugucugcaagga

SEQ ID NO: 295218 - RNA, 19 nt, Homo sapiens
ucacagggcaccuauucaa

SEQ ID NO: 295219 - RNA, 19 nt, Homo sapiens
agaggcaucugcacacuca

SEQ ID NO: 295220 - RNA, 19 nt, Homo sapiens
gagaacacgacacaacgaa

SEQ ID NO: 295221 - RNA, 19 nt, Homo sapiens
ugaaggcuauccacuacau

SEQ ID NO: 295222 - RNA, 19 nt, Homo sapiens
gaacacgacacaacgaacu

SEQ ID NO: 295223 - RNA, 19 nt, Homo sapiens
aaauagaccuaagccaugu

SEQ ID NO: 295224 - RNA, 19 nt, Homo sapiens
acaguucuaucucuucuuc

SEQ ID NO: 295225 - RNA, 19 nt, Homo sapiens
caguugaucagcuagauuu

SEQ ID NO: 295226 - RNA, 19 nt, Homo sapiens
gaccugauuuccauuugca

SEQ ID NO: 295227 - RNA, 19 nt, Homo sapiens
gaucaacagacaacaucaa

SEQ ID NO: 295228 - RNA, 19 nt, Homo sapiens
cugagcaguuguuauauuc

SEQ ID NO: 295229 - RNA, 19 nt, Homo sapiens
gcugagaucauuacacagu

SEQ ID NO: 295230 - RNA, 19 nt, Homo sapiens
ggagacagagaugagaauu

SEQ ID NO: 295231 - RNA, 19 nt, Homo sapiens
aauggcagaugaacggaaa

SEQ ID NO: 295232 - RNA, 19 nt, Homo sapiens
caucaaauaccagccuaaa

SEQ ID NO: 295233 - RNA, 19 nt, Homo sapiens
cagacaacaucaaauacca

SEQ ID NO: 295234 - RNA, 19 nt, Homo sapiens
ccaaagagaaugggaucaa

SEQ ID NO: 295235 - RNA, 19 nt, Homo sapiens
gaagggaagagcauguaag

SEQ ID NO: 295236 - RNA, 19 nt, Homo sapiens
caaagagaaugggaucaac

SEQ ID NO: 295237 - RNA, 19 nt, Homo sapiens
agaaauaacaaggcauuga

SEQ ID NO: 295238 - RNA, 19 nt, Homo sapiens
aaugucaguugaucagcua

SEQ ID NO: 295239 - RNA, 19 nt, Homo sapiens
gcauuugagcugugguuga

SEQ ID NO: 295240 - RNA, 19 nt, Homo sapiens
cagaguaugucaguccaau

SEQ ID NO: 295241 - RNA, 19 nt, Homo sapiens
gcucauuucacuauucugu

SEQ ID NO: 295242 - RNA, 19 nt, Homo sapiens
gaaagaagcucaacauaaa

SEQ ID NO: 295243 - RNA, 19 nt, Homo sapiens
gaaagaauguucacuauug

SEQ ID NO: 295244 - RNA, 19 nt, Homo sapiens
ggaaacaucuccagaauca

SEQ ID NO: 295245 - RNA, 19 nt, Homo sapiens
gaagaaagcuaaugauagg

SEQ ID NO: 295246 - RNA, 19 nt, Homo sapiens
gaagauaaaucaggaaugu

SEQ ID NO: 295247 - RNA, 19 nt, Homo sapiens
ggacaggaaccuauacuua

SEQ ID NO: 295248 - RNA, 19 nt, Homo sapiens
caacagacaacaucaaaua

SEQ ID NO: 295249 - RNA, 19 nt, Homo sapiens
caaagucucugacggagua

SEQ ID NO: 295250 - RNA, 19 nt, Homo sapiens
gaacagauagagaaaguaa

SEQ ID NO: 295251 - RNA, 19 nt, Homo sapiens
gcauaucucuggugacaaa

SEQ ID NO: 295252 - RNA, 19 nt, Homo sapiens
gcaaugaccuuacccaaag

SEQ ID NO: 295253 - RNA, 19 nt, Homo sapiens
ggaggugucugcaaggaua

SEQ ID NO: 295254 - RNA, 19 nt, Homo sapiens
gagaagagguugcacuuuc

SEQ ID NO: 295255 - RNA, 19 nt, Homo sapiens
cagcagagauucagaguga

SEQ ID NO: 295256 - RNA, 19 nt, Homo sapiens
gaaagaaggcacuaaaguu

SEQ ID NO: 295257 - RNA, 19 nt, Homo sapiens
gaagagauuuggccacaga

SEQ ID NO: 295258 - RNA, 19 nt, Homo sapiens
ugaaacaucugccuugaaa

SEQ ID NO: 295259 - RNA, 19 nt, Homo sapiens
gaaauaggcauaauucaga

SEQ ID NO: 295260 - RNA, 19 nt, Homo sapiens
gcauugaccucccuaaaga

SEQ ID NO: 295261 - RNA, 19 nt, Homo sapiens
gaagugguguuuagaaugu

SEQ ID NO: 295262 - RNA, 19 nt, Homo sapiens
ggaaaucagucccaucaga

SEQ ID NO: 295263 - RNA, 19 nt, Homo sapiens
ggaggaagauuuacuuaca

SEQ ID NO: 295264 - RNA, 19 nt, Homo sapiens
gggcggaaauguacaaauu

SEQ ID NO: 295265 - RNA, 19 nt, Homo sapiens
gcagagccauugcaugaaa

SEQ ID NO: 295266 - RNA, 19 nt, Homo sapiens
gagaagaaagcuaaugaua

SEQ ID NO: 295267 - RNA, 19 nt, Homo sapiens
aaagggaccuccacaguaa

SEQ ID NO: 295268 - RNA, 19 nt, Homo sapiens
gaagaaggucgccaucaua

SEQ ID NO: 295269 - RNA, 19 nt, Homo sapiens
caaagaagcaugucaauca

SEQ ID NO: 295270 - RNA, 19 nt, Homo sapiens
gaagaaauaggcauaauuc

SEQ ID NO: 295271 - RNA, 19 nt, Homo sapiens
aaagaaggcacuaaaguua

SEQ ID NO: 295272 - RNA, 19 nt, Homo sapiens
cgaaggcacugaugauaaa

SEQ ID NO: 295273 - RNA, 19 nt, Homo sapiens
gaaccuauacuuacugaaa

SEQ ID NO: 295274 - RNA, 19 nt, Homo sapiens
gaagagcauguaagaaaua

SEQ ID NO: 295275 - RNA, 19 nt, Homo sapiens
ggagaaagcugaaaaggaa

SEQ ID NO: 295276 - RNA, 19 nt, Homo sapiens
cgaaccaucugcauuaauu

SEQ ID NO: 295277 - RNA, 19 nt, Homo sapiens
guaaggaguuugaccaaga

SEQ ID NO: 295278 - RNA, 19 nt, Homo sapiens
gggaagaaagauucaauua

SEQ ID NO: 295279 - RNA, 19 nt, Homo sapiens
ggaagagcauguaagaaau

SEQ ID NO: 295280 - RNA, 19 nt, Homo sapiens
gggaagagcauguaagaaa

SEQ ID NO: 295281 - RNA, 19 nt, Homo sapiens
ggaagacacuggcuuuaca

SEQ ID NO: 295282 - RNA, 19 nt, Homo sapiens
caacucaucucuccugugu

SEQ ID NO: 295283 - RNA, 19 nt, Homo sapiens
acucaucucuccuguguua

SEQ ID NO: 295284 - RNA, 19 nt, Homo sapiens
ggaggcagaugcauuuaug

SEQ ID NO: 295285 - RNA, 19 nt, Homo sapiens
gaacaaagaagcaugucaa

SEQ ID NO: 295286 - RNA, 19 nt, Homo sapiens
gaaauaacaaggcauugaa

SEQ ID NO: 295287 - RNA, 19 nt, Homo sapiens
uuugggaccuggauaauua

SEQ ID NO: 295288 - RNA, 19 nt, Homo sapiens
aaaguugguucucuugaua

SEQ ID NO: 295289 - RNA, 19 nt, Homo sapiens
caacagagcuaaaacuuga

SEQ ID NO: 295290 - RNA, 19 nt, Homo sapiens
agagauagcugagguagaa

SEQ ID NO: 295291 - RNA, 19 nt, Homo sapiens
ugaagaggcuggugaugaa

SEQ ID NO: 295292 - RNA, 19 nt, Homo sapiens
gcuacuguguguucaauaa

SEQ ID NO: 295293 - RNA, 19 nt, Homo sapiens
gaccucagcugacagagaa

SEQ ID NO: 295294 - RNA, 19 nt, Homo sapiens
gaagaucgauuuuagcaaa

SEQ ID NO: 295295 - RNA, 19 nt, Homo sapiens
gaagaagaguuugaaguag

SEQ ID NO: 295296 - RNA, 19 nt, Homo sapiens
gaaggaaacaucuccagaa

SEQ ID NO: 295297 - RNA, 19 nt, Homo sapiens
agacagaagucaaacagaa

SEQ ID NO: 295298 - RNA, 19 nt, Homo sapiens
ccacagaccuuucacugau

SEQ ID NO: 295299 - RNA, 19 nt, Homo sapiens
caaagaggaagaacagaua

SEQ ID NO: 295300 - RNA, 19 nt, Homo sapiens
caagaaagaauguucacua

SEQ ID NO: 295301 - RNA, 19 nt, Homo sapiens
gaccgaaccaucugcauua

SEQ ID NO: 295302 - RNA, 19 nt, Homo sapiens
gaaagaagccagaaaauau

SEQ ID NO: 295303 - RNA, 19 nt, Homo sapiens
caucaugacagaacaguua

SEQ ID NO: 295304 - RNA, 19 nt, Homo sapiens
ugaagaagaguuugaagua

SEQ ID NO: 295305 - RNA, 19 nt, Homo sapiens
ucaagacagugagaauuua

SEQ ID NO: 295306 - RNA, 19 nt, Homo sapiens
aagcuucacucuuccuuua

SEQ ID NO: 295307 - RNA, 19 nt, Homo sapiens
uaaacaugcugccuuaguu

SEQ ID NO: 295308 - RNA, 19 nt, Homo sapiens
ggaauugacucccucuaca

SEQ ID NO: 295309 - RNA, 19 nt, Homo sapiens
caaauugucaguggaaaua

SEQ ID NO: 295310 - RNA, 19 nt, Homo sapiens
gcaggaggcagaugcauuu

SEQ ID NO: 295311 - RNA, 19 nt, Homo sapiens
agaaagaagcucaacauaa

SEQ ID NO: 295312 - RNA, 19 nt, Homo sapiens
gagaaagaagcucaacaua

SEQ ID NO: 295313 - RNA, 19 nt, Homo sapiens
gcucgaaucuccucagcuu

SEQ ID NO: 295314 - RNA, 19 nt, Homo sapiens
gggcugagaucauuacaca

SEQ ID NO: 295315 - RNA, 19 nt, Homo sapiens
aaagaugaguucaguguug

SEQ ID NO: 295316 - RNA, 19 nt, Homo sapiens
aaucaggaauguccaagua

SEQ ID NO: 295317 - RNA, 19 nt, Homo sapiens
guccaugagucuauugaua

SEQ ID NO: 295318 - RNA, 19 nt, Homo sapiens
ugaagaaugucaaauccaa

SEQ ID NO: 295319 - RNA, 19 nt, Homo sapiens
gggagaauaugauaaacug

SEQ ID NO: 295320 - RNA, 19 nt, Homo sapiens
gcaagcaguuacagauuca

SEQ ID NO: 295321 - RNA, 19 nt, Homo sapiens
gagaugaagugagaaggaa

SEQ ID NO: 295322 - RNA, 19 nt, Homo sapiens
cauaugcgcugauucuuca

SEQ ID NO: 295323 - RNA, 19 nt, Homo sapiens
gaaaggugaacaagagaaa

SEQ ID NO: 295324 - RNA, 19 nt, Homo sapiens
gaguaugucaguccaauaa

SEQ ID NO: 295325 - RNA, 19 nt, Homo sapiens
gcagagaagggucuuaguu

SEQ ID NO: 295326 - RNA, 19 nt, Homo sapiens
gagaguugaugacaaagau

SEQ ID NO: 295327 - RNA, 19 nt, Homo sapiens
cgacacaacgaacuuuaua

SEQ ID NO: 295328 - RNA, 19 nt, Homo sapiens
caaagaagcugugccaaaa

SEQ ID NO: 295329 - RNA, 19 nt, Homo sapiens
ccauagcccuuggauuuaa

SEQ ID NO: 295330 - RNA, 19 nt, Homo sapiens
aaugagaguugaugacaaa

SEQ ID NO: 295331 - RNA, 19 nt, Homo sapiens
ccuuaaacaugcugccuua

SEQ ID NO: 295332 - RNA, 19 nt, Homo sapiens
ggagaaauaacaaggcauu

SEQ ID NO: 295333 - RNA, 19 nt, Homo sapiens
gaagagugguaccucaaca

SEQ ID NO: 295334 - RNA, 19 nt, Homo sapiens
aaaggaagcucggagauca

SEQ ID NO: 295335 - RNA, 19 nt, Homo sapiens
ucagacacccuucagauaa

SEQ ID NO: 295336 - RNA, 19 nt, Homo sapiens
agaagcaugucaaucaauu

SEQ ID NO: 295337 - RNA, 19 nt, Homo sapiens
aaauguggcucucugaaga

SEQ ID NO: 295338 - RNA, 19 nt, Homo sapiens
ccacuuccuugaauaguug

SEQ ID NO: 295339 - RNA, 19 nt, Homo sapiens
gcgcauaucucuggugaca

SEQ ID NO: 295340 - RNA, 19 nt, Homo sapiens
gcaccugaccuuccugaaa

SEQ ID NO: 295341 - RNA, 19 nt, Homo sapiens
ggaagaacagauagagaaa

SEQ ID NO: 295342 - RNA, 19 nt, Homo sapiens
gaaagaagcucaacauaaa

SEQ ID NO: 295343 - RNA, 19 nt, Homo sapiens
caacagacaacaucaaaua

SEQ ID NO: 295344 - RNA, 19 nt, Homo sapiens
caaagucucugacggagua

SEQ ID NO: 295345 - RNA, 19 nt, Homo sapiens
ggaggugucugcaaggaua

SEQ ID NO: 295346 - RNA, 19 nt, Homo sapiens
gaagugguguuuagaaugu

SEQ ID NO: 295347 - RNA, 19 nt, Homo sapiens
gggcggaaauguacaaauu

SEQ ID NO: 295348 - RNA, 19 nt, Homo sapiens
gaagaaggucgccaucaua

SEQ ID NO: 295349 - RNA, 19 nt, Homo sapiens
gaagagcauguaagaaaua

SEQ ID NO: 295350 - RNA, 19 nt, Homo sapiens
gggaagaaagauucaauua

SEQ ID NO: 295351 - RNA, 19 nt, Homo sapiens
ggaagagcauguaagaaau

SEQ ID NO: 295352 - RNA, 19 nt, Homo sapiens
gggaagagcauguaagaaa

SEQ ID NO: 295353 - RNA, 19 nt, Homo sapiens
ggaagacacuggcuuuaca

SEQ ID NO: 295354 - RNA, 19 nt, Homo sapiens
gaaauaacaaggcauugaa

SEQ ID NO: 295355 - RNA, 19 nt, Homo sapiens
uuugggaccuggauaauua

SEQ ID NO: 295356 - RNA, 19 nt, Homo sapiens
aaaguugguucucuugaua

SEQ ID NO: 295357 - RNA, 19 nt, Homo sapiens
gaccucagcugacagagaa

SEQ ID NO: 295358 - RNA, 19 nt, Homo sapiens
gaagaucgauuuuagcaaa

SEQ ID NO: 295359 - RNA, 19 nt, Homo sapiens
gaaagaagccagaaaauau

SEQ ID NO: 295360 - RNA, 19 nt, Homo sapiens
agaaagaagcucaacauaa

SEQ ID NO: 295361 - RNA, 19 nt, Homo sapiens
gagaaagaagcucaacaua

SEQ ID NO: 295362 - RNA, 19 nt, Homo sapiens
gcucgaaucuccucagcuu

SEQ ID NO: 295363 - RNA, 19 nt, Homo sapiens
gggcugagaucauuacaca

SEQ ID NO: 295364 - RNA, 19 nt, Homo sapiens
ugaagaaugucaaauccaa

SEQ ID NO: 295365 - RNA, 19 nt, Homo sapiens
gaaaggugaacaagagaaa

SEQ ID NO: 295366 - RNA, 19 nt, Homo sapiens
cauaugcgcugauucuuca

SEQ ID NO: 295367 - RNA, 19 nt, Homo sapiens
gaguaugucaguccaauaa

SEQ ID NO: 295368 - RNA, 19 nt, Homo sapiens
cgacacaacgaacuuuaua

SEQ ID NO: 295369 - RNA, 19 nt, Homo sapiens
ggagaaauaacaaggcauu

SEQ ID NO: 295370 - RNA, 19 nt, Homo sapiens
gaagagugguaccucaaca

SEQ ID NO: 295371 - RNA, 19 nt, Homo sapiens
aaauguggcucucugaaga

SEQ ID NO: 295372 - RNA, 19 nt, Homo sapiens
caccugagauuaaggauca

SEQ ID NO: 295373 - RNA, 19 nt, Homo sapiens
ccacuuccuugaauaguug

SEQ ID NO: 295374 - RNA, 19 nt, Homo sapiens
ugagugguauugcugcaua

SEQ ID NO: 295375 - RNA, 19 nt, Homo sapiens
aauccaagcugcucauuuc

SEQ ID NO: 295376 - RNA, 19 nt, Homo sapiens
gcuauccacuacauucuga

SEQ ID NO: 295377 - RNA, 19 nt, Homo sapiens
uuacauggguucaauugga

SEQ ID NO: 295378 - RNA, 19 nt, Homo sapiens
ugggauacuuccucauaua

SEQ ID NO: 295379 - RNA, 19 nt, Homo sapiens
gcaucaaccugcucgaauc

SEQ ID NO: 295380 - RNA, 19 nt, Homo sapiens
cccaagaccuuccuccauu

SEQ ID NO: 295381 - RNA, 19 nt, Homo sapiens
gcaaggauaguucaaguag

SEQ ID NO: 295382 - RNA, 19 nt, Homo sapiens
guaugucaguccaauaaau

SEQ ID NO: 295383 - RNA, 19 nt, Homo sapiens
ugccagaccugaagaaugu

SEQ ID NO: 295384 - RNA, 19 nt, Homo sapiens
uaaaguugguucucuugau

SEQ ID NO: 295385 - RNA, 19 nt, Homo sapiens
ucacauccaccugagauua

SEQ ID NO: 295386 - RNA, 19 nt, Homo sapiens
gaucugguuccaaggauaa

SEQ ID NO: 295387 - RNA, 19 nt, Homo sapiens
guauaaaugggaagaaaga

SEQ ID NO: 295388 - RNA, 19 nt, Homo sapiens
gcagggcuugugaauauuu

SEQ ID NO: 295389 - RNA, 19 nt, Homo sapiens
ugaagagggugccuuugga

SEQ ID NO: 295390 - RNA, 19 nt, Homo sapiens
ggaugaagagggugccuuu

SEQ ID NO: 295391 - RNA, 19 nt, Homo sapiens
ggaagggaagagcauguaa

SEQ ID NO: 295392 - RNA, 19 nt, Homo sapiens
gagcaguuguuauauucau

SEQ ID NO: 295393 - RNA, 19 nt, Homo sapiens
gaagaaugucaaauccaaa

SEQ ID NO: 295394 - RNA, 19 nt, Homo sapiens
caacaguucuaucucuucu

SEQ ID NO: 295395 - RNA, 19 nt, Homo sapiens
uaacaaggcauugaagaau

SEQ ID NO: 295396 - RNA, 19 nt, Homo sapiens
ggaagugguguuuagaaug

SEQ ID NO: 295397 - RNA, 19 nt, Homo sapiens
uaaaugggaagaaagauuc

SEQ ID NO: 295398 - RNA, 19 nt, Homo sapiens
cuccucagcuugccacuuu

SEQ ID NO: 295399 - RNA, 19 nt, Homo sapiens
caaaggacaaagucucuga

SEQ ID NO: 295400 - RNA, 19 nt, Homo sapiens
aggcuagacuugaguggua

SEQ ID NO: 295401 - RNA, 19 nt, Homo sapiens
ccugaaaggugaacaagag

SEQ ID NO: 295402 - RNA, 19 nt, Homo sapiens
gagcauguaagaaauaagu

SEQ ID NO: 295403 - RNA, 19 nt, Homo sapiens
gagcugugguugaggaagu

SEQ ID NO: 295404 - RNA, 19 nt, Homo sapiens
gaauaguacaugcagaaau

SEQ ID NO: 295405 - RNA, 19 nt, Homo sapiens
ucugagcaguuguuauauu

SEQ ID NO: 295406 - RNA, 19 nt, Homo sapiens
aauaguugcaggagaaaua

SEQ ID NO: 295407 - RNA, 19 nt, Homo sapiens
uugaauaguugcaggagaa

SEQ ID NO: 295408 - RNA, 19 nt, Homo sapiens
gaggaagugguguuuagaa

SEQ ID NO: 295409 - RNA, 19 nt, Homo sapiens
aggauaacaucaaacauuc

SEQ ID NO: 295410 - RNA, 19 nt, Homo sapiens
agaagaaggucgccaucau

SEQ ID NO: 295411 - RNA, 19 nt, Homo sapiens
ccaagaccuuccuccauuc

SEQ ID NO: 295412 - RNA, 19 nt, Homo sapiens
uuuagcagcugaagaaaca

SEQ ID NO: 295413 - RNA, 19 nt, Homo sapiens
gggagcuacucauucagaa

SEQ ID NO: 295414 - RNA, 19 nt, Homo sapiens
aaaguucacuccagaucug

SEQ ID NO: 295415 - RNA, 19 nt, Homo sapiens
gcaaaguucacuccagauc

SEQ ID NO: 295416 - RNA, 19 nt, Homo sapiens
ucaaauaccagccuaaagg

SEQ ID NO: 295417 - RNA, 19 nt, Homo sapiens
ggucacagggcaccuauuc

SEQ ID NO: 295418 - RNA, 19 nt, Homo sapiens
gauacuuccucauauacuc

SEQ ID NO: 295419 - RNA, 19 nt, Homo sapiens
aaaccaaggagucugauug

SEQ ID NO: 295420 - RNA, 19 nt, Homo sapiens
gcauaugcgcugauucuuc

SEQ ID NO: 295421 - RNA, 19 nt, Homo sapiens
gagaacacgacacaacgaa

SEQ ID NO: 295422 - RNA, 19 nt, Homo sapiens
ccaaggauaacaucaaaca

SEQ ID NO: 295423 - RNA, 19 nt, Homo sapiens
gaaggucgccaucauacgu

SEQ ID NO: 295424 - RNA, 19 nt, Homo sapiens
aaggauaguucaaguaguc

SEQ ID NO: 295425 - RNA, 19 nt, Homo sapiens
gaggaggugucugcaagga

SEQ ID NO: 295426 - RNA, 19 nt, Homo sapiens
ucacagggcaccuauucaa

SEQ ID NO: 295427 - RNA, 19 nt, Homo sapiens
agaggcaucugcacacuca

SEQ ID NO: 295428 - RNA, 19 nt, Homo sapiens
gaacacgacacaacgaacu

SEQ ID NO: 295429 - RNA, 19 nt, Homo sapiens
ugaaggcuauccacuacau

SEQ ID NO: 295430 - RNA, 19 nt, Homo sapiens
aaauagaccuaagccaugu

SEQ ID NO: 295431 - RNA, 19 nt, Homo sapiens
acaguucuaucucuucuuc

SEQ ID NO: 295432 - RNA, 19 nt, Homo sapiens
caguugaucagcuagauuu

SEQ ID NO: 295433 - RNA, 19 nt, Homo sapiens
gaccugauuuccauuugca

SEQ ID NO: 295434 - RNA, 19 nt, Homo sapiens
gaucaacagacaacaucaa

SEQ ID NO: 295435 - RNA, 19 nt, Homo sapiens
cugagcaguuguuauauuc

SEQ ID NO: 295436 - RNA, 19 nt, Homo sapiens
gcugagaucauuacacagu

SEQ ID NO: 295437 - RNA, 19 nt, Homo sapiens
ggagacagagaugagaauu

SEQ ID NO: 295438 - RNA, 19 nt, Homo sapiens
aauggcagaugaacggaaa

SEQ ID NO: 295439 - RNA, 19 nt, Homo sapiens
acaagaagaucgauuuuag

SEQ ID NO: 295440 - RNA, 19 nt, Homo sapiens
caucaaauaccagccuaaa

SEQ ID NO: 295441 - RNA, 19 nt, Homo sapiens
cagacaacaucaaauacca

SEQ ID NO: 295442 - RNA, 19 nt, Homo sapiens
ggacaugucuccacuauca

SEQ ID NO: 295443 - RNA, 19 nt, Homo sapiens
gcacaagcauuggaaauaa

SEQ ID NO: 295444 - RNA, 19 nt, Homo sapiens
ggaaucacccaccaaauua

SEQ ID NO: 295445 - RNA, 19 nt, Homo sapiens
cgaggaggauucuguguua

SEQ ID NO: 295446 - RNA, 19 nt, Homo sapiens
gcaccuacuuucaugauuu

SEQ ID NO: 295447 - RNA, 19 nt, Homo sapiens
caacaccaguuccaauuaa

SEQ ID NO: 295448 - RNA, 19 nt, Homo sapiens
aaagugagcuacagccaua

SEQ ID NO: 295449 - RNA, 19 nt, Homo sapiens
ucaagaagaugacugcaaa

SEQ ID NO: 295450 - RNA, 19 nt, Homo sapiens
gaaagacaguuacgguaug

SEQ ID NO: 295451 - RNA, 19 nt, Homo sapiens
gaagaaaccgugcucagaa

SEQ ID NO: 295452 - RNA, 19 nt, Homo sapiens
caacugaauuccuugaaga

SEQ ID NO: 295453 - RNA, 19 nt, Homo sapiens
gcaaagacuucaacaucga

SEQ ID NO: 295454 - RNA, 19 nt, Homo sapiens
gaaauggcaucagaagaga

SEQ ID NO: 295455 - RNA, 19 nt, Homo sapiens
gcugauacuucaauauuug

SEQ ID NO: 295456 - RNA, 19 nt, Homo sapiens
gaaauauccucugcugaga

SEQ ID NO: 295457 - RNA, 19 nt, Homo sapiens
gccagaagauaccaacuuu

SEQ ID NO: 295458 - RNA, 19 nt, Homo sapiens
gcaacaccaguuccaauua

SEQ ID NO: 295459 - RNA, 19 nt, Homo sapiens
gaaauugcacaaacacaaa

SEQ ID NO: 295460 - RNA, 19 nt, Homo sapiens
ggacuucauugccacacua

SEQ ID NO: 295461 - RNA, 19 nt, Homo sapiens
gaaaggaaaccaugcaaca

SEQ ID NO: 295462 - RNA, 19 nt, Homo sapiens
gaccaaggauaaagcacua

SEQ ID NO: 295463 - RNA, 19 nt, Homo sapiens
gcagaggccuuugaugaug

SEQ ID NO: 295464 - RNA, 19 nt, Homo sapiens
ccacugccauuaagacuga

SEQ ID NO: 295465 - RNA, 19 nt, Homo sapiens
gaaacuagccagauugaag

SEQ ID NO: 295466 - RNA, 19 nt, Homo sapiens
gcacucagacuguugcaaa

SEQ ID NO: 295467 - RNA, 19 nt, Homo sapiens
ugccaggccuuccaucuua

SEQ ID NO: 295468 - RNA, 19 nt, Homo sapiens
gaaauaaugaugggacuga

SEQ ID NO: 295469 - RNA, 19 nt, Homo sapiens
caacggcaguucccuuaga

SEQ ID NO: 295470 - RNA, 19 nt, Homo sapiens
gaaagggccaggagaugaa

SEQ ID NO: 295471 - RNA, 19 nt, Homo sapiens
ggagacaagcaucuaauga

SEQ ID NO: 295472 - RNA, 19 nt, Homo sapiens
uggaggagaugucaagauu

SEQ ID NO: 295473 - RNA, 19 nt, Homo sapiens
ccacaacuccuuucauaga

SEQ ID NO: 295474 - RNA, 19 nt, Homo sapiens
ucagagaccucaggaauag

SEQ ID NO: 295475 - RNA, 19 nt, Homo sapiens
uaagugaggauucccauuu

SEQ ID NO: 295476 - RNA, 19 nt, Homo sapiens
ggaaauugcacaaacacaa

SEQ ID NO: 295477 - RNA, 19 nt, Homo sapiens
ccaaggaugugacacuguu

SEQ ID NO: 295478 - RNA, 19 nt, Homo sapiens
gaaaauggccuaccaggaa

SEQ ID NO: 295479 - RNA, 19 nt, Homo sapiens
gggcggagauauccuuaug

SEQ ID NO: 295480 - RNA, 19 nt, Homo sapiens
gaggugcugugaagacuga

SEQ ID NO: 295481 - RNA, 19 nt, Homo sapiens
uagaaucucugcaggaugu

SEQ ID NO: 295482 - RNA, 19 nt, Homo sapiens
caaugugacuccagccaaa

SEQ ID NO: 295483 - RNA, 19 nt, Homo sapiens
gaaaccaacgugaucuuga

SEQ ID NO: 295484 - RNA, 19 nt, Homo sapiens
gcagaugcauuaacagaac

SEQ ID NO: 295485 - RNA, 19 nt, Homo sapiens
ccaugucacugcagauuga

SEQ ID NO: 295486 - RNA, 19 nt, Homo sapiens
cuccacaacuccuuucaua

SEQ ID NO: 295487 - RNA, 19 nt, Homo sapiens
caaaagacgugaagccaaa

SEQ ID NO: 295488 - RNA, 19 nt, Homo sapiens
ccacuucucucccuaagca

SEQ ID NO: 295489 - RNA, 19 nt, Homo sapiens
uaccaggaauacccaaaua

SEQ ID NO: 295490 - RNA, 19 nt, Homo sapiens
ugaauuccuugaagagaaa

SEQ ID NO: 295491 - RNA, 19 nt, Homo sapiens
acaugaaaguccucaguaa

SEQ ID NO: 295492 - RNA, 19 nt, Homo sapiens
gcagaagucaagaagauga

SEQ ID NO: 295493 - RNA, 19 nt, Homo sapiens
ggcauuggcuaaagauaug

SEQ ID NO: 295494 - RNA, 19 nt, Homo sapiens
caagagcacucagacuguu

SEQ ID NO: 295495 - RNA, 19 nt, Homo sapiens
caaugguggucauggagua

SEQ ID NO: 295496 - RNA, 19 nt, Homo sapiens
gggagaaacuguuggaaaa

SEQ ID NO: 295497 - RNA, 19 nt, Homo sapiens
cccgaaagccugaaucuaa

SEQ ID NO: 295498 - RNA, 19 nt, Homo sapiens
aagugaggauucccauuua

SEQ ID NO: 295499 - RNA, 19 nt, Homo sapiens
ggacauggcacuagcuaca

SEQ ID NO: 295500 - RNA, 19 nt, Homo sapiens
ccuuuaagauguaccauga

SEQ ID NO: 295501 - RNA, 19 nt, Homo sapiens
agaaccaucuccagacauu

SEQ ID NO: 295502 - RNA, 19 nt, Homo sapiens
gggcccaucucccugcuuu

SEQ ID NO: 295503 - RNA, 19 nt, Homo sapiens
gauugaaagucagaaguug

SEQ ID NO: 295504 - RNA, 19 nt, Homo sapiens
gauaaagcgggacuucauu

SEQ ID NO: 295505 - RNA, 19 nt, Homo sapiens
cagcugauacuucaauauu

SEQ ID NO: 295506 - RNA, 19 nt, Homo sapiens
gacagcugauacuucaaua

SEQ ID NO: 295507 - RNA, 19 nt, Homo sapiens
augaugaccuggcagauuu

SEQ ID NO: 295508 - RNA, 19 nt, Homo sapiens
aagaaaccgugcucagaaa

SEQ ID NO: 295509 - RNA, 19 nt, Homo sapiens
gaaguaguucucaucaaga

SEQ ID NO: 295510 - RNA, 19 nt, Homo sapiens
gagggcaucuccuauaaaa

SEQ ID NO: 295511 - RNA, 19 nt, Homo sapiens
gagggcaucuccuauaaaa

SEQ ID NO: 295512 - RNA, 19 nt, Homo sapiens
agauagaaauggcaucaga

SEQ ID NO: 295513 - RNA, 19 nt, Homo sapiens
uauccagacugaucccuuu

SEQ ID NO: 295514 - RNA, 19 nt, Homo sapiens
ccuagcugcugucacauuu

SEQ ID NO: 295515 - RNA, 19 nt, Homo sapiens
ggucuaaggcuaacaucaa

SEQ ID NO: 295516 - RNA, 19 nt, Homo sapiens
ccgaaagccugaaucuaau

SEQ ID NO: 295517 - RNA, 19 nt, Homo sapiens
gagacaagcaucuaaugau

SEQ ID NO: 295518 - RNA, 19 nt, Homo sapiens
gugguaauguucagauuca

SEQ ID NO: 295519 - RNA, 19 nt, Homo sapiens
gaagcccacugccauuaag

SEQ ID NO: 295520 - RNA, 19 nt, Homo sapiens
aaacacagcccacuucucu

SEQ ID NO: 295521 - RNA, 19 nt, Homo sapiens
uuaaagacauggaaauugc

SEQ ID NO: 295522 - RNA, 19 nt, Homo sapiens
cuuaaacucuccacacuca

SEQ ID NO: 295523 - RNA, 19 nt, Homo sapiens
aaaccgugcucagaaacua

SEQ ID NO: 295524 - RNA, 19 nt, Homo sapiens
uggcaucucugucccauuc

SEQ ID NO: 295525 - RNA, 19 nt, Homo sapiens
aaauaguucugcagguuga

SEQ ID NO: 295526 - RNA, 19 nt, Homo sapiens
agacugaucccuuuaagau

SEQ ID NO: 295527 - RNA, 19 nt, Homo sapiens
guggucagcccuaggauaa

SEQ ID NO: 295528 - RNA, 19 nt, Homo sapiens
uggaaucacccaccaaauu

SEQ ID NO: 295529 - RNA, 19 nt, Homo sapiens
gauacuccaucuucuaaac

SEQ ID NO: 295530 - RNA, 19 nt, Homo sapiens
ugaaaguccucaguaagug

SEQ ID NO: 295531 - RNA, 19 nt, Homo sapiens
gaagaguggagguggauuc

SEQ ID NO: 295532 - RNA, 19 nt, Homo sapiens
ugggaucccucgauaaugu

SEQ ID NO: 295533 - RNA, 19 nt, Homo sapiens
gaaaguggacaucucuaag

SEQ ID NO: 295534 - RNA, 19 nt, Homo sapiens
guuccaaggacaauauuaa

SEQ ID NO: 295535 - RNA, 19 nt, Homo sapiens
caacuccuuucauagacaa

SEQ ID NO: 295536 - RNA, 19 nt, Homo sapiens
gugacacuguugaaagaaa

SEQ ID NO: 295537 - RNA, 19 nt, Homo sapiens
ggacugaagacuacugaca

SEQ ID NO: 295538 - RNA, 19 nt, Homo sapiens
gccaacggcaguucccuua

SEQ ID NO: 295539 - RNA, 19 nt, Homo sapiens
gaugaugaccuggcagauu

SEQ ID NO: 295540 - RNA, 19 nt, Homo sapiens
caacacuccuagccaaugg

SEQ ID NO: 295541 - RNA, 19 nt, Homo sapiens
caaaauaguucugcagguu

SEQ ID NO: 295542 - RNA, 19 nt, Homo sapiens
ggacaugucuccacuauca

SEQ ID NO: 295543 - RNA, 19 nt, Homo sapiens
gcacaagcauuggaaauaa

SEQ ID NO: 295544 - RNA, 19 nt, Homo sapiens
ggaaucacccaccaaauua

SEQ ID NO: 295545 - RNA, 19 nt, Homo sapiens
cgaggaggauucuguguua

SEQ ID NO: 295546 - RNA, 19 nt, Homo sapiens
gcaccuacuuucaugauuu

SEQ ID NO: 295547 - RNA, 19 nt, Homo sapiens
caacaccaguuccaauuaa

SEQ ID NO: 295548 - RNA, 19 nt, Homo sapiens
aaagugagcuacagccaua

SEQ ID NO: 295549 - RNA, 19 nt, Homo sapiens
ucaagaagaugacugcaaa

SEQ ID NO: 295550 - RNA, 19 nt, Homo sapiens
gaaagacaguuacgguaug

SEQ ID NO: 295551 - RNA, 19 nt, Homo sapiens
gaagaaaccgugcucagaa

SEQ ID NO: 295552 - RNA, 19 nt, Homo sapiens
caacugaauuccuugaaga

SEQ ID NO: 295553 - RNA, 19 nt, Homo sapiens
gcaaagacuucaacaucga

SEQ ID NO: 295554 - RNA, 19 nt, Homo sapiens
gaaauggcaucagaagaga

SEQ ID NO: 295555 - RNA, 19 nt, Homo sapiens
gcugauacuucaauauuug

SEQ ID NO: 295556 - RNA, 19 nt, Homo sapiens
gaaauauccucugcugaga

SEQ ID NO: 295557 - RNA, 19 nt, Homo sapiens
gccagaagauaccaacuuu

SEQ ID NO: 295558 - RNA, 19 nt, Homo sapiens
gcaacaccaguuccaauua

SEQ ID NO: 295559 - RNA, 19 nt, Homo sapiens
gaaauugcacaaacacaaa

SEQ ID NO: 295560 - RNA, 19 nt, Homo sapiens
ggacuucauugccacacua

SEQ ID NO: 295561 - RNA, 19 nt, Homo sapiens
gaaaggaaaccaugcaaca

SEQ ID NO: 295562 - RNA, 19 nt, Homo sapiens
gaccaaggauaaagcacua

SEQ ID NO: 295563 - RNA, 19 nt, Homo sapiens
gcagaggccuuugaugaug

SEQ ID NO: 295564 - RNA, 19 nt, Homo sapiens
ccacugccauuaagacuga

SEQ ID NO: 295565 - RNA, 19 nt, Homo sapiens
gaaacuagccagauugaag

SEQ ID NO: 295566 - RNA, 19 nt, Homo sapiens
gcacucagacuguugcaaa

SEQ ID NO: 295567 - RNA, 19 nt, Homo sapiens
ugccaggccuuccaucuua

SEQ ID NO: 295568 - RNA, 19 nt, Homo sapiens
gaaauaaugaugggacuga

SEQ ID NO: 295569 - RNA, 19 nt, Homo sapiens
caacggcaguucccuuaga

SEQ ID NO: 295570 - RNA, 19 nt, Homo sapiens
gaaagggccaggagaugaa

SEQ ID NO: 295571 - RNA, 19 nt, Homo sapiens
ggagacaagcaucuaauga

SEQ ID NO: 295572 - RNA, 19 nt, Homo sapiens
uggaggagaugucaagauu

SEQ ID NO: 295573 - RNA, 19 nt, Homo sapiens
ccacaacuccuuucauaga

SEQ ID NO: 295574 - RNA, 19 nt, Homo sapiens
ucagagaccucaggaauag

SEQ ID NO: 295575 - RNA, 19 nt, Homo sapiens
uaagugaggauucccauuu

SEQ ID NO: 295576 - RNA, 19 nt, Homo sapiens
ggaaauugcacaaacacaa

SEQ ID NO: 295577 - RNA, 19 nt, Homo sapiens
ccaaggaugugacacuguu

SEQ ID NO: 295578 - RNA, 19 nt, Homo sapiens
gaaaauggccuaccaggaa

SEQ ID NO: 295579 - RNA, 19 nt, Homo sapiens
gggcggagauauccuuaug

SEQ ID NO: 295580 - RNA, 19 nt, Homo sapiens
gaggugcugugaagacuga

SEQ ID NO: 295581 - RNA, 19 nt, Homo sapiens
uagaaucucugcaggaugu

SEQ ID NO: 295582 - RNA, 19 nt, Homo sapiens
caaugugacuccagccaaa

SEQ ID NO: 295583 - RNA, 19 nt, Homo sapiens
gaaaccaacgugaucuuga

SEQ ID NO: 295584 - RNA, 19 nt, Homo sapiens
gcagaugcauuaacagaac

SEQ ID NO: 295585 - RNA, 19 nt, Homo sapiens
ccaugucacugcagauuga

SEQ ID NO: 295586 - RNA, 19 nt, Homo sapiens
cuccacaacuccuuucaua

SEQ ID NO: 295587 - RNA, 19 nt, Homo sapiens
caaaagacgugaagccaaa

SEQ ID NO: 295588 - RNA, 19 nt, Homo sapiens
ccacuucucucccuaagca

SEQ ID NO: 295589 - RNA, 19 nt, Homo sapiens
uaccaggaauacccaaaua

SEQ ID NO: 295590 - RNA, 19 nt, Homo sapiens
ugaauuccuugaagagaaa

SEQ ID NO: 295591 - RNA, 19 nt, Homo sapiens
acaugaaaguccucaguaa

SEQ ID NO: 295592 - RNA, 19 nt, Homo sapiens
gcagaagucaagaagauga

SEQ ID NO: 295593 - RNA, 19 nt, Homo sapiens
ggcauuggcuaaagauaug

SEQ ID NO: 295594 - RNA, 19 nt, Homo sapiens
caagagcacucagacuguu

SEQ ID NO: 295595 - RNA, 19 nt, Homo sapiens
caaugguggucauggagua

SEQ ID NO: 295596 - RNA, 19 nt, Homo sapiens
gggagaaacuguuggaaaa

SEQ ID NO: 295597 - RNA, 19 nt, Homo sapiens
aagugaggauucccauuua

SEQ ID NO: 295598 - RNA, 19 nt, Homo sapiens
ggacauggcacuagcuaca

SEQ ID NO: 295599 - RNA, 19 nt, Homo sapiens
ccuuuaagauguaccauga

SEQ ID NO: 295600 - RNA, 19 nt, Homo sapiens
agaaccaucuccagacauu

SEQ ID NO: 295601 - RNA, 19 nt, Homo sapiens
gggcccaucucccugcuuu

SEQ ID NO: 295602 - RNA, 19 nt, Homo sapiens
gauugaaagucagaaguug

SEQ ID NO: 295603 - RNA, 19 nt, Homo sapiens
gauaaagcgggacuucauu

SEQ ID NO: 295604 - RNA, 19 nt, Homo sapiens
cagcugauacuucaauauu

SEQ ID NO: 295605 - RNA, 19 nt, Homo sapiens
gacagcugauacuucaaua

SEQ ID NO: 295606 - RNA, 19 nt, Homo sapiens
augaugaccuggcagauuu

SEQ ID NO: 295607 - RNA, 19 nt, Homo sapiens
aagaaaccgugcucagaaa

SEQ ID NO: 295608 - RNA, 19 nt, Homo sapiens
gaaguaguucucaucaaga

SEQ ID NO: 295609 - RNA, 19 nt, Homo sapiens
gagggcaucuccuauaaaa

SEQ ID NO: 295610 - RNA, 19 nt, Homo sapiens
gagggcaucuccuauaaaa

SEQ ID NO: 295611 - RNA, 19 nt, Homo sapiens
agauagaaauggcaucaga

SEQ ID NO: 295612 - RNA, 19 nt, Homo sapiens
uauccagacugaucccuuu

SEQ ID NO: 295613 - RNA, 19 nt, Homo sapiens
ccuagcugcugucacauuu

SEQ ID NO: 295614 - RNA, 19 nt, Homo sapiens
ggucuaaggcuaacaucaa

SEQ ID NO: 295615 - RNA, 19 nt, Homo sapiens
gagacaagcaucuaaugau

SEQ ID NO: 295616 - RNA, 19 nt, Homo sapiens
gugguaauguucagauuca

SEQ ID NO: 295617 - RNA, 19 nt, Homo sapiens
gaagcccacugccauuaag

SEQ ID NO: 295618 - RNA, 19 nt, Homo sapiens
aaacacagcccacuucucu

SEQ ID NO: 295619 - RNA, 19 nt, Homo sapiens
uuaaagacauggaaauugc

SEQ ID NO: 295620 - RNA, 19 nt, Homo sapiens
cuuaaacucuccacacuca

SEQ ID NO: 295621 - RNA, 19 nt, Homo sapiens
aaaccgugcucagaaacua

SEQ ID NO: 295622 - RNA, 19 nt, Homo sapiens
uggcaucucugucccauuc

SEQ ID NO: 295623 - RNA, 19 nt, Homo sapiens
aaauaguucugcagguuga

SEQ ID NO: 295624 - RNA, 19 nt, Homo sapiens
agacugaucccuuuaagau

SEQ ID NO: 295625 - RNA, 19 nt, Homo sapiens
guggucagcccuaggauaa

SEQ ID NO: 295626 - RNA, 19 nt, Homo sapiens
uggaaucacccaccaaauu

SEQ ID NO: 295627 - RNA, 19 nt, Homo sapiens
gauacuccaucuucuaaac

SEQ ID NO: 295628 - RNA, 19 nt, Homo sapiens
ugaaaguccucaguaagug

SEQ ID NO: 295629 - RNA, 19 nt, Homo sapiens
gaagaguggagguggauuc

SEQ ID NO: 295630 - RNA, 19 nt, Homo sapiens
ugggaucccucgauaaugu

SEQ ID NO: 295631 - RNA, 19 nt, Homo sapiens
gaaaguggacaucucuaag

SEQ ID NO: 295632 - RNA, 19 nt, Homo sapiens
guuccaaggacaauauuaa

SEQ ID NO: 295633 - RNA, 19 nt, Homo sapiens
caacuccuuucauagacaa

SEQ ID NO: 295634 - RNA, 19 nt, Homo sapiens
gugacacuguugaaagaaa

SEQ ID NO: 295635 - RNA, 19 nt, Homo sapiens
ggacugaagacuacugaca

SEQ ID NO: 295636 - RNA, 19 nt, Homo sapiens
gccaacggcaguucccuua

SEQ ID NO: 295637 - RNA, 19 nt, Homo sapiens
gaugaugaccuggcagauu

SEQ ID NO: 295638 - RNA, 19 nt, Homo sapiens
caacacuccuagccaaugg

SEQ ID NO: 295639 - RNA, 19 nt, Homo sapiens
caaaauaguucugcagguu

SEQ ID NO: 295640 - RNA, 19 nt, Homo sapiens
ucucuaaggucuccuccaa

SEQ ID NO: 295641 - RNA, 19 nt, Homo sapiens
cuccugaucugaagaaugu

SEQ ID NO: 295642 - RNA, 19 nt, Homo sapiens
ggacaugucuccacuauca

SEQ ID NO: 295643 - RNA, 19 nt, Homo sapiens
gcacaagcauuggaaauaa

SEQ ID NO: 295644 - RNA, 19 nt, Homo sapiens
ggaaucacccaccaaauua

SEQ ID NO: 295645 - RNA, 19 nt, Homo sapiens
cgaggaggauucuguguua

SEQ ID NO: 295646 - RNA, 19 nt, Homo sapiens
gcaccuacuuucaugauuu

SEQ ID NO: 295647 - RNA, 19 nt, Homo sapiens
caacaccaguuccaauuaa

SEQ ID NO: 295648 - RNA, 19 nt, Homo sapiens
ggagacaaauugagaccua

SEQ ID NO: 295649 - RNA, 19 nt, Homo sapiens
ucaagaagaugacugcaaa

SEQ ID NO: 295650 - RNA, 19 nt, Homo sapiens
gaaagacaguuacgguaug

SEQ ID NO: 295651 - RNA, 19 nt, Homo sapiens
gaagaaaccgugcucagaa

SEQ ID NO: 295652 - RNA, 19 nt, Homo sapiens
caacugaauuccuugaaga

SEQ ID NO: 295653 - RNA, 19 nt, Homo sapiens
gcaaagacuucaacaucga

SEQ ID NO: 295654 - RNA, 19 nt, Homo sapiens
gaaauggcaucagaagaga

SEQ ID NO: 295655 - RNA, 19 nt, Homo sapiens
gcugauacuucaauauuug

SEQ ID NO: 295656 - RNA, 19 nt, Homo sapiens
gaaauauccucugcugaga

SEQ ID NO: 295657 - RNA, 19 nt, Homo sapiens
gccagaagauaccaacuuu

SEQ ID NO: 295658 - RNA, 19 nt, Homo sapiens
gcaacaccaguuccaauua

SEQ ID NO: 295659 - RNA, 19 nt, Homo sapiens
gaaauugcacaaacacaaa

SEQ ID NO: 295660 - RNA, 19 nt, Homo sapiens
ggacuucauugccacacua

SEQ ID NO: 295661 - RNA, 19 nt, Homo sapiens
gaaaggaaaccaugcaaca

SEQ ID NO: 295662 - RNA, 19 nt, Homo sapiens
gaccaaggauaaagcacua

SEQ ID NO: 295663 - RNA, 19 nt, Homo sapiens
gcagaggccuuugaugaug

SEQ ID NO: 295664 - RNA, 19 nt, Homo sapiens
ccacugccauuaagacuga

SEQ ID NO: 295665 - RNA, 19 nt, Homo sapiens
gaaacuagccagauugaag

SEQ ID NO: 295666 - RNA, 19 nt, Homo sapiens
gcacucagacuguugcaaa

SEQ ID NO: 295667 - RNA, 19 nt, Homo sapiens
ugccaggccuuccaucuua

SEQ ID NO: 295668 - RNA, 19 nt, Homo sapiens
gaaauaaugaugggacuga

SEQ ID NO: 295669 - RNA, 19 nt, Homo sapiens
caacggcaguucccuuaga

SEQ ID NO: 295670 - RNA, 19 nt, Homo sapiens
gaaagggccaggagaugaa

SEQ ID NO: 295671 - RNA, 19 nt, Homo sapiens
uggaggagaugucaagauu

SEQ ID NO: 295672 - RNA, 19 nt, Homo sapiens
ccacaacuccuuucauaga

SEQ ID NO: 295673 - RNA, 19 nt, Homo sapiens
ucagagaccucaggaauag

SEQ ID NO: 295674 - RNA, 19 nt, Homo sapiens
uaagugaggauucccauuu

SEQ ID NO: 295675 - RNA, 19 nt, Homo sapiens
ggaaauugcacaaacacaa

SEQ ID NO: 295676 - RNA, 19 nt, Homo sapiens
ccaaggaugugacacuguu

SEQ ID NO: 295677 - RNA, 19 nt, Homo sapiens
gaaaauggccuaccaggaa

SEQ ID NO: 295678 - RNA, 19 nt, Homo sapiens
gggcggagauauccuuaug

SEQ ID NO: 295679 - RNA, 19 nt, Homo sapiens
gaggugcugugaagacuga

SEQ ID NO: 295680 - RNA, 19 nt, Homo sapiens
uagaaucucugcaggaugu

SEQ ID NO: 295681 - RNA, 19 nt, Homo sapiens
caaugugacuccagccaaa

SEQ ID NO: 295682 - RNA, 19 nt, Homo sapiens
gaaaccaacgugaucuuga

SEQ ID NO: 295683 - RNA, 19 nt, Homo sapiens
gcagaugcauuaacagaac

SEQ ID NO: 295684 - RNA, 19 nt, Homo sapiens
cuccacaacuccuuucaua

SEQ ID NO: 295685 - RNA, 19 nt, Homo sapiens
caaaagacgugaagccaaa

SEQ ID NO: 295686 - RNA, 19 nt, Homo sapiens
ccacuucucucccuaagca

SEQ ID NO: 295687 - RNA, 19 nt, Homo sapiens
uaccaggaauacccaaaua

SEQ ID NO: 295688 - RNA, 19 nt, Homo sapiens
ugaauuccuugaagagaaa

SEQ ID NO: 295689 - RNA, 19 nt, Homo sapiens
acaugaaaguccucaguaa

SEQ ID NO: 295690 - RNA, 19 nt, Homo sapiens
gcagaagucaagaagauga

SEQ ID NO: 295691 - RNA, 19 nt, Homo sapiens
ggcauuggcuaaagauaug

SEQ ID NO: 295692 - RNA, 19 nt, Homo sapiens
caagagcacucagacuguu

SEQ ID NO: 295693 - RNA, 19 nt, Homo sapiens
caaugguggucauggagua

SEQ ID NO: 295694 - RNA, 19 nt, Homo sapiens
gggagaaacuguuggaaaa

SEQ ID NO: 295695 - RNA, 19 nt, Homo sapiens
aagugaggauucccauuua

SEQ ID NO: 295696 - RNA, 19 nt, Homo sapiens
ggacauggcacuagcuaca

SEQ ID NO: 295697 - RNA, 19 nt, Homo sapiens
ccuuuaagauguaccauga

SEQ ID NO: 295698 - RNA, 19 nt, Homo sapiens
agaaccaucuccagacauu

SEQ ID NO: 295699 - RNA, 19 nt, Homo sapiens
gggcccaucucccugcuuu

SEQ ID NO: 295700 - RNA, 19 nt, Homo sapiens
gauugaaagucagaaguug

SEQ ID NO: 295701 - RNA, 19 nt, Homo sapiens
gauaaagcgggacuucauu

SEQ ID NO: 295702 - RNA, 19 nt, Homo sapiens
cagcugauacuucaauauu

SEQ ID NO: 295703 - RNA, 19 nt, Homo sapiens
gacagcugauacuucaaua

SEQ ID NO: 295704 - RNA, 19 nt, Homo sapiens
augaugaccuggcagauuu

SEQ ID NO: 295705 - RNA, 19 nt, Homo sapiens
aagaaaccgugcucagaaa

SEQ ID NO: 295706 - RNA, 19 nt, Homo sapiens
gaaguaguucucaucaaga

SEQ ID NO: 295707 - RNA, 19 nt, Homo sapiens
gagggcaucuccuauaaaa

SEQ ID NO: 295708 - RNA, 19 nt, Homo sapiens
gagggcaucuccuauaaaa

SEQ ID NO: 295709 - RNA, 19 nt, Homo sapiens
agauagaaauggcaucaga

SEQ ID NO: 295710 - RNA, 19 nt, Homo sapiens
uauccagacugaucccuuu

SEQ ID NO: 295711 - RNA, 19 nt, Homo sapiens
ccuagcugcugucacauuu

SEQ ID NO: 295712 - RNA, 19 nt, Homo sapiens
ggucuaaggcuaacaucaa

SEQ ID NO: 295713 - RNA, 19 nt, Homo sapiens
gaagcccacugccauuaag

SEQ ID NO: 295714 - RNA, 19 nt, Homo sapiens
aaacacagcccacuucucu

SEQ ID NO: 295715 - RNA, 19 nt, Homo sapiens
uuaaagacauggaaauugc

SEQ ID NO: 295716 - RNA, 19 nt, Homo sapiens
cuuaaacucuccacacuca

SEQ ID NO: 295717 - RNA, 19 nt, Homo sapiens
aaaccgugcucagaaacua

SEQ ID NO: 295718 - RNA, 19 nt, Homo sapiens
uggcaucucugucccauuc

SEQ ID NO: 295719 - RNA, 19 nt, Homo sapiens
aaauaguucugcagguuga

SEQ ID NO: 295720 - RNA, 19 nt, Homo sapiens
agacugaucccuuuaagau

SEQ ID NO: 295721 - RNA, 19 nt, Homo sapiens
guggucagcccuaggauaa

SEQ ID NO: 295722 - RNA, 19 nt, Homo sapiens
uggaaucacccaccaaauu

SEQ ID NO: 295723 - RNA, 19 nt, Homo sapiens
gauacuccaucuucuaaac

SEQ ID NO: 295724 - RNA, 19 nt, Homo sapiens
ugaaaguccucaguaagug

SEQ ID NO: 295725 - RNA, 19 nt, Homo sapiens
gaagaguggagguggauuc

SEQ ID NO: 295726 - RNA, 19 nt, Homo sapiens
ugggaucccucgauaaugu

SEQ ID NO: 295727 - RNA, 19 nt, Homo sapiens
gaaaguggacaucucuaag

SEQ ID NO: 295728 - RNA, 19 nt, Homo sapiens
caacuccuuucauagacaa

SEQ ID NO: 295729 - RNA, 19 nt, Homo sapiens
gugacacuguugaaagaaa

SEQ ID NO: 295730 - RNA, 19 nt, Homo sapiens
ggacugaagacuacugaca

SEQ ID NO: 295731 - RNA, 19 nt, Homo sapiens
gccaacggcaguucccuua

SEQ ID NO: 295732 - RNA, 19 nt, Homo sapiens
gaugaugaccuggcagauu

SEQ ID NO: 295733 - RNA, 19 nt, Homo sapiens
caacacuccuagccaaugg

SEQ ID NO: 295734 - RNA, 19 nt, Homo sapiens
caaaauaguucugcagguu

SEQ ID NO: 295735 - RNA, 19 nt, Homo sapiens
ucucuaaggucuccuccaa

SEQ ID NO: 295736 - RNA, 19 nt, Homo sapiens
cuccugaucugaagaaugu

SEQ ID NO: 295737 - RNA, 19 nt, Homo sapiens
cugcagaagucaagaagau

SEQ ID NO: 295738 - RNA, 19 nt, Homo sapiens
gaagggagcgauacuacag

SEQ ID NO: 295739 - RNA, 19 nt, Homo sapiens
ggaguagaagggagcgaua

SEQ ID NO: 295740 - RNA, 19 nt, Homo sapiens
caagaaagggccaggagau

SEQ ID NO: 295741 - RNA, 19 nt, Homo sapiens
aagguuggcuccacggaaa

SEQ ID NO: 295742 - RNA, 19 nt, Homo sapiens
ggacaugucuccacuauca

SEQ ID NO: 295743 - RNA, 19 nt, Homo sapiens
gcacaagcauuggaaauaa

SEQ ID NO: 295744 - RNA, 19 nt, Homo sapiens
ggaaucacccaccaaauua

SEQ ID NO: 295745 - RNA, 19 nt, Homo sapiens
cgaggaggauucuguguua

SEQ ID NO: 295746 - RNA, 19 nt, Homo sapiens
gcaccuacuuucaugauuu

SEQ ID NO: 295747 - RNA, 19 nt, Homo sapiens
caacaccaguuccaauuaa

SEQ ID NO: 295748 - RNA, 19 nt, Homo sapiens
ggagacaaauugagaccua

SEQ ID NO: 295749 - RNA, 19 nt, Homo sapiens
ucaagaagaugacugcaaa

SEQ ID NO: 295750 - RNA, 19 nt, Homo sapiens
gaagaaaccgugcucagaa

SEQ ID NO: 295751 - RNA, 19 nt, Homo sapiens
caacugaauuccuugaaga

SEQ ID NO: 295752 - RNA, 19 nt, Homo sapiens
gcaaagacuucaacaucga

SEQ ID NO: 295753 - RNA, 19 nt, Homo sapiens
gaaauggcaucagaagaga

SEQ ID NO: 295754 - RNA, 19 nt, Homo sapiens
gcugauacuucaauauuug

SEQ ID NO: 295755 - RNA, 19 nt, Homo sapiens
gaaauauccucugcugaga

SEQ ID NO: 295756 - RNA, 19 nt, Homo sapiens
gccagaagauaccaacuuu

SEQ ID NO: 295757 - RNA, 19 nt, Homo sapiens
gcaacaccaguuccaauua

SEQ ID NO: 295758 - RNA, 19 nt, Homo sapiens
gaaauugcacaaacacaaa

SEQ ID NO: 295759 - RNA, 19 nt, Homo sapiens
ggacuucauugccacacua

SEQ ID NO: 295760 - RNA, 19 nt, Homo sapiens
gaaaggaaaccaugcaaca

SEQ ID NO: 295761 - RNA, 19 nt, Homo sapiens
gaccaaggauaaagcacua

SEQ ID NO: 295762 - RNA, 19 nt, Homo sapiens
gcagaggccuuugaugaug

SEQ ID NO: 295763 - RNA, 19 nt, Homo sapiens
ccacugccauuaagacuga

SEQ ID NO: 295764 - RNA, 19 nt, Homo sapiens
gaaacuagccagauugaag

SEQ ID NO: 295765 - RNA, 19 nt, Homo sapiens
gcacucagacuguugcaaa

SEQ ID NO: 295766 - RNA, 19 nt, Homo sapiens
ugccaggccuuccaucuua

SEQ ID NO: 295767 - RNA, 19 nt, Homo sapiens
gaaauaaugaugggacuga

SEQ ID NO: 295768 - RNA, 19 nt, Homo sapiens
gaaagggccaggagaugaa

SEQ ID NO: 295769 - RNA, 19 nt, Homo sapiens
uggaggagaugucaagauu

SEQ ID NO: 295770 - RNA, 19 nt, Homo sapiens
ccacaacuccuuucauaga

SEQ ID NO: 295771 - RNA, 19 nt, Homo sapiens
ucagagaccucaggaauag

SEQ ID NO: 295772 - RNA, 19 nt, Homo sapiens
uaagugaggauucccauuu

SEQ ID NO: 295773 - RNA, 19 nt, Homo sapiens
ggaaauugcacaaacacaa

SEQ ID NO: 295774 - RNA, 19 nt, Homo sapiens
ccaaggaugugacacuguu

SEQ ID NO: 295775 - RNA, 19 nt, Homo sapiens
gaaaauggccuaccaggaa

SEQ ID NO: 295776 - RNA, 19 nt, Homo sapiens
gggcggagauauccuuaug

SEQ ID NO: 295777 - RNA, 19 nt, Homo sapiens
gaggugcugugaagacuga

SEQ ID NO: 295778 - RNA, 19 nt, Homo sapiens
uagaaucucugcaggaugu

SEQ ID NO: 295779 - RNA, 19 nt, Homo sapiens
caaugugacuccagccaaa

SEQ ID NO: 295780 - RNA, 19 nt, Homo sapiens
gaaaccaacgugaucuuga

SEQ ID NO: 295781 - RNA, 19 nt, Homo sapiens
gcagaugcauuaacagaac

SEQ ID NO: 295782 - RNA, 19 nt, Homo sapiens
cuccacaacuccuuucaua

SEQ ID NO: 295783 - RNA, 19 nt, Homo sapiens
caaaagacgugaagccaaa

SEQ ID NO: 295784 - RNA, 19 nt, Homo sapiens
ccacuucucucccuaagca

SEQ ID NO: 295785 - RNA, 19 nt, Homo sapiens
uaccaggaauacccaaaua

SEQ ID NO: 295786 - RNA, 19 nt, Homo sapiens
ugaauuccuugaagagaaa

SEQ ID NO: 295787 - RNA, 19 nt, Homo sapiens
acaugaaaguccucaguaa

SEQ ID NO: 295788 - RNA, 19 nt, Homo sapiens
gcagaagucaagaagauga

SEQ ID NO: 295789 - RNA, 19 nt, Homo sapiens
ggcauuggcuaaagauaug

SEQ ID NO: 295790 - RNA, 19 nt, Homo sapiens
caagagcacucagacuguu

SEQ ID NO: 295791 - RNA, 19 nt, Homo sapiens
caaugguggucauggagua

SEQ ID NO: 295792 - RNA, 19 nt, Homo sapiens
gggagaaacuguuggaaaa

SEQ ID NO: 295793 - RNA, 19 nt, Homo sapiens
aagugaggauucccauuua

SEQ ID NO: 295794 - RNA, 19 nt, Homo sapiens
agaaccaucuccagacauu

SEQ ID NO: 295795 - RNA, 19 nt, Homo sapiens
ggacauggcacuagcuaca

SEQ ID NO: 295796 - RNA, 19 nt, Homo sapiens
ccuuuaagauguaccauga

SEQ ID NO: 295797 - RNA, 19 nt, Homo sapiens
gggcccaucucccugcuuu

SEQ ID NO: 295798 - RNA, 19 nt, Homo sapiens
gauugaaagucagaaguug

SEQ ID NO: 295799 - RNA, 19 nt, Homo sapiens
gauaaagcgggacuucauu

SEQ ID NO: 295800 - RNA, 19 nt, Homo sapiens
cagcugauacuucaauauu

SEQ ID NO: 295801 - RNA, 19 nt, Homo sapiens
gacagcugauacuucaaua

SEQ ID NO: 295802 - RNA, 19 nt, Homo sapiens
augaugaccuggcagauuu

SEQ ID NO: 295803 - RNA, 19 nt, Homo sapiens
aagaaaccgugcucagaaa

SEQ ID NO: 295804 - RNA, 19 nt, Homo sapiens
gaaguaguucucaucaaga

SEQ ID NO: 295805 - RNA, 19 nt, Homo sapiens
gagggcaucuccuauaaaa

SEQ ID NO: 295806 - RNA, 19 nt, Homo sapiens
gagggcaucuccuauaaaa

SEQ ID NO: 295807 - RNA, 19 nt, Homo sapiens
agauagaaauggcaucaga

SEQ ID NO: 295808 - RNA, 19 nt, Homo sapiens
uauccagacugaucccuuu

SEQ ID NO: 295809 - RNA, 19 nt, Homo sapiens
ccuagcugcugucacauuu

SEQ ID NO: 295810 - RNA, 19 nt, Homo sapiens
ggucuaaggcuaacaucaa

SEQ ID NO: 295811 - RNA, 19 nt, Homo sapiens
gaagcccacugccauuaag

SEQ ID NO: 295812 - RNA, 19 nt, Homo sapiens
aaacacagcccacuucucu

SEQ ID NO: 295813 - RNA, 19 nt, Homo sapiens
uuaaagacauggaaauugc

SEQ ID NO: 295814 - RNA, 19 nt, Homo sapiens
acaguuacguucccuuaga

SEQ ID NO: 295815 - RNA, 19 nt, Homo sapiens
aaaccgugcucagaaacua

SEQ ID NO: 295816 - RNA, 19 nt, Homo sapiens
uggcaucucugucccauuc

SEQ ID NO: 295817 - RNA, 19 nt, Homo sapiens
aaauaguucugcagguuga

SEQ ID NO: 295818 - RNA, 19 nt, Homo sapiens
agacugaucccuuuaagau

SEQ ID NO: 295819 - RNA, 19 nt, Homo sapiens
guggucagcccuaggauaa

SEQ ID NO: 295820 - RNA, 19 nt, Homo sapiens
uggaaucacccaccaaauu

SEQ ID NO: 295821 - RNA, 19 nt, Homo sapiens
gauacuccaucuucuaaac

SEQ ID NO: 295822 - RNA, 19 nt, Homo sapiens
ugaaaguccucaguaagug

SEQ ID NO: 295823 - RNA, 19 nt, Homo sapiens
gaagaguggagguggauuc

SEQ ID NO: 295824 - RNA, 19 nt, Homo sapiens
ugggaucccucgauaaugu

SEQ ID NO: 295825 - RNA, 19 nt, Homo sapiens
gaaaguggacaucucuaag

SEQ ID NO: 295826 - RNA, 19 nt, Homo sapiens
caacuccuuucauagacaa

SEQ ID NO: 295827 - RNA, 19 nt, Homo sapiens
gugacacuguugaaagaaa

SEQ ID NO: 295828 - RNA, 19 nt, Homo sapiens
ggacugaagacuacugaca

SEQ ID NO: 295829 - RNA, 19 nt, Homo sapiens
gaugaugaccuggcagauu

SEQ ID NO: 295830 - RNA, 19 nt, Homo sapiens
caacacuccuagccaaugg

SEQ ID NO: 295831 - RNA, 19 nt, Homo sapiens
caaaauaguucugcagguu

SEQ ID NO: 295832 - RNA, 19 nt, Homo sapiens
ucucuaaggucuccuccaa

SEQ ID NO: 295833 - RNA, 19 nt, Homo sapiens
cuccugaucugaagaaugu

SEQ ID NO: 295834 - RNA, 19 nt, Homo sapiens
cugcagaagucaagaagau

SEQ ID NO: 295835 - RNA, 19 nt, Homo sapiens
gaagggagcgauacuacag

SEQ ID NO: 295836 - RNA, 19 nt, Homo sapiens
ggaguagaagggagcgaua

SEQ ID NO: 295837 - RNA, 19 nt, Homo sapiens
caagaaagggccaggagau

SEQ ID NO: 295838 - RNA, 19 nt, Homo sapiens
aagguuggcuccacggaaa

SEQ ID NO: 295839 - RNA, 19 nt, Homo sapiens
caagaagcccacugccauu

SEQ ID NO: 295840 - RNA, 19 nt, Homo sapiens
ccacgcuccugcccaagaa

SEQ ID NO: 295841 - RNA, 19 nt, Homo sapiens
cauggaaauugcacaaaca

SEQ ID NO: 295842 - RNA, 19 nt, Homo sapiens
gcaguucgguuaauugguu

SEQ ID NO: 295843 - RNA, 19 nt, Homo sapiens
ggaaggugcagauaauuaa

SEQ ID NO: 295844 - RNA, 19 nt, Homo sapiens
gggcggagaucguguacaa

SEQ ID NO: 295845 - RNA, 19 nt, Homo sapiens
gggaaggugcagauaauua

SEQ ID NO: 295846 - RNA, 19 nt, Homo sapiens
gaugaugaccuccuuagaa

SEQ ID NO: 295847 - RNA, 19 nt, Homo sapiens
caacauccaucauaaacca

SEQ ID NO: 295848 - RNA, 19 nt, Homo sapiens
ggaggaagcacaagaagug

SEQ ID NO: 295849 - RNA, 19 nt, Homo sapiens
gagaagggacagcggguua

SEQ ID NO: 295850 - RNA, 19 nt, Homo sapiens
gcaaauagucuacaaacca

SEQ ID NO: 295851 - RNA, 19 nt, Homo sapiens
gggcuaaccaguucucuuu

SEQ ID NO: 295852 - RNA, 19 nt, Homo sapiens
ggaguaagagcaaauuuca

SEQ ID NO: 295853 - RNA, 19 nt, Homo sapiens
ugaagaaugucaaguccaa

SEQ ID NO: 295854 - RNA, 19 nt, Homo sapiens
gcgggaaggugcagauaau

SEQ ID NO: 295855 - RNA, 19 nt, Homo sapiens
uagaaagacugaccuugau

SEQ ID NO: 295856 - RNA, 19 nt, Homo sapiens
gaugaccuccuuagaaaga

SEQ ID NO: 295857 - RNA, 19 nt, Homo sapiens
gcaaauuucaucuuuccaa

SEQ ID NO: 295858 - RNA, 19 nt, Homo sapiens
ugccagaccugaagaaugu

SEQ ID NO: 295859 - RNA, 19 nt, Homo sapiens
ccaccaggauuccagcaaa

SEQ ID NO: 295860 - RNA, 19 nt, Homo sapiens
uugcagaccugggacuuua

SEQ ID NO: 295861 - RNA, 19 nt, Homo sapiens
gcuguugucugccgugaga

SEQ ID NO: 295862 - RNA, 19 nt, Homo sapiens
cuaaccaguucucuuugua

SEQ ID NO: 295863 - RNA, 19 nt, Homo sapiens
gaaagacugaccuugaugu

SEQ ID NO: 295864 - RNA, 19 nt, Homo sapiens
uaggcaacauccaucauaa

SEQ ID NO: 295865 - RNA, 19 nt, Homo sapiens
gcuaaccaguucucuuugu

SEQ ID NO: 295866 - RNA, 19 nt, Homo sapiens
gagcaaauuucaucuuucc

SEQ ID NO: 295867 - RNA, 19 nt, Homo sapiens
ccaguucucuuuguaagga

SEQ ID NO: 295868 - RNA, 19 nt, Homo sapiens
gcaggaggguuggcacuuc

SEQ ID NO: 295869 - RNA, 19 nt, Homo sapiens
cuccaaguguggcucauua

SEQ ID NO: 295870 - RNA, 19 nt, Homo sapiens
aaguguggcucaaaggaua

SEQ ID NO: 295871 - RNA, 19 nt, Homo sapiens
augaugaccuccuuagaaa

SEQ ID NO: 295872 - RNA, 19 nt, Homo sapiens
ggaggaggaagcacaagaa

SEQ ID NO: 295873 - RNA, 19 nt, Homo sapiens
acuaucaggugaacuuuga

SEQ ID NO: 295874 - RNA, 19 nt, Homo sapiens
gcuccucgcaguucgguua

SEQ ID NO: 295875 - RNA, 19 nt, Homo sapiens
gaugggugggcuaguaaua

SEQ ID NO: 295876 - RNA, 19 nt, Homo sapiens
cacggacgcuggccugaaa

SEQ ID NO: 295877 - RNA, 19 nt, Homo sapiens
gaacugcugccaugauuuu

SEQ ID NO: 295878 - RNA, 19 nt, Homo sapiens
uuagaaagacugaccuuga

SEQ ID NO: 295879 - RNA, 19 nt, Homo sapiens
caacauuuccucaggcaau

SEQ ID NO: 295880 - RNA, 19 nt, Homo sapiens
ugaagaagcaggcauugga

SEQ ID NO: 295881 - RNA, 19 nt, Homo sapiens
ucugaaaccucugaugcua

SEQ ID NO: 295882 - RNA, 19 nt, Homo sapiens
gagaggagagaaugagaga

SEQ ID NO: 295883 - RNA, 19 nt, Homo sapiens
ugaaaccucugaugcuaag

SEQ ID NO: 295884 - RNA, 19 nt, Homo sapiens
uggaacugcugccaugauu

SEQ ID NO: 295885 - RNA, 19 nt, Homo sapiens
gaagggacagcggguuaaa

SEQ ID NO: 295886 - RNA, 19 nt, Homo sapiens
aaccacagcugaagaagca

SEQ ID NO: 295887 - RNA, 19 nt, Homo sapiens
gcuaagagcacuccaacag

SEQ ID NO: 295888 - RNA, 19 nt, Homo sapiens
gaaccgggcucugaaaccu

SEQ ID NO: 295889 - RNA, 19 nt, Homo sapiens
uaaccaguucucuuuguaa

SEQ ID NO: 295890 - RNA, 19 nt, Homo sapiens
ggcagacgaugucaaccuu

SEQ ID NO: 295891 - RNA, 19 nt, Homo sapiens
ugggugggcuaguaauaaa

SEQ ID NO: 295892 - RNA, 19 nt, Homo sapiens
gaggagagaaugagagagu

SEQ ID NO: 295893 - RNA, 19 nt, Homo sapiens
gcuacaccaugcaccaaga

SEQ ID NO: 295894 - RNA, 19 nt, Homo sapiens
aagaucggcuccacugaga

SEQ ID NO: 295895 - RNA, 19 nt, Homo sapiens
caucacacgucacaauguc

SEQ ID NO: 295896 - RNA, 19 nt, Homo sapiens
ugaccuugaugucuugaga

SEQ ID NO: 295897 - RNA, 19 nt, Homo sapiens
caagcaggguuugugauca

SEQ ID NO: 295898 - RNA, 19 nt, Homo sapiens
gcucgggacuucaaaauca

SEQ ID NO: 295899 - RNA, 19 nt, Homo sapiens
gucacaaugucccgaauuc

SEQ ID NO: 295900 - RNA, 19 nt, Homo sapiens
ggaacugcugccaugauuu

SEQ ID NO: 295901 - RNA, 19 nt, Homo sapiens
gaaggugcagauaauuaau

SEQ ID NO: 295902 - RNA, 19 nt, Homo sapiens
gggaguaagagcaaauuuc

SEQ ID NO: 295903 - RNA, 19 nt, Homo sapiens
aagcucgcauggucaguaa

SEQ ID NO: 295904 - RNA, 19 nt, Homo sapiens
gaaggaaccacagcugaag

SEQ ID NO: 295905 - RNA, 19 nt, Homo sapiens
ccucgccucugucgacuau

SEQ ID NO: 295906 - RNA, 19 nt, Homo sapiens
cagacgaugucaaccuugu

SEQ ID NO: 295907 - RNA, 19 nt, Homo sapiens
ccucgcaguucgguuaauu

SEQ ID NO: 295908 - RNA, 19 nt, Homo sapiens
uuaggcaacauccaucaua

SEQ ID NO: 295909 - RNA, 19 nt, Homo sapiens
ccacugagaaccugaagca

SEQ ID NO: 295910 - RNA, 19 nt, Homo sapiens
ccacugaggacggaucuga

SEQ ID NO: 295911 - RNA, 19 nt, Homo sapiens
gaggaaccgggcucugaaa

SEQ ID NO: 295912 - RNA, 19 nt, Homo sapiens
ggacuggaagcgaugacaa

SEQ ID NO: 295913 - RNA, 19 nt, Homo sapiens
gcggagaucguguacaagu

SEQ ID NO: 295914 - RNA, 19 nt, Homo sapiens
guaaggacuugugccucuu

SEQ ID NO: 295915 - RNA, 19 nt, Homo sapiens
guuggcacuucgaugauga

SEQ ID NO: 295916 - RNA, 19 nt, Homo sapiens
gccaggaguucgaagugau

SEQ ID NO: 295917 - RNA, 19 nt, Homo sapiens
gcagugugcaaauagucua

SEQ ID NO: 295918 - RNA, 19 nt, Homo sapiens
ggccaacgccaccaggauu

SEQ ID NO: 295919 - RNA, 19 nt, Homo sapiens
gggagacguccacccguuu

SEQ ID NO: 295920 - RNA, 19 nt, Homo sapiens
caguucgguuaauugguua

SEQ ID NO: 295921 - RNA, 19 nt, Homo sapiens
ggagagaaugagagagugu

SEQ ID NO: 295922 - RNA, 19 nt, Homo sapiens
agaguccagucgaagauug

SEQ ID NO: 295923 - RNA, 19 nt, Homo sapiens
caagcucgcauggucagua

SEQ ID NO: 295924 - RNA, 19 nt, Homo sapiens
ggaguucgaagugauggaa

SEQ ID NO: 295925 - RNA, 19 nt, Homo sapiens
gacugaccuugaugucuug

SEQ ID NO: 295926 - RNA, 19 nt, Homo sapiens
gacagaguccagucgaaga

SEQ ID NO: 295927 - RNA, 19 nt, Homo sapiens
aggcggcagugugcaaaua

SEQ ID NO: 295928 - RNA, 19 nt, Homo sapiens
caacguccaguccaagugu

SEQ ID NO: 295929 - RNA, 19 nt, Homo sapiens
gacuggaagcgaugacaaa

SEQ ID NO: 295930 - RNA, 19 nt, Homo sapiens
cagcacccuuaguggauga

SEQ ID NO: 295931 - RNA, 19 nt, Homo sapiens
gaacgccaaagccaagaca

SEQ ID NO: 295932 - RNA, 19 nt, Homo sapiens
guggccagguggaaguaaa

SEQ ID NO: 295933 - RNA, 19 nt, Homo sapiens
gaaugucaaguccaagauc

SEQ ID NO: 295934 - RNA, 19 nt, Homo sapiens
gacagcacccuuaguggau

SEQ ID NO: 295935 - RNA, 19 nt, Homo sapiens
gguuggcacuucgaugaug

SEQ ID NO: 295936 - RNA, 19 nt, Homo sapiens
gccacgugcuggagaguag

SEQ ID NO: 295937 - RNA, 19 nt, Homo sapiens
gggaggaggaagcacaaga

SEQ ID NO: 295938 - RNA, 19 nt, Homo sapiens
agaaugagagaguguggaa

SEQ ID NO: 295939 - RNA, 19 nt, Homo sapiens
agaaggaaccacagcugaa

SEQ ID NO: 295940 - RNA, 19 nt, Homo sapiens
gaagcaggcauuggagaca

SEQ ID NO: 295941 - RNA, 19 nt, Homo sapiens
agagcaaauuucaucuuuc

SEQ ID NO: 295942 - RNA, 19 nt, Homo sapiens
gcaguucgguuaauugguu

SEQ ID NO: 295943 - RNA, 19 nt, Homo sapiens
ggaaggugcagauaauuaa

SEQ ID NO: 295944 - RNA, 19 nt, Homo sapiens
gggcggagaucguguacaa

SEQ ID NO: 295945 - RNA, 19 nt, Homo sapiens
gggaaggugcagauaauua

SEQ ID NO: 295946 - RNA, 19 nt, Homo sapiens
gaugaugaccuccuuagaa

SEQ ID NO: 295947 - RNA, 19 nt, Homo sapiens
caacauccaucauaaacca

SEQ ID NO: 295948 - RNA, 19 nt, Homo sapiens
ggaggaagcacaagaagug

SEQ ID NO: 295949 - RNA, 19 nt, Homo sapiens
gagaagggacagcggguua

SEQ ID NO: 295950 - RNA, 19 nt, Homo sapiens
gcaaauagucuacaaacca

SEQ ID NO: 295951 - RNA, 19 nt, Homo sapiens
ccugaaagcugaagaagca

SEQ ID NO: 295952 - RNA, 19 nt, Homo sapiens
gggcuaaccaguucucuuu

SEQ ID NO: 295953 - RNA, 19 nt, Homo sapiens
ggaguaagagcaaauuuca

SEQ ID NO: 295954 - RNA, 19 nt, Homo sapiens
ugaagaaugucaaguccaa

SEQ ID NO: 295955 - RNA, 19 nt, Homo sapiens
gcgggaaggugcagauaau

SEQ ID NO: 295956 - RNA, 19 nt, Homo sapiens
uagaaagacugaccuugau

SEQ ID NO: 295957 - RNA, 19 nt, Homo sapiens
gaugaccuccuuagaaaga

SEQ ID NO: 295958 - RNA, 19 nt, Homo sapiens
gcaaauuucaucuuuccaa

SEQ ID NO: 295959 - RNA, 19 nt, Homo sapiens
ugccagaccugaagaaugu

SEQ ID NO: 295960 - RNA, 19 nt, Homo sapiens
ccaccaggauuccagcaaa

SEQ ID NO: 295961 - RNA, 19 nt, Homo sapiens
uugcagaccugggacuuua

SEQ ID NO: 295962 - RNA, 19 nt, Homo sapiens
gcuguugucugccgugaga

SEQ ID NO: 295963 - RNA, 19 nt, Homo sapiens
cuaaccaguucucuuugua

SEQ ID NO: 295964 - RNA, 19 nt, Homo sapiens
gaaagacugaccuugaugu

SEQ ID NO: 295965 - RNA, 19 nt, Homo sapiens
uaggcaacauccaucauaa

SEQ ID NO: 295966 - RNA, 19 nt, Homo sapiens
gcuaaccaguucucuuugu

SEQ ID NO: 295967 - RNA, 19 nt, Homo sapiens
gagcaaauuucaucuuucc

SEQ ID NO: 295968 - RNA, 19 nt, Homo sapiens
ccaguucucuuuguaagga

SEQ ID NO: 295969 - RNA, 19 nt, Homo sapiens
gcaggaggguuggcacuuc

SEQ ID NO: 295970 - RNA, 19 nt, Homo sapiens
cuccaaguguggcucauua

SEQ ID NO: 295971 - RNA, 19 nt, Homo sapiens
aaguguggcucaaaggaua

SEQ ID NO: 295972 - RNA, 19 nt, Homo sapiens
augaugaccuccuuagaaa

SEQ ID NO: 295973 - RNA, 19 nt, Homo sapiens
ggaggaggaagcacaagaa

SEQ ID NO: 295974 - RNA, 19 nt, Homo sapiens
acuaucaggugaacuuuga

SEQ ID NO: 295975 - RNA, 19 nt, Homo sapiens
gcuccucgcaguucgguua

SEQ ID NO: 295976 - RNA, 19 nt, Homo sapiens
gaugggugggcuaguaaua

SEQ ID NO: 295977 - RNA, 19 nt, Homo sapiens
cacggacgcuggccugaaa

SEQ ID NO: 295978 - RNA, 19 nt, Homo sapiens
gaacugcugccaugauuuu

SEQ ID NO: 295979 - RNA, 19 nt, Homo sapiens
uuagaaagacugaccuuga

SEQ ID NO: 295980 - RNA, 19 nt, Homo sapiens
caacauuuccucaggcaau

SEQ ID NO: 295981 - RNA, 19 nt, Homo sapiens
ugaagaagcaggcauugga

SEQ ID NO: 295982 - RNA, 19 nt, Homo sapiens
gagaggagagaaugagaga

SEQ ID NO: 295983 - RNA, 19 nt, Homo sapiens
uggaacugcugccaugauu

SEQ ID NO: 295984 - RNA, 19 nt, Homo sapiens
gaagggacagcggguuaaa

SEQ ID NO: 295985 - RNA, 19 nt, Homo sapiens
uaaccaguucucuuuguaa

SEQ ID NO: 295986 - RNA, 19 nt, Homo sapiens
ggcagacgaugucaaccuu

SEQ ID NO: 295987 - RNA, 19 nt, Homo sapiens
ugggugggcuaguaauaaa

SEQ ID NO: 295988 - RNA, 19 nt, Homo sapiens
gaggagagaaugagagagu

SEQ ID NO: 295989 - RNA, 19 nt, Homo sapiens
gcuacaccaugcaccaaga

SEQ ID NO: 295990 - RNA, 19 nt, Homo sapiens
aagaucggcuccacugaga

SEQ ID NO: 295991 - RNA, 19 nt, Homo sapiens
caucacacgucacaauguc

SEQ ID NO: 295992 - RNA, 19 nt, Homo sapiens
ugaccuugaugucuugaga

SEQ ID NO: 295993 - RNA, 19 nt, Homo sapiens
caagcaggguuugugauca

SEQ ID NO: 295994 - RNA, 19 nt, Homo sapiens
gcucgggacuucaaaauca

SEQ ID NO: 295995 - RNA, 19 nt, Homo sapiens
gucacaaugucccgaauuc

SEQ ID NO: 295996 - RNA, 19 nt, Homo sapiens
ggaacugcugccaugauuu

SEQ ID NO: 295997 - RNA, 19 nt, Homo sapiens
gaaggugcagauaauuaau

SEQ ID NO: 295998 - RNA, 19 nt, Homo sapiens
gggaguaagagcaaauuuc

SEQ ID NO: 295999 - RNA, 19 nt, Homo sapiens
aagcucgcauggucaguaa

SEQ ID NO: 296000 - RNA, 19 nt, Homo sapiens
ccucgccucugucgacuau

SEQ ID NO: 296001 - RNA, 19 nt, Homo sapiens
cagacgaugucaaccuugu

SEQ ID NO: 296002 - RNA, 19 nt, Homo sapiens
ccucgcaguucgguuaauu

SEQ ID NO: 296003 - RNA, 19 nt, Homo sapiens
uuaggcaacauccaucaua

SEQ ID NO: 296004 - RNA, 19 nt, Homo sapiens
ccacugagaaccugaagca

SEQ ID NO: 296005 - RNA, 19 nt, Homo sapiens
ggacuggaagcgaugacaa

SEQ ID NO: 296006 - RNA, 19 nt, Homo sapiens
gcggagaucguguacaagu

SEQ ID NO: 296007 - RNA, 19 nt, Homo sapiens
guaaggacuugugccucuu

SEQ ID NO: 296008 - RNA, 19 nt, Homo sapiens
gccaggaguucgaagugau

SEQ ID NO: 296009 - RNA, 19 nt, Homo sapiens
guuggcacuucgaugauga

SEQ ID NO: 296010 - RNA, 19 nt, Homo sapiens
gcagugugcaaauagucua

SEQ ID NO: 296011 - RNA, 19 nt, Homo sapiens
ggccaacgccaccaggauu

SEQ ID NO: 296012 - RNA, 19 nt, Homo sapiens
gggagacguccacccguuu

SEQ ID NO: 296013 - RNA, 19 nt, Homo sapiens
caguucgguuaauugguua

SEQ ID NO: 296014 - RNA, 19 nt, Homo sapiens
ggagagaaugagagagugu

SEQ ID NO: 296015 - RNA, 19 nt, Homo sapiens
agaguccagucgaagauug

SEQ ID NO: 296016 - RNA, 19 nt, Homo sapiens
caagcucgcauggucagua

SEQ ID NO: 296017 - RNA, 19 nt, Homo sapiens
gacugaccuugaugucuug

SEQ ID NO: 296018 - RNA, 19 nt, Homo sapiens
ggaguucgaagugauggaa

SEQ ID NO: 296019 - RNA, 19 nt, Homo sapiens
gacuggaagcgaugacaaa

SEQ ID NO: 296020 - RNA, 19 nt, Homo sapiens
gacagaguccagucgaaga

SEQ ID NO: 296021 - RNA, 19 nt, Homo sapiens
aggcggcagugugcaaaua

SEQ ID NO: 296022 - RNA, 19 nt, Homo sapiens
caacguccaguccaagugu

SEQ ID NO: 296023 - RNA, 19 nt, Homo sapiens
gaacgccaaagccaagaca

SEQ ID NO: 296024 - RNA, 19 nt, Homo sapiens
guggccagguggaaguaaa

SEQ ID NO: 296025 - RNA, 19 nt, Homo sapiens
gaaugucaaguccaagauc

SEQ ID NO: 296026 - RNA, 19 nt, Homo sapiens
gguuggcacuucgaugaug

SEQ ID NO: 296027 - RNA, 19 nt, Homo sapiens
gccacgugcuggagaguag

SEQ ID NO: 296028 - RNA, 19 nt, Homo sapiens
gggaggaggaagcacaaga

SEQ ID NO: 296029 - RNA, 19 nt, Homo sapiens
agaaugagagaguguggaa

SEQ ID NO: 296030 - RNA, 19 nt, Homo sapiens
agagcaaauuucaucuuuc

SEQ ID NO: 296031 - RNA, 19 nt, Homo sapiens
gaagcaggcauuggagaca

SEQ ID NO: 296032 - RNA, 19 nt, Homo sapiens
ccaagcaggguuugugauc

SEQ ID NO: 296033 - RNA, 19 nt, Homo sapiens
ggagacguccacccguuuc

SEQ ID NO: 296034 - RNA, 19 nt, Homo sapiens
cgaugucaaccuuguguga

SEQ ID NO: 296035 - RNA, 19 nt, Homo sapiens
aguaagagcaaauuucauc

SEQ ID NO: 296036 - RNA, 19 nt, Homo sapiens
ccaaguguggcucaaagga

SEQ ID NO: 296037 - RNA, 19 nt, Homo sapiens
guccaaguguggcucaaag

SEQ ID NO: 296038 - RNA, 19 nt, Homo sapiens
uggcagcaacaaaggauuu

SEQ ID NO: 296039 - RNA, 19 nt, Homo sapiens
auugaugggugggcuagua

SEQ ID NO: 296040 - RNA, 19 nt, Homo sapiens
ggccaagcaggguuuguga

SEQ ID NO: 296041 - RNA, 19 nt, Homo sapiens
gcaacguccaguccaagug

SEQ ID NO: 296042 - RNA, 19 nt, Homo sapiens
caaaggagaugaaacucaa

SEQ ID NO: 296043 - RNA, 19 nt, Homo sapiens
gcaguucgguuaauugguu

SEQ ID NO: 296044 - RNA, 19 nt, Homo sapiens
ggaaggugcagauaauuaa

SEQ ID NO: 296045 - RNA, 19 nt, Homo sapiens
gggcggagaucguguacaa

SEQ ID NO: 296046 - RNA, 19 nt, Homo sapiens
gggaaggugcagauaauua

SEQ ID NO: 296047 - RNA, 19 nt, Homo sapiens
gcaaggaggagguggauga

SEQ ID NO: 296048 - RNA, 19 nt, Homo sapiens
gaugaugaccuccuuagaa

SEQ ID NO: 296049 - RNA, 19 nt, Homo sapiens
caacauccaucauaaacca

SEQ ID NO: 296050 - RNA, 19 nt, Homo sapiens
gauuuccucuccaaaguuu

SEQ ID NO: 296051 - RNA, 19 nt, Homo sapiens
ggaggaagcacaagaagug

SEQ ID NO: 296052 - RNA, 19 nt, Homo sapiens
aaacacgucucuucuguca

SEQ ID NO: 296053 - RNA, 19 nt, Homo sapiens
gagaagggacagcggguua

SEQ ID NO: 296054 - RNA, 19 nt, Homo sapiens
gcaaauagucuacaaacca

SEQ ID NO: 296055 - RNA, 19 nt, Homo sapiens
gggcuaaccaguucucuuu

SEQ ID NO: 296056 - RNA, 19 nt, Homo sapiens
ggaguaagagcaaauuuca

SEQ ID NO: 296057 - RNA, 19 nt, Homo sapiens
ugaagaaugucaaguccaa

SEQ ID NO: 296058 - RNA, 19 nt, Homo sapiens
gccaagacauccacacguu

SEQ ID NO: 296059 - RNA, 19 nt, Homo sapiens
gcgggaaggugcagauaau

SEQ ID NO: 296060 - RNA, 19 nt, Homo sapiens
uagaaagacugaccuugau

SEQ ID NO: 296061 - RNA, 19 nt, Homo sapiens
gaugaccuccuuagaaaga

SEQ ID NO: 296062 - RNA, 19 nt, Homo sapiens
gcaaauuucaucuuuccaa

SEQ ID NO: 296063 - RNA, 19 nt, Homo sapiens
ugccagaccugaagaaugu

SEQ ID NO: 296064 - RNA, 19 nt, Homo sapiens
ccaccaggauuccagcaaa

SEQ ID NO: 296065 - RNA, 19 nt, Homo sapiens
gcaaaggagaugaaacuca

SEQ ID NO: 296066 - RNA, 19 nt, Homo sapiens
cuaaacacgucucuucugu

SEQ ID NO: 296067 - RNA, 19 nt, Homo sapiens
uugcagaccugggacuuua

SEQ ID NO: 296068 - RNA, 19 nt, Homo sapiens
gcuguugucugccgugaga

SEQ ID NO: 296069 - RNA, 19 nt, Homo sapiens
cuaaccaguucucuuugua

SEQ ID NO: 296070 - RNA, 19 nt, Homo sapiens
gaaagacugaccuugaugu

SEQ ID NO: 296071 - RNA, 19 nt, Homo sapiens
uaggcaacauccaucauaa

SEQ ID NO: 296072 - RNA, 19 nt, Homo sapiens
gcuaaccaguucucuuugu

SEQ ID NO: 296073 - RNA, 19 nt, Homo sapiens
gagcaaauuucaucuuucc

SEQ ID NO: 296074 - RNA, 19 nt, Homo sapiens
gagcaaaggagaugaaacu

SEQ ID NO: 296075 - RNA, 19 nt, Homo sapiens
ccaguucucuuuguaagga

SEQ ID NO: 296076 - RNA, 19 nt, Homo sapiens
gcaggaggguuggcacuuc

SEQ ID NO: 296077 - RNA, 19 nt, Homo sapiens
cuccaaguguggcucauua

SEQ ID NO: 296078 - RNA, 19 nt, Homo sapiens
aaguguggcucaaaggaua

SEQ ID NO: 296079 - RNA, 19 nt, Homo sapiens
ccagacagccgccagagaa

SEQ ID NO: 296080 - RNA, 19 nt, Homo sapiens
augaugaccuccuuagaaa

SEQ ID NO: 296081 - RNA, 19 nt, Homo sapiens
ggaggaggaagcacaagaa

SEQ ID NO: 296082 - RNA, 19 nt, Homo sapiens
acuaucaggugaacuuuga

SEQ ID NO: 296083 - RNA, 19 nt, Homo sapiens
gcuccucgcaguucgguua

SEQ ID NO: 296084 - RNA, 19 nt, Homo sapiens
cacggacgcuggccugaaa

SEQ ID NO: 296085 - RNA, 19 nt, Homo sapiens
gaugggugggcuaguaaua

SEQ ID NO: 296086 - RNA, 19 nt, Homo sapiens
gaacugcugccaugauuuu

SEQ ID NO: 296087 - RNA, 19 nt, Homo sapiens
uuagaaagacugaccuuga

SEQ ID NO: 296088 - RNA, 19 nt, Homo sapiens
caacauuuccucaggcaau

SEQ ID NO: 296089 - RNA, 19 nt, Homo sapiens
ugaagaagcaggcauugga

SEQ ID NO: 296090 - RNA, 19 nt, Homo sapiens
ucugaaaccucugaugcua

SEQ ID NO: 296091 - RNA, 19 nt, Homo sapiens
gagaggagagaaugagaga

SEQ ID NO: 296092 - RNA, 19 nt, Homo sapiens
ugaaaccucugaugcuaag

SEQ ID NO: 296093 - RNA, 19 nt, Homo sapiens
uggaacugcugccaugauu

SEQ ID NO: 296094 - RNA, 19 nt, Homo sapiens
gaagggacagcggguuaaa

SEQ ID NO: 296095 - RNA, 19 nt, Homo sapiens
aaccacagcugaagaagca

SEQ ID NO: 296096 - RNA, 19 nt, Homo sapiens
gcuaagagcacuccaacag

SEQ ID NO: 296097 - RNA, 19 nt, Homo sapiens
gaaccgggcucugaaaccu

SEQ ID NO: 296098 - RNA, 19 nt, Homo sapiens
uaaccaguucucuuuguaa

SEQ ID NO: 296099 - RNA, 19 nt, Homo sapiens
ggcagacgaugucaaccuu

SEQ ID NO: 296100 - RNA, 19 nt, Homo sapiens
ugggugggcuaguaauaaa

SEQ ID NO: 296101 - RNA, 19 nt, Homo sapiens
gaggagagaaugagagagu

SEQ ID NO: 296102 - RNA, 19 nt, Homo sapiens
ccgggucccucaacucaaa

SEQ ID NO: 296103 - RNA, 19 nt, Homo sapiens
aggaggagguggaugaaga

SEQ ID NO: 296104 - RNA, 19 nt, Homo sapiens
gcuacaccaugcaccaaga

SEQ ID NO: 296105 - RNA, 19 nt, Homo sapiens
aagaucggcuccacugaga

SEQ ID NO: 296106 - RNA, 19 nt, Homo sapiens
caucacacgucacaauguc

SEQ ID NO: 296107 - RNA, 19 nt, Homo sapiens
ugaccuugaugucuugaga

SEQ ID NO: 296108 - RNA, 19 nt, Homo sapiens
caagcaggguuugugauca

SEQ ID NO: 296109 - RNA, 19 nt, Homo sapiens
gagccaccuuccucuccua

SEQ ID NO: 296110 - RNA, 19 nt, Homo sapiens
gcucgggacuucaaaauca

SEQ ID NO: 296111 - RNA, 19 nt, Homo sapiens
gucacaaugucccgaauuc

SEQ ID NO: 296112 - RNA, 19 nt, Homo sapiens
ggaacugcugccaugauuu

SEQ ID NO: 296113 - RNA, 19 nt, Homo sapiens
gaaggugcagauaauuaau

SEQ ID NO: 296114 - RNA, 19 nt, Homo sapiens
gggaguaagagcaaauuuc

SEQ ID NO: 296115 - RNA, 19 nt, Homo sapiens
aagcucgcauggucaguaa

SEQ ID NO: 296116 - RNA, 19 nt, Homo sapiens
gaaggaaccacagcugaag

SEQ ID NO: 296117 - RNA, 19 nt, Homo sapiens
cagacgaugucaaccuugu

SEQ ID NO: 296118 - RNA, 19 nt, Homo sapiens
ccucgcaguucgguuaauu

SEQ ID NO: 296119 - RNA, 19 nt, Homo sapiens
uuaggcaacauccaucaua

SEQ ID NO: 296120 - RNA, 19 nt, Homo sapiens
ccucgccucugucgacuau

SEQ ID NO: 296121 - RNA, 19 nt, Homo sapiens
ccacugagaaccugaagca

SEQ ID NO: 296122 - RNA, 19 nt, Homo sapiens
gaggaaccgggcucugaaa

SEQ ID NO: 296123 - RNA, 19 nt, Homo sapiens
acacgucucuucugucacu

SEQ ID NO: 296124 - RNA, 19 nt, Homo sapiens
ggacuggaagcgaugacaa

SEQ ID NO: 296125 - RNA, 19 nt, Homo sapiens
ccacugaggacggaucuga

SEQ ID NO: 296126 - RNA, 19 nt, Homo sapiens
ucuccaaaguuuccacaga

SEQ ID NO: 296127 - RNA, 19 nt, Homo sapiens
gcggagaucguguacaagu

SEQ ID NO: 296128 - RNA, 19 nt, Homo sapiens
ggauuuccucuccaaaguu

SEQ ID NO: 296129 - RNA, 19 nt, Homo sapiens
guaaggacuugugccucuu

SEQ ID NO: 296130 - RNA, 19 nt, Homo sapiens
guuggcacuucgaugauga

SEQ ID NO: 296131 - RNA, 19 nt, Homo sapiens
gcagugugcaaauagucua

SEQ ID NO: 296132 - RNA, 19 nt, Homo sapiens
gccaggaguucgaagugau

SEQ ID NO: 296133 - RNA, 19 nt, Homo sapiens
ggccaacgccaccaggauu

SEQ ID NO: 296134 - RNA, 19 nt, Homo sapiens
gggagacguccacccguuu

SEQ ID NO: 296135 - RNA, 19 nt, Homo sapiens
caguucgguuaauugguua

SEQ ID NO: 296136 - RNA, 19 nt, Homo sapiens
ggagagaaugagagagugu

SEQ ID NO: 296137 - RNA, 19 nt, Homo sapiens
agaguccagucgaagauug

SEQ ID NO: 296138 - RNA, 19 nt, Homo sapiens
ggaguucgaagugauggaa

SEQ ID NO: 296139 - RNA, 19 nt, Homo sapiens
gacugaccuugaugucuug

SEQ ID NO: 296140 - RNA, 19 nt, Homo sapiens
gacagaguccagucgaaga

SEQ ID NO: 296141 - RNA, 19 nt, Homo sapiens
aggcggcagugugcaaaua

SEQ ID NO: 296142 - RNA, 19 nt, Homo sapiens
gcaguucgguuaauugguu

SEQ ID NO: 296143 - RNA, 19 nt, Homo sapiens
gggcggagaucguguacaa

SEQ ID NO: 296144 - RNA, 19 nt, Homo sapiens
gaugaugaccuccuuagaa

SEQ ID NO: 296145 - RNA, 19 nt, Homo sapiens
caacauccaucauaaacca

SEQ ID NO: 296146 - RNA, 19 nt, Homo sapiens
ggaggaagcacaagaagug

SEQ ID NO: 296147 - RNA, 19 nt, Homo sapiens
gagaagggacagcggguua

SEQ ID NO: 296148 - RNA, 19 nt, Homo sapiens
gcaaauagucuacaaacca

SEQ ID NO: 296149 - RNA, 19 nt, Homo sapiens
ccugaaagcugaagaagca

SEQ ID NO: 296150 - RNA, 19 nt, Homo sapiens
gggcuaaccaguucucuuu

SEQ ID NO: 296151 - RNA, 19 nt, Homo sapiens
ggaguaagagcaaauuuca

SEQ ID NO: 296152 - RNA, 19 nt, Homo sapiens
ugaagaaugucaaguccaa

SEQ ID NO: 296153 - RNA, 19 nt, Homo sapiens
uagaaagacugaccuugau

SEQ ID NO: 296154 - RNA, 19 nt, Homo sapiens
gaugaccuccuuagaaaga

SEQ ID NO: 296155 - RNA, 19 nt, Homo sapiens
gcaaauuucaucuuuccaa

SEQ ID NO: 296156 - RNA, 19 nt, Homo sapiens
ugccagaccugaagaaugu

SEQ ID NO: 296157 - RNA, 19 nt, Homo sapiens
ccaccaggauuccagcaaa

SEQ ID NO: 296158 - RNA, 19 nt, Homo sapiens
uugcagaccugggacuuua

SEQ ID NO: 296159 - RNA, 19 nt, Homo sapiens
gcuguugucugccgugaga

SEQ ID NO: 296160 - RNA, 19 nt, Homo sapiens
cuaaccaguucucuuugua

SEQ ID NO: 296161 - RNA, 19 nt, Homo sapiens
gaaagacugaccuugaugu

SEQ ID NO: 296162 - RNA, 19 nt, Homo sapiens
uaggcaacauccaucauaa

SEQ ID NO: 296163 - RNA, 19 nt, Homo sapiens
gcuaaccaguucucuuugu

SEQ ID NO: 296164 - RNA, 19 nt, Homo sapiens
gagcaaauuucaucuuucc

SEQ ID NO: 296165 - RNA, 19 nt, Homo sapiens
gcgggaaggugcaaauagu

SEQ ID NO: 296166 - RNA, 19 nt, Homo sapiens
ccaguucucuuuguaagga

SEQ ID NO: 296167 - RNA, 19 nt, Homo sapiens
gcaggaggguuggcacuuc

SEQ ID NO: 296168 - RNA, 19 nt, Homo sapiens
cuccaaguguggcucauua

SEQ ID NO: 296169 - RNA, 19 nt, Homo sapiens
augaugaccuccuuagaaa

SEQ ID NO: 296170 - RNA, 19 nt, Homo sapiens
ggaggaggaagcacaagaa

SEQ ID NO: 296171 - RNA, 19 nt, Homo sapiens
gcuccucgcaguucgguua

SEQ ID NO: 296172 - RNA, 19 nt, Homo sapiens
acuaucaggugaacuuuga

SEQ ID NO: 296173 - RNA, 19 nt, Homo sapiens
gaugggugggcuaguaaua

SEQ ID NO: 296174 - RNA, 19 nt, Homo sapiens
cacggacgcuggccugaaa

SEQ ID NO: 296175 - RNA, 19 nt, Homo sapiens
gaacugcugccaugauuuu

SEQ ID NO: 296176 - RNA, 19 nt, Homo sapiens
uuagaaagacugaccuuga

SEQ ID NO: 296177 - RNA, 19 nt, Homo sapiens
caacauuuccucaggcaau

SEQ ID NO: 296178 - RNA, 19 nt, Homo sapiens
ugaagaagcaggcauugga

SEQ ID NO: 296179 - RNA, 19 nt, Homo sapiens
gagaggagagaaugagaga

SEQ ID NO: 296180 - RNA, 19 nt, Homo sapiens
uggaacugcugccaugauu

SEQ ID NO: 296181 - RNA, 19 nt, Homo sapiens
gaagggacagcggguuaaa

SEQ ID NO: 296182 - RNA, 19 nt, Homo sapiens
uaaccaguucucuuuguaa

SEQ ID NO: 296183 - RNA, 19 nt, Homo sapiens
ggcagacgaugucaaccuu

SEQ ID NO: 296184 - RNA, 19 nt, Homo sapiens
ugggugggcuaguaauaaa

SEQ ID NO: 296185 - RNA, 19 nt, Homo sapiens
gaggagagaaugagagagu

SEQ ID NO: 296186 - RNA, 19 nt, Homo sapiens
gcuacaccaugcaccaaga

SEQ ID NO: 296187 - RNA, 19 nt, Homo sapiens
ggaaggugcaaauagucua

SEQ ID NO: 296188 - RNA, 19 nt, Homo sapiens
aagaucggcuccacugaga

SEQ ID NO: 296189 - RNA, 19 nt, Homo sapiens
caucacacgucacaauguc

SEQ ID NO: 296190 - RNA, 19 nt, Homo sapiens
ugaccuugaugucuugaga

SEQ ID NO: 296191 - RNA, 19 nt, Homo sapiens
caagcaggguuugugauca

SEQ ID NO: 296192 - RNA, 19 nt, Homo sapiens
gcucgggacuucaaaauca

SEQ ID NO: 296193 - RNA, 19 nt, Homo sapiens
gucacaaugucccgaauuc

SEQ ID NO: 296194 - RNA, 19 nt, Homo sapiens
ggaacugcugccaugauuu

SEQ ID NO: 296195 - RNA, 19 nt, Homo sapiens
gggaguaagagcaaauuuc

SEQ ID NO: 296196 - RNA, 19 nt, Homo sapiens
aagcucgcauggucaguaa

SEQ ID NO: 296197 - RNA, 19 nt, Homo sapiens
ccucgccucugucgacuau

SEQ ID NO: 296198 - RNA, 19 nt, Homo sapiens
cagacgaugucaaccuugu

SEQ ID NO: 296199 - RNA, 19 nt, Homo sapiens
ccucgcaguucgguuaauu

SEQ ID NO: 296200 - RNA, 19 nt, Homo sapiens
uuaggcaacauccaucaua

SEQ ID NO: 296201 - RNA, 19 nt, Homo sapiens
ccacugagaaccugaagca

SEQ ID NO: 296202 - RNA, 19 nt, Homo sapiens
ggacuggaagcgaugacaa

SEQ ID NO: 296203 - RNA, 19 nt, Homo sapiens
gcggagaucguguacaagu

SEQ ID NO: 296204 - RNA, 19 nt, Homo sapiens
guaaggacuugugccucuu

SEQ ID NO: 296205 - RNA, 19 nt, Homo sapiens
guuggcacuucgaugauga

SEQ ID NO: 296206 - RNA, 19 nt, Homo sapiens
gccaggaguucgaagugau

SEQ ID NO: 296207 - RNA, 19 nt, Homo sapiens
ggccaacgccaccaggauu

SEQ ID NO: 296208 - RNA, 19 nt, Homo sapiens
gggagacguccacccguuu

SEQ ID NO: 296209 - RNA, 19 nt, Homo sapiens
caagcucgcauggucagua

SEQ ID NO: 296210 - RNA, 19 nt, Homo sapiens
caguucgguuaauugguua

SEQ ID NO: 296211 - RNA, 19 nt, Homo sapiens
ggagagaaugagagagugu

SEQ ID NO: 296212 - RNA, 19 nt, Homo sapiens
agaguccagucgaagauug

SEQ ID NO: 296213 - RNA, 19 nt, Homo sapiens
gacugaccuugaugucuug

SEQ ID NO: 296214 - RNA, 19 nt, Homo sapiens
ggaguucgaagugauggaa

SEQ ID NO: 296215 - RNA, 19 nt, Homo sapiens
gacuggaagcgaugacaaa

SEQ ID NO: 296216 - RNA, 19 nt, Homo sapiens
gacagaguccagucgaaga

SEQ ID NO: 296217 - RNA, 19 nt, Homo sapiens
gaacgccaaagccaagaca

SEQ ID NO: 296218 - RNA, 19 nt, Homo sapiens
guggccagguggaaguaaa

SEQ ID NO: 296219 - RNA, 19 nt, Homo sapiens
gaaugucaaguccaagauc

SEQ ID NO: 296220 - RNA, 19 nt, Homo sapiens
gguuggcacuucgaugaug

SEQ ID NO: 296221 - RNA, 19 nt, Homo sapiens
gccacgugcuggagaguag

SEQ ID NO: 296222 - RNA, 19 nt, Homo sapiens
gggaggaggaagcacaaga

SEQ ID NO: 296223 - RNA, 19 nt, Homo sapiens
agaaugagagaguguggaa

SEQ ID NO: 296224 - RNA, 19 nt, Homo sapiens
gaagcaggcauuggagaca

SEQ ID NO: 296225 - RNA, 19 nt, Homo sapiens
agagcaaauuucaucuuuc

SEQ ID NO: 296226 - RNA, 19 nt, Homo sapiens
ccaagcaggguuugugauc

SEQ ID NO: 296227 - RNA, 19 nt, Homo sapiens
ggagacguccacccguuuc

SEQ ID NO: 296228 - RNA, 19 nt, Homo sapiens
cgaugucaaccuuguguga

SEQ ID NO: 296229 - RNA, 19 nt, Homo sapiens
aguaagagcaaauuucauc

SEQ ID NO: 296230 - RNA, 19 nt, Homo sapiens
uggcagcaacaaaggauuu

SEQ ID NO: 296231 - RNA, 19 nt, Homo sapiens
auugaugggugggcuagua

SEQ ID NO: 296232 - RNA, 19 nt, Homo sapiens
ggccaagcaggguuuguga

SEQ ID NO: 296233 - RNA, 19 nt, Homo sapiens
gaaggugcaaauagucuac

SEQ ID NO: 296234 - RNA, 19 nt, Homo sapiens
ccucaucacacgucacaau

SEQ ID NO: 296235 - RNA, 19 nt, Homo sapiens
uuauugaguucugaagguu

SEQ ID NO: 296236 - RNA, 19 nt, Homo sapiens
cacggcaucucagcaaugu

SEQ ID NO: 296237 - RNA, 19 nt, Homo sapiens
ggcaacauccaucauaaac

SEQ ID NO: 296238 - RNA, 19 nt, Homo sapiens
cgccaggaguucgaaguga

SEQ ID NO: 296239 - RNA, 19 nt, Homo sapiens
ggagagccaaggccuaugc

SEQ ID NO: 296240 - RNA, 19 nt, Homo sapiens
ugaaaacuuugguguguuc

SEQ ID NO: 296241 - RNA, 19 nt, Homo sapiens
gaugggaguaagagcaaau

SEQ ID NO: 296242 - RNA, 19 nt, Homo sapiens
gaucagugcuggcagauaa

SEQ ID NO: 296243 - RNA, 19 nt, Homo sapiens
aaacauugcugccuaaaga

SEQ ID NO: 296244 - RNA, 19 nt, Homo sapiens
gcacuuaaacugccucgua

SEQ ID NO: 296245 - RNA, 19 nt, Homo sapiens
ggaggaauguguaagauag

SEQ ID NO: 296246 - RNA, 19 nt, Homo sapiens
ggacgcauguaucuugaaa

SEQ ID NO: 296247 - RNA, 19 nt, Homo sapiens
uggagcagcugaacauaua

SEQ ID NO: 296248 - RNA, 19 nt, Homo sapiens
gcaauucuccuaaguugaa

SEQ ID NO: 296249 - RNA, 19 nt, Homo sapiens
gaaauuaagggaaggcaaa

SEQ ID NO: 296250 - RNA, 19 nt, Homo sapiens
ccagaacucuccaccaaga

SEQ ID NO: 296251 - RNA, 19 nt, Homo sapiens
cagcaauucuccuaaguug

SEQ ID NO: 296252 - RNA, 19 nt, Homo sapiens
ccacgaaucucaugaucug

SEQ ID NO: 296253 - RNA, 19 nt, Homo sapiens
gaucuuaaaugaggacaau

SEQ ID NO: 296254 - RNA, 19 nt, Homo sapiens
gaggaaggaugacuugaca

SEQ ID NO: 296255 - RNA, 19 nt, Homo sapiens
caacagagaccagcuucua

SEQ ID NO: 296256 - RNA, 19 nt, Homo sapiens
gcagcuggcuaguucauuc

SEQ ID NO: 296257 - RNA, 19 nt, Homo sapiens
gcccagaacucuccaccaa

SEQ ID NO: 296258 - RNA, 19 nt, Homo sapiens
gaaaucaucuuagcuuagc

SEQ ID NO: 296259 - RNA, 19 nt, Homo sapiens
gugaaugucuauauagugu

SEQ ID NO: 296260 - RNA, 19 nt, Homo sapiens
caucuuuguucuccaagua

SEQ ID NO: 296261 - RNA, 19 nt, Homo sapiens
gcuggcagauaaauugaaa

SEQ ID NO: 296262 - RNA, 19 nt, Homo sapiens
agccuaagaucaugguuua

SEQ ID NO: 296263 - RNA, 19 nt, Homo sapiens
ggaauguguaagauaguua

SEQ ID NO: 296264 - RNA, 19 nt, Homo sapiens
cugacucacuuuaucaaua

SEQ ID NO: 296265 - RNA, 19 nt, Homo sapiens
gcuagagcuuuaccugaaa

SEQ ID NO: 296266 - RNA, 19 nt, Homo sapiens
gaucugagaaggagaagga

SEQ ID NO: 296267 - RNA, 19 nt, Homo sapiens
gcuuacaacuccugcauca

SEQ ID NO: 296268 - RNA, 19 nt, Homo sapiens
caugauuucuucgguaauu

SEQ ID NO: 296269 - RNA, 19 nt, Homo sapiens
ugacucacuuuaucaauag

SEQ ID NO: 296270 - RNA, 19 nt, Homo sapiens
guaggaauauggacaucug

SEQ ID NO: 296271 - RNA, 19 nt, Homo sapiens
gcuauugcuuguugugcua

SEQ ID NO: 296272 - RNA, 19 nt, Homo sapiens
gcucagcuccacaugcaua

SEQ ID NO: 296273 - RNA, 19 nt, Homo sapiens
cacuuaaacugccucguaa

SEQ ID NO: 296274 - RNA, 19 nt, Homo sapiens
caccaugggccuucuuaua

SEQ ID NO: 296275 - RNA, 19 nt, Homo sapiens
ugaauugccuguccuggau

SEQ ID NO: 296276 - RNA, 19 nt, Homo sapiens
caaaggaggcuuacaacuc

SEQ ID NO: 296277 - RNA, 19 nt, Homo sapiens
caagucccaugauuucuuc

SEQ ID NO: 296278 - RNA, 19 nt, Homo sapiens
gcaagucccaugauuucuu

SEQ ID NO: 296279 - RNA, 19 nt, Homo sapiens
cuagauaggauauacugua

SEQ ID NO: 296280 - RNA, 19 nt, Homo sapiens
ggacucguguggccugugu

SEQ ID NO: 296281 - RNA, 19 nt, Homo sapiens
gcaaaguccaggcacaaga

SEQ ID NO: 296282 - RNA, 19 nt, Homo sapiens
ugauuucucuucagcuuug

SEQ ID NO: 296283 - RNA, 19 nt, Homo sapiens
gugagacuguauccuguuu

SEQ ID NO: 296284 - RNA, 19 nt, Homo sapiens
guaaugacccugguugguu

SEQ ID NO: 296285 - RNA, 19 nt, Homo sapiens
ccuagagccucaccuccua

SEQ ID NO: 296286 - RNA, 19 nt, Homo sapiens
gggaggaauguguaagaua

SEQ ID NO: 296287 - RNA, 19 nt, Homo sapiens
gcagcugaacauauacaua

SEQ ID NO: 296288 - RNA, 19 nt, Homo sapiens
auacugagggugaaauuaa

SEQ ID NO: 296289 - RNA, 19 nt, Homo sapiens
cagcagggauugggaugaa

SEQ ID NO: 296290 - RNA, 19 nt, Homo sapiens
guaguuggauuugucuguu

SEQ ID NO: 296291 - RNA, 19 nt, Homo sapiens
gggagcagccacggaguua

SEQ ID NO: 296292 - RNA, 19 nt, Homo sapiens
ggacugaagcgaugauguc

SEQ ID NO: 296293 - RNA, 19 nt, Homo sapiens
acgcauguaucuugaaaug

SEQ ID NO: 296294 - RNA, 19 nt, Homo sapiens
aaaggacgcauguaucuug

SEQ ID NO: 296295 - RNA, 19 nt, Homo sapiens
gagcagccacggaguuaga

SEQ ID NO: 296296 - RNA, 19 nt, Homo sapiens
ggauuugucuguuuaugcu

SEQ ID NO: 296297 - RNA, 19 nt, Homo sapiens
gggcacugcucagcuguga

SEQ ID NO: 296298 - RNA, 19 nt, Homo sapiens
gagccucaccuccuaauag

SEQ ID NO: 296299 - RNA, 19 nt, Homo sapiens
ggaauauggacaucugguu

SEQ ID NO: 296300 - RNA, 19 nt, Homo sapiens
gcagggauugggaugaauu

SEQ ID NO: 296301 - RNA, 19 nt, Homo sapiens
gcugugacccuagguguuu

SEQ ID NO: 296302 - RNA, 19 nt, Homo sapiens
gacuguauccuguuugcua

SEQ ID NO: 296303 - RNA, 19 nt, Homo sapiens
ggcuugugaucuuaaauga

SEQ ID NO: 296304 - RNA, 19 nt, Homo sapiens
cagcugaacauauacauag

SEQ ID NO: 296305 - RNA, 19 nt, Homo sapiens
cccaugauuucuucgguaa

SEQ ID NO: 296306 - RNA, 19 nt, Homo sapiens
gguaccuacuccauacuga

SEQ ID NO: 296307 - RNA, 19 nt, Homo sapiens
ucaagcugcugacucacuu

SEQ ID NO: 296308 - RNA, 19 nt, Homo sapiens
gcacaggauuaggacugaa

SEQ ID NO: 296309 - RNA, 19 nt, Homo sapiens
gucugugaaugucuauaua

SEQ ID NO: 296310 - RNA, 19 nt, Homo sapiens
gaagccaugcugucuguuc

SEQ ID NO: 296311 - RNA, 19 nt, Homo sapiens
gcugcugacucacuuuauc

SEQ ID NO: 296312 - RNA, 19 nt, Homo sapiens
ggaggccguucagcuguga

SEQ ID NO: 296313 - RNA, 19 nt, Homo sapiens
aaggcacgcuggcuuguga

SEQ ID NO: 296314 - RNA, 19 nt, Homo sapiens
gggaagccgccuuugcaaa

SEQ ID NO: 296315 - RNA, 19 nt, Homo sapiens
aggagacacuguucccaaa

SEQ ID NO: 296316 - RNA, 19 nt, Homo sapiens
caccagagugacuaugaua

SEQ ID NO: 296317 - RNA, 19 nt, Homo sapiens
gguccuaagcccacaauca

SEQ ID NO: 296318 - RNA, 19 nt, Homo sapiens
ccuucaagcugcugacuca

SEQ ID NO: 296319 - RNA, 19 nt, Homo sapiens
ggaagccgccuuugcaaaa

SEQ ID NO: 296320 - RNA, 19 nt, Homo sapiens
ccgcugaccuugcacaaac

SEQ ID NO: 296321 - RNA, 19 nt, Homo sapiens
cagcuccacaugcauagua

SEQ ID NO: 296322 - RNA, 19 nt, Homo sapiens
ugauuuacacugacuguug

SEQ ID NO: 296323 - RNA, 19 nt, Homo sapiens
gcugagaucacucgcuuca

SEQ ID NO: 296324 - RNA, 19 nt, Homo sapiens
aaucaugccucccuaagac

SEQ ID NO: 296325 - RNA, 19 nt, Homo sapiens
auggacaucugguugcuuu

SEQ ID NO: 296326 - RNA, 19 nt, Homo sapiens
uugaaaugcuuguaaagag

SEQ ID NO: 296327 - RNA, 19 nt, Homo sapiens
ccucaucuuuguucuccaa

SEQ ID NO: 296328 - RNA, 19 nt, Homo sapiens
gagacuguauccuguuugc

SEQ ID NO: 296329 - RNA, 19 nt, Homo sapiens
gguggugguuagagauaug

SEQ ID NO: 296330 - RNA, 19 nt, Homo sapiens
caucugcugccaugagaaa

SEQ ID NO: 296331 - RNA, 19 nt, Homo sapiens
agacuggguuccucuccaa

SEQ ID NO: 296332 - RNA, 19 nt, Homo sapiens
aguuggauuugucuguuua

SEQ ID NO: 296333 - RNA, 19 nt, Homo sapiens
uaguuggauuugucuguuu

SEQ ID NO: 296334 - RNA, 19 nt, Homo sapiens
cugaacauauacauagaug

SEQ ID NO: 296335 - RNA, 19 nt, Homo sapiens
ccauuuaaauugacuucag

SEQ ID NO: 296336 - RNA, 19 nt, Homo sapiens
uuacaacuccugcaucaca

SEQ ID NO: 296337 - RNA, 19 nt, Homo sapiens
uggaagccaugcugucugu

SEQ ID NO: 296338 - RNA, 19 nt, Homo sapiens
aaacuucugauuucucuuc

SEQ ID NO: 296339 - RNA, 19 nt, Homo sapiens
caaucaugccucccuaaga

SEQ ID NO: 296340 - RNA, 19 nt, Homo sapiens
gcuggcuugugaucuuaaa

SEQ ID NO: 296341 - RNA, 19 nt, Homo sapiens
caacaguuucggcugcauu

SEQ ID NO: 296342 - RNA, 19 nt, Homo sapiens
ggacaucuauugccuuuaa

SEQ ID NO: 296343 - RNA, 19 nt, Homo sapiens
gaccacagaucgauacgua

SEQ ID NO: 296344 - RNA, 19 nt, Homo sapiens
gaaguaugaugaaguuaug

SEQ ID NO: 296345 - RNA, 19 nt, Homo sapiens
ggaaauuaccguuuacaaa

SEQ ID NO: 296346 - RNA, 19 nt, Homo sapiens
ggaacaaauuggacacauu

SEQ ID NO: 296347 - RNA, 19 nt, Homo sapiens
gaagaccacuaguucaaug

SEQ ID NO: 296348 - RNA, 19 nt, Homo sapiens
guagagagguugcugugaa

SEQ ID NO: 296349 - RNA, 19 nt, Homo sapiens
gaauacauaugucugugaa

SEQ ID NO: 296350 - RNA, 19 nt, Homo sapiens
cagggaagauacauacaua

SEQ ID NO: 296351 - RNA, 19 nt, Homo sapiens
gaacuaaagccauauacug

SEQ ID NO: 296352 - RNA, 19 nt, Homo sapiens
gggaagauacauacauaua

SEQ ID NO: 296353 - RNA, 19 nt, Homo sapiens
ugaagguggugaaucguua

SEQ ID NO: 296354 - RNA, 19 nt, Homo sapiens
ccgaagcccucccucguua

SEQ ID NO: 296355 - RNA, 19 nt, Homo sapiens
gaagaacuaaagccauaua

SEQ ID NO: 296356 - RNA, 19 nt, Homo sapiens
aaagaucgauggaugaaug

SEQ ID NO: 296357 - RNA, 19 nt, Homo sapiens
acaaagauguggcucgaaa

SEQ ID NO: 296358 - RNA, 19 nt, Homo sapiens
ucagaaguaugaugaaguu

SEQ ID NO: 296359 - RNA, 19 nt, Homo sapiens
cauuggaaauuaccguuua

SEQ ID NO: 296360 - RNA, 19 nt, Homo sapiens
guacaguauugucaucaaa

SEQ ID NO: 296361 - RNA, 19 nt, Homo sapiens
ccacgacugucacuuaaug

SEQ ID NO: 296362 - RNA, 19 nt, Homo sapiens
cuaaugacaugaugagaga

SEQ ID NO: 296363 - RNA, 19 nt, Homo sapiens
gaaguacgaauaaugaaga

SEQ ID NO: 296364 - RNA, 19 nt, Homo sapiens
aggaagaacuaaagccaua

SEQ ID NO: 296365 - RNA, 19 nt, Homo sapiens
ggaagaggguaaagauucu

SEQ ID NO: 296366 - RNA, 19 nt, Homo sapiens
aaaaguagguucacaugua

SEQ ID NO: 296367 - RNA, 19 nt, Homo sapiens
aacgucaacugguauaaua

SEQ ID NO: 296368 - RNA, 19 nt, Homo sapiens
cuucaacuauuccaaguaa

SEQ ID NO: 296369 - RNA, 19 nt, Homo sapiens
cguauucccuucuauaugu

SEQ ID NO: 296370 - RNA, 19 nt, Homo sapiens
uaacugugauuaugagcaa

SEQ ID NO: 296371 - RNA, 19 nt, Homo sapiens
caacugguauaauaagcaa

SEQ ID NO: 296372 - RNA, 19 nt, Homo sapiens
caagaaggaauacauaugu

SEQ ID NO: 296373 - RNA, 19 nt, Homo sapiens
gcaagaaggaauacauaug

SEQ ID NO: 296374 - RNA, 19 nt, Homo sapiens
cgagaaguacgaauaauga

SEQ ID NO: 296375 - RNA, 19 nt, Homo sapiens
gcgaauaucugggacaucu

SEQ ID NO: 296376 - RNA, 19 nt, Homo sapiens
ggagguagcauggcaagaa

SEQ ID NO: 296377 - RNA, 19 nt, Homo sapiens
agaaguaucucagcaaauc

SEQ ID NO: 296378 - RNA, 19 nt, Homo sapiens
gaaagaggagugggacaaa

SEQ ID NO: 296379 - RNA, 19 nt, Homo sapiens
gaaagaggcccgugcaaaa

SEQ ID NO: 296380 - RNA, 19 nt, Homo sapiens
gaagaaugaaagagaaaga

SEQ ID NO: 296381 - RNA, 19 nt, Homo sapiens
caaguaacaauguguauuc

SEQ ID NO: 296382 - RNA, 19 nt, Homo sapiens
gaaaaccaccugaauuuga

SEQ ID NO: 296383 - RNA, 19 nt, Homo sapiens
agaagacucucuauuuagu

SEQ ID NO: 296384 - RNA, 19 nt, Homo sapiens
gaauaucugggacaucuau

SEQ ID NO: 296385 - RNA, 19 nt, Homo sapiens
gauggaagucugcaaguug

SEQ ID NO: 296386 - RNA, 19 nt, Homo sapiens
gaauguuggucaugaagag

SEQ ID NO: 296387 - RNA, 19 nt, Homo sapiens
gacuugagcucgcguacga

SEQ ID NO: 296388 - RNA, 19 nt, Homo sapiens
cgagggaaguaccguauuc

SEQ ID NO: 296389 - RNA, 19 nt, Homo sapiens
ggaaaagacagcagccuua

SEQ ID NO: 296390 - RNA, 19 nt, Homo sapiens
gcuaaauccuaccagucua

SEQ ID NO: 296391 - RNA, 19 nt, Homo sapiens
gaacagccucacauuggaa

SEQ ID NO: 296392 - RNA, 19 nt, Homo sapiens
gauacugaaucauccuaau

SEQ ID NO: 296393 - RNA, 19 nt, Homo sapiens
uagagagguugcugugaaa

SEQ ID NO: 296394 - RNA, 19 nt, Homo sapiens
caaauuggcaagacacguu

SEQ ID NO: 296395 - RNA, 19 nt, Homo sapiens
gaugaacagccucacauug

SEQ ID NO: 296396 - RNA, 19 nt, Homo sapiens
cauguagaauuugcccuua

SEQ ID NO: 296397 - RNA, 19 nt, Homo sapiens
cuaguucaauggacccuaa

SEQ ID NO: 296398 - RNA, 19 nt, Homo sapiens
gaaaggaccacagaucgau

SEQ ID NO: 296399 - RNA, 19 nt, Homo sapiens
ggaauacauaugucuguga

SEQ ID NO: 296400 - RNA, 19 nt, Homo sapiens
agaggcagcuuggaacaaa

SEQ ID NO: 296401 - RNA, 19 nt, Homo sapiens
gaaguaugaugggccugaa

SEQ ID NO: 296402 - RNA, 19 nt, Homo sapiens
uaucugcuguacaguauug

SEQ ID NO: 296403 - RNA, 19 nt, Homo sapiens
gcaagacacguucuaacug

SEQ ID NO: 296404 - RNA, 19 nt, Homo sapiens
caaggaagaggguaaagau

SEQ ID NO: 296405 - RNA, 19 nt, Homo sapiens
gaaccgacaccucaagaag

SEQ ID NO: 296406 - RNA, 19 nt, Homo sapiens
gaacgucaacugguauaau

SEQ ID NO: 296407 - RNA, 19 nt, Homo sapiens
uguggaaagugaacagaaa

SEQ ID NO: 296408 - RNA, 19 nt, Homo sapiens
cuaacaguguggaaaguga

SEQ ID NO: 296409 - RNA, 19 nt, Homo sapiens
auacgacuguggauggaua

SEQ ID NO: 296410 - RNA, 19 nt, Homo sapiens
caauagggaagggaaauuu

SEQ ID NO: 296411 - RNA, 19 nt, Homo sapiens
guacagguaaguauauugu

SEQ ID NO: 296412 - RNA, 19 nt, Homo sapiens
gaaaaguguuagaugcaaa

SEQ ID NO: 296413 - RNA, 19 nt, Homo sapiens
ccucguuacuguccgcaua

SEQ ID NO: 296414 - RNA, 19 nt, Homo sapiens
guaugaagaccacuaguuc

SEQ ID NO: 296415 - RNA, 19 nt, Homo sapiens
ccaugaaacgggugcauuu

SEQ ID NO: 296416 - RNA, 19 nt, Homo sapiens
uuacuuaguugcccaugga

SEQ ID NO: 296417 - RNA, 19 nt, Homo sapiens
ggggugaaguauuugauua

SEQ ID NO: 296418 - RNA, 19 nt, Homo sapiens
gaaguuauugaaacagaga

SEQ ID NO: 296419 - RNA, 19 nt, Homo sapiens
cgaauaaugaagauacuga

SEQ ID NO: 296420 - RNA, 19 nt, Homo sapiens
ugaacagccucacauugga

SEQ ID NO: 296421 - RNA, 19 nt, Homo sapiens
ucuauugccuuuaagaaca

SEQ ID NO: 296422 - RNA, 19 nt, Homo sapiens
accgacaccucaagaagua

SEQ ID NO: 296423 - RNA, 19 nt, Homo sapiens
ugggacaucuauugccuuu

SEQ ID NO: 296424 - RNA, 19 nt, Homo sapiens
ucacacugccaaccauuaa

SEQ ID NO: 296425 - RNA, 19 nt, Homo sapiens
aguggaaacuugugucaga

SEQ ID NO: 296426 - RNA, 19 nt, Homo sapiens
aaagagaggcagcuuggaa

SEQ ID NO: 296427 - RNA, 19 nt, Homo sapiens
acagguaaguauauugugu

SEQ ID NO: 296428 - RNA, 19 nt, Homo sapiens
guacugguaaugccuaaug

SEQ ID NO: 296429 - RNA, 19 nt, Homo sapiens
uguagaaacuccauuacgu

SEQ ID NO: 296430 - RNA, 19 nt, Homo sapiens
ugcacgagaugaaauaaau

SEQ ID NO: 296431 - RNA, 19 nt, Homo sapiens
ggauggauauacugaacca

SEQ ID NO: 296432 - RNA, 19 nt, Homo sapiens
guacgaauaaugaagauac

SEQ ID NO: 296433 - RNA, 19 nt, Homo sapiens
gagacaaggaagaggguaa

SEQ ID NO: 296434 - RNA, 19 nt, Homo sapiens
aaagacggcucugaagcuu

SEQ ID NO: 296435 - RNA, 19 nt, Homo sapiens
gagguagcauggcaagaag

SEQ ID NO: 296436 - RNA, 19 nt, Homo sapiens
gaucgauggaugaauguug

SEQ ID NO: 296437 - RNA, 19 nt, Homo sapiens
gagaaguacgaauaaugaa

SEQ ID NO: 296438 - RNA, 19 nt, Homo sapiens
aaaguagguucacauguac

SEQ ID NO: 296439 - RNA, 19 nt, Homo sapiens
ggacccuaaugacaugaug

SEQ ID NO: 296440 - RNA, 19 nt, Homo sapiens
ucgcagggauccaagugaa

SEQ ID NO: 296441 - RNA, 19 nt, Homo sapiens
ggauuucaaugacacaaaa

SEQ ID NO: 296442 - RNA, 19 nt, Homo sapiens
gcagagagguugcaauaaa

SEQ ID NO: 296443 - RNA, 19 nt, Homo sapiens
gaacauugcuugugugugu

SEQ ID NO: 296444 - RNA, 19 nt, Homo sapiens
gaacacugauggaaaugua

SEQ ID NO: 296445 - RNA, 19 nt, Homo sapiens
gaaauacgaugaaaucaca

SEQ ID NO: 296446 - RNA, 19 nt, Homo sapiens
ggaaugacacgacgaaaua

SEQ ID NO: 296447 - RNA, 19 nt, Homo sapiens
ugaagaagaugaacucaaa

SEQ ID NO: 296448 - RNA, 19 nt, Homo sapiens
gaaugacugcuaagaauua

SEQ ID NO: 296449 - RNA, 19 nt, Homo sapiens
uaagaccaguucauaguua

SEQ ID NO: 296450 - RNA, 19 nt, Homo sapiens
gaaguuaccucucguacca

SEQ ID NO: 296451 - RNA, 19 nt, Homo sapiens
cuaaguagauucacaagau

SEQ ID NO: 296452 - RNA, 19 nt, Homo sapiens
gaaguuauucgaagucauu

SEQ ID NO: 296453 - RNA, 19 nt, Homo sapiens
gcagugaucucaacaacag

SEQ ID NO: 296454 - RNA, 19 nt, Homo sapiens
gaacugagagagagaguau

SEQ ID NO: 296455 - RNA, 19 nt, Homo sapiens
aaucacagcuacauauuug

SEQ ID NO: 296456 - RNA, 19 nt, Homo sapiens
gaaaucacagcuacauauu

SEQ ID NO: 296457 - RNA, 19 nt, Homo sapiens
uaauacagguuuacaguuc

SEQ ID NO: 296458 - RNA, 19 nt, Homo sapiens
aagaugaacucaaaccauu

SEQ ID NO: 296459 - RNA, 19 nt, Homo sapiens
gcgguaaacucgacacguu

SEQ ID NO: 296460 - RNA, 19 nt, Homo sapiens
uuaaagaugugcaaccuau

SEQ ID NO: 296461 - RNA, 19 nt, Homo sapiens
gcaauaacgucugcaucuu

SEQ ID NO: 296462 - RNA, 19 nt, Homo sapiens
ggacauccauagccuucaa

SEQ ID NO: 296463 - RNA, 19 nt, Homo sapiens
ggaagcaucucccuacacu

SEQ ID NO: 296464 - RNA, 19 nt, Homo sapiens
gaugaaauacgaugaaauc

SEQ ID NO: 296465 - RNA, 19 nt, Homo sapiens
ggugcuaaauccaauuaaa

SEQ ID NO: 296466 - RNA, 19 nt, Homo sapiens
ggaaugcaaguaauccuaa

SEQ ID NO: 296467 - RNA, 19 nt, Homo sapiens
ggaaauccgcaaaguguug

SEQ ID NO: 296468 - RNA, 19 nt, Homo sapiens
gaccagcacugcagauagu

SEQ ID NO: 296469 - RNA, 19 nt, Homo sapiens
gaccagcuauuccuucugu

SEQ ID NO: 296470 - RNA, 19 nt, Homo sapiens
gaaaaccacuaguucaaug

SEQ ID NO: 296471 - RNA, 19 nt, Homo sapiens
cacaaggagucgcaaugua

SEQ ID NO: 296472 - RNA, 19 nt, Homo sapiens
ggaggaaaauacugaauga

SEQ ID NO: 296473 - RNA, 19 nt, Homo sapiens
gagaucauccggugcuaaa

SEQ ID NO: 296474 - RNA, 19 nt, Homo sapiens
guucaauacugccaucaga

SEQ ID NO: 296475 - RNA, 19 nt, Homo sapiens
auagugaccucaaagaaga

SEQ ID NO: 296476 - RNA, 19 nt, Homo sapiens
ugaaaucacagcuacauau

SEQ ID NO: 296477 - RNA, 19 nt, Homo sapiens
gcagagggagcgcuucuug

SEQ ID NO: 296478 - RNA, 19 nt, Homo sapiens
gccaauaacugcgacuaug

SEQ ID NO: 296479 - RNA, 19 nt, Homo sapiens
gacgaaauacuuauguuug

SEQ ID NO: 296480 - RNA, 19 nt, Homo sapiens
cgacgaaauacuuauguuu

SEQ ID NO: 296481 - RNA, 19 nt, Homo sapiens
ugacacgacgaaauacuua

SEQ ID NO: 296482 - RNA, 19 nt, Homo sapiens
aaugggauauucacaagaa

SEQ ID NO: 296483 - RNA, 19 nt, Homo sapiens
cgaauccgcuucccaagag

SEQ ID NO: 296484 - RNA, 19 nt, Homo sapiens
gcuagugauuccaguucua

SEQ ID NO: 296485 - RNA, 19 nt, Homo sapiens
gauugugucugcaguucaa

SEQ ID NO: 296486 - RNA, 19 nt, Homo sapiens
aaacagcacuauuccugau

SEQ ID NO: 296487 - RNA, 19 nt, Homo sapiens
gcaaguaauccuaauaagg

SEQ ID NO: 296488 - RNA, 19 nt, Homo sapiens
gaaugcaaguaauccuaau

SEQ ID NO: 296489 - RNA, 19 nt, Homo sapiens
ccucaaagaagauggaauu

SEQ ID NO: 296490 - RNA, 19 nt, Homo sapiens
gagcagugaucucaacaac

SEQ ID NO: 296491 - RNA, 19 nt, Homo sapiens
gaagaugaacucaaaccau

SEQ ID NO: 296492 - RNA, 19 nt, Homo sapiens
gaccaguucauaguuaaua

SEQ ID NO: 296493 - RNA, 19 nt, Homo sapiens
cugaaugacugcuaagaau

SEQ ID NO: 296494 - RNA, 19 nt, Homo sapiens
ugugugaagugguguauau

SEQ ID NO: 296495 - RNA, 19 nt, Homo sapiens
uaacgucugcaucuucuaa

SEQ ID NO: 296496 - RNA, 19 nt, Homo sapiens
ccugaacacugauggaaau

SEQ ID NO: 296497 - RNA, 19 nt, Homo sapiens
ccaauaacugcgacuauga

SEQ ID NO: 296498 - RNA, 19 nt, Homo sapiens
gcagugcuguuggaggaaa

SEQ ID NO: 296499 - RNA, 19 nt, Homo sapiens
agagggaaauacagaauuc

SEQ ID NO: 296500 - RNA, 19 nt, Homo sapiens
gauagugaccucaaagaag

SEQ ID NO: 296501 - RNA, 19 nt, Homo sapiens
uagcagcaaucuuucacuu

SEQ ID NO: 296502 - RNA, 19 nt, Homo sapiens
cuagacaucucagaccaaa

SEQ ID NO: 296503 - RNA, 19 nt, Homo sapiens
uagagcaaaucaugaagga

SEQ ID NO: 296504 - RNA, 19 nt, Homo sapiens
gagagagagaguauuaaga

SEQ ID NO: 296505 - RNA, 19 nt, Homo sapiens
ggagcucgguguagaaacu

SEQ ID NO: 296506 - RNA, 19 nt, Homo sapiens
gagaguggacgguaugugu

SEQ ID NO: 296507 - RNA, 19 nt, Homo sapiens
gagaugggcacgcggagaa

SEQ ID NO: 296508 - RNA, 19 nt, Homo sapiens
cggcgaaccgcaacauaua

SEQ ID NO: 296509 - RNA, 19 nt, Homo sapiens
caacacacaguaucaguag

SEQ ID NO: 296510 - RNA, 19 nt, Homo sapiens
auacuuauguuugcaguga

SEQ ID NO: 296511 - RNA, 19 nt, Homo sapiens
gggagggaguggagaagga

SEQ ID NO: 296512 - RNA, 19 nt, Homo sapiens
ggcaagacauauccuuaca

SEQ ID NO: 296513 - RNA, 19 nt, Homo sapiens
ggagaugggcgucaagaag

SEQ ID NO: 296514 - RNA, 19 nt, Homo sapiens
gugaagugguguauaugga

SEQ ID NO: 296515 - RNA, 19 nt, Homo sapiens
gggcugugcuguuuuguuu

SEQ ID NO: 296516 - RNA, 19 nt, Homo sapiens
cacagcaucugguggaaug

SEQ ID NO: 296517 - RNA, 19 nt, Homo sapiens
ugaaugaacgagacacuga

SEQ ID NO: 296518 - RNA, 19 nt, Homo sapiens
gaaauaugacgggccagaa

SEQ ID NO: 296519 - RNA, 19 nt, Homo sapiens
gcaguaaaauguccacuag

SEQ ID NO: 296520 - RNA, 19 nt, Homo sapiens
ccaugaagccacaccauug

SEQ ID NO: 296521 - RNA, 19 nt, Homo sapiens
acugagagagagaguauua

SEQ ID NO: 296522 - RNA, 19 nt, Homo sapiens
ucaauacugccaucagaaa

SEQ ID NO: 296523 - RNA, 19 nt, Homo sapiens
gcuguaacccagugauuau

SEQ ID NO: 296524 - RNA, 19 nt, Homo sapiens
aaggacagguggaucaaug

SEQ ID NO: 296525 - RNA, 19 nt, Homo sapiens
ccucaaggcugaaaaucua

SEQ ID NO: 296526 - RNA, 19 nt, Homo sapiens
aggcagagagguugcaaua

SEQ ID NO: 296527 - RNA, 19 nt, Homo sapiens
gagaugggcgucaagaagu

SEQ ID NO: 296528 - RNA, 19 nt, Homo sapiens
ccagucuccucaccacaaa

SEQ ID NO: 296529 - RNA, 19 nt, Homo sapiens
caagaaguuaccucucgua

SEQ ID NO: 296530 - RNA, 19 nt, Homo sapiens
gcgcuccacuuccuucaca

SEQ ID NO: 296531 - RNA, 19 nt, Homo sapiens
aauacugaaugacugcuaa

SEQ ID NO: 296532 - RNA, 19 nt, Homo sapiens
acaaggagucgcaauguau

SEQ ID NO: 296533 - RNA, 19 nt, Homo sapiens
gaaccgcaacauauaaugg

SEQ ID NO: 296534 - RNA, 19 nt, Homo sapiens
gggaaugcaaguaauccua

SEQ ID NO: 296535 - RNA, 19 nt, Homo sapiens
gaaugaacgagacacugaa

SEQ ID NO: 296536 - RNA, 19 nt, Homo sapiens
aagaccaguucauaguuaa

SEQ ID NO: 296537 - RNA, 19 nt, Homo sapiens
ucaacacacaguaucagua

SEQ ID NO: 296538 - RNA, 19 nt, Homo sapiens
guggcucacuucccuuuga

SEQ ID NO: 296539 - RNA, 19 nt, Homo sapiens
agcaaugaauuuacuguug

SEQ ID NO: 296540 - RNA, 19 nt, Homo sapiens
ugaaugacugcuaagaauu

SEQ ID NO: 296541 - RNA, 19 nt, Homo sapiens
caauaacgucugcaucuuc

SEQ ID NO: 296542 - RNA, 19 nt, Homo sapiens
cagaguaccugaacuauga

SEQ ID NO: 296543 - RNA, 19 nt, Homo sapiens
gaagggcugucaccaauga

SEQ ID NO: 296544 - RNA, 19 nt, Homo sapiens
ggacggaccugcugcugaa

SEQ ID NO: 296545 - RNA, 19 nt, Homo sapiens
gaugggaaauucucuaaga

SEQ ID NO: 296546 - RNA, 19 nt, Homo sapiens
gcgaaacucuuggaucuaa

SEQ ID NO: 296547 - RNA, 19 nt, Homo sapiens
uuaagaagccucaguguaa

SEQ ID NO: 296548 - RNA, 19 nt, Homo sapiens
gguauucuaugucugguuu

SEQ ID NO: 296549 - RNA, 19 nt, Homo sapiens
uaaaagaccuuggcucaua

SEQ ID NO: 296550 - RNA, 19 nt, Homo sapiens
uacaagcgcugauggauga

SEQ ID NO: 296551 - RNA, 19 nt, Homo sapiens
cgacauggcaaccaauaua

SEQ ID NO: 296552 - RNA, 19 nt, Homo sapiens
gggaagggcugucaccaau

SEQ ID NO: 296553 - RNA, 19 nt, Homo sapiens
gagaagggccuagaaaguu

SEQ ID NO: 296554 - RNA, 19 nt, Homo sapiens
gaccuuggcucauagaaag

SEQ ID NO: 296555 - RNA, 19 nt, Homo sapiens
gguuuaacauuucguuuga

SEQ ID NO: 296556 - RNA, 19 nt, Homo sapiens
uaagaagccucaguguaaa

SEQ ID NO: 296557 - RNA, 19 nt, Homo sapiens
gcucagugccgaugucuuu

SEQ ID NO: 296558 - RNA, 19 nt, Homo sapiens
agaagggccuagaaaguuu

SEQ ID NO: 296559 - RNA, 19 nt, Homo sapiens
ucaaugcugucgagcuuaa

SEQ ID NO: 296560 - RNA, 19 nt, Homo sapiens
ggagagcccugacucacau

SEQ ID NO: 296561 - RNA, 19 nt, Homo sapiens
cugcugcccuguacuauuu

SEQ ID NO: 296562 - RNA, 19 nt, Homo sapiens
ugaccagauugaaaguuua

SEQ ID NO: 296563 - RNA, 19 nt, Homo sapiens
gauagggacaguaauaaau

SEQ ID NO: 296564 - RNA, 19 nt, Homo sapiens
gaaaaugaccagauugaaa

SEQ ID NO: 296565 - RNA, 19 nt, Homo sapiens
caucaaugcugucgagcuu

SEQ ID NO: 296566 - RNA, 19 nt, Homo sapiens
gaaaggaaugugcucauca

SEQ ID NO: 296567 - RNA, 19 nt, Homo sapiens
gcugauggaugaagugaca

SEQ ID NO: 296568 - RNA, 19 nt, Homo sapiens
gcaguauccucaccauauc

SEQ ID NO: 296569 - RNA, 19 nt, Homo sapiens
ggagaagggccuagaaagu

SEQ ID NO: 296570 - RNA, 19 nt, Homo sapiens
uaauagauagggacaguaa

SEQ ID NO: 296571 - RNA, 19 nt, Homo sapiens
ggauguuugugucuaaguu

SEQ ID NO: 296572 - RNA, 19 nt, Homo sapiens
gaacuaugaggaugggaaa

SEQ ID NO: 296573 - RNA, 19 nt, Homo sapiens
ugacaaacuuccuguguac

SEQ ID NO: 296574 - RNA, 19 nt, Homo sapiens
cgggaugccuugcgcagua

SEQ ID NO: 296575 - RNA, 19 nt, Homo sapiens
gagcugaggauaacuauac

SEQ ID NO: 296576 - RNA, 19 nt, Homo sapiens
gaagacaagguauucuaug

SEQ ID NO: 296577 - RNA, 19 nt, Homo sapiens
ggagcuggcuacccuaucu

SEQ ID NO: 296578 - RNA, 19 nt, Homo sapiens
auucugagcugcuuaacaa

SEQ ID NO: 296579 - RNA, 19 nt, Homo sapiens
ggaagaacccagagcaagu

SEQ ID NO: 296580 - RNA, 19 nt, Homo sapiens
gcaagauacuguggagcaa

SEQ ID NO: 296581 - RNA, 19 nt, Homo sapiens
ggagcaagaugaccucacu

SEQ ID NO: 296582 - RNA, 19 nt, Homo sapiens
gaccugcugcugaagaaua

SEQ ID NO: 296583 - RNA, 19 nt, Homo sapiens
cuacagaguaccugaacua

SEQ ID NO: 296584 - RNA, 19 nt, Homo sapiens
gacaauguuccuuuccaua

SEQ ID NO: 296585 - RNA, 19 nt, Homo sapiens
ugggagagaugguggaaga

SEQ ID NO: 296586 - RNA, 19 nt, Homo sapiens
ggagauugcuauggcuguu

SEQ ID NO: 296587 - RNA, 19 nt, Homo sapiens
ggagguggcgaaacucuug

SEQ ID NO: 296588 - RNA, 19 nt, Homo sapiens
ggaccuguaucaguucaug

SEQ ID NO: 296589 - RNA, 19 nt, Homo sapiens
cagagcaaguggaccugua

SEQ ID NO: 296590 - RNA, 19 nt, Homo sapiens
caucauccaugcugacauc

SEQ ID NO: 296591 - RNA, 19 nt, Homo sapiens
auagauagggacaguaaua

SEQ ID NO: 296592 - RNA, 19 nt, Homo sapiens
gaccagauugaaaguuuaa

SEQ ID NO: 296593 - RNA, 19 nt, Homo sapiens
cugacaaacuuccugugua

SEQ ID NO: 296594 - RNA, 19 nt, Homo sapiens
gaagaacccagagcaagug

SEQ ID NO: 296595 - RNA, 19 nt, Homo sapiens
ugacaucuaccgcugguuu

SEQ ID NO: 296596 - RNA, 19 nt, Homo sapiens
gucagucccuuguuccaaa

SEQ ID NO: 296597 - RNA, 19 nt, Homo sapiens
aagacaagguauucuaugu

SEQ ID NO: 296598 - RNA, 19 nt, Homo sapiens
gggaaccccuguacccuua

SEQ ID NO: 296599 - RNA, 19 nt, Homo sapiens
aagaugaccucacuaacca

SEQ ID NO: 296600 - RNA, 19 nt, Homo sapiens
ggccuaaggucccugucuu

SEQ ID NO: 296601 - RNA, 19 nt, Homo sapiens
ccagcagaauccaguguug

SEQ ID NO: 296602 - RNA, 19 nt, Homo sapiens
ugcagagacuguacugaaa

SEQ ID NO: 296603 - RNA, 19 nt, Homo sapiens
gacacccaaugcccaguuu

SEQ ID NO: 296604 - RNA, 19 nt, Homo sapiens
guggcaagcucaucaaugc

SEQ ID NO: 296605 - RNA, 19 nt, Homo sapiens
gggcgugugucccuucugu

SEQ ID NO: 296606 - RNA, 19 nt, Homo sapiens
uggcgaaacucuuggaucu

SEQ ID NO: 296607 - RNA, 19 nt, Homo sapiens
gaagccagcaguuguagag

SEQ ID NO: 296608 - RNA, 19 nt, Homo sapiens
guucauggccaaagacaau

SEQ ID NO: 296609 - RNA, 19 nt, Homo sapiens
caggagaucugcgacaagu

SEQ ID NO: 296610 - RNA, 19 nt, Homo sapiens
cgaaacucuuggaucuaaa

SEQ ID NO: 296611 - RNA, 19 nt, Homo sapiens
aaacuuccuguguaccuua

SEQ ID NO: 296612 - RNA, 19 nt, Homo sapiens
caacgggcaggaacaguga

SEQ ID NO: 296613 - RNA, 19 nt, Homo sapiens
ccagcacuaucaccagcua

SEQ ID NO: 296614 - RNA, 19 nt, Homo sapiens
gcugacaucuggcgcuucu

SEQ ID NO: 296615 - RNA, 19 nt, Homo sapiens
aaguggaccuguaucaguu

SEQ ID NO: 296616 - RNA, 19 nt, Homo sapiens
ggagaucugcgacaaguac

SEQ ID NO: 296617 - RNA, 19 nt, Homo sapiens
gacauggcaaccaauauau

SEQ ID NO: 296618 - RNA, 19 nt, Homo sapiens
gcugggauguuugugucua

SEQ ID NO: 296619 - RNA, 19 nt, Homo sapiens
gcuucuaucugcuguacau

SEQ ID NO: 296620 - RNA, 19 nt, Homo sapiens
caaguggaccuguaucagu

SEQ ID NO: 296621 - RNA, 19 nt, Homo sapiens
gacaucuaccgcugguuua

SEQ ID NO: 296622 - RNA, 19 nt, Homo sapiens
cgacaaguaccacaucauc

SEQ ID NO: 296623 - RNA, 19 nt, Homo sapiens
cagaaucucuagccgacau

SEQ ID NO: 296624 - RNA, 19 nt, Homo sapiens
cgucagaacuguccuuucc

SEQ ID NO: 296625 - RNA, 19 nt, Homo sapiens
uuaacaaccugggcaacuu

SEQ ID NO: 296626 - RNA, 19 nt, Homo sapiens
caucacagccaacuacaca

SEQ ID NO: 296627 - RNA, 19 nt, Homo sapiens
ucccuuacgucaacaaugu

SEQ ID NO: 296628 - RNA, 19 nt, Homo sapiens
gagauugcuauggcuguua

SEQ ID NO: 296629 - RNA, 19 nt, Homo sapiens
cagagacuguacugaaaca

SEQ ID NO: 296630 - RNA, 19 nt, Homo sapiens
gcagauacaagcgcugaug

SEQ ID NO: 296631 - RNA, 19 nt, Homo sapiens
gcacagucagucccuuguu

SEQ ID NO: 296632 - RNA, 19 nt, Homo sapiens
agugcaaucugccgauauu

SEQ ID NO: 296633 - RNA, 19 nt, Homo sapiens
ugaccagugugacaagugu

SEQ ID NO: 296634 - RNA, 19 nt, Homo sapiens
uagauagggacaguaauaa

SEQ ID NO: 296635 - RNA, 19 nt, Homo sapiens
gaaacucuuggaucuaaag

SEQ ID NO: 296636 - RNA, 19 nt, Homo sapiens
augaccagauugaaaguuu

SEQ ID NO: 296637 - RNA, 19 nt, Homo sapiens
caaacuuccuguguaccuu

SEQ ID NO: 296638 - RNA, 19 nt, Homo sapiens
ggacacccaaugcccaguu

SEQ ID NO: 296639 - RNA, 19 nt, Homo sapiens
uguaaagucugccgaucau

SEQ ID NO: 296640 - RNA, 19 nt, Homo sapiens
uaccgcugguuuaacauuu

SEQ ID NO: 296641 - RNA, 19 nt, Homo sapiens
ggaacaucauugguugugu

SEQ ID NO: 296642 - RNA, 19 nt, Homo sapiens
ucacugcucuucuguauuu

SEQ ID NO: 296643 - RNA, 19 nt, Homo sapiens
cuacacaauugucacauua

SEQ ID NO: 296644 - RNA, 19 nt, Homo sapiens
cgacuaugcuuuagauuau

SEQ ID NO: 296645 - RNA, 19 nt, Homo sapiens
guaauacggucacaguuga

SEQ ID NO: 296646 - RNA, 19 nt, Homo sapiens
gaacaucucaucccauaug

SEQ ID NO: 296647 - RNA, 19 nt, Homo sapiens
aagaacaucucaucccaua

SEQ ID NO: 296648 - RNA, 19 nt, Homo sapiens
ugagggaaguuguggauaa

SEQ ID NO: 296649 - RNA, 19 nt, Homo sapiens
gcgccaacccuuucauuua

SEQ ID NO: 296650 - RNA, 19 nt, Homo sapiens
ugacuuaaguaucuccuaa

SEQ ID NO: 296651 - RNA, 19 nt, Homo sapiens
gcaguaagaagaagagauu

SEQ ID NO: 296652 - RNA, 19 nt, Homo sapiens
gagcagucaucaucuuuau

SEQ ID NO: 296653 - RNA, 19 nt, Homo sapiens
gaaagacaauuguaauacg

SEQ ID NO: 296654 - RNA, 19 nt, Homo sapiens
gaaaucccuucacugucua

SEQ ID NO: 296655 - RNA, 19 nt, Homo sapiens
gagggaaguuguggauaaa

SEQ ID NO: 296656 - RNA, 19 nt, Homo sapiens
ugacaucauuuguuguuga

SEQ ID NO: 296657 - RNA, 19 nt, Homo sapiens
ggccauuacuacacaauug

SEQ ID NO: 296658 - RNA, 19 nt, Homo sapiens
caucuugucuaucgacuau

SEQ ID NO: 296659 - RNA, 19 nt, Homo sapiens
gcagucaucaucuuuauag

SEQ ID NO: 296660 - RNA, 19 nt, Homo sapiens
gugcuuggaauaugacuua

SEQ ID NO: 296661 - RNA, 19 nt, Homo sapiens
agaaaucccuucacugucu

SEQ ID NO: 296662 - RNA, 19 nt, Homo sapiens
ccuccaagcuuuacauagu

SEQ ID NO: 296663 - RNA, 19 nt, Homo sapiens
ccauaugcaugagauacua

SEQ ID NO: 296664 - RNA, 19 nt, Homo sapiens
gaguauuggucgaccuuug

SEQ ID NO: 296665 - RNA, 19 nt, Homo sapiens
ccaaguaccagucggcauu

SEQ ID NO: 296666 - RNA, 19 nt, Homo sapiens
gaaugcacaucggcaaauc

SEQ ID NO: 296667 - RNA, 19 nt, Homo sapiens
gccagaaagacaauuguaa

SEQ ID NO: 296668 - RNA, 19 nt, Homo sapiens
cgacagagaagaagagagu

SEQ ID NO: 296669 - RNA, 19 nt, Homo sapiens
ucgacuaugcuuuagauua

SEQ ID NO: 296670 - RNA, 19 nt, Homo sapiens
ggaauaugacuuaaguauc

SEQ ID NO: 296671 - RNA, 19 nt, Homo sapiens
ccagaaagacaauuguaau

SEQ ID NO: 296672 - RNA, 19 nt, Homo sapiens
gugaagauccggaagaaca

SEQ ID NO: 296673 - RNA, 19 nt, Homo sapiens
uaucgacuaugcuuuagau

SEQ ID NO: 296674 - RNA, 19 nt, Homo sapiens
ucucacugcucuucuguau

SEQ ID NO: 296675 - RNA, 19 nt, Homo sapiens
aaacgugacaucauuuguu

SEQ ID NO: 296676 - RNA, 19 nt, Homo sapiens
ugaccaccauggaguaugu

SEQ ID NO: 296677 - RNA, 19 nt, Homo sapiens
cgagcagucaucaucuuua

SEQ ID NO: 296678 - RNA, 19 nt, Homo sapiens
acacaauugucacauuauc

SEQ ID NO: 296679 - RNA, 19 nt, Homo sapiens
guaagaagaagagauucaa

SEQ ID NO: 296680 - RNA, 19 nt, Homo sapiens
aacgugacaucauuuguug

SEQ ID NO: 296681 - RNA, 19 nt, Homo sapiens
ggaagcaguaagaagaaga

SEQ ID NO: 296682 - RNA, 19 nt, Homo sapiens
gugggaagcaguaagaaga

SEQ ID NO: 296683 - RNA, 19 nt, Homo sapiens
uccuuuaccugcuguacua

SEQ ID NO: 296684 - RNA, 19 nt, Homo sapiens
gugcaucgacagagaagaa

SEQ ID NO: 296685 - RNA, 19 nt, Homo sapiens
cuacaacacgggccucuau

SEQ ID NO: 296686 - RNA, 19 nt, Homo sapiens
ggaaugcacaucggcaaau

SEQ ID NO: 296687 - RNA, 19 nt, Homo sapiens
uaagaacugugagggaagu

SEQ ID NO: 296688 - RNA, 19 nt, Homo sapiens
cgccaacccuuucauuuac

SEQ ID NO: 296689 - RNA, 19 nt, Homo sapiens
gaacgccucagucgggaau

SEQ ID NO: 296690 - RNA, 19 nt, Homo sapiens
cuaaaugugauacagaaga

SEQ ID NO: 296691 - RNA, 19 nt, Homo sapiens
guuugugcuuggaauauga

SEQ ID NO: 296692 - RNA, 19 nt, Homo sapiens
gggaaccuacaccacauuu

SEQ ID NO: 296693 - RNA, 19 nt, Homo sapiens
ucccauuccuccaagcuuu

SEQ ID NO: 296694 - RNA, 19 nt, Homo sapiens
gucuaucgacuaugcuuua

SEQ ID NO: 296695 - RNA, 19 nt, Homo sapiens
cuuggaauaugacuuaagu

SEQ ID NO: 296696 - RNA, 19 nt, Homo sapiens
gaaccuacaccacauuucc

SEQ ID NO: 296697 - RNA, 19 nt, Homo sapiens
aaguaucuccuaaauguga

SEQ ID NO: 296698 - RNA, 19 nt, Homo sapiens
uguaauacggucacaguug

SEQ ID NO: 296699 - RNA, 19 nt, Homo sapiens
agaagaagagauucaagga

SEQ ID NO: 296700 - RNA, 19 nt, Homo sapiens
ccaacccuuucauuuacuu

SEQ ID NO: 296701 - RNA, 19 nt, Homo sapiens
gccgagcagucaucaucuu

SEQ ID NO: 296702 - RNA, 19 nt, Homo sapiens
ucaugugcaucgacagaga

SEQ ID NO: 296703 - RNA, 19 nt, Homo sapiens
caacacgggccucuaucug

SEQ ID NO: 296704 - RNA, 19 nt, Homo sapiens
uccuaaaugugauacagaa

SEQ ID NO: 296705 - RNA, 19 nt, Homo sapiens
gacaucauuuguuguugag

SEQ ID NO: 296706 - RNA, 19 nt, Homo sapiens
acuacacaauugucacauu

SEQ ID NO: 296707 - RNA, 19 nt, Homo sapiens
cuacaucacccaccugucu

SEQ ID NO: 296708 - RNA, 19 nt, Homo sapiens
uagauuaugagcuuucuuc

SEQ ID NO: 296709 - RNA, 19 nt, Homo sapiens
gggaaugcacaucggcaaa

SEQ ID NO: 296710 - RNA, 19 nt, Homo sapiens
caucccauaugcaugagau

SEQ ID NO: 296711 - RNA, 19 nt, Homo sapiens
gaggaacccacgaacaucu

SEQ ID NO: 296712 - RNA, 19 nt, Homo sapiens
uuuaccugcuguacuauga

SEQ ID NO: 296713 - RNA, 19 nt, Homo sapiens
gggaagcaguaagaagaag

SEQ ID NO: 296714 - RNA, 19 nt, Homo sapiens
ccacauuucccugcucuuc

SEQ ID NO: 296715 - RNA, 19 nt, Homo sapiens
cauuauauuccucaucuuc

SEQ ID NO: 296716 - RNA, 19 nt, Homo sapiens
uggaguaugucaugugcau

SEQ ID NO: 296717 - RNA, 19 nt, Homo sapiens
ugugggcucuuucuugcuu

SEQ ID NO: 296718 - RNA, 19 nt, Homo sapiens
cgugacaucauuuguuguu

SEQ ID NO: 296719 - RNA, 19 nt, Homo sapiens
gaagcaguaagaagaagag

SEQ ID NO: 296720 - RNA, 19 nt, Homo sapiens
gagcuuucuucuggccauu

SEQ ID NO: 296721 - RNA, 19 nt, Homo sapiens
gacuaugcuuuagauuaug

SEQ ID NO: 296722 - RNA, 19 nt, Homo sapiens
gguggaacacaggucauuu

SEQ ID NO: 296723 - RNA, 19 nt, Homo sapiens
ggucaccaucauuauauuc

SEQ ID NO: 296724 - RNA, 19 nt, Homo sapiens
ucgugaagauccggaagaa

SEQ ID NO: 296725 - RNA, 19 nt, Homo sapiens
ucccuucacugucuacauc

SEQ ID NO: 296726 - RNA, 19 nt, Homo sapiens
caucucaucccauaugcau

SEQ ID NO: 296727 - RNA, 19 nt, Homo sapiens
gacuuaaguaucuccuaaa

SEQ ID NO: 296728 - RNA, 19 nt, Homo sapiens
gggcuucccauuccuccaa

SEQ ID NO: 296729 - RNA, 19 nt, Homo sapiens
uuauagccauccugagcuu

SEQ ID NO: 296730 - RNA, 19 nt, Homo sapiens
gauuaugagcuuucuucug

SEQ ID NO: 296731 - RNA, 19 nt, Homo sapiens
ugcuuuagauuaugagcuu

SEQ ID NO: 296732 - RNA, 19 nt, Homo sapiens
cauaugcaugagauacuaa

SEQ ID NO: 296733 - RNA, 19 nt, Homo sapiens
cccuuucauuuacuucuuu

SEQ ID NO: 296734 - RNA, 19 nt, Homo sapiens
ucccugcucuucuccacaa

SEQ ID NO: 296735 - RNA, 19 nt, Homo sapiens
ccaugagacuccuuuaccu

SEQ ID NO: 296736 - RNA, 19 nt, Homo sapiens
uuccugugcuuccggauga

SEQ ID NO: 296737 - RNA, 19 nt, Homo sapiens
cgccagaaagacaauugua

SEQ ID NO: 296738 - RNA, 19 nt, Homo sapiens
ccgagcagucaucaucuuu

SEQ ID NO: 296739 - RNA, 19 nt, Homo sapiens
ggaacccacgaacaucuca

SEQ ID NO: 296740 - RNA, 19 nt, Homo sapiens
ucuccacaaucaacaguag

SEQ ID NO: 296741 - RNA, 19 nt, Homo sapiens
cugcucuucuccacaauca

SEQ ID NO: 296742 - RNA, 19 nt, Homo sapiens
gcuaauaacugaucucguu

SEQ ID NO: 296743 - RNA, 19 nt, Homo sapiens
caaagcagauucagaaaug

SEQ ID NO: 296744 - RNA, 19 nt, Homo sapiens
ggacccagcuaauaacuga

SEQ ID NO: 296745 - RNA, 19 nt, Homo sapiens
ggacugaccagcagcuuua

SEQ ID NO: 296746 - RNA, 19 nt, Homo sapiens
ccaggaagcuuguauuuua

SEQ ID NO: 296747 - RNA, 19 nt, Homo sapiens
gagguuggaucuugaugua

SEQ ID NO: 296748 - RNA, 19 nt, Homo sapiens
ccaaguaccuggacgaaga

SEQ ID NO: 296749 - RNA, 19 nt, Homo sapiens
guaacaggcucaaacaaug

SEQ ID NO: 296750 - RNA, 19 nt, Homo sapiens
agaccuagauguauaacua

SEQ ID NO: 296751 - RNA, 19 nt, Homo sapiens
gcaacgugcugguggcuuu

SEQ ID NO: 296752 - RNA, 19 nt, Homo sapiens
guuaauaguuccugcuaaa

SEQ ID NO: 296753 - RNA, 19 nt, Homo sapiens
ucagagacaugcagagauu

SEQ ID NO: 296754 - RNA, 19 nt, Homo sapiens
gcaauugucugaaaaguga

SEQ ID NO: 296755 - RNA, 19 nt, Homo sapiens
ugacaaagcagauucagaa

SEQ ID NO: 296756 - RNA, 19 nt, Homo sapiens
gaacuugccugccuuucca

SEQ ID NO: 296757 - RNA, 19 nt, Homo sapiens
gcuaaggucuuggaacuug

SEQ ID NO: 296758 - RNA, 19 nt, Homo sapiens
ggacagaaaugaggaggau

SEQ ID NO: 296759 - RNA, 19 nt, Homo sapiens
gcaacaugaugagguagua

SEQ ID NO: 296760 - RNA, 19 nt, Homo sapiens
ggacuuggccucucucuag

SEQ ID NO: 296761 - RNA, 19 nt, Homo sapiens
guuuagaccuagauguaua

SEQ ID NO: 296762 - RNA, 19 nt, Homo sapiens
ggacugaugucuccuaagc

SEQ ID NO: 296763 - RNA, 19 nt, Homo sapiens
gagccagggucuccagaaa

SEQ ID NO: 296764 - RNA, 19 nt, Homo sapiens
ccacagggcuauuuuguuu

SEQ ID NO: 296765 - RNA, 19 nt, Homo sapiens
ggccugagguuacuggaaa

SEQ ID NO: 296766 - RNA, 19 nt, Homo sapiens
ccuauggccucauguuaaa

SEQ ID NO: 296767 - RNA, 19 nt, Homo sapiens
cgagggacccagcuaauaa

SEQ ID NO: 296768 - RNA, 19 nt, Homo sapiens
ggagaagugugagaagaug

SEQ ID NO: 296769 - RNA, 19 nt, Homo sapiens
gagcagaagcagcaacuug

SEQ ID NO: 296770 - RNA, 19 nt, Homo sapiens
ccucaagucuuucucuuuc

SEQ ID NO: 296771 - RNA, 19 nt, Homo sapiens
gaaccucucagaagacaga

SEQ ID NO: 296772 - RNA, 19 nt, Homo sapiens
gaaggacuacaccaaggua

SEQ ID NO: 296773 - RNA, 19 nt, Homo sapiens
gagcagcaauccccagaua

SEQ ID NO: 296774 - RNA, 19 nt, Homo sapiens
ggagagggacacccggaua

SEQ ID NO: 296775 - RNA, 19 nt, Homo sapiens
ggaaagcaaagcacagaga

SEQ ID NO: 296776 - RNA, 19 nt, Homo sapiens
ccaggucccucucauuuag

SEQ ID NO: 296777 - RNA, 19 nt, Homo sapiens
ggccaagucucuggugaaa

SEQ ID NO: 296778 - RNA, 19 nt, Homo sapiens
gagagggacacccggauaa

SEQ ID NO: 296779 - RNA, 19 nt, Homo sapiens
gggcuugccuucugguguu

SEQ ID NO: 296780 - RNA, 19 nt, Homo sapiens
gagagugcuuguccagguu

SEQ ID NO: 296781 - RNA, 19 nt, Homo sapiens
gcgagggacccagcuaaua

SEQ ID NO: 296782 - RNA, 19 nt, Homo sapiens
uaacaggcucaaacaauga

SEQ ID NO: 296783 - RNA, 19 nt, Homo sapiens
ccaagucucuggugaaagc

SEQ ID NO: 296784 - RNA, 19 nt, Homo sapiens
gucacuggccguaagauua

SEQ ID NO: 296785 - RNA, 19 nt, Homo sapiens
caauggccaugguggacua

SEQ ID NO: 296786 - RNA, 19 nt, Homo sapiens
gccaagggcuuugacuuca

SEQ ID NO: 296787 - RNA, 19 nt, Homo sapiens
ccuacccucuagagaaaua

SEQ ID NO: 296788 - RNA, 19 nt, Homo sapiens
uggcuuaccuggcccauca

SEQ ID NO: 296789 - RNA, 19 nt, Homo sapiens
uuucuucacugcaacauga

SEQ ID NO: 296790 - RNA, 19 nt, Homo sapiens
gcaaagucacagccucaaa

SEQ ID NO: 296791 - RNA, 19 nt, Homo sapiens
gggcaauguuaauuuagug

SEQ ID NO: 296792 - RNA, 19 nt, Homo sapiens
ugaagaagcccaucuacca

SEQ ID NO: 296793 - RNA, 19 nt, Homo sapiens
ucagggauuuggacuugaa

SEQ ID NO: 296794 - RNA, 19 nt, Homo sapiens
ccauuuccaucuucaccua

SEQ ID NO: 296795 - RNA, 19 nt, Homo sapiens
ucucucaggugaaaggaaa

SEQ ID NO: 296796 - RNA, 19 nt, Homo sapiens
ggacaauggcgcagucauc

SEQ ID NO: 296797 - RNA, 19 nt, Homo sapiens
agacucaggugacaguuca

SEQ ID NO: 296798 - RNA, 19 nt, Homo sapiens
augaggagauucugccuuu

SEQ ID NO: 296799 - RNA, 19 nt, Homo sapiens
caacuuguccuagcacaga

SEQ ID NO: 296800 - RNA, 19 nt, Homo sapiens
gcagcaacuuguccuagca

SEQ ID NO: 296801 - RNA, 19 nt, Homo sapiens
uaaguccaguccaguccua

SEQ ID NO: 296802 - RNA, 19 nt, Homo sapiens
gcuggagguuggaucuuga

SEQ ID NO: 296803 - RNA, 19 nt, Homo sapiens
gccaggucccucucauuua

SEQ ID NO: 296804 - RNA, 19 nt, Homo sapiens
cuacggccauuucggaaga

SEQ ID NO: 296805 - RNA, 19 nt, Homo sapiens
uacggaaccucucagaaga

SEQ ID NO: 296806 - RNA, 19 nt, Homo sapiens
caagguggccugugagaca

SEQ ID NO: 296807 - RNA, 19 nt, Homo sapiens
ucagauuccuucccaugga

SEQ ID NO: 296808 - RNA, 19 nt, Homo sapiens
cagggaggcugguccuaug

SEQ ID NO: 296809 - RNA, 19 nt, Homo sapiens
ugagguuacuggaaauuag

SEQ ID NO: 296810 - RNA, 19 nt, Homo sapiens
gguuagagcaggacugaug

SEQ ID NO: 296811 - RNA, 19 nt, Homo sapiens
gguuggaucuugauguaag

SEQ ID NO: 296812 - RNA, 19 nt, Homo sapiens
ggcaggagaucaggguuug

SEQ ID NO: 296813 - RNA, 19 nt, Homo sapiens
ugucagggauuuggacuug

SEQ ID NO: 296814 - RNA, 19 nt, Homo sapiens
gcucacacucgacaugaaa

SEQ ID NO: 296815 - RNA, 19 nt, Homo sapiens
guguuuagaccuagaugua

SEQ ID NO: 296816 - RNA, 19 nt, Homo sapiens
ucccuacccucuagagaaa

SEQ ID NO: 296817 - RNA, 19 nt, Homo sapiens
guggagaagugugagaaga

SEQ ID NO: 296818 - RNA, 19 nt, Homo sapiens
ggugacaguucaguacaug

SEQ ID NO: 296819 - RNA, 19 nt, Homo sapiens
cauuuagccuguccuguca

SEQ ID NO: 296820 - RNA, 19 nt, Homo sapiens
uggauguggugcauaagaa

SEQ ID NO: 296821 - RNA, 19 nt, Homo sapiens
ccgagccgcuguccauuuc

SEQ ID NO: 296822 - RNA, 19 nt, Homo sapiens
ucacuggccguaagauuau

SEQ ID NO: 296823 - RNA, 19 nt, Homo sapiens
gaaauuaaggcaacaaaag

SEQ ID NO: 296824 - RNA, 19 nt, Homo sapiens
gggagugaguggcccuuuc

SEQ ID NO: 296825 - RNA, 19 nt, Homo sapiens
gaagcagcaacuuguccua

SEQ ID NO: 296826 - RNA, 19 nt, Homo sapiens
cgugggcaauugucugaaa

SEQ ID NO: 296827 - RNA, 19 nt, Homo sapiens
guuugcagguggccaaguu

SEQ ID NO: 296828 - RNA, 19 nt, Homo sapiens
ggagggagggagugguuug

SEQ ID NO: 296829 - RNA, 19 nt, Homo sapiens
uauggccucauguuaaaua

SEQ ID NO: 296830 - RNA, 19 nt, Homo sapiens
agcgagagcugcuggaugu

SEQ ID NO: 296831 - RNA, 19 nt, Homo sapiens
ucaggugaaaggaaauuaa

SEQ ID NO: 296832 - RNA, 19 nt, Homo sapiens
guugagccgugggcaauug

SEQ ID NO: 296833 - RNA, 19 nt, Homo sapiens
gacaaagcagauucagaaa

SEQ ID NO: 296834 - RNA, 19 nt, Homo sapiens
aaacucaaggagcaacuaa

SEQ ID NO: 296835 - RNA, 19 nt, Homo sapiens
guccuauggccucauguua

SEQ ID NO: 296836 - RNA, 19 nt, Homo sapiens
agaagcccaucuaccagaa

SEQ ID NO: 296837 - RNA, 19 nt, Homo sapiens
cuacggaaccucucagaag

SEQ ID NO: 296838 - RNA, 19 nt, Homo sapiens
gggcaggagaucaggguuu

SEQ ID NO: 296839 - RNA, 19 nt, Homo sapiens
gaccagcagcuuuagaauc

SEQ ID NO: 296840 - RNA, 19 nt, Homo sapiens
aaagcagauucagaaauga

SEQ ID NO: 296841 - RNA, 19 nt, Homo sapiens
guagaccgcucagcugcau

SEQ ID NO: 296842 - RNA, 19 nt, Homo sapiens
ggaaaucccuucauacuug

SEQ ID NO: 296843 - RNA, 19 nt, Homo sapiens
gaaaccagcuuccuucaga

SEQ ID NO: 296844 - RNA, 19 nt, Homo sapiens
caaaguagcuugugaaacu

SEQ ID NO: 296845 - RNA, 19 nt, Homo sapiens
gagcaacagucaccagaua

SEQ ID NO: 296846 - RNA, 19 nt, Homo sapiens
gagcauaggugauccaugu

SEQ ID NO: 296847 - RNA, 19 nt, Homo sapiens
ccaaugagcuuucugaaca

SEQ ID NO: 296848 - RNA, 19 nt, Homo sapiens
caaucaaucuugcauguaa

SEQ ID NO: 296849 - RNA, 19 nt, Homo sapiens
gaccagggcuuaauguuug

SEQ ID NO: 296850 - RNA, 19 nt, Homo sapiens
ugacuuggcugguguggua

SEQ ID NO: 296851 - RNA, 19 nt, Homo sapiens
ccaaguggcagauuuguua

SEQ ID NO: 296852 - RNA, 19 nt, Homo sapiens
ggacguacguaauaagguu

SEQ ID NO: 296853 - RNA, 19 nt, Homo sapiens
gaaacaacacuguaguaaa

SEQ ID NO: 296854 - RNA, 19 nt, Homo sapiens
ccauguaacugccuagaaa

SEQ ID NO: 296855 - RNA, 19 nt, Homo sapiens
guucaggucucuuaugcua

SEQ ID NO: 296856 - RNA, 19 nt, Homo sapiens
gagaagccaucaccucaga

SEQ ID NO: 296857 - RNA, 19 nt, Homo sapiens
gaaaucccuucauacuuga

SEQ ID NO: 296858 - RNA, 19 nt, Homo sapiens
caacauguuuccagcauuc

SEQ ID NO: 296859 - RNA, 19 nt, Homo sapiens
gaaauaccuugaugaggau

SEQ ID NO: 296860 - RNA, 19 nt, Homo sapiens
gcacuuggcagccuuguga

SEQ ID NO: 296861 - RNA, 19 nt, Homo sapiens
uaacgcaaguucccaguug

SEQ ID NO: 296862 - RNA, 19 nt, Homo sapiens
gucuugagcucuauuauga

SEQ ID NO: 296863 - RNA, 19 nt, Homo sapiens
ugaagaagccaauuuauca

SEQ ID NO: 296864 - RNA, 19 nt, Homo sapiens
gaagaagaauuucgaucuc

SEQ ID NO: 296865 - RNA, 19 nt, Homo sapiens
guacuuguaguuccacuua

SEQ ID NO: 296866 - RNA, 19 nt, Homo sapiens
gaaccuuugugcccuauca

SEQ ID NO: 296867 - RNA, 19 nt, Homo sapiens
gcuuugaaauugaaccuuu

SEQ ID NO: 296868 - RNA, 19 nt, Homo sapiens
ggagguuuauuacguaugu

SEQ ID NO: 296869 - RNA, 19 nt, Homo sapiens
gaaagugguucgugaagcu

SEQ ID NO: 296870 - RNA, 19 nt, Homo sapiens
guaacuugauccauuucua

SEQ ID NO: 296871 - RNA, 19 nt, Homo sapiens
agagagagcuauuagagau

SEQ ID NO: 296872 - RNA, 19 nt, Homo sapiens
gcuccagccugacaucaaa

SEQ ID NO: 296873 - RNA, 19 nt, Homo sapiens
gaucugaagaagccaauuu

SEQ ID NO: 296874 - RNA, 19 nt, Homo sapiens
ccacacaauuguuauaucu

SEQ ID NO: 296875 - RNA, 19 nt, Homo sapiens
uaagaaagccugaguacuc

SEQ ID NO: 296876 - RNA, 19 nt, Homo sapiens
caaaaucucuccacuuuca

SEQ ID NO: 296877 - RNA, 19 nt, Homo sapiens
ucaggucucuuaugcuauu

SEQ ID NO: 296878 - RNA, 19 nt, Homo sapiens
ccaauccuaugcaugguuu

SEQ ID NO: 296879 - RNA, 19 nt, Homo sapiens
uaugguaccucucagaaga

SEQ ID NO: 296880 - RNA, 19 nt, Homo sapiens
aggaggaaaucccuucaua

SEQ ID NO: 296881 - RNA, 19 nt, Homo sapiens
cuaauuauguagcucuuug

SEQ ID NO: 296882 - RNA, 19 nt, Homo sapiens
gcacguaaaguacuuguag

SEQ ID NO: 296883 - RNA, 19 nt, Homo sapiens
ucagaggacugcagccuau

SEQ ID NO: 296884 - RNA, 19 nt, Homo sapiens
caucagaguccacacaauu

SEQ ID NO: 296885 - RNA, 19 nt, Homo sapiens
uguaaugucuugagcucua

SEQ ID NO: 296886 - RNA, 19 nt, Homo sapiens
ucaacaccaugauuccuuu

SEQ ID NO: 296887 - RNA, 19 nt, Homo sapiens
gugcuuaugcucuuaauug

SEQ ID NO: 296888 - RNA, 19 nt, Homo sapiens
cagcaugaauuuguaaugu

SEQ ID NO: 296889 - RNA, 19 nt, Homo sapiens
gggaugcccuaaaggagaa

SEQ ID NO: 296890 - RNA, 19 nt, Homo sapiens
caagcuaaaugccaaacug

SEQ ID NO: 296891 - RNA, 19 nt, Homo sapiens
gcaacagucaccagauauu

SEQ ID NO: 296892 - RNA, 19 nt, Homo sapiens
gggaaggccacccagauaa

SEQ ID NO: 296893 - RNA, 19 nt, Homo sapiens
gcaugaauuuguaaugucu

SEQ ID NO: 296894 - RNA, 19 nt, Homo sapiens
ccaaagucauaauugcauu

SEQ ID NO: 296895 - RNA, 19 nt, Homo sapiens
acacuuugguaccagauaa

SEQ ID NO: 296896 - RNA, 19 nt, Homo sapiens
ccuguaacuugauccauuu

SEQ ID NO: 296897 - RNA, 19 nt, Homo sapiens
gcauaggugauccauguaa

SEQ ID NO: 296898 - RNA, 19 nt, Homo sapiens
gccaagguguccuacagaa

SEQ ID NO: 296899 - RNA, 19 nt, Homo sapiens
caccucagauggcagcuuu

SEQ ID NO: 296900 - RNA, 19 nt, Homo sapiens
acuccacacugcacaauaa

SEQ ID NO: 296901 - RNA, 19 nt, Homo sapiens
ggaucgaggugcugugcuu

SEQ ID NO: 296902 - RNA, 19 nt, Homo sapiens
guguaugccuuuaaccauu

SEQ ID NO: 296903 - RNA, 19 nt, Homo sapiens
gcagccuugugaugucaua

SEQ ID NO: 296904 - RNA, 19 nt, Homo sapiens
aaaggcaguuaccauuaaa

SEQ ID NO: 296905 - RNA, 19 nt, Homo sapiens
gaaaggauuauaccaaggu

SEQ ID NO: 296906 - RNA, 19 nt, Homo sapiens
guaaaccaauccuaugcau

SEQ ID NO: 296907 - RNA, 19 nt, Homo sapiens
gaaagucaucaaagcaguu

SEQ ID NO: 296908 - RNA, 19 nt, Homo sapiens
ggagaaagucaucaaagca

SEQ ID NO: 296909 - RNA, 19 nt, Homo sapiens
ggauccugaugccaaagua

SEQ ID NO: 296910 - RNA, 19 nt, Homo sapiens
caugauuccuuuaacaaca

SEQ ID NO: 296911 - RNA, 19 nt, Homo sapiens
gaggaaaucccuucauacu

SEQ ID NO: 296912 - RNA, 19 nt, Homo sapiens
gagagagagcuauuagaga

SEQ ID NO: 296913 - RNA, 19 nt, Homo sapiens
guuacgcccugauucuaaa

SEQ ID NO: 296914 - RNA, 19 nt, Homo sapiens
gaugauucuuccaaagguu

SEQ ID NO: 296915 - RNA, 19 nt, Homo sapiens
gauaugaugauucuuccaa

SEQ ID NO: 296916 - RNA, 19 nt, Homo sapiens
gcaguuaccauuaaaccau

SEQ ID NO: 296917 - RNA, 19 nt, Homo sapiens
uaaaguacuuguaguucca

SEQ ID NO: 296918 - RNA, 19 nt, Homo sapiens
ccaacgcuccaaagucaua

SEQ ID NO: 296919 - RNA, 19 nt, Homo sapiens
uuauaucuguucagcauga

SEQ ID NO: 296920 - RNA, 19 nt, Homo sapiens
uauccucccuguaacuuga

SEQ ID NO: 296921 - RNA, 19 nt, Homo sapiens
gcucuauuaugaaugugaa

SEQ ID NO: 296922 - RNA, 19 nt, Homo sapiens
uagaaacaacacuguagua

SEQ ID NO: 296923 - RNA, 19 nt, Homo sapiens
aaaucauuguggacacuua

SEQ ID NO: 296924 - RNA, 19 nt, Homo sapiens
aaaaggcaguuaccauuaa

SEQ ID NO: 296925 - RNA, 19 nt, Homo sapiens
gcacaccgacaccaacaug

SEQ ID NO: 296926 - RNA, 19 nt, Homo sapiens
ugagcucuauuaugaaugu

SEQ ID NO: 296927 - RNA, 19 nt, Homo sapiens
agaaacaacacuguaguaa

SEQ ID NO: 296928 - RNA, 19 nt, Homo sapiens
ggcccuccuuccuaaauuu

SEQ ID NO: 296929 - RNA, 19 nt, Homo sapiens
uagagauugugaagaagaa

SEQ ID NO: 296930 - RNA, 19 nt, Homo sapiens
gaaggccacccagauaaga

SEQ ID NO: 296931 - RNA, 19 nt, Homo sapiens
gaagagugagagagagcua

SEQ ID NO: 296932 - RNA, 19 nt, Homo sapiens
caacagucaccagauauug

SEQ ID NO: 296933 - RNA, 19 nt, Homo sapiens
gagcugcuguugacuacca

SEQ ID NO: 296934 - RNA, 19 nt, Homo sapiens
acuuguaguuccacuuaua

SEQ ID NO: 296935 - RNA, 19 nt, Homo sapiens
gugaugugcacguaaagua

SEQ ID NO: 296936 - RNA, 19 nt, Homo sapiens
agagagcuauuagagauug

SEQ ID NO: 296937 - RNA, 19 nt, Homo sapiens
ucucauccauuaucuaucu

SEQ ID NO: 296938 - RNA, 19 nt, Homo sapiens
ggaggugccuuuucaggaa

SEQ ID NO: 296939 - RNA, 19 nt, Homo sapiens
gggcccuccuuccuaaauu

SEQ ID NO: 296940 - RNA, 19 nt, Homo sapiens
uccauuaucuaucuccauu

SEQ ID NO: 296941 - RNA, 19 nt, Homo sapiens
uggaggacguacguaauaa

SEQ ID NO: 296942 - RNA, 19 nt, Homo sapiens
ugaagaauaucaaguguga

SEQ ID NO: 296943 - RNA, 19 nt, Homo sapiens
cgauaaagacggauucuaa

SEQ ID NO: 296944 - RNA, 19 nt, Homo sapiens
gaucggagagggagaguuu

SEQ ID NO: 296945 - RNA, 19 nt, Homo sapiens
gcuagagcaucuuaaaugu

SEQ ID NO: 296946 - RNA, 19 nt, Homo sapiens
ucugggaggucuucucaua

SEQ ID NO: 296947 - RNA, 19 nt, Homo sapiens
gcaacauccuggucucaga

SEQ ID NO: 296948 - RNA, 19 nt, Homo sapiens
gggauucggugcagaugga

SEQ ID NO: 296949 - RNA, 19 nt, Homo sapiens
ccgcucagcuccugcaguu

SEQ ID NO: 296950 - RNA, 19 nt, Homo sapiens
uacugaaccugcagcauuu

SEQ ID NO: 296951 - RNA, 19 nt, Homo sapiens
uaaagacggauucuaagga

SEQ ID NO: 296952 - RNA, 19 nt, Homo sapiens
uggaguaccuggagagcaa

SEQ ID NO: 296953 - RNA, 19 nt, Homo sapiens
uuacugaaccugcagcauu

SEQ ID NO: 296954 - RNA, 19 nt, Homo sapiens
gauaaagacggauucuaag

SEQ ID NO: 296955 - RNA, 19 nt, Homo sapiens
uggacaugguggagcauua

SEQ ID NO: 296956 - RNA, 19 nt, Homo sapiens
ugggaggucuucucauaug

SEQ ID NO: 296957 - RNA, 19 nt, Homo sapiens
gaagggauucggugcagau

SEQ ID NO: 296958 - RNA, 19 nt, Homo sapiens
ggaaacacgggaccaaguc

SEQ ID NO: 296959 - RNA, 19 nt, Homo sapiens
gagaggaagaggagaaagu

SEQ ID NO: 296960 - RNA, 19 nt, Homo sapiens
ggaaggggcuagacucaag

SEQ ID NO: 296961 - RNA, 19 nt, Homo sapiens
gcaaccuggugaacuuucu

SEQ ID NO: 296962 - RNA, 19 nt, Homo sapiens
ggaguccacgggccugaaa

SEQ ID NO: 296963 - RNA, 19 nt, Homo sapiens
gagagaggaagaggagaaa

SEQ ID NO: 296964 - RNA, 19 nt, Homo sapiens
cgagagaggaagaggagaa

SEQ ID NO: 296965 - RNA, 19 nt, Homo sapiens
agucggaugucuggaguuu

SEQ ID NO: 296966 - RNA, 19 nt, Homo sapiens
gaagaugcaacacgagaac

SEQ ID NO: 296967 - RNA, 19 nt, Homo sapiens
cgacaucgagagaggaaga

SEQ ID NO: 296968 - RNA, 19 nt, Homo sapiens
gaaccugcagcauuugaca

SEQ ID NO: 296969 - RNA, 19 nt, Homo sapiens
cccaguguaucaccaaaug

SEQ ID NO: 296970 - RNA, 19 nt, Homo sapiens
gcaagggcaaccuggugaa

SEQ ID NO: 296971 - RNA, 19 nt, Homo sapiens
cgugaagaauaucaagugu

SEQ ID NO: 296972 - RNA, 19 nt, Homo sapiens
gcccgaggcucucaaacac

SEQ ID NO: 296973 - RNA, 19 nt, Homo sapiens
gcaaggacaagggcgcuau

SEQ ID NO: 296974 - RNA, 19 nt, Homo sapiens
gccgcgacgucauccacua

SEQ ID NO: 296975 - RNA, 19 nt, Homo sapiens
acauuucccugcugaacga

SEQ ID NO: 296976 - RNA, 19 nt, Homo sapiens
ccagaccugcgaaggauga

SEQ ID NO: 296977 - RNA, 19 nt, Homo sapiens
ggaggucuucucauaugga

SEQ ID NO: 296978 - RNA, 19 nt, Homo sapiens
ggccaaggucagcgacuuu

SEQ ID NO: 296979 - RNA, 19 nt, Homo sapiens
ggcuguacauugucaugga

SEQ ID NO: 296980 - RNA, 19 nt, Homo sapiens
gcgagaacaagagcuggua

SEQ ID NO: 296981 - RNA, 19 nt, Homo sapiens
gcucugggaggucuucuca

SEQ ID NO: 296982 - RNA, 19 nt, Homo sapiens
gcuaggcgacaucgagaga

SEQ ID NO: 296983 - RNA, 19 nt, Homo sapiens
ggcaaaagguggccgugaa

SEQ ID NO: 296984 - RNA, 19 nt, Homo sapiens
cggauucuaaggacucuaa

SEQ ID NO: 296985 - RNA, 19 nt, Homo sapiens
cgaagaugcaacacgagaa

SEQ ID NO: 296986 - RNA, 19 nt, Homo sapiens
gggaggucuucucauaugg

SEQ ID NO: 296987 - RNA, 19 nt, Homo sapiens
gcucagcuccugcaguuuu

SEQ ID NO: 296988 - RNA, 19 nt, Homo sapiens
aagguggccgugaagaaua

SEQ ID NO: 296989 - RNA, 19 nt, Homo sapiens
aaagguggccgugaagaau

SEQ ID NO: 296990 - RNA, 19 nt, Homo sapiens
ggacauuucccugcugaac

SEQ ID NO: 296991 - RNA, 19 nt, Homo sapiens
uaaaugucccucucaugca

SEQ ID NO: 296992 - RNA, 19 nt, Homo sapiens
gcacccaguguaucaccaa

SEQ ID NO: 296993 - RNA, 19 nt, Homo sapiens
agggcaaccuggugaacuu

SEQ ID NO: 296994 - RNA, 19 nt, Homo sapiens
ucauggagcacgugagcaa

SEQ ID NO: 296995 - RNA, 19 nt, Homo sapiens
ggacaugguggagcauuac

SEQ ID NO: 296996 - RNA, 19 nt, Homo sapiens
ugucggaggccguggagaa

SEQ ID NO: 296997 - RNA, 19 nt, Homo sapiens
gugaguaccuggggcaaaa

SEQ ID NO: 296998 - RNA, 19 nt, Homo sapiens
gaugaggccguguucuucu

SEQ ID NO: 296999 - RNA, 19 nt, Homo sapiens
gagcugguaccgcgucaag

SEQ ID NO: 297000 - RNA, 19 nt, Homo sapiens
gcaaacuggccgagaagcu

SEQ ID NO: 297001 - RNA, 19 nt, Homo sapiens
ccuaaaaugucacugaaag

SEQ ID NO: 297002 - RNA, 19 nt, Homo sapiens
gacauugggagcacagauc

SEQ ID NO: 297003 - RNA, 19 nt, Homo sapiens
gcugguaccgcgucaagca

SEQ ID NO: 297004 - RNA, 19 nt, Homo sapiens
gggcaaccuggugaacuuu

SEQ ID NO: 297005 - RNA, 19 nt, Homo sapiens
aaaucaagcaguugguuag

SEQ ID NO: 297006 - RNA, 19 nt, Homo sapiens
cgacggccaccucacaauc

SEQ ID NO: 297007 - RNA, 19 nt, Homo sapiens
ggugagaccaaagcggaaa

SEQ ID NO: 297008 - RNA, 19 nt, Homo sapiens
ucgaugaggccguguucuu

SEQ ID NO: 297009 - RNA, 19 nt, Homo sapiens
ugaagaauaucaaguguga

SEQ ID NO: 297010 - RNA, 19 nt, Homo sapiens
cgauaaagacggauucuaa

SEQ ID NO: 297011 - RNA, 19 nt, Homo sapiens
gaucggagagggagaguuu

SEQ ID NO: 297012 - RNA, 19 nt, Homo sapiens
ucugggaggucuucucaua

SEQ ID NO: 297013 - RNA, 19 nt, Homo sapiens
gcaacauccuggucucaga

SEQ ID NO: 297014 - RNA, 19 nt, Homo sapiens
ccgcucagcuccugcaguu

SEQ ID NO: 297015 - RNA, 19 nt, Homo sapiens
uacugaaccugcagcauuu

SEQ ID NO: 297016 - RNA, 19 nt, Homo sapiens
uaaagacggauucuaagga

SEQ ID NO: 297017 - RNA, 19 nt, Homo sapiens
uggaguaccuggagagcaa

SEQ ID NO: 297018 - RNA, 19 nt, Homo sapiens
uuacugaaccugcagcauu

SEQ ID NO: 297019 - RNA, 19 nt, Homo sapiens
gauaaagacggauucuaag

SEQ ID NO: 297020 - RNA, 19 nt, Homo sapiens
uggacaugguggagcauua

SEQ ID NO: 297021 - RNA, 19 nt, Homo sapiens
ugggaggucuucucauaug

SEQ ID NO: 297022 - RNA, 19 nt, Homo sapiens
ggaaacacgggaccaaguc

SEQ ID NO: 297023 - RNA, 19 nt, Homo sapiens
ggaaggggcuagacucaag

SEQ ID NO: 297024 - RNA, 19 nt, Homo sapiens
gcaaccuggugaacuuucu

SEQ ID NO: 297025 - RNA, 19 nt, Homo sapiens
cccaguguaucaccaaaug

SEQ ID NO: 297026 - RNA, 19 nt, Homo sapiens
agucggaugucuggaguuu

SEQ ID NO: 297027 - RNA, 19 nt, Homo sapiens
gaagaugcaacacgagaac

SEQ ID NO: 297028 - RNA, 19 nt, Homo sapiens
gaaccugcagcauuugaca

SEQ ID NO: 297029 - RNA, 19 nt, Homo sapiens
gcaagggcaaccuggugaa

SEQ ID NO: 297030 - RNA, 19 nt, Homo sapiens
cgugaagaauaucaagugu

SEQ ID NO: 297031 - RNA, 19 nt, Homo sapiens
gcccgaggcucucaaacac

SEQ ID NO: 297032 - RNA, 19 nt, Homo sapiens
gcaaggacaagggcgcuau

SEQ ID NO: 297033 - RNA, 19 nt, Homo sapiens
gccgcgacgucauccacua

SEQ ID NO: 297034 - RNA, 19 nt, Homo sapiens
ccagaccugcgaaggauga

SEQ ID NO: 297035 - RNA, 19 nt, Homo sapiens
ggaggucuucucauaugga

SEQ ID NO: 297036 - RNA, 19 nt, Homo sapiens
ggccaaggucagcgacuuu

SEQ ID NO: 297037 - RNA, 19 nt, Homo sapiens
gcgagaacaagagcuggua

SEQ ID NO: 297038 - RNA, 19 nt, Homo sapiens
ggcuguacauugucaugga

SEQ ID NO: 297039 - RNA, 19 nt, Homo sapiens
gcucugggaggucuucuca

SEQ ID NO: 297040 - RNA, 19 nt, Homo sapiens
ggcaaaagguggccgugaa

SEQ ID NO: 297041 - RNA, 19 nt, Homo sapiens
cggauucuaaggacucuaa

SEQ ID NO: 297042 - RNA, 19 nt, Homo sapiens
cgaagaugcaacacgagaa

SEQ ID NO: 297043 - RNA, 19 nt, Homo sapiens
gggaggucuucucauaugg

SEQ ID NO: 297044 - RNA, 19 nt, Homo sapiens
gcucagcuccugcaguuuu

SEQ ID NO: 297045 - RNA, 19 nt, Homo sapiens
aagguggccgugaagaaua

SEQ ID NO: 297046 - RNA, 19 nt, Homo sapiens
aaagguggccgugaagaau

SEQ ID NO: 297047 - RNA, 19 nt, Homo sapiens
gcacccaguguaucaccaa

SEQ ID NO: 297048 - RNA, 19 nt, Homo sapiens
agggcaaccuggugaacuu

SEQ ID NO: 297049 - RNA, 19 nt, Homo sapiens
ucauggagcacgugagcaa

SEQ ID NO: 297050 - RNA, 19 nt, Homo sapiens
ggacaugguggagcauuac

SEQ ID NO: 297051 - RNA, 19 nt, Homo sapiens
ugucggaggccguggagaa

SEQ ID NO: 297052 - RNA, 19 nt, Homo sapiens
gagcugguaccgcgucaag

SEQ ID NO: 297053 - RNA, 19 nt, Homo sapiens
gugaguaccuggggcaaaa

SEQ ID NO: 297054 - RNA, 19 nt, Homo sapiens
gaugaggccguguucuucu

SEQ ID NO: 297055 - RNA, 19 nt, Homo sapiens
gcaaacuggccgagaagcu

SEQ ID NO: 297056 - RNA, 19 nt, Homo sapiens
ccuaaaaugucacugaaag

SEQ ID NO: 297057 - RNA, 19 nt, Homo sapiens
gacauugggagcacagauc

SEQ ID NO: 297058 - RNA, 19 nt, Homo sapiens
gcugguaccgcgucaagca

SEQ ID NO: 297059 - RNA, 19 nt, Homo sapiens
gggcaaccuggugaacuuu

SEQ ID NO: 297060 - RNA, 19 nt, Homo sapiens
cgacggccaccucacaauc

SEQ ID NO: 297061 - RNA, 19 nt, Homo sapiens
ucgaugaggccguguucuu

SEQ ID NO: 297062 - RNA, 19 nt, Homo sapiens
ggugagaccaaagcggaaa

SEQ ID NO: 297063 - RNA, 19 nt, Homo sapiens
ugaagaauaucaaguguga

SEQ ID NO: 297064 - RNA, 19 nt, Homo sapiens
gggcgaggcucucugguuu

SEQ ID NO: 297065 - RNA, 19 nt, Homo sapiens
cgauaaagacggauucuaa

SEQ ID NO: 297066 - RNA, 19 nt, Homo sapiens
gaucggagagggagaguuu

SEQ ID NO: 297067 - RNA, 19 nt, Homo sapiens
ucugggaggucuucucaua

SEQ ID NO: 297068 - RNA, 19 nt, Homo sapiens
gcaacauccuggucucaga

SEQ ID NO: 297069 - RNA, 19 nt, Homo sapiens
ccgcucagcuccugcaguu

SEQ ID NO: 297070 - RNA, 19 nt, Homo sapiens
uacugaaccugcagcauuu

SEQ ID NO: 297071 - RNA, 19 nt, Homo sapiens
uaaagacggauucuaagga

SEQ ID NO: 297072 - RNA, 19 nt, Homo sapiens
uggaguaccuggagagcaa

SEQ ID NO: 297073 - RNA, 19 nt, Homo sapiens
uuacugaaccugcagcauu

SEQ ID NO: 297074 - RNA, 19 nt, Homo sapiens
ccucucaccugccucaguu

SEQ ID NO: 297075 - RNA, 19 nt, Homo sapiens
gauaaagacggauucuaag

SEQ ID NO: 297076 - RNA, 19 nt, Homo sapiens
uggacaugguggagcauua

SEQ ID NO: 297077 - RNA, 19 nt, Homo sapiens
ugggaggucuucucauaug

SEQ ID NO: 297078 - RNA, 19 nt, Homo sapiens
ggaaacacgggaccaaguc

SEQ ID NO: 297079 - RNA, 19 nt, Homo sapiens
ggaaggggcuagacucaag

SEQ ID NO: 297080 - RNA, 19 nt, Homo sapiens
gcaaccuggugaacuuucu

SEQ ID NO: 297081 - RNA, 19 nt, Homo sapiens
agucggaugucuggaguuu

SEQ ID NO: 297082 - RNA, 19 nt, Homo sapiens
gaagaugcaacacgagaac

SEQ ID NO: 297083 - RNA, 19 nt, Homo sapiens
gaaccugcagcauuugaca

SEQ ID NO: 297084 - RNA, 19 nt, Homo sapiens
cccaguguaucaccaaaug

SEQ ID NO: 297085 - RNA, 19 nt, Homo sapiens
gcaagggcaaccuggugaa

SEQ ID NO: 297086 - RNA, 19 nt, Homo sapiens
cgugaagaauaucaagugu

SEQ ID NO: 297087 - RNA, 19 nt, Homo sapiens
gcccgaggcucucaaacac

SEQ ID NO: 297088 - RNA, 19 nt, Homo sapiens
gcaaggacaagggcgcuau

SEQ ID NO: 297089 - RNA, 19 nt, Homo sapiens
gccgcgacgucauccacua

SEQ ID NO: 297090 - RNA, 19 nt, Homo sapiens
ccagaccugcgaaggauga

SEQ ID NO: 297091 - RNA, 19 nt, Homo sapiens
ggaggucuucucauaugga

SEQ ID NO: 297092 - RNA, 19 nt, Homo sapiens
ggccaaggucagcgacuuu

SEQ ID NO: 297093 - RNA, 19 nt, Homo sapiens
ggcuguacauugucaugga

SEQ ID NO: 297094 - RNA, 19 nt, Homo sapiens
gcgagaacaagagcuggua

SEQ ID NO: 297095 - RNA, 19 nt, Homo sapiens
gcucugggaggucuucuca

SEQ ID NO: 297096 - RNA, 19 nt, Homo sapiens
ggcaaaagguggccgugaa

SEQ ID NO: 297097 - RNA, 19 nt, Homo sapiens
cggauucuaaggacucuaa

SEQ ID NO: 297098 - RNA, 19 nt, Homo sapiens
cgaagaugcaacacgagaa

SEQ ID NO: 297099 - RNA, 19 nt, Homo sapiens
gggaggucuucucauaugg

SEQ ID NO: 297100 - RNA, 19 nt, Homo sapiens
gcucagcuccugcaguuuu

SEQ ID NO: 297101 - RNA, 19 nt, Homo sapiens
aagguggccgugaagaaua

SEQ ID NO: 297102 - RNA, 19 nt, Homo sapiens
aaagguggccgugaagaau

SEQ ID NO: 297103 - RNA, 19 nt, Homo sapiens
gcacccaguguaucaccaa

SEQ ID NO: 297104 - RNA, 19 nt, Homo sapiens
agggcaaccuggugaacuu

SEQ ID NO: 297105 - RNA, 19 nt, Homo sapiens
ucauggagcacgugagcaa

SEQ ID NO: 297106 - RNA, 19 nt, Homo sapiens
ggacaugguggagcauuac

SEQ ID NO: 297107 - RNA, 19 nt, Homo sapiens
ugucggaggccguggagaa

SEQ ID NO: 297108 - RNA, 19 nt, Homo sapiens
gagcugguaccgcgucaag

SEQ ID NO: 297109 - RNA, 19 nt, Homo sapiens
gugaguaccuggggcaaaa

SEQ ID NO: 297110 - RNA, 19 nt, Homo sapiens
gaugaggccguguucuucu

SEQ ID NO: 297111 - RNA, 19 nt, Homo sapiens
gcaaacuggccgagaagcu

SEQ ID NO: 297112 - RNA, 19 nt, Homo sapiens
gcugguaccgcgucaagca

SEQ ID NO: 297113 - RNA, 19 nt, Homo sapiens
ccuaaaaugucacugaaag

SEQ ID NO: 297114 - RNA, 19 nt, Homo sapiens
gacauugggagcacagauc

SEQ ID NO: 297115 - RNA, 19 nt, Homo sapiens
gggcaaccuggugaacuuu

SEQ ID NO: 297116 - RNA, 19 nt, Homo sapiens
cgacggccaccucacaauc

SEQ ID NO: 297117 - RNA, 19 nt, Homo sapiens
ggugagaccaaagcggaaa

SEQ ID NO: 297118 - RNA, 19 nt, Homo sapiens
ucgaugaggccguguucuu

SEQ ID NO: 297119 - RNA, 19 nt, Homo sapiens
ggaagugaauuuaaugaga

SEQ ID NO: 297120 - RNA, 19 nt, Homo sapiens
ccacagaccugguguuugu

SEQ ID NO: 297121 - RNA, 19 nt, Homo sapiens
gcgagucccuggugaaauu

SEQ ID NO: 297122 - RNA, 19 nt, Homo sapiens
gcaaugccguggaggauga

SEQ ID NO: 297123 - RNA, 19 nt, Homo sapiens
cgccguagcuuuaccauuu

SEQ ID NO: 297124 - RNA, 19 nt, Homo sapiens
ggagaacacaguugucuaa

SEQ ID NO: 297125 - RNA, 19 nt, Homo sapiens
gaagaucuguguggaggaa

SEQ ID NO: 297126 - RNA, 19 nt, Homo sapiens
gcaugagucuugccagaau

SEQ ID NO: 297127 - RNA, 19 nt, Homo sapiens
ucgagaagcuguccaggaa

SEQ ID NO: 297128 - RNA, 19 nt, Homo sapiens
ccaguucgcuaucaccaaa

SEQ ID NO: 297129 - RNA, 19 nt, Homo sapiens
gaccucggcuuuaagaugu

SEQ ID NO: 297130 - RNA, 19 nt, Homo sapiens
gacaauuccuucacugugu

SEQ ID NO: 297131 - RNA, 19 nt, Homo sapiens
cacgagggcuucacucuga

SEQ ID NO: 297132 - RNA, 19 nt, Homo sapiens
gcagagcacuacuucuaca

SEQ ID NO: 297133 - RNA, 19 nt, Homo sapiens
ccacgucagucgucaguug

SEQ ID NO: 297134 - RNA, 19 nt, Homo sapiens
gagaagcuguccaggaagu

SEQ ID NO: 297135 - RNA, 19 nt, Homo sapiens
gcacacacaccuccauuca

SEQ ID NO: 297136 - RNA, 19 nt, Homo sapiens
gaaauuccaagccaaagug

SEQ ID NO: 297137 - RNA, 19 nt, Homo sapiens
ggcauugucuucacugaug

SEQ ID NO: 297138 - RNA, 19 nt, Homo sapiens
ggauuugggugugggauga

SEQ ID NO: 297139 - RNA, 19 nt, Homo sapiens
cuacacggcugacuucaag

SEQ ID NO: 297140 - RNA, 19 nt, Homo sapiens
gcucucaaguaccucauug

SEQ ID NO: 297141 - RNA, 19 nt, Homo sapiens
ggugagaaacaauuaaaug

SEQ ID NO: 297142 - RNA, 19 nt, Homo sapiens
ggagccaggacuacauuaa

SEQ ID NO: 297143 - RNA, 19 nt, Homo sapiens
acuuugagcuggugaagaa

SEQ ID NO: 297144 - RNA, 19 nt, Homo sapiens
gcugugaauuucuuuacug

SEQ ID NO: 297145 - RNA, 19 nt, Homo sapiens
ucgauuacguggagagcua

SEQ ID NO: 297146 - RNA, 19 nt, Homo sapiens
uggcagagcacuacuucua

SEQ ID NO: 297147 - RNA, 19 nt, Homo sapiens
gauuuaacguaagcaguga

SEQ ID NO: 297148 - RNA, 19 nt, Homo sapiens
uuaguuaacccuuucuuga

SEQ ID NO: 297149 - RNA, 19 nt, Homo sapiens
ucaagaccaucaaccagau

SEQ ID NO: 297150 - RNA, 19 nt, Homo sapiens
uuaaugaugcugccaagaa

SEQ ID NO: 297151 - RNA, 19 nt, Homo sapiens
gcuacagcgucaucgagaa

SEQ ID NO: 297152 - RNA, 19 nt, Homo sapiens
gaaacuggaagcugugagu

SEQ ID NO: 297153 - RNA, 19 nt, Homo sapiens
gaggaugagcugagggaaa

SEQ ID NO: 297154 - RNA, 19 nt, Homo sapiens
uaaugaugcugccaagaag

SEQ ID NO: 297155 - RNA, 19 nt, Homo sapiens
ucagucagaucguggauac

SEQ ID NO: 297156 - RNA, 19 nt, Homo sapiens
cguucggccuguugaauuu

SEQ ID NO: 297157 - RNA, 19 nt, Homo sapiens
ugagugcugugaauuucuu

SEQ ID NO: 297158 - RNA, 19 nt, Homo sapiens
ggugaaauuccaagccaaa

SEQ ID NO: 297159 - RNA, 19 nt, Homo sapiens
ccagauaggcaagaaguug

SEQ ID NO: 297160 - RNA, 19 nt, Homo sapiens
gagccaggacuacauuaau

SEQ ID NO: 297161 - RNA, 19 nt, Homo sapiens
gggugggcauggucaacua

SEQ ID NO: 297162 - RNA, 19 nt, Homo sapiens
uugagaaagugaagguauu

SEQ ID NO: 297163 - RNA, 19 nt, Homo sapiens
gagagggacugcguuugca

SEQ ID NO: 297164 - RNA, 19 nt, Homo sapiens
aggaugagcugagggaaau

SEQ ID NO: 297165 - RNA, 19 nt, Homo sapiens
uuugggagcucgugugugu

SEQ ID NO: 297166 - RNA, 19 nt, Homo sapiens
caagaccaucaaccagaua

SEQ ID NO: 297167 - RNA, 19 nt, Homo sapiens
ggaaggggaagugaauuua

SEQ ID NO: 297168 - RNA, 19 nt, Homo sapiens
ucaaccagauaggcaagaa

SEQ ID NO: 297169 - RNA, 19 nt, Homo sapiens
gcccacagaccugguguuu

SEQ ID NO: 297170 - RNA, 19 nt, Homo sapiens
gaaggggaagugaauuuaa

SEQ ID NO: 297171 - RNA, 19 nt, Homo sapiens
gccaggacuacauuaauga

SEQ ID NO: 297172 - RNA, 19 nt, Homo sapiens
agccaggacuacauuaaug

SEQ ID NO: 297173 - RNA, 19 nt, Homo sapiens
caaggcggcugugcggaau

SEQ ID NO: 297174 - RNA, 19 nt, Homo sapiens
cguguccgccguagcuuua

SEQ ID NO: 297175 - RNA, 19 nt, Homo sapiens
ggacuacauuaaugaugcu

SEQ ID NO: 297176 - RNA, 19 nt, Homo sapiens
gggcugcucucaaguaccu

SEQ ID NO: 297177 - RNA, 19 nt, Homo sapiens
gagggacugcguuugcauu

SEQ ID NO: 297178 - RNA, 19 nt, Homo sapiens
gaaguucaucagucagauc

SEQ ID NO: 297179 - RNA, 19 nt, Homo sapiens
ggagagcuacagcgucauc

SEQ ID NO: 297180 - RNA, 19 nt, Homo sapiens
gcguucggccuguugaauu

SEQ ID NO: 297181 - RNA, 19 nt, Homo sapiens
cuauugagagcguguaaug

SEQ ID NO: 297182 - RNA, 19 nt, Homo sapiens
guaagcggcuggccauccu

SEQ ID NO: 297183 - RNA, 19 nt, Homo sapiens
cugugaauuucuuuacuga

SEQ ID NO: 297184 - RNA, 19 nt, Homo sapiens
ucugagugcugugaauuuc

SEQ ID NO: 297185 - RNA, 19 nt, Homo sapiens
gagcucguguguguaugug

SEQ ID NO: 297186 - RNA, 19 nt, Homo sapiens
ggagcucguguguguaugu

SEQ ID NO: 297187 - RNA, 19 nt, Homo sapiens
agaacacaguugucuaagg

SEQ ID NO: 297188 - RNA, 19 nt, Homo sapiens
gaagcuguccaggaaguuc

SEQ ID NO: 297189 - RNA, 19 nt, Homo sapiens
gggcacacacaccuccauu

SEQ ID NO: 297190 - RNA, 19 nt, Homo sapiens
caugagucuugccagaaug

SEQ ID NO: 297191 - RNA, 19 nt, Homo sapiens
agaaguugcagaagaagau

SEQ ID NO: 297192 - RNA, 19 nt, Homo sapiens
gcucugugcgccaggaguu

SEQ ID NO: 297193 - RNA, 19 nt, Homo sapiens
gaacuuugagcuggugaag

SEQ ID NO: 297194 - RNA, 19 nt, Homo sapiens
aaacuggaagcugugagua

SEQ ID NO: 297195 - RNA, 19 nt, Homo sapiens
gcaccgugaagcaggaguu

SEQ ID NO: 297196 - RNA, 19 nt, Homo sapiens
ccggugagaaacaauuaaa

SEQ ID NO: 297197 - RNA, 19 nt, Homo sapiens
aacccuuucuugacucuga

SEQ ID NO: 297198 - RNA, 19 nt, Homo sapiens
agaccucggcuuuaagaug

SEQ ID NO: 297199 - RNA, 19 nt, Homo sapiens
gccauuggacucagguaug

SEQ ID NO: 297200 - RNA, 19 nt, Homo sapiens
ucagcaagguggucaucgu

SEQ ID NO: 297201 - RNA, 19 nt, Homo sapiens
gaugagcugagggaaauag

SEQ ID NO: 297202 - RNA, 19 nt, Homo sapiens
gcagugggguugauaagac

SEQ ID NO: 297203 - RNA, 19 nt, Homo sapiens
ccauuggacucagguaugc

SEQ ID NO: 297204 - RNA, 19 nt, Homo sapiens
gggaaggggaagugaauuu

SEQ ID NO: 297205 - RNA, 19 nt, Homo sapiens
ccucggcuuuaagauguuu

SEQ ID NO: 297206 - RNA, 19 nt, Homo sapiens
gccauccaguucgcuauca

SEQ ID NO: 297207 - RNA, 19 nt, Homo sapiens
gagucuugccagaauguga

SEQ ID NO: 297208 - RNA, 19 nt, Homo sapiens
ugaaauuccaagccaaagu

SEQ ID NO: 297209 - RNA, 19 nt, Homo sapiens
acaccaagaaggacaucaa

SEQ ID NO: 297210 - RNA, 19 nt, Homo sapiens
ccagcugccgcucuaguug

SEQ ID NO: 297211 - RNA, 19 nt, Homo sapiens
ugagaaagugaagguauuc

SEQ ID NO: 297212 - RNA, 19 nt, Homo sapiens
gaacaugaguguguaaaug

SEQ ID NO: 297213 - RNA, 19 nt, Homo sapiens
gcacaaagauagacuacug

SEQ ID NO: 297214 - RNA, 19 nt, Homo sapiens
gacaagaaguauacacuaa

SEQ ID NO: 297215 - RNA, 19 nt, Homo sapiens
uaacacagaugauuccuau

SEQ ID NO: 297216 - RNA, 19 nt, Homo sapiens
gcugauggcuccuaccuuu

SEQ ID NO: 297217 - RNA, 19 nt, Homo sapiens
ggaagacggugcaagaaau

SEQ ID NO: 297218 - RNA, 19 nt, Homo sapiens
guacuggacuuuaccuuga

SEQ ID NO: 297219 - RNA, 19 nt, Homo sapiens
gaacaaagacaagaaguau

SEQ ID NO: 297220 - RNA, 19 nt, Homo sapiens
aaacaaggcuacauucuca

SEQ ID NO: 297221 - RNA, 19 nt, Homo sapiens
gggaaacgcugccgaagga

SEQ ID NO: 297222 - RNA, 19 nt, Homo sapiens
gcagaaggaucaacuacug

SEQ ID NO: 297223 - RNA, 19 nt, Homo sapiens
ccaaugguaucacuaugua

SEQ ID NO: 297224 - RNA, 19 nt, Homo sapiens
gcagcacccuggagcauaa

SEQ ID NO: 297225 - RNA, 19 nt, Homo sapiens
aaacaagcaucucuucuau

SEQ ID NO: 297226 - RNA, 19 nt, Homo sapiens
caugaaggauuugcucuua

SEQ ID NO: 297227 - RNA, 19 nt, Homo sapiens
caacaucccuggcucauac

SEQ ID NO: 297228 - RNA, 19 nt, Homo sapiens
aaagaugucugccaagcua

SEQ ID NO: 297229 - RNA, 19 nt, Homo sapiens
ggacuacugugccucagaa

SEQ ID NO: 297230 - RNA, 19 nt, Homo sapiens
gaagaaaugacacagagaa

SEQ ID NO: 297231 - RNA, 19 nt, Homo sapiens
ccacacagguccacacaga

SEQ ID NO: 297232 - RNA, 19 nt, Homo sapiens
cgacacauuuguagucauu

SEQ ID NO: 297233 - RNA, 19 nt, Homo sapiens
acacagcgcuuagaagaaa

SEQ ID NO: 297234 - RNA, 19 nt, Homo sapiens
gcagcacugucaagaauga

SEQ ID NO: 297235 - RNA, 19 nt, Homo sapiens
gagauacagaugaagauua

SEQ ID NO: 297236 - RNA, 19 nt, Homo sapiens
ggaaggaugucugcaaauc

SEQ ID NO: 297237 - RNA, 19 nt, Homo sapiens
cuacuuuccuguucuaauu

SEQ ID NO: 297238 - RNA, 19 nt, Homo sapiens
caaacaagcaucucuucua

SEQ ID NO: 297239 - RNA, 19 nt, Homo sapiens
gagugggccugcuccaaua

SEQ ID NO: 297240 - RNA, 19 nt, Homo sapiens
gacuuuaccuugauauaug

SEQ ID NO: 297241 - RNA, 19 nt, Homo sapiens
gucauuguaucacggauua

SEQ ID NO: 297242 - RNA, 19 nt, Homo sapiens
uaacacagcgcuuagaaga

SEQ ID NO: 297243 - RNA, 19 nt, Homo sapiens
caacauggacagauccuuu

SEQ ID NO: 297244 - RNA, 19 nt, Homo sapiens
ccagugccaugaaggauuu

SEQ ID NO: 297245 - RNA, 19 nt, Homo sapiens
gaaaugacacagagaaugg

SEQ ID NO: 297246 - RNA, 19 nt, Homo sapiens
gagccagucaccauaaaua

SEQ ID NO: 297247 - RNA, 19 nt, Homo sapiens
guuugucacuggaauuaua

SEQ ID NO: 297248 - RNA, 19 nt, Homo sapiens
gcacugaaggcccaauuga

SEQ ID NO: 297249 - RNA, 19 nt, Homo sapiens
gagcagcugugucugaaca

SEQ ID NO: 297250 - RNA, 19 nt, Homo sapiens
gcauaacugugcccacuuc

SEQ ID NO: 297251 - RNA, 19 nt, Homo sapiens
gaacacuggccauaggaaa

SEQ ID NO: 297252 - RNA, 19 nt, Homo sapiens
gaauuuaccaggugagaau

SEQ ID NO: 297253 - RNA, 19 nt, Homo sapiens
gaaggaaggaugucugcaa

SEQ ID NO: 297254 - RNA, 19 nt, Homo sapiens
gaacauucguguguaagca

SEQ ID NO: 297255 - RNA, 19 nt, Homo sapiens
ggaccacgguugugaacau

SEQ ID NO: 297256 - RNA, 19 nt, Homo sapiens
ggacuuuaccuugauauau

SEQ ID NO: 297257 - RNA, 19 nt, Homo sapiens
uaucacggauuacaaugaa

SEQ ID NO: 297258 - RNA, 19 nt, Homo sapiens
gaucaaugcaaaugugaaa

SEQ ID NO: 297259 - RNA, 19 nt, Homo sapiens
caacucagccaaagacaug

SEQ ID NO: 297260 - RNA, 19 nt, Homo sapiens
gaagacgugugcaaaauug

SEQ ID NO: 297261 - RNA, 19 nt, Homo sapiens
gauaaaguuugcacagucu

SEQ ID NO: 297262 - RNA, 19 nt, Homo sapiens
gcaaucucauuugacuaua

SEQ ID NO: 297263 - RNA, 19 nt, Homo sapiens
cuucagaauucuaagauga

SEQ ID NO: 297264 - RNA, 19 nt, Homo sapiens
ggacaucuugcaauucuug

SEQ ID NO: 297265 - RNA, 19 nt, Homo sapiens
gaaaaucgccugagauaca

SEQ ID NO: 297266 - RNA, 19 nt, Homo sapiens
gccagugcuuugaagguua

SEQ ID NO: 297267 - RNA, 19 nt, Homo sapiens
gaucagacgacuugcagaa

SEQ ID NO: 297268 - RNA, 19 nt, Homo sapiens
guagaacacuggccauagg

SEQ ID NO: 297269 - RNA, 19 nt, Homo sapiens
ugaauaagcuaugcaaggu

SEQ ID NO: 297270 - RNA, 19 nt, Homo sapiens
caagaaaggcaucugugaa

SEQ ID NO: 297271 - RNA, 19 nt, Homo sapiens
gcucuuaacccagaugaaa

SEQ ID NO: 297272 - RNA, 19 nt, Homo sapiens
caagaaguauacacuaacu

SEQ ID NO: 297273 - RNA, 19 nt, Homo sapiens
uaaaguuugcacagucuua

SEQ ID NO: 297274 - RNA, 19 nt, Homo sapiens
gaauaagcuaugcaaggua

SEQ ID NO: 297275 - RNA, 19 nt, Homo sapiens
gaaccuugcaaacgaagaa

SEQ ID NO: 297276 - RNA, 19 nt, Homo sapiens
gauaucuguuugaagaaga

SEQ ID NO: 297277 - RNA, 19 nt, Homo sapiens
gagaauggaagcccuggaa

SEQ ID NO: 297278 - RNA, 19 nt, Homo sapiens
ccagaaccuugcaaacgaa

SEQ ID NO: 297279 - RNA, 19 nt, Homo sapiens
gaccuacuuuccuguucua

SEQ ID NO: 297280 - RNA, 19 nt, Homo sapiens
gaagacggugcaagaaaug

SEQ ID NO: 297281 - RNA, 19 nt, Homo sapiens
gaaggaugucugcaaauca

SEQ ID NO: 297282 - RNA, 19 nt, Homo sapiens
aauaagcuaugcaagguau

SEQ ID NO: 297283 - RNA, 19 nt, Homo sapiens
agauacagaugaagauuag

SEQ ID NO: 297284 - RNA, 19 nt, Homo sapiens
cacaaaagcuuucccauuc

SEQ ID NO: 297285 - RNA, 19 nt, Homo sapiens
caacuacugugcacugaac

SEQ ID NO: 297286 - RNA, 19 nt, Homo sapiens
caacacccaugacuaugca

SEQ ID NO: 297287 - RNA, 19 nt, Homo sapiens
gaaugaauaagcuaugcaa

SEQ ID NO: 297288 - RNA, 19 nt, Homo sapiens
ccucugagcccacaaacaa

SEQ ID NO: 297289 - RNA, 19 nt, Homo sapiens
aaggaaggaugucugcaaa

SEQ ID NO: 297290 - RNA, 19 nt, Homo sapiens
uggcagcacugucaagaau

SEQ ID NO: 297291 - RNA, 19 nt, Homo sapiens
ggaagcccuuuggaagaaa

SEQ ID NO: 297292 - RNA, 19 nt, Homo sapiens
ggaggaacuacaagagauu

SEQ ID NO: 297293 - RNA, 19 nt, Homo sapiens
acacagaugauuccuauuc

SEQ ID NO: 297294 - RNA, 19 nt, Homo sapiens
caauauggcagcacuguca

SEQ ID NO: 297295 - RNA, 19 nt, Homo sapiens
uuagaaaucgcgacacauu

SEQ ID NO: 297296 - RNA, 19 nt, Homo sapiens
ucagagggauuuguucuag

SEQ ID NO: 297297 - RNA, 19 nt, Homo sapiens
gcagugaagauucguuugu

SEQ ID NO: 297298 - RNA, 19 nt, Homo sapiens
gagcaugagugcgucaaca

SEQ ID NO: 297299 - RNA, 19 nt, Homo sapiens
gaaugugccacgggucaua

SEQ ID NO: 297300 - RNA, 19 nt, Homo sapiens
augcaaaggucaaggaguu

SEQ ID NO: 297301 - RNA, 19 nt, Homo sapiens
ucaagaccuucaagaggaa

SEQ ID NO: 297302 - RNA, 19 nt, Homo sapiens
cauauguacuuguggaaca

SEQ ID NO: 297303 - RNA, 19 nt, Homo sapiens
ccaaagcucaggcuauugu

SEQ ID NO: 297304 - RNA, 19 nt, Homo sapiens
cuagaagacuccgauggaa

SEQ ID NO: 297305 - RNA, 19 nt, Homo sapiens
ucaagaaaggcaucuguga

SEQ ID NO: 297306 - RNA, 19 nt, Homo sapiens
gaggaggaacuacaagaga

SEQ ID NO: 297307 - RNA, 19 nt, Homo sapiens
aaggaugucugcaaaucaa

SEQ ID NO: 297308 - RNA, 19 nt, Homo sapiens
ucagacgacuugcagaauc

SEQ ID NO: 297309 - RNA, 19 nt, Homo sapiens
ugaaguccauugggaguga

SEQ ID NO: 297310 - RNA, 19 nt, Homo sapiens
guggacaucuugcaauucu

SEQ ID NO: 297311 - RNA, 19 nt, Homo sapiens
caaacgaagaaguaagaaa

SEQ ID NO: 297312 - RNA, 19 nt, Homo sapiens
gaacaugaguguguaaaug

SEQ ID NO: 297313 - RNA, 19 nt, Homo sapiens
gcacaaagauagacuacug

SEQ ID NO: 297314 - RNA, 19 nt, Homo sapiens
gacaagaaguauacacuaa

SEQ ID NO: 297315 - RNA, 19 nt, Homo sapiens
uaacacagaugauuccuau

SEQ ID NO: 297316 - RNA, 19 nt, Homo sapiens
gcugauggcuccuaccuuu

SEQ ID NO: 297317 - RNA, 19 nt, Homo sapiens
ggaagacggugcaagaaau

SEQ ID NO: 297318 - RNA, 19 nt, Homo sapiens
guacuggacuuuaccuuga

SEQ ID NO: 297319 - RNA, 19 nt, Homo sapiens
gaacaaagacaagaaguau

SEQ ID NO: 297320 - RNA, 19 nt, Homo sapiens
aaacaaggcuacauucuca

SEQ ID NO: 297321 - RNA, 19 nt, Homo sapiens
gggaaacgcugccgaagga

SEQ ID NO: 297322 - RNA, 19 nt, Homo sapiens
gcagaaggaucaacuacug

SEQ ID NO: 297323 - RNA, 19 nt, Homo sapiens
ccaaugguaucacuaugua

SEQ ID NO: 297324 - RNA, 19 nt, Homo sapiens
gcagcacccuggagcauaa

SEQ ID NO: 297325 - RNA, 19 nt, Homo sapiens
aaacaagcaucucuucuau

SEQ ID NO: 297326 - RNA, 19 nt, Homo sapiens
caugaaggauuugcucuua

SEQ ID NO: 297327 - RNA, 19 nt, Homo sapiens
caacaucccuggcucauac

SEQ ID NO: 297328 - RNA, 19 nt, Homo sapiens
aaagaugucugccaagcua

SEQ ID NO: 297329 - RNA, 19 nt, Homo sapiens
ggacuacugugccucagaa

SEQ ID NO: 297330 - RNA, 19 nt, Homo sapiens
gaagaaaugacacagagaa

SEQ ID NO: 297331 - RNA, 19 nt, Homo sapiens
ccacacagguccacacaga

SEQ ID NO: 297332 - RNA, 19 nt, Homo sapiens
cgacacauuuguagucauu

SEQ ID NO: 297333 - RNA, 19 nt, Homo sapiens
acacagcgcuuagaagaaa

SEQ ID NO: 297334 - RNA, 19 nt, Homo sapiens
gcagcacugucaagaauga

SEQ ID NO: 297335 - RNA, 19 nt, Homo sapiens
gagauacagaugaagauua

SEQ ID NO: 297336 - RNA, 19 nt, Homo sapiens
ggaaggaugucugcaaauc

SEQ ID NO: 297337 - RNA, 19 nt, Homo sapiens
caaacaagcaucucuucua

SEQ ID NO: 297338 - RNA, 19 nt, Homo sapiens
gagugggccugcuccaaua

SEQ ID NO: 297339 - RNA, 19 nt, Homo sapiens
gacuuuaccuugauauaug

SEQ ID NO: 297340 - RNA, 19 nt, Homo sapiens
gucauuguaucacggauua

SEQ ID NO: 297341 - RNA, 19 nt, Homo sapiens
uaacacagcgcuuagaaga

SEQ ID NO: 297342 - RNA, 19 nt, Homo sapiens
caacagugcaacacagaua

SEQ ID NO: 297343 - RNA, 19 nt, Homo sapiens
caacauggacagauccuuu

SEQ ID NO: 297344 - RNA, 19 nt, Homo sapiens
ccagugccaugaaggauuu

SEQ ID NO: 297345 - RNA, 19 nt, Homo sapiens
gaaaugacacagagaaugg

SEQ ID NO: 297346 - RNA, 19 nt, Homo sapiens
guuugucacuggaauuaua

SEQ ID NO: 297347 - RNA, 19 nt, Homo sapiens
gcacugaaggcccaauuga

SEQ ID NO: 297348 - RNA, 19 nt, Homo sapiens
gagcagcugugucugaaca

SEQ ID NO: 297349 - RNA, 19 nt, Homo sapiens
gcauaacugugcccacuuc

SEQ ID NO: 297350 - RNA, 19 nt, Homo sapiens
gaacacuggccauaggaaa

SEQ ID NO: 297351 - RNA, 19 nt, Homo sapiens
gaauuuaccaggugagaau

SEQ ID NO: 297352 - RNA, 19 nt, Homo sapiens
gaaggaaggaugucugcaa

SEQ ID NO: 297353 - RNA, 19 nt, Homo sapiens
gaacauucguguguaagca

SEQ ID NO: 297354 - RNA, 19 nt, Homo sapiens
ggaccacgguugugaacau

SEQ ID NO: 297355 - RNA, 19 nt, Homo sapiens
ggacuuuaccuugauauau

SEQ ID NO: 297356 - RNA, 19 nt, Homo sapiens
uaucacggauuacaaugaa

SEQ ID NO: 297357 - RNA, 19 nt, Homo sapiens
gaucaaugcaaaugugaaa

SEQ ID NO: 297358 - RNA, 19 nt, Homo sapiens
caacucagccaaagacaug

SEQ ID NO: 297359 - RNA, 19 nt, Homo sapiens
gaagacgugugcaaaauug

SEQ ID NO: 297360 - RNA, 19 nt, Homo sapiens
gauaaaguuugcacagucu

SEQ ID NO: 297361 - RNA, 19 nt, Homo sapiens
gcaaucucauuugacuaua

SEQ ID NO: 297362 - RNA, 19 nt, Homo sapiens
cuucagaauucuaagauga

SEQ ID NO: 297363 - RNA, 19 nt, Homo sapiens
ggacaucuugcaauucuug

SEQ ID NO: 297364 - RNA, 19 nt, Homo sapiens
gaaaaucgccugagauaca

SEQ ID NO: 297365 - RNA, 19 nt, Homo sapiens
gccagugcuuugaagguua

SEQ ID NO: 297366 - RNA, 19 nt, Homo sapiens
gaucagacgacuugcagaa

SEQ ID NO: 297367 - RNA, 19 nt, Homo sapiens
guagaacacuggccauagg

SEQ ID NO: 297368 - RNA, 19 nt, Homo sapiens
ugaauaagcuaugcaaggu

SEQ ID NO: 297369 - RNA, 19 nt, Homo sapiens
caagaaaggcaucugugaa

SEQ ID NO: 297370 - RNA, 19 nt, Homo sapiens
gcucuuaacccagaugaaa

SEQ ID NO: 297371 - RNA, 19 nt, Homo sapiens
caagaaguauacacuaacu

SEQ ID NO: 297372 - RNA, 19 nt, Homo sapiens
uaaaguuugcacagucuua

SEQ ID NO: 297373 - RNA, 19 nt, Homo sapiens
gaauaagcuaugcaaggua

SEQ ID NO: 297374 - RNA, 19 nt, Homo sapiens
gaaccuugcaaacgaagaa

SEQ ID NO: 297375 - RNA, 19 nt, Homo sapiens
gauaucuguuugaagaaga

SEQ ID NO: 297376 - RNA, 19 nt, Homo sapiens
gagaauggaagcccuggaa

SEQ ID NO: 297377 - RNA, 19 nt, Homo sapiens
ccagaaccuugcaaacgaa

SEQ ID NO: 297378 - RNA, 19 nt, Homo sapiens
gaagacggugcaagaaaug

SEQ ID NO: 297379 - RNA, 19 nt, Homo sapiens
gaaggaugucugcaaauca

SEQ ID NO: 297380 - RNA, 19 nt, Homo sapiens
aauaagcuaugcaagguau

SEQ ID NO: 297381 - RNA, 19 nt, Homo sapiens
agauacagaugaagauuag

SEQ ID NO: 297382 - RNA, 19 nt, Homo sapiens
cacaaaagcuuucccauuc

SEQ ID NO: 297383 - RNA, 19 nt, Homo sapiens
caacuacugugcacugaac

SEQ ID NO: 297384 - RNA, 19 nt, Homo sapiens
caacacccaugacuaugca

SEQ ID NO: 297385 - RNA, 19 nt, Homo sapiens
gaaugaauaagcuaugcaa

SEQ ID NO: 297386 - RNA, 19 nt, Homo sapiens
ccucugagcccacaaacaa

SEQ ID NO: 297387 - RNA, 19 nt, Homo sapiens
aaggaaggaugucugcaaa

SEQ ID NO: 297388 - RNA, 19 nt, Homo sapiens
uggcagcacugucaagaau

SEQ ID NO: 297389 - RNA, 19 nt, Homo sapiens
ggaagcccuuuggaagaaa

SEQ ID NO: 297390 - RNA, 19 nt, Homo sapiens
ggaggaacuacaagagauu

SEQ ID NO: 297391 - RNA, 19 nt, Homo sapiens
acacagaugauuccuauuc

SEQ ID NO: 297392 - RNA, 19 nt, Homo sapiens
caauauggcagcacuguca

SEQ ID NO: 297393 - RNA, 19 nt, Homo sapiens
uuagaaaucgcgacacauu

SEQ ID NO: 297394 - RNA, 19 nt, Homo sapiens
ucagagggauuuguucuag

SEQ ID NO: 297395 - RNA, 19 nt, Homo sapiens
gcagugaagauucguuugu

SEQ ID NO: 297396 - RNA, 19 nt, Homo sapiens
gagcaugagugcgucaaca

SEQ ID NO: 297397 - RNA, 19 nt, Homo sapiens
gaaugugccacgggucaua

SEQ ID NO: 297398 - RNA, 19 nt, Homo sapiens
ucaagaccuucaagaggaa

SEQ ID NO: 297399 - RNA, 19 nt, Homo sapiens
augcaaaggucaaggaguu

SEQ ID NO: 297400 - RNA, 19 nt, Homo sapiens
cauauguacuuguggaaca

SEQ ID NO: 297401 - RNA, 19 nt, Homo sapiens
ccaaagcucaggcuauugu

SEQ ID NO: 297402 - RNA, 19 nt, Homo sapiens
cuagaagacuccgauggaa

SEQ ID NO: 297403 - RNA, 19 nt, Homo sapiens
ucaagaaaggcaucuguga

SEQ ID NO: 297404 - RNA, 19 nt, Homo sapiens
gaggaggaacuacaagaga

SEQ ID NO: 297405 - RNA, 19 nt, Homo sapiens
aaggaugucugcaaaucaa

SEQ ID NO: 297406 - RNA, 19 nt, Homo sapiens
ucagacgacuugcagaauc

SEQ ID NO: 297407 - RNA, 19 nt, Homo sapiens
ugaaguccauugggaguga

SEQ ID NO: 297408 - RNA, 19 nt, Homo sapiens
guggacaucuugcaauucu

SEQ ID NO: 297409 - RNA, 19 nt, Homo sapiens
caaacgaagaaguaagaaa

SEQ ID NO: 297410 - RNA, 19 nt, Homo sapiens
caauggaugagauaaguga

SEQ ID NO: 297411 - RNA, 19 nt, Homo sapiens
ugugaacauucguguguaa

SEQ ID NO: 297412 - RNA, 19 nt, Homo sapiens
ggaaauacauaugcagaua

SEQ ID NO: 297413 - RNA, 19 nt, Homo sapiens
ggacaaauacaucguuaaa

SEQ ID NO: 297414 - RNA, 19 nt, Homo sapiens
agaaguggcucuuaucauu

SEQ ID NO: 297415 - RNA, 19 nt, Homo sapiens
gaacaaaacaguccuuuaa

SEQ ID NO: 297416 - RNA, 19 nt, Homo sapiens
gagcacuaguugugaauuu

SEQ ID NO: 297417 - RNA, 19 nt, Homo sapiens
gaacagggucccaucauug

SEQ ID NO: 297418 - RNA, 19 nt, Homo sapiens
gguaggaaauagaaugaaa

SEQ ID NO: 297419 - RNA, 19 nt, Homo sapiens
gaagacuuguuuccacuga

SEQ ID NO: 297420 - RNA, 19 nt, Homo sapiens
gaaauguacuacuaaagag

SEQ ID NO: 297421 - RNA, 19 nt, Homo sapiens
gaacauuacauugccauuu

SEQ ID NO: 297422 - RNA, 19 nt, Homo sapiens
ugacagaaguggcucuuau

SEQ ID NO: 297423 - RNA, 19 nt, Homo sapiens
gcuugaauauuacuggaua

SEQ ID NO: 297424 - RNA, 19 nt, Homo sapiens
uaacacagaucaagugaac

SEQ ID NO: 297425 - RNA, 19 nt, Homo sapiens
ccaauguuccugcuaauaa

SEQ ID NO: 297426 - RNA, 19 nt, Homo sapiens
gaccugguguuuaucauug

SEQ ID NO: 297427 - RNA, 19 nt, Homo sapiens
gcacugcucaauucuguuu

SEQ ID NO: 297428 - RNA, 19 nt, Homo sapiens
gguuauaccuugaaugaag

SEQ ID NO: 297429 - RNA, 19 nt, Homo sapiens
cuugauaggugugcucuua

SEQ ID NO: 297430 - RNA, 19 nt, Homo sapiens
gaaaugauugguaggaaau

SEQ ID NO: 297431 - RNA, 19 nt, Homo sapiens
ugaaaugauugguaggaaa

SEQ ID NO: 297432 - RNA, 19 nt, Homo sapiens
gaagcacgaagacuuguuu

SEQ ID NO: 297433 - RNA, 19 nt, Homo sapiens
ggaguauuauugaagaugu

SEQ ID NO: 297434 - RNA, 19 nt, Homo sapiens
ugaagaugcuuguggaugu

SEQ ID NO: 297435 - RNA, 19 nt, Homo sapiens
gcccuaggcucucaugguu

SEQ ID NO: 297436 - RNA, 19 nt, Homo sapiens
uaugagggcuacacucuga

SEQ ID NO: 297437 - RNA, 19 nt, Homo sapiens
gaagaugugaucaauagau

SEQ ID NO: 297438 - RNA, 19 nt, Homo sapiens
acacuaaacuugaugacau

SEQ ID NO: 297439 - RNA, 19 nt, Homo sapiens
caagauaaaugugcuuugg

SEQ ID NO: 297440 - RNA, 19 nt, Homo sapiens
gauccaagugacaaaguua

SEQ ID NO: 297441 - RNA, 19 nt, Homo sapiens
ucaagaugauggccaguga

SEQ ID NO: 297442 - RNA, 19 nt, Homo sapiens
ggacagcuugguguacuua

SEQ ID NO: 297443 - RNA, 19 nt, Homo sapiens
gaaguggcucuuaucauug

SEQ ID NO: 297444 - RNA, 19 nt, Homo sapiens
cuuugaaacuugcaacuuu

SEQ ID NO: 297445 - RNA, 19 nt, Homo sapiens
ggauccaagugacaaaguu

SEQ ID NO: 297446 - RNA, 19 nt, Homo sapiens
aaagagcacuaguugugaa

SEQ ID NO: 297447 - RNA, 19 nt, Homo sapiens
aauggaaacuuuaggucua

SEQ ID NO: 297448 - RNA, 19 nt, Homo sapiens
cuaaagagcacuaguugug

SEQ ID NO: 297449 - RNA, 19 nt, Homo sapiens
gaauauggacaaauacauc

SEQ ID NO: 297450 - RNA, 19 nt, Homo sapiens
ccaagcaucugguauugag

SEQ ID NO: 297451 - RNA, 19 nt, Homo sapiens
ccaaagugcugggauuaca

SEQ ID NO: 297452 - RNA, 19 nt, Homo sapiens
acagaucaagugaacauua

SEQ ID NO: 297453 - RNA, 19 nt, Homo sapiens
uuacugagagugcaaauug

SEQ ID NO: 297454 - RNA, 19 nt, Homo sapiens
caauguuccugcuaauaau

SEQ ID NO: 297455 - RNA, 19 nt, Homo sapiens
agacugaacacuaaacuug

SEQ ID NO: 297456 - RNA, 19 nt, Homo sapiens
gaagaugcuuguggaugug

SEQ ID NO: 297457 - RNA, 19 nt, Homo sapiens
uauccuggcuacaccuuaa

SEQ ID NO: 297458 - RNA, 19 nt, Homo sapiens
cagcuugguguacuuaaua

SEQ ID NO: 297459 - RNA, 19 nt, Homo sapiens
agaacagggucccaucauu

SEQ ID NO: 297460 - RNA, 19 nt, Homo sapiens
gcaaauuguacaagguauu

SEQ ID NO: 297461 - RNA, 19 nt, Homo sapiens
ccaaggaaauacauaugca

SEQ ID NO: 297462 - RNA, 19 nt, Homo sapiens
gcccaagcaucugguauug

SEQ ID NO: 297463 - RNA, 19 nt, Homo sapiens
gaaacuugcaacuuugaga

SEQ ID NO: 297464 - RNA, 19 nt, Homo sapiens
gaggaagcacgaagacuug

SEQ ID NO: 297465 - RNA, 19 nt, Homo sapiens
gacauggcgucccucaaga

SEQ ID NO: 297466 - RNA, 19 nt, Homo sapiens
caucugguauugagcucua

SEQ ID NO: 297467 - RNA, 19 nt, Homo sapiens
aaggucagcucguaucuuc

SEQ ID NO: 297468 - RNA, 19 nt, Homo sapiens
guuggaguauuauugaaga

SEQ ID NO: 297469 - RNA, 19 nt, Homo sapiens
ggacaaggucagcucguau

SEQ ID NO: 297470 - RNA, 19 nt, Homo sapiens
ccuuggaccugguguuuau

SEQ ID NO: 297471 - RNA, 19 nt, Homo sapiens
ggaccugguguuuaucauu

SEQ ID NO: 297472 - RNA, 19 nt, Homo sapiens
guuauaccuugaaugaaga

SEQ ID NO: 297473 - RNA, 19 nt, Homo sapiens
ugagugcuaugaagguuau

SEQ ID NO: 297474 - RNA, 19 nt, Homo sapiens
cacuaaacuugaugacauu

SEQ ID NO: 297475 - RNA, 19 nt, Homo sapiens
cagauaagcagucccugaa

SEQ ID NO: 297476 - RNA, 19 nt, Homo sapiens
uaagguggccaucauuguu

SEQ ID NO: 297477 - RNA, 19 nt, Homo sapiens
cagaucaagugaacauuac

SEQ ID NO: 297478 - RNA, 19 nt, Homo sapiens
gugcaaauuguacaaggua

SEQ ID NO: 297479 - RNA, 19 nt, Homo sapiens
cuacuaauugagccauuua

SEQ ID NO: 297480 - RNA, 19 nt, Homo sapiens
gaaauacauaugcagauac

SEQ ID NO: 297481 - RNA, 19 nt, Homo sapiens
uuacaggcuugaaagucua

SEQ ID NO: 297482 - RNA, 19 nt, Homo sapiens
ggucuaguuucuuuugaua

SEQ ID NO: 297483 - RNA, 19 nt, Homo sapiens
cuuuaggucuaguuucuuu

SEQ ID NO: 297484 - RNA, 19 nt, Homo sapiens
gugaaaugauugguaggaa

SEQ ID NO: 297485 - RNA, 19 nt, Homo sapiens
agagcaaacuuuagugucu

SEQ ID NO: 297486 - RNA, 19 nt, Homo sapiens
gcacugugaagaucgaguu

SEQ ID NO: 297487 - RNA, 19 nt, Homo sapiens
cuccaggccuacacagaua

SEQ ID NO: 297488 - RNA, 19 nt, Homo sapiens
ggguggcaguggugaacua

SEQ ID NO: 297489 - RNA, 19 nt, Homo sapiens
aaucgacacucuggacauu

SEQ ID NO: 297490 - RNA, 19 nt, Homo sapiens
uaaagagcacuaguuguga

SEQ ID NO: 297491 - RNA, 19 nt, Homo sapiens
caagugaacauuacauugc

SEQ ID NO: 297492 - RNA, 19 nt, Homo sapiens
ggucagcucguaucuucaa

SEQ ID NO: 297493 - RNA, 19 nt, Homo sapiens
gcacuaguugugaauuuag

SEQ ID NO: 297494 - RNA, 19 nt, Homo sapiens
caacuucauauaacugaga

SEQ ID NO: 297495 - RNA, 19 nt, Homo sapiens
uuguucagcucaagauaaa

SEQ ID NO: 297496 - RNA, 19 nt, Homo sapiens
ucaagugaacauuacauug

SEQ ID NO: 297497 - RNA, 19 nt, Homo sapiens
cuggauaaauuguaugaag

SEQ ID NO: 297498 - RNA, 19 nt, Homo sapiens
ugaggaagcacgaagacuu

SEQ ID NO: 297499 - RNA, 19 nt, Homo sapiens
gaaaacguguucagcucuu

SEQ ID NO: 297500 - RNA, 19 nt, Homo sapiens
ucguuugcauugucuuuaa

SEQ ID NO: 297501 - RNA, 19 nt, Homo sapiens
aguuaugacugugaaauga

SEQ ID NO: 297502 - RNA, 19 nt, Homo sapiens
uaagagcaaacuuuagugu

SEQ ID NO: 297503 - RNA, 19 nt, Homo sapiens
gccaauguuccugcuaaua

SEQ ID NO: 297504 - RNA, 19 nt, Homo sapiens
gcacgaagacuuguuucca

SEQ ID NO: 297505 - RNA, 19 nt, Homo sapiens
aagguggccaucauuguua

SEQ ID NO: 297506 - RNA, 19 nt, Homo sapiens
cuaccacugugauugcuau

SEQ ID NO: 297507 - RNA, 19 nt, Homo sapiens
guucagcucaagauaaaug

SEQ ID NO: 297508 - RNA, 19 nt, Homo sapiens
ggaaggcaagcaccacugu

SEQ ID NO: 297509 - RNA, 19 nt, Homo sapiens
ggccaucauuguuacagau

SEQ ID NO: 297510 - RNA, 19 nt, Homo sapiens
aaacuugcaacuuugagaa

SEQ ID NO: 297511 - RNA, 19 nt, Homo sapiens
ccaagugacaaaguuauau

SEQ ID NO: 297512 - RNA, 19 nt, Homo sapiens
agaauugucuugcaaguua

SEQ ID NO: 297513 - RNA, 19 nt, Homo sapiens
gaacugcucuacuuugaga

SEQ ID NO: 297514 - RNA, 19 nt, Homo sapiens
gcaaagcgacagauucaua

SEQ ID NO: 297515 - RNA, 19 nt, Homo sapiens
gaaccugucuccauugugu

SEQ ID NO: 297516 - RNA, 19 nt, Homo sapiens
cagagucgcuggcauguuu

SEQ ID NO: 297517 - RNA, 19 nt, Homo sapiens
ggaagaagcuccggaugga

SEQ ID NO: 297518 - RNA, 19 nt, Homo sapiens
gaaauagagccaacugauu

SEQ ID NO: 297519 - RNA, 19 nt, Homo sapiens
caaacgggcucaucauaau

SEQ ID NO: 297520 - RNA, 19 nt, Homo sapiens
gaaugaacccuccuccuuu

SEQ ID NO: 297521 - RNA, 19 nt, Homo sapiens
gcauagagguuuuguauug

SEQ ID NO: 297522 - RNA, 19 nt, Homo sapiens
uagagaaguuugugguaua

SEQ ID NO: 297523 - RNA, 19 nt, Homo sapiens
ggacucggcuuguuguugu

SEQ ID NO: 297524 - RNA, 19 nt, Homo sapiens
agacaaagccacagaauau

SEQ ID NO: 297525 - RNA, 19 nt, Homo sapiens
guaaauaccaagagcaauu

SEQ ID NO: 297526 - RNA, 19 nt, Homo sapiens
guuuaggccucauuucuuu

SEQ ID NO: 297527 - RNA, 19 nt, Homo sapiens
cguagaagcucuuggacaa

SEQ ID NO: 297528 - RNA, 19 nt, Homo sapiens
gaugaccgguuuggaguaa

SEQ ID NO: 297529 - RNA, 19 nt, Homo sapiens
cgacagauucauaaaguaa

SEQ ID NO: 297530 - RNA, 19 nt, Homo sapiens
aaucugaacugcucuacuu

SEQ ID NO: 297531 - RNA, 19 nt, Homo sapiens
gaauuguaccuauuucuga

SEQ ID NO: 297532 - RNA, 19 nt, Homo sapiens
gacaaacgggcucaucaua

SEQ ID NO: 297533 - RNA, 19 nt, Homo sapiens
gcgacagauucauaaagua

SEQ ID NO: 297534 - RNA, 19 nt, Homo sapiens
caaagcgacagauucauaa

SEQ ID NO: 297535 - RNA, 19 nt, Homo sapiens
gaauugucuugcaaguuaa

SEQ ID NO: 297536 - RNA, 19 nt, Homo sapiens
gacaacagcucucguucuc

SEQ ID NO: 297537 - RNA, 19 nt, Homo sapiens
ccacagaauauauccagua

SEQ ID NO: 297538 - RNA, 19 nt, Homo sapiens
ggaaaugagcgauaacgau

SEQ ID NO: 297539 - RNA, 19 nt, Homo sapiens
guagggaccacaucaaaga

SEQ ID NO: 297540 - RNA, 19 nt, Homo sapiens
ggcauuugcugauuucuag

SEQ ID NO: 297541 - RNA, 19 nt, Homo sapiens
gaccagauccuuagagaag

SEQ ID NO: 297542 - RNA, 19 nt, Homo sapiens
cguaggaaaugagcgauaa

SEQ ID NO: 297543 - RNA, 19 nt, Homo sapiens
ugagugaauuguaccuauu

SEQ ID NO: 297544 - RNA, 19 nt, Homo sapiens
gacaaagccacagaauaua

SEQ ID NO: 297545 - RNA, 19 nt, Homo sapiens
auaaugcacuggaacgaaa

SEQ ID NO: 297546 - RNA, 19 nt, Homo sapiens
agagaaguuugugguauaa

SEQ ID NO: 297547 - RNA, 19 nt, Homo sapiens
uugagaagaugaccgguuu

SEQ ID NO: 297548 - RNA, 19 nt, Homo sapiens
ggagagcgacgaagagcaa

SEQ ID NO: 297549 - RNA, 19 nt, Homo sapiens
cacagaauauauccaguau

SEQ ID NO: 297550 - RNA, 19 nt, Homo sapiens
acaaacgggcucaucauaa

SEQ ID NO: 297551 - RNA, 19 nt, Homo sapiens
uguauacucuguagucuca

SEQ ID NO: 297552 - RNA, 19 nt, Homo sapiens
ugagagagcgagugaguga

SEQ ID NO: 297553 - RNA, 19 nt, Homo sapiens
gaaucugagugaauuguac

SEQ ID NO: 297554 - RNA, 19 nt, Homo sapiens
ggagauggcagcagugaag

SEQ ID NO: 297555 - RNA, 19 nt, Homo sapiens
ccauuuccacuguauauuu

SEQ ID NO: 297556 - RNA, 19 nt, Homo sapiens
ccagauccuuagagaaguu

SEQ ID NO: 297557 - RNA, 19 nt, Homo sapiens
gagugaauuguaccuauuu

SEQ ID NO: 297558 - RNA, 19 nt, Homo sapiens
gaaagaccagauccuuaga

SEQ ID NO: 297559 - RNA, 19 nt, Homo sapiens
agacagcuuucacaguuug

SEQ ID NO: 297560 - RNA, 19 nt, Homo sapiens
gcugauuucuaguguauac

SEQ ID NO: 297561 - RNA, 19 nt, Homo sapiens
ccacuuccuuuccuacugu

SEQ ID NO: 297562 - RNA, 19 nt, Homo sapiens
guaccuauuucugaugaug

SEQ ID NO: 297563 - RNA, 19 nt, Homo sapiens
ugaaagaccagauccuuag

SEQ ID NO: 297564 - RNA, 19 nt, Homo sapiens
cugaacugcucuacuuuga

SEQ ID NO: 297565 - RNA, 19 nt, Homo sapiens
ugauagacuuugugaaucu

SEQ ID NO: 297566 - RNA, 19 nt, Homo sapiens
uagacaaagccacagaaua

SEQ ID NO: 297567 - RNA, 19 nt, Homo sapiens
caccaucucugccuucgau

SEQ ID NO: 297568 - RNA, 19 nt, Homo sapiens
uuagagaaguuugugguau

SEQ ID NO: 297569 - RNA, 19 nt, Homo sapiens
ccucaccucugauagacuu

SEQ ID NO: 297570 - RNA, 19 nt, Homo sapiens
gaggucaagugcccaacug

SEQ ID NO: 297571 - RNA, 19 nt, Homo sapiens
acacacaccagcaagauau

SEQ ID NO: 297572 - RNA, 19 nt, Homo sapiens
acaaagccacagaauauau

SEQ ID NO: 297573 - RNA, 19 nt, Homo sapiens
guucguguuugauuccauu

SEQ ID NO: 297574 - RNA, 19 nt, Homo sapiens
gaugaugucggucuugcaa

SEQ ID NO: 297575 - RNA, 19 nt, Homo sapiens
gagggccagugaugauguu

SEQ ID NO: 297576 - RNA, 19 nt, Homo sapiens
uagaagcucuuggacaaca

SEQ ID NO: 297577 - RNA, 19 nt, Homo sapiens
agaaugaacccuccuccuu

SEQ ID NO: 297578 - RNA, 19 nt, Homo sapiens
ggacaacagcucucguucu

SEQ ID NO: 297579 - RNA, 19 nt, Homo sapiens
acaacagccucuacaccaa

SEQ ID NO: 297580 - RNA, 19 nt, Homo sapiens
cuauguaucgcuccuauug

SEQ ID NO: 297581 - RNA, 19 nt, Homo sapiens
guagagcccucagaaccau

SEQ ID NO: 297582 - RNA, 19 nt, Homo sapiens
aagaccagauccuuagaga

SEQ ID NO: 297583 - RNA, 19 nt, Homo sapiens
ucugauagacuuugugaau

SEQ ID NO: 297584 - RNA, 19 nt, Homo sapiens
ccggaccucugagcacaua

SEQ ID NO: 297585 - RNA, 19 nt, Homo sapiens
caucgucucauccuccuuu

SEQ ID NO: 297586 - RNA, 19 nt, Homo sapiens
agucucaguucguguuuga

SEQ ID NO: 297587 - RNA, 19 nt, Homo sapiens
ggucagcagaugccaguga

SEQ ID NO: 297588 - RNA, 19 nt, Homo sapiens
gagaaggcgaggucaagug

SEQ ID NO: 297589 - RNA, 19 nt, Homo sapiens
caaagccacagaauauauc

SEQ ID NO: 297590 - RNA, 19 nt, Homo sapiens
uugaaagaccagauccuua

SEQ ID NO: 297591 - RNA, 19 nt, Homo sapiens
gggcccaaauccuagacaa

SEQ ID NO: 297592 - RNA, 19 nt, Homo sapiens
uugcugauuucuaguguau

SEQ ID NO: 297593 - RNA, 19 nt, Homo sapiens
gugacacucucgugguaug

SEQ ID NO: 297594 - RNA, 19 nt, Homo sapiens
gcucuacuuugagaagaug

SEQ ID NO: 297595 - RNA, 19 nt, Homo sapiens
gcacuggaacgaaaacgua

SEQ ID NO: 297596 - RNA, 19 nt, Homo sapiens
aagacagcuuucacaguuu

SEQ ID NO: 297597 - RNA, 19 nt, Homo sapiens
cuacuccguuccuggcauu

SEQ ID NO: 297598 - RNA, 19 nt, Homo sapiens
gucagcagaugccagugaa

SEQ ID NO: 297599 - RNA, 19 nt, Homo sapiens
agaaauagagccaacugau

SEQ ID NO: 297600 - RNA, 19 nt, Homo sapiens
aaacguagggaccacauca

SEQ ID NO: 297601 - RNA, 19 nt, Homo sapiens
caucccacuuccuuuccua

SEQ ID NO: 297602 - RNA, 19 nt, Homo sapiens
guauugagggccagugaug

SEQ ID NO: 297603 - RNA, 19 nt, Homo sapiens
ggacagggaggguguuuug

SEQ ID NO: 297604 - RNA, 19 nt, Homo sapiens
uaucgcuccuauugaaaga

SEQ ID NO: 297605 - RNA, 19 nt, Homo sapiens
ccucagaaccauuuaagag

SEQ ID NO: 297606 - RNA, 19 nt, Homo sapiens
gugcccaacugcagaccaa

SEQ ID NO: 297607 - RNA, 19 nt, Homo sapiens
uguacauacugccgaagaa

SEQ ID NO: 297608 - RNA, 19 nt, Homo sapiens
ugaugucggucuugcaaag

SEQ ID NO: 297609 - RNA, 19 nt, Homo sapiens
cugagugaauuguaccuau

SEQ ID NO: 297610 - RNA, 19 nt, Homo sapiens
auguaucgcuccuauugaa

SEQ ID NO: 297611 - RNA, 19 nt, Homo sapiens
gauagacuuugugaaucug

SEQ ID NO: 297612 - RNA, 19 nt, Homo sapiens
agaauugucuugcaaguua

SEQ ID NO: 297613 - RNA, 19 nt, Homo sapiens
gaacugcucuacuuugaga

SEQ ID NO: 297614 - RNA, 19 nt, Homo sapiens
gcaaagcgacagauucaua

SEQ ID NO: 297615 - RNA, 19 nt, Homo sapiens
gaaccugucuccauugugu

SEQ ID NO: 297616 - RNA, 19 nt, Homo sapiens
cagagucgcuggcauguuu

SEQ ID NO: 297617 - RNA, 19 nt, Homo sapiens
ggaagaagcuccggaugga

SEQ ID NO: 297618 - RNA, 19 nt, Homo sapiens
gaaauagagccaacugauu

SEQ ID NO: 297619 - RNA, 19 nt, Homo sapiens
caaacgggcucaucauaau

SEQ ID NO: 297620 - RNA, 19 nt, Homo sapiens
gaaugaacccuccuccuuu

SEQ ID NO: 297621 - RNA, 19 nt, Homo sapiens
gcauagagguuuuguauug

SEQ ID NO: 297622 - RNA, 19 nt, Homo sapiens
uagagaaguuugugguaua

SEQ ID NO: 297623 - RNA, 19 nt, Homo sapiens
ggacucggcuuguuguugu

SEQ ID NO: 297624 - RNA, 19 nt, Homo sapiens
agacaaagccacagaauau

SEQ ID NO: 297625 - RNA, 19 nt, Homo sapiens
guaaauaccaagagcaauu

SEQ ID NO: 297626 - RNA, 19 nt, Homo sapiens
guuuaggccucauuucuuu

SEQ ID NO: 297627 - RNA, 19 nt, Homo sapiens
cguagaagcucuuggacaa

SEQ ID NO: 297628 - RNA, 19 nt, Homo sapiens
gaugaccgguuuggaguaa

SEQ ID NO: 297629 - RNA, 19 nt, Homo sapiens
cgacagauucauaaaguaa

SEQ ID NO: 297630 - RNA, 19 nt, Homo sapiens
aaucugaacugcucuacuu

SEQ ID NO: 297631 - RNA, 19 nt, Homo sapiens
gaauuguaccuauuucuga

SEQ ID NO: 297632 - RNA, 19 nt, Homo sapiens
gacaaacgggcucaucaua

SEQ ID NO: 297633 - RNA, 19 nt, Homo sapiens
gcgacagauucauaaagua

SEQ ID NO: 297634 - RNA, 19 nt, Homo sapiens
caaagcgacagauucauaa

SEQ ID NO: 297635 - RNA, 19 nt, Homo sapiens
gaauugucuugcaaguuaa

SEQ ID NO: 297636 - RNA, 19 nt, Homo sapiens
gacaacagcucucguucuc

SEQ ID NO: 297637 - RNA, 19 nt, Homo sapiens
ccacagaauauauccagua

SEQ ID NO: 297638 - RNA, 19 nt, Homo sapiens
ggaaaugagcgauaacgau

SEQ ID NO: 297639 - RNA, 19 nt, Homo sapiens
guagggaccacaucaaaga

SEQ ID NO: 297640 - RNA, 19 nt, Homo sapiens
ggcauuugcugauuucuag

SEQ ID NO: 297641 - RNA, 19 nt, Homo sapiens
gaccagauccuuagagaag

SEQ ID NO: 297642 - RNA, 19 nt, Homo sapiens
cguaggaaaugagcgauaa

SEQ ID NO: 297643 - RNA, 19 nt, Homo sapiens
ugagugaauuguaccuauu

SEQ ID NO: 297644 - RNA, 19 nt, Homo sapiens
gacaaagccacagaauaua

SEQ ID NO: 297645 - RNA, 19 nt, Homo sapiens
auaaugcacuggaacgaaa

SEQ ID NO: 297646 - RNA, 19 nt, Homo sapiens
agagaaguuugugguauaa

SEQ ID NO: 297647 - RNA, 19 nt, Homo sapiens
uugagaagaugaccgguuu

SEQ ID NO: 297648 - RNA, 19 nt, Homo sapiens
cacagaauauauccaguau

SEQ ID NO: 297649 - RNA, 19 nt, Homo sapiens
acaaacgggcucaucauaa

SEQ ID NO: 297650 - RNA, 19 nt, Homo sapiens
uguauacucuguagucuca

SEQ ID NO: 297651 - RNA, 19 nt, Homo sapiens
ugagagagcgagugaguga

SEQ ID NO: 297652 - RNA, 19 nt, Homo sapiens
gaaucugagugaauuguac

SEQ ID NO: 297653 - RNA, 19 nt, Homo sapiens
ggagauggcagcagugaag

SEQ ID NO: 297654 - RNA, 19 nt, Homo sapiens
ccauuuccacuguauauuu

SEQ ID NO: 297655 - RNA, 19 nt, Homo sapiens
ccagauccuuagagaaguu

SEQ ID NO: 297656 - RNA, 19 nt, Homo sapiens
gagugaauuguaccuauuu

SEQ ID NO: 297657 - RNA, 19 nt, Homo sapiens
gaaagaccagauccuuaga

SEQ ID NO: 297658 - RNA, 19 nt, Homo sapiens
agacagcuuucacaguuug

SEQ ID NO: 297659 - RNA, 19 nt, Homo sapiens
gcugauuucuaguguauac

SEQ ID NO: 297660 - RNA, 19 nt, Homo sapiens
ccacuuccuuuccuacugu

SEQ ID NO: 297661 - RNA, 19 nt, Homo sapiens
guaccuauuucugaugaug

SEQ ID NO: 297662 - RNA, 19 nt, Homo sapiens
ugaaagaccagauccuuag

SEQ ID NO: 297663 - RNA, 19 nt, Homo sapiens
cugaacugcucuacuuuga

SEQ ID NO: 297664 - RNA, 19 nt, Homo sapiens
ugauagacuuugugaaucu

SEQ ID NO: 297665 - RNA, 19 nt, Homo sapiens
uagacaaagccacagaaua

SEQ ID NO: 297666 - RNA, 19 nt, Homo sapiens
caccaucucugccuucgau

SEQ ID NO: 297667 - RNA, 19 nt, Homo sapiens
uuagagaaguuugugguau

SEQ ID NO: 297668 - RNA, 19 nt, Homo sapiens
ccucaccucugauagacuu

SEQ ID NO: 297669 - RNA, 19 nt, Homo sapiens
gaggucaagugcccaacug

SEQ ID NO: 297670 - RNA, 19 nt, Homo sapiens
acacacaccagcaagauau

SEQ ID NO: 297671 - RNA, 19 nt, Homo sapiens
acaaagccacagaauauau

SEQ ID NO: 297672 - RNA, 19 nt, Homo sapiens
guucguguuugauuccauu

SEQ ID NO: 297673 - RNA, 19 nt, Homo sapiens
gaugaugucggucuugcaa

SEQ ID NO: 297674 - RNA, 19 nt, Homo sapiens
gagggccagugaugauguu

SEQ ID NO: 297675 - RNA, 19 nt, Homo sapiens
uagaagcucuuggacaaca

SEQ ID NO: 297676 - RNA, 19 nt, Homo sapiens
agaaugaacccuccuccuu

SEQ ID NO: 297677 - RNA, 19 nt, Homo sapiens
ggacaacagcucucguucu

SEQ ID NO: 297678 - RNA, 19 nt, Homo sapiens
acaacagccucuacaccaa

SEQ ID NO: 297679 - RNA, 19 nt, Homo sapiens
cuauguaucgcuccuauug

SEQ ID NO: 297680 - RNA, 19 nt, Homo sapiens
guagagcccucagaaccau

SEQ ID NO: 297681 - RNA, 19 nt, Homo sapiens
aagaccagauccuuagaga

SEQ ID NO: 297682 - RNA, 19 nt, Homo sapiens
ucugauagacuuugugaau

SEQ ID NO: 297683 - RNA, 19 nt, Homo sapiens
ccggaccucugagcacaua

SEQ ID NO: 297684 - RNA, 19 nt, Homo sapiens
caucgucucauccuccuuu

SEQ ID NO: 297685 - RNA, 19 nt, Homo sapiens
agucucaguucguguuuga

SEQ ID NO: 297686 - RNA, 19 nt, Homo sapiens
ggucagcagaugccaguga

SEQ ID NO: 297687 - RNA, 19 nt, Homo sapiens
gagaaggcgaggucaagug

SEQ ID NO: 297688 - RNA, 19 nt, Homo sapiens
caaagccacagaauauauc

SEQ ID NO: 297689 - RNA, 19 nt, Homo sapiens
uugaaagaccagauccuua

SEQ ID NO: 297690 - RNA, 19 nt, Homo sapiens
gggcccaaauccuagacaa

SEQ ID NO: 297691 - RNA, 19 nt, Homo sapiens
uugcugauuucuaguguau

SEQ ID NO: 297692 - RNA, 19 nt, Homo sapiens
gugacacucucgugguaug

SEQ ID NO: 297693 - RNA, 19 nt, Homo sapiens
gcacuggaacgaaaacgua

SEQ ID NO: 297694 - RNA, 19 nt, Homo sapiens
gcucuacuuugagaagaug

SEQ ID NO: 297695 - RNA, 19 nt, Homo sapiens
aagacagcuuucacaguuu

SEQ ID NO: 297696 - RNA, 19 nt, Homo sapiens
cuacuccguuccuggcauu

SEQ ID NO: 297697 - RNA, 19 nt, Homo sapiens
gucagcagaugccagugaa

SEQ ID NO: 297698 - RNA, 19 nt, Homo sapiens
agaaauagagccaacugau

SEQ ID NO: 297699 - RNA, 19 nt, Homo sapiens
aaacguagggaccacauca

SEQ ID NO: 297700 - RNA, 19 nt, Homo sapiens
caucccacuuccuuuccua

SEQ ID NO: 297701 - RNA, 19 nt, Homo sapiens
guauugagggccagugaug

SEQ ID NO: 297702 - RNA, 19 nt, Homo sapiens
ggacagggaggguguuuug

SEQ ID NO: 297703 - RNA, 19 nt, Homo sapiens
uaucgcuccuauugaaaga

SEQ ID NO: 297704 - RNA, 19 nt, Homo sapiens
ccucagaaccauuuaagag

SEQ ID NO: 297705 - RNA, 19 nt, Homo sapiens
gugcccaacugcagaccaa

SEQ ID NO: 297706 - RNA, 19 nt, Homo sapiens
uguacauacugccgaagaa

SEQ ID NO: 297707 - RNA, 19 nt, Homo sapiens
ugaugucggucuugcaaag

SEQ ID NO: 297708 - RNA, 19 nt, Homo sapiens
cugagugaauuguaccuau

SEQ ID NO: 297709 - RNA, 19 nt, Homo sapiens
auguaucgcuccuauugaa

SEQ ID NO: 297710 - RNA, 19 nt, Homo sapiens
gauagacuuugugaaucug

SEQ ID NO: 297711 - RNA, 19 nt, Homo sapiens
gcccaaauccuagacaaag

SEQ ID NO: 297712 - RNA, 19 nt, Homo sapiens
agaauugucuugcaaguua

SEQ ID NO: 297713 - RNA, 19 nt, Homo sapiens
gaacugcucuacuuugaga

SEQ ID NO: 297714 - RNA, 19 nt, Homo sapiens
gcaaagcgacagauucaua

SEQ ID NO: 297715 - RNA, 19 nt, Homo sapiens
gaaccugucuccauugugu

SEQ ID NO: 297716 - RNA, 19 nt, Homo sapiens
cagagucgcuggcauguuu

SEQ ID NO: 297717 - RNA, 19 nt, Homo sapiens
ggaagaagcuccggaugga

SEQ ID NO: 297718 - RNA, 19 nt, Homo sapiens
gaaauagagccaacugauu

SEQ ID NO: 297719 - RNA, 19 nt, Homo sapiens
caaacgggcucaucauaau

SEQ ID NO: 297720 - RNA, 19 nt, Homo sapiens
gaaugaacccuccuccuuu

SEQ ID NO: 297721 - RNA, 19 nt, Homo sapiens
gcauagagguuuuguauug

SEQ ID NO: 297722 - RNA, 19 nt, Homo sapiens
uagagaaguuugugguaua

SEQ ID NO: 297723 - RNA, 19 nt, Homo sapiens
ggacucggcuuguuguugu

SEQ ID NO: 297724 - RNA, 19 nt, Homo sapiens
agacaaagccacagaauau

SEQ ID NO: 297725 - RNA, 19 nt, Homo sapiens
guaaauaccaagagcaauu

SEQ ID NO: 297726 - RNA, 19 nt, Homo sapiens
cauggaagaugcaaguaaa

SEQ ID NO: 297727 - RNA, 19 nt, Homo sapiens
guuuaggccucauuucuuu

SEQ ID NO: 297728 - RNA, 19 nt, Homo sapiens
cguagaagcucuuggacaa

SEQ ID NO: 297729 - RNA, 19 nt, Homo sapiens
gaugaccgguuuggaguaa

SEQ ID NO: 297730 - RNA, 19 nt, Homo sapiens
cgacagauucauaaaguaa

SEQ ID NO: 297731 - RNA, 19 nt, Homo sapiens
aaucugaacugcucuacuu

SEQ ID NO: 297732 - RNA, 19 nt, Homo sapiens
gaauuguaccuauuucuga

SEQ ID NO: 297733 - RNA, 19 nt, Homo sapiens
gacaaacgggcucaucaua

SEQ ID NO: 297734 - RNA, 19 nt, Homo sapiens
gcgacagauucauaaagua

SEQ ID NO: 297735 - RNA, 19 nt, Homo sapiens
caaagcgacagauucauaa

SEQ ID NO: 297736 - RNA, 19 nt, Homo sapiens
gaauugucuugcaaguuaa

SEQ ID NO: 297737 - RNA, 19 nt, Homo sapiens
gacaacagcucucguucuc

SEQ ID NO: 297738 - RNA, 19 nt, Homo sapiens
ccacagaauauauccagua

SEQ ID NO: 297739 - RNA, 19 nt, Homo sapiens
ggaaaugagcgauaacgau

SEQ ID NO: 297740 - RNA, 19 nt, Homo sapiens
guagggaccacaucaaaga

SEQ ID NO: 297741 - RNA, 19 nt, Homo sapiens
ggcauuugcugauuucuag

SEQ ID NO: 297742 - RNA, 19 nt, Homo sapiens
gaccagauccuuagagaag

SEQ ID NO: 297743 - RNA, 19 nt, Homo sapiens
agcgagagcugaucaaguu

SEQ ID NO: 297744 - RNA, 19 nt, Homo sapiens
cguaggaaaugagcgauaa

SEQ ID NO: 297745 - RNA, 19 nt, Homo sapiens
ugagugaauuguaccuauu

SEQ ID NO: 297746 - RNA, 19 nt, Homo sapiens
gacaaagccacagaauaua

SEQ ID NO: 297747 - RNA, 19 nt, Homo sapiens
auaaugcacuggaacgaaa

SEQ ID NO: 297748 - RNA, 19 nt, Homo sapiens
agagaaguuugugguauaa

SEQ ID NO: 297749 - RNA, 19 nt, Homo sapiens
uugagaagaugaccgguuu

SEQ ID NO: 297750 - RNA, 19 nt, Homo sapiens
ggagagcgacgaagagcaa

SEQ ID NO: 297751 - RNA, 19 nt, Homo sapiens
cacagaauauauccaguau

SEQ ID NO: 297752 - RNA, 19 nt, Homo sapiens
acaaacgggcucaucauaa

SEQ ID NO: 297753 - RNA, 19 nt, Homo sapiens
uguauacucuguagucuca

SEQ ID NO: 297754 - RNA, 19 nt, Homo sapiens
gaaucugagugaauuguac

SEQ ID NO: 297755 - RNA, 19 nt, Homo sapiens
ggagauggcagcagugaag

SEQ ID NO: 297756 - RNA, 19 nt, Homo sapiens
ccauuuccacuguauauuu

SEQ ID NO: 297757 - RNA, 19 nt, Homo sapiens
ugagagagcgagugaguga

SEQ ID NO: 297758 - RNA, 19 nt, Homo sapiens
gagcugaucaaguucuuug

SEQ ID NO: 297759 - RNA, 19 nt, Homo sapiens
ggaaagcgagagcugauca

SEQ ID NO: 297760 - RNA, 19 nt, Homo sapiens
ccagauccuuagagaaguu

SEQ ID NO: 297761 - RNA, 19 nt, Homo sapiens
gagugaauuguaccuauuu

SEQ ID NO: 297762 - RNA, 19 nt, Homo sapiens
gaaagaccagauccuuaga

SEQ ID NO: 297763 - RNA, 19 nt, Homo sapiens
agacagcuuucacaguuug

SEQ ID NO: 297764 - RNA, 19 nt, Homo sapiens
gcugauuucuaguguauac

SEQ ID NO: 297765 - RNA, 19 nt, Homo sapiens
ccacuuccuuuccuacugu

SEQ ID NO: 297766 - RNA, 19 nt, Homo sapiens
guaccuauuucugaugaug

SEQ ID NO: 297767 - RNA, 19 nt, Homo sapiens
ugaaagaccagauccuuag

SEQ ID NO: 297768 - RNA, 19 nt, Homo sapiens
cugaacugcucuacuuuga

SEQ ID NO: 297769 - RNA, 19 nt, Homo sapiens
ugauagacuuugugaaucu

SEQ ID NO: 297770 - RNA, 19 nt, Homo sapiens
gagagcugaucaaguucuu

SEQ ID NO: 297771 - RNA, 19 nt, Homo sapiens
uagacaaagccacagaaua

SEQ ID NO: 297772 - RNA, 19 nt, Homo sapiens
caccaucucugccuucgau

SEQ ID NO: 297773 - RNA, 19 nt, Homo sapiens
uuagagaaguuugugguau

SEQ ID NO: 297774 - RNA, 19 nt, Homo sapiens
ccucaccucugauagacuu

SEQ ID NO: 297775 - RNA, 19 nt, Homo sapiens
gaggucaagugcccaacug

SEQ ID NO: 297776 - RNA, 19 nt, Homo sapiens
acacacaccagcaagauau

SEQ ID NO: 297777 - RNA, 19 nt, Homo sapiens
acaaagccacagaauauau

SEQ ID NO: 297778 - RNA, 19 nt, Homo sapiens
guucguguuugauuccauu

SEQ ID NO: 297779 - RNA, 19 nt, Homo sapiens
gaugaugucggucuugcaa

SEQ ID NO: 297780 - RNA, 19 nt, Homo sapiens
gagggccagugaugauguu

SEQ ID NO: 297781 - RNA, 19 nt, Homo sapiens
uagaagcucuuggacaaca

SEQ ID NO: 297782 - RNA, 19 nt, Homo sapiens
agaaugaacccuccuccuu

SEQ ID NO: 297783 - RNA, 19 nt, Homo sapiens
ggacaacagcucucguucu

SEQ ID NO: 297784 - RNA, 19 nt, Homo sapiens
acaacagccucuacaccaa

SEQ ID NO: 297785 - RNA, 19 nt, Homo sapiens
cuauguaucgcuccuauug

SEQ ID NO: 297786 - RNA, 19 nt, Homo sapiens
guagagcccucagaaccau

SEQ ID NO: 297787 - RNA, 19 nt, Homo sapiens
aagaccagauccuuagaga

SEQ ID NO: 297788 - RNA, 19 nt, Homo sapiens
ucugauagacuuugugaau

SEQ ID NO: 297789 - RNA, 19 nt, Homo sapiens
ccggaccucugagcacaua

SEQ ID NO: 297790 - RNA, 19 nt, Homo sapiens
caucgucucauccuccuuu

SEQ ID NO: 297791 - RNA, 19 nt, Homo sapiens
agucucaguucguguuuga

SEQ ID NO: 297792 - RNA, 19 nt, Homo sapiens
ggucagcagaugccaguga

SEQ ID NO: 297793 - RNA, 19 nt, Homo sapiens
gagaaggcgaggucaagug

SEQ ID NO: 297794 - RNA, 19 nt, Homo sapiens
caaagccacagaauauauc

SEQ ID NO: 297795 - RNA, 19 nt, Homo sapiens
uugaaagaccagauccuua

SEQ ID NO: 297796 - RNA, 19 nt, Homo sapiens
gaaagcgagagcugaucaa

SEQ ID NO: 297797 - RNA, 19 nt, Homo sapiens
gggcccaaauccuagacaa

SEQ ID NO: 297798 - RNA, 19 nt, Homo sapiens
uugcugauuucuaguguau

SEQ ID NO: 297799 - RNA, 19 nt, Homo sapiens
gugacacucucgugguaug

SEQ ID NO: 297800 - RNA, 19 nt, Homo sapiens
gcacuggaacgaaaacgua

SEQ ID NO: 297801 - RNA, 19 nt, Homo sapiens
gcucuacuuugagaagaug

SEQ ID NO: 297802 - RNA, 19 nt, Homo sapiens
ucauggaagaugcaaguaa

SEQ ID NO: 297803 - RNA, 19 nt, Homo sapiens
cugaucaaguucuuuguuc

SEQ ID NO: 297804 - RNA, 19 nt, Homo sapiens
aagacagcuuucacaguuu

SEQ ID NO: 297805 - RNA, 19 nt, Homo sapiens
cuacuccguuccuggcauu

SEQ ID NO: 297806 - RNA, 19 nt, Homo sapiens
gucagcagaugccagugaa

SEQ ID NO: 297807 - RNA, 19 nt, Homo sapiens
agaaauagagccaacugau

SEQ ID NO: 297808 - RNA, 19 nt, Homo sapiens
aaacguagggaccacauca

SEQ ID NO: 297809 - RNA, 19 nt, Homo sapiens
caucccacuuccuuuccua

SEQ ID NO: 297810 - RNA, 19 nt, Homo sapiens
guauugagggccagugaug

SEQ ID NO: 297811 - RNA, 19 nt, Homo sapiens
ggacagggaggguguuuug

SEQ ID NO: 297812 - RNA, 19 nt, Homo sapiens
gaagcucuauuuccucuuu

SEQ ID NO: 297813 - RNA, 19 nt, Homo sapiens
ggaaauguacaccaguuua

SEQ ID NO: 297814 - RNA, 19 nt, Homo sapiens
caaacgggcucaucauaau

SEQ ID NO: 297815 - RNA, 19 nt, Homo sapiens
ggacucggcuuguuguugu

SEQ ID NO: 297816 - RNA, 19 nt, Homo sapiens
aaagauggcuuauucacau

SEQ ID NO: 297817 - RNA, 19 nt, Homo sapiens
gaacuaguuuaauguggau

SEQ ID NO: 297818 - RNA, 19 nt, Homo sapiens
gacaaacgggcucaucaua

SEQ ID NO: 297819 - RNA, 19 nt, Homo sapiens
aaaguuugaugcagaaaug

SEQ ID NO: 297820 - RNA, 19 nt, Homo sapiens
ggaaaugagcgauaacgau

SEQ ID NO: 297821 - RNA, 19 nt, Homo sapiens
gaaauguacaccaguuuag

SEQ ID NO: 297822 - RNA, 19 nt, Homo sapiens
guagggaccacaucaaaga

SEQ ID NO: 297823 - RNA, 19 nt, Homo sapiens
cguaggaaaugagcgauaa

SEQ ID NO: 297824 - RNA, 19 nt, Homo sapiens
gcuaccaagugcacaagaa

SEQ ID NO: 297825 - RNA, 19 nt, Homo sapiens
auaaugcacuggaacgaaa

SEQ ID NO: 297826 - RNA, 19 nt, Homo sapiens
gcugauagcucugccuuac

SEQ ID NO: 297827 - RNA, 19 nt, Homo sapiens
ggagagcgacgaagagcaa

SEQ ID NO: 297828 - RNA, 19 nt, Homo sapiens
acaaacgggcucaucauaa

SEQ ID NO: 297829 - RNA, 19 nt, Homo sapiens
ugagagagcgagugaguga

SEQ ID NO: 297830 - RNA, 19 nt, Homo sapiens
agacagcuuucacaguuug

SEQ ID NO: 297831 - RNA, 19 nt, Homo sapiens
uaaaacagaugucaguugu

SEQ ID NO: 297832 - RNA, 19 nt, Homo sapiens
uuacacaaaugucuuacuc

SEQ ID NO: 297833 - RNA, 19 nt, Homo sapiens
uuacuccuggcuuuaauua

SEQ ID NO: 297834 - RNA, 19 nt, Homo sapiens
ugccacaccuucauuucaa

SEQ ID NO: 297835 - RNA, 19 nt, Homo sapiens
aagacagcuuucacaguuu

SEQ ID NO: 297836 - RNA, 19 nt, Homo sapiens
gcacuggaacgaaaacgua

SEQ ID NO: 297837 - RNA, 19 nt, Homo sapiens
acagaugucaguuguugaa

SEQ ID NO: 297838 - RNA, 19 nt, Homo sapiens
aaacguagggaccacauca

SEQ ID NO: 297839 - RNA, 19 nt, Homo sapiens
acaccuucauuucaagcua

SEQ ID NO: 297840 - RNA, 19 nt, Homo sapiens
ggcccucccuuuaccuuca

SEQ ID NO: 297841 - RNA, 19 nt, Homo sapiens
acuccuggcuuuaauuaag

SEQ ID NO: 297842 - RNA, 19 nt, Homo sapiens
caaccuuccagccuccuuu

SEQ ID NO: 297843 - RNA, 19 nt, Homo sapiens
acucuggccuuacaaccuu

SEQ ID NO: 297844 - RNA, 19 nt, Homo sapiens
gauggcuuauucacaugga

SEQ ID NO: 297845 - RNA, 19 nt, Homo sapiens
cuaccaagugcacaagaaa

SEQ ID NO: 297846 - RNA, 19 nt, Homo sapiens
ugagugagagagcgaguga

SEQ ID NO: 297847 - RNA, 19 nt, Homo sapiens
cccuuuaccuucauaugug

SEQ ID NO: 297848 - RNA, 19 nt, Homo sapiens
aguuuaauguggauccaaa

SEQ ID NO: 297849 - RNA, 19 nt, Homo sapiens
ucaaucugcggcugacaaa

SEQ ID NO: 297850 - RNA, 19 nt, Homo sapiens
cgagugagugagugaguga

SEQ ID NO: 297851 - RNA, 19 nt, Homo sapiens
ugugcugacucuggccuua

SEQ ID NO: 297852 - RNA, 19 nt, Homo sapiens
cagaaaugccacaccuuca

SEQ ID NO: 297853 - RNA, 19 nt, Homo sapiens
cauaaugcacuggaacgaa

SEQ ID NO: 297854 - RNA, 19 nt, Homo sapiens
caagcuaccaagugcacaa

SEQ ID NO: 297855 - RNA, 19 nt, Homo sapiens
uucaaaagauggcuuauuc

SEQ ID NO: 297856 - RNA, 19 nt, Homo sapiens
aaacgggcucaucauaaug

SEQ ID NO: 297857 - RNA, 19 nt, Homo sapiens
ugacaaacgggcucaucau

SEQ ID NO: 297858 - RNA, 19 nt, Homo sapiens
gggacucggcuuguuguug

SEQ ID NO: 297859 - RNA, 19 nt, Homo sapiens
gcuuacacagguuucagaa

SEQ ID NO: 297860 - RNA, 19 nt, Homo sapiens
auggaaauguacaccaguu

SEQ ID NO: 297861 - RNA, 19 nt, Homo sapiens
aagauggcuuauucacaug

SEQ ID NO: 297862 - RNA, 19 nt, Homo sapiens
caaacgggcucaucauaau

SEQ ID NO: 297863 - RNA, 19 nt, Homo sapiens
ggacucggcuuguuguugu

SEQ ID NO: 297864 - RNA, 19 nt, Homo sapiens
agacaaagccacagaauau

SEQ ID NO: 297865 - RNA, 19 nt, Homo sapiens
gacaaacgggcucaucaua

SEQ ID NO: 297866 - RNA, 19 nt, Homo sapiens
ccacagaauauauccagua

SEQ ID NO: 297867 - RNA, 19 nt, Homo sapiens
ggaaaugagcgauaacgau

SEQ ID NO: 297868 - RNA, 19 nt, Homo sapiens
guagggaccacaucaaaga

SEQ ID NO: 297869 - RNA, 19 nt, Homo sapiens
cguaggaaaugagcgauaa

SEQ ID NO: 297870 - RNA, 19 nt, Homo sapiens
gacaaagccacagaauaua

SEQ ID NO: 297871 - RNA, 19 nt, Homo sapiens
auaaugcacuggaacgaaa

SEQ ID NO: 297872 - RNA, 19 nt, Homo sapiens
ggagagcgacgaagagcaa

SEQ ID NO: 297873 - RNA, 19 nt, Homo sapiens
cacagaauauauccaguau

SEQ ID NO: 297874 - RNA, 19 nt, Homo sapiens
acaaacgggcucaucauaa

SEQ ID NO: 297875 - RNA, 19 nt, Homo sapiens
ugagagagcgagugaguga

SEQ ID NO: 297876 - RNA, 19 nt, Homo sapiens
agacagcuuucacaguuug

SEQ ID NO: 297877 - RNA, 19 nt, Homo sapiens
cagagccagucauggagua

SEQ ID NO: 297878 - RNA, 19 nt, Homo sapiens
uagacaaagccacagaaua

SEQ ID NO: 297879 - RNA, 19 nt, Homo sapiens
acacacaccagcaagauau

SEQ ID NO: 297880 - RNA, 19 nt, Homo sapiens
acaaagccacagaauauau

SEQ ID NO: 297881 - RNA, 19 nt, Homo sapiens
uggaguaugugcucaguag

SEQ ID NO: 297882 - RNA, 19 nt, Homo sapiens
caaagccacagaauauauc

SEQ ID NO: 297883 - RNA, 19 nt, Homo sapiens
gggcccaaauccuagacaa

SEQ ID NO: 297884 - RNA, 19 nt, Homo sapiens
aagacagcuuucacaguuu

SEQ ID NO: 297885 - RNA, 19 nt, Homo sapiens
gcacuggaacgaaaacgua

SEQ ID NO: 297886 - RNA, 19 nt, Homo sapiens
aaacguagggaccacauca

SEQ ID NO: 297887 - RNA, 19 nt, Homo sapiens
gcccaaauccuagacaaag

SEQ ID NO: 297888 - RNA, 19 nt, Homo sapiens
ugagugagagagcgaguga

SEQ ID NO: 297889 - RNA, 19 nt, Homo sapiens
ucaaucugcggcugacaaa

SEQ ID NO: 297890 - RNA, 19 nt, Homo sapiens
gaccucaagcggcagaaug

SEQ ID NO: 297891 - RNA, 19 nt, Homo sapiens
cgagugagugagugaguga

SEQ ID NO: 297892 - RNA, 19 nt, Homo sapiens
agucagagccagucaugga

SEQ ID NO: 297893 - RNA, 19 nt, Homo sapiens
cacacacaccagcaagaua

SEQ ID NO: 297894 - RNA, 19 nt, Homo sapiens
cauaaugcacuggaacgaa

SEQ ID NO: 297895 - RNA, 19 nt, Homo sapiens
ccacacacaccagcaagau

SEQ ID NO: 297896 - RNA, 19 nt, Homo sapiens
ggcccaaauccuagacaaa

SEQ ID NO: 297897 - RNA, 19 nt, Homo sapiens
aaacgggcucaucauaaug

SEQ ID NO: 297898 - RNA, 19 nt, Homo sapiens
ugacaaacgggcucaucau

SEQ ID NO: 297899 - RNA, 19 nt, Homo sapiens
uccaguauaugcgaaggaa

SEQ ID NO: 297900 - RNA, 19 nt, Homo sapiens
gggacucggcuuguuguug

SEQ ID NO: 297901 - RNA, 19 nt, Homo sapiens
gaacggcccuucaaaugug

SEQ ID NO: 297902 - RNA, 19 nt, Homo sapiens
ggaguagagucccuuggua

SEQ ID NO: 297903 - RNA, 19 nt, Homo sapiens
gaaaggaggaagaaauguu

SEQ ID NO: 297904 - RNA, 19 nt, Homo sapiens
caaagguacuggugagguu

SEQ ID NO: 297905 - RNA, 19 nt, Homo sapiens
gcaaggaccgcaugagcua

SEQ ID NO: 297906 - RNA, 19 nt, Homo sapiens
caacagaacggcccuucaa

SEQ ID NO: 297907 - RNA, 19 nt, Homo sapiens
gagcucggcuuauauuucg

SEQ ID NO: 297908 - RNA, 19 nt, Homo sapiens
gaaccaugccugcgagaug

SEQ ID NO: 297909 - RNA, 19 nt, Homo sapiens
caagugcacucaacagaac

SEQ ID NO: 297910 - RNA, 19 nt, Homo sapiens
cagaacggcccuucaaaug

SEQ ID NO: 297911 - RNA, 19 nt, Homo sapiens
ggaagcgcauccggaagaa

SEQ ID NO: 297912 - RNA, 19 nt, Homo sapiens
aaaggaggaagaaauguuu

SEQ ID NO: 297913 - RNA, 19 nt, Homo sapiens
ucacguguguggcaagaug

SEQ ID NO: 297914 - RNA, 19 nt, Homo sapiens
ucaaaugugagaaauguga

SEQ ID NO: 297915 - RNA, 19 nt, Homo sapiens
cggaucaccucaacaguca

SEQ ID NO: 297916 - RNA, 19 nt, Homo sapiens
gggaagcgcauccggaaga

SEQ ID NO: 297917 - RNA, 19 nt, Homo sapiens
ccucaacagucacgucaga

SEQ ID NO: 297918 - RNA, 19 nt, Homo sapiens
cuucaaaugugagaaaugu

SEQ ID NO: 297919 - RNA, 19 nt, Homo sapiens
gcuccagucccgcuucuuu

SEQ ID NO: 297920 - RNA, 19 nt, Homo sapiens
gaaggaaaggaggaagaaa

SEQ ID NO: 297921 - RNA, 19 nt, Homo sapiens
gacaagugcacucaacaga

SEQ ID NO: 297922 - RNA, 19 nt, Homo sapiens
ucugugagcucugcaacaa

SEQ ID NO: 297923 - RNA, 19 nt, Homo sapiens
ggugagguuuguccaaugg

SEQ ID NO: 297924 - RNA, 19 nt, Homo sapiens
gcgccaaggaguucaagaa

SEQ ID NO: 297925 - RNA, 19 nt, Homo sapiens
ugacggcgcugugcacaag

SEQ ID NO: 297926 - RNA, 19 nt, Homo sapiens
caacagucacgucagacaa

SEQ ID NO: 297927 - RNA, 19 nt, Homo sapiens
ggaaaggaggaagaaaugu

SEQ ID NO: 297928 - RNA, 19 nt, Homo sapiens
aggagaaagugccauguca

SEQ ID NO: 297929 - RNA, 19 nt, Homo sapiens
agaaaugugaggcagcuuu

SEQ ID NO: 297930 - RNA, 19 nt, Homo sapiens
cgucugccuuggagaagaa

SEQ ID NO: 297931 - RNA, 19 nt, Homo sapiens
caagaacggcuacaaucuc

SEQ ID NO: 297932 - RNA, 19 nt, Homo sapiens
agaagaagacaaagagcaa

SEQ ID NO: 297933 - RNA, 19 nt, Homo sapiens
gagcucugcaacaaaggua

SEQ ID NO: 297934 - RNA, 19 nt, Homo sapiens
ugugagcucugcaacaaag

SEQ ID NO: 297935 - RNA, 19 nt, Homo sapiens
ucagacaagugcacucaac

SEQ ID NO: 297936 - RNA, 19 nt, Homo sapiens
acagaacggcccuucaaau

SEQ ID NO: 297937 - RNA, 19 nt, Homo sapiens
cuaugaagaugccgaccau

SEQ ID NO: 297938 - RNA, 19 nt, Homo sapiens
ucaagaacggcuacaaucu

SEQ ID NO: 297939 - RNA, 19 nt, Homo sapiens
agaacggcccuucaaaugu

SEQ ID NO: 297940 - RNA, 19 nt, Homo sapiens
acaagugcacucaacagaa

SEQ ID NO: 297941 - RNA, 19 nt, Homo sapiens
cuacaacugcucccacugu

SEQ ID NO: 297942 - RNA, 19 nt, Homo sapiens
cagaaggaaaggaggaaga

SEQ ID NO: 297943 - RNA, 19 nt, Homo sapiens
gaggagaaagugccauguc

SEQ ID NO: 297944 - RNA, 19 nt, Homo sapiens
aaggaaaggaggaagaaau

SEQ ID NO: 297945 - RNA, 19 nt, Homo sapiens
guagagucccuugguacaa

SEQ ID NO: 297946 - RNA, 19 nt, Homo sapiens
cuauuucccuaccaaccaa

SEQ ID NO: 297947 - RNA, 19 nt, Homo sapiens
gcccuucaaaugugagaaa

SEQ ID NO: 297948 - RNA, 19 nt, Homo sapiens
aggaaaggaggaagaaaug

SEQ ID NO: 297949 - RNA, 19 nt, Homo sapiens
ccaggguccucaccauguc

SEQ ID NO: 297950 - RNA, 19 nt, Homo sapiens
gagcuccagucccgcuucu

SEQ ID NO: 297951 - RNA, 19 nt, Homo sapiens
gccaggguccucaccaugu

SEQ ID NO: 297952 - RNA, 19 nt, Homo sapiens
ugagcucggcuuauauuuc

SEQ ID NO: 297953 - RNA, 19 nt, Homo sapiens
agaaggaaaggaggaagaa

SEQ ID NO: 297954 - RNA, 19 nt, Homo sapiens
aaccaugccugcgagaugu

SEQ ID NO: 297955 - RNA, 19 nt, Homo sapiens
ccuuggagaagaagacaaa

SEQ ID NO: 297956 - RNA, 19 nt, Homo sapiens
gaaugucccuuugcaauga

SEQ ID NO: 297957 - RNA, 19 nt, Homo sapiens
ggaaggacauggccuccaa

SEQ ID NO: 297958 - RNA, 19 nt, Homo sapiens
ggagaaguuugacaaguuc

SEQ ID NO: 297959 - RNA, 19 nt, Homo sapiens
ggacauggccuccaacuac

SEQ ID NO: 297960 - RNA, 19 nt, Homo sapiens
gaucucguguagccauaua

SEQ ID NO: 297961 - RNA, 19 nt, Homo sapiens
cugagugucugcuuuguuu

SEQ ID NO: 297962 - RNA, 19 nt, Homo sapiens
uggagaaguuugacaaguu

SEQ ID NO: 297963 - RNA, 19 nt, Homo sapiens
ggaagcauuugacuaucug

SEQ ID NO: 297964 - RNA, 19 nt, Homo sapiens
gcccuuggcucacuguguu

SEQ ID NO: 297965 - RNA, 19 nt, Homo sapiens
gaagucagaggacgagaug

SEQ ID NO: 297966 - RNA, 19 nt, Homo sapiens
gggaagcauuugacuaucu

SEQ ID NO: 297967 - RNA, 19 nt, Homo sapiens
aguagcaauugucugauua

SEQ ID NO: 297968 - RNA, 19 nt, Homo sapiens
auauagaguuugcuucuga

SEQ ID NO: 297969 - RNA, 19 nt, Homo sapiens
caguagcaauugucugauu

SEQ ID NO: 297970 - RNA, 19 nt, Homo sapiens
gcaaugaggaggagaucug

SEQ ID NO: 297971 - RNA, 19 nt, Homo sapiens
gacauggccuccaacuaca

SEQ ID NO: 297972 - RNA, 19 nt, Homo sapiens
agaguuugcuucugagugu

SEQ ID NO: 297973 - RNA, 19 nt, Homo sapiens
guguagccauauagaguuu

SEQ ID NO: 297974 - RNA, 19 nt, Homo sapiens
acaaggcccuggagcuguu

SEQ ID NO: 297975 - RNA, 19 nt, Homo sapiens
gugugugccuccucaggua

SEQ ID NO: 297976 - RNA, 19 nt, Homo sapiens
gaagguggaggcugacauc

SEQ ID NO: 297977 - RNA, 19 nt, Homo sapiens
caucaugaggcagagauua

SEQ ID NO: 297978 - RNA, 19 nt, Homo sapiens
cagaaugucccuuugcaau

SEQ ID NO: 297979 - RNA, 19 nt, Homo sapiens
guagcaauugucugauuaa

SEQ ID NO: 297980 - RNA, 19 nt, Homo sapiens
gguggcauccuuaagaaga

SEQ ID NO: 297981 - RNA, 19 nt, Homo sapiens
gcagaaugucccuuugcaa

SEQ ID NO: 297982 - RNA, 19 nt, Homo sapiens
ggaaugcaucauccagguu

SEQ ID NO: 297983 - RNA, 19 nt, Homo sapiens
guggcauccuuaagaagaa

SEQ ID NO: 297984 - RNA, 19 nt, Homo sapiens
gggcugggguguugaaguu

SEQ ID NO: 297985 - RNA, 19 nt, Homo sapiens
gcuucugagugucugcuuu

SEQ ID NO: 297986 - RNA, 19 nt, Homo sapiens
guccucaucaggcucuuua

SEQ ID NO: 297987 - RNA, 19 nt, Homo sapiens
ugacucaccugguuuuaau

SEQ ID NO: 297988 - RNA, 19 nt, Homo sapiens
acaaggagcugggcuucca

SEQ ID NO: 297989 - RNA, 19 nt, Homo sapiens
ugguuuggaucugaauuaa

SEQ ID NO: 297990 - RNA, 19 nt, Homo sapiens
uggguggcauccuuaagaa

SEQ ID NO: 297991 - RNA, 19 nt, Homo sapiens
cugcaugguuuggaucuga

SEQ ID NO: 297992 - RNA, 19 nt, Homo sapiens
gugucugcuuuguuuagua

SEQ ID NO: 297993 - RNA, 19 nt, Homo sapiens
uugacuaucuggaacuugu

SEQ ID NO: 297994 - RNA, 19 nt, Homo sapiens
aaaacaaccugcaacaucu

SEQ ID NO: 297995 - RNA, 19 nt, Homo sapiens
uaaaacaaccugcaacauc

SEQ ID NO: 297996 - RNA, 19 nt, Homo sapiens
agaaugucccuuugcaaug

SEQ ID NO: 297997 - RNA, 19 nt, Homo sapiens
acuguguucugcaugguuu

SEQ ID NO: 297998 - RNA, 19 nt, Homo sapiens
acagcagaaugucccuuug

SEQ ID NO: 297999 - RNA, 19 nt, Homo sapiens
gcccuggguggcauccuua

SEQ ID NO: 298000 - RNA, 19 nt, Homo sapiens
acaccugacaguagcaauu

SEQ ID NO: 298001 - RNA, 19 nt, Homo sapiens
cugaauuaauuguccuuuc

SEQ ID NO: 298002 - RNA, 19 nt, Homo sapiens
ugucugcuuuguuuaguag

SEQ ID NO: 298003 - RNA, 19 nt, Homo sapiens
ccauauagaguuugcuucu

SEQ ID NO: 298004 - RNA, 19 nt, Homo sapiens
gaguucaucucggaaugca

SEQ ID NO: 298005 - RNA, 19 nt, Homo sapiens
agucagaggacgagaugaa

SEQ ID NO: 298006 - RNA, 19 nt, Homo sapiens
cauauagaguuugcuucug

SEQ ID NO: 298007 - RNA, 19 nt, Homo sapiens
aaauccaagccauuaacua

SEQ ID NO: 298008 - RNA, 19 nt, Homo sapiens
gagugucugcuuuguuuag

SEQ ID NO: 298009 - RNA, 19 nt, Homo sapiens
gacacccagugagcccaua

SEQ ID NO: 298010 - RNA, 19 nt, Homo sapiens
uuaacuacaccugacagua

SEQ ID NO: 298011 - RNA, 19 nt, Homo sapiens
ccuccaaacuggcuguaac

SEQ ID NO: 298012 - RNA, 19 nt, Homo sapiens
ccaaauccaagccauuaac

SEQ ID NO: 298013 - RNA, 19 nt, Homo sapiens
aauccaagccauuaacuac

SEQ ID NO: 298014 - RNA, 19 nt, Homo sapiens
caaauccaagccauuaacu

SEQ ID NO: 298015 - RNA, 19 nt, Homo sapiens
gaagauggauguaaagugu

SEQ ID NO: 298016 - RNA, 19 nt, Homo sapiens
ucucuaagcuguucuauuu

SEQ ID NO: 298017 - RNA, 19 nt, Homo sapiens
guacagagauucuaugaag

SEQ ID NO: 298018 - RNA, 19 nt, Homo sapiens
gcaccaaccuuccaagugu

SEQ ID NO: 298019 - RNA, 19 nt, Homo sapiens
gcacuguacuuaauacuag

SEQ ID NO: 298020 - RNA, 19 nt, Homo sapiens
gaggauaacucaauauaac

SEQ ID NO: 298021 - RNA, 19 nt, Homo sapiens
guucaucuauuacugugua

SEQ ID NO: 298022 - RNA, 19 nt, Homo sapiens
gguaggcacuguacuuaau

SEQ ID NO: 298023 - RNA, 19 nt, Homo sapiens
cugccgaguucaucuauua

SEQ ID NO: 298024 - RNA, 19 nt, Homo sapiens
aaguugagcugacucgaua

SEQ ID NO: 298025 - RNA, 19 nt, Homo sapiens
ccacgaggauggccuggaa

SEQ ID NO: 298026 - RNA, 19 nt, Homo sapiens
gaagggaagauggauguaa

SEQ ID NO: 298027 - RNA, 19 nt, Homo sapiens
ccaacgaggugaucuagca

SEQ ID NO: 298028 - RNA, 19 nt, Homo sapiens
gcaaguacagagauucuau

SEQ ID NO: 298029 - RNA, 19 nt, Homo sapiens
ggaugauucugccuccaaa

SEQ ID NO: 298030 - RNA, 19 nt, Homo sapiens
caaggugacacauuacaaa

SEQ ID NO: 298031 - RNA, 19 nt, Homo sapiens
ggaauuagagaagcugaaa

SEQ ID NO: 298032 - RNA, 19 nt, Homo sapiens
caguaggaauuggaaauaa

SEQ ID NO: 298033 - RNA, 19 nt, Homo sapiens
caaagccacccuaccauga

SEQ ID NO: 298034 - RNA, 19 nt, Homo sapiens
ucacagaguuaaauaugca

SEQ ID NO: 298035 - RNA, 19 nt, Homo sapiens
aagggaagauggauguaaa

SEQ ID NO: 298036 - RNA, 19 nt, Homo sapiens
ccaacuuuaucauggaauu

SEQ ID NO: 298037 - RNA, 19 nt, Homo sapiens
gcacagagaauugccuuca

SEQ ID NO: 298038 - RNA, 19 nt, Homo sapiens
auacuaggauacagaaaug

SEQ ID NO: 298039 - RNA, 19 nt, Homo sapiens
ggaaacauagccucaccaa

SEQ ID NO: 298040 - RNA, 19 nt, Homo sapiens
ugugagaacuguggaauca

SEQ ID NO: 298041 - RNA, 19 nt, Homo sapiens
guaggcacuguacuuaaua

SEQ ID NO: 298042 - RNA, 19 nt, Homo sapiens
caucuuggcccuaccuuga

SEQ ID NO: 298043 - RNA, 19 nt, Homo sapiens
gagccgaggguguggagua

SEQ ID NO: 298044 - RNA, 19 nt, Homo sapiens
gcuccugggugcugugaga

SEQ ID NO: 298045 - RNA, 19 nt, Homo sapiens
uacaaauggugaauggauu

SEQ ID NO: 298046 - RNA, 19 nt, Homo sapiens
acaaugugcugcugcuuca

SEQ ID NO: 298047 - RNA, 19 nt, Homo sapiens
ggaagauggauguaaagug

SEQ ID NO: 298048 - RNA, 19 nt, Homo sapiens
caagaggauuguggccauu

SEQ ID NO: 298049 - RNA, 19 nt, Homo sapiens
ggacagcccuuuugugaac

SEQ ID NO: 298050 - RNA, 19 nt, Homo sapiens
gacaggauccgaagcaaag

SEQ ID NO: 298051 - RNA, 19 nt, Homo sapiens
caccaaccuuccaagugua

SEQ ID NO: 298052 - RNA, 19 nt, Homo sapiens
gaggagaacaaggaugauu

SEQ ID NO: 298053 - RNA, 19 nt, Homo sapiens
gauacggcccaugcaauuu

SEQ ID NO: 298054 - RNA, 19 nt, Homo sapiens
augcaaagcugaagaccau

SEQ ID NO: 298055 - RNA, 19 nt, Homo sapiens
ggagacaggauccgaagca

SEQ ID NO: 298056 - RNA, 19 nt, Homo sapiens
agaccaaggcugacacuga

SEQ ID NO: 298057 - RNA, 19 nt, Homo sapiens
gaggacagcccuuuuguga

SEQ ID NO: 298058 - RNA, 19 nt, Homo sapiens
gagacaggauccgaagcaa

SEQ ID NO: 298059 - RNA, 19 nt, Homo sapiens
gagaaccuggccuguggua

SEQ ID NO: 298060 - RNA, 19 nt, Homo sapiens
gcucagacaccuauuacca

SEQ ID NO: 298061 - RNA, 19 nt, Homo sapiens
gugguaggcacuguacuua

SEQ ID NO: 298062 - RNA, 19 nt, Homo sapiens
cuaugaagcccacccagaa

SEQ ID NO: 298063 - RNA, 19 nt, Homo sapiens
gggaagggaagauggaugu

SEQ ID NO: 298064 - RNA, 19 nt, Homo sapiens
ggccuagaguggcggaaga

SEQ ID NO: 298065 - RNA, 19 nt, Homo sapiens
uauuacaaauggugaaugg

SEQ ID NO: 298066 - RNA, 19 nt, Homo sapiens
gacgcucagacaccuauua

SEQ ID NO: 298067 - RNA, 19 nt, Homo sapiens
acaaggaggagaacaagga

SEQ ID NO: 298068 - RNA, 19 nt, Homo sapiens
acaguaggaauuggaaaua

SEQ ID NO: 298069 - RNA, 19 nt, Homo sapiens
gcacaguaggaauuggaaa

SEQ ID NO: 298070 - RNA, 19 nt, Homo sapiens
gcagucugguugccaaggu

SEQ ID NO: 298071 - RNA, 19 nt, Homo sapiens
ggacaaggaggagaacaag

SEQ ID NO: 298072 - RNA, 19 nt, Homo sapiens
uguugcagcuuccacagaa

SEQ ID NO: 298073 - RNA, 19 nt, Homo sapiens
guggugaggucaggaagga

SEQ ID NO: 298074 - RNA, 19 nt, Homo sapiens
ccucacagaguuaaauaug

SEQ ID NO: 298075 - RNA, 19 nt, Homo sapiens
caaauuggccccagaggaa

SEQ ID NO: 298076 - RNA, 19 nt, Homo sapiens
cauggaauuuaaugcugaa

SEQ ID NO: 298077 - RNA, 19 nt, Homo sapiens
guacuuaauacuaggauac

SEQ ID NO: 298078 - RNA, 19 nt, Homo sapiens
uuacaaagccacccuacca

SEQ ID NO: 298079 - RNA, 19 nt, Homo sapiens
ggcaacgugugaacugcaa

SEQ ID NO: 298080 - RNA, 19 nt, Homo sapiens
gagauacagcagucugguu

SEQ ID NO: 298081 - RNA, 19 nt, Homo sapiens
cacagagaauugccuucaa

SEQ ID NO: 298082 - RNA, 19 nt, Homo sapiens
ccucuucgacuucaaacaa

SEQ ID NO: 298083 - RNA, 19 nt, Homo sapiens
gacuggaggcuucuacaga

SEQ ID NO: 298084 - RNA, 19 nt, Homo sapiens
agauacggcccaugcaauu

SEQ ID NO: 298085 - RNA, 19 nt, Homo sapiens
ggcacuguacuuaauacua

SEQ ID NO: 298086 - RNA, 19 nt, Homo sapiens
ggaagggaagauggaugua

SEQ ID NO: 298087 - RNA, 19 nt, Homo sapiens
acagagaauugccuucaac

SEQ ID NO: 298088 - RNA, 19 nt, Homo sapiens
uuacaaauggugaauggau

SEQ ID NO: 298089 - RNA, 19 nt, Homo sapiens
aaagauacggcccaugcaa

SEQ ID NO: 298090 - RNA, 19 nt, Homo sapiens
uaugaagcccacccagaaa

SEQ ID NO: 298091 - RNA, 19 nt, Homo sapiens
ucucuuguggcccaucuua

SEQ ID NO: 298092 - RNA, 19 nt, Homo sapiens
gcccuccgguuaucaagca

SEQ ID NO: 298093 - RNA, 19 nt, Homo sapiens
ggagcuagaaagcaguaga

SEQ ID NO: 298094 - RNA, 19 nt, Homo sapiens
auaccggccuggugccaaa

SEQ ID NO: 298095 - RNA, 19 nt, Homo sapiens
caaguacagagauucuaug

SEQ ID NO: 298096 - RNA, 19 nt, Homo sapiens
ccaaggugacacauuacaa

SEQ ID NO: 298097 - RNA, 19 nt, Homo sapiens
gauacauggcaacguguga

SEQ ID NO: 298098 - RNA, 19 nt, Homo sapiens
gaaaaugcaaagcugaaga

SEQ ID NO: 298099 - RNA, 19 nt, Homo sapiens
gcccuuccucacagaguua

SEQ ID NO: 298100 - RNA, 19 nt, Homo sapiens
uggguguccugcagaagaa

SEQ ID NO: 298101 - RNA, 19 nt, Homo sapiens
ugauucugccuccaaauug

SEQ ID NO: 298102 - RNA, 19 nt, Homo sapiens
ucaaaacguugugcaaaga

SEQ ID NO: 298103 - RNA, 19 nt, Homo sapiens
aaagccacccuaccaugaa

SEQ ID NO: 298104 - RNA, 19 nt, Homo sapiens
uuagagaagcugaaaggau

SEQ ID NO: 298105 - RNA, 19 nt, Homo sapiens
gaccauacccaggcuccaa

SEQ ID NO: 298106 - RNA, 19 nt, Homo sapiens
gggcacaguaggaauugga

SEQ ID NO: 298107 - RNA, 19 nt, Homo sapiens
aacauagccucaccaaggu

SEQ ID NO: 298108 - RNA, 19 nt, Homo sapiens
agacaggauccgaagcaaa

SEQ ID NO: 298109 - RNA, 19 nt, Homo sapiens
aggaggagaacaaggauga

SEQ ID NO: 298110 - RNA, 19 nt, Homo sapiens
caucggggcuguucugcaa

SEQ ID NO: 298111 - RNA, 19 nt, Homo sapiens
ccaaaggcagcggcucaaa

SEQ ID NO: 298112 - RNA, 19 nt, Homo sapiens
gauuuccaacuuuaucaug

SEQ ID NO: 298113 - RNA, 19 nt, Homo sapiens
cgaguucaucuauuacugu

SEQ ID NO: 298114 - RNA, 19 nt, Homo sapiens
gagacgcugccuccggauu

SEQ ID NO: 298115 - RNA, 19 nt, Homo sapiens
gaagauggauguaaagugu

SEQ ID NO: 298116 - RNA, 19 nt, Homo sapiens
ucucuaagcuguucuauuu

SEQ ID NO: 298117 - RNA, 19 nt, Homo sapiens
guacagagauucuaugaag

SEQ ID NO: 298118 - RNA, 19 nt, Homo sapiens
gcaccaaccuuccaagugu

SEQ ID NO: 298119 - RNA, 19 nt, Homo sapiens
gcacuguacuuaauacuag

SEQ ID NO: 298120 - RNA, 19 nt, Homo sapiens
gaggauaacucaauauaac

SEQ ID NO: 298121 - RNA, 19 nt, Homo sapiens
gcacagcuguccugacuuc

SEQ ID NO: 298122 - RNA, 19 nt, Homo sapiens
guucaucuauuacugugua

SEQ ID NO: 298123 - RNA, 19 nt, Homo sapiens
gguaggcacuguacuuaau

SEQ ID NO: 298124 - RNA, 19 nt, Homo sapiens
cugccgaguucaucuauua

SEQ ID NO: 298125 - RNA, 19 nt, Homo sapiens
aaguugagcugacucgaua

SEQ ID NO: 298126 - RNA, 19 nt, Homo sapiens
ccacgaggauggccuggaa

SEQ ID NO: 298127 - RNA, 19 nt, Homo sapiens
gaagggaagauggauguaa

SEQ ID NO: 298128 - RNA, 19 nt, Homo sapiens
ccaacgaggugaucuagca

SEQ ID NO: 298129 - RNA, 19 nt, Homo sapiens
gcaaguacagagauucuau

SEQ ID NO: 298130 - RNA, 19 nt, Homo sapiens
ggaugauucugccuccaaa

SEQ ID NO: 298131 - RNA, 19 nt, Homo sapiens
caaggugacacauuacaaa

SEQ ID NO: 298132 - RNA, 19 nt, Homo sapiens
ggaauuagagaagcugaaa

SEQ ID NO: 298133 - RNA, 19 nt, Homo sapiens
caguaggaauuggaaauaa

SEQ ID NO: 298134 - RNA, 19 nt, Homo sapiens
caaagccacccuaccauga

SEQ ID NO: 298135 - RNA, 19 nt, Homo sapiens
ucacagaguuaaauaugca

SEQ ID NO: 298136 - RNA, 19 nt, Homo sapiens
aagggaagauggauguaaa

SEQ ID NO: 298137 - RNA, 19 nt, Homo sapiens
ccaacuuuaucauggaauu

SEQ ID NO: 298138 - RNA, 19 nt, Homo sapiens
gcacagagaauugccuuca

SEQ ID NO: 298139 - RNA, 19 nt, Homo sapiens
auacuaggauacagaaaug

SEQ ID NO: 298140 - RNA, 19 nt, Homo sapiens
ggaaacauagccucaccaa

SEQ ID NO: 298141 - RNA, 19 nt, Homo sapiens
ugugagaacuguggaauca

SEQ ID NO: 298142 - RNA, 19 nt, Homo sapiens
guaggcacuguacuuaaua

SEQ ID NO: 298143 - RNA, 19 nt, Homo sapiens
caucuuggcccuaccuuga

SEQ ID NO: 298144 - RNA, 19 nt, Homo sapiens
gagccgaggguguggagua

SEQ ID NO: 298145 - RNA, 19 nt, Homo sapiens
gaguuggguuguggccuua

SEQ ID NO: 298146 - RNA, 19 nt, Homo sapiens
gcuccugggugcugugaga

SEQ ID NO: 298147 - RNA, 19 nt, Homo sapiens
uacaaauggugaauggauu

SEQ ID NO: 298148 - RNA, 19 nt, Homo sapiens
acaaugugcugcugcuuca

SEQ ID NO: 298149 - RNA, 19 nt, Homo sapiens
ggaagauggauguaaagug

SEQ ID NO: 298150 - RNA, 19 nt, Homo sapiens
caagaggauuguggccauu

SEQ ID NO: 298151 - RNA, 19 nt, Homo sapiens
ggacagcccuuuugugaac

SEQ ID NO: 298152 - RNA, 19 nt, Homo sapiens
gacaggauccgaagcaaag

SEQ ID NO: 298153 - RNA, 19 nt, Homo sapiens
caccaaccuuccaagugua

SEQ ID NO: 298154 - RNA, 19 nt, Homo sapiens
gaggagaacaaggaugauu

SEQ ID NO: 298155 - RNA, 19 nt, Homo sapiens
ggagacaggauccgaagca

SEQ ID NO: 298156 - RNA, 19 nt, Homo sapiens
gauacggcccaugcaauuu

SEQ ID NO: 298157 - RNA, 19 nt, Homo sapiens
augcaaagcugaagaccau

SEQ ID NO: 298158 - RNA, 19 nt, Homo sapiens
agaccaaggcugacacuga

SEQ ID NO: 298159 - RNA, 19 nt, Homo sapiens
gaggacagcccuuuuguga

SEQ ID NO: 298160 - RNA, 19 nt, Homo sapiens
gagaaccuggccuguggua

SEQ ID NO: 298161 - RNA, 19 nt, Homo sapiens
gcucagacaccuauuacca

SEQ ID NO: 298162 - RNA, 19 nt, Homo sapiens
ccugacuucucccguauug

SEQ ID NO: 298163 - RNA, 19 nt, Homo sapiens
gagacaggauccgaagcaa

SEQ ID NO: 298164 - RNA, 19 nt, Homo sapiens
gugguaggcacuguacuua

SEQ ID NO: 298165 - RNA, 19 nt, Homo sapiens
cuaugaagcccacccagaa

SEQ ID NO: 298166 - RNA, 19 nt, Homo sapiens
gggaagggaagauggaugu

SEQ ID NO: 298167 - RNA, 19 nt, Homo sapiens
ggccuagaguggcggaaga

SEQ ID NO: 298168 - RNA, 19 nt, Homo sapiens
uauuacaaauggugaaugg

SEQ ID NO: 298169 - RNA, 19 nt, Homo sapiens
gacgcucagacaccuauua

SEQ ID NO: 298170 - RNA, 19 nt, Homo sapiens
acaaggaggagaacaagga

SEQ ID NO: 298171 - RNA, 19 nt, Homo sapiens
acaguaggaauuggaaaua

SEQ ID NO: 298172 - RNA, 19 nt, Homo sapiens
gcacaguaggaauuggaaa

SEQ ID NO: 298173 - RNA, 19 nt, Homo sapiens
gcagucugguugccaaggu

SEQ ID NO: 298174 - RNA, 19 nt, Homo sapiens
ggacaaggaggagaacaag

SEQ ID NO: 298175 - RNA, 19 nt, Homo sapiens
uguugcagcuuccacagaa

SEQ ID NO: 298176 - RNA, 19 nt, Homo sapiens
guggugaggucaggaagga

SEQ ID NO: 298177 - RNA, 19 nt, Homo sapiens
ccucacagaguuaaauaug

SEQ ID NO: 298178 - RNA, 19 nt, Homo sapiens
caaauuggccccagaggaa

SEQ ID NO: 298179 - RNA, 19 nt, Homo sapiens
cauggaauuuaaugcugaa

SEQ ID NO: 298180 - RNA, 19 nt, Homo sapiens
guacuuaauacuaggauac

SEQ ID NO: 298181 - RNA, 19 nt, Homo sapiens
uuacaaagccacccuacca

SEQ ID NO: 298182 - RNA, 19 nt, Homo sapiens
ggcaacgugugaacugcaa

SEQ ID NO: 298183 - RNA, 19 nt, Homo sapiens
gagauacagcagucugguu

SEQ ID NO: 298184 - RNA, 19 nt, Homo sapiens
cacagagaauugccuucaa

SEQ ID NO: 298185 - RNA, 19 nt, Homo sapiens
ccucuucgacuucaaacaa

SEQ ID NO: 298186 - RNA, 19 nt, Homo sapiens
gacuggaggcuucuacaga

SEQ ID NO: 298187 - RNA, 19 nt, Homo sapiens
agauacggcccaugcaauu

SEQ ID NO: 298188 - RNA, 19 nt, Homo sapiens
ggcacuguacuuaauacua

SEQ ID NO: 298189 - RNA, 19 nt, Homo sapiens
ggaagggaagauggaugua

SEQ ID NO: 298190 - RNA, 19 nt, Homo sapiens
acagagaauugccuucaac

SEQ ID NO: 298191 - RNA, 19 nt, Homo sapiens
uuacaaauggugaauggau

SEQ ID NO: 298192 - RNA, 19 nt, Homo sapiens
aaagauacggcccaugcaa

SEQ ID NO: 298193 - RNA, 19 nt, Homo sapiens
uaugaagcccacccagaaa

SEQ ID NO: 298194 - RNA, 19 nt, Homo sapiens
ucucuuguggcccaucuua

SEQ ID NO: 298195 - RNA, 19 nt, Homo sapiens
gcccuccgguuaucaagca

SEQ ID NO: 298196 - RNA, 19 nt, Homo sapiens
ggagcuagaaagcaguaga

SEQ ID NO: 298197 - RNA, 19 nt, Homo sapiens
auaccggccuggugccaaa

SEQ ID NO: 298198 - RNA, 19 nt, Homo sapiens
aggcacagcuguccugacu

SEQ ID NO: 298199 - RNA, 19 nt, Homo sapiens
caaguacagagauucuaug

SEQ ID NO: 298200 - RNA, 19 nt, Homo sapiens
ccaaggugacacauuacaa

SEQ ID NO: 298201 - RNA, 19 nt, Homo sapiens
gauacauggcaacguguga

SEQ ID NO: 298202 - RNA, 19 nt, Homo sapiens
guccugacuucucccguau

SEQ ID NO: 298203 - RNA, 19 nt, Homo sapiens
gaaaaugcaaagcugaaga

SEQ ID NO: 298204 - RNA, 19 nt, Homo sapiens
gcccuuccucacagaguua

SEQ ID NO: 298205 - RNA, 19 nt, Homo sapiens
uggguguccugcagaagaa

SEQ ID NO: 298206 - RNA, 19 nt, Homo sapiens
ugauucugccuccaaauug

SEQ ID NO: 298207 - RNA, 19 nt, Homo sapiens
ucaaaacguugugcaaaga

SEQ ID NO: 298208 - RNA, 19 nt, Homo sapiens
aaagccacccuaccaugaa

SEQ ID NO: 298209 - RNA, 19 nt, Homo sapiens
uuagagaagcugaaaggau

SEQ ID NO: 298210 - RNA, 19 nt, Homo sapiens
gaccauacccaggcuccaa

SEQ ID NO: 298211 - RNA, 19 nt, Homo sapiens
gggcacaguaggaauugga

SEQ ID NO: 298212 - RNA, 19 nt, Homo sapiens
agacaggauccgaagcaaa

SEQ ID NO: 298213 - RNA, 19 nt, Homo sapiens
aacauagccucaccaaggu

SEQ ID NO: 298214 - RNA, 19 nt, Homo sapiens
aggaggagaacaaggauga

SEQ ID NO: 298215 - RNA, 19 nt, Homo sapiens
gaagauggauguaaagugu

SEQ ID NO: 298216 - RNA, 19 nt, Homo sapiens
aaguugagcugacucgaua

SEQ ID NO: 298217 - RNA, 19 nt, Homo sapiens
ccacgaggauggccuggaa

SEQ ID NO: 298218 - RNA, 19 nt, Homo sapiens
gaagggaagauggauguaa

SEQ ID NO: 298219 - RNA, 19 nt, Homo sapiens
ggaugauucugccuccaaa

SEQ ID NO: 298220 - RNA, 19 nt, Homo sapiens
aagggaagauggauguaaa

SEQ ID NO: 298221 - RNA, 19 nt, Homo sapiens
gcacagagaauugccuuca

SEQ ID NO: 298222 - RNA, 19 nt, Homo sapiens
ugugagaacuguggaauca

SEQ ID NO: 298223 - RNA, 19 nt, Homo sapiens
caucuuggcccuaccuuga

SEQ ID NO: 298224 - RNA, 19 nt, Homo sapiens
gagccgaggguguggagua

SEQ ID NO: 298225 - RNA, 19 nt, Homo sapiens
gcuccugggugcugugaga

SEQ ID NO: 298226 - RNA, 19 nt, Homo sapiens
ggaagauggauguaaagug

SEQ ID NO: 298227 - RNA, 19 nt, Homo sapiens
caagaggauuguggccauu

SEQ ID NO: 298228 - RNA, 19 nt, Homo sapiens
gacaggauccgaagcaaag

SEQ ID NO: 298229 - RNA, 19 nt, Homo sapiens
gaggagaacaaggaugauu

SEQ ID NO: 298230 - RNA, 19 nt, Homo sapiens
gccaaugccugcaguuugc

SEQ ID NO: 298231 - RNA, 19 nt, Homo sapiens
agaccaaggcugacacuga

SEQ ID NO: 298232 - RNA, 19 nt, Homo sapiens
ggagacaggauccgaagca

SEQ ID NO: 298233 - RNA, 19 nt, Homo sapiens
gcagucugguugccaaguc

SEQ ID NO: 298234 - RNA, 19 nt, Homo sapiens
gagacaggauccgaagcaa

SEQ ID NO: 298235 - RNA, 19 nt, Homo sapiens
gcucagacaccuauuacca

SEQ ID NO: 298236 - RNA, 19 nt, Homo sapiens
gggaagggaagauggaugu

SEQ ID NO: 298237 - RNA, 19 nt, Homo sapiens
acaaggaggagaacaagga

SEQ ID NO: 298238 - RNA, 19 nt, Homo sapiens
gacgcucagacaccuauua

SEQ ID NO: 298239 - RNA, 19 nt, Homo sapiens
ggccuagaguggcggaaga

SEQ ID NO: 298240 - RNA, 19 nt, Homo sapiens
ggacaaggaggagaacaag

SEQ ID NO: 298241 - RNA, 19 nt, Homo sapiens
uguugcagcuuccacagaa

SEQ ID NO: 298242 - RNA, 19 nt, Homo sapiens
guggugaggucaggaagga

SEQ ID NO: 298243 - RNA, 19 nt, Homo sapiens
caaauuggccccagaggaa

SEQ ID NO: 298244 - RNA, 19 nt, Homo sapiens
gagauacagcagucugguu

SEQ ID NO: 298245 - RNA, 19 nt, Homo sapiens
cacagagaauugccuucaa

SEQ ID NO: 298246 - RNA, 19 nt, Homo sapiens
ccucuucgacuucaaacaa

SEQ ID NO: 298247 - RNA, 19 nt, Homo sapiens
ggaagggaagauggaugua

SEQ ID NO: 298248 - RNA, 19 nt, Homo sapiens
acagagaauugccuucaac

SEQ ID NO: 298249 - RNA, 19 nt, Homo sapiens
auaccggccuggugccaaa

SEQ ID NO: 298250 - RNA, 19 nt, Homo sapiens
gcgccaaugccugcaguuu

SEQ ID NO: 298251 - RNA, 19 nt, Homo sapiens
gcccuuccucacagaguua

SEQ ID NO: 298252 - RNA, 19 nt, Homo sapiens
uggguguccugcagaagaa

SEQ ID NO: 298253 - RNA, 19 nt, Homo sapiens
ugauucugccuccaaauug

SEQ ID NO: 298254 - RNA, 19 nt, Homo sapiens
gcugcgacaagcccaaauu

SEQ ID NO: 298255 - RNA, 19 nt, Homo sapiens
ucaaaacguugugcaaaga

SEQ ID NO: 298256 - RNA, 19 nt, Homo sapiens
gaccauacccaggcuccaa

SEQ ID NO: 298257 - RNA, 19 nt, Homo sapiens
aggaggagaacaaggauga

SEQ ID NO: 298258 - RNA, 19 nt, Homo sapiens
caucggggcuguucugcaa

SEQ ID NO: 298259 - RNA, 19 nt, Homo sapiens
agacaggauccgaagcaaa

SEQ ID NO: 298260 - RNA, 19 nt, Homo sapiens
ccaaaggcagcggcucaaa

SEQ ID NO: 298261 - RNA, 19 nt, Homo sapiens
gcaaccagaagcgccagaa

SEQ ID NO: 298262 - RNA, 19 nt, Homo sapiens
gagacgcugccuccggauu

SEQ ID NO: 298263 - RNA, 19 nt, Homo sapiens
gccugcaguuugccaugaa

SEQ ID NO: 298264 - RNA, 19 nt, Homo sapiens
ccagcaagaagcgaaagaa

SEQ ID NO: 298265 - RNA, 19 nt, Homo sapiens
guggguguccugcagaaga

SEQ ID NO: 298266 - RNA, 19 nt, Homo sapiens
ccaccuccagcuucgauga

SEQ ID NO: 298267 - RNA, 19 nt, Homo sapiens
ccaccuuaccgucgucgaa

SEQ ID NO: 298268 - RNA, 19 nt, Homo sapiens
aagcaaaguugagcugacu

SEQ ID NO: 298269 - RNA, 19 nt, Homo sapiens
cgacuucugcugcgacaag

SEQ ID NO: 298270 - RNA, 19 nt, Homo sapiens
gcuggugcccuuccucaca

SEQ ID NO: 298271 - RNA, 19 nt, Homo sapiens
gaacccgcuuccgagauac

SEQ ID NO: 298272 - RNA, 19 nt, Homo sapiens
uggcacugaccuuguguuu

SEQ ID NO: 298273 - RNA, 19 nt, Homo sapiens
gccuggcacugaccuugug

SEQ ID NO: 298274 - RNA, 19 nt, Homo sapiens
agacgcugccuccggauug

SEQ ID NO: 298275 - RNA, 19 nt, Homo sapiens
gaagauggauguaaagugu

SEQ ID NO: 298276 - RNA, 19 nt, Homo sapiens
ucucuaagcuguucuauuu

SEQ ID NO: 298277 - RNA, 19 nt, Homo sapiens
guacagagauucuaugaag

SEQ ID NO: 298278 - RNA, 19 nt, Homo sapiens
gcaccaaccuuccaagugu

SEQ ID NO: 298279 - RNA, 19 nt, Homo sapiens
gcacuguacuuaauacuag

SEQ ID NO: 298280 - RNA, 19 nt, Homo sapiens
gaggauaacucaauauaac

SEQ ID NO: 298281 - RNA, 19 nt, Homo sapiens
gcacagcuguccugacuuc

SEQ ID NO: 298282 - RNA, 19 nt, Homo sapiens
guucaucuauuacugugua

SEQ ID NO: 298283 - RNA, 19 nt, Homo sapiens
gguaggcacuguacuuaau

SEQ ID NO: 298284 - RNA, 19 nt, Homo sapiens
cugccgaguucaucuauua

SEQ ID NO: 298285 - RNA, 19 nt, Homo sapiens
aaguugagcugacucgaua

SEQ ID NO: 298286 - RNA, 19 nt, Homo sapiens
ccacgaggauggccuggaa

SEQ ID NO: 298287 - RNA, 19 nt, Homo sapiens
gaagggaagauggauguaa

SEQ ID NO: 298288 - RNA, 19 nt, Homo sapiens
ccaacgaggugaucuagca

SEQ ID NO: 298289 - RNA, 19 nt, Homo sapiens
gcaaguacagagauucuau

SEQ ID NO: 298290 - RNA, 19 nt, Homo sapiens
ggaugauucugccuccaaa

SEQ ID NO: 298291 - RNA, 19 nt, Homo sapiens
caaggugacacauuacaaa

SEQ ID NO: 298292 - RNA, 19 nt, Homo sapiens
ggaauuagagaagcugaaa

SEQ ID NO: 298293 - RNA, 19 nt, Homo sapiens
caguaggaauuggaaauaa

SEQ ID NO: 298294 - RNA, 19 nt, Homo sapiens
caaagccacccuaccauga

SEQ ID NO: 298295 - RNA, 19 nt, Homo sapiens
ucacagaguuaaauaugca

SEQ ID NO: 298296 - RNA, 19 nt, Homo sapiens
aagggaagauggauguaaa

SEQ ID NO: 298297 - RNA, 19 nt, Homo sapiens
ccaacuuuaucauggaauu

SEQ ID NO: 298298 - RNA, 19 nt, Homo sapiens
gcacagagaauugccuuca

SEQ ID NO: 298299 - RNA, 19 nt, Homo sapiens
auacuaggauacagaaaug

SEQ ID NO: 298300 - RNA, 19 nt, Homo sapiens
ggaaacauagccucaccaa

SEQ ID NO: 298301 - RNA, 19 nt, Homo sapiens
ugugagaacuguggaauca

SEQ ID NO: 298302 - RNA, 19 nt, Homo sapiens
guaggcacuguacuuaaua

SEQ ID NO: 298303 - RNA, 19 nt, Homo sapiens
caucuuggcccuaccuuga

SEQ ID NO: 298304 - RNA, 19 nt, Homo sapiens
gagccgaggguguggagua

SEQ ID NO: 298305 - RNA, 19 nt, Homo sapiens
gaguuggguuguggccuua

SEQ ID NO: 298306 - RNA, 19 nt, Homo sapiens
gcuccugggugcugugaga

SEQ ID NO: 298307 - RNA, 19 nt, Homo sapiens
uacaaauggugaauggauu

SEQ ID NO: 298308 - RNA, 19 nt, Homo sapiens
acaaugugcugcugcuuca

SEQ ID NO: 298309 - RNA, 19 nt, Homo sapiens
ggaagauggauguaaagug

SEQ ID NO: 298310 - RNA, 19 nt, Homo sapiens
caagaggauuguggccauu

SEQ ID NO: 298311 - RNA, 19 nt, Homo sapiens
ggacagcccuuuugugaac

SEQ ID NO: 298312 - RNA, 19 nt, Homo sapiens
gacaggauccgaagcaaag

SEQ ID NO: 298313 - RNA, 19 nt, Homo sapiens
caccaaccuuccaagugua

SEQ ID NO: 298314 - RNA, 19 nt, Homo sapiens
gaggagaacaaggaugauu

SEQ ID NO: 298315 - RNA, 19 nt, Homo sapiens
gccaaugccugcaguuugc

SEQ ID NO: 298316 - RNA, 19 nt, Homo sapiens
ggagacaggauccgaagca

SEQ ID NO: 298317 - RNA, 19 nt, Homo sapiens
gauacggcccaugcaauuu

SEQ ID NO: 298318 - RNA, 19 nt, Homo sapiens
augcaaagcugaagaccau

SEQ ID NO: 298319 - RNA, 19 nt, Homo sapiens
agaccaaggcugacacuga

SEQ ID NO: 298320 - RNA, 19 nt, Homo sapiens
gaggacagcccuuuuguga

SEQ ID NO: 298321 - RNA, 19 nt, Homo sapiens
gagaaccuggccuguggua

SEQ ID NO: 298322 - RNA, 19 nt, Homo sapiens
gcucagacaccuauuacca

SEQ ID NO: 298323 - RNA, 19 nt, Homo sapiens
ccugacuucucccguauug

SEQ ID NO: 298324 - RNA, 19 nt, Homo sapiens
gagacaggauccgaagcaa

SEQ ID NO: 298325 - RNA, 19 nt, Homo sapiens
gugguaggcacuguacuua

SEQ ID NO: 298326 - RNA, 19 nt, Homo sapiens
cuaugaagcccacccagaa

SEQ ID NO: 298327 - RNA, 19 nt, Homo sapiens
gggaagggaagauggaugu

SEQ ID NO: 298328 - RNA, 19 nt, Homo sapiens
ggccuagaguggcggaaga

SEQ ID NO: 298329 - RNA, 19 nt, Homo sapiens
uauuacaaauggugaaugg

SEQ ID NO: 298330 - RNA, 19 nt, Homo sapiens
gacgcucagacaccuauua

SEQ ID NO: 298331 - RNA, 19 nt, Homo sapiens
acaaggaggagaacaagga

SEQ ID NO: 298332 - RNA, 19 nt, Homo sapiens
acaguaggaauuggaaaua

SEQ ID NO: 298333 - RNA, 19 nt, Homo sapiens
gcacaguaggaauuggaaa

SEQ ID NO: 298334 - RNA, 19 nt, Homo sapiens
gcagucugguugccaaggu

SEQ ID NO: 298335 - RNA, 19 nt, Homo sapiens
ggacaaggaggagaacaag

SEQ ID NO: 298336 - RNA, 19 nt, Homo sapiens
uguugcagcuuccacagaa

SEQ ID NO: 298337 - RNA, 19 nt, Homo sapiens
guggugaggucaggaagga

SEQ ID NO: 298338 - RNA, 19 nt, Homo sapiens
ccucacagaguuaaauaug

SEQ ID NO: 298339 - RNA, 19 nt, Homo sapiens
caaauuggccccagaggaa

SEQ ID NO: 298340 - RNA, 19 nt, Homo sapiens
cauggaauuuaaugcugaa

SEQ ID NO: 298341 - RNA, 19 nt, Homo sapiens
guacuuaauacuaggauac

SEQ ID NO: 298342 - RNA, 19 nt, Homo sapiens
uuacaaagccacccuacca

SEQ ID NO: 298343 - RNA, 19 nt, Homo sapiens
ggcaacgugugaacugcaa

SEQ ID NO: 298344 - RNA, 19 nt, Homo sapiens
gagauacagcagucugguu

SEQ ID NO: 298345 - RNA, 19 nt, Homo sapiens
cacagagaauugccuucaa

SEQ ID NO: 298346 - RNA, 19 nt, Homo sapiens
ccucuucgacuucaaacaa

SEQ ID NO: 298347 - RNA, 19 nt, Homo sapiens
gacuggaggcuucuacaga

SEQ ID NO: 298348 - RNA, 19 nt, Homo sapiens
agauacggcccaugcaauu

SEQ ID NO: 298349 - RNA, 19 nt, Homo sapiens
ggcacuguacuuaauacua

SEQ ID NO: 298350 - RNA, 19 nt, Homo sapiens
ggaagggaagauggaugua

SEQ ID NO: 298351 - RNA, 19 nt, Homo sapiens
acagagaauugccuucaac

SEQ ID NO: 298352 - RNA, 19 nt, Homo sapiens
uuacaaauggugaauggau

SEQ ID NO: 298353 - RNA, 19 nt, Homo sapiens
aaagauacggcccaugcaa

SEQ ID NO: 298354 - RNA, 19 nt, Homo sapiens
uaugaagcccacccagaaa

SEQ ID NO: 298355 - RNA, 19 nt, Homo sapiens
ucucuuguggcccaucuua

SEQ ID NO: 298356 - RNA, 19 nt, Homo sapiens
gcccuccgguuaucaagca

SEQ ID NO: 298357 - RNA, 19 nt, Homo sapiens
ggagcuagaaagcaguaga

SEQ ID NO: 298358 - RNA, 19 nt, Homo sapiens
auaccggccuggugccaaa

SEQ ID NO: 298359 - RNA, 19 nt, Homo sapiens
aggcacagcuguccugacu

SEQ ID NO: 298360 - RNA, 19 nt, Homo sapiens
caaguacagagauucuaug

SEQ ID NO: 298361 - RNA, 19 nt, Homo sapiens
ccaaggugacacauuacaa

SEQ ID NO: 298362 - RNA, 19 nt, Homo sapiens
gauacauggcaacguguga

SEQ ID NO: 298363 - RNA, 19 nt, Homo sapiens
guccugacuucucccguau

SEQ ID NO: 298364 - RNA, 19 nt, Homo sapiens
gcgccaaugccugcaguuu

SEQ ID NO: 298365 - RNA, 19 nt, Homo sapiens
gaaaaugcaaagcugaaga

SEQ ID NO: 298366 - RNA, 19 nt, Homo sapiens
gcccuuccucacagaguua

SEQ ID NO: 298367 - RNA, 19 nt, Homo sapiens
uggguguccugcagaagaa

SEQ ID NO: 298368 - RNA, 19 nt, Homo sapiens
ugauucugccuccaaauug

SEQ ID NO: 298369 - RNA, 19 nt, Homo sapiens
gcugcgacaagcccaaauu

SEQ ID NO: 298370 - RNA, 19 nt, Homo sapiens
ucaaaacguugugcaaaga

SEQ ID NO: 298371 - RNA, 19 nt, Homo sapiens
aaagccacccuaccaugaa

SEQ ID NO: 298372 - RNA, 19 nt, Homo sapiens
uuagagaagcugaaaggau

SEQ ID NO: 298373 - RNA, 19 nt, Homo sapiens
gaccauacccaggcuccaa

SEQ ID NO: 298374 - RNA, 19 nt, Homo sapiens
gggcacaguaggaauugga

SEQ ID NO: 298375 - RNA, 19 nt, Homo sapiens
gaagauggauguaaagugu

SEQ ID NO: 298376 - RNA, 19 nt, Homo sapiens
ucucuaagcuguucuauuu

SEQ ID NO: 298377 - RNA, 19 nt, Homo sapiens
guacagagauucuaugaag

SEQ ID NO: 298378 - RNA, 19 nt, Homo sapiens
gcaccaaccuuccaagugu

SEQ ID NO: 298379 - RNA, 19 nt, Homo sapiens
gcacuguacuuaauacuag

SEQ ID NO: 298380 - RNA, 19 nt, Homo sapiens
gaggauaacucaauauaac

SEQ ID NO: 298381 - RNA, 19 nt, Homo sapiens
gcacagcuguccugacuuc

SEQ ID NO: 298382 - RNA, 19 nt, Homo sapiens
guucaucuauuacugugua

SEQ ID NO: 298383 - RNA, 19 nt, Homo sapiens
gguaggcacuguacuuaau

SEQ ID NO: 298384 - RNA, 19 nt, Homo sapiens
cugccgaguucaucuauua

SEQ ID NO: 298385 - RNA, 19 nt, Homo sapiens
aaguugagcugacucgaua

SEQ ID NO: 298386 - RNA, 19 nt, Homo sapiens
ccacgaggauggccuggaa

SEQ ID NO: 298387 - RNA, 19 nt, Homo sapiens
gaagggaagauggauguaa

SEQ ID NO: 298388 - RNA, 19 nt, Homo sapiens
ccaacgaggugaucuagca

SEQ ID NO: 298389 - RNA, 19 nt, Homo sapiens
gcaaguacagagauucuau

SEQ ID NO: 298390 - RNA, 19 nt, Homo sapiens
ggaugauucugccuccaaa

SEQ ID NO: 298391 - RNA, 19 nt, Homo sapiens
caaggugacacauuacaaa

SEQ ID NO: 298392 - RNA, 19 nt, Homo sapiens
ggaauuagagaagcugaaa

SEQ ID NO: 298393 - RNA, 19 nt, Homo sapiens
caguaggaauuggaaauaa

SEQ ID NO: 298394 - RNA, 19 nt, Homo sapiens
caaagccacccuaccauga

SEQ ID NO: 298395 - RNA, 19 nt, Homo sapiens
ucacagaguuaaauaugca

SEQ ID NO: 298396 - RNA, 19 nt, Homo sapiens
aagggaagauggauguaaa

SEQ ID NO: 298397 - RNA, 19 nt, Homo sapiens
ccaacuuuaucauggaauu

SEQ ID NO: 298398 - RNA, 19 nt, Homo sapiens
gcacagagaauugccuuca

SEQ ID NO: 298399 - RNA, 19 nt, Homo sapiens
auacuaggauacagaaaug

SEQ ID NO: 298400 - RNA, 19 nt, Homo sapiens
ggaaacauagccucaccaa

SEQ ID NO: 298401 - RNA, 19 nt, Homo sapiens
ugugagaacuguggaauca

SEQ ID NO: 298402 - RNA, 19 nt, Homo sapiens
guaggcacuguacuuaaua

SEQ ID NO: 298403 - RNA, 19 nt, Homo sapiens
caucuuggcccuaccuuga

SEQ ID NO: 298404 - RNA, 19 nt, Homo sapiens
gagccgaggguguggagua

SEQ ID NO: 298405 - RNA, 19 nt, Homo sapiens
gaguuggguuguggccuua

SEQ ID NO: 298406 - RNA, 19 nt, Homo sapiens
gcuccugggugcugugaga

SEQ ID NO: 298407 - RNA, 19 nt, Homo sapiens
uacaaauggugaauggauu

SEQ ID NO: 298408 - RNA, 19 nt, Homo sapiens
acaaugugcugcugcuuca

SEQ ID NO: 298409 - RNA, 19 nt, Homo sapiens
ggaagauggauguaaagug

SEQ ID NO: 298410 - RNA, 19 nt, Homo sapiens
caagaggauuguggccauu

SEQ ID NO: 298411 - RNA, 19 nt, Homo sapiens
ggacagcccuuuugugaac

SEQ ID NO: 298412 - RNA, 19 nt, Homo sapiens
gacaggauccgaagcaaag

SEQ ID NO: 298413 - RNA, 19 nt, Homo sapiens
caccaaccuuccaagugua

SEQ ID NO: 298414 - RNA, 19 nt, Homo sapiens
gaggagaacaaggaugauu

SEQ ID NO: 298415 - RNA, 19 nt, Homo sapiens
gccaaugccugcaguuugc

SEQ ID NO: 298416 - RNA, 19 nt, Homo sapiens
ggagacaggauccgaagca

SEQ ID NO: 298417 - RNA, 19 nt, Homo sapiens
gauacggcccaugcaauuu

SEQ ID NO: 298418 - RNA, 19 nt, Homo sapiens
augcaaagcugaagaccau

SEQ ID NO: 298419 - RNA, 19 nt, Homo sapiens
agaccaaggcugacacuga

SEQ ID NO: 298420 - RNA, 19 nt, Homo sapiens
gaggacagcccuuuuguga

SEQ ID NO: 298421 - RNA, 19 nt, Homo sapiens
gagaaccuggccuguggua

SEQ ID NO: 298422 - RNA, 19 nt, Homo sapiens
gcucagacaccuauuacca

SEQ ID NO: 298423 - RNA, 19 nt, Homo sapiens
ccugacuucucccguauug

SEQ ID NO: 298424 - RNA, 19 nt, Homo sapiens
gagacaggauccgaagcaa

SEQ ID NO: 298425 - RNA, 19 nt, Homo sapiens
gugguaggcacuguacuua

SEQ ID NO: 298426 - RNA, 19 nt, Homo sapiens
cuaugaagcccacccagaa

SEQ ID NO: 298427 - RNA, 19 nt, Homo sapiens
gggaagggaagauggaugu

SEQ ID NO: 298428 - RNA, 19 nt, Homo sapiens
ggccuagaguggcggaaga

SEQ ID NO: 298429 - RNA, 19 nt, Homo sapiens
uauuacaaauggugaaugg

SEQ ID NO: 298430 - RNA, 19 nt, Homo sapiens
gacgcucagacaccuauua

SEQ ID NO: 298431 - RNA, 19 nt, Homo sapiens
acaaggaggagaacaagga

SEQ ID NO: 298432 - RNA, 19 nt, Homo sapiens
acaguaggaauuggaaaua

SEQ ID NO: 298433 - RNA, 19 nt, Homo sapiens
gcacaguaggaauuggaaa

SEQ ID NO: 298434 - RNA, 19 nt, Homo sapiens
gcagucugguugccaaggu

SEQ ID NO: 298435 - RNA, 19 nt, Homo sapiens
ggacaaggaggagaacaag

SEQ ID NO: 298436 - RNA, 19 nt, Homo sapiens
uguugcagcuuccacagaa

SEQ ID NO: 298437 - RNA, 19 nt, Homo sapiens
guggugaggucaggaagga

SEQ ID NO: 298438 - RNA, 19 nt, Homo sapiens
ccucacagaguuaaauaug

SEQ ID NO: 298439 - RNA, 19 nt, Homo sapiens
caaauuggccccagaggaa

SEQ ID NO: 298440 - RNA, 19 nt, Homo sapiens
cauggaauuuaaugcugaa

SEQ ID NO: 298441 - RNA, 19 nt, Homo sapiens
guacuuaauacuaggauac

SEQ ID NO: 298442 - RNA, 19 nt, Homo sapiens
uuacaaagccacccuacca

SEQ ID NO: 298443 - RNA, 19 nt, Homo sapiens
ggcaacgugugaacugcaa

SEQ ID NO: 298444 - RNA, 19 nt, Homo sapiens
gagauacagcagucugguu

SEQ ID NO: 298445 - RNA, 19 nt, Homo sapiens
cacagagaauugccuucaa

SEQ ID NO: 298446 - RNA, 19 nt, Homo sapiens
ccucuucgacuucaaacaa

SEQ ID NO: 298447 - RNA, 19 nt, Homo sapiens
gacuggaggcuucuacaga

SEQ ID NO: 298448 - RNA, 19 nt, Homo sapiens
agauacggcccaugcaauu

SEQ ID NO: 298449 - RNA, 19 nt, Homo sapiens
ggcacuguacuuaauacua

SEQ ID NO: 298450 - RNA, 19 nt, Homo sapiens
ggaagggaagauggaugua

SEQ ID NO: 298451 - RNA, 19 nt, Homo sapiens
acagagaauugccuucaac

SEQ ID NO: 298452 - RNA, 19 nt, Homo sapiens
uuacaaauggugaauggau

SEQ ID NO: 298453 - RNA, 19 nt, Homo sapiens
aaagauacggcccaugcaa

SEQ ID NO: 298454 - RNA, 19 nt, Homo sapiens
uaugaagcccacccagaaa

SEQ ID NO: 298455 - RNA, 19 nt, Homo sapiens
ucucuuguggcccaucuua

SEQ ID NO: 298456 - RNA, 19 nt, Homo sapiens
gcccuccgguuaucaagca

SEQ ID NO: 298457 - RNA, 19 nt, Homo sapiens
ggagcuagaaagcaguaga

SEQ ID NO: 298458 - RNA, 19 nt, Homo sapiens
auaccggccuggugccaaa

SEQ ID NO: 298459 - RNA, 19 nt, Homo sapiens
aggcacagcuguccugacu

SEQ ID NO: 298460 - RNA, 19 nt, Homo sapiens
caaguacagagauucuaug

SEQ ID NO: 298461 - RNA, 19 nt, Homo sapiens
ccaaggugacacauuacaa

SEQ ID NO: 298462 - RNA, 19 nt, Homo sapiens
gauacauggcaacguguga

SEQ ID NO: 298463 - RNA, 19 nt, Homo sapiens
guccugacuucucccguau

SEQ ID NO: 298464 - RNA, 19 nt, Homo sapiens
gcgccaaugccugcaguuu

SEQ ID NO: 298465 - RNA, 19 nt, Homo sapiens
gaaaaugcaaagcugaaga

SEQ ID NO: 298466 - RNA, 19 nt, Homo sapiens
gcccuuccucacagaguua

SEQ ID NO: 298467 - RNA, 19 nt, Homo sapiens
uggguguccugcagaagaa

SEQ ID NO: 298468 - RNA, 19 nt, Homo sapiens
ugauucugccuccaaauug

SEQ ID NO: 298469 - RNA, 19 nt, Homo sapiens
gcugcgacaagcccaaauu

SEQ ID NO: 298470 - RNA, 19 nt, Homo sapiens
ucaaaacguugugcaaaga

SEQ ID NO: 298471 - RNA, 19 nt, Homo sapiens
aaagccacccuaccaugaa

SEQ ID NO: 298472 - RNA, 19 nt, Homo sapiens
uuagagaagcugaaaggau

SEQ ID NO: 298473 - RNA, 19 nt, Homo sapiens
gaccauacccaggcuccaa

SEQ ID NO: 298474 - RNA, 19 nt, Homo sapiens
gggcacaguaggaauugga

SEQ ID NO: 298475 - RNA, 19 nt, Homo sapiens
gcaaacagcuucacaaauu

SEQ ID NO: 298476 - RNA, 19 nt, Homo sapiens
gaacuaggguggugcauuu

SEQ ID NO: 298477 - RNA, 19 nt, Homo sapiens
ggaaucauauuguguguaa

SEQ ID NO: 298478 - RNA, 19 nt, Homo sapiens
gcacuaauuucacuaccua

SEQ ID NO: 298479 - RNA, 19 nt, Homo sapiens
guaauaagguugaacacuu

SEQ ID NO: 298480 - RNA, 19 nt, Homo sapiens
uaacaaaucucaagcaaac

SEQ ID NO: 298481 - RNA, 19 nt, Homo sapiens
gguauagacuccugaaaga

SEQ ID NO: 298482 - RNA, 19 nt, Homo sapiens
ggacauggugcacuaauuu

SEQ ID NO: 298483 - RNA, 19 nt, Homo sapiens
guaguagucaugcuaauua

SEQ ID NO: 298484 - RNA, 19 nt, Homo sapiens
guacacagaaauacaguua

SEQ ID NO: 298485 - RNA, 19 nt, Homo sapiens
uagaauagauauccacuug

SEQ ID NO: 298486 - RNA, 19 nt, Homo sapiens
gaacauuccuggacuuguc

SEQ ID NO: 298487 - RNA, 19 nt, Homo sapiens
ugaugaagauuguguauug

SEQ ID NO: 298488 - RNA, 19 nt, Homo sapiens
aaacagaaauggcacguau

SEQ ID NO: 298489 - RNA, 19 nt, Homo sapiens
gaaguacccguucacauuu

SEQ ID NO: 298490 - RNA, 19 nt, Homo sapiens
augcagaacuggcaacuua

SEQ ID NO: 298491 - RNA, 19 nt, Homo sapiens
ucaaucaacuuaugcagaa

SEQ ID NO: 298492 - RNA, 19 nt, Homo sapiens
gcacuuggguaucuucuuc

SEQ ID NO: 298493 - RNA, 19 nt, Homo sapiens
gaagagaacccacgaacau

SEQ ID NO: 298494 - RNA, 19 nt, Homo sapiens
gaaauagacugaccuacac

SEQ ID NO: 298495 - RNA, 19 nt, Homo sapiens
gaauagauauccacuugag

SEQ ID NO: 298496 - RNA, 19 nt, Homo sapiens
gcaaacaaguugggaacaa

SEQ ID NO: 298497 - RNA, 19 nt, Homo sapiens
ucacuuaauugcuacauga

SEQ ID NO: 298498 - RNA, 19 nt, Homo sapiens
guauucagcuuuaguagau

SEQ ID NO: 298499 - RNA, 19 nt, Homo sapiens
gaauuaagucugugagauu

SEQ ID NO: 298500 - RNA, 19 nt, Homo sapiens
ggaaauagacugaccuaca

SEQ ID NO: 298501 - RNA, 19 nt, Homo sapiens
caucauguaucgcuucauu

SEQ ID NO: 298502 - RNA, 19 nt, Homo sapiens
caacaaugcugguucugau

SEQ ID NO: 298503 - RNA, 19 nt, Homo sapiens
guaguuagcagcagcagua

SEQ ID NO: 298504 - RNA, 19 nt, Homo sapiens
cauauuguguguaauguug

SEQ ID NO: 298505 - RNA, 19 nt, Homo sapiens
cagaaacugugaccuguga

SEQ ID NO: 298506 - RNA, 19 nt, Homo sapiens
uaucuaaacuggauucaca

SEQ ID NO: 298507 - RNA, 19 nt, Homo sapiens
guauaugcauagucaugua

SEQ ID NO: 298508 - RNA, 19 nt, Homo sapiens
gaagacagaagggcaguuu

SEQ ID NO: 298509 - RNA, 19 nt, Homo sapiens
gggaugaugaaauaaguua

SEQ ID NO: 298510 - RNA, 19 nt, Homo sapiens
caaacaguacacuaucuua

SEQ ID NO: 298511 - RNA, 19 nt, Homo sapiens
guucauccauucuauuguu

SEQ ID NO: 298512 - RNA, 19 nt, Homo sapiens
ugacaucaccacaguuuaa

SEQ ID NO: 298513 - RNA, 19 nt, Homo sapiens
ucauguaucgcuucauuua

SEQ ID NO: 298514 - RNA, 19 nt, Homo sapiens
ucacacacauacauaccua

SEQ ID NO: 298515 - RNA, 19 nt, Homo sapiens
caaacagcuucacaaauuc

SEQ ID NO: 298516 - RNA, 19 nt, Homo sapiens
gauuguguauugcuacuga

SEQ ID NO: 298517 - RNA, 19 nt, Homo sapiens
gugaaggccuuguguguca

SEQ ID NO: 298518 - RNA, 19 nt, Homo sapiens
gaaaauauggcaauacuug

SEQ ID NO: 298519 - RNA, 19 nt, Homo sapiens
uuaacuugcugcaguauga

SEQ ID NO: 298520 - RNA, 19 nt, Homo sapiens
agaaauggcacguaucaaa

SEQ ID NO: 298521 - RNA, 19 nt, Homo sapiens
guaaugcuuucgauagugu

SEQ ID NO: 298522 - RNA, 19 nt, Homo sapiens
gugaaauaaugaccuuuga

SEQ ID NO: 298523 - RNA, 19 nt, Homo sapiens
caaccuugcuuugauggaa

SEQ ID NO: 298524 - RNA, 19 nt, Homo sapiens
uaacuaggauuucucuaac

SEQ ID NO: 298525 - RNA, 19 nt, Homo sapiens
guuagcagcagcaguagua

SEQ ID NO: 298526 - RNA, 19 nt, Homo sapiens
gcaacuuacuacugaaucu

SEQ ID NO: 298527 - RNA, 19 nt, Homo sapiens
guacaaaaguuucauccuu

SEQ ID NO: 298528 - RNA, 19 nt, Homo sapiens
gagccuuccuuucuguuug

SEQ ID NO: 298529 - RNA, 19 nt, Homo sapiens
ugaagauuguguauugcua

SEQ ID NO: 298530 - RNA, 19 nt, Homo sapiens
caggaaugcugcagagaau

SEQ ID NO: 298531 - RNA, 19 nt, Homo sapiens
acacagaaauacaguuaag

SEQ ID NO: 298532 - RNA, 19 nt, Homo sapiens
gagucuaucaaucaacuua

SEQ ID NO: 298533 - RNA, 19 nt, Homo sapiens
uuaaguggcuuccaauuuu

SEQ ID NO: 298534 - RNA, 19 nt, Homo sapiens
ccuauauacucacuuucua

SEQ ID NO: 298535 - RNA, 19 nt, Homo sapiens
cugaaucucuaaucaaugu

SEQ ID NO: 298536 - RNA, 19 nt, Homo sapiens
uaacuguaguccagcuuug

SEQ ID NO: 298537 - RNA, 19 nt, Homo sapiens
ccuaagugauuguaugaau

SEQ ID NO: 298538 - RNA, 19 nt, Homo sapiens
ucugugagauucauucaug

SEQ ID NO: 298539 - RNA, 19 nt, Homo sapiens
cuaaugacaucaccacagu

SEQ ID NO: 298540 - RNA, 19 nt, Homo sapiens
caccaacaaagcaauaaua

SEQ ID NO: 298541 - RNA, 19 nt, Homo sapiens
guuauaacuccuccuagua

SEQ ID NO: 298542 - RNA, 19 nt, Homo sapiens
gcaguaguagucaugcuaa

SEQ ID NO: 298543 - RNA, 19 nt, Homo sapiens
acaguuaugccgcuagaua

SEQ ID NO: 298544 - RNA, 19 nt, Homo sapiens
cauguaagcugaaaauaug

SEQ ID NO: 298545 - RNA, 19 nt, Homo sapiens
gggaccacauugagucuau

SEQ ID NO: 298546 - RNA, 19 nt, Homo sapiens
gauguaaagugauauuucc

SEQ ID NO: 298547 - RNA, 19 nt, Homo sapiens
gcaauaauaguaguaguag

SEQ ID NO: 298548 - RNA, 19 nt, Homo sapiens
gaccuucucucugggcaaa

SEQ ID NO: 298549 - RNA, 19 nt, Homo sapiens
gauuaaccuucccugaguu

SEQ ID NO: 298550 - RNA, 19 nt, Homo sapiens
uaacuccuccuaguacuaa

SEQ ID NO: 298551 - RNA, 19 nt, Homo sapiens
acaaacaccugugcucugu

SEQ ID NO: 298552 - RNA, 19 nt, Homo sapiens
uauccaguauuguuccuuu

SEQ ID NO: 298553 - RNA, 19 nt, Homo sapiens
ggauguaaagugauauuuc

SEQ ID NO: 298554 - RNA, 19 nt, Homo sapiens
agacugaccuacacaaacu

SEQ ID NO: 298555 - RNA, 19 nt, Homo sapiens
ccugaaagacaauauaaug

SEQ ID NO: 298556 - RNA, 19 nt, Homo sapiens
uugaaaccaugaagagauu

SEQ ID NO: 298557 - RNA, 19 nt, Homo sapiens
aguacuaacuccuaggaaa

SEQ ID NO: 298558 - RNA, 19 nt, Homo sapiens
caaauucucacacacauac

SEQ ID NO: 298559 - RNA, 19 nt, Homo sapiens
ccucauauccaguauuguu

SEQ ID NO: 298560 - RNA, 19 nt, Homo sapiens
caaacaaguugggaacaag

SEQ ID NO: 298561 - RNA, 19 nt, Homo sapiens
gaaauggcacguaucaaaa

SEQ ID NO: 298562 - RNA, 19 nt, Homo sapiens
ggcagcgucuuacucagaa

SEQ ID NO: 298563 - RNA, 19 nt, Homo sapiens
agacagcacuauguaggaa

SEQ ID NO: 298564 - RNA, 19 nt, Homo sapiens
gaugcucuaugugcuugua

SEQ ID NO: 298565 - RNA, 19 nt, Homo sapiens
gaggaaagcauguauucag

SEQ ID NO: 298566 - RNA, 19 nt, Homo sapiens
uaacagcaccaacaaagca

SEQ ID NO: 298567 - RNA, 19 nt, Homo sapiens
gccgcuagauacaugcuuu

SEQ ID NO: 298568 - RNA, 19 nt, Homo sapiens
ggaagagaacccacgaaca

SEQ ID NO: 298569 - RNA, 19 nt, Homo sapiens
acacacauacauaccuaua

SEQ ID NO: 298570 - RNA, 19 nt, Homo sapiens
acuaugaggcccuaucuuu

SEQ ID NO: 298571 - RNA, 19 nt, Homo sapiens
ggugaaauaaugaccuuug

SEQ ID NO: 298572 - RNA, 19 nt, Homo sapiens
caagucaagauuuccauau

SEQ ID NO: 298573 - RNA, 19 nt, Homo sapiens
ccuuuaaaguguguaguaa

SEQ ID NO: 298574 - RNA, 19 nt, Homo sapiens
uguguagucuuacgauguu

SEQ ID NO: 298575 - RNA, 19 nt, Homo sapiens
ggacaaaugugcuugguuu

SEQ ID NO: 298576 - RNA, 19 nt, Homo sapiens
gagagaaaccuguauaaua

SEQ ID NO: 298577 - RNA, 19 nt, Homo sapiens
ugagagagaugcuuucuaa

SEQ ID NO: 298578 - RNA, 19 nt, Homo sapiens
gaaguuaaguuguugcuau

SEQ ID NO: 298579 - RNA, 19 nt, Homo sapiens
gagagaugcuuucuaauau

SEQ ID NO: 298580 - RNA, 19 nt, Homo sapiens
gaucaaggcugcccaauac

SEQ ID NO: 298581 - RNA, 19 nt, Homo sapiens
gaagaaagcagcacuguca

SEQ ID NO: 298582 - RNA, 19 nt, Homo sapiens
gaucagauauuccuuacau

SEQ ID NO: 298583 - RNA, 19 nt, Homo sapiens
gaaauccacugcacacugu

SEQ ID NO: 298584 - RNA, 19 nt, Homo sapiens
agagaaaccuguauaauag

SEQ ID NO: 298585 - RNA, 19 nt, Homo sapiens
aaagaugcauaccuaguua

SEQ ID NO: 298586 - RNA, 19 nt, Homo sapiens
ggagauaaauggacgcaau

SEQ ID NO: 298587 - RNA, 19 nt, Homo sapiens
ggaaguauguagagaguuc

SEQ ID NO: 298588 - RNA, 19 nt, Homo sapiens
uaucaggccuuguuauaaa

SEQ ID NO: 298589 - RNA, 19 nt, Homo sapiens
acaaggagcugacaaguuc

SEQ ID NO: 298590 - RNA, 19 nt, Homo sapiens
gauaaugggcacuuguuua

SEQ ID NO: 298591 - RNA, 19 nt, Homo sapiens
ggcagacaauugaguaaua

SEQ ID NO: 298592 - RNA, 19 nt, Homo sapiens
caaacucucucaauacaga

SEQ ID NO: 298593 - RNA, 19 nt, Homo sapiens
ggccaaaucugccugaaga

SEQ ID NO: 298594 - RNA, 19 nt, Homo sapiens
cauaauaucugccgaacau

SEQ ID NO: 298595 - RNA, 19 nt, Homo sapiens
gagauucccuuucagacaa

SEQ ID NO: 298596 - RNA, 19 nt, Homo sapiens
cgaagggucugccacguuu

SEQ ID NO: 298597 - RNA, 19 nt, Homo sapiens
ugaauuacauguaguguca

SEQ ID NO: 298598 - RNA, 19 nt, Homo sapiens
gcacuucuguauauaguca

SEQ ID NO: 298599 - RNA, 19 nt, Homo sapiens
gcagacaauugaguaauau

SEQ ID NO: 298600 - RNA, 19 nt, Homo sapiens
agagagaugcuuucuaaua

SEQ ID NO: 298601 - RNA, 19 nt, Homo sapiens
gcacagaguuaugcauuca

SEQ ID NO: 298602 - RNA, 19 nt, Homo sapiens
caaacuccauugcaaauuc

SEQ ID NO: 298603 - RNA, 19 nt, Homo sapiens
caacaauccuggcagacaa

SEQ ID NO: 298604 - RNA, 19 nt, Homo sapiens
ggaaucauccaaaggaauu

SEQ ID NO: 298605 - RNA, 19 nt, Homo sapiens
aaccaaagcugucucagaa

SEQ ID NO: 298606 - RNA, 19 nt, Homo sapiens
cacaagacauccacauauu

SEQ ID NO: 298607 - RNA, 19 nt, Homo sapiens
uuacccagauguagaauuu

SEQ ID NO: 298608 - RNA, 19 nt, Homo sapiens
gggaauuccucaagcugua

SEQ ID NO: 298609 - RNA, 19 nt, Homo sapiens
ccauuaaggugaaaucaug

SEQ ID NO: 298610 - RNA, 19 nt, Homo sapiens
ggaaagauacgccauccuu

SEQ ID NO: 298611 - RNA, 19 nt, Homo sapiens
cagauaaacucacacauac

SEQ ID NO: 298612 - RNA, 19 nt, Homo sapiens
ccaaagcugucucagaaau

SEQ ID NO: 298613 - RNA, 19 nt, Homo sapiens
gaggugauauuccugucua

SEQ ID NO: 298614 - RNA, 19 nt, Homo sapiens
aaacgcaguuggagauaaa

SEQ ID NO: 298615 - RNA, 19 nt, Homo sapiens
guggacagcuuguaguuug

SEQ ID NO: 298616 - RNA, 19 nt, Homo sapiens
guaagaaguuaaguuguug

SEQ ID NO: 298617 - RNA, 19 nt, Homo sapiens
gcucuaaacugcugcaucu

SEQ ID NO: 298618 - RNA, 19 nt, Homo sapiens
cuaggcugcuuuaguguua

SEQ ID NO: 298619 - RNA, 19 nt, Homo sapiens
caacuuacuuucugcuugu

SEQ ID NO: 298620 - RNA, 19 nt, Homo sapiens
gauacgccauccuuucaaa

SEQ ID NO: 298621 - RNA, 19 nt, Homo sapiens
ccaccaaacuccauugcaa

SEQ ID NO: 298622 - RNA, 19 nt, Homo sapiens
gagaaaagcucuaaguauc

SEQ ID NO: 298623 - RNA, 19 nt, Homo sapiens
ccacaaugcucccaugaca

SEQ ID NO: 298624 - RNA, 19 nt, Homo sapiens
acagauaaacucacacaua

SEQ ID NO: 298625 - RNA, 19 nt, Homo sapiens
aacacaaacucucucaaua

SEQ ID NO: 298626 - RNA, 19 nt, Homo sapiens
gcaagggccucuuucaaaa

SEQ ID NO: 298627 - RNA, 19 nt, Homo sapiens
gugaggagauucccuuuca

SEQ ID NO: 298628 - RNA, 19 nt, Homo sapiens
gagcugacaaguuccauuu

SEQ ID NO: 298629 - RNA, 19 nt, Homo sapiens
aaacgcaguucaaauuuca

SEQ ID NO: 298630 - RNA, 19 nt, Homo sapiens
acucaaaguuuacguaaug

SEQ ID NO: 298631 - RNA, 19 nt, Homo sapiens
guacaugggugaauuuuau

SEQ ID NO: 298632 - RNA, 19 nt, Homo sapiens
gagauaaauggacgcaaua

SEQ ID NO: 298633 - RNA, 19 nt, Homo sapiens
gcccuaggcugcuuuagug

SEQ ID NO: 298634 - RNA, 19 nt, Homo sapiens
gaaagcagcacugucauca

SEQ ID NO: 298635 - RNA, 19 nt, Homo sapiens
caaagaugcauaccuaguu

SEQ ID NO: 298636 - RNA, 19 nt, Homo sapiens
caacucagaagcacucaaa

SEQ ID NO: 298637 - RNA, 19 nt, Homo sapiens
caacacaaacucucucaau

SEQ ID NO: 298638 - RNA, 19 nt, Homo sapiens
augcauaccuaguuaguuu

SEQ ID NO: 298639 - RNA, 19 nt, Homo sapiens
guaaaggacgaggucauua

SEQ ID NO: 298640 - RNA, 19 nt, Homo sapiens
ggagaucuuuuccuugaua

SEQ ID NO: 298641 - RNA, 19 nt, Homo sapiens
aaucaugacucccacaaug

SEQ ID NO: 298642 - RNA, 19 nt, Homo sapiens
gaucaguuucugccaauuu

SEQ ID NO: 298643 - RNA, 19 nt, Homo sapiens
gaaaucauggaucagauau

SEQ ID NO: 298644 - RNA, 19 nt, Homo sapiens
guaauuggguggguuaagu

SEQ ID NO: 298645 - RNA, 19 nt, Homo sapiens
caauacagauaaacucaca

SEQ ID NO: 298646 - RNA, 19 nt, Homo sapiens
auucaaagaugcauaccua

SEQ ID NO: 298647 - RNA, 19 nt, Homo sapiens
gaaaaugauugucgguuug

SEQ ID NO: 298648 - RNA, 19 nt, Homo sapiens
gauaucuucugccaggaaa

SEQ ID NO: 298649 - RNA, 19 nt, Homo sapiens
aagcagcacugucaucaga

SEQ ID NO: 298650 - RNA, 19 nt, Homo sapiens
ccacaagacauccacauau

SEQ ID NO: 298651 - RNA, 19 nt, Homo sapiens
gacacggaauguaaauuug

SEQ ID NO: 298652 - RNA, 19 nt, Homo sapiens
ggccagacacggaauguaa

SEQ ID NO: 298653 - RNA, 19 nt, Homo sapiens
ugugagagguugguacuaa

SEQ ID NO: 298654 - RNA, 19 nt, Homo sapiens
guaggauccuguucuuuca

SEQ ID NO: 298655 - RNA, 19 nt, Homo sapiens
gagagaaagaacuauacua

SEQ ID NO: 298656 - RNA, 19 nt, Homo sapiens
gaacgcaugagauggaaga

SEQ ID NO: 298657 - RNA, 19 nt, Homo sapiens
gacuucacauguuauugua

SEQ ID NO: 298658 - RNA, 19 nt, Homo sapiens
cacaaacucucucaauaca

SEQ ID NO: 298659 - RNA, 19 nt, Homo sapiens
gacuguacaucaaauuaga

SEQ ID NO: 298660 - RNA, 19 nt, Homo sapiens
aaagugaaauugcccuaau

SEQ ID NO: 298661 - RNA, 19 nt, Homo sapiens
aaucauggaucagauauuc

SEQ ID NO: 298662 - RNA, 19 nt, Homo sapiens
aaagagagaaaccuguaua

SEQ ID NO: 298663 - RNA, 19 nt, Homo sapiens
gaagugccauagacuguac

SEQ ID NO: 298664 - RNA, 19 nt, Homo sapiens
aaagacagacuauggugua

SEQ ID NO: 298665 - RNA, 19 nt, Homo sapiens
gcaacaacaucugccacaa

SEQ ID NO: 298666 - RNA, 19 nt, Homo sapiens
gaacuuuccauacuuccaa

SEQ ID NO: 298667 - RNA, 19 nt, Homo sapiens
aaauagaugugcauucagu

SEQ ID NO: 298668 - RNA, 19 nt, Homo sapiens
gccauagacuguacaucaa

SEQ ID NO: 298669 - RNA, 19 nt, Homo sapiens
caacaucugccacaagugu

SEQ ID NO: 298670 - RNA, 19 nt, Homo sapiens
agacacggaauguaaauuu

SEQ ID NO: 298671 - RNA, 19 nt, Homo sapiens
auauaagacugauguguug

SEQ ID NO: 298672 - RNA, 19 nt, Homo sapiens
cagauuaacugcuuauagc

SEQ ID NO: 298673 - RNA, 19 nt, Homo sapiens
uuaaguacaugggugaauu

SEQ ID NO: 298674 - RNA, 19 nt, Homo sapiens
acaaguauguuacccagau

SEQ ID NO: 298675 - RNA, 19 nt, Homo sapiens
gcacacagcugcagagaca

SEQ ID NO: 298676 - RNA, 19 nt, Homo sapiens
gcagagcguccgacuauaa

SEQ ID NO: 298677 - RNA, 19 nt, Homo sapiens
cauccaagcuuccuuuguu

SEQ ID NO: 298678 - RNA, 19 nt, Homo sapiens
guccucagcuucuuaauau

SEQ ID NO: 298679 - RNA, 19 nt, Homo sapiens
ucucucaccuccuaaagua

SEQ ID NO: 298680 - RNA, 19 nt, Homo sapiens
ggcaagaacugcucacuac

SEQ ID NO: 298681 - RNA, 19 nt, Homo sapiens
ggccaacaguuaaaugaga

SEQ ID NO: 298682 - RNA, 19 nt, Homo sapiens
uaacaggauuagacaguca

SEQ ID NO: 298683 - RNA, 19 nt, Homo sapiens
ggaauccuguccucagcuu

SEQ ID NO: 298684 - RNA, 19 nt, Homo sapiens
gucaaggaguggcuuacua

SEQ ID NO: 298685 - RNA, 19 nt, Homo sapiens
gccaacaguuaaaugagaa

SEQ ID NO: 298686 - RNA, 19 nt, Homo sapiens
ccucagcuucuuaauauaa

SEQ ID NO: 298687 - RNA, 19 nt, Homo sapiens
aggaguggcuuacuacaug

SEQ ID NO: 298688 - RNA, 19 nt, Homo sapiens
guccuucucucaccuccua

SEQ ID NO: 298689 - RNA, 19 nt, Homo sapiens
gaaaacagaaaacgguuaa

SEQ ID NO: 298690 - RNA, 19 nt, Homo sapiens
ccuaaugccugcggaguug

SEQ ID NO: 298691 - RNA, 19 nt, Homo sapiens
ggaguggcuuacuacaugu

SEQ ID NO: 298692 - RNA, 19 nt, Homo sapiens
acaguuaaaugagaacaug

SEQ ID NO: 298693 - RNA, 19 nt, Homo sapiens
ugacauccaagcuuccuuu

SEQ ID NO: 298694 - RNA, 19 nt, Homo sapiens
ggccagagaccaggauuug

SEQ ID NO: 298695 - RNA, 19 nt, Homo sapiens
caagguacccuggcuaaag

SEQ ID NO: 298696 - RNA, 19 nt, Homo sapiens
agaaaacgguuaaaacugu

SEQ ID NO: 298697 - RNA, 19 nt, Homo sapiens
gcaagguacccuggcuaaa

SEQ ID NO: 298698 - RNA, 19 nt, Homo sapiens
cagagcguccgacuauaaa

SEQ ID NO: 298699 - RNA, 19 nt, Homo sapiens
ggcaagguacccuggcuaa

SEQ ID NO: 298700 - RNA, 19 nt, Homo sapiens
gauagucgcucuggaucac

SEQ ID NO: 298701 - RNA, 19 nt, Homo sapiens
ggcagagcguccgacuaua

SEQ ID NO: 298702 - RNA, 19 nt, Homo sapiens
aggcagagcguccgacuau

SEQ ID NO: 298703 - RNA, 19 nt, Homo sapiens
gaugaccccuccccuaaug

SEQ ID NO: 298704 - RNA, 19 nt, Homo sapiens
aagcugggaggaagagaua

SEQ ID NO: 298705 - RNA, 19 nt, Homo sapiens
gacuauaaaucggcucaca

SEQ ID NO: 298706 - RNA, 19 nt, Homo sapiens
gagcguccgacuauaaauc

SEQ ID NO: 298707 - RNA, 19 nt, Homo sapiens
aaacugucccuuucugugu

SEQ ID NO: 298708 - RNA, 19 nt, Homo sapiens
uguccucagcuucuuaaua

SEQ ID NO: 298709 - RNA, 19 nt, Homo sapiens
caacauguacaaggacuca

SEQ ID NO: 298710 - RNA, 19 nt, Homo sapiens
gguuaaaacugucccuuuc

SEQ ID NO: 298711 - RNA, 19 nt, Homo sapiens
gcaauuuccggccaacagu

SEQ ID NO: 298712 - RNA, 19 nt, Homo sapiens
gagacacgggcauccuuga

SEQ ID NO: 298713 - RNA, 19 nt, Homo sapiens
cugcggaguugugcacgua

SEQ ID NO: 298714 - RNA, 19 nt, Homo sapiens
ccacagcaaguaccaugga

SEQ ID NO: 298715 - RNA, 19 nt, Homo sapiens
cggcaagaacugcucacua

SEQ ID NO: 298716 - RNA, 19 nt, Homo sapiens
ugugcaacauguacaagga

SEQ ID NO: 298717 - RNA, 19 nt, Homo sapiens
ccagggcacgcuuuccaaa

SEQ ID NO: 298718 - RNA, 19 nt, Homo sapiens
ucacaccacccggcaagaa

SEQ ID NO: 298719 - RNA, 19 nt, Homo sapiens
guaccuggccacagcaagu

SEQ ID NO: 298720 - RNA, 19 nt, Homo sapiens
gggcacgcuuuccaaaauu

SEQ ID NO: 298721 - RNA, 19 nt, Homo sapiens
ucaaggaguggcuuacuac

SEQ ID NO: 298722 - RNA, 19 nt, Homo sapiens
auccaagcuuccuuuguuu

SEQ ID NO: 298723 - RNA, 19 nt, Homo sapiens
aauuuccggccaacaguua

SEQ ID NO: 298724 - RNA, 19 nt, Homo sapiens
ggccggacccaagaugaaa

SEQ ID NO: 298725 - RNA, 19 nt, Homo sapiens
cuauaaaucggcucacaag

SEQ ID NO: 298726 - RNA, 19 nt, Homo sapiens
ccugggcugugcaacaugu

SEQ ID NO: 298727 - RNA, 19 nt, Homo sapiens
acacagcugcagagacaga

SEQ ID NO: 298728 - RNA, 19 nt, Homo sapiens
cagaugaccccuccccuaa

SEQ ID NO: 298729 - RNA, 19 nt, Homo sapiens
caaagaggauggacuaaau

SEQ ID NO: 298730 - RNA, 19 nt, Homo sapiens
gaaagucugguaauaaaug

SEQ ID NO: 298731 - RNA, 19 nt, Homo sapiens
gauauuguguggucugguu

SEQ ID NO: 298732 - RNA, 19 nt, Homo sapiens
caccagggcuuuggccuua

SEQ ID NO: 298733 - RNA, 19 nt, Homo sapiens
aggaaagucugguaauaaa

SEQ ID NO: 298734 - RNA, 19 nt, Homo sapiens
agagggagguggugauauu

SEQ ID NO: 298735 - RNA, 19 nt, Homo sapiens
gugcagggaucccagagaa

SEQ ID NO: 298736 - RNA, 19 nt, Homo sapiens
cagcaucacccaccuuaaa

SEQ ID NO: 298737 - RNA, 19 nt, Homo sapiens
gcagagggagguggugaua

SEQ ID NO: 298738 - RNA, 19 nt, Homo sapiens
caggaaagucugguaauaa

SEQ ID NO: 298739 - RNA, 19 nt, Homo sapiens
gcagacagcccuggcaaau

SEQ ID NO: 298740 - RNA, 19 nt, Homo sapiens
gggaagcuccggacuccua

SEQ ID NO: 298741 - RNA, 19 nt, Homo sapiens
gaggauggacuaaaugauc

SEQ ID NO: 298742 - RNA, 19 nt, Homo sapiens
agacagcccuggcaaaugc

SEQ ID NO: 298743 - RNA, 19 nt, Homo sapiens
gcagggaucccagagaaga

SEQ ID NO: 298744 - RNA, 19 nt, Homo sapiens
caacgacuccuuccugcuu

SEQ ID NO: 298745 - RNA, 19 nt, Homo sapiens
uggacuaaaugaucucuga

SEQ ID NO: 298746 - RNA, 19 nt, Homo sapiens
ggaaagucugguaauaaau

SEQ ID NO: 298747 - RNA, 19 nt, Homo sapiens
gaacuucaaccucuuucuc

SEQ ID NO: 298748 - RNA, 19 nt, Homo sapiens
ccagggcuuuggccuuaaa

SEQ ID NO: 298749 - RNA, 19 nt, Homo sapiens
uaaaugugacucagcauca

SEQ ID NO: 298750 - RNA, 19 nt, Homo sapiens
gcugggaugugaagucucu

SEQ ID NO: 298751 - RNA, 19 nt, Homo sapiens
ucaaagaggauggacuaaa

SEQ ID NO: 298752 - RNA, 19 nt, Homo sapiens
gggagguggugauauugug

SEQ ID NO: 298753 - RNA, 19 nt, Homo sapiens
caucugcaaugccaucauc

SEQ ID NO: 298754 - RNA, 19 nt, Homo sapiens
ugucaaagaggauggacua

SEQ ID NO: 298755 - RNA, 19 nt, Homo sapiens
ggacuaaaugaucucugaa

SEQ ID NO: 298756 - RNA, 19 nt, Homo sapiens
caggaaggcaggagacaga

SEQ ID NO: 298757 - RNA, 19 nt, Homo sapiens
gacccugggcaguuccuua

SEQ ID NO: 298758 - RNA, 19 nt, Homo sapiens
gcagcaccaugaacuaagc

SEQ ID NO: 298759 - RNA, 19 nt, Homo sapiens
gcucauggccgugcuguac

SEQ ID NO: 298760 - RNA, 19 nt, Homo sapiens
gaaccggaaccugcacuca

SEQ ID NO: 298761 - RNA, 19 nt, Homo sapiens
cuacaucuccaucuucuac

SEQ ID NO: 298762 - RNA, 19 nt, Homo sapiens
aaccugcacucacccaugu

SEQ ID NO: 298763 - RNA, 19 nt, Homo sapiens
aaagaggauggacuaaaug

SEQ ID NO: 298764 - RNA, 19 nt, Homo sapiens
guggaagugugugccaaga

SEQ ID NO: 298765 - RNA, 19 nt, Homo sapiens
cagcugggaugugaagucu

SEQ ID NO: 298766 - RNA, 19 nt, Homo sapiens
gccaaccucaggcuccuaa

SEQ ID NO: 298767 - RNA, 19 nt, Homo sapiens
aagaggauggacuaaauga

SEQ ID NO: 298768 - RNA, 19 nt, Homo sapiens
gguggccagugucgucuuc

SEQ ID NO: 298769 - RNA, 19 nt, Homo sapiens
gaccagugccugugagcau

SEQ ID NO: 298770 - RNA, 19 nt, Homo sapiens
cgucugcuccaaugacuga

SEQ ID NO: 298771 - RNA, 19 nt, Homo sapiens
ggccaagggaccagguuug

SEQ ID NO: 298772 - RNA, 19 nt, Homo sapiens
ggagguggugauauugugu

SEQ ID NO: 298773 - RNA, 19 nt, Homo sapiens
gcccucaucaucugcaaug

SEQ ID NO: 298774 - RNA, 19 nt, Homo sapiens
aaggagauccgcgguguga

SEQ ID NO: 298775 - RNA, 19 nt, Homo sapiens
gcagagaaaagcuccauuc

SEQ ID NO: 298776 - RNA, 19 nt, Homo sapiens
gagggagguggugauauug

SEQ ID NO: 298777 - RNA, 19 nt, Homo sapiens
cuucugggcucccucaacu

SEQ ID NO: 298778 - RNA, 19 nt, Homo sapiens
caggcuugguugugagaau

SEQ ID NO: 298779 - RNA, 19 nt, Homo sapiens
ucacccauguacugcuuca

SEQ ID NO: 298780 - RNA, 19 nt, Homo sapiens
uggcagcaccaugaacuaa

SEQ ID NO: 298781 - RNA, 19 nt, Homo sapiens
gaccagaaagcuucaucca

SEQ ID NO: 298782 - RNA, 19 nt, Homo sapiens
aaccucaggcuccuaaaga

SEQ ID NO: 298783 - RNA, 19 nt, Homo sapiens
caaccucaggcuccuaaag

SEQ ID NO: 298784 - RNA, 19 nt, Homo sapiens
aggauggacuaaaugaucu

SEQ ID NO: 298785 - RNA, 19 nt, Homo sapiens
caacacagcaagaaauaau

SEQ ID NO: 298786 - RNA, 19 nt, Homo sapiens
caucaucgacucccuguuu

SEQ ID NO: 298787 - RNA, 19 nt, Homo sapiens
caacaacacagcaagaaau

SEQ ID NO: 298788 - RNA, 19 nt, Homo sapiens
gcucagggacgcauucaaa

SEQ ID NO: 298789 - RNA, 19 nt, Homo sapiens
cgacuguccucgugugguu

SEQ ID NO: 298790 - RNA, 19 nt, Homo sapiens
ggacuggcaucaccauggu

SEQ ID NO: 298791 - RNA, 19 nt, Homo sapiens
gaucuucucccaucaugug

SEQ ID NO: 298792 - RNA, 19 nt, Homo sapiens
uggcuguguucaagaauaa

SEQ ID NO: 298793 - RNA, 19 nt, Homo sapiens
aaacaugggcuaucucaag

SEQ ID NO: 298794 - RNA, 19 nt, Homo sapiens
ugagaaacaugggcuaucu

SEQ ID NO: 298795 - RNA, 19 nt, Homo sapiens
gaucauauugagaaacaug

SEQ ID NO: 298796 - RNA, 19 nt, Homo sapiens
cuacugcgccugcuacaug

SEQ ID NO: 298797 - RNA, 19 nt, Homo sapiens
cugcuuggcuccaucuuca

SEQ ID NO: 298798 - RNA, 19 nt, Homo sapiens
aacaacacagcaagaaaua

SEQ ID NO: 298799 - RNA, 19 nt, Homo sapiens
cagccuauauaagaucuug

SEQ ID NO: 298800 - RNA, 19 nt, Homo sapiens
aagaaauaauuccgacugu

SEQ ID NO: 298801 - RNA, 19 nt, Homo sapiens
cugaucauauugagaaaca

SEQ ID NO: 298802 - RNA, 19 nt, Homo sapiens
ucaacaacacagcaagaaa

SEQ ID NO: 298803 - RNA, 19 nt, Homo sapiens
gcacauuaucaacucguau

SEQ ID NO: 298804 - RNA, 19 nt, Homo sapiens
gugaacggcauguugauca

SEQ ID NO: 298805 - RNA, 19 nt, Homo sapiens
caggugaacggcauguuga

SEQ ID NO: 298806 - RNA, 19 nt, Homo sapiens
ccaggugaacggcauguug

SEQ ID NO: 298807 - RNA, 19 nt, Homo sapiens
caucaacaacacagcaaga

SEQ ID NO: 298808 - RNA, 19 nt, Homo sapiens
gaaacaugggcuaucucaa

SEQ ID NO: 298809 - RNA, 19 nt, Homo sapiens
cuggcuguguucaagaaua

SEQ ID NO: 298810 - RNA, 19 nt, Homo sapiens
acacagcaagaaauaauuc

SEQ ID NO: 298811 - RNA, 19 nt, Homo sapiens
guagcuuggccauaucuga

SEQ ID NO: 298812 - RNA, 19 nt, Homo sapiens
cugggcagccuauauaaga

SEQ ID NO: 298813 - RNA, 19 nt, Homo sapiens
ugacauucugcccaaguaa

SEQ ID NO: 298814 - RNA, 19 nt, Homo sapiens
agaaacaugggcuaucuca

SEQ ID NO: 298815 - RNA, 19 nt, Homo sapiens
ccaggcacccauguacuuu

SEQ ID NO: 298816 - RNA, 19 nt, Homo sapiens
ucauugaccccuucauaua

SEQ ID NO: 298817 - RNA, 19 nt, Homo sapiens
ccacguggcaguuuugaaa

SEQ ID NO: 298818 - RNA, 19 nt, Homo sapiens
ugaacggcauguugaucau

SEQ ID NO: 298819 - RNA, 19 nt, Homo sapiens
augacauucugcccaagua

SEQ ID NO: 298820 - RNA, 19 nt, Homo sapiens
gaugacauucugcccaagu

SEQ ID NO: 298821 - RNA, 19 nt, Homo sapiens
caacucguaugaaaacauc

SEQ ID NO: 298822 - RNA, 19 nt, Homo sapiens
ggaaaauauccugaucaua

SEQ ID NO: 298823 - RNA, 19 nt, Homo sapiens
ggagggagauuuugucuuu

SEQ ID NO: 298824 - RNA, 19 nt, Homo sapiens
gaauugcgcaacaccuuua

SEQ ID NO: 298825 - RNA, 19 nt, Homo sapiens
gcacauggacaacaucuuc

SEQ ID NO: 298826 - RNA, 19 nt, Homo sapiens
gugcacauguuccucuuug

SEQ ID NO: 298827 - RNA, 19 nt, Homo sapiens
ggaauugcgcaacaccuuu

SEQ ID NO: 298828 - RNA, 19 nt, Homo sapiens
gcgacuaccugaccuucga

SEQ ID NO: 298829 - RNA, 19 nt, Homo sapiens
ccaaugcccuggagaccau

SEQ ID NO: 298830 - RNA, 19 nt, Homo sapiens
gugagcaggucuucaucaa

SEQ ID NO: 298831 - RNA, 19 nt, Homo sapiens
gcagucaccaucaccauuc

SEQ ID NO: 298832 - RNA, 19 nt, Homo sapiens
gaccuucgaggaccaguuu

SEQ ID NO: 298833 - RNA, 19 nt, Homo sapiens
caacaccuuuagggagauu

SEQ ID NO: 298834 - RNA, 19 nt, Homo sapiens
gagcagcagcgccuucugu

SEQ ID NO: 298835 - RNA, 19 nt, Homo sapiens
gauuuugucuuuccuguga

SEQ ID NO: 298836 - RNA, 19 nt, Homo sapiens
gagcagcagcagcuuccua

SEQ ID NO: 298837 - RNA, 19 nt, Homo sapiens
acagguacgucaccaucuu

SEQ ID NO: 298838 - RNA, 19 nt, Homo sapiens
gcagcagcgccuucuguga

SEQ ID NO: 298839 - RNA, 19 nt, Homo sapiens
cugcuacacugcccacuuc

SEQ ID NO: 298840 - RNA, 19 nt, Homo sapiens
gucauugugugccucauca

SEQ ID NO: 298841 - RNA, 19 nt, Homo sapiens
gcugguaaguguguccaau

SEQ ID NO: 298842 - RNA, 19 nt, Homo sapiens
gcacgucaagcgcauagca

SEQ ID NO: 298843 - RNA, 19 nt, Homo sapiens
ccaucgccgucgacaggua

SEQ ID NO: 298844 - RNA, 19 nt, Homo sapiens
ccgacaugcugguaagugu

SEQ ID NO: 298845 - RNA, 19 nt, Homo sapiens
caucgucagucugcuggaa

SEQ ID NO: 298846 - RNA, 19 nt, Homo sapiens
cagccaacacugccuaaug

SEQ ID NO: 298847 - RNA, 19 nt, Homo sapiens
caucuucgacuccaugauc

SEQ ID NO: 298848 - RNA, 19 nt, Homo sapiens
gcaacaccuuuagggagau

SEQ ID NO: 298849 - RNA, 19 nt, Homo sapiens
ccgauguacuucuuucucu

SEQ ID NO: 298850 - RNA, 19 nt, Homo sapiens
agccaacacugccuaaugg

SEQ ID NO: 298851 - RNA, 19 nt, Homo sapiens
acaccuaccugguccucau

SEQ ID NO: 298852 - RNA, 19 nt, Homo sapiens
caccugguccucaucauca

SEQ ID NO: 298853 - RNA, 19 nt, Homo sapiens
cgucaucgacccacucauc

SEQ ID NO: 298854 - RNA, 19 nt, Homo sapiens
gcucggaucagcccuucug

SEQ ID NO: 298855 - RNA, 19 nt, Homo sapiens
ggcagucaccaucaccauu

SEQ ID NO: 298856 - RNA, 19 nt, Homo sapiens
cagguacgucaccaucuuu

SEQ ID NO: 298857 - RNA, 19 nt, Homo sapiens
gacaugcugguaagugugu

SEQ ID NO: 298858 - RNA, 19 nt, Homo sapiens
uggaaaacauccugguuau

SEQ ID NO: 298859 - RNA, 19 nt, Homo sapiens
gagaauaucuuagugauug

SEQ ID NO: 298860 - RNA, 19 nt, Homo sapiens
ucucauggcuucucucuau

SEQ ID NO: 298861 - RNA, 19 nt, Homo sapiens
gcaguggacagguacuuua

SEQ ID NO: 298862 - RNA, 19 nt, Homo sapiens
gaucauguguaauucaauc

SEQ ID NO: 298863 - RNA, 19 nt, Homo sapiens
ugacuugucuagcagauau

SEQ ID NO: 298864 - RNA, 19 nt, Homo sapiens
ggaaaaggcuacucugaug

SEQ ID NO: 298865 - RNA, 19 nt, Homo sapiens
caauugcaguggacaggua

SEQ ID NO: 298866 - RNA, 19 nt, Homo sapiens
uggccaggcuucacauuaa

SEQ ID NO: 298867 - RNA, 19 nt, Homo sapiens
guggacagguacuuuacua

SEQ ID NO: 298868 - RNA, 19 nt, Homo sapiens
ucaucgauccucugauuua

SEQ ID NO: 298869 - RNA, 19 nt, Homo sapiens
gacagguacuuuacuaucu

SEQ ID NO: 298870 - RNA, 19 nt, Homo sapiens
ucauacugaucauguguaa

SEQ ID NO: 298871 - RNA, 19 nt, Homo sapiens
ggacagguacuuuacuauc

SEQ ID NO: 298872 - RNA, 19 nt, Homo sapiens
gcaauagccaagaacaaga

SEQ ID NO: 298873 - RNA, 19 nt, Homo sapiens
cacuuuaacuuguaucuca

SEQ ID NO: 298874 - RNA, 19 nt, Homo sapiens
cagaauccauauugugugu

SEQ ID NO: 298875 - RNA, 19 nt, Homo sapiens
ggugagcguuucaaaugga

SEQ ID NO: 298876 - RNA, 19 nt, Homo sapiens
ggagaauaucuuagugauu

SEQ ID NO: 298877 - RNA, 19 nt, Homo sapiens
gggaggccuuugugacuug

SEQ ID NO: 298878 - RNA, 19 nt, Homo sapiens
ucaaauggaucagaaacca

SEQ ID NO: 298879 - RNA, 19 nt, Homo sapiens
gucaucaucugccucauca

SEQ ID NO: 298880 - RNA, 19 nt, Homo sapiens
ugucucacuuuaacuugua

SEQ ID NO: 298881 - RNA, 19 nt, Homo sapiens
gauaugcuggugagcguuu

SEQ ID NO: 298882 - RNA, 19 nt, Homo sapiens
cauccugauuggcgucuuu

SEQ ID NO: 298883 - RNA, 19 nt, Homo sapiens
ccgccaaggugccaauaug

SEQ ID NO: 298884 - RNA, 19 nt, Homo sapiens
guucaucauuuacucagau

SEQ ID NO: 298885 - RNA, 19 nt, Homo sapiens
caucgauccucugauuuau

SEQ ID NO: 298886 - RNA, 19 nt, Homo sapiens
caauagccaagaacaagaa

SEQ ID NO: 298887 - RNA, 19 nt, Homo sapiens
gaaccgcagcaguuacaga

SEQ ID NO: 298888 - RNA, 19 nt, Homo sapiens
gccagugagucccuuggaa

SEQ ID NO: 298889 - RNA, 19 nt, Homo sapiens
guagugcugucaucaucug

SEQ ID NO: 298890 - RNA, 19 nt, Homo sapiens
ccagugagucccuuggaaa

SEQ ID NO: 298891 - RNA, 19 nt, Homo sapiens
acagguacuuuacuaucuu

SEQ ID NO: 298892 - RNA, 19 nt, Homo sapiens
gcauucacccauguacuuu

SEQ ID NO: 298893 - RNA, 19 nt, Homo sapiens
guuacagacugcacagcaa

SEQ ID NO: 298894 - RNA, 19 nt, Homo sapiens
ggaaaaccuucaaagagau

SEQ ID NO: 298895 - RNA, 19 nt, Homo sapiens
gcuuggcuguggcugauau

SEQ ID NO: 298896 - RNA, 19 nt, Homo sapiens
ucaaucaucgauccucuga

SEQ ID NO: 298897 - RNA, 19 nt, Homo sapiens
cuucaugucucacuuuaac

SEQ ID NO: 298898 - RNA, 19 nt, Homo sapiens
ucagcuuguuggagaauau

SEQ ID NO: 298899 - RNA, 19 nt, Homo sapiens
uaguagugcugucaucauc

SEQ ID NO: 298900 - RNA, 19 nt, Homo sapiens
uggagaauaucuuagugau

SEQ ID NO: 298901 - RNA, 19 nt, Homo sapiens
aauaugaagggagcgauua

SEQ ID NO: 298902 - RNA, 19 nt, Homo sapiens
gccaaggugccaauaugaa

SEQ ID NO: 298903 - RNA, 19 nt, Homo sapiens
gauaguagugcugucauca

SEQ ID NO: 298904 - RNA, 19 nt, Homo sapiens
aggaaaaccuucaaagaga

SEQ ID NO: 298905 - RNA, 19 nt, Homo sapiens
ccacuuaauauucuacauc

SEQ ID NO: 298906 - RNA, 19 nt, Homo sapiens
gcucuccaguaccauaaca

SEQ ID NO: 298907 - RNA, 19 nt, Homo sapiens
gcuccuugcuugcauccau

SEQ ID NO: 298908 - RNA, 19 nt, Homo sapiens
caauaugaagggagcgauu

SEQ ID NO: 298909 - RNA, 19 nt, Homo sapiens
guuggagaauaucuuagug

SEQ ID NO: 298910 - RNA, 19 nt, Homo sapiens
cugaucauguguaauucaa

SEQ ID NO: 298911 - RNA, 19 nt, Homo sapiens
guccucagaauccauauug

SEQ ID NO: 298912 - RNA, 19 nt, Homo sapiens
auacggaugcacagaguuu

SEQ ID NO: 298913 - RNA, 19 nt, Homo sapiens
cauguguaauucaaucauc

SEQ ID NO: 298914 - RNA, 19 nt, Homo sapiens
ggccaggcuucacauuaag

SEQ ID NO: 298915 - RNA, 19 nt, Homo sapiens
cuggugagcguuucaaaug

SEQ ID NO: 298916 - RNA, 19 nt, Homo sapiens
ggcaauagccaagaacaag

SEQ ID NO: 298917 - RNA, 19 nt, Homo sapiens
cugauuggcgucuuuguug

SEQ ID NO: 298918 - RNA, 19 nt, Homo sapiens
ucuaugcucuccaguacca

SEQ ID NO: 298919 - RNA, 19 nt, Homo sapiens
cguuucaaauggaucagaa

SEQ ID NO: 298920 - RNA, 19 nt, Homo sapiens
gaggaaaaccuucaaagag

SEQ ID NO: 298921 - RNA, 19 nt, Homo sapiens
ggagucaagaacugaggaa

SEQ ID NO: 298922 - RNA, 19 nt, Homo sapiens
uaucucauacugaucaugu

SEQ ID NO: 298923 - RNA, 19 nt, Homo sapiens
ugcuucaugucucacuuua

SEQ ID NO: 298924 - RNA, 19 nt, Homo sapiens
gaacugaggaaaaccuuca

SEQ ID NO: 298925 - RNA, 19 nt, Homo sapiens
ucgauccucugauuuaugc

SEQ ID NO: 298926 - RNA, 19 nt, Homo sapiens
ccaaggugccaauaugaag

SEQ ID NO: 298927 - RNA, 19 nt, Homo sapiens
cuccaguaccauaacauua

SEQ ID NO: 298928 - RNA, 19 nt, Homo sapiens
cuucuaugcucuccaguac

SEQ ID NO: 298929 - RNA, 19 nt, Homo sapiens
cagguacuuuacuaucuuc

SEQ ID NO: 298930 - RNA, 19 nt, Homo sapiens
uauugugugugcuucaugu

SEQ ID NO: 298931 - RNA, 19 nt, Homo sapiens
ccucagaauccauauugug

SEQ ID NO: 298932 - RNA, 19 nt, Homo sapiens
cccauucuuccuccacuua

SEQ ID NO: 298933 - RNA, 19 nt, Homo sapiens
ugauuggcgucuuuguugu

SEQ ID NO: 298934 - RNA, 19 nt, Homo sapiens
ucuggaaccgcagcaguua

SEQ ID NO: 298935 - RNA, 19 nt, Homo sapiens
aaucugcauucacccaugu

SEQ ID NO: 298936 - RNA, 19 nt, Homo sapiens
gguacuuuacuaucuucua

SEQ ID NO: 298937 - RNA, 19 nt, Homo sapiens
cuuguuggagaauaucuua

SEQ ID NO: 298938 - RNA, 19 nt, Homo sapiens
gagcguuucaaauggauca

SEQ ID NO: 298939 - RNA, 19 nt, Homo sapiens
caucucuuguccucagaau

SEQ ID NO: 298940 - RNA, 19 nt, Homo sapiens
ggcauuuuguucaucauuu

SEQ ID NO: 298941 - RNA, 19 nt, Homo sapiens
gaucuguagcuccuugcuu

SEQ ID NO: 298942 - RNA, 19 nt, Homo sapiens
ucaugucucacuuuaacuu

SEQ ID NO: 298943 - RNA, 19 nt, Homo sapiens
gugcuucaugucucacuuu

SEQ ID NO: 298944 - RNA, 19 nt, Homo sapiens
agauacggaugcacagagu

SEQ ID NO: 298945 - RNA, 19 nt, Homo sapiens
gcuggugagcguuucaaau

SEQ ID NO: 298946 - RNA, 19 nt, Homo sapiens
caucauuuacucagauagu

SEQ ID NO: 298947 - RNA, 19 nt, Homo sapiens
uagccaagaacaagaaucu

SEQ ID NO: 298948 - RNA, 19 nt, Homo sapiens
cauauugugugugcuucau

SEQ ID NO: 298949 - RNA, 19 nt, Homo sapiens
gaauaucuuagugauugug

SEQ ID NO: 298950 - RNA, 19 nt, Homo sapiens
uaccuugaccauccugauu

SEQ ID NO: 298951 - RNA, 19 nt, Homo sapiens
cgccaaggugccaauauga

SEQ ID NO: 298952 - RNA, 19 nt, Homo sapiens
ucaccaugcuggcucucau

SEQ ID NO: 298953 - RNA, 19 nt, Homo sapiens
gauggacccucucauauau

SEQ ID NO: 298954 - RNA, 19 nt, Homo sapiens
caacaagcaccuagugaua

SEQ ID NO: 298955 - RNA, 19 nt, Homo sapiens
aaacaagucuucaccaugu

SEQ ID NO: 298956 - RNA, 19 nt, Homo sapiens
gagaacaucuuggucauag

SEQ ID NO: 298957 - RNA, 19 nt, Homo sapiens
cuacugcucucgcuucaug

SEQ ID NO: 298958 - RNA, 19 nt, Homo sapiens
ucacuuuaaugcuuucuug

SEQ ID NO: 298959 - RNA, 19 nt, Homo sapiens
caucucacuuuaaugcuuu

SEQ ID NO: 298960 - RNA, 19 nt, Homo sapiens
gggagaccaucaccaucua

SEQ ID NO: 298961 - RNA, 19 nt, Homo sapiens
ugauggacccucucauaua

SEQ ID NO: 298962 - RNA, 19 nt, Homo sapiens
gagaugcggaagaccuuua

SEQ ID NO: 298963 - RNA, 19 nt, Homo sapiens
ccauugcaguggauaggua

SEQ ID NO: 298964 - RNA, 19 nt, Homo sapiens
ggagaacaucuuggucaua

SEQ ID NO: 298965 - RNA, 19 nt, Homo sapiens
cuucaugucucacuucaau

SEQ ID NO: 298966 - RNA, 19 nt, Homo sapiens
caacaacaagcaccuagug

SEQ ID NO: 298967 - RNA, 19 nt, Homo sapiens
gaccaucaccaucuaccua

SEQ ID NO: 298968 - RNA, 19 nt, Homo sapiens
ccuggugucucuguacaua

SEQ ID NO: 298969 - RNA, 19 nt, Homo sapiens
gcauugcuguggagguguu

SEQ ID NO: 298970 - RNA, 19 nt, Homo sapiens
ccacagagggcaaccuuuc

SEQ ID NO: 298971 - RNA, 19 nt, Homo sapiens
cgugauggacccucucaua

SEQ ID NO: 298972 - RNA, 19 nt, Homo sapiens
ccaucuaccuacucaacaa

SEQ ID NO: 298973 - RNA, 19 nt, Homo sapiens
ugucucacuucaauaugua

SEQ ID NO: 298974 - RNA, 19 nt, Homo sapiens
gauagcagacgccuuugug

SEQ ID NO: 298975 - RNA, 19 nt, Homo sapiens
gccugcagcuuucccagaa

SEQ ID NO: 298976 - RNA, 19 nt, Homo sapiens
ucauacucaucauguguaa

SEQ ID NO: 298977 - RNA, 19 nt, Homo sapiens
gcauugucuucauccugua

SEQ ID NO: 298978 - RNA, 19 nt, Homo sapiens
guucuucgcuaugcuguuc

SEQ ID NO: 298979 - RNA, 19 nt, Homo sapiens
gugauggacccucucauau

SEQ ID NO: 298980 - RNA, 19 nt, Homo sapiens
cauuucaccugcauuucuu

SEQ ID NO: 298981 - RNA, 19 nt, Homo sapiens
ucaucucacuuuaaugcuu

SEQ ID NO: 298982 - RNA, 19 nt, Homo sapiens
agugauagcagacgccuuu

SEQ ID NO: 298983 - RNA, 19 nt, Homo sapiens
gccaagagaugcggaagac

SEQ ID NO: 298984 - RNA, 19 nt, Homo sapiens
ucaucagccucuuggagaa

SEQ ID NO: 298985 - RNA, 19 nt, Homo sapiens
ccucauuucaccugcauuu

SEQ ID NO: 298986 - RNA, 19 nt, Homo sapiens
ucaccugcauuucuuggau

SEQ ID NO: 298987 - RNA, 19 nt, Homo sapiens
ucaugucucacuucaauau

SEQ ID NO: 298988 - RNA, 19 nt, Homo sapiens
guacgucaccaucuucuac

SEQ ID NO: 298989 - RNA, 19 nt, Homo sapiens
ucuuggaucucaaccugaa

SEQ ID NO: 298990 - RNA, 19 nt, Homo sapiens
gggccauagugaagaacaa

SEQ ID NO: 298991 - RNA, 19 nt, Homo sapiens
gcucucgcuucaugucuca

SEQ ID NO: 298992 - RNA, 19 nt, Homo sapiens
cauguguaauuccgugaug

SEQ ID NO: 298993 - RNA, 19 nt, Homo sapiens
auagguacgucaccaucuu

SEQ ID NO: 298994 - RNA, 19 nt, Homo sapiens
gcagcuuacuggccauugc

SEQ ID NO: 298995 - RNA, 19 nt, Homo sapiens
cuuccuucaucucacuuua

SEQ ID NO: 298996 - RNA, 19 nt, Homo sapiens
gcgcuaccaccacaucaug

SEQ ID NO: 298997 - RNA, 19 nt, Homo sapiens
gugaagacaugggcauugc

SEQ ID NO: 298998 - RNA, 19 nt, Homo sapiens
guguuugacuccaugaucu

SEQ ID NO: 298999 - RNA, 19 nt, Homo sapiens
auuauuugcugccgugguu

SEQ ID NO: 299000 - RNA, 19 nt, Homo sapiens
gggcugcggcauugucuuc

SEQ ID NO: 299001 - RNA, 19 nt, Homo sapiens
gcauccaugugcagcuuac

SEQ ID NO: 299002 - RNA, 19 nt, Homo sapiens
cugcauuucuuggaucuca

SEQ ID NO: 299003 - RNA, 19 nt, Homo sapiens
gauagguacgucaccaucu

SEQ ID NO: 299004 - RNA, 19 nt, Homo sapiens
acaacaagcaccuagugau

SEQ ID NO: 299005 - RNA, 19 nt, Homo sapiens
acaauguguuugacuccau

SEQ ID NO: 299006 - RNA, 19 nt, Homo sapiens
acaagcaccuagugauagc

SEQ ID NO: 299007 - RNA, 19 nt, Homo sapiens
ggccauagugaagaacaaa

SEQ ID NO: 299008 - RNA, 19 nt, Homo sapiens
uggagaacaucuuggucau

SEQ ID NO: 299009 - RNA, 19 nt, Homo sapiens
gaacuggugucauuccuua

SEQ ID NO: 299010 - RNA, 19 nt, Homo sapiens
gcaaauggcucaagcucua

SEQ ID NO: 299011 - RNA, 19 nt, Homo sapiens
agacaaagaugcccaguuu

SEQ ID NO: 299012 - RNA, 19 nt, Homo sapiens
gaacuuggacaccaugaua

SEQ ID NO: 299013 - RNA, 19 nt, Homo sapiens
gcagacagcuacccuacuu

SEQ ID NO: 299014 - RNA, 19 nt, Homo sapiens
cagauaagcucccagaaga

SEQ ID NO: 299015 - RNA, 19 nt, Homo sapiens
gaaacccugucucuacuaa

SEQ ID NO: 299016 - RNA, 19 nt, Homo sapiens
caagucaucugguacaaga

SEQ ID NO: 299017 - RNA, 19 nt, Homo sapiens
gcaccaaacuucuacaaac

SEQ ID NO: 299018 - RNA, 19 nt, Homo sapiens
gaaagagaauaugguguug

SEQ ID NO: 299019 - RNA, 19 nt, Homo sapiens
agaagcagcugcaguguug

SEQ ID NO: 299020 - RNA, 19 nt, Homo sapiens
ggagacagguguugaaugc

SEQ ID NO: 299021 - RNA, 19 nt, Homo sapiens
ugauaucgcugcugaguga

SEQ ID NO: 299022 - RNA, 19 nt, Homo sapiens
caaagucuccugugacauu

SEQ ID NO: 299023 - RNA, 19 nt, Homo sapiens
gaagucaccgucccuguuu

SEQ ID NO: 299024 - RNA, 19 nt, Homo sapiens
ggagcuaugucccuuccua

SEQ ID NO: 299025 - RNA, 19 nt, Homo sapiens
gcaggagaaugguaugaau

SEQ ID NO: 299026 - RNA, 19 nt, Homo sapiens
gggauuaaagcuaugguua

SEQ ID NO: 299027 - RNA, 19 nt, Homo sapiens
aggcacagcugguuaaaga

SEQ ID NO: 299028 - RNA, 19 nt, Homo sapiens
gcugggcgcuguccucuau

SEQ ID NO: 299029 - RNA, 19 nt, Homo sapiens
gaaguuaagucagauaagc

SEQ ID NO: 299030 - RNA, 19 nt, Homo sapiens
caaagggacuagagagaag

SEQ ID NO: 299031 - RNA, 19 nt, Homo sapiens
gaagaaccggguccacauu

SEQ ID NO: 299032 - RNA, 19 nt, Homo sapiens
ccaccacacuucagcauca

SEQ ID NO: 299033 - RNA, 19 nt, Homo sapiens
aagaugaggucuacacugu

SEQ ID NO: 299034 - RNA, 19 nt, Homo sapiens
ucagagggccacuggguua

SEQ ID NO: 299035 - RNA, 19 nt, Homo sapiens
uccuggagcuggucaauuu

SEQ ID NO: 299036 - RNA, 19 nt, Homo sapiens
aagagaauaugguguugaa

SEQ ID NO: 299037 - RNA, 19 nt, Homo sapiens
ugucagguguguaaauuug

SEQ ID NO: 299038 - RNA, 19 nt, Homo sapiens
gagaauaugguguugaauc

SEQ ID NO: 299039 - RNA, 19 nt, Homo sapiens
uauauuagcaccaaacuuc

SEQ ID NO: 299040 - RNA, 19 nt, Homo sapiens
ugaaagagaauaugguguu

SEQ ID NO: 299041 - RNA, 19 nt, Homo sapiens
ggaagucaccgucccuguu

SEQ ID NO: 299042 - RNA, 19 nt, Homo sapiens
uagaagggcccaaaugaga

SEQ ID NO: 299043 - RNA, 19 nt, Homo sapiens
ggauuaaagcuaugguuau

SEQ ID NO: 299044 - RNA, 19 nt, Homo sapiens
acaucgaucugaggcauua

SEQ ID NO: 299045 - RNA, 19 nt, Homo sapiens
gauaagcucccagaagaga

SEQ ID NO: 299046 - RNA, 19 nt, Homo sapiens
uguugaaucugucuuguga

SEQ ID NO: 299047 - RNA, 19 nt, Homo sapiens
gaacuacuggugaacuaug

SEQ ID NO: 299048 - RNA, 19 nt, Homo sapiens
gaacacagugggcgcuaug

SEQ ID NO: 299049 - RNA, 19 nt, Homo sapiens
ggucuacacuguccuucau

SEQ ID NO: 299050 - RNA, 19 nt, Homo sapiens
gagaccagggagagaaaua

SEQ ID NO: 299051 - RNA, 19 nt, Homo sapiens
gcaccuauagucccagcua

SEQ ID NO: 299052 - RNA, 19 nt, Homo sapiens
cagcagagaucagggguua

SEQ ID NO: 299053 - RNA, 19 nt, Homo sapiens
ccacuggccucagcacuuc

SEQ ID NO: 299054 - RNA, 19 nt, Homo sapiens
gcguggaaaucagguguuu

SEQ ID NO: 299055 - RNA, 19 nt, Homo sapiens
aaugagagaaugguacuua

SEQ ID NO: 299056 - RNA, 19 nt, Homo sapiens
ccaaacuucuacaaaccaa

SEQ ID NO: 299057 - RNA, 19 nt, Homo sapiens
caagugaacaagaccaaga

SEQ ID NO: 299058 - RNA, 19 nt, Homo sapiens
agaauaugguguugaaucu

SEQ ID NO: 299059 - RNA, 19 nt, Homo sapiens
gaagggcccaaaugagaga

SEQ ID NO: 299060 - RNA, 19 nt, Homo sapiens
ggugaaacccugucucuac

SEQ ID NO: 299061 - RNA, 19 nt, Homo sapiens
caucguggcugugauugug

SEQ ID NO: 299062 - RNA, 19 nt, Homo sapiens
gcacggcaagugaacaaga

SEQ ID NO: 299063 - RNA, 19 nt, Homo sapiens
gcacagcugguuaaagaag

SEQ ID NO: 299064 - RNA, 19 nt, Homo sapiens
aagcuuaauugucccagaa

SEQ ID NO: 299065 - RNA, 19 nt, Homo sapiens
ccuagaagggcccaaauga

SEQ ID NO: 299066 - RNA, 19 nt, Homo sapiens
ccaaagggacuagagagaa

SEQ ID NO: 299067 - RNA, 19 nt, Homo sapiens
uaguugaaguuaagucaga

SEQ ID NO: 299068 - RNA, 19 nt, Homo sapiens
cacaggaacuacuggugaa

SEQ ID NO: 299069 - RNA, 19 nt, Homo sapiens
acaaagaugcccaguuuua

SEQ ID NO: 299070 - RNA, 19 nt, Homo sapiens
gagaaauacaucgaucuga

SEQ ID NO: 299071 - RNA, 19 nt, Homo sapiens
ggagucgagugguuuguac

SEQ ID NO: 299072 - RNA, 19 nt, Homo sapiens
gcucgccucuucaaagucu

SEQ ID NO: 299073 - RNA, 19 nt, Homo sapiens
aauaugguguugaaucugu

SEQ ID NO: 299074 - RNA, 19 nt, Homo sapiens
gguuaaagaagacaaagau

SEQ ID NO: 299075 - RNA, 19 nt, Homo sapiens
ugaaggcacagcugguuaa

SEQ ID NO: 299076 - RNA, 19 nt, Homo sapiens
acaccagacuccaacacaa

SEQ ID NO: 299077 - RNA, 19 nt, Homo sapiens
ggaacacagugggcgcuau

SEQ ID NO: 299078 - RNA, 19 nt, Homo sapiens
ucccauagcccucuugaug

SEQ ID NO: 299079 - RNA, 19 nt, Homo sapiens
aaagucuccugugacauuu

SEQ ID NO: 299080 - RNA, 19 nt, Homo sapiens
cacauuauggcuguaaaua

SEQ ID NO: 299081 - RNA, 19 nt, Homo sapiens
ggucaucguggcugugauu

SEQ ID NO: 299082 - RNA, 19 nt, Homo sapiens
gcauccagcuccgcgucua

SEQ ID NO: 299083 - RNA, 19 nt, Homo sapiens
gcaccuccacagagagaaa

SEQ ID NO: 299084 - RNA, 19 nt, Homo sapiens
caacggcacggcaagugaa

SEQ ID NO: 299085 - RNA, 19 nt, Homo sapiens
ggaaggugugggugaaaga

SEQ ID NO: 299086 - RNA, 19 nt, Homo sapiens
gaaggcacagcugguuaaa

SEQ ID NO: 299087 - RNA, 19 nt, Homo sapiens
gugaaacccugucucuacu

SEQ ID NO: 299088 - RNA, 19 nt, Homo sapiens
aggaacuacuggugaacua

SEQ ID NO: 299089 - RNA, 19 nt, Homo sapiens
uuguacaccuugcagagua

SEQ ID NO: 299090 - RNA, 19 nt, Homo sapiens
gagcuucgggugugugugu

SEQ ID NO: 299091 - RNA, 19 nt, Homo sapiens
caauuuaaccacccucaca

SEQ ID NO: 299092 - RNA, 19 nt, Homo sapiens
gccaggaccucgaguucca

SEQ ID NO: 299093 - RNA, 19 nt, Homo sapiens
cguagugguuggcaccuau

SEQ ID NO: 299094 - RNA, 19 nt, Homo sapiens
gagggccacuggguuagga

SEQ ID NO: 299095 - RNA, 19 nt, Homo sapiens
aacagcaccuccacagaga

SEQ ID NO: 299096 - RNA, 19 nt, Homo sapiens
gagugaaccacaggaacua

SEQ ID NO: 299097 - RNA, 19 nt, Homo sapiens
cgagugguuuguacaccuu

SEQ ID NO: 299098 - RNA, 19 nt, Homo sapiens
ccuguaaucccagcacuuu

SEQ ID NO: 299099 - RNA, 19 nt, Homo sapiens
agaggaaggugugggugaa

SEQ ID NO: 299100 - RNA, 19 nt, Homo sapiens
ggaggcagaggaagagaca

SEQ ID NO: 299101 - RNA, 19 nt, Homo sapiens
gacgagcgcaucuucuugu

SEQ ID NO: 299102 - RNA, 19 nt, Homo sapiens
ugaagcaggagaaugguau

SEQ ID NO: 299103 - RNA, 19 nt, Homo sapiens
acgagaccauccuggcuaa

SEQ ID NO: 299104 - RNA, 19 nt, Homo sapiens
ucagauaagcucccagaag

SEQ ID NO: 299105 - RNA, 19 nt, Homo sapiens
uguccucuauuuccucuau

SEQ ID NO: 299106 - RNA, 19 nt, Homo sapiens
ggccugugcuucaguugca

SEQ ID NO: 299107 - RNA, 19 nt, Homo sapiens
ccagggaggcagaggaaga

SEQ ID NO: 299108 - RNA, 19 nt, Homo sapiens
cauuauggcuguaaauacc

SEQ ID NO: 299109 - RNA, 19 nt, Homo sapiens
gaaggaccauuuacuguuu

SEQ ID NO: 299110 - RNA, 19 nt, Homo sapiens
ccacaugggugcauuugua

SEQ ID NO: 299111 - RNA, 19 nt, Homo sapiens
gagcugagaaacauuauua

SEQ ID NO: 299112 - RNA, 19 nt, Homo sapiens
ugacagggcuggagaaugu

SEQ ID NO: 299113 - RNA, 19 nt, Homo sapiens
caaugaaacuucgcuuuaa

SEQ ID NO: 299114 - RNA, 19 nt, Homo sapiens
gaacugcgaucagaacuca

SEQ ID NO: 299115 - RNA, 19 nt, Homo sapiens
gagaauccauccaaaguuc

SEQ ID NO: 299116 - RNA, 19 nt, Homo sapiens
gaggagauacugaacauuu

SEQ ID NO: 299117 - RNA, 19 nt, Homo sapiens
ccaaugaaacuucgcuuua

SEQ ID NO: 299118 - RNA, 19 nt, Homo sapiens
gaaacagaacggcugaaua

SEQ ID NO: 299119 - RNA, 19 nt, Homo sapiens
ggagauauaguggaacuua

SEQ ID NO: 299120 - RNA, 19 nt, Homo sapiens
ugccauagcugacuacaaa

SEQ ID NO: 299121 - RNA, 19 nt, Homo sapiens
gaagggagcgcucucuuga

SEQ ID NO: 299122 - RNA, 19 nt, Homo sapiens
gaacgggaccuucuggaaa

SEQ ID NO: 299123 - RNA, 19 nt, Homo sapiens
caguggagccuuauuaaua

SEQ ID NO: 299124 - RNA, 19 nt, Homo sapiens
ggacuaaggccaccaugaa

SEQ ID NO: 299125 - RNA, 19 nt, Homo sapiens
gaacugaaccggacuaagg

SEQ ID NO: 299126 - RNA, 19 nt, Homo sapiens
ggucucaacuuuaagauag

SEQ ID NO: 299127 - RNA, 19 nt, Homo sapiens
gcucaugacugccggaaga

SEQ ID NO: 299128 - RNA, 19 nt, Homo sapiens
caagagcugagaaacauua

SEQ ID NO: 299129 - RNA, 19 nt, Homo sapiens
gacugugccugaacaauuu

SEQ ID NO: 299130 - RNA, 19 nt, Homo sapiens
ggacugugccugaacaauu

SEQ ID NO: 299131 - RNA, 19 nt, Homo sapiens
gcagguaggucggcacuug

SEQ ID NO: 299132 - RNA, 19 nt, Homo sapiens
ggacagaagggcccaugua

SEQ ID NO: 299133 - RNA, 19 nt, Homo sapiens
gagcagaggcugaaggauu

SEQ ID NO: 299134 - RNA, 19 nt, Homo sapiens
guaccaaaguaacugaauu

SEQ ID NO: 299135 - RNA, 19 nt, Homo sapiens
gagauauaguggaacuuaa

SEQ ID NO: 299136 - RNA, 19 nt, Homo sapiens
cauccaaaguucccuauga

SEQ ID NO: 299137 - RNA, 19 nt, Homo sapiens
cuucaggacugcuccaaua

SEQ ID NO: 299138 - RNA, 19 nt, Homo sapiens
ccagggcacuacauaauug

SEQ ID NO: 299139 - RNA, 19 nt, Homo sapiens
gaaaauggcugucuagacu

SEQ ID NO: 299140 - RNA, 19 nt, Homo sapiens
ccaaggcccugcucaugaa

SEQ ID NO: 299141 - RNA, 19 nt, Homo sapiens
gcuaggcaguaccaaagua

SEQ ID NO: 299142 - RNA, 19 nt, Homo sapiens
acaagacacugaggagaua

SEQ ID NO: 299143 - RNA, 19 nt, Homo sapiens
acacggaucugccaucuca

SEQ ID NO: 299144 - RNA, 19 nt, Homo sapiens
agacuuagcuccuguuguc

SEQ ID NO: 299145 - RNA, 19 nt, Homo sapiens
cugcagaguucgugaauga

SEQ ID NO: 299146 - RNA, 19 nt, Homo sapiens
agcagaggcugaaggauua

SEQ ID NO: 299147 - RNA, 19 nt, Homo sapiens
aaacagaacggcugaauag

SEQ ID NO: 299148 - RNA, 19 nt, Homo sapiens
aaagggagauauaguggaa

SEQ ID NO: 299149 - RNA, 19 nt, Homo sapiens
uaaaaggacugcugauuug

SEQ ID NO: 299150 - RNA, 19 nt, Homo sapiens
gcagugaaauccgacauca

SEQ ID NO: 299151 - RNA, 19 nt, Homo sapiens
gaggugaucucugggaguu

SEQ ID NO: 299152 - RNA, 19 nt, Homo sapiens
gggcucaucuucuagaauc

SEQ ID NO: 299153 - RNA, 19 nt, Homo sapiens
gcaaagaggaagaacugaa

SEQ ID NO: 299154 - RNA, 19 nt, Homo sapiens
uugcggagcucaacaagaa

SEQ ID NO: 299155 - RNA, 19 nt, Homo sapiens
uaauaaacgucuccagcaa

SEQ ID NO: 299156 - RNA, 19 nt, Homo sapiens
caucaugaauuccggaguu

SEQ ID NO: 299157 - RNA, 19 nt, Homo sapiens
guagacagguguuacuuac

SEQ ID NO: 299158 - RNA, 19 nt, Homo sapiens
gacauuuguuucuguaaga

SEQ ID NO: 299159 - RNA, 19 nt, Homo sapiens
uccagcagcucaagaauga

SEQ ID NO: 299160 - RNA, 19 nt, Homo sapiens
ggaccaagcaguggauauu

SEQ ID NO: 299161 - RNA, 19 nt, Homo sapiens
aaucaaaucucuuccacau

SEQ ID NO: 299162 - RNA, 19 nt, Homo sapiens
acugugaccuggcuauuaa

SEQ ID NO: 299163 - RNA, 19 nt, Homo sapiens
uugaggagguuucugcaua

SEQ ID NO: 299164 - RNA, 19 nt, Homo sapiens
cauagcugacuacaaauua

SEQ ID NO: 299165 - RNA, 19 nt, Homo sapiens
aaauggcugucuagacuaa

SEQ ID NO: 299166 - RNA, 19 nt, Homo sapiens
acaccgaguucacuaaaga

SEQ ID NO: 299167 - RNA, 19 nt, Homo sapiens
ggagguuucugcauagagu

SEQ ID NO: 299168 - RNA, 19 nt, Homo sapiens
guucuacacugauacacuu

SEQ ID NO: 299169 - RNA, 19 nt, Homo sapiens
gugagggaaugguaguuaa

SEQ ID NO: 299170 - RNA, 19 nt, Homo sapiens
ggaccugucucuaccuaag

SEQ ID NO: 299171 - RNA, 19 nt, Homo sapiens
gaaacauuauuagcacuuc

SEQ ID NO: 299172 - RNA, 19 nt, Homo sapiens
gaaaagugcaucaugaauu

SEQ ID NO: 299173 - RNA, 19 nt, Homo sapiens
ucagcaaucugcagaguuc

SEQ ID NO: 299174 - RNA, 19 nt, Homo sapiens
cagaagggcccauguacuu

SEQ ID NO: 299175 - RNA, 19 nt, Homo sapiens
ggaagggagcgcucucuug

SEQ ID NO: 299176 - RNA, 19 nt, Homo sapiens
aaggacugcugauuuguuu

SEQ ID NO: 299177 - RNA, 19 nt, Homo sapiens
gugaagcuaucaaagacaa

SEQ ID NO: 299178 - RNA, 19 nt, Homo sapiens
ccagauacauggugauggu

SEQ ID NO: 299179 - RNA, 19 nt, Homo sapiens
aaacuuaucacgccuacuu

SEQ ID NO: 299180 - RNA, 19 nt, Homo sapiens
gaaguuagagucgcagaug

SEQ ID NO: 299181 - RNA, 19 nt, Homo sapiens
uuugauaccuguaguggaa

SEQ ID NO: 299182 - RNA, 19 nt, Homo sapiens
ggagcgcucucuugauucu

SEQ ID NO: 299183 - RNA, 19 nt, Homo sapiens
ggaguugccaugaaauaug

SEQ ID NO: 299184 - RNA, 19 nt, Homo sapiens
agggagcgcucucuugauu

SEQ ID NO: 299185 - RNA, 19 nt, Homo sapiens
caacgugcagcgagaauga

SEQ ID NO: 299186 - RNA, 19 nt, Homo sapiens
gaccauaaccuuggaggaa

SEQ ID NO: 299187 - RNA, 19 nt, Homo sapiens
ugagagagcaugaggaugu

SEQ ID NO: 299188 - RNA, 19 nt, Homo sapiens
cagauacacuaaaguuaca

SEQ ID NO: 299189 - RNA, 19 nt, Homo sapiens
aaagcaagauuagagaguu

SEQ ID NO: 299190 - RNA, 19 nt, Homo sapiens
gaaagcaagauuagagagu

SEQ ID NO: 299191 - RNA, 19 nt, Homo sapiens
ggacugcuccaauauccaa

SEQ ID NO: 299192 - RNA, 19 nt, Homo sapiens
uuucagagcaugauacaaa

SEQ ID NO: 299193 - RNA, 19 nt, Homo sapiens
cuacauaauugcuguucug

SEQ ID NO: 299194 - RNA, 19 nt, Homo sapiens
aguggagccuuauuaauau

SEQ ID NO: 299195 - RNA, 19 nt, Homo sapiens
ggugaucucugggaguuau

SEQ ID NO: 299196 - RNA, 19 nt, Homo sapiens
gcuccaauauccaagagau

SEQ ID NO: 299197 - RNA, 19 nt, Homo sapiens
ggaacgggaccuucuggaa

SEQ ID NO: 299198 - RNA, 19 nt, Homo sapiens
acacuugaaggaccauuua

SEQ ID NO: 299199 - RNA, 19 nt, Homo sapiens
acacuaaaguuacaaacag

SEQ ID NO: 299200 - RNA, 19 nt, Homo sapiens
ucccgggucucaacuuuaa

SEQ ID NO: 299201 - RNA, 19 nt, Homo sapiens
gugugugccuccagcauuu

SEQ ID NO: 299202 - RNA, 19 nt, Homo sapiens
ucagaaaucaguagcauag

SEQ ID NO: 299203 - RNA, 19 nt, Homo sapiens
gaagaacugaaccggacua

SEQ ID NO: 299204 - RNA, 19 nt, Homo sapiens
uuacuuacagucccagaua

SEQ ID NO: 299205 - RNA, 19 nt, Homo sapiens
ggucggcacuuggacaaug

SEQ ID NO: 299206 - RNA, 19 nt, Homo sapiens
guucgugaaugaucuaaag

SEQ ID NO: 299207 - RNA, 19 nt, Homo sapiens
gaaguugaaggccagaguu

SEQ ID NO: 299208 - RNA, 19 nt, Homo sapiens
aagcaagauuagagaguuu

SEQ ID NO: 299209 - RNA, 19 nt, Homo sapiens
ggacagggaaguugaguua

SEQ ID NO: 299210 - RNA, 19 nt, Homo sapiens
gaaaggacuugucugaaau

SEQ ID NO: 299211 - RNA, 19 nt, Homo sapiens
ugaaaggacuugucugaaa

SEQ ID NO: 299212 - RNA, 19 nt, Homo sapiens
ggacacagcugagagauag

SEQ ID NO: 299213 - RNA, 19 nt, Homo sapiens
ggacuugucugaaaucaca

SEQ ID NO: 299214 - RNA, 19 nt, Homo sapiens
caagggagaucuggcauuu

SEQ ID NO: 299215 - RNA, 19 nt, Homo sapiens
gaaaugagagccuauaagu

SEQ ID NO: 299216 - RNA, 19 nt, Homo sapiens
gagauaggaugaccaagga

SEQ ID NO: 299217 - RNA, 19 nt, Homo sapiens
guaaaggaaugcuggaugu

SEQ ID NO: 299218 - RNA, 19 nt, Homo sapiens
gcaauaagugggaaaggua

SEQ ID NO: 299219 - RNA, 19 nt, Homo sapiens
gaguagcuauaaagacaua

SEQ ID NO: 299220 - RNA, 19 nt, Homo sapiens
gaguuuauaucgugccuuu

SEQ ID NO: 299221 - RNA, 19 nt, Homo sapiens
gaaaggacagggaaguuga

SEQ ID NO: 299222 - RNA, 19 nt, Homo sapiens
gaaacugaguccaccacuu

SEQ ID NO: 299223 - RNA, 19 nt, Homo sapiens
gcagagaccaugagaagga

SEQ ID NO: 299224 - RNA, 19 nt, Homo sapiens
cuacauggcuuagagaaug

SEQ ID NO: 299225 - RNA, 19 nt, Homo sapiens
gagaggcacuguggugaaa

SEQ ID NO: 299226 - RNA, 19 nt, Homo sapiens
gguaaacuaugggauggua

SEQ ID NO: 299227 - RNA, 19 nt, Homo sapiens
caacaucacucaggauaag

SEQ ID NO: 299228 - RNA, 19 nt, Homo sapiens
gaaugucuuuguucuuguu

SEQ ID NO: 299229 - RNA, 19 nt, Homo sapiens
uuuagaagcuucaaccaaa

SEQ ID NO: 299230 - RNA, 19 nt, Homo sapiens
agaagcaggucccuauauu

SEQ ID NO: 299231 - RNA, 19 nt, Homo sapiens
gcacguuucuuucucucuu

SEQ ID NO: 299232 - RNA, 19 nt, Homo sapiens
ggacguguuugaugccuau

SEQ ID NO: 299233 - RNA, 19 nt, Homo sapiens
agaggaagcugaugcaaca

SEQ ID NO: 299234 - RNA, 19 nt, Homo sapiens
ccagauuuaugaaugugua

SEQ ID NO: 299235 - RNA, 19 nt, Homo sapiens
uaaaugaacccaagucaca

SEQ ID NO: 299236 - RNA, 19 nt, Homo sapiens
ugacuuggcuccuacucaa

SEQ ID NO: 299237 - RNA, 19 nt, Homo sapiens
ggauaagccucaaugaaaa

SEQ ID NO: 299238 - RNA, 19 nt, Homo sapiens
gaagcaggucccuauauug

SEQ ID NO: 299239 - RNA, 19 nt, Homo sapiens
aagaguagcuauaaagaca

SEQ ID NO: 299240 - RNA, 19 nt, Homo sapiens
ugagaagaguagcuauaaa

SEQ ID NO: 299241 - RNA, 19 nt, Homo sapiens
ccuguuaccugugaaauga

SEQ ID NO: 299242 - RNA, 19 nt, Homo sapiens
ugaguuagccacauaaaug

SEQ ID NO: 299243 - RNA, 19 nt, Homo sapiens
gcacugcggccaagucgaa

SEQ ID NO: 299244 - RNA, 19 nt, Homo sapiens
gagaagaguagcuauaaag

SEQ ID NO: 299245 - RNA, 19 nt, Homo sapiens
gagcugacgccucugcuuu

SEQ ID NO: 299246 - RNA, 19 nt, Homo sapiens
ggagggaaaccugaacuuu

SEQ ID NO: 299247 - RNA, 19 nt, Homo sapiens
uuccaaaggugguaaacua

SEQ ID NO: 299248 - RNA, 19 nt, Homo sapiens
ggucagauuuuccuauuuu

SEQ ID NO: 299249 - RNA, 19 nt, Homo sapiens
acuaugggaugguaaauau

SEQ ID NO: 299250 - RNA, 19 nt, Homo sapiens
acaaagugauggcuuggaa

SEQ ID NO: 299251 - RNA, 19 nt, Homo sapiens
ggaaaggacagggaaguug

SEQ ID NO: 299252 - RNA, 19 nt, Homo sapiens
gaagggaggagagagcuuu

SEQ ID NO: 299253 - RNA, 19 nt, Homo sapiens
caaaggugguaaacuaugg

SEQ ID NO: 299254 - RNA, 19 nt, Homo sapiens
gguggucacuagcuucuga

SEQ ID NO: 299255 - RNA, 19 nt, Homo sapiens
gagaagcaggucccuauau

SEQ ID NO: 299256 - RNA, 19 nt, Homo sapiens
ggagaagcaggucccuaua

SEQ ID NO: 299257 - RNA, 19 nt, Homo sapiens
ucagaugacuuggcuccua

SEQ ID NO: 299258 - RNA, 19 nt, Homo sapiens
gggagccgcuggcagaaau

SEQ ID NO: 299259 - RNA, 19 nt, Homo sapiens
aaacugaguccaccacuug

SEQ ID NO: 299260 - RNA, 19 nt, Homo sapiens
caaggguuguguccaguga

SEQ ID NO: 299261 - RNA, 19 nt, Homo sapiens
aggauaagccucaaugaaa

SEQ ID NO: 299262 - RNA, 19 nt, Homo sapiens
gagcuggucugggaacugu

SEQ ID NO: 299263 - RNA, 19 nt, Homo sapiens
cuaaucaucucccauggau

SEQ ID NO: 299264 - RNA, 19 nt, Homo sapiens
ggaggaaagcagaggauga

SEQ ID NO: 299265 - RNA, 19 nt, Homo sapiens
ggugagaagggucagauuu

SEQ ID NO: 299266 - RNA, 19 nt, Homo sapiens
ggcaaggacugcacguuuc

SEQ ID NO: 299267 - RNA, 19 nt, Homo sapiens
aaggaaugcuggaugugua

SEQ ID NO: 299268 - RNA, 19 nt, Homo sapiens
ggacaagcagagaccauga

SEQ ID NO: 299269 - RNA, 19 nt, Homo sapiens
ggugcacucuucauggaaa

SEQ ID NO: 299270 - RNA, 19 nt, Homo sapiens
ccacuucggcuaccuucua

SEQ ID NO: 299271 - RNA, 19 nt, Homo sapiens
ugaccaaggacaacaguuu

SEQ ID NO: 299272 - RNA, 19 nt, Homo sapiens
gaguuagccacauaaauga

SEQ ID NO: 299273 - RNA, 19 nt, Homo sapiens
gaccagaguuuaucaugcu

SEQ ID NO: 299274 - RNA, 19 nt, Homo sapiens
gaggcacuguggugaaaug

SEQ ID NO: 299275 - RNA, 19 nt, Homo sapiens
gccaacaucacucaggaua

SEQ ID NO: 299276 - RNA, 19 nt, Homo sapiens
uaacaucacccacggaucu

SEQ ID NO: 299277 - RNA, 19 nt, Homo sapiens
gaagacuuuaggagcaaua

SEQ ID NO: 299278 - RNA, 19 nt, Homo sapiens
gcagagccgccaagcuuug

SEQ ID NO: 299279 - RNA, 19 nt, Homo sapiens
gaaguugaguuagccacau

SEQ ID NO: 299280 - RNA, 19 nt, Homo sapiens
ggaaaugagagccuauaag

SEQ ID NO: 299281 - RNA, 19 nt, Homo sapiens
gcaaaacucggaagugaaa

SEQ ID NO: 299282 - RNA, 19 nt, Homo sapiens
aagcaggucccuauauuga

SEQ ID NO: 299283 - RNA, 19 nt, Homo sapiens
ucaaggaggugcgcuucuu

SEQ ID NO: 299284 - RNA, 19 nt, Homo sapiens
uagguuccuuccagguuua

SEQ ID NO: 299285 - RNA, 19 nt, Homo sapiens
agggagaacaggcacauua

SEQ ID NO: 299286 - RNA, 19 nt, Homo sapiens
ggacugcacguuucuuucu

SEQ ID NO: 299287 - RNA, 19 nt, Homo sapiens
gcgcugcccuuugccaaga

SEQ ID NO: 299288 - RNA, 19 nt, Homo sapiens
guagagauaggaugaccaa

SEQ ID NO: 299289 - RNA, 19 nt, Homo sapiens
caggauaagccucaaugaa

SEQ ID NO: 299290 - RNA, 19 nt, Homo sapiens
gcaagggagaucuggcauu

SEQ ID NO: 299291 - RNA, 19 nt, Homo sapiens
gcucauggaaccucuggaa

SEQ ID NO: 299292 - RNA, 19 nt, Homo sapiens
caaccuguccgaccucuuc

SEQ ID NO: 299293 - RNA, 19 nt, Homo sapiens
ggagaggcacuguggugaa

SEQ ID NO: 299294 - RNA, 19 nt, Homo sapiens
caggugcacucuucaugga

SEQ ID NO: 299295 - RNA, 19 nt, Homo sapiens
uaaacuaugggaugguaaa

SEQ ID NO: 299296 - RNA, 19 nt, Homo sapiens
ccaaaugaaacuugaaucu

SEQ ID NO: 299297 - RNA, 19 nt, Homo sapiens
uuagguuccuuccagguuu

SEQ ID NO: 299298 - RNA, 19 nt, Homo sapiens
gauagaggaggcugugaau

SEQ ID NO: 299299 - RNA, 19 nt, Homo sapiens
ggaagagcaagcagaguca

SEQ ID NO: 299300 - RNA, 19 nt, Homo sapiens
uauaggaggaagguauuua

SEQ ID NO: 299301 - RNA, 19 nt, Homo sapiens
cauccucccugcaaagcaa

SEQ ID NO: 299302 - RNA, 19 nt, Homo sapiens
aaguugaguuagccacaua

SEQ ID NO: 299303 - RNA, 19 nt, Homo sapiens
gucccgagcucaggaaaug

SEQ ID NO: 299304 - RNA, 19 nt, Homo sapiens
gaggaaagcagaggaugau

SEQ ID NO: 299305 - RNA, 19 nt, Homo sapiens
gggacacagcugagagaua

SEQ ID NO: 299306 - RNA, 19 nt, Homo sapiens
gaagaguagcuauaaagac

SEQ ID NO: 299307 - RNA, 19 nt, Homo sapiens
ggaggaagguauuuaaaac

SEQ ID NO: 299308 - RNA, 19 nt, Homo sapiens
ggugugccguagccacgua

SEQ ID NO: 299309 - RNA, 19 nt, Homo sapiens
uaaagaagaugcucagaaa

SEQ ID NO: 299310 - RNA, 19 nt, Homo sapiens
ugaaauggcucuacccuuu

SEQ ID NO: 299311 - RNA, 19 nt, Homo sapiens
agaaauggcucagauguua

SEQ ID NO: 299312 - RNA, 19 nt, Homo sapiens
gcucuacccuuuauaaauu

SEQ ID NO: 299313 - RNA, 19 nt, Homo sapiens
ggcaauagcuuggauguuu

SEQ ID NO: 299314 - RNA, 19 nt, Homo sapiens
gggaaugucuucuagcuaa

SEQ ID NO: 299315 - RNA, 19 nt, Homo sapiens
gaacugggcaagaugauaa

SEQ ID NO: 299316 - RNA, 19 nt, Homo sapiens
gguaucaucuguugaagaa

SEQ ID NO: 299317 - RNA, 19 nt, Homo sapiens
ggaagaaguuuauauuguc

SEQ ID NO: 299318 - RNA, 19 nt, Homo sapiens
gcaacaggaucaauuaaca

SEQ ID NO: 299319 - RNA, 19 nt, Homo sapiens
gaaagcaacaggaucaauu

SEQ ID NO: 299320 - RNA, 19 nt, Homo sapiens
gaagaagacuuggagacaa

SEQ ID NO: 299321 - RNA, 19 nt, Homo sapiens
agacagaacuaccagauga

SEQ ID NO: 299322 - RNA, 19 nt, Homo sapiens
gcacauacuucuuuucuuu

SEQ ID NO: 299323 - RNA, 19 nt, Homo sapiens
caagguggauucagcguuu

SEQ ID NO: 299324 - RNA, 19 nt, Homo sapiens
uaacagaacgggauaaguu

SEQ ID NO: 299325 - RNA, 19 nt, Homo sapiens
gaaauggcucuacccuuua

SEQ ID NO: 299326 - RNA, 19 nt, Homo sapiens
caaguaaagcacaacauua

SEQ ID NO: 299327 - RNA, 19 nt, Homo sapiens
uagacuggauuccuauuua

SEQ ID NO: 299328 - RNA, 19 nt, Homo sapiens
ugaaagguaucaucuguug

SEQ ID NO: 299329 - RNA, 19 nt, Homo sapiens
ugacauacauugaugacaa

SEQ ID NO: 299330 - RNA, 19 nt, Homo sapiens
ugaggaaacugaauuggaa

SEQ ID NO: 299331 - RNA, 19 nt, Homo sapiens
uggaaucacugaauaugua

SEQ ID NO: 299332 - RNA, 19 nt, Homo sapiens
ucaaguacaugauauggaa

SEQ ID NO: 299333 - RNA, 19 nt, Homo sapiens
gggauaaguuucagauuuc

SEQ ID NO: 299334 - RNA, 19 nt, Homo sapiens
cgggauaaguuucagauuu

SEQ ID NO: 299335 - RNA, 19 nt, Homo sapiens
gauauuacauggacacaag

SEQ ID NO: 299336 - RNA, 19 nt, Homo sapiens
gaaaauggaugaaguugga

SEQ ID NO: 299337 - RNA, 19 nt, Homo sapiens
caagaaaggugcuacaaaa

SEQ ID NO: 299338 - RNA, 19 nt, Homo sapiens
uaaaugaacugggcaagau

SEQ ID NO: 299339 - RNA, 19 nt, Homo sapiens
gaaacaauuuggaggaagu

SEQ ID NO: 299340 - RNA, 19 nt, Homo sapiens
ggaaacagcuuuugaugga

SEQ ID NO: 299341 - RNA, 19 nt, Homo sapiens
gaaaauaggccccucauga

SEQ ID NO: 299342 - RNA, 19 nt, Homo sapiens
cgagaacuguauacuguuu

SEQ ID NO: 299343 - RNA, 19 nt, Homo sapiens
guaaagcacaacauuauga

SEQ ID NO: 299344 - RNA, 19 nt, Homo sapiens
agaagcagcucguauuuca

SEQ ID NO: 299345 - RNA, 19 nt, Homo sapiens
gaacugauacagacugaga

SEQ ID NO: 299346 - RNA, 19 nt, Homo sapiens
cguacuaaaugaacugaua

SEQ ID NO: 299347 - RNA, 19 nt, Homo sapiens
gagcuuaagguucaaauga

SEQ ID NO: 299348 - RNA, 19 nt, Homo sapiens
ccacagcacauacuucuuu

SEQ ID NO: 299349 - RNA, 19 nt, Homo sapiens
gcucguauuucaucaaugu

SEQ ID NO: 299350 - RNA, 19 nt, Homo sapiens
cugaaacacugcaguauga

SEQ ID NO: 299351 - RNA, 19 nt, Homo sapiens
gacuauagcucaaguaaaa

SEQ ID NO: 299352 - RNA, 19 nt, Homo sapiens
ugaaagaaauggcucagau

SEQ ID NO: 299353 - RNA, 19 nt, Homo sapiens
ugaaggauuuggcuagauu

SEQ ID NO: 299354 - RNA, 19 nt, Homo sapiens
gaaacauggcagaaauaua

SEQ ID NO: 299355 - RNA, 19 nt, Homo sapiens
ucagaaagcucuccaagac

SEQ ID NO: 299356 - RNA, 19 nt, Homo sapiens
gcugaaagguaucaucugu

SEQ ID NO: 299357 - RNA, 19 nt, Homo sapiens
cuucagaaaugcuauagaa

SEQ ID NO: 299358 - RNA, 19 nt, Homo sapiens
gaauggaucaucuucagaa

SEQ ID NO: 299359 - RNA, 19 nt, Homo sapiens
gagcucaguuagugauuug

SEQ ID NO: 299360 - RNA, 19 nt, Homo sapiens
caagaagcagcucguauuu

SEQ ID NO: 299361 - RNA, 19 nt, Homo sapiens
ggauuccuauuuacucaaa

SEQ ID NO: 299362 - RNA, 19 nt, Homo sapiens
uaaagaaccacguacuaaa

SEQ ID NO: 299363 - RNA, 19 nt, Homo sapiens
aagcagaacuggcugaugu

SEQ ID NO: 299364 - RNA, 19 nt, Homo sapiens
gaaugucaucggcaaauaa

SEQ ID NO: 299365 - RNA, 19 nt, Homo sapiens
ggugugccuuggauuauuu

SEQ ID NO: 299366 - RNA, 19 nt, Homo sapiens
ugaagucaguuaaugauuc

SEQ ID NO: 299367 - RNA, 19 nt, Homo sapiens
caacgaaucacuaaauauc

SEQ ID NO: 299368 - RNA, 19 nt, Homo sapiens
cagaugauauucccucaau

SEQ ID NO: 299369 - RNA, 19 nt, Homo sapiens
gaagucaguuaaugauucu

SEQ ID NO: 299370 - RNA, 19 nt, Homo sapiens
ccaagaagcagcucguauu

SEQ ID NO: 299371 - RNA, 19 nt, Homo sapiens
uuagugauuugcugacaua

SEQ ID NO: 299372 - RNA, 19 nt, Homo sapiens
ugucagauauugugcuuga

SEQ ID NO: 299373 - RNA, 19 nt, Homo sapiens
ugaugaagcuacuauguca

SEQ ID NO: 299374 - RNA, 19 nt, Homo sapiens
gagaguuuauguucgagaa

SEQ ID NO: 299375 - RNA, 19 nt, Homo sapiens
aauauuaucuccugagcuu

SEQ ID NO: 299376 - RNA, 19 nt, Homo sapiens
uuaauaaguugcugacuca

SEQ ID NO: 299377 - RNA, 19 nt, Homo sapiens
guucaagacuagaauguca

SEQ ID NO: 299378 - RNA, 19 nt, Homo sapiens
uaucaucuguugaagaaug

SEQ ID NO: 299379 - RNA, 19 nt, Homo sapiens
gaaagaaauggcucagaug

SEQ ID NO: 299380 - RNA, 19 nt, Homo sapiens
gacauuggauuuugguuua

SEQ ID NO: 299381 - RNA, 19 nt, Homo sapiens
gcacuugguuuugguuuua

SEQ ID NO: 299382 - RNA, 19 nt, Homo sapiens
aagaugagguucagaagga

SEQ ID NO: 299383 - RNA, 19 nt, Homo sapiens
aaagcaacaggaucaauua

SEQ ID NO: 299384 - RNA, 19 nt, Homo sapiens
gaaaucugguauggugaaa

SEQ ID NO: 299385 - RNA, 19 nt, Homo sapiens
ggugauaaccgcaaguuug

SEQ ID NO: 299386 - RNA, 19 nt, Homo sapiens
cgaaauggcagaagcaaau

SEQ ID NO: 299387 - RNA, 19 nt, Homo sapiens
gaauaagcccagaucagaa

SEQ ID NO: 299388 - RNA, 19 nt, Homo sapiens
aagaagacuuggagacaaa

SEQ ID NO: 299389 - RNA, 19 nt, Homo sapiens
gacugaaguugaauuucua

SEQ ID NO: 299390 - RNA, 19 nt, Homo sapiens
ugacugaaguugaauuucu

SEQ ID NO: 299391 - RNA, 19 nt, Homo sapiens
guucagggcuacugucugu

SEQ ID NO: 299392 - RNA, 19 nt, Homo sapiens
gagcucaaaugaugcagau

SEQ ID NO: 299393 - RNA, 19 nt, Homo sapiens
uguccaggcuucuaaugua

SEQ ID NO: 299394 - RNA, 19 nt, Homo sapiens
gauaaccgcaaguuugaaa

SEQ ID NO: 299395 - RNA, 19 nt, Homo sapiens
gaaguuggaaucacugaau

SEQ ID NO: 299396 - RNA, 19 nt, Homo sapiens
ggaaugucaaagaaaguua

SEQ ID NO: 299397 - RNA, 19 nt, Homo sapiens
ugaauuccauaacgacauu

SEQ ID NO: 299398 - RNA, 19 nt, Homo sapiens
uacguuaccuuucugauau

SEQ ID NO: 299399 - RNA, 19 nt, Homo sapiens
agaacuggcugauguaaca

SEQ ID NO: 299400 - RNA, 19 nt, Homo sapiens
uggaucaucuucagaaaug

SEQ ID NO: 299401 - RNA, 19 nt, Homo sapiens
aaagaaaccacagcacaua

SEQ ID NO: 299402 - RNA, 19 nt, Homo sapiens
gaaacugaauuggaacaca

SEQ ID NO: 299403 - RNA, 19 nt, Homo sapiens
guacugaggaaacugaauu

SEQ ID NO: 299404 - RNA, 19 nt, Homo sapiens
uaauguagaugugaagaug

SEQ ID NO: 299405 - RNA, 19 nt, Homo sapiens
gaagaaggcacucgaugca

SEQ ID NO: 299406 - RNA, 19 nt, Homo sapiens
gcccagaucagaaacaauu

SEQ ID NO: 299407 - RNA, 19 nt, Homo sapiens
ggaaacauggcagaaauau

SEQ ID NO: 299408 - RNA, 19 nt, Homo sapiens
agauggcucuccuauauug

SEQ ID NO: 299409 - RNA, 19 nt, Homo sapiens
gaacuagggucauuugaaa

SEQ ID NO: 299410 - RNA, 19 nt, Homo sapiens
ccacagaccuuucaucuuu

SEQ ID NO: 299411 - RNA, 19 nt, Homo sapiens
cuaauuagcuuucccagua

SEQ ID NO: 299412 - RNA, 19 nt, Homo sapiens
gcaagaggauuauggcuaa

SEQ ID NO: 299413 - RNA, 19 nt, Homo sapiens
gaaagugucuauauuggaa

SEQ ID NO: 299414 - RNA, 19 nt, Homo sapiens
uaagacagcuuguaaaugu

SEQ ID NO: 299415 - RNA, 19 nt, Homo sapiens
aaacgggacuggcuaguua

SEQ ID NO: 299416 - RNA, 19 nt, Homo sapiens
gaagaaagugucuauauug

SEQ ID NO: 299417 - RNA, 19 nt, Homo sapiens
gaauugauguguaacugua

SEQ ID NO: 299418 - RNA, 19 nt, Homo sapiens
ggaaugugcugcuggcuuu

SEQ ID NO: 299419 - RNA, 19 nt, Homo sapiens
ggaaacaagugcauagaug

SEQ ID NO: 299420 - RNA, 19 nt, Homo sapiens
cgaaggaaguaucgaauuu

SEQ ID NO: 299421 - RNA, 19 nt, Homo sapiens
ggaguaugcucacuuaaau

SEQ ID NO: 299422 - RNA, 19 nt, Homo sapiens
gcauagaugugaauugguu

SEQ ID NO: 299423 - RNA, 19 nt, Homo sapiens
gcaaguggcaagaggauua

SEQ ID NO: 299424 - RNA, 19 nt, Homo sapiens
acaaggaucuuaguugaua

SEQ ID NO: 299425 - RNA, 19 nt, Homo sapiens
gaagcaaaguucaguuuca

SEQ ID NO: 299426 - RNA, 19 nt, Homo sapiens
uuauuaggcuugcuuguua

SEQ ID NO: 299427 - RNA, 19 nt, Homo sapiens
gaaggaaguaucgaauuua

SEQ ID NO: 299428 - RNA, 19 nt, Homo sapiens
agacaaggaucuuaguuga

SEQ ID NO: 299429 - RNA, 19 nt, Homo sapiens
gauuauggcuaacaagaau

SEQ ID NO: 299430 - RNA, 19 nt, Homo sapiens
ugauaacuaugcagguuua

SEQ ID NO: 299431 - RNA, 19 nt, Homo sapiens
acggaaggcucaguaauua

SEQ ID NO: 299432 - RNA, 19 nt, Homo sapiens
aaacgaagacgaugugaaa

SEQ ID NO: 299433 - RNA, 19 nt, Homo sapiens
gaaagggaggauuugcuua

SEQ ID NO: 299434 - RNA, 19 nt, Homo sapiens
uggauauccucaauucuua

SEQ ID NO: 299435 - RNA, 19 nt, Homo sapiens
ggaggcagguggucuaagu

SEQ ID NO: 299436 - RNA, 19 nt, Homo sapiens
ggaacaaaucugauaacua

SEQ ID NO: 299437 - RNA, 19 nt, Homo sapiens
ggcagucgcuggagauuau

SEQ ID NO: 299438 - RNA, 19 nt, Homo sapiens
ugucaaauguaguguguuu

SEQ ID NO: 299439 - RNA, 19 nt, Homo sapiens
gaggaggacuuuuagauuu

SEQ ID NO: 299440 - RNA, 19 nt, Homo sapiens
gaagagugcuccccauuga

SEQ ID NO: 299441 - RNA, 19 nt, Homo sapiens
gggcucaucuuuaaagcuu

SEQ ID NO: 299442 - RNA, 19 nt, Homo sapiens
agacuuaauuuccuuguug

SEQ ID NO: 299443 - RNA, 19 nt, Homo sapiens
gaagguggcaucaggaaug

SEQ ID NO: 299444 - RNA, 19 nt, Homo sapiens
caaauaaugggcucugauu

SEQ ID NO: 299445 - RNA, 19 nt, Homo sapiens
gaggugagcuguguuaaac

SEQ ID NO: 299446 - RNA, 19 nt, Homo sapiens
ggauuucagucuugauguu

SEQ ID NO: 299447 - RNA, 19 nt, Homo sapiens
uaaccauggugcuauuauu

SEQ ID NO: 299448 - RNA, 19 nt, Homo sapiens
gcuaaacuuuguucuguuc

SEQ ID NO: 299449 - RNA, 19 nt, Homo sapiens
gcucaguaauuaguuauga

SEQ ID NO: 299450 - RNA, 19 nt, Homo sapiens
gaagagucacugucugaaa

SEQ ID NO: 299451 - RNA, 19 nt, Homo sapiens
uaucauguaucucuaagga

SEQ ID NO: 299452 - RNA, 19 nt, Homo sapiens
agaacgaauugauguguaa

SEQ ID NO: 299453 - RNA, 19 nt, Homo sapiens
ccaggcaagucauagaauu

SEQ ID NO: 299454 - RNA, 19 nt, Homo sapiens
ggaacuagggucauuugaa

SEQ ID NO: 299455 - RNA, 19 nt, Homo sapiens
gcauuggcaucuuuggauu

SEQ ID NO: 299456 - RNA, 19 nt, Homo sapiens
gaaacaagugcauagaugu

SEQ ID NO: 299457 - RNA, 19 nt, Homo sapiens
ugaaauugcugauuguucu

SEQ ID NO: 299458 - RNA, 19 nt, Homo sapiens
gacggaaggcucaguaauu

SEQ ID NO: 299459 - RNA, 19 nt, Homo sapiens
ggaaagggaggauuugcuu

SEQ ID NO: 299460 - RNA, 19 nt, Homo sapiens
auaggaguaugcucacuua

SEQ ID NO: 299461 - RNA, 19 nt, Homo sapiens
cagaacgaauugaugugua

SEQ ID NO: 299462 - RNA, 19 nt, Homo sapiens
guuaagagaagcacuaaga

SEQ ID NO: 299463 - RNA, 19 nt, Homo sapiens
gguuuggcauaucuaauaa

SEQ ID NO: 299464 - RNA, 19 nt, Homo sapiens
cugauaaacugaagaaagu

SEQ ID NO: 299465 - RNA, 19 nt, Homo sapiens
agaaagaggugagcugugu

SEQ ID NO: 299466 - RNA, 19 nt, Homo sapiens
ugccaucccugaacucuuu

SEQ ID NO: 299467 - RNA, 19 nt, Homo sapiens
ggaaguaucgaauuuacau

SEQ ID NO: 299468 - RNA, 19 nt, Homo sapiens
gaaagaagcaaaguucagu

SEQ ID NO: 299469 - RNA, 19 nt, Homo sapiens
gcaguccucuaguguuuca

SEQ ID NO: 299470 - RNA, 19 nt, Homo sapiens
uaauguugguugucaaaug

SEQ ID NO: 299471 - RNA, 19 nt, Homo sapiens
uuaaacagcuguacuuuug

SEQ ID NO: 299472 - RNA, 19 nt, Homo sapiens
gggacuggcuaguuaaaca

SEQ ID NO: 299473 - RNA, 19 nt, Homo sapiens
uaucacagacguucucgua

SEQ ID NO: 299474 - RNA, 19 nt, Homo sapiens
aaagaggugagcuguguua

SEQ ID NO: 299475 - RNA, 19 nt, Homo sapiens
gggauggguuuguggaguu

SEQ ID NO: 299476 - RNA, 19 nt, Homo sapiens
ucacagacguucucguaag

SEQ ID NO: 299477 - RNA, 19 nt, Homo sapiens
uaggaccaacuacaaauua

SEQ ID NO: 299478 - RNA, 19 nt, Homo sapiens
caucuuugcuagagcuauu

SEQ ID NO: 299479 - RNA, 19 nt, Homo sapiens
uuaugaggcuuucucuaaa

SEQ ID NO: 299480 - RNA, 19 nt, Homo sapiens
uucaugggcucaucuuuaa

SEQ ID NO: 299481 - RNA, 19 nt, Homo sapiens
guucuagaguguauacaga

SEQ ID NO: 299482 - RNA, 19 nt, Homo sapiens
auuaggaaccuguuucuua

SEQ ID NO: 299483 - RNA, 19 nt, Homo sapiens
gcaagucauagaauugauu

SEQ ID NO: 299484 - RNA, 19 nt, Homo sapiens
gugcauagaugugaauugg

SEQ ID NO: 299485 - RNA, 19 nt, Homo sapiens
ggauugagagguugaugaa

SEQ ID NO: 299486 - RNA, 19 nt, Homo sapiens
guucaguucuagaguguau

SEQ ID NO: 299487 - RNA, 19 nt, Homo sapiens
ccaagaaagcugcaucgaa

SEQ ID NO: 299488 - RNA, 19 nt, Homo sapiens
cauaaggucaucuuugcua

SEQ ID NO: 299489 - RNA, 19 nt, Homo sapiens
aacaugaccuuuagucugu

SEQ ID NO: 299490 - RNA, 19 nt, Homo sapiens
gaaaagcaggcuagucuaa

SEQ ID NO: 299491 - RNA, 19 nt, Homo sapiens
cucauuagcugugugcaua

SEQ ID NO: 299492 - RNA, 19 nt, Homo sapiens
gauugugacucucauuucu

SEQ ID NO: 299493 - RNA, 19 nt, Homo sapiens
ucacgaacuugauccuguu

SEQ ID NO: 299494 - RNA, 19 nt, Homo sapiens
cuggugaaauuuaaaguga

SEQ ID NO: 299495 - RNA, 19 nt, Homo sapiens
ggaaggcucaguaauuagu

SEQ ID NO: 299496 - RNA, 19 nt, Homo sapiens
gaauaaauacaugggaaga

SEQ ID NO: 299497 - RNA, 19 nt, Homo sapiens
gagcugguuuggcauaucu

SEQ ID NO: 299498 - RNA, 19 nt, Homo sapiens
cgagugaugauccauguuu

SEQ ID NO: 299499 - RNA, 19 nt, Homo sapiens
ugaagaccauaaaccaaga

SEQ ID NO: 299500 - RNA, 19 nt, Homo sapiens
gaccaacuacaaauuaaug

SEQ ID NO: 299501 - RNA, 19 nt, Homo sapiens
gaaauacagacaaggaucu

SEQ ID NO: 299502 - RNA, 19 nt, Homo sapiens
gccauaaggucaucuuugc

SEQ ID NO: 299503 - RNA, 19 nt, Homo sapiens
gaaugccagugaccugugu

SEQ ID NO: 299504 - RNA, 19 nt, Homo sapiens
gggaggauuugcuuagaag

SEQ ID NO: 299505 - RNA, 19 nt, Homo sapiens
ucucggaacaugaccuuua

SEQ ID NO: 299506 - RNA, 19 nt, Homo sapiens
cauuagcugugugcauaua

SEQ ID NO: 299507 - RNA, 19 nt, Homo sapiens
cauuugaguuccuuccauu

SEQ ID NO: 299508 - RNA, 19 nt, Homo sapiens
gacuuaauuuccuuguuga

SEQ ID NO: 299509 - RNA, 19 nt, Homo sapiens
gaagauguuuguaaucguu

SEQ ID NO: 299510 - RNA, 19 nt, Homo sapiens
gagaaggacuugguggaua

SEQ ID NO: 299511 - RNA, 19 nt, Homo sapiens
gaagaucuuugccagcauu

SEQ ID NO: 299512 - RNA, 19 nt, Homo sapiens
ggauaaggcucgucagauc

SEQ ID NO: 299513 - RNA, 19 nt, Homo sapiens
guacuagggucagggcuua

SEQ ID NO: 299514 - RNA, 19 nt, Homo sapiens
gcaccuggcaugacuguuu

SEQ ID NO: 299515 - RNA, 19 nt, Homo sapiens
caacagagcaucuccaucu

SEQ ID NO: 299516 - RNA, 19 nt, Homo sapiens
agaaggacuugguggauaa

SEQ ID NO: 299517 - RNA, 19 nt, Homo sapiens
cagagcaggugacauauca

SEQ ID NO: 299518 - RNA, 19 nt, Homo sapiens
gccgugggcuccuguauga

SEQ ID NO: 299519 - RNA, 19 nt, Homo sapiens
caacgcaggagacgagaua

SEQ ID NO: 299520 - RNA, 19 nt, Homo sapiens
caagguacguggugauauc

SEQ ID NO: 299521 - RNA, 19 nt, Homo sapiens
ucacuagccucuccaagga

SEQ ID NO: 299522 - RNA, 19 nt, Homo sapiens
gaaccuggaggaucucaaa

SEQ ID NO: 299523 - RNA, 19 nt, Homo sapiens
acagugagcucuucaggau

SEQ ID NO: 299524 - RNA, 19 nt, Homo sapiens
uggcagagcaggugacaua

SEQ ID NO: 299525 - RNA, 19 nt, Homo sapiens
gaggagaccaucuaucaga

SEQ ID NO: 299526 - RNA, 19 nt, Homo sapiens
gggacuaugugaucgaaga

SEQ ID NO: 299527 - RNA, 19 nt, Homo sapiens
gguugaagauguuuguaau

SEQ ID NO: 299528 - RNA, 19 nt, Homo sapiens
cgaggagugugucucauug

SEQ ID NO: 299529 - RNA, 19 nt, Homo sapiens
gcaucuaucacaacaacua

SEQ ID NO: 299530 - RNA, 19 nt, Homo sapiens
ugaggcagcugcaucugaa

SEQ ID NO: 299531 - RNA, 19 nt, Homo sapiens
ggacagaaccagcauccau

SEQ ID NO: 299532 - RNA, 19 nt, Homo sapiens
uaugauggcucccucaaca

SEQ ID NO: 299533 - RNA, 19 nt, Homo sapiens
gccgugaccuuccaccauu

SEQ ID NO: 299534 - RNA, 19 nt, Homo sapiens
ccacaaccucucugcauuu

SEQ ID NO: 299535 - RNA, 19 nt, Homo sapiens
cuggagagcuucauagaca

SEQ ID NO: 299536 - RNA, 19 nt, Homo sapiens
acagugaccugaggaaaga

SEQ ID NO: 299537 - RNA, 19 nt, Homo sapiens
gaacugaccgaugaagaug

SEQ ID NO: 299538 - RNA, 19 nt, Homo sapiens
ggaacugaccgaugaagau

SEQ ID NO: 299539 - RNA, 19 nt, Homo sapiens
gacuggcucuggaugauga

SEQ ID NO: 299540 - RNA, 19 nt, Homo sapiens
gguguuagccuucuuacau

SEQ ID NO: 299541 - RNA, 19 nt, Homo sapiens
ccagagcacuugaugaacu

SEQ ID NO: 299542 - RNA, 19 nt, Homo sapiens
uggccaagauguacaguga

SEQ ID NO: 299543 - RNA, 19 nt, Homo sapiens
gcauugcuccuuccaucua

SEQ ID NO: 299544 - RNA, 19 nt, Homo sapiens
cauuggagauggcauggaa

SEQ ID NO: 299545 - RNA, 19 nt, Homo sapiens
cuauugaggucccugagaa

SEQ ID NO: 299546 - RNA, 19 nt, Homo sapiens
caagaaggacaacaagguu

SEQ ID NO: 299547 - RNA, 19 nt, Homo sapiens
ccaaccacguggccaagaa

SEQ ID NO: 299548 - RNA, 19 nt, Homo sapiens
uggcaugacuguuuguuuc

SEQ ID NO: 299549 - RNA, 19 nt, Homo sapiens
ggacaagguggccaagaug

SEQ ID NO: 299550 - RNA, 19 nt, Homo sapiens
gaagaaguacaucaucuac

SEQ ID NO: 299551 - RNA, 19 nt, Homo sapiens
gaagaugugaagaugauca

SEQ ID NO: 299552 - RNA, 19 nt, Homo sapiens
cgaugaagaugugaagaug

SEQ ID NO: 299553 - RNA, 19 nt, Homo sapiens
ugacuggcaucuaucacaa

SEQ ID NO: 299554 - RNA, 19 nt, Homo sapiens
ggugaacuaugaggacuug

SEQ ID NO: 299555 - RNA, 19 nt, Homo sapiens
gagagcugguugaagaugu

SEQ ID NO: 299556 - RNA, 19 nt, Homo sapiens
gcgugugguuuagguguua

SEQ ID NO: 299557 - RNA, 19 nt, Homo sapiens
agucgcaguuucucaagua

SEQ ID NO: 299558 - RNA, 19 nt, Homo sapiens
agugagcucuucaggauga

SEQ ID NO: 299559 - RNA, 19 nt, Homo sapiens
gcagcaugcgcaagacuuu

SEQ ID NO: 299560 - RNA, 19 nt, Homo sapiens
ucacagagcccaucaucuc

SEQ ID NO: 299561 - RNA, 19 nt, Homo sapiens
caaccucucugcauuuuau

SEQ ID NO: 299562 - RNA, 19 nt, Homo sapiens
ugaagaaguacaucaucua

SEQ ID NO: 299563 - RNA, 19 nt, Homo sapiens
gaauuugacaagaugaaug

SEQ ID NO: 299564 - RNA, 19 nt, Homo sapiens
ccaggagaguccaggcaaa

SEQ ID NO: 299565 - RNA, 19 nt, Homo sapiens
cagugugucuuacuugguu

SEQ ID NO: 299566 - RNA, 19 nt, Homo sapiens
ucagugcccucugugcuuu

SEQ ID NO: 299567 - RNA, 19 nt, Homo sapiens
gcuuugacauccugugugu

SEQ ID NO: 299568 - RNA, 19 nt, Homo sapiens
cgcaguuucucaaguauau

SEQ ID NO: 299569 - RNA, 19 nt, Homo sapiens
ugaugaauuugacaagaug

SEQ ID NO: 299570 - RNA, 19 nt, Homo sapiens
gugagagccugguggugaa

SEQ ID NO: 299571 - RNA, 19 nt, Homo sapiens
gccacaacgucuucaagga

SEQ ID NO: 299572 - RNA, 19 nt, Homo sapiens
gauaaggcucgucagauca

SEQ ID NO: 299573 - RNA, 19 nt, Homo sapiens
gaugaagaugugaagauga

SEQ ID NO: 299574 - RNA, 19 nt, Homo sapiens
agagcugacuggcaucuau

SEQ ID NO: 299575 - RNA, 19 nt, Homo sapiens
guguuagccuucuuacaug

SEQ ID NO: 299576 - RNA, 19 nt, Homo sapiens
gcauccaucugcgggacua

SEQ ID NO: 299577 - RNA, 19 nt, Homo sapiens
gauaucaacgugcucuugu

SEQ ID NO: 299578 - RNA, 19 nt, Homo sapiens
gaccaucuaucagaacuac

SEQ ID NO: 299579 - RNA, 19 nt, Homo sapiens
uauccacucgccacaguua

SEQ ID NO: 299580 - RNA, 19 nt, Homo sapiens
ucgagaaccuggaggaucu

SEQ ID NO: 299581 - RNA, 19 nt, Homo sapiens
ccaagaaggacaacaaggu

SEQ ID NO: 299582 - RNA, 19 nt, Homo sapiens
guuaucagcugccauugcu

SEQ ID NO: 299583 - RNA, 19 nt, Homo sapiens
gagcugacggccagucgaa

SEQ ID NO: 299584 - RNA, 19 nt, Homo sapiens
gcuuugugcuucucaccuu

SEQ ID NO: 299585 - RNA, 19 nt, Homo sapiens
aaccagagcacuugaugaa

SEQ ID NO: 299586 - RNA, 19 nt, Homo sapiens
cccaucaucucacgcuuug

SEQ ID NO: 299587 - RNA, 19 nt, Homo sapiens
ggagaguccaggcaaagug

SEQ ID NO: 299588 - RNA, 19 nt, Homo sapiens
gagaccaucuaucagaacu

SEQ ID NO: 299589 - RNA, 19 nt, Homo sapiens
uggaggagaccaucuauca

SEQ ID NO: 299590 - RNA, 19 nt, Homo sapiens
cgaagucgcaguuucucaa

SEQ ID NO: 299591 - RNA, 19 nt, Homo sapiens
uggcgugaguugcguauuc

SEQ ID NO: 299592 - RNA, 19 nt, Homo sapiens
ucagcgacaugugcaaaga

SEQ ID NO: 299593 - RNA, 19 nt, Homo sapiens
uuacuugguugcugaacau

SEQ ID NO: 299594 - RNA, 19 nt, Homo sapiens
ugggaugccuugccagugu

SEQ ID NO: 299595 - RNA, 19 nt, Homo sapiens
caccuggcaugacuguuug

SEQ ID NO: 299596 - RNA, 19 nt, Homo sapiens
gguggucagugcccucugu

SEQ ID NO: 299597 - RNA, 19 nt, Homo sapiens
gcagagcaggugacauauc

SEQ ID NO: 299598 - RNA, 19 nt, Homo sapiens
guacagugaccugaggaaa

SEQ ID NO: 299599 - RNA, 19 nt, Homo sapiens
gccugguggugaacuauga

SEQ ID NO: 299600 - RNA, 19 nt, Homo sapiens
gggacuggcucuggaugau

SEQ ID NO: 299601 - RNA, 19 nt, Homo sapiens
uccacaaccucucugcauu

SEQ ID NO: 299602 - RNA, 19 nt, Homo sapiens
ucauagacacacagaaguu

SEQ ID NO: 299603 - RNA, 19 nt, Homo sapiens
gaugcuggagagcuucaua

SEQ ID NO: 299604 - RNA, 19 nt, Homo sapiens
acccgaagcucaaccagau

SEQ ID NO: 299605 - RNA, 19 nt, Homo sapiens
ggagugugucucauugaug

SEQ ID NO: 299606 - RNA, 19 nt, Homo sapiens
caccaccgcuucaagaacu

SEQ ID NO: 299607 - RNA, 19 nt, Homo sapiens
cagcagaucggagagaaga

SEQ ID NO: 299608 - RNA, 19 nt, Homo sapiens
gguuugguuucuguaguuu

SEQ ID NO: 299609 - RNA, 19 nt, Homo sapiens
ggacaucaauauucuucua

SEQ ID NO: 299610 - RNA, 19 nt, Homo sapiens
uauccgagauguugaauaa

SEQ ID NO: 299611 - RNA, 19 nt, Homo sapiens
gccaggacaucuccaguua

SEQ ID NO: 299612 - RNA, 19 nt, Homo sapiens
gaugaugacuugguggaua

SEQ ID NO: 299613 - RNA, 19 nt, Homo sapiens
gaauaaacuuagccauuuc

SEQ ID NO: 299614 - RNA, 19 nt, Homo sapiens
gcacaacuguuuucuguuu

SEQ ID NO: 299615 - RNA, 19 nt, Homo sapiens
gagaguuuguucuguguuu

SEQ ID NO: 299616 - RNA, 19 nt, Homo sapiens
gcagguaugaccaguauaa

SEQ ID NO: 299617 - RNA, 19 nt, Homo sapiens
cugauugccuguaauguua

SEQ ID NO: 299618 - RNA, 19 nt, Homo sapiens
caguuaaggugaauaugua

SEQ ID NO: 299619 - RNA, 19 nt, Homo sapiens
ggaaaugccucaaguacac

SEQ ID NO: 299620 - RNA, 19 nt, Homo sapiens
gaagugaggaugaaucaga

SEQ ID NO: 299621 - RNA, 19 nt, Homo sapiens
gcacagccauccaugaagu

SEQ ID NO: 299622 - RNA, 19 nt, Homo sapiens
cagcauucaugaagaagua

SEQ ID NO: 299623 - RNA, 19 nt, Homo sapiens
gaauauggccuuucugucu

SEQ ID NO: 299624 - RNA, 19 nt, Homo sapiens
uagccaagaucaagaaguu

SEQ ID NO: 299625 - RNA, 19 nt, Homo sapiens
ugagcaagaugcaggauga

SEQ ID NO: 299626 - RNA, 19 nt, Homo sapiens
gaagcgaagugaggaugaa

SEQ ID NO: 299627 - RNA, 19 nt, Homo sapiens
ccaccuacauugcagaaga

SEQ ID NO: 299628 - RNA, 19 nt, Homo sapiens
agaggaagcuguggaguug

SEQ ID NO: 299629 - RNA, 19 nt, Homo sapiens
ucacugcugucacgauuug

SEQ ID NO: 299630 - RNA, 19 nt, Homo sapiens
gguuugcauugaugaauuu

SEQ ID NO: 299631 - RNA, 19 nt, Homo sapiens
ggagggcauugucacuaaa

SEQ ID NO: 299632 - RNA, 19 nt, Homo sapiens
gaggaauguuggugaugaa

SEQ ID NO: 299633 - RNA, 19 nt, Homo sapiens
cgaggaauguuggugauga

SEQ ID NO: 299634 - RNA, 19 nt, Homo sapiens
gagagaguuuguucugugu

SEQ ID NO: 299635 - RNA, 19 nt, Homo sapiens
gagcagaagaggaagagaa

SEQ ID NO: 299636 - RNA, 19 nt, Homo sapiens
cccaauauccagaugaaua

SEQ ID NO: 299637 - RNA, 19 nt, Homo sapiens
gugcagcauucaugaagaa

SEQ ID NO: 299638 - RNA, 19 nt, Homo sapiens
gaucaagaaguucaguaaa

SEQ ID NO: 299639 - RNA, 19 nt, Homo sapiens
gggaaugggucaugaaagc

SEQ ID NO: 299640 - RNA, 19 nt, Homo sapiens
gauggugagugcagcauuc

SEQ ID NO: 299641 - RNA, 19 nt, Homo sapiens
ggaagaccagggaauuuau

SEQ ID NO: 299642 - RNA, 19 nt, Homo sapiens
caaguacacacuccaaaga

SEQ ID NO: 299643 - RNA, 19 nt, Homo sapiens
acacccagauuuaugagaa

SEQ ID NO: 299644 - RNA, 19 nt, Homo sapiens
cacagaugaucccaacuuu

SEQ ID NO: 299645 - RNA, 19 nt, Homo sapiens
gagauuaccuggacuuccu

SEQ ID NO: 299646 - RNA, 19 nt, Homo sapiens
gaggaagaccagggaauuu

SEQ ID NO: 299647 - RNA, 19 nt, Homo sapiens
agaaggagaagaaacguaa

SEQ ID NO: 299648 - RNA, 19 nt, Homo sapiens
caggacaucuccaguuaca

SEQ ID NO: 299649 - RNA, 19 nt, Homo sapiens
gaauauccgagauguugaa

SEQ ID NO: 299650 - RNA, 19 nt, Homo sapiens
ccagagcacuuuggucuag

SEQ ID NO: 299651 - RNA, 19 nt, Homo sapiens
gaccaaggaaucccagaaa

SEQ ID NO: 299652 - RNA, 19 nt, Homo sapiens
cagcaggacacccagauuu

SEQ ID NO: 299653 - RNA, 19 nt, Homo sapiens
cagaugaucccaacuuuag

SEQ ID NO: 299654 - RNA, 19 nt, Homo sapiens
aauauggccuuucugucua

SEQ ID NO: 299655 - RNA, 19 nt, Homo sapiens
gaccauagagcgacguuau

SEQ ID NO: 299656 - RNA, 19 nt, Homo sapiens
gcugaucagugacaaccaa

SEQ ID NO: 299657 - RNA, 19 nt, Homo sapiens
uaacauaugacuucugagu

SEQ ID NO: 299658 - RNA, 19 nt, Homo sapiens
cggcagguaugaccaguau

SEQ ID NO: 299659 - RNA, 19 nt, Homo sapiens
gcaagaugcaggaugacaa

SEQ ID NO: 299660 - RNA, 19 nt, Homo sapiens
gcaugaaucgccucacaga

SEQ ID NO: 299661 - RNA, 19 nt, Homo sapiens
aaaguggaguugagugaau

SEQ ID NO: 299662 - RNA, 19 nt, Homo sapiens
aaucagagacagaagauga

SEQ ID NO: 299663 - RNA, 19 nt, Homo sapiens
gagaaggagaagaaacgua

SEQ ID NO: 299664 - RNA, 19 nt, Homo sapiens
ugagaagcaugacaaccuu

SEQ ID NO: 299665 - RNA, 19 nt, Homo sapiens
gaauuuaucagagcaaagu

SEQ ID NO: 299666 - RNA, 19 nt, Homo sapiens
ccacagaugaucccaacuu

SEQ ID NO: 299667 - RNA, 19 nt, Homo sapiens
uggagggcauugucacuaa

SEQ ID NO: 299668 - RNA, 19 nt, Homo sapiens
cuaaccggcuucugaacaa

SEQ ID NO: 299669 - RNA, 19 nt, Homo sapiens
caacugaaggcgaggaaug

SEQ ID NO: 299670 - RNA, 19 nt, Homo sapiens
gagcccuucucuucaguug

SEQ ID NO: 299671 - RNA, 19 nt, Homo sapiens
gaaaguggaguugagugaa

SEQ ID NO: 299672 - RNA, 19 nt, Homo sapiens
caaggaaucccagaaagug

SEQ ID NO: 299673 - RNA, 19 nt, Homo sapiens
ggagucggccaccuacauu

SEQ ID NO: 299674 - RNA, 19 nt, Homo sapiens
gaccagggaauuuaucaga

SEQ ID NO: 299675 - RNA, 19 nt, Homo sapiens
gcuaugcccuuggguagug

SEQ ID NO: 299676 - RNA, 19 nt, Homo sapiens
gaucucagaccauguccuu

SEQ ID NO: 299677 - RNA, 19 nt, Homo sapiens
cgauuugacuugcucuuca

SEQ ID NO: 299678 - RNA, 19 nt, Homo sapiens
gagcgacguuauucugauc

SEQ ID NO: 299679 - RNA, 19 nt, Homo sapiens
ugaaucgccucacagaauc

SEQ ID NO: 299680 - RNA, 19 nt, Homo sapiens
gcaggacacccagauuuau

SEQ ID NO: 299681 - RNA, 19 nt, Homo sapiens
gggaggcucagagagauua

SEQ ID NO: 299682 - RNA, 19 nt, Homo sapiens
gaauguuggugaugaagcu

SEQ ID NO: 299683 - RNA, 19 nt, Homo sapiens
ggcaucaucuuccucaucu

SEQ ID NO: 299684 - RNA, 19 nt, Homo sapiens
gggaauuuaucagagcaaa

SEQ ID NO: 299685 - RNA, 19 nt, Homo sapiens
cuacauugcagaagaguau

SEQ ID NO: 299686 - RNA, 19 nt, Homo sapiens
cuacuaagaagaccauaga

SEQ ID NO: 299687 - RNA, 19 nt, Homo sapiens
uaaauguucucuaguucgu

SEQ ID NO: 299688 - RNA, 19 nt, Homo sapiens
ccaguuaaggugaauaugu

SEQ ID NO: 299689 - RNA, 19 nt, Homo sapiens
acauaugacuucugaguac

SEQ ID NO: 299690 - RNA, 19 nt, Homo sapiens
ccagccagaugccaaagau

SEQ ID NO: 299691 - RNA, 19 nt, Homo sapiens
ccagaugaauauccgagau

SEQ ID NO: 299692 - RNA, 19 nt, Homo sapiens
gggcacaacuguuuucugu

SEQ ID NO: 299693 - RNA, 19 nt, Homo sapiens
aggaagaccagggaauuua

SEQ ID NO: 299694 - RNA, 19 nt, Homo sapiens
acagaugaucccaacuuua

SEQ ID NO: 299695 - RNA, 19 nt, Homo sapiens
ccaaggaugaggagaacaa

SEQ ID NO: 299696 - RNA, 19 nt, Homo sapiens
guaugaggaguucuacgua

SEQ ID NO: 299697 - RNA, 19 nt, Homo sapiens
caaacccaauauccagaug

SEQ ID NO: 299698 - RNA, 19 nt, Homo sapiens
cgaggaagaccagggaauu

SEQ ID NO: 299699 - RNA, 19 nt, Homo sapiens
caucaucuuccucaucuga

SEQ ID NO: 299700 - RNA, 19 nt, Homo sapiens
uucgggagcugaucaguga

SEQ ID NO: 299701 - RNA, 19 nt, Homo sapiens
ccaaagauggggauucaua

SEQ ID NO: 299702 - RNA, 19 nt, Homo sapiens
caaccaauaccggcugauu

SEQ ID NO: 299703 - RNA, 19 nt, Homo sapiens
gaagaccagggaauuuauc

SEQ ID NO: 299704 - RNA, 19 nt, Homo sapiens
ggagaucucagaccauguc

SEQ ID NO: 299705 - RNA, 19 nt, Homo sapiens
uuaagcagaugagcaagga

SEQ ID NO: 299706 - RNA, 19 nt, Homo sapiens
cauucuggaugaugacuug

SEQ ID NO: 299707 - RNA, 19 nt, Homo sapiens
gagacagaauauggccuuu

SEQ ID NO: 299708 - RNA, 19 nt, Homo sapiens
cuaccuaugccaagcagua

SEQ ID NO: 299709 - RNA, 19 nt, Homo sapiens
gaagaucccuggcaucauc

SEQ ID NO: 299710 - RNA, 19 nt, Homo sapiens
gaacaggguuaccaucaug

SEQ ID NO: 299711 - RNA, 19 nt, Homo sapiens
ggacaacauugacuucaug

SEQ ID NO: 299712 - RNA, 19 nt, Homo sapiens
ccaaggagguagcugauga

SEQ ID NO: 299713 - RNA, 19 nt, Homo sapiens
uggcauccguuaauaauaa

SEQ ID NO: 299714 - RNA, 19 nt, Homo sapiens
ggauugagguggagaugga

SEQ ID NO: 299715 - RNA, 19 nt, Homo sapiens
ggaccuggccgacuacuug

SEQ ID NO: 299716 - RNA, 19 nt, Homo sapiens
cgaaagaggcucccugaug

SEQ ID NO: 299717 - RNA, 19 nt, Homo sapiens
gcaacacccucaccaacau

SEQ ID NO: 299718 - RNA, 19 nt, Homo sapiens
uggccaagcugaagaaguu

SEQ ID NO: 299719 - RNA, 19 nt, Homo sapiens
gaagaaccgcuacaucauc

SEQ ID NO: 299720 - RNA, 19 nt, Homo sapiens
ggaacaggguuaccaucau

SEQ ID NO: 299721 - RNA, 19 nt, Homo sapiens
gaacucaagcggcauuaca

SEQ ID NO: 299722 - RNA, 19 nt, Homo sapiens
ccagacacaugcagcucua

SEQ ID NO: 299723 - RNA, 19 nt, Homo sapiens
gcacgggcuucaccuucaa

SEQ ID NO: 299724 - RNA, 19 nt, Homo sapiens
ucaaggaugagcacaauga

SEQ ID NO: 299725 - RNA, 19 nt, Homo sapiens
ggagaugcccagacacaug

SEQ ID NO: 299726 - RNA, 19 nt, Homo sapiens
ggacuucaccaagcagaaa

SEQ ID NO: 299727 - RNA, 19 nt, Homo sapiens
ccaagcaugucaucacucu

SEQ ID NO: 299728 - RNA, 19 nt, Homo sapiens
aagaaccgcuacaucauca

SEQ ID NO: 299729 - RNA, 19 nt, Homo sapiens
ugacgaguuugacaagaug

SEQ ID NO: 299730 - RNA, 19 nt, Homo sapiens
gcgcagucaugucgggauu

SEQ ID NO: 299731 - RNA, 19 nt, Homo sapiens
ucaaggacuucaccaagca

SEQ ID NO: 299732 - RNA, 19 nt, Homo sapiens
ggaagugcaacacagauca

SEQ ID NO: 299733 - RNA, 19 nt, Homo sapiens
auacagggaugaacucaag

SEQ ID NO: 299734 - RNA, 19 nt, Homo sapiens
gaggcucccugauggacuu

SEQ ID NO: 299735 - RNA, 19 nt, Homo sapiens
gaucuggccagcuuugaug

SEQ ID NO: 299736 - RNA, 19 nt, Homo sapiens
gggcuucaccuucaaauac

SEQ ID NO: 299737 - RNA, 19 nt, Homo sapiens
gaaccgcuacaucaucaug

SEQ ID NO: 299738 - RNA, 19 nt, Homo sapiens
ugaaguuuguggagaagug

SEQ ID NO: 299739 - RNA, 19 nt, Homo sapiens
gaagcccucagcaagauga

SEQ ID NO: 299740 - RNA, 19 nt, Homo sapiens
uggcugcccucccaaaugu

SEQ ID NO: 299741 - RNA, 19 nt, Homo sapiens
gggaacaggguuaccauca

SEQ ID NO: 299742 - RNA, 19 nt, Homo sapiens
uggaggaucuggccagcuu

SEQ ID NO: 299743 - RNA, 19 nt, Homo sapiens
ggcauccguuaauaauaaa

SEQ ID NO: 299744 - RNA, 19 nt, Homo sapiens
gguauacacgucugggaaa

SEQ ID NO: 299745 - RNA, 19 nt, Homo sapiens
cgccagcccuuccagcauu

SEQ ID NO: 299746 - RNA, 19 nt, Homo sapiens
gcggaagcccucagcaaga

SEQ ID NO: 299747 - RNA, 19 nt, Homo sapiens
cgucaaggaugagcacaau

SEQ ID NO: 299748 - RNA, 19 nt, Homo sapiens
cugaagaaccgcuacauca

SEQ ID NO: 299749 - RNA, 19 nt, Homo sapiens
gacaagaugcgagaagaug

SEQ ID NO: 299750 - RNA, 19 nt, Homo sapiens
caagaaguuuggccugacu

SEQ ID NO: 299751 - RNA, 19 nt, Homo sapiens
gcacgugagcgcacugaca

SEQ ID NO: 299752 - RNA, 19 nt, Homo sapiens
gagcagcagaccaucucua

SEQ ID NO: 299753 - RNA, 19 nt, Homo sapiens
gcaucuacuccaucaagaa

SEQ ID NO: 299754 - RNA, 19 nt, Homo sapiens
ggaggacaacauugacuuc

SEQ ID NO: 299755 - RNA, 19 nt, Homo sapiens
gugaagaucccuggcauca

SEQ ID NO: 299756 - RNA, 19 nt, Homo sapiens
gaugaacucaagcggcauu

SEQ ID NO: 299757 - RNA, 19 nt, Homo sapiens
cggaagcccucagcaagau

SEQ ID NO: 299758 - RNA, 19 nt, Homo sapiens
gccaagcugaagaaguuua

SEQ ID NO: 299759 - RNA, 19 nt, Homo sapiens
ucuacuccaucaagaaguu

SEQ ID NO: 299760 - RNA, 19 nt, Homo sapiens
ggcaucuacuccaucaaga

SEQ ID NO: 299761 - RNA, 19 nt, Homo sapiens
caucaugcccgacaaaugc

SEQ ID NO: 299762 - RNA, 19 nt, Homo sapiens
augaggaccuggccgacua

SEQ ID NO: 299763 - RNA, 19 nt, Homo sapiens
cagcagaccaucucuaucg

SEQ ID NO: 299764 - RNA, 19 nt, Homo sapiens
ggaagcugccaaggaggua

SEQ ID NO: 299765 - RNA, 19 nt, Homo sapiens
ccgccucacuggacucaug

SEQ ID NO: 299766 - RNA, 19 nt, Homo sapiens
agaaguuuauugccuacug

SEQ ID NO: 299767 - RNA, 19 nt, Homo sapiens
ccaagucccagcuucugaa

SEQ ID NO: 299768 - RNA, 19 nt, Homo sapiens
caacacccucaccaacauu

SEQ ID NO: 299769 - RNA, 19 nt, Homo sapiens
ggcuucaccuucaaauaca

SEQ ID NO: 299770 - RNA, 19 nt, Homo sapiens
cugcggcucuuccaagugu

SEQ ID NO: 299771 - RNA, 19 nt, Homo sapiens
ggccaagcaugucaucacu

SEQ ID NO: 299772 - RNA, 19 nt, Homo sapiens
gacccuucgucccggaauu

SEQ ID NO: 299773 - RNA, 19 nt, Homo sapiens
gggcaucuacuccaucaag

SEQ ID NO: 299774 - RNA, 19 nt, Homo sapiens
ggacccguacuucaucaug

SEQ ID NO: 299775 - RNA, 19 nt, Homo sapiens
ccaggaagugcaacacaga

SEQ ID NO: 299776 - RNA, 19 nt, Homo sapiens
ugaagaaccgcuacaucau

SEQ ID NO: 299777 - RNA, 19 nt, Homo sapiens
gggaggacaacauugacuu

SEQ ID NO: 299778 - RNA, 19 nt, Homo sapiens
gaggaucuggccagcuuug

SEQ ID NO: 299779 - RNA, 19 nt, Homo sapiens
ucaaauacagggaugaacu

SEQ ID NO: 299780 - RNA, 19 nt, Homo sapiens
aagcugaagaaguuuauug

SEQ ID NO: 299781 - RNA, 19 nt, Homo sapiens
gcgcgguucugggaagugu

SEQ ID NO: 299782 - RNA, 19 nt, Homo sapiens
cugcagagaaacugaagaa

SEQ ID NO: 299783 - RNA, 19 nt, Homo sapiens
caaauacagggaugaacuc

SEQ ID NO: 299784 - RNA, 19 nt, Homo sapiens
gaucuucaucgucaaggau

SEQ ID NO: 299785 - RNA, 19 nt, Homo sapiens
guauacacgucugggaaag

SEQ ID NO: 299786 - RNA, 19 nt, Homo sapiens
ggagcacgccauccacaag

SEQ ID NO: 299787 - RNA, 19 nt, Homo sapiens
gaggacaacauugacuuca

SEQ ID NO: 299788 - RNA, 19 nt, Homo sapiens
acaagaugcgagaagauga

SEQ ID NO: 299789 - RNA, 19 nt, Homo sapiens
aaccagaggcgcagucaug

SEQ ID NO: 299790 - RNA, 19 nt, Homo sapiens
acaaggugcugcagcucau

SEQ ID NO: 299791 - RNA, 19 nt, Homo sapiens
gcagucaugucgggauucg

SEQ ID NO: 299792 - RNA, 19 nt, Homo sapiens
agauugaccuggccaagcu

SEQ ID NO: 299793 - RNA, 19 nt, Homo sapiens
guauugacgaguuugacaa

SEQ ID NO: 299794 - RNA, 19 nt, Homo sapiens
gagcguggagguucuuguc

SEQ ID NO: 299795 - RNA, 19 nt, Homo sapiens
gaggaaggagcuguagugu

SEQ ID NO: 299796 - RNA, 19 nt, Homo sapiens
agaggaaggagcuguagug

SEQ ID NO: 299797 - RNA, 19 nt, Homo sapiens
auucgacgauccuggcauu

SEQ ID NO: 299798 - RNA, 19 nt, Homo sapiens
ccaagcugaagaaguuuau

SEQ ID NO: 299799 - RNA, 19 nt, Homo sapiens
gccaagucccagcuucuga

SEQ ID NO: 299800 - RNA, 19 nt, Homo sapiens
uugacgaguuugacaagau

SEQ ID NO: 299801 - RNA, 19 nt, Homo sapiens
gucccggaauuucaucaug

SEQ ID NO: 299802 - RNA, 19 nt, Homo sapiens
cgacgauccuggcauuuuc

SEQ ID NO: 299803 - RNA, 19 nt, Homo sapiens
gcaugcagcgcaagguucu

SEQ ID NO: 299804 - RNA, 19 nt, Homo sapiens
cgcacgggcuucaccuuca

SEQ ID NO: 299805 - RNA, 19 nt, Homo sapiens
cuucaugcccaccaucuug

SEQ ID NO: 299806 - RNA, 19 nt, Homo sapiens
caucuacuccaucaagaag

SEQ ID NO: 299807 - RNA, 19 nt, Homo sapiens
ugacaagaugcgagaagau

SEQ ID NO: 299808 - RNA, 19 nt, Homo sapiens
guucuugucuccccugguu

SEQ ID NO: 299809 - RNA, 19 nt, Homo sapiens
ccacaaguauguacaauua

SEQ ID NO: 299810 - RNA, 19 nt, Homo sapiens
ggaaagagcucagagauga

SEQ ID NO: 299811 - RNA, 19 nt, Homo sapiens
ggaaucaacuuguaugaaa

SEQ ID NO: 299812 - RNA, 19 nt, Homo sapiens
ugaagaaucucaugaguuu

SEQ ID NO: 299813 - RNA, 19 nt, Homo sapiens
gagcagcgauggagaaauu

SEQ ID NO: 299814 - RNA, 19 nt, Homo sapiens
ggaaacaccugaugucaau

SEQ ID NO: 299815 - RNA, 19 nt, Homo sapiens
gauagacucugaagaagaa

SEQ ID NO: 299816 - RNA, 19 nt, Homo sapiens
ggaaaucgaaucagagaua

SEQ ID NO: 299817 - RNA, 19 nt, Homo sapiens
ugaagaagaucccuacuug

SEQ ID NO: 299818 - RNA, 19 nt, Homo sapiens
uaacaguuccugagacuua

SEQ ID NO: 299819 - RNA, 19 nt, Homo sapiens
ccaaaugacugugaaagaa

SEQ ID NO: 299820 - RNA, 19 nt, Homo sapiens
ccaaacaucugccgaaauc

SEQ ID NO: 299821 - RNA, 19 nt, Homo sapiens
ggagcgagcuuguuaacug

SEQ ID NO: 299822 - RNA, 19 nt, Homo sapiens
ucagaaagguggaagaaga

SEQ ID NO: 299823 - RNA, 19 nt, Homo sapiens
gaaacuaauucccguguca

SEQ ID NO: 299824 - RNA, 19 nt, Homo sapiens
guucugaaguugucuauug

SEQ ID NO: 299825 - RNA, 19 nt, Homo sapiens
caaauaauguguagucucu

SEQ ID NO: 299826 - RNA, 19 nt, Homo sapiens
gagcucaccucauccagaa

SEQ ID NO: 299827 - RNA, 19 nt, Homo sapiens
gagaaaguguuugagauga

SEQ ID NO: 299828 - RNA, 19 nt, Homo sapiens
gaggaguucuauagaguuu

SEQ ID NO: 299829 - RNA, 19 nt, Homo sapiens
gaagugagagcuaugaaga

SEQ ID NO: 299830 - RNA, 19 nt, Homo sapiens
ugaaggaaaucgaaucaga

SEQ ID NO: 299831 - RNA, 19 nt, Homo sapiens
caagacagauuaauauagg

SEQ ID NO: 299832 - RNA, 19 nt, Homo sapiens
gagaugacuuuccaagguu

SEQ ID NO: 299833 - RNA, 19 nt, Homo sapiens
gauucgaucucuucuuuau

SEQ ID NO: 299834 - RNA, 19 nt, Homo sapiens
guagaaagcaagacagauu

SEQ ID NO: 299835 - RNA, 19 nt, Homo sapiens
gcucgaagauugagauagu

SEQ ID NO: 299836 - RNA, 19 nt, Homo sapiens
gcuaagagccaauuucuca

SEQ ID NO: 299837 - RNA, 19 nt, Homo sapiens
ugagaugagucaagauaaa

SEQ ID NO: 299838 - RNA, 19 nt, Homo sapiens
ugccgaaucucuaaccuua

SEQ ID NO: 299839 - RNA, 19 nt, Homo sapiens
ccgauucgaucucuucuuu

SEQ ID NO: 299840 - RNA, 19 nt, Homo sapiens
gaccagagcugaggaacug

SEQ ID NO: 299841 - RNA, 19 nt, Homo sapiens
caaucuagaucaagaggaa

SEQ ID NO: 299842 - RNA, 19 nt, Homo sapiens
caacaggaggagauucuua

SEQ ID NO: 299843 - RNA, 19 nt, Homo sapiens
gaacugauucguccugaga

SEQ ID NO: 299844 - RNA, 19 nt, Homo sapiens
ucaagagucugcucccaaa

SEQ ID NO: 299845 - RNA, 19 nt, Homo sapiens
gaucagggauguagaacag

SEQ ID NO: 299846 - RNA, 19 nt, Homo sapiens
uuagggaccuuucuuauag

SEQ ID NO: 299847 - RNA, 19 nt, Homo sapiens
caauuuaaccagcaacuuu

SEQ ID NO: 299848 - RNA, 19 nt, Homo sapiens
agccagaaaucuauuagua

SEQ ID NO: 299849 - RNA, 19 nt, Homo sapiens
ggaugaauguaaugagguu

SEQ ID NO: 299850 - RNA, 19 nt, Homo sapiens
gauguuggcugauaauggu

SEQ ID NO: 299851 - RNA, 19 nt, Homo sapiens
ucacauucaucacagguuu

SEQ ID NO: 299852 - RNA, 19 nt, Homo sapiens
gaaaucgaaucagagauag

SEQ ID NO: 299853 - RNA, 19 nt, Homo sapiens
ccgaaucucuaaccuuauu

SEQ ID NO: 299854 - RNA, 19 nt, Homo sapiens
cauaguagauuugcauuca

SEQ ID NO: 299855 - RNA, 19 nt, Homo sapiens
gguuacagauuaugccauu

SEQ ID NO: 299856 - RNA, 19 nt, Homo sapiens
gauaaugguguguguugua

SEQ ID NO: 299857 - RNA, 19 nt, Homo sapiens
ucuauagaguuuacccuua

SEQ ID NO: 299858 - RNA, 19 nt, Homo sapiens
ggaugagguuucuaugaga

SEQ ID NO: 299859 - RNA, 19 nt, Homo sapiens
gaccauauccaucacuaaa

SEQ ID NO: 299860 - RNA, 19 nt, Homo sapiens
ggagaaaguguuugagaug

SEQ ID NO: 299861 - RNA, 19 nt, Homo sapiens
caagaggaguucuauagag

SEQ ID NO: 299862 - RNA, 19 nt, Homo sapiens
gaaacaagaauugaguuga

SEQ ID NO: 299863 - RNA, 19 nt, Homo sapiens
ucaaguugcuauucaugaa

SEQ ID NO: 299864 - RNA, 19 nt, Homo sapiens
gggagaaaguguuugagau

SEQ ID NO: 299865 - RNA, 19 nt, Homo sapiens
guuagggaccuuucuuaua

SEQ ID NO: 299866 - RNA, 19 nt, Homo sapiens
gcaagacagauuaauauag

SEQ ID NO: 299867 - RNA, 19 nt, Homo sapiens
gaagauugagauagugaaa

SEQ ID NO: 299868 - RNA, 19 nt, Homo sapiens
ucagugguguugauggaua

SEQ ID NO: 299869 - RNA, 19 nt, Homo sapiens
ggaaccaaauaauguguag

SEQ ID NO: 299870 - RNA, 19 nt, Homo sapiens
uggcuacaaugaagacaua

SEQ ID NO: 299871 - RNA, 19 nt, Homo sapiens
gcuuuccgguuacugaaua

SEQ ID NO: 299872 - RNA, 19 nt, Homo sapiens
gggaucaaguugcuauuca

SEQ ID NO: 299873 - RNA, 19 nt, Homo sapiens
ccugacgucuccaagcuua

SEQ ID NO: 299874 - RNA, 19 nt, Homo sapiens
gaucaauggcuacaaugaa

SEQ ID NO: 299875 - RNA, 19 nt, Homo sapiens
uagaaagcaagacagauua

SEQ ID NO: 299876 - RNA, 19 nt, Homo sapiens
gcaauuagcagaggaacug

SEQ ID NO: 299877 - RNA, 19 nt, Homo sapiens
uacuguacccugauuauua

SEQ ID NO: 299878 - RNA, 19 nt, Homo sapiens
acacuaugaucauguucua

SEQ ID NO: 299879 - RNA, 19 nt, Homo sapiens
caauugaucgugucuauuc

SEQ ID NO: 299880 - RNA, 19 nt, Homo sapiens
gaaaguguuugagaugagu

SEQ ID NO: 299881 - RNA, 19 nt, Homo sapiens
ggaacaauuuaaccagcaa

SEQ ID NO: 299882 - RNA, 19 nt, Homo sapiens
gcuagaggccuuagagaug

SEQ ID NO: 299883 - RNA, 19 nt, Homo sapiens
caucacagguuucauacca

SEQ ID NO: 299884 - RNA, 19 nt, Homo sapiens
ugagagcuaugaagaagau

SEQ ID NO: 299885 - RNA, 19 nt, Homo sapiens
gagauagacucugaagaag

SEQ ID NO: 299886 - RNA, 19 nt, Homo sapiens
ucuauucccucgaugauau

SEQ ID NO: 299887 - RNA, 19 nt, Homo sapiens
gcuuugauguuggcugaua

SEQ ID NO: 299888 - RNA, 19 nt, Homo sapiens
gaaagaaugggagaaagug

SEQ ID NO: 299889 - RNA, 19 nt, Homo sapiens
cuagaggccuuagagauga

SEQ ID NO: 299890 - RNA, 19 nt, Homo sapiens
aagaggagcgagcuuguua

SEQ ID NO: 299891 - RNA, 19 nt, Homo sapiens
ggacgagucagcauuaaag

SEQ ID NO: 299892 - RNA, 19 nt, Homo sapiens
gaggacgagucagcauuaa

SEQ ID NO: 299893 - RNA, 19 nt, Homo sapiens
caaagaccguaaagagauc

SEQ ID NO: 299894 - RNA, 19 nt, Homo sapiens
gauuauuacuuccaucuac

SEQ ID NO: 299895 - RNA, 19 nt, Homo sapiens
gaagcuuuccgguuacuga

SEQ ID NO: 299896 - RNA, 19 nt, Homo sapiens
acagacagcugagagcauu

SEQ ID NO: 299897 - RNA, 19 nt, Homo sapiens
gcacgugcagaaacuaauu

SEQ ID NO: 299898 - RNA, 19 nt, Homo sapiens
gguaauuucucaggauugu

SEQ ID NO: 299899 - RNA, 19 nt, Homo sapiens
gagcaugauucgucucucu

SEQ ID NO: 299900 - RNA, 19 nt, Homo sapiens
acauggcaaugaugaagua

SEQ ID NO: 299901 - RNA, 19 nt, Homo sapiens
cagcugagagcauuaagaa

SEQ ID NO: 299902 - RNA, 19 nt, Homo sapiens
gauucuuacuggauacaaa

SEQ ID NO: 299903 - RNA, 19 nt, Homo sapiens
ggaguucuauagaguuuac

SEQ ID NO: 299904 - RNA, 19 nt, Homo sapiens
agagaugacuuuccaaggu

SEQ ID NO: 299905 - RNA, 19 nt, Homo sapiens
cuuguuaacugguacuuga

SEQ ID NO: 299906 - RNA, 19 nt, Homo sapiens
gguccaaccuaaacaugug

SEQ ID NO: 299907 - RNA, 19 nt, Homo sapiens
gcgauggagaaauuaaaua

SEQ ID NO: 299908 - RNA, 19 nt, Homo sapiens
ucaaagaccguaaagagau

SEQ ID NO: 299909 - RNA, 19 nt, Homo sapiens
ggaaauaucccucguagua

SEQ ID NO: 299910 - RNA, 19 nt, Homo sapiens
gaaagaagaugugaaugaa

SEQ ID NO: 299911 - RNA, 19 nt, Homo sapiens
ggaagaagcaguucaagua

SEQ ID NO: 299912 - RNA, 19 nt, Homo sapiens
gcacugcucucccgguuug

SEQ ID NO: 299913 - RNA, 19 nt, Homo sapiens
ggagagaacacaaggauug

SEQ ID NO: 299914 - RNA, 19 nt, Homo sapiens
agagggaagugguaaauaa

SEQ ID NO: 299915 - RNA, 19 nt, Homo sapiens
ucaaaggacucucuucuag

SEQ ID NO: 299916 - RNA, 19 nt, Homo sapiens
gaacucaugcgcagauuug

SEQ ID NO: 299917 - RNA, 19 nt, Homo sapiens
uaauggagaugucaaagga

SEQ ID NO: 299918 - RNA, 19 nt, Homo sapiens
gaacaagagugaggaugau

SEQ ID NO: 299919 - RNA, 19 nt, Homo sapiens
ggagaaagaagaugugaau

SEQ ID NO: 299920 - RNA, 19 nt, Homo sapiens
guggagaacugaccuuaga

SEQ ID NO: 299921 - RNA, 19 nt, Homo sapiens
agucucagcuccugucaua

SEQ ID NO: 299922 - RNA, 19 nt, Homo sapiens
gggaagugguaaauaaaga

SEQ ID NO: 299923 - RNA, 19 nt, Homo sapiens
gaagaagcaguucaaguau

SEQ ID NO: 299924 - RNA, 19 nt, Homo sapiens
gggaggagcugaggcaaau

SEQ ID NO: 299925 - RNA, 19 nt, Homo sapiens
aaaggacucucuucuagga

SEQ ID NO: 299926 - RNA, 19 nt, Homo sapiens
agaaagaagaugugaauga

SEQ ID NO: 299927 - RNA, 19 nt, Homo sapiens
gcagauuugagcuguauuu

SEQ ID NO: 299928 - RNA, 19 nt, Homo sapiens
gcgaagcucuuugcugaug

SEQ ID NO: 299929 - RNA, 19 nt, Homo sapiens
gaaauaucccucguaguau

SEQ ID NO: 299930 - RNA, 19 nt, Homo sapiens
gcuccagauucaucaaauu

SEQ ID NO: 299931 - RNA, 19 nt, Homo sapiens
gauccagucucccacuuuc

SEQ ID NO: 299932 - RNA, 19 nt, Homo sapiens
gcucaugaggcguuacaua

SEQ ID NO: 299933 - RNA, 19 nt, Homo sapiens
cagcagaccaucuccauug

SEQ ID NO: 299934 - RNA, 19 nt, Homo sapiens
gcaugaagaugugaagaag

SEQ ID NO: 299935 - RNA, 19 nt, Homo sapiens
gguacaggguuuacucuca

SEQ ID NO: 299936 - RNA, 19 nt, Homo sapiens
gcgcagauuugagcuguau

SEQ ID NO: 299937 - RNA, 19 nt, Homo sapiens
cgauggcacugaaggacua

SEQ ID NO: 299938 - RNA, 19 nt, Homo sapiens
ggugugugcugcauugaug

SEQ ID NO: 299939 - RNA, 19 nt, Homo sapiens
gcaagaacauagugaucag

SEQ ID NO: 299940 - RNA, 19 nt, Homo sapiens
gauuugagcuguauuuuca

SEQ ID NO: 299941 - RNA, 19 nt, Homo sapiens
gcagagcagcgcuguguau

SEQ ID NO: 299942 - RNA, 19 nt, Homo sapiens
gagcagcgcuguguaucuc

SEQ ID NO: 299943 - RNA, 19 nt, Homo sapiens
agaggaggauuucuacgaa

SEQ ID NO: 299944 - RNA, 19 nt, Homo sapiens
gagggaagugguaaauaaa

SEQ ID NO: 299945 - RNA, 19 nt, Homo sapiens
ggacuacgcgcuagagaag

SEQ ID NO: 299946 - RNA, 19 nt, Homo sapiens
guaaggaugccaccuauac

SEQ ID NO: 299947 - RNA, 19 nt, Homo sapiens
gaccuccucuggcugauuc

SEQ ID NO: 299948 - RNA, 19 nt, Homo sapiens
gaagaugcaagaacauagu

SEQ ID NO: 299949 - RNA, 19 nt, Homo sapiens
gagagggaagugguaaaua

SEQ ID NO: 299950 - RNA, 19 nt, Homo sapiens
guacccugcugaacucaug

SEQ ID NO: 299951 - RNA, 19 nt, Homo sapiens
ggacacggaucacuuuugu

SEQ ID NO: 299952 - RNA, 19 nt, Homo sapiens
cgagaggcuugggcuagua

SEQ ID NO: 299953 - RNA, 19 nt, Homo sapiens
cagcauacguggagaugag

SEQ ID NO: 299954 - RNA, 19 nt, Homo sapiens
gaaauauacgggcaugaag

SEQ ID NO: 299955 - RNA, 19 nt, Homo sapiens
aaauaucccucguaguauc

SEQ ID NO: 299956 - RNA, 19 nt, Homo sapiens
cagcuccugucauacauug

SEQ ID NO: 299957 - RNA, 19 nt, Homo sapiens
gaggagcugaggcaaauug

SEQ ID NO: 299958 - RNA, 19 nt, Homo sapiens
agaagcaguucaaguaugg

SEQ ID NO: 299959 - RNA, 19 nt, Homo sapiens
ugaacaagagugaggauga

SEQ ID NO: 299960 - RNA, 19 nt, Homo sapiens
gacaggugguacaggguuu

SEQ ID NO: 299961 - RNA, 19 nt, Homo sapiens
agaugaagaugcaagaaca

SEQ ID NO: 299962 - RNA, 19 nt, Homo sapiens
gaagugguaaauaaagaug

SEQ ID NO: 299963 - RNA, 19 nt, Homo sapiens
gaaccaguacccugcugaa

SEQ ID NO: 299964 - RNA, 19 nt, Homo sapiens
gagugaggaugaugagucu

SEQ ID NO: 299965 - RNA, 19 nt, Homo sapiens
aagaagcaguucaaguaug

SEQ ID NO: 299966 - RNA, 19 nt, Homo sapiens
cggcagcgauggcacugaa

SEQ ID NO: 299967 - RNA, 19 nt, Homo sapiens
ggagagggaagugguaaau

SEQ ID NO: 299968 - RNA, 19 nt, Homo sapiens
cagggugugugcugcauug

SEQ ID NO: 299969 - RNA, 19 nt, Homo sapiens
ccaguacccugcugaacuc

SEQ ID NO: 299970 - RNA, 19 nt, Homo sapiens
aagagcugcugccucagua

SEQ ID NO: 299971 - RNA, 19 nt, Homo sapiens
uaguaaggaugccaccuau

SEQ ID NO: 299972 - RNA, 19 nt, Homo sapiens
gaguggagaacugaccuua

SEQ ID NO: 299973 - RNA, 19 nt, Homo sapiens
ggaagugguaaauaaagau

SEQ ID NO: 299974 - RNA, 19 nt, Homo sapiens
cgaccgagacaaugaccua

SEQ ID NO: 299975 - RNA, 19 nt, Homo sapiens
aggaaaagguuaagaaguu

SEQ ID NO: 299976 - RNA, 19 nt, Homo sapiens
caaggagagggaaguggua

SEQ ID NO: 299977 - RNA, 19 nt, Homo sapiens
gucaaaggacucucuucua

SEQ ID NO: 299978 - RNA, 19 nt, Homo sapiens
gagaggcuugggcuaguaa

SEQ ID NO: 299979 - RNA, 19 nt, Homo sapiens
augcugcacuuacuccuuu

SEQ ID NO: 299980 - RNA, 19 nt, Homo sapiens
uggaugugguggagaaaga

SEQ ID NO: 299981 - RNA, 19 nt, Homo sapiens
ggcaugaagaugugaagaa

SEQ ID NO: 299982 - RNA, 19 nt, Homo sapiens
ccuggaagcccaucggauu

SEQ ID NO: 299983 - RNA, 19 nt, Homo sapiens
ucaaguaugggaaccaguu

SEQ ID NO: 299984 - RNA, 19 nt, Homo sapiens
agaaauauacgggcaugaa

SEQ ID NO: 299985 - RNA, 19 nt, Homo sapiens
ggaagcccaucggauugug

SEQ ID NO: 299986 - RNA, 19 nt, Homo sapiens
gaaggagagaacacaagga

SEQ ID NO: 299987 - RNA, 19 nt, Homo sapiens
ucaaauuccaggagaugaa

SEQ ID NO: 299988 - RNA, 19 nt, Homo sapiens
ucgugucucugaagucaaa

SEQ ID NO: 299989 - RNA, 19 nt, Homo sapiens
gcgagaggcuugggcuagu

SEQ ID NO: 299990 - RNA, 19 nt, Homo sapiens
gugcugcauugaugaguuc

SEQ ID NO: 299991 - RNA, 19 nt, Homo sapiens
gguggccacuuacacuugu

SEQ ID NO: 299992 - RNA, 19 nt, Homo sapiens
cuaguaaggaugccaccua

SEQ ID NO: 299993 - RNA, 19 nt, Homo sapiens
uugaaccucuggacaugaa

SEQ ID NO: 299994 - RNA, 19 nt, Homo sapiens
gcagcagaccaucuccauu

SEQ ID NO: 299995 - RNA, 19 nt, Homo sapiens
uugaugaguucgacaagau

SEQ ID NO: 299996 - RNA, 19 nt, Homo sapiens
gcauugaugaguucgacaa

SEQ ID NO: 299997 - RNA, 19 nt, Homo sapiens
ugaagaugaacaagaguga

SEQ ID NO: 299998 - RNA, 19 nt, Homo sapiens
guaucacggugcugguaga

SEQ ID NO: 299999 - RNA, 19 nt, Homo sapiens
aaucgucacucgugucucu

SEQ ID NO: 300000 - RNA, 19 nt, Homo sapiens
gggaagaagcaguucaagu

SEQ ID NO: 300001 - RNA, 19 nt, Homo sapiens
augaugaacucgggaagaa

SEQ ID NO: 300002 - RNA, 19 nt, Homo sapiens
ugaagcucaugaggcguua

SEQ ID NO: 300003 - RNA, 19 nt, Homo sapiens
guuugaaccucuggacaug

SEQ ID NO: 300004 - RNA, 19 nt, Homo sapiens
aaauauacgggcaugaaga

SEQ ID NO: 300005 - RNA, 19 nt, Homo sapiens
cagaggaggauuucuacga

SEQ ID NO: 300006 - RNA, 19 nt, Homo sapiens
ggaaaagguuaagaaguuc

SEQ ID NO: 300007 - RNA, 19 nt, Homo sapiens
gcacuuacuccuuuugcua

SEQ ID NO: 300008 - RNA, 19 nt, Homo sapiens
gaugccaccuauacuucug

SEQ ID NO: 300009 - RNA, 19 nt, Homo sapiens
gcacauaccuaacugauga

SEQ ID NO: 300010 - RNA, 19 nt, Homo sapiens
gcacagaguugaaguuuau

SEQ ID NO: 300011 - RNA, 19 nt, Homo sapiens
gaaaguggcuugaaaucuu

SEQ ID NO: 300012 - RNA, 19 nt, Homo sapiens
gcacaaacuuggcuucuuu

SEQ ID NO: 300013 - RNA, 19 nt, Homo sapiens
gcagggauaugcuguauuu

SEQ ID NO: 300014 - RNA, 19 nt, Homo sapiens
gaacaaacaggaauucuga

SEQ ID NO: 300015 - RNA, 19 nt, Homo sapiens
gcaagaugcuuuaggaaga

SEQ ID NO: 300016 - RNA, 19 nt, Homo sapiens
uaaagaaaguggcuugaaa

SEQ ID NO: 300017 - RNA, 19 nt, Homo sapiens
ggagagagcacgauuuauu

SEQ ID NO: 300018 - RNA, 19 nt, Homo sapiens
ugauagagguucuuuauug

SEQ ID NO: 300019 - RNA, 19 nt, Homo sapiens
agagaaacauguccauaua

SEQ ID NO: 300020 - RNA, 19 nt, Homo sapiens
gaagaaaggcacauaccua

SEQ ID NO: 300021 - RNA, 19 nt, Homo sapiens
cagaugcacuuuauuugua

SEQ ID NO: 300022 - RNA, 19 nt, Homo sapiens
cagagaggcugaauagauu

SEQ ID NO: 300023 - RNA, 19 nt, Homo sapiens
guacagauaucuucaaagg

SEQ ID NO: 300024 - RNA, 19 nt, Homo sapiens
ggacuuacgaguuugguua

SEQ ID NO: 300025 - RNA, 19 nt, Homo sapiens
ccaaagacauguuuauagu

SEQ ID NO: 300026 - RNA, 19 nt, Homo sapiens
ucagaaagcuagaaagugu

SEQ ID NO: 300027 - RNA, 19 nt, Homo sapiens
gguuaaacaugcccucuaa

SEQ ID NO: 300028 - RNA, 19 nt, Homo sapiens
aaacagauaucaggauuug

SEQ ID NO: 300029 - RNA, 19 nt, Homo sapiens
ccaagcaguuucuuucaaa

SEQ ID NO: 300030 - RNA, 19 nt, Homo sapiens
cuauggagcucauugguaa

SEQ ID NO: 300031 - RNA, 19 nt, Homo sapiens
gcagagaggcugaauagau

SEQ ID NO: 300032 - RNA, 19 nt, Homo sapiens
gaauguagguagcauccuu

SEQ ID NO: 300033 - RNA, 19 nt, Homo sapiens
caauguggcuugaauguag

SEQ ID NO: 300034 - RNA, 19 nt, Homo sapiens
aaacacaccuuuagugaag

SEQ ID NO: 300035 - RNA, 19 nt, Homo sapiens
ucaagaguguagaagaaua

SEQ ID NO: 300036 - RNA, 19 nt, Homo sapiens
gaaaacagauaucaggauu

SEQ ID NO: 300037 - RNA, 19 nt, Homo sapiens
uaaaggaucaguagcaauu

SEQ ID NO: 300038 - RNA, 19 nt, Homo sapiens
gaacuuaaaggaucaguag

SEQ ID NO: 300039 - RNA, 19 nt, Homo sapiens
gagaaucuuaguccauuua

SEQ ID NO: 300040 - RNA, 19 nt, Homo sapiens
cagcaugccugguuguauu

SEQ ID NO: 300041 - RNA, 19 nt, Homo sapiens
aaagagaacuccguauguu

SEQ ID NO: 300042 - RNA, 19 nt, Homo sapiens
aaaugggacuuacgaguuu

SEQ ID NO: 300043 - RNA, 19 nt, Homo sapiens
cagauaaccucaagucaca

SEQ ID NO: 300044 - RNA, 19 nt, Homo sapiens
guuaucagaugcacuuuau

SEQ ID NO: 300045 - RNA, 19 nt, Homo sapiens
gagcagagaggcugaauag

SEQ ID NO: 300046 - RNA, 19 nt, Homo sapiens
gagcugaauaugccacuua

SEQ ID NO: 300047 - RNA, 19 nt, Homo sapiens
guauaugucuuaccucauc

SEQ ID NO: 300048 - RNA, 19 nt, Homo sapiens
ugagauuggugaacgagua

SEQ ID NO: 300049 - RNA, 19 nt, Homo sapiens
gauaaaaguuugaggagaa

SEQ ID NO: 300050 - RNA, 19 nt, Homo sapiens
ugucuuaccucaucuccua

SEQ ID NO: 300051 - RNA, 19 nt, Homo sapiens
gugaacgaguagauuauaa

SEQ ID NO: 300052 - RNA, 19 nt, Homo sapiens
uagcucagguagcacuuua

SEQ ID NO: 300053 - RNA, 19 nt, Homo sapiens
ggaagaagaaaggcacaua

SEQ ID NO: 300054 - RNA, 19 nt, Homo sapiens
gagagagcacgauuuauug

SEQ ID NO: 300055 - RNA, 19 nt, Homo sapiens
aaucaagaguguagaagaa

SEQ ID NO: 300056 - RNA, 19 nt, Homo sapiens
ggucauugcugugauuguu

SEQ ID NO: 300057 - RNA, 19 nt, Homo sapiens
caaaugggacuuacgaguu

SEQ ID NO: 300058 - RNA, 19 nt, Homo sapiens
gacagaagcguauaugaau

SEQ ID NO: 300059 - RNA, 19 nt, Homo sapiens
gaauuaagcacagaguuga

SEQ ID NO: 300060 - RNA, 19 nt, Homo sapiens
guaaauguuccuuuccuuu

SEQ ID NO: 300061 - RNA, 19 nt, Homo sapiens
uuacaagccuccagucuca

SEQ ID NO: 300062 - RNA, 19 nt, Homo sapiens
ccagauccauuuucacuua

SEQ ID NO: 300063 - RNA, 19 nt, Homo sapiens
aaauauagcucagguagca

SEQ ID NO: 300064 - RNA, 19 nt, Homo sapiens
caaaguaagccauguaucu

SEQ ID NO: 300065 - RNA, 19 nt, Homo sapiens
ugacagaagcguauaugaa

SEQ ID NO: 300066 - RNA, 19 nt, Homo sapiens
ucaagaaugucgcaauuac

SEQ ID NO: 300067 - RNA, 19 nt, Homo sapiens
gaacagauugccugcuuuc

SEQ ID NO: 300068 - RNA, 19 nt, Homo sapiens
aaggaauacuugacaguuu

SEQ ID NO: 300069 - RNA, 19 nt, Homo sapiens
gaaggaauacuugacaguu

SEQ ID NO: 300070 - RNA, 19 nt, Homo sapiens
caagaguguagaagaauaa

SEQ ID NO: 300071 - RNA, 19 nt, Homo sapiens
gcucagguagcacuuuaua

SEQ ID NO: 300072 - RNA, 19 nt, Homo sapiens
guaauguguucggugauuu

SEQ ID NO: 300073 - RNA, 19 nt, Homo sapiens
gaauuuggguaugaacaga

SEQ ID NO: 300074 - RNA, 19 nt, Homo sapiens
gaaggagagaugagagaaa

SEQ ID NO: 300075 - RNA, 19 nt, Homo sapiens
ccacagagaaguaaaauuu

SEQ ID NO: 300076 - RNA, 19 nt, Homo sapiens
gggaauaugcacaaacuug

SEQ ID NO: 300077 - RNA, 19 nt, Homo sapiens
gaaaggcacauaccuaacu

SEQ ID NO: 300078 - RNA, 19 nt, Homo sapiens
gaaaacacaccuuuaguga

SEQ ID NO: 300079 - RNA, 19 nt, Homo sapiens
gaugacgccuguuauagag

SEQ ID NO: 300080 - RNA, 19 nt, Homo sapiens
ucagaugacgccuguuaua

SEQ ID NO: 300081 - RNA, 19 nt, Homo sapiens
gaauucugguuacaugugu

SEQ ID NO: 300082 - RNA, 19 nt, Homo sapiens
caaagagaacuccguaugu

SEQ ID NO: 300083 - RNA, 19 nt, Homo sapiens
ccuaacugaucgaauauau

SEQ ID NO: 300084 - RNA, 19 nt, Homo sapiens
aaacuuggcuucuuuaacc

SEQ ID NO: 300085 - RNA, 19 nt, Homo sapiens
uagcuaauauugcaaugug

SEQ ID NO: 300086 - RNA, 19 nt, Homo sapiens
ccacuuaccagacuaaauc

SEQ ID NO: 300087 - RNA, 19 nt, Homo sapiens
gagaaacauguccauauau

SEQ ID NO: 300088 - RNA, 19 nt, Homo sapiens
gauagagguucuuuauugc

SEQ ID NO: 300089 - RNA, 19 nt, Homo sapiens
aaagaaacauugccuugag

SEQ ID NO: 300090 - RNA, 19 nt, Homo sapiens
caaagaaacauugccuuga

SEQ ID NO: 300091 - RNA, 19 nt, Homo sapiens
guacaaaaccuccagcuuu

SEQ ID NO: 300092 - RNA, 19 nt, Homo sapiens
cuacaaagcaacaguuaug

SEQ ID NO: 300093 - RNA, 19 nt, Homo sapiens
acgaguagauuauaagugu

SEQ ID NO: 300094 - RNA, 19 nt, Homo sapiens
ccaccaacauuugaagcua

SEQ ID NO: 300095 - RNA, 19 nt, Homo sapiens
agauuaaugccaacucuua

SEQ ID NO: 300096 - RNA, 19 nt, Homo sapiens
uauacgggauccuuuaaau

SEQ ID NO: 300097 - RNA, 19 nt, Homo sapiens
acagaagcguauaugaauu

SEQ ID NO: 300098 - RNA, 19 nt, Homo sapiens
aaaggcagaguacaaagua

SEQ ID NO: 300099 - RNA, 19 nt, Homo sapiens
ccaaagagaacuccguaug

SEQ ID NO: 300100 - RNA, 19 nt, Homo sapiens
gcaauguggcuugaaugua

SEQ ID NO: 300101 - RNA, 19 nt, Homo sapiens
cgaguuugguuaucagaug

SEQ ID NO: 300102 - RNA, 19 nt, Homo sapiens
ggacugccacugcauuuca

SEQ ID NO: 300103 - RNA, 19 nt, Homo sapiens
gccaagcaguuucuuucaa

SEQ ID NO: 300104 - RNA, 19 nt, Homo sapiens
aagaaaggcacauaccuaa

SEQ ID NO: 300105 - RNA, 19 nt, Homo sapiens
gaacgaguagauuauaagu

SEQ ID NO: 300106 - RNA, 19 nt, Homo sapiens
gugaggagccaccaacauu

SEQ ID NO: 300107 - RNA, 19 nt, Homo sapiens
uaaauguuccuuuccuuug

SEQ ID NO: 300108 - RNA, 19 nt, Homo sapiens
uacauugccuuggcuagua

SEQ ID NO: 300109 - RNA, 19 nt, Homo sapiens
gcacagaguugaaguuuau

SEQ ID NO: 300110 - RNA, 19 nt, Homo sapiens
gaaaguggcuugaaaucuu

SEQ ID NO: 300111 - RNA, 19 nt, Homo sapiens
gcacaaacuuggcuucuuu

SEQ ID NO: 300112 - RNA, 19 nt, Homo sapiens
gcagggauaugcuguauuu

SEQ ID NO: 300113 - RNA, 19 nt, Homo sapiens
gaacaaacaggaauucuga

SEQ ID NO: 300114 - RNA, 19 nt, Homo sapiens
gcaagaugcuuuaggaaga

SEQ ID NO: 300115 - RNA, 19 nt, Homo sapiens
uaaagaaaguggcuugaaa

SEQ ID NO: 300116 - RNA, 19 nt, Homo sapiens
ggagagagcacgauuuauu

SEQ ID NO: 300117 - RNA, 19 nt, Homo sapiens
ugauagagguucuuuauug

SEQ ID NO: 300118 - RNA, 19 nt, Homo sapiens
agagaaacauguccauaua

SEQ ID NO: 300119 - RNA, 19 nt, Homo sapiens
cagaugcacuuuauuugua

SEQ ID NO: 300120 - RNA, 19 nt, Homo sapiens
cagagaggcugaauagauu

SEQ ID NO: 300121 - RNA, 19 nt, Homo sapiens
guacagauaucuucaaagg

SEQ ID NO: 300122 - RNA, 19 nt, Homo sapiens
ggacuuacgaguuugguua

SEQ ID NO: 300123 - RNA, 19 nt, Homo sapiens
ccaaagacauguuuauagu

SEQ ID NO: 300124 - RNA, 19 nt, Homo sapiens
ucagaaagcuagaaagugu

SEQ ID NO: 300125 - RNA, 19 nt, Homo sapiens
gguuaaacaugcccucuaa

SEQ ID NO: 300126 - RNA, 19 nt, Homo sapiens
aaacagauaucaggauuug

SEQ ID NO: 300127 - RNA, 19 nt, Homo sapiens
ccaagcaguuucuuucaaa

SEQ ID NO: 300128 - RNA, 19 nt, Homo sapiens
cuauggagcucauugguaa

SEQ ID NO: 300129 - RNA, 19 nt, Homo sapiens
gcagagaggcugaauagau

SEQ ID NO: 300130 - RNA, 19 nt, Homo sapiens
gaauguagguagcauccuu

SEQ ID NO: 300131 - RNA, 19 nt, Homo sapiens
caauguggcuugaauguag

SEQ ID NO: 300132 - RNA, 19 nt, Homo sapiens
aaacacaccuuuagugaag

SEQ ID NO: 300133 - RNA, 19 nt, Homo sapiens
ucaagaguguagaagaaua

SEQ ID NO: 300134 - RNA, 19 nt, Homo sapiens
gaaaacagauaucaggauu

SEQ ID NO: 300135 - RNA, 19 nt, Homo sapiens
uaaaggaucaguagcaauu

SEQ ID NO: 300136 - RNA, 19 nt, Homo sapiens
gaacuuaaaggaucaguag

SEQ ID NO: 300137 - RNA, 19 nt, Homo sapiens
gagaaucuuaguccauuua

SEQ ID NO: 300138 - RNA, 19 nt, Homo sapiens
cagcaugccugguuguauu

SEQ ID NO: 300139 - RNA, 19 nt, Homo sapiens
aaagagaacuccguauguu

SEQ ID NO: 300140 - RNA, 19 nt, Homo sapiens
aaaugggacuuacgaguuu

SEQ ID NO: 300141 - RNA, 19 nt, Homo sapiens
cagauaaccucaagucaca

SEQ ID NO: 300142 - RNA, 19 nt, Homo sapiens
guuaucagaugcacuuuau

SEQ ID NO: 300143 - RNA, 19 nt, Homo sapiens
gagcagagaggcugaauag

SEQ ID NO: 300144 - RNA, 19 nt, Homo sapiens
gagcugaauaugccacuua

SEQ ID NO: 300145 - RNA, 19 nt, Homo sapiens
guauaugucuuaccucauc

SEQ ID NO: 300146 - RNA, 19 nt, Homo sapiens
ugagauuggugaacgagua

SEQ ID NO: 300147 - RNA, 19 nt, Homo sapiens
gauaaaaguuugaggagaa

SEQ ID NO: 300148 - RNA, 19 nt, Homo sapiens
ugucuuaccucaucuccua

SEQ ID NO: 300149 - RNA, 19 nt, Homo sapiens
gugaacgaguagauuauaa

SEQ ID NO: 300150 - RNA, 19 nt, Homo sapiens
uagcucagguagcacuuua

SEQ ID NO: 300151 - RNA, 19 nt, Homo sapiens
gagagagcacgauuuauug

SEQ ID NO: 300152 - RNA, 19 nt, Homo sapiens
aaucaagaguguagaagaa

SEQ ID NO: 300153 - RNA, 19 nt, Homo sapiens
ggucauugcugugauuguu

SEQ ID NO: 300154 - RNA, 19 nt, Homo sapiens
caaaugggacuuacgaguu

SEQ ID NO: 300155 - RNA, 19 nt, Homo sapiens
gacagaagcguauaugaau

SEQ ID NO: 300156 - RNA, 19 nt, Homo sapiens
gaauuaagcacagaguuga

SEQ ID NO: 300157 - RNA, 19 nt, Homo sapiens
guaaauguuccuuuccuuu

SEQ ID NO: 300158 - RNA, 19 nt, Homo sapiens
uuacaagccuccagucuca

SEQ ID NO: 300159 - RNA, 19 nt, Homo sapiens
ccagauccauuuucacuua

SEQ ID NO: 300160 - RNA, 19 nt, Homo sapiens
aaauauagcucagguagca

SEQ ID NO: 300161 - RNA, 19 nt, Homo sapiens
caaaguaagccauguaucu

SEQ ID NO: 300162 - RNA, 19 nt, Homo sapiens
ugacagaagcguauaugaa

SEQ ID NO: 300163 - RNA, 19 nt, Homo sapiens
ucaagaaugucgcaauuac

SEQ ID NO: 300164 - RNA, 19 nt, Homo sapiens
gaacagauugccugcuuuc

SEQ ID NO: 300165 - RNA, 19 nt, Homo sapiens
gaagaaagggaaagcagau

SEQ ID NO: 300166 - RNA, 19 nt, Homo sapiens
aaggaauacuugacaguuu

SEQ ID NO: 300167 - RNA, 19 nt, Homo sapiens
gaaggaauacuugacaguu

SEQ ID NO: 300168 - RNA, 19 nt, Homo sapiens
caagaguguagaagaauaa

SEQ ID NO: 300169 - RNA, 19 nt, Homo sapiens
gcucagguagcacuuuaua

SEQ ID NO: 300170 - RNA, 19 nt, Homo sapiens
guaauguguucggugauuu

SEQ ID NO: 300171 - RNA, 19 nt, Homo sapiens
gaauuuggguaugaacaga

SEQ ID NO: 300172 - RNA, 19 nt, Homo sapiens
gggaauaugcacaaacuug

SEQ ID NO: 300173 - RNA, 19 nt, Homo sapiens
gaaaacacaccuuuaguga

SEQ ID NO: 300174 - RNA, 19 nt, Homo sapiens
gaugacgccuguuauagag

SEQ ID NO: 300175 - RNA, 19 nt, Homo sapiens
ucagaugacgccuguuaua

SEQ ID NO: 300176 - RNA, 19 nt, Homo sapiens
gaauucugguuacaugugu

SEQ ID NO: 300177 - RNA, 19 nt, Homo sapiens
caaagagaacuccguaugu

SEQ ID NO: 300178 - RNA, 19 nt, Homo sapiens
ccuaacugaucgaauauau

SEQ ID NO: 300179 - RNA, 19 nt, Homo sapiens
aaacuuggcuucuuuaacc

SEQ ID NO: 300180 - RNA, 19 nt, Homo sapiens
uagcuaauauugcaaugug

SEQ ID NO: 300181 - RNA, 19 nt, Homo sapiens
ccacuuaccagacuaaauc

SEQ ID NO: 300182 - RNA, 19 nt, Homo sapiens
gagaaacauguccauauau

SEQ ID NO: 300183 - RNA, 19 nt, Homo sapiens
gauagagguucuuuauugc

SEQ ID NO: 300184 - RNA, 19 nt, Homo sapiens
aaagaaacauugccuugag

SEQ ID NO: 300185 - RNA, 19 nt, Homo sapiens
caaagaaacauugccuuga

SEQ ID NO: 300186 - RNA, 19 nt, Homo sapiens
cuacaaagcaacaguuaug

SEQ ID NO: 300187 - RNA, 19 nt, Homo sapiens
acgaguagauuauaagugu

SEQ ID NO: 300188 - RNA, 19 nt, Homo sapiens
agauuaaugccaacucuua

SEQ ID NO: 300189 - RNA, 19 nt, Homo sapiens
ccaccaacauuugaagcua

SEQ ID NO: 300190 - RNA, 19 nt, Homo sapiens
uauacgggauccuuuaaau

SEQ ID NO: 300191 - RNA, 19 nt, Homo sapiens
acagaagcguauaugaauu

SEQ ID NO: 300192 - RNA, 19 nt, Homo sapiens
aaaggcagaguacaaagua

SEQ ID NO: 300193 - RNA, 19 nt, Homo sapiens
ccaaagagaacuccguaug

SEQ ID NO: 300194 - RNA, 19 nt, Homo sapiens
gcaauguggcuugaaugua

SEQ ID NO: 300195 - RNA, 19 nt, Homo sapiens
cgaguuugguuaucagaug

SEQ ID NO: 300196 - RNA, 19 nt, Homo sapiens
ggacugccacugcauuuca

SEQ ID NO: 300197 - RNA, 19 nt, Homo sapiens
gccaagcaguuucuuucaa

SEQ ID NO: 300198 - RNA, 19 nt, Homo sapiens
gaacgaguagauuauaagu

SEQ ID NO: 300199 - RNA, 19 nt, Homo sapiens
uaaauguuccuuuccuuug

SEQ ID NO: 300200 - RNA, 19 nt, Homo sapiens
uacauugccuuggcuagua

SEQ ID NO: 300201 - RNA, 19 nt, Homo sapiens
caccaacuauagaauguau

SEQ ID NO: 300202 - RNA, 19 nt, Homo sapiens
guagguagcauccuuugau

SEQ ID NO: 300203 - RNA, 19 nt, Homo sapiens
gauggcagcgacacaauug

SEQ ID NO: 300204 - RNA, 19 nt, Homo sapiens
gugaggagccaccaacauu

SEQ ID NO: 300205 - RNA, 19 nt, Homo sapiens
gaggagccaccaacauuug

SEQ ID NO: 300206 - RNA, 19 nt, Homo sapiens
gcuauggagcucauuggua

SEQ ID NO: 300207 - RNA, 19 nt, Homo sapiens
acacaccuuuagugaagua

SEQ ID NO: 300208 - RNA, 19 nt, Homo sapiens
ucucagaugacgccuguua

SEQ ID NO: 300209 - RNA, 19 nt, Homo sapiens
gcacagaguugaaguuuau

SEQ ID NO: 300210 - RNA, 19 nt, Homo sapiens
gaaaguggcuugaaaucuu

SEQ ID NO: 300211 - RNA, 19 nt, Homo sapiens
gcacaaacuuggcuucuuu

SEQ ID NO: 300212 - RNA, 19 nt, Homo sapiens
gcagggauaugcuguauuu

SEQ ID NO: 300213 - RNA, 19 nt, Homo sapiens
gaacaaacaggaauucuga

SEQ ID NO: 300214 - RNA, 19 nt, Homo sapiens
gcaagaugcuuuaggaaga

SEQ ID NO: 300215 - RNA, 19 nt, Homo sapiens
uaaagaaaguggcuugaaa

SEQ ID NO: 300216 - RNA, 19 nt, Homo sapiens
ggagagagcacgauuuauu

SEQ ID NO: 300217 - RNA, 19 nt, Homo sapiens
ugauagagguucuuuauug

SEQ ID NO: 300218 - RNA, 19 nt, Homo sapiens
agagaaacauguccauaua

SEQ ID NO: 300219 - RNA, 19 nt, Homo sapiens
cagaugcacuuuauuugua

SEQ ID NO: 300220 - RNA, 19 nt, Homo sapiens
cagagaggcugaauagauu

SEQ ID NO: 300221 - RNA, 19 nt, Homo sapiens
ggacuuacgaguuugguua

SEQ ID NO: 300222 - RNA, 19 nt, Homo sapiens
ccaaagacauguuuauagu

SEQ ID NO: 300223 - RNA, 19 nt, Homo sapiens
ucagaaagcuagaaagugu

SEQ ID NO: 300224 - RNA, 19 nt, Homo sapiens
gguuaaacaugcccucuaa

SEQ ID NO: 300225 - RNA, 19 nt, Homo sapiens
aaacagauaucaggauuug

SEQ ID NO: 300226 - RNA, 19 nt, Homo sapiens
ccaagcaguuucuuucaaa

SEQ ID NO: 300227 - RNA, 19 nt, Homo sapiens
cuauggagcucauugguaa

SEQ ID NO: 300228 - RNA, 19 nt, Homo sapiens
gcagagaggcugaauagau

SEQ ID NO: 300229 - RNA, 19 nt, Homo sapiens
gaauguagguagcauccuu

SEQ ID NO: 300230 - RNA, 19 nt, Homo sapiens
caauguggcuugaauguag

SEQ ID NO: 300231 - RNA, 19 nt, Homo sapiens
aaacacaccuuuagugaag

SEQ ID NO: 300232 - RNA, 19 nt, Homo sapiens
ucaagaguguagaagaaua

SEQ ID NO: 300233 - RNA, 19 nt, Homo sapiens
gaaaacagauaucaggauu

SEQ ID NO: 300234 - RNA, 19 nt, Homo sapiens
uaaaggaucaguagcaauu

SEQ ID NO: 300235 - RNA, 19 nt, Homo sapiens
gaacuuaaaggaucaguag

SEQ ID NO: 300236 - RNA, 19 nt, Homo sapiens
gagaaucuuaguccauuua

SEQ ID NO: 300237 - RNA, 19 nt, Homo sapiens
cagcaugccugguuguauu

SEQ ID NO: 300238 - RNA, 19 nt, Homo sapiens
aaagagaacuccguauguu

SEQ ID NO: 300239 - RNA, 19 nt, Homo sapiens
aaaugggacuuacgaguuu

SEQ ID NO: 300240 - RNA, 19 nt, Homo sapiens
cagauaaccucaagucaca

SEQ ID NO: 300241 - RNA, 19 nt, Homo sapiens
guuaucagaugcacuuuau

SEQ ID NO: 300242 - RNA, 19 nt, Homo sapiens
gagcagagaggcugaauag

SEQ ID NO: 300243 - RNA, 19 nt, Homo sapiens
gagcugaauaugccacuua

SEQ ID NO: 300244 - RNA, 19 nt, Homo sapiens
guauaugucuuaccucauc

SEQ ID NO: 300245 - RNA, 19 nt, Homo sapiens
ugagauuggugaacgagua

SEQ ID NO: 300246 - RNA, 19 nt, Homo sapiens
gauaaaaguuugaggagaa

SEQ ID NO: 300247 - RNA, 19 nt, Homo sapiens
ugucuuaccucaucuccua

SEQ ID NO: 300248 - RNA, 19 nt, Homo sapiens
gugaacgaguagauuauaa

SEQ ID NO: 300249 - RNA, 19 nt, Homo sapiens
uagcucagguagcacuuua

SEQ ID NO: 300250 - RNA, 19 nt, Homo sapiens
gagagagcacgauuuauug

SEQ ID NO: 300251 - RNA, 19 nt, Homo sapiens
aaucaagaguguagaagaa

SEQ ID NO: 300252 - RNA, 19 nt, Homo sapiens
ggucauugcugugauuguu

SEQ ID NO: 300253 - RNA, 19 nt, Homo sapiens
caaaugggacuuacgaguu

SEQ ID NO: 300254 - RNA, 19 nt, Homo sapiens
gacagaagcguauaugaau

SEQ ID NO: 300255 - RNA, 19 nt, Homo sapiens
gaauuaagcacagaguuga

SEQ ID NO: 300256 - RNA, 19 nt, Homo sapiens
guaaauguuccuuuccuuu

SEQ ID NO: 300257 - RNA, 19 nt, Homo sapiens
uuacaagccuccagucuca

SEQ ID NO: 300258 - RNA, 19 nt, Homo sapiens
ccagauccauuuucacuua

SEQ ID NO: 300259 - RNA, 19 nt, Homo sapiens
aaauauagcucagguagca

SEQ ID NO: 300260 - RNA, 19 nt, Homo sapiens
caaaguaagccauguaucu

SEQ ID NO: 300261 - RNA, 19 nt, Homo sapiens
ugacagaagcguauaugaa

SEQ ID NO: 300262 - RNA, 19 nt, Homo sapiens
ucaagaaugucgcaauuac

SEQ ID NO: 300263 - RNA, 19 nt, Homo sapiens
gaacagauugccugcuuuc

SEQ ID NO: 300264 - RNA, 19 nt, Homo sapiens
aaggaauacuugacaguuu

SEQ ID NO: 300265 - RNA, 19 nt, Homo sapiens
gaaggaauacuugacaguu

SEQ ID NO: 300266 - RNA, 19 nt, Homo sapiens
caagaguguagaagaauaa

SEQ ID NO: 300267 - RNA, 19 nt, Homo sapiens
gcucagguagcacuuuaua

SEQ ID NO: 300268 - RNA, 19 nt, Homo sapiens
guaauguguucggugauuu

SEQ ID NO: 300269 - RNA, 19 nt, Homo sapiens
gaauuuggguaugaacaga

SEQ ID NO: 300270 - RNA, 19 nt, Homo sapiens
gggaauaugcacaaacuug

SEQ ID NO: 300271 - RNA, 19 nt, Homo sapiens
gaaaacacaccuuuaguga

SEQ ID NO: 300272 - RNA, 19 nt, Homo sapiens
gaugacgccuguuauagag

SEQ ID NO: 300273 - RNA, 19 nt, Homo sapiens
ucagaugacgccuguuaua

SEQ ID NO: 300274 - RNA, 19 nt, Homo sapiens
gaauucugguuacaugugu

SEQ ID NO: 300275 - RNA, 19 nt, Homo sapiens
caaagagaacuccguaugu

SEQ ID NO: 300276 - RNA, 19 nt, Homo sapiens
ccuaacugaucgaauauau

SEQ ID NO: 300277 - RNA, 19 nt, Homo sapiens
aaacuuggcuucuuuaacc

SEQ ID NO: 300278 - RNA, 19 nt, Homo sapiens
uagcuaauauugcaaugug

SEQ ID NO: 300279 - RNA, 19 nt, Homo sapiens
ccacuuaccagacuaaauc

SEQ ID NO: 300280 - RNA, 19 nt, Homo sapiens
gagaaacauguccauauau

SEQ ID NO: 300281 - RNA, 19 nt, Homo sapiens
gauagagguucuuuauugc

SEQ ID NO: 300282 - RNA, 19 nt, Homo sapiens
aaagaaacauugccuugag

SEQ ID NO: 300283 - RNA, 19 nt, Homo sapiens
caaagaaacauugccuuga

SEQ ID NO: 300284 - RNA, 19 nt, Homo sapiens
cuacaaagcaacaguuaug

SEQ ID NO: 300285 - RNA, 19 nt, Homo sapiens
acgaguagauuauaagugu

SEQ ID NO: 300286 - RNA, 19 nt, Homo sapiens
ccaccaacauuugaagcua

SEQ ID NO: 300287 - RNA, 19 nt, Homo sapiens
agauuaaugccaacucuua

SEQ ID NO: 300288 - RNA, 19 nt, Homo sapiens
uauacgggauccuuuaaau

SEQ ID NO: 300289 - RNA, 19 nt, Homo sapiens
acagaagcguauaugaauu

SEQ ID NO: 300290 - RNA, 19 nt, Homo sapiens
aaaggcagaguacaaagua

SEQ ID NO: 300291 - RNA, 19 nt, Homo sapiens
ccaaagagaacuccguaug

SEQ ID NO: 300292 - RNA, 19 nt, Homo sapiens
gcaauguggcuugaaugua

SEQ ID NO: 300293 - RNA, 19 nt, Homo sapiens
cgaguuugguuaucagaug

SEQ ID NO: 300294 - RNA, 19 nt, Homo sapiens
ggacugccacugcauuuca

SEQ ID NO: 300295 - RNA, 19 nt, Homo sapiens
gccaagcaguuucuuucaa

SEQ ID NO: 300296 - RNA, 19 nt, Homo sapiens
gaacgaguagauuauaagu

SEQ ID NO: 300297 - RNA, 19 nt, Homo sapiens
uaaauguuccuuuccuuug

SEQ ID NO: 300298 - RNA, 19 nt, Homo sapiens
gugaggagccaccaacauu

SEQ ID NO: 300299 - RNA, 19 nt, Homo sapiens
uacauugccuuggcuagua

SEQ ID NO: 300300 - RNA, 19 nt, Homo sapiens
caccaacuauagaauguau

SEQ ID NO: 300301 - RNA, 19 nt, Homo sapiens
guagguagcauccuuugau

SEQ ID NO: 300302 - RNA, 19 nt, Homo sapiens
gauggcagcgacacaauug

SEQ ID NO: 300303 - RNA, 19 nt, Homo sapiens
gaggagccaccaacauuug

SEQ ID NO: 300304 - RNA, 19 nt, Homo sapiens
acacaccuuuagugaagua

SEQ ID NO: 300305 - RNA, 19 nt, Homo sapiens
gcuauggagcucauuggua

SEQ ID NO: 300306 - RNA, 19 nt, Homo sapiens
ucucagaugacgccuguua

SEQ ID NO: 300307 - RNA, 19 nt, Homo sapiens
ggaaguuuguuuaaaugac

SEQ ID NO: 300308 - RNA, 19 nt, Homo sapiens
aagaaugucgcaauuacua

SEQ ID NO: 300309 - RNA, 19 nt, Homo sapiens
gcacauaccuaacugauga

SEQ ID NO: 300310 - RNA, 19 nt, Homo sapiens
gcacagaguugaaguuuau

SEQ ID NO: 300311 - RNA, 19 nt, Homo sapiens
gaaaguggcuugaaaucuu

SEQ ID NO: 300312 - RNA, 19 nt, Homo sapiens
gcacaaacuuggcuucuuu

SEQ ID NO: 300313 - RNA, 19 nt, Homo sapiens
gcagggauaugcuguauuu

SEQ ID NO: 300314 - RNA, 19 nt, Homo sapiens
gaacaaacaggaauucuga

SEQ ID NO: 300315 - RNA, 19 nt, Homo sapiens
gcaagaugcuuuaggaaga

SEQ ID NO: 300316 - RNA, 19 nt, Homo sapiens
uaaagaaaguggcuugaaa

SEQ ID NO: 300317 - RNA, 19 nt, Homo sapiens
ggagagagcacgauuuauu

SEQ ID NO: 300318 - RNA, 19 nt, Homo sapiens
ugauagagguucuuuauug

SEQ ID NO: 300319 - RNA, 19 nt, Homo sapiens
agagaaacauguccauaua

SEQ ID NO: 300320 - RNA, 19 nt, Homo sapiens
gaagaaaggcacauaccua

SEQ ID NO: 300321 - RNA, 19 nt, Homo sapiens
cagaugcacuuuauuugua

SEQ ID NO: 300322 - RNA, 19 nt, Homo sapiens
cagagaggcugaauagauu

SEQ ID NO: 300323 - RNA, 19 nt, Homo sapiens
guacagauaucuucaaagg

SEQ ID NO: 300324 - RNA, 19 nt, Homo sapiens
ggacuuacgaguuugguua

SEQ ID NO: 300325 - RNA, 19 nt, Homo sapiens
ccaaagacauguuuauagu

SEQ ID NO: 300326 - RNA, 19 nt, Homo sapiens
ucagaaagcuagaaagugu

SEQ ID NO: 300327 - RNA, 19 nt, Homo sapiens
gguuaaacaugcccucuaa

SEQ ID NO: 300328 - RNA, 19 nt, Homo sapiens
aaacagauaucaggauuug

SEQ ID NO: 300329 - RNA, 19 nt, Homo sapiens
ccaagcaguuucuuucaaa

SEQ ID NO: 300330 - RNA, 19 nt, Homo sapiens
cuauggagcucauugguaa

SEQ ID NO: 300331 - RNA, 19 nt, Homo sapiens
gcagagaggcugaauagau

SEQ ID NO: 300332 - RNA, 19 nt, Homo sapiens
gaauguagguagcauccuu

SEQ ID NO: 300333 - RNA, 19 nt, Homo sapiens
caauguggcuugaauguag

SEQ ID NO: 300334 - RNA, 19 nt, Homo sapiens
aaacacaccuuuagugaag

SEQ ID NO: 300335 - RNA, 19 nt, Homo sapiens
ucaagaguguagaagaaua

SEQ ID NO: 300336 - RNA, 19 nt, Homo sapiens
gaaaacagauaucaggauu

SEQ ID NO: 300337 - RNA, 19 nt, Homo sapiens
uaaaggaucaguagcaauu

SEQ ID NO: 300338 - RNA, 19 nt, Homo sapiens
gaacuuaaaggaucaguag

SEQ ID NO: 300339 - RNA, 19 nt, Homo sapiens
gagaaucuuaguccauuua

SEQ ID NO: 300340 - RNA, 19 nt, Homo sapiens
cagcaugccugguuguauu

SEQ ID NO: 300341 - RNA, 19 nt, Homo sapiens
aaagagaacuccguauguu

SEQ ID NO: 300342 - RNA, 19 nt, Homo sapiens
aaaugggacuuacgaguuu

SEQ ID NO: 300343 - RNA, 19 nt, Homo sapiens
cagauaaccucaagucaca

SEQ ID NO: 300344 - RNA, 19 nt, Homo sapiens
guuaucagaugcacuuuau

SEQ ID NO: 300345 - RNA, 19 nt, Homo sapiens
gagcagagaggcugaauag

SEQ ID NO: 300346 - RNA, 19 nt, Homo sapiens
gagcugaauaugccacuua

SEQ ID NO: 300347 - RNA, 19 nt, Homo sapiens
guauaugucuuaccucauc

SEQ ID NO: 300348 - RNA, 19 nt, Homo sapiens
ugagauuggugaacgagua

SEQ ID NO: 300349 - RNA, 19 nt, Homo sapiens
gauaaaaguuugaggagaa

SEQ ID NO: 300350 - RNA, 19 nt, Homo sapiens
ugucuuaccucaucuccua

SEQ ID NO: 300351 - RNA, 19 nt, Homo sapiens
gugaacgaguagauuauaa

SEQ ID NO: 300352 - RNA, 19 nt, Homo sapiens
uagcucagguagcacuuua

SEQ ID NO: 300353 - RNA, 19 nt, Homo sapiens
ggaagaagaaaggcacaua

SEQ ID NO: 300354 - RNA, 19 nt, Homo sapiens
gagagagcacgauuuauug

SEQ ID NO: 300355 - RNA, 19 nt, Homo sapiens
aaucaagaguguagaagaa

SEQ ID NO: 300356 - RNA, 19 nt, Homo sapiens
ggucauugcugugauuguu

SEQ ID NO: 300357 - RNA, 19 nt, Homo sapiens
caaaugggacuuacgaguu

SEQ ID NO: 300358 - RNA, 19 nt, Homo sapiens
gacagaagcguauaugaau

SEQ ID NO: 300359 - RNA, 19 nt, Homo sapiens
gaauuaagcacagaguuga

SEQ ID NO: 300360 - RNA, 19 nt, Homo sapiens
guaaauguuccuuuccuuu

SEQ ID NO: 300361 - RNA, 19 nt, Homo sapiens
uuacaagccuccagucuca

SEQ ID NO: 300362 - RNA, 19 nt, Homo sapiens
ccagauccauuuucacuua

SEQ ID NO: 300363 - RNA, 19 nt, Homo sapiens
aaauauagcucagguagca

SEQ ID NO: 300364 - RNA, 19 nt, Homo sapiens
caaaguaagccauguaucu

SEQ ID NO: 300365 - RNA, 19 nt, Homo sapiens
ugacagaagcguauaugaa

SEQ ID NO: 300366 - RNA, 19 nt, Homo sapiens
ucaagaaugucgcaauuac

SEQ ID NO: 300367 - RNA, 19 nt, Homo sapiens
gaacagauugccugcuuuc

SEQ ID NO: 300368 - RNA, 19 nt, Homo sapiens
aaggaauacuugacaguuu

SEQ ID NO: 300369 - RNA, 19 nt, Homo sapiens
gaaggaauacuugacaguu

SEQ ID NO: 300370 - RNA, 19 nt, Homo sapiens
caagaguguagaagaauaa

SEQ ID NO: 300371 - RNA, 19 nt, Homo sapiens
gcucagguagcacuuuaua

SEQ ID NO: 300372 - RNA, 19 nt, Homo sapiens
guaauguguucggugauuu

SEQ ID NO: 300373 - RNA, 19 nt, Homo sapiens
gaauuuggguaugaacaga

SEQ ID NO: 300374 - RNA, 19 nt, Homo sapiens
gaaggagagaugagagaaa

SEQ ID NO: 300375 - RNA, 19 nt, Homo sapiens
ccacagagaaguaaaauuu

SEQ ID NO: 300376 - RNA, 19 nt, Homo sapiens
gggaauaugcacaaacuug

SEQ ID NO: 300377 - RNA, 19 nt, Homo sapiens
gaaaggcacauaccuaacu

SEQ ID NO: 300378 - RNA, 19 nt, Homo sapiens
gaaaacacaccuuuaguga

SEQ ID NO: 300379 - RNA, 19 nt, Homo sapiens
gaugacgccuguuauagag

SEQ ID NO: 300380 - RNA, 19 nt, Homo sapiens
ucagaugacgccuguuaua

SEQ ID NO: 300381 - RNA, 19 nt, Homo sapiens
gaauucugguuacaugugu

SEQ ID NO: 300382 - RNA, 19 nt, Homo sapiens
caaagagaacuccguaugu

SEQ ID NO: 300383 - RNA, 19 nt, Homo sapiens
ccuaacugaucgaauauau

SEQ ID NO: 300384 - RNA, 19 nt, Homo sapiens
aaacuuggcuucuuuaacc

SEQ ID NO: 300385 - RNA, 19 nt, Homo sapiens
uagcuaauauugcaaugug

SEQ ID NO: 300386 - RNA, 19 nt, Homo sapiens
ccacuuaccagacuaaauc

SEQ ID NO: 300387 - RNA, 19 nt, Homo sapiens
gagaaacauguccauauau

SEQ ID NO: 300388 - RNA, 19 nt, Homo sapiens
gauagagguucuuuauugc

SEQ ID NO: 300389 - RNA, 19 nt, Homo sapiens
aaagaaacauugccuugag

SEQ ID NO: 300390 - RNA, 19 nt, Homo sapiens
caaagaaacauugccuuga

SEQ ID NO: 300391 - RNA, 19 nt, Homo sapiens
cuacaaagcaacaguuaug

SEQ ID NO: 300392 - RNA, 19 nt, Homo sapiens
acgaguagauuauaagugu

SEQ ID NO: 300393 - RNA, 19 nt, Homo sapiens
ccaccaacauuugaagcua

SEQ ID NO: 300394 - RNA, 19 nt, Homo sapiens
agauuaaugccaacucuua

SEQ ID NO: 300395 - RNA, 19 nt, Homo sapiens
uauacgggauccuuuaaau

SEQ ID NO: 300396 - RNA, 19 nt, Homo sapiens
acagaagcguauaugaauu

SEQ ID NO: 300397 - RNA, 19 nt, Homo sapiens
aaaggcagaguacaaagua

SEQ ID NO: 300398 - RNA, 19 nt, Homo sapiens
ccaaagagaacuccguaug

SEQ ID NO: 300399 - RNA, 19 nt, Homo sapiens
gcaauguggcuugaaugua

SEQ ID NO: 300400 - RNA, 19 nt, Homo sapiens
cgaguuugguuaucagaug

SEQ ID NO: 300401 - RNA, 19 nt, Homo sapiens
ggacugccacugcauuuca

SEQ ID NO: 300402 - RNA, 19 nt, Homo sapiens
gaacgaguagauuauaagu

SEQ ID NO: 300403 - RNA, 19 nt, Homo sapiens
gccaagcaguuucuuucaa

SEQ ID NO: 300404 - RNA, 19 nt, Homo sapiens
aagaaaggcacauaccuaa

SEQ ID NO: 300405 - RNA, 19 nt, Homo sapiens
gugaggagccaccaacauu

SEQ ID NO: 300406 - RNA, 19 nt, Homo sapiens
uaaauguuccuuuccuuug

SEQ ID NO: 300407 - RNA, 19 nt, Homo sapiens
uacauugccuuggcuagua

SEQ ID NO: 300408 - RNA, 19 nt, Homo sapiens
caccaacuauagaauguau

SEQ ID NO: 300409 - RNA, 19 nt, Homo sapiens
gcacauaccuaacugauga

SEQ ID NO: 300410 - RNA, 19 nt, Homo sapiens
gcacagaguugaaguuuau

SEQ ID NO: 300411 - RNA, 19 nt, Homo sapiens
gaaaguggcuugaaaucuu

SEQ ID NO: 300412 - RNA, 19 nt, Homo sapiens
gcacaaacuuggcuucuuu

SEQ ID NO: 300413 - RNA, 19 nt, Homo sapiens
gcagggauaugcuguauuu

SEQ ID NO: 300414 - RNA, 19 nt, Homo sapiens
gaacaaacaggaauucuga

SEQ ID NO: 300415 - RNA, 19 nt, Homo sapiens
gcaagaugcuuuaggaaga

SEQ ID NO: 300416 - RNA, 19 nt, Homo sapiens
uaaagaaaguggcuugaaa

SEQ ID NO: 300417 - RNA, 19 nt, Homo sapiens
ggagagagcacgauuuauu

SEQ ID NO: 300418 - RNA, 19 nt, Homo sapiens
ugauagagguucuuuauug

SEQ ID NO: 300419 - RNA, 19 nt, Homo sapiens
agagaaacauguccauaua

SEQ ID NO: 300420 - RNA, 19 nt, Homo sapiens
gaagaaaggcacauaccua

SEQ ID NO: 300421 - RNA, 19 nt, Homo sapiens
cagaugcacuuuauuugua

SEQ ID NO: 300422 - RNA, 19 nt, Homo sapiens
cagagaggcugaauagauu

SEQ ID NO: 300423 - RNA, 19 nt, Homo sapiens
guacagauaucuucaaagg

SEQ ID NO: 300424 - RNA, 19 nt, Homo sapiens
ggacuuacgaguuugguua

SEQ ID NO: 300425 - RNA, 19 nt, Homo sapiens
ccaaagacauguuuauagu

SEQ ID NO: 300426 - RNA, 19 nt, Homo sapiens
ucagaaagcuagaaagugu

SEQ ID NO: 300427 - RNA, 19 nt, Homo sapiens
gguuaaacaugcccucuaa

SEQ ID NO: 300428 - RNA, 19 nt, Homo sapiens
aaacagauaucaggauuug

SEQ ID NO: 300429 - RNA, 19 nt, Homo sapiens
ccaagcaguuucuuucaaa

SEQ ID NO: 300430 - RNA, 19 nt, Homo sapiens
cuauggagcucauugguaa

SEQ ID NO: 300431 - RNA, 19 nt, Homo sapiens
gcagagaggcugaauagau

SEQ ID NO: 300432 - RNA, 19 nt, Homo sapiens
gaauguagguagcauccuu

SEQ ID NO: 300433 - RNA, 19 nt, Homo sapiens
caauguggcuugaauguag

SEQ ID NO: 300434 - RNA, 19 nt, Homo sapiens
aaacacaccuuuagugaag

SEQ ID NO: 300435 - RNA, 19 nt, Homo sapiens
ucaagaguguagaagaaua

SEQ ID NO: 300436 - RNA, 19 nt, Homo sapiens
gaaaacagauaucaggauu

SEQ ID NO: 300437 - RNA, 19 nt, Homo sapiens
uaaaggaucaguagcaauu

SEQ ID NO: 300438 - RNA, 19 nt, Homo sapiens
gaacuuaaaggaucaguag

SEQ ID NO: 300439 - RNA, 19 nt, Homo sapiens
gagaaucuuaguccauuua

SEQ ID NO: 300440 - RNA, 19 nt, Homo sapiens
cagcaugccugguuguauu

SEQ ID NO: 300441 - RNA, 19 nt, Homo sapiens
aaagagaacuccguauguu

SEQ ID NO: 300442 - RNA, 19 nt, Homo sapiens
aaaugggacuuacgaguuu

SEQ ID NO: 300443 - RNA, 19 nt, Homo sapiens
cagauaaccucaagucaca

SEQ ID NO: 300444 - RNA, 19 nt, Homo sapiens
guuaucagaugcacuuuau

SEQ ID NO: 300445 - RNA, 19 nt, Homo sapiens
gagcagagaggcugaauag

SEQ ID NO: 300446 - RNA, 19 nt, Homo sapiens
gagcugaauaugccacuua

SEQ ID NO: 300447 - RNA, 19 nt, Homo sapiens
guauaugucuuaccucauc

SEQ ID NO: 300448 - RNA, 19 nt, Homo sapiens
ugagauuggugaacgagua

SEQ ID NO: 300449 - RNA, 19 nt, Homo sapiens
gauaaaaguuugaggagaa

SEQ ID NO: 300450 - RNA, 19 nt, Homo sapiens
ugucuuaccucaucuccua

SEQ ID NO: 300451 - RNA, 19 nt, Homo sapiens
gugaacgaguagauuauaa

SEQ ID NO: 300452 - RNA, 19 nt, Homo sapiens
uagcucagguagcacuuua

SEQ ID NO: 300453 - RNA, 19 nt, Homo sapiens
ggaagaagaaaggcacaua

SEQ ID NO: 300454 - RNA, 19 nt, Homo sapiens
gagagagcacgauuuauug

SEQ ID NO: 300455 - RNA, 19 nt, Homo sapiens
aaucaagaguguagaagaa

SEQ ID NO: 300456 - RNA, 19 nt, Homo sapiens
ggucauugcugugauuguu

SEQ ID NO: 300457 - RNA, 19 nt, Homo sapiens
caaaugggacuuacgaguu

SEQ ID NO: 300458 - RNA, 19 nt, Homo sapiens
gacagaagcguauaugaau

SEQ ID NO: 300459 - RNA, 19 nt, Homo sapiens
gaauuaagcacagaguuga

SEQ ID NO: 300460 - RNA, 19 nt, Homo sapiens
guaaauguuccuuuccuuu

SEQ ID NO: 300461 - RNA, 19 nt, Homo sapiens
uuacaagccuccagucuca

SEQ ID NO: 300462 - RNA, 19 nt, Homo sapiens
ccagauccauuuucacuua

SEQ ID NO: 300463 - RNA, 19 nt, Homo sapiens
aaauauagcucagguagca

SEQ ID NO: 300464 - RNA, 19 nt, Homo sapiens
caaaguaagccauguaucu

SEQ ID NO: 300465 - RNA, 19 nt, Homo sapiens
ugacagaagcguauaugaa

SEQ ID NO: 300466 - RNA, 19 nt, Homo sapiens
ucaagaaugucgcaauuac

SEQ ID NO: 300467 - RNA, 19 nt, Homo sapiens
gaacagauugccugcuuuc

SEQ ID NO: 300468 - RNA, 19 nt, Homo sapiens
aaggaauacuugacaguuu

SEQ ID NO: 300469 - RNA, 19 nt, Homo sapiens
gaaggaauacuugacaguu

SEQ ID NO: 300470 - RNA, 19 nt, Homo sapiens
caagaguguagaagaauaa

SEQ ID NO: 300471 - RNA, 19 nt, Homo sapiens
gcucagguagcacuuuaua

SEQ ID NO: 300472 - RNA, 19 nt, Homo sapiens
guaauguguucggugauuu

SEQ ID NO: 300473 - RNA, 19 nt, Homo sapiens
gaauuuggguaugaacaga

SEQ ID NO: 300474 - RNA, 19 nt, Homo sapiens
gaaggagagaugagagaaa

SEQ ID NO: 300475 - RNA, 19 nt, Homo sapiens
ccacagagaaguaaaauuu

SEQ ID NO: 300476 - RNA, 19 nt, Homo sapiens
gggaauaugcacaaacuug

SEQ ID NO: 300477 - RNA, 19 nt, Homo sapiens
gaaaggcacauaccuaacu

SEQ ID NO: 300478 - RNA, 19 nt, Homo sapiens
gaaaacacaccuuuaguga

SEQ ID NO: 300479 - RNA, 19 nt, Homo sapiens
gaugacgccuguuauagag

SEQ ID NO: 300480 - RNA, 19 nt, Homo sapiens
ucagaugacgccuguuaua

SEQ ID NO: 300481 - RNA, 19 nt, Homo sapiens
gaauucugguuacaugugu

SEQ ID NO: 300482 - RNA, 19 nt, Homo sapiens
caaagagaacuccguaugu

SEQ ID NO: 300483 - RNA, 19 nt, Homo sapiens
ccuaacugaucgaauauau

SEQ ID NO: 300484 - RNA, 19 nt, Homo sapiens
aaacuuggcuucuuuaacc

SEQ ID NO: 300485 - RNA, 19 nt, Homo sapiens
uagcuaauauugcaaugug

SEQ ID NO: 300486 - RNA, 19 nt, Homo sapiens
ccacuuaccagacuaaauc

SEQ ID NO: 300487 - RNA, 19 nt, Homo sapiens
gagaaacauguccauauau

SEQ ID NO: 300488 - RNA, 19 nt, Homo sapiens
gauagagguucuuuauugc

SEQ ID NO: 300489 - RNA, 19 nt, Homo sapiens
aaagaaacauugccuugag

SEQ ID NO: 300490 - RNA, 19 nt, Homo sapiens
caaagaaacauugccuuga

SEQ ID NO: 300491 - RNA, 19 nt, Homo sapiens
cuacaaagcaacaguuaug

SEQ ID NO: 300492 - RNA, 19 nt, Homo sapiens
acgaguagauuauaagugu

SEQ ID NO: 300493 - RNA, 19 nt, Homo sapiens
ccaccaacauuugaagcua

SEQ ID NO: 300494 - RNA, 19 nt, Homo sapiens
agauuaaugccaacucuua

SEQ ID NO: 300495 - RNA, 19 nt, Homo sapiens
uauacgggauccuuuaaau

SEQ ID NO: 300496 - RNA, 19 nt, Homo sapiens
acagaagcguauaugaauu

SEQ ID NO: 300497 - RNA, 19 nt, Homo sapiens
aaaggcagaguacaaagua

SEQ ID NO: 300498 - RNA, 19 nt, Homo sapiens
ccaaagagaacuccguaug

SEQ ID NO: 300499 - RNA, 19 nt, Homo sapiens
gcaauguggcuugaaugua

SEQ ID NO: 300500 - RNA, 19 nt, Homo sapiens
cgaguuugguuaucagaug

SEQ ID NO: 300501 - RNA, 19 nt, Homo sapiens
ggacugccacugcauuuca

SEQ ID NO: 300502 - RNA, 19 nt, Homo sapiens
gaacgaguagauuauaagu

SEQ ID NO: 300503 - RNA, 19 nt, Homo sapiens
gccaagcaguuucuuucaa

SEQ ID NO: 300504 - RNA, 19 nt, Homo sapiens
aagaaaggcacauaccuaa

SEQ ID NO: 300505 - RNA, 19 nt, Homo sapiens
gugaggagccaccaacauu

SEQ ID NO: 300506 - RNA, 19 nt, Homo sapiens
uaaauguuccuuuccuuug

SEQ ID NO: 300507 - RNA, 19 nt, Homo sapiens
uacauugccuuggcuagua

SEQ ID NO: 300508 - RNA, 19 nt, Homo sapiens
caccaacuauagaauguau

SEQ ID NO: 300509 - RNA, 19 nt, Homo sapiens
gcacagaguugaaguuuau

SEQ ID NO: 300510 - RNA, 19 nt, Homo sapiens
gaaaguggcuugaaaucuu

SEQ ID NO: 300511 - RNA, 19 nt, Homo sapiens
gcacaaacuuggcuucuuu

SEQ ID NO: 300512 - RNA, 19 nt, Homo sapiens
gcagggauaugcuguauuu

SEQ ID NO: 300513 - RNA, 19 nt, Homo sapiens
gaacaaacaggaauucuga

SEQ ID NO: 300514 - RNA, 19 nt, Homo sapiens
gcaagaugcuuuaggaaga

SEQ ID NO: 300515 - RNA, 19 nt, Homo sapiens
uaaagaaaguggcuugaaa

SEQ ID NO: 300516 - RNA, 19 nt, Homo sapiens
ggagagagcacgauuuauu

SEQ ID NO: 300517 - RNA, 19 nt, Homo sapiens
ugauagagguucuuuauug

SEQ ID NO: 300518 - RNA, 19 nt, Homo sapiens
agagaaacauguccauaua

SEQ ID NO: 300519 - RNA, 19 nt, Homo sapiens
cagaugcacuuuauuugua

SEQ ID NO: 300520 - RNA, 19 nt, Homo sapiens
cagagaggcugaauagauu

SEQ ID NO: 300521 - RNA, 19 nt, Homo sapiens
guacagauaucuucaaagg

SEQ ID NO: 300522 - RNA, 19 nt, Homo sapiens
ggacuuacgaguuugguua

SEQ ID NO: 300523 - RNA, 19 nt, Homo sapiens
ccaaagacauguuuauagu

SEQ ID NO: 300524 - RNA, 19 nt, Homo sapiens
ucagaaagcuagaaagugu

SEQ ID NO: 300525 - RNA, 19 nt, Homo sapiens
gguuaaacaugcccucuaa

SEQ ID NO: 300526 - RNA, 19 nt, Homo sapiens
aaacagauaucaggauuug

SEQ ID NO: 300527 - RNA, 19 nt, Homo sapiens
ccaagcaguuucuuucaaa

SEQ ID NO: 300528 - RNA, 19 nt, Homo sapiens
cuauggagcucauugguaa

SEQ ID NO: 300529 - RNA, 19 nt, Homo sapiens
gcagagaggcugaauagau

SEQ ID NO: 300530 - RNA, 19 nt, Homo sapiens
gaauguagguagcauccuu

SEQ ID NO: 300531 - RNA, 19 nt, Homo sapiens
caauguggcuugaauguag

SEQ ID NO: 300532 - RNA, 19 nt, Homo sapiens
aaacacaccuuuagugaag

SEQ ID NO: 300533 - RNA, 19 nt, Homo sapiens
ucaagaguguagaagaaua

SEQ ID NO: 300534 - RNA, 19 nt, Homo sapiens
gaaaacagauaucaggauu

SEQ ID NO: 300535 - RNA, 19 nt, Homo sapiens
uaaaggaucaguagcaauu

SEQ ID NO: 300536 - RNA, 19 nt, Homo sapiens
gaacuuaaaggaucaguag

SEQ ID NO: 300537 - RNA, 19 nt, Homo sapiens
gagaaucuuaguccauuua

SEQ ID NO: 300538 - RNA, 19 nt, Homo sapiens
cagcaugccugguuguauu

SEQ ID NO: 300539 - RNA, 19 nt, Homo sapiens
aaagagaacuccguauguu

SEQ ID NO: 300540 - RNA, 19 nt, Homo sapiens
aaaugggacuuacgaguuu

SEQ ID NO: 300541 - RNA, 19 nt, Homo sapiens
cagauaaccucaagucaca

SEQ ID NO: 300542 - RNA, 19 nt, Homo sapiens
guuaucagaugcacuuuau

SEQ ID NO: 300543 - RNA, 19 nt, Homo sapiens
gagcagagaggcugaauag

SEQ ID NO: 300544 - RNA, 19 nt, Homo sapiens
gagcugaauaugccacuua

SEQ ID NO: 300545 - RNA, 19 nt, Homo sapiens
guauaugucuuaccucauc

SEQ ID NO: 300546 - RNA, 19 nt, Homo sapiens
ugagauuggugaacgagua

SEQ ID NO: 300547 - RNA, 19 nt, Homo sapiens
gauaaaaguuugaggagaa

SEQ ID NO: 300548 - RNA, 19 nt, Homo sapiens
ugucuuaccucaucuccua

SEQ ID NO: 300549 - RNA, 19 nt, Homo sapiens
gugaacgaguagauuauaa

SEQ ID NO: 300550 - RNA, 19 nt, Homo sapiens
uagcucagguagcacuuua

SEQ ID NO: 300551 - RNA, 19 nt, Homo sapiens
gagagagcacgauuuauug

SEQ ID NO: 300552 - RNA, 19 nt, Homo sapiens
aaucaagaguguagaagaa

SEQ ID NO: 300553 - RNA, 19 nt, Homo sapiens
ggucauugcugugauuguu

SEQ ID NO: 300554 - RNA, 19 nt, Homo sapiens
caaaugggacuuacgaguu

SEQ ID NO: 300555 - RNA, 19 nt, Homo sapiens
gacagaagcguauaugaau

SEQ ID NO: 300556 - RNA, 19 nt, Homo sapiens
gaauuaagcacagaguuga

SEQ ID NO: 300557 - RNA, 19 nt, Homo sapiens
guaaauguuccuuuccuuu

SEQ ID NO: 300558 - RNA, 19 nt, Homo sapiens
uuacaagccuccagucuca

SEQ ID NO: 300559 - RNA, 19 nt, Homo sapiens
ccagauccauuuucacuua

SEQ ID NO: 300560 - RNA, 19 nt, Homo sapiens
aaauauagcucagguagca

SEQ ID NO: 300561 - RNA, 19 nt, Homo sapiens
caaaguaagccauguaucu

SEQ ID NO: 300562 - RNA, 19 nt, Homo sapiens
ugacagaagcguauaugaa

SEQ ID NO: 300563 - RNA, 19 nt, Homo sapiens
ucaagaaugucgcaauuac

SEQ ID NO: 300564 - RNA, 19 nt, Homo sapiens
gaacagauugccugcuuuc

SEQ ID NO: 300565 - RNA, 19 nt, Homo sapiens
gaagaaagggaaagcagau

SEQ ID NO: 300566 - RNA, 19 nt, Homo sapiens
aaggaauacuugacaguuu

SEQ ID NO: 300567 - RNA, 19 nt, Homo sapiens
gaaggaauacuugacaguu

SEQ ID NO: 300568 - RNA, 19 nt, Homo sapiens
caagaguguagaagaauaa

SEQ ID NO: 300569 - RNA, 19 nt, Homo sapiens
gcucagguagcacuuuaua

SEQ ID NO: 300570 - RNA, 19 nt, Homo sapiens
guaauguguucggugauuu

SEQ ID NO: 300571 - RNA, 19 nt, Homo sapiens
gaauuuggguaugaacaga

SEQ ID NO: 300572 - RNA, 19 nt, Homo sapiens
gggaauaugcacaaacuug

SEQ ID NO: 300573 - RNA, 19 nt, Homo sapiens
gaaaacacaccuuuaguga

SEQ ID NO: 300574 - RNA, 19 nt, Homo sapiens
gaugacgccuguuauagag

SEQ ID NO: 300575 - RNA, 19 nt, Homo sapiens
ucagaugacgccuguuaua

SEQ ID NO: 300576 - RNA, 19 nt, Homo sapiens
gaauucugguuacaugugu

SEQ ID NO: 300577 - RNA, 19 nt, Homo sapiens
caaagagaacuccguaugu

SEQ ID NO: 300578 - RNA, 19 nt, Homo sapiens
ccuaacugaucgaauauau

SEQ ID NO: 300579 - RNA, 19 nt, Homo sapiens
aaacuuggcuucuuuaacc

SEQ ID NO: 300580 - RNA, 19 nt, Homo sapiens
uagcuaauauugcaaugug

SEQ ID NO: 300581 - RNA, 19 nt, Homo sapiens
ccacuuaccagacuaaauc

SEQ ID NO: 300582 - RNA, 19 nt, Homo sapiens
gagaaacauguccauauau

SEQ ID NO: 300583 - RNA, 19 nt, Homo sapiens
gauagagguucuuuauugc

SEQ ID NO: 300584 - RNA, 19 nt, Homo sapiens
aaagaaacauugccuugag

SEQ ID NO: 300585 - RNA, 19 nt, Homo sapiens
caaagaaacauugccuuga

SEQ ID NO: 300586 - RNA, 19 nt, Homo sapiens
cuacaaagcaacaguuaug

SEQ ID NO: 300587 - RNA, 19 nt, Homo sapiens
acgaguagauuauaagugu

SEQ ID NO: 300588 - RNA, 19 nt, Homo sapiens
agauuaaugccaacucuua

SEQ ID NO: 300589 - RNA, 19 nt, Homo sapiens
ccaccaacauuugaagcua

SEQ ID NO: 300590 - RNA, 19 nt, Homo sapiens
uauacgggauccuuuaaau

SEQ ID NO: 300591 - RNA, 19 nt, Homo sapiens
acagaagcguauaugaauu

SEQ ID NO: 300592 - RNA, 19 nt, Homo sapiens
aaaggcagaguacaaagua

SEQ ID NO: 300593 - RNA, 19 nt, Homo sapiens
ccaaagagaacuccguaug

SEQ ID NO: 300594 - RNA, 19 nt, Homo sapiens
gcaauguggcuugaaugua

SEQ ID NO: 300595 - RNA, 19 nt, Homo sapiens
cgaguuugguuaucagaug

SEQ ID NO: 300596 - RNA, 19 nt, Homo sapiens
ggacugccacugcauuuca

SEQ ID NO: 300597 - RNA, 19 nt, Homo sapiens
gccaagcaguuucuuucaa

SEQ ID NO: 300598 - RNA, 19 nt, Homo sapiens
gaacgaguagauuauaagu

SEQ ID NO: 300599 - RNA, 19 nt, Homo sapiens
uaaauguuccuuuccuuug

SEQ ID NO: 300600 - RNA, 19 nt, Homo sapiens
uacauugccuuggcuagua

SEQ ID NO: 300601 - RNA, 19 nt, Homo sapiens
caccaacuauagaauguau

SEQ ID NO: 300602 - RNA, 19 nt, Homo sapiens
guagguagcauccuuugau

SEQ ID NO: 300603 - RNA, 19 nt, Homo sapiens
gauggcagcgacacaauug

SEQ ID NO: 300604 - RNA, 19 nt, Homo sapiens
gugaggagccaccaacauu

SEQ ID NO: 300605 - RNA, 19 nt, Homo sapiens
gaggagccaccaacauuug

SEQ ID NO: 300606 - RNA, 19 nt, Homo sapiens
gcuauggagcucauuggua

SEQ ID NO: 300607 - RNA, 19 nt, Homo sapiens
acacaccuuuagugaagua

SEQ ID NO: 300608 - RNA, 19 nt, Homo sapiens
ucucagaugacgccuguua

SEQ ID NO: 300609 - RNA, 19 nt, Homo sapiens
gcacauaccuaacugauga

SEQ ID NO: 300610 - RNA, 19 nt, Homo sapiens
gcacagaguugaaguuuau

SEQ ID NO: 300611 - RNA, 19 nt, Homo sapiens
gaaaguggcuugaaaucuu

SEQ ID NO: 300612 - RNA, 19 nt, Homo sapiens
gcacaaacuuggcuucuuu

SEQ ID NO: 300613 - RNA, 19 nt, Homo sapiens
gcagggauaugcuguauuu

SEQ ID NO: 300614 - RNA, 19 nt, Homo sapiens
gaacaaacaggaauucuga

SEQ ID NO: 300615 - RNA, 19 nt, Homo sapiens
gcaagaugcuuuaggaaga

SEQ ID NO: 300616 - RNA, 19 nt, Homo sapiens
uaaagaaaguggcuugaaa

SEQ ID NO: 300617 - RNA, 19 nt, Homo sapiens
ggagagagcacgauuuauu

SEQ ID NO: 300618 - RNA, 19 nt, Homo sapiens
ugauagagguucuuuauug

SEQ ID NO: 300619 - RNA, 19 nt, Homo sapiens
agagaaacauguccauaua

SEQ ID NO: 300620 - RNA, 19 nt, Homo sapiens
gaagaaaggcacauaccua

SEQ ID NO: 300621 - RNA, 19 nt, Homo sapiens
cagaugcacuuuauuugua

SEQ ID NO: 300622 - RNA, 19 nt, Homo sapiens
cagagaggcugaauagauu

SEQ ID NO: 300623 - RNA, 19 nt, Homo sapiens
guacagauaucuucaaagg

SEQ ID NO: 300624 - RNA, 19 nt, Homo sapiens
ggacuuacgaguuugguua

SEQ ID NO: 300625 - RNA, 19 nt, Homo sapiens
ccaaagacauguuuauagu

SEQ ID NO: 300626 - RNA, 19 nt, Homo sapiens
ucagaaagcuagaaagugu

SEQ ID NO: 300627 - RNA, 19 nt, Homo sapiens
gguuaaacaugcccucuaa

SEQ ID NO: 300628 - RNA, 19 nt, Homo sapiens
aaacagauaucaggauuug

SEQ ID NO: 300629 - RNA, 19 nt, Homo sapiens
ccaagcaguuucuuucaaa

SEQ ID NO: 300630 - RNA, 19 nt, Homo sapiens
cuauggagcucauugguaa

SEQ ID NO: 300631 - RNA, 19 nt, Homo sapiens
gcagagaggcugaauagau

SEQ ID NO: 300632 - RNA, 19 nt, Homo sapiens
gaauguagguagcauccuu

SEQ ID NO: 300633 - RNA, 19 nt, Homo sapiens
caauguggcuugaauguag

SEQ ID NO: 300634 - RNA, 19 nt, Homo sapiens
aaacacaccuuuagugaag

SEQ ID NO: 300635 - RNA, 19 nt, Homo sapiens
ucaagaguguagaagaaua

SEQ ID NO: 300636 - RNA, 19 nt, Homo sapiens
gaaaacagauaucaggauu

SEQ ID NO: 300637 - RNA, 19 nt, Homo sapiens
uaaaggaucaguagcaauu

SEQ ID NO: 300638 - RNA, 19 nt, Homo sapiens
gaacuuaaaggaucaguag

SEQ ID NO: 300639 - RNA, 19 nt, Homo sapiens
gagaaucuuaguccauuua

SEQ ID NO: 300640 - RNA, 19 nt, Homo sapiens
cagcaugccugguuguauu

SEQ ID NO: 300641 - RNA, 19 nt, Homo sapiens
aaagagaacuccguauguu

SEQ ID NO: 300642 - RNA, 19 nt, Homo sapiens
aaaugggacuuacgaguuu

SEQ ID NO: 300643 - RNA, 19 nt, Homo sapiens
cagauaaccucaagucaca

SEQ ID NO: 300644 - RNA, 19 nt, Homo sapiens
guuaucagaugcacuuuau

SEQ ID NO: 300645 - RNA, 19 nt, Homo sapiens
gagcagagaggcugaauag

SEQ ID NO: 300646 - RNA, 19 nt, Homo sapiens
gagcugaauaugccacuua

SEQ ID NO: 300647 - RNA, 19 nt, Homo sapiens
guauaugucuuaccucauc

SEQ ID NO: 300648 - RNA, 19 nt, Homo sapiens
ugagauuggugaacgagua

SEQ ID NO: 300649 - RNA, 19 nt, Homo sapiens
gauaaaaguuugaggagaa

SEQ ID NO: 300650 - RNA, 19 nt, Homo sapiens
ugucuuaccucaucuccua

SEQ ID NO: 300651 - RNA, 19 nt, Homo sapiens
gugaacgaguagauuauaa

SEQ ID NO: 300652 - RNA, 19 nt, Homo sapiens
uagcucagguagcacuuua

SEQ ID NO: 300653 - RNA, 19 nt, Homo sapiens
ggaagaagaaaggcacaua

SEQ ID NO: 300654 - RNA, 19 nt, Homo sapiens
gagagagcacgauuuauug

SEQ ID NO: 300655 - RNA, 19 nt, Homo sapiens
aaucaagaguguagaagaa

SEQ ID NO: 300656 - RNA, 19 nt, Homo sapiens
ggucauugcugugauuguu

SEQ ID NO: 300657 - RNA, 19 nt, Homo sapiens
caaaugggacuuacgaguu

SEQ ID NO: 300658 - RNA, 19 nt, Homo sapiens
gacagaagcguauaugaau

SEQ ID NO: 300659 - RNA, 19 nt, Homo sapiens
gaauuaagcacagaguuga

SEQ ID NO: 300660 - RNA, 19 nt, Homo sapiens
guaaauguuccuuuccuuu

SEQ ID NO: 300661 - RNA, 19 nt, Homo sapiens
ccagauccauuuucacuua

SEQ ID NO: 300662 - RNA, 19 nt, Homo sapiens
aaauauagcucagguagca

SEQ ID NO: 300663 - RNA, 19 nt, Homo sapiens
caaaguaagccauguaucu

SEQ ID NO: 300664 - RNA, 19 nt, Homo sapiens
ugacagaagcguauaugaa

SEQ ID NO: 300665 - RNA, 19 nt, Homo sapiens
ucaagaaugucgcaauuac

SEQ ID NO: 300666 - RNA, 19 nt, Homo sapiens
gaacagauugccugcuuuc

SEQ ID NO: 300667 - RNA, 19 nt, Homo sapiens
aaggaauacuugacaguuu

SEQ ID NO: 300668 - RNA, 19 nt, Homo sapiens
gaaggaauacuugacaguu

SEQ ID NO: 300669 - RNA, 19 nt, Homo sapiens
caagaguguagaagaauaa

SEQ ID NO: 300670 - RNA, 19 nt, Homo sapiens
gcucagguagcacuuuaua

SEQ ID NO: 300671 - RNA, 19 nt, Homo sapiens
guaauguguucggugauuu

SEQ ID NO: 300672 - RNA, 19 nt, Homo sapiens
gaauuuggguaugaacaga

SEQ ID NO: 300673 - RNA, 19 nt, Homo sapiens
gaaggagagaugagagaaa

SEQ ID NO: 300674 - RNA, 19 nt, Homo sapiens
ccacagagaaguaaaauuu

SEQ ID NO: 300675 - RNA, 19 nt, Homo sapiens
gggaauaugcacaaacuug

SEQ ID NO: 300676 - RNA, 19 nt, Homo sapiens
gaaaggcacauaccuaacu

SEQ ID NO: 300677 - RNA, 19 nt, Homo sapiens
gaaaacacaccuuuaguga

SEQ ID NO: 300678 - RNA, 19 nt, Homo sapiens
gaugacgccuguuauagag

SEQ ID NO: 300679 - RNA, 19 nt, Homo sapiens
ucagaugacgccuguuaua

SEQ ID NO: 300680 - RNA, 19 nt, Homo sapiens
gaauucugguuacaugugu

SEQ ID NO: 300681 - RNA, 19 nt, Homo sapiens
caaagagaacuccguaugu

SEQ ID NO: 300682 - RNA, 19 nt, Homo sapiens
ccuaacugaucgaauauau

SEQ ID NO: 300683 - RNA, 19 nt, Homo sapiens
aaacuuggcuucuuuaacc

SEQ ID NO: 300684 - RNA, 19 nt, Homo sapiens
uagcuaauauugcaaugug

SEQ ID NO: 300685 - RNA, 19 nt, Homo sapiens
ccacuuaccagacuaaauc

SEQ ID NO: 300686 - RNA, 19 nt, Homo sapiens
gagaaacauguccauauau

SEQ ID NO: 300687 - RNA, 19 nt, Homo sapiens
gauagagguucuuuauugc

SEQ ID NO: 300688 - RNA, 19 nt, Homo sapiens
aaagaaacauugccuugag

SEQ ID NO: 300689 - RNA, 19 nt, Homo sapiens
caaagaaacauugccuuga

SEQ ID NO: 300690 - RNA, 19 nt, Homo sapiens
guacaaaaccuccagcuuu

SEQ ID NO: 300691 - RNA, 19 nt, Homo sapiens
cuacaaagcaacaguuaug

SEQ ID NO: 300692 - RNA, 19 nt, Homo sapiens
acgaguagauuauaagugu

SEQ ID NO: 300693 - RNA, 19 nt, Homo sapiens
agauuaaugccaacucuua

SEQ ID NO: 300694 - RNA, 19 nt, Homo sapiens
ccaccaacauuugaagcua

SEQ ID NO: 300695 - RNA, 19 nt, Homo sapiens
uauacgggauccuuuaaau

SEQ ID NO: 300696 - RNA, 19 nt, Homo sapiens
acagaagcguauaugaauu

SEQ ID NO: 300697 - RNA, 19 nt, Homo sapiens
aaaggcagaguacaaagua

SEQ ID NO: 300698 - RNA, 19 nt, Homo sapiens
ccaaagagaacuccguaug

SEQ ID NO: 300699 - RNA, 19 nt, Homo sapiens
gcaauguggcuugaaugua

SEQ ID NO: 300700 - RNA, 19 nt, Homo sapiens
cgaguuugguuaucagaug

SEQ ID NO: 300701 - RNA, 19 nt, Homo sapiens
ggacugccacugcauuuca

SEQ ID NO: 300702 - RNA, 19 nt, Homo sapiens
gaacgaguagauuauaagu

SEQ ID NO: 300703 - RNA, 19 nt, Homo sapiens
gccaagcaguuucuuucaa

SEQ ID NO: 300704 - RNA, 19 nt, Homo sapiens
aagaaaggcacauaccuaa

SEQ ID NO: 300705 - RNA, 19 nt, Homo sapiens
gugaggagccaccaacauu

SEQ ID NO: 300706 - RNA, 19 nt, Homo sapiens
uaaauguuccuuuccuuug

SEQ ID NO: 300707 - RNA, 19 nt, Homo sapiens
uacauugccuuggcuagua

SEQ ID NO: 300708 - RNA, 19 nt, Homo sapiens
caccaacuauagaauguau

SEQ ID NO: 300709 - RNA, 19 nt, Homo sapiens
gcacauaccuaacugauga

SEQ ID NO: 300710 - RNA, 19 nt, Homo sapiens
gcacagaguugaaguuuau

SEQ ID NO: 300711 - RNA, 19 nt, Homo sapiens
gaaaguggcuugaaaucuu

SEQ ID NO: 300712 - RNA, 19 nt, Homo sapiens
gcacaaacuuggcuucuuu

SEQ ID NO: 300713 - RNA, 19 nt, Homo sapiens
gcagggauaugcuguauuu

SEQ ID NO: 300714 - RNA, 19 nt, Homo sapiens
gaacaaacaggaauucuga

SEQ ID NO: 300715 - RNA, 19 nt, Homo sapiens
gcaagaugcuuuaggaaga

SEQ ID NO: 300716 - RNA, 19 nt, Homo sapiens
uaaagaaaguggcuugaaa

SEQ ID NO: 300717 - RNA, 19 nt, Homo sapiens
ggagagagcacgauuuauu

SEQ ID NO: 300718 - RNA, 19 nt, Homo sapiens
ugauagagguucuuuauug

SEQ ID NO: 300719 - RNA, 19 nt, Homo sapiens
agagaaacauguccauaua

SEQ ID NO: 300720 - RNA, 19 nt, Homo sapiens
gaagaaaggcacauaccua

SEQ ID NO: 300721 - RNA, 19 nt, Homo sapiens
cagaugcacuuuauuugua

SEQ ID NO: 300722 - RNA, 19 nt, Homo sapiens
cagagaggcugaauagauu

SEQ ID NO: 300723 - RNA, 19 nt, Homo sapiens
guacagauaucuucaaagg

SEQ ID NO: 300724 - RNA, 19 nt, Homo sapiens
ggacuuacgaguuugguua

SEQ ID NO: 300725 - RNA, 19 nt, Homo sapiens
ccaaagacauguuuauagu

SEQ ID NO: 300726 - RNA, 19 nt, Homo sapiens
ucagaaagcuagaaagugu

SEQ ID NO: 300727 - RNA, 19 nt, Homo sapiens
gguuaaacaugcccucuaa

SEQ ID NO: 300728 - RNA, 19 nt, Homo sapiens
aaacagauaucaggauuug

SEQ ID NO: 300729 - RNA, 19 nt, Homo sapiens
ccaagcaguuucuuucaaa

SEQ ID NO: 300730 - RNA, 19 nt, Homo sapiens
cuauggagcucauugguaa

SEQ ID NO: 300731 - RNA, 19 nt, Homo sapiens
gcagagaggcugaauagau

SEQ ID NO: 300732 - RNA, 19 nt, Homo sapiens
gaauguagguagcauccuu

SEQ ID NO: 300733 - RNA, 19 nt, Homo sapiens
caauguggcuugaauguag

SEQ ID NO: 300734 - RNA, 19 nt, Homo sapiens
aaacacaccuuuagugaag

SEQ ID NO: 300735 - RNA, 19 nt, Homo sapiens
ucaagaguguagaagaaua

SEQ ID NO: 300736 - RNA, 19 nt, Homo sapiens
gaaaacagauaucaggauu

SEQ ID NO: 300737 - RNA, 19 nt, Homo sapiens
uaaaggaucaguagcaauu

SEQ ID NO: 300738 - RNA, 19 nt, Homo sapiens
gaacuuaaaggaucaguag

SEQ ID NO: 300739 - RNA, 19 nt, Homo sapiens
gagaaucuuaguccauuua

SEQ ID NO: 300740 - RNA, 19 nt, Homo sapiens
cagcaugccugguuguauu

SEQ ID NO: 300741 - RNA, 19 nt, Homo sapiens
aaagagaacuccguauguu

SEQ ID NO: 300742 - RNA, 19 nt, Homo sapiens
aaaugggacuuacgaguuu

SEQ ID NO: 300743 - RNA, 19 nt, Homo sapiens
cagauaaccucaagucaca

SEQ ID NO: 300744 - RNA, 19 nt, Homo sapiens
guuaucagaugcacuuuau

SEQ ID NO: 300745 - RNA, 19 nt, Homo sapiens
gagcagagaggcugaauag

SEQ ID NO: 300746 - RNA, 19 nt, Homo sapiens
gagcugaauaugccacuua

SEQ ID NO: 300747 - RNA, 19 nt, Homo sapiens
guauaugucuuaccucauc

SEQ ID NO: 300748 - RNA, 19 nt, Homo sapiens
ugagauuggugaacgagua

SEQ ID NO: 300749 - RNA, 19 nt, Homo sapiens
gauaaaaguuugaggagaa

SEQ ID NO: 300750 - RNA, 19 nt, Homo sapiens
ugucuuaccucaucuccua

SEQ ID NO: 300751 - RNA, 19 nt, Homo sapiens
gugaacgaguagauuauaa

SEQ ID NO: 300752 - RNA, 19 nt, Homo sapiens
uagcucagguagcacuuua

SEQ ID NO: 300753 - RNA, 19 nt, Homo sapiens
ggaagaagaaaggcacaua

SEQ ID NO: 300754 - RNA, 19 nt, Homo sapiens
gagagagcacgauuuauug

SEQ ID NO: 300755 - RNA, 19 nt, Homo sapiens
aaucaagaguguagaagaa

SEQ ID NO: 300756 - RNA, 19 nt, Homo sapiens
ggucauugcugugauuguu

SEQ ID NO: 300757 - RNA, 19 nt, Homo sapiens
caaaugggacuuacgaguu

SEQ ID NO: 300758 - RNA, 19 nt, Homo sapiens
gacagaagcguauaugaau

SEQ ID NO: 300759 - RNA, 19 nt, Homo sapiens
gaauuaagcacagaguuga

SEQ ID NO: 300760 - RNA, 19 nt, Homo sapiens
guaaauguuccuuuccuuu

SEQ ID NO: 300761 - RNA, 19 nt, Homo sapiens
ccagauccauuuucacuua

SEQ ID NO: 300762 - RNA, 19 nt, Homo sapiens
aaauauagcucagguagca

SEQ ID NO: 300763 - RNA, 19 nt, Homo sapiens
caaaguaagccauguaucu

SEQ ID NO: 300764 - RNA, 19 nt, Homo sapiens
ugacagaagcguauaugaa

SEQ ID NO: 300765 - RNA, 19 nt, Homo sapiens
ucaagaaugucgcaauuac

SEQ ID NO: 300766 - RNA, 19 nt, Homo sapiens
gaacagauugccugcuuuc

SEQ ID NO: 300767 - RNA, 19 nt, Homo sapiens
aaggaauacuugacaguuu

SEQ ID NO: 300768 - RNA, 19 nt, Homo sapiens
gaaggaauacuugacaguu

SEQ ID NO: 300769 - RNA, 19 nt, Homo sapiens
caagaguguagaagaauaa

SEQ ID NO: 300770 - RNA, 19 nt, Homo sapiens
gcucagguagcacuuuaua

SEQ ID NO: 300771 - RNA, 19 nt, Homo sapiens
guaauguguucggugauuu

SEQ ID NO: 300772 - RNA, 19 nt, Homo sapiens
gaauuuggguaugaacaga

SEQ ID NO: 300773 - RNA, 19 nt, Homo sapiens
gaaggagagaugagagaaa

SEQ ID NO: 300774 - RNA, 19 nt, Homo sapiens
ccacagagaaguaaaauuu

SEQ ID NO: 300775 - RNA, 19 nt, Homo sapiens
gggaauaugcacaaacuug

SEQ ID NO: 300776 - RNA, 19 nt, Homo sapiens
gaaaggcacauaccuaacu

SEQ ID NO: 300777 - RNA, 19 nt, Homo sapiens
gaaaacacaccuuuaguga

SEQ ID NO: 300778 - RNA, 19 nt, Homo sapiens
gaugacgccuguuauagag

SEQ ID NO: 300779 - RNA, 19 nt, Homo sapiens
ucagaugacgccuguuaua

SEQ ID NO: 300780 - RNA, 19 nt, Homo sapiens
gaauucugguuacaugugu

SEQ ID NO: 300781 - RNA, 19 nt, Homo sapiens
caaagagaacuccguaugu

SEQ ID NO: 300782 - RNA, 19 nt, Homo sapiens
ccuaacugaucgaauauau

SEQ ID NO: 300783 - RNA, 19 nt, Homo sapiens
aaacuuggcuucuuuaacc

SEQ ID NO: 300784 - RNA, 19 nt, Homo sapiens
uagcuaauauugcaaugug

SEQ ID NO: 300785 - RNA, 19 nt, Homo sapiens
ccacuuaccagacuaaauc

SEQ ID NO: 300786 - RNA, 19 nt, Homo sapiens
gagaaacauguccauauau

SEQ ID NO: 300787 - RNA, 19 nt, Homo sapiens
gauagagguucuuuauugc

SEQ ID NO: 300788 - RNA, 19 nt, Homo sapiens
aaagaaacauugccuugag

SEQ ID NO: 300789 - RNA, 19 nt, Homo sapiens
caaagaaacauugccuuga

SEQ ID NO: 300790 - RNA, 19 nt, Homo sapiens
cuacaaagcaacaguuaug

SEQ ID NO: 300791 - RNA, 19 nt, Homo sapiens
acgaguagauuauaagugu

SEQ ID NO: 300792 - RNA, 19 nt, Homo sapiens
agauuaaugccaacucuua

SEQ ID NO: 300793 - RNA, 19 nt, Homo sapiens
ccaccaacauuugaagcua

SEQ ID NO: 300794 - RNA, 19 nt, Homo sapiens
uauacgggauccuuuaaau

SEQ ID NO: 300795 - RNA, 19 nt, Homo sapiens
acagaagcguauaugaauu

SEQ ID NO: 300796 - RNA, 19 nt, Homo sapiens
aaaggcagaguacaaagua

SEQ ID NO: 300797 - RNA, 19 nt, Homo sapiens
ccaaagagaacuccguaug

SEQ ID NO: 300798 - RNA, 19 nt, Homo sapiens
gcaauguggcuugaaugua

SEQ ID NO: 300799 - RNA, 19 nt, Homo sapiens
cgaguuugguuaucagaug

SEQ ID NO: 300800 - RNA, 19 nt, Homo sapiens
ggacugccacugcauuuca

SEQ ID NO: 300801 - RNA, 19 nt, Homo sapiens
gccaagcaguuucuuucaa

SEQ ID NO: 300802 - RNA, 19 nt, Homo sapiens
gaacgaguagauuauaagu

SEQ ID NO: 300803 - RNA, 19 nt, Homo sapiens
aagaaaggcacauaccuaa

SEQ ID NO: 300804 - RNA, 19 nt, Homo sapiens
gugaggagccaccaacauu

SEQ ID NO: 300805 - RNA, 19 nt, Homo sapiens
uaaauguuccuuuccuuug

SEQ ID NO: 300806 - RNA, 19 nt, Homo sapiens
uacauugccuuggcuagua

SEQ ID NO: 300807 - RNA, 19 nt, Homo sapiens
caccaacuauagaauguau

SEQ ID NO: 300808 - RNA, 19 nt, Homo sapiens
guagguagcauccuuugau

SEQ ID NO: 300809 - RNA, 19 nt, Homo sapiens
gcacagaguugaaguuuau

SEQ ID NO: 300810 - RNA, 19 nt, Homo sapiens
gaaaguggcuugaaaucuu

SEQ ID NO: 300811 - RNA, 19 nt, Homo sapiens
gcacaaacuuggcuucuuu

SEQ ID NO: 300812 - RNA, 19 nt, Homo sapiens
gcagggauaugcuguauuu

SEQ ID NO: 300813 - RNA, 19 nt, Homo sapiens
gaacaaacaggaauucuga

SEQ ID NO: 300814 - RNA, 19 nt, Homo sapiens
gcaagaugcuuuaggaaga

SEQ ID NO: 300815 - RNA, 19 nt, Homo sapiens
uaaagaaaguggcuugaaa

SEQ ID NO: 300816 - RNA, 19 nt, Homo sapiens
ggagagagcacgauuuauu

SEQ ID NO: 300817 - RNA, 19 nt, Homo sapiens
ugauagagguucuuuauug

SEQ ID NO: 300818 - RNA, 19 nt, Homo sapiens
agagaaacauguccauaua

SEQ ID NO: 300819 - RNA, 19 nt, Homo sapiens
cagaugcacuuuauuugua

SEQ ID NO: 300820 - RNA, 19 nt, Homo sapiens
cagagaggcugaauagauu

SEQ ID NO: 300821 - RNA, 19 nt, Homo sapiens
guacagauaucuucaaagg

SEQ ID NO: 300822 - RNA, 19 nt, Homo sapiens
ggacuuacgaguuugguua

SEQ ID NO: 300823 - RNA, 19 nt, Homo sapiens
ccaaagacauguuuauagu

SEQ ID NO: 300824 - RNA, 19 nt, Homo sapiens
ucagaaagcuagaaagugu

SEQ ID NO: 300825 - RNA, 19 nt, Homo sapiens
gguuaaacaugcccucuaa

SEQ ID NO: 300826 - RNA, 19 nt, Homo sapiens
aaacagauaucaggauuug

SEQ ID NO: 300827 - RNA, 19 nt, Homo sapiens
ccaagcaguuucuuucaaa

SEQ ID NO: 300828 - RNA, 19 nt, Homo sapiens
cuauggagcucauugguaa

SEQ ID NO: 300829 - RNA, 19 nt, Homo sapiens
gcagagaggcugaauagau

SEQ ID NO: 300830 - RNA, 19 nt, Homo sapiens
gaauguagguagcauccuu

SEQ ID NO: 300831 - RNA, 19 nt, Homo sapiens
caauguggcuugaauguag

SEQ ID NO: 300832 - RNA, 19 nt, Homo sapiens
aaacacaccuuuagugaag

SEQ ID NO: 300833 - RNA, 19 nt, Homo sapiens
ucaagaguguagaagaaua

SEQ ID NO: 300834 - RNA, 19 nt, Homo sapiens
gaaaacagauaucaggauu

SEQ ID NO: 300835 - RNA, 19 nt, Homo sapiens
uaaaggaucaguagcaauu

SEQ ID NO: 300836 - RNA, 19 nt, Homo sapiens
gaacuuaaaggaucaguag

SEQ ID NO: 300837 - RNA, 19 nt, Homo sapiens
gagaaucuuaguccauuua

SEQ ID NO: 300838 - RNA, 19 nt, Homo sapiens
cagcaugccugguuguauu

SEQ ID NO: 300839 - RNA, 19 nt, Homo sapiens
aaagagaacuccguauguu

SEQ ID NO: 300840 - RNA, 19 nt, Homo sapiens
aaaugggacuuacgaguuu

SEQ ID NO: 300841 - RNA, 19 nt, Homo sapiens
cagauaaccucaagucaca

SEQ ID NO: 300842 - RNA, 19 nt, Homo sapiens
guuaucagaugcacuuuau

SEQ ID NO: 300843 - RNA, 19 nt, Homo sapiens
gagcagagaggcugaauag

SEQ ID NO: 300844 - RNA, 19 nt, Homo sapiens
gagcugaauaugccacuua

SEQ ID NO: 300845 - RNA, 19 nt, Homo sapiens
guauaugucuuaccucauc

SEQ ID NO: 300846 - RNA, 19 nt, Homo sapiens
ugagauuggugaacgagua

SEQ ID NO: 300847 - RNA, 19 nt, Homo sapiens
gauaaaaguuugaggagaa

SEQ ID NO: 300848 - RNA, 19 nt, Homo sapiens
ugucuuaccucaucuccua

SEQ ID NO: 300849 - RNA, 19 nt, Homo sapiens
gugaacgaguagauuauaa

SEQ ID NO: 300850 - RNA, 19 nt, Homo sapiens
uagcucagguagcacuuua

SEQ ID NO: 300851 - RNA, 19 nt, Homo sapiens
gagagagcacgauuuauug

SEQ ID NO: 300852 - RNA, 19 nt, Homo sapiens
aaucaagaguguagaagaa

SEQ ID NO: 300853 - RNA, 19 nt, Homo sapiens
ggucauugcugugauuguu

SEQ ID NO: 300854 - RNA, 19 nt, Homo sapiens
caaaugggacuuacgaguu

SEQ ID NO: 300855 - RNA, 19 nt, Homo sapiens
gacagaagcguauaugaau

SEQ ID NO: 300856 - RNA, 19 nt, Homo sapiens
gaauuaagcacagaguuga

SEQ ID NO: 300857 - RNA, 19 nt, Homo sapiens
guaaauguuccuuuccuuu

SEQ ID NO: 300858 - RNA, 19 nt, Homo sapiens
ccagauccauuuucacuua

SEQ ID NO: 300859 - RNA, 19 nt, Homo sapiens
aaauauagcucagguagca

SEQ ID NO: 300860 - RNA, 19 nt, Homo sapiens
caaaguaagccauguaucu

SEQ ID NO: 300861 - RNA, 19 nt, Homo sapiens
ugacagaagcguauaugaa

SEQ ID NO: 300862 - RNA, 19 nt, Homo sapiens
ucaagaaugucgcaauuac

SEQ ID NO: 300863 - RNA, 19 nt, Homo sapiens
gaacagauugccugcuuuc

SEQ ID NO: 300864 - RNA, 19 nt, Homo sapiens
gaagaaagggaaagcagau

SEQ ID NO: 300865 - RNA, 19 nt, Homo sapiens
aaggaauacuugacaguuu

SEQ ID NO: 300866 - RNA, 19 nt, Homo sapiens
gaaggaauacuugacaguu

SEQ ID NO: 300867 - RNA, 19 nt, Homo sapiens
caagaguguagaagaauaa

SEQ ID NO: 300868 - RNA, 19 nt, Homo sapiens
gcucagguagcacuuuaua

SEQ ID NO: 300869 - RNA, 19 nt, Homo sapiens
guaauguguucggugauuu

SEQ ID NO: 300870 - RNA, 19 nt, Homo sapiens
gaauuuggguaugaacaga

SEQ ID NO: 300871 - RNA, 19 nt, Homo sapiens
gggaauaugcacaaacuug

SEQ ID NO: 300872 - RNA, 19 nt, Homo sapiens
gaaaacacaccuuuaguga

SEQ ID NO: 300873 - RNA, 19 nt, Homo sapiens
gaugacgccuguuauagag

SEQ ID NO: 300874 - RNA, 19 nt, Homo sapiens
ucagaugacgccuguuaua

SEQ ID NO: 300875 - RNA, 19 nt, Homo sapiens
gaauucugguuacaugugu

SEQ ID NO: 300876 - RNA, 19 nt, Homo sapiens
caaagagaacuccguaugu

SEQ ID NO: 300877 - RNA, 19 nt, Homo sapiens
ccuaacugaucgaauauau

SEQ ID NO: 300878 - RNA, 19 nt, Homo sapiens
aaacuuggcuucuuuaacc

SEQ ID NO: 300879 - RNA, 19 nt, Homo sapiens
uagcuaauauugcaaugug

SEQ ID NO: 300880 - RNA, 19 nt, Homo sapiens
ccacuuaccagacuaaauc

SEQ ID NO: 300881 - RNA, 19 nt, Homo sapiens
gagaaacauguccauauau

SEQ ID NO: 300882 - RNA, 19 nt, Homo sapiens
gauagagguucuuuauugc

SEQ ID NO: 300883 - RNA, 19 nt, Homo sapiens
aaagaaacauugccuugag

SEQ ID NO: 300884 - RNA, 19 nt, Homo sapiens
caaagaaacauugccuuga

SEQ ID NO: 300885 - RNA, 19 nt, Homo sapiens
cuacaaagcaacaguuaug

SEQ ID NO: 300886 - RNA, 19 nt, Homo sapiens
acgaguagauuauaagugu

SEQ ID NO: 300887 - RNA, 19 nt, Homo sapiens
agauuaaugccaacucuua

SEQ ID NO: 300888 - RNA, 19 nt, Homo sapiens
ccaccaacauuugaagcua

SEQ ID NO: 300889 - RNA, 19 nt, Homo sapiens
uauacgggauccuuuaaau

SEQ ID NO: 300890 - RNA, 19 nt, Homo sapiens
acagaagcguauaugaauu

SEQ ID NO: 300891 - RNA, 19 nt, Homo sapiens
aaaggcagaguacaaagua

SEQ ID NO: 300892 - RNA, 19 nt, Homo sapiens
ccaaagagaacuccguaug

SEQ ID NO: 300893 - RNA, 19 nt, Homo sapiens
gcaauguggcuugaaugua

SEQ ID NO: 300894 - RNA, 19 nt, Homo sapiens
cgaguuugguuaucagaug

SEQ ID NO: 300895 - RNA, 19 nt, Homo sapiens
ggacugccacugcauuuca

SEQ ID NO: 300896 - RNA, 19 nt, Homo sapiens
gccaagcaguuucuuucaa

SEQ ID NO: 300897 - RNA, 19 nt, Homo sapiens
gaacgaguagauuauaagu

SEQ ID NO: 300898 - RNA, 19 nt, Homo sapiens
uaaauguuccuuuccuuug

SEQ ID NO: 300899 - RNA, 19 nt, Homo sapiens
gugaggagccaccaacauu

SEQ ID NO: 300900 - RNA, 19 nt, Homo sapiens
uacauugccuuggcuagua

SEQ ID NO: 300901 - RNA, 19 nt, Homo sapiens
caccaacuauagaauguau

SEQ ID NO: 300902 - RNA, 19 nt, Homo sapiens
guagguagcauccuuugau

SEQ ID NO: 300903 - RNA, 19 nt, Homo sapiens
gauggcagcgacacaauug

SEQ ID NO: 300904 - RNA, 19 nt, Homo sapiens
gaggagccaccaacauuug

SEQ ID NO: 300905 - RNA, 19 nt, Homo sapiens
gcuauggagcucauuggua

SEQ ID NO: 300906 - RNA, 19 nt, Homo sapiens
acacaccuuuagugaagua

SEQ ID NO: 300907 - RNA, 19 nt, Homo sapiens
ucucagaugacgccuguua

SEQ ID NO: 300908 - RNA, 19 nt, Homo sapiens
ggaaguuuguuuaaaugac

SEQ ID NO: 300909 - RNA, 19 nt, Homo sapiens
gcacauaccuaacugauga

SEQ ID NO: 300910 - RNA, 19 nt, Homo sapiens
gcacagaguugaaguuuau

SEQ ID NO: 300911 - RNA, 19 nt, Homo sapiens
gaaaguggcuugaaaucuu

SEQ ID NO: 300912 - RNA, 19 nt, Homo sapiens
gcacaaacuuggcuucuuu

SEQ ID NO: 300913 - RNA, 19 nt, Homo sapiens
gcagggauaugcuguauuu

SEQ ID NO: 300914 - RNA, 19 nt, Homo sapiens
caaagugucuuaaaggaua

SEQ ID NO: 300915 - RNA, 19 nt, Homo sapiens
gaacaaacaggaauucuga

SEQ ID NO: 300916 - RNA, 19 nt, Homo sapiens
gcaagaugcuuuaggaaga

SEQ ID NO: 300917 - RNA, 19 nt, Homo sapiens
uaaagaaaguggcuugaaa

SEQ ID NO: 300918 - RNA, 19 nt, Homo sapiens
ggagagagcacgauuuauu

SEQ ID NO: 300919 - RNA, 19 nt, Homo sapiens
ugauagagguucuuuauug

SEQ ID NO: 300920 - RNA, 19 nt, Homo sapiens
agagaaacauguccauaua

SEQ ID NO: 300921 - RNA, 19 nt, Homo sapiens
gaagaaaggcacauaccua

SEQ ID NO: 300922 - RNA, 19 nt, Homo sapiens
cagaugcacuuuauuugua

SEQ ID NO: 300923 - RNA, 19 nt, Homo sapiens
cagagaggcugaauagauu

SEQ ID NO: 300924 - RNA, 19 nt, Homo sapiens
guacagauaucuucaaagg

SEQ ID NO: 300925 - RNA, 19 nt, Homo sapiens
ggacuuacgaguuugguua

SEQ ID NO: 300926 - RNA, 19 nt, Homo sapiens
ccaaagacauguuuauagu

SEQ ID NO: 300927 - RNA, 19 nt, Homo sapiens
ucagaaagcuagaaagugu

SEQ ID NO: 300928 - RNA, 19 nt, Homo sapiens
gguuaaacaugcccucuaa

SEQ ID NO: 300929 - RNA, 19 nt, Homo sapiens
aaacagauaucaggauuug

SEQ ID NO: 300930 - RNA, 19 nt, Homo sapiens
ccaagcaguuucuuucaaa

SEQ ID NO: 300931 - RNA, 19 nt, Homo sapiens
cuauggagcucauugguaa

SEQ ID NO: 300932 - RNA, 19 nt, Homo sapiens
gcagagaggcugaauagau

SEQ ID NO: 300933 - RNA, 19 nt, Homo sapiens
gaauguagguagcauccuu

SEQ ID NO: 300934 - RNA, 19 nt, Homo sapiens
caauguggcuugaauguag

SEQ ID NO: 300935 - RNA, 19 nt, Homo sapiens
aaacacaccuuuagugaag

SEQ ID NO: 300936 - RNA, 19 nt, Homo sapiens
ucaagaguguagaagaaua

SEQ ID NO: 300937 - RNA, 19 nt, Homo sapiens
gaaaacagauaucaggauu

SEQ ID NO: 300938 - RNA, 19 nt, Homo sapiens
uaaaggaucaguagcaauu

SEQ ID NO: 300939 - RNA, 19 nt, Homo sapiens
gaacuuaaaggaucaguag

SEQ ID NO: 300940 - RNA, 19 nt, Homo sapiens
gagaaucuuaguccauuua

SEQ ID NO: 300941 - RNA, 19 nt, Homo sapiens
cagcaugccugguuguauu

SEQ ID NO: 300942 - RNA, 19 nt, Homo sapiens
aaagagaacuccguauguu

SEQ ID NO: 300943 - RNA, 19 nt, Homo sapiens
aaaugggacuuacgaguuu

SEQ ID NO: 300944 - RNA, 19 nt, Homo sapiens
cagauaaccucaagucaca

SEQ ID NO: 300945 - RNA, 19 nt, Homo sapiens
guuaucagaugcacuuuau

SEQ ID NO: 300946 - RNA, 19 nt, Homo sapiens
gagcagagaggcugaauag

SEQ ID NO: 300947 - RNA, 19 nt, Homo sapiens
gagcugaauaugccacuua

SEQ ID NO: 300948 - RNA, 19 nt, Homo sapiens
guauaugucuuaccucauc

SEQ ID NO: 300949 - RNA, 19 nt, Homo sapiens
ugagauuggugaacgagua

SEQ ID NO: 300950 - RNA, 19 nt, Homo sapiens
gauaaaaguuugaggagaa

SEQ ID NO: 300951 - RNA, 19 nt, Homo sapiens
ugucuuaccucaucuccua

SEQ ID NO: 300952 - RNA, 19 nt, Homo sapiens
gugaacgaguagauuauaa

SEQ ID NO: 300953 - RNA, 19 nt, Homo sapiens
uagcucagguagcacuuua

SEQ ID NO: 300954 - RNA, 19 nt, Homo sapiens
ggaagaagaaaggcacaua

SEQ ID NO: 300955 - RNA, 19 nt, Homo sapiens
gagagagcacgauuuauug

SEQ ID NO: 300956 - RNA, 19 nt, Homo sapiens
aaucaagaguguagaagaa

SEQ ID NO: 300957 - RNA, 19 nt, Homo sapiens
ggucauugcugugauuguu

SEQ ID NO: 300958 - RNA, 19 nt, Homo sapiens
caaaugggacuuacgaguu

SEQ ID NO: 300959 - RNA, 19 nt, Homo sapiens
gacagaagcguauaugaau

SEQ ID NO: 300960 - RNA, 19 nt, Homo sapiens
gaauuaagcacagaguuga

SEQ ID NO: 300961 - RNA, 19 nt, Homo sapiens
guaaauguuccuuuccuuu

SEQ ID NO: 300962 - RNA, 19 nt, Homo sapiens
ccagauccauuuucacuua

SEQ ID NO: 300963 - RNA, 19 nt, Homo sapiens
aaauauagcucagguagca

SEQ ID NO: 300964 - RNA, 19 nt, Homo sapiens
caaaguaagccauguaucu

SEQ ID NO: 300965 - RNA, 19 nt, Homo sapiens
ugacagaagcguauaugaa

SEQ ID NO: 300966 - RNA, 19 nt, Homo sapiens
ucaagaaugucgcaauuac

SEQ ID NO: 300967 - RNA, 19 nt, Homo sapiens
gaacagauugccugcuuuc

SEQ ID NO: 300968 - RNA, 19 nt, Homo sapiens
aaggaauacuugacaguuu

SEQ ID NO: 300969 - RNA, 19 nt, Homo sapiens
gaaggaauacuugacaguu

SEQ ID NO: 300970 - RNA, 19 nt, Homo sapiens
caagaguguagaagaauaa

SEQ ID NO: 300971 - RNA, 19 nt, Homo sapiens
gcucagguagcacuuuaua

SEQ ID NO: 300972 - RNA, 19 nt, Homo sapiens
guaauguguucggugauuu

SEQ ID NO: 300973 - RNA, 19 nt, Homo sapiens
gaauuuggguaugaacaga

SEQ ID NO: 300974 - RNA, 19 nt, Homo sapiens
gaaggagagaugagagaaa

SEQ ID NO: 300975 - RNA, 19 nt, Homo sapiens
ccacagagaaguaaaauuu

SEQ ID NO: 300976 - RNA, 19 nt, Homo sapiens
gggaauaugcacaaacuug

SEQ ID NO: 300977 - RNA, 19 nt, Homo sapiens
gaaaggcacauaccuaacu

SEQ ID NO: 300978 - RNA, 19 nt, Homo sapiens
gaaaacacaccuuuaguga

SEQ ID NO: 300979 - RNA, 19 nt, Homo sapiens
gaugacgccuguuauagag

SEQ ID NO: 300980 - RNA, 19 nt, Homo sapiens
ucagaugacgccuguuaua

SEQ ID NO: 300981 - RNA, 19 nt, Homo sapiens
gaauucugguuacaugugu

SEQ ID NO: 300982 - RNA, 19 nt, Homo sapiens
caaagagaacuccguaugu

SEQ ID NO: 300983 - RNA, 19 nt, Homo sapiens
ccuaacugaucgaauauau

SEQ ID NO: 300984 - RNA, 19 nt, Homo sapiens
aaacuuggcuucuuuaacc

SEQ ID NO: 300985 - RNA, 19 nt, Homo sapiens
uagcuaauauugcaaugug

SEQ ID NO: 300986 - RNA, 19 nt, Homo sapiens
ccacuuaccagacuaaauc

SEQ ID NO: 300987 - RNA, 19 nt, Homo sapiens
gagaaacauguccauauau

SEQ ID NO: 300988 - RNA, 19 nt, Homo sapiens
gauagagguucuuuauugc

SEQ ID NO: 300989 - RNA, 19 nt, Homo sapiens
aaagaaacauugccuugag

SEQ ID NO: 300990 - RNA, 19 nt, Homo sapiens
caaagaaacauugccuuga

SEQ ID NO: 300991 - RNA, 19 nt, Homo sapiens
cuacaaagcaacaguuaug

SEQ ID NO: 300992 - RNA, 19 nt, Homo sapiens
acgaguagauuauaagugu

SEQ ID NO: 300993 - RNA, 19 nt, Homo sapiens
ccaccaacauuugaagcua

SEQ ID NO: 300994 - RNA, 19 nt, Homo sapiens
agauuaaugccaacucuua

SEQ ID NO: 300995 - RNA, 19 nt, Homo sapiens
uauacgggauccuuuaaau

SEQ ID NO: 300996 - RNA, 19 nt, Homo sapiens
acagaagcguauaugaauu

SEQ ID NO: 300997 - RNA, 19 nt, Homo sapiens
aaaggcagaguacaaagua

SEQ ID NO: 300998 - RNA, 19 nt, Homo sapiens
ccaaagagaacuccguaug

SEQ ID NO: 300999 - RNA, 19 nt, Homo sapiens
gcaauguggcuugaaugua

SEQ ID NO: 301000 - RNA, 19 nt, Homo sapiens
cgaguuugguuaucagaug

SEQ ID NO: 301001 - RNA, 19 nt, Homo sapiens
ggacugccacugcauuuca

SEQ ID NO: 301002 - RNA, 19 nt, Homo sapiens
gaacgaguagauuauaagu

SEQ ID NO: 301003 - RNA, 19 nt, Homo sapiens
gccaagcaguuucuuucaa

SEQ ID NO: 301004 - RNA, 19 nt, Homo sapiens
aagaaaggcacauaccuaa

SEQ ID NO: 301005 - RNA, 19 nt, Homo sapiens
gugaggagccaccaacauu

SEQ ID NO: 301006 - RNA, 19 nt, Homo sapiens
uaaauguuccuuuccuuug

SEQ ID NO: 301007 - RNA, 19 nt, Homo sapiens
uacauugccuuggcuagua

SEQ ID NO: 301008 - RNA, 19 nt, Homo sapiens
caccaacuauagaauguau

SEQ ID NO: 301009 - RNA, 19 nt, Homo sapiens
gcacagaguugaaguuuau

SEQ ID NO: 301010 - RNA, 19 nt, Homo sapiens
gaaaguggcuugaaaucuu

SEQ ID NO: 301011 - RNA, 19 nt, Homo sapiens
gcacaaacuuggcuucuuu

SEQ ID NO: 301012 - RNA, 19 nt, Homo sapiens
gcagggauaugcuguauuu

SEQ ID NO: 301013 - RNA, 19 nt, Homo sapiens
gaacaaacaggaauucuga

SEQ ID NO: 301014 - RNA, 19 nt, Homo sapiens
gcaagaugcuuuaggaaga

SEQ ID NO: 301015 - RNA, 19 nt, Homo sapiens
uaaagaaaguggcuugaaa

SEQ ID NO: 301016 - RNA, 19 nt, Homo sapiens
ggagagagcacgauuuauu

SEQ ID NO: 301017 - RNA, 19 nt, Homo sapiens
ugauagagguucuuuauug

SEQ ID NO: 301018 - RNA, 19 nt, Homo sapiens
agagaaacauguccauaua

SEQ ID NO: 301019 - RNA, 19 nt, Homo sapiens
cagaugcacuuuauuugua

SEQ ID NO: 301020 - RNA, 19 nt, Homo sapiens
cagagaggcugaauagauu

SEQ ID NO: 301021 - RNA, 19 nt, Homo sapiens
ggacuuacgaguuugguua

SEQ ID NO: 301022 - RNA, 19 nt, Homo sapiens
ccaaagacauguuuauagu

SEQ ID NO: 301023 - RNA, 19 nt, Homo sapiens
ucagaaagcuagaaagugu

SEQ ID NO: 301024 - RNA, 19 nt, Homo sapiens
gguuaaacaugcccucuaa

SEQ ID NO: 301025 - RNA, 19 nt, Homo sapiens
aaacagauaucaggauuug

SEQ ID NO: 301026 - RNA, 19 nt, Homo sapiens
ccaagcaguuucuuucaaa

SEQ ID NO: 301027 - RNA, 19 nt, Homo sapiens
cuauggagcucauugguaa

SEQ ID NO: 301028 - RNA, 19 nt, Homo sapiens
gcagagaggcugaauagau

SEQ ID NO: 301029 - RNA, 19 nt, Homo sapiens
gaauguagguagcauccuu

SEQ ID NO: 301030 - RNA, 19 nt, Homo sapiens
caauguggcuugaauguag

SEQ ID NO: 301031 - RNA, 19 nt, Homo sapiens
aaacacaccuuuagugaag

SEQ ID NO: 301032 - RNA, 19 nt, Homo sapiens
ucaagaguguagaagaaua

SEQ ID NO: 301033 - RNA, 19 nt, Homo sapiens
gaaaacagauaucaggauu

SEQ ID NO: 301034 - RNA, 19 nt, Homo sapiens
uaaaggaucaguagcaauu

SEQ ID NO: 301035 - RNA, 19 nt, Homo sapiens
gaacuuaaaggaucaguag

SEQ ID NO: 301036 - RNA, 19 nt, Homo sapiens
gagaaucuuaguccauuua

SEQ ID NO: 301037 - RNA, 19 nt, Homo sapiens
cagcaugccugguuguauu

SEQ ID NO: 301038 - RNA, 19 nt, Homo sapiens
aaagagaacuccguauguu

SEQ ID NO: 301039 - RNA, 19 nt, Homo sapiens
aaaugggacuuacgaguuu

SEQ ID NO: 301040 - RNA, 19 nt, Homo sapiens
cagauaaccucaagucaca

SEQ ID NO: 301041 - RNA, 19 nt, Homo sapiens
guuaucagaugcacuuuau

SEQ ID NO: 301042 - RNA, 19 nt, Homo sapiens
gagcagagaggcugaauag

SEQ ID NO: 301043 - RNA, 19 nt, Homo sapiens
gagcugaauaugccacuua

SEQ ID NO: 301044 - RNA, 19 nt, Homo sapiens
guauaugucuuaccucauc

SEQ ID NO: 301045 - RNA, 19 nt, Homo sapiens
ugagauuggugaacgagua

SEQ ID NO: 301046 - RNA, 19 nt, Homo sapiens
gauaaaaguuugaggagaa

SEQ ID NO: 301047 - RNA, 19 nt, Homo sapiens
ugucuuaccucaucuccua

SEQ ID NO: 301048 - RNA, 19 nt, Homo sapiens
gugaacgaguagauuauaa

SEQ ID NO: 301049 - RNA, 19 nt, Homo sapiens
uagcucagguagcacuuua

SEQ ID NO: 301050 - RNA, 19 nt, Homo sapiens
gagagagcacgauuuauug

SEQ ID NO: 301051 - RNA, 19 nt, Homo sapiens
aaucaagaguguagaagaa

SEQ ID NO: 301052 - RNA, 19 nt, Homo sapiens
ggucauugcugugauuguu

SEQ ID NO: 301053 - RNA, 19 nt, Homo sapiens
caaaugggacuuacgaguu

SEQ ID NO: 301054 - RNA, 19 nt, Homo sapiens
gacagaagcguauaugaau

SEQ ID NO: 301055 - RNA, 19 nt, Homo sapiens
gaauuaagcacagaguuga

SEQ ID NO: 301056 - RNA, 19 nt, Homo sapiens
guaaauguuccuuuccuuu

SEQ ID NO: 301057 - RNA, 19 nt, Homo sapiens
uuacaagccuccagucuca

SEQ ID NO: 301058 - RNA, 19 nt, Homo sapiens
ccagauccauuuucacuua

SEQ ID NO: 301059 - RNA, 19 nt, Homo sapiens
aaauauagcucagguagca

SEQ ID NO: 301060 - RNA, 19 nt, Homo sapiens
caaaguaagccauguaucu

SEQ ID NO: 301061 - RNA, 19 nt, Homo sapiens
ugacagaagcguauaugaa

SEQ ID NO: 301062 - RNA, 19 nt, Homo sapiens
ucaagaaugucgcaauuac

SEQ ID NO: 301063 - RNA, 19 nt, Homo sapiens
gaacagauugccugcuuuc

SEQ ID NO: 301064 - RNA, 19 nt, Homo sapiens
gaagaaagggaaagcagau

SEQ ID NO: 301065 - RNA, 19 nt, Homo sapiens
ugccauagauaucuucaaa

SEQ ID NO: 301066 - RNA, 19 nt, Homo sapiens
aaggaauacuugacaguuu

SEQ ID NO: 301067 - RNA, 19 nt, Homo sapiens
gaaggaauacuugacaguu

SEQ ID NO: 301068 - RNA, 19 nt, Homo sapiens
caagaguguagaagaauaa

SEQ ID NO: 301069 - RNA, 19 nt, Homo sapiens
gcucagguagcacuuuaua

SEQ ID NO: 301070 - RNA, 19 nt, Homo sapiens
guaauguguucggugauuu

SEQ ID NO: 301071 - RNA, 19 nt, Homo sapiens
gaauuuggguaugaacaga

SEQ ID NO: 301072 - RNA, 19 nt, Homo sapiens
gggaauaugcacaaacuug

SEQ ID NO: 301073 - RNA, 19 nt, Homo sapiens
ccauagauaucuucaaagg

SEQ ID NO: 301074 - RNA, 19 nt, Homo sapiens
gaaaacacaccuuuaguga

SEQ ID NO: 301075 - RNA, 19 nt, Homo sapiens
gaugacgccuguuauagag

SEQ ID NO: 301076 - RNA, 19 nt, Homo sapiens
ucagaugacgccuguuaua

SEQ ID NO: 301077 - RNA, 19 nt, Homo sapiens
gaauucugguuacaugugu

SEQ ID NO: 301078 - RNA, 19 nt, Homo sapiens
caaagagaacuccguaugu

SEQ ID NO: 301079 - RNA, 19 nt, Homo sapiens
ccuaacugaucgaauauau

SEQ ID NO: 301080 - RNA, 19 nt, Homo sapiens
aaacuuggcuucuuuaacc

SEQ ID NO: 301081 - RNA, 19 nt, Homo sapiens
uagcuaauauugcaaugug

SEQ ID NO: 301082 - RNA, 19 nt, Homo sapiens
ccacuuaccagacuaaauc

SEQ ID NO: 301083 - RNA, 19 nt, Homo sapiens
gagaaacauguccauauau

SEQ ID NO: 301084 - RNA, 19 nt, Homo sapiens
gauagagguucuuuauugc

SEQ ID NO: 301085 - RNA, 19 nt, Homo sapiens
aaagaaacauugccuugag

SEQ ID NO: 301086 - RNA, 19 nt, Homo sapiens
caaagaaacauugccuuga

SEQ ID NO: 301087 - RNA, 19 nt, Homo sapiens
cuacaaagcaacaguuaug

SEQ ID NO: 301088 - RNA, 19 nt, Homo sapiens
acgaguagauuauaagugu

SEQ ID NO: 301089 - RNA, 19 nt, Homo sapiens
agauuaaugccaacucuua

SEQ ID NO: 301090 - RNA, 19 nt, Homo sapiens
ccaccaacauuugaagcua

SEQ ID NO: 301091 - RNA, 19 nt, Homo sapiens
uauacgggauccuuuaaau

SEQ ID NO: 301092 - RNA, 19 nt, Homo sapiens
acagaagcguauaugaauu

SEQ ID NO: 301093 - RNA, 19 nt, Homo sapiens
aaaggcagaguacaaagua

SEQ ID NO: 301094 - RNA, 19 nt, Homo sapiens
ccaaagagaacuccguaug

SEQ ID NO: 301095 - RNA, 19 nt, Homo sapiens
gcaauguggcuugaaugua

SEQ ID NO: 301096 - RNA, 19 nt, Homo sapiens
cgaguuugguuaucagaug

SEQ ID NO: 301097 - RNA, 19 nt, Homo sapiens
ggacugccacugcauuuca

SEQ ID NO: 301098 - RNA, 19 nt, Homo sapiens
gccaagcaguuucuuucaa

SEQ ID NO: 301099 - RNA, 19 nt, Homo sapiens
gaacgaguagauuauaagu

SEQ ID NO: 301100 - RNA, 19 nt, Homo sapiens
uaaauguuccuuuccuuug

SEQ ID NO: 301101 - RNA, 19 nt, Homo sapiens
gugaggagccaccaacauu

SEQ ID NO: 301102 - RNA, 19 nt, Homo sapiens
uacauugccuuggcuagua

SEQ ID NO: 301103 - RNA, 19 nt, Homo sapiens
caccaacuauagaauguau

SEQ ID NO: 301104 - RNA, 19 nt, Homo sapiens
guagguagcauccuuugau

SEQ ID NO: 301105 - RNA, 19 nt, Homo sapiens
gauggcagcgacacaauug

SEQ ID NO: 301106 - RNA, 19 nt, Homo sapiens
gaggagccaccaacauuug

SEQ ID NO: 301107 - RNA, 19 nt, Homo sapiens
gcuauggagcucauuggua

SEQ ID NO: 301108 - RNA, 19 nt, Homo sapiens
acacaccuuuagugaagua

SEQ ID NO: 301109 - RNA, 19 nt, Homo sapiens
gcacagaguugaaguuuau

SEQ ID NO: 301110 - RNA, 19 nt, Homo sapiens
gaaaguggcuugaaaucuu

SEQ ID NO: 301111 - RNA, 19 nt, Homo sapiens
gcacaaacuuggcuucuuu

SEQ ID NO: 301112 - RNA, 19 nt, Homo sapiens
gcagggauaugcuguauuu

SEQ ID NO: 301113 - RNA, 19 nt, Homo sapiens
gaacaaacaggaauucuga

SEQ ID NO: 301114 - RNA, 19 nt, Homo sapiens
gcaagaugcuuuaggaaga

SEQ ID NO: 301115 - RNA, 19 nt, Homo sapiens
uaaagaaaguggcuugaaa

SEQ ID NO: 301116 - RNA, 19 nt, Homo sapiens
ggagagagcacgauuuauu

SEQ ID NO: 301117 - RNA, 19 nt, Homo sapiens
ugauagagguucuuuauug

SEQ ID NO: 301118 - RNA, 19 nt, Homo sapiens
agagaaacauguccauaua

SEQ ID NO: 301119 - RNA, 19 nt, Homo sapiens
cagaugcacuuuauuugua

SEQ ID NO: 301120 - RNA, 19 nt, Homo sapiens
cagagaggcugaauagauu

SEQ ID NO: 301121 - RNA, 19 nt, Homo sapiens
guacagauaucuucaaagg

SEQ ID NO: 301122 - RNA, 19 nt, Homo sapiens
ggacuuacgaguuugguua

SEQ ID NO: 301123 - RNA, 19 nt, Homo sapiens
ccaaagacauguuuauagu

SEQ ID NO: 301124 - RNA, 19 nt, Homo sapiens
ucagaaagcuagaaagugu

SEQ ID NO: 301125 - RNA, 19 nt, Homo sapiens
gguuaaacaugcccucuaa

SEQ ID NO: 301126 - RNA, 19 nt, Homo sapiens
aaacagauaucaggauuug

SEQ ID NO: 301127 - RNA, 19 nt, Homo sapiens
ccaagcaguuucuuucaaa

SEQ ID NO: 301128 - RNA, 19 nt, Homo sapiens
cuauggagcucauugguaa

SEQ ID NO: 301129 - RNA, 19 nt, Homo sapiens
gcagagaggcugaauagau

SEQ ID NO: 301130 - RNA, 19 nt, Homo sapiens
gaauguagguagcauccuu

SEQ ID NO: 301131 - RNA, 19 nt, Homo sapiens
caauguggcuugaauguag

SEQ ID NO: 301132 - RNA, 19 nt, Homo sapiens
aaacacaccuuuagugaag

SEQ ID NO: 301133 - RNA, 19 nt, Homo sapiens
ucaagaguguagaagaaua

SEQ ID NO: 301134 - RNA, 19 nt, Homo sapiens
gaaaacagauaucaggauu

SEQ ID NO: 301135 - RNA, 19 nt, Homo sapiens
uaaaggaucaguagcaauu

SEQ ID NO: 301136 - RNA, 19 nt, Homo sapiens
gaacuuaaaggaucaguag

SEQ ID NO: 301137 - RNA, 19 nt, Homo sapiens
gagaaucuuaguccauuua

SEQ ID NO: 301138 - RNA, 19 nt, Homo sapiens
cagcaugccugguuguauu

SEQ ID NO: 301139 - RNA, 19 nt, Homo sapiens
aaagagaacuccguauguu

SEQ ID NO: 301140 - RNA, 19 nt, Homo sapiens
aaaugggacuuacgaguuu

SEQ ID NO: 301141 - RNA, 19 nt, Homo sapiens
cagauaaccucaagucaca

SEQ ID NO: 301142 - RNA, 19 nt, Homo sapiens
guuaucagaugcacuuuau

SEQ ID NO: 301143 - RNA, 19 nt, Homo sapiens
gagcagagaggcugaauag

SEQ ID NO: 301144 - RNA, 19 nt, Homo sapiens
gagcugaauaugccacuua

SEQ ID NO: 301145 - RNA, 19 nt, Homo sapiens
guauaugucuuaccucauc

SEQ ID NO: 301146 - RNA, 19 nt, Homo sapiens
ugagauuggugaacgagua

SEQ ID NO: 301147 - RNA, 19 nt, Homo sapiens
gauaaaaguuugaggagaa

SEQ ID NO: 301148 - RNA, 19 nt, Homo sapiens
ugucuuaccucaucuccua

SEQ ID NO: 301149 - RNA, 19 nt, Homo sapiens
gugaacgaguagauuauaa

SEQ ID NO: 301150 - RNA, 19 nt, Homo sapiens
uagcucagguagcacuuua

SEQ ID NO: 301151 - RNA, 19 nt, Homo sapiens
gagagagcacgauuuauug

SEQ ID NO: 301152 - RNA, 19 nt, Homo sapiens
aaucaagaguguagaagaa

SEQ ID NO: 301153 - RNA, 19 nt, Homo sapiens
ggucauugcugugauuguu

SEQ ID NO: 301154 - RNA, 19 nt, Homo sapiens
caaaugggacuuacgaguu

SEQ ID NO: 301155 - RNA, 19 nt, Homo sapiens
gacagaagcguauaugaau

SEQ ID NO: 301156 - RNA, 19 nt, Homo sapiens
gaauuaagcacagaguuga

SEQ ID NO: 301157 - RNA, 19 nt, Homo sapiens
guaaauguuccuuuccuuu

SEQ ID NO: 301158 - RNA, 19 nt, Homo sapiens
uuacaagccuccagucuca

SEQ ID NO: 301159 - RNA, 19 nt, Homo sapiens
ccagauccauuuucacuua

SEQ ID NO: 301160 - RNA, 19 nt, Homo sapiens
aaauauagcucagguagca

SEQ ID NO: 301161 - RNA, 19 nt, Homo sapiens
caaaguaagccauguaucu

SEQ ID NO: 301162 - RNA, 19 nt, Homo sapiens
ugacagaagcguauaugaa

SEQ ID NO: 301163 - RNA, 19 nt, Homo sapiens
ucaagaaugucgcaauuac

SEQ ID NO: 301164 - RNA, 19 nt, Homo sapiens
gaacagauugccugcuuuc

SEQ ID NO: 301165 - RNA, 19 nt, Homo sapiens
gaagaaagggaaagcagau

SEQ ID NO: 301166 - RNA, 19 nt, Homo sapiens
aaggaauacuugacaguuu

SEQ ID NO: 301167 - RNA, 19 nt, Homo sapiens
gaaggaauacuugacaguu

SEQ ID NO: 301168 - RNA, 19 nt, Homo sapiens
caagaguguagaagaauaa

SEQ ID NO: 301169 - RNA, 19 nt, Homo sapiens
gcucagguagcacuuuaua

SEQ ID NO: 301170 - RNA, 19 nt, Homo sapiens
guaauguguucggugauuu

SEQ ID NO: 301171 - RNA, 19 nt, Homo sapiens
gaauuuggguaugaacaga

SEQ ID NO: 301172 - RNA, 19 nt, Homo sapiens
gggaauaugcacaaacuug

SEQ ID NO: 301173 - RNA, 19 nt, Homo sapiens
gaaaacacaccuuuaguga

SEQ ID NO: 301174 - RNA, 19 nt, Homo sapiens
gaugacgccuguuauagag

SEQ ID NO: 301175 - RNA, 19 nt, Homo sapiens
ucagaugacgccuguuaua

SEQ ID NO: 301176 - RNA, 19 nt, Homo sapiens
gaauucugguuacaugugu

SEQ ID NO: 301177 - RNA, 19 nt, Homo sapiens
caaagagaacuccguaugu

SEQ ID NO: 301178 - RNA, 19 nt, Homo sapiens
ccuaacugaucgaauauau

SEQ ID NO: 301179 - RNA, 19 nt, Homo sapiens
aaacuuggcuucuuuaacc

SEQ ID NO: 301180 - RNA, 19 nt, Homo sapiens
uagcuaauauugcaaugug

SEQ ID NO: 301181 - RNA, 19 nt, Homo sapiens
ccacuuaccagacuaaauc

SEQ ID NO: 301182 - RNA, 19 nt, Homo sapiens
gagaaacauguccauauau

SEQ ID NO: 301183 - RNA, 19 nt, Homo sapiens
gauagagguucuuuauugc

SEQ ID NO: 301184 - RNA, 19 nt, Homo sapiens
aaagaaacauugccuugag

SEQ ID NO: 301185 - RNA, 19 nt, Homo sapiens
caaagaaacauugccuuga

SEQ ID NO: 301186 - RNA, 19 nt, Homo sapiens
guacaaaaccuccagcuuu

SEQ ID NO: 301187 - RNA, 19 nt, Homo sapiens
cuacaaagcaacaguuaug

SEQ ID NO: 301188 - RNA, 19 nt, Homo sapiens
acgaguagauuauaagugu

SEQ ID NO: 301189 - RNA, 19 nt, Homo sapiens
agauuaaugccaacucuua

SEQ ID NO: 301190 - RNA, 19 nt, Homo sapiens
ccaccaacauuugaagcua

SEQ ID NO: 301191 - RNA, 19 nt, Homo sapiens
uauacgggauccuuuaaau

SEQ ID NO: 301192 - RNA, 19 nt, Homo sapiens
acagaagcguauaugaauu

SEQ ID NO: 301193 - RNA, 19 nt, Homo sapiens
aaaggcagaguacaaagua

SEQ ID NO: 301194 - RNA, 19 nt, Homo sapiens
ccaaagagaacuccguaug

SEQ ID NO: 301195 - RNA, 19 nt, Homo sapiens
gcaauguggcuugaaugua

SEQ ID NO: 301196 - RNA, 19 nt, Homo sapiens
cgaguuugguuaucagaug

SEQ ID NO: 301197 - RNA, 19 nt, Homo sapiens
ggacugccacugcauuuca

SEQ ID NO: 301198 - RNA, 19 nt, Homo sapiens
gccaagcaguuucuuucaa

SEQ ID NO: 301199 - RNA, 19 nt, Homo sapiens
gaacgaguagauuauaagu

SEQ ID NO: 301200 - RNA, 19 nt, Homo sapiens
uaaauguuccuuuccuuug

SEQ ID NO: 301201 - RNA, 19 nt, Homo sapiens
uacauugccuuggcuagua

SEQ ID NO: 301202 - RNA, 19 nt, Homo sapiens
caccaacuauagaauguau

SEQ ID NO: 301203 - RNA, 19 nt, Homo sapiens
guagguagcauccuuugau

SEQ ID NO: 301204 - RNA, 19 nt, Homo sapiens
gauggcagcgacacaauug

SEQ ID NO: 301205 - RNA, 19 nt, Homo sapiens
gugaggagccaccaacauu

SEQ ID NO: 301206 - RNA, 19 nt, Homo sapiens
gaggagccaccaacauuug

SEQ ID NO: 301207 - RNA, 19 nt, Homo sapiens
gcuauggagcucauuggua

SEQ ID NO: 301208 - RNA, 19 nt, Homo sapiens
acacaccuuuagugaagua

SEQ ID NO: 301209 - RNA, 19 nt, Homo sapiens
gcacagaguugaaguuuau

SEQ ID NO: 301210 - RNA, 19 nt, Homo sapiens
gaaaguggcuugaaaucuu

SEQ ID NO: 301211 - RNA, 19 nt, Homo sapiens
gcacaaacuuggcuucuuu

SEQ ID NO: 301212 - RNA, 19 nt, Homo sapiens
gcagggauaugcuguauuu

SEQ ID NO: 301213 - RNA, 19 nt, Homo sapiens
gaacaaacaggaauucuga

SEQ ID NO: 301214 - RNA, 19 nt, Homo sapiens
gcaagaugcuuuaggaaga

SEQ ID NO: 301215 - RNA, 19 nt, Homo sapiens
uaaagaaaguggcuugaaa

SEQ ID NO: 301216 - RNA, 19 nt, Homo sapiens
ggagagagcacgauuuauu

SEQ ID NO: 301217 - RNA, 19 nt, Homo sapiens
ugauagagguucuuuauug

SEQ ID NO: 301218 - RNA, 19 nt, Homo sapiens
agagaaacauguccauaua

SEQ ID NO: 301219 - RNA, 19 nt, Homo sapiens
cagaugcacuuuauuugua

SEQ ID NO: 301220 - RNA, 19 nt, Homo sapiens
cagagaggcugaauagauu

SEQ ID NO: 301221 - RNA, 19 nt, Homo sapiens
guacagauaucuucaaagg

SEQ ID NO: 301222 - RNA, 19 nt, Homo sapiens
ggacuuacgaguuugguua

SEQ ID NO: 301223 - RNA, 19 nt, Homo sapiens
ccaaagacauguuuauagu

SEQ ID NO: 301224 - RNA, 19 nt, Homo sapiens
ucagaaagcuagaaagugu

SEQ ID NO: 301225 - RNA, 19 nt, Homo sapiens
gguuaaacaugcccucuaa

SEQ ID NO: 301226 - RNA, 19 nt, Homo sapiens
aaacagauaucaggauuug

SEQ ID NO: 301227 - RNA, 19 nt, Homo sapiens
ccaagcaguuucuuucaaa

SEQ ID NO: 301228 - RNA, 19 nt, Homo sapiens
cuauggagcucauugguaa

SEQ ID NO: 301229 - RNA, 19 nt, Homo sapiens
gcagagaggcugaauagau

SEQ ID NO: 301230 - RNA, 19 nt, Homo sapiens
gaauguagguagcauccuu

SEQ ID NO: 301231 - RNA, 19 nt, Homo sapiens
caauguggcuugaauguag

SEQ ID NO: 301232 - RNA, 19 nt, Homo sapiens
aaacacaccuuuagugaag

SEQ ID NO: 301233 - RNA, 19 nt, Homo sapiens
ucaagaguguagaagaaua

SEQ ID NO: 301234 - RNA, 19 nt, Homo sapiens
gaaaacagauaucaggauu

SEQ ID NO: 301235 - RNA, 19 nt, Homo sapiens
uaaaggaucaguagcaauu

SEQ ID NO: 301236 - RNA, 19 nt, Homo sapiens
gaacuuaaaggaucaguag

SEQ ID NO: 301237 - RNA, 19 nt, Homo sapiens
gagaaucuuaguccauuua

SEQ ID NO: 301238 - RNA, 19 nt, Homo sapiens
cagcaugccugguuguauu

SEQ ID NO: 301239 - RNA, 19 nt, Homo sapiens
aaagagaacuccguauguu

SEQ ID NO: 301240 - RNA, 19 nt, Homo sapiens
aaaugggacuuacgaguuu

SEQ ID NO: 301241 - RNA, 19 nt, Homo sapiens
cagauaaccucaagucaca

SEQ ID NO: 301242 - RNA, 19 nt, Homo sapiens
guuaucagaugcacuuuau

SEQ ID NO: 301243 - RNA, 19 nt, Homo sapiens
gagcagagaggcugaauag

SEQ ID NO: 301244 - RNA, 19 nt, Homo sapiens
gagcugaauaugccacuua

SEQ ID NO: 301245 - RNA, 19 nt, Homo sapiens
guauaugucuuaccucauc

SEQ ID NO: 301246 - RNA, 19 nt, Homo sapiens
ugagauuggugaacgagua

SEQ ID NO: 301247 - RNA, 19 nt, Homo sapiens
gauaaaaguuugaggagaa

SEQ ID NO: 301248 - RNA, 19 nt, Homo sapiens
ugucuuaccucaucuccua

SEQ ID NO: 301249 - RNA, 19 nt, Homo sapiens
gugaacgaguagauuauaa

SEQ ID NO: 301250 - RNA, 19 nt, Homo sapiens
uagcucagguagcacuuua

SEQ ID NO: 301251 - RNA, 19 nt, Homo sapiens
gagagagcacgauuuauug

SEQ ID NO: 301252 - RNA, 19 nt, Homo sapiens
aaucaagaguguagaagaa

SEQ ID NO: 301253 - RNA, 19 nt, Homo sapiens
ggucauugcugugauuguu

SEQ ID NO: 301254 - RNA, 19 nt, Homo sapiens
caaaugggacuuacgaguu

SEQ ID NO: 301255 - RNA, 19 nt, Homo sapiens
gacagaagcguauaugaau

SEQ ID NO: 301256 - RNA, 19 nt, Homo sapiens
gaauuaagcacagaguuga

SEQ ID NO: 301257 - RNA, 19 nt, Homo sapiens
guaaauguuccuuuccuuu

SEQ ID NO: 301258 - RNA, 19 nt, Homo sapiens
ccagauccauuuucacuua

SEQ ID NO: 301259 - RNA, 19 nt, Homo sapiens
aaauauagcucagguagca

SEQ ID NO: 301260 - RNA, 19 nt, Homo sapiens
caaaguaagccauguaucu

SEQ ID NO: 301261 - RNA, 19 nt, Homo sapiens
ugacagaagcguauaugaa

SEQ ID NO: 301262 - RNA, 19 nt, Homo sapiens
ucaagaaugucgcaauuac

SEQ ID NO: 301263 - RNA, 19 nt, Homo sapiens
gaacagauugccugcuuuc

SEQ ID NO: 301264 - RNA, 19 nt, Homo sapiens
gaagaaagggaaagcagau

SEQ ID NO: 301265 - RNA, 19 nt, Homo sapiens
aaggaauacuugacaguuu

SEQ ID NO: 301266 - RNA, 19 nt, Homo sapiens
gaaggaauacuugacaguu

SEQ ID NO: 301267 - RNA, 19 nt, Homo sapiens
caagaguguagaagaauaa

SEQ ID NO: 301268 - RNA, 19 nt, Homo sapiens
gcucagguagcacuuuaua

SEQ ID NO: 301269 - RNA, 19 nt, Homo sapiens
guaauguguucggugauuu

SEQ ID NO: 301270 - RNA, 19 nt, Homo sapiens
gaauuuggguaugaacaga

SEQ ID NO: 301271 - RNA, 19 nt, Homo sapiens
gggaauaugcacaaacuug

SEQ ID NO: 301272 - RNA, 19 nt, Homo sapiens
gaaaacacaccuuuaguga

SEQ ID NO: 301273 - RNA, 19 nt, Homo sapiens
gaugacgccuguuauagag

SEQ ID NO: 301274 - RNA, 19 nt, Homo sapiens
ucagaugacgccuguuaua

SEQ ID NO: 301275 - RNA, 19 nt, Homo sapiens
gaauucugguuacaugugu

SEQ ID NO: 301276 - RNA, 19 nt, Homo sapiens
caaagagaacuccguaugu

SEQ ID NO: 301277 - RNA, 19 nt, Homo sapiens
ccuaacugaucgaauauau

SEQ ID NO: 301278 - RNA, 19 nt, Homo sapiens
aaacuuggcuucuuuaacc

SEQ ID NO: 301279 - RNA, 19 nt, Homo sapiens
uagcuaauauugcaaugug

SEQ ID NO: 301280 - RNA, 19 nt, Homo sapiens
ccacuuaccagacuaaauc

SEQ ID NO: 301281 - RNA, 19 nt, Homo sapiens
gagaaacauguccauauau

SEQ ID NO: 301282 - RNA, 19 nt, Homo sapiens
gauagagguucuuuauugc

SEQ ID NO: 301283 - RNA, 19 nt, Homo sapiens
aaagaaacauugccuugag

SEQ ID NO: 301284 - RNA, 19 nt, Homo sapiens
caaagaaacauugccuuga

SEQ ID NO: 301285 - RNA, 19 nt, Homo sapiens
guacaaaaccuccagcuuu

SEQ ID NO: 301286 - RNA, 19 nt, Homo sapiens
cuacaaagcaacaguuaug

SEQ ID NO: 301287 - RNA, 19 nt, Homo sapiens
acgaguagauuauaagugu

SEQ ID NO: 301288 - RNA, 19 nt, Homo sapiens
agauuaaugccaacucuua

SEQ ID NO: 301289 - RNA, 19 nt, Homo sapiens
ccaccaacauuugaagcua

SEQ ID NO: 301290 - RNA, 19 nt, Homo sapiens
uauacgggauccuuuaaau

SEQ ID NO: 301291 - RNA, 19 nt, Homo sapiens
acagaagcguauaugaauu

SEQ ID NO: 301292 - RNA, 19 nt, Homo sapiens
aaaggcagaguacaaagua

SEQ ID NO: 301293 - RNA, 19 nt, Homo sapiens
ccaaagagaacuccguaug

SEQ ID NO: 301294 - RNA, 19 nt, Homo sapiens
gcaauguggcuugaaugua

SEQ ID NO: 301295 - RNA, 19 nt, Homo sapiens
cgaguuugguuaucagaug

SEQ ID NO: 301296 - RNA, 19 nt, Homo sapiens
ggacugccacugcauuuca

SEQ ID NO: 301297 - RNA, 19 nt, Homo sapiens
gccaagcaguuucuuucaa

SEQ ID NO: 301298 - RNA, 19 nt, Homo sapiens
gaacgaguagauuauaagu

SEQ ID NO: 301299 - RNA, 19 nt, Homo sapiens
uaaauguuccuuuccuuug

SEQ ID NO: 301300 - RNA, 19 nt, Homo sapiens
gugaggagccaccaacauu

SEQ ID NO: 301301 - RNA, 19 nt, Homo sapiens
uacauugccuuggcuagua

SEQ ID NO: 301302 - RNA, 19 nt, Homo sapiens
caccaacuauagaauguau

SEQ ID NO: 301303 - RNA, 19 nt, Homo sapiens
guagguagcauccuuugau

SEQ ID NO: 301304 - RNA, 19 nt, Homo sapiens
gauggcagcgacacaauug

SEQ ID NO: 301305 - RNA, 19 nt, Homo sapiens
gaggagccaccaacauuug

SEQ ID NO: 301306 - RNA, 19 nt, Homo sapiens
gcuauggagcucauuggua

SEQ ID NO: 301307 - RNA, 19 nt, Homo sapiens
acacaccuuuagugaagua

SEQ ID NO: 301308 - RNA, 19 nt, Homo sapiens
ucucagaugacgccuguua

SEQ ID NO: 301309 - RNA, 19 nt, Homo sapiens
gcacagaguugaaguuuau

SEQ ID NO: 301310 - RNA, 19 nt, Homo sapiens
gaaaguggcuugaaaucuu

SEQ ID NO: 301311 - RNA, 19 nt, Homo sapiens
gcacaaacuuggcuucuuu

SEQ ID NO: 301312 - RNA, 19 nt, Homo sapiens
gcagggauaugcuguauuu

SEQ ID NO: 301313 - RNA, 19 nt, Homo sapiens
caaagugucuuaaaggaua

SEQ ID NO: 301314 - RNA, 19 nt, Homo sapiens
gaacaaacaggaauucuga

SEQ ID NO: 301315 - RNA, 19 nt, Homo sapiens
gcaagaugcuuuaggaaga

SEQ ID NO: 301316 - RNA, 19 nt, Homo sapiens
uaaagaaaguggcuugaaa

SEQ ID NO: 301317 - RNA, 19 nt, Homo sapiens
ggagagagcacgauuuauu

SEQ ID NO: 301318 - RNA, 19 nt, Homo sapiens
ugauagagguucuuuauug

SEQ ID NO: 301319 - RNA, 19 nt, Homo sapiens
agagaaacauguccauaua

SEQ ID NO: 301320 - RNA, 19 nt, Homo sapiens
cagaugcacuuuauuugua

SEQ ID NO: 301321 - RNA, 19 nt, Homo sapiens
cagagaggcugaauagauu

SEQ ID NO: 301322 - RNA, 19 nt, Homo sapiens
guacagauaucuucaaagg

SEQ ID NO: 301323 - RNA, 19 nt, Homo sapiens
ggacuuacgaguuugguua

SEQ ID NO: 301324 - RNA, 19 nt, Homo sapiens
ccaaagacauguuuauagu

SEQ ID NO: 301325 - RNA, 19 nt, Homo sapiens
ucagaaagcuagaaagugu

SEQ ID NO: 301326 - RNA, 19 nt, Homo sapiens
gguuaaacaugcccucuaa

SEQ ID NO: 301327 - RNA, 19 nt, Homo sapiens
aaacagauaucaggauuug

SEQ ID NO: 301328 - RNA, 19 nt, Homo sapiens
ccaagcaguuucuuucaaa

SEQ ID NO: 301329 - RNA, 19 nt, Homo sapiens
cuauggagcucauugguaa

SEQ ID NO: 301330 - RNA, 19 nt, Homo sapiens
gcagagaggcugaauagau

SEQ ID NO: 301331 - RNA, 19 nt, Homo sapiens
gaauguagguagcauccuu

SEQ ID NO: 301332 - RNA, 19 nt, Homo sapiens
caauguggcuugaauguag

SEQ ID NO: 301333 - RNA, 19 nt, Homo sapiens
aaacacaccuuuagugaag

SEQ ID NO: 301334 - RNA, 19 nt, Homo sapiens
ucaagaguguagaagaaua

SEQ ID NO: 301335 - RNA, 19 nt, Homo sapiens
gaaaacagauaucaggauu

SEQ ID NO: 301336 - RNA, 19 nt, Homo sapiens
uaaaggaucaguagcaauu

SEQ ID NO: 301337 - RNA, 19 nt, Homo sapiens
gaacuuaaaggaucaguag

SEQ ID NO: 301338 - RNA, 19 nt, Homo sapiens
gagaaucuuaguccauuua

SEQ ID NO: 301339 - RNA, 19 nt, Homo sapiens
cagcaugccugguuguauu

SEQ ID NO: 301340 - RNA, 19 nt, Homo sapiens
aaagagaacuccguauguu

SEQ ID NO: 301341 - RNA, 19 nt, Homo sapiens
aaaugggacuuacgaguuu

SEQ ID NO: 301342 - RNA, 19 nt, Homo sapiens
cagauaaccucaagucaca

SEQ ID NO: 301343 - RNA, 19 nt, Homo sapiens
guuaucagaugcacuuuau

SEQ ID NO: 301344 - RNA, 19 nt, Homo sapiens
gagcagagaggcugaauag

SEQ ID NO: 301345 - RNA, 19 nt, Homo sapiens
gagcugaauaugccacuua

SEQ ID NO: 301346 - RNA, 19 nt, Homo sapiens
guauaugucuuaccucauc

SEQ ID NO: 301347 - RNA, 19 nt, Homo sapiens
ugagauuggugaacgagua

SEQ ID NO: 301348 - RNA, 19 nt, Homo sapiens
gauaaaaguuugaggagaa

SEQ ID NO: 301349 - RNA, 19 nt, Homo sapiens
ugucuuaccucaucuccua

SEQ ID NO: 301350 - RNA, 19 nt, Homo sapiens
gugaacgaguagauuauaa

SEQ ID NO: 301351 - RNA, 19 nt, Homo sapiens
uagcucagguagcacuuua

SEQ ID NO: 301352 - RNA, 19 nt, Homo sapiens
gagagagcacgauuuauug

SEQ ID NO: 301353 - RNA, 19 nt, Homo sapiens
aaucaagaguguagaagaa

SEQ ID NO: 301354 - RNA, 19 nt, Homo sapiens
ggucauugcugugauuguu

SEQ ID NO: 301355 - RNA, 19 nt, Homo sapiens
caaaugggacuuacgaguu

SEQ ID NO: 301356 - RNA, 19 nt, Homo sapiens
gacagaagcguauaugaau

SEQ ID NO: 301357 - RNA, 19 nt, Homo sapiens
gaauuaagcacagaguuga

SEQ ID NO: 301358 - RNA, 19 nt, Homo sapiens
guaaauguuccuuuccuuu

SEQ ID NO: 301359 - RNA, 19 nt, Homo sapiens
ccagauccauuuucacuua

SEQ ID NO: 301360 - RNA, 19 nt, Homo sapiens
aaauauagcucagguagca

SEQ ID NO: 301361 - RNA, 19 nt, Homo sapiens
caaaguaagccauguaucu

SEQ ID NO: 301362 - RNA, 19 nt, Homo sapiens
ugacagaagcguauaugaa

SEQ ID NO: 301363 - RNA, 19 nt, Homo sapiens
ucaagaaugucgcaauuac

SEQ ID NO: 301364 - RNA, 19 nt, Homo sapiens
gaacagauugccugcuuuc

SEQ ID NO: 301365 - RNA, 19 nt, Homo sapiens
gaagaaagggaaagcagau

SEQ ID NO: 301366 - RNA, 19 nt, Homo sapiens
aaggaauacuugacaguuu

SEQ ID NO: 301367 - RNA, 19 nt, Homo sapiens
gaaggaauacuugacaguu

SEQ ID NO: 301368 - RNA, 19 nt, Homo sapiens
caagaguguagaagaauaa

SEQ ID NO: 301369 - RNA, 19 nt, Homo sapiens
gcucagguagcacuuuaua

SEQ ID NO: 301370 - RNA, 19 nt, Homo sapiens
guaauguguucggugauuu

SEQ ID NO: 301371 - RNA, 19 nt, Homo sapiens
gaauuuggguaugaacaga

SEQ ID NO: 301372 - RNA, 19 nt, Homo sapiens
gggaauaugcacaaacuug

SEQ ID NO: 301373 - RNA, 19 nt, Homo sapiens
gaaaacacaccuuuaguga

SEQ ID NO: 301374 - RNA, 19 nt, Homo sapiens
gaugacgccuguuauagag

SEQ ID NO: 301375 - RNA, 19 nt, Homo sapiens
ucagaugacgccuguuaua

SEQ ID NO: 301376 - RNA, 19 nt, Homo sapiens
gaauucugguuacaugugu

SEQ ID NO: 301377 - RNA, 19 nt, Homo sapiens
caaagagaacuccguaugu

SEQ ID NO: 301378 - RNA, 19 nt, Homo sapiens
ccuaacugaucgaauauau

SEQ ID NO: 301379 - RNA, 19 nt, Homo sapiens
aaacuuggcuucuuuaacc

SEQ ID NO: 301380 - RNA, 19 nt, Homo sapiens
uagcuaauauugcaaugug

SEQ ID NO: 301381 - RNA, 19 nt, Homo sapiens
ccacuuaccagacuaaauc

SEQ ID NO: 301382 - RNA, 19 nt, Homo sapiens
gagaaacauguccauauau

SEQ ID NO: 301383 - RNA, 19 nt, Homo sapiens
gauagagguucuuuauugc

SEQ ID NO: 301384 - RNA, 19 nt, Homo sapiens
aaagaaacauugccuugag

SEQ ID NO: 301385 - RNA, 19 nt, Homo sapiens
caaagaaacauugccuuga

SEQ ID NO: 301386 - RNA, 19 nt, Homo sapiens
cuacaaagcaacaguuaug

SEQ ID NO: 301387 - RNA, 19 nt, Homo sapiens
acgaguagauuauaagugu

SEQ ID NO: 301388 - RNA, 19 nt, Homo sapiens
agauuaaugccaacucuua

SEQ ID NO: 301389 - RNA, 19 nt, Homo sapiens
ccaccaacauuugaagcua

SEQ ID NO: 301390 - RNA, 19 nt, Homo sapiens
uauacgggauccuuuaaau

SEQ ID NO: 301391 - RNA, 19 nt, Homo sapiens
acagaagcguauaugaauu

SEQ ID NO: 301392 - RNA, 19 nt, Homo sapiens
aaaggcagaguacaaagua

SEQ ID NO: 301393 - RNA, 19 nt, Homo sapiens
ccaaagagaacuccguaug

SEQ ID NO: 301394 - RNA, 19 nt, Homo sapiens
gcaauguggcuugaaugua

SEQ ID NO: 301395 - RNA, 19 nt, Homo sapiens
cgaguuugguuaucagaug

SEQ ID NO: 301396 - RNA, 19 nt, Homo sapiens
ggacugccacugcauuuca

SEQ ID NO: 301397 - RNA, 19 nt, Homo sapiens
gccaagcaguuucuuucaa

SEQ ID NO: 301398 - RNA, 19 nt, Homo sapiens
gaacgaguagauuauaagu

SEQ ID NO: 301399 - RNA, 19 nt, Homo sapiens
uaaauguuccuuuccuuug

SEQ ID NO: 301400 - RNA, 19 nt, Homo sapiens
uacauugccuuggcuagua

SEQ ID NO: 301401 - RNA, 19 nt, Homo sapiens
caccaacuauagaauguau

SEQ ID NO: 301402 - RNA, 19 nt, Homo sapiens
guagguagcauccuuugau

SEQ ID NO: 301403 - RNA, 19 nt, Homo sapiens
gauggcagcgacacaauug

SEQ ID NO: 301404 - RNA, 19 nt, Homo sapiens
gugaggagccaccaacauu

SEQ ID NO: 301405 - RNA, 19 nt, Homo sapiens
gaggagccaccaacauuug

SEQ ID NO: 301406 - RNA, 19 nt, Homo sapiens
gcuauggagcucauuggua

SEQ ID NO: 301407 - RNA, 19 nt, Homo sapiens
acacaccuuuagugaagua

SEQ ID NO: 301408 - RNA, 19 nt, Homo sapiens
ucucagaugacgccuguua

SEQ ID NO: 301409 - RNA, 19 nt, Homo sapiens
gcacagaaauaaagagcaa

SEQ ID NO: 301410 - RNA, 19 nt, Homo sapiens
gaagaugugugaccagaca

SEQ ID NO: 301411 - RNA, 19 nt, Homo sapiens
cuagugauccugacauuua

SEQ ID NO: 301412 - RNA, 19 nt, Homo sapiens
gaagaagucaaacaaagaa

SEQ ID NO: 301413 - RNA, 19 nt, Homo sapiens
ucacuaggcugcugaggaa

SEQ ID NO: 301414 - RNA, 19 nt, Homo sapiens
gaccaagccugaagucuca

SEQ ID NO: 301415 - RNA, 19 nt, Homo sapiens
ugaggaagaucaauaauac

SEQ ID NO: 301416 - RNA, 19 nt, Homo sapiens
gcuccuauuucccaucaua

SEQ ID NO: 301417 - RNA, 19 nt, Homo sapiens
ggaaaugggaggaugaaga

SEQ ID NO: 301418 - RNA, 19 nt, Homo sapiens
gcaaaugagagcagaagaa

SEQ ID NO: 301419 - RNA, 19 nt, Homo sapiens
agaaucaucuuuccuagug

SEQ ID NO: 301420 - RNA, 19 nt, Homo sapiens
cagaagaagucaaacaaag

SEQ ID NO: 301421 - RNA, 19 nt, Homo sapiens
ggccaugccuuucacuuug

SEQ ID NO: 301422 - RNA, 19 nt, Homo sapiens
gaagucaaacaaagaagaa

SEQ ID NO: 301423 - RNA, 19 nt, Homo sapiens
gcagaagaagucaaacaaa

SEQ ID NO: 301424 - RNA, 19 nt, Homo sapiens
gagcccaacucaccgcaaa

SEQ ID NO: 301425 - RNA, 19 nt, Homo sapiens
gcuagaaucaucuuuccua

SEQ ID NO: 301426 - RNA, 19 nt, Homo sapiens
ugaagaggcuagaaucauc

SEQ ID NO: 301427 - RNA, 19 nt, Homo sapiens
aauaauaccuacuggaauc

SEQ ID NO: 301428 - RNA, 19 nt, Homo sapiens
gagagcagaagaagucaaa

SEQ ID NO: 301429 - RNA, 19 nt, Homo sapiens
gaaaugggaggaugaagag

SEQ ID NO: 301430 - RNA, 19 nt, Homo sapiens
ucaauaauaccuacuggaa

SEQ ID NO: 301431 - RNA, 19 nt, Homo sapiens
ccaaugagaggcuccuauu

SEQ ID NO: 301432 - RNA, 19 nt, Homo sapiens
gaagucaagcauggaaauu

SEQ ID NO: 301433 - RNA, 19 nt, Homo sapiens
uuagacagcacagaaauaa

SEQ ID NO: 301434 - RNA, 19 nt, Homo sapiens
gaaucaucuuuccuaguga

SEQ ID NO: 301435 - RNA, 19 nt, Homo sapiens
ggaagaucaauaauaccua

SEQ ID NO: 301436 - RNA, 19 nt, Homo sapiens
aaucaaugcugcccaccaa

SEQ ID NO: 301437 - RNA, 19 nt, Homo sapiens
gaaccagugcugccaguca

SEQ ID NO: 301438 - RNA, 19 nt, Homo sapiens
gaugaagaggcuagaauca

SEQ ID NO: 301439 - RNA, 19 nt, Homo sapiens
gggccaugccuuucacuuu

SEQ ID NO: 301440 - RNA, 19 nt, Homo sapiens
gagcagaagaagucaaaca

SEQ ID NO: 301441 - RNA, 19 nt, Homo sapiens
caaugagaggcuccuauuu

SEQ ID NO: 301442 - RNA, 19 nt, Homo sapiens
cugaggaagaucaauaaua

SEQ ID NO: 301443 - RNA, 19 nt, Homo sapiens
ggcuagaccuguguuuaga

SEQ ID NO: 301444 - RNA, 19 nt, Homo sapiens
agaagaagucaaacaaaga

SEQ ID NO: 301445 - RNA, 19 nt, Homo sapiens
cuagaccuguguuuagaga

SEQ ID NO: 301446 - RNA, 19 nt, Homo sapiens
ggaugaagaggcuagaauc

SEQ ID NO: 301447 - RNA, 19 nt, Homo sapiens
agacagcacagaaauaaag

SEQ ID NO: 301448 - RNA, 19 nt, Homo sapiens
aaugagaggcuccuauuuc

SEQ ID NO: 301449 - RNA, 19 nt, Homo sapiens
caaaugagagcagaagaag

SEQ ID NO: 301450 - RNA, 19 nt, Homo sapiens
agucaagcauggaaauugu

SEQ ID NO: 301451 - RNA, 19 nt, Homo sapiens
ggcuuuggcuucugauagu

SEQ ID NO: 301452 - RNA, 19 nt, Homo sapiens
ccaacucaccgcaaacuca

SEQ ID NO: 301453 - RNA, 19 nt, Homo sapiens
ccugaagucucaccccuua

SEQ ID NO: 301454 - RNA, 19 nt, Homo sapiens
caauaauaccuacuggaau

SEQ ID NO: 301455 - RNA, 19 nt, Homo sapiens
gaagaggcuagaaucaucu

SEQ ID NO: 301456 - RNA, 19 nt, Homo sapiens
gagaagucaagcauggaaa

SEQ ID NO: 301457 - RNA, 19 nt, Homo sapiens
gaccaguaccuccaagugu

SEQ ID NO: 301458 - RNA, 19 nt, Homo sapiens
gagaagcaguuuucacagu

SEQ ID NO: 301459 - RNA, 19 nt, Homo sapiens
ccaugccuuucacuuugua

SEQ ID NO: 301460 - RNA, 19 nt, Homo sapiens
uggaaucagucaugagaag

SEQ ID NO: 301461 - RNA, 19 nt, Homo sapiens
agucaaugcugcccaccaa

SEQ ID NO: 301462 - RNA, 19 nt, Homo sapiens
aaugagagcagaagaaguc

SEQ ID NO: 301463 - RNA, 19 nt, Homo sapiens
gaggcuagaaucaucuuuc

SEQ ID NO: 301464 - RNA, 19 nt, Homo sapiens
gaaucagucaugagaaguc

SEQ ID NO: 301465 - RNA, 19 nt, Homo sapiens
gccaugccuuucacuuugu

SEQ ID NO: 301466 - RNA, 19 nt, Homo sapiens
accaguaccuccaaguguu

SEQ ID NO: 301467 - RNA, 19 nt, Homo sapiens
cugcugaggaagaucaaua

SEQ ID NO: 301468 - RNA, 19 nt, Homo sapiens
cccuuaacauggagucuga

SEQ ID NO: 301469 - RNA, 19 nt, Homo sapiens
caggccaggugcugugguu

SEQ ID NO: 301470 - RNA, 19 nt, Homo sapiens
gacagcacagaaauaaaga

SEQ ID NO: 301471 - RNA, 19 nt, Homo sapiens
ucaagcauggaaauuguga

SEQ ID NO: 301472 - RNA, 19 nt, Homo sapiens
ugagaagucaagcauggaa

SEQ ID NO: 301473 - RNA, 19 nt, Homo sapiens
agaccuguguuuagagaag

SEQ ID NO: 301474 - RNA, 19 nt, Homo sapiens
agaagucaaacaaagaaga

SEQ ID NO: 301475 - RNA, 19 nt, Homo sapiens
cauuuagacagcacagaaa

SEQ ID NO: 301476 - RNA, 19 nt, Homo sapiens
cuccaaguguucagaagau

SEQ ID NO: 301477 - RNA, 19 nt, Homo sapiens
guccaggccaagcaaauga

SEQ ID NO: 301478 - RNA, 19 nt, Homo sapiens
uuuagacagcacagaaaua

SEQ ID NO: 301479 - RNA, 19 nt, Homo sapiens
caaguguucagaagaugug

SEQ ID NO: 301480 - RNA, 19 nt, Homo sapiens
ggccaggugcugugguuug

SEQ ID NO: 301481 - RNA, 19 nt, Homo sapiens
aaccagugcugccagucaa

SEQ ID NO: 301482 - RNA, 19 nt, Homo sapiens
acauuuagacagcacagaa

SEQ ID NO: 301483 - RNA, 19 nt, Homo sapiens
uagugauccugacauuuag

SEQ ID NO: 301484 - RNA, 19 nt, Homo sapiens
ggaaucagucaugagaagu

SEQ ID NO: 301485 - RNA, 19 nt, Homo sapiens
ggagaccaagccugaaguc

SEQ ID NO: 301486 - RNA, 19 nt, Homo sapiens
aaucagucaugagaaguca

SEQ ID NO: 301487 - RNA, 19 nt, Homo sapiens
guguguggccagaccagua

SEQ ID NO: 301488 - RNA, 19 nt, Homo sapiens
ccccauagcccacaaaaug

SEQ ID NO: 301489 - RNA, 19 nt, Homo sapiens
gaaccuggccgaugugaua

SEQ ID NO: 301490 - RNA, 19 nt, Homo sapiens
ggacagaaccugggcauga

SEQ ID NO: 301491 - RNA, 19 nt, Homo sapiens
gaugggaacuugacuuaca

SEQ ID NO: 301492 - RNA, 19 nt, Homo sapiens
gcagcugccucuucaacaa

SEQ ID NO: 301493 - RNA, 19 nt, Homo sapiens
cuacggaggucgcugcaaa

SEQ ID NO: 301494 - RNA, 19 nt, Homo sapiens
ccaaguauguggagcuaau

SEQ ID NO: 301495 - RNA, 19 nt, Homo sapiens
gagcuuggaggaaguauga

SEQ ID NO: 301496 - RNA, 19 nt, Homo sapiens
gaacgaguacggcaacaug

SEQ ID NO: 301497 - RNA, 19 nt, Homo sapiens
ugcacaagcuggacgguua

SEQ ID NO: 301498 - RNA, 19 nt, Homo sapiens
gguggcaacugcugcaaga

SEQ ID NO: 301499 - RNA, 19 nt, Homo sapiens
gcaaccacaugucccagau

SEQ ID NO: 301500 - RNA, 19 nt, Homo sapiens
ggaaguaugagugcugauu

SEQ ID NO: 301501 - RNA, 19 nt, Homo sapiens
gaaucuuaaucgaugaaug

SEQ ID NO: 301502 - RNA, 19 nt, Homo sapiens
gggcugacaucuacauuuu

SEQ ID NO: 301503 - RNA, 19 nt, Homo sapiens
gcuggacgguuacuacugu

SEQ ID NO: 301504 - RNA, 19 nt, Homo sapiens
gaucgucuccaauucgaaa

SEQ ID NO: 301505 - RNA, 19 nt, Homo sapiens
ucaguagugucaccuucua

SEQ ID NO: 301506 - RNA, 19 nt, Homo sapiens
ggaggcaccaugcaaaugu

SEQ ID NO: 301507 - RNA, 19 nt, Homo sapiens
ggcaacugcugcaagaaau

SEQ ID NO: 301508 - RNA, 19 nt, Homo sapiens
gaaguaugagugcugauuc

SEQ ID NO: 301509 - RNA, 19 nt, Homo sapiens
ggaggacacuggguucuac

SEQ ID NO: 301510 - RNA, 19 nt, Homo sapiens
gacagaaccugggcaugau

SEQ ID NO: 301511 - RNA, 19 nt, Homo sapiens
gcacagugaaaccaaguau

SEQ ID NO: 301512 - RNA, 19 nt, Homo sapiens
ggacggggcugacaucuac

SEQ ID NO: 301513 - RNA, 19 nt, Homo sapiens
ggagacggagagauauaaa

SEQ ID NO: 301514 - RNA, 19 nt, Homo sapiens
ggccgaggcugagaaggaa

SEQ ID NO: 301515 - RNA, 19 nt, Homo sapiens
gagggaggcaccaugcaaa

SEQ ID NO: 301516 - RNA, 19 nt, Homo sapiens
gggagacggagagauauaa

SEQ ID NO: 301517 - RNA, 19 nt, Homo sapiens
ggcaaagacugcaguaucc

SEQ ID NO: 301518 - RNA, 19 nt, Homo sapiens
cgacgaguacaaccaguuu

SEQ ID NO: 301519 - RNA, 19 nt, Homo sapiens
gcugcagcaucgacgagua

SEQ ID NO: 301520 - RNA, 19 nt, Homo sapiens
cggagaaacugagguaugg

SEQ ID NO: 301521 - RNA, 19 nt, Homo sapiens
ggagggaggcaccaugcaa

SEQ ID NO: 301522 - RNA, 19 nt, Homo sapiens
aaagacugcaguauccaua

SEQ ID NO: 301523 - RNA, 19 nt, Homo sapiens
ccaggugaguuucgucauc

SEQ ID NO: 301524 - RNA, 19 nt, Homo sapiens
gcaaugaagggaagugcau

SEQ ID NO: 301525 - RNA, 19 nt, Homo sapiens
gcuacgagaagcugaaugu

SEQ ID NO: 301526 - RNA, 19 nt, Homo sapiens
uaugagugcugauucaaac

SEQ ID NO: 301527 - RNA, 19 nt, Homo sapiens
guaugagugcugauucaaa

SEQ ID NO: 301528 - RNA, 19 nt, Homo sapiens
ggcaugauguggaacaaac

SEQ ID NO: 301529 - RNA, 19 nt, Homo sapiens
gguccucaccagcaacuuu

SEQ ID NO: 301530 - RNA, 19 nt, Homo sapiens
acagugaaaccaaguaugu

SEQ ID NO: 301531 - RNA, 19 nt, Homo sapiens
cugaugggaacuugacuua

SEQ ID NO: 301532 - RNA, 19 nt, Homo sapiens
cagaucgucuccaauucga

SEQ ID NO: 301533 - RNA, 19 nt, Homo sapiens
uggccgaugugauauacaa

SEQ ID NO: 301534 - RNA, 19 nt, Homo sapiens
caucccagccuucaacuca

SEQ ID NO: 301535 - RNA, 19 nt, Homo sapiens
ccagucggcuccuccaaac

SEQ ID NO: 301536 - RNA, 19 nt, Homo sapiens
gcccaaggccuagguuaug

SEQ ID NO: 301537 - RNA, 19 nt, Homo sapiens
gcaccaugcaaaugucuuc

SEQ ID NO: 301538 - RNA, 19 nt, Homo sapiens
gccuucaacucaaacuuca

SEQ ID NO: 301539 - RNA, 19 nt, Homo sapiens
agaaaugcacccugacuca

SEQ ID NO: 301540 - RNA, 19 nt, Homo sapiens
gcaacugcugcaagaaaug

SEQ ID NO: 301541 - RNA, 19 nt, Homo sapiens
ucccagaucgucuccaauu

SEQ ID NO: 301542 - RNA, 19 nt, Homo sapiens
ccgaugugauauacaagga

SEQ ID NO: 301543 - RNA, 19 nt, Homo sapiens
gguccaaacccuucaacuc

SEQ ID NO: 301544 - RNA, 19 nt, Homo sapiens
gcuucugccuucaacuuca

SEQ ID NO: 301545 - RNA, 19 nt, Homo sapiens
gagugcugauucaaaccaa

SEQ ID NO: 301546 - RNA, 19 nt, Homo sapiens
aaguaugagugcugauuca

SEQ ID NO: 301547 - RNA, 19 nt, Homo sapiens
ucccagccuucaacucaaa

SEQ ID NO: 301548 - RNA, 19 nt, Homo sapiens
uggcaacugcugcaagaaa

SEQ ID NO: 301549 - RNA, 19 nt, Homo sapiens
gaggcaccaugcaaauguc

SEQ ID NO: 301550 - RNA, 19 nt, Homo sapiens
cagcuucugccuucaacuu

SEQ ID NO: 301551 - RNA, 19 nt, Homo sapiens
caagaaaugcacccugacu

SEQ ID NO: 301552 - RNA, 19 nt, Homo sapiens
ggagcuaauugugaucaac

SEQ ID NO: 301553 - RNA, 19 nt, Homo sapiens
uauguggagcuaauuguga

SEQ ID NO: 301554 - RNA, 19 nt, Homo sapiens
uggugaaccuggccgaugu

SEQ ID NO: 301555 - RNA, 19 nt, Homo sapiens
caacgaccaccagcuguuc

SEQ ID NO: 301556 - RNA, 19 nt, Homo sapiens
gguauggccaugcccuaga

SEQ ID NO: 301557 - RNA, 19 nt, Homo sapiens
ugggagacaucaguagugu

SEQ ID NO: 301558 - RNA, 19 nt, Homo sapiens
uuacuacugugaccaugag

SEQ ID NO: 301559 - RNA, 19 nt, Homo sapiens
cgccuaaccugcacaagcu

SEQ ID NO: 301560 - RNA, 19 nt, Homo sapiens
ccaaguccguggugaaccu

SEQ ID NO: 301561 - RNA, 19 nt, Homo sapiens
aaccaaguauguggagcua

SEQ ID NO: 301562 - RNA, 19 nt, Homo sapiens
caguggaccuagccuggau

SEQ ID NO: 301563 - RNA, 19 nt, Homo sapiens
ggcacgggcuggggauuua

SEQ ID NO: 301564 - RNA, 19 nt, Homo sapiens
ggcaccaacaucaucauug

SEQ ID NO: 301565 - RNA, 19 nt, Homo sapiens
caagcuggacgguuacuac

SEQ ID NO: 301566 - RNA, 19 nt, Homo sapiens
cguccugguugccauggaa

SEQ ID NO: 301567 - RNA, 19 nt, Homo sapiens
cccgaaguccugucacuga

SEQ ID NO: 301568 - RNA, 19 nt, Homo sapiens
gagacggagagauauaaag

SEQ ID NO: 301569 - RNA, 19 nt, Homo sapiens
cugcugaucgcuucugcua

SEQ ID NO: 301570 - RNA, 19 nt, Homo sapiens
ucaacgaccaccagcuguu

SEQ ID NO: 301571 - RNA, 19 nt, Homo sapiens
ugucccagaucgucuccaa

SEQ ID NO: 301572 - RNA, 19 nt, Homo sapiens
gaugaccacacccgaaguc

SEQ ID NO: 301573 - RNA, 19 nt, Homo sapiens
gggaggcaccaugcaaaug

SEQ ID NO: 301574 - RNA, 19 nt, Homo sapiens
caaagacugcaguauccau

SEQ ID NO: 301575 - RNA, 19 nt, Homo sapiens
caccuccucuccucgcaau

SEQ ID NO: 301576 - RNA, 19 nt, Homo sapiens
caaguauguggagcuaauu

SEQ ID NO: 301577 - RNA, 19 nt, Homo sapiens
gcagauguggggauguuuu

SEQ ID NO: 301578 - RNA, 19 nt, Homo sapiens
gggcagauguggggauguu

SEQ ID NO: 301579 - RNA, 19 nt, Homo sapiens
acccuacagugcacaguga

SEQ ID NO: 301580 - RNA, 19 nt, Homo sapiens
gggcuggagaccacugcua

SEQ ID NO: 301581 - RNA, 19 nt, Homo sapiens
gcagugccagguucuuugg

SEQ ID NO: 301582 - RNA, 19 nt, Homo sapiens
guauguggagcuaauugug

SEQ ID NO: 301583 - RNA, 19 nt, Homo sapiens
gcacaagcuggacgguuac

SEQ ID NO: 301584 - RNA, 19 nt, Homo sapiens
gaaccuggccgaugugaua

SEQ ID NO: 301585 - RNA, 19 nt, Homo sapiens
ggacagaaccugggcauga

SEQ ID NO: 301586 - RNA, 19 nt, Homo sapiens
gaugggaacuugacuuaca

SEQ ID NO: 301587 - RNA, 19 nt, Homo sapiens
gcagcugccucuucaacaa

SEQ ID NO: 301588 - RNA, 19 nt, Homo sapiens
cuacggaggucgcugcaaa

SEQ ID NO: 301589 - RNA, 19 nt, Homo sapiens
ccaaguauguggagcuaau

SEQ ID NO: 301590 - RNA, 19 nt, Homo sapiens
gagcuuggaggaaguauga

SEQ ID NO: 301591 - RNA, 19 nt, Homo sapiens
gaacgaguacggcaacaug

SEQ ID NO: 301592 - RNA, 19 nt, Homo sapiens
ugcacaagcuggacgguua

SEQ ID NO: 301593 - RNA, 19 nt, Homo sapiens
caacuccucuccucgcaau

SEQ ID NO: 301594 - RNA, 19 nt, Homo sapiens
gguggcaacugcugcaaga

SEQ ID NO: 301595 - RNA, 19 nt, Homo sapiens
gcaaccacaugucccagau

SEQ ID NO: 301596 - RNA, 19 nt, Homo sapiens
ggaaguaugagugcugauu

SEQ ID NO: 301597 - RNA, 19 nt, Homo sapiens
gaaucuuaaucgaugaaug

SEQ ID NO: 301598 - RNA, 19 nt, Homo sapiens
gggcugacaucuacauuuu

SEQ ID NO: 301599 - RNA, 19 nt, Homo sapiens
gcuggacgguuacuacugu

SEQ ID NO: 301600 - RNA, 19 nt, Homo sapiens
gaucgucuccaauucgaaa

SEQ ID NO: 301601 - RNA, 19 nt, Homo sapiens
ucaguagugucaccuucua

SEQ ID NO: 301602 - RNA, 19 nt, Homo sapiens
ggaggcaccaugcaaaugu

SEQ ID NO: 301603 - RNA, 19 nt, Homo sapiens
ggcaacugcugcaagaaau

SEQ ID NO: 301604 - RNA, 19 nt, Homo sapiens
gaaguaugagugcugauuc

SEQ ID NO: 301605 - RNA, 19 nt, Homo sapiens
ggaggacacuggguucuac

SEQ ID NO: 301606 - RNA, 19 nt, Homo sapiens
gacagaaccugggcaugau

SEQ ID NO: 301607 - RNA, 19 nt, Homo sapiens
gcacagugaaaccaaguau

SEQ ID NO: 301608 - RNA, 19 nt, Homo sapiens
ggacggggcugacaucuac

SEQ ID NO: 301609 - RNA, 19 nt, Homo sapiens
ggagacggagagauauaaa

SEQ ID NO: 301610 - RNA, 19 nt, Homo sapiens
ggccgaggcugagaaggaa

SEQ ID NO: 301611 - RNA, 19 nt, Homo sapiens
gagggaggcaccaugcaaa

SEQ ID NO: 301612 - RNA, 19 nt, Homo sapiens
gggagacggagagauauaa

SEQ ID NO: 301613 - RNA, 19 nt, Homo sapiens
ggcaaagacugcaguaucc

SEQ ID NO: 301614 - RNA, 19 nt, Homo sapiens
cgacgaguacaaccaguuu

SEQ ID NO: 301615 - RNA, 19 nt, Homo sapiens
gcugcagcaucgacgagua

SEQ ID NO: 301616 - RNA, 19 nt, Homo sapiens
cggagaaacugagguaugg

SEQ ID NO: 301617 - RNA, 19 nt, Homo sapiens
ggagggaggcaccaugcaa

SEQ ID NO: 301618 - RNA, 19 nt, Homo sapiens
aaagacugcaguauccaua

SEQ ID NO: 301619 - RNA, 19 nt, Homo sapiens
gcaaugaagggaagugcau

SEQ ID NO: 301620 - RNA, 19 nt, Homo sapiens
gcuacgagaagcugaaugu

SEQ ID NO: 301621 - RNA, 19 nt, Homo sapiens
uaugagugcugauucaaac

SEQ ID NO: 301622 - RNA, 19 nt, Homo sapiens
guaugagugcugauucaaa

SEQ ID NO: 301623 - RNA, 19 nt, Homo sapiens
ggcaugauguggaacaaac

SEQ ID NO: 301624 - RNA, 19 nt, Homo sapiens
cugaugggaacuugacuua

SEQ ID NO: 301625 - RNA, 19 nt, Homo sapiens
gguccucaccagcaacuuu

SEQ ID NO: 301626 - RNA, 19 nt, Homo sapiens
acagugaaaccaaguaugu

SEQ ID NO: 301627 - RNA, 19 nt, Homo sapiens
cagaucgucuccaauucga

SEQ ID NO: 301628 - RNA, 19 nt, Homo sapiens
uggccgaugugauauacaa

SEQ ID NO: 301629 - RNA, 19 nt, Homo sapiens
ccagucggcuccuccaaac

SEQ ID NO: 301630 - RNA, 19 nt, Homo sapiens
gcccaaggccuagguuaug

SEQ ID NO: 301631 - RNA, 19 nt, Homo sapiens
gcaccaugcaaaugucuuc

SEQ ID NO: 301632 - RNA, 19 nt, Homo sapiens
agaaaugcacccugacuca

SEQ ID NO: 301633 - RNA, 19 nt, Homo sapiens
gcaacugcugcaagaaaug

SEQ ID NO: 301634 - RNA, 19 nt, Homo sapiens
ucccagaucgucuccaauu

SEQ ID NO: 301635 - RNA, 19 nt, Homo sapiens
ccgaugugauauacaagga

SEQ ID NO: 301636 - RNA, 19 nt, Homo sapiens
gguccaaacccuucaacuc

SEQ ID NO: 301637 - RNA, 19 nt, Homo sapiens
gcuucugccuucaacuuca

SEQ ID NO: 301638 - RNA, 19 nt, Homo sapiens
gagugcugauucaaaccaa

SEQ ID NO: 301639 - RNA, 19 nt, Homo sapiens
aaguaugagugcugauuca

SEQ ID NO: 301640 - RNA, 19 nt, Homo sapiens
uggcaacugcugcaagaaa

SEQ ID NO: 301641 - RNA, 19 nt, Homo sapiens
gaggcaccaugcaaauguc

SEQ ID NO: 301642 - RNA, 19 nt, Homo sapiens
cagcuucugccuucaacuu

SEQ ID NO: 301643 - RNA, 19 nt, Homo sapiens
caagaaaugcacccugacu

SEQ ID NO: 301644 - RNA, 19 nt, Homo sapiens
ggagcuaauugugaucaac

SEQ ID NO: 301645 - RNA, 19 nt, Homo sapiens
uauguggagcuaauuguga

SEQ ID NO: 301646 - RNA, 19 nt, Homo sapiens
uggugaaccuggccgaugu

SEQ ID NO: 301647 - RNA, 19 nt, Homo sapiens
caacgaccaccagcuguuc

SEQ ID NO: 301648 - RNA, 19 nt, Homo sapiens
gguauggccaugcccuaga

SEQ ID NO: 301649 - RNA, 19 nt, Homo sapiens
ugggagacaucaguagugu

SEQ ID NO: 301650 - RNA, 19 nt, Homo sapiens
uuacuacugugaccaugag

SEQ ID NO: 301651 - RNA, 19 nt, Homo sapiens
cgccuaaccugcacaagcu

SEQ ID NO: 301652 - RNA, 19 nt, Homo sapiens
aaccaaguauguggagcua

SEQ ID NO: 301653 - RNA, 19 nt, Homo sapiens
guaaugccacccaccucuu

SEQ ID NO: 301654 - RNA, 19 nt, Homo sapiens
ccaaguccguggugaaccu

SEQ ID NO: 301655 - RNA, 19 nt, Homo sapiens
caguggaccuagccuggau

SEQ ID NO: 301656 - RNA, 19 nt, Homo sapiens
ggcacgggcuggggauuua

SEQ ID NO: 301657 - RNA, 19 nt, Homo sapiens
ggcaccaacaucaucauug

SEQ ID NO: 301658 - RNA, 19 nt, Homo sapiens
caagcuggacgguuacuac

SEQ ID NO: 301659 - RNA, 19 nt, Homo sapiens
cguccugguugccauggaa

SEQ ID NO: 301660 - RNA, 19 nt, Homo sapiens
cccgaaguccugucacuga

SEQ ID NO: 301661 - RNA, 19 nt, Homo sapiens
gagacggagagauauaaag

SEQ ID NO: 301662 - RNA, 19 nt, Homo sapiens
cugcugaucgcuucugcua

SEQ ID NO: 301663 - RNA, 19 nt, Homo sapiens
ucaacgaccaccagcuguu

SEQ ID NO: 301664 - RNA, 19 nt, Homo sapiens
ugucccagaucgucuccaa

SEQ ID NO: 301665 - RNA, 19 nt, Homo sapiens
gaugaccacacccgaaguc

SEQ ID NO: 301666 - RNA, 19 nt, Homo sapiens
gggaggcaccaugcaaaug

SEQ ID NO: 301667 - RNA, 19 nt, Homo sapiens
caaagacugcaguauccau

SEQ ID NO: 301668 - RNA, 19 nt, Homo sapiens
gcaguaagcagccccaaca

SEQ ID NO: 301669 - RNA, 19 nt, Homo sapiens
caaguauguggagcuaauu

SEQ ID NO: 301670 - RNA, 19 nt, Homo sapiens
acccuacagugcacaguga

SEQ ID NO: 301671 - RNA, 19 nt, Homo sapiens
gcagauguggggauguuuu

SEQ ID NO: 301672 - RNA, 19 nt, Homo sapiens
gggcagauguggggauguu

SEQ ID NO: 301673 - RNA, 19 nt, Homo sapiens
guauguggagcuaauugug

SEQ ID NO: 301674 - RNA, 19 nt, Homo sapiens
gcagugccagguucuuugg

SEQ ID NO: 301675 - RNA, 19 nt, Homo sapiens
gcacaagcuggacgguuac

SEQ ID NO: 301676 - RNA, 19 nt, Homo sapiens
gggcuggagaccacugcua

SEQ ID NO: 301677 - RNA, 19 nt, Homo sapiens
ggagggaggucuguucuau

SEQ ID NO: 301678 - RNA, 19 nt, Homo sapiens
ggaggucuguucuaucugu

SEQ ID NO: 301679 - RNA, 19 nt, Homo sapiens
guuaccagguucauacauu

SEQ ID NO: 301680 - RNA, 19 nt, Homo sapiens
gggaacacugugaaaguua

SEQ ID NO: 301681 - RNA, 19 nt, Homo sapiens
gcccaggacugucacacaa

SEQ ID NO: 301682 - RNA, 19 nt, Homo sapiens
ggaacacugugaaaguuac

SEQ ID NO: 301683 - RNA, 19 nt, Homo sapiens
ugaacucuuuacuggguua

SEQ ID NO: 301684 - RNA, 19 nt, Homo sapiens
gagaagccugaacucuuua

SEQ ID NO: 301685 - RNA, 19 nt, Homo sapiens
uuaccagguucauacauug

SEQ ID NO: 301686 - RNA, 19 nt, Homo sapiens
ccacccauguccucucaga

SEQ ID NO: 301687 - RNA, 19 nt, Homo sapiens
ucuccagucuccuuuccua

SEQ ID NO: 301688 - RNA, 19 nt, Homo sapiens
uguucuaucuguugcugua

SEQ ID NO: 301689 - RNA, 19 nt, Homo sapiens
aguaagagcagcagcaaau

SEQ ID NO: 301690 - RNA, 19 nt, Homo sapiens
agggaggucuguucuaucu

SEQ ID NO: 301691 - RNA, 19 nt, Homo sapiens
cagggcagcaagaagagua

SEQ ID NO: 301692 - RNA, 19 nt, Homo sapiens
gaggucuguucuaucuguu

SEQ ID NO: 301693 - RNA, 19 nt, Homo sapiens
gaagggagggaggucuguu

SEQ ID NO: 301694 - RNA, 19 nt, Homo sapiens
ggggaacacugugaaaguu

SEQ ID NO: 301695 - RNA, 19 nt, Homo sapiens
gggagggaggucuguucua

SEQ ID NO: 301696 - RNA, 19 nt, Homo sapiens
gaguaagagcagcagcaaa

SEQ ID NO: 301697 - RNA, 19 nt, Homo sapiens
cauccuguccugccuguuc

SEQ ID NO: 301698 - RNA, 19 nt, Homo sapiens
ccaaggcccaccggaaguu

SEQ ID NO: 301699 - RNA, 19 nt, Homo sapiens
gcugugggcucugcuucuc

SEQ ID NO: 301700 - RNA, 19 nt, Homo sapiens
ucuaucuguugcuguaaau

SEQ ID NO: 301701 - RNA, 19 nt, Homo sapiens
gcagcaagaagaguaagag

SEQ ID NO: 301702 - RNA, 19 nt, Homo sapiens
agaaaggaaugguuugaua

SEQ ID NO: 301703 - RNA, 19 nt, Homo sapiens
ggagguggauuauuugaug

SEQ ID NO: 301704 - RNA, 19 nt, Homo sapiens
gcagugaaaccuuuacuaa

SEQ ID NO: 301705 - RNA, 19 nt, Homo sapiens
gguugacucuuccucauua

SEQ ID NO: 301706 - RNA, 19 nt, Homo sapiens
gacaguaguucuuauucua

SEQ ID NO: 301707 - RNA, 19 nt, Homo sapiens
gaugacauguuugaagaua

SEQ ID NO: 301708 - RNA, 19 nt, Homo sapiens
gaaacacucucagaugcua

SEQ ID NO: 301709 - RNA, 19 nt, Homo sapiens
ggacaaagagguaguggaa

SEQ ID NO: 301710 - RNA, 19 nt, Homo sapiens
cggauagacuuauuucuuu

SEQ ID NO: 301711 - RNA, 19 nt, Homo sapiens
ucacuaauaucaccaguau

SEQ ID NO: 301712 - RNA, 19 nt, Homo sapiens
aaacaagugucucauacaa

SEQ ID NO: 301713 - RNA, 19 nt, Homo sapiens
gaggaaauaugguuacuac

SEQ ID NO: 301714 - RNA, 19 nt, Homo sapiens
uaauuucugugcaaccuua

SEQ ID NO: 301715 - RNA, 19 nt, Homo sapiens
aaaguugcauguucuauga

SEQ ID NO: 301716 - RNA, 19 nt, Homo sapiens
gaaaggaaugguuugauau

SEQ ID NO: 301717 - RNA, 19 nt, Homo sapiens
gagaacaguaucuugguua

SEQ ID NO: 301718 - RNA, 19 nt, Homo sapiens
ggagaacaguaucuugguu

SEQ ID NO: 301719 - RNA, 19 nt, Homo sapiens
gaaauauugccaagagauu

SEQ ID NO: 301720 - RNA, 19 nt, Homo sapiens
gugcaugauuucacuuuaa

SEQ ID NO: 301721 - RNA, 19 nt, Homo sapiens
ggaaugguuugauauuuac

SEQ ID NO: 301722 - RNA, 19 nt, Homo sapiens
ggacaguaguucuuauucu

SEQ ID NO: 301723 - RNA, 19 nt, Homo sapiens
ggaaauaugguuacuacau

SEQ ID NO: 301724 - RNA, 19 nt, Homo sapiens
uauccucucucucaucuuu

SEQ ID NO: 301725 - RNA, 19 nt, Homo sapiens
gaaguaccacccugacaaa

SEQ ID NO: 301726 - RNA, 19 nt, Homo sapiens
gaaggccuuucacaaguug

SEQ ID NO: 301727 - RNA, 19 nt, Homo sapiens
gguaauuucuacugcauuc

SEQ ID NO: 301728 - RNA, 19 nt, Homo sapiens
gugaaaccuuuacuaauuc

SEQ ID NO: 301729 - RNA, 19 nt, Homo sapiens
caacgaagaggaaauaugg

SEQ ID NO: 301730 - RNA, 19 nt, Homo sapiens
ugacauguuugaagauaug

SEQ ID NO: 301731 - RNA, 19 nt, Homo sapiens
gcuaauuauuucccugauu

SEQ ID NO: 301732 - RNA, 19 nt, Homo sapiens
gagcagucauuuaacuuca

SEQ ID NO: 301733 - RNA, 19 nt, Homo sapiens
gguaaaggacaaagaggua

SEQ ID NO: 301734 - RNA, 19 nt, Homo sapiens
caagaaggccuuucacaag

SEQ ID NO: 301735 - RNA, 19 nt, Homo sapiens
acaaagagguaguggaagu

SEQ ID NO: 301736 - RNA, 19 nt, Homo sapiens
acaagugucucauacaaca

SEQ ID NO: 301737 - RNA, 19 nt, Homo sapiens
gaaaucauagcuacuuaca

SEQ ID NO: 301738 - RNA, 19 nt, Homo sapiens
ccaguauuauuaccaagaa

SEQ ID NO: 301739 - RNA, 19 nt, Homo sapiens
guagacaaaggcaucauuu

SEQ ID NO: 301740 - RNA, 19 nt, Homo sapiens
cgaagaggaaauaugguua

SEQ ID NO: 301741 - RNA, 19 nt, Homo sapiens
acaaaggcaucauuuccaa

SEQ ID NO: 301742 - RNA, 19 nt, Homo sapiens
cacauuauacuccauauga

SEQ ID NO: 301743 - RNA, 19 nt, Homo sapiens
caucagagcgccaaaucaa

SEQ ID NO: 301744 - RNA, 19 nt, Homo sapiens
agaacaguaucuugguuaa

SEQ ID NO: 301745 - RNA, 19 nt, Homo sapiens
gcagucauuuaacuucaau

SEQ ID NO: 301746 - RNA, 19 nt, Homo sapiens
gcuaaacaauuuucuguga

SEQ ID NO: 301747 - RNA, 19 nt, Homo sapiens
gagguggauuauuugauga

SEQ ID NO: 301748 - RNA, 19 nt, Homo sapiens
gaagcaaaauucagagaga

SEQ ID NO: 301749 - RNA, 19 nt, Homo sapiens
uuugauagcuugaagaucu

SEQ ID NO: 301750 - RNA, 19 nt, Homo sapiens
gaacugggguaaaggaaau

SEQ ID NO: 301751 - RNA, 19 nt, Homo sapiens
ugugugaaccuaaugauuu

SEQ ID NO: 301752 - RNA, 19 nt, Homo sapiens
cuacauacacugacuguuc

SEQ ID NO: 301753 - RNA, 19 nt, Homo sapiens
augcaacucuggagguaua

SEQ ID NO: 301754 - RNA, 19 nt, Homo sapiens
ggcaucauuuccaagaauu

SEQ ID NO: 301755 - RNA, 19 nt, Homo sapiens
ucaagaaggccuuucacaa

SEQ ID NO: 301756 - RNA, 19 nt, Homo sapiens
acugauaccucauucuguu

SEQ ID NO: 301757 - RNA, 19 nt, Homo sapiens
ucucucaucuuuaucuaga

SEQ ID NO: 301758 - RNA, 19 nt, Homo sapiens
gacugucacucaacgaaga

SEQ ID NO: 301759 - RNA, 19 nt, Homo sapiens
aagaaggccuuucacaagu

SEQ ID NO: 301760 - RNA, 19 nt, Homo sapiens
ugccaguucuuuccucuuu

SEQ ID NO: 301761 - RNA, 19 nt, Homo sapiens
ccugagaaaugugugcuuu

SEQ ID NO: 301762 - RNA, 19 nt, Homo sapiens
guuaauugcuacugaaagg

SEQ ID NO: 301763 - RNA, 19 nt, Homo sapiens
auccuucucucacaaauuu

SEQ ID NO: 301764 - RNA, 19 nt, Homo sapiens
acucuuaggucuuaguaug

SEQ ID NO: 301765 - RNA, 19 nt, Homo sapiens
caaaguugcauguucuaug

SEQ ID NO: 301766 - RNA, 19 nt, Homo sapiens
agaaggccuuucacaaguu

SEQ ID NO: 301767 - RNA, 19 nt, Homo sapiens
gccaguucuuuccucuuua

SEQ ID NO: 301768 - RNA, 19 nt, Homo sapiens
gcacucuuaggucuuagua

SEQ ID NO: 301769 - RNA, 19 nt, Homo sapiens
guaucuugguuaauugcua

SEQ ID NO: 301770 - RNA, 19 nt, Homo sapiens
ucaccaguauuauuaccaa

SEQ ID NO: 301771 - RNA, 19 nt, Homo sapiens
uuugacaagugcaugauuu

SEQ ID NO: 301772 - RNA, 19 nt, Homo sapiens
ugaccaaccugaaaacuga

SEQ ID NO: 301773 - RNA, 19 nt, Homo sapiens
gccaguaauuucugugcaa

SEQ ID NO: 301774 - RNA, 19 nt, Homo sapiens
cuacugaaagguugagaaa

SEQ ID NO: 301775 - RNA, 19 nt, Homo sapiens
ucagagcgccaaaucaaga

SEQ ID NO: 301776 - RNA, 19 nt, Homo sapiens
acaaguuggccaugaagua

SEQ ID NO: 301777 - RNA, 19 nt, Homo sapiens
uggauuauuugaugacaug

SEQ ID NO: 301778 - RNA, 19 nt, Homo sapiens
ggauggugguuccaguaga

SEQ ID NO: 301779 - RNA, 19 nt, Homo sapiens
gauaggauuuuguuuguca

SEQ ID NO: 301780 - RNA, 19 nt, Homo sapiens
gaagaggaaauaugguuac

SEQ ID NO: 301781 - RNA, 19 nt, Homo sapiens
uugaugacauguuugaaga

SEQ ID NO: 301782 - RNA, 19 nt, Homo sapiens
acucucagaugcuaauaga

SEQ ID NO: 301783 - RNA, 19 nt, Homo sapiens
cccuugggcucacuaauau

SEQ ID NO: 301784 - RNA, 19 nt, Homo sapiens
ccaguucuuuccucuuuag

SEQ ID NO: 301785 - RNA, 19 nt, Homo sapiens
aauuaauucuggccucaaa

SEQ ID NO: 301786 - RNA, 19 nt, Homo sapiens
guugagaaaggaaugguuu

SEQ ID NO: 301787 - RNA, 19 nt, Homo sapiens
caaauucaacauucaacga

SEQ ID NO: 301788 - RNA, 19 nt, Homo sapiens
uacauacacugacuguuca

SEQ ID NO: 301789 - RNA, 19 nt, Homo sapiens
acugaaagguugagaaagg

SEQ ID NO: 301790 - RNA, 19 nt, Homo sapiens
gaacaguaucuugguuaau

SEQ ID NO: 301791 - RNA, 19 nt, Homo sapiens
cucauuaucuuugaugcua

SEQ ID NO: 301792 - RNA, 19 nt, Homo sapiens
ucacuaaauccaacugguu

SEQ ID NO: 301793 - RNA, 19 nt, Homo sapiens
ugaaguaccacccugacaa

SEQ ID NO: 301794 - RNA, 19 nt, Homo sapiens
ggugcaggauauuagaaau

SEQ ID NO: 301795 - RNA, 19 nt, Homo sapiens
acaguaucuugguuaauug

SEQ ID NO: 301796 - RNA, 19 nt, Homo sapiens
ggagggugcaggauauuag

SEQ ID NO: 301797 - RNA, 19 nt, Homo sapiens
caguaaaggagaacaguau

SEQ ID NO: 301798 - RNA, 19 nt, Homo sapiens
ccaaucagcauacaguaca

SEQ ID NO: 301799 - RNA, 19 nt, Homo sapiens
uaugaaacacucucagaug

SEQ ID NO: 301800 - RNA, 19 nt, Homo sapiens
ccugaaaacugauaggauu

SEQ ID NO: 301801 - RNA, 19 nt, Homo sapiens
gaaagguugagaaaggaau

SEQ ID NO: 301802 - RNA, 19 nt, Homo sapiens
gaaaggaaguugguguuua

SEQ ID NO: 301803 - RNA, 19 nt, Homo sapiens
caaaggaacugacagaaga

SEQ ID NO: 301804 - RNA, 19 nt, Homo sapiens
ggaaauggaucugucuuug

SEQ ID NO: 301805 - RNA, 19 nt, Homo sapiens
ggaaguugguguuuaugaa

SEQ ID NO: 301806 - RNA, 19 nt, Homo sapiens
gaaggucucccuauuaaug

SEQ ID NO: 301807 - RNA, 19 nt, Homo sapiens
ugacucaaguaccaaauaa

SEQ ID NO: 301808 - RNA, 19 nt, Homo sapiens
aauaagaccuggaaguuug

SEQ ID NO: 301809 - RNA, 19 nt, Homo sapiens
gaauaagaccuggaaguuu

SEQ ID NO: 301810 - RNA, 19 nt, Homo sapiens
gggaaggcauggagagaaa

SEQ ID NO: 301811 - RNA, 19 nt, Homo sapiens
guaaagaucagccuauaau

SEQ ID NO: 301812 - RNA, 19 nt, Homo sapiens
aaaggaaguugguguuuau

SEQ ID NO: 301813 - RNA, 19 nt, Homo sapiens
uggagcagcuggucaaauu

SEQ ID NO: 301814 - RNA, 19 nt, Homo sapiens
gaagucaguuaagguuauu

SEQ ID NO: 301815 - RNA, 19 nt, Homo sapiens
gguacagguuugugaauga

SEQ ID NO: 301816 - RNA, 19 nt, Homo sapiens
gugcagccuuagauaaaua

SEQ ID NO: 301817 - RNA, 19 nt, Homo sapiens
uugaaggucucccuauuaa

SEQ ID NO: 301818 - RNA, 19 nt, Homo sapiens
gaaauugcaaggaaaggaa

SEQ ID NO: 301819 - RNA, 19 nt, Homo sapiens
caucaaggcucgaaaacua

SEQ ID NO: 301820 - RNA, 19 nt, Homo sapiens
gagaauuugucacgacugu

SEQ ID NO: 301821 - RNA, 19 nt, Homo sapiens
guugaaggucucccuauua

SEQ ID NO: 301822 - RNA, 19 nt, Homo sapiens
ggaaaggaaguugguguuu

SEQ ID NO: 301823 - RNA, 19 nt, Homo sapiens
caagaagucaguuaagguu

SEQ ID NO: 301824 - RNA, 19 nt, Homo sapiens
caaauugcucuuaaacuug

SEQ ID NO: 301825 - RNA, 19 nt, Homo sapiens
guuugugaaugacaguuua

SEQ ID NO: 301826 - RNA, 19 nt, Homo sapiens
gcaaaggaacugacagaag

SEQ ID NO: 301827 - RNA, 19 nt, Homo sapiens
aagcucaaauugcucuuaa

SEQ ID NO: 301828 - RNA, 19 nt, Homo sapiens
gguaaagaucagccuauaa

SEQ ID NO: 301829 - RNA, 19 nt, Homo sapiens
agaagucaguuaagguuau

SEQ ID NO: 301830 - RNA, 19 nt, Homo sapiens
augaagcucugaaagauga

SEQ ID NO: 301831 - RNA, 19 nt, Homo sapiens
aaagaucagccuauaauuc

SEQ ID NO: 301832 - RNA, 19 nt, Homo sapiens
guacaguauuggaaaugga

SEQ ID NO: 301833 - RNA, 19 nt, Homo sapiens
ggaucuuacugcaaaggaa

SEQ ID NO: 301834 - RNA, 19 nt, Homo sapiens
ccaaucagaguccuuguga

SEQ ID NO: 301835 - RNA, 19 nt, Homo sapiens
ccuaugguguuccugauga

SEQ ID NO: 301836 - RNA, 19 nt, Homo sapiens
ccauggguguuaucucuga

SEQ ID NO: 301837 - RNA, 19 nt, Homo sapiens
caguuaagguuauuguugu

SEQ ID NO: 301838 - RNA, 19 nt, Homo sapiens
gaucagccuauaauucuug

SEQ ID NO: 301839 - RNA, 19 nt, Homo sapiens
gaaauggaucugucuuugg

SEQ ID NO: 301840 - RNA, 19 nt, Homo sapiens
gaucacaaccgagcuaaag

SEQ ID NO: 301841 - RNA, 19 nt, Homo sapiens
gaaagcaaaugugaaaauc

SEQ ID NO: 301842 - RNA, 19 nt, Homo sapiens
aaauggaucugucuuuggu

SEQ ID NO: 301843 - RNA, 19 nt, Homo sapiens
ucaaagcugaagaaucuaa

SEQ ID NO: 301844 - RNA, 19 nt, Homo sapiens
aaggugaaauugcaaggaa

SEQ ID NO: 301845 - RNA, 19 nt, Homo sapiens
ucaguugcuugacucguuu

SEQ ID NO: 301846 - RNA, 19 nt, Homo sapiens
gggugcagccuuagauaaa

SEQ ID NO: 301847 - RNA, 19 nt, Homo sapiens
caucgcaacagauaaagaa

SEQ ID NO: 301848 - RNA, 19 nt, Homo sapiens
ugguaaagaucagccuaua

SEQ ID NO: 301849 - RNA, 19 nt, Homo sapiens
guuacuaaaugcuucaaag

SEQ ID NO: 301850 - RNA, 19 nt, Homo sapiens
ugacuagacaaugauguua

SEQ ID NO: 301851 - RNA, 19 nt, Homo sapiens
agaauaagaccuggaaguu

SEQ ID NO: 301852 - RNA, 19 nt, Homo sapiens
uuaugaagcucugaaagau

SEQ ID NO: 301853 - RNA, 19 nt, Homo sapiens
gcucuuaaacuugguguga

SEQ ID NO: 301854 - RNA, 19 nt, Homo sapiens
gaaauuguccccgcaguuu

SEQ ID NO: 301855 - RNA, 19 nt, Homo sapiens
gaaguugguguuuaugaag

SEQ ID NO: 301856 - RNA, 19 nt, Homo sapiens
gaaaccauuccucgacuca

SEQ ID NO: 301857 - RNA, 19 nt, Homo sapiens
ucaguuaagguuauuguug

SEQ ID NO: 301858 - RNA, 19 nt, Homo sapiens
gaaaagauuuacugaaagc

SEQ ID NO: 301859 - RNA, 19 nt, Homo sapiens
uaaauacgccaagaaguca

SEQ ID NO: 301860 - RNA, 19 nt, Homo sapiens
ucaagaauaagaccuggaa

SEQ ID NO: 301861 - RNA, 19 nt, Homo sapiens
uuacugaaagcaaauguga

SEQ ID NO: 301862 - RNA, 19 nt, Homo sapiens
guccauggguguuaucucu

SEQ ID NO: 301863 - RNA, 19 nt, Homo sapiens
agggacaucugguuuggaa

SEQ ID NO: 301864 - RNA, 19 nt, Homo sapiens
gcaaggaaaggaaguuggu

SEQ ID NO: 301865 - RNA, 19 nt, Homo sapiens
gccaagaagucaguuaagg

SEQ ID NO: 301866 - RNA, 19 nt, Homo sapiens
gauaaauacgccaagaagu

SEQ ID NO: 301867 - RNA, 19 nt, Homo sapiens
ggugcagccuuagauaaau

SEQ ID NO: 301868 - RNA, 19 nt, Homo sapiens
gauuacgugcuucuuggua

SEQ ID NO: 301869 - RNA, 19 nt, Homo sapiens
gaucugcucuacucauucc

SEQ ID NO: 301870 - RNA, 19 nt, Homo sapiens
cuauaauucuugugcuguu

SEQ ID NO: 301871 - RNA, 19 nt, Homo sapiens
ugugacugcuaaugaugua

SEQ ID NO: 301872 - RNA, 19 nt, Homo sapiens
gcuguuagugugcauucua

SEQ ID NO: 301873 - RNA, 19 nt, Homo sapiens
uguugaaggucucccuauu

SEQ ID NO: 301874 - RNA, 19 nt, Homo sapiens
cugaugaucugcucuacuc

SEQ ID NO: 301875 - RNA, 19 nt, Homo sapiens
gcuaaugauguaaagaaug

SEQ ID NO: 301876 - RNA, 19 nt, Homo sapiens
uuagauaaauacgccaaga

SEQ ID NO: 301877 - RNA, 19 nt, Homo sapiens
ggauguggccauucuugug

SEQ ID NO: 301878 - RNA, 19 nt, Homo sapiens
cagcuggucaaauugcaua

SEQ ID NO: 301879 - RNA, 19 nt, Homo sapiens
acugaaagcaaaugugaaa

SEQ ID NO: 301880 - RNA, 19 nt, Homo sapiens
ugucaucgcaacagauaaa

SEQ ID NO: 301881 - RNA, 19 nt, Homo sapiens
caaagcugaagaaucuaaa

SEQ ID NO: 301882 - RNA, 19 nt, Homo sapiens
cugccugacuagacaauga

SEQ ID NO: 301883 - RNA, 19 nt, Homo sapiens
aaacuuggugugacugcua

SEQ ID NO: 301884 - RNA, 19 nt, Homo sapiens
cuggucaaauugcauauuc

SEQ ID NO: 301885 - RNA, 19 nt, Homo sapiens
cucauucccuguuguaauc

SEQ ID NO: 301886 - RNA, 19 nt, Homo sapiens
cuacucauucccuguugua

SEQ ID NO: 301887 - RNA, 19 nt, Homo sapiens
cgucagggacaucugguuu

SEQ ID NO: 301888 - RNA, 19 nt, Homo sapiens
ugacugcuaaugauguaaa

SEQ ID NO: 301889 - RNA, 19 nt, Homo sapiens
aagaucagccuauaauucu

SEQ ID NO: 301890 - RNA, 19 nt, Homo sapiens
gcucaaauugcucuuaaac

SEQ ID NO: 301891 - RNA, 19 nt, Homo sapiens
ccaagaagucaguuaaggu

SEQ ID NO: 301892 - RNA, 19 nt, Homo sapiens
auaaauacgccaagaaguc

SEQ ID NO: 301893 - RNA, 19 nt, Homo sapiens
gcucuacucauucccuguu

SEQ ID NO: 301894 - RNA, 19 nt, Homo sapiens
aagaagucaguuaagguua

SEQ ID NO: 301895 - RNA, 19 nt, Homo sapiens
ccuguuguaaucaagaaua

SEQ ID NO: 301896 - RNA, 19 nt, Homo sapiens
gcucaagggagaauuuguc

SEQ ID NO: 301897 - RNA, 19 nt, Homo sapiens
guaauccagccaauaccaa

SEQ ID NO: 301898 - RNA, 19 nt, Homo sapiens
uauaauucuugugcuguug

SEQ ID NO: 301899 - RNA, 19 nt, Homo sapiens
uagauaaauacgccaagaa

SEQ ID NO: 301900 - RNA, 19 nt, Homo sapiens
auggaucugucuuugguaa

SEQ ID NO: 301901 - RNA, 19 nt, Homo sapiens
gaccuggaaguuuguugaa

SEQ ID NO: 301902 - RNA, 19 nt, Homo sapiens
caucaugccuuccaaauug

SEQ ID NO: 301903 - RNA, 19 nt, Homo sapiens
gaaagguugugauguggua

SEQ ID NO: 301904 - RNA, 19 nt, Homo sapiens
ccagaacaaugcuaaagua

SEQ ID NO: 301905 - RNA, 19 nt, Homo sapiens
gaccaaagccgcugugaaa

SEQ ID NO: 301906 - RNA, 19 nt, Homo sapiens
aaaggaagguguuguggaa

SEQ ID NO: 301907 - RNA, 19 nt, Homo sapiens
uugcagagcugaaggguuu

SEQ ID NO: 301908 - RNA, 19 nt, Homo sapiens
caaagccguugcagauaaa

SEQ ID NO: 301909 - RNA, 19 nt, Homo sapiens
caacaccaaugccacgauu

SEQ ID NO: 301910 - RNA, 19 nt, Homo sapiens
gaugauuacuguauugaca

SEQ ID NO: 301911 - RNA, 19 nt, Homo sapiens
ccaguuuccuuaauuuaug

SEQ ID NO: 301912 - RNA, 19 nt, Homo sapiens
caacgucccugucauuggu

SEQ ID NO: 301913 - RNA, 19 nt, Homo sapiens
uaaaagccguccuugauuu

SEQ ID NO: 301914 - RNA, 19 nt, Homo sapiens
caagaagcauggaguguac

SEQ ID NO: 301915 - RNA, 19 nt, Homo sapiens
ggugaugauuacuguauug

SEQ ID NO: 301916 - RNA, 19 nt, Homo sapiens
cgucagagccaacaccuuu

SEQ ID NO: 301917 - RNA, 19 nt, Homo sapiens
ccugaaagguugugaugug

SEQ ID NO: 301918 - RNA, 19 nt, Homo sapiens
gaauguuccuucguuaagu

SEQ ID NO: 301919 - RNA, 19 nt, Homo sapiens
ggaagguguuguggaaugu

SEQ ID NO: 301920 - RNA, 19 nt, Homo sapiens
cagcagaaguuuucaagaa

SEQ ID NO: 301921 - RNA, 19 nt, Homo sapiens
gaaacggaauguaccuacu

SEQ ID NO: 301922 - RNA, 19 nt, Homo sapiens
guugugaugugguaguuau

SEQ ID NO: 301923 - RNA, 19 nt, Homo sapiens
gggaagauuucgugaagac

SEQ ID NO: 301924 - RNA, 19 nt, Homo sapiens
ggcaucaugucacugcaaa

SEQ ID NO: 301925 - RNA, 19 nt, Homo sapiens
cugaaggccuccaucaaga

SEQ ID NO: 301926 - RNA, 19 nt, Homo sapiens
gaaccugggcaucggcaaa

SEQ ID NO: 301927 - RNA, 19 nt, Homo sapiens
ucaagaagcauggagugua

SEQ ID NO: 301928 - RNA, 19 nt, Homo sapiens
cgccugacccucuaugaua

SEQ ID NO: 301929 - RNA, 19 nt, Homo sapiens
uuaauuugcuuuggugaug

SEQ ID NO: 301930 - RNA, 19 nt, Homo sapiens
ggccaguuuccuuaauuua

SEQ ID NO: 301931 - RNA, 19 nt, Homo sapiens
gaauggaaaggaagguguu

SEQ ID NO: 301932 - RNA, 19 nt, Homo sapiens
ggauccagcucgagucaac

SEQ ID NO: 301933 - RNA, 19 nt, Homo sapiens
gccugacccucuaugauau

SEQ ID NO: 301934 - RNA, 19 nt, Homo sapiens
guggccaguuuccuuaauu

SEQ ID NO: 301935 - RNA, 19 nt, Homo sapiens
gcugaaggccuccaucaag

SEQ ID NO: 301936 - RNA, 19 nt, Homo sapiens
uggaugcaaugaauggaaa

SEQ ID NO: 301937 - RNA, 19 nt, Homo sapiens
ggaggucguuggagucacu

SEQ ID NO: 301938 - RNA, 19 nt, Homo sapiens
uggccaguuuccuuaauuu

SEQ ID NO: 301939 - RNA, 19 nt, Homo sapiens
ugugacggguggccaguuu

SEQ ID NO: 301940 - RNA, 19 nt, Homo sapiens
gagcugaaggccuccauca

SEQ ID NO: 301941 - RNA, 19 nt, Homo sapiens
cggagguggucaaggcuaa

SEQ ID NO: 301942 - RNA, 19 nt, Homo sapiens
ucugugggcgcaucaauaa

SEQ ID NO: 301943 - RNA, 19 nt, Homo sapiens
gggcagccacuuucacuuc

SEQ ID NO: 301944 - RNA, 19 nt, Homo sapiens
ugcaaugaauggaaaggaa

SEQ ID NO: 301945 - RNA, 19 nt, Homo sapiens
gccaguuuccuuaauuuau

SEQ ID NO: 301946 - RNA, 19 nt, Homo sapiens
uaauuugcuuuggugauga

SEQ ID NO: 301947 - RNA, 19 nt, Homo sapiens
aggaagguguuguggaaug

SEQ ID NO: 301948 - RNA, 19 nt, Homo sapiens
ggaguggccgcagaucuga

SEQ ID NO: 301949 - RNA, 19 nt, Homo sapiens
ccgcagaucugagccacau

SEQ ID NO: 301950 - RNA, 19 nt, Homo sapiens
gguggccaguuuccuuaau

SEQ ID NO: 301951 - RNA, 19 nt, Homo sapiens
gaaggccuccaucaagaag

SEQ ID NO: 301952 - RNA, 19 nt, Homo sapiens
aaacggaauguaccuacuu

SEQ ID NO: 301953 - RNA, 19 nt, Homo sapiens
ccaaagccgcugugaaagg

SEQ ID NO: 301954 - RNA, 19 nt, Homo sapiens
ucaucaugccuuccaaauu

SEQ ID NO: 301955 - RNA, 19 nt, Homo sapiens
ugaaggccuccaucaagaa

SEQ ID NO: 301956 - RNA, 19 nt, Homo sapiens
ucacaggaaacggaaugua

SEQ ID NO: 301957 - RNA, 19 nt, Homo sapiens
ccuuguggaugcaaugaau

SEQ ID NO: 301958 - RNA, 19 nt, Homo sapiens
cggguggccaguuuccuua

SEQ ID NO: 301959 - RNA, 19 nt, Homo sapiens
cgagucaacgucccuguca

SEQ ID NO: 301960 - RNA, 19 nt, Homo sapiens
ugauuacuguauugacauc

SEQ ID NO: 301961 - RNA, 19 nt, Homo sapiens
gaagguguuguggaauguu

SEQ ID NO: 301962 - RNA, 19 nt, Homo sapiens
gcugaaggguuuggaucca

SEQ ID NO: 301963 - RNA, 19 nt, Homo sapiens
caucaucaugccuuccaaa

SEQ ID NO: 301964 - RNA, 19 nt, Homo sapiens
ugagccacaucgagaccaa

SEQ ID NO: 301965 - RNA, 19 nt, Homo sapiens
guacaaccccaacaaaauc

SEQ ID NO: 301966 - RNA, 19 nt, Homo sapiens
ggcagccacuuucacuucu

SEQ ID NO: 301967 - RNA, 19 nt, Homo sapiens
cguugcagauaaacuuugu

SEQ ID NO: 301968 - RNA, 19 nt, Homo sapiens
cagaacaaugcuaaaguag

SEQ ID NO: 301969 - RNA, 19 nt, Homo sapiens
cgugaagacccugaaguga

SEQ ID NO: 301970 - RNA, 19 nt, Homo sapiens
uugccaauccgguuaauuc

SEQ ID NO: 301971 - RNA, 19 nt, Homo sapiens
ugagccgccugacccucua

SEQ ID NO: 301972 - RNA, 19 nt, Homo sapiens
gcagccacuuucacuucuc

SEQ ID NO: 301973 - RNA, 19 nt, Homo sapiens
agucaacgucccugucauu

SEQ ID NO: 301974 - RNA, 19 nt, Homo sapiens
gcaaguacaaguuugagaa

SEQ ID NO: 301975 - RNA, 19 nt, Homo sapiens
agaaagauaaggugaagaa

SEQ ID NO: 301976 - RNA, 19 nt, Homo sapiens
cgacugcaaguacaaguuu

SEQ ID NO: 301977 - RNA, 19 nt, Homo sapiens
aaagaaagauaaggugaag

SEQ ID NO: 301978 - RNA, 19 nt, Homo sapiens
cucguuagcuuuaaucaau

SEQ ID NO: 301979 - RNA, 19 nt, Homo sapiens
ccaagaaagggaagggaaa

SEQ ID NO: 301980 - RNA, 19 nt, Homo sapiens
gaccaaagcaaaggccaaa

SEQ ID NO: 301981 - RNA, 19 nt, Homo sapiens
gcaaaggccaaagccaaga

SEQ ID NO: 301982 - RNA, 19 nt, Homo sapiens
ugucugcucguuagcuuua

SEQ ID NO: 301983 - RNA, 19 nt, Homo sapiens
caaaggccaaagccaagaa

SEQ ID NO: 301984 - RNA, 19 nt, Homo sapiens
gccaaggcacccugaagaa

SEQ ID NO: 301985 - RNA, 19 nt, Homo sapiens
ggagccgacugcaaguaca

SEQ ID NO: 301986 - RNA, 19 nt, Homo sapiens
cacaauuccauuacuaaga

SEQ ID NO: 301987 - RNA, 19 nt, Homo sapiens
gacugcaaguacaaguuug

SEQ ID NO: 301988 - RNA, 19 nt, Homo sapiens
gggcacaggcaccaaaguc

SEQ ID NO: 301989 - RNA, 19 nt, Homo sapiens
gggauucugggaagcuuga

SEQ ID NO: 301990 - RNA, 19 nt, Homo sapiens
ccacaauuccauuacuaag

SEQ ID NO: 301991 - RNA, 19 nt, Homo sapiens
cguuagcuuuaaucaauca

SEQ ID NO: 301992 - RNA, 19 nt, Homo sapiens
ggaagggaaaggacuagac

SEQ ID NO: 301993 - RNA, 19 nt, Homo sapiens
caagaaagggaagggaaag

SEQ ID NO: 301994 - RNA, 19 nt, Homo sapiens
gaaagauaaggugaagaag

SEQ ID NO: 301995 - RNA, 19 nt, Homo sapiens
gagccgacugcaaguacaa

SEQ ID NO: 301996 - RNA, 19 nt, Homo sapiens
gcucguuagcuuuaaucaa

SEQ ID NO: 301997 - RNA, 19 nt, Homo sapiens
gaacuggggugcgugugau

SEQ ID NO: 301998 - RNA, 19 nt, Homo sapiens
cccacaauuccauuacuaa

SEQ ID NO: 301999 - RNA, 19 nt, Homo sapiens
cgccaaggcacccugaaga

SEQ ID NO: 302000 - RNA, 19 nt, Homo sapiens
ggagauauguugugaaaga

SEQ ID NO: 302001 - RNA, 19 nt, Homo sapiens
ccacaaaucugauaguauu

SEQ ID NO: 302002 - RNA, 19 nt, Homo sapiens
gacaagaacucucagauga

SEQ ID NO: 302003 - RNA, 19 nt, Homo sapiens
ugaagaagauccugaaauu

SEQ ID NO: 302004 - RNA, 19 nt, Homo sapiens
gaagauaaagggaaagaua

SEQ ID NO: 302005 - RNA, 19 nt, Homo sapiens
gaugagguauaucaaguua

SEQ ID NO: 302006 - RNA, 19 nt, Homo sapiens
ggaagaaacccaagacaaa

SEQ ID NO: 302007 - RNA, 19 nt, Homo sapiens
gaacaagagacccugguua

SEQ ID NO: 302008 - RNA, 19 nt, Homo sapiens
gccaguauauuaugacuaa

SEQ ID NO: 302009 - RNA, 19 nt, Homo sapiens
caccacaccuggcuaauuu

SEQ ID NO: 302010 - RNA, 19 nt, Homo sapiens
ucacauagauuucuucucu

SEQ ID NO: 302011 - RNA, 19 nt, Homo sapiens
auauguagcucauccuuua

SEQ ID NO: 302012 - RNA, 19 nt, Homo sapiens
uaauugaccuacuuuggua

SEQ ID NO: 302013 - RNA, 19 nt, Homo sapiens
ugaauuaucuggugaacga

SEQ ID NO: 302014 - RNA, 19 nt, Homo sapiens
gaauaagcccugcccagua

SEQ ID NO: 302015 - RNA, 19 nt, Homo sapiens
uaucuuggccaguauauua

SEQ ID NO: 302016 - RNA, 19 nt, Homo sapiens
gaauuuagacaaccugaaa

SEQ ID NO: 302017 - RNA, 19 nt, Homo sapiens
gugccaagcuucucuguga

SEQ ID NO: 302018 - RNA, 19 nt, Homo sapiens
gaaaaugccucaauucaca

SEQ ID NO: 302019 - RNA, 19 nt, Homo sapiens
guauuucccuuuccuuuga

SEQ ID NO: 302020 - RNA, 19 nt, Homo sapiens
acaagaaagugaagacuau

SEQ ID NO: 302021 - RNA, 19 nt, Homo sapiens
gaagaagauccugaaauuu

SEQ ID NO: 302022 - RNA, 19 nt, Homo sapiens
gaugagaagcaacaacaua

SEQ ID NO: 302023 - RNA, 19 nt, Homo sapiens
guggaauagugaauacuua

SEQ ID NO: 302024 - RNA, 19 nt, Homo sapiens
agagaaaccuucaucuuca

SEQ ID NO: 302025 - RNA, 19 nt, Homo sapiens
cauugaaccuugugugauu

SEQ ID NO: 302026 - RNA, 19 nt, Homo sapiens
agaugaagaugaugaggua

SEQ ID NO: 302027 - RNA, 19 nt, Homo sapiens
guaaccaccucacagauuc

SEQ ID NO: 302028 - RNA, 19 nt, Homo sapiens
aagaagaugugaaagaguu

SEQ ID NO: 302029 - RNA, 19 nt, Homo sapiens
uacacaagcuucacaauca

SEQ ID NO: 302030 - RNA, 19 nt, Homo sapiens
ggacaagaacucucagaug

SEQ ID NO: 302031 - RNA, 19 nt, Homo sapiens
caaagaagcuaaagaaaag

SEQ ID NO: 302032 - RNA, 19 nt, Homo sapiens
ggagagugauacagauuca

SEQ ID NO: 302033 - RNA, 19 nt, Homo sapiens
gagaagcaacaacauauug

SEQ ID NO: 302034 - RNA, 19 nt, Homo sapiens
gauuauagccuuagugaag

SEQ ID NO: 302035 - RNA, 19 nt, Homo sapiens
uaagggagauauguuguga

SEQ ID NO: 302036 - RNA, 19 nt, Homo sapiens
guacaucugugagugagaa

SEQ ID NO: 302037 - RNA, 19 nt, Homo sapiens
ucagaagauuauagccuua

SEQ ID NO: 302038 - RNA, 19 nt, Homo sapiens
gcaaagaagcuaaagaaaa

SEQ ID NO: 302039 - RNA, 19 nt, Homo sapiens
aauaagcccugcccaguau

SEQ ID NO: 302040 - RNA, 19 nt, Homo sapiens
gcuuugauguuccugauug

SEQ ID NO: 302041 - RNA, 19 nt, Homo sapiens
gugcaaagaagcuaaagaa

SEQ ID NO: 302042 - RNA, 19 nt, Homo sapiens
gaagagaguguggaaucua

SEQ ID NO: 302043 - RNA, 19 nt, Homo sapiens
ccaagaagaugugaaagag

SEQ ID NO: 302044 - RNA, 19 nt, Homo sapiens
ugagaaagccaaacuggaa

SEQ ID NO: 302045 - RNA, 19 nt, Homo sapiens
caagaacucucagaugaag

SEQ ID NO: 302046 - RNA, 19 nt, Homo sapiens
ggaucaggauucaguuuca

SEQ ID NO: 302047 - RNA, 19 nt, Homo sapiens
gaaggagagcaauuaguga

SEQ ID NO: 302048 - RNA, 19 nt, Homo sapiens
gaacuugguaguagucaau

SEQ ID NO: 302049 - RNA, 19 nt, Homo sapiens
gaccgagucuugcucuguu

SEQ ID NO: 302050 - RNA, 19 nt, Homo sapiens
cuauauaacccuaggaauu

SEQ ID NO: 302051 - RNA, 19 nt, Homo sapiens
gaaucuaguuugccccuua

SEQ ID NO: 302052 - RNA, 19 nt, Homo sapiens
ucagaucaguuuaguguag

SEQ ID NO: 302053 - RNA, 19 nt, Homo sapiens
ucggaaagauggagcaaga

SEQ ID NO: 302054 - RNA, 19 nt, Homo sapiens
gaaauuuccuuagcugacu

SEQ ID NO: 302055 - RNA, 19 nt, Homo sapiens
aagaagauccugaaauuuc

SEQ ID NO: 302056 - RNA, 19 nt, Homo sapiens
gagauauguugugaaagaa

SEQ ID NO: 302057 - RNA, 19 nt, Homo sapiens
caaagaagagaguguggaa

SEQ ID NO: 302058 - RNA, 19 nt, Homo sapiens
gaagaaacccaagacaaag

SEQ ID NO: 302059 - RNA, 19 nt, Homo sapiens
ugaagaugaugagguauau

SEQ ID NO: 302060 - RNA, 19 nt, Homo sapiens
guaauaagggagauauguu

SEQ ID NO: 302061 - RNA, 19 nt, Homo sapiens
ccaaagugcugggauuaca

SEQ ID NO: 302062 - RNA, 19 nt, Homo sapiens
ugccucagccucccaauua

SEQ ID NO: 302063 - RNA, 19 nt, Homo sapiens
aaugagaaguacuugguuu

SEQ ID NO: 302064 - RNA, 19 nt, Homo sapiens
caucuuauggccugcuuua

SEQ ID NO: 302065 - RNA, 19 nt, Homo sapiens
caucgaauccggaucuuga

SEQ ID NO: 302066 - RNA, 19 nt, Homo sapiens
agggagauauguugugaaa

SEQ ID NO: 302067 - RNA, 19 nt, Homo sapiens
gacaaccaauucaaaugau

SEQ ID NO: 302068 - RNA, 19 nt, Homo sapiens
guagacaaccaauucaaau

SEQ ID NO: 302069 - RNA, 19 nt, Homo sapiens
caaaugauugugcuaacuu

SEQ ID NO: 302070 - RNA, 19 nt, Homo sapiens
agacaaccaauucaaauga

SEQ ID NO: 302071 - RNA, 19 nt, Homo sapiens
gggaagaaacccaagacaa

SEQ ID NO: 302072 - RNA, 19 nt, Homo sapiens
gagaaagccaaacuggaaa

SEQ ID NO: 302073 - RNA, 19 nt, Homo sapiens
uuacaccaacuccuaauuu

SEQ ID NO: 302074 - RNA, 19 nt, Homo sapiens
ucucagccaucaacuucua

SEQ ID NO: 302075 - RNA, 19 nt, Homo sapiens
gcaggcaaaugugcaauac

SEQ ID NO: 302076 - RNA, 19 nt, Homo sapiens
gaaggugggagugaucaaa

SEQ ID NO: 302077 - RNA, 19 nt, Homo sapiens
ucuacucugucuuaaauga

SEQ ID NO: 302078 - RNA, 19 nt, Homo sapiens
guaguggaauagugaauac

SEQ ID NO: 302079 - RNA, 19 nt, Homo sapiens
guauguagacaaccaauuc

SEQ ID NO: 302080 - RNA, 19 nt, Homo sapiens
gugaggagcaggcaaaugu

SEQ ID NO: 302081 - RNA, 19 nt, Homo sapiens
ggaucuugaugcuggugua

SEQ ID NO: 302082 - RNA, 19 nt, Homo sapiens
uaauaagggagauauguug

SEQ ID NO: 302083 - RNA, 19 nt, Homo sapiens
ucuagaaggagagcaauua

SEQ ID NO: 302084 - RNA, 19 nt, Homo sapiens
aaaccuucaucuucacauu

SEQ ID NO: 302085 - RNA, 19 nt, Homo sapiens
gguaguggaauagugaaua

SEQ ID NO: 302086 - RNA, 19 nt, Homo sapiens
gccaagaagaugugaaaga

SEQ ID NO: 302087 - RNA, 19 nt, Homo sapiens
uugaaucucucgacucaga

SEQ ID NO: 302088 - RNA, 19 nt, Homo sapiens
guguagaauuugaaguuga

SEQ ID NO: 302089 - RNA, 19 nt, Homo sapiens
gaugugaaagaguuugaaa

SEQ ID NO: 302090 - RNA, 19 nt, Homo sapiens
cgccacaaaucugauagua

SEQ ID NO: 302091 - RNA, 19 nt, Homo sapiens
ggaaagauggagcaagaag

SEQ ID NO: 302092 - RNA, 19 nt, Homo sapiens
gaauauguagcucauccuu

SEQ ID NO: 302093 - RNA, 19 nt, Homo sapiens
gaaaacgccacaaaucuga

SEQ ID NO: 302094 - RNA, 19 nt, Homo sapiens
uaaaugagaaguacuuggu

SEQ ID NO: 302095 - RNA, 19 nt, Homo sapiens
ggaacaagagacccugguu

SEQ ID NO: 302096 - RNA, 19 nt, Homo sapiens
ugagguauaucaaguuacu

SEQ ID NO: 302097 - RNA, 19 nt, Homo sapiens
ccucaauucacauagauuu

SEQ ID NO: 302098 - RNA, 19 nt, Homo sapiens
agagucauguguugaggaa

SEQ ID NO: 302099 - RNA, 19 nt, Homo sapiens
ugauguuccugauuguaaa

SEQ ID NO: 302100 - RNA, 19 nt, Homo sapiens
gacaagaacucucagauga

SEQ ID NO: 302101 - RNA, 19 nt, Homo sapiens
ugaagaagauccugaaauu

SEQ ID NO: 302102 - RNA, 19 nt, Homo sapiens
gaagauaaagggaaagaua

SEQ ID NO: 302103 - RNA, 19 nt, Homo sapiens
gaugagguauaucaaguua

SEQ ID NO: 302104 - RNA, 19 nt, Homo sapiens
ggaagaaacccaagacaaa

SEQ ID NO: 302105 - RNA, 19 nt, Homo sapiens
caccacaccuggcuaauuu

SEQ ID NO: 302106 - RNA, 19 nt, Homo sapiens
ucacauagauuucuucucu

SEQ ID NO: 302107 - RNA, 19 nt, Homo sapiens
auauguagcucauccuuua

SEQ ID NO: 302108 - RNA, 19 nt, Homo sapiens
uaauugaccuacuuuggua

SEQ ID NO: 302109 - RNA, 19 nt, Homo sapiens
gaauaagcccugcccagua

SEQ ID NO: 302110 - RNA, 19 nt, Homo sapiens
gaauuuagacaaccugaaa

SEQ ID NO: 302111 - RNA, 19 nt, Homo sapiens
gaaaaugccucaauucaca

SEQ ID NO: 302112 - RNA, 19 nt, Homo sapiens
acaagaaagugaagacuau

SEQ ID NO: 302113 - RNA, 19 nt, Homo sapiens
gaagaagauccugaaauuu

SEQ ID NO: 302114 - RNA, 19 nt, Homo sapiens
guggaauagugaauacuua

SEQ ID NO: 302115 - RNA, 19 nt, Homo sapiens
cauugaaccuugugugauu

SEQ ID NO: 302116 - RNA, 19 nt, Homo sapiens
agaugaagaugaugaggua

SEQ ID NO: 302117 - RNA, 19 nt, Homo sapiens
guaaccaccucacagauuc

SEQ ID NO: 302118 - RNA, 19 nt, Homo sapiens
aagaagaugugaaagaguu

SEQ ID NO: 302119 - RNA, 19 nt, Homo sapiens
uacacaagcuucacaauca

SEQ ID NO: 302120 - RNA, 19 nt, Homo sapiens
ggacaagaacucucagaug

SEQ ID NO: 302121 - RNA, 19 nt, Homo sapiens
caaagaagcuaaagaaaag

SEQ ID NO: 302122 - RNA, 19 nt, Homo sapiens
ggagagugauacagauuca

SEQ ID NO: 302123 - RNA, 19 nt, Homo sapiens
gauuauagccuuagugaag

SEQ ID NO: 302124 - RNA, 19 nt, Homo sapiens
ucagaagauuauagccuua

SEQ ID NO: 302125 - RNA, 19 nt, Homo sapiens
gcaaagaagcuaaagaaaa

SEQ ID NO: 302126 - RNA, 19 nt, Homo sapiens
aauaagcccugcccaguau

SEQ ID NO: 302127 - RNA, 19 nt, Homo sapiens
gcuuugauguuccugauug

SEQ ID NO: 302128 - RNA, 19 nt, Homo sapiens
gugcaaagaagcuaaagaa

SEQ ID NO: 302129 - RNA, 19 nt, Homo sapiens
gaagagaguguggaaucua

SEQ ID NO: 302130 - RNA, 19 nt, Homo sapiens
ccaagaagaugugaaagag

SEQ ID NO: 302131 - RNA, 19 nt, Homo sapiens
ugagaaagccaaacuggaa

SEQ ID NO: 302132 - RNA, 19 nt, Homo sapiens
caagaacucucagaugaag

SEQ ID NO: 302133 - RNA, 19 nt, Homo sapiens
ggaucaggauucaguuuca

SEQ ID NO: 302134 - RNA, 19 nt, Homo sapiens
gaccgagucuugcucuguu

SEQ ID NO: 302135 - RNA, 19 nt, Homo sapiens
cuauauaacccuaggaauu

SEQ ID NO: 302136 - RNA, 19 nt, Homo sapiens
gaaucuaguuugccccuua

SEQ ID NO: 302137 - RNA, 19 nt, Homo sapiens
ucagaucaguuuaguguag

SEQ ID NO: 302138 - RNA, 19 nt, Homo sapiens
ucggaaagauggagcaaga

SEQ ID NO: 302139 - RNA, 19 nt, Homo sapiens
gaaauuuccuuagcugacu

SEQ ID NO: 302140 - RNA, 19 nt, Homo sapiens
aagaagauccugaaauuuc

SEQ ID NO: 302141 - RNA, 19 nt, Homo sapiens
caaagaagagaguguggaa

SEQ ID NO: 302142 - RNA, 19 nt, Homo sapiens
gaagaaacccaagacaaag

SEQ ID NO: 302143 - RNA, 19 nt, Homo sapiens
ugaagaugaugagguauau

SEQ ID NO: 302144 - RNA, 19 nt, Homo sapiens
ccaaagugcugggauuaca

SEQ ID NO: 302145 - RNA, 19 nt, Homo sapiens
ugccucagccucccaauua

SEQ ID NO: 302146 - RNA, 19 nt, Homo sapiens
aaugagaaguacuugguuu

SEQ ID NO: 302147 - RNA, 19 nt, Homo sapiens
caucuuauggccugcuuua

SEQ ID NO: 302148 - RNA, 19 nt, Homo sapiens
gacaaccaauucaaaugau

SEQ ID NO: 302149 - RNA, 19 nt, Homo sapiens
guagacaaccaauucaaau

SEQ ID NO: 302150 - RNA, 19 nt, Homo sapiens
caaaugauugugcuaacuu

SEQ ID NO: 302151 - RNA, 19 nt, Homo sapiens
agacaaccaauucaaauga

SEQ ID NO: 302152 - RNA, 19 nt, Homo sapiens
gggaagaaacccaagacaa

SEQ ID NO: 302153 - RNA, 19 nt, Homo sapiens
gagaaagccaaacuggaaa

SEQ ID NO: 302154 - RNA, 19 nt, Homo sapiens
uuacaccaacuccuaauuu

SEQ ID NO: 302155 - RNA, 19 nt, Homo sapiens
ucucagccaucaacuucua

SEQ ID NO: 302156 - RNA, 19 nt, Homo sapiens
gcaggcaaaugugcaauac

SEQ ID NO: 302157 - RNA, 19 nt, Homo sapiens
ucuacucugucuuaaauga

SEQ ID NO: 302158 - RNA, 19 nt, Homo sapiens
gugaggagcaggcaaaugu

SEQ ID NO: 302159 - RNA, 19 nt, Homo sapiens
guaguggaauagugaauac

SEQ ID NO: 302160 - RNA, 19 nt, Homo sapiens
guauguagacaaccaauuc

SEQ ID NO: 302161 - RNA, 19 nt, Homo sapiens
ggaucuugaugcuggugua

SEQ ID NO: 302162 - RNA, 19 nt, Homo sapiens
gguaguggaauagugaaua

SEQ ID NO: 302163 - RNA, 19 nt, Homo sapiens
gccaagaagaugugaaaga

SEQ ID NO: 302164 - RNA, 19 nt, Homo sapiens
uugaaucucucgacucaga

SEQ ID NO: 302165 - RNA, 19 nt, Homo sapiens
guguagaauuugaaguuga

SEQ ID NO: 302166 - RNA, 19 nt, Homo sapiens
gaugugaaagaguuugaaa

SEQ ID NO: 302167 - RNA, 19 nt, Homo sapiens
ggaaagauggagcaagaag

SEQ ID NO: 302168 - RNA, 19 nt, Homo sapiens
gaauauguagcucauccuu

SEQ ID NO: 302169 - RNA, 19 nt, Homo sapiens
uaaaugagaaguacuuggu

SEQ ID NO: 302170 - RNA, 19 nt, Homo sapiens
ugagguauaucaaguuacu

SEQ ID NO: 302171 - RNA, 19 nt, Homo sapiens
ccucaauucacauagauuu

SEQ ID NO: 302172 - RNA, 19 nt, Homo sapiens
agagucauguguugaggaa

SEQ ID NO: 302173 - RNA, 19 nt, Homo sapiens
ugauguuccugauuguaaa

SEQ ID NO: 302174 - RNA, 19 nt, Homo sapiens
gcuucacaaucacaagaaa

SEQ ID NO: 302175 - RNA, 19 nt, Homo sapiens
cagccaagaagaugugaaa

SEQ ID NO: 302176 - RNA, 19 nt, Homo sapiens
cacaagaaagugaagacua

SEQ ID NO: 302177 - RNA, 19 nt, Homo sapiens
gagugauacagauucauuu

SEQ ID NO: 302178 - RNA, 19 nt, Homo sapiens
gaagaaggacaagaacucu

SEQ ID NO: 302179 - RNA, 19 nt, Homo sapiens
gaagauuauagccuuagug

SEQ ID NO: 302180 - RNA, 19 nt, Homo sapiens
gcgucgugcuuccgcagua

SEQ ID NO: 302181 - RNA, 19 nt, Homo sapiens
gagaaaaugccucaauuca

SEQ ID NO: 302182 - RNA, 19 nt, Homo sapiens
caacuucuaguagcauuau

SEQ ID NO: 302183 - RNA, 19 nt, Homo sapiens
ccaccacaccuggcuaauu

SEQ ID NO: 302184 - RNA, 19 nt, Homo sapiens
gagaguguggaaucuaguu

SEQ ID NO: 302185 - RNA, 19 nt, Homo sapiens
aagagaguguggaaucuag

SEQ ID NO: 302186 - RNA, 19 nt, Homo sapiens
gaaggaaacuggggagucu

SEQ ID NO: 302187 - RNA, 19 nt, Homo sapiens
gaagaugugaaagaguuug

SEQ ID NO: 302188 - RNA, 19 nt, Homo sapiens
aaagugaagacuauucuca

SEQ ID NO: 302189 - RNA, 19 nt, Homo sapiens
gggcuuugauguuccugau

SEQ ID NO: 302190 - RNA, 19 nt, Homo sapiens
uuccuuagcugacuauugg

SEQ ID NO: 302191 - RNA, 19 nt, Homo sapiens
aagauuauagccuuaguga

SEQ ID NO: 302192 - RNA, 19 nt, Homo sapiens
gacaggguuucaccguguu

SEQ ID NO: 302193 - RNA, 19 nt, Homo sapiens
gccauugaaccuuguguga

SEQ ID NO: 302194 - RNA, 19 nt, Homo sapiens
cagaucaguuuaguguaga

SEQ ID NO: 302195 - RNA, 19 nt, Homo sapiens
ggauucaguuucagaucag

SEQ ID NO: 302196 - RNA, 19 nt, Homo sapiens
ggagugcagugggugaucu

SEQ ID NO: 302197 - RNA, 19 nt, Homo sapiens
ggaauuuagacaaccugaa

SEQ ID NO: 302198 - RNA, 19 nt, Homo sapiens
ggcaaaacaggacaucuua

SEQ ID NO: 302199 - RNA, 19 nt, Homo sapiens
aggcaaaugugcaauacca

SEQ ID NO: 302200 - RNA, 19 nt, Homo sapiens
gaagauaaagggaaagaua

SEQ ID NO: 302201 - RNA, 19 nt, Homo sapiens
ggaagaaacccaagacaaa

SEQ ID NO: 302202 - RNA, 19 nt, Homo sapiens
caccacaccuggcuaauuu

SEQ ID NO: 302203 - RNA, 19 nt, Homo sapiens
ucacauagauuucuucucu

SEQ ID NO: 302204 - RNA, 19 nt, Homo sapiens
auauguagcucauccuuua

SEQ ID NO: 302205 - RNA, 19 nt, Homo sapiens
uaauugaccuacuuuggua

SEQ ID NO: 302206 - RNA, 19 nt, Homo sapiens
gaauaagcccugcccagua

SEQ ID NO: 302207 - RNA, 19 nt, Homo sapiens
gaauuuagacaaccugaaa

SEQ ID NO: 302208 - RNA, 19 nt, Homo sapiens
gaaaaugccucaauucaca

SEQ ID NO: 302209 - RNA, 19 nt, Homo sapiens
acaagaaagugaagacuau

SEQ ID NO: 302210 - RNA, 19 nt, Homo sapiens
guggaauagugaauacuua

SEQ ID NO: 302211 - RNA, 19 nt, Homo sapiens
cauugaaccuugugugauu

SEQ ID NO: 302212 - RNA, 19 nt, Homo sapiens
guaaccaccucacagauuc

SEQ ID NO: 302213 - RNA, 19 nt, Homo sapiens
aagaagaugugaaagaguu

SEQ ID NO: 302214 - RNA, 19 nt, Homo sapiens
uacacaagcuucacaauca

SEQ ID NO: 302215 - RNA, 19 nt, Homo sapiens
caaagaagcuaaagaaaag

SEQ ID NO: 302216 - RNA, 19 nt, Homo sapiens
aagagacccuggacuauug

SEQ ID NO: 302217 - RNA, 19 nt, Homo sapiens
gcaaagaagcuaaagaaaa

SEQ ID NO: 302218 - RNA, 19 nt, Homo sapiens
aauaagcccugcccaguau

SEQ ID NO: 302219 - RNA, 19 nt, Homo sapiens
gcuuugauguuccugauug

SEQ ID NO: 302220 - RNA, 19 nt, Homo sapiens
gugcaaagaagcuaaagaa

SEQ ID NO: 302221 - RNA, 19 nt, Homo sapiens
gaagagaguguggaaucua

SEQ ID NO: 302222 - RNA, 19 nt, Homo sapiens
ccaagaagaugugaaagag

SEQ ID NO: 302223 - RNA, 19 nt, Homo sapiens
ugagaaagccaaacuggaa

SEQ ID NO: 302224 - RNA, 19 nt, Homo sapiens
gaccgagucuugcucuguu

SEQ ID NO: 302225 - RNA, 19 nt, Homo sapiens
cuauauaacccuaggaauu

SEQ ID NO: 302226 - RNA, 19 nt, Homo sapiens
gaaucuaguuugccccuua

SEQ ID NO: 302227 - RNA, 19 nt, Homo sapiens
ucggaaagauggagcaaga

SEQ ID NO: 302228 - RNA, 19 nt, Homo sapiens
caagagacccuggacuauu

SEQ ID NO: 302229 - RNA, 19 nt, Homo sapiens
caaagaagagaguguggaa

SEQ ID NO: 302230 - RNA, 19 nt, Homo sapiens
gaagaaacccaagacaaag

SEQ ID NO: 302231 - RNA, 19 nt, Homo sapiens
ccaaagugcugggauuaca

SEQ ID NO: 302232 - RNA, 19 nt, Homo sapiens
ugccucagccucccaauua

SEQ ID NO: 302233 - RNA, 19 nt, Homo sapiens
aaugagaaguacuugguuu

SEQ ID NO: 302234 - RNA, 19 nt, Homo sapiens
caucuuauggccugcuuua

SEQ ID NO: 302235 - RNA, 19 nt, Homo sapiens
gacaaccaauucaaaugau

SEQ ID NO: 302236 - RNA, 19 nt, Homo sapiens
guagacaaccaauucaaau

SEQ ID NO: 302237 - RNA, 19 nt, Homo sapiens
caaaugauugugcuaacuu

SEQ ID NO: 302238 - RNA, 19 nt, Homo sapiens
agacaaccaauucaaauga

SEQ ID NO: 302239 - RNA, 19 nt, Homo sapiens
gggaagaaacccaagacaa

SEQ ID NO: 302240 - RNA, 19 nt, Homo sapiens
gagaaagccaaacuggaaa

SEQ ID NO: 302241 - RNA, 19 nt, Homo sapiens
uuacaccaacuccuaauuu

SEQ ID NO: 302242 - RNA, 19 nt, Homo sapiens
ucucagccaucaacuucua

SEQ ID NO: 302243 - RNA, 19 nt, Homo sapiens
gcaggcaaaugugcaauac

SEQ ID NO: 302244 - RNA, 19 nt, Homo sapiens
ucuacucugucuuaaauga

SEQ ID NO: 302245 - RNA, 19 nt, Homo sapiens
guaguggaauagugaauac

SEQ ID NO: 302246 - RNA, 19 nt, Homo sapiens
guauguagacaaccaauuc

SEQ ID NO: 302247 - RNA, 19 nt, Homo sapiens
gugaggagcaggcaaaugu

SEQ ID NO: 302248 - RNA, 19 nt, Homo sapiens
gguaguggaauagugaaua

SEQ ID NO: 302249 - RNA, 19 nt, Homo sapiens
gccaagaagaugugaaaga

SEQ ID NO: 302250 - RNA, 19 nt, Homo sapiens
gaugugaaagaguuugaaa

SEQ ID NO: 302251 - RNA, 19 nt, Homo sapiens
ggaaagauggagcaagaag

SEQ ID NO: 302252 - RNA, 19 nt, Homo sapiens
gaauauguagcucauccuu

SEQ ID NO: 302253 - RNA, 19 nt, Homo sapiens
uaaaugagaaguacuuggu

SEQ ID NO: 302254 - RNA, 19 nt, Homo sapiens
ccucaauucacauagauuu

SEQ ID NO: 302255 - RNA, 19 nt, Homo sapiens
agagucauguguugaggaa

SEQ ID NO: 302256 - RNA, 19 nt, Homo sapiens
ugauguuccugauuguaaa

SEQ ID NO: 302257 - RNA, 19 nt, Homo sapiens
gcuucacaaucacaagaaa

SEQ ID NO: 302258 - RNA, 19 nt, Homo sapiens
cagccaagaagaugugaaa

SEQ ID NO: 302259 - RNA, 19 nt, Homo sapiens
cacaagaaagugaagacua

SEQ ID NO: 302260 - RNA, 19 nt, Homo sapiens
gcgucgugcuuccgcagua

SEQ ID NO: 302261 - RNA, 19 nt, Homo sapiens
aacaagagacccuggacua

SEQ ID NO: 302262 - RNA, 19 nt, Homo sapiens
gagaaaaugccucaauuca

SEQ ID NO: 302263 - RNA, 19 nt, Homo sapiens
caacuucuaguagcauuau

SEQ ID NO: 302264 - RNA, 19 nt, Homo sapiens
ccaccacaccuggcuaauu

SEQ ID NO: 302265 - RNA, 19 nt, Homo sapiens
gaaggaaacuggggagucu

SEQ ID NO: 302266 - RNA, 19 nt, Homo sapiens
gagaguguggaaucuaguu

SEQ ID NO: 302267 - RNA, 19 nt, Homo sapiens
aagagaguguggaaucuag

SEQ ID NO: 302268 - RNA, 19 nt, Homo sapiens
gaagaugugaaagaguuug

SEQ ID NO: 302269 - RNA, 19 nt, Homo sapiens
aaagugaagacuauucuca

SEQ ID NO: 302270 - RNA, 19 nt, Homo sapiens
gggcuuugauguuccugau

SEQ ID NO: 302271 - RNA, 19 nt, Homo sapiens
gacaggguuucaccguguu

SEQ ID NO: 302272 - RNA, 19 nt, Homo sapiens
gccauugaaccuuguguga

SEQ ID NO: 302273 - RNA, 19 nt, Homo sapiens
gacccuggacuauuggaaa

SEQ ID NO: 302274 - RNA, 19 nt, Homo sapiens
ggagugcagugggugaucu

SEQ ID NO: 302275 - RNA, 19 nt, Homo sapiens
ggaauuuagacaaccugaa

SEQ ID NO: 302276 - RNA, 19 nt, Homo sapiens
ggcaaaacaggacaucuua

SEQ ID NO: 302277 - RNA, 19 nt, Homo sapiens
caagaaagugaagacuauu

SEQ ID NO: 302278 - RNA, 19 nt, Homo sapiens
aggcaaaugugcaauacca

SEQ ID NO: 302279 - RNA, 19 nt, Homo sapiens
gauaaagggaaagauaaag

SEQ ID NO: 302280 - RNA, 19 nt, Homo sapiens
ucaaaugauugugcuaacu

SEQ ID NO: 302281 - RNA, 19 nt, Homo sapiens
cuuauggccugcuuuacau

SEQ ID NO: 302282 - RNA, 19 nt, Homo sapiens
agacuauucucagccauca

SEQ ID NO: 302283 - RNA, 19 nt, Homo sapiens
uguaaccaccucacagauu

SEQ ID NO: 302284 - RNA, 19 nt, Homo sapiens
aagaagagaguguggaauc

SEQ ID NO: 302285 - RNA, 19 nt, Homo sapiens
caccaacuccuaauuuuaa

SEQ ID NO: 302286 - RNA, 19 nt, Homo sapiens
uguagacaaccaauucaaa

SEQ ID NO: 302287 - RNA, 19 nt, Homo sapiens
caaaacaggacaucuuaug

SEQ ID NO: 302288 - RNA, 19 nt, Homo sapiens
aaccuugugugauuuguca

SEQ ID NO: 302289 - RNA, 19 nt, Homo sapiens
uccagagagucauguguug

SEQ ID NO: 302290 - RNA, 19 nt, Homo sapiens
uagacaaccaauucaaaug

SEQ ID NO: 302291 - RNA, 19 nt, Homo sapiens
gaguguggaaucuaguuug

SEQ ID NO: 302292 - RNA, 19 nt, Homo sapiens
aagaaacccaagacaaaga

SEQ ID NO: 302293 - RNA, 19 nt, Homo sapiens
gaaagugaagacuauucuc

SEQ ID NO: 302294 - RNA, 19 nt, Homo sapiens
ugucuuaaaugagaaguac

SEQ ID NO: 302295 - RNA, 19 nt, Homo sapiens
gacaaccugaaauuuauuc

SEQ ID NO: 302296 - RNA, 19 nt, Homo sapiens
agaagagaguguggaaucu

SEQ ID NO: 302297 - RNA, 19 nt, Homo sapiens
agaaacccaagacaaagaa

SEQ ID NO: 302298 - RNA, 19 nt, Homo sapiens
uuacacaagcuucacaauc

SEQ ID NO: 302299 - RNA, 19 nt, Homo sapiens
ggagcaggcaaaugugcaa

SEQ ID NO: 302300 - RNA, 19 nt, Homo sapiens
gacaagaacucucagauga

SEQ ID NO: 302301 - RNA, 19 nt, Homo sapiens
ugaagaagauccugaaauu

SEQ ID NO: 302302 - RNA, 19 nt, Homo sapiens
gaagauaaagggaaagaua

SEQ ID NO: 302303 - RNA, 19 nt, Homo sapiens
gaugagguauaucaaguua

SEQ ID NO: 302304 - RNA, 19 nt, Homo sapiens
ggaagaaacccaagacaaa

SEQ ID NO: 302305 - RNA, 19 nt, Homo sapiens
gaacaagagacccugguua

SEQ ID NO: 302306 - RNA, 19 nt, Homo sapiens
caccacaccuggcuaauuu

SEQ ID NO: 302307 - RNA, 19 nt, Homo sapiens
ucacauagauuucuucucu

SEQ ID NO: 302308 - RNA, 19 nt, Homo sapiens
auauguagcucauccuuua

SEQ ID NO: 302309 - RNA, 19 nt, Homo sapiens
uaauugaccuacuuuggua

SEQ ID NO: 302310 - RNA, 19 nt, Homo sapiens
gaauaagcccugcccagua

SEQ ID NO: 302311 - RNA, 19 nt, Homo sapiens
gaauuuagacaaccugaaa

SEQ ID NO: 302312 - RNA, 19 nt, Homo sapiens
gaaaaugccucaauucaca

SEQ ID NO: 302313 - RNA, 19 nt, Homo sapiens
acaagaaagugaagacuau

SEQ ID NO: 302314 - RNA, 19 nt, Homo sapiens
gaagaagauccugaaauuu

SEQ ID NO: 302315 - RNA, 19 nt, Homo sapiens
guggaauagugaauacuua

SEQ ID NO: 302316 - RNA, 19 nt, Homo sapiens
cauugaaccuugugugauu

SEQ ID NO: 302317 - RNA, 19 nt, Homo sapiens
agaugaagaugaugaggua

SEQ ID NO: 302318 - RNA, 19 nt, Homo sapiens
guaaccaccucacagauuc

SEQ ID NO: 302319 - RNA, 19 nt, Homo sapiens
aagaagaugugaaagaguu

SEQ ID NO: 302320 - RNA, 19 nt, Homo sapiens
uacacaagcuucacaauca

SEQ ID NO: 302321 - RNA, 19 nt, Homo sapiens
ggacaagaacucucagaug

SEQ ID NO: 302322 - RNA, 19 nt, Homo sapiens
caaagaagcuaaagaaaag

SEQ ID NO: 302323 - RNA, 19 nt, Homo sapiens
ggagagugauacagauuca

SEQ ID NO: 302324 - RNA, 19 nt, Homo sapiens
gauuauagccuuagugaag

SEQ ID NO: 302325 - RNA, 19 nt, Homo sapiens
ucagaagauuauagccuua

SEQ ID NO: 302326 - RNA, 19 nt, Homo sapiens
gcaaagaagcuaaagaaaa

SEQ ID NO: 302327 - RNA, 19 nt, Homo sapiens
aauaagcccugcccaguau

SEQ ID NO: 302328 - RNA, 19 nt, Homo sapiens
gcuuugauguuccugauug

SEQ ID NO: 302329 - RNA, 19 nt, Homo sapiens
gugcaaagaagcuaaagaa

SEQ ID NO: 302330 - RNA, 19 nt, Homo sapiens
gaagagaguguggaaucua

SEQ ID NO: 302331 - RNA, 19 nt, Homo sapiens
ccaagaagaugugaaagag

SEQ ID NO: 302332 - RNA, 19 nt, Homo sapiens
ugagaaagccaaacuggaa

SEQ ID NO: 302333 - RNA, 19 nt, Homo sapiens
caagaacucucagaugaag

SEQ ID NO: 302334 - RNA, 19 nt, Homo sapiens
ggaucaggauucaguuuca

SEQ ID NO: 302335 - RNA, 19 nt, Homo sapiens
gaccgagucuugcucuguu

SEQ ID NO: 302336 - RNA, 19 nt, Homo sapiens
cuauauaacccuaggaauu

SEQ ID NO: 302337 - RNA, 19 nt, Homo sapiens
gaaucuaguuugccccuua

SEQ ID NO: 302338 - RNA, 19 nt, Homo sapiens
ucagaucaguuuaguguag

SEQ ID NO: 302339 - RNA, 19 nt, Homo sapiens
ucggaaagauggagcaaga

SEQ ID NO: 302340 - RNA, 19 nt, Homo sapiens
gaaauuuccuuagcugacu

SEQ ID NO: 302341 - RNA, 19 nt, Homo sapiens
aagaagauccugaaauuuc

SEQ ID NO: 302342 - RNA, 19 nt, Homo sapiens
caaagaagagaguguggaa

SEQ ID NO: 302343 - RNA, 19 nt, Homo sapiens
gaagaaacccaagacaaag

SEQ ID NO: 302344 - RNA, 19 nt, Homo sapiens
ugaagaugaugagguauau

SEQ ID NO: 302345 - RNA, 19 nt, Homo sapiens
ccaaagugcugggauuaca

SEQ ID NO: 302346 - RNA, 19 nt, Homo sapiens
ugccucagccucccaauua

SEQ ID NO: 302347 - RNA, 19 nt, Homo sapiens
aaugagaaguacuugguuu

SEQ ID NO: 302348 - RNA, 19 nt, Homo sapiens
caucuuauggccugcuuua

SEQ ID NO: 302349 - RNA, 19 nt, Homo sapiens
gacaaccaauucaaaugau

SEQ ID NO: 302350 - RNA, 19 nt, Homo sapiens
guagacaaccaauucaaau

SEQ ID NO: 302351 - RNA, 19 nt, Homo sapiens
caaaugauugugcuaacuu

SEQ ID NO: 302352 - RNA, 19 nt, Homo sapiens
agacaaccaauucaaauga

SEQ ID NO: 302353 - RNA, 19 nt, Homo sapiens
gggaagaaacccaagacaa

SEQ ID NO: 302354 - RNA, 19 nt, Homo sapiens
gagaaagccaaacuggaaa

SEQ ID NO: 302355 - RNA, 19 nt, Homo sapiens
uuacaccaacuccuaauuu

SEQ ID NO: 302356 - RNA, 19 nt, Homo sapiens
ucucagccaucaacuucua

SEQ ID NO: 302357 - RNA, 19 nt, Homo sapiens
gcaggcaaaugugcaauac

SEQ ID NO: 302358 - RNA, 19 nt, Homo sapiens
ucuacucugucuuaaauga

SEQ ID NO: 302359 - RNA, 19 nt, Homo sapiens
guaguggaauagugaauac

SEQ ID NO: 302360 - RNA, 19 nt, Homo sapiens
guauguagacaaccaauuc

SEQ ID NO: 302361 - RNA, 19 nt, Homo sapiens
gugaggagcaggcaaaugu

SEQ ID NO: 302362 - RNA, 19 nt, Homo sapiens
gguaguggaauagugaaua

SEQ ID NO: 302363 - RNA, 19 nt, Homo sapiens
gccaagaagaugugaaaga

SEQ ID NO: 302364 - RNA, 19 nt, Homo sapiens
uugaaucucucgacucaga

SEQ ID NO: 302365 - RNA, 19 nt, Homo sapiens
guguagaauuugaaguuga

SEQ ID NO: 302366 - RNA, 19 nt, Homo sapiens
gaugugaaagaguuugaaa

SEQ ID NO: 302367 - RNA, 19 nt, Homo sapiens
ggaaagauggagcaagaag

SEQ ID NO: 302368 - RNA, 19 nt, Homo sapiens
gaauauguagcucauccuu

SEQ ID NO: 302369 - RNA, 19 nt, Homo sapiens
uaaaugagaaguacuuggu

SEQ ID NO: 302370 - RNA, 19 nt, Homo sapiens
ugagguauaucaaguuacu

SEQ ID NO: 302371 - RNA, 19 nt, Homo sapiens
ggaacaagagacccugguu

SEQ ID NO: 302372 - RNA, 19 nt, Homo sapiens
ccucaauucacauagauuu

SEQ ID NO: 302373 - RNA, 19 nt, Homo sapiens
agagucauguguugaggaa

SEQ ID NO: 302374 - RNA, 19 nt, Homo sapiens
ugauguuccugauuguaaa

SEQ ID NO: 302375 - RNA, 19 nt, Homo sapiens
gcuucacaaucacaagaaa

SEQ ID NO: 302376 - RNA, 19 nt, Homo sapiens
cagccaagaagaugugaaa

SEQ ID NO: 302377 - RNA, 19 nt, Homo sapiens
cacaagaaagugaagacua

SEQ ID NO: 302378 - RNA, 19 nt, Homo sapiens
gagugauacagauucauuu

SEQ ID NO: 302379 - RNA, 19 nt, Homo sapiens
gaagaaggacaagaacucu

SEQ ID NO: 302380 - RNA, 19 nt, Homo sapiens
gaagauuauagccuuagug

SEQ ID NO: 302381 - RNA, 19 nt, Homo sapiens
gcgucgugcuuccgcagua

SEQ ID NO: 302382 - RNA, 19 nt, Homo sapiens
gagaaaaugccucaauuca

SEQ ID NO: 302383 - RNA, 19 nt, Homo sapiens
caacuucuaguagcauuau

SEQ ID NO: 302384 - RNA, 19 nt, Homo sapiens
ccaccacaccuggcuaauu

SEQ ID NO: 302385 - RNA, 19 nt, Homo sapiens
gagaguguggaaucuaguu

SEQ ID NO: 302386 - RNA, 19 nt, Homo sapiens
aagagaguguggaaucuag

SEQ ID NO: 302387 - RNA, 19 nt, Homo sapiens
gaagaugugaaagaguuug

SEQ ID NO: 302388 - RNA, 19 nt, Homo sapiens
aaagugaagacuauucuca

SEQ ID NO: 302389 - RNA, 19 nt, Homo sapiens
gggcuuugauguuccugau

SEQ ID NO: 302390 - RNA, 19 nt, Homo sapiens
uuccuuagcugacuauugg

SEQ ID NO: 302391 - RNA, 19 nt, Homo sapiens
gaaggaaacuggggagucu

SEQ ID NO: 302392 - RNA, 19 nt, Homo sapiens
aagauuauagccuuaguga

SEQ ID NO: 302393 - RNA, 19 nt, Homo sapiens
gacaggguuucaccguguu

SEQ ID NO: 302394 - RNA, 19 nt, Homo sapiens
caagagacccugguuagac

SEQ ID NO: 302395 - RNA, 19 nt, Homo sapiens
gccauugaaccuuguguga

SEQ ID NO: 302396 - RNA, 19 nt, Homo sapiens
cagaucaguuuaguguaga

SEQ ID NO: 302397 - RNA, 19 nt, Homo sapiens
ggauucaguuucagaucag

SEQ ID NO: 302398 - RNA, 19 nt, Homo sapiens
ggagugcagugggugaucu

SEQ ID NO: 302399 - RNA, 19 nt, Homo sapiens
ggaauuuagacaaccugaa

SEQ ID NO: 302400 - RNA, 19 nt, Homo sapiens
ggaagaaacccaagacaaa

SEQ ID NO: 302401 - RNA, 19 nt, Homo sapiens
gaacaagagacccugguua

SEQ ID NO: 302402 - RNA, 19 nt, Homo sapiens
caccacaccuggcuaauuu

SEQ ID NO: 302403 - RNA, 19 nt, Homo sapiens
ucacauagauuucuucucu

SEQ ID NO: 302404 - RNA, 19 nt, Homo sapiens
auauguagcucauccuuua

SEQ ID NO: 302405 - RNA, 19 nt, Homo sapiens
uaauugaccuacuuuggua

SEQ ID NO: 302406 - RNA, 19 nt, Homo sapiens
gaauaagcccugcccagua

SEQ ID NO: 302407 - RNA, 19 nt, Homo sapiens
gaauuuagacaaccugaaa

SEQ ID NO: 302408 - RNA, 19 nt, Homo sapiens
gaaaaugccucaauucaca

SEQ ID NO: 302409 - RNA, 19 nt, Homo sapiens
acaagaaagugaagacuau

SEQ ID NO: 302410 - RNA, 19 nt, Homo sapiens
guggaauagugaauacuua

SEQ ID NO: 302411 - RNA, 19 nt, Homo sapiens
cauugaaccuugugugauu

SEQ ID NO: 302412 - RNA, 19 nt, Homo sapiens
guaaccaccucacagauuc

SEQ ID NO: 302413 - RNA, 19 nt, Homo sapiens
aagaagaugugaaagaguu

SEQ ID NO: 302414 - RNA, 19 nt, Homo sapiens
caaagaagcuaaagaaaag

SEQ ID NO: 302415 - RNA, 19 nt, Homo sapiens
gcaaagaagcuaaagaaaa

SEQ ID NO: 302416 - RNA, 19 nt, Homo sapiens
cuaguugaccugucuauaa

SEQ ID NO: 302417 - RNA, 19 nt, Homo sapiens
aauaagcccugcccaguau

SEQ ID NO: 302418 - RNA, 19 nt, Homo sapiens
gugcaaagaagcuaaagaa

SEQ ID NO: 302419 - RNA, 19 nt, Homo sapiens
gaagagaguguggaaucua

SEQ ID NO: 302420 - RNA, 19 nt, Homo sapiens
ccaagaagaugugaaagag

SEQ ID NO: 302421 - RNA, 19 nt, Homo sapiens
gaccgagucuugcucuguu

SEQ ID NO: 302422 - RNA, 19 nt, Homo sapiens
cuauauaacccuaggaauu

SEQ ID NO: 302423 - RNA, 19 nt, Homo sapiens
gaaucuaguuugccccuua

SEQ ID NO: 302424 - RNA, 19 nt, Homo sapiens
gacaagaaagugaagacua

SEQ ID NO: 302425 - RNA, 19 nt, Homo sapiens
ucggaaagauggagcaaga

SEQ ID NO: 302426 - RNA, 19 nt, Homo sapiens
caaagaagagaguguggaa

SEQ ID NO: 302427 - RNA, 19 nt, Homo sapiens
gaagaaacccaagacaaag

SEQ ID NO: 302428 - RNA, 19 nt, Homo sapiens
ccaaagugcugggauuaca

SEQ ID NO: 302429 - RNA, 19 nt, Homo sapiens
ugccucagccucccaauua

SEQ ID NO: 302430 - RNA, 19 nt, Homo sapiens
aaugagaaguacuugguuu

SEQ ID NO: 302431 - RNA, 19 nt, Homo sapiens
caucuuauggccugcuuua

SEQ ID NO: 302432 - RNA, 19 nt, Homo sapiens
ugaccugucuauaagagaa

SEQ ID NO: 302433 - RNA, 19 nt, Homo sapiens
gacaaccaauucaaaugau

SEQ ID NO: 302434 - RNA, 19 nt, Homo sapiens
guagacaaccaauucaaau

SEQ ID NO: 302435 - RNA, 19 nt, Homo sapiens
caaaugauugugcuaacuu

SEQ ID NO: 302436 - RNA, 19 nt, Homo sapiens
agacaaccaauucaaauga

SEQ ID NO: 302437 - RNA, 19 nt, Homo sapiens
gggaagaaacccaagacaa

SEQ ID NO: 302438 - RNA, 19 nt, Homo sapiens
uuacaccaacuccuaauuu

SEQ ID NO: 302439 - RNA, 19 nt, Homo sapiens
ucucagccaucaacuucua

SEQ ID NO: 302440 - RNA, 19 nt, Homo sapiens
gcaggcaaaugugcaauac

SEQ ID NO: 302441 - RNA, 19 nt, Homo sapiens
ucuacucugucuuaaauga

SEQ ID NO: 302442 - RNA, 19 nt, Homo sapiens
guaguggaauagugaauac

SEQ ID NO: 302443 - RNA, 19 nt, Homo sapiens
guauguagacaaccaauuc

SEQ ID NO: 302444 - RNA, 19 nt, Homo sapiens
gugaggagcaggcaaaugu

SEQ ID NO: 302445 - RNA, 19 nt, Homo sapiens
gguaguggaauagugaaua

SEQ ID NO: 302446 - RNA, 19 nt, Homo sapiens
gccaagaagaugugaaaga

SEQ ID NO: 302447 - RNA, 19 nt, Homo sapiens
gaugugaaagaguuugaaa

SEQ ID NO: 302448 - RNA, 19 nt, Homo sapiens
ggaaagauggagcaagaag

SEQ ID NO: 302449 - RNA, 19 nt, Homo sapiens
gaauauguagcucauccuu

SEQ ID NO: 302450 - RNA, 19 nt, Homo sapiens
uaaaugagaaguacuuggu

SEQ ID NO: 302451 - RNA, 19 nt, Homo sapiens
ggaacaagagacccugguu

SEQ ID NO: 302452 - RNA, 19 nt, Homo sapiens
ccucaauucacauagauuu

SEQ ID NO: 302453 - RNA, 19 nt, Homo sapiens
gacccugguuagacaagaa

SEQ ID NO: 302454 - RNA, 19 nt, Homo sapiens
uaguugaccugucuauaag

SEQ ID NO: 302455 - RNA, 19 nt, Homo sapiens
cagccaagaagaugugaaa

SEQ ID NO: 302456 - RNA, 19 nt, Homo sapiens
aagagacccugguuagaca

SEQ ID NO: 302457 - RNA, 19 nt, Homo sapiens
gcgucgugcuuccgcagua

SEQ ID NO: 302458 - RNA, 19 nt, Homo sapiens
gagaaaaugccucaauuca

SEQ ID NO: 302459 - RNA, 19 nt, Homo sapiens
caacuucuaguagcauuau

SEQ ID NO: 302460 - RNA, 19 nt, Homo sapiens
ccaccacaccuggcuaauu

SEQ ID NO: 302461 - RNA, 19 nt, Homo sapiens
gaaggaaacuggggagucu

SEQ ID NO: 302462 - RNA, 19 nt, Homo sapiens
gagaguguggaaucuaguu

SEQ ID NO: 302463 - RNA, 19 nt, Homo sapiens
aagagaguguggaaucuag

SEQ ID NO: 302464 - RNA, 19 nt, Homo sapiens
gaagaugugaaagaguuug

SEQ ID NO: 302465 - RNA, 19 nt, Homo sapiens
aaagugaagacuauucuca

SEQ ID NO: 302466 - RNA, 19 nt, Homo sapiens
gacaggguuucaccguguu

SEQ ID NO: 302467 - RNA, 19 nt, Homo sapiens
gccauugaaccuuguguga

SEQ ID NO: 302468 - RNA, 19 nt, Homo sapiens
caagagacccugguuagac

SEQ ID NO: 302469 - RNA, 19 nt, Homo sapiens
ggagugcagugggugaucu

SEQ ID NO: 302470 - RNA, 19 nt, Homo sapiens
aggcaaaugugcaauacca

SEQ ID NO: 302471 - RNA, 19 nt, Homo sapiens
ggaauuuagacaaccugaa

SEQ ID NO: 302472 - RNA, 19 nt, Homo sapiens
ggcaaaacaggacaucuua

SEQ ID NO: 302473 - RNA, 19 nt, Homo sapiens
caagaaagugaagacuauu

SEQ ID NO: 302474 - RNA, 19 nt, Homo sapiens
uguaaccaccucacagauu

SEQ ID NO: 302475 - RNA, 19 nt, Homo sapiens
ucaaaugauugugcuaacu

SEQ ID NO: 302476 - RNA, 19 nt, Homo sapiens
cuuauggccugcuuuacau

SEQ ID NO: 302477 - RNA, 19 nt, Homo sapiens
agacuauucucagccauca

SEQ ID NO: 302478 - RNA, 19 nt, Homo sapiens
aagaagagaguguggaauc

SEQ ID NO: 302479 - RNA, 19 nt, Homo sapiens
caccaacuccuaauuuuaa

SEQ ID NO: 302480 - RNA, 19 nt, Homo sapiens
uguagacaaccaauucaaa

SEQ ID NO: 302481 - RNA, 19 nt, Homo sapiens
caaaacaggacaucuuaug

SEQ ID NO: 302482 - RNA, 19 nt, Homo sapiens
aaccuugugugauuuguca

SEQ ID NO: 302483 - RNA, 19 nt, Homo sapiens
uagacaaccaauucaaaug

SEQ ID NO: 302484 - RNA, 19 nt, Homo sapiens
gaguguggaaucuaguuug

SEQ ID NO: 302485 - RNA, 19 nt, Homo sapiens
aagaaacccaagacaaaga

SEQ ID NO: 302486 - RNA, 19 nt, Homo sapiens
gaaagugaagacuauucuc

SEQ ID NO: 302487 - RNA, 19 nt, Homo sapiens
ugucuuaaaugagaaguac

SEQ ID NO: 302488 - RNA, 19 nt, Homo sapiens
gacaaccugaaauuuauuc

SEQ ID NO: 302489 - RNA, 19 nt, Homo sapiens
ggagcaggcaaaugugcaa

SEQ ID NO: 302490 - RNA, 19 nt, Homo sapiens
agaagagaguguggaaucu

SEQ ID NO: 302491 - RNA, 19 nt, Homo sapiens
agaaacccaagacaaagaa

SEQ ID NO: 302492 - RNA, 19 nt, Homo sapiens
uagccaggauggucucgau

SEQ ID NO: 302493 - RNA, 19 nt, Homo sapiens
gguuagacaagaaagugaa

SEQ ID NO: 302494 - RNA, 19 nt, Homo sapiens
guugaccugucuauaagag

SEQ ID NO: 302495 - RNA, 19 nt, Homo sapiens
uauaauugaccuacuuugg

SEQ ID NO: 302496 - RNA, 19 nt, Homo sapiens
ccgagauccugcugcuuuc

SEQ ID NO: 302497 - RNA, 19 nt, Homo sapiens
caagaagaugugaaagagu

SEQ ID NO: 302498 - RNA, 19 nt, Homo sapiens
ccaucaacuucuaguagca

SEQ ID NO: 302499 - RNA, 19 nt, Homo sapiens
ucaacuucuaguagcauua

SEQ ID NO: 302500 - RNA, 19 nt, Homo sapiens
gaacaagagacccugguua

SEQ ID NO: 302501 - RNA, 19 nt, Homo sapiens
gccaguauauuaugacuaa

SEQ ID NO: 302502 - RNA, 19 nt, Homo sapiens
caccacaccuggcuaauuu

SEQ ID NO: 302503 - RNA, 19 nt, Homo sapiens
ucacauagauuucuucucu

SEQ ID NO: 302504 - RNA, 19 nt, Homo sapiens
auauguagcucauccuuua

SEQ ID NO: 302505 - RNA, 19 nt, Homo sapiens
uaauugaccuacuuuggua

SEQ ID NO: 302506 - RNA, 19 nt, Homo sapiens
uaucuuggccaguauauua

SEQ ID NO: 302507 - RNA, 19 nt, Homo sapiens
gaauuuagacaaccugaaa

SEQ ID NO: 302508 - RNA, 19 nt, Homo sapiens
gaaaaugccucaauucaca

SEQ ID NO: 302509 - RNA, 19 nt, Homo sapiens
gaugagaagcaacaacaua

SEQ ID NO: 302510 - RNA, 19 nt, Homo sapiens
guggaauagugaauacuua

SEQ ID NO: 302511 - RNA, 19 nt, Homo sapiens
guaaccaccucacagauuc

SEQ ID NO: 302512 - RNA, 19 nt, Homo sapiens
gagaagcaacaacauauug

SEQ ID NO: 302513 - RNA, 19 nt, Homo sapiens
cuaguugaccugucuauaa

SEQ ID NO: 302514 - RNA, 19 nt, Homo sapiens
gaccgagucuugcucuguu

SEQ ID NO: 302515 - RNA, 19 nt, Homo sapiens
cuauauaacccuaggaauu

SEQ ID NO: 302516 - RNA, 19 nt, Homo sapiens
ucggaaagauggagcaaga

SEQ ID NO: 302517 - RNA, 19 nt, Homo sapiens
ccaaagugcugggauuaca

SEQ ID NO: 302518 - RNA, 19 nt, Homo sapiens
ugccucagccucccaauua

SEQ ID NO: 302519 - RNA, 19 nt, Homo sapiens
aaugagaaguacuugguuu

SEQ ID NO: 302520 - RNA, 19 nt, Homo sapiens
ugaccugucuauaagagaa

SEQ ID NO: 302521 - RNA, 19 nt, Homo sapiens
uuacaccaacuccuaauuu

SEQ ID NO: 302522 - RNA, 19 nt, Homo sapiens
gcaggcaaaugugcaauac

SEQ ID NO: 302523 - RNA, 19 nt, Homo sapiens
ucuacucugucuuaaauga

SEQ ID NO: 302524 - RNA, 19 nt, Homo sapiens
guaguggaauagugaauac

SEQ ID NO: 302525 - RNA, 19 nt, Homo sapiens
gugaggagcaggcaaaugu

SEQ ID NO: 302526 - RNA, 19 nt, Homo sapiens
gguaguggaauagugaaua

SEQ ID NO: 302527 - RNA, 19 nt, Homo sapiens
ggaaagauggagcaagaag

SEQ ID NO: 302528 - RNA, 19 nt, Homo sapiens
gaauauguagcucauccuu

SEQ ID NO: 302529 - RNA, 19 nt, Homo sapiens
guaaaugauugugcuaacu

SEQ ID NO: 302530 - RNA, 19 nt, Homo sapiens
uaaaugagaaguacuuggu

SEQ ID NO: 302531 - RNA, 19 nt, Homo sapiens
ggaacaagagacccugguu

SEQ ID NO: 302532 - RNA, 19 nt, Homo sapiens
ccucaauucacauagauuu

SEQ ID NO: 302533 - RNA, 19 nt, Homo sapiens
uaguugaccugucuauaag

SEQ ID NO: 302534 - RNA, 19 nt, Homo sapiens
gcgucgugcuuccgcagua

SEQ ID NO: 302535 - RNA, 19 nt, Homo sapiens
ugagaagcaacaacauauu

SEQ ID NO: 302536 - RNA, 19 nt, Homo sapiens
gagaaaaugccucaauuca

SEQ ID NO: 302537 - RNA, 19 nt, Homo sapiens
gauuauaugaugagaagca

SEQ ID NO: 302538 - RNA, 19 nt, Homo sapiens
acgauuauaugaugagaag

SEQ ID NO: 302539 - RNA, 19 nt, Homo sapiens
ccaccacaccuggcuaauu

SEQ ID NO: 302540 - RNA, 19 nt, Homo sapiens
gaaggaaacuggggagucu

SEQ ID NO: 302541 - RNA, 19 nt, Homo sapiens
gacaggguuucaccguguu

SEQ ID NO: 302542 - RNA, 19 nt, Homo sapiens
caagagacccugguuagac

SEQ ID NO: 302543 - RNA, 19 nt, Homo sapiens
ggagugcagugggugaucu

SEQ ID NO: 302544 - RNA, 19 nt, Homo sapiens
ggaauuuagacaaccugaa

SEQ ID NO: 302545 - RNA, 19 nt, Homo sapiens
aggcaaaugugcaauacca

SEQ ID NO: 302546 - RNA, 19 nt, Homo sapiens
uguaaccaccucacagauu

SEQ ID NO: 302547 - RNA, 19 nt, Homo sapiens
caccaacuccuaauuuuaa

SEQ ID NO: 302548 - RNA, 19 nt, Homo sapiens
ugucuuaaaugagaaguac

SEQ ID NO: 302549 - RNA, 19 nt, Homo sapiens
gacaaccugaaauuuauuc

SEQ ID NO: 302550 - RNA, 19 nt, Homo sapiens
ggagcaggcaaaugugcaa

SEQ ID NO: 302551 - RNA, 19 nt, Homo sapiens
uagccaggauggucucgau

SEQ ID NO: 302552 - RNA, 19 nt, Homo sapiens
guugaccugucuauaagag

SEQ ID NO: 302553 - RNA, 19 nt, Homo sapiens
ccgagauccugcugcuuuc

SEQ ID NO: 302554 - RNA, 19 nt, Homo sapiens
uauaauugaccuacuuugg

SEQ ID NO: 302555 - RNA, 19 nt, Homo sapiens
uacucugucuuaaaugaga

SEQ ID NO: 302556 - RNA, 19 nt, Homo sapiens
ggaauagugaauacuuacu

SEQ ID NO: 302557 - RNA, 19 nt, Homo sapiens
cacauagauuucuucucuu

SEQ ID NO: 302558 - RNA, 19 nt, Homo sapiens
aaaugccucaauucacaua

SEQ ID NO: 302559 - RNA, 19 nt, Homo sapiens
uauaugaugagaagcaaca

SEQ ID NO: 302560 - RNA, 19 nt, Homo sapiens
accgagauccugcugcuuu

SEQ ID NO: 302561 - RNA, 19 nt, Homo sapiens
uacaccaacuccuaauuuu

SEQ ID NO: 302562 - RNA, 19 nt, Homo sapiens
uguaaaugauugugcuaac

SEQ ID NO: 302563 - RNA, 19 nt, Homo sapiens
acaagagacccugguuaga

SEQ ID NO: 302564 - RNA, 19 nt, Homo sapiens
aacaagagacccugguuag

SEQ ID NO: 302565 - RNA, 19 nt, Homo sapiens
caauuagcuuggccuacag

SEQ ID NO: 302566 - RNA, 19 nt, Homo sapiens
gccauugcuuuugaaguua

SEQ ID NO: 302567 - RNA, 19 nt, Homo sapiens
gcaguuagguguuggaaua

SEQ ID NO: 302568 - RNA, 19 nt, Homo sapiens
gaaaugaugucccugauug

SEQ ID NO: 302569 - RNA, 19 nt, Homo sapiens
uagagaagaugaagacuua

SEQ ID NO: 302570 - RNA, 19 nt, Homo sapiens
gcagucagguacauaguua

SEQ ID NO: 302571 - RNA, 19 nt, Homo sapiens
gauaaaguguuuccuucua

SEQ ID NO: 302572 - RNA, 19 nt, Homo sapiens
cgucagagcuucuccguaa

SEQ ID NO: 302573 - RNA, 19 nt, Homo sapiens
acaaacaagugaagaagua

SEQ ID NO: 302574 - RNA, 19 nt, Homo sapiens
uuaaagaggucaugcacua

SEQ ID NO: 302575 - RNA, 19 nt, Homo sapiens
ccauguagcuuaugugaga

SEQ ID NO: 302576 - RNA, 19 nt, Homo sapiens
gaagaaguagggaaaguaa

SEQ ID NO: 302577 - RNA, 19 nt, Homo sapiens
gaagcaaagugcagaggaa

SEQ ID NO: 302578 - RNA, 19 nt, Homo sapiens
caacugauuuacagacaaa

SEQ ID NO: 302579 - RNA, 19 nt, Homo sapiens
caagguagcuguaagaaaa

SEQ ID NO: 302580 - RNA, 19 nt, Homo sapiens
ugaagcaacuuuaugauca

SEQ ID NO: 302581 - RNA, 19 nt, Homo sapiens
agauucagcugguuauuaa

SEQ ID NO: 302582 - RNA, 19 nt, Homo sapiens
aguaauggcucaacugauu

SEQ ID NO: 302583 - RNA, 19 nt, Homo sapiens
gaaguaauggcucaacuga

SEQ ID NO: 302584 - RNA, 19 nt, Homo sapiens
gagauucagcugguuauua

SEQ ID NO: 302585 - RNA, 19 nt, Homo sapiens
guacugccauuguuucaga

SEQ ID NO: 302586 - RNA, 19 nt, Homo sapiens
gaagaugaagacuuaauug

SEQ ID NO: 302587 - RNA, 19 nt, Homo sapiens
gaggaugaguggcagugua

SEQ ID NO: 302588 - RNA, 19 nt, Homo sapiens
ccacgagacgggaacauua

SEQ ID NO: 302589 - RNA, 19 nt, Homo sapiens
uagauaaccuuucugaaca

SEQ ID NO: 302590 - RNA, 19 nt, Homo sapiens
gaaagagauucagcugguu

SEQ ID NO: 302591 - RNA, 19 nt, Homo sapiens
gaagugcagugagucaaga

SEQ ID NO: 302592 - RNA, 19 nt, Homo sapiens
cuauuuaggucaguacaua

SEQ ID NO: 302593 - RNA, 19 nt, Homo sapiens
ucacuuaccacauuauuug

SEQ ID NO: 302594 - RNA, 19 nt, Homo sapiens
gaggaaggauugguauuca

SEQ ID NO: 302595 - RNA, 19 nt, Homo sapiens
ccaugcacauuuacaauau

SEQ ID NO: 302596 - RNA, 19 nt, Homo sapiens
gcaacucaguggaauucuu

SEQ ID NO: 302597 - RNA, 19 nt, Homo sapiens
guucaaaguuaacccauuc

SEQ ID NO: 302598 - RNA, 19 nt, Homo sapiens
ggauugguauucagauugu

SEQ ID NO: 302599 - RNA, 19 nt, Homo sapiens
aaauuuaacucuccaagca

SEQ ID NO: 302600 - RNA, 19 nt, Homo sapiens
guacugaaugcaagaaauu

SEQ ID NO: 302601 - RNA, 19 nt, Homo sapiens
ucauggagcugccguaagu

SEQ ID NO: 302602 - RNA, 19 nt, Homo sapiens
ggauuuggcucacaguucu

SEQ ID NO: 302603 - RNA, 19 nt, Homo sapiens
caagcaagagguacuguuu

SEQ ID NO: 302604 - RNA, 19 nt, Homo sapiens
agaagcaacuauacaccua

SEQ ID NO: 302605 - RNA, 19 nt, Homo sapiens
aaauuuagcccaagaugaa

SEQ ID NO: 302606 - RNA, 19 nt, Homo sapiens
caagcccucucuaugauau

SEQ ID NO: 302607 - RNA, 19 nt, Homo sapiens
agacaguccuucagcuauu

SEQ ID NO: 302608 - RNA, 19 nt, Homo sapiens
uuucuuccaugcacauuua

SEQ ID NO: 302609 - RNA, 19 nt, Homo sapiens
ggaaggacgggccaucuug

SEQ ID NO: 302610 - RNA, 19 nt, Homo sapiens
ggaaaugaugucccugauu

SEQ ID NO: 302611 - RNA, 19 nt, Homo sapiens
gaacaaacaagugaagaag

SEQ ID NO: 302612 - RNA, 19 nt, Homo sapiens
gacaguccuucagcuauuu

SEQ ID NO: 302613 - RNA, 19 nt, Homo sapiens
auaguuaggugaacccaaa

SEQ ID NO: 302614 - RNA, 19 nt, Homo sapiens
gaacagagaacagauacag

SEQ ID NO: 302615 - RNA, 19 nt, Homo sapiens
guauucagauuguucaaag

SEQ ID NO: 302616 - RNA, 19 nt, Homo sapiens
gaacuacagaagacgauau

SEQ ID NO: 302617 - RNA, 19 nt, Homo sapiens
gaacccaagcccucucuau

SEQ ID NO: 302618 - RNA, 19 nt, Homo sapiens
gaacuacugggacgucaga

SEQ ID NO: 302619 - RNA, 19 nt, Homo sapiens
gaucucuccuggacaaauc

SEQ ID NO: 302620 - RNA, 19 nt, Homo sapiens
aagcaugggagaacaguua

SEQ ID NO: 302621 - RNA, 19 nt, Homo sapiens
ggaaggauugguauucaga

SEQ ID NO: 302622 - RNA, 19 nt, Homo sapiens
ggauguggguacugccauu

SEQ ID NO: 302623 - RNA, 19 nt, Homo sapiens
uuaggaaacuugagaagca

SEQ ID NO: 302624 - RNA, 19 nt, Homo sapiens
caguggaauucuuggauuu

SEQ ID NO: 302625 - RNA, 19 nt, Homo sapiens
gaaagaaaacuccaaacuu

SEQ ID NO: 302626 - RNA, 19 nt, Homo sapiens
gaccuaaagaugcguauau

SEQ ID NO: 302627 - RNA, 19 nt, Homo sapiens
aaagagauucagcugguua

SEQ ID NO: 302628 - RNA, 19 nt, Homo sapiens
ucaguggaauucuuggauu

SEQ ID NO: 302629 - RNA, 19 nt, Homo sapiens
caacucaguggaauucuug

SEQ ID NO: 302630 - RNA, 19 nt, Homo sapiens
caaugaagaacagaaguaa

SEQ ID NO: 302631 - RNA, 19 nt, Homo sapiens
aagaggucaugcacuauuu

SEQ ID NO: 302632 - RNA, 19 nt, Homo sapiens
gagaagaugaagacuuaau

SEQ ID NO: 302633 - RNA, 19 nt, Homo sapiens
cagaaaacauggaggauug

SEQ ID NO: 302634 - RNA, 19 nt, Homo sapiens
ugggagaacaguuagauaa

SEQ ID NO: 302635 - RNA, 19 nt, Homo sapiens
ugaagcugcugauacugaa

SEQ ID NO: 302636 - RNA, 19 nt, Homo sapiens
uaauggcucaacugauuua

SEQ ID NO: 302637 - RNA, 19 nt, Homo sapiens
gcaggagcagcauauggua

SEQ ID NO: 302638 - RNA, 19 nt, Homo sapiens
gaagcaacuuuaugaucag

SEQ ID NO: 302639 - RNA, 19 nt, Homo sapiens
ccaacagacugcaguuucu

SEQ ID NO: 302640 - RNA, 19 nt, Homo sapiens
ugccauggauuacuuuaug

SEQ ID NO: 302641 - RNA, 19 nt, Homo sapiens
uauuaagugccauggauua

SEQ ID NO: 302642 - RNA, 19 nt, Homo sapiens
cauggaggauugccagaau

SEQ ID NO: 302643 - RNA, 19 nt, Homo sapiens
acagagaacagauacagaa

SEQ ID NO: 302644 - RNA, 19 nt, Homo sapiens
gauugucgaagaaccauuu

SEQ ID NO: 302645 - RNA, 19 nt, Homo sapiens
caggaucacaguauggaua

SEQ ID NO: 302646 - RNA, 19 nt, Homo sapiens
ucagagcaguuagguguug

SEQ ID NO: 302647 - RNA, 19 nt, Homo sapiens
acaaugaagaacagaagua

SEQ ID NO: 302648 - RNA, 19 nt, Homo sapiens
gagcuaacaaugaagaaca

SEQ ID NO: 302649 - RNA, 19 nt, Homo sapiens
gaaauguucacuguuaaag

SEQ ID NO: 302650 - RNA, 19 nt, Homo sapiens
ugauaccgauguagagguu

SEQ ID NO: 302651 - RNA, 19 nt, Homo sapiens
guaauggcucaacugauuu

SEQ ID NO: 302652 - RNA, 19 nt, Homo sapiens
gcaaagugcagaggaaagu

SEQ ID NO: 302653 - RNA, 19 nt, Homo sapiens
ugaagaaguagggaaagua

SEQ ID NO: 302654 - RNA, 19 nt, Homo sapiens
gacugcaguuucuucacua

SEQ ID NO: 302655 - RNA, 19 nt, Homo sapiens
gaucagcaggagcagcaua

SEQ ID NO: 302656 - RNA, 19 nt, Homo sapiens
gacgggaacauuauucaug

SEQ ID NO: 302657 - RNA, 19 nt, Homo sapiens
gcaguuucuucacuaccaa

SEQ ID NO: 302658 - RNA, 19 nt, Homo sapiens
ccuaaagaugcguauauaa

SEQ ID NO: 302659 - RNA, 19 nt, Homo sapiens
gaaaaugaaggaaaugaug

SEQ ID NO: 302660 - RNA, 19 nt, Homo sapiens
caagaccaacugaagcaaa

SEQ ID NO: 302661 - RNA, 19 nt, Homo sapiens
gaucacaguauggauauuc

SEQ ID NO: 302662 - RNA, 19 nt, Homo sapiens
aaagaggucaugcacuauu

SEQ ID NO: 302663 - RNA, 19 nt, Homo sapiens
ucaaucagguacgaccaaa

SEQ ID NO: 302664 - RNA, 19 nt, Homo sapiens
ugaacaaacaagugaagaa

SEQ ID NO: 302665 - RNA, 19 nt, Homo sapiens
gucaguaucagagcaguua

SEQ ID NO: 302666 - RNA, 19 nt, Homo sapiens
cuacagaugacuugugguu

SEQ ID NO: 302667 - RNA, 19 nt, Homo sapiens
ugacaaugcuggagagaua

SEQ ID NO: 302668 - RNA, 19 nt, Homo sapiens
caaggaaacuggccacaaa

SEQ ID NO: 302669 - RNA, 19 nt, Homo sapiens
gaagagaagcucagacgua

SEQ ID NO: 302670 - RNA, 19 nt, Homo sapiens
gaacuucgagagucaaaua

SEQ ID NO: 302671 - RNA, 19 nt, Homo sapiens
ugaaauaccuuuggaagaa

SEQ ID NO: 302672 - RNA, 19 nt, Homo sapiens
gaaauaccuuuggaagaaa

SEQ ID NO: 302673 - RNA, 19 nt, Homo sapiens
ggaaacuggccacaaauaa

SEQ ID NO: 302674 - RNA, 19 nt, Homo sapiens
gagagagagugaaagaaga

SEQ ID NO: 302675 - RNA, 19 nt, Homo sapiens
cgaaguaggugaaaaguuu

SEQ ID NO: 302676 - RNA, 19 nt, Homo sapiens
gagagaaacaggagagaaa

SEQ ID NO: 302677 - RNA, 19 nt, Homo sapiens
gaguguggauugagagaaa

SEQ ID NO: 302678 - RNA, 19 nt, Homo sapiens
gaaacuggccacaaauaau

SEQ ID NO: 302679 - RNA, 19 nt, Homo sapiens
gaaaauagaacagcucaua

SEQ ID NO: 302680 - RNA, 19 nt, Homo sapiens
gaagaucgaaguaggugaa

SEQ ID NO: 302681 - RNA, 19 nt, Homo sapiens
gaaggaaaggauccaagaa

SEQ ID NO: 302682 - RNA, 19 nt, Homo sapiens
ggagagagagugaaagaag

SEQ ID NO: 302683 - RNA, 19 nt, Homo sapiens
gcucgagccaguccaauuu

SEQ ID NO: 302684 - RNA, 19 nt, Homo sapiens
caacuacccugaaauaccu

SEQ ID NO: 302685 - RNA, 19 nt, Homo sapiens
ggagagagagagagagaga

SEQ ID NO: 302686 - RNA, 19 nt, Homo sapiens
gagaagcucagacguagga

SEQ ID NO: 302687 - RNA, 19 nt, Homo sapiens
ggagggagagagagugaaa

SEQ ID NO: 302688 - RNA, 19 nt, Homo sapiens
ggguaagcguucacucuug

SEQ ID NO: 302689 - RNA, 19 nt, Homo sapiens
uggcaacuacccugaaaua

SEQ ID NO: 302690 - RNA, 19 nt, Homo sapiens
aaacuggccacaaauaaug

SEQ ID NO: 302691 - RNA, 19 nt, Homo sapiens
gggcaggacuaggaauaug

SEQ ID NO: 302692 - RNA, 19 nt, Homo sapiens
gauagcgaguguggauuga

SEQ ID NO: 302693 - RNA, 19 nt, Homo sapiens
aagcucagacguaggaaua

SEQ ID NO: 302694 - RNA, 19 nt, Homo sapiens
cuaccgacguuuccucguu

SEQ ID NO: 302695 - RNA, 19 nt, Homo sapiens
uauggcaacuacccugaaa

SEQ ID NO: 302696 - RNA, 19 nt, Homo sapiens
gagagagacaggagagaga

SEQ ID NO: 302697 - RNA, 19 nt, Homo sapiens
cggaggcccuuuccacgaa

SEQ ID NO: 302698 - RNA, 19 nt, Homo sapiens
ggccacaaauaaugagugu

SEQ ID NO: 302699 - RNA, 19 nt, Homo sapiens
uagcgaguguggauugaga

SEQ ID NO: 302700 - RNA, 19 nt, Homo sapiens
gcacucccucccucaauau

SEQ ID NO: 302701 - RNA, 19 nt, Homo sapiens
gcaaggaaacuggccacaa

SEQ ID NO: 302702 - RNA, 19 nt, Homo sapiens
ggagcgcaaugccaucuac

SEQ ID NO: 302703 - RNA, 19 nt, Homo sapiens
gugaaaaguuugggccuua

SEQ ID NO: 302704 - RNA, 19 nt, Homo sapiens
ccacauccagugaagcauu

SEQ ID NO: 302705 - RNA, 19 nt, Homo sapiens
ugcaagguguccaaacuga

SEQ ID NO: 302706 - RNA, 19 nt, Homo sapiens
aaggaaaggauccaagaaa

SEQ ID NO: 302707 - RNA, 19 nt, Homo sapiens
uaccgacguuuccucguuu

SEQ ID NO: 302708 - RNA, 19 nt, Homo sapiens
gaauauggaccaaaaggaa

SEQ ID NO: 302709 - RNA, 19 nt, Homo sapiens
caaaggcagggcaaggaaa

SEQ ID NO: 302710 - RNA, 19 nt, Homo sapiens
gcacagcaugagauccaaa

SEQ ID NO: 302711 - RNA, 19 nt, Homo sapiens
gagaaacaggagagaaaca

SEQ ID NO: 302712 - RNA, 19 nt, Homo sapiens
ugaaagcaguuuuguaaag

SEQ ID NO: 302713 - RNA, 19 nt, Homo sapiens
auacagagagugagugugu

SEQ ID NO: 302714 - RNA, 19 nt, Homo sapiens
aggaaacuggccacaaaua

SEQ ID NO: 302715 - RNA, 19 nt, Homo sapiens
ccaaaggcagggcaaggaa

SEQ ID NO: 302716 - RNA, 19 nt, Homo sapiens
gaaagcaguuuuguaaagg

SEQ ID NO: 302717 - RNA, 19 nt, Homo sapiens
gccagaugcagauggagua

SEQ ID NO: 302718 - RNA, 19 nt, Homo sapiens
gagccaguccaauuuaugg

SEQ ID NO: 302719 - RNA, 19 nt, Homo sapiens
cuaggaauauggaccaaaa

SEQ ID NO: 302720 - RNA, 19 nt, Homo sapiens
gcaggacuaggaauaugga

SEQ ID NO: 302721 - RNA, 19 nt, Homo sapiens
agcacucccucccucaaua

SEQ ID NO: 302722 - RNA, 19 nt, Homo sapiens
ggaagaaaugccagaugca

SEQ ID NO: 302723 - RNA, 19 nt, Homo sapiens
gcaacuacccugaaauacc

SEQ ID NO: 302724 - RNA, 19 nt, Homo sapiens
cuggagagauagcgagugu

SEQ ID NO: 302725 - RNA, 19 nt, Homo sapiens
agaaggaaaggauccaaga

SEQ ID NO: 302726 - RNA, 19 nt, Homo sapiens
ggagcgagagggagagcaa

SEQ ID NO: 302727 - RNA, 19 nt, Homo sapiens
cagacgaccuuuuguuuuc

SEQ ID NO: 302728 - RNA, 19 nt, Homo sapiens
agagagagugaaagaagaa

SEQ ID NO: 302729 - RNA, 19 nt, Homo sapiens
gaggguaagcguucacucu

SEQ ID NO: 302730 - RNA, 19 nt, Homo sapiens
cugcaaguauccagaccuu

SEQ ID NO: 302731 - RNA, 19 nt, Homo sapiens
caaaaggaagaucgaagua

SEQ ID NO: 302732 - RNA, 19 nt, Homo sapiens
gaaaugccagaugcagaug

SEQ ID NO: 302733 - RNA, 19 nt, Homo sapiens
guuugaacuucgagaguca

SEQ ID NO: 302734 - RNA, 19 nt, Homo sapiens
agaaaugccagaugcagau

SEQ ID NO: 302735 - RNA, 19 nt, Homo sapiens
guguguauauggcaacuac

SEQ ID NO: 302736 - RNA, 19 nt, Homo sapiens
ucgagccaguccaauuuau

SEQ ID NO: 302737 - RNA, 19 nt, Homo sapiens
agagagagagagagagaga

SEQ ID NO: 302738 - RNA, 19 nt, Homo sapiens
agagagagagagagagaga

SEQ ID NO: 302739 - RNA, 19 nt, Homo sapiens
agagagagagagagagaga

SEQ ID NO: 302740 - RNA, 19 nt, Homo sapiens
agagagagagagagagaga

SEQ ID NO: 302741 - RNA, 19 nt, Homo sapiens
agagagagagagagagaga

SEQ ID NO: 302742 - RNA, 19 nt, Homo sapiens
agagagagagagagagaga

SEQ ID NO: 302743 - RNA, 19 nt, Homo sapiens
agagagagagagagagaga

SEQ ID NO: 302744 - RNA, 19 nt, Homo sapiens
agagagagagagagagaga

SEQ ID NO: 302745 - RNA, 19 nt, Homo sapiens
agagauagcgaguguggau

SEQ ID NO: 302746 - RNA, 19 nt, Homo sapiens
agagagagagagagagaga

SEQ ID NO: 302747 - RNA, 19 nt, Homo sapiens
agagagagagagagagaga

SEQ ID NO: 302748 - RNA, 19 nt, Homo sapiens
agagagagagagagagaga

SEQ ID NO: 302749 - RNA, 19 nt, Homo sapiens
agagagagagagagagaga

SEQ ID NO: 302750 - RNA, 19 nt, Homo sapiens
agagagagagagagagaga

SEQ ID NO: 302751 - RNA, 19 nt, Homo sapiens
cacauccagugaagcauuc

SEQ ID NO: 302752 - RNA, 19 nt, Homo sapiens
agagagagagagagagaga

SEQ ID NO: 302753 - RNA, 19 nt, Homo sapiens
agagagagagagagagaga

SEQ ID NO: 302754 - RNA, 19 nt, Homo sapiens
gaaaauacagagagugagu

SEQ ID NO: 302755 - RNA, 19 nt, Homo sapiens
agagagagagagagagaga

SEQ ID NO: 302756 - RNA, 19 nt, Homo sapiens
ugccguaccugcaaguauc

SEQ ID NO: 302757 - RNA, 19 nt, Homo sapiens
gaaagaccccaguuaugga

SEQ ID NO: 302758 - RNA, 19 nt, Homo sapiens
gggcacagcaugagaucca

SEQ ID NO: 302759 - RNA, 19 nt, Homo sapiens
aggaaaggauccaagaaaa

SEQ ID NO: 302760 - RNA, 19 nt, Homo sapiens
guucacucuugguuguauu

SEQ ID NO: 302761 - RNA, 19 nt, Homo sapiens
caguccaauuuauggcuaa

SEQ ID NO: 302762 - RNA, 19 nt, Homo sapiens
gaagcucagacguaggaau

SEQ ID NO: 302763 - RNA, 19 nt, Homo sapiens
ugggagagcagaggucaaa

SEQ ID NO: 302764 - RNA, 19 nt, Homo sapiens
ggacugggcacagcaugag

SEQ ID NO: 302765 - RNA, 19 nt, Homo sapiens
uggaagagagagagaaaca

SEQ ID NO: 302766 - RNA, 19 nt, Homo sapiens
gaagcauucacuccaaagg

SEQ ID NO: 302767 - RNA, 19 nt, Homo sapiens
ugacagguaucuucucuua

SEQ ID NO: 302768 - RNA, 19 nt, Homo sapiens
gaagagagacagcaauuga

SEQ ID NO: 302769 - RNA, 19 nt, Homo sapiens
ggauaaacaucacaugaga

SEQ ID NO: 302770 - RNA, 19 nt, Homo sapiens
caucugacauugagaaauu

SEQ ID NO: 302771 - RNA, 19 nt, Homo sapiens
gcaaacauuucuaacucua

SEQ ID NO: 302772 - RNA, 19 nt, Homo sapiens
gaaagaugcauaccaagaa

SEQ ID NO: 302773 - RNA, 19 nt, Homo sapiens
gaccuuggcuguaauggaa

SEQ ID NO: 302774 - RNA, 19 nt, Homo sapiens
aguaagagguucugaauau

SEQ ID NO: 302775 - RNA, 19 nt, Homo sapiens
gaugaauccucaagaaugu

SEQ ID NO: 302776 - RNA, 19 nt, Homo sapiens
gcagaucacagauaauauu

SEQ ID NO: 302777 - RNA, 19 nt, Homo sapiens
ugaggcagaucacagauaa

SEQ ID NO: 302778 - RNA, 19 nt, Homo sapiens
gaccaaaguugaccaguag

SEQ ID NO: 302779 - RNA, 19 nt, Homo sapiens
ggaagagggucggcuuuau

SEQ ID NO: 302780 - RNA, 19 nt, Homo sapiens
gauccagguucuuagagua

SEQ ID NO: 302781 - RNA, 19 nt, Homo sapiens
gaaccuagaagccauuguu

SEQ ID NO: 302782 - RNA, 19 nt, Homo sapiens
caaauggacagacccuaua

SEQ ID NO: 302783 - RNA, 19 nt, Homo sapiens
acagguaucuucucuuaau

SEQ ID NO: 302784 - RNA, 19 nt, Homo sapiens
ucacuuugccuucugguua

SEQ ID NO: 302785 - RNA, 19 nt, Homo sapiens
gauucuaccugauuguuau

SEQ ID NO: 302786 - RNA, 19 nt, Homo sapiens
cagaaaagauugugaaaga

SEQ ID NO: 302787 - RNA, 19 nt, Homo sapiens
gguuauagcucagcaagug

SEQ ID NO: 302788 - RNA, 19 nt, Homo sapiens
agaacaaacugucugauca

SEQ ID NO: 302789 - RNA, 19 nt, Homo sapiens
gagaaauucaugccuauug

SEQ ID NO: 302790 - RNA, 19 nt, Homo sapiens
agaccaaaguugaccagua

SEQ ID NO: 302791 - RNA, 19 nt, Homo sapiens
aaagaugcauaccaagaaa

SEQ ID NO: 302792 - RNA, 19 nt, Homo sapiens
agacagcaauugaacauuc

SEQ ID NO: 302793 - RNA, 19 nt, Homo sapiens
ccuugcagcucuucgaaua

SEQ ID NO: 302794 - RNA, 19 nt, Homo sapiens
gaaaagacagccacaguuu

SEQ ID NO: 302795 - RNA, 19 nt, Homo sapiens
agauauggcugguugauuc

SEQ ID NO: 302796 - RNA, 19 nt, Homo sapiens
caucugaacucugacuuug

SEQ ID NO: 302797 - RNA, 19 nt, Homo sapiens
ccaaguauggcaugaauug

SEQ ID NO: 302798 - RNA, 19 nt, Homo sapiens
ccaguaggauaauagcaaa

SEQ ID NO: 302799 - RNA, 19 nt, Homo sapiens
uagaagccauuguucaaga

SEQ ID NO: 302800 - RNA, 19 nt, Homo sapiens
aagagaaguuugcccauga

SEQ ID NO: 302801 - RNA, 19 nt, Homo sapiens
gaaaaugaggaguuacuua

SEQ ID NO: 302802 - RNA, 19 nt, Homo sapiens
uagcaaacauuucuaacuc

SEQ ID NO: 302803 - RNA, 19 nt, Homo sapiens
uaagagguucugaauauga

SEQ ID NO: 302804 - RNA, 19 nt, Homo sapiens
gggcaucccuguggguaaa

SEQ ID NO: 302805 - RNA, 19 nt, Homo sapiens
caauauaguuugguguuuc

SEQ ID NO: 302806 - RNA, 19 nt, Homo sapiens
gcucagcaagugucagaua

SEQ ID NO: 302807 - RNA, 19 nt, Homo sapiens
aaugaacggccuauuauuu

SEQ ID NO: 302808 - RNA, 19 nt, Homo sapiens
ucaaugaacggccuauuau

SEQ ID NO: 302809 - RNA, 19 nt, Homo sapiens
guaagagguucugaauaug

SEQ ID NO: 302810 - RNA, 19 nt, Homo sapiens
guaaauuggcucuauauac

SEQ ID NO: 302811 - RNA, 19 nt, Homo sapiens
gcauauugcuucaguucuc

SEQ ID NO: 302812 - RNA, 19 nt, Homo sapiens
gaaauucaugccuauuguu

SEQ ID NO: 302813 - RNA, 19 nt, Homo sapiens
auagagugcugacaucuga

SEQ ID NO: 302814 - RNA, 19 nt, Homo sapiens
gaccagauucuaccugauu

SEQ ID NO: 302815 - RNA, 19 nt, Homo sapiens
aaagacagccacaguuuau

SEQ ID NO: 302816 - RNA, 19 nt, Homo sapiens
ugugaaagaugcauaccaa

SEQ ID NO: 302817 - RNA, 19 nt, Homo sapiens
ucgagcaucugaacucuga

SEQ ID NO: 302818 - RNA, 19 nt, Homo sapiens
gaagagggucggcuuuauc

SEQ ID NO: 302819 - RNA, 19 nt, Homo sapiens
ugggagaccuuggcuguaa

SEQ ID NO: 302820 - RNA, 19 nt, Homo sapiens
gaauaccauuagagauguu

SEQ ID NO: 302821 - RNA, 19 nt, Homo sapiens
caggagauccagguucuua

SEQ ID NO: 302822 - RNA, 19 nt, Homo sapiens
ggcaguuucuuccaaguau

SEQ ID NO: 302823 - RNA, 19 nt, Homo sapiens
cggagaaacucaucauuuu

SEQ ID NO: 302824 - RNA, 19 nt, Homo sapiens
aaacaucacaugagacaau

SEQ ID NO: 302825 - RNA, 19 nt, Homo sapiens
gaaaugaagaaccuagaag

SEQ ID NO: 302826 - RNA, 19 nt, Homo sapiens
uaacacaagagaaagagaa

SEQ ID NO: 302827 - RNA, 19 nt, Homo sapiens
aaaccaguauugcacauuc

SEQ ID NO: 302828 - RNA, 19 nt, Homo sapiens
gaguaagagguucugaaua

SEQ ID NO: 302829 - RNA, 19 nt, Homo sapiens
gguaaauuggcucuauaua

SEQ ID NO: 302830 - RNA, 19 nt, Homo sapiens
gcugacaucugacauugag

SEQ ID NO: 302831 - RNA, 19 nt, Homo sapiens
cagauaaacacuuggaaga

SEQ ID NO: 302832 - RNA, 19 nt, Homo sapiens
gggacgugcuuccuuaaca

SEQ ID NO: 302833 - RNA, 19 nt, Homo sapiens
uaugguuucugucugaauu

SEQ ID NO: 302834 - RNA, 19 nt, Homo sapiens
gaaaauacagaccaaaguu

SEQ ID NO: 302835 - RNA, 19 nt, Homo sapiens
ugaaagaugcauaccaaga

SEQ ID NO: 302836 - RNA, 19 nt, Homo sapiens
gaagaaccuagaagccauu

SEQ ID NO: 302837 - RNA, 19 nt, Homo sapiens
aaagauccacucuacauug

SEQ ID NO: 302838 - RNA, 19 nt, Homo sapiens
gugcugacaucugacauug

SEQ ID NO: 302839 - RNA, 19 nt, Homo sapiens
acaaguaucgaaaccagua

SEQ ID NO: 302840 - RNA, 19 nt, Homo sapiens
ggagauccagguucuuaga

SEQ ID NO: 302841 - RNA, 19 nt, Homo sapiens
agaaauucaugccuauugu

SEQ ID NO: 302842 - RNA, 19 nt, Homo sapiens
cugccuacguucucuuuaa

SEQ ID NO: 302843 - RNA, 19 nt, Homo sapiens
gcaaaacaaagaagcauuu

SEQ ID NO: 302844 - RNA, 19 nt, Homo sapiens
agccauuguucaagaaaua

SEQ ID NO: 302845 - RNA, 19 nt, Homo sapiens
caagagaaagagaaguuug

SEQ ID NO: 302846 - RNA, 19 nt, Homo sapiens
caaugaugauauucaagga

SEQ ID NO: 302847 - RNA, 19 nt, Homo sapiens
uaaagauccacucuacauu

SEQ ID NO: 302848 - RNA, 19 nt, Homo sapiens
gagggcauauugcuucagu

SEQ ID NO: 302849 - RNA, 19 nt, Homo sapiens
ggaagagagacagcaauug

SEQ ID NO: 302850 - RNA, 19 nt, Homo sapiens
aaaguugaccaguaggaua

SEQ ID NO: 302851 - RNA, 19 nt, Homo sapiens
gcucccagauguauaguac

SEQ ID NO: 302852 - RNA, 19 nt, Homo sapiens
aaaaccaacugcccucaua

SEQ ID NO: 302853 - RNA, 19 nt, Homo sapiens
gguaucuucucuuaaugga

SEQ ID NO: 302854 - RNA, 19 nt, Homo sapiens
aaauacagaccaaaguuga

SEQ ID NO: 302855 - RNA, 19 nt, Homo sapiens
ugaauaccauuagagaugu

SEQ ID NO: 302856 - RNA, 19 nt, Homo sapiens
aggcagaucacagauaaua

SEQ ID NO: 302857 - RNA, 19 nt, Homo sapiens
ccaaauggacagacccuau

SEQ ID NO: 302858 - RNA, 19 nt, Homo sapiens
cagagaagaguaagagguu

SEQ ID NO: 302859 - RNA, 19 nt, Homo sapiens
gauggagagcguauucuug

SEQ ID NO: 302860 - RNA, 19 nt, Homo sapiens
gaaaagauugugaaagaug

SEQ ID NO: 302861 - RNA, 19 nt, Homo sapiens
caaugaacggccuauuauu

SEQ ID NO: 302862 - RNA, 19 nt, Homo sapiens
acucugacuuugacaggua

SEQ ID NO: 302863 - RNA, 19 nt, Homo sapiens
gcaucugaacucugacuuu

SEQ ID NO: 302864 - RNA, 19 nt, Homo sapiens
uggguaaauuggcucuaua

SEQ ID NO: 302865 - RNA, 19 nt, Homo sapiens
ggucuuuaaaccuuucaua

SEQ ID NO: 302866 - RNA, 19 nt, Homo sapiens
ucuccaagauagaaaugaa

SEQ ID NO: 302867 - RNA, 19 nt, Homo sapiens
gaagaagcauauacacuua

SEQ ID NO: 302868 - RNA, 19 nt, Homo sapiens
ugaaaggccuguaauauuu

SEQ ID NO: 302869 - RNA, 19 nt, Homo sapiens
gagauaaugucuucaguuu

SEQ ID NO: 302870 - RNA, 19 nt, Homo sapiens
gaacauggcggagugaaua

SEQ ID NO: 302871 - RNA, 19 nt, Homo sapiens
cagaauaccuauaugcuaa

SEQ ID NO: 302872 - RNA, 19 nt, Homo sapiens
gaaacgagaucgcacacaa

SEQ ID NO: 302873 - RNA, 19 nt, Homo sapiens
ggccaaauauguuaaagaa

SEQ ID NO: 302874 - RNA, 19 nt, Homo sapiens
ccagagagcauaccugaua

SEQ ID NO: 302875 - RNA, 19 nt, Homo sapiens
ggaacacacucauucaguu

SEQ ID NO: 302876 - RNA, 19 nt, Homo sapiens
uagaagaccuaagggauua

SEQ ID NO: 302877 - RNA, 19 nt, Homo sapiens
gcacacaacaguaugauga

SEQ ID NO: 302878 - RNA, 19 nt, Homo sapiens
agacagaggucauguuaga

SEQ ID NO: 302879 - RNA, 19 nt, Homo sapiens
gagcauaccugauacuuuu

SEQ ID NO: 302880 - RNA, 19 nt, Homo sapiens
guggauaacuggccagaaa

SEQ ID NO: 302881 - RNA, 19 nt, Homo sapiens
gcaagccacuuaugcugaa

SEQ ID NO: 302882 - RNA, 19 nt, Homo sapiens
aagaugacauugagaguuu

SEQ ID NO: 302883 - RNA, 19 nt, Homo sapiens
uguaacacccggcauauua

SEQ ID NO: 302884 - RNA, 19 nt, Homo sapiens
gacaaggccaaauauguua

SEQ ID NO: 302885 - RNA, 19 nt, Homo sapiens
cgagaccucuggugaaaga

SEQ ID NO: 302886 - RNA, 19 nt, Homo sapiens
gaaaaugacuagcccuuug

SEQ ID NO: 302887 - RNA, 19 nt, Homo sapiens
gaauacggccugauagaug

SEQ ID NO: 302888 - RNA, 19 nt, Homo sapiens
gagggcagguguuuguuug

SEQ ID NO: 302889 - RNA, 19 nt, Homo sapiens
caaugaaaggccuguaaua

SEQ ID NO: 302890 - RNA, 19 nt, Homo sapiens
ucagacagaggucauguua

SEQ ID NO: 302891 - RNA, 19 nt, Homo sapiens
ggcauuuacuuuacaagaa

SEQ ID NO: 302892 - RNA, 19 nt, Homo sapiens
gcaucaagcccuccuguga

SEQ ID NO: 302893 - RNA, 19 nt, Homo sapiens
gaucaauuguggauaacug

SEQ ID NO: 302894 - RNA, 19 nt, Homo sapiens
gaaaggccuguaauauuug

SEQ ID NO: 302895 - RNA, 19 nt, Homo sapiens
gaagacaaggccaaauaug

SEQ ID NO: 302896 - RNA, 19 nt, Homo sapiens
gaagaugcagugaauauac

SEQ ID NO: 302897 - RNA, 19 nt, Homo sapiens
ugaagaagcauauacacuu

SEQ ID NO: 302898 - RNA, 19 nt, Homo sapiens
guaaaccaaucuccgaaca

SEQ ID NO: 302899 - RNA, 19 nt, Homo sapiens
uaaaauggcuuuccgauac

SEQ ID NO: 302900 - RNA, 19 nt, Homo sapiens
gccauggccucuaucaaug

SEQ ID NO: 302901 - RNA, 19 nt, Homo sapiens
uagcuguuauucucuguaa

SEQ ID NO: 302902 - RNA, 19 nt, Homo sapiens
ugaccugauugaugaguuu

SEQ ID NO: 302903 - RNA, 19 nt, Homo sapiens
augaugaccugauugauga

SEQ ID NO: 302904 - RNA, 19 nt, Homo sapiens
gaugugggaacugauaaua

SEQ ID NO: 302905 - RNA, 19 nt, Homo sapiens
guauugaugugggaacuga

SEQ ID NO: 302906 - RNA, 19 nt, Homo sapiens
ggaauacaagaaagaaaug

SEQ ID NO: 302907 - RNA, 19 nt, Homo sapiens
acaagauauucaagccuua

SEQ ID NO: 302908 - RNA, 19 nt, Homo sapiens
caagccaauugacagauga

SEQ ID NO: 302909 - RNA, 19 nt, Homo sapiens
gcauauuagugacaguguu

SEQ ID NO: 302910 - RNA, 19 nt, Homo sapiens
agaccuaagggauuauuua

SEQ ID NO: 302911 - RNA, 19 nt, Homo sapiens
auagaauacugcaagauga

SEQ ID NO: 302912 - RNA, 19 nt, Homo sapiens
gggaauacaagaaagaaau

SEQ ID NO: 302913 - RNA, 19 nt, Homo sapiens
gacaaaugcuuggucuuca

SEQ ID NO: 302914 - RNA, 19 nt, Homo sapiens
agacaaggccaaauauguu

SEQ ID NO: 302915 - RNA, 19 nt, Homo sapiens
gaagacuuuggaaaucaua

SEQ ID NO: 302916 - RNA, 19 nt, Homo sapiens
gccuuacgauuucauagaa

SEQ ID NO: 302917 - RNA, 19 nt, Homo sapiens
gguguggcuuuagcuguua

SEQ ID NO: 302918 - RNA, 19 nt, Homo sapiens
gugcacggcugaagaagca

SEQ ID NO: 302919 - RNA, 19 nt, Homo sapiens
gcauuuacuuuacaagaac

SEQ ID NO: 302920 - RNA, 19 nt, Homo sapiens
uagaagcacuccccugaua

SEQ ID NO: 302921 - RNA, 19 nt, Homo sapiens
ggaauugcaaaucuuauag

SEQ ID NO: 302922 - RNA, 19 nt, Homo sapiens
gaaagcuauuacugacaga

SEQ ID NO: 302923 - RNA, 19 nt, Homo sapiens
ccugauaaauacuuucugu

SEQ ID NO: 302924 - RNA, 19 nt, Homo sapiens
caggaaguuucuauuaaca

SEQ ID NO: 302925 - RNA, 19 nt, Homo sapiens
ggaaccauuuacucacuca

SEQ ID NO: 302926 - RNA, 19 nt, Homo sapiens
guucgaagacuuuggaaau

SEQ ID NO: 302927 - RNA, 19 nt, Homo sapiens
acaguaugaugaccugauu

SEQ ID NO: 302928 - RNA, 19 nt, Homo sapiens
gauagaugccugccagugu

SEQ ID NO: 302929 - RNA, 19 nt, Homo sapiens
uguuaaggcuguuguagug

SEQ ID NO: 302930 - RNA, 19 nt, Homo sapiens
gaccuaagggauuauuuau

SEQ ID NO: 302931 - RNA, 19 nt, Homo sapiens
uauucaagccuuacgauuu

SEQ ID NO: 302932 - RNA, 19 nt, Homo sapiens
cugaagacaaggccaaaua

SEQ ID NO: 302933 - RNA, 19 nt, Homo sapiens
aaaccaaucuccgaacaca

SEQ ID NO: 302934 - RNA, 19 nt, Homo sapiens
ggaauacggccugauagau

SEQ ID NO: 302935 - RNA, 19 nt, Homo sapiens
ggucauguuagaucaauug

SEQ ID NO: 302936 - RNA, 19 nt, Homo sapiens
ugccagauguguaugaaug

SEQ ID NO: 302937 - RNA, 19 nt, Homo sapiens
ucaggaaguuucuauuaac

SEQ ID NO: 302938 - RNA, 19 nt, Homo sapiens
acccaccgcuugcuaauau

SEQ ID NO: 302939 - RNA, 19 nt, Homo sapiens
ugucgacauuugcacauaa

SEQ ID NO: 302940 - RNA, 19 nt, Homo sapiens
ccagugaaacuuacagaug

SEQ ID NO: 302941 - RNA, 19 nt, Homo sapiens
gcuaauauucaggaaguuu

SEQ ID NO: 302942 - RNA, 19 nt, Homo sapiens
cauauuagugacaguguuu

SEQ ID NO: 302943 - RNA, 19 nt, Homo sapiens
gcacggcugaagaagcaua

SEQ ID NO: 302944 - RNA, 19 nt, Homo sapiens
aagaaaaucuggauguuug

SEQ ID NO: 302945 - RNA, 19 nt, Homo sapiens
gaaaauggccugucagaac

SEQ ID NO: 302946 - RNA, 19 nt, Homo sapiens
cgacaaaugcuuggucuuc

SEQ ID NO: 302947 - RNA, 19 nt, Homo sapiens
cauaaugcauucagguucu

SEQ ID NO: 302948 - RNA, 19 nt, Homo sapiens
acaaaugcuuggucuucaa

SEQ ID NO: 302949 - RNA, 19 nt, Homo sapiens
gaggucauguuagaucaau

SEQ ID NO: 302950 - RNA, 19 nt, Homo sapiens
cauaaugggaauacaagaa

SEQ ID NO: 302951 - RNA, 19 nt, Homo sapiens
ugaagaugcagugaauaua

SEQ ID NO: 302952 - RNA, 19 nt, Homo sapiens
gaacaagaggcacaaaaga

SEQ ID NO: 302953 - RNA, 19 nt, Homo sapiens
ucaagggacagcugcagua

SEQ ID NO: 302954 - RNA, 19 nt, Homo sapiens
gagaguuuaaugccaauug

SEQ ID NO: 302955 - RNA, 19 nt, Homo sapiens
caguauggacacaucuuua

SEQ ID NO: 302956 - RNA, 19 nt, Homo sapiens
caagaugacauugagaguu

SEQ ID NO: 302957 - RNA, 19 nt, Homo sapiens
uauagaauacugcaagaug

SEQ ID NO: 302958 - RNA, 19 nt, Homo sapiens
gcacuccccugauaaauac

SEQ ID NO: 302959 - RNA, 19 nt, Homo sapiens
gaagaccuaagggauuauu

SEQ ID NO: 302960 - RNA, 19 nt, Homo sapiens
gauguugucccgguuaaga

SEQ ID NO: 302961 - RNA, 19 nt, Homo sapiens
auucaagccuuacgauuuc

SEQ ID NO: 302962 - RNA, 19 nt, Homo sapiens
ugaagacaaggccaaauau

SEQ ID NO: 302963 - RNA, 19 nt, Homo sapiens
ggcuuuagcuguuauucuc

SEQ ID NO: 302964 - RNA, 19 nt, Homo sapiens
uuacagagggcagguguuu

SEQ ID NO: 302965 - RNA, 19 nt, Homo sapiens
augaaaggccuguaauauu

SEQ ID NO: 302966 - RNA, 19 nt, Homo sapiens
aaugaaaggccuguaauau

SEQ ID NO: 302967 - RNA, 19 nt, Homo sapiens
gaaccaagauccugaacaa

SEQ ID NO: 302968 - RNA, 19 nt, Homo sapiens
gcacaggacugaacacauc

SEQ ID NO: 302969 - RNA, 19 nt, Homo sapiens
gaacacaucccugguugua

SEQ ID NO: 302970 - RNA, 19 nt, Homo sapiens
gggaagaugugguacagaa

SEQ ID NO: 302971 - RNA, 19 nt, Homo sapiens
gaauaaagcaccuauguac

SEQ ID NO: 302972 - RNA, 19 nt, Homo sapiens
agugagagcugccuuauau

SEQ ID NO: 302973 - RNA, 19 nt, Homo sapiens
gagaauaaagcaccuaugu

SEQ ID NO: 302974 - RNA, 19 nt, Homo sapiens
gaacaaccacagcucuauu

SEQ ID NO: 302975 - RNA, 19 nt, Homo sapiens
gacaauggcuggaguaagc

SEQ ID NO: 302976 - RNA, 19 nt, Homo sapiens
uaaagcaccuauguacuga

SEQ ID NO: 302977 - RNA, 19 nt, Homo sapiens
acacaucccugguuguaau

SEQ ID NO: 302978 - RNA, 19 nt, Homo sapiens
ccaaccaccuuagcaugua

SEQ ID NO: 302979 - RNA, 19 nt, Homo sapiens
gcacaucagacuucucaga

SEQ ID NO: 302980 - RNA, 19 nt, Homo sapiens
ggaagugaccacagugaga

SEQ ID NO: 302981 - RNA, 19 nt, Homo sapiens
ucagagacccacuuuauuc

SEQ ID NO: 302982 - RNA, 19 nt, Homo sapiens
gagcugccuuauauuccua

SEQ ID NO: 302983 - RNA, 19 nt, Homo sapiens
gagugaagaugaagaugag

SEQ ID NO: 302984 - RNA, 19 nt, Homo sapiens
gugaggagccugaggaaga

SEQ ID NO: 302985 - RNA, 19 nt, Homo sapiens
ugccuuauauuccuacauu

SEQ ID NO: 302986 - RNA, 19 nt, Homo sapiens
ggauggagauguaguugcu

SEQ ID NO: 302987 - RNA, 19 nt, Homo sapiens
gagacccacuuuauucagu

SEQ ID NO: 302988 - RNA, 19 nt, Homo sapiens
gaagaugugguacagaaag

SEQ ID NO: 302989 - RNA, 19 nt, Homo sapiens
ccaagauccugaacaagag

SEQ ID NO: 302990 - RNA, 19 nt, Homo sapiens
agaauaaagcaccuaugua

SEQ ID NO: 302991 - RNA, 19 nt, Homo sapiens
gauggcaacaguaguucua

SEQ ID NO: 302992 - RNA, 19 nt, Homo sapiens
gagcguaucuuccccaauc

SEQ ID NO: 302993 - RNA, 19 nt, Homo sapiens
ggaagaugugguacagaaa

SEQ ID NO: 302994 - RNA, 19 nt, Homo sapiens
gagcuacagcguugaacaa

SEQ ID NO: 302995 - RNA, 19 nt, Homo sapiens
cauuagagagugaagauga

SEQ ID NO: 302996 - RNA, 19 nt, Homo sapiens
caaccaccuuagcauguau

SEQ ID NO: 302997 - RNA, 19 nt, Homo sapiens
ugagagcugccuuauauuc

SEQ ID NO: 302998 - RNA, 19 nt, Homo sapiens
ccagugggaagauguggua

SEQ ID NO: 302999 - RNA, 19 nt, Homo sapiens
ugccugggcucgggagaua

SEQ ID NO: 303000 - RNA, 19 nt, Homo sapiens
ucaaggcacaucagacuuc

SEQ ID NO: 303001 - RNA, 19 nt, Homo sapiens
auaaagcaccuauguacug

SEQ ID NO: 303002 - RNA, 19 nt, Homo sapiens
agagugaagaugaagauga

SEQ ID NO: 303003 - RNA, 19 nt, Homo sapiens
agacccacuuuauucaguu

SEQ ID NO: 303004 - RNA, 19 nt, Homo sapiens
cagagacccacuuuauuca

SEQ ID NO: 303005 - RNA, 19 nt, Homo sapiens
cugaggaacugggacauca

SEQ ID NO: 303006 - RNA, 19 nt, Homo sapiens
auucaguucuguacauaug

SEQ ID NO: 303007 - RNA, 19 nt, Homo sapiens
ggacccagaacauguagag

SEQ ID NO: 303008 - RNA, 19 nt, Homo sapiens
gaagaugaggagggagcua

SEQ ID NO: 303009 - RNA, 19 nt, Homo sapiens
accaagauccugaacaaga

SEQ ID NO: 303010 - RNA, 19 nt, Homo sapiens
guaucacucuguggagaau

SEQ ID NO: 303011 - RNA, 19 nt, Homo sapiens
gacaucagggcccuucaga

SEQ ID NO: 303012 - RNA, 19 nt, Homo sapiens
ggagaauaaagcaccuaug

SEQ ID NO: 303013 - RNA, 19 nt, Homo sapiens
caucaaggcacaucagacu

SEQ ID NO: 303014 - RNA, 19 nt, Homo sapiens
gggcucgggagauaucuga

SEQ ID NO: 303015 - RNA, 19 nt, Homo sapiens
gacccacuuuauucaguuc

SEQ ID NO: 303016 - RNA, 19 nt, Homo sapiens
cagugagagcugccuuaua

SEQ ID NO: 303017 - RNA, 19 nt, Homo sapiens
ggagcuacagcguugaaca

SEQ ID NO: 303018 - RNA, 19 nt, Homo sapiens
ccagacccaccauuagaga

SEQ ID NO: 303019 - RNA, 19 nt, Homo sapiens
ggcaacaguaguucuagga

SEQ ID NO: 303020 - RNA, 19 nt, Homo sapiens
ccacuuuauucaguucugu

SEQ ID NO: 303021 - RNA, 19 nt, Homo sapiens
ugaacaaccacagcucuau

SEQ ID NO: 303022 - RNA, 19 nt, Homo sapiens
ccggauggcaacaguaguu

SEQ ID NO: 303023 - RNA, 19 nt, Homo sapiens
caaggcacaucagacuucu

SEQ ID NO: 303024 - RNA, 19 nt, Homo sapiens
cacagugagagcugccuua

SEQ ID NO: 303025 - RNA, 19 nt, Homo sapiens
ggacaauggcuggaguaag

SEQ ID NO: 303026 - RNA, 19 nt, Homo sapiens
auuagagagugaagaugaa

SEQ ID NO: 303027 - RNA, 19 nt, Homo sapiens
caccuuagcauguaucacu

SEQ ID NO: 303028 - RNA, 19 nt, Homo sapiens
gcucgggagauaucugaug

SEQ ID NO: 303029 - RNA, 19 nt, Homo sapiens
ugaggagccugaggaagag

SEQ ID NO: 303030 - RNA, 19 nt, Homo sapiens
ggagauguaguugcugaca

SEQ ID NO: 303031 - RNA, 19 nt, Homo sapiens
aucacucuguggagaauaa

SEQ ID NO: 303032 - RNA, 19 nt, Homo sapiens
ugacaaagcuucccgauua

SEQ ID NO: 303033 - RNA, 19 nt, Homo sapiens
guaaaucucuucuguguuu

SEQ ID NO: 303034 - RNA, 19 nt, Homo sapiens
gaauguaccuguauacguu

SEQ ID NO: 303035 - RNA, 19 nt, Homo sapiens
gcaaagacauuguuucauc

SEQ ID NO: 303036 - RNA, 19 nt, Homo sapiens
gaaaacaucuccuuagaaa

SEQ ID NO: 303037 - RNA, 19 nt, Homo sapiens
gcagagagcauuauaauca

SEQ ID NO: 303038 - RNA, 19 nt, Homo sapiens
ccgaauagcugauguguug

SEQ ID NO: 303039 - RNA, 19 nt, Homo sapiens
acacaaagcaguugaauuu

SEQ ID NO: 303040 - RNA, 19 nt, Homo sapiens
ggaaguaugauguguauuu

SEQ ID NO: 303041 - RNA, 19 nt, Homo sapiens
gaauacaccuugcuucugu

SEQ ID NO: 303042 - RNA, 19 nt, Homo sapiens
gaagaucuuugggcauaua

SEQ ID NO: 303043 - RNA, 19 nt, Homo sapiens
gaaguaccuuaucaaagua

SEQ ID NO: 303044 - RNA, 19 nt, Homo sapiens
caugguagcugggauguua

SEQ ID NO: 303045 - RNA, 19 nt, Homo sapiens
gaacugaagucuguauugu

SEQ ID NO: 303046 - RNA, 19 nt, Homo sapiens
ggagucagcuguuucuaga

SEQ ID NO: 303047 - RNA, 19 nt, Homo sapiens
ugaaagaggucccaagguu

SEQ ID NO: 303048 - RNA, 19 nt, Homo sapiens
gcauauauguguccauuuc

SEQ ID NO: 303049 - RNA, 19 nt, Homo sapiens
gaaaucgacgcccgaguua

SEQ ID NO: 303050 - RNA, 19 nt, Homo sapiens
gaagucaguucucaacaau

SEQ ID NO: 303051 - RNA, 19 nt, Homo sapiens
ggacauggcuucugaaccu

SEQ ID NO: 303052 - RNA, 19 nt, Homo sapiens
agaacuaccuggauuugua

SEQ ID NO: 303053 - RNA, 19 nt, Homo sapiens
ggacagcuuagaauuauuu

SEQ ID NO: 303054 - RNA, 19 nt, Homo sapiens
caacagugcugaucuaaaa

SEQ ID NO: 303055 - RNA, 19 nt, Homo sapiens
gggaaaagcugaacacuga

SEQ ID NO: 303056 - RNA, 19 nt, Homo sapiens
ccaaauggauuccuguuuc

SEQ ID NO: 303057 - RNA, 19 nt, Homo sapiens
agaaguaccuuaucaaagu

SEQ ID NO: 303058 - RNA, 19 nt, Homo sapiens
gaaguaugauguguauuug

SEQ ID NO: 303059 - RNA, 19 nt, Homo sapiens
gggaguaguuggagcauug

SEQ ID NO: 303060 - RNA, 19 nt, Homo sapiens
gagcagaaaccaccuaaga

SEQ ID NO: 303061 - RNA, 19 nt, Homo sapiens
acacaucccuggacccuaa

SEQ ID NO: 303062 - RNA, 19 nt, Homo sapiens
gcugauguguugccacuuu

SEQ ID NO: 303063 - RNA, 19 nt, Homo sapiens
gguaauaaccagacacaaa

SEQ ID NO: 303064 - RNA, 19 nt, Homo sapiens
aaagugggcucagcacaua

SEQ ID NO: 303065 - RNA, 19 nt, Homo sapiens
aaacuaggcuccuucaaca

SEQ ID NO: 303066 - RNA, 19 nt, Homo sapiens
gacaaagcuucccgauuaa

SEQ ID NO: 303067 - RNA, 19 nt, Homo sapiens
ccaacaggauuccauggua

SEQ ID NO: 303068 - RNA, 19 nt, Homo sapiens
gaaauccuaccuuugaauu

SEQ ID NO: 303069 - RNA, 19 nt, Homo sapiens
gaaaacauuuggcagaaaa

SEQ ID NO: 303070 - RNA, 19 nt, Homo sapiens
gagagcagaugaggugaaa

SEQ ID NO: 303071 - RNA, 19 nt, Homo sapiens
ugucuguacuugaacauua

SEQ ID NO: 303072 - RNA, 19 nt, Homo sapiens
gcacaggucaggcuaaugu

SEQ ID NO: 303073 - RNA, 19 nt, Homo sapiens
ggugugaccucaauuucaa

SEQ ID NO: 303074 - RNA, 19 nt, Homo sapiens
uguguugucuuguguauuu

SEQ ID NO: 303075 - RNA, 19 nt, Homo sapiens
gaaaauguucuuccaguua

SEQ ID NO: 303076 - RNA, 19 nt, Homo sapiens
agagacaguuggauucuuu

SEQ ID NO: 303077 - RNA, 19 nt, Homo sapiens
agaguuagcugacuuuaca

SEQ ID NO: 303078 - RNA, 19 nt, Homo sapiens
cuaaguaaaucucuucugu

SEQ ID NO: 303079 - RNA, 19 nt, Homo sapiens
cuagagaguuuagcuguaa

SEQ ID NO: 303080 - RNA, 19 nt, Homo sapiens
ugacagugauggcgaaaga

SEQ ID NO: 303081 - RNA, 19 nt, Homo sapiens
gccaugaacugucaagugu

SEQ ID NO: 303082 - RNA, 19 nt, Homo sapiens
guaaaccugucugaaugua

SEQ ID NO: 303083 - RNA, 19 nt, Homo sapiens
caguaaaccugucugaaug

SEQ ID NO: 303084 - RNA, 19 nt, Homo sapiens
agucaguucucaacaauuu

SEQ ID NO: 303085 - RNA, 19 nt, Homo sapiens
ccaaaggcaucacgaguca

SEQ ID NO: 303086 - RNA, 19 nt, Homo sapiens
caaacuggcuugaauuggu

SEQ ID NO: 303087 - RNA, 19 nt, Homo sapiens
ggacugaagaccuguaaga

SEQ ID NO: 303088 - RNA, 19 nt, Homo sapiens
gaaaauaaguaggucguuu

SEQ ID NO: 303089 - RNA, 19 nt, Homo sapiens
acacuuagcuggagauguc

SEQ ID NO: 303090 - RNA, 19 nt, Homo sapiens
ggagagugcugacuguagu

SEQ ID NO: 303091 - RNA, 19 nt, Homo sapiens
acugaagucuguauuguaa

SEQ ID NO: 303092 - RNA, 19 nt, Homo sapiens
cggcguguguucaguguua

SEQ ID NO: 303093 - RNA, 19 nt, Homo sapiens
caaauggauuccuguuuca

SEQ ID NO: 303094 - RNA, 19 nt, Homo sapiens
caaagcagagagcauuaua

SEQ ID NO: 303095 - RNA, 19 nt, Homo sapiens
caaagcaaaccaacaagaa

SEQ ID NO: 303096 - RNA, 19 nt, Homo sapiens
gcauaggccugcuuugucu

SEQ ID NO: 303097 - RNA, 19 nt, Homo sapiens
ggagugaaacaucauagaa

SEQ ID NO: 303098 - RNA, 19 nt, Homo sapiens
caacugagaaguaccuuau

SEQ ID NO: 303099 - RNA, 19 nt, Homo sapiens
guccuuaucuagcugcaua

SEQ ID NO: 303100 - RNA, 19 nt, Homo sapiens
gaaucccuguaaccuauuu

SEQ ID NO: 303101 - RNA, 19 nt, Homo sapiens
gaaggagugaaacaucaua

SEQ ID NO: 303102 - RNA, 19 nt, Homo sapiens
guugagaacuaccuggauu

SEQ ID NO: 303103 - RNA, 19 nt, Homo sapiens
uuacaacagugcugaucua

SEQ ID NO: 303104 - RNA, 19 nt, Homo sapiens
ugaagucaguucucaacaa

SEQ ID NO: 303105 - RNA, 19 nt, Homo sapiens
uaauguggcuucuggaauc

SEQ ID NO: 303106 - RNA, 19 nt, Homo sapiens
cuaccuggauuuguauaua

SEQ ID NO: 303107 - RNA, 19 nt, Homo sapiens
gcaaagcaaaccaacaaga

SEQ ID NO: 303108 - RNA, 19 nt, Homo sapiens
gcucuaaaguggaguugau

SEQ ID NO: 303109 - RNA, 19 nt, Homo sapiens
aggcauagucuacuuguua

SEQ ID NO: 303110 - RNA, 19 nt, Homo sapiens
gaucaggaaccauaguuga

SEQ ID NO: 303111 - RNA, 19 nt, Homo sapiens
caaaguagcaaaugagaca

SEQ ID NO: 303112 - RNA, 19 nt, Homo sapiens
gcagaaaccaccuaagaag

SEQ ID NO: 303113 - RNA, 19 nt, Homo sapiens
cagagucaguagucaauga

SEQ ID NO: 303114 - RNA, 19 nt, Homo sapiens
gaaacuuguucuuccaaag

SEQ ID NO: 303115 - RNA, 19 nt, Homo sapiens
gaaacaucauagaaacugu

SEQ ID NO: 303116 - RNA, 19 nt, Homo sapiens
ccucuuaacugugguguug

SEQ ID NO: 303117 - RNA, 19 nt, Homo sapiens
gaaaaggcauagucuacuu

SEQ ID NO: 303118 - RNA, 19 nt, Homo sapiens
caaguuggguggagaaagg

SEQ ID NO: 303119 - RNA, 19 nt, Homo sapiens
gccuuaagcugcaggauuc

SEQ ID NO: 303120 - RNA, 19 nt, Homo sapiens
gcaguugcccagccucuuu

SEQ ID NO: 303121 - RNA, 19 nt, Homo sapiens
gcaaagcagagacaucaga

SEQ ID NO: 303122 - RNA, 19 nt, Homo sapiens
uagcauauauguguccauu

SEQ ID NO: 303123 - RNA, 19 nt, Homo sapiens
gagugaaacaucauagaaa

SEQ ID NO: 303124 - RNA, 19 nt, Homo sapiens
gaacucugccugcccuuug

SEQ ID NO: 303125 - RNA, 19 nt, Homo sapiens
ccacgaagcuccgaaacuc

SEQ ID NO: 303126 - RNA, 19 nt, Homo sapiens
gaacuaccuggauuuguau

SEQ ID NO: 303127 - RNA, 19 nt, Homo sapiens
gagcaaacuggcuugaauu

SEQ ID NO: 303128 - RNA, 19 nt, Homo sapiens
gaauaaaggcagcuguugu

SEQ ID NO: 303129 - RNA, 19 nt, Homo sapiens
gcgcaaagacauuguuuca

SEQ ID NO: 303130 - RNA, 19 nt, Homo sapiens
cccuguaaccuauuuauua

SEQ ID NO: 303131 - RNA, 19 nt, Homo sapiens
gcaauaaaaugaccaugga

SEQ ID NO: 303132 - RNA, 19 nt, Homo sapiens
ggaaagggcuguugauauu

SEQ ID NO: 303133 - RNA, 19 nt, Homo sapiens
gaagaaagccuaugaacuu

SEQ ID NO: 303134 - RNA, 19 nt, Homo sapiens
gaagugaucuuuagcuaau

SEQ ID NO: 303135 - RNA, 19 nt, Homo sapiens
gcaaauagcuuaggcaaag

SEQ ID NO: 303136 - RNA, 19 nt, Homo sapiens
ggacaaaguucuucucaag

SEQ ID NO: 303137 - RNA, 19 nt, Homo sapiens
gaaaccagaucuucgaguu

SEQ ID NO: 303138 - RNA, 19 nt, Homo sapiens
gcacugauauggacaaagu

SEQ ID NO: 303139 - RNA, 19 nt, Homo sapiens
gcaaagucaugccuacaaa

SEQ ID NO: 303140 - RNA, 19 nt, Homo sapiens
gcagccagcucaacguuaa

SEQ ID NO: 303141 - RNA, 19 nt, Homo sapiens
acaaaguucuucucaagua

SEQ ID NO: 303142 - RNA, 19 nt, Homo sapiens
gagaaaguuuggauuaaug

SEQ ID NO: 303143 - RNA, 19 nt, Homo sapiens
uaaggaaaguugacugaaa

SEQ ID NO: 303144 - RNA, 19 nt, Homo sapiens
ugaaauagcacucaucauu

SEQ ID NO: 303145 - RNA, 19 nt, Homo sapiens
cuacaacacugauuauuca

SEQ ID NO: 303146 - RNA, 19 nt, Homo sapiens
gaauggauuuguaaacuca

SEQ ID NO: 303147 - RNA, 19 nt, Homo sapiens
caaaccacauuacauagaa

SEQ ID NO: 303148 - RNA, 19 nt, Homo sapiens
gaccucagaucuuguagaa

SEQ ID NO: 303149 - RNA, 19 nt, Homo sapiens
gaagaggaauuggaguuga

SEQ ID NO: 303150 - RNA, 19 nt, Homo sapiens
caacagcucuaacaaacug

SEQ ID NO: 303151 - RNA, 19 nt, Homo sapiens
agagaaacguguacccaua

SEQ ID NO: 303152 - RNA, 19 nt, Homo sapiens
gcaaggaucauaucuaagu

SEQ ID NO: 303153 - RNA, 19 nt, Homo sapiens
gaacacauucugcuaugaa

SEQ ID NO: 303154 - RNA, 19 nt, Homo sapiens
aaagggcuguugauauuaa

SEQ ID NO: 303155 - RNA, 19 nt, Homo sapiens
gaaagggcuguugauauua

SEQ ID NO: 303156 - RNA, 19 nt, Homo sapiens
cgacuuccauucuccaauu

SEQ ID NO: 303157 - RNA, 19 nt, Homo sapiens
gcauuaggguauugaagaa

SEQ ID NO: 303158 - RNA, 19 nt, Homo sapiens
gaaaacacccuuaugaauu

SEQ ID NO: 303159 - RNA, 19 nt, Homo sapiens
ucuaguagcuccuaugaug

SEQ ID NO: 303160 - RNA, 19 nt, Homo sapiens
gcccucagcucucuuguug

SEQ ID NO: 303161 - RNA, 19 nt, Homo sapiens
cugcaaggaucauaucuaa

SEQ ID NO: 303162 - RNA, 19 nt, Homo sapiens
gaacaagaaggaacacaga

SEQ ID NO: 303163 - RNA, 19 nt, Homo sapiens
gaaagccuaugaacuuagu

SEQ ID NO: 303164 - RNA, 19 nt, Homo sapiens
ccaaagcuauauguuguaa

SEQ ID NO: 303165 - RNA, 19 nt, Homo sapiens
cuaaaucgguaaauaagga

SEQ ID NO: 303166 - RNA, 19 nt, Homo sapiens
ccucaaaccacauuacaua

SEQ ID NO: 303167 - RNA, 19 nt, Homo sapiens
acuagaagcugaaauaaca

SEQ ID NO: 303168 - RNA, 19 nt, Homo sapiens
gaagugcaguggugugauc

SEQ ID NO: 303169 - RNA, 19 nt, Homo sapiens
gcacuuccuuggacuacuu

SEQ ID NO: 303170 - RNA, 19 nt, Homo sapiens
caagagcuucuccaaauuu

SEQ ID NO: 303171 - RNA, 19 nt, Homo sapiens
aagaaagccuaugaacuua

SEQ ID NO: 303172 - RNA, 19 nt, Homo sapiens
ccucagagaccaccaagua

SEQ ID NO: 303173 - RNA, 19 nt, Homo sapiens
gaauagcuuuaucuugguu

SEQ ID NO: 303174 - RNA, 19 nt, Homo sapiens
gaacagagcaguagaaaag

SEQ ID NO: 303175 - RNA, 19 nt, Homo sapiens
ucaagagcuucuccaaauu

SEQ ID NO: 303176 - RNA, 19 nt, Homo sapiens
uggaauaugucagaaguuu

SEQ ID NO: 303177 - RNA, 19 nt, Homo sapiens
aaacguguacccauauaua

SEQ ID NO: 303178 - RNA, 19 nt, Homo sapiens
gcugauacuucauuucuag

SEQ ID NO: 303179 - RNA, 19 nt, Homo sapiens
gcucugugacugugaaaua

SEQ ID NO: 303180 - RNA, 19 nt, Homo sapiens
ggugggauguugagcacua

SEQ ID NO: 303181 - RNA, 19 nt, Homo sapiens
auacaaaucacacgcauaa

SEQ ID NO: 303182 - RNA, 19 nt, Homo sapiens
ggacuagaagcugaaauaa

SEQ ID NO: 303183 - RNA, 19 nt, Homo sapiens
gaccugcccuacauaucua

SEQ ID NO: 303184 - RNA, 19 nt, Homo sapiens
ggacuuguguacucagcaa

SEQ ID NO: 303185 - RNA, 19 nt, Homo sapiens
caaaguucuucucaaguau

SEQ ID NO: 303186 - RNA, 19 nt, Homo sapiens
caccaugccuggcugauau

SEQ ID NO: 303187 - RNA, 19 nt, Homo sapiens
gggaaagggcuguugauau

SEQ ID NO: 303188 - RNA, 19 nt, Homo sapiens
gaaagcaauacuguacaua

SEQ ID NO: 303189 - RNA, 19 nt, Homo sapiens
cucaagagcuucuccaaau

SEQ ID NO: 303190 - RNA, 19 nt, Homo sapiens
ggaauggauuuguaaacuc

SEQ ID NO: 303191 - RNA, 19 nt, Homo sapiens
gcucaacguuaacagauuc

SEQ ID NO: 303192 - RNA, 19 nt, Homo sapiens
ugacuguaguuacuuaaga

SEQ ID NO: 303193 - RNA, 19 nt, Homo sapiens
agaaacguguacccauaua

SEQ ID NO: 303194 - RNA, 19 nt, Homo sapiens
uaguagagauggaguuuca

SEQ ID NO: 303195 - RNA, 19 nt, Homo sapiens
caagaaagcaauacuguac

SEQ ID NO: 303196 - RNA, 19 nt, Homo sapiens
ucguaaagauaaccaguuu

SEQ ID NO: 303197 - RNA, 19 nt, Homo sapiens
aagcugauguuuguacuuu

SEQ ID NO: 303198 - RNA, 19 nt, Homo sapiens
cgcaugagauauucagaaa

SEQ ID NO: 303199 - RNA, 19 nt, Homo sapiens
ccucagaucuuguagaaaa

SEQ ID NO: 303200 - RNA, 19 nt, Homo sapiens
guaaauaaggacaugaguu

SEQ ID NO: 303201 - RNA, 19 nt, Homo sapiens
ggaaugaacaguaggaaac

SEQ ID NO: 303202 - RNA, 19 nt, Homo sapiens
gauaauaugaugcggaauc

SEQ ID NO: 303203 - RNA, 19 nt, Homo sapiens
gaaccaacucggauauugu

SEQ ID NO: 303204 - RNA, 19 nt, Homo sapiens
gaaaaugcuuuguagaaca

SEQ ID NO: 303205 - RNA, 19 nt, Homo sapiens
gguuccaauuuauccauua

SEQ ID NO: 303206 - RNA, 19 nt, Homo sapiens
gggaauggauuuguaaacu

SEQ ID NO: 303207 - RNA, 19 nt, Homo sapiens
gagaaacguguacccauau

SEQ ID NO: 303208 - RNA, 19 nt, Homo sapiens
ucacacgcauaauggauga

SEQ ID NO: 303209 - RNA, 19 nt, Homo sapiens
aaacacgcaugagauauuc

SEQ ID NO: 303210 - RNA, 19 nt, Homo sapiens
ccaagaaagcaauacugua

SEQ ID NO: 303211 - RNA, 19 nt, Homo sapiens
ucucaggguuccaauuuau

SEQ ID NO: 303212 - RNA, 19 nt, Homo sapiens
gugguaaucuuggaaugaa

SEQ ID NO: 303213 - RNA, 19 nt, Homo sapiens
gcccagacccugauacuuc

SEQ ID NO: 303214 - RNA, 19 nt, Homo sapiens
gagaaaaugcuuuguagaa

SEQ ID NO: 303215 - RNA, 19 nt, Homo sapiens
cuuccaagcugauguuugu

SEQ ID NO: 303216 - RNA, 19 nt, Homo sapiens
caucaaguccgaaccgauu

SEQ ID NO: 303217 - RNA, 19 nt, Homo sapiens
uaucucaggguuccaauuu

SEQ ID NO: 303218 - RNA, 19 nt, Homo sapiens
ccucagaacuuuucaaugu

SEQ ID NO: 303219 - RNA, 19 nt, Homo sapiens
agaaccaacucggauauug

SEQ ID NO: 303220 - RNA, 19 nt, Homo sapiens
gcagaaccaacucggauau

SEQ ID NO: 303221 - RNA, 19 nt, Homo sapiens
acaaaucacacgcauaaug

SEQ ID NO: 303222 - RNA, 19 nt, Homo sapiens
gcagacaaagcacccugua

SEQ ID NO: 303223 - RNA, 19 nt, Homo sapiens
ggaagaggaauuggaguug

SEQ ID NO: 303224 - RNA, 19 nt, Homo sapiens
caaugcaggugggauguug

SEQ ID NO: 303225 - RNA, 19 nt, Homo sapiens
caaaucacacgcauaaugg

SEQ ID NO: 303226 - RNA, 19 nt, Homo sapiens
aaaacacccuuaugaauug

SEQ ID NO: 303227 - RNA, 19 nt, Homo sapiens
gaaacguguacccauauau

SEQ ID NO: 303228 - RNA, 19 nt, Homo sapiens
ggaaccgacaggucacuuu

SEQ ID NO: 303229 - RNA, 19 nt, Homo sapiens
uguauugggucaagaagug

SEQ ID NO: 303230 - RNA, 19 nt, Homo sapiens
uaaugaagaaagccuauga

SEQ ID NO: 303231 - RNA, 19 nt, Homo sapiens
guagaacagagcaguagaa

SEQ ID NO: 303232 - RNA, 19 nt, Homo sapiens
ggaagaaagucacggacaa

SEQ ID NO: 303233 - RNA, 19 nt, Homo sapiens
ggacuaaacaccuccagaa

SEQ ID NO: 303234 - RNA, 19 nt, Homo sapiens
gaaagucacggacaaguuc

SEQ ID NO: 303235 - RNA, 19 nt, Homo sapiens
ggacagcagcgucuacuuc

SEQ ID NO: 303236 - RNA, 19 nt, Homo sapiens
ccaaccgccucuuccagua

SEQ ID NO: 303237 - RNA, 19 nt, Homo sapiens
acaaagaucauuccacuca

SEQ ID NO: 303238 - RNA, 19 nt, Homo sapiens
gcucugugacugugagaua

SEQ ID NO: 303239 - RNA, 19 nt, Homo sapiens
ggaaucggcaggugacguu

SEQ ID NO: 303240 - RNA, 19 nt, Homo sapiens
caagccaccucaccagcaa

SEQ ID NO: 303241 - RNA, 19 nt, Homo sapiens
agagaagacccaacaguga

SEQ ID NO: 303242 - RNA, 19 nt, Homo sapiens
ggugcacccucucuucuca

SEQ ID NO: 303243 - RNA, 19 nt, Homo sapiens
ugaugaagaaggccuauga

SEQ ID NO: 303244 - RNA, 19 nt, Homo sapiens
ucacggacaaguucacuga

SEQ ID NO: 303245 - RNA, 19 nt, Homo sapiens
uggagggucugcucaaaca

SEQ ID NO: 303246 - RNA, 19 nt, Homo sapiens
gcccagcccagauguggua

SEQ ID NO: 303247 - RNA, 19 nt, Homo sapiens
gaagaaagucacggacaag

SEQ ID NO: 303248 - RNA, 19 nt, Homo sapiens
caucuacacuguggaguac

SEQ ID NO: 303249 - RNA, 19 nt, Homo sapiens
ggagccaggagagaaguuu

SEQ ID NO: 303250 - RNA, 19 nt, Homo sapiens
cacgagagccgcaccaaca

SEQ ID NO: 303251 - RNA, 19 nt, Homo sapiens
ucaaacaggccaucagcau

SEQ ID NO: 303252 - RNA, 19 nt, Homo sapiens
ccaucuacacuguggagua

SEQ ID NO: 303253 - RNA, 19 nt, Homo sapiens
accgugugcugcugaagua

SEQ ID NO: 303254 - RNA, 19 nt, Homo sapiens
ggaaguucgggcugaugaa

SEQ ID NO: 303255 - RNA, 19 nt, Homo sapiens
agaaagucacggacaaguu

SEQ ID NO: 303256 - RNA, 19 nt, Homo sapiens
cacccucucuucucaccaa

SEQ ID NO: 303257 - RNA, 19 nt, Homo sapiens
gcuccuuuccuucuuccua

SEQ ID NO: 303258 - RNA, 19 nt, Homo sapiens
gcuaugcccagcccagaug

SEQ ID NO: 303259 - RNA, 19 nt, Homo sapiens
acggacaaguucacugaga

SEQ ID NO: 303260 - RNA, 19 nt, Homo sapiens
caaccgccucuuccaguau

SEQ ID NO: 303261 - RNA, 19 nt, Homo sapiens
gaaguucgggcugaugaag

SEQ ID NO: 303262 - RNA, 19 nt, Homo sapiens
cguggagggucugcucaaa

SEQ ID NO: 303263 - RNA, 19 nt, Homo sapiens
cagcccagaugugguauac

SEQ ID NO: 303264 - RNA, 19 nt, Homo sapiens
aguucgggcugaugaagaa

SEQ ID NO: 303265 - RNA, 19 nt, Homo sapiens
ccacucagccugggacgau

SEQ ID NO: 303266 - RNA, 19 nt, Homo sapiens
ccagggagccaucuacacu

SEQ ID NO: 303267 - RNA, 19 nt, Homo sapiens
cuuccuauuuguguguaua

SEQ ID NO: 303268 - RNA, 19 nt, Homo sapiens
gacuaaacaccuccagaag

SEQ ID NO: 303269 - RNA, 19 nt, Homo sapiens
cauccgggaccauaugaau

SEQ ID NO: 303270 - RNA, 19 nt, Homo sapiens
ucagagaagacccaacagu

SEQ ID NO: 303271 - RNA, 19 nt, Homo sapiens
ucacugagagcgucuacgu

SEQ ID NO: 303272 - RNA, 19 nt, Homo sapiens
ccgccaacccagacaaaga

SEQ ID NO: 303273 - RNA, 19 nt, Homo sapiens
ccuaagaccuuccccuauc

SEQ ID NO: 303274 - RNA, 19 nt, Homo sapiens
cggaaguucgggcugauga

SEQ ID NO: 303275 - RNA, 19 nt, Homo sapiens
cagcauccgggaccauaug

SEQ ID NO: 303276 - RNA, 19 nt, Homo sapiens
gaucugaaauccacaauua

SEQ ID NO: 303277 - RNA, 19 nt, Homo sapiens
caagagaccuuauuaacua

SEQ ID NO: 303278 - RNA, 19 nt, Homo sapiens
ggacauuucuuauccauuu

SEQ ID NO: 303279 - RNA, 19 nt, Homo sapiens
aaacagaaaugcugagaua

SEQ ID NO: 303280 - RNA, 19 nt, Homo sapiens
gaagauauaggcaguaaua

SEQ ID NO: 303281 - RNA, 19 nt, Homo sapiens
gaacugagcugugcaagug

SEQ ID NO: 303282 - RNA, 19 nt, Homo sapiens
gcauguaugucaucuauuu

SEQ ID NO: 303283 - RNA, 19 nt, Homo sapiens
ucacaaaccugcaggcaua

SEQ ID NO: 303284 - RNA, 19 nt, Homo sapiens
gagauaagcuuagcacuug

SEQ ID NO: 303285 - RNA, 19 nt, Homo sapiens
uaaaucaucugguugguuu

SEQ ID NO: 303286 - RNA, 19 nt, Homo sapiens
gcacauguccugcaaauau

SEQ ID NO: 303287 - RNA, 19 nt, Homo sapiens
caacugacauccauuguau

SEQ ID NO: 303288 - RNA, 19 nt, Homo sapiens
caagaaaucccauaaagaa

SEQ ID NO: 303289 - RNA, 19 nt, Homo sapiens
ggaauuuacuuggugaaua

SEQ ID NO: 303290 - RNA, 19 nt, Homo sapiens
acaaagugcuucucaagua

SEQ ID NO: 303291 - RNA, 19 nt, Homo sapiens
ggaagcagguaaagggaua

SEQ ID NO: 303292 - RNA, 19 nt, Homo sapiens
gaaauuaacaugcuugugu

SEQ ID NO: 303293 - RNA, 19 nt, Homo sapiens
cggcagaucuuuacugaaa

SEQ ID NO: 303294 - RNA, 19 nt, Homo sapiens
gaagaucugucgauucauc

SEQ ID NO: 303295 - RNA, 19 nt, Homo sapiens
gagagcagcuguuaugcaa

SEQ ID NO: 303296 - RNA, 19 nt, Homo sapiens
gcuauuggauugacuuuga

SEQ ID NO: 303297 - RNA, 19 nt, Homo sapiens
uaacacagguggucugaug

SEQ ID NO: 303298 - RNA, 19 nt, Homo sapiens
uaucaacacugcuauauca

SEQ ID NO: 303299 - RNA, 19 nt, Homo sapiens
gcaaauauggcccuagaaa

SEQ ID NO: 303300 - RNA, 19 nt, Homo sapiens
caacagaacacuuguacaa

SEQ ID NO: 303301 - RNA, 19 nt, Homo sapiens
uaaagaaccucucuauguc

SEQ ID NO: 303302 - RNA, 19 nt, Homo sapiens
caacauaugguaccgagua

SEQ ID NO: 303303 - RNA, 19 nt, Homo sapiens
gaaaauaucccaaggacua

SEQ ID NO: 303304 - RNA, 19 nt, Homo sapiens
ggucucaccugguaacuug

SEQ ID NO: 303305 - RNA, 19 nt, Homo sapiens
aaaugucacuucugcauaa

SEQ ID NO: 303306 - RNA, 19 nt, Homo sapiens
gcuuagcacuugaguugua

SEQ ID NO: 303307 - RNA, 19 nt, Homo sapiens
ccaaugaauuuaggaauga

SEQ ID NO: 303308 - RNA, 19 nt, Homo sapiens
caagugauauggaauuuac

SEQ ID NO: 303309 - RNA, 19 nt, Homo sapiens
ggaauucaguaagugcaua

SEQ ID NO: 303310 - RNA, 19 nt, Homo sapiens
gaaccuguuucuccuccua

SEQ ID NO: 303311 - RNA, 19 nt, Homo sapiens
gcaccgacauggacaaagu

SEQ ID NO: 303312 - RNA, 19 nt, Homo sapiens
caacacugcuauaucaugu

SEQ ID NO: 303313 - RNA, 19 nt, Homo sapiens
gaacaaucccgguguguca

SEQ ID NO: 303314 - RNA, 19 nt, Homo sapiens
gcacuacccuaagccauga

SEQ ID NO: 303315 - RNA, 19 nt, Homo sapiens
caacagcaacaccuacaua

SEQ ID NO: 303316 - RNA, 19 nt, Homo sapiens
ggauauccaucagccauuu

SEQ ID NO: 303317 - RNA, 19 nt, Homo sapiens
acaagaauaugcaagcaaa

SEQ ID NO: 303318 - RNA, 19 nt, Homo sapiens
uaacuugcccauauucuaa

SEQ ID NO: 303319 - RNA, 19 nt, Homo sapiens
ugacauccauuguauauac

SEQ ID NO: 303320 - RNA, 19 nt, Homo sapiens
aagaggaccauaccuauua

SEQ ID NO: 303321 - RNA, 19 nt, Homo sapiens
ugaagaaggagauuuguuu

SEQ ID NO: 303322 - RNA, 19 nt, Homo sapiens
gaucgggucuuccuucauc

SEQ ID NO: 303323 - RNA, 19 nt, Homo sapiens
gaugcuagccugccuugua

SEQ ID NO: 303324 - RNA, 19 nt, Homo sapiens
agaaacaagugauauggaa

SEQ ID NO: 303325 - RNA, 19 nt, Homo sapiens
guaguuuacuuaagccaaa

SEQ ID NO: 303326 - RNA, 19 nt, Homo sapiens
uuaaauugccucagugaua

SEQ ID NO: 303327 - RNA, 19 nt, Homo sapiens
aaagucagguacucuguuu

SEQ ID NO: 303328 - RNA, 19 nt, Homo sapiens
gaacaagaauaugcaagca

SEQ ID NO: 303329 - RNA, 19 nt, Homo sapiens
caggugacauuuacaaaga

SEQ ID NO: 303330 - RNA, 19 nt, Homo sapiens
uuacgaggauuauggauga

SEQ ID NO: 303331 - RNA, 19 nt, Homo sapiens
gaaauaugcccagaauaga

SEQ ID NO: 303332 - RNA, 19 nt, Homo sapiens
uauccuaacuugcccauau

SEQ ID NO: 303333 - RNA, 19 nt, Homo sapiens
uaaaccagaucuccgaguu

SEQ ID NO: 303334 - RNA, 19 nt, Homo sapiens
guggagacguugagaaaga

SEQ ID NO: 303335 - RNA, 19 nt, Homo sapiens
guuagaacauaucacauug

SEQ ID NO: 303336 - RNA, 19 nt, Homo sapiens
gggucugcaucucuuauua

SEQ ID NO: 303337 - RNA, 19 nt, Homo sapiens
gcaacaugaucagauuauu

SEQ ID NO: 303338 - RNA, 19 nt, Homo sapiens
ccagaucuccgaguucuua

SEQ ID NO: 303339 - RNA, 19 nt, Homo sapiens
gcaggaauuugggaacuga

SEQ ID NO: 303340 - RNA, 19 nt, Homo sapiens
ggaggaaacaggaaagaga

SEQ ID NO: 303341 - RNA, 19 nt, Homo sapiens
gaagaaggagauuuguuug

SEQ ID NO: 303342 - RNA, 19 nt, Homo sapiens
caaugcaccuuugguugua

SEQ ID NO: 303343 - RNA, 19 nt, Homo sapiens
augaagaacuccaugcuuu

SEQ ID NO: 303344 - RNA, 19 nt, Homo sapiens
agacagaguuugcaaagca

SEQ ID NO: 303345 - RNA, 19 nt, Homo sapiens
aaagagagagcagcuguua

SEQ ID NO: 303346 - RNA, 19 nt, Homo sapiens
gugcagaccugucaucucu

SEQ ID NO: 303347 - RNA, 19 nt, Homo sapiens
gacaaggaaugggaggaua

SEQ ID NO: 303348 - RNA, 19 nt, Homo sapiens
uuggagggcuaacauauuu

SEQ ID NO: 303349 - RNA, 19 nt, Homo sapiens
uacaauagauagugucaug

SEQ ID NO: 303350 - RNA, 19 nt, Homo sapiens
gaauaaccguaaaccagau

SEQ ID NO: 303351 - RNA, 19 nt, Homo sapiens
gaacgaaugcaggaauuug

SEQ ID NO: 303352 - RNA, 19 nt, Homo sapiens
auaaagaaccucucuaugu

SEQ ID NO: 303353 - RNA, 19 nt, Homo sapiens
gggcacauguccugcaaau

SEQ ID NO: 303354 - RNA, 19 nt, Homo sapiens
ggagggcuaacauauuuaa

SEQ ID NO: 303355 - RNA, 19 nt, Homo sapiens
aagcauguaugucaucuau

SEQ ID NO: 303356 - RNA, 19 nt, Homo sapiens
gcagguaaagggauaguug

SEQ ID NO: 303357 - RNA, 19 nt, Homo sapiens
guuauaaauucccacagaa

SEQ ID NO: 303358 - RNA, 19 nt, Homo sapiens
gauauggaauuuacuuggu

SEQ ID NO: 303359 - RNA, 19 nt, Homo sapiens
uuagaaauaugcccagaau

SEQ ID NO: 303360 - RNA, 19 nt, Homo sapiens
caccaugcaucuuggaauu

SEQ ID NO: 303361 - RNA, 19 nt, Homo sapiens
uaacagacaggugacauuu

SEQ ID NO: 303362 - RNA, 19 nt, Homo sapiens
gaaacaggaaagagaaaga

SEQ ID NO: 303363 - RNA, 19 nt, Homo sapiens
caagauaacuguuuucucu

SEQ ID NO: 303364 - RNA, 19 nt, Homo sapiens
gcagguucaacguuauuua

SEQ ID NO: 303365 - RNA, 19 nt, Homo sapiens
ccaccaggcagcaagaaua

SEQ ID NO: 303366 - RNA, 19 nt, Homo sapiens
gcagaggaauaguaugucu

SEQ ID NO: 303367 - RNA, 19 nt, Homo sapiens
ggacaaagugcuucucaag

SEQ ID NO: 303368 - RNA, 19 nt, Homo sapiens
aaauuuggguugaugaaga

SEQ ID NO: 303369 - RNA, 19 nt, Homo sapiens
ugacauacacagcaaagaa

SEQ ID NO: 303370 - RNA, 19 nt, Homo sapiens
agaaauaugcccagaauag

SEQ ID NO: 303371 - RNA, 19 nt, Homo sapiens
gguuagaacauaucacauu

SEQ ID NO: 303372 - RNA, 19 nt, Homo sapiens
gaggaaauuuggguugaug

SEQ ID NO: 303373 - RNA, 19 nt, Homo sapiens
aagaagauauaggcaguaa

SEQ ID NO: 303374 - RNA, 19 nt, Homo sapiens
gcauugacauacacagcaa

SEQ ID NO: 303375 - RNA, 19 nt, Homo sapiens
caaaugucacuucugcaua

SEQ ID NO: 303376 - RNA, 19 nt, Homo sapiens
acaaggugcugcucaagua

SEQ ID NO: 303377 - RNA, 19 nt, Homo sapiens
cuugauaccuggacauuaa

SEQ ID NO: 303378 - RNA, 19 nt, Homo sapiens
gugcagagcucuccuccuu

SEQ ID NO: 303379 - RNA, 19 nt, Homo sapiens
gaugaagaguugacaaucu

SEQ ID NO: 303380 - RNA, 19 nt, Homo sapiens
gcagagcucuccuccuuac

SEQ ID NO: 303381 - RNA, 19 nt, Homo sapiens
gcaccgacauggacaaggu

SEQ ID NO: 303382 - RNA, 19 nt, Homo sapiens
ggucaucccugccaagucu

SEQ ID NO: 303383 - RNA, 19 nt, Homo sapiens
gcaacagccuaaacaaggu

SEQ ID NO: 303384 - RNA, 19 nt, Homo sapiens
gagcugagcgugcuaugug

SEQ ID NO: 303385 - RNA, 19 nt, Homo sapiens
gcucagcugugaagaggau

SEQ ID NO: 303386 - RNA, 19 nt, Homo sapiens
ccauuuagaucugaacaau

SEQ ID NO: 303387 - RNA, 19 nt, Homo sapiens
ggaaccgacaggugacuuu

SEQ ID NO: 303388 - RNA, 19 nt, Homo sapiens
ugacugaggaccauuuaga

SEQ ID NO: 303389 - RNA, 19 nt, Homo sapiens
ugaagaggaugcggcuuga

SEQ ID NO: 303390 - RNA, 19 nt, Homo sapiens
ucacugcaguucagcaauc

SEQ ID NO: 303391 - RNA, 19 nt, Homo sapiens
aagaggaugcggcuugaua

SEQ ID NO: 303392 - RNA, 19 nt, Homo sapiens
gaaagggguuaaugcauca

SEQ ID NO: 303393 - RNA, 19 nt, Homo sapiens
gacauuaaagugacgauuc

SEQ ID NO: 303394 - RNA, 19 nt, Homo sapiens
gaggaccauuuagaucuga

SEQ ID NO: 303395 - RNA, 19 nt, Homo sapiens
ugaugaagaaggcguauga

SEQ ID NO: 303396 - RNA, 19 nt, Homo sapiens
cgagaucgcacucaucauc

SEQ ID NO: 303397 - RNA, 19 nt, Homo sapiens
gcggaaguuuggccugaug

SEQ ID NO: 303398 - RNA, 19 nt, Homo sapiens
guucaugagcacaguguaa

SEQ ID NO: 303399 - RNA, 19 nt, Homo sapiens
guuaaugcaucacuugacu

SEQ ID NO: 303400 - RNA, 19 nt, Homo sapiens
uaaugcaucacuugacuga

SEQ ID NO: 303401 - RNA, 19 nt, Homo sapiens
cguguccuguugacgguua

SEQ ID NO: 303402 - RNA, 19 nt, Homo sapiens
ccacaucagcaucaaguca

SEQ ID NO: 303403 - RNA, 19 nt, Homo sapiens
gcuggaggcugugcagaag

SEQ ID NO: 303404 - RNA, 19 nt, Homo sapiens
gcaacagccaccucagcaa

SEQ ID NO: 303405 - RNA, 19 nt, Homo sapiens
ucgagacccugaggaagaa

SEQ ID NO: 303406 - RNA, 19 nt, Homo sapiens
caccaacgccgacaucauc

SEQ ID NO: 303407 - RNA, 19 nt, Homo sapiens
ggaaguuuggccugaugaa

SEQ ID NO: 303408 - RNA, 19 nt, Homo sapiens
cagccucccugaugaagag

SEQ ID NO: 303409 - RNA, 19 nt, Homo sapiens
ggacauuaaagugacgauu

SEQ ID NO: 303410 - RNA, 19 nt, Homo sapiens
cuacagaggaacagugugu

SEQ ID NO: 303411 - RNA, 19 nt, Homo sapiens
ccuguugacgguuacauuu

SEQ ID NO: 303412 - RNA, 19 nt, Homo sapiens
ugaggaccauuuagaucug

SEQ ID NO: 303413 - RNA, 19 nt, Homo sapiens
ucacuugacugaggaccau

SEQ ID NO: 303414 - RNA, 19 nt, Homo sapiens
gagaagauggggaggaaaa

SEQ ID NO: 303415 - RNA, 19 nt, Homo sapiens
gcuugauaccuggacauua

SEQ ID NO: 303416 - RNA, 19 nt, Homo sapiens
gcaccaacgccgacaucau

SEQ ID NO: 303417 - RNA, 19 nt, Homo sapiens
aguuuggccugaugaagaa

SEQ ID NO: 303418 - RNA, 19 nt, Homo sapiens
gaaccgacaggugacuuuc

SEQ ID NO: 303419 - RNA, 19 nt, Homo sapiens
guucccagaccguucauga

SEQ ID NO: 303420 - RNA, 19 nt, Homo sapiens
ccacagcacccagcuugga

SEQ ID NO: 303421 - RNA, 19 nt, Homo sapiens
gacaaggugcugcucaagu

SEQ ID NO: 303422 - RNA, 19 nt, Homo sapiens
uaccuggacauuaaaguga

SEQ ID NO: 303423 - RNA, 19 nt, Homo sapiens
cugccuacaacacagauua

SEQ ID NO: 303424 - RNA, 19 nt, Homo sapiens
gaaguuuggccugaugaag

SEQ ID NO: 303425 - RNA, 19 nt, Homo sapiens
uguugacgguuacauuugu

SEQ ID NO: 303426 - RNA, 19 nt, Homo sapiens
auuuagaucugaacaaugc

SEQ ID NO: 303427 - RNA, 19 nt, Homo sapiens
uggacaaggugcugcucaa

SEQ ID NO: 303428 - RNA, 19 nt, Homo sapiens
gaccugcgagucaucacuu

SEQ ID NO: 303429 - RNA, 19 nt, Homo sapiens
gaucgcacucaucaucuuc

SEQ ID NO: 303430 - RNA, 19 nt, Homo sapiens
gacugaggaccauuuagau

SEQ ID NO: 303431 - RNA, 19 nt, Homo sapiens
agccagcacuacagaggaa

SEQ ID NO: 303432 - RNA, 19 nt, Homo sapiens
cagcagccagcacuacaga

SEQ ID NO: 303433 - RNA, 19 nt, Homo sapiens
gcucacugcaguucagcaa

SEQ ID NO: 303434 - RNA, 19 nt, Homo sapiens
ggacaaggugcugcucaag

SEQ ID NO: 303435 - RNA, 19 nt, Homo sapiens
gcuaugugacugcgagauc

SEQ ID NO: 303436 - RNA, 19 nt, Homo sapiens
ggguuaaugcaucacuuga

SEQ ID NO: 303437 - RNA, 19 nt, Homo sapiens
aaguuuggccugaugaaga

SEQ ID NO: 303438 - RNA, 19 nt, Homo sapiens
gaacacagcuccucugacu

SEQ ID NO: 303439 - RNA, 19 nt, Homo sapiens
gaacgaacauguuagucaa

SEQ ID NO: 303440 - RNA, 19 nt, Homo sapiens
ggaaagaugcgaccuagaa

SEQ ID NO: 303441 - RNA, 19 nt, Homo sapiens
ggauagaaguauuugugua

SEQ ID NO: 303442 - RNA, 19 nt, Homo sapiens
gaaauucuccugacucuag

SEQ ID NO: 303443 - RNA, 19 nt, Homo sapiens
guucagaaauggaaauguu

SEQ ID NO: 303444 - RNA, 19 nt, Homo sapiens
ugacugggccucaugaaua

SEQ ID NO: 303445 - RNA, 19 nt, Homo sapiens
guacggagucguugcauaa

SEQ ID NO: 303446 - RNA, 19 nt, Homo sapiens
gcacaaaguacuucucaga

SEQ ID NO: 303447 - RNA, 19 nt, Homo sapiens
gaccacuccucaagagaua

SEQ ID NO: 303448 - RNA, 19 nt, Homo sapiens
gacugggccucaugaauaa

SEQ ID NO: 303449 - RNA, 19 nt, Homo sapiens
gaaggaaggcccuggaaau

SEQ ID NO: 303450 - RNA, 19 nt, Homo sapiens
cgaaguagcugggauuaca

SEQ ID NO: 303451 - RNA, 19 nt, Homo sapiens
gugaagacauguacugaug

SEQ ID NO: 303452 - RNA, 19 nt, Homo sapiens
gaucccacaucuauacauu

SEQ ID NO: 303453 - RNA, 19 nt, Homo sapiens
gaaauggaaauguucaaug

SEQ ID NO: 303454 - RNA, 19 nt, Homo sapiens
gaugacacaccauggauuu

SEQ ID NO: 303455 - RNA, 19 nt, Homo sapiens
ccacggagccuacccgauu

SEQ ID NO: 303456 - RNA, 19 nt, Homo sapiens
ggauugggauagaaguauu

SEQ ID NO: 303457 - RNA, 19 nt, Homo sapiens
gaagauuuggcccucauuu

SEQ ID NO: 303458 - RNA, 19 nt, Homo sapiens
ggaacgaacauguuaguca

SEQ ID NO: 303459 - RNA, 19 nt, Homo sapiens
guuaggaacgaacauguua

SEQ ID NO: 303460 - RNA, 19 nt, Homo sapiens
guucugggcucuccgaguu

SEQ ID NO: 303461 - RNA, 19 nt, Homo sapiens
gcaggagcauuucuuugug

SEQ ID NO: 303462 - RNA, 19 nt, Homo sapiens
gaauauuccacacaagaaa

SEQ ID NO: 303463 - RNA, 19 nt, Homo sapiens
ggacauuggagacaucuug

SEQ ID NO: 303464 - RNA, 19 nt, Homo sapiens
gcccgcaaauccagaaauu

SEQ ID NO: 303465 - RNA, 19 nt, Homo sapiens
gaagaguguuagacuugga

SEQ ID NO: 303466 - RNA, 19 nt, Homo sapiens
uuugacagcuguaucauug

SEQ ID NO: 303467 - RNA, 19 nt, Homo sapiens
gaugaucugaagaguguua

SEQ ID NO: 303468 - RNA, 19 nt, Homo sapiens
ggagaaggcagugagcuuu

SEQ ID NO: 303469 - RNA, 19 nt, Homo sapiens
ugacagcuguaucauuguu

SEQ ID NO: 303470 - RNA, 19 nt, Homo sapiens
ccacucugcuggucaccua

SEQ ID NO: 303471 - RNA, 19 nt, Homo sapiens
ccaaagugcugggauuaca

SEQ ID NO: 303472 - RNA, 19 nt, Homo sapiens
cagaaacccugcguucaga

SEQ ID NO: 303473 - RNA, 19 nt, Homo sapiens
gaagacauguacugaugac

SEQ ID NO: 303474 - RNA, 19 nt, Homo sapiens
ggaaagggaacaugacucu

SEQ ID NO: 303475 - RNA, 19 nt, Homo sapiens
cugaugaucugaagagugu

SEQ ID NO: 303476 - RNA, 19 nt, Homo sapiens
gagaagagcacaaaguacu

SEQ ID NO: 303477 - RNA, 19 nt, Homo sapiens
agaagcagcuggagcaucu

SEQ ID NO: 303478 - RNA, 19 nt, Homo sapiens
cacggagccuacccgauua

SEQ ID NO: 303479 - RNA, 19 nt, Homo sapiens
gcuacuggguggugauaau

SEQ ID NO: 303480 - RNA, 19 nt, Homo sapiens
gaaacccugcguucagaaa

SEQ ID NO: 303481 - RNA, 19 nt, Homo sapiens
agucagaguuuguggagaa

SEQ ID NO: 303482 - RNA, 19 nt, Homo sapiens
ggccaugauucuuaagaga

SEQ ID NO: 303483 - RNA, 19 nt, Homo sapiens
guaccuggauuaaugaacu

SEQ ID NO: 303484 - RNA, 19 nt, Homo sapiens
uagcagagguaaguuagga

SEQ ID NO: 303485 - RNA, 19 nt, Homo sapiens
acacagcuccucugacuau

SEQ ID NO: 303486 - RNA, 19 nt, Homo sapiens
ggaagcaucuccuuuuaca

SEQ ID NO: 303487 - RNA, 19 nt, Homo sapiens
gacauguacugaugacaca

SEQ ID NO: 303488 - RNA, 19 nt, Homo sapiens
cuucuggccuuguaucuug

SEQ ID NO: 303489 - RNA, 19 nt, Homo sapiens
uaucuugcauucacacuca

SEQ ID NO: 303490 - RNA, 19 nt, Homo sapiens
gagcacaaaguacuucuca

SEQ ID NO: 303491 - RNA, 19 nt, Homo sapiens
gcaggacauuggagacauc

SEQ ID NO: 303492 - RNA, 19 nt, Homo sapiens
uggaacagcaggagcauuu

SEQ ID NO: 303493 - RNA, 19 nt, Homo sapiens
gagcccaucugccucaucu

SEQ ID NO: 303494 - RNA, 19 nt, Homo sapiens
ugccaggacucccaugaaa

SEQ ID NO: 303495 - RNA, 19 nt, Homo sapiens
gauaugggaagccuagaga

SEQ ID NO: 303496 - RNA, 19 nt, Homo sapiens
ggauauauguccccuuguu

SEQ ID NO: 303497 - RNA, 19 nt, Homo sapiens
gagguaaguuaggaacgaa

SEQ ID NO: 303498 - RNA, 19 nt, Homo sapiens
ggccuuguaucuugcauuc

SEQ ID NO: 303499 - RNA, 19 nt, Homo sapiens
uggagaagagcacaaagua

SEQ ID NO: 303500 - RNA, 19 nt, Homo sapiens
gaacuucugcaggacauug

SEQ ID NO: 303501 - RNA, 19 nt, Homo sapiens
aaagacagcugcgaaucug

SEQ ID NO: 303502 - RNA, 19 nt, Homo sapiens
gauagaaguauuuguguac

SEQ ID NO: 303503 - RNA, 19 nt, Homo sapiens
gcaggcccuucgaagugua

SEQ ID NO: 303504 - RNA, 19 nt, Homo sapiens
gcuucugucuugaggauau

SEQ ID NO: 303505 - RNA, 19 nt, Homo sapiens
caacacugcaucucucuuc

SEQ ID NO: 303506 - RNA, 19 nt, Homo sapiens
gauuauagcagagguaagu

SEQ ID NO: 303507 - RNA, 19 nt, Homo sapiens
ggaaggagacccaguugac

SEQ ID NO: 303508 - RNA, 19 nt, Homo sapiens
ucgagaaguucaaguucaa

SEQ ID NO: 303509 - RNA, 19 nt, Homo sapiens
caccagaagucagaguuug

SEQ ID NO: 303510 - RNA, 19 nt, Homo sapiens
ggaccacuccucaagagau

SEQ ID NO: 303511 - RNA, 19 nt, Homo sapiens
ugaagaagcugagaaaauc

SEQ ID NO: 303512 - RNA, 19 nt, Homo sapiens
gccuugaggucaccauuuc

SEQ ID NO: 303513 - RNA, 19 nt, Homo sapiens
gaaagaugcgaccuagaag

SEQ ID NO: 303514 - RNA, 19 nt, Homo sapiens
gaggaaguacggagucguu

SEQ ID NO: 303515 - RNA, 19 nt, Homo sapiens
ucaggcacaugcuguuaau

SEQ ID NO: 303516 - RNA, 19 nt, Homo sapiens
gcucaggcacaugcuguua

SEQ ID NO: 303517 - RNA, 19 nt, Homo sapiens
uggagcagguguacuacuu

SEQ ID NO: 303518 - RNA, 19 nt, Homo sapiens
gagccaggccggugaagau

SEQ ID NO: 303519 - RNA, 19 nt, Homo sapiens
cuggauuaaugaacuauga

SEQ ID NO: 303520 - RNA, 19 nt, Homo sapiens
guauuuguguaccuggauu

SEQ ID NO: 303521 - RNA, 19 nt, Homo sapiens
gcauaugacacccgcguau

SEQ ID NO: 303522 - RNA, 19 nt, Homo sapiens
ggacgugggccagaugguu

SEQ ID NO: 303523 - RNA, 19 nt, Homo sapiens
gagcaaacgcagagagaag

SEQ ID NO: 303524 - RNA, 19 nt, Homo sapiens
gaacagcaggagcauuucu

SEQ ID NO: 303525 - RNA, 19 nt, Homo sapiens
ugccucaucugcagucuga

SEQ ID NO: 303526 - RNA, 19 nt, Homo sapiens
ucucucugcuucugucuug

SEQ ID NO: 303527 - RNA, 19 nt, Homo sapiens
aaagggaacaugacucugu

SEQ ID NO: 303528 - RNA, 19 nt, Homo sapiens
uuguguaccuggauuaaug

SEQ ID NO: 303529 - RNA, 19 nt, Homo sapiens
gauugggauagaaguauuu

SEQ ID NO: 303530 - RNA, 19 nt, Homo sapiens
gaaguacggagucguugca

SEQ ID NO: 303531 - RNA, 19 nt, Homo sapiens
cauucacacucaauaguca

SEQ ID NO: 303532 - RNA, 19 nt, Homo sapiens
gugauaaugaugaaggaaa

SEQ ID NO: 303533 - RNA, 19 nt, Homo sapiens
ugcaagacauccauaagca

SEQ ID NO: 303534 - RNA, 19 nt, Homo sapiens
ccaaggagugccagucaga

SEQ ID NO: 303535 - RNA, 19 nt, Homo sapiens
aaacugaagcgcugaagca

SEQ ID NO: 303536 - RNA, 19 nt, Homo sapiens
gaacacaagaagaaaauuc

SEQ ID NO: 303537 - RNA, 19 nt, Homo sapiens
ugccucagccuccgaagua

SEQ ID NO: 303538 - RNA, 19 nt, Homo sapiens
ccagaagccuccuuacauu

SEQ ID NO: 303539 - RNA, 19 nt, Homo sapiens
caaugacgcuuuaaagaga

SEQ ID NO: 303540 - RNA, 19 nt, Homo sapiens
gaggauauauuagaaguug

SEQ ID NO: 303541 - RNA, 19 nt, Homo sapiens
caacaaccaccaccuuaua

SEQ ID NO: 303542 - RNA, 19 nt, Homo sapiens
gaauuggccugaacagaug

SEQ ID NO: 303543 - RNA, 19 nt, Homo sapiens
gaagguacacgaauuaugu

SEQ ID NO: 303544 - RNA, 19 nt, Homo sapiens
ggucugauuugcaggauuu

SEQ ID NO: 303545 - RNA, 19 nt, Homo sapiens
ccaaggagcaucccuaauu

SEQ ID NO: 303546 - RNA, 19 nt, Homo sapiens
ggacaggaaggucugauuu

SEQ ID NO: 303547 - RNA, 19 nt, Homo sapiens
gagcaucccuaauucuuca

SEQ ID NO: 303548 - RNA, 19 nt, Homo sapiens
caagugaacaauugguuua

SEQ ID NO: 303549 - RNA, 19 nt, Homo sapiens
gagaacaaagagugaaaua

SEQ ID NO: 303550 - RNA, 19 nt, Homo sapiens
ggacauucaugcucaguag

SEQ ID NO: 303551 - RNA, 19 nt, Homo sapiens
gauagacgauagagaagga

SEQ ID NO: 303552 - RNA, 19 nt, Homo sapiens
caugggagguuucguaaug

SEQ ID NO: 303553 - RNA, 19 nt, Homo sapiens
caaaguagccacaaauauc

SEQ ID NO: 303554 - RNA, 19 nt, Homo sapiens
gcaaagguacgacgaucua

SEQ ID NO: 303555 - RNA, 19 nt, Homo sapiens
gaagccuccuuacauuaaa

SEQ ID NO: 303556 - RNA, 19 nt, Homo sapiens
caaggagcaucccuaauuc

SEQ ID NO: 303557 - RNA, 19 nt, Homo sapiens
ggaaugggcaugaauaugg

SEQ ID NO: 303558 - RNA, 19 nt, Homo sapiens
uagagaagguacacgaauu

SEQ ID NO: 303559 - RNA, 19 nt, Homo sapiens
ggaaauaccaacugaaguc

SEQ ID NO: 303560 - RNA, 19 nt, Homo sapiens
aaacugcagucaucaacaa

SEQ ID NO: 303561 - RNA, 19 nt, Homo sapiens
gggacaugcuaaauaacua

SEQ ID NO: 303562 - RNA, 19 nt, Homo sapiens
ggugauagacgauagagaa

SEQ ID NO: 303563 - RNA, 19 nt, Homo sapiens
gauucaagccauacaagua

SEQ ID NO: 303564 - RNA, 19 nt, Homo sapiens
gcacaggugacgaugauga

SEQ ID NO: 303565 - RNA, 19 nt, Homo sapiens
gaccagcccucuuggaaca

SEQ ID NO: 303566 - RNA, 19 nt, Homo sapiens
guacacgaauuaugugaca

SEQ ID NO: 303567 - RNA, 19 nt, Homo sapiens
gagcaaagcaucggucaug

SEQ ID NO: 303568 - RNA, 19 nt, Homo sapiens
uaacugaccagcccucuug

SEQ ID NO: 303569 - RNA, 19 nt, Homo sapiens
cuggauaacuugaugauuc

SEQ ID NO: 303570 - RNA, 19 nt, Homo sapiens
cagaagccuccuuacauua

SEQ ID NO: 303571 - RNA, 19 nt, Homo sapiens
gaggaggcauggaaaccaa

SEQ ID NO: 303572 - RNA, 19 nt, Homo sapiens
aauggugacugauuucaaa

SEQ ID NO: 303573 - RNA, 19 nt, Homo sapiens
gugaagauauaacaagauc

SEQ ID NO: 303574 - RNA, 19 nt, Homo sapiens
uuccauagcucuucacuuc

SEQ ID NO: 303575 - RNA, 19 nt, Homo sapiens
caacauaugggaauuagag

SEQ ID NO: 303576 - RNA, 19 nt, Homo sapiens
agagaagguacacgaauua

SEQ ID NO: 303577 - RNA, 19 nt, Homo sapiens
gguuucaucuauuggaauu

SEQ ID NO: 303578 - RNA, 19 nt, Homo sapiens
gcaacaaccaccaccuuau

SEQ ID NO: 303579 - RNA, 19 nt, Homo sapiens
gacauuaagagaacaaaga

SEQ ID NO: 303580 - RNA, 19 nt, Homo sapiens
guaugggacagccaaguua

SEQ ID NO: 303581 - RNA, 19 nt, Homo sapiens
cagcacaggugacgaugau

SEQ ID NO: 303582 - RNA, 19 nt, Homo sapiens
ugagaaaugugaauuagcu

SEQ ID NO: 303583 - RNA, 19 nt, Homo sapiens
cugcaauggugacugauuu

SEQ ID NO: 303584 - RNA, 19 nt, Homo sapiens
gacaagucauggacauuca

SEQ ID NO: 303585 - RNA, 19 nt, Homo sapiens
ggacaagucauggacauuc

SEQ ID NO: 303586 - RNA, 19 nt, Homo sapiens
cauguaaccuucaucuagu

SEQ ID NO: 303587 - RNA, 19 nt, Homo sapiens
ccaaaguagccacaaauau

SEQ ID NO: 303588 - RNA, 19 nt, Homo sapiens
ggugauggcuuggacaaca

SEQ ID NO: 303589 - RNA, 19 nt, Homo sapiens
aagcaucggucaugugugu

SEQ ID NO: 303590 - RNA, 19 nt, Homo sapiens
cagugaagauauaacaaga

SEQ ID NO: 303591 - RNA, 19 nt, Homo sapiens
gaccaaggagcaucccuaa

SEQ ID NO: 303592 - RNA, 19 nt, Homo sapiens
gauauaacaagaucagcaa

SEQ ID NO: 303593 - RNA, 19 nt, Homo sapiens
gaagauauaacaagaucag

SEQ ID NO: 303594 - RNA, 19 nt, Homo sapiens
gaacuggauaacuugauga

SEQ ID NO: 303595 - RNA, 19 nt, Homo sapiens
caaacagauucgcgcagaa

SEQ ID NO: 303596 - RNA, 19 nt, Homo sapiens
caaagcaucggucaugugu

SEQ ID NO: 303597 - RNA, 19 nt, Homo sapiens
agaagccuccuuacauuaa

SEQ ID NO: 303598 - RNA, 19 nt, Homo sapiens
ggacaugcuaaauaacuau

SEQ ID NO: 303599 - RNA, 19 nt, Homo sapiens
ugaauuggccugaacagau

SEQ ID NO: 303600 - RNA, 19 nt, Homo sapiens
ggggaaggcugcaaaguau

SEQ ID NO: 303601 - RNA, 19 nt, Homo sapiens
caaccgagcaguaagucaa

SEQ ID NO: 303602 - RNA, 19 nt, Homo sapiens
gaaauaccaacugaaguca

SEQ ID NO: 303603 - RNA, 19 nt, Homo sapiens
gcaaagcaucggucaugug

SEQ ID NO: 303604 - RNA, 19 nt, Homo sapiens
ggccugaacagauguaaau

SEQ ID NO: 303605 - RNA, 19 nt, Homo sapiens
acaggagacccaacaauga

SEQ ID NO: 303606 - RNA, 19 nt, Homo sapiens
ggacucaccauccuucaag

SEQ ID NO: 303607 - RNA, 19 nt, Homo sapiens
gcacaagacacgggacuca

SEQ ID NO: 303608 - RNA, 19 nt, Homo sapiens
gacaggaaggucugauuug

SEQ ID NO: 303609 - RNA, 19 nt, Homo sapiens
cucaguagcuuaagggaau

SEQ ID NO: 303610 - RNA, 19 nt, Homo sapiens
aaaguagccacaaauauca

SEQ ID NO: 303611 - RNA, 19 nt, Homo sapiens
gguaggaggaggcauggaa

SEQ ID NO: 303612 - RNA, 19 nt, Homo sapiens
gcuugaauuugcaugucua

SEQ ID NO: 303613 - RNA, 19 nt, Homo sapiens
aauaccaacugaagucaau

SEQ ID NO: 303614 - RNA, 19 nt, Homo sapiens
ugucugcaauggugacuga

SEQ ID NO: 303615 - RNA, 19 nt, Homo sapiens
cagcaacauaugggaauua

SEQ ID NO: 303616 - RNA, 19 nt, Homo sapiens
ggacagcccaugggagguu

SEQ ID NO: 303617 - RNA, 19 nt, Homo sapiens
uggauaacuugaugauuca

SEQ ID NO: 303618 - RNA, 19 nt, Homo sapiens
ccaaaaggccguguguuua

SEQ ID NO: 303619 - RNA, 19 nt, Homo sapiens
ccucuucccucucuuagca

SEQ ID NO: 303620 - RNA, 19 nt, Homo sapiens
gaauagugcagcccaugau

SEQ ID NO: 303621 - RNA, 19 nt, Homo sapiens
gacacggcaucuacucguu

SEQ ID NO: 303622 - RNA, 19 nt, Homo sapiens
agaacuggauaacuugaug

SEQ ID NO: 303623 - RNA, 19 nt, Homo sapiens
aaauaacuaucaggcagaa

SEQ ID NO: 303624 - RNA, 19 nt, Homo sapiens
gcccaugggagguuucgua

SEQ ID NO: 303625 - RNA, 19 nt, Homo sapiens
aaacagauucgcgcagaaa

SEQ ID NO: 303626 - RNA, 19 nt, Homo sapiens
ucaaugacgcuuuaaagag

SEQ ID NO: 303627 - RNA, 19 nt, Homo sapiens
auacaucacuuccuguuuu

SEQ ID NO: 303628 - RNA, 19 nt, Homo sapiens
cuaguuaaccaaucgcaaa

SEQ ID NO: 303629 - RNA, 19 nt, Homo sapiens
ucaagugaacaauugguuu

SEQ ID NO: 303630 - RNA, 19 nt, Homo sapiens
aaucagacagugaagauau

SEQ ID NO: 303631 - RNA, 19 nt, Homo sapiens
cgauagagaaggaggauca

SEQ ID NO: 303632 - RNA, 19 nt, Homo sapiens
gaagccuaauugucacauc

SEQ ID NO: 303633 - RNA, 19 nt, Homo sapiens
guuaaccaaucgcaaagca

SEQ ID NO: 303634 - RNA, 19 nt, Homo sapiens
cccaaaguagccacaaaua

SEQ ID NO: 303635 - RNA, 19 nt, Homo sapiens
auaacaagaucagcaaauc

SEQ ID NO: 303636 - RNA, 19 nt, Homo sapiens
gcaggcagugucuuaagga

SEQ ID NO: 303637 - RNA, 19 nt, Homo sapiens
auuagaaguugaaguagga

SEQ ID NO: 303638 - RNA, 19 nt, Homo sapiens
ucaaagagcuugccaauga

SEQ ID NO: 303639 - RNA, 19 nt, Homo sapiens
guacuaagguuucaucuuu

SEQ ID NO: 303640 - RNA, 19 nt, Homo sapiens
gaccagauguugacacuua

SEQ ID NO: 303641 - RNA, 19 nt, Homo sapiens
gcuguuaccuuuaagcuuu

SEQ ID NO: 303642 - RNA, 19 nt, Homo sapiens
caagucagaucaugaagaa

SEQ ID NO: 303643 - RNA, 19 nt, Homo sapiens
ggacugugacguuauguua

SEQ ID NO: 303644 - RNA, 19 nt, Homo sapiens
gagagacugugguauauau

SEQ ID NO: 303645 - RNA, 19 nt, Homo sapiens
uaagggaacucaagggaaa

SEQ ID NO: 303646 - RNA, 19 nt, Homo sapiens
gaguuaagcuggucucuuc

SEQ ID NO: 303647 - RNA, 19 nt, Homo sapiens
uaucagaucugcuguggaa

SEQ ID NO: 303648 - RNA, 19 nt, Homo sapiens
ccagacagcugugauuauu

SEQ ID NO: 303649 - RNA, 19 nt, Homo sapiens
ggacauucaugcccaauag

SEQ ID NO: 303650 - RNA, 19 nt, Homo sapiens
gcaauggcacuacauguaa

SEQ ID NO: 303651 - RNA, 19 nt, Homo sapiens
gauacaagcaauacaagua

SEQ ID NO: 303652 - RNA, 19 nt, Homo sapiens
guacagaguucggucuauu

SEQ ID NO: 303653 - RNA, 19 nt, Homo sapiens
agaguucggucuauuaauu

SEQ ID NO: 303654 - RNA, 19 nt, Homo sapiens
gcaagagaauacuguaaca

SEQ ID NO: 303655 - RNA, 19 nt, Homo sapiens
ggagugugcucugaguuaa

SEQ ID NO: 303656 - RNA, 19 nt, Homo sapiens
guaacaaacuucguacaga

SEQ ID NO: 303657 - RNA, 19 nt, Homo sapiens
guaaagcaaucgcaaagca

SEQ ID NO: 303658 - RNA, 19 nt, Homo sapiens
gaaccacacuggagaucau

SEQ ID NO: 303659 - RNA, 19 nt, Homo sapiens
guguuuaccucaauugaaa

SEQ ID NO: 303660 - RNA, 19 nt, Homo sapiens
gcaacaagaacacaaaugu

SEQ ID NO: 303661 - RNA, 19 nt, Homo sapiens
gaaaucaugggcugacuga

SEQ ID NO: 303662 - RNA, 19 nt, Homo sapiens
ggaaugggcaugaauaugg

SEQ ID NO: 303663 - RNA, 19 nt, Homo sapiens
gguauuguauguccaugaa

SEQ ID NO: 303664 - RNA, 19 nt, Homo sapiens
caaagagcuugccaaugaa

SEQ ID NO: 303665 - RNA, 19 nt, Homo sapiens
uaugaggacugugacguua

SEQ ID NO: 303666 - RNA, 19 nt, Homo sapiens
uaacuaggacuuuaucaga

SEQ ID NO: 303667 - RNA, 19 nt, Homo sapiens
uauguugccucaaauaguu

SEQ ID NO: 303668 - RNA, 19 nt, Homo sapiens
caacagaggaccaaugcaa

SEQ ID NO: 303669 - RNA, 19 nt, Homo sapiens
gcacagagccccacaaugu

SEQ ID NO: 303670 - RNA, 19 nt, Homo sapiens
caaaguagcaacaaauauc

SEQ ID NO: 303671 - RNA, 19 nt, Homo sapiens
caggagagacugugguaua

SEQ ID NO: 303672 - RNA, 19 nt, Homo sapiens
gaccauaacccuucuucuu

SEQ ID NO: 303673 - RNA, 19 nt, Homo sapiens
cagcuuuccucaacacaaa

SEQ ID NO: 303674 - RNA, 19 nt, Homo sapiens
acacaggacuuacaauucu

SEQ ID NO: 303675 - RNA, 19 nt, Homo sapiens
gggagugugcucugaguua

SEQ ID NO: 303676 - RNA, 19 nt, Homo sapiens
ucuguuagcucuggucuuu

SEQ ID NO: 303677 - RNA, 19 nt, Homo sapiens
ggacaaggacgcgaucuau

SEQ ID NO: 303678 - RNA, 19 nt, Homo sapiens
aaccauaacuaggacuuua

SEQ ID NO: 303679 - RNA, 19 nt, Homo sapiens
gcuugccaaugaagauuua

SEQ ID NO: 303680 - RNA, 19 nt, Homo sapiens
gcuggacaauuugaugaua

SEQ ID NO: 303681 - RNA, 19 nt, Homo sapiens
guaaagauccucuggaaaa

SEQ ID NO: 303682 - RNA, 19 nt, Homo sapiens
gaacuuugaccagauguug

SEQ ID NO: 303683 - RNA, 19 nt, Homo sapiens
ggcaauggcacuacaugua

SEQ ID NO: 303684 - RNA, 19 nt, Homo sapiens
ccaucgaccucgucauuga

SEQ ID NO: 303685 - RNA, 19 nt, Homo sapiens
caauacaaguacuaagguu

SEQ ID NO: 303686 - RNA, 19 nt, Homo sapiens
gagacugugguauauauuu

SEQ ID NO: 303687 - RNA, 19 nt, Homo sapiens
gccguuauguugccucaaa

SEQ ID NO: 303688 - RNA, 19 nt, Homo sapiens
acaauucuguccauguaaa

SEQ ID NO: 303689 - RNA, 19 nt, Homo sapiens
gaggaccaaugcaacaaga

SEQ ID NO: 303690 - RNA, 19 nt, Homo sapiens
gaugauacaagcaauacaa

SEQ ID NO: 303691 - RNA, 19 nt, Homo sapiens
gagcaagagaauacuguaa

SEQ ID NO: 303692 - RNA, 19 nt, Homo sapiens
gcgcaagacacaggacuua

SEQ ID NO: 303693 - RNA, 19 nt, Homo sapiens
uauaguucgugcuucauaa

SEQ ID NO: 303694 - RNA, 19 nt, Homo sapiens
ggagagacugugguauaua

SEQ ID NO: 303695 - RNA, 19 nt, Homo sapiens
gaacuccagcuucaagaau

SEQ ID NO: 303696 - RNA, 19 nt, Homo sapiens
cccacacccuacucaauua

SEQ ID NO: 303697 - RNA, 19 nt, Homo sapiens
guauguccaugaauucuuc

SEQ ID NO: 303698 - RNA, 19 nt, Homo sapiens
ccacaauguuaaauucugu

SEQ ID NO: 303699 - RNA, 19 nt, Homo sapiens
cccaaugcauucauauuug

SEQ ID NO: 303700 - RNA, 19 nt, Homo sapiens
guacaggugacgaugauga

SEQ ID NO: 303701 - RNA, 19 nt, Homo sapiens
gaaaaugcuguuaccuuua

SEQ ID NO: 303702 - RNA, 19 nt, Homo sapiens
ccaaggagcagcauauagu

SEQ ID NO: 303703 - RNA, 19 nt, Homo sapiens
ggucauugaaccauaacua

SEQ ID NO: 303704 - RNA, 19 nt, Homo sapiens
ccgaagagcagaagaaaca

SEQ ID NO: 303705 - RNA, 19 nt, Homo sapiens
agacaacaguguagcuuca

SEQ ID NO: 303706 - RNA, 19 nt, Homo sapiens
acgaugagcugccccauua

SEQ ID NO: 303707 - RNA, 19 nt, Homo sapiens
agaaaaugcuguuaccuuu

SEQ ID NO: 303708 - RNA, 19 nt, Homo sapiens
cagcacguguuccucacua

SEQ ID NO: 303709 - RNA, 19 nt, Homo sapiens
ggccuuuguuccuccauaa

SEQ ID NO: 303710 - RNA, 19 nt, Homo sapiens
ugacaagguugcuggaucu

SEQ ID NO: 303711 - RNA, 19 nt, Homo sapiens
gcaagacacaggacuuaca

SEQ ID NO: 303712 - RNA, 19 nt, Homo sapiens
agaaacaguuagcgcaaga

SEQ ID NO: 303713 - RNA, 19 nt, Homo sapiens
gagcuggacaauuugauga

SEQ ID NO: 303714 - RNA, 19 nt, Homo sapiens
gaucugcuguggaauuggu

SEQ ID NO: 303715 - RNA, 19 nt, Homo sapiens
gauguugacacuuaauaug

SEQ ID NO: 303716 - RNA, 19 nt, Homo sapiens
gggcauggaugggcaaugg

SEQ ID NO: 303717 - RNA, 19 nt, Homo sapiens
agacacaggacuuacaauu

SEQ ID NO: 303718 - RNA, 19 nt, Homo sapiens
cagaucugcuguggaauug

SEQ ID NO: 303719 - RNA, 19 nt, Homo sapiens
gaaccauaacuaggacuuu

SEQ ID NO: 303720 - RNA, 19 nt, Homo sapiens
acugugacguuauguuaaa

SEQ ID NO: 303721 - RNA, 19 nt, Homo sapiens
ggagcaagagaauacugua

SEQ ID NO: 303722 - RNA, 19 nt, Homo sapiens
acuaggacuuuaucagaaa

SEQ ID NO: 303723 - RNA, 19 nt, Homo sapiens
guacauuucuguugaucac

SEQ ID NO: 303724 - RNA, 19 nt, Homo sapiens
agacagcugugauuauuuu

SEQ ID NO: 303725 - RNA, 19 nt, Homo sapiens
gcggacagguuauggacau

SEQ ID NO: 303726 - RNA, 19 nt, Homo sapiens
gagccaaggagcagcauau

SEQ ID NO: 303727 - RNA, 19 nt, Homo sapiens
uguuagcucuggucuuuga

SEQ ID NO: 303728 - RNA, 19 nt, Homo sapiens
ccaaaguagcaacaaauau

SEQ ID NO: 303729 - RNA, 19 nt, Homo sapiens
gcccaucgaccucgucauu

SEQ ID NO: 303730 - RNA, 19 nt, Homo sapiens
ugaggacugugacguuaug

SEQ ID NO: 303731 - RNA, 19 nt, Homo sapiens
uaucagaaacucaaagcuu

SEQ ID NO: 303732 - RNA, 19 nt, Homo sapiens
gacagguuauggacauuca

SEQ ID NO: 303733 - RNA, 19 nt, Homo sapiens
uaaccuucaucauguaaag

SEQ ID NO: 303734 - RNA, 19 nt, Homo sapiens
uaguacagcccaugauuga

SEQ ID NO: 303735 - RNA, 19 nt, Homo sapiens
gacacaggacuuacaauuc

SEQ ID NO: 303736 - RNA, 19 nt, Homo sapiens
caagacacaggacuuacaa

SEQ ID NO: 303737 - RNA, 19 nt, Homo sapiens
caaaucucgcugaccauaa

SEQ ID NO: 303738 - RNA, 19 nt, Homo sapiens
ucaaagagcuugccaauga

SEQ ID NO: 303739 - RNA, 19 nt, Homo sapiens
guacuaagguuucaucuuu

SEQ ID NO: 303740 - RNA, 19 nt, Homo sapiens
gaccagauguugacacuua

SEQ ID NO: 303741 - RNA, 19 nt, Homo sapiens
gagagaggaucguauuaua

SEQ ID NO: 303742 - RNA, 19 nt, Homo sapiens
gcuguuaccuuuaagcuuu

SEQ ID NO: 303743 - RNA, 19 nt, Homo sapiens
caagucagaucaugaagaa

SEQ ID NO: 303744 - RNA, 19 nt, Homo sapiens
ggacugugacguuauguua

SEQ ID NO: 303745 - RNA, 19 nt, Homo sapiens
gagagacugugguauauau

SEQ ID NO: 303746 - RNA, 19 nt, Homo sapiens
uaagggaacucaagggaaa

SEQ ID NO: 303747 - RNA, 19 nt, Homo sapiens
aaacugaggcucuucaaua

SEQ ID NO: 303748 - RNA, 19 nt, Homo sapiens
uaucagaucugcuguggaa

SEQ ID NO: 303749 - RNA, 19 nt, Homo sapiens
ccagacagcugugauuauu

SEQ ID NO: 303750 - RNA, 19 nt, Homo sapiens
ggacauucaugcccaauag

SEQ ID NO: 303751 - RNA, 19 nt, Homo sapiens
gcaauggcacuacauguaa

SEQ ID NO: 303752 - RNA, 19 nt, Homo sapiens
gauacaagcaauacaagua

SEQ ID NO: 303753 - RNA, 19 nt, Homo sapiens
guacagaguucggucuauu

SEQ ID NO: 303754 - RNA, 19 nt, Homo sapiens
agaguucggucuauuaauu

SEQ ID NO: 303755 - RNA, 19 nt, Homo sapiens
gcaagagaauacuguaaca

SEQ ID NO: 303756 - RNA, 19 nt, Homo sapiens
aaacgggucugaaagauuc

SEQ ID NO: 303757 - RNA, 19 nt, Homo sapiens
guaacaaacuucguacaga

SEQ ID NO: 303758 - RNA, 19 nt, Homo sapiens
guaaagcaaucgcaaagca

SEQ ID NO: 303759 - RNA, 19 nt, Homo sapiens
gaaccacacuggagaucau

SEQ ID NO: 303760 - RNA, 19 nt, Homo sapiens
guguuuaccucaauugaaa

SEQ ID NO: 303761 - RNA, 19 nt, Homo sapiens
gcaacaagaacacaaaugu

SEQ ID NO: 303762 - RNA, 19 nt, Homo sapiens
gagaggaucguauuauaga

SEQ ID NO: 303763 - RNA, 19 nt, Homo sapiens
gaaaucaugggcugacuga

SEQ ID NO: 303764 - RNA, 19 nt, Homo sapiens
ggaaugggcaugaauaugg

SEQ ID NO: 303765 - RNA, 19 nt, Homo sapiens
caucaaccaucauucauuc

SEQ ID NO: 303766 - RNA, 19 nt, Homo sapiens
caaaauaccuaccaggaaa

SEQ ID NO: 303767 - RNA, 19 nt, Homo sapiens
gguauuguauguccaugaa

SEQ ID NO: 303768 - RNA, 19 nt, Homo sapiens
gaggaucguauuauagaua

SEQ ID NO: 303769 - RNA, 19 nt, Homo sapiens
caaagagcuugccaaugaa

SEQ ID NO: 303770 - RNA, 19 nt, Homo sapiens
uaugaggacugugacguua

SEQ ID NO: 303771 - RNA, 19 nt, Homo sapiens
uaacuaggacuuuaucaga

SEQ ID NO: 303772 - RNA, 19 nt, Homo sapiens
uauguugccucaaauaguu

SEQ ID NO: 303773 - RNA, 19 nt, Homo sapiens
caacagaggaccaaugcaa

SEQ ID NO: 303774 - RNA, 19 nt, Homo sapiens
gcacagagccccacaaugu

SEQ ID NO: 303775 - RNA, 19 nt, Homo sapiens
caaaguagcaacaaauauc

SEQ ID NO: 303776 - RNA, 19 nt, Homo sapiens
caggagagacugugguaua

SEQ ID NO: 303777 - RNA, 19 nt, Homo sapiens
gaccauaacccuucuucuu

SEQ ID NO: 303778 - RNA, 19 nt, Homo sapiens
cagcuuuccucaacacaaa

SEQ ID NO: 303779 - RNA, 19 nt, Homo sapiens
ucuguuagcucuggucuuu

SEQ ID NO: 303780 - RNA, 19 nt, Homo sapiens
ggacaaggacgcgaucuau

SEQ ID NO: 303781 - RNA, 19 nt, Homo sapiens
aaccauaacuaggacuuua

SEQ ID NO: 303782 - RNA, 19 nt, Homo sapiens
gcuugccaaugaagauuua

SEQ ID NO: 303783 - RNA, 19 nt, Homo sapiens
gcuggacaauuugaugaua

SEQ ID NO: 303784 - RNA, 19 nt, Homo sapiens
guaaagauccucuggaaaa

SEQ ID NO: 303785 - RNA, 19 nt, Homo sapiens
gaacuuugaccagauguug

SEQ ID NO: 303786 - RNA, 19 nt, Homo sapiens
ggcaauggcacuacaugua

SEQ ID NO: 303787 - RNA, 19 nt, Homo sapiens
ccaucgaccucgucauuga

SEQ ID NO: 303788 - RNA, 19 nt, Homo sapiens
caauacaaguacuaagguu

SEQ ID NO: 303789 - RNA, 19 nt, Homo sapiens
aaacacgacaguucgguua

SEQ ID NO: 303790 - RNA, 19 nt, Homo sapiens
gagacugugguauauauuu

SEQ ID NO: 303791 - RNA, 19 nt, Homo sapiens
gccguuauguugccucaaa

SEQ ID NO: 303792 - RNA, 19 nt, Homo sapiens
acaauucuguccauguaaa

SEQ ID NO: 303793 - RNA, 19 nt, Homo sapiens
gaggaccaaugcaacaaga

SEQ ID NO: 303794 - RNA, 19 nt, Homo sapiens
uccagcaucucacaguuua

SEQ ID NO: 303795 - RNA, 19 nt, Homo sapiens
gaugauacaagcaauacaa

SEQ ID NO: 303796 - RNA, 19 nt, Homo sapiens
aacugaggcucuucaauaa

SEQ ID NO: 303797 - RNA, 19 nt, Homo sapiens
gagcaagagaauacuguaa

SEQ ID NO: 303798 - RNA, 19 nt, Homo sapiens
uauaguucgugcuucauaa

SEQ ID NO: 303799 - RNA, 19 nt, Homo sapiens
ggagagacugugguauaua

SEQ ID NO: 303800 - RNA, 19 nt, Homo sapiens
cagccuagaucacuuucuu

SEQ ID NO: 303801 - RNA, 19 nt, Homo sapiens
gaacuccagcuucaagaau

SEQ ID NO: 303802 - RNA, 19 nt, Homo sapiens
cccacacccuacucaauua

SEQ ID NO: 303803 - RNA, 19 nt, Homo sapiens
cgacacauccaggaguuua

SEQ ID NO: 303804 - RNA, 19 nt, Homo sapiens
guauguccaugaauucuuc

SEQ ID NO: 303805 - RNA, 19 nt, Homo sapiens
ccacaauguuaaauucugu

SEQ ID NO: 303806 - RNA, 19 nt, Homo sapiens
cccaaugcauucauauuug

SEQ ID NO: 303807 - RNA, 19 nt, Homo sapiens
gcaucucacaguuuauuaa

SEQ ID NO: 303808 - RNA, 19 nt, Homo sapiens
guacaggugacgaugauga

SEQ ID NO: 303809 - RNA, 19 nt, Homo sapiens
aaagagagaggaucguauu

SEQ ID NO: 303810 - RNA, 19 nt, Homo sapiens
gaaaaugcuguuaccuuua

SEQ ID NO: 303811 - RNA, 19 nt, Homo sapiens
ccaaggagcagcauauagu

SEQ ID NO: 303812 - RNA, 19 nt, Homo sapiens
ggucauugaaccauaacua

SEQ ID NO: 303813 - RNA, 19 nt, Homo sapiens
agacaacaguguagcuuca

SEQ ID NO: 303814 - RNA, 19 nt, Homo sapiens
acgaugagcugccccauua

SEQ ID NO: 303815 - RNA, 19 nt, Homo sapiens
agaaaaugcuguuaccuuu

SEQ ID NO: 303816 - RNA, 19 nt, Homo sapiens
cagcacguguuccucacua

SEQ ID NO: 303817 - RNA, 19 nt, Homo sapiens
ggccuuuguuccuccauaa

SEQ ID NO: 303818 - RNA, 19 nt, Homo sapiens
gagcuggacaauuugauga

SEQ ID NO: 303819 - RNA, 19 nt, Homo sapiens
gaucugcuguggaauuggu

SEQ ID NO: 303820 - RNA, 19 nt, Homo sapiens
agaaagagagcgagagaga

SEQ ID NO: 303821 - RNA, 19 nt, Homo sapiens
gauguugacacuuaauaug

SEQ ID NO: 303822 - RNA, 19 nt, Homo sapiens
gggcauggaugggcaaugg

SEQ ID NO: 303823 - RNA, 19 nt, Homo sapiens
cagaucugcuguggaauug

SEQ ID NO: 303824 - RNA, 19 nt, Homo sapiens
gaaccauaacuaggacuuu

SEQ ID NO: 303825 - RNA, 19 nt, Homo sapiens
ucucacugcuuucuuugaa

SEQ ID NO: 303826 - RNA, 19 nt, Homo sapiens
cuagaucacuuucuuaucc

SEQ ID NO: 303827 - RNA, 19 nt, Homo sapiens
acugugacguuauguuaaa

SEQ ID NO: 303828 - RNA, 19 nt, Homo sapiens
ggagcaagagaauacugua

SEQ ID NO: 303829 - RNA, 19 nt, Homo sapiens
acuaggacuuuaucagaaa

SEQ ID NO: 303830 - RNA, 19 nt, Homo sapiens
guacauuucuguugaucac

SEQ ID NO: 303831 - RNA, 19 nt, Homo sapiens
agacagcugugauuauuuu

SEQ ID NO: 303832 - RNA, 19 nt, Homo sapiens
gcggacagguuauggacau

SEQ ID NO: 303833 - RNA, 19 nt, Homo sapiens
gagccaaggagcagcauau

SEQ ID NO: 303834 - RNA, 19 nt, Homo sapiens
uguuagcucuggucuuuga

SEQ ID NO: 303835 - RNA, 19 nt, Homo sapiens
gcagacugauggcgcaaag

SEQ ID NO: 303836 - RNA, 19 nt, Homo sapiens
caacaccuacugacacuca

SEQ ID NO: 303837 - RNA, 19 nt, Homo sapiens
ggaggaggaagaagaggaa

SEQ ID NO: 303838 - RNA, 19 nt, Homo sapiens
ucaaagagcuugccaauga

SEQ ID NO: 303839 - RNA, 19 nt, Homo sapiens
guacuaagguuucaucuuu

SEQ ID NO: 303840 - RNA, 19 nt, Homo sapiens
gaccagauguugacacuua

SEQ ID NO: 303841 - RNA, 19 nt, Homo sapiens
gagagaggaucguauuaua

SEQ ID NO: 303842 - RNA, 19 nt, Homo sapiens
gcuguuaccuuuaagcuuu

SEQ ID NO: 303843 - RNA, 19 nt, Homo sapiens
caagucagaucaugaagaa

SEQ ID NO: 303844 - RNA, 19 nt, Homo sapiens
ggacugugacguuauguua

SEQ ID NO: 303845 - RNA, 19 nt, Homo sapiens
gagagacugugguauauau

SEQ ID NO: 303846 - RNA, 19 nt, Homo sapiens
uaagggaacucaagggaaa

SEQ ID NO: 303847 - RNA, 19 nt, Homo sapiens
aaacugaggcucuucaaua

SEQ ID NO: 303848 - RNA, 19 nt, Homo sapiens
uaucagaucugcuguggaa

SEQ ID NO: 303849 - RNA, 19 nt, Homo sapiens
ccagacagcugugauuauu

SEQ ID NO: 303850 - RNA, 19 nt, Homo sapiens
ggacauucaugcccaauag

SEQ ID NO: 303851 - RNA, 19 nt, Homo sapiens
gcaauggcacuacauguaa

SEQ ID NO: 303852 - RNA, 19 nt, Homo sapiens
gauacaagcaauacaagua

SEQ ID NO: 303853 - RNA, 19 nt, Homo sapiens
guacagaguucggucuauu

SEQ ID NO: 303854 - RNA, 19 nt, Homo sapiens
agaguucggucuauuaauu

SEQ ID NO: 303855 - RNA, 19 nt, Homo sapiens
gcaagagaauacuguaaca

SEQ ID NO: 303856 - RNA, 19 nt, Homo sapiens
aaacgggucugaaagauuc

SEQ ID NO: 303857 - RNA, 19 nt, Homo sapiens
guaacaaacuucguacaga

SEQ ID NO: 303858 - RNA, 19 nt, Homo sapiens
guaaagcaaucgcaaagca

SEQ ID NO: 303859 - RNA, 19 nt, Homo sapiens
gaaccacacuggagaucau

SEQ ID NO: 303860 - RNA, 19 nt, Homo sapiens
guguuuaccucaauugaaa

SEQ ID NO: 303861 - RNA, 19 nt, Homo sapiens
gcaacaagaacacaaaugu

SEQ ID NO: 303862 - RNA, 19 nt, Homo sapiens
gagaggaucguauuauaga

SEQ ID NO: 303863 - RNA, 19 nt, Homo sapiens
gaaaucaugggcugacuga

SEQ ID NO: 303864 - RNA, 19 nt, Homo sapiens
ggaaugggcaugaauaugg

SEQ ID NO: 303865 - RNA, 19 nt, Homo sapiens
caucaaccaucauucauuc

SEQ ID NO: 303866 - RNA, 19 nt, Homo sapiens
caaaauaccuaccaggaaa

SEQ ID NO: 303867 - RNA, 19 nt, Homo sapiens
gguauuguauguccaugaa

SEQ ID NO: 303868 - RNA, 19 nt, Homo sapiens
gaggaucguauuauagaua

SEQ ID NO: 303869 - RNA, 19 nt, Homo sapiens
caaagagcuugccaaugaa

SEQ ID NO: 303870 - RNA, 19 nt, Homo sapiens
uaugaggacugugacguua

SEQ ID NO: 303871 - RNA, 19 nt, Homo sapiens
uaacuaggacuuuaucaga

SEQ ID NO: 303872 - RNA, 19 nt, Homo sapiens
uauguugccucaaauaguu

SEQ ID NO: 303873 - RNA, 19 nt, Homo sapiens
caacagaggaccaaugcaa

SEQ ID NO: 303874 - RNA, 19 nt, Homo sapiens
gcacagagccccacaaugu

SEQ ID NO: 303875 - RNA, 19 nt, Homo sapiens
caaaguagcaacaaauauc

SEQ ID NO: 303876 - RNA, 19 nt, Homo sapiens
caggagagacugugguaua

SEQ ID NO: 303877 - RNA, 19 nt, Homo sapiens
gaccauaacccuucuucuu

SEQ ID NO: 303878 - RNA, 19 nt, Homo sapiens
cagcuuuccucaacacaaa

SEQ ID NO: 303879 - RNA, 19 nt, Homo sapiens
acacaggacuuacaauucu

SEQ ID NO: 303880 - RNA, 19 nt, Homo sapiens
ucuguuagcucuggucuuu

SEQ ID NO: 303881 - RNA, 19 nt, Homo sapiens
ggacaaggacgcgaucuau

SEQ ID NO: 303882 - RNA, 19 nt, Homo sapiens
aaccauaacuaggacuuua

SEQ ID NO: 303883 - RNA, 19 nt, Homo sapiens
gcuugccaaugaagauuua

SEQ ID NO: 303884 - RNA, 19 nt, Homo sapiens
gcuggacaauuugaugaua

SEQ ID NO: 303885 - RNA, 19 nt, Homo sapiens
guaaagauccucuggaaaa

SEQ ID NO: 303886 - RNA, 19 nt, Homo sapiens
gaacuuugaccagauguug

SEQ ID NO: 303887 - RNA, 19 nt, Homo sapiens
ggcaauggcacuacaugua

SEQ ID NO: 303888 - RNA, 19 nt, Homo sapiens
ccaucgaccucgucauuga

SEQ ID NO: 303889 - RNA, 19 nt, Homo sapiens
caauacaaguacuaagguu

SEQ ID NO: 303890 - RNA, 19 nt, Homo sapiens
aaacacgacaguucgguua

SEQ ID NO: 303891 - RNA, 19 nt, Homo sapiens
gagacugugguauauauuu

SEQ ID NO: 303892 - RNA, 19 nt, Homo sapiens
gccguuauguugccucaaa

SEQ ID NO: 303893 - RNA, 19 nt, Homo sapiens
acaauucuguccauguaaa

SEQ ID NO: 303894 - RNA, 19 nt, Homo sapiens
gaggaccaaugcaacaaga

SEQ ID NO: 303895 - RNA, 19 nt, Homo sapiens
gaugauacaagcaauacaa

SEQ ID NO: 303896 - RNA, 19 nt, Homo sapiens
aacugaggcucuucaauaa

SEQ ID NO: 303897 - RNA, 19 nt, Homo sapiens
gagcaagagaauacuguaa

SEQ ID NO: 303898 - RNA, 19 nt, Homo sapiens
gcgcaagacacaggacuua

SEQ ID NO: 303899 - RNA, 19 nt, Homo sapiens
uauaguucgugcuucauaa

SEQ ID NO: 303900 - RNA, 19 nt, Homo sapiens
ggagagacugugguauaua

SEQ ID NO: 303901 - RNA, 19 nt, Homo sapiens
cagccuagaucacuuucuu

SEQ ID NO: 303902 - RNA, 19 nt, Homo sapiens
gaacuccagcuucaagaau

SEQ ID NO: 303903 - RNA, 19 nt, Homo sapiens
cccacacccuacucaauua

SEQ ID NO: 303904 - RNA, 19 nt, Homo sapiens
cgacacauccaggaguuua

SEQ ID NO: 303905 - RNA, 19 nt, Homo sapiens
guauguccaugaauucuuc

SEQ ID NO: 303906 - RNA, 19 nt, Homo sapiens
ccacaauguuaaauucugu

SEQ ID NO: 303907 - RNA, 19 nt, Homo sapiens
cccaaugcauucauauuug

SEQ ID NO: 303908 - RNA, 19 nt, Homo sapiens
guacaggugacgaugauga

SEQ ID NO: 303909 - RNA, 19 nt, Homo sapiens
aaagagagaggaucguauu

SEQ ID NO: 303910 - RNA, 19 nt, Homo sapiens
gaaaaugcuguuaccuuua

SEQ ID NO: 303911 - RNA, 19 nt, Homo sapiens
ccaaggagcagcauauagu

SEQ ID NO: 303912 - RNA, 19 nt, Homo sapiens
ggucauugaaccauaacua

SEQ ID NO: 303913 - RNA, 19 nt, Homo sapiens
ccgaagagcagaagaaaca

SEQ ID NO: 303914 - RNA, 19 nt, Homo sapiens
agacaacaguguagcuuca

SEQ ID NO: 303915 - RNA, 19 nt, Homo sapiens
acgaugagcugccccauua

SEQ ID NO: 303916 - RNA, 19 nt, Homo sapiens
agaaaaugcuguuaccuuu

SEQ ID NO: 303917 - RNA, 19 nt, Homo sapiens
cagcacguguuccucacua

SEQ ID NO: 303918 - RNA, 19 nt, Homo sapiens
ggccuuuguuccuccauaa

SEQ ID NO: 303919 - RNA, 19 nt, Homo sapiens
gcaagacacaggacuuaca

SEQ ID NO: 303920 - RNA, 19 nt, Homo sapiens
agaaacaguuagcgcaaga

SEQ ID NO: 303921 - RNA, 19 nt, Homo sapiens
gagcuggacaauuugauga

SEQ ID NO: 303922 - RNA, 19 nt, Homo sapiens
gaucugcuguggaauuggu

SEQ ID NO: 303923 - RNA, 19 nt, Homo sapiens
agaaagagagcgagagaga

SEQ ID NO: 303924 - RNA, 19 nt, Homo sapiens
gauguugacacuuaauaug

SEQ ID NO: 303925 - RNA, 19 nt, Homo sapiens
gggcauggaugggcaaugg

SEQ ID NO: 303926 - RNA, 19 nt, Homo sapiens
agacacaggacuuacaauu

SEQ ID NO: 303927 - RNA, 19 nt, Homo sapiens
cagaucugcuguggaauug

SEQ ID NO: 303928 - RNA, 19 nt, Homo sapiens
gaaccauaacuaggacuuu

SEQ ID NO: 303929 - RNA, 19 nt, Homo sapiens
ucucacugcuuucuuugaa

SEQ ID NO: 303930 - RNA, 19 nt, Homo sapiens
cuagaucacuuucuuaucc

SEQ ID NO: 303931 - RNA, 19 nt, Homo sapiens
acugugacguuauguuaaa

SEQ ID NO: 303932 - RNA, 19 nt, Homo sapiens
ggagcaagagaauacugua

SEQ ID NO: 303933 - RNA, 19 nt, Homo sapiens
acuaggacuuuaucagaaa

SEQ ID NO: 303934 - RNA, 19 nt, Homo sapiens
caacaccuacugacacuca

SEQ ID NO: 303935 - RNA, 19 nt, Homo sapiens
guacauuucuguugaucac

SEQ ID NO: 303936 - RNA, 19 nt, Homo sapiens
agacagcugugauuauuuu

SEQ ID NO: 303937 - RNA, 19 nt, Homo sapiens
gcggacagguuauggacau

SEQ ID NO: 303938 - RNA, 19 nt, Homo sapiens
ucaaagagcuugccaauga

SEQ ID NO: 303939 - RNA, 19 nt, Homo sapiens
guacuaagguuucaucuuu

SEQ ID NO: 303940 - RNA, 19 nt, Homo sapiens
gaccagauguugacacuua

SEQ ID NO: 303941 - RNA, 19 nt, Homo sapiens
gagagaggaucguauuaua

SEQ ID NO: 303942 - RNA, 19 nt, Homo sapiens
gcuguuaccuuuaagcuuu

SEQ ID NO: 303943 - RNA, 19 nt, Homo sapiens
caagucagaucaugaagaa

SEQ ID NO: 303944 - RNA, 19 nt, Homo sapiens
ggacugugacguuauguua

SEQ ID NO: 303945 - RNA, 19 nt, Homo sapiens
gagagacugugguauauau

SEQ ID NO: 303946 - RNA, 19 nt, Homo sapiens
uaagggaacucaagggaaa

SEQ ID NO: 303947 - RNA, 19 nt, Homo sapiens
aaacugaggcucuucaaua

SEQ ID NO: 303948 - RNA, 19 nt, Homo sapiens
uaucagaucugcuguggaa

SEQ ID NO: 303949 - RNA, 19 nt, Homo sapiens
ccagacagcugugauuauu

SEQ ID NO: 303950 - RNA, 19 nt, Homo sapiens
ggacauucaugcccaauag

SEQ ID NO: 303951 - RNA, 19 nt, Homo sapiens
gauacaagcaauacaagua

SEQ ID NO: 303952 - RNA, 19 nt, Homo sapiens
guacagaguucggucuauu

SEQ ID NO: 303953 - RNA, 19 nt, Homo sapiens
agaguucggucuauuaauu

SEQ ID NO: 303954 - RNA, 19 nt, Homo sapiens
gcaagagaauacuguaaca

SEQ ID NO: 303955 - RNA, 19 nt, Homo sapiens
aaacgggucugaaagauuc

SEQ ID NO: 303956 - RNA, 19 nt, Homo sapiens
guaacaaacuucguacaga

SEQ ID NO: 303957 - RNA, 19 nt, Homo sapiens
gaaccacacuggagaucau

SEQ ID NO: 303958 - RNA, 19 nt, Homo sapiens
guguuuaccucaauugaaa

SEQ ID NO: 303959 - RNA, 19 nt, Homo sapiens
gcaacaagaacacaaaugu

SEQ ID NO: 303960 - RNA, 19 nt, Homo sapiens
gagaggaucguauuauaga

SEQ ID NO: 303961 - RNA, 19 nt, Homo sapiens
gaaaucaugggcugacuga

SEQ ID NO: 303962 - RNA, 19 nt, Homo sapiens
caucaaccaucauucauuc

SEQ ID NO: 303963 - RNA, 19 nt, Homo sapiens
caaaauaccuaccaggaaa

SEQ ID NO: 303964 - RNA, 19 nt, Homo sapiens
gguauuguauguccaugaa

SEQ ID NO: 303965 - RNA, 19 nt, Homo sapiens
gaggaucguauuauagaua

SEQ ID NO: 303966 - RNA, 19 nt, Homo sapiens
caaagagcuugccaaugaa

SEQ ID NO: 303967 - RNA, 19 nt, Homo sapiens
uaugaggacugugacguua

SEQ ID NO: 303968 - RNA, 19 nt, Homo sapiens
uaacuaggacuuuaucaga

SEQ ID NO: 303969 - RNA, 19 nt, Homo sapiens
uauguugccucaaauaguu

SEQ ID NO: 303970 - RNA, 19 nt, Homo sapiens
caacagaggaccaaugcaa

SEQ ID NO: 303971 - RNA, 19 nt, Homo sapiens
gcacagagccccacaaugu

SEQ ID NO: 303972 - RNA, 19 nt, Homo sapiens
caaaguagcaacaaauauc

SEQ ID NO: 303973 - RNA, 19 nt, Homo sapiens
caggagagacugugguaua

SEQ ID NO: 303974 - RNA, 19 nt, Homo sapiens
gaccauaacccuucuucuu

SEQ ID NO: 303975 - RNA, 19 nt, Homo sapiens
cagcuuuccucaacacaaa

SEQ ID NO: 303976 - RNA, 19 nt, Homo sapiens
acacaggacuuacaauucu

SEQ ID NO: 303977 - RNA, 19 nt, Homo sapiens
ucuguuagcucuggucuuu

SEQ ID NO: 303978 - RNA, 19 nt, Homo sapiens
ggacaaggacgcgaucuau

SEQ ID NO: 303979 - RNA, 19 nt, Homo sapiens
aaccauaacuaggacuuua

SEQ ID NO: 303980 - RNA, 19 nt, Homo sapiens
gcuugccaaugaagauuua

SEQ ID NO: 303981 - RNA, 19 nt, Homo sapiens
gcuggacaauuugaugaua

SEQ ID NO: 303982 - RNA, 19 nt, Homo sapiens
guaaagauccucuggaaaa

SEQ ID NO: 303983 - RNA, 19 nt, Homo sapiens
gaacuuugaccagauguug

SEQ ID NO: 303984 - RNA, 19 nt, Homo sapiens
gauccggccugcagguuug

SEQ ID NO: 303985 - RNA, 19 nt, Homo sapiens
ccaucgaccucgucauuga

SEQ ID NO: 303986 - RNA, 19 nt, Homo sapiens
caauacaaguacuaagguu

SEQ ID NO: 303987 - RNA, 19 nt, Homo sapiens
aaacacgacaguucgguua

SEQ ID NO: 303988 - RNA, 19 nt, Homo sapiens
gagacugugguauauauuu

SEQ ID NO: 303989 - RNA, 19 nt, Homo sapiens
gccguuauguugccucaaa

SEQ ID NO: 303990 - RNA, 19 nt, Homo sapiens
acaauucuguccauguaaa

SEQ ID NO: 303991 - RNA, 19 nt, Homo sapiens
gaggaccaaugcaacaaga

SEQ ID NO: 303992 - RNA, 19 nt, Homo sapiens
gaugauacaagcaauacaa

SEQ ID NO: 303993 - RNA, 19 nt, Homo sapiens
gagcaagagaauacuguaa

SEQ ID NO: 303994 - RNA, 19 nt, Homo sapiens
aacugaggcucuucaauaa

SEQ ID NO: 303995 - RNA, 19 nt, Homo sapiens
gcgcaagacacaggacuua

SEQ ID NO: 303996 - RNA, 19 nt, Homo sapiens
uauaguucgugcuucauaa

SEQ ID NO: 303997 - RNA, 19 nt, Homo sapiens
ggagagacugugguauaua

SEQ ID NO: 303998 - RNA, 19 nt, Homo sapiens
cagccuagaucacuuucuu

SEQ ID NO: 303999 - RNA, 19 nt, Homo sapiens
gaacuccagcuucaagaau

SEQ ID NO: 304000 - RNA, 19 nt, Homo sapiens
cccacacccuacucaauua

SEQ ID NO: 304001 - RNA, 19 nt, Homo sapiens
cgacacauccaggaguuua

SEQ ID NO: 304002 - RNA, 19 nt, Homo sapiens
guauguccaugaauucuuc

SEQ ID NO: 304003 - RNA, 19 nt, Homo sapiens
ccacaauguuaaauucugu

SEQ ID NO: 304004 - RNA, 19 nt, Homo sapiens
cccaaugcauucauauuug

SEQ ID NO: 304005 - RNA, 19 nt, Homo sapiens
guacaggugacgaugauga

SEQ ID NO: 304006 - RNA, 19 nt, Homo sapiens
aaagagagaggaucguauu

SEQ ID NO: 304007 - RNA, 19 nt, Homo sapiens
gaaaaugcuguuaccuuua

SEQ ID NO: 304008 - RNA, 19 nt, Homo sapiens
ccaaggagcagcauauagu

SEQ ID NO: 304009 - RNA, 19 nt, Homo sapiens
ggucauugaaccauaacua

SEQ ID NO: 304010 - RNA, 19 nt, Homo sapiens
ccgaagagcagaagaaaca

SEQ ID NO: 304011 - RNA, 19 nt, Homo sapiens
agacaacaguguagcuuca

SEQ ID NO: 304012 - RNA, 19 nt, Homo sapiens
acgaugagcugccccauua

SEQ ID NO: 304013 - RNA, 19 nt, Homo sapiens
agaaaaugcuguuaccuuu

SEQ ID NO: 304014 - RNA, 19 nt, Homo sapiens
cagcacguguuccucacua

SEQ ID NO: 304015 - RNA, 19 nt, Homo sapiens
ggccuuuguuccuccauaa

SEQ ID NO: 304016 - RNA, 19 nt, Homo sapiens
gcaagacacaggacuuaca

SEQ ID NO: 304017 - RNA, 19 nt, Homo sapiens
agaaacaguuagcgcaaga

SEQ ID NO: 304018 - RNA, 19 nt, Homo sapiens
gagcuggacaauuugauga

SEQ ID NO: 304019 - RNA, 19 nt, Homo sapiens
gaucugcuguggaauuggu

SEQ ID NO: 304020 - RNA, 19 nt, Homo sapiens
gauguugacacuuaauaug

SEQ ID NO: 304021 - RNA, 19 nt, Homo sapiens
agaaagagagcgagagaga

SEQ ID NO: 304022 - RNA, 19 nt, Homo sapiens
agacacaggacuuacaauu

SEQ ID NO: 304023 - RNA, 19 nt, Homo sapiens
ucucacugcuuucuuugaa

SEQ ID NO: 304024 - RNA, 19 nt, Homo sapiens
cagaucugcuguggaauug

SEQ ID NO: 304025 - RNA, 19 nt, Homo sapiens
gaaccauaacuaggacuuu

SEQ ID NO: 304026 - RNA, 19 nt, Homo sapiens
cuagaucacuuucuuaucc

SEQ ID NO: 304027 - RNA, 19 nt, Homo sapiens
acugugacguuauguuaaa

SEQ ID NO: 304028 - RNA, 19 nt, Homo sapiens
ggagcaagagaauacugua

SEQ ID NO: 304029 - RNA, 19 nt, Homo sapiens
acuaggacuuuaucagaaa

SEQ ID NO: 304030 - RNA, 19 nt, Homo sapiens
caacaccuacugacacuca

SEQ ID NO: 304031 - RNA, 19 nt, Homo sapiens
guacauuucuguugaucac

SEQ ID NO: 304032 - RNA, 19 nt, Homo sapiens
agacagcugugauuauuuu

SEQ ID NO: 304033 - RNA, 19 nt, Homo sapiens
gcggacagguuauggacau

SEQ ID NO: 304034 - RNA, 19 nt, Homo sapiens
gagccaaggagcagcauau

SEQ ID NO: 304035 - RNA, 19 nt, Homo sapiens
uguuagcucuggucuuuga

SEQ ID NO: 304036 - RNA, 19 nt, Homo sapiens
gcagacugauggcgcaaag

SEQ ID NO: 304037 - RNA, 19 nt, Homo sapiens
ggaggaggaagaagaggaa

SEQ ID NO: 304038 - RNA, 19 nt, Homo sapiens
ucaaagagcuugccaauga

SEQ ID NO: 304039 - RNA, 19 nt, Homo sapiens
guacuaagguuucaucuuu

SEQ ID NO: 304040 - RNA, 19 nt, Homo sapiens
gaccagauguugacacuua

SEQ ID NO: 304041 - RNA, 19 nt, Homo sapiens
gagagaggaucguauuaua

SEQ ID NO: 304042 - RNA, 19 nt, Homo sapiens
gcuguuaccuuuaagcuuu

SEQ ID NO: 304043 - RNA, 19 nt, Homo sapiens
caagucagaucaugaagaa

SEQ ID NO: 304044 - RNA, 19 nt, Homo sapiens
ggacugugacguuauguua

SEQ ID NO: 304045 - RNA, 19 nt, Homo sapiens
gagagacugugguauauau

SEQ ID NO: 304046 - RNA, 19 nt, Homo sapiens
uaagggaacucaagggaaa

SEQ ID NO: 304047 - RNA, 19 nt, Homo sapiens
aaacugaggcucuucaaua

SEQ ID NO: 304048 - RNA, 19 nt, Homo sapiens
uaucagaucugcuguggaa

SEQ ID NO: 304049 - RNA, 19 nt, Homo sapiens
ccagacagcugugauuauu

SEQ ID NO: 304050 - RNA, 19 nt, Homo sapiens
ggacauucaugcccaauag

SEQ ID NO: 304051 - RNA, 19 nt, Homo sapiens
gauacaagcaauacaagua

SEQ ID NO: 304052 - RNA, 19 nt, Homo sapiens
guacagaguucggucuauu

SEQ ID NO: 304053 - RNA, 19 nt, Homo sapiens
agaguucggucuauuaauu

SEQ ID NO: 304054 - RNA, 19 nt, Homo sapiens
gcaagagaauacuguaaca

SEQ ID NO: 304055 - RNA, 19 nt, Homo sapiens
aaacgggucugaaagauuc

SEQ ID NO: 304056 - RNA, 19 nt, Homo sapiens
guaacaaacuucguacaga

SEQ ID NO: 304057 - RNA, 19 nt, Homo sapiens
gaaccacacuggagaucau

SEQ ID NO: 304058 - RNA, 19 nt, Homo sapiens
guguuuaccucaauugaaa

SEQ ID NO: 304059 - RNA, 19 nt, Homo sapiens
gcaacaagaacacaaaugu

SEQ ID NO: 304060 - RNA, 19 nt, Homo sapiens
gagaggaucguauuauaga

SEQ ID NO: 304061 - RNA, 19 nt, Homo sapiens
gaaaucaugggcugacuga

SEQ ID NO: 304062 - RNA, 19 nt, Homo sapiens
caucaaccaucauucauuc

SEQ ID NO: 304063 - RNA, 19 nt, Homo sapiens
caaaauaccuaccaggaaa

SEQ ID NO: 304064 - RNA, 19 nt, Homo sapiens
gguauuguauguccaugaa

SEQ ID NO: 304065 - RNA, 19 nt, Homo sapiens
gaggaucguauuauagaua

SEQ ID NO: 304066 - RNA, 19 nt, Homo sapiens
caaagagcuugccaaugaa

SEQ ID NO: 304067 - RNA, 19 nt, Homo sapiens
uaugaggacugugacguua

SEQ ID NO: 304068 - RNA, 19 nt, Homo sapiens
uaacuaggacuuuaucaga

SEQ ID NO: 304069 - RNA, 19 nt, Homo sapiens
uauguugccucaaauaguu

SEQ ID NO: 304070 - RNA, 19 nt, Homo sapiens
caacagaggaccaaugcaa

SEQ ID NO: 304071 - RNA, 19 nt, Homo sapiens
gcacagagccccacaaugu

SEQ ID NO: 304072 - RNA, 19 nt, Homo sapiens
caaaguagcaacaaauauc

SEQ ID NO: 304073 - RNA, 19 nt, Homo sapiens
caggagagacugugguaua

SEQ ID NO: 304074 - RNA, 19 nt, Homo sapiens
gaccauaacccuucuucuu

SEQ ID NO: 304075 - RNA, 19 nt, Homo sapiens
cagcuuuccucaacacaaa

SEQ ID NO: 304076 - RNA, 19 nt, Homo sapiens
acacaggacuuacaauucu

SEQ ID NO: 304077 - RNA, 19 nt, Homo sapiens
ucuguuagcucuggucuuu

SEQ ID NO: 304078 - RNA, 19 nt, Homo sapiens
ggacaaggacgcgaucuau

SEQ ID NO: 304079 - RNA, 19 nt, Homo sapiens
aaccauaacuaggacuuua

SEQ ID NO: 304080 - RNA, 19 nt, Homo sapiens
gcuugccaaugaagauuua

SEQ ID NO: 304081 - RNA, 19 nt, Homo sapiens
gcuggacaauuugaugaua

SEQ ID NO: 304082 - RNA, 19 nt, Homo sapiens
guaaagauccucuggaaaa

SEQ ID NO: 304083 - RNA, 19 nt, Homo sapiens
gaacuuugaccagauguug

SEQ ID NO: 304084 - RNA, 19 nt, Homo sapiens
gauccggccugcagguuug

SEQ ID NO: 304085 - RNA, 19 nt, Homo sapiens
ccaucgaccucgucauuga

SEQ ID NO: 304086 - RNA, 19 nt, Homo sapiens
caauacaaguacuaagguu

SEQ ID NO: 304087 - RNA, 19 nt, Homo sapiens
aaacacgacaguucgguua

SEQ ID NO: 304088 - RNA, 19 nt, Homo sapiens
gagacugugguauauauuu

SEQ ID NO: 304089 - RNA, 19 nt, Homo sapiens
gccguuauguugccucaaa

SEQ ID NO: 304090 - RNA, 19 nt, Homo sapiens
acaauucuguccauguaaa

SEQ ID NO: 304091 - RNA, 19 nt, Homo sapiens
gaggaccaaugcaacaaga

SEQ ID NO: 304092 - RNA, 19 nt, Homo sapiens
gaugauacaagcaauacaa

SEQ ID NO: 304093 - RNA, 19 nt, Homo sapiens
gagcaagagaauacuguaa

SEQ ID NO: 304094 - RNA, 19 nt, Homo sapiens
aacugaggcucuucaauaa

SEQ ID NO: 304095 - RNA, 19 nt, Homo sapiens
gcgcaagacacaggacuua

SEQ ID NO: 304096 - RNA, 19 nt, Homo sapiens
uauaguucgugcuucauaa

SEQ ID NO: 304097 - RNA, 19 nt, Homo sapiens
ggagagacugugguauaua

SEQ ID NO: 304098 - RNA, 19 nt, Homo sapiens
cagccuagaucacuuucuu

SEQ ID NO: 304099 - RNA, 19 nt, Homo sapiens
gaacuccagcuucaagaau

SEQ ID NO: 304100 - RNA, 19 nt, Homo sapiens
cccacacccuacucaauua

SEQ ID NO: 304101 - RNA, 19 nt, Homo sapiens
cgacacauccaggaguuua

SEQ ID NO: 304102 - RNA, 19 nt, Homo sapiens
guauguccaugaauucuuc

SEQ ID NO: 304103 - RNA, 19 nt, Homo sapiens
ccacaauguuaaauucugu

SEQ ID NO: 304104 - RNA, 19 nt, Homo sapiens
cccaaugcauucauauuug

SEQ ID NO: 304105 - RNA, 19 nt, Homo sapiens
guacaggugacgaugauga

SEQ ID NO: 304106 - RNA, 19 nt, Homo sapiens
aaagagagaggaucguauu

SEQ ID NO: 304107 - RNA, 19 nt, Homo sapiens
gaaaaugcuguuaccuuua

SEQ ID NO: 304108 - RNA, 19 nt, Homo sapiens
ccaaggagcagcauauagu

SEQ ID NO: 304109 - RNA, 19 nt, Homo sapiens
ggucauugaaccauaacua

SEQ ID NO: 304110 - RNA, 19 nt, Homo sapiens
ccgaagagcagaagaaaca

SEQ ID NO: 304111 - RNA, 19 nt, Homo sapiens
agacaacaguguagcuuca

SEQ ID NO: 304112 - RNA, 19 nt, Homo sapiens
acgaugagcugccccauua

SEQ ID NO: 304113 - RNA, 19 nt, Homo sapiens
agaaaaugcuguuaccuuu

SEQ ID NO: 304114 - RNA, 19 nt, Homo sapiens
cagcacguguuccucacua

SEQ ID NO: 304115 - RNA, 19 nt, Homo sapiens
ggccuuuguuccuccauaa

SEQ ID NO: 304116 - RNA, 19 nt, Homo sapiens
gcaagacacaggacuuaca

SEQ ID NO: 304117 - RNA, 19 nt, Homo sapiens
agaaacaguuagcgcaaga

SEQ ID NO: 304118 - RNA, 19 nt, Homo sapiens
gagcuggacaauuugauga

SEQ ID NO: 304119 - RNA, 19 nt, Homo sapiens
gaucugcuguggaauuggu

SEQ ID NO: 304120 - RNA, 19 nt, Homo sapiens
gauguugacacuuaauaug

SEQ ID NO: 304121 - RNA, 19 nt, Homo sapiens
agaaagagagcgagagaga

SEQ ID NO: 304122 - RNA, 19 nt, Homo sapiens
agacacaggacuuacaauu

SEQ ID NO: 304123 - RNA, 19 nt, Homo sapiens
ucucacugcuuucuuugaa

SEQ ID NO: 304124 - RNA, 19 nt, Homo sapiens
cagaucugcuguggaauug

SEQ ID NO: 304125 - RNA, 19 nt, Homo sapiens
gaaccauaacuaggacuuu

SEQ ID NO: 304126 - RNA, 19 nt, Homo sapiens
cuagaucacuuucuuaucc

SEQ ID NO: 304127 - RNA, 19 nt, Homo sapiens
acugugacguuauguuaaa

SEQ ID NO: 304128 - RNA, 19 nt, Homo sapiens
ggagcaagagaauacugua

SEQ ID NO: 304129 - RNA, 19 nt, Homo sapiens
acuaggacuuuaucagaaa

SEQ ID NO: 304130 - RNA, 19 nt, Homo sapiens
caacaccuacugacacuca

SEQ ID NO: 304131 - RNA, 19 nt, Homo sapiens
guacauuucuguugaucac

SEQ ID NO: 304132 - RNA, 19 nt, Homo sapiens
agacagcugugauuauuuu

SEQ ID NO: 304133 - RNA, 19 nt, Homo sapiens
gcggacagguuauggacau

SEQ ID NO: 304134 - RNA, 19 nt, Homo sapiens
gagccaaggagcagcauau

SEQ ID NO: 304135 - RNA, 19 nt, Homo sapiens
uguuagcucuggucuuuga

SEQ ID NO: 304136 - RNA, 19 nt, Homo sapiens
gcagacugauggcgcaaag

SEQ ID NO: 304137 - RNA, 19 nt, Homo sapiens
ggaggaggaagaagaggaa

SEQ ID NO: 304138 - RNA, 19 nt, Homo sapiens
ucaaagagcuugccaauga

SEQ ID NO: 304139 - RNA, 19 nt, Homo sapiens
guacuaagguuucaucuuu

SEQ ID NO: 304140 - RNA, 19 nt, Homo sapiens
gaccagauguugacacuua

SEQ ID NO: 304141 - RNA, 19 nt, Homo sapiens
gagagaggaucguauuaua

SEQ ID NO: 304142 - RNA, 19 nt, Homo sapiens
gcuguuaccuuuaagcuuu

SEQ ID NO: 304143 - RNA, 19 nt, Homo sapiens
caagucagaucaugaagaa

SEQ ID NO: 304144 - RNA, 19 nt, Homo sapiens
ggacugugacguuauguua

SEQ ID NO: 304145 - RNA, 19 nt, Homo sapiens
gagagacugugguauauau

SEQ ID NO: 304146 - RNA, 19 nt, Homo sapiens
uaagggaacucaagggaaa

SEQ ID NO: 304147 - RNA, 19 nt, Homo sapiens
aaacugaggcucuucaaua

SEQ ID NO: 304148 - RNA, 19 nt, Homo sapiens
uaucagaucugcuguggaa

SEQ ID NO: 304149 - RNA, 19 nt, Homo sapiens
ccagacagcugugauuauu

SEQ ID NO: 304150 - RNA, 19 nt, Homo sapiens
ggacauucaugcccaauag

SEQ ID NO: 304151 - RNA, 19 nt, Homo sapiens
gcaauggcacuacauguaa

SEQ ID NO: 304152 - RNA, 19 nt, Homo sapiens
gauacaagcaauacaagua

SEQ ID NO: 304153 - RNA, 19 nt, Homo sapiens
guacagaguucggucuauu

SEQ ID NO: 304154 - RNA, 19 nt, Homo sapiens
agaguucggucuauuaauu

SEQ ID NO: 304155 - RNA, 19 nt, Homo sapiens
gcaagagaauacuguaaca

SEQ ID NO: 304156 - RNA, 19 nt, Homo sapiens
aaacgggucugaaagauuc

SEQ ID NO: 304157 - RNA, 19 nt, Homo sapiens
guaacaaacuucguacaga

SEQ ID NO: 304158 - RNA, 19 nt, Homo sapiens
guaaagcaaucgcaaagca

SEQ ID NO: 304159 - RNA, 19 nt, Homo sapiens
gaaccacacuggagaucau

SEQ ID NO: 304160 - RNA, 19 nt, Homo sapiens
guguuuaccucaauugaaa

SEQ ID NO: 304161 - RNA, 19 nt, Homo sapiens
gcaacaagaacacaaaugu

SEQ ID NO: 304162 - RNA, 19 nt, Homo sapiens
gagaggaucguauuauaga

SEQ ID NO: 304163 - RNA, 19 nt, Homo sapiens
gaaaucaugggcugacuga

SEQ ID NO: 304164 - RNA, 19 nt, Homo sapiens
ggaaugggcaugaauaugg

SEQ ID NO: 304165 - RNA, 19 nt, Homo sapiens
caucaaccaucauucauuc

SEQ ID NO: 304166 - RNA, 19 nt, Homo sapiens
caaaauaccuaccaggaaa

SEQ ID NO: 304167 - RNA, 19 nt, Homo sapiens
gguauuguauguccaugaa

SEQ ID NO: 304168 - RNA, 19 nt, Homo sapiens
gaggaucguauuauagaua

SEQ ID NO: 304169 - RNA, 19 nt, Homo sapiens
caaagagcuugccaaugaa

SEQ ID NO: 304170 - RNA, 19 nt, Homo sapiens
uaugaggacugugacguua

SEQ ID NO: 304171 - RNA, 19 nt, Homo sapiens
uaacuaggacuuuaucaga

SEQ ID NO: 304172 - RNA, 19 nt, Homo sapiens
uauguugccucaaauaguu

SEQ ID NO: 304173 - RNA, 19 nt, Homo sapiens
caacagaggaccaaugcaa

SEQ ID NO: 304174 - RNA, 19 nt, Homo sapiens
gcacagagccccacaaugu

SEQ ID NO: 304175 - RNA, 19 nt, Homo sapiens
caaaguagcaacaaauauc

SEQ ID NO: 304176 - RNA, 19 nt, Homo sapiens
caggagagacugugguaua

SEQ ID NO: 304177 - RNA, 19 nt, Homo sapiens
gaccauaacccuucuucuu

SEQ ID NO: 304178 - RNA, 19 nt, Homo sapiens
cagcuuuccucaacacaaa

SEQ ID NO: 304179 - RNA, 19 nt, Homo sapiens
acacaggacuuacaauucu

SEQ ID NO: 304180 - RNA, 19 nt, Homo sapiens
ucuguuagcucuggucuuu

SEQ ID NO: 304181 - RNA, 19 nt, Homo sapiens
ggacaaggacgcgaucuau

SEQ ID NO: 304182 - RNA, 19 nt, Homo sapiens
aaccauaacuaggacuuua

SEQ ID NO: 304183 - RNA, 19 nt, Homo sapiens
gcuugccaaugaagauuua

SEQ ID NO: 304184 - RNA, 19 nt, Homo sapiens
gcuggacaauuugaugaua

SEQ ID NO: 304185 - RNA, 19 nt, Homo sapiens
guaaagauccucuggaaaa

SEQ ID NO: 304186 - RNA, 19 nt, Homo sapiens
gaacuuugaccagauguug

SEQ ID NO: 304187 - RNA, 19 nt, Homo sapiens
ggcaauggcacuacaugua

SEQ ID NO: 304188 - RNA, 19 nt, Homo sapiens
ccaucgaccucgucauuga

SEQ ID NO: 304189 - RNA, 19 nt, Homo sapiens
caauacaaguacuaagguu

SEQ ID NO: 304190 - RNA, 19 nt, Homo sapiens
aaacacgacaguucgguua

SEQ ID NO: 304191 - RNA, 19 nt, Homo sapiens
gagacugugguauauauuu

SEQ ID NO: 304192 - RNA, 19 nt, Homo sapiens
gccguuauguugccucaaa

SEQ ID NO: 304193 - RNA, 19 nt, Homo sapiens
acaauucuguccauguaaa

SEQ ID NO: 304194 - RNA, 19 nt, Homo sapiens
gaggaccaaugcaacaaga

SEQ ID NO: 304195 - RNA, 19 nt, Homo sapiens
gaugauacaagcaauacaa

SEQ ID NO: 304196 - RNA, 19 nt, Homo sapiens
aacugaggcucuucaauaa

SEQ ID NO: 304197 - RNA, 19 nt, Homo sapiens
gagcaagagaauacuguaa

SEQ ID NO: 304198 - RNA, 19 nt, Homo sapiens
gcgcaagacacaggacuua

SEQ ID NO: 304199 - RNA, 19 nt, Homo sapiens
uauaguucgugcuucauaa

SEQ ID NO: 304200 - RNA, 19 nt, Homo sapiens
ggagagacugugguauaua

SEQ ID NO: 304201 - RNA, 19 nt, Homo sapiens
cagccuagaucacuuucuu

SEQ ID NO: 304202 - RNA, 19 nt, Homo sapiens
gaacuccagcuucaagaau

SEQ ID NO: 304203 - RNA, 19 nt, Homo sapiens
cccacacccuacucaauua

SEQ ID NO: 304204 - RNA, 19 nt, Homo sapiens
cgacacauccaggaguuua

SEQ ID NO: 304205 - RNA, 19 nt, Homo sapiens
guauguccaugaauucuuc

SEQ ID NO: 304206 - RNA, 19 nt, Homo sapiens
ccacaauguuaaauucugu

SEQ ID NO: 304207 - RNA, 19 nt, Homo sapiens
cccaaugcauucauauuug

SEQ ID NO: 304208 - RNA, 19 nt, Homo sapiens
guacaggugacgaugauga

SEQ ID NO: 304209 - RNA, 19 nt, Homo sapiens
aaagagagaggaucguauu

SEQ ID NO: 304210 - RNA, 19 nt, Homo sapiens
gaaaaugcuguuaccuuua

SEQ ID NO: 304211 - RNA, 19 nt, Homo sapiens
ccaaggagcagcauauagu

SEQ ID NO: 304212 - RNA, 19 nt, Homo sapiens
ggucauugaaccauaacua

SEQ ID NO: 304213 - RNA, 19 nt, Homo sapiens
ccgaagagcagaagaaaca

SEQ ID NO: 304214 - RNA, 19 nt, Homo sapiens
agacaacaguguagcuuca

SEQ ID NO: 304215 - RNA, 19 nt, Homo sapiens
acgaugagcugccccauua

SEQ ID NO: 304216 - RNA, 19 nt, Homo sapiens
agaaaaugcuguuaccuuu

SEQ ID NO: 304217 - RNA, 19 nt, Homo sapiens
cagcacguguuccucacua

SEQ ID NO: 304218 - RNA, 19 nt, Homo sapiens
ggccuuuguuccuccauaa

SEQ ID NO: 304219 - RNA, 19 nt, Homo sapiens
gcaagacacaggacuuaca

SEQ ID NO: 304220 - RNA, 19 nt, Homo sapiens
agaaacaguuagcgcaaga

SEQ ID NO: 304221 - RNA, 19 nt, Homo sapiens
gagcuggacaauuugauga

SEQ ID NO: 304222 - RNA, 19 nt, Homo sapiens
gaucugcuguggaauuggu

SEQ ID NO: 304223 - RNA, 19 nt, Homo sapiens
agaaagagagcgagagaga

SEQ ID NO: 304224 - RNA, 19 nt, Homo sapiens
gauguugacacuuaauaug

SEQ ID NO: 304225 - RNA, 19 nt, Homo sapiens
gggcauggaugggcaaugg

SEQ ID NO: 304226 - RNA, 19 nt, Homo sapiens
agacacaggacuuacaauu

SEQ ID NO: 304227 - RNA, 19 nt, Homo sapiens
cagaucugcuguggaauug

SEQ ID NO: 304228 - RNA, 19 nt, Homo sapiens
gaaccauaacuaggacuuu

SEQ ID NO: 304229 - RNA, 19 nt, Homo sapiens
ucucacugcuuucuuugaa

SEQ ID NO: 304230 - RNA, 19 nt, Homo sapiens
cuagaucacuuucuuaucc

SEQ ID NO: 304231 - RNA, 19 nt, Homo sapiens
acugugacguuauguuaaa

SEQ ID NO: 304232 - RNA, 19 nt, Homo sapiens
ggagcaagagaauacugua

SEQ ID NO: 304233 - RNA, 19 nt, Homo sapiens
acuaggacuuuaucagaaa

SEQ ID NO: 304234 - RNA, 19 nt, Homo sapiens
caacaccuacugacacuca

SEQ ID NO: 304235 - RNA, 19 nt, Homo sapiens
guacauuucuguugaucac

SEQ ID NO: 304236 - RNA, 19 nt, Homo sapiens
agacagcugugauuauuuu

SEQ ID NO: 304237 - RNA, 19 nt, Homo sapiens
gcggacagguuauggacau

SEQ ID NO: 304238 - RNA, 19 nt, Homo sapiens
ucaaagagcuugccaauga

SEQ ID NO: 304239 - RNA, 19 nt, Homo sapiens
guacuaagguuucaucuuu

SEQ ID NO: 304240 - RNA, 19 nt, Homo sapiens
gaccagauguugacacuua

SEQ ID NO: 304241 - RNA, 19 nt, Homo sapiens
gcuguuaccuuuaagcuuu

SEQ ID NO: 304242 - RNA, 19 nt, Homo sapiens
caagucagaucaugaagaa

SEQ ID NO: 304243 - RNA, 19 nt, Homo sapiens
ggacugugacguuauguua

SEQ ID NO: 304244 - RNA, 19 nt, Homo sapiens
gagagacugugguauauau

SEQ ID NO: 304245 - RNA, 19 nt, Homo sapiens
uaagggaacucaagggaaa

SEQ ID NO: 304246 - RNA, 19 nt, Homo sapiens
uaucagaucugcuguggaa

SEQ ID NO: 304247 - RNA, 19 nt, Homo sapiens
ccagacagcugugauuauu

SEQ ID NO: 304248 - RNA, 19 nt, Homo sapiens
ggacauucaugcccaauag

SEQ ID NO: 304249 - RNA, 19 nt, Homo sapiens
gcaauggcacuacauguaa

SEQ ID NO: 304250 - RNA, 19 nt, Homo sapiens
gauacaagcaauacaagua

SEQ ID NO: 304251 - RNA, 19 nt, Homo sapiens
guacagaguucggucuauu

SEQ ID NO: 304252 - RNA, 19 nt, Homo sapiens
agaguucggucuauuaauu

SEQ ID NO: 304253 - RNA, 19 nt, Homo sapiens
gcaagagaauacuguaaca

SEQ ID NO: 304254 - RNA, 19 nt, Homo sapiens
guaacaaacuucguacaga

SEQ ID NO: 304255 - RNA, 19 nt, Homo sapiens
guaaagcaaucgcaaagca

SEQ ID NO: 304256 - RNA, 19 nt, Homo sapiens
gaaccacacuggagaucau

SEQ ID NO: 304257 - RNA, 19 nt, Homo sapiens
guguuuaccucaauugaaa

SEQ ID NO: 304258 - RNA, 19 nt, Homo sapiens
gcaacaagaacacaaaugu

SEQ ID NO: 304259 - RNA, 19 nt, Homo sapiens
gaaaucaugggcugacuga

SEQ ID NO: 304260 - RNA, 19 nt, Homo sapiens
ggaaugggcaugaauaugg

SEQ ID NO: 304261 - RNA, 19 nt, Homo sapiens
gguauuguauguccaugaa

SEQ ID NO: 304262 - RNA, 19 nt, Homo sapiens
caaagagcuugccaaugaa

SEQ ID NO: 304263 - RNA, 19 nt, Homo sapiens
uaugaggacugugacguua

SEQ ID NO: 304264 - RNA, 19 nt, Homo sapiens
uaacuaggacuuuaucaga

SEQ ID NO: 304265 - RNA, 19 nt, Homo sapiens
uauguugccucaaauaguu

SEQ ID NO: 304266 - RNA, 19 nt, Homo sapiens
caacagaggaccaaugcaa

SEQ ID NO: 304267 - RNA, 19 nt, Homo sapiens
gcacagagccccacaaugu

SEQ ID NO: 304268 - RNA, 19 nt, Homo sapiens
caaaguagcaacaaauauc

SEQ ID NO: 304269 - RNA, 19 nt, Homo sapiens
caggagagacugugguaua

SEQ ID NO: 304270 - RNA, 19 nt, Homo sapiens
gaccauaacccuucuucuu

SEQ ID NO: 304271 - RNA, 19 nt, Homo sapiens
cagcuuuccucaacacaaa

SEQ ID NO: 304272 - RNA, 19 nt, Homo sapiens
ggacaaggacgcgaucuau

SEQ ID NO: 304273 - RNA, 19 nt, Homo sapiens
acacaggacuuacaauucu

SEQ ID NO: 304274 - RNA, 19 nt, Homo sapiens
ucuguuagcucuggucuuu

SEQ ID NO: 304275 - RNA, 19 nt, Homo sapiens
aaccauaacuaggacuuua

SEQ ID NO: 304276 - RNA, 19 nt, Homo sapiens
gcuugccaaugaagauuua

SEQ ID NO: 304277 - RNA, 19 nt, Homo sapiens
gcuggacaauuugaugaua

SEQ ID NO: 304278 - RNA, 19 nt, Homo sapiens
guaaagauccucuggaaaa

SEQ ID NO: 304279 - RNA, 19 nt, Homo sapiens
gaacuuugaccagauguug

SEQ ID NO: 304280 - RNA, 19 nt, Homo sapiens
ggcaauggcacuacaugua

SEQ ID NO: 304281 - RNA, 19 nt, Homo sapiens
ccaucgaccucgucauuga

SEQ ID NO: 304282 - RNA, 19 nt, Homo sapiens
caauacaaguacuaagguu

SEQ ID NO: 304283 - RNA, 19 nt, Homo sapiens
gagacugugguauauauuu

SEQ ID NO: 304284 - RNA, 19 nt, Homo sapiens
gccguuauguugccucaaa

SEQ ID NO: 304285 - RNA, 19 nt, Homo sapiens
acaauucuguccauguaaa

SEQ ID NO: 304286 - RNA, 19 nt, Homo sapiens
gaggaccaaugcaacaaga

SEQ ID NO: 304287 - RNA, 19 nt, Homo sapiens
gaugauacaagcaauacaa

SEQ ID NO: 304288 - RNA, 19 nt, Homo sapiens
gagcaagagaauacuguaa

SEQ ID NO: 304289 - RNA, 19 nt, Homo sapiens
gcgcaagacacaggacuua

SEQ ID NO: 304290 - RNA, 19 nt, Homo sapiens
uauaguucgugcuucauaa

SEQ ID NO: 304291 - RNA, 19 nt, Homo sapiens
ggagagacugugguauaua

SEQ ID NO: 304292 - RNA, 19 nt, Homo sapiens
gaacuccagcuucaagaau

SEQ ID NO: 304293 - RNA, 19 nt, Homo sapiens
cccacacccuacucaauua

SEQ ID NO: 304294 - RNA, 19 nt, Homo sapiens
guauguccaugaauucuuc

SEQ ID NO: 304295 - RNA, 19 nt, Homo sapiens
ccacaauguuaaauucugu

SEQ ID NO: 304296 - RNA, 19 nt, Homo sapiens
cccaaugcauucauauuug

SEQ ID NO: 304297 - RNA, 19 nt, Homo sapiens
guacaggugacgaugauga

SEQ ID NO: 304298 - RNA, 19 nt, Homo sapiens
gaaaaugcuguuaccuuua

SEQ ID NO: 304299 - RNA, 19 nt, Homo sapiens
ccaaggagcagcauauagu

SEQ ID NO: 304300 - RNA, 19 nt, Homo sapiens
acgaugagcugccccauua

SEQ ID NO: 304301 - RNA, 19 nt, Homo sapiens
ggucauugaaccauaacua

SEQ ID NO: 304302 - RNA, 19 nt, Homo sapiens
ccgaagagcagaagaaaca

SEQ ID NO: 304303 - RNA, 19 nt, Homo sapiens
agacaacaguguagcuuca

SEQ ID NO: 304304 - RNA, 19 nt, Homo sapiens
agaaaaugcuguuaccuuu

SEQ ID NO: 304305 - RNA, 19 nt, Homo sapiens
cagcacguguuccucacua

SEQ ID NO: 304306 - RNA, 19 nt, Homo sapiens
ggccuuuguuccuccauaa

SEQ ID NO: 304307 - RNA, 19 nt, Homo sapiens
gcaagacacaggacuuaca

SEQ ID NO: 304308 - RNA, 19 nt, Homo sapiens
gagcuggacaauuugauga

SEQ ID NO: 304309 - RNA, 19 nt, Homo sapiens
agaaacaguuagcgcaaga

SEQ ID NO: 304310 - RNA, 19 nt, Homo sapiens
gaucugcuguggaauuggu

SEQ ID NO: 304311 - RNA, 19 nt, Homo sapiens
gauguugacacuuaauaug

SEQ ID NO: 304312 - RNA, 19 nt, Homo sapiens
gggcauggaugggcaaugg

SEQ ID NO: 304313 - RNA, 19 nt, Homo sapiens
agacacaggacuuacaauu

SEQ ID NO: 304314 - RNA, 19 nt, Homo sapiens
cagaucugcuguggaauug

SEQ ID NO: 304315 - RNA, 19 nt, Homo sapiens
gaaccauaacuaggacuuu

SEQ ID NO: 304316 - RNA, 19 nt, Homo sapiens
acugugacguuauguuaaa

SEQ ID NO: 304317 - RNA, 19 nt, Homo sapiens
ggagcaagagaauacugua

SEQ ID NO: 304318 - RNA, 19 nt, Homo sapiens
acuaggacuuuaucagaaa

SEQ ID NO: 304319 - RNA, 19 nt, Homo sapiens
guacauuucuguugaucac

SEQ ID NO: 304320 - RNA, 19 nt, Homo sapiens
agacagcugugauuauuuu

SEQ ID NO: 304321 - RNA, 19 nt, Homo sapiens
gcggacagguuauggacau

SEQ ID NO: 304322 - RNA, 19 nt, Homo sapiens
gagccaaggagcagcauau

SEQ ID NO: 304323 - RNA, 19 nt, Homo sapiens
uguuagcucuggucuuuga

SEQ ID NO: 304324 - RNA, 19 nt, Homo sapiens
ccaaaguagcaacaaauau

SEQ ID NO: 304325 - RNA, 19 nt, Homo sapiens
gcccaucgaccucgucauu

SEQ ID NO: 304326 - RNA, 19 nt, Homo sapiens
ugaggacugugacguuaug

SEQ ID NO: 304327 - RNA, 19 nt, Homo sapiens
gcucuggucuuugagaagu

SEQ ID NO: 304328 - RNA, 19 nt, Homo sapiens
gcaauacaaguacuaaggu

SEQ ID NO: 304329 - RNA, 19 nt, Homo sapiens
uaucagaaacucaaagcuu

SEQ ID NO: 304330 - RNA, 19 nt, Homo sapiens
gacagguuauggacauuca

SEQ ID NO: 304331 - RNA, 19 nt, Homo sapiens
uaaccuucaucauguaaag

SEQ ID NO: 304332 - RNA, 19 nt, Homo sapiens
uaguacagcccaugauuga

SEQ ID NO: 304333 - RNA, 19 nt, Homo sapiens
gacacaggacuuacaauuc

SEQ ID NO: 304334 - RNA, 19 nt, Homo sapiens
caagacacaggacuuacaa

SEQ ID NO: 304335 - RNA, 19 nt, Homo sapiens
caaaucucgcugaccauaa

SEQ ID NO: 304336 - RNA, 19 nt, Homo sapiens
ucagaucugcuguggaauu

SEQ ID NO: 304337 - RNA, 19 nt, Homo sapiens
gagaauacuguaacaaacu

SEQ ID NO: 304338 - RNA, 19 nt, Homo sapiens
ucaaagagcuugccaauga

SEQ ID NO: 304339 - RNA, 19 nt, Homo sapiens
ggaauccgcugcuaaauaa

SEQ ID NO: 304340 - RNA, 19 nt, Homo sapiens
guacuaagguuucaucuuu

SEQ ID NO: 304341 - RNA, 19 nt, Homo sapiens
gaccagauguugacacuua

SEQ ID NO: 304342 - RNA, 19 nt, Homo sapiens
gcuguuaccuuuaagcuuu

SEQ ID NO: 304343 - RNA, 19 nt, Homo sapiens
caagucagaucaugaagaa

SEQ ID NO: 304344 - RNA, 19 nt, Homo sapiens
ggacugugacguuauguua

SEQ ID NO: 304345 - RNA, 19 nt, Homo sapiens
gagagacugugguauauau

SEQ ID NO: 304346 - RNA, 19 nt, Homo sapiens
uaagggaacucaagggaaa

SEQ ID NO: 304347 - RNA, 19 nt, Homo sapiens
uaucagaucugcuguggaa

SEQ ID NO: 304348 - RNA, 19 nt, Homo sapiens
ccagacagcugugauuauu

SEQ ID NO: 304349 - RNA, 19 nt, Homo sapiens
ggacauucaugcccaauag

SEQ ID NO: 304350 - RNA, 19 nt, Homo sapiens
gcaauggcacuacauguaa

SEQ ID NO: 304351 - RNA, 19 nt, Homo sapiens
gauacaagcaauacaagua

SEQ ID NO: 304352 - RNA, 19 nt, Homo sapiens
guacagaguucggucuauu

SEQ ID NO: 304353 - RNA, 19 nt, Homo sapiens
agaguucggucuauuaauu

SEQ ID NO: 304354 - RNA, 19 nt, Homo sapiens
gcaagagaauacuguaaca

SEQ ID NO: 304355 - RNA, 19 nt, Homo sapiens
gggaauccgcugcuaaaua

SEQ ID NO: 304356 - RNA, 19 nt, Homo sapiens
guaacaaacuucguacaga

SEQ ID NO: 304357 - RNA, 19 nt, Homo sapiens
guaaagcaaucgcaaagca

SEQ ID NO: 304358 - RNA, 19 nt, Homo sapiens
gaaccacacuggagaucau

SEQ ID NO: 304359 - RNA, 19 nt, Homo sapiens
guguuuaccucaauugaaa

SEQ ID NO: 304360 - RNA, 19 nt, Homo sapiens
gcaacaagaacacaaaugu

SEQ ID NO: 304361 - RNA, 19 nt, Homo sapiens
gaaaucaugggcugacuga

SEQ ID NO: 304362 - RNA, 19 nt, Homo sapiens
ggaaugggcaugaauaugg

SEQ ID NO: 304363 - RNA, 19 nt, Homo sapiens
gguauuguauguccaugaa

SEQ ID NO: 304364 - RNA, 19 nt, Homo sapiens
caaagagcuugccaaugaa

SEQ ID NO: 304365 - RNA, 19 nt, Homo sapiens
uaugaggacugugacguua

SEQ ID NO: 304366 - RNA, 19 nt, Homo sapiens
gcugcucgcugcuugauga

SEQ ID NO: 304367 - RNA, 19 nt, Homo sapiens
uaacuaggacuuuaucaga

SEQ ID NO: 304368 - RNA, 19 nt, Homo sapiens
uauguugccucaaauaguu

SEQ ID NO: 304369 - RNA, 19 nt, Homo sapiens
caacagaggaccaaugcaa

SEQ ID NO: 304370 - RNA, 19 nt, Homo sapiens
gcacagagccccacaaugu

SEQ ID NO: 304371 - RNA, 19 nt, Homo sapiens
caaaguagcaacaaauauc

SEQ ID NO: 304372 - RNA, 19 nt, Homo sapiens
caggagagacugugguaua

SEQ ID NO: 304373 - RNA, 19 nt, Homo sapiens
gaccauaacccuucuucuu

SEQ ID NO: 304374 - RNA, 19 nt, Homo sapiens
cagcuuuccucaacacaaa

SEQ ID NO: 304375 - RNA, 19 nt, Homo sapiens
acacaggacuuacaauucu

SEQ ID NO: 304376 - RNA, 19 nt, Homo sapiens
ggacaaggacgcgaucuau

SEQ ID NO: 304377 - RNA, 19 nt, Homo sapiens
uaauguuucuguacgauga

SEQ ID NO: 304378 - RNA, 19 nt, Homo sapiens
aaccauaacuaggacuuua

SEQ ID NO: 304379 - RNA, 19 nt, Homo sapiens
gcuugccaaugaagauuua

SEQ ID NO: 304380 - RNA, 19 nt, Homo sapiens
gcuggacaauuugaugaua

SEQ ID NO: 304381 - RNA, 19 nt, Homo sapiens
guaaagauccucuggaaaa

SEQ ID NO: 304382 - RNA, 19 nt, Homo sapiens
gaacuuugaccagauguug

SEQ ID NO: 304383 - RNA, 19 nt, Homo sapiens
ggcaauggcacuacaugua

SEQ ID NO: 304384 - RNA, 19 nt, Homo sapiens
ccaucgaccucgucauuga

SEQ ID NO: 304385 - RNA, 19 nt, Homo sapiens
caauacaaguacuaagguu

SEQ ID NO: 304386 - RNA, 19 nt, Homo sapiens
gagacugugguauauauuu

SEQ ID NO: 304387 - RNA, 19 nt, Homo sapiens
gccguuauguugccucaaa

SEQ ID NO: 304388 - RNA, 19 nt, Homo sapiens
acaauucuguccauguaaa

SEQ ID NO: 304389 - RNA, 19 nt, Homo sapiens
gaggaccaaugcaacaaga

SEQ ID NO: 304390 - RNA, 19 nt, Homo sapiens
gaugauacaagcaauacaa

SEQ ID NO: 304391 - RNA, 19 nt, Homo sapiens
gagcaagagaauacuguaa

SEQ ID NO: 304392 - RNA, 19 nt, Homo sapiens
gcgcaagacacaggacuua

SEQ ID NO: 304393 - RNA, 19 nt, Homo sapiens
uauaguucgugcuucauaa

SEQ ID NO: 304394 - RNA, 19 nt, Homo sapiens
ggagagacugugguauaua

SEQ ID NO: 304395 - RNA, 19 nt, Homo sapiens
gaacuccagcuucaagaau

SEQ ID NO: 304396 - RNA, 19 nt, Homo sapiens
cccacacccuacucaauua

SEQ ID NO: 304397 - RNA, 19 nt, Homo sapiens
guauguccaugaauucuuc

SEQ ID NO: 304398 - RNA, 19 nt, Homo sapiens
ccacaauguuaaauucugu

SEQ ID NO: 304399 - RNA, 19 nt, Homo sapiens
cccaaugcauucauauuug

SEQ ID NO: 304400 - RNA, 19 nt, Homo sapiens
ucucugaaauugacaagga

SEQ ID NO: 304401 - RNA, 19 nt, Homo sapiens
guacaggugacgaugauga

SEQ ID NO: 304402 - RNA, 19 nt, Homo sapiens
gaaaaugcuguuaccuuua

SEQ ID NO: 304403 - RNA, 19 nt, Homo sapiens
ccaaggagcagcauauagu

SEQ ID NO: 304404 - RNA, 19 nt, Homo sapiens
ggucauugaaccauaacua

SEQ ID NO: 304405 - RNA, 19 nt, Homo sapiens
ccgaagagcagaagaaaca

SEQ ID NO: 304406 - RNA, 19 nt, Homo sapiens
agacaacaguguagcuuca

SEQ ID NO: 304407 - RNA, 19 nt, Homo sapiens
acgaugagcugccccauua

SEQ ID NO: 304408 - RNA, 19 nt, Homo sapiens
agaaaaugcuguuaccuuu

SEQ ID NO: 304409 - RNA, 19 nt, Homo sapiens
cagcacguguuccucacua

SEQ ID NO: 304410 - RNA, 19 nt, Homo sapiens
ggccuuuguuccuccauaa

SEQ ID NO: 304411 - RNA, 19 nt, Homo sapiens
gcaagacacaggacuuaca

SEQ ID NO: 304412 - RNA, 19 nt, Homo sapiens
agaaacaguuagcgcaaga

SEQ ID NO: 304413 - RNA, 19 nt, Homo sapiens
gagcuggacaauuugauga

SEQ ID NO: 304414 - RNA, 19 nt, Homo sapiens
cuauggcucuggucuuuga

SEQ ID NO: 304415 - RNA, 19 nt, Homo sapiens
gaucugcuguggaauuggu

SEQ ID NO: 304416 - RNA, 19 nt, Homo sapiens
gauguugacacuuaauaug

SEQ ID NO: 304417 - RNA, 19 nt, Homo sapiens
gggcauggaugggcaaugg

SEQ ID NO: 304418 - RNA, 19 nt, Homo sapiens
agacacaggacuuacaauu

SEQ ID NO: 304419 - RNA, 19 nt, Homo sapiens
cagaucugcuguggaauug

SEQ ID NO: 304420 - RNA, 19 nt, Homo sapiens
gaaccauaacuaggacuuu

SEQ ID NO: 304421 - RNA, 19 nt, Homo sapiens
acugugacguuauguuaaa

SEQ ID NO: 304422 - RNA, 19 nt, Homo sapiens
ggagcaagagaauacugua

SEQ ID NO: 304423 - RNA, 19 nt, Homo sapiens
acuaggacuuuaucagaaa

SEQ ID NO: 304424 - RNA, 19 nt, Homo sapiens
guacauuucuguugaucac

SEQ ID NO: 304425 - RNA, 19 nt, Homo sapiens
agacagcugugauuauuuu

SEQ ID NO: 304426 - RNA, 19 nt, Homo sapiens
gcggacagguuauggacau

SEQ ID NO: 304427 - RNA, 19 nt, Homo sapiens
gagccaaggagcagcauau

SEQ ID NO: 304428 - RNA, 19 nt, Homo sapiens
ccaaaguagcaacaaauau

SEQ ID NO: 304429 - RNA, 19 nt, Homo sapiens
gcccaucgaccucgucauu

SEQ ID NO: 304430 - RNA, 19 nt, Homo sapiens
ugaggacugugacguuaug

SEQ ID NO: 304431 - RNA, 19 nt, Homo sapiens
uaucagaaacucaaagcuu

SEQ ID NO: 304432 - RNA, 19 nt, Homo sapiens
gacagguuauggacauuca

SEQ ID NO: 304433 - RNA, 19 nt, Homo sapiens
uaaccuucaucauguaaag

SEQ ID NO: 304434 - RNA, 19 nt, Homo sapiens
uaguacagcccaugauuga

SEQ ID NO: 304435 - RNA, 19 nt, Homo sapiens
gacacaggacuuacaauuc

SEQ ID NO: 304436 - RNA, 19 nt, Homo sapiens
caagacacaggacuuacaa

SEQ ID NO: 304437 - RNA, 19 nt, Homo sapiens
caaaucucgcugaccauaa

SEQ ID NO: 304438 - RNA, 19 nt, Homo sapiens
gauagaagcucaagcauga

SEQ ID NO: 304439 - RNA, 19 nt, Homo sapiens
gaaaagagcugaagguugu

SEQ ID NO: 304440 - RNA, 19 nt, Homo sapiens
aaacucagcuuuaugacaa

SEQ ID NO: 304441 - RNA, 19 nt, Homo sapiens
gauaugagaccaugaagaa

SEQ ID NO: 304442 - RNA, 19 nt, Homo sapiens
caaaugucaugcugccuua

SEQ ID NO: 304443 - RNA, 19 nt, Homo sapiens
uaaagaacuugcagcauga

SEQ ID NO: 304444 - RNA, 19 nt, Homo sapiens
ccaagcagguccaauuuga

SEQ ID NO: 304445 - RNA, 19 nt, Homo sapiens
gagcuucccugacaacaga

SEQ ID NO: 304446 - RNA, 19 nt, Homo sapiens
ggccuaggcugcauugaaa

SEQ ID NO: 304447 - RNA, 19 nt, Homo sapiens
gcaaacgccugcagacgau

SEQ ID NO: 304448 - RNA, 19 nt, Homo sapiens
gcccagagcuucccugaca

SEQ ID NO: 304449 - RNA, 19 nt, Homo sapiens
ggacagaaaccauaacagu

SEQ ID NO: 304450 - RNA, 19 nt, Homo sapiens
gcuuagaguuggccauauu

SEQ ID NO: 304451 - RNA, 19 nt, Homo sapiens
gaaacagcaucuccaagca

SEQ ID NO: 304452 - RNA, 19 nt, Homo sapiens
gagauccaguugcuaaaga

SEQ ID NO: 304453 - RNA, 19 nt, Homo sapiens
gggaaacucagcuuuauga

SEQ ID NO: 304454 - RNA, 19 nt, Homo sapiens
agacacaggucacucaaau

SEQ ID NO: 304455 - RNA, 19 nt, Homo sapiens
gacgugaacuugcuuccaa

SEQ ID NO: 304456 - RNA, 19 nt, Homo sapiens
gaaucaaguucgagcacaa

SEQ ID NO: 304457 - RNA, 19 nt, Homo sapiens
caacagacaggaauacuca

SEQ ID NO: 304458 - RNA, 19 nt, Homo sapiens
gagaagacccugaccaucu

SEQ ID NO: 304459 - RNA, 19 nt, Homo sapiens
caaggugacaacaguauuu

SEQ ID NO: 304460 - RNA, 19 nt, Homo sapiens
ggaguugucauuaaaggaa

SEQ ID NO: 304461 - RNA, 19 nt, Homo sapiens
gcacaaggugacaacagua

SEQ ID NO: 304462 - RNA, 19 nt, Homo sapiens
gcacaaauggcgagaacau

SEQ ID NO: 304463 - RNA, 19 nt, Homo sapiens
cuacagugauggcagaaga

SEQ ID NO: 304464 - RNA, 19 nt, Homo sapiens
ucaaugcaguugucucugu

SEQ ID NO: 304465 - RNA, 19 nt, Homo sapiens
gguaugaagaguguuauuu

SEQ ID NO: 304466 - RNA, 19 nt, Homo sapiens
gagcacaaauggcgagaac

SEQ ID NO: 304467 - RNA, 19 nt, Homo sapiens
gacagaaaccauaacaguu

SEQ ID NO: 304468 - RNA, 19 nt, Homo sapiens
gaaacucagcuuuaugaca

SEQ ID NO: 304469 - RNA, 19 nt, Homo sapiens
gacaaccucuugaucuaca

SEQ ID NO: 304470 - RNA, 19 nt, Homo sapiens
uggacaaccucuugaucua

SEQ ID NO: 304471 - RNA, 19 nt, Homo sapiens
cgagggcuauggaaggaaa

SEQ ID NO: 304472 - RNA, 19 nt, Homo sapiens
ccaauuugauccagacagu

SEQ ID NO: 304473 - RNA, 19 nt, Homo sapiens
caaagacacaggucacuca

SEQ ID NO: 304474 - RNA, 19 nt, Homo sapiens
ccacaagccugagggaaag

SEQ ID NO: 304475 - RNA, 19 nt, Homo sapiens
gaugagcccugaggugauc

SEQ ID NO: 304476 - RNA, 19 nt, Homo sapiens
cacaaggacuacagugaug

SEQ ID NO: 304477 - RNA, 19 nt, Homo sapiens
uuucuaaacuggagacugu

SEQ ID NO: 304478 - RNA, 19 nt, Homo sapiens
aagaccaguugaaggcuua

SEQ ID NO: 304479 - RNA, 19 nt, Homo sapiens
gaagcaggcaccucucugu

SEQ ID NO: 304480 - RNA, 19 nt, Homo sapiens
caaagaugaaugaagcaaa

SEQ ID NO: 304481 - RNA, 19 nt, Homo sapiens
gaaaguacacgcggcagau

SEQ ID NO: 304482 - RNA, 19 nt, Homo sapiens
gaaaagccuuaggauauug

SEQ ID NO: 304483 - RNA, 19 nt, Homo sapiens
gaucuacauuacaugaaca

SEQ ID NO: 304484 - RNA, 19 nt, Homo sapiens
ugugaaauaugaagaugug

SEQ ID NO: 304485 - RNA, 19 nt, Homo sapiens
caaugcaguugucucuguu

SEQ ID NO: 304486 - RNA, 19 nt, Homo sapiens
acagaaaccauaacaguuc

SEQ ID NO: 304487 - RNA, 19 nt, Homo sapiens
gaguugucauuaaaggaaa

SEQ ID NO: 304488 - RNA, 19 nt, Homo sapiens
cuugggaguugucauuaaa

SEQ ID NO: 304489 - RNA, 19 nt, Homo sapiens
gaagggaaagcccauaugc

SEQ ID NO: 304490 - RNA, 19 nt, Homo sapiens
uugcacagcucauguacug

SEQ ID NO: 304491 - RNA, 19 nt, Homo sapiens
cagagagcgugacccgaaa

SEQ ID NO: 304492 - RNA, 19 nt, Homo sapiens
ggacgaacaggaggcauug

SEQ ID NO: 304493 - RNA, 19 nt, Homo sapiens
acaccagcaucaacaguga

SEQ ID NO: 304494 - RNA, 19 nt, Homo sapiens
gaacaggaggcauugaacu

SEQ ID NO: 304495 - RNA, 19 nt, Homo sapiens
agggaaagcccauaugcua

SEQ ID NO: 304496 - RNA, 19 nt, Homo sapiens
gggcagaguaugaagcuau

SEQ ID NO: 304497 - RNA, 19 nt, Homo sapiens
uggagaugcugacagagaa

SEQ ID NO: 304498 - RNA, 19 nt, Homo sapiens
ggaaugugccaaccaaguc

SEQ ID NO: 304499 - RNA, 19 nt, Homo sapiens
gaucgggaaacucagcuuu

SEQ ID NO: 304500 - RNA, 19 nt, Homo sapiens
acacaggucacucaaauag

SEQ ID NO: 304501 - RNA, 19 nt, Homo sapiens
acaaugagcucuccauccu

SEQ ID NO: 304502 - RNA, 19 nt, Homo sapiens
gggcaucucugggcuggau

SEQ ID NO: 304503 - RNA, 19 nt, Homo sapiens
gcagagugacgucagaauc

SEQ ID NO: 304504 - RNA, 19 nt, Homo sapiens
ugaacucaaucaugaacga

SEQ ID NO: 304505 - RNA, 19 nt, Homo sapiens
agaggaaugugccaaccaa

SEQ ID NO: 304506 - RNA, 19 nt, Homo sapiens
gacacaggucacucaaaua

SEQ ID NO: 304507 - RNA, 19 nt, Homo sapiens
ccagacaggugcggaucaa

SEQ ID NO: 304508 - RNA, 19 nt, Homo sapiens
ugaaaagccuuaggauauu

SEQ ID NO: 304509 - RNA, 19 nt, Homo sapiens
ccaguuuccuugggaguug

SEQ ID NO: 304510 - RNA, 19 nt, Homo sapiens
gggccuaggcugcauugaa

SEQ ID NO: 304511 - RNA, 19 nt, Homo sapiens
caggguaugaagaguguua

SEQ ID NO: 304512 - RNA, 19 nt, Homo sapiens
gccaggguaugaagagugu

SEQ ID NO: 304513 - RNA, 19 nt, Homo sapiens
agacucugcugggaaugua

SEQ ID NO: 304514 - RNA, 19 nt, Homo sapiens
gagcgugacccgaaaguac

SEQ ID NO: 304515 - RNA, 19 nt, Homo sapiens
ccacaaggacuacagugau

SEQ ID NO: 304516 - RNA, 19 nt, Homo sapiens
agacaggaauacucagauc

SEQ ID NO: 304517 - RNA, 19 nt, Homo sapiens
ggauaugagaccaugaaga

SEQ ID NO: 304518 - RNA, 19 nt, Homo sapiens
ccuugggaguugucauuaa

SEQ ID NO: 304519 - RNA, 19 nt, Homo sapiens
cagcugcccucccacaucu

SEQ ID NO: 304520 - RNA, 19 nt, Homo sapiens
ggcagaguaugaagcuaug

SEQ ID NO: 304521 - RNA, 19 nt, Homo sapiens
gcacugugguggagaugcu

SEQ ID NO: 304522 - RNA, 19 nt, Homo sapiens
ggcacacccuacuggauga

SEQ ID NO: 304523 - RNA, 19 nt, Homo sapiens
ggagugcgagauccaguug

SEQ ID NO: 304524 - RNA, 19 nt, Homo sapiens
gauggcagaagaacauuuc

SEQ ID NO: 304525 - RNA, 19 nt, Homo sapiens
cagcuuagaguuggccaua

SEQ ID NO: 304526 - RNA, 19 nt, Homo sapiens
uguggaggcucgccagaga

SEQ ID NO: 304527 - RNA, 19 nt, Homo sapiens
ucgggaaacucagcuuuau

SEQ ID NO: 304528 - RNA, 19 nt, Homo sapiens
cagagugacgucagaauca

SEQ ID NO: 304529 - RNA, 19 nt, Homo sapiens
aaaugugccuauugcuaga

SEQ ID NO: 304530 - RNA, 19 nt, Homo sapiens
caaaaugugccuauugcua

SEQ ID NO: 304531 - RNA, 19 nt, Homo sapiens
cuuaugcuguacccaguuu

SEQ ID NO: 304532 - RNA, 19 nt, Homo sapiens
gaucagcggcgagggcuau

SEQ ID NO: 304533 - RNA, 19 nt, Homo sapiens
ccgagacucugcugggaau

SEQ ID NO: 304534 - RNA, 19 nt, Homo sapiens
uguccuaccugcacagcaa

SEQ ID NO: 304535 - RNA, 19 nt, Homo sapiens
cgaauacggcgucaucaag

SEQ ID NO: 304536 - RNA, 19 nt, Homo sapiens
gaagaacauuuccccgaau

SEQ ID NO: 304537 - RNA, 19 nt, Homo sapiens
ggugacaacaguauuugga

SEQ ID NO: 304538 - RNA, 19 nt, Homo sapiens
gagcacaacuuucaaauua

SEQ ID NO: 304539 - RNA, 19 nt, Homo sapiens
gaacaaaucucugauccua

SEQ ID NO: 304540 - RNA, 19 nt, Homo sapiens
uaaagaagcugcauguuaa

SEQ ID NO: 304541 - RNA, 19 nt, Homo sapiens
gaaaugaggagaaagaaua

SEQ ID NO: 304542 - RNA, 19 nt, Homo sapiens
gaaaucaucaggucuguua

SEQ ID NO: 304543 - RNA, 19 nt, Homo sapiens
caacagagcgugaucauaa

SEQ ID NO: 304544 - RNA, 19 nt, Homo sapiens
ggaaauagcagcagaauuc

SEQ ID NO: 304545 - RNA, 19 nt, Homo sapiens
ggagagcugugcugaauuu

SEQ ID NO: 304546 - RNA, 19 nt, Homo sapiens
ggaaguggaugaauuaugu

SEQ ID NO: 304547 - RNA, 19 nt, Homo sapiens
gaagauaggagacaaauau

SEQ ID NO: 304548 - RNA, 19 nt, Homo sapiens
gaagaagaauggaauuuca

SEQ ID NO: 304549 - RNA, 19 nt, Homo sapiens
guaaugagccggaguauga

SEQ ID NO: 304550 - RNA, 19 nt, Homo sapiens
uaauggagcugcuagagua

SEQ ID NO: 304551 - RNA, 19 nt, Homo sapiens
guaaagauacugcuucuaa

SEQ ID NO: 304552 - RNA, 19 nt, Homo sapiens
ugaauuauguccugacuaa

SEQ ID NO: 304553 - RNA, 19 nt, Homo sapiens
caaaucagccuccacauaa

SEQ ID NO: 304554 - RNA, 19 nt, Homo sapiens
ggauuuaccuucauucgaa

SEQ ID NO: 304555 - RNA, 19 nt, Homo sapiens
gcaaaaggcugauuacuga

SEQ ID NO: 304556 - RNA, 19 nt, Homo sapiens
gagauucgauuucaaccua

SEQ ID NO: 304557 - RNA, 19 nt, Homo sapiens
gcacaacuuucaaauuaug

SEQ ID NO: 304558 - RNA, 19 nt, Homo sapiens
caaggaaacugcagacgaa

SEQ ID NO: 304559 - RNA, 19 nt, Homo sapiens
gaaaagagguaccgagaaa

SEQ ID NO: 304560 - RNA, 19 nt, Homo sapiens
uaaagaaguuguucguuug

SEQ ID NO: 304561 - RNA, 19 nt, Homo sapiens
gaaaggaccuggaaauagc

SEQ ID NO: 304562 - RNA, 19 nt, Homo sapiens
guacagugcucauucaugu

SEQ ID NO: 304563 - RNA, 19 nt, Homo sapiens
gaauaucauuggucaaguu

SEQ ID NO: 304564 - RNA, 19 nt, Homo sapiens
ccaucucucuugaguauua

SEQ ID NO: 304565 - RNA, 19 nt, Homo sapiens
gcaaauuccuggguuagaa

SEQ ID NO: 304566 - RNA, 19 nt, Homo sapiens
ugacacagaaggagaauua

SEQ ID NO: 304567 - RNA, 19 nt, Homo sapiens
ugaagaggaucuacauaaa

SEQ ID NO: 304568 - RNA, 19 nt, Homo sapiens
gaggagaagaguauuauuu

SEQ ID NO: 304569 - RNA, 19 nt, Homo sapiens
gagaaaggaccuggaaaua

SEQ ID NO: 304570 - RNA, 19 nt, Homo sapiens
gcaagaguccugaaucuga

SEQ ID NO: 304571 - RNA, 19 nt, Homo sapiens
gagcaaagaggacaagaaa

SEQ ID NO: 304572 - RNA, 19 nt, Homo sapiens
uuaaagaagcugcauguua

SEQ ID NO: 304573 - RNA, 19 nt, Homo sapiens
uaaaggaguuggaaaguag

SEQ ID NO: 304574 - RNA, 19 nt, Homo sapiens
guacauagaagcacuuuau

SEQ ID NO: 304575 - RNA, 19 nt, Homo sapiens
gaagucaguccgauuguuu

SEQ ID NO: 304576 - RNA, 19 nt, Homo sapiens
gaacuucggacacuaauca

SEQ ID NO: 304577 - RNA, 19 nt, Homo sapiens
ugauuaggcuguauucaaa

SEQ ID NO: 304578 - RNA, 19 nt, Homo sapiens
ucagacagcccauagauaa

SEQ ID NO: 304579 - RNA, 19 nt, Homo sapiens
ggacaccaccuucaucuga

SEQ ID NO: 304580 - RNA, 19 nt, Homo sapiens
gcacguauagcauugguaa

SEQ ID NO: 304581 - RNA, 19 nt, Homo sapiens
uuccauagcugcugaauug

SEQ ID NO: 304582 - RNA, 19 nt, Homo sapiens
uggagaauguggaagaaua

SEQ ID NO: 304583 - RNA, 19 nt, Homo sapiens
ggaugagagugaagaagaa

SEQ ID NO: 304584 - RNA, 19 nt, Homo sapiens
ggaaacugcagacgaauug

SEQ ID NO: 304585 - RNA, 19 nt, Homo sapiens
gagcuucgccuuuguuaga

SEQ ID NO: 304586 - RNA, 19 nt, Homo sapiens
ccaaaucagccuccacaua

SEQ ID NO: 304587 - RNA, 19 nt, Homo sapiens
gagagugacccaaagauga

SEQ ID NO: 304588 - RNA, 19 nt, Homo sapiens
gcagguggauaaucuuuua

SEQ ID NO: 304589 - RNA, 19 nt, Homo sapiens
aaugaagccuaguagaaua

SEQ ID NO: 304590 - RNA, 19 nt, Homo sapiens
gaaugaagccuaguagaau

SEQ ID NO: 304591 - RNA, 19 nt, Homo sapiens
gcagcagaauucaggcuuu

SEQ ID NO: 304592 - RNA, 19 nt, Homo sapiens
gcaaagggcacguauagca

SEQ ID NO: 304593 - RNA, 19 nt, Homo sapiens
gauuguagguuacucaaca

SEQ ID NO: 304594 - RNA, 19 nt, Homo sapiens
cagcagaucguuuaaaguu

SEQ ID NO: 304595 - RNA, 19 nt, Homo sapiens
gaaccugccuuuauuucag

SEQ ID NO: 304596 - RNA, 19 nt, Homo sapiens
ggaaaggacuguucaaaag

SEQ ID NO: 304597 - RNA, 19 nt, Homo sapiens
uuaagcagcuggugagaga

SEQ ID NO: 304598 - RNA, 19 nt, Homo sapiens
gcacucuguuugugguuaa

SEQ ID NO: 304599 - RNA, 19 nt, Homo sapiens
cagcacaccucgacagaug

SEQ ID NO: 304600 - RNA, 19 nt, Homo sapiens
cuaacgaacugaucugguu

SEQ ID NO: 304601 - RNA, 19 nt, Homo sapiens
gccagucggucuaauuuga

SEQ ID NO: 304602 - RNA, 19 nt, Homo sapiens
ccaaacaucagaggaauaa

SEQ ID NO: 304603 - RNA, 19 nt, Homo sapiens
ggagaaagaauaucauugg

SEQ ID NO: 304604 - RNA, 19 nt, Homo sapiens
gcaauugaaccugccuuua

SEQ ID NO: 304605 - RNA, 19 nt, Homo sapiens
caucaggucuguuauagag

SEQ ID NO: 304606 - RNA, 19 nt, Homo sapiens
ggaaugcugcugaaaucua

SEQ ID NO: 304607 - RNA, 19 nt, Homo sapiens
gaauggaauuucaccaaag

SEQ ID NO: 304608 - RNA, 19 nt, Homo sapiens
uuaaaggaguuggaaagua

SEQ ID NO: 304609 - RNA, 19 nt, Homo sapiens
uugcacagaugaagaauga

SEQ ID NO: 304610 - RNA, 19 nt, Homo sapiens
gcugaaaucuacaggaagu

SEQ ID NO: 304611 - RNA, 19 nt, Homo sapiens
guauagcauugguaaagaa

SEQ ID NO: 304612 - RNA, 19 nt, Homo sapiens
caagccaucccagauauua

SEQ ID NO: 304613 - RNA, 19 nt, Homo sapiens
caaagcagaucaccauugc

SEQ ID NO: 304614 - RNA, 19 nt, Homo sapiens
guaccucgaugccauagug

SEQ ID NO: 304615 - RNA, 19 nt, Homo sapiens
caauugaaccugccuuuau

SEQ ID NO: 304616 - RNA, 19 nt, Homo sapiens
gcccggaaguggaugaauu

SEQ ID NO: 304617 - RNA, 19 nt, Homo sapiens
gcaugcagguggauaaucu

SEQ ID NO: 304618 - RNA, 19 nt, Homo sapiens
uuagagaccuccuggaugu

SEQ ID NO: 304619 - RNA, 19 nt, Homo sapiens
ucaagcaucgcauaguuua

SEQ ID NO: 304620 - RNA, 19 nt, Homo sapiens
gaaaucagacagcccauag

SEQ ID NO: 304621 - RNA, 19 nt, Homo sapiens
gccagagggucucauuuga

SEQ ID NO: 304622 - RNA, 19 nt, Homo sapiens
gcagaucguuuaaaguuuu

SEQ ID NO: 304623 - RNA, 19 nt, Homo sapiens
gcaagcugcagguuuguaa

SEQ ID NO: 304624 - RNA, 19 nt, Homo sapiens
cauaaagacugugcugaga

SEQ ID NO: 304625 - RNA, 19 nt, Homo sapiens
gaagcaugcagguggauaa

SEQ ID NO: 304626 - RNA, 19 nt, Homo sapiens
gcacuuggauuugcuaaaa

SEQ ID NO: 304627 - RNA, 19 nt, Homo sapiens
caggagagcugugcugaau

SEQ ID NO: 304628 - RNA, 19 nt, Homo sapiens
acaaagcacugaagcagau

SEQ ID NO: 304629 - RNA, 19 nt, Homo sapiens
caaaagaaguuguaguguu

SEQ ID NO: 304630 - RNA, 19 nt, Homo sapiens
ugacaucagcguaguguuu

SEQ ID NO: 304631 - RNA, 19 nt, Homo sapiens
ccauaagacuaucaaggaa

SEQ ID NO: 304632 - RNA, 19 nt, Homo sapiens
ggugcaaauuccuggguua

SEQ ID NO: 304633 - RNA, 19 nt, Homo sapiens
caaagccacuccuggaaca

SEQ ID NO: 304634 - RNA, 19 nt, Homo sapiens
uaaccgaucuaacgaacug

SEQ ID NO: 304635 - RNA, 19 nt, Homo sapiens
cauuaaaggugccaauauc

SEQ ID NO: 304636 - RNA, 19 nt, Homo sapiens
caggaaugcugcugaaauc

SEQ ID NO: 304637 - RNA, 19 nt, Homo sapiens
agaauggaauuucaccaaa

SEQ ID NO: 304638 - RNA, 19 nt, Homo sapiens
gagcacaacuuucaaauua

SEQ ID NO: 304639 - RNA, 19 nt, Homo sapiens
gaacaaaucucugauccua

SEQ ID NO: 304640 - RNA, 19 nt, Homo sapiens
uaaagaagcugcauguuaa

SEQ ID NO: 304641 - RNA, 19 nt, Homo sapiens
gaaaugaggagaaagaaua

SEQ ID NO: 304642 - RNA, 19 nt, Homo sapiens
gaaaucaucaggucuguua

SEQ ID NO: 304643 - RNA, 19 nt, Homo sapiens
caacagagcgugaucauaa

SEQ ID NO: 304644 - RNA, 19 nt, Homo sapiens
ggaaauagcagcagaauuc

SEQ ID NO: 304645 - RNA, 19 nt, Homo sapiens
ggagagcugugcugaauuu

SEQ ID NO: 304646 - RNA, 19 nt, Homo sapiens
ggaaguggaugaauuaugu

SEQ ID NO: 304647 - RNA, 19 nt, Homo sapiens
gaagauaggagacaaauau

SEQ ID NO: 304648 - RNA, 19 nt, Homo sapiens
gaagaagaauggaauuuca

SEQ ID NO: 304649 - RNA, 19 nt, Homo sapiens
guaaugagccggaguauga

SEQ ID NO: 304650 - RNA, 19 nt, Homo sapiens
uaauggagcugcuagagua

SEQ ID NO: 304651 - RNA, 19 nt, Homo sapiens
guaaagauacugcuucuaa

SEQ ID NO: 304652 - RNA, 19 nt, Homo sapiens
ugaauuauguccugacuaa

SEQ ID NO: 304653 - RNA, 19 nt, Homo sapiens
caaaucagccuccacauaa

SEQ ID NO: 304654 - RNA, 19 nt, Homo sapiens
ggauuuaccuucauucgaa

SEQ ID NO: 304655 - RNA, 19 nt, Homo sapiens
gcaaaaggcugauuacuga

SEQ ID NO: 304656 - RNA, 19 nt, Homo sapiens
gagauucgauuucaaccua

SEQ ID NO: 304657 - RNA, 19 nt, Homo sapiens
gcacaacuuucaaauuaug

SEQ ID NO: 304658 - RNA, 19 nt, Homo sapiens
caaggaaacugcagacgaa

SEQ ID NO: 304659 - RNA, 19 nt, Homo sapiens
gaaaagagguaccgagaaa

SEQ ID NO: 304660 - RNA, 19 nt, Homo sapiens
uaaagaaguuguucguuug

SEQ ID NO: 304661 - RNA, 19 nt, Homo sapiens
gaaaggaccuggaaauagc

SEQ ID NO: 304662 - RNA, 19 nt, Homo sapiens
guacagugcucauucaugu

SEQ ID NO: 304663 - RNA, 19 nt, Homo sapiens
gaauaucauuggucaaguu

SEQ ID NO: 304664 - RNA, 19 nt, Homo sapiens
ccaucucucuugaguauua

SEQ ID NO: 304665 - RNA, 19 nt, Homo sapiens
gcaaauuccuggguuagaa

SEQ ID NO: 304666 - RNA, 19 nt, Homo sapiens
ugacacagaaggagaauua

SEQ ID NO: 304667 - RNA, 19 nt, Homo sapiens
ugaagaggaucuacauaaa

SEQ ID NO: 304668 - RNA, 19 nt, Homo sapiens
gaggagaagaguauuauuu

SEQ ID NO: 304669 - RNA, 19 nt, Homo sapiens
gagaaaggaccuggaaaua

SEQ ID NO: 304670 - RNA, 19 nt, Homo sapiens
gcaagaguccugaaucuga

SEQ ID NO: 304671 - RNA, 19 nt, Homo sapiens
gagcaaagaggacaagaaa

SEQ ID NO: 304672 - RNA, 19 nt, Homo sapiens
uuaaagaagcugcauguua

SEQ ID NO: 304673 - RNA, 19 nt, Homo sapiens
uaaaggaguuggaaaguag

SEQ ID NO: 304674 - RNA, 19 nt, Homo sapiens
guacauagaagcacuuuau

SEQ ID NO: 304675 - RNA, 19 nt, Homo sapiens
gaagucaguccgauuguuu

SEQ ID NO: 304676 - RNA, 19 nt, Homo sapiens
gaacuucggacacuaauca

SEQ ID NO: 304677 - RNA, 19 nt, Homo sapiens
ugauuaggcuguauucaaa

SEQ ID NO: 304678 - RNA, 19 nt, Homo sapiens
ucagacagcccauagauaa

SEQ ID NO: 304679 - RNA, 19 nt, Homo sapiens
ggacaccaccuucaucuga

SEQ ID NO: 304680 - RNA, 19 nt, Homo sapiens
gcacguauagcauugguaa

SEQ ID NO: 304681 - RNA, 19 nt, Homo sapiens
uuccauagcugcugaauug

SEQ ID NO: 304682 - RNA, 19 nt, Homo sapiens
uggagaauguggaagaaua

SEQ ID NO: 304683 - RNA, 19 nt, Homo sapiens
ggaugagagugaagaagaa

SEQ ID NO: 304684 - RNA, 19 nt, Homo sapiens
ggaaacugcagacgaauug

SEQ ID NO: 304685 - RNA, 19 nt, Homo sapiens
gagcuucgccuuuguuaga

SEQ ID NO: 304686 - RNA, 19 nt, Homo sapiens
ccaaaucagccuccacaua

SEQ ID NO: 304687 - RNA, 19 nt, Homo sapiens
gagagugacccaaagauga

SEQ ID NO: 304688 - RNA, 19 nt, Homo sapiens
gcagguggauaaucuuuua

SEQ ID NO: 304689 - RNA, 19 nt, Homo sapiens
aaugaagccuaguagaaua

SEQ ID NO: 304690 - RNA, 19 nt, Homo sapiens
gaaugaagccuaguagaau

SEQ ID NO: 304691 - RNA, 19 nt, Homo sapiens
gcagcagaauucaggcuuu

SEQ ID NO: 304692 - RNA, 19 nt, Homo sapiens
gcaaagggcacguauagca

SEQ ID NO: 304693 - RNA, 19 nt, Homo sapiens
gauuguagguuacucaaca

SEQ ID NO: 304694 - RNA, 19 nt, Homo sapiens
cagcagaucguuuaaaguu

SEQ ID NO: 304695 - RNA, 19 nt, Homo sapiens
gaaccugccuuuauuucag

SEQ ID NO: 304696 - RNA, 19 nt, Homo sapiens
ggaaaggacuguucaaaag

SEQ ID NO: 304697 - RNA, 19 nt, Homo sapiens
uuaagcagcuggugagaga

SEQ ID NO: 304698 - RNA, 19 nt, Homo sapiens
gcacucuguuugugguuaa

SEQ ID NO: 304699 - RNA, 19 nt, Homo sapiens
cagcacaccucgacagaug

SEQ ID NO: 304700 - RNA, 19 nt, Homo sapiens
cuaacgaacugaucugguu

SEQ ID NO: 304701 - RNA, 19 nt, Homo sapiens
gccagucggucuaauuuga

SEQ ID NO: 304702 - RNA, 19 nt, Homo sapiens
ccaaacaucagaggaauaa

SEQ ID NO: 304703 - RNA, 19 nt, Homo sapiens
ggagaaagaauaucauugg

SEQ ID NO: 304704 - RNA, 19 nt, Homo sapiens
gcaauugaaccugccuuua

SEQ ID NO: 304705 - RNA, 19 nt, Homo sapiens
caucaggucuguuauagag

SEQ ID NO: 304706 - RNA, 19 nt, Homo sapiens
ggaaugcugcugaaaucua

SEQ ID NO: 304707 - RNA, 19 nt, Homo sapiens
gaauggaauuucaccaaag

SEQ ID NO: 304708 - RNA, 19 nt, Homo sapiens
uuaaaggaguuggaaagua

SEQ ID NO: 304709 - RNA, 19 nt, Homo sapiens
uugcacagaugaagaauga

SEQ ID NO: 304710 - RNA, 19 nt, Homo sapiens
gcugaaaucuacaggaagu

SEQ ID NO: 304711 - RNA, 19 nt, Homo sapiens
guauagcauugguaaagaa

SEQ ID NO: 304712 - RNA, 19 nt, Homo sapiens
caagccaucccagauauua

SEQ ID NO: 304713 - RNA, 19 nt, Homo sapiens
caaagcagaucaccauugc

SEQ ID NO: 304714 - RNA, 19 nt, Homo sapiens
guaccucgaugccauagug

SEQ ID NO: 304715 - RNA, 19 nt, Homo sapiens
caauugaaccugccuuuau

SEQ ID NO: 304716 - RNA, 19 nt, Homo sapiens
gcccggaaguggaugaauu

SEQ ID NO: 304717 - RNA, 19 nt, Homo sapiens
gcaugcagguggauaaucu

SEQ ID NO: 304718 - RNA, 19 nt, Homo sapiens
uuagagaccuccuggaugu

SEQ ID NO: 304719 - RNA, 19 nt, Homo sapiens
ucaagcaucgcauaguuua

SEQ ID NO: 304720 - RNA, 19 nt, Homo sapiens
gaaaucagacagcccauag

SEQ ID NO: 304721 - RNA, 19 nt, Homo sapiens
gccagagggucucauuuga

SEQ ID NO: 304722 - RNA, 19 nt, Homo sapiens
gcagaucguuuaaaguuuu

SEQ ID NO: 304723 - RNA, 19 nt, Homo sapiens
gcaagcugcagguuuguaa

SEQ ID NO: 304724 - RNA, 19 nt, Homo sapiens
cauaaagacugugcugaga

SEQ ID NO: 304725 - RNA, 19 nt, Homo sapiens
gaagcaugcagguggauaa

SEQ ID NO: 304726 - RNA, 19 nt, Homo sapiens
gcacuuggauuugcuaaaa

SEQ ID NO: 304727 - RNA, 19 nt, Homo sapiens
caggagagcugugcugaau

SEQ ID NO: 304728 - RNA, 19 nt, Homo sapiens
acaaagcacugaagcagau

SEQ ID NO: 304729 - RNA, 19 nt, Homo sapiens
caaaagaaguuguaguguu

SEQ ID NO: 304730 - RNA, 19 nt, Homo sapiens
ugacaucagcguaguguuu

SEQ ID NO: 304731 - RNA, 19 nt, Homo sapiens
ccauaagacuaucaaggaa

SEQ ID NO: 304732 - RNA, 19 nt, Homo sapiens
ggugcaaauuccuggguua

SEQ ID NO: 304733 - RNA, 19 nt, Homo sapiens
caaagccacuccuggaaca

SEQ ID NO: 304734 - RNA, 19 nt, Homo sapiens
uaaccgaucuaacgaacug

SEQ ID NO: 304735 - RNA, 19 nt, Homo sapiens
cauuaaaggugccaauauc

SEQ ID NO: 304736 - RNA, 19 nt, Homo sapiens
caggaaugcugcugaaauc

SEQ ID NO: 304737 - RNA, 19 nt, Homo sapiens
agaauggaauuucaccaaa

SEQ ID NO: 304738 - RNA, 19 nt, Homo sapiens
caggaaagcucguaauuua

SEQ ID NO: 304739 - RNA, 19 nt, Homo sapiens
gaacagccuucaaaucaaa

SEQ ID NO: 304740 - RNA, 19 nt, Homo sapiens
ggaaagcucguaauuuaua

SEQ ID NO: 304741 - RNA, 19 nt, Homo sapiens
gauguucucuacuauguua

SEQ ID NO: 304742 - RNA, 19 nt, Homo sapiens
gcaaauacuggaaggauua

SEQ ID NO: 304743 - RNA, 19 nt, Homo sapiens
gaagaaauagcauugcaua

SEQ ID NO: 304744 - RNA, 19 nt, Homo sapiens
gaacuaaggccacauuuca

SEQ ID NO: 304745 - RNA, 19 nt, Homo sapiens
cagcagauauugucauaaa

SEQ ID NO: 304746 - RNA, 19 nt, Homo sapiens
gaaauagcauugcauaaac

SEQ ID NO: 304747 - RNA, 19 nt, Homo sapiens
uaaguagucuucuugguaa

SEQ ID NO: 304748 - RNA, 19 nt, Homo sapiens
gcacaaauacugaagauuc

SEQ ID NO: 304749 - RNA, 19 nt, Homo sapiens
gaauggagcugaugaagac

SEQ ID NO: 304750 - RNA, 19 nt, Homo sapiens
ucaagaugcugucaauaaa

SEQ ID NO: 304751 - RNA, 19 nt, Homo sapiens
guauauggcaccagaaaua

SEQ ID NO: 304752 - RNA, 19 nt, Homo sapiens
gggaaucuauacucaauga

SEQ ID NO: 304753 - RNA, 19 nt, Homo sapiens
gaaauuuccuaacuacauc

SEQ ID NO: 304754 - RNA, 19 nt, Homo sapiens
gguuagguuuccaguauua

SEQ ID NO: 304755 - RNA, 19 nt, Homo sapiens
gaaaccuaauggaaucuuu

SEQ ID NO: 304756 - RNA, 19 nt, Homo sapiens
gcuaacgacuugcuuguug

SEQ ID NO: 304757 - RNA, 19 nt, Homo sapiens
gcacuucagccaaauguuu

SEQ ID NO: 304758 - RNA, 19 nt, Homo sapiens
auacagagcugaucuucuu

SEQ ID NO: 304759 - RNA, 19 nt, Homo sapiens
ggaacagccuucaaaucaa

SEQ ID NO: 304760 - RNA, 19 nt, Homo sapiens
gaaggagacugugaaagug

SEQ ID NO: 304761 - RNA, 19 nt, Homo sapiens
gcacaugcuugaacuguag

SEQ ID NO: 304762 - RNA, 19 nt, Homo sapiens
uaaggacucuucauaagga

SEQ ID NO: 304763 - RNA, 19 nt, Homo sapiens
ggaaggcuaucauugacuu

SEQ ID NO: 304764 - RNA, 19 nt, Homo sapiens
ggaaggagacugugaaagu

SEQ ID NO: 304765 - RNA, 19 nt, Homo sapiens
ggacuaugauucuauugug

SEQ ID NO: 304766 - RNA, 19 nt, Homo sapiens
gaacaaaaccaaaauguga

SEQ ID NO: 304767 - RNA, 19 nt, Homo sapiens
gcaaagcgaaggacaaguu

SEQ ID NO: 304768 - RNA, 19 nt, Homo sapiens
caugguaccucaagucuau

SEQ ID NO: 304769 - RNA, 19 nt, Homo sapiens
acacuacagucaggaauua

SEQ ID NO: 304770 - RNA, 19 nt, Homo sapiens
gugacaauguguugauuaa

SEQ ID NO: 304771 - RNA, 19 nt, Homo sapiens
ucacaauucugaugauuuc

SEQ ID NO: 304772 - RNA, 19 nt, Homo sapiens
caauaaaguucuucggaau

SEQ ID NO: 304773 - RNA, 19 nt, Homo sapiens
ggacaaguugcuucagaua

SEQ ID NO: 304774 - RNA, 19 nt, Homo sapiens
gaaacucgacuuuggagaa

SEQ ID NO: 304775 - RNA, 19 nt, Homo sapiens
cagaauugcuauuaaggaa

SEQ ID NO: 304776 - RNA, 19 nt, Homo sapiens
caagucagaauugcuauua

SEQ ID NO: 304777 - RNA, 19 nt, Homo sapiens
caagaaagguauacaugag

SEQ ID NO: 304778 - RNA, 19 nt, Homo sapiens
ggacauaaagggugacaau

SEQ ID NO: 304779 - RNA, 19 nt, Homo sapiens
ggaaagagaaagaauuaca

SEQ ID NO: 304780 - RNA, 19 nt, Homo sapiens
acagagauauccaggacua

SEQ ID NO: 304781 - RNA, 19 nt, Homo sapiens
ugagaaaccuaauggaauc

SEQ ID NO: 304782 - RNA, 19 nt, Homo sapiens
gagcuacccuucacaggau

SEQ ID NO: 304783 - RNA, 19 nt, Homo sapiens
gccaaggcauucauacuga

SEQ ID NO: 304784 - RNA, 19 nt, Homo sapiens
gcaccagaaauaauagaua

SEQ ID NO: 304785 - RNA, 19 nt, Homo sapiens
cauaaagggugacaaugug

SEQ ID NO: 304786 - RNA, 19 nt, Homo sapiens
ggaguaugacuaugaauau

SEQ ID NO: 304787 - RNA, 19 nt, Homo sapiens
gugguuagguuuccaguau

SEQ ID NO: 304788 - RNA, 19 nt, Homo sapiens
ggagaaaggcgcugcacuu

SEQ ID NO: 304789 - RNA, 19 nt, Homo sapiens
aaagagaugucaagggaau

SEQ ID NO: 304790 - RNA, 19 nt, Homo sapiens
cuaaagcuauccauugugu

SEQ ID NO: 304791 - RNA, 19 nt, Homo sapiens
guaguaauguuagcuuguu

SEQ ID NO: 304792 - RNA, 19 nt, Homo sapiens
ucucugggcuguacaauca

SEQ ID NO: 304793 - RNA, 19 nt, Homo sapiens
acaaguugcuucagauaug

SEQ ID NO: 304794 - RNA, 19 nt, Homo sapiens
ccaacaacaucauccucua

SEQ ID NO: 304795 - RNA, 19 nt, Homo sapiens
caugauaacuccacauaac

SEQ ID NO: 304796 - RNA, 19 nt, Homo sapiens
ggcugaagauuauacacua

SEQ ID NO: 304797 - RNA, 19 nt, Homo sapiens
ucaucgagcuauugaagaa

SEQ ID NO: 304798 - RNA, 19 nt, Homo sapiens
gcucaccggucacugaaug

SEQ ID NO: 304799 - RNA, 19 nt, Homo sapiens
agacuuggauguagaagau

SEQ ID NO: 304800 - RNA, 19 nt, Homo sapiens
gcacuuaugggauagucua

SEQ ID NO: 304801 - RNA, 19 nt, Homo sapiens
gugacuugcuggaguauga

SEQ ID NO: 304802 - RNA, 19 nt, Homo sapiens
guucuacugugucucauga

SEQ ID NO: 304803 - RNA, 19 nt, Homo sapiens
gcacuggauguuugccuua

SEQ ID NO: 304804 - RNA, 19 nt, Homo sapiens
aaagaggcuugcuggcaua

SEQ ID NO: 304805 - RNA, 19 nt, Homo sapiens
cuaucaaccuucuuauuug

SEQ ID NO: 304806 - RNA, 19 nt, Homo sapiens
cuaaguagucuucuuggua

SEQ ID NO: 304807 - RNA, 19 nt, Homo sapiens
gauauguauugccuaguug

SEQ ID NO: 304808 - RNA, 19 nt, Homo sapiens
ccaggacuaugauucuauu

SEQ ID NO: 304809 - RNA, 19 nt, Homo sapiens
uuacuuuccuacagagaua

SEQ ID NO: 304810 - RNA, 19 nt, Homo sapiens
gcagauauugucauaaauc

SEQ ID NO: 304811 - RNA, 19 nt, Homo sapiens
ucggaaagagaaagaauua

SEQ ID NO: 304812 - RNA, 19 nt, Homo sapiens
gacaagagagccugugcua

SEQ ID NO: 304813 - RNA, 19 nt, Homo sapiens
cagcugaguuggcaagaau

SEQ ID NO: 304814 - RNA, 19 nt, Homo sapiens
gaaagcucguaauuuauac

SEQ ID NO: 304815 - RNA, 19 nt, Homo sapiens
uguuacacgugaugacuua

SEQ ID NO: 304816 - RNA, 19 nt, Homo sapiens
aaaucaaacuguccgaaga

SEQ ID NO: 304817 - RNA, 19 nt, Homo sapiens
gcugaagaaccgaaacuaa

SEQ ID NO: 304818 - RNA, 19 nt, Homo sapiens
aaacucgacuuuggagaaa

SEQ ID NO: 304819 - RNA, 19 nt, Homo sapiens
gcaaacaauuggcuuuuau

SEQ ID NO: 304820 - RNA, 19 nt, Homo sapiens
auaaacaccugaagcacaa

SEQ ID NO: 304821 - RNA, 19 nt, Homo sapiens
aaucuaaucuucgauggaa

SEQ ID NO: 304822 - RNA, 19 nt, Homo sapiens
uauuggauguucucuacua

SEQ ID NO: 304823 - RNA, 19 nt, Homo sapiens
gacggaagaccaagacaaa

SEQ ID NO: 304824 - RNA, 19 nt, Homo sapiens
gagcaaccaagucagaauu

SEQ ID NO: 304825 - RNA, 19 nt, Homo sapiens
ggacaccaguuugaaucuu

SEQ ID NO: 304826 - RNA, 19 nt, Homo sapiens
gaagguggcacaagcaagu

SEQ ID NO: 304827 - RNA, 19 nt, Homo sapiens
acacugaaauuuccuaacu

SEQ ID NO: 304828 - RNA, 19 nt, Homo sapiens
gaaacaaacagacuugacu

SEQ ID NO: 304829 - RNA, 19 nt, Homo sapiens
ggaagaauugguucggaaa

SEQ ID NO: 304830 - RNA, 19 nt, Homo sapiens
ucagagaauuugugagauc

SEQ ID NO: 304831 - RNA, 19 nt, Homo sapiens
aaaaggcacuuaugggaua

SEQ ID NO: 304832 - RNA, 19 nt, Homo sapiens
gggagugaguauuucuaaa

SEQ ID NO: 304833 - RNA, 19 nt, Homo sapiens
gacuaugauucuauuguga

SEQ ID NO: 304834 - RNA, 19 nt, Homo sapiens
gagauauccaggacuauga

SEQ ID NO: 304835 - RNA, 19 nt, Homo sapiens
caagagagccugugcuaac

SEQ ID NO: 304836 - RNA, 19 nt, Homo sapiens
gcuggaguaugacuaugaa

SEQ ID NO: 304837 - RNA, 19 nt, Homo sapiens
gaacaccauuaccgaagag

SEQ ID NO: 304838 - RNA, 19 nt, Homo sapiens
gaauuaaacugcagauaug

SEQ ID NO: 304839 - RNA, 19 nt, Homo sapiens
gaacaagugugaugugaau

SEQ ID NO: 304840 - RNA, 19 nt, Homo sapiens
gaacaccgccuuacucuga

SEQ ID NO: 304841 - RNA, 19 nt, Homo sapiens
gaacuggauucgcaacauu

SEQ ID NO: 304842 - RNA, 19 nt, Homo sapiens
ccagagauaucaaagcaaa

SEQ ID NO: 304843 - RNA, 19 nt, Homo sapiens
ggacacagccggucaggaa

SEQ ID NO: 304844 - RNA, 19 nt, Homo sapiens
ccauaggaauugacuuuaa

SEQ ID NO: 304845 - RNA, 19 nt, Homo sapiens
caaaggaaagcacaaauga

SEQ ID NO: 304846 - RNA, 19 nt, Homo sapiens
ggagauggaauaaguuaaa

SEQ ID NO: 304847 - RNA, 19 nt, Homo sapiens
gaagaccuguguccuguuc

SEQ ID NO: 304848 - RNA, 19 nt, Homo sapiens
caacauaucagcaauaguc

SEQ ID NO: 304849 - RNA, 19 nt, Homo sapiens
gcacagcagucuggcuuga

SEQ ID NO: 304850 - RNA, 19 nt, Homo sapiens
gauaaaugcacuuaaggaa

SEQ ID NO: 304851 - RNA, 19 nt, Homo sapiens
gcaauugagaaaucguuua

SEQ ID NO: 304852 - RNA, 19 nt, Homo sapiens
gaaauccuguguaaagcau

SEQ ID NO: 304853 - RNA, 19 nt, Homo sapiens
ggaaagcacaaaugaagga

SEQ ID NO: 304854 - RNA, 19 nt, Homo sapiens
caacuuuggagauggaaua

SEQ ID NO: 304855 - RNA, 19 nt, Homo sapiens
uggcgaagaccuacgauua

SEQ ID NO: 304856 - RNA, 19 nt, Homo sapiens
gggaacaagugugauguga

SEQ ID NO: 304857 - RNA, 19 nt, Homo sapiens
ggacaagugacaaaccauu

SEQ ID NO: 304858 - RNA, 19 nt, Homo sapiens
gaagcgauucugucuuuga

SEQ ID NO: 304859 - RNA, 19 nt, Homo sapiens
guagugccaugaagcgauu

SEQ ID NO: 304860 - RNA, 19 nt, Homo sapiens
guaaagcauugagaaggaa

SEQ ID NO: 304861 - RNA, 19 nt, Homo sapiens
agaaugcaauugagaaauc

SEQ ID NO: 304862 - RNA, 19 nt, Homo sapiens
augaagcgauucugucuuu

SEQ ID NO: 304863 - RNA, 19 nt, Homo sapiens
gggagagaguguaauaugg

SEQ ID NO: 304864 - RNA, 19 nt, Homo sapiens
gcgauucugucuuugacuu

SEQ ID NO: 304865 - RNA, 19 nt, Homo sapiens
ggacauggccaagacacaa

SEQ ID NO: 304866 - RNA, 19 nt, Homo sapiens
agagacaaguuuccaagga

SEQ ID NO: 304867 - RNA, 19 nt, Homo sapiens
uguaaagcauugagaagga

SEQ ID NO: 304868 - RNA, 19 nt, Homo sapiens
aagcacaaaugaaggaaau

SEQ ID NO: 304869 - RNA, 19 nt, Homo sapiens
gacaagugacaaaccauuu

SEQ ID NO: 304870 - RNA, 19 nt, Homo sapiens
gagcaaccagggagucaaa

SEQ ID NO: 304871 - RNA, 19 nt, Homo sapiens
guaauauggcgaagaccua

SEQ ID NO: 304872 - RNA, 19 nt, Homo sapiens
ccaaaggaaagcacaaaug

SEQ ID NO: 304873 - RNA, 19 nt, Homo sapiens
ggaacuggauucgcaacau

SEQ ID NO: 304874 - RNA, 19 nt, Homo sapiens
caccauaggaauugacuuu

SEQ ID NO: 304875 - RNA, 19 nt, Homo sapiens
aaucggacguucuuucuag

SEQ ID NO: 304876 - RNA, 19 nt, Homo sapiens
acagcagucuggcuugauu

SEQ ID NO: 304877 - RNA, 19 nt, Homo sapiens
ggaacaagugugaugugaa

SEQ ID NO: 304878 - RNA, 19 nt, Homo sapiens
gagaauuaaacugcagaua

SEQ ID NO: 304879 - RNA, 19 nt, Homo sapiens
aaaccaacauaucagcaau

SEQ ID NO: 304880 - RNA, 19 nt, Homo sapiens
gcgcgaaggccaacaucaa

SEQ ID NO: 304881 - RNA, 19 nt, Homo sapiens
gaucacaacggccuacuac

SEQ ID NO: 304882 - RNA, 19 nt, Homo sapiens
ccagaaugcaauugagaaa

SEQ ID NO: 304883 - RNA, 19 nt, Homo sapiens
ccaaaucggacguucuuuc

SEQ ID NO: 304884 - RNA, 19 nt, Homo sapiens
ggaaauccuguguaaagca

SEQ ID NO: 304885 - RNA, 19 nt, Homo sapiens
uuuaguaacugucugaucu

SEQ ID NO: 304886 - RNA, 19 nt, Homo sapiens
gcagaagaggagcagcuuu

SEQ ID NO: 304887 - RNA, 19 nt, Homo sapiens
ugaugugaaugacaagaga

SEQ ID NO: 304888 - RNA, 19 nt, Homo sapiens
uaaagcucaucuuaaaguc

SEQ ID NO: 304889 - RNA, 19 nt, Homo sapiens
aagcugcugucaauccaaa

SEQ ID NO: 304890 - RNA, 19 nt, Homo sapiens
gcauugagaaggaaagaag

SEQ ID NO: 304891 - RNA, 19 nt, Homo sapiens
cguuguauauucagagaga

SEQ ID NO: 304892 - RNA, 19 nt, Homo sapiens
uaguaacugucugaucuuu

SEQ ID NO: 304893 - RNA, 19 nt, Homo sapiens
cgccagagauaucaaagca

SEQ ID NO: 304894 - RNA, 19 nt, Homo sapiens
ccacccacacguuguauau

SEQ ID NO: 304895 - RNA, 19 nt, Homo sapiens
gaaugacaagagacaaguu

SEQ ID NO: 304896 - RNA, 19 nt, Homo sapiens
acaagugugaugugaauga

SEQ ID NO: 304897 - RNA, 19 nt, Homo sapiens
gaacgguuucggacgauca

SEQ ID NO: 304898 - RNA, 19 nt, Homo sapiens
cgauaaaugcacuuaagga

SEQ ID NO: 304899 - RNA, 19 nt, Homo sapiens
caaaucggacguucuuucu

SEQ ID NO: 304900 - RNA, 19 nt, Homo sapiens
gaaagcacaaaugaaggaa

SEQ ID NO: 304901 - RNA, 19 nt, Homo sapiens
ccgauguguucuucuguga

SEQ ID NO: 304902 - RNA, 19 nt, Homo sapiens
aaagcuggcccucgacuau

SEQ ID NO: 304903 - RNA, 19 nt, Homo sapiens
aaaggaaagcacaaaugaa

SEQ ID NO: 304904 - RNA, 19 nt, Homo sapiens
ccucugggccuuugcuuug

SEQ ID NO: 304905 - RNA, 19 nt, Homo sapiens
gaggaacaccgccuuacuc

SEQ ID NO: 304906 - RNA, 19 nt, Homo sapiens
cgacaucaccaacgagaag

SEQ ID NO: 304907 - RNA, 19 nt, Homo sapiens
cucgauggcaagagaauua

SEQ ID NO: 304908 - RNA, 19 nt, Homo sapiens
gccuucaacuccacuuuua

SEQ ID NO: 304909 - RNA, 19 nt, Homo sapiens
acccacacguuguauauuc

SEQ ID NO: 304910 - RNA, 19 nt, Homo sapiens
agagcucgauggcaagaga

SEQ ID NO: 304911 - RNA, 19 nt, Homo sapiens
gaaugcaauugagaaaucg

SEQ ID NO: 304912 - RNA, 19 nt, Homo sapiens
ccauuggcaucaucguuuc

SEQ ID NO: 304913 - RNA, 19 nt, Homo sapiens
ggccaagacacaaggcauu

SEQ ID NO: 304914 - RNA, 19 nt, Homo sapiens
aaggaaagcacaaaugaag

SEQ ID NO: 304915 - RNA, 19 nt, Homo sapiens
ccaccucuucucucaguuu

SEQ ID NO: 304916 - RNA, 19 nt, Homo sapiens
gacugugccuguucugagu

SEQ ID NO: 304917 - RNA, 19 nt, Homo sapiens
gcgaaggccaacaucaaug

SEQ ID NO: 304918 - RNA, 19 nt, Homo sapiens
acaugguccuccugaaguu

SEQ ID NO: 304919 - RNA, 19 nt, Homo sapiens
cuuuggagauggaauaagu

SEQ ID NO: 304920 - RNA, 19 nt, Homo sapiens
caaccacagccgucacaug

SEQ ID NO: 304921 - RNA, 19 nt, Homo sapiens
gcaucacccaggagauuug

SEQ ID NO: 304922 - RNA, 19 nt, Homo sapiens
ccaccagaaugcaauugag

SEQ ID NO: 304923 - RNA, 19 nt, Homo sapiens
caagugaccccgaaaacaa

SEQ ID NO: 304924 - RNA, 19 nt, Homo sapiens
ccucgacuauggaaucaag

SEQ ID NO: 304925 - RNA, 19 nt, Homo sapiens
ucacaacggccuacuacag

SEQ ID NO: 304926 - RNA, 19 nt, Homo sapiens
aaugacaagagacaaguuu

SEQ ID NO: 304927 - RNA, 19 nt, Homo sapiens
agugugaugugaaugacaa

SEQ ID NO: 304928 - RNA, 19 nt, Homo sapiens
aauccuguguaaagcauug

SEQ ID NO: 304929 - RNA, 19 nt, Homo sapiens
uuggagauggaauaaguua

SEQ ID NO: 304930 - RNA, 19 nt, Homo sapiens
ucacaugguccuccugaag

SEQ ID NO: 304931 - RNA, 19 nt, Homo sapiens
ggaagaccuguguccuguu

SEQ ID NO: 304932 - RNA, 19 nt, Homo sapiens
aagcaucacccaggagauu

SEQ ID NO: 304933 - RNA, 19 nt, Homo sapiens
cacguuguauauucagaga

SEQ ID NO: 304934 - RNA, 19 nt, Homo sapiens
ucuacgacaucaccaacga

SEQ ID NO: 304935 - RNA, 19 nt, Homo sapiens
gcucuguuuacaucgauaa

SEQ ID NO: 304936 - RNA, 19 nt, Homo sapiens
caucuguagugccaugaag

SEQ ID NO: 304937 - RNA, 19 nt, Homo sapiens
uaucuccaccauaggaauu

SEQ ID NO: 304938 - RNA, 19 nt, Homo sapiens
gaaggucuccgaugucaua

SEQ ID NO: 304939 - RNA, 19 nt, Homo sapiens
gaucauacaugcgcuguga

SEQ ID NO: 304940 - RNA, 19 nt, Homo sapiens
ggacaggccucaccucuac

SEQ ID NO: 304941 - RNA, 19 nt, Homo sapiens
gccgugagcuggugaagaa

SEQ ID NO: 304942 - RNA, 19 nt, Homo sapiens
ugaagaaggucuccgaugu

SEQ ID NO: 304943 - RNA, 19 nt, Homo sapiens
gcaaaggccucugaacuac

SEQ ID NO: 304944 - RNA, 19 nt, Homo sapiens
ggagcuggcuguaccugaa

SEQ ID NO: 304945 - RNA, 19 nt, Homo sapiens
gaucaugccuggguagugu

SEQ ID NO: 304946 - RNA, 19 nt, Homo sapiens
ugggacaucuggaaaggua

SEQ ID NO: 304947 - RNA, 19 nt, Homo sapiens
gcugagguuucacccuuaa

SEQ ID NO: 304948 - RNA, 19 nt, Homo sapiens
caaggaguucuuugaagua

SEQ ID NO: 304949 - RNA, 19 nt, Homo sapiens
ggccucaccucuacccaaa

SEQ ID NO: 304950 - RNA, 19 nt, Homo sapiens
acaaggaguucuuugaagu

SEQ ID NO: 304951 - RNA, 19 nt, Homo sapiens
gaaccuggcagaucuagag

SEQ ID NO: 304952 - RNA, 19 nt, Homo sapiens
ggucuccgaugucauaugg

SEQ ID NO: 304953 - RNA, 19 nt, Homo sapiens
uguaggagcugagguuuca

SEQ ID NO: 304954 - RNA, 19 nt, Homo sapiens
acgaggagaucuacaagga

SEQ ID NO: 304955 - RNA, 19 nt, Homo sapiens
ccacugucauccaggacua

SEQ ID NO: 304956 - RNA, 19 nt, Homo sapiens
cgcaaaggccucugaacua

SEQ ID NO: 304957 - RNA, 19 nt, Homo sapiens
cgucaucccuaccaacguu

SEQ ID NO: 304958 - RNA, 19 nt, Homo sapiens
gggaagacgaggagaucua

SEQ ID NO: 304959 - RNA, 19 nt, Homo sapiens
gaacacaucuaccccuaca

SEQ ID NO: 304960 - RNA, 19 nt, Homo sapiens
gaagaaggucuccgauguc

SEQ ID NO: 304961 - RNA, 19 nt, Homo sapiens
gcacuucagaauuccauau

SEQ ID NO: 304962 - RNA, 19 nt, Homo sapiens
ugacuacacucugucuuuc

SEQ ID NO: 304963 - RNA, 19 nt, Homo sapiens
gaagaugaagggcaugaag

SEQ ID NO: 304964 - RNA, 19 nt, Homo sapiens
gaguauauuuccgcacuuc

SEQ ID NO: 304965 - RNA, 19 nt, Homo sapiens
cuacaaggaguucuuugaa

SEQ ID NO: 304966 - RNA, 19 nt, Homo sapiens
ggaccuagagaucccagaa

SEQ ID NO: 304967 - RNA, 19 nt, Homo sapiens
cagaaggugcgcauaguga

SEQ ID NO: 304968 - RNA, 19 nt, Homo sapiens
guuccaagaaagaugaaua

SEQ ID NO: 304969 - RNA, 19 nt, Homo sapiens
ucacgcuggguccuaauua

SEQ ID NO: 304970 - RNA, 19 nt, Homo sapiens
gugacuacacucugucuuu

SEQ ID NO: 304971 - RNA, 19 nt, Homo sapiens
ugaaguagccaaugauguc

SEQ ID NO: 304972 - RNA, 19 nt, Homo sapiens
gaucuacaaggaguucuuu

SEQ ID NO: 304973 - RNA, 19 nt, Homo sapiens
gccaucaacccuuccauug

SEQ ID NO: 304974 - RNA, 19 nt, Homo sapiens
ggaguauauuuccgcacuu

SEQ ID NO: 304975 - RNA, 19 nt, Homo sapiens
ccuaauuaccagucuuuaa

SEQ ID NO: 304976 - RNA, 19 nt, Homo sapiens
gcagaaggugcgcauagug

SEQ ID NO: 304977 - RNA, 19 nt, Homo sapiens
cuucagaauuccauaucuu

SEQ ID NO: 304978 - RNA, 19 nt, Homo sapiens
cggaaccgcucaccuagag

SEQ ID NO: 304979 - RNA, 19 nt, Homo sapiens
aaaggccucugaacuacug

SEQ ID NO: 304980 - RNA, 19 nt, Homo sapiens
gaccuacuaucgggaugaa

SEQ ID NO: 304981 - RNA, 19 nt, Homo sapiens
uagggaaccuggcagaucu

SEQ ID NO: 304982 - RNA, 19 nt, Homo sapiens
aagaaggucuccgauguca

SEQ ID NO: 304983 - RNA, 19 nt, Homo sapiens
ccaagaaagaugaauacau

SEQ ID NO: 304984 - RNA, 19 nt, Homo sapiens
gcgcaaaggccucugaacu

SEQ ID NO: 304985 - RNA, 19 nt, Homo sapiens
gagaagaugaagggcauga

SEQ ID NO: 304986 - RNA, 19 nt, Homo sapiens
ucuccgaugucauauggaa

SEQ ID NO: 304987 - RNA, 19 nt, Homo sapiens
ucuuugaaguagccaauga

SEQ ID NO: 304988 - RNA, 19 nt, Homo sapiens
uacaaggaguucuuugaag

SEQ ID NO: 304989 - RNA, 19 nt, Homo sapiens
cgacguggugcgccuguuu

SEQ ID NO: 304990 - RNA, 19 nt, Homo sapiens
gagcaucccggaggaaauc

SEQ ID NO: 304991 - RNA, 19 nt, Homo sapiens
gggacaggccucaccucua

SEQ ID NO: 304992 - RNA, 19 nt, Homo sapiens
gaaguagccaaugauguca

SEQ ID NO: 304993 - RNA, 19 nt, Homo sapiens
ccugaaaggaucauacaug

SEQ ID NO: 304994 - RNA, 19 nt, Homo sapiens
uguaucaaacccacgauuu

SEQ ID NO: 304995 - RNA, 19 nt, Homo sapiens
ggcagaaggugcgcauagu

SEQ ID NO: 304996 - RNA, 19 nt, Homo sapiens
ccacauccagucccucuuc

SEQ ID NO: 304997 - RNA, 19 nt, Homo sapiens
uuuccgcacuucagaauuc

SEQ ID NO: 304998 - RNA, 19 nt, Homo sapiens
gcagaugaagaagcagaaa

SEQ ID NO: 304999 - RNA, 19 nt, Homo sapiens
agccugaucucuuccuguu

SEQ ID NO: 305000 - RNA, 19 nt, Homo sapiens
gaccugggacaucuggaaa

SEQ ID NO: 305001 - RNA, 19 nt, Homo sapiens
gagcuggcuguaccugaaa

SEQ ID NO: 305002 - RNA, 19 nt, Homo sapiens
cagcuccgguguggccuuu

SEQ ID NO: 305003 - RNA, 19 nt, Homo sapiens
ccugaucucuuccuguuuu

SEQ ID NO: 305004 - RNA, 19 nt, Homo sapiens
aguccugcuuccagaauuu

SEQ ID NO: 305005 - RNA, 19 nt, Homo sapiens
ggagaucuacaaggaguuc

SEQ ID NO: 305006 - RNA, 19 nt, Homo sapiens
cagacccacucacccucua

SEQ ID NO: 305007 - RNA, 19 nt, Homo sapiens
cccaguaggcaccaaauug

SEQ ID NO: 305008 - RNA, 19 nt, Homo sapiens
ucaguuccaagaaagauga

SEQ ID NO: 305009 - RNA, 19 nt, Homo sapiens
ggaagccuccugggacugu

SEQ ID NO: 305010 - RNA, 19 nt, Homo sapiens
gggcugggccaccuuucuu

SEQ ID NO: 305011 - RNA, 19 nt, Homo sapiens
gcugugaccgcaagaugga

SEQ ID NO: 305012 - RNA, 19 nt, Homo sapiens
ugaaggaggcagccagcuu

SEQ ID NO: 305013 - RNA, 19 nt, Homo sapiens
ggaagacgaggagaucuac

SEQ ID NO: 305014 - RNA, 19 nt, Homo sapiens
ucuaugaccugggacaucu

SEQ ID NO: 305015 - RNA, 19 nt, Homo sapiens
agucgcaagugcagaugaa

SEQ ID NO: 305016 - RNA, 19 nt, Homo sapiens
ucuacaaggaguucuuuga

SEQ ID NO: 305017 - RNA, 19 nt, Homo sapiens
ccucagccaagaccuacua

SEQ ID NO: 305018 - RNA, 19 nt, Homo sapiens
guccuaauuaccagucuuu

SEQ ID NO: 305019 - RNA, 19 nt, Homo sapiens
cccagucguuagaauauag

SEQ ID NO: 305020 - RNA, 19 nt, Homo sapiens
gcagcgcaaaggccucuga

SEQ ID NO: 305021 - RNA, 19 nt, Homo sapiens
ugcucuggcugcucuauga

SEQ ID NO: 305022 - RNA, 19 nt, Homo sapiens
gaaaucugcagagggguua

SEQ ID NO: 305023 - RNA, 19 nt, Homo sapiens
ggagcaucccggaggaaau

SEQ ID NO: 305024 - RNA, 19 nt, Homo sapiens
uuccauaucuugcgaaucc

SEQ ID NO: 305025 - RNA, 19 nt, Homo sapiens
gcuuguaggagcugagguu

SEQ ID NO: 305026 - RNA, 19 nt, Homo sapiens
gguccuaauuaccagucuu

SEQ ID NO: 305027 - RNA, 19 nt, Homo sapiens
guuagaauauaggucucuu

SEQ ID NO: 305028 - RNA, 19 nt, Homo sapiens
gaugaagaagcagaaagug

SEQ ID NO: 305029 - RNA, 19 nt, Homo sapiens
cgcaagugcagaugaagaa

SEQ ID NO: 305030 - RNA, 19 nt, Homo sapiens
agauggagguggcguucau

SEQ ID NO: 305031 - RNA, 19 nt, Homo sapiens
caguccugcuuccagaauu

SEQ ID NO: 305032 - RNA, 19 nt, Homo sapiens
gggcuccucccagcuugua

SEQ ID NO: 305033 - RNA, 19 nt, Homo sapiens
ucaccuagagccagaccaa

SEQ ID NO: 305034 - RNA, 19 nt, Homo sapiens
guaucaaacccacgauuuu

SEQ ID NO: 305035 - RNA, 19 nt, Homo sapiens
ggacuucggaccgcuugug

SEQ ID NO: 305036 - RNA, 19 nt, Homo sapiens
uccagucccucuucagcuu

SEQ ID NO: 305037 - RNA, 19 nt, Homo sapiens
gcgcugugaccgcaagaug

SEQ ID NO: 305038 - RNA, 19 nt, Homo sapiens
gaaggucuccgaugucaua

SEQ ID NO: 305039 - RNA, 19 nt, Homo sapiens
gaucauacaugcgcuguga

SEQ ID NO: 305040 - RNA, 19 nt, Homo sapiens
ggacaggccucaccucuac

SEQ ID NO: 305041 - RNA, 19 nt, Homo sapiens
gccgugagcuggugaagaa

SEQ ID NO: 305042 - RNA, 19 nt, Homo sapiens
ugaagaaggucuccgaugu

SEQ ID NO: 305043 - RNA, 19 nt, Homo sapiens
gcaaaggccucugaacuac

SEQ ID NO: 305044 - RNA, 19 nt, Homo sapiens
ggagcuggcuguaccugaa

SEQ ID NO: 305045 - RNA, 19 nt, Homo sapiens
gaucaugccuggguagugu

SEQ ID NO: 305046 - RNA, 19 nt, Homo sapiens
ugggacaucuggaaaggua

SEQ ID NO: 305047 - RNA, 19 nt, Homo sapiens
gcugagguuucacccuuaa

SEQ ID NO: 305048 - RNA, 19 nt, Homo sapiens
caaggaguucuuugaagua

SEQ ID NO: 305049 - RNA, 19 nt, Homo sapiens
ggccucaccucuacccaaa

SEQ ID NO: 305050 - RNA, 19 nt, Homo sapiens
acaaggaguucuuugaagu

SEQ ID NO: 305051 - RNA, 19 nt, Homo sapiens
gaaccuggcagaucuagag

SEQ ID NO: 305052 - RNA, 19 nt, Homo sapiens
caucacaggcaccaaauug

SEQ ID NO: 305053 - RNA, 19 nt, Homo sapiens
ggucuccgaugucauaugg

SEQ ID NO: 305054 - RNA, 19 nt, Homo sapiens
uguaggagcugagguuuca

SEQ ID NO: 305055 - RNA, 19 nt, Homo sapiens
acgaggagaucuacaagga

SEQ ID NO: 305056 - RNA, 19 nt, Homo sapiens
ccacugucauccaggacua

SEQ ID NO: 305057 - RNA, 19 nt, Homo sapiens
cgcaaaggccucugaacua

SEQ ID NO: 305058 - RNA, 19 nt, Homo sapiens
cgucaucccuaccaacguu

SEQ ID NO: 305059 - RNA, 19 nt, Homo sapiens
gggaagacgaggagaucua

SEQ ID NO: 305060 - RNA, 19 nt, Homo sapiens
gaacacaucuaccccuaca

SEQ ID NO: 305061 - RNA, 19 nt, Homo sapiens
gaagaaggucuccgauguc

SEQ ID NO: 305062 - RNA, 19 nt, Homo sapiens
gcacuucagaauuccauau

SEQ ID NO: 305063 - RNA, 19 nt, Homo sapiens
ugacuacacucugucuuuc

SEQ ID NO: 305064 - RNA, 19 nt, Homo sapiens
gaagaugaagggcaugaag

SEQ ID NO: 305065 - RNA, 19 nt, Homo sapiens
gaguauauuuccgcacuuc

SEQ ID NO: 305066 - RNA, 19 nt, Homo sapiens
cuacaaggaguucuuugaa

SEQ ID NO: 305067 - RNA, 19 nt, Homo sapiens
ggaccuagagaucccagaa

SEQ ID NO: 305068 - RNA, 19 nt, Homo sapiens
cagaaggugcgcauaguga

SEQ ID NO: 305069 - RNA, 19 nt, Homo sapiens
guuccaagaaagaugaaua

SEQ ID NO: 305070 - RNA, 19 nt, Homo sapiens
ucacgcuggguccuaauua

SEQ ID NO: 305071 - RNA, 19 nt, Homo sapiens
gugacuacacucugucuuu

SEQ ID NO: 305072 - RNA, 19 nt, Homo sapiens
ugaaguagccaaugauguc

SEQ ID NO: 305073 - RNA, 19 nt, Homo sapiens
gaucuacaaggaguucuuu

SEQ ID NO: 305074 - RNA, 19 nt, Homo sapiens
gccaucaacccuuccauug

SEQ ID NO: 305075 - RNA, 19 nt, Homo sapiens
ggaguauauuuccgcacuu

SEQ ID NO: 305076 - RNA, 19 nt, Homo sapiens
ccuaauuaccagucuuuaa

SEQ ID NO: 305077 - RNA, 19 nt, Homo sapiens
gcagaaggugcgcauagug

SEQ ID NO: 305078 - RNA, 19 nt, Homo sapiens
cuucagaauuccauaucuu

SEQ ID NO: 305079 - RNA, 19 nt, Homo sapiens
cggaaccgcucaccuagag

SEQ ID NO: 305080 - RNA, 19 nt, Homo sapiens
aaaggccucugaacuacug

SEQ ID NO: 305081 - RNA, 19 nt, Homo sapiens
gaccuacuaucgggaugaa

SEQ ID NO: 305082 - RNA, 19 nt, Homo sapiens
uagggaaccuggcagaucu

SEQ ID NO: 305083 - RNA, 19 nt, Homo sapiens
aagaaggucuccgauguca

SEQ ID NO: 305084 - RNA, 19 nt, Homo sapiens
ccaagaaagaugaauacau

SEQ ID NO: 305085 - RNA, 19 nt, Homo sapiens
gcgcaaaggccucugaacu

SEQ ID NO: 305086 - RNA, 19 nt, Homo sapiens
gagaagaugaagggcauga

SEQ ID NO: 305087 - RNA, 19 nt, Homo sapiens
ucuccgaugucauauggaa

SEQ ID NO: 305088 - RNA, 19 nt, Homo sapiens
ucuuugaaguagccaauga

SEQ ID NO: 305089 - RNA, 19 nt, Homo sapiens
uacaaggaguucuuugaag

SEQ ID NO: 305090 - RNA, 19 nt, Homo sapiens
cgacguggugcgccuguuu

SEQ ID NO: 305091 - RNA, 19 nt, Homo sapiens
gagcaucccggaggaaauc

SEQ ID NO: 305092 - RNA, 19 nt, Homo sapiens
gggacaggccucaccucua

SEQ ID NO: 305093 - RNA, 19 nt, Homo sapiens
gaaguagccaaugauguca

SEQ ID NO: 305094 - RNA, 19 nt, Homo sapiens
ccugaaaggaucauacaug

SEQ ID NO: 305095 - RNA, 19 nt, Homo sapiens
uguaucaaacccacgauuu

SEQ ID NO: 305096 - RNA, 19 nt, Homo sapiens
ggcagaaggugcgcauagu

SEQ ID NO: 305097 - RNA, 19 nt, Homo sapiens
ccacauccagucccucuuc

SEQ ID NO: 305098 - RNA, 19 nt, Homo sapiens
uuuccgcacuucagaauuc

SEQ ID NO: 305099 - RNA, 19 nt, Homo sapiens
gcagaugaagaagcagaaa

SEQ ID NO: 305100 - RNA, 19 nt, Homo sapiens
agccugaucucuuccuguu

SEQ ID NO: 305101 - RNA, 19 nt, Homo sapiens
gaccugggacaucuggaaa

SEQ ID NO: 305102 - RNA, 19 nt, Homo sapiens
gagcuggcuguaccugaaa

SEQ ID NO: 305103 - RNA, 19 nt, Homo sapiens
cagcuccgguguggccuuu

SEQ ID NO: 305104 - RNA, 19 nt, Homo sapiens
ccugaucucuuccuguuuu

SEQ ID NO: 305105 - RNA, 19 nt, Homo sapiens
aguccugcuuccagaauuu

SEQ ID NO: 305106 - RNA, 19 nt, Homo sapiens
ggagaucuacaaggaguuc

SEQ ID NO: 305107 - RNA, 19 nt, Homo sapiens
cagacccacucacccucua

SEQ ID NO: 305108 - RNA, 19 nt, Homo sapiens
ucaguuccaagaaagauga

SEQ ID NO: 305109 - RNA, 19 nt, Homo sapiens
ggaagccuccugggacugu

SEQ ID NO: 305110 - RNA, 19 nt, Homo sapiens
gggcugggccaccuuucuu

SEQ ID NO: 305111 - RNA, 19 nt, Homo sapiens
gcugugaccgcaagaugga

SEQ ID NO: 305112 - RNA, 19 nt, Homo sapiens
ugaaggaggcagccagcuu

SEQ ID NO: 305113 - RNA, 19 nt, Homo sapiens
ggaagacgaggagaucuac

SEQ ID NO: 305114 - RNA, 19 nt, Homo sapiens
ucuaugaccugggacaucu

SEQ ID NO: 305115 - RNA, 19 nt, Homo sapiens
agucgcaagugcagaugaa

SEQ ID NO: 305116 - RNA, 19 nt, Homo sapiens
ucuacaaggaguucuuuga

SEQ ID NO: 305117 - RNA, 19 nt, Homo sapiens
ccucagccaagaccuacua

SEQ ID NO: 305118 - RNA, 19 nt, Homo sapiens
guccuaauuaccagucuuu

SEQ ID NO: 305119 - RNA, 19 nt, Homo sapiens
cccagucguuagaauauag

SEQ ID NO: 305120 - RNA, 19 nt, Homo sapiens
gcagcgcaaaggccucuga

SEQ ID NO: 305121 - RNA, 19 nt, Homo sapiens
ugcucuggcugcucuauga

SEQ ID NO: 305122 - RNA, 19 nt, Homo sapiens
gaaaucugcagagggguua

SEQ ID NO: 305123 - RNA, 19 nt, Homo sapiens
ggagcaucccggaggaaau

SEQ ID NO: 305124 - RNA, 19 nt, Homo sapiens
uuccauaucuugcgaaucc

SEQ ID NO: 305125 - RNA, 19 nt, Homo sapiens
gcuuguaggagcugagguu

SEQ ID NO: 305126 - RNA, 19 nt, Homo sapiens
gguccuaauuaccagucuu

SEQ ID NO: 305127 - RNA, 19 nt, Homo sapiens
guuagaauauaggucucuu

SEQ ID NO: 305128 - RNA, 19 nt, Homo sapiens
gaugaagaagcagaaagug

SEQ ID NO: 305129 - RNA, 19 nt, Homo sapiens
cgcaagugcagaugaagaa

SEQ ID NO: 305130 - RNA, 19 nt, Homo sapiens
agauggagguggcguucau

SEQ ID NO: 305131 - RNA, 19 nt, Homo sapiens
caguccugcuuccagaauu

SEQ ID NO: 305132 - RNA, 19 nt, Homo sapiens
gggcuccucccagcuugua

SEQ ID NO: 305133 - RNA, 19 nt, Homo sapiens
ucaccuagagccagaccaa

SEQ ID NO: 305134 - RNA, 19 nt, Homo sapiens
guaucaaacccacgauuuu

SEQ ID NO: 305135 - RNA, 19 nt, Homo sapiens
ggacuucggaccgcuugug

SEQ ID NO: 305136 - RNA, 19 nt, Homo sapiens
uccagucccucuucagcuu

SEQ ID NO: 305137 - RNA, 19 nt, Homo sapiens
gcgcugugaccgcaagaug

SEQ ID NO: 305138 - RNA, 19 nt, Homo sapiens
gaaggucuccgaugucaua

SEQ ID NO: 305139 - RNA, 19 nt, Homo sapiens
gaucauacaugcgcuguga

SEQ ID NO: 305140 - RNA, 19 nt, Homo sapiens
ggacaggccucaccucuac

SEQ ID NO: 305141 - RNA, 19 nt, Homo sapiens
gccgugagcuggugaagaa

SEQ ID NO: 305142 - RNA, 19 nt, Homo sapiens
ugaagaaggucuccgaugu

SEQ ID NO: 305143 - RNA, 19 nt, Homo sapiens
gcaaaggccucugaacuac

SEQ ID NO: 305144 - RNA, 19 nt, Homo sapiens
ggagcuggcuguaccugaa

SEQ ID NO: 305145 - RNA, 19 nt, Homo sapiens
gaucaugccuggguagugu

SEQ ID NO: 305146 - RNA, 19 nt, Homo sapiens
ugggacaucuggaaaggua

SEQ ID NO: 305147 - RNA, 19 nt, Homo sapiens
gcugagguuucacccuuaa

SEQ ID NO: 305148 - RNA, 19 nt, Homo sapiens
caaggaguucuuugaagua

SEQ ID NO: 305149 - RNA, 19 nt, Homo sapiens
ggccucaccucuacccaaa

SEQ ID NO: 305150 - RNA, 19 nt, Homo sapiens
acaaggaguucuuugaagu

SEQ ID NO: 305151 - RNA, 19 nt, Homo sapiens
gaaccuggcagaucuagag

SEQ ID NO: 305152 - RNA, 19 nt, Homo sapiens
ggucuccgaugucauaugg

SEQ ID NO: 305153 - RNA, 19 nt, Homo sapiens
uguaggagcugagguuuca

SEQ ID NO: 305154 - RNA, 19 nt, Homo sapiens
acgaggagaucuacaagga

SEQ ID NO: 305155 - RNA, 19 nt, Homo sapiens
ccacugucauccaggacua

SEQ ID NO: 305156 - RNA, 19 nt, Homo sapiens
cgcaaaggccucugaacua

SEQ ID NO: 305157 - RNA, 19 nt, Homo sapiens
cgucaucccuaccaacguu

SEQ ID NO: 305158 - RNA, 19 nt, Homo sapiens
gggaagacgaggagaucua

SEQ ID NO: 305159 - RNA, 19 nt, Homo sapiens
gaacacaucuaccccuaca

SEQ ID NO: 305160 - RNA, 19 nt, Homo sapiens
gaagaaggucuccgauguc

SEQ ID NO: 305161 - RNA, 19 nt, Homo sapiens
gcacuucagaauuccauau

SEQ ID NO: 305162 - RNA, 19 nt, Homo sapiens
ugacuacacucugucuuuc

SEQ ID NO: 305163 - RNA, 19 nt, Homo sapiens
gaagaugaagggcaugaag

SEQ ID NO: 305164 - RNA, 19 nt, Homo sapiens
gaguauauuuccgcacuuc

SEQ ID NO: 305165 - RNA, 19 nt, Homo sapiens
cuacaaggaguucuuugaa

SEQ ID NO: 305166 - RNA, 19 nt, Homo sapiens
cagaaggugcgcauaguga

SEQ ID NO: 305167 - RNA, 19 nt, Homo sapiens
guuccaagaaagaugaaua

SEQ ID NO: 305168 - RNA, 19 nt, Homo sapiens
ucacgcuggguccuaauua

SEQ ID NO: 305169 - RNA, 19 nt, Homo sapiens
gugacuacacucugucuuu

SEQ ID NO: 305170 - RNA, 19 nt, Homo sapiens
ugaaguagccaaugauguc

SEQ ID NO: 305171 - RNA, 19 nt, Homo sapiens
gaucuacaaggaguucuuu

SEQ ID NO: 305172 - RNA, 19 nt, Homo sapiens
gccaucaacccuuccauug

SEQ ID NO: 305173 - RNA, 19 nt, Homo sapiens
ggaguauauuuccgcacuu

SEQ ID NO: 305174 - RNA, 19 nt, Homo sapiens
ccuaauuaccagucuuuaa

SEQ ID NO: 305175 - RNA, 19 nt, Homo sapiens
gcagaaggugcgcauagug

SEQ ID NO: 305176 - RNA, 19 nt, Homo sapiens
cuucagaauuccauaucuu

SEQ ID NO: 305177 - RNA, 19 nt, Homo sapiens
cggaaccgcucaccuagag

SEQ ID NO: 305178 - RNA, 19 nt, Homo sapiens
aaaggccucugaacuacug

SEQ ID NO: 305179 - RNA, 19 nt, Homo sapiens
gaccuacuaucgggaugaa

SEQ ID NO: 305180 - RNA, 19 nt, Homo sapiens
uagggaaccuggcagaucu

SEQ ID NO: 305181 - RNA, 19 nt, Homo sapiens
aagaaggucuccgauguca

SEQ ID NO: 305182 - RNA, 19 nt, Homo sapiens
ccaagaaagaugaauacau

SEQ ID NO: 305183 - RNA, 19 nt, Homo sapiens
gcgcaaaggccucugaacu

SEQ ID NO: 305184 - RNA, 19 nt, Homo sapiens
gagaagaugaagggcauga

SEQ ID NO: 305185 - RNA, 19 nt, Homo sapiens
ucuccgaugucauauggaa

SEQ ID NO: 305186 - RNA, 19 nt, Homo sapiens
cgacguggugcgccuguuu

SEQ ID NO: 305187 - RNA, 19 nt, Homo sapiens
ucuuugaaguagccaauga

SEQ ID NO: 305188 - RNA, 19 nt, Homo sapiens
uacaaggaguucuuugaag

SEQ ID NO: 305189 - RNA, 19 nt, Homo sapiens
gagcaucccggaggaaauc

SEQ ID NO: 305190 - RNA, 19 nt, Homo sapiens
gggacaggccucaccucua

SEQ ID NO: 305191 - RNA, 19 nt, Homo sapiens
gaaguagccaaugauguca

SEQ ID NO: 305192 - RNA, 19 nt, Homo sapiens
ccugaaaggaucauacaug

SEQ ID NO: 305193 - RNA, 19 nt, Homo sapiens
uguaucaaacccacgauuu

SEQ ID NO: 305194 - RNA, 19 nt, Homo sapiens
ggcagaaggugcgcauagu

SEQ ID NO: 305195 - RNA, 19 nt, Homo sapiens
ccacauccagucccucuuc

SEQ ID NO: 305196 - RNA, 19 nt, Homo sapiens
uuuccgcacuucagaauuc

SEQ ID NO: 305197 - RNA, 19 nt, Homo sapiens
gcagaugaagaagcagaaa

SEQ ID NO: 305198 - RNA, 19 nt, Homo sapiens
agccugaucucuuccuguu

SEQ ID NO: 305199 - RNA, 19 nt, Homo sapiens
gaccugggacaucuggaaa

SEQ ID NO: 305200 - RNA, 19 nt, Homo sapiens
gagcuggcuguaccugaaa

SEQ ID NO: 305201 - RNA, 19 nt, Homo sapiens
cagcuccgguguggccuuu

SEQ ID NO: 305202 - RNA, 19 nt, Homo sapiens
ccugaucucuuccuguuuu

SEQ ID NO: 305203 - RNA, 19 nt, Homo sapiens
aguccugcuuccagaauuu

SEQ ID NO: 305204 - RNA, 19 nt, Homo sapiens
ggagaucuacaaggaguuc

SEQ ID NO: 305205 - RNA, 19 nt, Homo sapiens
cagacccacucacccucua

SEQ ID NO: 305206 - RNA, 19 nt, Homo sapiens
cccaguaggcaccaaauug

SEQ ID NO: 305207 - RNA, 19 nt, Homo sapiens
ucaguuccaagaaagauga

SEQ ID NO: 305208 - RNA, 19 nt, Homo sapiens
ggaagccuccugggacugu

SEQ ID NO: 305209 - RNA, 19 nt, Homo sapiens
gggcugggccaccuuucuu

SEQ ID NO: 305210 - RNA, 19 nt, Homo sapiens
gcugugaccgcaagaugga

SEQ ID NO: 305211 - RNA, 19 nt, Homo sapiens
ugaaggaggcagccagcuu

SEQ ID NO: 305212 - RNA, 19 nt, Homo sapiens
ggaagacgaggagaucuac

SEQ ID NO: 305213 - RNA, 19 nt, Homo sapiens
ucuaugaccugggacaucu

SEQ ID NO: 305214 - RNA, 19 nt, Homo sapiens
agucgcaagugcagaugaa

SEQ ID NO: 305215 - RNA, 19 nt, Homo sapiens
ucuacaaggaguucuuuga

SEQ ID NO: 305216 - RNA, 19 nt, Homo sapiens
ccucagccaagaccuacua

SEQ ID NO: 305217 - RNA, 19 nt, Homo sapiens
guccuaauuaccagucuuu

SEQ ID NO: 305218 - RNA, 19 nt, Homo sapiens
cccagucguuagaauauag

SEQ ID NO: 305219 - RNA, 19 nt, Homo sapiens
gcagcgcaaaggccucuga

SEQ ID NO: 305220 - RNA, 19 nt, Homo sapiens
ugcucuggcugcucuauga

SEQ ID NO: 305221 - RNA, 19 nt, Homo sapiens
gaaaucugcagagggguua

SEQ ID NO: 305222 - RNA, 19 nt, Homo sapiens
ggagcaucccggaggaaau

SEQ ID NO: 305223 - RNA, 19 nt, Homo sapiens
uuccauaucuugcgaaucc

SEQ ID NO: 305224 - RNA, 19 nt, Homo sapiens
gcuuguaggagcugagguu

SEQ ID NO: 305225 - RNA, 19 nt, Homo sapiens
gguccuaauuaccagucuu

SEQ ID NO: 305226 - RNA, 19 nt, Homo sapiens
guuagaauauaggucucuu

SEQ ID NO: 305227 - RNA, 19 nt, Homo sapiens
gaugaagaagcagaaagug

SEQ ID NO: 305228 - RNA, 19 nt, Homo sapiens
cgcaagugcagaugaagaa

SEQ ID NO: 305229 - RNA, 19 nt, Homo sapiens
agauggagguggcguucau

SEQ ID NO: 305230 - RNA, 19 nt, Homo sapiens
caguccugcuuccagaauu

SEQ ID NO: 305231 - RNA, 19 nt, Homo sapiens
gggcuccucccagcuugua

SEQ ID NO: 305232 - RNA, 19 nt, Homo sapiens
ucaccuagagccagaccaa

SEQ ID NO: 305233 - RNA, 19 nt, Homo sapiens
uccagucccucuucagcuu

SEQ ID NO: 305234 - RNA, 19 nt, Homo sapiens
guaucaaacccacgauuuu

SEQ ID NO: 305235 - RNA, 19 nt, Homo sapiens
ggacuucggaccgcuugug

SEQ ID NO: 305236 - RNA, 19 nt, Homo sapiens
gcgcugugaccgcaagaug

SEQ ID NO: 305237 - RNA, 19 nt, Homo sapiens
ugccuagugugggauguaa

SEQ ID NO: 305238 - RNA, 19 nt, Homo sapiens
gaaggucuccgaugucaua

SEQ ID NO: 305239 - RNA, 19 nt, Homo sapiens
gaucauacaugcgcuguga

SEQ ID NO: 305240 - RNA, 19 nt, Homo sapiens
ggacaggccucaccucuac

SEQ ID NO: 305241 - RNA, 19 nt, Homo sapiens
gccgugagcuggugaagaa

SEQ ID NO: 305242 - RNA, 19 nt, Homo sapiens
ugaagaaggucuccgaugu

SEQ ID NO: 305243 - RNA, 19 nt, Homo sapiens
gcaaaggccucugaacuac

SEQ ID NO: 305244 - RNA, 19 nt, Homo sapiens
ggagcuggcuguaccugaa

SEQ ID NO: 305245 - RNA, 19 nt, Homo sapiens
gaucaugccuggguagugu

SEQ ID NO: 305246 - RNA, 19 nt, Homo sapiens
ugggacaucuggaaaggua

SEQ ID NO: 305247 - RNA, 19 nt, Homo sapiens
gcugagguuucacccuuaa

SEQ ID NO: 305248 - RNA, 19 nt, Homo sapiens
caaggaguucuuugaagua

SEQ ID NO: 305249 - RNA, 19 nt, Homo sapiens
ggccucaccucuacccaaa

SEQ ID NO: 305250 - RNA, 19 nt, Homo sapiens
acaaggaguucuuugaagu

SEQ ID NO: 305251 - RNA, 19 nt, Homo sapiens
gaaccuggcagaucuagag

SEQ ID NO: 305252 - RNA, 19 nt, Homo sapiens
ggucuccgaugucauaugg

SEQ ID NO: 305253 - RNA, 19 nt, Homo sapiens
uguaggagcugagguuuca

SEQ ID NO: 305254 - RNA, 19 nt, Homo sapiens
acgaggagaucuacaagga

SEQ ID NO: 305255 - RNA, 19 nt, Homo sapiens
ccacugucauccaggacua

SEQ ID NO: 305256 - RNA, 19 nt, Homo sapiens
cgcaaaggccucugaacua

SEQ ID NO: 305257 - RNA, 19 nt, Homo sapiens
cgucaucccuaccaacguu

SEQ ID NO: 305258 - RNA, 19 nt, Homo sapiens
gggaagacgaggagaucua

SEQ ID NO: 305259 - RNA, 19 nt, Homo sapiens
gaacacaucuaccccuaca

SEQ ID NO: 305260 - RNA, 19 nt, Homo sapiens
gaagaaggucuccgauguc

SEQ ID NO: 305261 - RNA, 19 nt, Homo sapiens
gcacuucagaauuccauau

SEQ ID NO: 305262 - RNA, 19 nt, Homo sapiens
ugacuacacucugucuuuc

SEQ ID NO: 305263 - RNA, 19 nt, Homo sapiens
gaagaugaagggcaugaag

SEQ ID NO: 305264 - RNA, 19 nt, Homo sapiens
gaguauauuuccgcacuuc

SEQ ID NO: 305265 - RNA, 19 nt, Homo sapiens
cuacaaggaguucuuugaa

SEQ ID NO: 305266 - RNA, 19 nt, Homo sapiens
cagaaggugcgcauaguga

SEQ ID NO: 305267 - RNA, 19 nt, Homo sapiens
guuccaagaaagaugaaua

SEQ ID NO: 305268 - RNA, 19 nt, Homo sapiens
ucacgcuggguccuaauua

SEQ ID NO: 305269 - RNA, 19 nt, Homo sapiens
gugacuacacucugucuuu

SEQ ID NO: 305270 - RNA, 19 nt, Homo sapiens
ugaaguagccaaugauguc

SEQ ID NO: 305271 - RNA, 19 nt, Homo sapiens
gaucuacaaggaguucuuu

SEQ ID NO: 305272 - RNA, 19 nt, Homo sapiens
gccaucaacccuuccauug

SEQ ID NO: 305273 - RNA, 19 nt, Homo sapiens
ggaguauauuuccgcacuu

SEQ ID NO: 305274 - RNA, 19 nt, Homo sapiens
ccuaauuaccagucuuuaa

SEQ ID NO: 305275 - RNA, 19 nt, Homo sapiens
gcagaaggugcgcauagug

SEQ ID NO: 305276 - RNA, 19 nt, Homo sapiens
cuucagaauuccauaucuu

SEQ ID NO: 305277 - RNA, 19 nt, Homo sapiens
cggaaccgcucaccuagag

SEQ ID NO: 305278 - RNA, 19 nt, Homo sapiens
aaaggccucugaacuacug

SEQ ID NO: 305279 - RNA, 19 nt, Homo sapiens
gaccuacuaucgggaugaa

SEQ ID NO: 305280 - RNA, 19 nt, Homo sapiens
uagggaaccuggcagaucu

SEQ ID NO: 305281 - RNA, 19 nt, Homo sapiens
aagaaggucuccgauguca

SEQ ID NO: 305282 - RNA, 19 nt, Homo sapiens
ccaagaaagaugaauacau

SEQ ID NO: 305283 - RNA, 19 nt, Homo sapiens
gcgcaaaggccucugaacu

SEQ ID NO: 305284 - RNA, 19 nt, Homo sapiens
gagaagaugaagggcauga

SEQ ID NO: 305285 - RNA, 19 nt, Homo sapiens
ucuccgaugucauauggaa

SEQ ID NO: 305286 - RNA, 19 nt, Homo sapiens
ucuuugaaguagccaauga

SEQ ID NO: 305287 - RNA, 19 nt, Homo sapiens
uacaaggaguucuuugaag

SEQ ID NO: 305288 - RNA, 19 nt, Homo sapiens
cgacguggugcgccuguuu

SEQ ID NO: 305289 - RNA, 19 nt, Homo sapiens
gagcaucccggaggaaauc

SEQ ID NO: 305290 - RNA, 19 nt, Homo sapiens
gggacaggccucaccucua

SEQ ID NO: 305291 - RNA, 19 nt, Homo sapiens
gaaguagccaaugauguca

SEQ ID NO: 305292 - RNA, 19 nt, Homo sapiens
ccugaaaggaucauacaug

SEQ ID NO: 305293 - RNA, 19 nt, Homo sapiens
uguaucaaacccacgauuu

SEQ ID NO: 305294 - RNA, 19 nt, Homo sapiens
ggcagaaggugcgcauagu

SEQ ID NO: 305295 - RNA, 19 nt, Homo sapiens
ccacauccagucccucuuc

SEQ ID NO: 305296 - RNA, 19 nt, Homo sapiens
uuuccgcacuucagaauuc

SEQ ID NO: 305297 - RNA, 19 nt, Homo sapiens
gcagaugaagaagcagaaa

SEQ ID NO: 305298 - RNA, 19 nt, Homo sapiens
agccugaucucuuccuguu

SEQ ID NO: 305299 - RNA, 19 nt, Homo sapiens
gaccugggacaucuggaaa

SEQ ID NO: 305300 - RNA, 19 nt, Homo sapiens
gagcuggcuguaccugaaa

SEQ ID NO: 305301 - RNA, 19 nt, Homo sapiens
cagcuccgguguggccuuu

SEQ ID NO: 305302 - RNA, 19 nt, Homo sapiens
ccugaucucuuccuguuuu

SEQ ID NO: 305303 - RNA, 19 nt, Homo sapiens
aguccugcuuccagaauuu

SEQ ID NO: 305304 - RNA, 19 nt, Homo sapiens
ggagaucuacaaggaguuc

SEQ ID NO: 305305 - RNA, 19 nt, Homo sapiens
cagacccacucacccucua

SEQ ID NO: 305306 - RNA, 19 nt, Homo sapiens
cccaguaggcaccaaauug

SEQ ID NO: 305307 - RNA, 19 nt, Homo sapiens
ucaguuccaagaaagauga

SEQ ID NO: 305308 - RNA, 19 nt, Homo sapiens
ggaagccuccugggacugu

SEQ ID NO: 305309 - RNA, 19 nt, Homo sapiens
gggcugggccaccuuucuu

SEQ ID NO: 305310 - RNA, 19 nt, Homo sapiens
gcugugaccgcaagaugga

SEQ ID NO: 305311 - RNA, 19 nt, Homo sapiens
ugaaggaggcagccagcuu

SEQ ID NO: 305312 - RNA, 19 nt, Homo sapiens
ggaagacgaggagaucuac

SEQ ID NO: 305313 - RNA, 19 nt, Homo sapiens
ucuaugaccugggacaucu

SEQ ID NO: 305314 - RNA, 19 nt, Homo sapiens
agucgcaagugcagaugaa

SEQ ID NO: 305315 - RNA, 19 nt, Homo sapiens
ucuacaaggaguucuuuga

SEQ ID NO: 305316 - RNA, 19 nt, Homo sapiens
ccucagccaagaccuacua

SEQ ID NO: 305317 - RNA, 19 nt, Homo sapiens
guccuaauuaccagucuuu

SEQ ID NO: 305318 - RNA, 19 nt, Homo sapiens
cccagucguuagaauauag

SEQ ID NO: 305319 - RNA, 19 nt, Homo sapiens
gcagcgcaaaggccucuga

SEQ ID NO: 305320 - RNA, 19 nt, Homo sapiens
ugcucuggcugcucuauga

SEQ ID NO: 305321 - RNA, 19 nt, Homo sapiens
gaaaucugcagagggguua

SEQ ID NO: 305322 - RNA, 19 nt, Homo sapiens
ggagcaucccggaggaaau

SEQ ID NO: 305323 - RNA, 19 nt, Homo sapiens
uuccauaucuugcgaaucc

SEQ ID NO: 305324 - RNA, 19 nt, Homo sapiens
gcuuguaggagcugagguu

SEQ ID NO: 305325 - RNA, 19 nt, Homo sapiens
gguccuaauuaccagucuu

SEQ ID NO: 305326 - RNA, 19 nt, Homo sapiens
guuagaauauaggucucuu

SEQ ID NO: 305327 - RNA, 19 nt, Homo sapiens
gaugaagaagcagaaagug

SEQ ID NO: 305328 - RNA, 19 nt, Homo sapiens
cgcaagugcagaugaagaa

SEQ ID NO: 305329 - RNA, 19 nt, Homo sapiens
agauggagguggcguucau

SEQ ID NO: 305330 - RNA, 19 nt, Homo sapiens
caguccugcuuccagaauu

SEQ ID NO: 305331 - RNA, 19 nt, Homo sapiens
gggcuccucccagcuugua

SEQ ID NO: 305332 - RNA, 19 nt, Homo sapiens
ucaccuagagccagaccaa

SEQ ID NO: 305333 - RNA, 19 nt, Homo sapiens
guaucaaacccacgauuuu

SEQ ID NO: 305334 - RNA, 19 nt, Homo sapiens
ggacuucggaccgcuugug

SEQ ID NO: 305335 - RNA, 19 nt, Homo sapiens
uccagucccucuucagcuu

SEQ ID NO: 305336 - RNA, 19 nt, Homo sapiens
gcgcugugaccgcaagaug

SEQ ID NO: 305337 - RNA, 19 nt, Homo sapiens
gcccaguaggcaccaaauu

SEQ ID NO: 305338 - RNA, 19 nt, Homo sapiens
gaaggucuccgaugucaua

SEQ ID NO: 305339 - RNA, 19 nt, Homo sapiens
gaucauacaugcgcuguga

SEQ ID NO: 305340 - RNA, 19 nt, Homo sapiens
ggacaggccucaccucuac

SEQ ID NO: 305341 - RNA, 19 nt, Homo sapiens
gccgugagcuggugaagaa

SEQ ID NO: 305342 - RNA, 19 nt, Homo sapiens
ugaagaaggucuccgaugu

SEQ ID NO: 305343 - RNA, 19 nt, Homo sapiens
gcaaaggccucugaacuac

SEQ ID NO: 305344 - RNA, 19 nt, Homo sapiens
ggagcuggcuguaccugaa

SEQ ID NO: 305345 - RNA, 19 nt, Homo sapiens
gaucaugccuggguagugu

SEQ ID NO: 305346 - RNA, 19 nt, Homo sapiens
ugggacaucuggaaaggua

SEQ ID NO: 305347 - RNA, 19 nt, Homo sapiens
gcugagguuucacccuuaa

SEQ ID NO: 305348 - RNA, 19 nt, Homo sapiens
caaggaguucuuugaagua

SEQ ID NO: 305349 - RNA, 19 nt, Homo sapiens
ggccucaccucuacccaaa

SEQ ID NO: 305350 - RNA, 19 nt, Homo sapiens
acaaggaguucuuugaagu

SEQ ID NO: 305351 - RNA, 19 nt, Homo sapiens
gaaccuggcagaucuagag

SEQ ID NO: 305352 - RNA, 19 nt, Homo sapiens
ggucuccgaugucauaugg

SEQ ID NO: 305353 - RNA, 19 nt, Homo sapiens
uguaggagcugagguuuca

SEQ ID NO: 305354 - RNA, 19 nt, Homo sapiens
acgaggagaucuacaagga

SEQ ID NO: 305355 - RNA, 19 nt, Homo sapiens
ccacugucauccaggacua

SEQ ID NO: 305356 - RNA, 19 nt, Homo sapiens
cgcaaaggccucugaacua

SEQ ID NO: 305357 - RNA, 19 nt, Homo sapiens
cgucaucccuaccaacguu

SEQ ID NO: 305358 - RNA, 19 nt, Homo sapiens
gggaagacgaggagaucua

SEQ ID NO: 305359 - RNA, 19 nt, Homo sapiens
gaacacaucuaccccuaca

SEQ ID NO: 305360 - RNA, 19 nt, Homo sapiens
gaagaaggucuccgauguc

SEQ ID NO: 305361 - RNA, 19 nt, Homo sapiens
gcacuucagaauuccauau

SEQ ID NO: 305362 - RNA, 19 nt, Homo sapiens
ugacuacacucugucuuuc

SEQ ID NO: 305363 - RNA, 19 nt, Homo sapiens
gaagaugaagggcaugaag

SEQ ID NO: 305364 - RNA, 19 nt, Homo sapiens
gaguauauuuccgcacuuc

SEQ ID NO: 305365 - RNA, 19 nt, Homo sapiens
cuacaaggaguucuuugaa

SEQ ID NO: 305366 - RNA, 19 nt, Homo sapiens
ggaccuagagaucccagaa

SEQ ID NO: 305367 - RNA, 19 nt, Homo sapiens
cagaaggugcgcauaguga

SEQ ID NO: 305368 - RNA, 19 nt, Homo sapiens
guuccaagaaagaugaaua

SEQ ID NO: 305369 - RNA, 19 nt, Homo sapiens
ucacgcuggguccuaauua

SEQ ID NO: 305370 - RNA, 19 nt, Homo sapiens
gugacuacacucugucuuu

SEQ ID NO: 305371 - RNA, 19 nt, Homo sapiens
ugaaguagccaaugauguc

SEQ ID NO: 305372 - RNA, 19 nt, Homo sapiens
gaucuacaaggaguucuuu

SEQ ID NO: 305373 - RNA, 19 nt, Homo sapiens
gccaucaacccuuccauug

SEQ ID NO: 305374 - RNA, 19 nt, Homo sapiens
ggaguauauuuccgcacuu

SEQ ID NO: 305375 - RNA, 19 nt, Homo sapiens
ccuaauuaccagucuuuaa

SEQ ID NO: 305376 - RNA, 19 nt, Homo sapiens
gcagaaggugcgcauagug

SEQ ID NO: 305377 - RNA, 19 nt, Homo sapiens
cuucagaauuccauaucuu

SEQ ID NO: 305378 - RNA, 19 nt, Homo sapiens
cggaaccgcucaccuagag

SEQ ID NO: 305379 - RNA, 19 nt, Homo sapiens
aaaggccucugaacuacug

SEQ ID NO: 305380 - RNA, 19 nt, Homo sapiens
gaccuacuaucgggaugaa

SEQ ID NO: 305381 - RNA, 19 nt, Homo sapiens
uagggaaccuggcagaucu

SEQ ID NO: 305382 - RNA, 19 nt, Homo sapiens
aagaaggucuccgauguca

SEQ ID NO: 305383 - RNA, 19 nt, Homo sapiens
ccaagaaagaugaauacau

SEQ ID NO: 305384 - RNA, 19 nt, Homo sapiens
gcgcaaaggccucugaacu

SEQ ID NO: 305385 - RNA, 19 nt, Homo sapiens
gagaagaugaagggcauga

SEQ ID NO: 305386 - RNA, 19 nt, Homo sapiens
ucuccgaugucauauggaa

SEQ ID NO: 305387 - RNA, 19 nt, Homo sapiens
cgacguggugcgccuguuu

SEQ ID NO: 305388 - RNA, 19 nt, Homo sapiens
ucuuugaaguagccaauga

SEQ ID NO: 305389 - RNA, 19 nt, Homo sapiens
uacaaggaguucuuugaag

SEQ ID NO: 305390 - RNA, 19 nt, Homo sapiens
gagcaucccggaggaaauc

SEQ ID NO: 305391 - RNA, 19 nt, Homo sapiens
gggacaggccucaccucua

SEQ ID NO: 305392 - RNA, 19 nt, Homo sapiens
gaaguagccaaugauguca

SEQ ID NO: 305393 - RNA, 19 nt, Homo sapiens
ccugaaaggaucauacaug

SEQ ID NO: 305394 - RNA, 19 nt, Homo sapiens
cugaguaucucgggaagga

SEQ ID NO: 305395 - RNA, 19 nt, Homo sapiens
uguaucaaacccacgauuu

SEQ ID NO: 305396 - RNA, 19 nt, Homo sapiens
ggcagaaggugcgcauagu

SEQ ID NO: 305397 - RNA, 19 nt, Homo sapiens
ccacauccagucccucuuc

SEQ ID NO: 305398 - RNA, 19 nt, Homo sapiens
uuuccgcacuucagaauuc

SEQ ID NO: 305399 - RNA, 19 nt, Homo sapiens
gcagaugaagaagcagaaa

SEQ ID NO: 305400 - RNA, 19 nt, Homo sapiens
agccugaucucuuccuguu

SEQ ID NO: 305401 - RNA, 19 nt, Homo sapiens
gaccugggacaucuggaaa

SEQ ID NO: 305402 - RNA, 19 nt, Homo sapiens
gagcuggcuguaccugaaa

SEQ ID NO: 305403 - RNA, 19 nt, Homo sapiens
cagcuccgguguggccuuu

SEQ ID NO: 305404 - RNA, 19 nt, Homo sapiens
ccugaucucuuccuguuuu

SEQ ID NO: 305405 - RNA, 19 nt, Homo sapiens
aguccugcuuccagaauuu

SEQ ID NO: 305406 - RNA, 19 nt, Homo sapiens
ggagaucuacaaggaguuc

SEQ ID NO: 305407 - RNA, 19 nt, Homo sapiens
cagacccacucacccucua

SEQ ID NO: 305408 - RNA, 19 nt, Homo sapiens
cccaguaggcaccaaauug

SEQ ID NO: 305409 - RNA, 19 nt, Homo sapiens
ucaguuccaagaaagauga

SEQ ID NO: 305410 - RNA, 19 nt, Homo sapiens
ggaagccuccugggacugu

SEQ ID NO: 305411 - RNA, 19 nt, Homo sapiens
gggcugggccaccuuucuu

SEQ ID NO: 305412 - RNA, 19 nt, Homo sapiens
gcugugaccgcaagaugga

SEQ ID NO: 305413 - RNA, 19 nt, Homo sapiens
ugaaggaggcagccagcuu

SEQ ID NO: 305414 - RNA, 19 nt, Homo sapiens
ggaagacgaggagaucuac

SEQ ID NO: 305415 - RNA, 19 nt, Homo sapiens
ucuaugaccugggacaucu

SEQ ID NO: 305416 - RNA, 19 nt, Homo sapiens
agucgcaagugcagaugaa

SEQ ID NO: 305417 - RNA, 19 nt, Homo sapiens
ucuacaaggaguucuuuga

SEQ ID NO: 305418 - RNA, 19 nt, Homo sapiens
ccucagccaagaccuacua

SEQ ID NO: 305419 - RNA, 19 nt, Homo sapiens
guccuaauuaccagucuuu

SEQ ID NO: 305420 - RNA, 19 nt, Homo sapiens
cccagucguuagaauauag

SEQ ID NO: 305421 - RNA, 19 nt, Homo sapiens
gcagcgcaaaggccucuga

SEQ ID NO: 305422 - RNA, 19 nt, Homo sapiens
ugcucuggcugcucuauga

SEQ ID NO: 305423 - RNA, 19 nt, Homo sapiens
gaaaucugcagagggguua

SEQ ID NO: 305424 - RNA, 19 nt, Homo sapiens
ggagcaucccggaggaaau

SEQ ID NO: 305425 - RNA, 19 nt, Homo sapiens
uuccauaucuugcgaaucc

SEQ ID NO: 305426 - RNA, 19 nt, Homo sapiens
gcuuguaggagcugagguu

SEQ ID NO: 305427 - RNA, 19 nt, Homo sapiens
gguccuaauuaccagucuu

SEQ ID NO: 305428 - RNA, 19 nt, Homo sapiens
guuagaauauaggucucuu

SEQ ID NO: 305429 - RNA, 19 nt, Homo sapiens
gaugaagaagcagaaagug

SEQ ID NO: 305430 - RNA, 19 nt, Homo sapiens
cgcaagugcagaugaagaa

SEQ ID NO: 305431 - RNA, 19 nt, Homo sapiens
agauggagguggcguucau

SEQ ID NO: 305432 - RNA, 19 nt, Homo sapiens
caguccugcuuccagaauu

SEQ ID NO: 305433 - RNA, 19 nt, Homo sapiens
gggcuccucccagcuugua

SEQ ID NO: 305434 - RNA, 19 nt, Homo sapiens
ucaccuagagccagaccaa

SEQ ID NO: 305435 - RNA, 19 nt, Homo sapiens
guaucaaacccacgauuuu

SEQ ID NO: 305436 - RNA, 19 nt, Homo sapiens
ggacuucggaccgcuugug

SEQ ID NO: 305437 - RNA, 19 nt, Homo sapiens
gcgcugugaccgcaagaug

SEQ ID NO: 305438 - RNA, 19 nt, Homo sapiens
gaaggucuccgaugucaua

SEQ ID NO: 305439 - RNA, 19 nt, Homo sapiens
uaaagcggcugaacacauu

SEQ ID NO: 305440 - RNA, 19 nt, Homo sapiens
gaucauacaugcgcuguga

SEQ ID NO: 305441 - RNA, 19 nt, Homo sapiens
ggacaggccucaccucuac

SEQ ID NO: 305442 - RNA, 19 nt, Homo sapiens
guaggcaucuuuauauguu

SEQ ID NO: 305443 - RNA, 19 nt, Homo sapiens
gcacauacacacaaaauua

SEQ ID NO: 305444 - RNA, 19 nt, Homo sapiens
gccgugagcuggugaagaa

SEQ ID NO: 305445 - RNA, 19 nt, Homo sapiens
ugaagaaggucuccgaugu

SEQ ID NO: 305446 - RNA, 19 nt, Homo sapiens
gcaaaggccucugaacuac

SEQ ID NO: 305447 - RNA, 19 nt, Homo sapiens
ggagcuggcuguaccugaa

SEQ ID NO: 305448 - RNA, 19 nt, Homo sapiens
gaucaugccuggguagugu

SEQ ID NO: 305449 - RNA, 19 nt, Homo sapiens
cagaguaggcaucuuuaua

SEQ ID NO: 305450 - RNA, 19 nt, Homo sapiens
gaguaggcaucuuuauaug

SEQ ID NO: 305451 - RNA, 19 nt, Homo sapiens
ugggacaucuggaaaggua

SEQ ID NO: 305452 - RNA, 19 nt, Homo sapiens
gcugagguuucacccuuaa

SEQ ID NO: 305453 - RNA, 19 nt, Homo sapiens
caaggaguucuuugaagua

SEQ ID NO: 305454 - RNA, 19 nt, Homo sapiens
ggccucaccucuacccaaa

SEQ ID NO: 305455 - RNA, 19 nt, Homo sapiens
acaaggaguucuuugaagu

SEQ ID NO: 305456 - RNA, 19 nt, Homo sapiens
acacagaguaggcaucuuu

SEQ ID NO: 305457 - RNA, 19 nt, Homo sapiens
gaaccuggcagaucuagag

SEQ ID NO: 305458 - RNA, 19 nt, Homo sapiens
ggucuccgaugucauaugg

SEQ ID NO: 305459 - RNA, 19 nt, Homo sapiens
uguaggagcugagguuuca

SEQ ID NO: 305460 - RNA, 19 nt, Homo sapiens
acgaggagaucuacaagga

SEQ ID NO: 305461 - RNA, 19 nt, Homo sapiens
ccacugucauccaggacua

SEQ ID NO: 305462 - RNA, 19 nt, Homo sapiens
agaguaggcaucuuuauau

SEQ ID NO: 305463 - RNA, 19 nt, Homo sapiens
cgcaaaggccucugaacua

SEQ ID NO: 305464 - RNA, 19 nt, Homo sapiens
cgucaucccuaccaacguu

SEQ ID NO: 305465 - RNA, 19 nt, Homo sapiens
gggaagacgaggagaucua

SEQ ID NO: 305466 - RNA, 19 nt, Homo sapiens
gaacacaucuaccccuaca

SEQ ID NO: 305467 - RNA, 19 nt, Homo sapiens
gaagaaggucuccgauguc

SEQ ID NO: 305468 - RNA, 19 nt, Homo sapiens
gcacuucagaauuccauau

SEQ ID NO: 305469 - RNA, 19 nt, Homo sapiens
ugacuacacucugucuuuc

SEQ ID NO: 305470 - RNA, 19 nt, Homo sapiens
gaagaugaagggcaugaag

SEQ ID NO: 305471 - RNA, 19 nt, Homo sapiens
gaccgugucucaaaacaaa

SEQ ID NO: 305472 - RNA, 19 nt, Homo sapiens
gaguauauuuccgcacuuc

SEQ ID NO: 305473 - RNA, 19 nt, Homo sapiens
cuacaaggaguucuuugaa

SEQ ID NO: 305474 - RNA, 19 nt, Homo sapiens
cuuagcacguguuagagua

SEQ ID NO: 305475 - RNA, 19 nt, Homo sapiens
cagaaggugcgcauaguga

SEQ ID NO: 305476 - RNA, 19 nt, Homo sapiens
caaacaaaagcuacucuua

SEQ ID NO: 305477 - RNA, 19 nt, Homo sapiens
guuccaagaaagaugaaua

SEQ ID NO: 305478 - RNA, 19 nt, Homo sapiens
ucacgcuggguccuaauua

SEQ ID NO: 305479 - RNA, 19 nt, Homo sapiens
gugacuacacucugucuuu

SEQ ID NO: 305480 - RNA, 19 nt, Homo sapiens
ugaaguagccaaugauguc

SEQ ID NO: 305481 - RNA, 19 nt, Homo sapiens
gaucuacaaggaguucuuu

SEQ ID NO: 305482 - RNA, 19 nt, Homo sapiens
gccaucaacccuuccauug

SEQ ID NO: 305483 - RNA, 19 nt, Homo sapiens
ggaguauauuuccgcacuu

SEQ ID NO: 305484 - RNA, 19 nt, Homo sapiens
ccuaauuaccagucuuuaa

SEQ ID NO: 305485 - RNA, 19 nt, Homo sapiens
gcagaaggugcgcauagug

SEQ ID NO: 305486 - RNA, 19 nt, Homo sapiens
cuucagaauuccauaucuu

SEQ ID NO: 305487 - RNA, 19 nt, Homo sapiens
cggaaccgcucaccuagag

SEQ ID NO: 305488 - RNA, 19 nt, Homo sapiens
aaaggccucugaacuacug

SEQ ID NO: 305489 - RNA, 19 nt, Homo sapiens
gaccuacuaucgggaugaa

SEQ ID NO: 305490 - RNA, 19 nt, Homo sapiens
uagggaaccuggcagaucu

SEQ ID NO: 305491 - RNA, 19 nt, Homo sapiens
aagaaggucuccgauguca

SEQ ID NO: 305492 - RNA, 19 nt, Homo sapiens
acacugauacccagcuaaa

SEQ ID NO: 305493 - RNA, 19 nt, Homo sapiens
ccaagaaagaugaauacau

SEQ ID NO: 305494 - RNA, 19 nt, Homo sapiens
gcgcaaaggccucugaacu

SEQ ID NO: 305495 - RNA, 19 nt, Homo sapiens
gagaagaugaagggcauga

SEQ ID NO: 305496 - RNA, 19 nt, Homo sapiens
ucuccgaugucauauggaa

SEQ ID NO: 305497 - RNA, 19 nt, Homo sapiens
gggcggaagugggaaacga

SEQ ID NO: 305498 - RNA, 19 nt, Homo sapiens
ucuuugaaguagccaauga

SEQ ID NO: 305499 - RNA, 19 nt, Homo sapiens
uacaaggaguucuuugaag

SEQ ID NO: 305500 - RNA, 19 nt, Homo sapiens
cgacguggugcgccuguuu

SEQ ID NO: 305501 - RNA, 19 nt, Homo sapiens
gagcaucccggaggaaauc

SEQ ID NO: 305502 - RNA, 19 nt, Homo sapiens
gggacaggccucaccucua

SEQ ID NO: 305503 - RNA, 19 nt, Homo sapiens
gaaguagccaaugauguca

SEQ ID NO: 305504 - RNA, 19 nt, Homo sapiens
gcacacagaguaggcaucu

SEQ ID NO: 305505 - RNA, 19 nt, Homo sapiens
ccugaaaggaucauacaug

SEQ ID NO: 305506 - RNA, 19 nt, Homo sapiens
agacacugauacccagcua

SEQ ID NO: 305507 - RNA, 19 nt, Homo sapiens
uguaucaaacccacgauuu

SEQ ID NO: 305508 - RNA, 19 nt, Homo sapiens
ggcagaaggugcgcauagu

SEQ ID NO: 305509 - RNA, 19 nt, Homo sapiens
ccacauccagucccucuuc

SEQ ID NO: 305510 - RNA, 19 nt, Homo sapiens
uuuccgcacuucagaauuc

SEQ ID NO: 305511 - RNA, 19 nt, Homo sapiens
gcagaugaagaagcagaaa

SEQ ID NO: 305512 - RNA, 19 nt, Homo sapiens
acucuuagcacguguuaga

SEQ ID NO: 305513 - RNA, 19 nt, Homo sapiens
agccugaucucuuccuguu

SEQ ID NO: 305514 - RNA, 19 nt, Homo sapiens
cacagaguaggcaucuuua

SEQ ID NO: 305515 - RNA, 19 nt, Homo sapiens
gaccugggacaucuggaaa

SEQ ID NO: 305516 - RNA, 19 nt, Homo sapiens
gagcuggcuguaccugaaa

SEQ ID NO: 305517 - RNA, 19 nt, Homo sapiens
cagcuccgguguggccuuu

SEQ ID NO: 305518 - RNA, 19 nt, Homo sapiens
cugaacacauuuacucucu

SEQ ID NO: 305519 - RNA, 19 nt, Homo sapiens
ccugaucucuuccuguuuu

SEQ ID NO: 305520 - RNA, 19 nt, Homo sapiens
aguccugcuuccagaauuu

SEQ ID NO: 305521 - RNA, 19 nt, Homo sapiens
ggagaucuacaaggaguuc

SEQ ID NO: 305522 - RNA, 19 nt, Homo sapiens
cagacccacucacccucua

SEQ ID NO: 305523 - RNA, 19 nt, Homo sapiens
cccaguaggcaccaaauug

SEQ ID NO: 305524 - RNA, 19 nt, Homo sapiens
ucaguuccaagaaagauga

SEQ ID NO: 305525 - RNA, 19 nt, Homo sapiens
ggaagccuccugggacugu

SEQ ID NO: 305526 - RNA, 19 nt, Homo sapiens
gggcugggccaccuuucuu

SEQ ID NO: 305527 - RNA, 19 nt, Homo sapiens
gcugugaccgcaagaugga

SEQ ID NO: 305528 - RNA, 19 nt, Homo sapiens
ugaaggaggcagccagcuu

SEQ ID NO: 305529 - RNA, 19 nt, Homo sapiens
cuaaagcggcugaacacau

SEQ ID NO: 305530 - RNA, 19 nt, Homo sapiens
ggaagacgaggagaucuac

SEQ ID NO: 305531 - RNA, 19 nt, Homo sapiens
ucuaugaccugggacaucu

SEQ ID NO: 305532 - RNA, 19 nt, Homo sapiens
agucgcaagugcagaugaa

SEQ ID NO: 305533 - RNA, 19 nt, Homo sapiens
ucuacaaggaguucuuuga

SEQ ID NO: 305534 - RNA, 19 nt, Homo sapiens
ccucagccaagaccuacua

SEQ ID NO: 305535 - RNA, 19 nt, Homo sapiens
guccuaauuaccagucuuu

SEQ ID NO: 305536 - RNA, 19 nt, Homo sapiens
cccagucguuagaauauag

SEQ ID NO: 305537 - RNA, 19 nt, Homo sapiens
gcagcgcaaaggccucuga

SEQ ID NO: 305538 - RNA, 19 nt, Homo sapiens
gaaggucuccgaugucaua

SEQ ID NO: 305539 - RNA, 19 nt, Homo sapiens
gaucauacaugcgcuguga

SEQ ID NO: 305540 - RNA, 19 nt, Homo sapiens
ggacaggccucaccucuac

SEQ ID NO: 305541 - RNA, 19 nt, Homo sapiens
gcacauacacacaaaauua

SEQ ID NO: 305542 - RNA, 19 nt, Homo sapiens
gccgugagcuggugaagaa

SEQ ID NO: 305543 - RNA, 19 nt, Homo sapiens
ugaagaaggucuccgaugu

SEQ ID NO: 305544 - RNA, 19 nt, Homo sapiens
gcaaaggccucugaacuac

SEQ ID NO: 305545 - RNA, 19 nt, Homo sapiens
ggagcuggcuguaccugaa

SEQ ID NO: 305546 - RNA, 19 nt, Homo sapiens
gaucaugccuggguagugu

SEQ ID NO: 305547 - RNA, 19 nt, Homo sapiens
ugggacaucuggaaaggua

SEQ ID NO: 305548 - RNA, 19 nt, Homo sapiens
gcugagguuucacccuuaa

SEQ ID NO: 305549 - RNA, 19 nt, Homo sapiens
caaggaguucuuugaagua

SEQ ID NO: 305550 - RNA, 19 nt, Homo sapiens
ggccucaccucuacccaaa

SEQ ID NO: 305551 - RNA, 19 nt, Homo sapiens
acaaggaguucuuugaagu

SEQ ID NO: 305552 - RNA, 19 nt, Homo sapiens
gcacacagacaaccugauc

SEQ ID NO: 305553 - RNA, 19 nt, Homo sapiens
gaaccuggcagaucuagag

SEQ ID NO: 305554 - RNA, 19 nt, Homo sapiens
ggucuccgaugucauaugg

SEQ ID NO: 305555 - RNA, 19 nt, Homo sapiens
uguaggagcugagguuuca

SEQ ID NO: 305556 - RNA, 19 nt, Homo sapiens
acgaggagaucuacaagga

SEQ ID NO: 305557 - RNA, 19 nt, Homo sapiens
ccacugucauccaggacua

SEQ ID NO: 305558 - RNA, 19 nt, Homo sapiens
cgcaaaggccucugaacua

SEQ ID NO: 305559 - RNA, 19 nt, Homo sapiens
cgucaucccuaccaacguu

SEQ ID NO: 305560 - RNA, 19 nt, Homo sapiens
gggaagacgaggagaucua

SEQ ID NO: 305561 - RNA, 19 nt, Homo sapiens
gaacacaucuaccccuaca

SEQ ID NO: 305562 - RNA, 19 nt, Homo sapiens
gaagaaggucuccgauguc

SEQ ID NO: 305563 - RNA, 19 nt, Homo sapiens
gcacuucagaauuccauau

SEQ ID NO: 305564 - RNA, 19 nt, Homo sapiens
ugacuacacucugucuuuc

SEQ ID NO: 305565 - RNA, 19 nt, Homo sapiens
gaagaugaagggcaugaag

SEQ ID NO: 305566 - RNA, 19 nt, Homo sapiens
gaccgugucucaaaacaaa

SEQ ID NO: 305567 - RNA, 19 nt, Homo sapiens
gaguauauuuccgcacuuc

SEQ ID NO: 305568 - RNA, 19 nt, Homo sapiens
cuacaaggaguucuuugaa

SEQ ID NO: 305569 - RNA, 19 nt, Homo sapiens
cuuagcacguguuagagua

SEQ ID NO: 305570 - RNA, 19 nt, Homo sapiens
cagaaggugcgcauaguga

SEQ ID NO: 305571 - RNA, 19 nt, Homo sapiens
caaacaaaagcuacucuua

SEQ ID NO: 305572 - RNA, 19 nt, Homo sapiens
guuccaagaaagaugaaua

SEQ ID NO: 305573 - RNA, 19 nt, Homo sapiens
ucacgcuggguccuaauua

SEQ ID NO: 305574 - RNA, 19 nt, Homo sapiens
gugacuacacucugucuuu

SEQ ID NO: 305575 - RNA, 19 nt, Homo sapiens
ugaaguagccaaugauguc

SEQ ID NO: 305576 - RNA, 19 nt, Homo sapiens
gaucuacaaggaguucuuu

SEQ ID NO: 305577 - RNA, 19 nt, Homo sapiens
gccaucaacccuuccauug

SEQ ID NO: 305578 - RNA, 19 nt, Homo sapiens
ggaguauauuuccgcacuu

SEQ ID NO: 305579 - RNA, 19 nt, Homo sapiens
ccuaauuaccagucuuuaa

SEQ ID NO: 305580 - RNA, 19 nt, Homo sapiens
gcagaaggugcgcauagug

SEQ ID NO: 305581 - RNA, 19 nt, Homo sapiens
cuucagaauuccauaucuu

SEQ ID NO: 305582 - RNA, 19 nt, Homo sapiens
cggaaccgcucaccuagag

SEQ ID NO: 305583 - RNA, 19 nt, Homo sapiens
aaaggccucugaacuacug

SEQ ID NO: 305584 - RNA, 19 nt, Homo sapiens
gaccuacuaucgggaugaa

SEQ ID NO: 305585 - RNA, 19 nt, Homo sapiens
uagggaaccuggcagaucu

SEQ ID NO: 305586 - RNA, 19 nt, Homo sapiens
aagaaggucuccgauguca

SEQ ID NO: 305587 - RNA, 19 nt, Homo sapiens
ccaagaaagaugaauacau

SEQ ID NO: 305588 - RNA, 19 nt, Homo sapiens
gcgcaaaggccucugaacu

SEQ ID NO: 305589 - RNA, 19 nt, Homo sapiens
gagaagaugaagggcauga

SEQ ID NO: 305590 - RNA, 19 nt, Homo sapiens
ucuccgaugucauauggaa

SEQ ID NO: 305591 - RNA, 19 nt, Homo sapiens
gggcggaagugggaaacga

SEQ ID NO: 305592 - RNA, 19 nt, Homo sapiens
ucuuugaaguagccaauga

SEQ ID NO: 305593 - RNA, 19 nt, Homo sapiens
uacaaggaguucuuugaag

SEQ ID NO: 305594 - RNA, 19 nt, Homo sapiens
cgacguggugcgccuguuu

SEQ ID NO: 305595 - RNA, 19 nt, Homo sapiens
gagcaucccggaggaaauc

SEQ ID NO: 305596 - RNA, 19 nt, Homo sapiens
gggacaggccucaccucua

SEQ ID NO: 305597 - RNA, 19 nt, Homo sapiens
gaaguagccaaugauguca

SEQ ID NO: 305598 - RNA, 19 nt, Homo sapiens
ccugaaaggaucauacaug

SEQ ID NO: 305599 - RNA, 19 nt, Homo sapiens
uguaucaaacccacgauuu

SEQ ID NO: 305600 - RNA, 19 nt, Homo sapiens
ggcagaaggugcgcauagu

SEQ ID NO: 305601 - RNA, 19 nt, Homo sapiens
ccacauccagucccucuuc

SEQ ID NO: 305602 - RNA, 19 nt, Homo sapiens
acucuuagcacguguuaga

SEQ ID NO: 305603 - RNA, 19 nt, Homo sapiens
uuuccgcacuucagaauuc

SEQ ID NO: 305604 - RNA, 19 nt, Homo sapiens
gcagaugaagaagcagaaa

SEQ ID NO: 305605 - RNA, 19 nt, Homo sapiens
agccugaucucuuccuguu

SEQ ID NO: 305606 - RNA, 19 nt, Homo sapiens
gaccugggacaucuggaaa

SEQ ID NO: 305607 - RNA, 19 nt, Homo sapiens
gagcuggcuguaccugaaa

SEQ ID NO: 305608 - RNA, 19 nt, Homo sapiens
cagcuccgguguggccuuu

SEQ ID NO: 305609 - RNA, 19 nt, Homo sapiens
ccugaucucuuccuguuuu

SEQ ID NO: 305610 - RNA, 19 nt, Homo sapiens
aguccugcuuccagaauuu

SEQ ID NO: 305611 - RNA, 19 nt, Homo sapiens
acacagacaaccugaucuu

SEQ ID NO: 305612 - RNA, 19 nt, Homo sapiens
ggagaucuacaaggaguuc

SEQ ID NO: 305613 - RNA, 19 nt, Homo sapiens
cagacccacucacccucua

SEQ ID NO: 305614 - RNA, 19 nt, Homo sapiens
cccaguaggcaccaaauug

SEQ ID NO: 305615 - RNA, 19 nt, Homo sapiens
ucaguuccaagaaagauga

SEQ ID NO: 305616 - RNA, 19 nt, Homo sapiens
ggaagccuccugggacugu

SEQ ID NO: 305617 - RNA, 19 nt, Homo sapiens
gggcugggccaccuuucuu

SEQ ID NO: 305618 - RNA, 19 nt, Homo sapiens
gcugugaccgcaagaugga

SEQ ID NO: 305619 - RNA, 19 nt, Homo sapiens
ugaaggaggcagccagcuu

SEQ ID NO: 305620 - RNA, 19 nt, Homo sapiens
ggaagacgaggagaucuac

SEQ ID NO: 305621 - RNA, 19 nt, Homo sapiens
ucuaugaccugggacaucu

SEQ ID NO: 305622 - RNA, 19 nt, Homo sapiens
agucgcaagugcagaugaa

SEQ ID NO: 305623 - RNA, 19 nt, Homo sapiens
ucuacaaggaguucuuuga

SEQ ID NO: 305624 - RNA, 19 nt, Homo sapiens
ccucagccaagaccuacua

SEQ ID NO: 305625 - RNA, 19 nt, Homo sapiens
guccuaauuaccagucuuu

SEQ ID NO: 305626 - RNA, 19 nt, Homo sapiens
cccagucguuagaauauag

SEQ ID NO: 305627 - RNA, 19 nt, Homo sapiens
gcagcgcaaaggccucuga

SEQ ID NO: 305628 - RNA, 19 nt, Homo sapiens
ugcucuggcugcucuauga

SEQ ID NO: 305629 - RNA, 19 nt, Homo sapiens
gaaaucugcagagggguua

SEQ ID NO: 305630 - RNA, 19 nt, Homo sapiens
ggagcaucccggaggaaau

SEQ ID NO: 305631 - RNA, 19 nt, Homo sapiens
uuccauaucuugcgaaucc

SEQ ID NO: 305632 - RNA, 19 nt, Homo sapiens
gcuuguaggagcugagguu

SEQ ID NO: 305633 - RNA, 19 nt, Homo sapiens
cuacucuuagcacguguua

SEQ ID NO: 305634 - RNA, 19 nt, Homo sapiens
gguccuaauuaccagucuu

SEQ ID NO: 305635 - RNA, 19 nt, Homo sapiens
guuagaauauaggucucuu

SEQ ID NO: 305636 - RNA, 19 nt, Homo sapiens
gaugaagaagcagaaagug

SEQ ID NO: 305637 - RNA, 19 nt, Homo sapiens
cgcaagugcagaugaagaa

SEQ ID NO: 305638 - RNA, 19 nt, Homo sapiens
ggaaacagcuucagagaua

SEQ ID NO: 305639 - RNA, 19 nt, Homo sapiens
caaaugagauggcugguua

SEQ ID NO: 305640 - RNA, 19 nt, Homo sapiens
gauaugagauugcgguaaa

SEQ ID NO: 305641 - RNA, 19 nt, Homo sapiens
guacgcagauguaaucauu

SEQ ID NO: 305642 - RNA, 19 nt, Homo sapiens
gaaaaugauugccaaauga

SEQ ID NO: 305643 - RNA, 19 nt, Homo sapiens
gggaggaaaugcuagguuu

SEQ ID NO: 305644 - RNA, 19 nt, Homo sapiens
gagcucaauucacuuugua

SEQ ID NO: 305645 - RNA, 19 nt, Homo sapiens
gaaaggagaguucagacaa

SEQ ID NO: 305646 - RNA, 19 nt, Homo sapiens
acacaucccugucuccaaa

SEQ ID NO: 305647 - RNA, 19 nt, Homo sapiens
gggcugugcuccagagaaa

SEQ ID NO: 305648 - RNA, 19 nt, Homo sapiens
ggaagguucuccagugaca

SEQ ID NO: 305649 - RNA, 19 nt, Homo sapiens
gagaggagcuuuggaacca

SEQ ID NO: 305650 - RNA, 19 nt, Homo sapiens
ggaaaaugauugccaaaug

SEQ ID NO: 305651 - RNA, 19 nt, Homo sapiens
caaauuuguuggcuaagug

SEQ ID NO: 305652 - RNA, 19 nt, Homo sapiens
gaacaacuaggagcugaaa

SEQ ID NO: 305653 - RNA, 19 nt, Homo sapiens
ucugagaacugacuagaga

SEQ ID NO: 305654 - RNA, 19 nt, Homo sapiens
ugacucggcuccgcagaua

SEQ ID NO: 305655 - RNA, 19 nt, Homo sapiens
ccaaugagacagagaagaa

SEQ ID NO: 305656 - RNA, 19 nt, Homo sapiens
ggaaaguaaaugcuucaaa

SEQ ID NO: 305657 - RNA, 19 nt, Homo sapiens
gaggacugauggccaaaga

SEQ ID NO: 305658 - RNA, 19 nt, Homo sapiens
cguagaggcuggaaagugu

SEQ ID NO: 305659 - RNA, 19 nt, Homo sapiens
caagagcuguggaaaauga

SEQ ID NO: 305660 - RNA, 19 nt, Homo sapiens
gaugacauuugaggacuga

SEQ ID NO: 305661 - RNA, 19 nt, Homo sapiens
ggagaaaggagaguucaga

SEQ ID NO: 305662 - RNA, 19 nt, Homo sapiens
guggaacccuggaguggaa

SEQ ID NO: 305663 - RNA, 19 nt, Homo sapiens
gaguuuggaucucuuguac

SEQ ID NO: 305664 - RNA, 19 nt, Homo sapiens
caacguagaggcuggaaag

SEQ ID NO: 305665 - RNA, 19 nt, Homo sapiens
gcuggcgacucggaaagua

SEQ ID NO: 305666 - RNA, 19 nt, Homo sapiens
gcuguguguucuacaaaug

SEQ ID NO: 305667 - RNA, 19 nt, Homo sapiens
gcagauguaaucauucaca

SEQ ID NO: 305668 - RNA, 19 nt, Homo sapiens
agacagagaagaaaucauc

SEQ ID NO: 305669 - RNA, 19 nt, Homo sapiens
gcacugccaaugagacaga

SEQ ID NO: 305670 - RNA, 19 nt, Homo sapiens
ggauggauuuaagcucuug

SEQ ID NO: 305671 - RNA, 19 nt, Homo sapiens
gcagaguuugcccaucaua

SEQ ID NO: 305672 - RNA, 19 nt, Homo sapiens
ggcaagagcuguggaaaau

SEQ ID NO: 305673 - RNA, 19 nt, Homo sapiens
guaaaugcuucaaaaggaa

SEQ ID NO: 305674 - RNA, 19 nt, Homo sapiens
gaaacagcuucagagauac

SEQ ID NO: 305675 - RNA, 19 nt, Homo sapiens
gaaaguguccccugcauuc

SEQ ID NO: 305676 - RNA, 19 nt, Homo sapiens
cgagcucaauucacuuugu

SEQ ID NO: 305677 - RNA, 19 nt, Homo sapiens
acgcagauguaaucauuca

SEQ ID NO: 305678 - RNA, 19 nt, Homo sapiens
gugagggccuggagaugug

SEQ ID NO: 305679 - RNA, 19 nt, Homo sapiens
gagcagcuacuccuuuuaa

SEQ ID NO: 305680 - RNA, 19 nt, Homo sapiens
gacaagaaugaacccauga

SEQ ID NO: 305681 - RNA, 19 nt, Homo sapiens
gaaugaggagagucaagga

SEQ ID NO: 305682 - RNA, 19 nt, Homo sapiens
ccugggagucuuaggauuu

SEQ ID NO: 305683 - RNA, 19 nt, Homo sapiens
gggauggauuuaagcucuu

SEQ ID NO: 305684 - RNA, 19 nt, Homo sapiens
gaacugacuagagaagaca

SEQ ID NO: 305685 - RNA, 19 nt, Homo sapiens
caucuuucccugacucuug

SEQ ID NO: 305686 - RNA, 19 nt, Homo sapiens
aggagcacaucuucacuga

SEQ ID NO: 305687 - RNA, 19 nt, Homo sapiens
guucagacaaccaggagaa

SEQ ID NO: 305688 - RNA, 19 nt, Homo sapiens
cagaguuugcccaucauaa

SEQ ID NO: 305689 - RNA, 19 nt, Homo sapiens
aaaggaaggaaaugacaga

SEQ ID NO: 305690 - RNA, 19 nt, Homo sapiens
gaaguggaagcgugugaag

SEQ ID NO: 305691 - RNA, 19 nt, Homo sapiens
guccagaugcugaguuguu

SEQ ID NO: 305692 - RNA, 19 nt, Homo sapiens
gaaggaaaugacagagaca

SEQ ID NO: 305693 - RNA, 19 nt, Homo sapiens
ggcagccucuccacaucuu

SEQ ID NO: 305694 - RNA, 19 nt, Homo sapiens
ccacagccucuccaaguuc

SEQ ID NO: 305695 - RNA, 19 nt, Homo sapiens
caacgugaguuuggaucuc

SEQ ID NO: 305696 - RNA, 19 nt, Homo sapiens
cugcacaucugaggcuuug

SEQ ID NO: 305697 - RNA, 19 nt, Homo sapiens
aaaggagaguucagacaac

SEQ ID NO: 305698 - RNA, 19 nt, Homo sapiens
ggugagggccuggagaugu

SEQ ID NO: 305699 - RNA, 19 nt, Homo sapiens
caagaaugaacccaugaca

SEQ ID NO: 305700 - RNA, 19 nt, Homo sapiens
cuucagagauacugcuucu

SEQ ID NO: 305701 - RNA, 19 nt, Homo sapiens
caaugagacagagaagaaa

SEQ ID NO: 305702 - RNA, 19 nt, Homo sapiens
uuccagaaccgaaggauga

SEQ ID NO: 305703 - RNA, 19 nt, Homo sapiens
ggaggucaacgugaguuug

SEQ ID NO: 305704 - RNA, 19 nt, Homo sapiens
gagcacugccaaugagaca

SEQ ID NO: 305705 - RNA, 19 nt, Homo sapiens
gagaacugacuagagaaga

SEQ ID NO: 305706 - RNA, 19 nt, Homo sapiens
gaaucagacagagauccua

SEQ ID NO: 305707 - RNA, 19 nt, Homo sapiens
ugaguuuggaucucuugua

SEQ ID NO: 305708 - RNA, 19 nt, Homo sapiens
uugacuggguggacaagaa

SEQ ID NO: 305709 - RNA, 19 nt, Homo sapiens
ucuguaggcugcacaucug

SEQ ID NO: 305710 - RNA, 19 nt, Homo sapiens
ccucuucccuagggccuuu

SEQ ID NO: 305711 - RNA, 19 nt, Homo sapiens
cacagccucuccaaguuca

SEQ ID NO: 305712 - RNA, 19 nt, Homo sapiens
ucucuuguacgcagaugua

SEQ ID NO: 305713 - RNA, 19 nt, Homo sapiens
cagaaacacaucccugucu

SEQ ID NO: 305714 - RNA, 19 nt, Homo sapiens
gcugcaagccagaaacaca

SEQ ID NO: 305715 - RNA, 19 nt, Homo sapiens
acacucucauggaaucaga

SEQ ID NO: 305716 - RNA, 19 nt, Homo sapiens
uccacagccucuccaaguu

SEQ ID NO: 305717 - RNA, 19 nt, Homo sapiens
accgaaggaugaaguggaa

SEQ ID NO: 305718 - RNA, 19 nt, Homo sapiens
ugugcgagcucaauucacu

SEQ ID NO: 305719 - RNA, 19 nt, Homo sapiens
ccaggaggagcacaucuuc

SEQ ID NO: 305720 - RNA, 19 nt, Homo sapiens
gaggucaacgugaguuugg

SEQ ID NO: 305721 - RNA, 19 nt, Homo sapiens
uucuggagaugacauuuga

SEQ ID NO: 305722 - RNA, 19 nt, Homo sapiens
ugacuagagaagacagaaa

SEQ ID NO: 305723 - RNA, 19 nt, Homo sapiens
cauggaaucagacagagau

SEQ ID NO: 305724 - RNA, 19 nt, Homo sapiens
ucucauggaaucagacaga

SEQ ID NO: 305725 - RNA, 19 nt, Homo sapiens
gggaggucaacgugaguuu

SEQ ID NO: 305726 - RNA, 19 nt, Homo sapiens
ccaaaugagauggcugguu

SEQ ID NO: 305727 - RNA, 19 nt, Homo sapiens
uccagaugcugaguuguug

SEQ ID NO: 305728 - RNA, 19 nt, Homo sapiens
uugaaaaccuguccagaug

SEQ ID NO: 305729 - RNA, 19 nt, Homo sapiens
ggagagucaaggacagcaa

SEQ ID NO: 305730 - RNA, 19 nt, Homo sapiens
uugcccaccuuccucugua

SEQ ID NO: 305731 - RNA, 19 nt, Homo sapiens
uccuaccgcuguucuccua

SEQ ID NO: 305732 - RNA, 19 nt, Homo sapiens
ccacccaugccuccuccua

SEQ ID NO: 305733 - RNA, 19 nt, Homo sapiens
ccggaugaaucuggaaaca

SEQ ID NO: 305734 - RNA, 19 nt, Homo sapiens
cagcauuccugggagucuu

SEQ ID NO: 305735 - RNA, 19 nt, Homo sapiens
gcagcaaagcccgcaagga

SEQ ID NO: 305736 - RNA, 19 nt, Homo sapiens
ucaaagugugguuccagaa

SEQ ID NO: 305737 - RNA, 19 nt, Homo sapiens
gcucaauucacuuuguaag

SEQ ID NO: 305738 - RNA, 19 nt, Homo sapiens
ggaaacagcuucagagaua

SEQ ID NO: 305739 - RNA, 19 nt, Homo sapiens
caaaugagauggcugguua

SEQ ID NO: 305740 - RNA, 19 nt, Homo sapiens
guacgcagauguaaucauu

SEQ ID NO: 305741 - RNA, 19 nt, Homo sapiens
gaaaaugauugccaaauga

SEQ ID NO: 305742 - RNA, 19 nt, Homo sapiens
gggaggaaaugcuagguuu

SEQ ID NO: 305743 - RNA, 19 nt, Homo sapiens
gagcucaauucacuuugua

SEQ ID NO: 305744 - RNA, 19 nt, Homo sapiens
acacaucccugucuccaaa

SEQ ID NO: 305745 - RNA, 19 nt, Homo sapiens
gggcugugcuccagagaaa

SEQ ID NO: 305746 - RNA, 19 nt, Homo sapiens
ggaagguucuccagugaca

SEQ ID NO: 305747 - RNA, 19 nt, Homo sapiens
gagaggagcuuuggaacca

SEQ ID NO: 305748 - RNA, 19 nt, Homo sapiens
ggaaaaugauugccaaaug

SEQ ID NO: 305749 - RNA, 19 nt, Homo sapiens
caaauuuguuggcuaagug

SEQ ID NO: 305750 - RNA, 19 nt, Homo sapiens
gaacaacuaggagcugaaa

SEQ ID NO: 305751 - RNA, 19 nt, Homo sapiens
ucugagaacugacuagaga

SEQ ID NO: 305752 - RNA, 19 nt, Homo sapiens
ccaaugagacagagaagaa

SEQ ID NO: 305753 - RNA, 19 nt, Homo sapiens
ggaaaguaaaugcuucaaa

SEQ ID NO: 305754 - RNA, 19 nt, Homo sapiens
gaggacugauggccaaaga

SEQ ID NO: 305755 - RNA, 19 nt, Homo sapiens
cguagaggcuggaaagugu

SEQ ID NO: 305756 - RNA, 19 nt, Homo sapiens
caagagcuguggaaaauga

SEQ ID NO: 305757 - RNA, 19 nt, Homo sapiens
gaugacauuugaggacuga

SEQ ID NO: 305758 - RNA, 19 nt, Homo sapiens
guggaacccuggaguggaa

SEQ ID NO: 305759 - RNA, 19 nt, Homo sapiens
gaguuuggaucucuuguac

SEQ ID NO: 305760 - RNA, 19 nt, Homo sapiens
caacguagaggcuggaaag

SEQ ID NO: 305761 - RNA, 19 nt, Homo sapiens
gcuggcgacucggaaagua

SEQ ID NO: 305762 - RNA, 19 nt, Homo sapiens
gcuguguguucuacaaaug

SEQ ID NO: 305763 - RNA, 19 nt, Homo sapiens
gcagauguaaucauucaca

SEQ ID NO: 305764 - RNA, 19 nt, Homo sapiens
agacagagaagaaaucauc

SEQ ID NO: 305765 - RNA, 19 nt, Homo sapiens
gcacugccaaugagacaga

SEQ ID NO: 305766 - RNA, 19 nt, Homo sapiens
ggauggauuuaagcucuug

SEQ ID NO: 305767 - RNA, 19 nt, Homo sapiens
ggcaagagcuguggaaaau

SEQ ID NO: 305768 - RNA, 19 nt, Homo sapiens
guaaaugcuucaaaaggaa

SEQ ID NO: 305769 - RNA, 19 nt, Homo sapiens
gaaacagcuucagagauac

SEQ ID NO: 305770 - RNA, 19 nt, Homo sapiens
aaggagaguucaggucaaa

SEQ ID NO: 305771 - RNA, 19 nt, Homo sapiens
gaaaguguccccugcauuc

SEQ ID NO: 305772 - RNA, 19 nt, Homo sapiens
ggagaguucaggucaaagu

SEQ ID NO: 305773 - RNA, 19 nt, Homo sapiens
cgagcucaauucacuuugu

SEQ ID NO: 305774 - RNA, 19 nt, Homo sapiens
acgcagauguaaucauuca

SEQ ID NO: 305775 - RNA, 19 nt, Homo sapiens
gugagggccuggagaugug

SEQ ID NO: 305776 - RNA, 19 nt, Homo sapiens
gagcagcuacuccuuuuaa

SEQ ID NO: 305777 - RNA, 19 nt, Homo sapiens
gacaagaaugaacccauga

SEQ ID NO: 305778 - RNA, 19 nt, Homo sapiens
gaaugaggagagucaagga

SEQ ID NO: 305779 - RNA, 19 nt, Homo sapiens
ccugggagucuuaggauuu

SEQ ID NO: 305780 - RNA, 19 nt, Homo sapiens
gggauggauuuaagcucuu

SEQ ID NO: 305781 - RNA, 19 nt, Homo sapiens
aggagcacaucuucacuga

SEQ ID NO: 305782 - RNA, 19 nt, Homo sapiens
gaacugacuagagaagaca

SEQ ID NO: 305783 - RNA, 19 nt, Homo sapiens
caucuuucccugacucuug

SEQ ID NO: 305784 - RNA, 19 nt, Homo sapiens
aaaggagaguucaggucaa

SEQ ID NO: 305785 - RNA, 19 nt, Homo sapiens
aaaggaaggaaaugacaga

SEQ ID NO: 305786 - RNA, 19 nt, Homo sapiens
gaaguggaagcgugugaag

SEQ ID NO: 305787 - RNA, 19 nt, Homo sapiens
guccagaugcugaguuguu

SEQ ID NO: 305788 - RNA, 19 nt, Homo sapiens
gaaggaaaugacagagaca

SEQ ID NO: 305789 - RNA, 19 nt, Homo sapiens
ggcagccucuccacaucuu

SEQ ID NO: 305790 - RNA, 19 nt, Homo sapiens
ccacagccucuccaaguuc

SEQ ID NO: 305791 - RNA, 19 nt, Homo sapiens
caacgugaguuuggaucuc

SEQ ID NO: 305792 - RNA, 19 nt, Homo sapiens
cugcacaucugaggcuuug

SEQ ID NO: 305793 - RNA, 19 nt, Homo sapiens
ggugagggccuggagaugu

SEQ ID NO: 305794 - RNA, 19 nt, Homo sapiens
caagaaugaacccaugaca

SEQ ID NO: 305795 - RNA, 19 nt, Homo sapiens
cuucagagauacugcuucu

SEQ ID NO: 305796 - RNA, 19 nt, Homo sapiens
caaugagacagagaagaaa

SEQ ID NO: 305797 - RNA, 19 nt, Homo sapiens
uuccagaaccgaaggauga

SEQ ID NO: 305798 - RNA, 19 nt, Homo sapiens
ggaggucaacgugaguuug

SEQ ID NO: 305799 - RNA, 19 nt, Homo sapiens
gagaacugacuagagaaga

SEQ ID NO: 305800 - RNA, 19 nt, Homo sapiens
gaaucagacagagauccua

SEQ ID NO: 305801 - RNA, 19 nt, Homo sapiens
gagcacugccaaugagaca

SEQ ID NO: 305802 - RNA, 19 nt, Homo sapiens
ugaguuuggaucucuugua

SEQ ID NO: 305803 - RNA, 19 nt, Homo sapiens
uugacuggguggacaagaa

SEQ ID NO: 305804 - RNA, 19 nt, Homo sapiens
ucuguaggcugcacaucug

SEQ ID NO: 305805 - RNA, 19 nt, Homo sapiens
ccucuucccuagggccuuu

SEQ ID NO: 305806 - RNA, 19 nt, Homo sapiens
cacagccucuccaaguuca

SEQ ID NO: 305807 - RNA, 19 nt, Homo sapiens
ucucuuguacgcagaugua

SEQ ID NO: 305808 - RNA, 19 nt, Homo sapiens
cagaaacacaucccugucu

SEQ ID NO: 305809 - RNA, 19 nt, Homo sapiens
gcugcaagccagaaacaca

SEQ ID NO: 305810 - RNA, 19 nt, Homo sapiens
acacucucauggaaucaga

SEQ ID NO: 305811 - RNA, 19 nt, Homo sapiens
uccacagccucuccaaguu

SEQ ID NO: 305812 - RNA, 19 nt, Homo sapiens
accgaaggaugaaguggaa

SEQ ID NO: 305813 - RNA, 19 nt, Homo sapiens
ugugcgagcucaauucacu

SEQ ID NO: 305814 - RNA, 19 nt, Homo sapiens
ccaggaggagcacaucuuc

SEQ ID NO: 305815 - RNA, 19 nt, Homo sapiens
gaggucaacgugaguuugg

SEQ ID NO: 305816 - RNA, 19 nt, Homo sapiens
uucuggagaugacauuuga

SEQ ID NO: 305817 - RNA, 19 nt, Homo sapiens
ugacuagagaagacagaaa

SEQ ID NO: 305818 - RNA, 19 nt, Homo sapiens
cauggaaucagacagagau

SEQ ID NO: 305819 - RNA, 19 nt, Homo sapiens
ucucauggaaucagacaga

SEQ ID NO: 305820 - RNA, 19 nt, Homo sapiens
gggaggucaacgugaguuu

SEQ ID NO: 305821 - RNA, 19 nt, Homo sapiens
ccaaaugagauggcugguu

SEQ ID NO: 305822 - RNA, 19 nt, Homo sapiens
ucaaagugugguuccagaa

SEQ ID NO: 305823 - RNA, 19 nt, Homo sapiens
uccagaugcugaguuguug

SEQ ID NO: 305824 - RNA, 19 nt, Homo sapiens
uugaaaaccuguccagaug

SEQ ID NO: 305825 - RNA, 19 nt, Homo sapiens
ggagagucaaggacagcaa

SEQ ID NO: 305826 - RNA, 19 nt, Homo sapiens
uugcccaccuuccucugua

SEQ ID NO: 305827 - RNA, 19 nt, Homo sapiens
uccuaccgcuguucuccua

SEQ ID NO: 305828 - RNA, 19 nt, Homo sapiens
ccacccaugccuccuccua

SEQ ID NO: 305829 - RNA, 19 nt, Homo sapiens
ccggaugaaucuggaaaca

SEQ ID NO: 305830 - RNA, 19 nt, Homo sapiens
gagaguucaggucaaagug

SEQ ID NO: 305831 - RNA, 19 nt, Homo sapiens
cagcauuccugggagucuu

SEQ ID NO: 305832 - RNA, 19 nt, Homo sapiens
gcucaauucacuuuguaag

SEQ ID NO: 305833 - RNA, 19 nt, Homo sapiens
uuacaucaagcuaauugug

SEQ ID NO: 305834 - RNA, 19 nt, Homo sapiens
gcugguuagagcaugauuu

SEQ ID NO: 305835 - RNA, 19 nt, Homo sapiens
gcagcggacagcagaugga

SEQ ID NO: 305836 - RNA, 19 nt, Homo sapiens
cagcguacccugacuucuc

SEQ ID NO: 305837 - RNA, 19 nt, Homo sapiens
gaggggaggggagauaaua

SEQ ID NO: 305838 - RNA, 19 nt, Homo sapiens
ggaaagaaauguugugaug

SEQ ID NO: 305839 - RNA, 19 nt, Homo sapiens
ggaaggaaauuacaaguca

SEQ ID NO: 305840 - RNA, 19 nt, Homo sapiens
gaacuugcauugaacauuc

SEQ ID NO: 305841 - RNA, 19 nt, Homo sapiens
gaacuugcuuugaauauuc

SEQ ID NO: 305842 - RNA, 19 nt, Homo sapiens
gaucugaccauaugucuua

SEQ ID NO: 305843 - RNA, 19 nt, Homo sapiens
caagaugucuccagaguga

SEQ ID NO: 305844 - RNA, 19 nt, Homo sapiens
gcagguauguguuugcuuu

SEQ ID NO: 305845 - RNA, 19 nt, Homo sapiens
gauaggacauauucuugua

SEQ ID NO: 305846 - RNA, 19 nt, Homo sapiens
ggacagcauuuaccaaaga

SEQ ID NO: 305847 - RNA, 19 nt, Homo sapiens
gaacacuucucccaucaga

SEQ ID NO: 305848 - RNA, 19 nt, Homo sapiens
aaacauuucuuccugauug

SEQ ID NO: 305849 - RNA, 19 nt, Homo sapiens
caucagagcugucgggaau

SEQ ID NO: 305850 - RNA, 19 nt, Homo sapiens
gaaagaaaggacagcauuu

SEQ ID NO: 305851 - RNA, 19 nt, Homo sapiens
caacgaagagggcauguuu

SEQ ID NO: 305852 - RNA, 19 nt, Homo sapiens
uuaccuagcuccugaauuc

SEQ ID NO: 305853 - RNA, 19 nt, Homo sapiens
gaucauaggcaaaucaguu

SEQ ID NO: 305854 - RNA, 19 nt, Homo sapiens
gugaaagucugguuccaaa

SEQ ID NO: 305855 - RNA, 19 nt, Homo sapiens
ggaaagaaaggacagcauu

SEQ ID NO: 305856 - RNA, 19 nt, Homo sapiens
uauagaggguuuacacaaa

SEQ ID NO: 305857 - RNA, 19 nt, Homo sapiens
gaauauuccagauguguuu

SEQ ID NO: 305858 - RNA, 19 nt, Homo sapiens
caaauaucguuuacacaga

SEQ ID NO: 305859 - RNA, 19 nt, Homo sapiens
uggaagaucugaccauaug

SEQ ID NO: 305860 - RNA, 19 nt, Homo sapiens
caugcgcacuuaugauaua

SEQ ID NO: 305861 - RNA, 19 nt, Homo sapiens
gguaaaggguggacagcaa

SEQ ID NO: 305862 - RNA, 19 nt, Homo sapiens
ccaaagagcaaaucagaga

SEQ ID NO: 305863 - RNA, 19 nt, Homo sapiens
aaagaaaggacagcauuua

SEQ ID NO: 305864 - RNA, 19 nt, Homo sapiens
gaaauuacaagucagaagu

SEQ ID NO: 305865 - RNA, 19 nt, Homo sapiens
gacaaucaguaugugcuua

SEQ ID NO: 305866 - RNA, 19 nt, Homo sapiens
gcagugagcagguaugugu

SEQ ID NO: 305867 - RNA, 19 nt, Homo sapiens
uaaagagcuuccacaguga

SEQ ID NO: 305868 - RNA, 19 nt, Homo sapiens
gagccaguuucuugucuuu

SEQ ID NO: 305869 - RNA, 19 nt, Homo sapiens
gagcaaaucagagaacuug

SEQ ID NO: 305870 - RNA, 19 nt, Homo sapiens
aaacuugcaugcuauggaa

SEQ ID NO: 305871 - RNA, 19 nt, Homo sapiens
gaaucuggaucucacugaa

SEQ ID NO: 305872 - RNA, 19 nt, Homo sapiens
gauacgagauagcagugaa

SEQ ID NO: 305873 - RNA, 19 nt, Homo sapiens
gcaaaucagagaacuugaa

SEQ ID NO: 305874 - RNA, 19 nt, Homo sapiens
ucaguuaccuugcagaaag

SEQ ID NO: 305875 - RNA, 19 nt, Homo sapiens
ggcaagccuuacccaaaua

SEQ ID NO: 305876 - RNA, 19 nt, Homo sapiens
uggcagugauguuuaauau

SEQ ID NO: 305877 - RNA, 19 nt, Homo sapiens
gcuuaccuguguucaagua

SEQ ID NO: 305878 - RNA, 19 nt, Homo sapiens
cauaugugauguauucaug

SEQ ID NO: 305879 - RNA, 19 nt, Homo sapiens
aggaugaacuugcauugaa

SEQ ID NO: 305880 - RNA, 19 nt, Homo sapiens
aaggugaacuugcuuugaa

SEQ ID NO: 305881 - RNA, 19 nt, Homo sapiens
ugugugagaucauguguau

SEQ ID NO: 305882 - RNA, 19 nt, Homo sapiens
aaaaggaacuggugaaugu

SEQ ID NO: 305883 - RNA, 19 nt, Homo sapiens
cagagaacuugaagcagaa

SEQ ID NO: 305884 - RNA, 19 nt, Homo sapiens
gggacucuauagcaaauga

SEQ ID NO: 305885 - RNA, 19 nt, Homo sapiens
gaacuugaagcagaauuug

SEQ ID NO: 305886 - RNA, 19 nt, Homo sapiens
gaaaggacagcauuuacca

SEQ ID NO: 305887 - RNA, 19 nt, Homo sapiens
gaaaauaggcacucacaau

SEQ ID NO: 305888 - RNA, 19 nt, Homo sapiens
gcauugaacauuccagaug

SEQ ID NO: 305889 - RNA, 19 nt, Homo sapiens
gagugaagaugccgaggau

SEQ ID NO: 305890 - RNA, 19 nt, Homo sapiens
caacugcugcuaauacguu

SEQ ID NO: 305891 - RNA, 19 nt, Homo sapiens
gaaggugaacuugcuuuga

SEQ ID NO: 305892 - RNA, 19 nt, Homo sapiens
cugaauucuuccuaucuua

SEQ ID NO: 305893 - RNA, 19 nt, Homo sapiens
gugcaccgcuauugcuuug

SEQ ID NO: 305894 - RNA, 19 nt, Homo sapiens
gugaagaugccgaggauga

SEQ ID NO: 305895 - RNA, 19 nt, Homo sapiens
cuauggcagugauguuuaa

SEQ ID NO: 305896 - RNA, 19 nt, Homo sapiens
uggcaagccuuacccaaau

SEQ ID NO: 305897 - RNA, 19 nt, Homo sapiens
gaaacuugcaugcuaugga

SEQ ID NO: 305898 - RNA, 19 nt, Homo sapiens
gcauucauauuagcugaug

SEQ ID NO: 305899 - RNA, 19 nt, Homo sapiens
ucagagcugucgggaauug

SEQ ID NO: 305900 - RNA, 19 nt, Homo sapiens
caacagcaaacccaggaaa

SEQ ID NO: 305901 - RNA, 19 nt, Homo sapiens
ccagagacaaucaguaugu

SEQ ID NO: 305902 - RNA, 19 nt, Homo sapiens
gcaaugcauucauauuagc

SEQ ID NO: 305903 - RNA, 19 nt, Homo sapiens
ucaccagacugaggcgaua

SEQ ID NO: 305904 - RNA, 19 nt, Homo sapiens
aagcagaauuugcccauca

SEQ ID NO: 305905 - RNA, 19 nt, Homo sapiens
gugcaaagcgaaacugguu

SEQ ID NO: 305906 - RNA, 19 nt, Homo sapiens
gcuccugaauucuuccuau

SEQ ID NO: 305907 - RNA, 19 nt, Homo sapiens
auaauuaucucaccagacu

SEQ ID NO: 305908 - RNA, 19 nt, Homo sapiens
cagaauuugcccaucauaa

SEQ ID NO: 305909 - RNA, 19 nt, Homo sapiens
gcagaauuugcccaucaua

SEQ ID NO: 305910 - RNA, 19 nt, Homo sapiens
aaauaggcacucacaauga

SEQ ID NO: 305911 - RNA, 19 nt, Homo sapiens
uuuccugucuucacuaauu

SEQ ID NO: 305912 - RNA, 19 nt, Homo sapiens
ccagaugugugagaucaug

SEQ ID NO: 305913 - RNA, 19 nt, Homo sapiens
cgaaacugguugcucaagu

SEQ ID NO: 305914 - RNA, 19 nt, Homo sapiens
uaucaagagcaaacuauga

SEQ ID NO: 305915 - RNA, 19 nt, Homo sapiens
gagaaggugaacuugcuuu

SEQ ID NO: 305916 - RNA, 19 nt, Homo sapiens
gcaaacaggggacucuaua

SEQ ID NO: 305917 - RNA, 19 nt, Homo sapiens
gaagaucugaccauauguc

SEQ ID NO: 305918 - RNA, 19 nt, Homo sapiens
gugggcagguauuugcuuu

SEQ ID NO: 305919 - RNA, 19 nt, Homo sapiens
ggaugaacuugcauugaac

SEQ ID NO: 305920 - RNA, 19 nt, Homo sapiens
ggugaacuugcuuugaaua

SEQ ID NO: 305921 - RNA, 19 nt, Homo sapiens
caugauuuauagaggguuu

SEQ ID NO: 305922 - RNA, 19 nt, Homo sapiens
acccgaaacuugcaugcua

SEQ ID NO: 305923 - RNA, 19 nt, Homo sapiens
agucagaagucaacagcaa

SEQ ID NO: 305924 - RNA, 19 nt, Homo sapiens
gugcuuaccuguguucaag

SEQ ID NO: 305925 - RNA, 19 nt, Homo sapiens
aaccagagccaguuucuug

SEQ ID NO: 305926 - RNA, 19 nt, Homo sapiens
cagccacagugccugaauu

SEQ ID NO: 305927 - RNA, 19 nt, Homo sapiens
ugaagacagucacgacagu

SEQ ID NO: 305928 - RNA, 19 nt, Homo sapiens
cagcaaacccaggaaagaa

SEQ ID NO: 305929 - RNA, 19 nt, Homo sapiens
gcagaagugcaccgcuauu

SEQ ID NO: 305930 - RNA, 19 nt, Homo sapiens
gaggaugaacuugcauuga

SEQ ID NO: 305931 - RNA, 19 nt, Homo sapiens
uauagcaaaugaagacagu

SEQ ID NO: 305932 - RNA, 19 nt, Homo sapiens
cagugaagauggagaaggu

SEQ ID NO: 305933 - RNA, 19 nt, Homo sapiens
gcagccacccuccagcaaa

SEQ ID NO: 305934 - RNA, 19 nt, Homo sapiens
guauggcagugagcaggua

SEQ ID NO: 305935 - RNA, 19 nt, Homo sapiens
ccaggcauuucgaaucugu

SEQ ID NO: 305936 - RNA, 19 nt, Homo sapiens
gcaagccuuacccaaauau

SEQ ID NO: 305937 - RNA, 19 nt, Homo sapiens
ccagcuccauucucaggaa

SEQ ID NO: 305938 - RNA, 19 nt, Homo sapiens
ggagagagcucauauauca

SEQ ID NO: 305939 - RNA, 19 nt, Homo sapiens
gcacacaucuccagcgaua

SEQ ID NO: 305940 - RNA, 19 nt, Homo sapiens
gcaaacaucuguggaauga

SEQ ID NO: 305941 - RNA, 19 nt, Homo sapiens
ggacggaccgggaugauua

SEQ ID NO: 305942 - RNA, 19 nt, Homo sapiens
ggacagaacauuuccauug

SEQ ID NO: 305943 - RNA, 19 nt, Homo sapiens
caucuuggcugauaauuug

SEQ ID NO: 305944 - RNA, 19 nt, Homo sapiens
gcuaugugcuccuaaugua

SEQ ID NO: 305945 - RNA, 19 nt, Homo sapiens
aaacaucuguggaaugauu

SEQ ID NO: 305946 - RNA, 19 nt, Homo sapiens
ucaauacacccuaugauua

SEQ ID NO: 305947 - RNA, 19 nt, Homo sapiens
uaagagaaggccuuuaaua

SEQ ID NO: 305948 - RNA, 19 nt, Homo sapiens
agaaagcucugguuacuug

SEQ ID NO: 305949 - RNA, 19 nt, Homo sapiens
agacugaaguucccucuaa

SEQ ID NO: 305950 - RNA, 19 nt, Homo sapiens
gcacaacuuugacaccuau

SEQ ID NO: 305951 - RNA, 19 nt, Homo sapiens
uaaaggagccauucuguau

SEQ ID NO: 305952 - RNA, 19 nt, Homo sapiens
cauagcagcuguaccgauu

SEQ ID NO: 305953 - RNA, 19 nt, Homo sapiens
gaauuuaccuagaugacau

SEQ ID NO: 305954 - RNA, 19 nt, Homo sapiens
caucauauuuguggacuuu

SEQ ID NO: 305955 - RNA, 19 nt, Homo sapiens
aagagaaggccuuuaauaa

SEQ ID NO: 305956 - RNA, 19 nt, Homo sapiens
cuaccagccuuucucauuu

SEQ ID NO: 305957 - RNA, 19 nt, Homo sapiens
gaaggagagagcucauaua

SEQ ID NO: 305958 - RNA, 19 nt, Homo sapiens
ggacaacgccuggauuuca

SEQ ID NO: 305959 - RNA, 19 nt, Homo sapiens
gcaauggcuuggauuagau

SEQ ID NO: 305960 - RNA, 19 nt, Homo sapiens
gcagcaauggcuuggauua

SEQ ID NO: 305961 - RNA, 19 nt, Homo sapiens
ggaccgggaugauuaugug

SEQ ID NO: 305962 - RNA, 19 nt, Homo sapiens
gagaugaugaccacaauug

SEQ ID NO: 305963 - RNA, 19 nt, Homo sapiens
ggacaugcuuucuucuaca

SEQ ID NO: 305964 - RNA, 19 nt, Homo sapiens
uaccagccuuucucauuua

SEQ ID NO: 305965 - RNA, 19 nt, Homo sapiens
caauacacccuaugauuau

SEQ ID NO: 305966 - RNA, 19 nt, Homo sapiens
gggcuggagugguuucauu

SEQ ID NO: 305967 - RNA, 19 nt, Homo sapiens
gccaagaucccugaguuua

SEQ ID NO: 305968 - RNA, 19 nt, Homo sapiens
ucaucacacuucauuguaa

SEQ ID NO: 305969 - RNA, 19 nt, Homo sapiens
ccaaggaugugccuauaag

SEQ ID NO: 305970 - RNA, 19 nt, Homo sapiens
gcacauuguuggcacucaa

SEQ ID NO: 305971 - RNA, 19 nt, Homo sapiens
caucacacuucauuguaaa

SEQ ID NO: 305972 - RNA, 19 nt, Homo sapiens
gacagaacauuuccauugg

SEQ ID NO: 305973 - RNA, 19 nt, Homo sapiens
gcacauguuguucucauug

SEQ ID NO: 305974 - RNA, 19 nt, Homo sapiens
uagcagcuguaccgauuaa

SEQ ID NO: 305975 - RNA, 19 nt, Homo sapiens
ggccaaggaugugccuaua

SEQ ID NO: 305976 - RNA, 19 nt, Homo sapiens
ugacaacacucaucacacu

SEQ ID NO: 305977 - RNA, 19 nt, Homo sapiens
gaagaagguucgggaaagg

SEQ ID NO: 305978 - RNA, 19 nt, Homo sapiens
ccaagaucccugaguuuaa

SEQ ID NO: 305979 - RNA, 19 nt, Homo sapiens
cagccaagaucccugaguu

SEQ ID NO: 305980 - RNA, 19 nt, Homo sapiens
agagagcucauauaucaua

SEQ ID NO: 305981 - RNA, 19 nt, Homo sapiens
acagaaggauauuucagaa

SEQ ID NO: 305982 - RNA, 19 nt, Homo sapiens
gauuaagcaucuuccugaa

SEQ ID NO: 305983 - RNA, 19 nt, Homo sapiens
gacauccucuugcagaaau

SEQ ID NO: 305984 - RNA, 19 nt, Homo sapiens
uaucuaguguguccuguga

SEQ ID NO: 305985 - RNA, 19 nt, Homo sapiens
caaagaggaacagaaguuu

SEQ ID NO: 305986 - RNA, 19 nt, Homo sapiens
ucaaagaggaacagaaguu

SEQ ID NO: 305987 - RNA, 19 nt, Homo sapiens
uugcagaaauccagaaaug

SEQ ID NO: 305988 - RNA, 19 nt, Homo sapiens
ucuaagagaaggccuuuaa

SEQ ID NO: 305989 - RNA, 19 nt, Homo sapiens
ccuaauguaucuagugugu

SEQ ID NO: 305990 - RNA, 19 nt, Homo sapiens
gauuagauccacuugcauu

SEQ ID NO: 305991 - RNA, 19 nt, Homo sapiens
aaacagacaggugauaauu

SEQ ID NO: 305992 - RNA, 19 nt, Homo sapiens
gaauuucucccaaguccuu

SEQ ID NO: 305993 - RNA, 19 nt, Homo sapiens
uagagaggcugaaccgaau

SEQ ID NO: 305994 - RNA, 19 nt, Homo sapiens
accaaauucuuucagguua

SEQ ID NO: 305995 - RNA, 19 nt, Homo sapiens
ugaaccgaauguacaauug

SEQ ID NO: 305996 - RNA, 19 nt, Homo sapiens
gacuugggcuggagugguu

SEQ ID NO: 305997 - RNA, 19 nt, Homo sapiens
acagacaggugauaauuac

SEQ ID NO: 305998 - RNA, 19 nt, Homo sapiens
ucagagcccucgauucuac

SEQ ID NO: 305999 - RNA, 19 nt, Homo sapiens
ggaagaggcagcccuacug

SEQ ID NO: 306000 - RNA, 19 nt, Homo sapiens
ucagugccauugauuuaga

SEQ ID NO: 306001 - RNA, 19 nt, Homo sapiens
gaccaaauucuuucagguu

SEQ ID NO: 306002 - RNA, 19 nt, Homo sapiens
augcauggcuggcacauug

SEQ ID NO: 306003 - RNA, 19 nt, Homo sapiens
gaggaagcccuaccuguca

SEQ ID NO: 306004 - RNA, 19 nt, Homo sapiens
gacugaaguucccucuaaa

SEQ ID NO: 306005 - RNA, 19 nt, Homo sapiens
caagaucccugaguuuaac

SEQ ID NO: 306006 - RNA, 19 nt, Homo sapiens
caacacucaucacacuuca

SEQ ID NO: 306007 - RNA, 19 nt, Homo sapiens
uggugaaggugcagacuuu

SEQ ID NO: 306008 - RNA, 19 nt, Homo sapiens
ggauuucagugccauugau

SEQ ID NO: 306009 - RNA, 19 nt, Homo sapiens
ccuuacaucuuggcugaua

SEQ ID NO: 306010 - RNA, 19 nt, Homo sapiens
ggacauccucuugcagaaa

SEQ ID NO: 306011 - RNA, 19 nt, Homo sapiens
ucauauuuguggacuuuga

SEQ ID NO: 306012 - RNA, 19 nt, Homo sapiens
ggugauaauuaccauccuu

SEQ ID NO: 306013 - RNA, 19 nt, Homo sapiens
gaaaacagacaggugauaa

SEQ ID NO: 306014 - RNA, 19 nt, Homo sapiens
gcucaaagaggaacagaag

SEQ ID NO: 306015 - RNA, 19 nt, Homo sapiens
acacaucuccagcgauaaa

SEQ ID NO: 306016 - RNA, 19 nt, Homo sapiens
cuacuggagucucggauuc

SEQ ID NO: 306017 - RNA, 19 nt, Homo sapiens
gaacagaaggauauuucag

SEQ ID NO: 306018 - RNA, 19 nt, Homo sapiens
aaauguacaugaugcagau

SEQ ID NO: 306019 - RNA, 19 nt, Homo sapiens
ccaugcaggccuuaacuuu

SEQ ID NO: 306020 - RNA, 19 nt, Homo sapiens
gacccaaacccuugccaaa

SEQ ID NO: 306021 - RNA, 19 nt, Homo sapiens
caccacaacucacacucuu

SEQ ID NO: 306022 - RNA, 19 nt, Homo sapiens
caucauagaacacgagauc

SEQ ID NO: 306023 - RNA, 19 nt, Homo sapiens
cuaaaggagccauucugua

SEQ ID NO: 306024 - RNA, 19 nt, Homo sapiens
gaugaugaccacaauugga

SEQ ID NO: 306025 - RNA, 19 nt, Homo sapiens
gggacauccucuugcagaa

SEQ ID NO: 306026 - RNA, 19 nt, Homo sapiens
gcacuaccagccuuucuca

SEQ ID NO: 306027 - RNA, 19 nt, Homo sapiens
aaggagagagcucauauau

SEQ ID NO: 306028 - RNA, 19 nt, Homo sapiens
gcuaaaggagccauucugu

SEQ ID NO: 306029 - RNA, 19 nt, Homo sapiens
gcaggcacauguuguucuc

SEQ ID NO: 306030 - RNA, 19 nt, Homo sapiens
gcaggucuccgaagaaggu

SEQ ID NO: 306031 - RNA, 19 nt, Homo sapiens
ugacagcacaggcaauguu

SEQ ID NO: 306032 - RNA, 19 nt, Homo sapiens
uuucagugccauugauuua

SEQ ID NO: 306033 - RNA, 19 nt, Homo sapiens
gcaaguguucccaccauca

SEQ ID NO: 306034 - RNA, 19 nt, Homo sapiens
cagccuuucucauuuaaca

SEQ ID NO: 306035 - RNA, 19 nt, Homo sapiens
acacucaucacacuucauu

SEQ ID NO: 306036 - RNA, 19 nt, Homo sapiens
ggugggaaccuaucauaca

SEQ ID NO: 306037 - RNA, 19 nt, Homo sapiens
gcaccagagaugacacuga

SEQ ID NO: 306038 - RNA, 19 nt, Homo sapiens
gaagauagcuuggaaauga

SEQ ID NO: 306039 - RNA, 19 nt, Homo sapiens
gaacagagccgacaauugu

SEQ ID NO: 306040 - RNA, 19 nt, Homo sapiens
guagaacgcuguacccuaa

SEQ ID NO: 306041 - RNA, 19 nt, Homo sapiens
ggacaggccuucuaaagug

SEQ ID NO: 306042 - RNA, 19 nt, Homo sapiens
gaagaaauaucgugaaagg

SEQ ID NO: 306043 - RNA, 19 nt, Homo sapiens
caauguggauggcaauuua

SEQ ID NO: 306044 - RNA, 19 nt, Homo sapiens
caacauggauuuauggaau

SEQ ID NO: 306045 - RNA, 19 nt, Homo sapiens
gauagcagcucuguaaaug

SEQ ID NO: 306046 - RNA, 19 nt, Homo sapiens
ggauuucgccuaagugaua

SEQ ID NO: 306047 - RNA, 19 nt, Homo sapiens
caucauggauuucgccuaa

SEQ ID NO: 306048 - RNA, 19 nt, Homo sapiens
gguuaugccuuucagauuu

SEQ ID NO: 306049 - RNA, 19 nt, Homo sapiens
caaaggcucuggugcauca

SEQ ID NO: 306050 - RNA, 19 nt, Homo sapiens
caacugaacaucuauauca

SEQ ID NO: 306051 - RNA, 19 nt, Homo sapiens
ggcaaacugugaccgaaua

SEQ ID NO: 306052 - RNA, 19 nt, Homo sapiens
gaaagugaccaagaaguuu

SEQ ID NO: 306053 - RNA, 19 nt, Homo sapiens
guuaugccuuucagauuua

SEQ ID NO: 306054 - RNA, 19 nt, Homo sapiens
gaaacacggugcccucauc

SEQ ID NO: 306055 - RNA, 19 nt, Homo sapiens
aaguauagauggccucaua

SEQ ID NO: 306056 - RNA, 19 nt, Homo sapiens
gaccaggacauauuugaua

SEQ ID NO: 306057 - RNA, 19 nt, Homo sapiens
gaaaggaugagcucaaauc

SEQ ID NO: 306058 - RNA, 19 nt, Homo sapiens
caauauggccagcuaauga

SEQ ID NO: 306059 - RNA, 19 nt, Homo sapiens
gugaucaacugaacaucua

SEQ ID NO: 306060 - RNA, 19 nt, Homo sapiens
ugaaucaacuguauaacug

SEQ ID NO: 306061 - RNA, 19 nt, Homo sapiens
ugaauguucccuaugauua

SEQ ID NO: 306062 - RNA, 19 nt, Homo sapiens
gcagagagcacaauuuuaa

SEQ ID NO: 306063 - RNA, 19 nt, Homo sapiens
gaagcuacaacauggauuu

SEQ ID NO: 306064 - RNA, 19 nt, Homo sapiens
gaauggaccaggacauauu

SEQ ID NO: 306065 - RNA, 19 nt, Homo sapiens
ccaaauggaacucuguaua

SEQ ID NO: 306066 - RNA, 19 nt, Homo sapiens
ggaguauucugcagacaau

SEQ ID NO: 306067 - RNA, 19 nt, Homo sapiens
ugucauaguuagcuacuuu

SEQ ID NO: 306068 - RNA, 19 nt, Homo sapiens
gaagauuaacucgacaaua

SEQ ID NO: 306069 - RNA, 19 nt, Homo sapiens
gagcucaaaucgaccaaau

SEQ ID NO: 306070 - RNA, 19 nt, Homo sapiens
ggauauauuuccacuugau

SEQ ID NO: 306071 - RNA, 19 nt, Homo sapiens
uaaggaauuucacacaguu

SEQ ID NO: 306072 - RNA, 19 nt, Homo sapiens
gcuuggaaaugaaugcuaa

SEQ ID NO: 306073 - RNA, 19 nt, Homo sapiens
agacauaucucaccucaac

SEQ ID NO: 306074 - RNA, 19 nt, Homo sapiens
gcuacaacauggauuuaug

SEQ ID NO: 306075 - RNA, 19 nt, Homo sapiens
gcaacggguuucacagguu

SEQ ID NO: 306076 - RNA, 19 nt, Homo sapiens
acucugaucuccuaaaguu

SEQ ID NO: 306077 - RNA, 19 nt, Homo sapiens
uauggaaucugucuugguu

SEQ ID NO: 306078 - RNA, 19 nt, Homo sapiens
caccucaacucuacacaaa

SEQ ID NO: 306079 - RNA, 19 nt, Homo sapiens
ggaaccagugccuuuauaa

SEQ ID NO: 306080 - RNA, 19 nt, Homo sapiens
acugggagcuggcaacuuu

SEQ ID NO: 306081 - RNA, 19 nt, Homo sapiens
ggagaaaggugugaaaaga

SEQ ID NO: 306082 - RNA, 19 nt, Homo sapiens
gcaacuuuaucauguaaca

SEQ ID NO: 306083 - RNA, 19 nt, Homo sapiens
gcuggcaacuuuaucaugu

SEQ ID NO: 306084 - RNA, 19 nt, Homo sapiens
acaagaaucucagacuuug

SEQ ID NO: 306085 - RNA, 19 nt, Homo sapiens
ucacaagaaucucagacuu

SEQ ID NO: 306086 - RNA, 19 nt, Homo sapiens
gugaaaggaugagcucaaa

SEQ ID NO: 306087 - RNA, 19 nt, Homo sapiens
caauuuaacccuuguggaa

SEQ ID NO: 306088 - RNA, 19 nt, Homo sapiens
ccaagguucugguuucuuc

SEQ ID NO: 306089 - RNA, 19 nt, Homo sapiens
cuugauagggcacaaauua

SEQ ID NO: 306090 - RNA, 19 nt, Homo sapiens
gcaacaagccacaaugaca

SEQ ID NO: 306091 - RNA, 19 nt, Homo sapiens
caaauggaacucuguauag

SEQ ID NO: 306092 - RNA, 19 nt, Homo sapiens
uagcagcucuguaaaugug

SEQ ID NO: 306093 - RNA, 19 nt, Homo sapiens
gauccaaaguucaggagau

SEQ ID NO: 306094 - RNA, 19 nt, Homo sapiens
gaaaauguguguggcauga

SEQ ID NO: 306095 - RNA, 19 nt, Homo sapiens
gauaaugugggacagaauu

SEQ ID NO: 306096 - RNA, 19 nt, Homo sapiens
guaaugcacuacaguaaaa

SEQ ID NO: 306097 - RNA, 19 nt, Homo sapiens
aaagugaccaagaaguuua

SEQ ID NO: 306098 - RNA, 19 nt, Homo sapiens
ggaacagagccgacaauug

SEQ ID NO: 306099 - RNA, 19 nt, Homo sapiens
gaucaucacccuugucagu

SEQ ID NO: 306100 - RNA, 19 nt, Homo sapiens
cauugaaagugaccaagaa

SEQ ID NO: 306101 - RNA, 19 nt, Homo sapiens
ggaguuauccucaaugcau

SEQ ID NO: 306102 - RNA, 19 nt, Homo sapiens
uaagggaguuauccucaau

SEQ ID NO: 306103 - RNA, 19 nt, Homo sapiens
gaucaacugaacaucuaua

SEQ ID NO: 306104 - RNA, 19 nt, Homo sapiens
ugauguagauggcggaaug

SEQ ID NO: 306105 - RNA, 19 nt, Homo sapiens
aggaagaaauaucgugaaa

SEQ ID NO: 306106 - RNA, 19 nt, Homo sapiens
ccucaacucuacacaaauc

SEQ ID NO: 306107 - RNA, 19 nt, Homo sapiens
gacggugucugcacuguuc

SEQ ID NO: 306108 - RNA, 19 nt, Homo sapiens
uggaaccagugccuuuaua

SEQ ID NO: 306109 - RNA, 19 nt, Homo sapiens
agggauauauuuccacuug

SEQ ID NO: 306110 - RNA, 19 nt, Homo sapiens
gaguuauccucaaugcauu

SEQ ID NO: 306111 - RNA, 19 nt, Homo sapiens
ugauaucaaugaagguuug

SEQ ID NO: 306112 - RNA, 19 nt, Homo sapiens
gagaugauguuuauauccu

SEQ ID NO: 306113 - RNA, 19 nt, Homo sapiens
ugaaagugaccaagaaguu

SEQ ID NO: 306114 - RNA, 19 nt, Homo sapiens
ucuagaagauagcuuggaa

SEQ ID NO: 306115 - RNA, 19 nt, Homo sapiens
cuaaugcagggauauauuu

SEQ ID NO: 306116 - RNA, 19 nt, Homo sapiens
acacggugcccucaucaua

SEQ ID NO: 306117 - RNA, 19 nt, Homo sapiens
gaauuucacacaguucauu

SEQ ID NO: 306118 - RNA, 19 nt, Homo sapiens
gguggucugucuauugaug

SEQ ID NO: 306119 - RNA, 19 nt, Homo sapiens
gaugugaucggccaacgaa

SEQ ID NO: 306120 - RNA, 19 nt, Homo sapiens
cacaagaaucucagacuuu

SEQ ID NO: 306121 - RNA, 19 nt, Homo sapiens
gauagggcacaaauuagaa

SEQ ID NO: 306122 - RNA, 19 nt, Homo sapiens
agaaauaucgugaaaggau

SEQ ID NO: 306123 - RNA, 19 nt, Homo sapiens
gauucuucaucauggauuu

SEQ ID NO: 306124 - RNA, 19 nt, Homo sapiens
gcuguuucaucuacuguug

SEQ ID NO: 306125 - RNA, 19 nt, Homo sapiens
uaucucaccucaacucuac

SEQ ID NO: 306126 - RNA, 19 nt, Homo sapiens
uggcaacuuuaucauguaa

SEQ ID NO: 306127 - RNA, 19 nt, Homo sapiens
ugaaagugaucaacugaac

SEQ ID NO: 306128 - RNA, 19 nt, Homo sapiens
ggauuucagugccugcaau

SEQ ID NO: 306129 - RNA, 19 nt, Homo sapiens
cagugacucugaucuccua

SEQ ID NO: 306130 - RNA, 19 nt, Homo sapiens
acacuucaguaaugcacua

SEQ ID NO: 306131 - RNA, 19 nt, Homo sapiens
caucuacuguugcuguguu

SEQ ID NO: 306132 - RNA, 19 nt, Homo sapiens
ggaauggaccaggacauau

SEQ ID NO: 306133 - RNA, 19 nt, Homo sapiens
caaugcauuugaacguuau

SEQ ID NO: 306134 - RNA, 19 nt, Homo sapiens
cauagucauugcuguuuca

SEQ ID NO: 306135 - RNA, 19 nt, Homo sapiens
gcuuuguucucuaauggaa

SEQ ID NO: 306136 - RNA, 19 nt, Homo sapiens
uggguggucugucuauuga

SEQ ID NO: 306137 - RNA, 19 nt, Homo sapiens
gugccaagguucugguuuc

SEQ ID NO: 306138 - RNA, 19 nt, Homo sapiens
ggacuucucugaaauauuu

SEQ ID NO: 306139 - RNA, 19 nt, Homo sapiens
caacaggaauucuauagua

SEQ ID NO: 306140 - RNA, 19 nt, Homo sapiens
gaucaaauguauagacuug

SEQ ID NO: 306141 - RNA, 19 nt, Homo sapiens
ggagguaucuuuccugaga

SEQ ID NO: 306142 - RNA, 19 nt, Homo sapiens
gaaauucugaugagcauua

SEQ ID NO: 306143 - RNA, 19 nt, Homo sapiens
ugucauaccuuuggauuua

SEQ ID NO: 306144 - RNA, 19 nt, Homo sapiens
ugccagagauguacuguua

SEQ ID NO: 306145 - RNA, 19 nt, Homo sapiens
agucaaagcaggauuauua

SEQ ID NO: 306146 - RNA, 19 nt, Homo sapiens
caauguagcucaguaauuc

SEQ ID NO: 306147 - RNA, 19 nt, Homo sapiens
gggaagggauuguugugua

SEQ ID NO: 306148 - RNA, 19 nt, Homo sapiens
ccacaucacuauuccauau

SEQ ID NO: 306149 - RNA, 19 nt, Homo sapiens
gacuaagguugacauaaua

SEQ ID NO: 306150 - RNA, 19 nt, Homo sapiens
gagcauuacuauucacuga

SEQ ID NO: 306151 - RNA, 19 nt, Homo sapiens
ugacuaagguugacauaau

SEQ ID NO: 306152 - RNA, 19 nt, Homo sapiens
ccucauaccucagugguua

SEQ ID NO: 306153 - RNA, 19 nt, Homo sapiens
cagagaggcuuuccaaugu

SEQ ID NO: 306154 - RNA, 19 nt, Homo sapiens
aagaguagcuucccuguau

SEQ ID NO: 306155 - RNA, 19 nt, Homo sapiens
gcaugucucucuugagcua

SEQ ID NO: 306156 - RNA, 19 nt, Homo sapiens
ccagagauguacuguuauu

SEQ ID NO: 306157 - RNA, 19 nt, Homo sapiens
gaacuucuuuguauucucu

SEQ ID NO: 306158 - RNA, 19 nt, Homo sapiens
gcaggauuauuaagugauu

SEQ ID NO: 306159 - RNA, 19 nt, Homo sapiens
ccagaaacuuuaagaacaa

SEQ ID NO: 306160 - RNA, 19 nt, Homo sapiens
aaauggugcugaauacuuu

SEQ ID NO: 306161 - RNA, 19 nt, Homo sapiens
caacaaugacgggaacuua

SEQ ID NO: 306162 - RNA, 19 nt, Homo sapiens
guaaaucccuauccagagu

SEQ ID NO: 306163 - RNA, 19 nt, Homo sapiens
ugaaagaccuaugagcaaa

SEQ ID NO: 306164 - RNA, 19 nt, Homo sapiens
guacacugauuccuuuaug

SEQ ID NO: 306165 - RNA, 19 nt, Homo sapiens
gcucuugccucuguaacua

SEQ ID NO: 306166 - RNA, 19 nt, Homo sapiens
cugaugaacuucuuuguau

SEQ ID NO: 306167 - RNA, 19 nt, Homo sapiens
ucacacgacugaugaacuu

SEQ ID NO: 306168 - RNA, 19 nt, Homo sapiens
ggaagggauuguuguguag

SEQ ID NO: 306169 - RNA, 19 nt, Homo sapiens
gcauuacuauucacugaug

SEQ ID NO: 306170 - RNA, 19 nt, Homo sapiens
gcagggauccgcaacaaug

SEQ ID NO: 306171 - RNA, 19 nt, Homo sapiens
ggugaacaguguauaggaa

SEQ ID NO: 306172 - RNA, 19 nt, Homo sapiens
ucaaauuggugaacagugu

SEQ ID NO: 306173 - RNA, 19 nt, Homo sapiens
gccauuggauccuguaaau

SEQ ID NO: 306174 - RNA, 19 nt, Homo sapiens
gacgggaacuuagucauug

SEQ ID NO: 306175 - RNA, 19 nt, Homo sapiens
guauagacuuggcuuuguu

SEQ ID NO: 306176 - RNA, 19 nt, Homo sapiens
gaguagcuucccuguauua

SEQ ID NO: 306177 - RNA, 19 nt, Homo sapiens
gaccaauucuaacagcaaa

SEQ ID NO: 306178 - RNA, 19 nt, Homo sapiens
gauugcccuugauuucuua

SEQ ID NO: 306179 - RNA, 19 nt, Homo sapiens
ccagagaggcuuuccaaug

SEQ ID NO: 306180 - RNA, 19 nt, Homo sapiens
aauguacacugauuccuuu

SEQ ID NO: 306181 - RNA, 19 nt, Homo sapiens
aaagcaggauuauuaagug

SEQ ID NO: 306182 - RNA, 19 nt, Homo sapiens
gauucuggaugaccacauu

SEQ ID NO: 306183 - RNA, 19 nt, Homo sapiens
caaagcaggauuauuaagu

SEQ ID NO: 306184 - RNA, 19 nt, Homo sapiens
caaauggugcugaauacuu

SEQ ID NO: 306185 - RNA, 19 nt, Homo sapiens
gacagucucuuacaguaca

SEQ ID NO: 306186 - RNA, 19 nt, Homo sapiens
caacuuugaaacuggaaua

SEQ ID NO: 306187 - RNA, 19 nt, Homo sapiens
gagaggcuuuccaauguag

SEQ ID NO: 306188 - RNA, 19 nt, Homo sapiens
gaugaacuucuuuguauuc

SEQ ID NO: 306189 - RNA, 19 nt, Homo sapiens
agagaggcuuuccaaugua

SEQ ID NO: 306190 - RNA, 19 nt, Homo sapiens
agaagcaugucucucuuga

SEQ ID NO: 306191 - RNA, 19 nt, Homo sapiens
cuucugagcuggaaagagu

SEQ ID NO: 306192 - RNA, 19 nt, Homo sapiens
gggcagggauccgcaacaa

SEQ ID NO: 306193 - RNA, 19 nt, Homo sapiens
gagcuucucuacagguaca

SEQ ID NO: 306194 - RNA, 19 nt, Homo sapiens
ccaauucuaacagcaaaua

SEQ ID NO: 306195 - RNA, 19 nt, Homo sapiens
ggacauuaaggaccaauag

SEQ ID NO: 306196 - RNA, 19 nt, Homo sapiens
ccauuacuuugauaucuga

SEQ ID NO: 306197 - RNA, 19 nt, Homo sapiens
cagcaggagcucugacuaa

SEQ ID NO: 306198 - RNA, 19 nt, Homo sapiens
gaacaguguauaggaagaa

SEQ ID NO: 306199 - RNA, 19 nt, Homo sapiens
uauaugggcuucaucaacu

SEQ ID NO: 306200 - RNA, 19 nt, Homo sapiens
gcauauaugggcuucauca

SEQ ID NO: 306201 - RNA, 19 nt, Homo sapiens
gggaagaccaauucuaaca

SEQ ID NO: 306202 - RNA, 19 nt, Homo sapiens
auaauucucucacaaaguc

SEQ ID NO: 306203 - RNA, 19 nt, Homo sapiens
cccaugggcuucuugaaug

SEQ ID NO: 306204 - RNA, 19 nt, Homo sapiens
cagugucgauucuggauga

SEQ ID NO: 306205 - RNA, 19 nt, Homo sapiens
ucaugacuauggagauauu

SEQ ID NO: 306206 - RNA, 19 nt, Homo sapiens
gaaagaccuaugagcaaau

SEQ ID NO: 306207 - RNA, 19 nt, Homo sapiens
caggagcucugacuaaggu

SEQ ID NO: 306208 - RNA, 19 nt, Homo sapiens
ccacuuuacucaaauuggu

SEQ ID NO: 306209 - RNA, 19 nt, Homo sapiens
uccagaaacuuuaagaaca

SEQ ID NO: 306210 - RNA, 19 nt, Homo sapiens
ccaauguagcucaguaauu

SEQ ID NO: 306211 - RNA, 19 nt, Homo sapiens
acuauucacugaugcagaa

SEQ ID NO: 306212 - RNA, 19 nt, Homo sapiens
caaacauaauucucucaca

SEQ ID NO: 306213 - RNA, 19 nt, Homo sapiens
ucaaucagaggaagaaguu

SEQ ID NO: 306214 - RNA, 19 nt, Homo sapiens
uaugaugacugcuuaacuc

SEQ ID NO: 306215 - RNA, 19 nt, Homo sapiens
gagauguacuguuauuagc

SEQ ID NO: 306216 - RNA, 19 nt, Homo sapiens
gaguagugaagcuaauuaa

SEQ ID NO: 306217 - RNA, 19 nt, Homo sapiens
gaucgccuccgcaggauga

SEQ ID NO: 306218 - RNA, 19 nt, Homo sapiens
ucaaccuucuuucucauga

SEQ ID NO: 306219 - RNA, 19 nt, Homo sapiens
ggugauugcccuugauuuc

SEQ ID NO: 306220 - RNA, 19 nt, Homo sapiens
ccuuuaugaugacugcuua

SEQ ID NO: 306221 - RNA, 19 nt, Homo sapiens
acugauuccuuuaugauga

SEQ ID NO: 306222 - RNA, 19 nt, Homo sapiens
guagugaagcuaauuaaac

SEQ ID NO: 306223 - RNA, 19 nt, Homo sapiens
cugaugagcauuacuauuc

SEQ ID NO: 306224 - RNA, 19 nt, Homo sapiens
aauaguccaccucccauua

SEQ ID NO: 306225 - RNA, 19 nt, Homo sapiens
agagauaguugugcuuuua

SEQ ID NO: 306226 - RNA, 19 nt, Homo sapiens
ggaaguccagagauaguug

SEQ ID NO: 306227 - RNA, 19 nt, Homo sapiens
ugauugcccuugauuucuu

SEQ ID NO: 306228 - RNA, 19 nt, Homo sapiens
aagcaggauuauuaaguga

SEQ ID NO: 306229 - RNA, 19 nt, Homo sapiens
aaagaccuaugagcaaaug

SEQ ID NO: 306230 - RNA, 19 nt, Homo sapiens
caugcugaauguacacuga

SEQ ID NO: 306231 - RNA, 19 nt, Homo sapiens
caagucaccaugcugaaug

SEQ ID NO: 306232 - RNA, 19 nt, Homo sapiens
aagaacaaacucugaaaga

SEQ ID NO: 306233 - RNA, 19 nt, Homo sapiens
ugaugagcauuacuauuca

SEQ ID NO: 306234 - RNA, 19 nt, Homo sapiens
guacaagauuugggaaggu

SEQ ID NO: 306235 - RNA, 19 nt, Homo sapiens
uugacagucucuuacagua

SEQ ID NO: 306236 - RNA, 19 nt, Homo sapiens
ucaaauggagguaucuuuc

SEQ ID NO: 306237 - RNA, 19 nt, Homo sapiens
caucacuauuccauauuug

SEQ ID NO: 306238 - RNA, 19 nt, Homo sapiens
gaaagaaccucucaacauu

SEQ ID NO: 306239 - RNA, 19 nt, Homo sapiens
gaagaucaguuuccuaauu

SEQ ID NO: 306240 - RNA, 19 nt, Homo sapiens
ggacaaggcugaccauaug

SEQ ID NO: 306241 - RNA, 19 nt, Homo sapiens
ccaaugaccugcugaaauu

SEQ ID NO: 306242 - RNA, 19 nt, Homo sapiens
gaacagcgagcuaaauaua

SEQ ID NO: 306243 - RNA, 19 nt, Homo sapiens
ggaagaagaucacgaagau

SEQ ID NO: 306244 - RNA, 19 nt, Homo sapiens
gagcauacauuaaaccaaa

SEQ ID NO: 306245 - RNA, 19 nt, Homo sapiens
ccagagacauguaugauaa

SEQ ID NO: 306246 - RNA, 19 nt, Homo sapiens
ggacaaugauggcaagaaa

SEQ ID NO: 306247 - RNA, 19 nt, Homo sapiens
aauaagagcugugagaaua

SEQ ID NO: 306248 - RNA, 19 nt, Homo sapiens
gaacagaaucacugacaua

SEQ ID NO: 306249 - RNA, 19 nt, Homo sapiens
agacaagcaucuucaguua

SEQ ID NO: 306250 - RNA, 19 nt, Homo sapiens
gaaguccucuuaacaucua

SEQ ID NO: 306251 - RNA, 19 nt, Homo sapiens
cauaggacuuguauuguua

SEQ ID NO: 306252 - RNA, 19 nt, Homo sapiens
gaaacuguaugcuggauga

SEQ ID NO: 306253 - RNA, 19 nt, Homo sapiens
gaacuggugucccggauau

SEQ ID NO: 306254 - RNA, 19 nt, Homo sapiens
gaucuucucuacuuucauu

SEQ ID NO: 306255 - RNA, 19 nt, Homo sapiens
gcacaaagcaagccagauu

SEQ ID NO: 306256 - RNA, 19 nt, Homo sapiens
ggagguguuuggaaagaua

SEQ ID NO: 306257 - RNA, 19 nt, Homo sapiens
ccaaagcgaugaaauaucu

SEQ ID NO: 306258 - RNA, 19 nt, Homo sapiens
ggaaagaaccucucaacau

SEQ ID NO: 306259 - RNA, 19 nt, Homo sapiens
gcacuguuauuacuacuug

SEQ ID NO: 306260 - RNA, 19 nt, Homo sapiens
gugcaaagcugccagugaa

SEQ ID NO: 306261 - RNA, 19 nt, Homo sapiens
caacaucgcucuaauucag

SEQ ID NO: 306262 - RNA, 19 nt, Homo sapiens
ugaguuugcuguuaaauug

SEQ ID NO: 306263 - RNA, 19 nt, Homo sapiens
ucacgaagaucccauugaa

SEQ ID NO: 306264 - RNA, 19 nt, Homo sapiens
uaaaggagaccucaccaua

SEQ ID NO: 306265 - RNA, 19 nt, Homo sapiens
ggaaaugccucuggagugu

SEQ ID NO: 306266 - RNA, 19 nt, Homo sapiens
gcaauaccauaaauucuuc

SEQ ID NO: 306267 - RNA, 19 nt, Homo sapiens
cagaaucacugacauagga

SEQ ID NO: 306268 - RNA, 19 nt, Homo sapiens
ucaaauaugucaacgacuu

SEQ ID NO: 306269 - RNA, 19 nt, Homo sapiens
agauaaaccucucauaaug

SEQ ID NO: 306270 - RNA, 19 nt, Homo sapiens
uaagagcugugagaauaua

SEQ ID NO: 306271 - RNA, 19 nt, Homo sapiens
aguuaaaggugaaguguua

SEQ ID NO: 306272 - RNA, 19 nt, Homo sapiens
gagccagccugaaugauga

SEQ ID NO: 306273 - RNA, 19 nt, Homo sapiens
caaagaaggaaguguuuaa

SEQ ID NO: 306274 - RNA, 19 nt, Homo sapiens
guaagugcccgaaguguaa

SEQ ID NO: 306275 - RNA, 19 nt, Homo sapiens
gaucagaauuucacaggau

SEQ ID NO: 306276 - RNA, 19 nt, Homo sapiens
cagcaaagccaauuuauca

SEQ ID NO: 306277 - RNA, 19 nt, Homo sapiens
ggaaauaagagcugugaga

SEQ ID NO: 306278 - RNA, 19 nt, Homo sapiens
cuauguggauccuguaaua

SEQ ID NO: 306279 - RNA, 19 nt, Homo sapiens
gaaagauaaaccucucaua

SEQ ID NO: 306280 - RNA, 19 nt, Homo sapiens
cuacuuaugugaacguaaa

SEQ ID NO: 306281 - RNA, 19 nt, Homo sapiens
ggagaaguuucccaauuuc

SEQ ID NO: 306282 - RNA, 19 nt, Homo sapiens
ugauauauccaguccauua

SEQ ID NO: 306283 - RNA, 19 nt, Homo sapiens
uuaaagaucugggcaguga

SEQ ID NO: 306284 - RNA, 19 nt, Homo sapiens
gaaauaagagcugugagaa

SEQ ID NO: 306285 - RNA, 19 nt, Homo sapiens
aaugagagcugcaccuuga

SEQ ID NO: 306286 - RNA, 19 nt, Homo sapiens
ucaacaagaucgucaacaa

SEQ ID NO: 306287 - RNA, 19 nt, Homo sapiens
cguaaacaccuuugauaua

SEQ ID NO: 306288 - RNA, 19 nt, Homo sapiens
gaaagucugcaaacucaaa

SEQ ID NO: 306289 - RNA, 19 nt, Homo sapiens
ggauuucggaggaauaaua

SEQ ID NO: 306290 - RNA, 19 nt, Homo sapiens
ccauaggacuuguauuguu

SEQ ID NO: 306291 - RNA, 19 nt, Homo sapiens
gaagauaacgcugaugaug

SEQ ID NO: 306292 - RNA, 19 nt, Homo sapiens
guacauaauccuguguuua

SEQ ID NO: 306293 - RNA, 19 nt, Homo sapiens
gaagcaggaaggaacuuua

SEQ ID NO: 306294 - RNA, 19 nt, Homo sapiens
cgagaauggucauaaaugu

SEQ ID NO: 306295 - RNA, 19 nt, Homo sapiens
gaauaucgaacagaguuua

SEQ ID NO: 306296 - RNA, 19 nt, Homo sapiens
guaaagaggcacuagcaaa

SEQ ID NO: 306297 - RNA, 19 nt, Homo sapiens
ccagcuugcuagacaaaua

SEQ ID NO: 306298 - RNA, 19 nt, Homo sapiens
uaggagaaguuucccaauu

SEQ ID NO: 306299 - RNA, 19 nt, Homo sapiens
cagaagaucaguuuccuaa

SEQ ID NO: 306300 - RNA, 19 nt, Homo sapiens
gcacuuuacuuacuuuaac

SEQ ID NO: 306301 - RNA, 19 nt, Homo sapiens
gcugguggcacuuuacuua

SEQ ID NO: 306302 - RNA, 19 nt, Homo sapiens
aggagaaguuucccaauuu

SEQ ID NO: 306303 - RNA, 19 nt, Homo sapiens
gcaaaauacuguccacauu

SEQ ID NO: 306304 - RNA, 19 nt, Homo sapiens
gacguaaacaccuuugaua

SEQ ID NO: 306305 - RNA, 19 nt, Homo sapiens
caaaugaaucuguagacua

SEQ ID NO: 306306 - RNA, 19 nt, Homo sapiens
gaauuucacaggauugauu

SEQ ID NO: 306307 - RNA, 19 nt, Homo sapiens
ggacauggacucaacagau

SEQ ID NO: 306308 - RNA, 19 nt, Homo sapiens
gugcauucccuaucaaaua

SEQ ID NO: 306309 - RNA, 19 nt, Homo sapiens
gaucauccauugcauucga

SEQ ID NO: 306310 - RNA, 19 nt, Homo sapiens
guaaaggaccgguucauca

SEQ ID NO: 306311 - RNA, 19 nt, Homo sapiens
ggaaagauaacaucaacau

SEQ ID NO: 306312 - RNA, 19 nt, Homo sapiens
ggaucgaucugccaugugu

SEQ ID NO: 306313 - RNA, 19 nt, Homo sapiens
gagaugaaugugaauauga

SEQ ID NO: 306314 - RNA, 19 nt, Homo sapiens
caaucauacugcugacaua

SEQ ID NO: 306315 - RNA, 19 nt, Homo sapiens
aagcaacaguccacacuuu

SEQ ID NO: 306316 - RNA, 19 nt, Homo sapiens
gaaauugaacagcgagcua

SEQ ID NO: 306317 - RNA, 19 nt, Homo sapiens
uaacaucuauauccaccuu

SEQ ID NO: 306318 - RNA, 19 nt, Homo sapiens
caacaagaucgucaacaaa

SEQ ID NO: 306319 - RNA, 19 nt, Homo sapiens
ggaaacacccauccagaau

SEQ ID NO: 306320 - RNA, 19 nt, Homo sapiens
gaaaugcgcccauccuuuu

SEQ ID NO: 306321 - RNA, 19 nt, Homo sapiens
gugaaauccuugaacagaa

SEQ ID NO: 306322 - RNA, 19 nt, Homo sapiens
gaaauucauccaaccaaau

SEQ ID NO: 306323 - RNA, 19 nt, Homo sapiens
gagacaagcaucuucaguu

SEQ ID NO: 306324 - RNA, 19 nt, Homo sapiens
gagcugcaccuugacuuua

SEQ ID NO: 306325 - RNA, 19 nt, Homo sapiens
gcagcgcguugacuuauuc

SEQ ID NO: 306326 - RNA, 19 nt, Homo sapiens
gaaguuucccaauuucuga

SEQ ID NO: 306327 - RNA, 19 nt, Homo sapiens
ugaauuaguucgcuacgau

SEQ ID NO: 306328 - RNA, 19 nt, Homo sapiens
gguguugucucaauaucaa

SEQ ID NO: 306329 - RNA, 19 nt, Homo sapiens
gacauggacucaacagauc

SEQ ID NO: 306330 - RNA, 19 nt, Homo sapiens
gauuguggagcauacauua

SEQ ID NO: 306331 - RNA, 19 nt, Homo sapiens
aaacacccauccagaaugu

SEQ ID NO: 306332 - RNA, 19 nt, Homo sapiens
gaagguugcugaguacaag

SEQ ID NO: 306333 - RNA, 19 nt, Homo sapiens
gaacgcuacuuaugugaac

SEQ ID NO: 306334 - RNA, 19 nt, Homo sapiens
ucagcgaucuucucuacuu

SEQ ID NO: 306335 - RNA, 19 nt, Homo sapiens
caagugcaguauccucuga

SEQ ID NO: 306336 - RNA, 19 nt, Homo sapiens
gaugggauccuuuccaaau

SEQ ID NO: 306337 - RNA, 19 nt, Homo sapiens
cauaaacucuggauugcau

SEQ ID NO: 306338 - RNA, 19 nt, Homo sapiens
caaagcagcugacugagau

SEQ ID NO: 306339 - RNA, 19 nt, Homo sapiens
aaacaaagcagcugacuga

SEQ ID NO: 306340 - RNA, 19 nt, Homo sapiens
gcagguggcuuccagaaca

SEQ ID NO: 306341 - RNA, 19 nt, Homo sapiens
gaagagcacccacuguuug

SEQ ID NO: 306342 - RNA, 19 nt, Homo sapiens
gaugugcacucauuucgaa

SEQ ID NO: 306343 - RNA, 19 nt, Homo sapiens
gaauaugccuacgugcuaa

SEQ ID NO: 306344 - RNA, 19 nt, Homo sapiens
ggaauguaguccaucuaaa

SEQ ID NO: 306345 - RNA, 19 nt, Homo sapiens
ucaauuaccacuucuguuu

SEQ ID NO: 306346 - RNA, 19 nt, Homo sapiens
gcagugaccucccaaacca

SEQ ID NO: 306347 - RNA, 19 nt, Homo sapiens
ggacuggucugagcuauac

SEQ ID NO: 306348 - RNA, 19 nt, Homo sapiens
ccacugguguucaugacua

SEQ ID NO: 306349 - RNA, 19 nt, Homo sapiens
guaauggagggaagaauuu

SEQ ID NO: 306350 - RNA, 19 nt, Homo sapiens
acacaguacucucuuaaag

SEQ ID NO: 306351 - RNA, 19 nt, Homo sapiens
gcaccuuccuaacuucuuc

SEQ ID NO: 306352 - RNA, 19 nt, Homo sapiens
gacuggaugugcacucauu

SEQ ID NO: 306353 - RNA, 19 nt, Homo sapiens
uggcuaugguggccuguua

SEQ ID NO: 306354 - RNA, 19 nt, Homo sapiens
gaaaggguggaguauguau

SEQ ID NO: 306355 - RNA, 19 nt, Homo sapiens
ggaaaggguggaguaugua

SEQ ID NO: 306356 - RNA, 19 nt, Homo sapiens
gaauguaguccaucuaaac

SEQ ID NO: 306357 - RNA, 19 nt, Homo sapiens
cgaagagcacccacuguuu

SEQ ID NO: 306358 - RNA, 19 nt, Homo sapiens
cagccugccuggucacuga

SEQ ID NO: 306359 - RNA, 19 nt, Homo sapiens
aagcacaaguggcgaauca

SEQ ID NO: 306360 - RNA, 19 nt, Homo sapiens
aggaaaggguggaguaugu

SEQ ID NO: 306361 - RNA, 19 nt, Homo sapiens
gaauuucccagccaucuuc

SEQ ID NO: 306362 - RNA, 19 nt, Homo sapiens
gagccacgaugacccaaag

SEQ ID NO: 306363 - RNA, 19 nt, Homo sapiens
gcacuccuuucuccuugug

SEQ ID NO: 306364 - RNA, 19 nt, Homo sapiens
gcacaaguggcgaaucauc

SEQ ID NO: 306365 - RNA, 19 nt, Homo sapiens
ccacuucuguuugcuuugu

SEQ ID NO: 306366 - RNA, 19 nt, Homo sapiens
gaaucuguguucccuaaaa

SEQ ID NO: 306367 - RNA, 19 nt, Homo sapiens
guucuucgcuccacucacu

SEQ ID NO: 306368 - RNA, 19 nt, Homo sapiens
uaccacuucuguuugcuuu

SEQ ID NO: 306369 - RNA, 19 nt, Homo sapiens
agaauaugccuacgugcua

SEQ ID NO: 306370 - RNA, 19 nt, Homo sapiens
cacgaugacccaaaggaua

SEQ ID NO: 306371 - RNA, 19 nt, Homo sapiens
ccacguggauuugguagag

SEQ ID NO: 306372 - RNA, 19 nt, Homo sapiens
cguaauggagggaagaauu

SEQ ID NO: 306373 - RNA, 19 nt, Homo sapiens
gaucauggcagccgagacu

SEQ ID NO: 306374 - RNA, 19 nt, Homo sapiens
agacacaguacucucuuaa

SEQ ID NO: 306375 - RNA, 19 nt, Homo sapiens
ggacaucuaggcaccucaa

SEQ ID NO: 306376 - RNA, 19 nt, Homo sapiens
uggaggaccugagugaaga

SEQ ID NO: 306377 - RNA, 19 nt, Homo sapiens
cagcuggaaugaggaaugu

SEQ ID NO: 306378 - RNA, 19 nt, Homo sapiens
gaucucuccucagcuggaa

SEQ ID NO: 306379 - RNA, 19 nt, Homo sapiens
gacacaguacucucuuaaa

SEQ ID NO: 306380 - RNA, 19 nt, Homo sapiens
gagcugagacacaguacuc

SEQ ID NO: 306381 - RNA, 19 nt, Homo sapiens
acgcugcgcuacccuguga

SEQ ID NO: 306382 - RNA, 19 nt, Homo sapiens
caaguggaguuugcagaca

SEQ ID NO: 306383 - RNA, 19 nt, Homo sapiens
cccaaaggauaagaaagaa

SEQ ID NO: 306384 - RNA, 19 nt, Homo sapiens
acgaugacccaaaggauaa

SEQ ID NO: 306385 - RNA, 19 nt, Homo sapiens
caauuaccacuucuguuug

SEQ ID NO: 306386 - RNA, 19 nt, Homo sapiens
acaaagcagcugacugaga

SEQ ID NO: 306387 - RNA, 19 nt, Homo sapiens
ccaaaggauaagaaagaaa

SEQ ID NO: 306388 - RNA, 19 nt, Homo sapiens
ugaggaauguaguccaucu

SEQ ID NO: 306389 - RNA, 19 nt, Homo sapiens
ucgaagagcacccacuguu

SEQ ID NO: 306390 - RNA, 19 nt, Homo sapiens
gcucaauuaccacuucugu

SEQ ID NO: 306391 - RNA, 19 nt, Homo sapiens
gaaaguucuacguaaugga

SEQ ID NO: 306392 - RNA, 19 nt, Homo sapiens
acaagggccagcugacaaa

SEQ ID NO: 306393 - RNA, 19 nt, Homo sapiens
uaucauaugccuucuacca

SEQ ID NO: 306394 - RNA, 19 nt, Homo sapiens
gagcuacacgacuggaugu

SEQ ID NO: 306395 - RNA, 19 nt, Homo sapiens
cuuccuaacuucuucuaca

SEQ ID NO: 306396 - RNA, 19 nt, Homo sapiens
uugcuaggcucaauuacca

SEQ ID NO: 306397 - RNA, 19 nt, Homo sapiens
caucuaggcaccucaacug

SEQ ID NO: 306398 - RNA, 19 nt, Homo sapiens
aguggaguuugcagacaua

SEQ ID NO: 306399 - RNA, 19 nt, Homo sapiens
uguaucauaugccuucuac

SEQ ID NO: 306400 - RNA, 19 nt, Homo sapiens
gauggacuggucugagcua

SEQ ID NO: 306401 - RNA, 19 nt, Homo sapiens
ccugggauaacauguauau

SEQ ID NO: 306402 - RNA, 19 nt, Homo sapiens
gaggaauguaguccaucua

SEQ ID NO: 306403 - RNA, 19 nt, Homo sapiens
acccaaaggauaagaaaga

SEQ ID NO: 306404 - RNA, 19 nt, Homo sapiens
ccaucuaaacugcuugcua

SEQ ID NO: 306405 - RNA, 19 nt, Homo sapiens
aggaauguaguccaucuaa

SEQ ID NO: 306406 - RNA, 19 nt, Homo sapiens
ugacccaaaggauaagaaa

SEQ ID NO: 306407 - RNA, 19 nt, Homo sapiens
ggaaggcuguggggucuug

SEQ ID NO: 306408 - RNA, 19 nt, Homo sapiens
ccgaugugcuggagcuaca

SEQ ID NO: 306409 - RNA, 19 nt, Homo sapiens
guagcaaugccaugaagca

SEQ ID NO: 306410 - RNA, 19 nt, Homo sapiens
ucaccgcuguucccagaca

SEQ ID NO: 306411 - RNA, 19 nt, Homo sapiens
uaggcucaauuaccacuuc

SEQ ID NO: 306412 - RNA, 19 nt, Homo sapiens
gcuggaaugaggaauguag

SEQ ID NO: 306413 - RNA, 19 nt, Homo sapiens
uguauaccauaaccgaugu

SEQ ID NO: 306414 - RNA, 19 nt, Homo sapiens
ucacugacugcuuacucua

SEQ ID NO: 306415 - RNA, 19 nt, Homo sapiens
ugagcuauacccagaguuc

SEQ ID NO: 306416 - RNA, 19 nt, Homo sapiens
guguacacaugccuauucu

SEQ ID NO: 306417 - RNA, 19 nt, Homo sapiens
aaugaggaauguaguccau

SEQ ID NO: 306418 - RNA, 19 nt, Homo sapiens
ggcagaacccacugguguu

SEQ ID NO: 306419 - RNA, 19 nt, Homo sapiens
aagagcacccacuguuuga

SEQ ID NO: 306420 - RNA, 19 nt, Homo sapiens
gcuauacccagaguucuuc

SEQ ID NO: 306421 - RNA, 19 nt, Homo sapiens
caucagucccacccugcua

SEQ ID NO: 306422 - RNA, 19 nt, Homo sapiens
ccuauucugccauuucuca

SEQ ID NO: 306423 - RNA, 19 nt, Homo sapiens
ccacgaugacccaaaggau

SEQ ID NO: 306424 - RNA, 19 nt, Homo sapiens
ggaugugcacucauuucga

SEQ ID NO: 306425 - RNA, 19 nt, Homo sapiens
cacaaguggcgaaucauca

SEQ ID NO: 306426 - RNA, 19 nt, Homo sapiens
gggucuugcucuuccuuag

SEQ ID NO: 306427 - RNA, 19 nt, Homo sapiens
agggccagcugacaaagau

SEQ ID NO: 306428 - RNA, 19 nt, Homo sapiens
uuccuaacuucuucuacaa

SEQ ID NO: 306429 - RNA, 19 nt, Homo sapiens
guucccagacacacuuauu

SEQ ID NO: 306430 - RNA, 19 nt, Homo sapiens
caaagcagcugacugagau

SEQ ID NO: 306431 - RNA, 19 nt, Homo sapiens
aaacaaagcagcugacuga

SEQ ID NO: 306432 - RNA, 19 nt, Homo sapiens
gcagguggcuuccagaaca

SEQ ID NO: 306433 - RNA, 19 nt, Homo sapiens
gaagagcacccacuguuug

SEQ ID NO: 306434 - RNA, 19 nt, Homo sapiens
gaugugcacucauuucgaa

SEQ ID NO: 306435 - RNA, 19 nt, Homo sapiens
gaauaugccuacgugcuaa

SEQ ID NO: 306436 - RNA, 19 nt, Homo sapiens
ggaauguaguccaucuaaa

SEQ ID NO: 306437 - RNA, 19 nt, Homo sapiens
ucaauuaccacuucuguuu

SEQ ID NO: 306438 - RNA, 19 nt, Homo sapiens
gcacaaacacaaaguagga

SEQ ID NO: 306439 - RNA, 19 nt, Homo sapiens
gcagugaccucccaaacca

SEQ ID NO: 306440 - RNA, 19 nt, Homo sapiens
ggacuggucugagcuauac

SEQ ID NO: 306441 - RNA, 19 nt, Homo sapiens
ccacugguguucaugacua

SEQ ID NO: 306442 - RNA, 19 nt, Homo sapiens
guaauggagggaagaauuu

SEQ ID NO: 306443 - RNA, 19 nt, Homo sapiens
acacaguacucucuuaaag

SEQ ID NO: 306444 - RNA, 19 nt, Homo sapiens
gcaccuuccuaacuucuuc

SEQ ID NO: 306445 - RNA, 19 nt, Homo sapiens
gacuggaugugcacucauu

SEQ ID NO: 306446 - RNA, 19 nt, Homo sapiens
uggcuaugguggccuguua

SEQ ID NO: 306447 - RNA, 19 nt, Homo sapiens
gcgcuaagcacaaacacaa

SEQ ID NO: 306448 - RNA, 19 nt, Homo sapiens
gaaaggguggaguauguau

SEQ ID NO: 306449 - RNA, 19 nt, Homo sapiens
ggaaaggguggaguaugua

SEQ ID NO: 306450 - RNA, 19 nt, Homo sapiens
gaauguaguccaucuaaac

SEQ ID NO: 306451 - RNA, 19 nt, Homo sapiens
cgaagagcacccacuguuu

SEQ ID NO: 306452 - RNA, 19 nt, Homo sapiens
cagccugccuggucacuga

SEQ ID NO: 306453 - RNA, 19 nt, Homo sapiens
aagcacaaguggcgaauca

SEQ ID NO: 306454 - RNA, 19 nt, Homo sapiens
guaggaucccagugcauua

SEQ ID NO: 306455 - RNA, 19 nt, Homo sapiens
aggaaaggguggaguaugu

SEQ ID NO: 306456 - RNA, 19 nt, Homo sapiens
gaauuucccagccaucuuc

SEQ ID NO: 306457 - RNA, 19 nt, Homo sapiens
gagccacgaugacccaaag

SEQ ID NO: 306458 - RNA, 19 nt, Homo sapiens
gcacuccuuucuccuugug

SEQ ID NO: 306459 - RNA, 19 nt, Homo sapiens
gcacaaguggcgaaucauc

SEQ ID NO: 306460 - RNA, 19 nt, Homo sapiens
ccacuucuguuugcuuugu

SEQ ID NO: 306461 - RNA, 19 nt, Homo sapiens
gaaucuguguucccuaaaa

SEQ ID NO: 306462 - RNA, 19 nt, Homo sapiens
guucuucgcuccacucacu

SEQ ID NO: 306463 - RNA, 19 nt, Homo sapiens
uaccacuucuguuugcuuu

SEQ ID NO: 306464 - RNA, 19 nt, Homo sapiens
agaauaugccuacgugcua

SEQ ID NO: 306465 - RNA, 19 nt, Homo sapiens
cacgaugacccaaaggaua

SEQ ID NO: 306466 - RNA, 19 nt, Homo sapiens
ccacguggauuugguagag

SEQ ID NO: 306467 - RNA, 19 nt, Homo sapiens
cguaauggagggaagaauu

SEQ ID NO: 306468 - RNA, 19 nt, Homo sapiens
uaagcacaaacacaaagua

SEQ ID NO: 306469 - RNA, 19 nt, Homo sapiens
agacacaguacucucuuaa

SEQ ID NO: 306470 - RNA, 19 nt, Homo sapiens
gaucauggcagccgagacu

SEQ ID NO: 306471 - RNA, 19 nt, Homo sapiens
ggacaucuaggcaccucaa

SEQ ID NO: 306472 - RNA, 19 nt, Homo sapiens
uggaggaccugagugaaga

SEQ ID NO: 306473 - RNA, 19 nt, Homo sapiens
cagcuggaaugaggaaugu

SEQ ID NO: 306474 - RNA, 19 nt, Homo sapiens
gaucucuccucagcuggaa

SEQ ID NO: 306475 - RNA, 19 nt, Homo sapiens
gacacaguacucucuuaaa

SEQ ID NO: 306476 - RNA, 19 nt, Homo sapiens
gagcugagacacaguacuc

SEQ ID NO: 306477 - RNA, 19 nt, Homo sapiens
caaguggaguuugcagaca

SEQ ID NO: 306478 - RNA, 19 nt, Homo sapiens
cccaaaggauaagaaagaa

SEQ ID NO: 306479 - RNA, 19 nt, Homo sapiens
acgaugacccaaaggauaa

SEQ ID NO: 306480 - RNA, 19 nt, Homo sapiens
caauuaccacuucuguuug

SEQ ID NO: 306481 - RNA, 19 nt, Homo sapiens
acaaagcagcugacugaga

SEQ ID NO: 306482 - RNA, 19 nt, Homo sapiens
ccaaaggauaagaaagaaa

SEQ ID NO: 306483 - RNA, 19 nt, Homo sapiens
ugaggaauguaguccaucu

SEQ ID NO: 306484 - RNA, 19 nt, Homo sapiens
ucgaagagcacccacuguu

SEQ ID NO: 306485 - RNA, 19 nt, Homo sapiens
gcucaauuaccacuucugu

SEQ ID NO: 306486 - RNA, 19 nt, Homo sapiens
gaaaguucuacguaaugga

SEQ ID NO: 306487 - RNA, 19 nt, Homo sapiens
ggaccacacgcugcgcuaa

SEQ ID NO: 306488 - RNA, 19 nt, Homo sapiens
acaagggccagcugacaaa

SEQ ID NO: 306489 - RNA, 19 nt, Homo sapiens
uaucauaugccuucuacca

SEQ ID NO: 306490 - RNA, 19 nt, Homo sapiens
gagcuacacgacuggaugu

SEQ ID NO: 306491 - RNA, 19 nt, Homo sapiens
cuuccuaacuucuucuaca

SEQ ID NO: 306492 - RNA, 19 nt, Homo sapiens
uugcuaggcucaauuacca

SEQ ID NO: 306493 - RNA, 19 nt, Homo sapiens
caucuaggcaccucaacug

SEQ ID NO: 306494 - RNA, 19 nt, Homo sapiens
aguggaguuugcagacaua

SEQ ID NO: 306495 - RNA, 19 nt, Homo sapiens
uguaucauaugccuucuac

SEQ ID NO: 306496 - RNA, 19 nt, Homo sapiens
ccugggauaacauguauau

SEQ ID NO: 306497 - RNA, 19 nt, Homo sapiens
gaggaauguaguccaucua

SEQ ID NO: 306498 - RNA, 19 nt, Homo sapiens
gauggacuggucugagcua

SEQ ID NO: 306499 - RNA, 19 nt, Homo sapiens
acccaaaggauaagaaaga

SEQ ID NO: 306500 - RNA, 19 nt, Homo sapiens
gcuaagcacaaacacaaag

SEQ ID NO: 306501 - RNA, 19 nt, Homo sapiens
ccaucuaaacugcuugcua

SEQ ID NO: 306502 - RNA, 19 nt, Homo sapiens
aggaauguaguccaucuaa

SEQ ID NO: 306503 - RNA, 19 nt, Homo sapiens
acgcugcgcuaagcacaaa

SEQ ID NO: 306504 - RNA, 19 nt, Homo sapiens
ggaaggcuguggggucuug

SEQ ID NO: 306505 - RNA, 19 nt, Homo sapiens
ccgaugugcuggagcuaca

SEQ ID NO: 306506 - RNA, 19 nt, Homo sapiens
guagcaaugccaugaagca

SEQ ID NO: 306507 - RNA, 19 nt, Homo sapiens
ucaccgcuguucccagaca

SEQ ID NO: 306508 - RNA, 19 nt, Homo sapiens
ucacaucaaccgccagaag

SEQ ID NO: 306509 - RNA, 19 nt, Homo sapiens
ugacccaaaggauaagaaa

SEQ ID NO: 306510 - RNA, 19 nt, Homo sapiens
uaggcucaauuaccacuuc

SEQ ID NO: 306511 - RNA, 19 nt, Homo sapiens
gcuggaaugaggaauguag

SEQ ID NO: 306512 - RNA, 19 nt, Homo sapiens
uguauaccauaaccgaugu

SEQ ID NO: 306513 - RNA, 19 nt, Homo sapiens
ucacugacugcuuacucua

SEQ ID NO: 306514 - RNA, 19 nt, Homo sapiens
guguacacaugccuauucu

SEQ ID NO: 306515 - RNA, 19 nt, Homo sapiens
ugagcuauacccagaguuc

SEQ ID NO: 306516 - RNA, 19 nt, Homo sapiens
gcuauacccagaguucuuc

SEQ ID NO: 306517 - RNA, 19 nt, Homo sapiens
aaugaggaauguaguccau

SEQ ID NO: 306518 - RNA, 19 nt, Homo sapiens
ggcagaacccacugguguu

SEQ ID NO: 306519 - RNA, 19 nt, Homo sapiens
aagagcacccacuguuuga

SEQ ID NO: 306520 - RNA, 19 nt, Homo sapiens
caucagucccacccugcua

SEQ ID NO: 306521 - RNA, 19 nt, Homo sapiens
ccuauucugccauuucuca

SEQ ID NO: 306522 - RNA, 19 nt, Homo sapiens
ccacgaugacccaaaggau

SEQ ID NO: 306523 - RNA, 19 nt, Homo sapiens
ggaugugcacucauuucga

SEQ ID NO: 306524 - RNA, 19 nt, Homo sapiens
cacaaguggcgaaucauca

SEQ ID NO: 306525 - RNA, 19 nt, Homo sapiens
gggucuugcucuuccuuag

SEQ ID NO: 306526 - RNA, 19 nt, Homo sapiens
agggccagcugacaaagau

SEQ ID NO: 306527 - RNA, 19 nt, Homo sapiens
uuccuaacuucuucuacaa

SEQ ID NO: 306528 - RNA, 19 nt, Homo sapiens
guucccagacacacuuauu

SEQ ID NO: 306529 - RNA, 19 nt, Homo sapiens
caaagcagcugacugagau

SEQ ID NO: 306530 - RNA, 19 nt, Homo sapiens
aaacaaagcagcugacuga

SEQ ID NO: 306531 - RNA, 19 nt, Homo sapiens
gaagagcacccacuguuug

SEQ ID NO: 306532 - RNA, 19 nt, Homo sapiens
gaugugcacucauuucgaa

SEQ ID NO: 306533 - RNA, 19 nt, Homo sapiens
gaauaugccuacgugcuaa

SEQ ID NO: 306534 - RNA, 19 nt, Homo sapiens
ggaauguaguccaucuaaa

SEQ ID NO: 306535 - RNA, 19 nt, Homo sapiens
ucaauuaccacuucuguuu

SEQ ID NO: 306536 - RNA, 19 nt, Homo sapiens
gcagugaccucccaaacca

SEQ ID NO: 306537 - RNA, 19 nt, Homo sapiens
ggacuggucugagcuauac

SEQ ID NO: 306538 - RNA, 19 nt, Homo sapiens
ccacugguguucaugacua

SEQ ID NO: 306539 - RNA, 19 nt, Homo sapiens
ccuguuagcugacaaagau

SEQ ID NO: 306540 - RNA, 19 nt, Homo sapiens
guaauggagggaagaauuu

SEQ ID NO: 306541 - RNA, 19 nt, Homo sapiens
acacaguacucucuuaaag

SEQ ID NO: 306542 - RNA, 19 nt, Homo sapiens
gacuggaugugcacucauu

SEQ ID NO: 306543 - RNA, 19 nt, Homo sapiens
uggcuaugguggccuguua

SEQ ID NO: 306544 - RNA, 19 nt, Homo sapiens
gaaaggguggaguauguau

SEQ ID NO: 306545 - RNA, 19 nt, Homo sapiens
ggaaaggguggaguaugua

SEQ ID NO: 306546 - RNA, 19 nt, Homo sapiens
gaauguaguccaucuaaac

SEQ ID NO: 306547 - RNA, 19 nt, Homo sapiens
cgaagagcacccacuguuu

SEQ ID NO: 306548 - RNA, 19 nt, Homo sapiens
cagccugccuggucacuga

SEQ ID NO: 306549 - RNA, 19 nt, Homo sapiens
aagcacaaguggcgaauca

SEQ ID NO: 306550 - RNA, 19 nt, Homo sapiens
aggaaaggguggaguaugu

SEQ ID NO: 306551 - RNA, 19 nt, Homo sapiens
gaauuucccagccaucuuc

SEQ ID NO: 306552 - RNA, 19 nt, Homo sapiens
gagccacgaugacccaaag

SEQ ID NO: 306553 - RNA, 19 nt, Homo sapiens
gcacuccuuucuccuugug

SEQ ID NO: 306554 - RNA, 19 nt, Homo sapiens
gcacaaguggcgaaucauc

SEQ ID NO: 306555 - RNA, 19 nt, Homo sapiens
ccacuucuguuugcuuugu

SEQ ID NO: 306556 - RNA, 19 nt, Homo sapiens
gaaucuguguucccuaaaa

SEQ ID NO: 306557 - RNA, 19 nt, Homo sapiens
guucuucgcuccacucacu

SEQ ID NO: 306558 - RNA, 19 nt, Homo sapiens
uaccacuucuguuugcuuu

SEQ ID NO: 306559 - RNA, 19 nt, Homo sapiens
agaauaugccuacgugcua

SEQ ID NO: 306560 - RNA, 19 nt, Homo sapiens
cacgaugacccaaaggaua

SEQ ID NO: 306561 - RNA, 19 nt, Homo sapiens
ccacguggauuugguagag

SEQ ID NO: 306562 - RNA, 19 nt, Homo sapiens
cguaauggagggaagaauu

SEQ ID NO: 306563 - RNA, 19 nt, Homo sapiens
gaucauggcagccgagacu

SEQ ID NO: 306564 - RNA, 19 nt, Homo sapiens
agacacaguacucucuuaa

SEQ ID NO: 306565 - RNA, 19 nt, Homo sapiens
ggacaucuaggcaccucaa

SEQ ID NO: 306566 - RNA, 19 nt, Homo sapiens
uggaggaccugagugaaga

SEQ ID NO: 306567 - RNA, 19 nt, Homo sapiens
cagcuggaaugaggaaugu

SEQ ID NO: 306568 - RNA, 19 nt, Homo sapiens
acgcugcgcuacccuguga

SEQ ID NO: 306569 - RNA, 19 nt, Homo sapiens
gaucucuccucagcuggaa

SEQ ID NO: 306570 - RNA, 19 nt, Homo sapiens
gacacaguacucucuuaaa

SEQ ID NO: 306571 - RNA, 19 nt, Homo sapiens
gagcugagacacaguacuc

SEQ ID NO: 306572 - RNA, 19 nt, Homo sapiens
caaguggaguuugcagaca

SEQ ID NO: 306573 - RNA, 19 nt, Homo sapiens
cccaaaggauaagaaagaa

SEQ ID NO: 306574 - RNA, 19 nt, Homo sapiens
acgaugacccaaaggauaa

SEQ ID NO: 306575 - RNA, 19 nt, Homo sapiens
caauuaccacuucuguuug

SEQ ID NO: 306576 - RNA, 19 nt, Homo sapiens
acaaagcagcugacugaga

SEQ ID NO: 306577 - RNA, 19 nt, Homo sapiens
ccaaaggauaagaaagaaa

SEQ ID NO: 306578 - RNA, 19 nt, Homo sapiens
ugaggaauguaguccaucu

SEQ ID NO: 306579 - RNA, 19 nt, Homo sapiens
ucgaagagcacccacuguu

SEQ ID NO: 306580 - RNA, 19 nt, Homo sapiens
gcucaauuaccacuucugu

SEQ ID NO: 306581 - RNA, 19 nt, Homo sapiens
gaaaguucuacguaaugga

SEQ ID NO: 306582 - RNA, 19 nt, Homo sapiens
uaucauaugccuucuacca

SEQ ID NO: 306583 - RNA, 19 nt, Homo sapiens
gagcuacacgacuggaugu

SEQ ID NO: 306584 - RNA, 19 nt, Homo sapiens
uugcuaggcucaauuacca

SEQ ID NO: 306585 - RNA, 19 nt, Homo sapiens
caucuaggcaccucaacug

SEQ ID NO: 306586 - RNA, 19 nt, Homo sapiens
aguggaguuugcagacaua

SEQ ID NO: 306587 - RNA, 19 nt, Homo sapiens
uguaucauaugccuucuac

SEQ ID NO: 306588 - RNA, 19 nt, Homo sapiens
ccugggauaacauguauau

SEQ ID NO: 306589 - RNA, 19 nt, Homo sapiens
gaggaauguaguccaucua

SEQ ID NO: 306590 - RNA, 19 nt, Homo sapiens
gauggacuggucugagcua

SEQ ID NO: 306591 - RNA, 19 nt, Homo sapiens
acccaaaggauaagaaaga

SEQ ID NO: 306592 - RNA, 19 nt, Homo sapiens
ccaucuaaacugcuugcua

SEQ ID NO: 306593 - RNA, 19 nt, Homo sapiens
aggaauguaguccaucuaa

SEQ ID NO: 306594 - RNA, 19 nt, Homo sapiens
ugacccaaaggauaagaaa

SEQ ID NO: 306595 - RNA, 19 nt, Homo sapiens
ggaaggcuguggggucuug

SEQ ID NO: 306596 - RNA, 19 nt, Homo sapiens
ccgaugugcuggagcuaca

SEQ ID NO: 306597 - RNA, 19 nt, Homo sapiens
uaggcucaauuaccacuuc

SEQ ID NO: 306598 - RNA, 19 nt, Homo sapiens
gcuggaaugaggaauguag

SEQ ID NO: 306599 - RNA, 19 nt, Homo sapiens
uguauaccauaaccgaugu

SEQ ID NO: 306600 - RNA, 19 nt, Homo sapiens
ucacugacugcuuacucua

SEQ ID NO: 306601 - RNA, 19 nt, Homo sapiens
guguacacaugccuauucu

SEQ ID NO: 306602 - RNA, 19 nt, Homo sapiens
aaugaggaauguaguccau

SEQ ID NO: 306603 - RNA, 19 nt, Homo sapiens
ugagcuauacccagaguuc

SEQ ID NO: 306604 - RNA, 19 nt, Homo sapiens
ggcagaacccacugguguu

SEQ ID NO: 306605 - RNA, 19 nt, Homo sapiens
aagagcacccacuguuuga

SEQ ID NO: 306606 - RNA, 19 nt, Homo sapiens
gcuauacccagaguucuuc

SEQ ID NO: 306607 - RNA, 19 nt, Homo sapiens
caucagucccacccugcua

SEQ ID NO: 306608 - RNA, 19 nt, Homo sapiens
ccuauucugccauuucuca

SEQ ID NO: 306609 - RNA, 19 nt, Homo sapiens
ccacgaugacccaaaggau

SEQ ID NO: 306610 - RNA, 19 nt, Homo sapiens
ggaugugcacucauuucga

SEQ ID NO: 306611 - RNA, 19 nt, Homo sapiens
cacaaguggcgaaucauca

SEQ ID NO: 306612 - RNA, 19 nt, Homo sapiens
gggucuugcucuuccuuag

SEQ ID NO: 306613 - RNA, 19 nt, Homo sapiens
ggaaagcacuguccaggua

SEQ ID NO: 306614 - RNA, 19 nt, Homo sapiens
gagaagcgcuugagaagga

SEQ ID NO: 306615 - RNA, 19 nt, Homo sapiens
ggaaauugaugaugaggaa

SEQ ID NO: 306616 - RNA, 19 nt, Homo sapiens
ggaugaggaugaagaagua

SEQ ID NO: 306617 - RNA, 19 nt, Homo sapiens
gaacaaugcauuacuucua

SEQ ID NO: 306618 - RNA, 19 nt, Homo sapiens
ggagaaagcagaaauugaa

SEQ ID NO: 306619 - RNA, 19 nt, Homo sapiens
caaaagagcuggaagagaa

SEQ ID NO: 306620 - RNA, 19 nt, Homo sapiens
ugaggaggaugaagaauuu

SEQ ID NO: 306621 - RNA, 19 nt, Homo sapiens
gcaaagucauuaccaacaa

SEQ ID NO: 306622 - RNA, 19 nt, Homo sapiens
caaauacacucaccuugug

SEQ ID NO: 306623 - RNA, 19 nt, Homo sapiens
ggacagagaagaucgagaa

SEQ ID NO: 306624 - RNA, 19 nt, Homo sapiens
acacaaaguucuucaaaca

SEQ ID NO: 306625 - RNA, 19 nt, Homo sapiens
ggaguaauauacccggaaa

SEQ ID NO: 306626 - RNA, 19 nt, Homo sapiens
ggacucagguggaaggaau

SEQ ID NO: 306627 - RNA, 19 nt, Homo sapiens
uaagaaagccaaagaacaa

SEQ ID NO: 306628 - RNA, 19 nt, Homo sapiens
ggaggaucauuucaauaaa

SEQ ID NO: 306629 - RNA, 19 nt, Homo sapiens
gagcugaacuucgggcaaa

SEQ ID NO: 306630 - RNA, 19 nt, Homo sapiens
ggacuguucugacuuucuu

SEQ ID NO: 306631 - RNA, 19 nt, Homo sapiens
gcucaggucgcaccaaaua

SEQ ID NO: 306632 - RNA, 19 nt, Homo sapiens
guaagugaacaaugcauua

SEQ ID NO: 306633 - RNA, 19 nt, Homo sapiens
gcaaacggcaaagucauua

SEQ ID NO: 306634 - RNA, 19 nt, Homo sapiens
gaaggugcuuugugagguu

SEQ ID NO: 306635 - RNA, 19 nt, Homo sapiens
uaauauacccggaaaucua

SEQ ID NO: 306636 - RNA, 19 nt, Homo sapiens
auuagaggcuucccacuua

SEQ ID NO: 306637 - RNA, 19 nt, Homo sapiens
gauauuggacuuacugcua

SEQ ID NO: 306638 - RNA, 19 nt, Homo sapiens
gcaaauacaaguucuuaca

SEQ ID NO: 306639 - RNA, 19 nt, Homo sapiens
caaagucauuaccaacaaa

SEQ ID NO: 306640 - RNA, 19 nt, Homo sapiens
gaaggagaaagcagaaauu

SEQ ID NO: 306641 - RNA, 19 nt, Homo sapiens
gggcaaauacaaguucuua

SEQ ID NO: 306642 - RNA, 19 nt, Homo sapiens
ucugagaaaucuuagguuu

SEQ ID NO: 306643 - RNA, 19 nt, Homo sapiens
caagauaccaccuccuuug

SEQ ID NO: 306644 - RNA, 19 nt, Homo sapiens
gcccuuagcuuggguuaga

SEQ ID NO: 306645 - RNA, 19 nt, Homo sapiens
ggaauuucuucucuucguu

SEQ ID NO: 306646 - RNA, 19 nt, Homo sapiens
ggacuuacugcuauacuug

SEQ ID NO: 306647 - RNA, 19 nt, Homo sapiens
gagauggagccucgccuua

SEQ ID NO: 306648 - RNA, 19 nt, Homo sapiens
uuacagaaccguauuagug

SEQ ID NO: 306649 - RNA, 19 nt, Homo sapiens
gaaagccaaagaacaagaa

SEQ ID NO: 306650 - RNA, 19 nt, Homo sapiens
acacucaccuuguggauca

SEQ ID NO: 306651 - RNA, 19 nt, Homo sapiens
uggaggaucauuucaauaa

SEQ ID NO: 306652 - RNA, 19 nt, Homo sapiens
uggaugcacucaauacuga

SEQ ID NO: 306653 - RNA, 19 nt, Homo sapiens
aaucuaagcucauggaaac

SEQ ID NO: 306654 - RNA, 19 nt, Homo sapiens
ggaggaaauugaugaugag

SEQ ID NO: 306655 - RNA, 19 nt, Homo sapiens
gaagguaaagcguuaugug

SEQ ID NO: 306656 - RNA, 19 nt, Homo sapiens
gguguucacuguuuggaau

SEQ ID NO: 306657 - RNA, 19 nt, Homo sapiens
aggaggaaauugaugauga

SEQ ID NO: 306658 - RNA, 19 nt, Homo sapiens
aguggaaccugaaguggua

SEQ ID NO: 306659 - RNA, 19 nt, Homo sapiens
ggaaaucuaagcucaugga

SEQ ID NO: 306660 - RNA, 19 nt, Homo sapiens
augcauuacuucuaccuua

SEQ ID NO: 306661 - RNA, 19 nt, Homo sapiens
gguacgagauguauuugag

SEQ ID NO: 306662 - RNA, 19 nt, Homo sapiens
ccaaauacacucaccuugu

SEQ ID NO: 306663 - RNA, 19 nt, Homo sapiens
aagugaagguaaagcguua

SEQ ID NO: 306664 - RNA, 19 nt, Homo sapiens
gaaguauacaagagagauu

SEQ ID NO: 306665 - RNA, 19 nt, Homo sapiens
gauggagccucgccuuaag

SEQ ID NO: 306666 - RNA, 19 nt, Homo sapiens
guacacagacagugaagau

SEQ ID NO: 306667 - RNA, 19 nt, Homo sapiens
gaagacagcagugaagaag

SEQ ID NO: 306668 - RNA, 19 nt, Homo sapiens
caagcgcucucaugaagca

SEQ ID NO: 306669 - RNA, 19 nt, Homo sapiens
aaaccauucuuccuaaagu

SEQ ID NO: 306670 - RNA, 19 nt, Homo sapiens
ggaauaugaggcauggaaa

SEQ ID NO: 306671 - RNA, 19 nt, Homo sapiens
acacagacagugaagauga

SEQ ID NO: 306672 - RNA, 19 nt, Homo sapiens
gauuagaggcuucccacuu

SEQ ID NO: 306673 - RNA, 19 nt, Homo sapiens
gaugaagaaguauacaaga

SEQ ID NO: 306674 - RNA, 19 nt, Homo sapiens
gaaucaagagggacagaga

SEQ ID NO: 306675 - RNA, 19 nt, Homo sapiens
ggaaaguucgagagcuaaa

SEQ ID NO: 306676 - RNA, 19 nt, Homo sapiens
gccgaagcauugaaacaga

SEQ ID NO: 306677 - RNA, 19 nt, Homo sapiens
aaggugagauuucaaugga

SEQ ID NO: 306678 - RNA, 19 nt, Homo sapiens
gauaccaccuccuuugacu

SEQ ID NO: 306679 - RNA, 19 nt, Homo sapiens
gagaggagucagaaucaga

SEQ ID NO: 306680 - RNA, 19 nt, Homo sapiens
gcugagaaacccacaggaa

SEQ ID NO: 306681 - RNA, 19 nt, Homo sapiens
ucaugcaggucaagaacuu

SEQ ID NO: 306682 - RNA, 19 nt, Homo sapiens
uaugaggcauggaaaguuc

SEQ ID NO: 306683 - RNA, 19 nt, Homo sapiens
cgaaagaaggaccgaguga

SEQ ID NO: 306684 - RNA, 19 nt, Homo sapiens
ugaagaaguauacaagaga

SEQ ID NO: 306685 - RNA, 19 nt, Homo sapiens
acucaauacugaugaugaa

SEQ ID NO: 306686 - RNA, 19 nt, Homo sapiens
ccgaagcauugaaacagaa

SEQ ID NO: 306687 - RNA, 19 nt, Homo sapiens
gaagaggaggaggaaauug

SEQ ID NO: 306688 - RNA, 19 nt, Homo sapiens
agacagcagugaagaagag

SEQ ID NO: 306689 - RNA, 19 nt, Homo sapiens
aagcagagccugaggaaca

SEQ ID NO: 306690 - RNA, 19 nt, Homo sapiens
aauauacccggaaaucuaa

SEQ ID NO: 306691 - RNA, 19 nt, Homo sapiens
aaaguggacauguaaguga

SEQ ID NO: 306692 - RNA, 19 nt, Homo sapiens
ggaugaagaaguauacaag

SEQ ID NO: 306693 - RNA, 19 nt, Homo sapiens
caagagggacagagaagau

SEQ ID NO: 306694 - RNA, 19 nt, Homo sapiens
gaggaaaggcgccaguaca

SEQ ID NO: 306695 - RNA, 19 nt, Homo sapiens
cccaagcgcucucaugaag

SEQ ID NO: 306696 - RNA, 19 nt, Homo sapiens
gaaccguauuagugaagau

SEQ ID NO: 306697 - RNA, 19 nt, Homo sapiens
ggacauguaagugaacaau

SEQ ID NO: 306698 - RNA, 19 nt, Homo sapiens
uuagaggcuucccacuuaa

SEQ ID NO: 306699 - RNA, 19 nt, Homo sapiens
gcacuguccagguaggauu

SEQ ID NO: 306700 - RNA, 19 nt, Homo sapiens
cuuugaaggugcuuuguga

SEQ ID NO: 306701 - RNA, 19 nt, Homo sapiens
gagcggccaucugccaaga

SEQ ID NO: 306702 - RNA, 19 nt, Homo sapiens
gagaagacagcagugaaga

SEQ ID NO: 306703 - RNA, 19 nt, Homo sapiens
gccaagagagugcccagaa

SEQ ID NO: 306704 - RNA, 19 nt, Homo sapiens
ccuggaggaucauuucaau

SEQ ID NO: 306705 - RNA, 19 nt, Homo sapiens
gaaaccugacugaggaaga

SEQ ID NO: 306706 - RNA, 19 nt, Homo sapiens
aagccagucuucauucgaa

SEQ ID NO: 306707 - RNA, 19 nt, Homo sapiens
cagaugaggaggaugaaga

SEQ ID NO: 306708 - RNA, 19 nt, Homo sapiens
gaaaucuaagcucauggaa

SEQ ID NO: 306709 - RNA, 19 nt, Homo sapiens
uuagaaaaguggacaugua

SEQ ID NO: 306710 - RNA, 19 nt, Homo sapiens
ggcaaacggcaaagucauu

SEQ ID NO: 306711 - RNA, 19 nt, Homo sapiens
uacagaaccguauuaguga

SEQ ID NO: 306712 - RNA, 19 nt, Homo sapiens
gugugcaugucagaaauaa

SEQ ID NO: 306713 - RNA, 19 nt, Homo sapiens
gcauggaccaccuuuauuu

SEQ ID NO: 306714 - RNA, 19 nt, Homo sapiens
gggacaaguucuccaaaug

SEQ ID NO: 306715 - RNA, 19 nt, Homo sapiens
ggacaaguucuccaaaugu

SEQ ID NO: 306716 - RNA, 19 nt, Homo sapiens
ggagaucuguguucguaca

SEQ ID NO: 306717 - RNA, 19 nt, Homo sapiens
cagcuggucugcuuggauu

SEQ ID NO: 306718 - RNA, 19 nt, Homo sapiens
gacaaguucuccaaaugug

SEQ ID NO: 306719 - RNA, 19 nt, Homo sapiens
aaggagaucuguguucgua

SEQ ID NO: 306720 - RNA, 19 nt, Homo sapiens
gggcauggaccaccuuuau

SEQ ID NO: 306721 - RNA, 19 nt, Homo sapiens
cgacaacccagacuacuau

SEQ ID NO: 306722 - RNA, 19 nt, Homo sapiens
ggaccaccuuuauuuuaua

SEQ ID NO: 306723 - RNA, 19 nt, Homo sapiens
ucaacgaggucugcuucua

SEQ ID NO: 306724 - RNA, 19 nt, Homo sapiens
ccuccgagcugaccucugu

SEQ ID NO: 306725 - RNA, 19 nt, Homo sapiens
gcaaacagugucucaacga

SEQ ID NO: 306726 - RNA, 19 nt, Homo sapiens
acacaggccuugcaaacag

SEQ ID NO: 306727 - RNA, 19 nt, Homo sapiens
gcagcaaguccaacaggaa

SEQ ID NO: 306728 - RNA, 19 nt, Homo sapiens
guguguacgucauuaacaa

SEQ ID NO: 306729 - RNA, 19 nt, Homo sapiens
gcacccgccucuacuccau

SEQ ID NO: 306730 - RNA, 19 nt, Homo sapiens
caacccagacuacuaugau

SEQ ID NO: 306731 - RNA, 19 nt, Homo sapiens
cgggacaaguucuccaaau

SEQ ID NO: 306732 - RNA, 19 nt, Homo sapiens
cuccaaauguggcgugaug

SEQ ID NO: 306733 - RNA, 19 nt, Homo sapiens
caacgaggucugcuucuac

SEQ ID NO: 306734 - RNA, 19 nt, Homo sapiens
ggcauggaccaccuuuauu

SEQ ID NO: 306735 - RNA, 19 nt, Homo sapiens
gaucgacaacccagacuac

SEQ ID NO: 306736 - RNA, 19 nt, Homo sapiens
gccuaccucuuccugcuau

SEQ ID NO: 306737 - RNA, 19 nt, Homo sapiens
ccucuuuguugccaugaga

SEQ ID NO: 306738 - RNA, 19 nt, Homo sapiens
uaccugaccuggugcuuuu

SEQ ID NO: 306739 - RNA, 19 nt, Homo sapiens
acccagacuacuaugauua

SEQ ID NO: 306740 - RNA, 19 nt, Homo sapiens
aacccagacuacuaugauu

SEQ ID NO: 306741 - RNA, 19 nt, Homo sapiens
cgccguguguacgucauua

SEQ ID NO: 306742 - RNA, 19 nt, Homo sapiens
ucgacaacccagacuacua

SEQ ID NO: 306743 - RNA, 19 nt, Homo sapiens
uuaacaaggagaucugugu

SEQ ID NO: 306744 - RNA, 19 nt, Homo sapiens
ggucugcuuggauuuccua

SEQ ID NO: 306745 - RNA, 19 nt, Homo sapiens
guccaguacacccacuaua

SEQ ID NO: 306746 - RNA, 19 nt, Homo sapiens
gcauggaccaccuuuauuu

SEQ ID NO: 306747 - RNA, 19 nt, Homo sapiens
gggacaaguucuccaaaug

SEQ ID NO: 306748 - RNA, 19 nt, Homo sapiens
ggacaaguucuccaaaugu

SEQ ID NO: 306749 - RNA, 19 nt, Homo sapiens
ggagaucuguguucguaca

SEQ ID NO: 306750 - RNA, 19 nt, Homo sapiens
cagcuggucugcuuggauu

SEQ ID NO: 306751 - RNA, 19 nt, Homo sapiens
gacaaguucuccaaaugug

SEQ ID NO: 306752 - RNA, 19 nt, Homo sapiens
aaggagaucuguguucgua

SEQ ID NO: 306753 - RNA, 19 nt, Homo sapiens
gggcauggaccaccuuuau

SEQ ID NO: 306754 - RNA, 19 nt, Homo sapiens
cgacaacccagacuacuau

SEQ ID NO: 306755 - RNA, 19 nt, Homo sapiens
ggaccaccuuuauuuuaua

SEQ ID NO: 306756 - RNA, 19 nt, Homo sapiens
ucaacgaggucugcuucua

SEQ ID NO: 306757 - RNA, 19 nt, Homo sapiens
ccuccgagcugaccucugu

SEQ ID NO: 306758 - RNA, 19 nt, Homo sapiens
gcaaacagugucucaacga

SEQ ID NO: 306759 - RNA, 19 nt, Homo sapiens
acacaggccuugcaaacag

SEQ ID NO: 306760 - RNA, 19 nt, Homo sapiens
gcagcaaguccaacaggaa

SEQ ID NO: 306761 - RNA, 19 nt, Homo sapiens
guguguacgucauuaacaa

SEQ ID NO: 306762 - RNA, 19 nt, Homo sapiens
gaacggagucacaaaagaa

SEQ ID NO: 306763 - RNA, 19 nt, Homo sapiens
gcacccgccucuacuccau

SEQ ID NO: 306764 - RNA, 19 nt, Homo sapiens
caacccagacuacuaugau

SEQ ID NO: 306765 - RNA, 19 nt, Homo sapiens
cgggacaaguucuccaaau

SEQ ID NO: 306766 - RNA, 19 nt, Homo sapiens
cuccaaauguggcgugaug

SEQ ID NO: 306767 - RNA, 19 nt, Homo sapiens
caacgaggucugcuucuac

SEQ ID NO: 306768 - RNA, 19 nt, Homo sapiens
ggcauggaccaccuuuauu

SEQ ID NO: 306769 - RNA, 19 nt, Homo sapiens
gaucgacaacccagacuac

SEQ ID NO: 306770 - RNA, 19 nt, Homo sapiens
gccuaccucuuccugcuau

SEQ ID NO: 306771 - RNA, 19 nt, Homo sapiens
ccucuuuguugccaugaga

SEQ ID NO: 306772 - RNA, 19 nt, Homo sapiens
uaccugaccuggugcuuuu

SEQ ID NO: 306773 - RNA, 19 nt, Homo sapiens
acccagacuacuaugauua

SEQ ID NO: 306774 - RNA, 19 nt, Homo sapiens
aacccagacuacuaugauu

SEQ ID NO: 306775 - RNA, 19 nt, Homo sapiens
cgccguguguacgucauua

SEQ ID NO: 306776 - RNA, 19 nt, Homo sapiens
ucgacaacccagacuacua

SEQ ID NO: 306777 - RNA, 19 nt, Homo sapiens
uuaacaaggagaucugugu

SEQ ID NO: 306778 - RNA, 19 nt, Homo sapiens
ggucugcuuggauuuccua

SEQ ID NO: 306779 - RNA, 19 nt, Homo sapiens
guccaguacacccacuaua

SEQ ID NO: 306780 - RNA, 19 nt, Homo sapiens
gcacaugucuguaggguua

SEQ ID NO: 306781 - RNA, 19 nt, Homo sapiens
gcacuaaccugaaauaaga

SEQ ID NO: 306782 - RNA, 19 nt, Homo sapiens
gaacuagcguuucaauuga

SEQ ID NO: 306783 - RNA, 19 nt, Homo sapiens
ggauuaagcugagaucuaa

SEQ ID NO: 306784 - RNA, 19 nt, Homo sapiens
ucaauaagaugagggauua

SEQ ID NO: 306785 - RNA, 19 nt, Homo sapiens
uaacugaucuuccaaagug

SEQ ID NO: 306786 - RNA, 19 nt, Homo sapiens
ggaaauagcaguucagguu

SEQ ID NO: 306787 - RNA, 19 nt, Homo sapiens
ggaguuugcucguuauauu

SEQ ID NO: 306788 - RNA, 19 nt, Homo sapiens
gaaaagcacugaacuaaga

SEQ ID NO: 306789 - RNA, 19 nt, Homo sapiens
gaugauggcucucugaaug

SEQ ID NO: 306790 - RNA, 19 nt, Homo sapiens
gagaagcacuaaccugaaa

SEQ ID NO: 306791 - RNA, 19 nt, Homo sapiens
ggaacuagcguuucaauug

SEQ ID NO: 306792 - RNA, 19 nt, Homo sapiens
gaacgugaauugccaaagu

SEQ ID NO: 306793 - RNA, 19 nt, Homo sapiens
ggugagaucugaaguuguu

SEQ ID NO: 306794 - RNA, 19 nt, Homo sapiens
gccaaagucuucauuagaa

SEQ ID NO: 306795 - RNA, 19 nt, Homo sapiens
gaucugaaguuguuucuag

SEQ ID NO: 306796 - RNA, 19 nt, Homo sapiens
uaagaacagugucaaauca

SEQ ID NO: 306797 - RNA, 19 nt, Homo sapiens
ucacucaucucuaaguaaa

SEQ ID NO: 306798 - RNA, 19 nt, Homo sapiens
ggucacaguucuuccauug

SEQ ID NO: 306799 - RNA, 19 nt, Homo sapiens
ccaaaugguuucacuggaa

SEQ ID NO: 306800 - RNA, 19 nt, Homo sapiens
ccaugaagcuacauuguug

SEQ ID NO: 306801 - RNA, 19 nt, Homo sapiens
aaucuucacucaucucuaa

SEQ ID NO: 306802 - RNA, 19 nt, Homo sapiens
gaacaaggccaggaaauag

SEQ ID NO: 306803 - RNA, 19 nt, Homo sapiens
gggauuaggugagaucuga

SEQ ID NO: 306804 - RNA, 19 nt, Homo sapiens
ccauggaguuugcucguua

SEQ ID NO: 306805 - RNA, 19 nt, Homo sapiens
gugagcaguuuauuucuaa

SEQ ID NO: 306806 - RNA, 19 nt, Homo sapiens
gaaguuguuucuagcucua

SEQ ID NO: 306807 - RNA, 19 nt, Homo sapiens
gaaauagcaguucagguuu

SEQ ID NO: 306808 - RNA, 19 nt, Homo sapiens
gaggguguguuacuauauu

SEQ ID NO: 306809 - RNA, 19 nt, Homo sapiens
uaacugcucuguaaacuac

SEQ ID NO: 306810 - RNA, 19 nt, Homo sapiens
gggauuaucuaagguggua

SEQ ID NO: 306811 - RNA, 19 nt, Homo sapiens
caacaaacgggauuaucua

SEQ ID NO: 306812 - RNA, 19 nt, Homo sapiens
caaagugagcaguuuauuu

SEQ ID NO: 306813 - RNA, 19 nt, Homo sapiens
ccacaccaaugucauaaug

SEQ ID NO: 306814 - RNA, 19 nt, Homo sapiens
gagaugggacggaguaauu

SEQ ID NO: 306815 - RNA, 19 nt, Homo sapiens
gccaaagucacacaauuua

SEQ ID NO: 306816 - RNA, 19 nt, Homo sapiens
gaagggcccugcucucaag

SEQ ID NO: 306817 - RNA, 19 nt, Homo sapiens
ggacacaucagucaacgaa

SEQ ID NO: 306818 - RNA, 19 nt, Homo sapiens
gaagcacuaaccugaaaua

SEQ ID NO: 306819 - RNA, 19 nt, Homo sapiens
gcaguuuauuucuaaggua

SEQ ID NO: 306820 - RNA, 19 nt, Homo sapiens
gguggaaagugguugguuu

SEQ ID NO: 306821 - RNA, 19 nt, Homo sapiens
aagcugagaucuaaauuuc

SEQ ID NO: 306822 - RNA, 19 nt, Homo sapiens
aaaggaaccuguuucuuag

SEQ ID NO: 306823 - RNA, 19 nt, Homo sapiens
uauaggaucugcagaaucu

SEQ ID NO: 306824 - RNA, 19 nt, Homo sapiens
agagagaccugccuugaau

SEQ ID NO: 306825 - RNA, 19 nt, Homo sapiens
aaugauaugugcaagauug

SEQ ID NO: 306826 - RNA, 19 nt, Homo sapiens
gguggcaucuaugucauua

SEQ ID NO: 306827 - RNA, 19 nt, Homo sapiens
ucagaaggccuuugagauu

SEQ ID NO: 306828 - RNA, 19 nt, Homo sapiens
acacucaucuugaauguca

SEQ ID NO: 306829 - RNA, 19 nt, Homo sapiens
ucugauaacuuccuaaaca

SEQ ID NO: 306830 - RNA, 19 nt, Homo sapiens
gguuggaucugauacuuau

SEQ ID NO: 306831 - RNA, 19 nt, Homo sapiens
gauauaggaucugcagaau

SEQ ID NO: 306832 - RNA, 19 nt, Homo sapiens
cagaaggccuuugagauug

SEQ ID NO: 306833 - RNA, 19 nt, Homo sapiens
gagugucuauuacaugauu

SEQ ID NO: 306834 - RNA, 19 nt, Homo sapiens
gaugagggauuaggugaga

SEQ ID NO: 306835 - RNA, 19 nt, Homo sapiens
ugaccugggugaaagaauu

SEQ ID NO: 306836 - RNA, 19 nt, Homo sapiens
gaauaagaacagugucaaa

SEQ ID NO: 306837 - RNA, 19 nt, Homo sapiens
aaaaggaaccuguuucuua

SEQ ID NO: 306838 - RNA, 19 nt, Homo sapiens
caaacgggauuaucuaagg

SEQ ID NO: 306839 - RNA, 19 nt, Homo sapiens
gugaggguguguuacuaua

SEQ ID NO: 306840 - RNA, 19 nt, Homo sapiens
ggaagcaaaucguaguucu

SEQ ID NO: 306841 - RNA, 19 nt, Homo sapiens
uaaauuacccgcugugcuu

SEQ ID NO: 306842 - RNA, 19 nt, Homo sapiens
acccaucaccuuuaaauua

SEQ ID NO: 306843 - RNA, 19 nt, Homo sapiens
gaacuaagagucccauggu

SEQ ID NO: 306844 - RNA, 19 nt, Homo sapiens
ggugaaagaauuaaagaga

SEQ ID NO: 306845 - RNA, 19 nt, Homo sapiens
aagcaaaucguaguucuua

SEQ ID NO: 306846 - RNA, 19 nt, Homo sapiens
aaagugagcaguuuauuuc

SEQ ID NO: 306847 - RNA, 19 nt, Homo sapiens
aaacguauccccaucauua

SEQ ID NO: 306848 - RNA, 19 nt, Homo sapiens
ggccaucaaugaguucuuu

SEQ ID NO: 306849 - RNA, 19 nt, Homo sapiens
caaucacacucaucuugaa

SEQ ID NO: 306850 - RNA, 19 nt, Homo sapiens
ggucuuagguauggugcua

SEQ ID NO: 306851 - RNA, 19 nt, Homo sapiens
gaagaacuggcaagaagug

SEQ ID NO: 306852 - RNA, 19 nt, Homo sapiens
aaucguaguucuuacaaug

SEQ ID NO: 306853 - RNA, 19 nt, Homo sapiens
ucuaagguauaacgucuuu

SEQ ID NO: 306854 - RNA, 19 nt, Homo sapiens
ugaacaaggccaggaaaua

SEQ ID NO: 306855 - RNA, 19 nt, Homo sapiens
gauguggacuucgaccaaa

SEQ ID NO: 306856 - RNA, 19 nt, Homo sapiens
ggaaaggauuaagcugaga

SEQ ID NO: 306857 - RNA, 19 nt, Homo sapiens
guucucuacucacaucuuu

SEQ ID NO: 306858 - RNA, 19 nt, Homo sapiens
gauacguaauucugagcua

SEQ ID NO: 306859 - RNA, 19 nt, Homo sapiens
ucuaaacugucgagccuuu

SEQ ID NO: 306860 - RNA, 19 nt, Homo sapiens
acacacaacugaucuagac

SEQ ID NO: 306861 - RNA, 19 nt, Homo sapiens
aaucaucugucuucuggaa

SEQ ID NO: 306862 - RNA, 19 nt, Homo sapiens
gcugagaucuaaauuucca

SEQ ID NO: 306863 - RNA, 19 nt, Homo sapiens
caguccaccugaugauaua

SEQ ID NO: 306864 - RNA, 19 nt, Homo sapiens
acacggcugugcaugauga

SEQ ID NO: 306865 - RNA, 19 nt, Homo sapiens
gcgaaaagcagauuauaaa

SEQ ID NO: 306866 - RNA, 19 nt, Homo sapiens
gcaaaucguaguucuuaca

SEQ ID NO: 306867 - RNA, 19 nt, Homo sapiens
cuacauuguugcuuauuca

SEQ ID NO: 306868 - RNA, 19 nt, Homo sapiens
gcaugcgucuuuaucuugu

SEQ ID NO: 306869 - RNA, 19 nt, Homo sapiens
uaagguauaacgucuuuga

SEQ ID NO: 306870 - RNA, 19 nt, Homo sapiens
uaaacuacuuuccaugagu

SEQ ID NO: 306871 - RNA, 19 nt, Homo sapiens
uaaaggagccccagauaaa

SEQ ID NO: 306872 - RNA, 19 nt, Homo sapiens
acaaugcuguaacccagua

SEQ ID NO: 306873 - RNA, 19 nt, Homo sapiens
caagguggcaucuauguca

SEQ ID NO: 306874 - RNA, 19 nt, Homo sapiens
gaccugggugaaagaauua

SEQ ID NO: 306875 - RNA, 19 nt, Homo sapiens
gauaacuuccuaaacauca

SEQ ID NO: 306876 - RNA, 19 nt, Homo sapiens
guaaacuacuuuccaugag

SEQ ID NO: 306877 - RNA, 19 nt, Homo sapiens
uaggugagaucugaaguug

SEQ ID NO: 306878 - RNA, 19 nt, Homo sapiens
caaggcagcagucauuuca

SEQ ID NO: 306879 - RNA, 19 nt, Homo sapiens
agaaggccaucaaugaguu

SEQ ID NO: 306880 - RNA, 19 nt, Homo sapiens
gaacagggcccauggugua

SEQ ID NO: 306881 - RNA, 19 nt, Homo sapiens
ggacugaaggucucaauaa

SEQ ID NO: 306882 - RNA, 19 nt, Homo sapiens
gagauucaauggcucagua

SEQ ID NO: 306883 - RNA, 19 nt, Homo sapiens
gacugaaggucucaauaaa

SEQ ID NO: 306884 - RNA, 19 nt, Homo sapiens
caaacgcacugagaugaaa

SEQ ID NO: 306885 - RNA, 19 nt, Homo sapiens
ccucugggcugcucucaaa

SEQ ID NO: 306886 - RNA, 19 nt, Homo sapiens
gaacaugcaccuccugaca

SEQ ID NO: 306887 - RNA, 19 nt, Homo sapiens
caauaaaccuucagaaccu

SEQ ID NO: 306888 - RNA, 19 nt, Homo sapiens
gcugagcagugcaguguga

SEQ ID NO: 306889 - RNA, 19 nt, Homo sapiens
caaaccaugucccaucuuc

SEQ ID NO: 306890 - RNA, 19 nt, Homo sapiens
ggacugugacgacaucuau

SEQ ID NO: 306891 - RNA, 19 nt, Homo sapiens
ccaccucucuuaugccaau

SEQ ID NO: 306892 - RNA, 19 nt, Homo sapiens
uggcugggcuccaugagaa

SEQ ID NO: 306893 - RNA, 19 nt, Homo sapiens
caaccucaauggcuucuac

SEQ ID NO: 306894 - RNA, 19 nt, Homo sapiens
ggcgggaaguggacgguuu

SEQ ID NO: 306895 - RNA, 19 nt, Homo sapiens
cuucauacacacaaacaua

SEQ ID NO: 306896 - RNA, 19 nt, Homo sapiens
gagcaccaacuccuuacaa

SEQ ID NO: 306897 - RNA, 19 nt, Homo sapiens
gcaugcauaugaggucuuc

SEQ ID NO: 306898 - RNA, 19 nt, Homo sapiens
gggccacccuagugugcua

SEQ ID NO: 306899 - RNA, 19 nt, Homo sapiens
gcucccaccucucuuaugc

SEQ ID NO: 306900 - RNA, 19 nt, Homo sapiens
ggaccaggaccucuuugug

SEQ ID NO: 306901 - RNA, 19 nt, Homo sapiens
gggaguggguagggacuga

SEQ ID NO: 306902 - RNA, 19 nt, Homo sapiens
cacugaagcagaaguauga

SEQ ID NO: 306903 - RNA, 19 nt, Homo sapiens
ugacacugaagcagaagua

SEQ ID NO: 306904 - RNA, 19 nt, Homo sapiens
uucaauggcucaguaaguu

SEQ ID NO: 306905 - RNA, 19 nt, Homo sapiens
uggaggacuuugagaacaa

SEQ ID NO: 306906 - RNA, 19 nt, Homo sapiens
guauuucacaggccucauu

SEQ ID NO: 306907 - RNA, 19 nt, Homo sapiens
aagguaggcaugcauauga

SEQ ID NO: 306908 - RNA, 19 nt, Homo sapiens
gaugcaugcuucugcugau

SEQ ID NO: 306909 - RNA, 19 nt, Homo sapiens
ggauggcuacacccucuuu

SEQ ID NO: 306910 - RNA, 19 nt, Homo sapiens
gaguggacuuggaggacuu

SEQ ID NO: 306911 - RNA, 19 nt, Homo sapiens
gggacugaaggucucaaua

SEQ ID NO: 306912 - RNA, 19 nt, Homo sapiens
ccaccucacuaucauacuc

SEQ ID NO: 306913 - RNA, 19 nt, Homo sapiens
ggacuuggaggacuuugag

SEQ ID NO: 306914 - RNA, 19 nt, Homo sapiens
gccaagguaggcaugcaua

SEQ ID NO: 306915 - RNA, 19 nt, Homo sapiens
caagguaggcaugcauaug

SEQ ID NO: 306916 - RNA, 19 nt, Homo sapiens
ucaaacgcacugagaugaa

SEQ ID NO: 306917 - RNA, 19 nt, Homo sapiens
ccacuuugccaaccucaau

SEQ ID NO: 306918 - RNA, 19 nt, Homo sapiens
ucacaggccucauuuugau

SEQ ID NO: 306919 - RNA, 19 nt, Homo sapiens
ugagagguuuagccacaug

SEQ ID NO: 306920 - RNA, 19 nt, Homo sapiens
ucaauggcucaguaaguuu

SEQ ID NO: 306921 - RNA, 19 nt, Homo sapiens
gcagaacugacagcaugaa

SEQ ID NO: 306922 - RNA, 19 nt, Homo sapiens
cagggcccaugguguauuc

SEQ ID NO: 306923 - RNA, 19 nt, Homo sapiens
ccucaauggcuucuaccua

SEQ ID NO: 306924 - RNA, 19 nt, Homo sapiens
gagaacaacacggccuaug

SEQ ID NO: 306925 - RNA, 19 nt, Homo sapiens
ucacuaucauacucagcuu

SEQ ID NO: 306926 - RNA, 19 nt, Homo sapiens
cagcccaccucacuaucau

SEQ ID NO: 306927 - RNA, 19 nt, Homo sapiens
cccagggcauccauuccua

SEQ ID NO: 306928 - RNA, 19 nt, Homo sapiens
ccagggcauccauuccuaa

SEQ ID NO: 306929 - RNA, 19 nt, Homo sapiens
cggcuggaaugacuacaag

SEQ ID NO: 306930 - RNA, 19 nt, Homo sapiens
caauggcucaguaaguuuc

SEQ ID NO: 306931 - RNA, 19 nt, Homo sapiens
ggcccaugguguauucuag

SEQ ID NO: 306932 - RNA, 19 nt, Homo sapiens
gagcagugcagugugaaca

SEQ ID NO: 306933 - RNA, 19 nt, Homo sapiens
gagaggcacaugguucuag

SEQ ID NO: 306934 - RNA, 19 nt, Homo sapiens
uuccgcagcugccacuuug

SEQ ID NO: 306935 - RNA, 19 nt, Homo sapiens
cugaaggucucaauaaacc

SEQ ID NO: 306936 - RNA, 19 nt, Homo sapiens
ggaggacuuugagaacaac

SEQ ID NO: 306937 - RNA, 19 nt, Homo sapiens
ugagggagcagaggacaau

SEQ ID NO: 306938 - RNA, 19 nt, Homo sapiens
ccuccacccugucccaaca

SEQ ID NO: 306939 - RNA, 19 nt, Homo sapiens
cccgagcaccaacuccuua

SEQ ID NO: 306940 - RNA, 19 nt, Homo sapiens
gugacucccuguccuacca

SEQ ID NO: 306941 - RNA, 19 nt, Homo sapiens
ccucaggagccuucugguu

SEQ ID NO: 306942 - RNA, 19 nt, Homo sapiens
gagagguuuagccacauga

SEQ ID NO: 306943 - RNA, 19 nt, Homo sapiens
ccaagguaggcaugcauau

SEQ ID NO: 306944 - RNA, 19 nt, Homo sapiens
cccuacaccugaaguuaca

SEQ ID NO: 306945 - RNA, 19 nt, Homo sapiens
guuccgcagcugccacuuu

SEQ ID NO: 306946 - RNA, 19 nt, Homo sapiens
ggucagcgcagaggaggau

SEQ ID NO: 306947 - RNA, 19 nt, Homo sapiens
acacggccuaugccaagua

SEQ ID NO: 306948 - RNA, 19 nt, Homo sapiens
acacugaagcagaaguaug

SEQ ID NO: 306949 - RNA, 19 nt, Homo sapiens
aagaagaacuuguuugaga

SEQ ID NO: 306950 - RNA, 19 nt, Homo sapiens
gcgaggagauuucccaaga

SEQ ID NO: 306951 - RNA, 19 nt, Homo sapiens
gcacugagggaucugagua

SEQ ID NO: 306952 - RNA, 19 nt, Homo sapiens
gacaaccacucccacaaga

SEQ ID NO: 306953 - RNA, 19 nt, Homo sapiens
ggucugggauggacaggaa

SEQ ID NO: 306954 - RNA, 19 nt, Homo sapiens
caaaguagggcgugugguu

SEQ ID NO: 306955 - RNA, 19 nt, Homo sapiens
gaggagauuucccaagaag

SEQ ID NO: 306956 - RNA, 19 nt, Homo sapiens
acaggcagcuuccaaaaua

SEQ ID NO: 306957 - RNA, 19 nt, Homo sapiens
ggagauuucccaagaagug

SEQ ID NO: 306958 - RNA, 19 nt, Homo sapiens
ucacuguccuguuuucuua

SEQ ID NO: 306959 - RNA, 19 nt, Homo sapiens
ggacacaggcagcuuccaa

SEQ ID NO: 306960 - RNA, 19 nt, Homo sapiens
ggacaagcagggcaacuuc

SEQ ID NO: 306961 - RNA, 19 nt, Homo sapiens
cgaggagauuucccaagaa

SEQ ID NO: 306962 - RNA, 19 nt, Homo sapiens
ggacaaccacucccacaag

SEQ ID NO: 306963 - RNA, 19 nt, Homo sapiens
cauccuggcucgcuaugug

SEQ ID NO: 306964 - RNA, 19 nt, Homo sapiens
cuacaagguugccuacagu

SEQ ID NO: 306965 - RNA, 19 nt, Homo sapiens
gaaagggagcgaggucaga

SEQ ID NO: 306966 - RNA, 19 nt, Homo sapiens
caaccacugugagacgaaa

SEQ ID NO: 306967 - RNA, 19 nt, Homo sapiens
aguccucacuguccuguuu

SEQ ID NO: 306968 - RNA, 19 nt, Homo sapiens
cccugggccugaagaauaa

SEQ ID NO: 306969 - RNA, 19 nt, Homo sapiens
ggccugcacucugcgcuuu

SEQ ID NO: 306970 - RNA, 19 nt, Homo sapiens
caagguugccuacaguaau

SEQ ID NO: 306971 - RNA, 19 nt, Homo sapiens
cagcagcaaugacgauaac

SEQ ID NO: 306972 - RNA, 19 nt, Homo sapiens
ggacacccagcagcaauga

SEQ ID NO: 306973 - RNA, 19 nt, Homo sapiens
aagguugccuacaguaaug

SEQ ID NO: 306974 - RNA, 19 nt, Homo sapiens
guggguaacuggaacaaaa

SEQ ID NO: 306975 - RNA, 19 nt, Homo sapiens
uggagcugcugggcuguua

SEQ ID NO: 306976 - RNA, 19 nt, Homo sapiens
caaccacucccacaagaag

SEQ ID NO: 306977 - RNA, 19 nt, Homo sapiens
cuuuggcucuguccaguuu

SEQ ID NO: 306978 - RNA, 19 nt, Homo sapiens
ggaggugacaggcaucauc

SEQ ID NO: 306979 - RNA, 19 nt, Homo sapiens
gagcuacgguaacgaucag

SEQ ID NO: 306980 - RNA, 19 nt, Homo sapiens
gaggugacaggcaucauca

SEQ ID NO: 306981 - RNA, 19 nt, Homo sapiens
ggagcuacgguaacgauca

SEQ ID NO: 306982 - RNA, 19 nt, Homo sapiens
gacacaggcagcuuccaaa

SEQ ID NO: 306983 - RNA, 19 nt, Homo sapiens
acaagguugccuacaguaa

SEQ ID NO: 306984 - RNA, 19 nt, Homo sapiens
aauaacagcaucccugaca

SEQ ID NO: 306985 - RNA, 19 nt, Homo sapiens
caagaagugcgaggagaug

SEQ ID NO: 306986 - RNA, 19 nt, Homo sapiens
ccacugggcauggagaaug

SEQ ID NO: 306987 - RNA, 19 nt, Homo sapiens
ccuacaagguugccuacag

SEQ ID NO: 306988 - RNA, 19 nt, Homo sapiens
uaacagcaucccugacaag

SEQ ID NO: 306989 - RNA, 19 nt, Homo sapiens
caugguggccucaagaaag

SEQ ID NO: 306990 - RNA, 19 nt, Homo sapiens
aaaguagggcgugugguuu

SEQ ID NO: 306991 - RNA, 19 nt, Homo sapiens
ccaagaagugcgaggagau

SEQ ID NO: 306992 - RNA, 19 nt, Homo sapiens
gugcgaacuggacugagua

SEQ ID NO: 306993 - RNA, 19 nt, Homo sapiens
gaagugcgaggagaugucu

SEQ ID NO: 306994 - RNA, 19 nt, Homo sapiens
ccagcagcaaugacgauaa

SEQ ID NO: 306995 - RNA, 19 nt, Homo sapiens
gcaaccacugugagacgaa

SEQ ID NO: 306996 - RNA, 19 nt, Homo sapiens
gugcaugucaaccuguuug

SEQ ID NO: 306997 - RNA, 19 nt, Homo sapiens
gugcgcauccugccuguag

SEQ ID NO: 306998 - RNA, 19 nt, Homo sapiens
gugugaccuucuuggguuu

SEQ ID NO: 306999 - RNA, 19 nt, Homo sapiens
ggaacauugccaacucaca

SEQ ID NO: 307000 - RNA, 19 nt, Homo sapiens
ugggaacauugccaacuca

SEQ ID NO: 307001 - RNA, 19 nt, Homo sapiens
gacaagcagggcaacuuca

SEQ ID NO: 307002 - RNA, 19 nt, Homo sapiens
ccaugguggccucaagaaa

SEQ ID NO: 307003 - RNA, 19 nt, Homo sapiens
cugcggaggauguggguaa

SEQ ID NO: 307004 - RNA, 19 nt, Homo sapiens
gggcugcgauguacucaaa

SEQ ID NO: 307005 - RNA, 19 nt, Homo sapiens
ugaagggucugcucuguga

SEQ ID NO: 307006 - RNA, 19 nt, Homo sapiens
gagccgaggugucccaguu

SEQ ID NO: 307007 - RNA, 19 nt, Homo sapiens
gaagaaguacggccugguu

SEQ ID NO: 307008 - RNA, 19 nt, Homo sapiens
gaaaggagcacggccugaa

SEQ ID NO: 307009 - RNA, 19 nt, Homo sapiens
gagacgaccacaauaagaa

SEQ ID NO: 307010 - RNA, 19 nt, Homo sapiens
ggcagcagcuuccagaugu

SEQ ID NO: 307011 - RNA, 19 nt, Homo sapiens
ccagaaguguggagacaug

SEQ ID NO: 307012 - RNA, 19 nt, Homo sapiens
ggagagauacuacgacuac

SEQ ID NO: 307013 - RNA, 19 nt, Homo sapiens
gggcaggagagaccaguua

SEQ ID NO: 307014 - RNA, 19 nt, Homo sapiens
ggagacgaccacaauaaga

SEQ ID NO: 307015 - RNA, 19 nt, Homo sapiens
caacacaaacggccacaau

SEQ ID NO: 307016 - RNA, 19 nt, Homo sapiens
acacaaccgucuuugacaa

SEQ ID NO: 307017 - RNA, 19 nt, Homo sapiens
ggacguggcuuuugugaag

SEQ ID NO: 307018 - RNA, 19 nt, Homo sapiens
uaaguggcgaggacauuua

SEQ ID NO: 307019 - RNA, 19 nt, Homo sapiens
ggugaugggcugcgaugua

SEQ ID NO: 307020 - RNA, 19 nt, Homo sapiens
gcucccaugugaccauuga

SEQ ID NO: 307021 - RNA, 19 nt, Homo sapiens
ggagaaugcgggugacguu

SEQ ID NO: 307022 - RNA, 19 nt, Homo sapiens
gcagugagcgaguucuuca

SEQ ID NO: 307023 - RNA, 19 nt, Homo sapiens
uggaagggaugucgucuca

SEQ ID NO: 307024 - RNA, 19 nt, Homo sapiens
gcacacaaccgucuuugac

SEQ ID NO: 307025 - RNA, 19 nt, Homo sapiens
caacaucuucaccguguau

SEQ ID NO: 307026 - RNA, 19 nt, Homo sapiens
acacaaacggccacaauuc

SEQ ID NO: 307027 - RNA, 19 nt, Homo sapiens
gcagcagcuuccagauguu

SEQ ID NO: 307028 - RNA, 19 nt, Homo sapiens
gcacgguacuggagaacac

SEQ ID NO: 307029 - RNA, 19 nt, Homo sapiens
guucgacuccuccaacuau

SEQ ID NO: 307030 - RNA, 19 nt, Homo sapiens
uguauggacugcuggacaa

SEQ ID NO: 307031 - RNA, 19 nt, Homo sapiens
gccaagaccugcuuuucaa

SEQ ID NO: 307032 - RNA, 19 nt, Homo sapiens
caacuaucauggccaagac

SEQ ID NO: 307033 - RNA, 19 nt, Homo sapiens
caugaagggucugcucugu

SEQ ID NO: 307034 - RNA, 19 nt, Homo sapiens
gccgaggugucccaguuug

SEQ ID NO: 307035 - RNA, 19 nt, Homo sapiens
gaccauugacacccugaaa

SEQ ID NO: 307036 - RNA, 19 nt, Homo sapiens
gagcucccaugugaccauu

SEQ ID NO: 307037 - RNA, 19 nt, Homo sapiens
ggucagaggacuaugaacu

SEQ ID NO: 307038 - RNA, 19 nt, Homo sapiens
gggcagcagcuuccagaug

SEQ ID NO: 307039 - RNA, 19 nt, Homo sapiens
gugagcgaguucuucaaug

SEQ ID NO: 307040 - RNA, 19 nt, Homo sapiens
gugaugggcugcgauguac

SEQ ID NO: 307041 - RNA, 19 nt, Homo sapiens
ugagcgaguucuucaaugc

SEQ ID NO: 307042 - RNA, 19 nt, Homo sapiens
gcugcggaauccagaagga

SEQ ID NO: 307043 - RNA, 19 nt, Homo sapiens
gcucaggucagaggacuau

SEQ ID NO: 307044 - RNA, 19 nt, Homo sapiens
cacaagugcggcaacauga

SEQ ID NO: 307045 - RNA, 19 nt, Homo sapiens
ccaacaucuucaccgugua

SEQ ID NO: 307046 - RNA, 19 nt, Homo sapiens
gagcaggucgacgcuguga

SEQ ID NO: 307047 - RNA, 19 nt, Homo sapiens
gaaggccagcgucuguuca

SEQ ID NO: 307048 - RNA, 19 nt, Homo sapiens
cgaaguguacgaucaagag

SEQ ID NO: 307049 - RNA, 19 nt, Homo sapiens
ucaggucagaggacuauga

SEQ ID NO: 307050 - RNA, 19 nt, Homo sapiens
cuaaguggcgaggacauuu

SEQ ID NO: 307051 - RNA, 19 nt, Homo sapiens
ccaacuaucauggccaaga

SEQ ID NO: 307052 - RNA, 19 nt, Homo sapiens
gggcgaaguguacgaucaa

SEQ ID NO: 307053 - RNA, 19 nt, Homo sapiens
uuggagacgaccacaauaa

SEQ ID NO: 307054 - RNA, 19 nt, Homo sapiens
ccugcaaccuggcacagau

SEQ ID NO: 307055 - RNA, 19 nt, Homo sapiens
gaaggggugugugacaaga

SEQ ID NO: 307056 - RNA, 19 nt, Homo sapiens
ugaacaaccccaagaacua

SEQ ID NO: 307057 - RNA, 19 nt, Homo sapiens
gugggugcccuuauucaga

SEQ ID NO: 307058 - RNA, 19 nt, Homo sapiens
gagagauacuacgacuaca

SEQ ID NO: 307059 - RNA, 19 nt, Homo sapiens
gcgaaguguacgaucaaga

SEQ ID NO: 307060 - RNA, 19 nt, Homo sapiens
caacagccaggagcgguau

SEQ ID NO: 307061 - RNA, 19 nt, Homo sapiens
acagcacgguacuggagaa

SEQ ID NO: 307062 - RNA, 19 nt, Homo sapiens
guuuggagacgaccacaau

SEQ ID NO: 307063 - RNA, 19 nt, Homo sapiens
caggucagaggacuaugaa

SEQ ID NO: 307064 - RNA, 19 nt, Homo sapiens
cucccgagauccagaagug

SEQ ID NO: 307065 - RNA, 19 nt, Homo sapiens
gccagaaggaucuacucuu

SEQ ID NO: 307066 - RNA, 19 nt, Homo sapiens
cgaaggccagcgucuguuc

SEQ ID NO: 307067 - RNA, 19 nt, Homo sapiens
ggacuacacugaaucauua

SEQ ID NO: 307068 - RNA, 19 nt, Homo sapiens
guagggauauguuggguua

SEQ ID NO: 307069 - RNA, 19 nt, Homo sapiens
gcaccuaaaugaugccuuu

SEQ ID NO: 307070 - RNA, 19 nt, Homo sapiens
ggacgagucugacaaagga

SEQ ID NO: 307071 - RNA, 19 nt, Homo sapiens
ugacaggacuuucauuguu

SEQ ID NO: 307072 - RNA, 19 nt, Homo sapiens
gauggaagcaccuaaauga

SEQ ID NO: 307073 - RNA, 19 nt, Homo sapiens
uaaaauagcuuugcaguga

SEQ ID NO: 307074 - RNA, 19 nt, Homo sapiens
gggcugcgauguacucaaa

SEQ ID NO: 307075 - RNA, 19 nt, Homo sapiens
gaaguggcauaaaugucua

SEQ ID NO: 307076 - RNA, 19 nt, Homo sapiens
gaccagaucugaggaggaa

SEQ ID NO: 307077 - RNA, 19 nt, Homo sapiens
gaaaugggcucccguucac

SEQ ID NO: 307078 - RNA, 19 nt, Homo sapiens
aaucagcucuuucaaacuu

SEQ ID NO: 307079 - RNA, 19 nt, Homo sapiens
ggguagaaguggcauaaau

SEQ ID NO: 307080 - RNA, 19 nt, Homo sapiens
gacaggacuuucauuguuc

SEQ ID NO: 307081 - RNA, 19 nt, Homo sapiens
ggaaaugggcucccguuca

SEQ ID NO: 307082 - RNA, 19 nt, Homo sapiens
gaaaggagcacggccugaa

SEQ ID NO: 307083 - RNA, 19 nt, Homo sapiens
uauguuggguuaagaauca

SEQ ID NO: 307084 - RNA, 19 nt, Homo sapiens
gcaaagaguagggauaugu

SEQ ID NO: 307085 - RNA, 19 nt, Homo sapiens
agaaucagcucuuucaaac

SEQ ID NO: 307086 - RNA, 19 nt, Homo sapiens
ggagagauacuacgacuac

SEQ ID NO: 307087 - RNA, 19 nt, Homo sapiens
ggagaacacggaugaaagu

SEQ ID NO: 307088 - RNA, 19 nt, Homo sapiens
gggcaggagagaccaguua

SEQ ID NO: 307089 - RNA, 19 nt, Homo sapiens
aaauagcuuugcagugaaa

SEQ ID NO: 307090 - RNA, 19 nt, Homo sapiens
ggacguggcuuuugugaag

SEQ ID NO: 307091 - RNA, 19 nt, Homo sapiens
ggugaugggcugcgaugua

SEQ ID NO: 307092 - RNA, 19 nt, Homo sapiens
gcucccaugugaccauuga

SEQ ID NO: 307093 - RNA, 19 nt, Homo sapiens
aaacauggaccagaucuga

SEQ ID NO: 307094 - RNA, 19 nt, Homo sapiens
gguagaaguggcauaaaug

SEQ ID NO: 307095 - RNA, 19 nt, Homo sapiens
gguguuugguuuuguuuua

SEQ ID NO: 307096 - RNA, 19 nt, Homo sapiens
ccagagcucuaaccaaagg

SEQ ID NO: 307097 - RNA, 19 nt, Homo sapiens
acagaaagauugguaagag

SEQ ID NO: 307098 - RNA, 19 nt, Homo sapiens
gcgugcaccuggcagcuuu

SEQ ID NO: 307099 - RNA, 19 nt, Homo sapiens
guagaaguggcauaaaugu

SEQ ID NO: 307100 - RNA, 19 nt, Homo sapiens
caaagaguagggauauguu

SEQ ID NO: 307101 - RNA, 19 nt, Homo sapiens
gggcaaagaguagggauau

SEQ ID NO: 307102 - RNA, 19 nt, Homo sapiens
ggaaaacgggcaaagagua

SEQ ID NO: 307103 - RNA, 19 nt, Homo sapiens
aaacuaccauguggccauu

SEQ ID NO: 307104 - RNA, 19 nt, Homo sapiens
guaaucugaggcaaucuaa

SEQ ID NO: 307105 - RNA, 19 nt, Homo sapiens
gcacgguacuggagaacac

SEQ ID NO: 307106 - RNA, 19 nt, Homo sapiens
gguaaucugaggcaaucua

SEQ ID NO: 307107 - RNA, 19 nt, Homo sapiens
uggcauaaaugucuaaagc

SEQ ID NO: 307108 - RNA, 19 nt, Homo sapiens
ggauauguuggguuaagaa

SEQ ID NO: 307109 - RNA, 19 nt, Homo sapiens
guaggacgaugcgcucuag

SEQ ID NO: 307110 - RNA, 19 nt, Homo sapiens
gggauauguuggguuaaga

SEQ ID NO: 307111 - RNA, 19 nt, Homo sapiens
ccccagagcucuaaccaaa

SEQ ID NO: 307112 - RNA, 19 nt, Homo sapiens
uggaagcaccuaaaugaug

SEQ ID NO: 307113 - RNA, 19 nt, Homo sapiens
gcugauggaagcaccuaaa

SEQ ID NO: 307114 - RNA, 19 nt, Homo sapiens
gagcucccaugugaccauu

SEQ ID NO: 307115 - RNA, 19 nt, Homo sapiens
ccaggacgagucugacaaa

SEQ ID NO: 307116 - RNA, 19 nt, Homo sapiens
gaccauugacacccugaaa

SEQ ID NO: 307117 - RNA, 19 nt, Homo sapiens
aggcaaacauggaccagau

SEQ ID NO: 307118 - RNA, 19 nt, Homo sapiens
ucacgaaggcaaacaugga

SEQ ID NO: 307119 - RNA, 19 nt, Homo sapiens
ccuaaaugaugccuuuguc

SEQ ID NO: 307120 - RNA, 19 nt, Homo sapiens
cugaguagcugggaugaca

SEQ ID NO: 307121 - RNA, 19 nt, Homo sapiens
gugaugggcugcgauguac

SEQ ID NO: 307122 - RNA, 19 nt, Homo sapiens
acuaccauguggccauuaa

SEQ ID NO: 307123 - RNA, 19 nt, Homo sapiens
gcaaucuaagggagucauu

SEQ ID NO: 307124 - RNA, 19 nt, Homo sapiens
cacaagugcggcaacauga

SEQ ID NO: 307125 - RNA, 19 nt, Homo sapiens
gcaaacauggaccagaucu

SEQ ID NO: 307126 - RNA, 19 nt, Homo sapiens
agaaguggcauaaaugucu

SEQ ID NO: 307127 - RNA, 19 nt, Homo sapiens
ccauguggccauuaacaau

SEQ ID NO: 307128 - RNA, 19 nt, Homo sapiens
gaugguaaucugaggcaau

SEQ ID NO: 307129 - RNA, 19 nt, Homo sapiens
caacugauccucgcaucuc

SEQ ID NO: 307130 - RNA, 19 nt, Homo sapiens
cgaaguguacgaucaagag

SEQ ID NO: 307131 - RNA, 19 nt, Homo sapiens
gauauguuggguuaagaau

SEQ ID NO: 307132 - RNA, 19 nt, Homo sapiens
caaugaccuuuagggaguu

SEQ ID NO: 307133 - RNA, 19 nt, Homo sapiens
ggcaaagaguagggauaug

SEQ ID NO: 307134 - RNA, 19 nt, Homo sapiens
gggcgaaguguacgaucaa

SEQ ID NO: 307135 - RNA, 19 nt, Homo sapiens
ccagaucugaggaggaaga

SEQ ID NO: 307136 - RNA, 19 nt, Homo sapiens
aaaugaugccuuugucugu

SEQ ID NO: 307137 - RNA, 19 nt, Homo sapiens
aaagaguagggauauguug

SEQ ID NO: 307138 - RNA, 19 nt, Homo sapiens
gaaggggugugugacaaga

SEQ ID NO: 307139 - RNA, 19 nt, Homo sapiens
cuauuuccuuguagagguu

SEQ ID NO: 307140 - RNA, 19 nt, Homo sapiens
caaucuaagggagucauuu

SEQ ID NO: 307141 - RNA, 19 nt, Homo sapiens
gaaaacgggcaaagaguag

SEQ ID NO: 307142 - RNA, 19 nt, Homo sapiens
gagagauacuacgacuaca

SEQ ID NO: 307143 - RNA, 19 nt, Homo sapiens
gcacacgaggaagcacgua

SEQ ID NO: 307144 - RNA, 19 nt, Homo sapiens
gcgaaguguacgaucaaga

SEQ ID NO: 307145 - RNA, 19 nt, Homo sapiens
acagcacgguacuggagaa

SEQ ID NO: 307146 - RNA, 19 nt, Homo sapiens
ugauggaagcaccuaaaug

SEQ ID NO: 307147 - RNA, 19 nt, Homo sapiens
gugacaggacuuucauugu

SEQ ID NO: 307148 - RNA, 19 nt, Homo sapiens
gcuuucaugaccauacaaa

SEQ ID NO: 307149 - RNA, 19 nt, Homo sapiens
gaagcgggaguggcugaug

SEQ ID NO: 307150 - RNA, 19 nt, Homo sapiens
gaacuaagcaaauccaaua

SEQ ID NO: 307151 - RNA, 19 nt, Homo sapiens
ggacauggguggaaugaug

SEQ ID NO: 307152 - RNA, 19 nt, Homo sapiens
gcacgaggcugguacaguu

SEQ ID NO: 307153 - RNA, 19 nt, Homo sapiens
caagauggcugcugaguuc

SEQ ID NO: 307154 - RNA, 19 nt, Homo sapiens
ggacacaucugcucucauc

SEQ ID NO: 307155 - RNA, 19 nt, Homo sapiens
gcuacacgaugucuucauu

SEQ ID NO: 307156 - RNA, 19 nt, Homo sapiens
ggaaaggccaagacaauca

SEQ ID NO: 307157 - RNA, 19 nt, Homo sapiens
gaagggacauggguggaau

SEQ ID NO: 307158 - RNA, 19 nt, Homo sapiens
caaauccaauagagauguu

SEQ ID NO: 307159 - RNA, 19 nt, Homo sapiens
gcuaaugucucucagucau

SEQ ID NO: 307160 - RNA, 19 nt, Homo sapiens
gcuauucccuccagcaucu

SEQ ID NO: 307161 - RNA, 19 nt, Homo sapiens
gaacugcugggcaaagguu

SEQ ID NO: 307162 - RNA, 19 nt, Homo sapiens
gaaggaaaggccaagacaa

SEQ ID NO: 307163 - RNA, 19 nt, Homo sapiens
ggaaacucaacgucauuaa

SEQ ID NO: 307164 - RNA, 19 nt, Homo sapiens
ggugcuggcuucugcauca

SEQ ID NO: 307165 - RNA, 19 nt, Homo sapiens
ccagugggcuuaggugguu

SEQ ID NO: 307166 - RNA, 19 nt, Homo sapiens
gggaaacucaacgucauua

SEQ ID NO: 307167 - RNA, 19 nt, Homo sapiens
gccuggagcugcugcuuga

SEQ ID NO: 307168 - RNA, 19 nt, Homo sapiens
agacaaucauccacagcua

SEQ ID NO: 307169 - RNA, 19 nt, Homo sapiens
gcaagauggcugcugaguu

SEQ ID NO: 307170 - RNA, 19 nt, Homo sapiens
agauuucgcucccuccauu

SEQ ID NO: 307171 - RNA, 19 nt, Homo sapiens
gaaacucaacgucauuaag

SEQ ID NO: 307172 - RNA, 19 nt, Homo sapiens
caaccagucucccaaagcu

SEQ ID NO: 307173 - RNA, 19 nt, Homo sapiens
caccaugggcuauaucauu

SEQ ID NO: 307174 - RNA, 19 nt, Homo sapiens
gcagccaccuugcuaccau

SEQ ID NO: 307175 - RNA, 19 nt, Homo sapiens
cuaagcaaauccaauagag

SEQ ID NO: 307176 - RNA, 19 nt, Homo sapiens
ccaauugugaugauccuuu

SEQ ID NO: 307177 - RNA, 19 nt, Homo sapiens
cugcacagcucccagaaca

SEQ ID NO: 307178 - RNA, 19 nt, Homo sapiens
gcuauaucauugagugcaa

SEQ ID NO: 307179 - RNA, 19 nt, Homo sapiens
gcaaauccaauagagaugu

SEQ ID NO: 307180 - RNA, 19 nt, Homo sapiens
gcaucugguucuguacaaa

SEQ ID NO: 307181 - RNA, 19 nt, Homo sapiens
cccagaugauggagcauaa

SEQ ID NO: 307182 - RNA, 19 nt, Homo sapiens
gaccagggaacagacauuu

SEQ ID NO: 307183 - RNA, 19 nt, Homo sapiens
ggaacuaagcaaauccaau

SEQ ID NO: 307184 - RNA, 19 nt, Homo sapiens
ccagagggaacuaagcaaa

SEQ ID NO: 307185 - RNA, 19 nt, Homo sapiens
uaacgggucccagccaauu

SEQ ID NO: 307186 - RNA, 19 nt, Homo sapiens
gaacaggaccagauuuugu

SEQ ID NO: 307187 - RNA, 19 nt, Homo sapiens
uguggacgaugacaacuau

SEQ ID NO: 307188 - RNA, 19 nt, Homo sapiens
ccucagcuacggugucuuu

SEQ ID NO: 307189 - RNA, 19 nt, Homo sapiens
ccagggaacagacauuugu

SEQ ID NO: 307190 - RNA, 19 nt, Homo sapiens
gaaaggccaagacaaucau

SEQ ID NO: 307191 - RNA, 19 nt, Homo sapiens
ccugaugccugccagacuu

SEQ ID NO: 307192 - RNA, 19 nt, Homo sapiens
ccaucuuccugcuauaaau

SEQ ID NO: 307193 - RNA, 19 nt, Homo sapiens
cagcuacggugucuuugag

SEQ ID NO: 307194 - RNA, 19 nt, Homo sapiens
accaugggcuauaucauug

SEQ ID NO: 307195 - RNA, 19 nt, Homo sapiens
gcugguacaguucugguuu

SEQ ID NO: 307196 - RNA, 19 nt, Homo sapiens
gacgaugacaacuauguga

SEQ ID NO: 307197 - RNA, 19 nt, Homo sapiens
ggaccagggaacagacauu

SEQ ID NO: 307198 - RNA, 19 nt, Homo sapiens
agagggaacuaagcaaauc

SEQ ID NO: 307199 - RNA, 19 nt, Homo sapiens
gugggucccuggcaagugu

SEQ ID NO: 307200 - RNA, 19 nt, Homo sapiens
ccagcucuguccugcaaga

SEQ ID NO: 307201 - RNA, 19 nt, Homo sapiens
aaggaaaggccaagacaau

SEQ ID NO: 307202 - RNA, 19 nt, Homo sapiens
aagcaaauccaauagagau

SEQ ID NO: 307203 - RNA, 19 nt, Homo sapiens
guggaaugauggcagaauc

SEQ ID NO: 307204 - RNA, 19 nt, Homo sapiens
ccucagcuccuaccucuuc

SEQ ID NO: 307205 - RNA, 19 nt, Homo sapiens
ggcaaagguugggcagaga

SEQ ID NO: 307206 - RNA, 19 nt, Homo sapiens
ggacgaugacaacuaugug

SEQ ID NO: 307207 - RNA, 19 nt, Homo sapiens
gacaaucauccacagcuau

SEQ ID NO: 307208 - RNA, 19 nt, Homo sapiens
ccaccuugcuaccaugaag

SEQ ID NO: 307209 - RNA, 19 nt, Homo sapiens
uaagcaaauccaauagaga

SEQ ID NO: 307210 - RNA, 19 nt, Homo sapiens
acaaucauccacagcuauu

SEQ ID NO: 307211 - RNA, 19 nt, Homo sapiens
ggaucugaguggcaauugg

SEQ ID NO: 307212 - RNA, 19 nt, Homo sapiens
caauugugaugauccuuuu

SEQ ID NO: 307213 - RNA, 19 nt, Homo sapiens
ugucugcgguaccacuuga

SEQ ID NO: 307214 - RNA, 19 nt, Homo sapiens
cguuggcccuggcuaaugu

SEQ ID NO: 307215 - RNA, 19 nt, Homo sapiens
cugcaucaaucgcaaacug

SEQ ID NO: 307216 - RNA, 19 nt, Homo sapiens
ugaguucgacaccuucuug

SEQ ID NO: 307217 - RNA, 19 nt, Homo sapiens
gcccagaugauggagcaua

SEQ ID NO: 307218 - RNA, 19 nt, Homo sapiens
cugcugaguucgacaccuu

SEQ ID NO: 307219 - RNA, 19 nt, Homo sapiens
cagagggaacuaagcaaau

SEQ ID NO: 307220 - RNA, 19 nt, Homo sapiens
gccaaccagucucccaaag

SEQ ID NO: 307221 - RNA, 19 nt, Homo sapiens
ggcccuggcuaaugucucu

SEQ ID NO: 307222 - RNA, 19 nt, Homo sapiens
ugaaggaaaggccaagaca

SEQ ID NO: 307223 - RNA, 19 nt, Homo sapiens
gcuauaaauguggguguga

SEQ ID NO: 307224 - RNA, 19 nt, Homo sapiens
gcgaacaggaccagauuuu

SEQ ID NO: 307225 - RNA, 19 nt, Homo sapiens
aaacucaacgucauuaagc

SEQ ID NO: 307226 - RNA, 19 nt, Homo sapiens
gcuggcuucugcaucaauc

SEQ ID NO: 307227 - RNA, 19 nt, Homo sapiens
caucuuccugcuauaaaug

SEQ ID NO: 307228 - RNA, 19 nt, Homo sapiens
acccagcucuguccugcaa

SEQ ID NO: 307229 - RNA, 19 nt, Homo sapiens
gcauggggcuccugugucu

SEQ ID NO: 307230 - RNA, 19 nt, Homo sapiens
ucagcuacggugucuuuga

SEQ ID NO: 307231 - RNA, 19 nt, Homo sapiens
cuauaaaugugggugugau

SEQ ID NO: 307232 - RNA, 19 nt, Homo sapiens
caaccucucucuugccuua

SEQ ID NO: 307233 - RNA, 19 nt, Homo sapiens
gagaggacuugguggauuu

SEQ ID NO: 307234 - RNA, 19 nt, Homo sapiens
uggacaagcugcugcauua

SEQ ID NO: 307235 - RNA, 19 nt, Homo sapiens
aguggaagcuacagaauua

SEQ ID NO: 307236 - RNA, 19 nt, Homo sapiens
gugcauggcugccuccuaa

SEQ ID NO: 307237 - RNA, 19 nt, Homo sapiens
guucugagauggaaaguug

SEQ ID NO: 307238 - RNA, 19 nt, Homo sapiens
gaccagcaccucaaguuua

SEQ ID NO: 307239 - RNA, 19 nt, Homo sapiens
ggagaggacuugguggauu

SEQ ID NO: 307240 - RNA, 19 nt, Homo sapiens
gaaaguggaagcuacagaa

SEQ ID NO: 307241 - RNA, 19 nt, Homo sapiens
gaacuauucuaggguaugu

SEQ ID NO: 307242 - RNA, 19 nt, Homo sapiens
caagaacgaugaccuuugg

SEQ ID NO: 307243 - RNA, 19 nt, Homo sapiens
ggaagcuacagaauuauuu

SEQ ID NO: 307244 - RNA, 19 nt, Homo sapiens
gcacgagcccuccuucuau

SEQ ID NO: 307245 - RNA, 19 nt, Homo sapiens
aauaaaggcugaauugucu

SEQ ID NO: 307246 - RNA, 19 nt, Homo sapiens
ggacugaguuaugggagaa

SEQ ID NO: 307247 - RNA, 19 nt, Homo sapiens
gcacaaaugauaacaagag

SEQ ID NO: 307248 - RNA, 19 nt, Homo sapiens
gauccuagcuggaauuagc

SEQ ID NO: 307249 - RNA, 19 nt, Homo sapiens
gcccuucucuccugucuga

SEQ ID NO: 307250 - RNA, 19 nt, Homo sapiens
cacgagcccuccuucuaua

SEQ ID NO: 307251 - RNA, 19 nt, Homo sapiens
gagcaugugcagagaguuu

SEQ ID NO: 307252 - RNA, 19 nt, Homo sapiens
gggccaggaugcugaagaa

SEQ ID NO: 307253 - RNA, 19 nt, Homo sapiens
ccucuuaggugcauuuauc

SEQ ID NO: 307254 - RNA, 19 nt, Homo sapiens
gguccuggguugacugaga

SEQ ID NO: 307255 - RNA, 19 nt, Homo sapiens
gcagagaguuuggcaacgu

SEQ ID NO: 307256 - RNA, 19 nt, Homo sapiens
gugcacaaaugauaacaag

SEQ ID NO: 307257 - RNA, 19 nt, Homo sapiens
caaaugauaacaagaggau

SEQ ID NO: 307258 - RNA, 19 nt, Homo sapiens
ggacuucuucgaguacuuu

SEQ ID NO: 307259 - RNA, 19 nt, Homo sapiens
ucucuugccuuaccucaga

SEQ ID NO: 307260 - RNA, 19 nt, Homo sapiens
gaaagccgacucccgaagu

SEQ ID NO: 307261 - RNA, 19 nt, Homo sapiens
gagaaagugaggaccaaug

SEQ ID NO: 307262 - RNA, 19 nt, Homo sapiens
ucaaguuuaucaagcugaa

SEQ ID NO: 307263 - RNA, 19 nt, Homo sapiens
guagaagacagaauucgau

SEQ ID NO: 307264 - RNA, 19 nt, Homo sapiens
ggcacgagcccuccuucua

SEQ ID NO: 307265 - RNA, 19 nt, Homo sapiens
gcaucggccugccuguguu

SEQ ID NO: 307266 - RNA, 19 nt, Homo sapiens
gggacagcuucaaggcuuu

SEQ ID NO: 307267 - RNA, 19 nt, Homo sapiens
agaaagugaggaccaauga

SEQ ID NO: 307268 - RNA, 19 nt, Homo sapiens
aaagccgacucccgaaguu

SEQ ID NO: 307269 - RNA, 19 nt, Homo sapiens
cagagaguuuggcaacguu

SEQ ID NO: 307270 - RNA, 19 nt, Homo sapiens
ggaggccuaugaccgagau

SEQ ID NO: 307271 - RNA, 19 nt, Homo sapiens
ggaaugacaacggcaagga

SEQ ID NO: 307272 - RNA, 19 nt, Homo sapiens
aaauaaaggcugaauuguc

SEQ ID NO: 307273 - RNA, 19 nt, Homo sapiens
ugaaagaaaguggaagcua

SEQ ID NO: 307274 - RNA, 19 nt, Homo sapiens
gccuagcaguuuauaguuc

SEQ ID NO: 307275 - RNA, 19 nt, Homo sapiens
ccaccuauccgcugcugaa

SEQ ID NO: 307276 - RNA, 19 nt, Homo sapiens
gcaaguuccagggcuacua

SEQ ID NO: 307277 - RNA, 19 nt, Homo sapiens
gggagaaggggacauauuu

SEQ ID NO: 307278 - RNA, 19 nt, Homo sapiens
ucaagaacgaugaccuuug

SEQ ID NO: 307279 - RNA, 19 nt, Homo sapiens
uaaaggcugaauugucuga

SEQ ID NO: 307280 - RNA, 19 nt, Homo sapiens
gguagaagacagaauucga

SEQ ID NO: 307281 - RNA, 19 nt, Homo sapiens
ugccuguguuucccucuua

SEQ ID NO: 307282 - RNA, 19 nt, Homo sapiens
ugaccagcaccucaaguuu

SEQ ID NO: 307283 - RNA, 19 nt, Homo sapiens
gagcccaaguggccaaagg

SEQ ID NO: 307284 - RNA, 19 nt, Homo sapiens
gacaagcugcugcauuauc

SEQ ID NO: 307285 - RNA, 19 nt, Homo sapiens
gcaacguucgcucucuuga

SEQ ID NO: 307286 - RNA, 19 nt, Homo sapiens
ggauuauucucccguucuc

SEQ ID NO: 307287 - RNA, 19 nt, Homo sapiens
accagcaccucaaguuuau

SEQ ID NO: 307288 - RNA, 19 nt, Homo sapiens
gcucuaccgcaccgacuuu

SEQ ID NO: 307289 - RNA, 19 nt, Homo sapiens
ggacaagcugcugcauuau

SEQ ID NO: 307290 - RNA, 19 nt, Homo sapiens
cagccuagcaguuuauagu

SEQ ID NO: 307291 - RNA, 19 nt, Homo sapiens
guccuggguugacugagaa

SEQ ID NO: 307292 - RNA, 19 nt, Homo sapiens
gggaacuauucuaggguau

SEQ ID NO: 307293 - RNA, 19 nt, Homo sapiens
gcaccugccuguccuuccu

SEQ ID NO: 307294 - RNA, 19 nt, Homo sapiens
gcccagcugucaggagaga

SEQ ID NO: 307295 - RNA, 19 nt, Homo sapiens
cuuaggugcauuuaucuuu

SEQ ID NO: 307296 - RNA, 19 nt, Homo sapiens
acaagcugcugcauuaucg

SEQ ID NO: 307297 - RNA, 19 nt, Homo sapiens
uuccagggcuacuacaaga

SEQ ID NO: 307298 - RNA, 19 nt, Homo sapiens
aaggcugaauugucugaaa

SEQ ID NO: 307299 - RNA, 19 nt, Homo sapiens
ugggagggcuaugauccua

SEQ ID NO: 307300 - RNA, 19 nt, Homo sapiens
cgacgugggagggcuauga

SEQ ID NO: 307301 - RNA, 19 nt, Homo sapiens
ugggacaaccucucucuug

SEQ ID NO: 307302 - RNA, 19 nt, Homo sapiens
gcugagcucuuccccauca

SEQ ID NO: 307303 - RNA, 19 nt, Homo sapiens
cuugcagccuagcaguuua

SEQ ID NO: 307304 - RNA, 19 nt, Homo sapiens
gcauggcugccuccuaauc

SEQ ID NO: 307305 - RNA, 19 nt, Homo sapiens
gcaccucaaguuuaucaag

SEQ ID NO: 307306 - RNA, 19 nt, Homo sapiens
ugauucgccuggcccaaga

SEQ ID NO: 307307 - RNA, 19 nt, Homo sapiens
gccacgggcaguucuuuga

SEQ ID NO: 307308 - RNA, 19 nt, Homo sapiens
gagccacgggcaguucuuu

SEQ ID NO: 307309 - RNA, 19 nt, Homo sapiens
aaagaaaguggaagcuaca

SEQ ID NO: 307310 - RNA, 19 nt, Homo sapiens
ccuagcaguuuauaguucu

SEQ ID NO: 307311 - RNA, 19 nt, Homo sapiens
ggaacuauucuaggguaug

SEQ ID NO: 307312 - RNA, 19 nt, Homo sapiens
cagcaccucaaguuuauca

SEQ ID NO: 307313 - RNA, 19 nt, Homo sapiens
uggaagcuacagaauuauu

SEQ ID NO: 307314 - RNA, 19 nt, Homo sapiens
ccaaaaugauacuaaccaa

SEQ ID NO: 307315 - RNA, 19 nt, Homo sapiens
ggaccaaugaccggaagga

SEQ ID NO: 307316 - RNA, 19 nt, Homo sapiens
uuauaguucugagauggaa

SEQ ID NO: 307317 - RNA, 19 nt, Homo sapiens
ccaaggcucugggugucau

SEQ ID NO: 307318 - RNA, 19 nt, Homo sapiens
cuugguagaagacagaauu

SEQ ID NO: 307319 - RNA, 19 nt, Homo sapiens
uggcaacguucgcucucuu

SEQ ID NO: 307320 - RNA, 19 nt, Homo sapiens
gcugccuccuaaucccaua

SEQ ID NO: 307321 - RNA, 19 nt, Homo sapiens
gggcagggacagcuucaag

SEQ ID NO: 307322 - RNA, 19 nt, Homo sapiens
agaggaggcaucccuagga

SEQ ID NO: 307323 - RNA, 19 nt, Homo sapiens
gagaucucaagaacgauga

SEQ ID NO: 307324 - RNA, 19 nt, Homo sapiens
gcaguuuauaguucugaga

SEQ ID NO: 307325 - RNA, 19 nt, Homo sapiens
aaaugauacuaaccaaagg

SEQ ID NO: 307326 - RNA, 19 nt, Homo sapiens
uggagaaagugaggaccaa

SEQ ID NO: 307327 - RNA, 19 nt, Homo sapiens
aaucagugcccucccuguu

SEQ ID NO: 307328 - RNA, 19 nt, Homo sapiens
ggagaaagugaggaccaau

SEQ ID NO: 307329 - RNA, 19 nt, Homo sapiens
gaccaucaauuccgacaua

SEQ ID NO: 307330 - RNA, 19 nt, Homo sapiens
gguguaauaugaagaguaa

SEQ ID NO: 307331 - RNA, 19 nt, Homo sapiens
gaacucaucuguugauugc

SEQ ID NO: 307332 - RNA, 19 nt, Homo sapiens
cgacauaucuauaccugaa

SEQ ID NO: 307333 - RNA, 19 nt, Homo sapiens
gacagcauuugguguaaua

SEQ ID NO: 307334 - RNA, 19 nt, Homo sapiens
ucagagggcuacagacuau

SEQ ID NO: 307335 - RNA, 19 nt, Homo sapiens
ggaaacugcuagacaacug

SEQ ID NO: 307336 - RNA, 19 nt, Homo sapiens
ggaaauucaagcaguguuu

SEQ ID NO: 307337 - RNA, 19 nt, Homo sapiens
acucaucuguugauugcua

SEQ ID NO: 307338 - RNA, 19 nt, Homo sapiens
uguggaaacugcuagacaa

SEQ ID NO: 307339 - RNA, 19 nt, Homo sapiens
cacagcaacuuccuugauc

SEQ ID NO: 307340 - RNA, 19 nt, Homo sapiens
ggacugaugaugcauacag

SEQ ID NO: 307341 - RNA, 19 nt, Homo sapiens
gcauuugguguaauaugaa

SEQ ID NO: 307342 - RNA, 19 nt, Homo sapiens
agcauuugguguaauauga

SEQ ID NO: 307343 - RNA, 19 nt, Homo sapiens
caauuccgacauaucuaua

SEQ ID NO: 307344 - RNA, 19 nt, Homo sapiens
ccacagcaacuuccuugau

SEQ ID NO: 307345 - RNA, 19 nt, Homo sapiens
ucacauagaacucugaaaa

SEQ ID NO: 307346 - RNA, 19 nt, Homo sapiens
caucaauuccgacauaucu

SEQ ID NO: 307347 - RNA, 19 nt, Homo sapiens
cgacagcauuugguguaau

SEQ ID NO: 307348 - RNA, 19 nt, Homo sapiens
cuucaagaguucauagaca

SEQ ID NO: 307349 - RNA, 19 nt, Homo sapiens
ucaauuccgacauaucuau

SEQ ID NO: 307350 - RNA, 19 nt, Homo sapiens
gaaacugcuagacaacugu

SEQ ID NO: 307351 - RNA, 19 nt, Homo sapiens
acgcacgacugaacacaga

SEQ ID NO: 307352 - RNA, 19 nt, Homo sapiens
ccauuucaauaacuaacug

SEQ ID NO: 307353 - RNA, 19 nt, Homo sapiens
caagcaguguuuccucaac

SEQ ID NO: 307354 - RNA, 19 nt, Homo sapiens
ccacuuuucuuucuugugu

SEQ ID NO: 307355 - RNA, 19 nt, Homo sapiens
gcucagagggcuacagacu

SEQ ID NO: 307356 - RNA, 19 nt, Homo sapiens
uacgacagcauuuggugua

SEQ ID NO: 307357 - RNA, 19 nt, Homo sapiens
cucaaccagucacauagaa

SEQ ID NO: 307358 - RNA, 19 nt, Homo sapiens
aagaguucauagacaguga

SEQ ID NO: 307359 - RNA, 19 nt, Homo sapiens
gcacgacugaacacagaca

SEQ ID NO: 307360 - RNA, 19 nt, Homo sapiens
uggaggacaugguugaaaa

SEQ ID NO: 307361 - RNA, 19 nt, Homo sapiens
caaccagucacauagaacu

SEQ ID NO: 307362 - RNA, 19 nt, Homo sapiens
caauaacuaacugcaaauc

SEQ ID NO: 307363 - RNA, 19 nt, Homo sapiens
cagcauuugguguaauaug

SEQ ID NO: 307364 - RNA, 19 nt, Homo sapiens
agaagaggaucacuacuua

SEQ ID NO: 307365 - RNA, 19 nt, Homo sapiens
ggaacugguuucugcuuua

SEQ ID NO: 307366 - RNA, 19 nt, Homo sapiens
ggacuggacucuucaauac

SEQ ID NO: 307367 - RNA, 19 nt, Homo sapiens
gaagaaugccgcuuugaaa

SEQ ID NO: 307368 - RNA, 19 nt, Homo sapiens
ccagagaccugccgaagaa

SEQ ID NO: 307369 - RNA, 19 nt, Homo sapiens
gaacugguuucugcuuuaa

SEQ ID NO: 307370 - RNA, 19 nt, Homo sapiens
gaaugccgcuuugaaauug

SEQ ID NO: 307371 - RNA, 19 nt, Homo sapiens
ucaccucaauguagaaaua

SEQ ID NO: 307372 - RNA, 19 nt, Homo sapiens
uggcauggcugacaaggua

SEQ ID NO: 307373 - RNA, 19 nt, Homo sapiens
gcauucaguuguacccuaa

SEQ ID NO: 307374 - RNA, 19 nt, Homo sapiens
uugcuucacugguuuaaua

SEQ ID NO: 307375 - RNA, 19 nt, Homo sapiens
gaaggcauucuacaaguuu

SEQ ID NO: 307376 - RNA, 19 nt, Homo sapiens
gagaagaggggaaauuuua

SEQ ID NO: 307377 - RNA, 19 nt, Homo sapiens
uguaaaagguguccaaaua

SEQ ID NO: 307378 - RNA, 19 nt, Homo sapiens
uuagauuccuguacuauug

SEQ ID NO: 307379 - RNA, 19 nt, Homo sapiens
aaacaggacauacaauuga

SEQ ID NO: 307380 - RNA, 19 nt, Homo sapiens
aagcgacagucuucuauuu

SEQ ID NO: 307381 - RNA, 19 nt, Homo sapiens
gaaauacagugguuuuguu

SEQ ID NO: 307382 - RNA, 19 nt, Homo sapiens
gaacagucauuuucaguau

SEQ ID NO: 307383 - RNA, 19 nt, Homo sapiens
ccaaacaggacauacaauu

SEQ ID NO: 307384 - RNA, 19 nt, Homo sapiens
auagaagacugcagugaaa

SEQ ID NO: 307385 - RNA, 19 nt, Homo sapiens
agauuaugcuggccuuaua

SEQ ID NO: 307386 - RNA, 19 nt, Homo sapiens
ucaaauuccuaggaucuuu

SEQ ID NO: 307387 - RNA, 19 nt, Homo sapiens
uaaacacccugucagaaca

SEQ ID NO: 307388 - RNA, 19 nt, Homo sapiens
ucucuugacacacuuauua

SEQ ID NO: 307389 - RNA, 19 nt, Homo sapiens
caaacaggacauacaauug

SEQ ID NO: 307390 - RNA, 19 nt, Homo sapiens
ugaaggcauucuacaaguu

SEQ ID NO: 307391 - RNA, 19 nt, Homo sapiens
guauuagauuccuguacua

SEQ ID NO: 307392 - RNA, 19 nt, Homo sapiens
gcaagagugcccugaaugu

SEQ ID NO: 307393 - RNA, 19 nt, Homo sapiens
gcaaugggcgacaaaggaa

SEQ ID NO: 307394 - RNA, 19 nt, Homo sapiens
gggauugcuucacugguuu

SEQ ID NO: 307395 - RNA, 19 nt, Homo sapiens
aaagguguccaaauacaua

SEQ ID NO: 307396 - RNA, 19 nt, Homo sapiens
gcucaguucuggccgucua

SEQ ID NO: 307397 - RNA, 19 nt, Homo sapiens
gguagugacccuagagauu

SEQ ID NO: 307398 - RNA, 19 nt, Homo sapiens
guuguacccuaacgaguuu

SEQ ID NO: 307399 - RNA, 19 nt, Homo sapiens
uguaccagcugaacuuuga

SEQ ID NO: 307400 - RNA, 19 nt, Homo sapiens
gcaguugcggguugucaua

SEQ ID NO: 307401 - RNA, 19 nt, Homo sapiens
gggacuggacucuucaaua

SEQ ID NO: 307402 - RNA, 19 nt, Homo sapiens
ccagaaacucuaacuauca

SEQ ID NO: 307403 - RNA, 19 nt, Homo sapiens
caacguccucgucaucuuu

SEQ ID NO: 307404 - RNA, 19 nt, Homo sapiens
gaacacacuuucuuuugga

SEQ ID NO: 307405 - RNA, 19 nt, Homo sapiens
cugaaacuuuguacacuuu

SEQ ID NO: 307406 - RNA, 19 nt, Homo sapiens
acugguuucugcuuuaaua

SEQ ID NO: 307407 - RNA, 19 nt, Homo sapiens
cagcaagagugcccugaau

SEQ ID NO: 307408 - RNA, 19 nt, Homo sapiens
cgaagaaugccgcuuugaa

SEQ ID NO: 307409 - RNA, 19 nt, Homo sapiens
guagugacccuagagauug

SEQ ID NO: 307410 - RNA, 19 nt, Homo sapiens
ccuaacgaguuuccaggua

SEQ ID NO: 307411 - RNA, 19 nt, Homo sapiens
guucuuuccuuucagcauu

SEQ ID NO: 307412 - RNA, 19 nt, Homo sapiens
caaauucucccagaccaaa

SEQ ID NO: 307413 - RNA, 19 nt, Homo sapiens
gacacuuucuguacuuaug

SEQ ID NO: 307414 - RNA, 19 nt, Homo sapiens
ggaaauccacagagcacaa

SEQ ID NO: 307415 - RNA, 19 nt, Homo sapiens
gugaaggcauucuacaagu

SEQ ID NO: 307416 - RNA, 19 nt, Homo sapiens
caggacauacaauugaaua

SEQ ID NO: 307417 - RNA, 19 nt, Homo sapiens
uagaagaggaucacuacuu

SEQ ID NO: 307418 - RNA, 19 nt, Homo sapiens
gagcagcaaugggcgacaa

SEQ ID NO: 307419 - RNA, 19 nt, Homo sapiens
gguuucugcuuuaauacaa

SEQ ID NO: 307420 - RNA, 19 nt, Homo sapiens
ugacaagguagaugugaaa

SEQ ID NO: 307421 - RNA, 19 nt, Homo sapiens
agaaugccgcuuugaaauu

SEQ ID NO: 307422 - RNA, 19 nt, Homo sapiens
gaugaaauuguuaggguau

SEQ ID NO: 307423 - RNA, 19 nt, Homo sapiens
uaugcuggccuuauacuuu

SEQ ID NO: 307424 - RNA, 19 nt, Homo sapiens
gguggaagcugcauuuugu

SEQ ID NO: 307425 - RNA, 19 nt, Homo sapiens
ccaguuaugucugauuaag

SEQ ID NO: 307426 - RNA, 19 nt, Homo sapiens
uuccaguuaugucugauua

SEQ ID NO: 307427 - RNA, 19 nt, Homo sapiens
uauagaagacugcagugaa

SEQ ID NO: 307428 - RNA, 19 nt, Homo sapiens
ggaaacugaagcagcaaga

SEQ ID NO: 307429 - RNA, 19 nt, Homo sapiens
cuacuuagccccagacuuu

SEQ ID NO: 307430 - RNA, 19 nt, Homo sapiens
cagguguucuuuccuuuca

SEQ ID NO: 307431 - RNA, 19 nt, Homo sapiens
cagaaacucuaacuaucag

SEQ ID NO: 307432 - RNA, 19 nt, Homo sapiens
gaaauccacagagcacaau

SEQ ID NO: 307433 - RNA, 19 nt, Homo sapiens
gagauuaugcuggccuuau

SEQ ID NO: 307434 - RNA, 19 nt, Homo sapiens
gccgaagaaugccgcuuug

SEQ ID NO: 307435 - RNA, 19 nt, Homo sapiens
ggugguggaagcugcauuu

SEQ ID NO: 307436 - RNA, 19 nt, Homo sapiens
cugcuggacucacuucgaa

SEQ ID NO: 307437 - RNA, 19 nt, Homo sapiens
ggauugcuucacugguuua

SEQ ID NO: 307438 - RNA, 19 nt, Homo sapiens
cucaaucuguuaucugcua

SEQ ID NO: 307439 - RNA, 19 nt, Homo sapiens
uaaaagguguccaaauaca

SEQ ID NO: 307440 - RNA, 19 nt, Homo sapiens
gacuguaucuugucuucca

SEQ ID NO: 307441 - RNA, 19 nt, Homo sapiens
caguuucacucucuugaca

SEQ ID NO: 307442 - RNA, 19 nt, Homo sapiens
ucugaaacuuuguacacuu

SEQ ID NO: 307443 - RNA, 19 nt, Homo sapiens
gaagaggggaaauuuuauu

SEQ ID NO: 307444 - RNA, 19 nt, Homo sapiens
ucaaucuguuaucugcuaa

SEQ ID NO: 307445 - RNA, 19 nt, Homo sapiens
uccagaaacucuaacuauc

SEQ ID NO: 307446 - RNA, 19 nt, Homo sapiens
ugguaugcaucacaagaaa

SEQ ID NO: 307447 - RNA, 19 nt, Homo sapiens
gaagaggaucacuacuuag

SEQ ID NO: 307448 - RNA, 19 nt, Homo sapiens
uaacgaguuuccagguagu

SEQ ID NO: 307449 - RNA, 19 nt, Homo sapiens
agggauugcuucacugguu

SEQ ID NO: 307450 - RNA, 19 nt, Homo sapiens
acuggacucuucaauacuu

SEQ ID NO: 307451 - RNA, 19 nt, Homo sapiens
aagagugcccugaauguga

SEQ ID NO: 307452 - RNA, 19 nt, Homo sapiens
gaaaagcccagggaauuga

SEQ ID NO: 307453 - RNA, 19 nt, Homo sapiens
gcagcaagagugcccugaa

SEQ ID NO: 307454 - RNA, 19 nt, Homo sapiens
gaauuucuguccgguucug

SEQ ID NO: 307455 - RNA, 19 nt, Homo sapiens
guuaaacacccugucagaa

SEQ ID NO: 307456 - RNA, 19 nt, Homo sapiens
aacaggacauacaauugaa

SEQ ID NO: 307457 - RNA, 19 nt, Homo sapiens
uguagaccauccacucaga

SEQ ID NO: 307458 - RNA, 19 nt, Homo sapiens
uuauagagaggccaaauuc

SEQ ID NO: 307459 - RNA, 19 nt, Homo sapiens
cgccgaugcucgagcugua

SEQ ID NO: 307460 - RNA, 19 nt, Homo sapiens
gagguuccgcaucuacaaa

SEQ ID NO: 307461 - RNA, 19 nt, Homo sapiens
uugacacacuuauuaggaa

SEQ ID NO: 307462 - RNA, 19 nt, Homo sapiens
gagagaagaggggaaauuu

SEQ ID NO: 307463 - RNA, 19 nt, Homo sapiens
gguguccaaauacauagua

SEQ ID NO: 307464 - RNA, 19 nt, Homo sapiens
ccaaguaccugcugaagaa

SEQ ID NO: 307465 - RNA, 19 nt, Homo sapiens
gaaaauaucccuccuguug

SEQ ID NO: 307466 - RNA, 19 nt, Homo sapiens
ucaagacccuguccuaugu

SEQ ID NO: 307467 - RNA, 19 nt, Homo sapiens
gaucugauaggguuuguga

SEQ ID NO: 307468 - RNA, 19 nt, Homo sapiens
ggacgaggcggaagucuag

SEQ ID NO: 307469 - RNA, 19 nt, Homo sapiens
gccacaaggugcucuaugu

SEQ ID NO: 307470 - RNA, 19 nt, Homo sapiens
gggagaugcugaccaaugg

SEQ ID NO: 307471 - RNA, 19 nt, Homo sapiens
gcuacaagcucuuucucau

SEQ ID NO: 307472 - RNA, 19 nt, Homo sapiens
cugaagcccuugugaauca

SEQ ID NO: 307473 - RNA, 19 nt, Homo sapiens
uacaagcucuuucucaugu

SEQ ID NO: 307474 - RNA, 19 nt, Homo sapiens
ccagggcucuguaaguaga

SEQ ID NO: 307475 - RNA, 19 nt, Homo sapiens
agagcugcaugaucugaua

SEQ ID NO: 307476 - RNA, 19 nt, Homo sapiens
ccaauggcaccuucgagua

SEQ ID NO: 307477 - RNA, 19 nt, Homo sapiens
acccagggcucuguaagua

SEQ ID NO: 307478 - RNA, 19 nt, Homo sapiens
ggacaccaccgaguauuuc

SEQ ID NO: 307479 - RNA, 19 nt, Homo sapiens
caacgucaaccacgaguuc

SEQ ID NO: 307480 - RNA, 19 nt, Homo sapiens
gaagaugagacgcuacaag

SEQ ID NO: 307481 - RNA, 19 nt, Homo sapiens
gucuagagcugcaugaucu

SEQ ID NO: 307482 - RNA, 19 nt, Homo sapiens
acaaggugcucuaugucuu

SEQ ID NO: 307483 - RNA, 19 nt, Homo sapiens
caagcucuuucucauguuc

SEQ ID NO: 307484 - RNA, 19 nt, Homo sapiens
ccuuugagcucagaaaaua

SEQ ID NO: 307485 - RNA, 19 nt, Homo sapiens
gcccuucgccuuccacaug

SEQ ID NO: 307486 - RNA, 19 nt, Homo sapiens
acauguaugcgcccaagua

SEQ ID NO: 307487 - RNA, 19 nt, Homo sapiens
gcucguguccgcccagaau

SEQ ID NO: 307488 - RNA, 19 nt, Homo sapiens
ccgaggacaccaccgagua

SEQ ID NO: 307489 - RNA, 19 nt, Homo sapiens
cuacugaagcccuugugaa

SEQ ID NO: 307490 - RNA, 19 nt, Homo sapiens
aagagagccugcaggaucu

SEQ ID NO: 307491 - RNA, 19 nt, Homo sapiens
gaagucuagagcugcauga

SEQ ID NO: 307492 - RNA, 19 nt, Homo sapiens
cuacaagcucuuucucaug

SEQ ID NO: 307493 - RNA, 19 nt, Homo sapiens
ccgagggcaucuacuucaa

SEQ ID NO: 307494 - RNA, 19 nt, Homo sapiens
caaggugcucuaugucuuc

SEQ ID NO: 307495 - RNA, 19 nt, Homo sapiens
ucuguaaguagaugcauuu

SEQ ID NO: 307496 - RNA, 19 nt, Homo sapiens
cgacgugguggacgccuuu

SEQ ID NO: 307497 - RNA, 19 nt, Homo sapiens
cgaggacaccaccgaguau

SEQ ID NO: 307498 - RNA, 19 nt, Homo sapiens
aguaccugcugaagaacua

SEQ ID NO: 307499 - RNA, 19 nt, Homo sapiens
ggacaagcgggaccugaac

SEQ ID NO: 307500 - RNA, 19 nt, Homo sapiens
ucaacgccaucaacgucaa

SEQ ID NO: 307501 - RNA, 19 nt, Homo sapiens
gaggacaccaccgaguauu

SEQ ID NO: 307502 - RNA, 19 nt, Homo sapiens
caauggcaccuucgaguac

SEQ ID NO: 307503 - RNA, 19 nt, Homo sapiens
gggaggguaggcaggauug

SEQ ID NO: 307504 - RNA, 19 nt, Homo sapiens
ccagcgagcacauguaugc

SEQ ID NO: 307505 - RNA, 19 nt, Homo sapiens
caccaugcccaacuucaga

SEQ ID NO: 307506 - RNA, 19 nt, Homo sapiens
acuccaaccugcccaccaa

SEQ ID NO: 307507 - RNA, 19 nt, Homo sapiens
gccugugccucaucuccuu

SEQ ID NO: 307508 - RNA, 19 nt, Homo sapiens
uuucucauguucuguaugg

SEQ ID NO: 307509 - RNA, 19 nt, Homo sapiens
cgggagaugcugaccaaug

SEQ ID NO: 307510 - RNA, 19 nt, Homo sapiens
ggaagagagccugcaggau

SEQ ID NO: 307511 - RNA, 19 nt, Homo sapiens
gacccagggcucuguaagu

SEQ ID NO: 307512 - RNA, 19 nt, Homo sapiens
uacugaagcccuugugaau

SEQ ID NO: 307513 - RNA, 19 nt, Homo sapiens
gagacgcuacaagcucuuu

SEQ ID NO: 307514 - RNA, 19 nt, Homo sapiens
acaagcgggaccugaacua

SEQ ID NO: 307515 - RNA, 19 nt, Homo sapiens
ccuuaugacugccaagacu

SEQ ID NO: 307516 - RNA, 19 nt, Homo sapiens
ccacaaggugcucuauguc

SEQ ID NO: 307517 - RNA, 19 nt, Homo sapiens
uccgggagaugcugaccaa

SEQ ID NO: 307518 - RNA, 19 nt, Homo sapiens
caaagaauauucccaguua

SEQ ID NO: 307519 - RNA, 19 nt, Homo sapiens
gaacacuggucuagaauug

SEQ ID NO: 307520 - RNA, 19 nt, Homo sapiens
ggaucuggcugcauuaaua

SEQ ID NO: 307521 - RNA, 19 nt, Homo sapiens
cgaagaagcugaucauaau

SEQ ID NO: 307522 - RNA, 19 nt, Homo sapiens
uggcaaaccuucucuguua

SEQ ID NO: 307523 - RNA, 19 nt, Homo sapiens
gaacuuacguuaugauagu

SEQ ID NO: 307524 - RNA, 19 nt, Homo sapiens
caaauaagauguagcaauc

SEQ ID NO: 307525 - RNA, 19 nt, Homo sapiens
gauaggaucuggcugcauu

SEQ ID NO: 307526 - RNA, 19 nt, Homo sapiens
guuaagagguagauaguaa

SEQ ID NO: 307527 - RNA, 19 nt, Homo sapiens
guacugaacccgaauuuaa

SEQ ID NO: 307528 - RNA, 19 nt, Homo sapiens
cuacaaagaguaucuguua

SEQ ID NO: 307529 - RNA, 19 nt, Homo sapiens
gaauagugauggaauguau

SEQ ID NO: 307530 - RNA, 19 nt, Homo sapiens
ugaagaagguuguaggaaa

SEQ ID NO: 307531 - RNA, 19 nt, Homo sapiens
ucaaggaaaucaugaagaa

SEQ ID NO: 307532 - RNA, 19 nt, Homo sapiens
caagggcucugaaacauga

SEQ ID NO: 307533 - RNA, 19 nt, Homo sapiens
ggaagcaugugcaggguuu

SEQ ID NO: 307534 - RNA, 19 nt, Homo sapiens
caccugaacuccagugaua

SEQ ID NO: 307535 - RNA, 19 nt, Homo sapiens
gaccacaucuccucaguug

SEQ ID NO: 307536 - RNA, 19 nt, Homo sapiens
acaaggacaugcugaagua

SEQ ID NO: 307537 - RNA, 19 nt, Homo sapiens
ggaagaaaguccucguuca

SEQ ID NO: 307538 - RNA, 19 nt, Homo sapiens
ggaaagaucaaguggauga

SEQ ID NO: 307539 - RNA, 19 nt, Homo sapiens
gaacuuauuccuccuaaau

SEQ ID NO: 307540 - RNA, 19 nt, Homo sapiens
caaccuacaccaugaauuu

SEQ ID NO: 307541 - RNA, 19 nt, Homo sapiens
gggaagcccugauugagaa

SEQ ID NO: 307542 - RNA, 19 nt, Homo sapiens
gaauaagcacuguguguuu

SEQ ID NO: 307543 - RNA, 19 nt, Homo sapiens
cagaggaacuuacguuaug

SEQ ID NO: 307544 - RNA, 19 nt, Homo sapiens
gagcucauuuacauugaua

SEQ ID NO: 307545 - RNA, 19 nt, Homo sapiens
gaagaauuccgguggauga

SEQ ID NO: 307546 - RNA, 19 nt, Homo sapiens
gaaaauugguguccucauu

SEQ ID NO: 307547 - RNA, 19 nt, Homo sapiens
ggaacaaacucaaccaacu

SEQ ID NO: 307548 - RNA, 19 nt, Homo sapiens
ggaagaauaagaagaucua

SEQ ID NO: 307549 - RNA, 19 nt, Homo sapiens
gaacccgaauuuaaucaug

SEQ ID NO: 307550 - RNA, 19 nt, Homo sapiens
gaagaagguuguaggaaac

SEQ ID NO: 307551 - RNA, 19 nt, Homo sapiens
gaaaacccuugcuguguua

SEQ ID NO: 307552 - RNA, 19 nt, Homo sapiens
ggaagugcaugcaacuguu

SEQ ID NO: 307553 - RNA, 19 nt, Homo sapiens
gaaccagucccuuguguau

SEQ ID NO: 307554 - RNA, 19 nt, Homo sapiens
gaagaauccuuugacugaa

SEQ ID NO: 307555 - RNA, 19 nt, Homo sapiens
ccagggcucugaaagcuaa

SEQ ID NO: 307556 - RNA, 19 nt, Homo sapiens
ccagguggcucucugcaaa

SEQ ID NO: 307557 - RNA, 19 nt, Homo sapiens
caaauuaugcccaaucgaa

SEQ ID NO: 307558 - RNA, 19 nt, Homo sapiens
gaugguaugucacaauauc

SEQ ID NO: 307559 - RNA, 19 nt, Homo sapiens
cagaagcacauaauaauga

SEQ ID NO: 307560 - RNA, 19 nt, Homo sapiens
ccucuucuuugucuaguua

SEQ ID NO: 307561 - RNA, 19 nt, Homo sapiens
caaucuaccucuucuuugu

SEQ ID NO: 307562 - RNA, 19 nt, Homo sapiens
agaagaauccuuugacuga

SEQ ID NO: 307563 - RNA, 19 nt, Homo sapiens
aagaugguaugucacaaua

SEQ ID NO: 307564 - RNA, 19 nt, Homo sapiens
ugacaucccagcauccuua

SEQ ID NO: 307565 - RNA, 19 nt, Homo sapiens
gaagaucuacuuggacauu

SEQ ID NO: 307566 - RNA, 19 nt, Homo sapiens
ucaaggcacuggcagaaga

SEQ ID NO: 307567 - RNA, 19 nt, Homo sapiens
guuccugaaucauaagaua

SEQ ID NO: 307568 - RNA, 19 nt, Homo sapiens
ggucugugcuggcauuaga

SEQ ID NO: 307569 - RNA, 19 nt, Homo sapiens
gcugaccuuugccaaguua

SEQ ID NO: 307570 - RNA, 19 nt, Homo sapiens
uggcugagcucaaggaaau

SEQ ID NO: 307571 - RNA, 19 nt, Homo sapiens
gccauacgcuggagucaug

SEQ ID NO: 307572 - RNA, 19 nt, Homo sapiens
gcucagguccuacuuguug

SEQ ID NO: 307573 - RNA, 19 nt, Homo sapiens
gaauugagagguuggcaaa

SEQ ID NO: 307574 - RNA, 19 nt, Homo sapiens
ggagugauuuaauuacauc

SEQ ID NO: 307575 - RNA, 19 nt, Homo sapiens
guauguacacucugaagua

SEQ ID NO: 307576 - RNA, 19 nt, Homo sapiens
ggucuagaauugagagguu

SEQ ID NO: 307577 - RNA, 19 nt, Homo sapiens
caugacagcuuaugaucug

SEQ ID NO: 307578 - RNA, 19 nt, Homo sapiens
ggacauuauucacacauac

SEQ ID NO: 307579 - RNA, 19 nt, Homo sapiens
auaagaagaucuacuugga

SEQ ID NO: 307580 - RNA, 19 nt, Homo sapiens
gaagaagcugaucauaauu

SEQ ID NO: 307581 - RNA, 19 nt, Homo sapiens
ucucaucacuaaacacuga

SEQ ID NO: 307582 - RNA, 19 nt, Homo sapiens
aaacuacucugccuuuuaa

SEQ ID NO: 307583 - RNA, 19 nt, Homo sapiens
gaauuguugagcucauuua

SEQ ID NO: 307584 - RNA, 19 nt, Homo sapiens
gaaguuguccucucagaag

SEQ ID NO: 307585 - RNA, 19 nt, Homo sapiens
agagccaucucaucacuaa

SEQ ID NO: 307586 - RNA, 19 nt, Homo sapiens
gugccuggauuauuucauu

SEQ ID NO: 307587 - RNA, 19 nt, Homo sapiens
gaagauugagccauacaug

SEQ ID NO: 307588 - RNA, 19 nt, Homo sapiens
caauagaacaccagaacuu

SEQ ID NO: 307589 - RNA, 19 nt, Homo sapiens
uauaccauguucccucaua

SEQ ID NO: 307590 - RNA, 19 nt, Homo sapiens
cauggcuucugguuuauuu

SEQ ID NO: 307591 - RNA, 19 nt, Homo sapiens
ccagcaaauuuaagaguug

SEQ ID NO: 307592 - RNA, 19 nt, Homo sapiens
uuacaguuccugaaucaua

SEQ ID NO: 307593 - RNA, 19 nt, Homo sapiens
ggcaaaccuucucuguuaa

SEQ ID NO: 307594 - RNA, 19 nt, Homo sapiens
gaagugcaugcaacuguuu

SEQ ID NO: 307595 - RNA, 19 nt, Homo sapiens
gaauuugugucuaucuucu

SEQ ID NO: 307596 - RNA, 19 nt, Homo sapiens
uacaguuccugaaucauaa

SEQ ID NO: 307597 - RNA, 19 nt, Homo sapiens
gcuuacaguuccugaauca

SEQ ID NO: 307598 - RNA, 19 nt, Homo sapiens
ucaagauccugcuaccauu

SEQ ID NO: 307599 - RNA, 19 nt, Homo sapiens
gcagaggaacuuacguuau

SEQ ID NO: 307600 - RNA, 19 nt, Homo sapiens
guucuguuaucuccuauga

SEQ ID NO: 307601 - RNA, 19 nt, Homo sapiens
ggccaugacauuaggauuu

SEQ ID NO: 307602 - RNA, 19 nt, Homo sapiens
ccacuuggcuaauucuucu

SEQ ID NO: 307603 - RNA, 19 nt, Homo sapiens
gaaacuacucugccuuuua

SEQ ID NO: 307604 - RNA, 19 nt, Homo sapiens
ugaaguacagccuggguua

SEQ ID NO: 307605 - RNA, 19 nt, Homo sapiens
ggccugagaauucacauuu

SEQ ID NO: 307606 - RNA, 19 nt, Homo sapiens
ggaccauccuggguucauu

SEQ ID NO: 307607 - RNA, 19 nt, Homo sapiens
ucagugagguugaaaauug

SEQ ID NO: 307608 - RNA, 19 nt, Homo sapiens
gauauugaaccagcaaauu

SEQ ID NO: 307609 - RNA, 19 nt, Homo sapiens
cauaauugcuuagcuucuu

SEQ ID NO: 307610 - RNA, 19 nt, Homo sapiens
ggaguaccaugugagauuc

SEQ ID NO: 307611 - RNA, 19 nt, Homo sapiens
gguaaccauuugcaaccua

SEQ ID NO: 307612 - RNA, 19 nt, Homo sapiens
ccuuugacccuaagaauaa

SEQ ID NO: 307613 - RNA, 19 nt, Homo sapiens
gaagcuaucgcaaauggau

SEQ ID NO: 307614 - RNA, 19 nt, Homo sapiens
ggacuuggguucccuuacg

SEQ ID NO: 307615 - RNA, 19 nt, Homo sapiens
gaccugcaguuccuucuuc

SEQ ID NO: 307616 - RNA, 19 nt, Homo sapiens
gaauaagaagaucuacuug

SEQ ID NO: 307617 - RNA, 19 nt, Homo sapiens
caacuccacuacagcuguu

SEQ ID NO: 307618 - RNA, 19 nt, Homo sapiens
ucacagaacugcaggguau

SEQ ID NO: 307619 - RNA, 19 nt, Homo sapiens
caaaugccauagaugaauu

SEQ ID NO: 307620 - RNA, 19 nt, Homo sapiens
gaaaccugcuauacauguu

SEQ ID NO: 307621 - RNA, 19 nt, Homo sapiens
cagcagucuuugugauuua

SEQ ID NO: 307622 - RNA, 19 nt, Homo sapiens
gacaaucaauccacaagug

SEQ ID NO: 307623 - RNA, 19 nt, Homo sapiens
gagcaauguugagguguuu

SEQ ID NO: 307624 - RNA, 19 nt, Homo sapiens
guugaaaccugcuauacau

SEQ ID NO: 307625 - RNA, 19 nt, Homo sapiens
cuacaaaugccauagauga

SEQ ID NO: 307626 - RNA, 19 nt, Homo sapiens
gcagcagccucaccaugaa

SEQ ID NO: 307627 - RNA, 19 nt, Homo sapiens
caccuucucuuucuuaugu

SEQ ID NO: 307628 - RNA, 19 nt, Homo sapiens
ccacaccuucucuuucuua

SEQ ID NO: 307629 - RNA, 19 nt, Homo sapiens
ggaugaaacucugagcaau

SEQ ID NO: 307630 - RNA, 19 nt, Homo sapiens
caaaccacaccuucucuuu

SEQ ID NO: 307631 - RNA, 19 nt, Homo sapiens
gaaacucugagcaauguug

SEQ ID NO: 307632 - RNA, 19 nt, Homo sapiens
gacaaugccacuacaaaug

SEQ ID NO: 307633 - RNA, 19 nt, Homo sapiens
gaaugugauuuccaagaca

SEQ ID NO: 307634 - RNA, 19 nt, Homo sapiens
uagaugaauugaaggaaug

SEQ ID NO: 307635 - RNA, 19 nt, Homo sapiens
gagaaugugauuuccaaga

SEQ ID NO: 307636 - RNA, 19 nt, Homo sapiens
ugagguguuuaugcaauua

SEQ ID NO: 307637 - RNA, 19 nt, Homo sapiens
gaugaaacucugagcaaug

SEQ ID NO: 307638 - RNA, 19 nt, Homo sapiens
gagaaaccaacuacggauu

SEQ ID NO: 307639 - RNA, 19 nt, Homo sapiens
ugccauagaugaauugaag

SEQ ID NO: 307640 - RNA, 19 nt, Homo sapiens
ugacagcagucuuugugau

SEQ ID NO: 307641 - RNA, 19 nt, Homo sapiens
gaaggaauguuuucuuaac

SEQ ID NO: 307642 - RNA, 19 nt, Homo sapiens
cgacaaugccacuacaaau

SEQ ID NO: 307643 - RNA, 19 nt, Homo sapiens
acagcagucuuugugauuu

SEQ ID NO: 307644 - RNA, 19 nt, Homo sapiens
gacagcagucuuugugauu

SEQ ID NO: 307645 - RNA, 19 nt, Homo sapiens
aaccugcuauacauguuua

SEQ ID NO: 307646 - RNA, 19 nt, Homo sapiens
gaaaccaacuacggauugc

SEQ ID NO: 307647 - RNA, 19 nt, Homo sapiens
gcaauguugagguguuuau

SEQ ID NO: 307648 - RNA, 19 nt, Homo sapiens
gcaaaccacaccuucucuu

SEQ ID NO: 307649 - RNA, 19 nt, Homo sapiens
guugagguguuuaugcaau

SEQ ID NO: 307650 - RNA, 19 nt, Homo sapiens
gcaagaccuuuggcucaca

SEQ ID NO: 307651 - RNA, 19 nt, Homo sapiens
ugagcaauguugagguguu

SEQ ID NO: 307652 - RNA, 19 nt, Homo sapiens
caagacaauuguugaaacc

SEQ ID NO: 307653 - RNA, 19 nt, Homo sapiens
uaaccaaacggaugaaacu

SEQ ID NO: 307654 - RNA, 19 nt, Homo sapiens
aaccacaccuucucuuucu

SEQ ID NO: 307655 - RNA, 19 nt, Homo sapiens
agaaaccaacuacggauug

SEQ ID NO: 307656 - RNA, 19 nt, Homo sapiens
ucaauccacaagugucuaa

SEQ ID NO: 307657 - RNA, 19 nt, Homo sapiens
ugaaaccugcuauacaugu

SEQ ID NO: 307658 - RNA, 19 nt, Homo sapiens
cuacaaacuacaagacaau

SEQ ID NO: 307659 - RNA, 19 nt, Homo sapiens
ccacuacaaaugccauaga

SEQ ID NO: 307660 - RNA, 19 nt, Homo sapiens
acuacaaacuacaagacaa

SEQ ID NO: 307661 - RNA, 19 nt, Homo sapiens
aaaccacaccuucucuuuc

SEQ ID NO: 307662 - RNA, 19 nt, Homo sapiens
aaugugauuuccaagacaa

SEQ ID NO: 307663 - RNA, 19 nt, Homo sapiens
agaaugugauuuccaagac

SEQ ID NO: 307664 - RNA, 19 nt, Homo sapiens
ugcaggguauggugagaaa

SEQ ID NO: 307665 - RNA, 19 nt, Homo sapiens
augaaacucugagcaaugu

SEQ ID NO: 307666 - RNA, 19 nt, Homo sapiens
cacuacaaaugccauagau

SEQ ID NO: 307667 - RNA, 19 nt, Homo sapiens
agacgacaaugccacuaca

SEQ ID NO: 307668 - RNA, 19 nt, Homo sapiens
uaugacagcagucuuugug

SEQ ID NO: 307669 - RNA, 19 nt, Homo sapiens
auauaugacagcagucuuu

SEQ ID NO: 307670 - RNA, 19 nt, Homo sapiens
caagacaaucaauccacaa

SEQ ID NO: 307671 - RNA, 19 nt, Homo sapiens
gagguguuuaugcaauuaa

SEQ ID NO: 307672 - RNA, 19 nt, Homo sapiens
ccauagaugaauugaagga

SEQ ID NO: 307673 - RNA, 19 nt, Homo sapiens
acaaaugccauagaugaau

SEQ ID NO: 307674 - RNA, 19 nt, Homo sapiens
uacaaaugccauagaugaa

SEQ ID NO: 307675 - RNA, 19 nt, Homo sapiens
acaaacuacaagacaauug

SEQ ID NO: 307676 - RNA, 19 nt, Homo sapiens
cuaagacugaauacaaaga

SEQ ID NO: 307677 - RNA, 19 nt, Homo sapiens
uugagguguuuaugcaauu

SEQ ID NO: 307678 - RNA, 19 nt, Homo sapiens
cggaugaaacucugagcaa

SEQ ID NO: 307679 - RNA, 19 nt, Homo sapiens
ggaauguuuucuuaaccaa

SEQ ID NO: 307680 - RNA, 19 nt, Homo sapiens
gacugaauacaaagaacuu

SEQ ID NO: 307681 - RNA, 19 nt, Homo sapiens
uauuggagaaugugauuuc

SEQ ID NO: 307682 - RNA, 19 nt, Homo sapiens
gaaauacucugucuagaaa

SEQ ID NO: 307683 - RNA, 19 nt, Homo sapiens
gaagagaaauccaaacauu

SEQ ID NO: 307684 - RNA, 19 nt, Homo sapiens
caagaaaccugacaauauu

SEQ ID NO: 307685 - RNA, 19 nt, Homo sapiens
gcaagaagcugaaguaugg

SEQ ID NO: 307686 - RNA, 19 nt, Homo sapiens
gaaaggcagugaagcauaa

SEQ ID NO: 307687 - RNA, 19 nt, Homo sapiens
gaaagaaaccucaaugauu

SEQ ID NO: 307688 - RNA, 19 nt, Homo sapiens
gaaguagagucaucuuuaa

SEQ ID NO: 307689 - RNA, 19 nt, Homo sapiens
gcaagaaaccugacaauau

SEQ ID NO: 307690 - RNA, 19 nt, Homo sapiens
gaaaugauaccaaagauga

SEQ ID NO: 307691 - RNA, 19 nt, Homo sapiens
ugacaaaugugcucucuuu

SEQ ID NO: 307692 - RNA, 19 nt, Homo sapiens
caaaugagccugcuacuga

SEQ ID NO: 307693 - RNA, 19 nt, Homo sapiens
gaaauuaacaguagaggaa

SEQ ID NO: 307694 - RNA, 19 nt, Homo sapiens
ggagaaagaaaccaaauuu

SEQ ID NO: 307695 - RNA, 19 nt, Homo sapiens
gagaagacauaacggauga

SEQ ID NO: 307696 - RNA, 19 nt, Homo sapiens
caaaguacaugcagaacaa

SEQ ID NO: 307697 - RNA, 19 nt, Homo sapiens
acaaguagcugaagccaaa

SEQ ID NO: 307698 - RNA, 19 nt, Homo sapiens
ggaaaauggugcuuacuua

SEQ ID NO: 307699 - RNA, 19 nt, Homo sapiens
gaugauaacuuggaauuag

SEQ ID NO: 307700 - RNA, 19 nt, Homo sapiens
ggaaagaacaagugaguga

SEQ ID NO: 307701 - RNA, 19 nt, Homo sapiens
gaagaagaauuggagagaa

SEQ ID NO: 307702 - RNA, 19 nt, Homo sapiens
caacagaagcacaaaguuu

SEQ ID NO: 307703 - RNA, 19 nt, Homo sapiens
ggauaacuguagugaauga

SEQ ID NO: 307704 - RNA, 19 nt, Homo sapiens
ggacaaaugugaaaguaac

SEQ ID NO: 307705 - RNA, 19 nt, Homo sapiens
gauucaugcugcuaaguua

SEQ ID NO: 307706 - RNA, 19 nt, Homo sapiens
gaacgcuuguuaaagauga

SEQ ID NO: 307707 - RNA, 19 nt, Homo sapiens
caaaugugcucucuuucuu

SEQ ID NO: 307708 - RNA, 19 nt, Homo sapiens
gagcuuacagagcauauua

SEQ ID NO: 307709 - RNA, 19 nt, Homo sapiens
caggauaacuguagugaau

SEQ ID NO: 307710 - RNA, 19 nt, Homo sapiens
gaagaacgacugaagauag

SEQ ID NO: 307711 - RNA, 19 nt, Homo sapiens
agucagagguccauuguuu

SEQ ID NO: 307712 - RNA, 19 nt, Homo sapiens
ugaacaagaugaauugaug

SEQ ID NO: 307713 - RNA, 19 nt, Homo sapiens
ugaaguagagucaucuuua

SEQ ID NO: 307714 - RNA, 19 nt, Homo sapiens
cugaagagcuggagaccua

SEQ ID NO: 307715 - RNA, 19 nt, Homo sapiens
uaaagaaagucacaucaag

SEQ ID NO: 307716 - RNA, 19 nt, Homo sapiens
gaacagguccaauucugaa

SEQ ID NO: 307717 - RNA, 19 nt, Homo sapiens
gaaacagagcuuaaauuug

SEQ ID NO: 307718 - RNA, 19 nt, Homo sapiens
guaugaaggcuaugaagua

SEQ ID NO: 307719 - RNA, 19 nt, Homo sapiens
gaaaguaacauuugaagac

SEQ ID NO: 307720 - RNA, 19 nt, Homo sapiens
gauacagucucuagaagau

SEQ ID NO: 307721 - RNA, 19 nt, Homo sapiens
ggaaaggcagugaagcaua

SEQ ID NO: 307722 - RNA, 19 nt, Homo sapiens
cagugaagcauaacuaaua

SEQ ID NO: 307723 - RNA, 19 nt, Homo sapiens
gcccaaagcaacaaauuaa

SEQ ID NO: 307724 - RNA, 19 nt, Homo sapiens
gaaacuccacaggaaauua

SEQ ID NO: 307725 - RNA, 19 nt, Homo sapiens
ccagauauuuccaaugaau

SEQ ID NO: 307726 - RNA, 19 nt, Homo sapiens
gaagguaugagaccagauu

SEQ ID NO: 307727 - RNA, 19 nt, Homo sapiens
aaaugaaacuccacaggaa

SEQ ID NO: 307728 - RNA, 19 nt, Homo sapiens
uuaagcuucuugcacauua

SEQ ID NO: 307729 - RNA, 19 nt, Homo sapiens
caagaacuguauuuacugu

SEQ ID NO: 307730 - RNA, 19 nt, Homo sapiens
gagcuucucgagauuauuu

SEQ ID NO: 307731 - RNA, 19 nt, Homo sapiens
gucaaugccuucagaaaug

SEQ ID NO: 307732 - RNA, 19 nt, Homo sapiens
gccaagaacuguauuuacu

SEQ ID NO: 307733 - RNA, 19 nt, Homo sapiens
guagaaaugauaccaaaga

SEQ ID NO: 307734 - RNA, 19 nt, Homo sapiens
acugaacgcuuguuaaaga

SEQ ID NO: 307735 - RNA, 19 nt, Homo sapiens
caaacauucugaacaagau

SEQ ID NO: 307736 - RNA, 19 nt, Homo sapiens
uggaggauauugagaugua

SEQ ID NO: 307737 - RNA, 19 nt, Homo sapiens
uaauaugccuucuuuggau

SEQ ID NO: 307738 - RNA, 19 nt, Homo sapiens
gacugaagauagcaauaaa

SEQ ID NO: 307739 - RNA, 19 nt, Homo sapiens
caaaaugaccuuccagaua

SEQ ID NO: 307740 - RNA, 19 nt, Homo sapiens
caguagaaaugauaccaaa

SEQ ID NO: 307741 - RNA, 19 nt, Homo sapiens
ggugauaugugcagcuguu

SEQ ID NO: 307742 - RNA, 19 nt, Homo sapiens
gcuguuacuuaagugauua

SEQ ID NO: 307743 - RNA, 19 nt, Homo sapiens
caagacagauuuuguucua

SEQ ID NO: 307744 - RNA, 19 nt, Homo sapiens
uaucaagggcagauuauuu

SEQ ID NO: 307745 - RNA, 19 nt, Homo sapiens
ugacugaacgcuuguuaaa

SEQ ID NO: 307746 - RNA, 19 nt, Homo sapiens
gaauugauggcggauauuu

SEQ ID NO: 307747 - RNA, 19 nt, Homo sapiens
ugaaauacucugucuagaa

SEQ ID NO: 307748 - RNA, 19 nt, Homo sapiens
gaugaaauacucugucuag

SEQ ID NO: 307749 - RNA, 19 nt, Homo sapiens
ugaagucugugucuuuaug

SEQ ID NO: 307750 - RNA, 19 nt, Homo sapiens
uaacugaaacagagcuuaa

SEQ ID NO: 307751 - RNA, 19 nt, Homo sapiens
cagauuauuucccaugaga

SEQ ID NO: 307752 - RNA, 19 nt, Homo sapiens
aaaaugaccuuccagauau

SEQ ID NO: 307753 - RNA, 19 nt, Homo sapiens
gaccaggaccguaggauga

SEQ ID NO: 307754 - RNA, 19 nt, Homo sapiens
ccucaaugauuuaaggaaa

SEQ ID NO: 307755 - RNA, 19 nt, Homo sapiens
ccacaggaaauuaacagua

SEQ ID NO: 307756 - RNA, 19 nt, Homo sapiens
ucagaagcuucaacagaaa

SEQ ID NO: 307757 - RNA, 19 nt, Homo sapiens
gaagagcuggagaccuaua

SEQ ID NO: 307758 - RNA, 19 nt, Homo sapiens
uaacuguagugaaugaugu

SEQ ID NO: 307759 - RNA, 19 nt, Homo sapiens
guggacaaaugugaaagua

SEQ ID NO: 307760 - RNA, 19 nt, Homo sapiens
ucugaagucugugucuuua

SEQ ID NO: 307761 - RNA, 19 nt, Homo sapiens
ggaauccuuuggaccauca

SEQ ID NO: 307762 - RNA, 19 nt, Homo sapiens
gcagagagcauuccccaua

SEQ ID NO: 307763 - RNA, 19 nt, Homo sapiens
gcacucgauguuccaaaua

SEQ ID NO: 307764 - RNA, 19 nt, Homo sapiens
uuccagauauuuccaauga

SEQ ID NO: 307765 - RNA, 19 nt, Homo sapiens
caaaaucccucaaaucaca

SEQ ID NO: 307766 - RNA, 19 nt, Homo sapiens
ggucuuuuguguucaauua

SEQ ID NO: 307767 - RNA, 19 nt, Homo sapiens
gugcagcuguuguuggauu

SEQ ID NO: 307768 - RNA, 19 nt, Homo sapiens
caaaggaagagcuuacaga

SEQ ID NO: 307769 - RNA, 19 nt, Homo sapiens
gaaggagaaagaaaccaaa

SEQ ID NO: 307770 - RNA, 19 nt, Homo sapiens
cgacugaagauagcaauaa

SEQ ID NO: 307771 - RNA, 19 nt, Homo sapiens
gaauccaguagaaaugaua

SEQ ID NO: 307772 - RNA, 19 nt, Homo sapiens
ggucaaugccuucagaaau

SEQ ID NO: 307773 - RNA, 19 nt, Homo sapiens
cacaggaaauuaacaguag

SEQ ID NO: 307774 - RNA, 19 nt, Homo sapiens
gauaaagaaagucacauca

SEQ ID NO: 307775 - RNA, 19 nt, Homo sapiens
auucugaacuugaggauga

SEQ ID NO: 307776 - RNA, 19 nt, Homo sapiens
gaaagaaaaugcucacaac

SEQ ID NO: 307777 - RNA, 19 nt, Homo sapiens
caucaagacucugacugaa

SEQ ID NO: 307778 - RNA, 19 nt, Homo sapiens
agaaacagcuuuugcaaga

SEQ ID NO: 307779 - RNA, 19 nt, Homo sapiens
ggcccaaagcaacaaauua

SEQ ID NO: 307780 - RNA, 19 nt, Homo sapiens
ggaugaugauaacuuggaa

SEQ ID NO: 307781 - RNA, 19 nt, Homo sapiens
uaacggaugaugauaacuu

SEQ ID NO: 307782 - RNA, 19 nt, Homo sapiens
ggaaucgugugacuaauaa

SEQ ID NO: 307783 - RNA, 19 nt, Homo sapiens
gaagggaucugcaggaauc

SEQ ID NO: 307784 - RNA, 19 nt, Homo sapiens
ggacuugggucucauuuag

SEQ ID NO: 307785 - RNA, 19 nt, Homo sapiens
gcacugaauuaaucaucua

SEQ ID NO: 307786 - RNA, 19 nt, Homo sapiens
ugaagaggauaaugagaua

SEQ ID NO: 307787 - RNA, 19 nt, Homo sapiens
aaacuuggauucucacuug

SEQ ID NO: 307788 - RNA, 19 nt, Homo sapiens
gcaggaaucgugugacuaa

SEQ ID NO: 307789 - RNA, 19 nt, Homo sapiens
acaccuagcuuuauucuuc

SEQ ID NO: 307790 - RNA, 19 nt, Homo sapiens
gagcaggacucuauuuuaa

SEQ ID NO: 307791 - RNA, 19 nt, Homo sapiens
gaccacaucuuuaucuguu

SEQ ID NO: 307792 - RNA, 19 nt, Homo sapiens
ucugaaggcuugaguaauu

SEQ ID NO: 307793 - RNA, 19 nt, Homo sapiens
ugacugaucuucuggacaa

SEQ ID NO: 307794 - RNA, 19 nt, Homo sapiens
gaaacuggcacugaauuaa

SEQ ID NO: 307795 - RNA, 19 nt, Homo sapiens
caugauaacccucaaauau

SEQ ID NO: 307796 - RNA, 19 nt, Homo sapiens
gcagccagcucccuuagga

SEQ ID NO: 307797 - RNA, 19 nt, Homo sapiens
guucauguuugcuucauaa

SEQ ID NO: 307798 - RNA, 19 nt, Homo sapiens
gagaaagauuccagaguca

SEQ ID NO: 307799 - RNA, 19 nt, Homo sapiens
ugauaacccucaaauaugu

SEQ ID NO: 307800 - RNA, 19 nt, Homo sapiens
cauguuugcuucauaaaug

SEQ ID NO: 307801 - RNA, 19 nt, Homo sapiens
gaauauagucgaugaccuu

SEQ ID NO: 307802 - RNA, 19 nt, Homo sapiens
ugacagaccacaucuuuau

SEQ ID NO: 307803 - RNA, 19 nt, Homo sapiens
ccaaaagacuacaugauaa

SEQ ID NO: 307804 - RNA, 19 nt, Homo sapiens
ucacuaaauugguggcaaa

SEQ ID NO: 307805 - RNA, 19 nt, Homo sapiens
acacaaacuuggauucuca

SEQ ID NO: 307806 - RNA, 19 nt, Homo sapiens
gcauggagcaggacucuau

SEQ ID NO: 307807 - RNA, 19 nt, Homo sapiens
gagagaguuucaagaagug

SEQ ID NO: 307808 - RNA, 19 nt, Homo sapiens
ugugguuucuucaacauua

SEQ ID NO: 307809 - RNA, 19 nt, Homo sapiens
gcgcugccuuuccuuauga

SEQ ID NO: 307810 - RNA, 19 nt, Homo sapiens
gauucucacuugcauuuau

SEQ ID NO: 307811 - RNA, 19 nt, Homo sapiens
uugcauggcuccagaaaug

SEQ ID NO: 307812 - RNA, 19 nt, Homo sapiens
gagagagaguuucaagaag

SEQ ID NO: 307813 - RNA, 19 nt, Homo sapiens
ccagaacccaggcucuuua

SEQ ID NO: 307814 - RNA, 19 nt, Homo sapiens
cagacugcauguaccauuu

SEQ ID NO: 307815 - RNA, 19 nt, Homo sapiens
gacuuuauauggaugauuc

SEQ ID NO: 307816 - RNA, 19 nt, Homo sapiens
auaaguauguugcaagaga

SEQ ID NO: 307817 - RNA, 19 nt, Homo sapiens
ugaagaagacacaaacuug

SEQ ID NO: 307818 - RNA, 19 nt, Homo sapiens
ugaaacuggcacugaauua

SEQ ID NO: 307819 - RNA, 19 nt, Homo sapiens
gaggauaaugagauaagua

SEQ ID NO: 307820 - RNA, 19 nt, Homo sapiens
gaagagaaagcacgugucu

SEQ ID NO: 307821 - RNA, 19 nt, Homo sapiens
aaacucaucuaaggaucua

SEQ ID NO: 307822 - RNA, 19 nt, Homo sapiens
cuaaauugguggcaaaucu

SEQ ID NO: 307823 - RNA, 19 nt, Homo sapiens
ucacuugcauuuaucuuca

SEQ ID NO: 307824 - RNA, 19 nt, Homo sapiens
agagagaguuucaagaagu

SEQ ID NO: 307825 - RNA, 19 nt, Homo sapiens
gacagcaguagcaguaaua

SEQ ID NO: 307826 - RNA, 19 nt, Homo sapiens
aacauuaaguccugagaaa

SEQ ID NO: 307827 - RNA, 19 nt, Homo sapiens
gcgagaugguaguacaauu

SEQ ID NO: 307828 - RNA, 19 nt, Homo sapiens
agagagagaguuucaagaa

SEQ ID NO: 307829 - RNA, 19 nt, Homo sapiens
cugaaggcuugaguaauua

SEQ ID NO: 307830 - RNA, 19 nt, Homo sapiens
cuccagaaaugucuaaaug

SEQ ID NO: 307831 - RNA, 19 nt, Homo sapiens
uaaguauguugcaagagaa

SEQ ID NO: 307832 - RNA, 19 nt, Homo sapiens
gauaagcgagaugguagua

SEQ ID NO: 307833 - RNA, 19 nt, Homo sapiens
gaagacacaaacuuggauu

SEQ ID NO: 307834 - RNA, 19 nt, Homo sapiens
ccagaaaugucuaaaugcu

SEQ ID NO: 307835 - RNA, 19 nt, Homo sapiens
ccagcucccuuaggaauga

SEQ ID NO: 307836 - RNA, 19 nt, Homo sapiens
uaagcgagaugguaguaca

SEQ ID NO: 307837 - RNA, 19 nt, Homo sapiens
gaacuugcagcugauguug

SEQ ID NO: 307838 - RNA, 19 nt, Homo sapiens
gugauugugugguuucuuc

SEQ ID NO: 307839 - RNA, 19 nt, Homo sapiens
uaaauuguggcuuguauca

SEQ ID NO: 307840 - RNA, 19 nt, Homo sapiens
agagaaagagagagaguuu

SEQ ID NO: 307841 - RNA, 19 nt, Homo sapiens
uauagucgaugaccuugug

SEQ ID NO: 307842 - RNA, 19 nt, Homo sapiens
cgagaugguaguacaauug

SEQ ID NO: 307843 - RNA, 19 nt, Homo sapiens
cagcugauguuggaagaga

SEQ ID NO: 307844 - RNA, 19 nt, Homo sapiens
cauauucugucuggaguga

SEQ ID NO: 307845 - RNA, 19 nt, Homo sapiens
agauaaguauguugcaaga

SEQ ID NO: 307846 - RNA, 19 nt, Homo sapiens
cagcuugacugaucuucug

SEQ ID NO: 307847 - RNA, 19 nt, Homo sapiens
uacauuggcugguaacagu

SEQ ID NO: 307848 - RNA, 19 nt, Homo sapiens
gaaagauuccagagucagu

SEQ ID NO: 307849 - RNA, 19 nt, Homo sapiens
gaacccaggcucuuuacuc

SEQ ID NO: 307850 - RNA, 19 nt, Homo sapiens
cuucagcugcuccuauuua

SEQ ID NO: 307851 - RNA, 19 nt, Homo sapiens
gaagaggauaaugagauaa

SEQ ID NO: 307852 - RNA, 19 nt, Homo sapiens
caagggcaguugaaaauau

SEQ ID NO: 307853 - RNA, 19 nt, Homo sapiens
cauuaaguccugagaaaga

SEQ ID NO: 307854 - RNA, 19 nt, Homo sapiens
aaagaaaacucaucuaagg

SEQ ID NO: 307855 - RNA, 19 nt, Homo sapiens
gcaguagcaguaauaggaa

SEQ ID NO: 307856 - RNA, 19 nt, Homo sapiens
caacauuaaguccugagaa

SEQ ID NO: 307857 - RNA, 19 nt, Homo sapiens
cagcugcuccuauuuaauc

SEQ ID NO: 307858 - RNA, 19 nt, Homo sapiens
gaugguaguacaauuguca

SEQ ID NO: 307859 - RNA, 19 nt, Homo sapiens
ggagcaggacucuauuuua

SEQ ID NO: 307860 - RNA, 19 nt, Homo sapiens
uguaaauuguggcuuguau

SEQ ID NO: 307861 - RNA, 19 nt, Homo sapiens
ugacagcaguagcaguaau

SEQ ID NO: 307862 - RNA, 19 nt, Homo sapiens
aaugacagcaguagcagua

SEQ ID NO: 307863 - RNA, 19 nt, Homo sapiens
ugagauaaguauguugcaa

SEQ ID NO: 307864 - RNA, 19 nt, Homo sapiens
agaaagcacgugucucaga

SEQ ID NO: 307865 - RNA, 19 nt, Homo sapiens
gggacuugggucucauuua

SEQ ID NO: 307866 - RNA, 19 nt, Homo sapiens
aaacuggcacugaauuaau

SEQ ID NO: 307867 - RNA, 19 nt, Homo sapiens
caucugaaacuagugauug

SEQ ID NO: 307868 - RNA, 19 nt, Homo sapiens
gagaugguaguacaauugu

SEQ ID NO: 307869 - RNA, 19 nt, Homo sapiens
gugguuucuucaacauuaa

SEQ ID NO: 307870 - RNA, 19 nt, Homo sapiens
gaaggcuugaguaauuauu

SEQ ID NO: 307871 - RNA, 19 nt, Homo sapiens
aggaaucgugugacuaaua

SEQ ID NO: 307872 - RNA, 19 nt, Homo sapiens
gcuuuauucuucagauaca

SEQ ID NO: 307873 - RNA, 19 nt, Homo sapiens
gugacagaccacaucuuua

SEQ ID NO: 307874 - RNA, 19 nt, Homo sapiens
ucaagaaguguaaauugug

SEQ ID NO: 307875 - RNA, 19 nt, Homo sapiens
ugccuuuccuuaugaagaa

SEQ ID NO: 307876 - RNA, 19 nt, Homo sapiens
uggauucucacuugcauuu

SEQ ID NO: 307877 - RNA, 19 nt, Homo sapiens
guaaaagacgucacuaaau

SEQ ID NO: 307878 - RNA, 19 nt, Homo sapiens
ucgugugacuaauaaugua

SEQ ID NO: 307879 - RNA, 19 nt, Homo sapiens
gugaaacuggcacugaauu

SEQ ID NO: 307880 - RNA, 19 nt, Homo sapiens
ccacaucuuuaucuguucu

SEQ ID NO: 307881 - RNA, 19 nt, Homo sapiens
gagaguuucaagaagugua

SEQ ID NO: 307882 - RNA, 19 nt, Homo sapiens
ggaaucgugugacuaauaa

SEQ ID NO: 307883 - RNA, 19 nt, Homo sapiens
gaagggaucugcaggaauc

SEQ ID NO: 307884 - RNA, 19 nt, Homo sapiens
ggacuugggucucauuuag

SEQ ID NO: 307885 - RNA, 19 nt, Homo sapiens
gcacugaauuaaucaucua

SEQ ID NO: 307886 - RNA, 19 nt, Homo sapiens
ugaagaggauaaugagaua

SEQ ID NO: 307887 - RNA, 19 nt, Homo sapiens
aaacuuggauucucacuug

SEQ ID NO: 307888 - RNA, 19 nt, Homo sapiens
gcaggaaucgugugacuaa

SEQ ID NO: 307889 - RNA, 19 nt, Homo sapiens
acaccuagcuuuauucuuc

SEQ ID NO: 307890 - RNA, 19 nt, Homo sapiens
gagcaggacucuauuuuaa

SEQ ID NO: 307891 - RNA, 19 nt, Homo sapiens
gaccacaucuuuaucuguu

SEQ ID NO: 307892 - RNA, 19 nt, Homo sapiens
ucugaaggcuugaguaauu

SEQ ID NO: 307893 - RNA, 19 nt, Homo sapiens
ugacugaucuucuggacaa

SEQ ID NO: 307894 - RNA, 19 nt, Homo sapiens
gaaacuggcacugaauuaa

SEQ ID NO: 307895 - RNA, 19 nt, Homo sapiens
caugauaacccucaaauau

SEQ ID NO: 307896 - RNA, 19 nt, Homo sapiens
guucauguuugcuucauaa

SEQ ID NO: 307897 - RNA, 19 nt, Homo sapiens
ugauaacccucaaauaugu

SEQ ID NO: 307898 - RNA, 19 nt, Homo sapiens
cauguuugcuucauaaaug

SEQ ID NO: 307899 - RNA, 19 nt, Homo sapiens
gaauauagucgaugaccuu

SEQ ID NO: 307900 - RNA, 19 nt, Homo sapiens
ugacagaccacaucuuuau

SEQ ID NO: 307901 - RNA, 19 nt, Homo sapiens
ccaaaagacuacaugauaa

SEQ ID NO: 307902 - RNA, 19 nt, Homo sapiens
ucacuaaauugguggcaaa

SEQ ID NO: 307903 - RNA, 19 nt, Homo sapiens
acacaaacuuggauucuca

SEQ ID NO: 307904 - RNA, 19 nt, Homo sapiens
gcauggagcaggacucuau

SEQ ID NO: 307905 - RNA, 19 nt, Homo sapiens
gcgcugccuuuccuuauga

SEQ ID NO: 307906 - RNA, 19 nt, Homo sapiens
gagagaguuucaagaagug

SEQ ID NO: 307907 - RNA, 19 nt, Homo sapiens
ugugguuucuucaacauua

SEQ ID NO: 307908 - RNA, 19 nt, Homo sapiens
gauucucacuugcauuuau

SEQ ID NO: 307909 - RNA, 19 nt, Homo sapiens
uugcauggcuccagaaaug

SEQ ID NO: 307910 - RNA, 19 nt, Homo sapiens
gagagagaguuucaagaag

SEQ ID NO: 307911 - RNA, 19 nt, Homo sapiens
ccagaacccaggcucuuua

SEQ ID NO: 307912 - RNA, 19 nt, Homo sapiens
cagacugcauguaccauuu

SEQ ID NO: 307913 - RNA, 19 nt, Homo sapiens
gacuuuauauggaugauuc

SEQ ID NO: 307914 - RNA, 19 nt, Homo sapiens
auaaguauguugcaagaga

SEQ ID NO: 307915 - RNA, 19 nt, Homo sapiens
ugaagaagacacaaacuug

SEQ ID NO: 307916 - RNA, 19 nt, Homo sapiens
ugaaacuggcacugaauua

SEQ ID NO: 307917 - RNA, 19 nt, Homo sapiens
gaggauaaugagauaagua

SEQ ID NO: 307918 - RNA, 19 nt, Homo sapiens
gaagagaaagcacgugucu

SEQ ID NO: 307919 - RNA, 19 nt, Homo sapiens
aaacucaucuaaggaucua

SEQ ID NO: 307920 - RNA, 19 nt, Homo sapiens
cuaaauugguggcaaaucu

SEQ ID NO: 307921 - RNA, 19 nt, Homo sapiens
ucacuugcauuuaucuuca

SEQ ID NO: 307922 - RNA, 19 nt, Homo sapiens
agagagaguuucaagaagu

SEQ ID NO: 307923 - RNA, 19 nt, Homo sapiens
aacauuaaguccugagaaa

SEQ ID NO: 307924 - RNA, 19 nt, Homo sapiens
gcgagaugguaguacaauu

SEQ ID NO: 307925 - RNA, 19 nt, Homo sapiens
agagagagaguuucaagaa

SEQ ID NO: 307926 - RNA, 19 nt, Homo sapiens
cugaaggcuugaguaauua

SEQ ID NO: 307927 - RNA, 19 nt, Homo sapiens
cuccagaaaugucuaaaug

SEQ ID NO: 307928 - RNA, 19 nt, Homo sapiens
gaagacacaaacuuggauu

SEQ ID NO: 307929 - RNA, 19 nt, Homo sapiens
uaaguauguugcaagagaa

SEQ ID NO: 307930 - RNA, 19 nt, Homo sapiens
gauaagcgagaugguagua

SEQ ID NO: 307931 - RNA, 19 nt, Homo sapiens
ccagaaaugucuaaaugcu

SEQ ID NO: 307932 - RNA, 19 nt, Homo sapiens
uaagcgagaugguaguaca

SEQ ID NO: 307933 - RNA, 19 nt, Homo sapiens
gaacuugcagcugauguug

SEQ ID NO: 307934 - RNA, 19 nt, Homo sapiens
gugauugugugguuucuuc

SEQ ID NO: 307935 - RNA, 19 nt, Homo sapiens
uaaauuguggcuuguauca

SEQ ID NO: 307936 - RNA, 19 nt, Homo sapiens
agagaaagagagagaguuu

SEQ ID NO: 307937 - RNA, 19 nt, Homo sapiens
uauagucgaugaccuugug

SEQ ID NO: 307938 - RNA, 19 nt, Homo sapiens
cgagaugguaguacaauug

SEQ ID NO: 307939 - RNA, 19 nt, Homo sapiens
cagcugauguuggaagaga

SEQ ID NO: 307940 - RNA, 19 nt, Homo sapiens
cauauucugucuggaguga

SEQ ID NO: 307941 - RNA, 19 nt, Homo sapiens
agauaaguauguugcaaga

SEQ ID NO: 307942 - RNA, 19 nt, Homo sapiens
cagcuugacugaucuucug

SEQ ID NO: 307943 - RNA, 19 nt, Homo sapiens
uacauuggcugguaacagu

SEQ ID NO: 307944 - RNA, 19 nt, Homo sapiens
gaacccaggcucuuuacuc

SEQ ID NO: 307945 - RNA, 19 nt, Homo sapiens
cuucagcugcuccuauuua

SEQ ID NO: 307946 - RNA, 19 nt, Homo sapiens
gaagaggauaaugagauaa

SEQ ID NO: 307947 - RNA, 19 nt, Homo sapiens
caagggcaguugaaaauau

SEQ ID NO: 307948 - RNA, 19 nt, Homo sapiens
aaagaaaacucaucuaagg

SEQ ID NO: 307949 - RNA, 19 nt, Homo sapiens
caacauuaaguccugagaa

SEQ ID NO: 307950 - RNA, 19 nt, Homo sapiens
cagcugcuccuauuuaauc

SEQ ID NO: 307951 - RNA, 19 nt, Homo sapiens
gaugguaguacaauuguca

SEQ ID NO: 307952 - RNA, 19 nt, Homo sapiens
ggagcaggacucuauuuua

SEQ ID NO: 307953 - RNA, 19 nt, Homo sapiens
uguaaauuguggcuuguau

SEQ ID NO: 307954 - RNA, 19 nt, Homo sapiens
ugagauaaguauguugcaa

SEQ ID NO: 307955 - RNA, 19 nt, Homo sapiens
agaaagcacgugucucaga

SEQ ID NO: 307956 - RNA, 19 nt, Homo sapiens
gggacuugggucucauuua

SEQ ID NO: 307957 - RNA, 19 nt, Homo sapiens
aaacuggcacugaauuaau

SEQ ID NO: 307958 - RNA, 19 nt, Homo sapiens
caucugaaacuagugauug

SEQ ID NO: 307959 - RNA, 19 nt, Homo sapiens
gagaugguaguacaauugu

SEQ ID NO: 307960 - RNA, 19 nt, Homo sapiens
gugguuucuucaacauuaa

SEQ ID NO: 307961 - RNA, 19 nt, Homo sapiens
gaaggcuugaguaauuauu

SEQ ID NO: 307962 - RNA, 19 nt, Homo sapiens
aggaaucgugugacuaaua

SEQ ID NO: 307963 - RNA, 19 nt, Homo sapiens
gcuuuauucuucagauaca

SEQ ID NO: 307964 - RNA, 19 nt, Homo sapiens
gugacagaccacaucuuua

SEQ ID NO: 307965 - RNA, 19 nt, Homo sapiens
ucaagaaguguaaauugug

SEQ ID NO: 307966 - RNA, 19 nt, Homo sapiens
uggauucucacuugcauuu

SEQ ID NO: 307967 - RNA, 19 nt, Homo sapiens
ugccuuuccuuaugaagaa

SEQ ID NO: 307968 - RNA, 19 nt, Homo sapiens
guaaaagacgucacuaaau

SEQ ID NO: 307969 - RNA, 19 nt, Homo sapiens
ucgugugacuaauaaugua

SEQ ID NO: 307970 - RNA, 19 nt, Homo sapiens
gugaaacuggcacugaauu

SEQ ID NO: 307971 - RNA, 19 nt, Homo sapiens
ccacaucuuuaucuguucu

SEQ ID NO: 307972 - RNA, 19 nt, Homo sapiens
gagaguuucaagaagugua

SEQ ID NO: 307973 - RNA, 19 nt, Homo sapiens
acuugggucucauuuagaa

SEQ ID NO: 307974 - RNA, 19 nt, Homo sapiens
agugacagaccacaucuuu

SEQ ID NO: 307975 - RNA, 19 nt, Homo sapiens
uggcuuguaucaacacugu

SEQ ID NO: 307976 - RNA, 19 nt, Homo sapiens
uaaauugguggcaaaucuu

SEQ ID NO: 307977 - RNA, 19 nt, Homo sapiens
uuucguacauuggcuggua

SEQ ID NO: 307978 - RNA, 19 nt, Homo sapiens
gacacaaacuuggauucuc

SEQ ID NO: 307979 - RNA, 19 nt, Homo sapiens
caagagaaagagagagagu

SEQ ID NO: 307980 - RNA, 19 nt, Homo sapiens
guggagugcgucaaagaaa

SEQ ID NO: 307981 - RNA, 19 nt, Homo sapiens
aaagagagagaguuucaag

SEQ ID NO: 307982 - RNA, 19 nt, Homo sapiens
gcaguaggauggauguuug

SEQ ID NO: 307983 - RNA, 19 nt, Homo sapiens
gaaauucggagaagugauu

SEQ ID NO: 307984 - RNA, 19 nt, Homo sapiens
ccagacagguguuauggaa

SEQ ID NO: 307985 - RNA, 19 nt, Homo sapiens
caaggauugugaaaugaaa

SEQ ID NO: 307986 - RNA, 19 nt, Homo sapiens
ggaagcugcugaagguugu

SEQ ID NO: 307987 - RNA, 19 nt, Homo sapiens
gcaccgcuguauuaaagga

SEQ ID NO: 307988 - RNA, 19 nt, Homo sapiens
uauggaagcugcugaaggu

SEQ ID NO: 307989 - RNA, 19 nt, Homo sapiens
uggaggcaccgcuguauua

SEQ ID NO: 307990 - RNA, 19 nt, Homo sapiens
gcugaagguugugaaauuc

SEQ ID NO: 307991 - RNA, 19 nt, Homo sapiens
ggaggcaccgcuguauuaa

SEQ ID NO: 307992 - RNA, 19 nt, Homo sapiens
ggccgaaacugaguaugug

SEQ ID NO: 307993 - RNA, 19 nt, Homo sapiens
ugcugaagguugugaaauu

SEQ ID NO: 307994 - RNA, 19 nt, Homo sapiens
aggcaccgcuguauuaaag

SEQ ID NO: 307995 - RNA, 19 nt, Homo sapiens
gcagugggaggagcaauga

SEQ ID NO: 307996 - RNA, 19 nt, Homo sapiens
cugaguaugugcaguagga

SEQ ID NO: 307997 - RNA, 19 nt, Homo sapiens
ccgaggcuaucgaagaguu

SEQ ID NO: 307998 - RNA, 19 nt, Homo sapiens
gcccgaggcuaucgaagag

SEQ ID NO: 307999 - RNA, 19 nt, Homo sapiens
gaggcaccgcuguauuaaa

SEQ ID NO: 308000 - RNA, 19 nt, Homo sapiens
gauuucuuaccagcaauua

SEQ ID NO: 308001 - RNA, 19 nt, Homo sapiens
aagagucguucaccagaca

SEQ ID NO: 308002 - RNA, 19 nt, Homo sapiens
agugauuucuuaccagcaa

SEQ ID NO: 308003 - RNA, 19 nt, Homo sapiens
guugugaaauucggagaag

SEQ ID NO: 308004 - RNA, 19 nt, Homo sapiens
ccucaucccgugccacaga

SEQ ID NO: 308005 - RNA, 19 nt, Homo sapiens
gauacaaugcugccuauaa

SEQ ID NO: 308006 - RNA, 19 nt, Homo sapiens
cauggaaucuuaugaacuu

SEQ ID NO: 308007 - RNA, 19 nt, Homo sapiens
caaaggagagucaacauau

SEQ ID NO: 308008 - RNA, 19 nt, Homo sapiens
uagcagcauuacugaaaua

SEQ ID NO: 308009 - RNA, 19 nt, Homo sapiens
auaaacuucuggugugaua

SEQ ID NO: 308010 - RNA, 19 nt, Homo sapiens
augaaagcauggaaucuua

SEQ ID NO: 308011 - RNA, 19 nt, Homo sapiens
acaagaacccugagacuga

SEQ ID NO: 308012 - RNA, 19 nt, Homo sapiens
ucaaaggagagucaacaua

SEQ ID NO: 308013 - RNA, 19 nt, Homo sapiens
ccagauugauaaguaauga

SEQ ID NO: 308014 - RNA, 19 nt, Homo sapiens
auacaaugcugccuauaau

SEQ ID NO: 308015 - RNA, 19 nt, Homo sapiens
uaauaaacuucugguguga

SEQ ID NO: 308016 - RNA, 19 nt, Homo sapiens
cagcauuacugaaauacau

SEQ ID NO: 308017 - RNA, 19 nt, Homo sapiens
ugugaugacuacagacuuu

SEQ ID NO: 308018 - RNA, 19 nt, Homo sapiens
ggagaaaugcaaauaccuu

SEQ ID NO: 308019 - RNA, 19 nt, Homo sapiens
aaaggagagucaacauaug

SEQ ID NO: 308020 - RNA, 19 nt, Homo sapiens
ggaagccugugaugacuac

SEQ ID NO: 308021 - RNA, 19 nt, Homo sapiens
gaaagcauggaaucuuaug

SEQ ID NO: 308022 - RNA, 19 nt, Homo sapiens
caaugcuucuuuccuguau

SEQ ID NO: 308023 - RNA, 19 nt, Homo sapiens
guagcagcauuacugaaau

SEQ ID NO: 308024 - RNA, 19 nt, Homo sapiens
ccuuagcgguaguaacuuu

SEQ ID NO: 308025 - RNA, 19 nt, Homo sapiens
ggagagucaacauauguga

SEQ ID NO: 308026 - RNA, 19 nt, Homo sapiens
gaaaugcaaauaccuucau

SEQ ID NO: 308027 - RNA, 19 nt, Homo sapiens
uguagcagcauuacugaaa

SEQ ID NO: 308028 - RNA, 19 nt, Homo sapiens
gcuggcaccugauuuugua

SEQ ID NO: 308029 - RNA, 19 nt, Homo sapiens
aaaugagacugagggaaga

SEQ ID NO: 308030 - RNA, 19 nt, Homo sapiens
agagucaacauaugugauu

SEQ ID NO: 308031 - RNA, 19 nt, Homo sapiens
acugaaauacauaggcuua

SEQ ID NO: 308032 - RNA, 19 nt, Homo sapiens
gagucaacauaugugauug

SEQ ID NO: 308033 - RNA, 19 nt, Homo sapiens
uaacaggagaaaugcaaau

SEQ ID NO: 308034 - RNA, 19 nt, Homo sapiens
uggauacaaugcugccuau

SEQ ID NO: 308035 - RNA, 19 nt, Homo sapiens
caugguuuauggauacaau

SEQ ID NO: 308036 - RNA, 19 nt, Homo sapiens
aagcauggaaucuuaugaa

SEQ ID NO: 308037 - RNA, 19 nt, Homo sapiens
ggucaaaggagagucaaca

SEQ ID NO: 308038 - RNA, 19 nt, Homo sapiens
ggaggcuggcaccugauuu

SEQ ID NO: 308039 - RNA, 19 nt, Homo sapiens
ucaauagggaagccuguga

SEQ ID NO: 308040 - RNA, 19 nt, Homo sapiens
aggcuuauauacaaugcuu

SEQ ID NO: 308041 - RNA, 19 nt, Homo sapiens
gggaagccugugaugacua

SEQ ID NO: 308042 - RNA, 19 nt, Homo sapiens
ugaaagcauggaaucuuau

SEQ ID NO: 308043 - RNA, 19 nt, Homo sapiens
caggagaaaugcaaauacc

SEQ ID NO: 308044 - RNA, 19 nt, Homo sapiens
acaaugcuucuuuccugua

SEQ ID NO: 308045 - RNA, 19 nt, Homo sapiens
ggauacaaugcugccuaua

SEQ ID NO: 308046 - RNA, 19 nt, Homo sapiens
aaggagagucaacauaugu

SEQ ID NO: 308047 - RNA, 19 nt, Homo sapiens
augcuucuuuccuguauau

SEQ ID NO: 308048 - RNA, 19 nt, Homo sapiens
gcauggaaucuuaugaacu

SEQ ID NO: 308049 - RNA, 19 nt, Homo sapiens
gauccgagaacgcucuaag

SEQ ID NO: 308050 - RNA, 19 nt, Homo sapiens
aacaggagaaaugcaaaua

SEQ ID NO: 308051 - RNA, 19 nt, Homo sapiens
gagagucaacauaugugau

SEQ ID NO: 308052 - RNA, 19 nt, Homo sapiens
gagggucaaaggagaguca

SEQ ID NO: 308053 - RNA, 19 nt, Homo sapiens
gcauuacugaaauacauag

SEQ ID NO: 308054 - RNA, 19 nt, Homo sapiens
gcaggacgaaaccaugaag

SEQ ID NO: 308055 - RNA, 19 nt, Homo sapiens
gguaauggaugaugaagua

SEQ ID NO: 308056 - RNA, 19 nt, Homo sapiens
ggaauuggccuccuguauu

SEQ ID NO: 308057 - RNA, 19 nt, Homo sapiens
caacugcauucuauagauu

SEQ ID NO: 308058 - RNA, 19 nt, Homo sapiens
gcagaggaauuaugaacug

SEQ ID NO: 308059 - RNA, 19 nt, Homo sapiens
gcaacugcauucuauagau

SEQ ID NO: 308060 - RNA, 19 nt, Homo sapiens
gcagagcccaccugaauga

SEQ ID NO: 308061 - RNA, 19 nt, Homo sapiens
ucgaacagaugacagagua

SEQ ID NO: 308062 - RNA, 19 nt, Homo sapiens
agaagacuguguagcauuu

SEQ ID NO: 308063 - RNA, 19 nt, Homo sapiens
gaauugcacguaugagaaa

SEQ ID NO: 308064 - RNA, 19 nt, Homo sapiens
ucacacaacaccucacuuu

SEQ ID NO: 308065 - RNA, 19 nt, Homo sapiens
ccacaccauugcauauuug

SEQ ID NO: 308066 - RNA, 19 nt, Homo sapiens
gcacguaugagaaaccuau

SEQ ID NO: 308067 - RNA, 19 nt, Homo sapiens
gagaaaaugccaagaagua

SEQ ID NO: 308068 - RNA, 19 nt, Homo sapiens
gaacagaugacagaguaga

SEQ ID NO: 308069 - RNA, 19 nt, Homo sapiens
gggagcagaggaauuauga

SEQ ID NO: 308070 - RNA, 19 nt, Homo sapiens
ccaccugaaugaccuugaa

SEQ ID NO: 308071 - RNA, 19 nt, Homo sapiens
ugacagaguagaacgugua

SEQ ID NO: 308072 - RNA, 19 nt, Homo sapiens
ucacccagguaauggauga

SEQ ID NO: 308073 - RNA, 19 nt, Homo sapiens
uaagaauucuguacuucca

SEQ ID NO: 308074 - RNA, 19 nt, Homo sapiens
cuacagccauccugcacuu

SEQ ID NO: 308075 - RNA, 19 nt, Homo sapiens
gguaaacccauuuugaaua

SEQ ID NO: 308076 - RNA, 19 nt, Homo sapiens
aaaugaugcuuaugaguac

SEQ ID NO: 308077 - RNA, 19 nt, Homo sapiens
uaaaagaauugcacguaug

SEQ ID NO: 308078 - RNA, 19 nt, Homo sapiens
gaggggagcagaggaauua

SEQ ID NO: 308079 - RNA, 19 nt, Homo sapiens
ucaauacugcugaaacaga

SEQ ID NO: 308080 - RNA, 19 nt, Homo sapiens
aauggaugaugaaguauuc

SEQ ID NO: 308081 - RNA, 19 nt, Homo sapiens
gagcagaggaauuaugaac

SEQ ID NO: 308082 - RNA, 19 nt, Homo sapiens
ccagaagacuguguagcau

SEQ ID NO: 308083 - RNA, 19 nt, Homo sapiens
cacaacaccucacuuuuga

SEQ ID NO: 308084 - RNA, 19 nt, Homo sapiens
acgcagagcccaccugaau

SEQ ID NO: 308085 - RNA, 19 nt, Homo sapiens
cguaugagaaaccuauauu

SEQ ID NO: 308086 - RNA, 19 nt, Homo sapiens
guaaauuguaccuguaaag

SEQ ID NO: 308087 - RNA, 19 nt, Homo sapiens
acagguugcugaaaaguaa

SEQ ID NO: 308088 - RNA, 19 nt, Homo sapiens
agaauucuguacuuccaau

SEQ ID NO: 308089 - RNA, 19 nt, Homo sapiens
gcuuacagguugcugaaaa

SEQ ID NO: 308090 - RNA, 19 nt, Homo sapiens
gcacuucagacuauuuguc

SEQ ID NO: 308091 - RNA, 19 nt, Homo sapiens
agaauugcacguaugagaa

SEQ ID NO: 308092 - RNA, 19 nt, Homo sapiens
cagaagacuguguagcauu

SEQ ID NO: 308093 - RNA, 19 nt, Homo sapiens
uuuguuggauauggaguua

SEQ ID NO: 308094 - RNA, 19 nt, Homo sapiens
accacaccauugcauauuu

SEQ ID NO: 308095 - RNA, 19 nt, Homo sapiens
cauccuaugcaacaauuau

SEQ ID NO: 308096 - RNA, 19 nt, Homo sapiens
aagaauugcacguaugaga

SEQ ID NO: 308097 - RNA, 19 nt, Homo sapiens
ccagguaauggaugaugaa

SEQ ID NO: 308098 - RNA, 19 nt, Homo sapiens
gaagacuguguagcauuug

SEQ ID NO: 308099 - RNA, 19 nt, Homo sapiens
cccagguaauggaugauga

SEQ ID NO: 308100 - RNA, 19 nt, Homo sapiens
caauccagaagacugugua

SEQ ID NO: 308101 - RNA, 19 nt, Homo sapiens
cuaccacaccauugcauau

SEQ ID NO: 308102 - RNA, 19 nt, Homo sapiens
agauugacaagaaagguuu

SEQ ID NO: 308103 - RNA, 19 nt, Homo sapiens
acacaacaccucacuuuug

SEQ ID NO: 308104 - RNA, 19 nt, Homo sapiens
gcugaaaaguaaauuguac

SEQ ID NO: 308105 - RNA, 19 nt, Homo sapiens
caccauugcauauuugaca

SEQ ID NO: 308106 - RNA, 19 nt, Homo sapiens
gaaaaugccaagaaguauc

SEQ ID NO: 308107 - RNA, 19 nt, Homo sapiens
auccugcacuucagacuau

SEQ ID NO: 308108 - RNA, 19 nt, Homo sapiens
cauccugcacuucagacua

SEQ ID NO: 308109 - RNA, 19 nt, Homo sapiens
ggccuccuguauuccuuga

SEQ ID NO: 308110 - RNA, 19 nt, Homo sapiens
uagauugacaagaaagguu

SEQ ID NO: 308111 - RNA, 19 nt, Homo sapiens
uggaauuggccuccuguau

SEQ ID NO: 308112 - RNA, 19 nt, Homo sapiens
gguaauggaugaugaagua

SEQ ID NO: 308113 - RNA, 19 nt, Homo sapiens
cuacugaaaugacaaguua

SEQ ID NO: 308114 - RNA, 19 nt, Homo sapiens
ggaauuggccuccuguauu

SEQ ID NO: 308115 - RNA, 19 nt, Homo sapiens
caacugcauucuauagauu

SEQ ID NO: 308116 - RNA, 19 nt, Homo sapiens
gcagaggaauuaugaacug

SEQ ID NO: 308117 - RNA, 19 nt, Homo sapiens
gcaacugcauucuauagau

SEQ ID NO: 308118 - RNA, 19 nt, Homo sapiens
gcagagcccaccugaauga

SEQ ID NO: 308119 - RNA, 19 nt, Homo sapiens
ucgaacagaugacagagua

SEQ ID NO: 308120 - RNA, 19 nt, Homo sapiens
agaagacuguguagcauuu

SEQ ID NO: 308121 - RNA, 19 nt, Homo sapiens
gaauacuacugaaaugaca

SEQ ID NO: 308122 - RNA, 19 nt, Homo sapiens
gaauugcacguaugagaaa

SEQ ID NO: 308123 - RNA, 19 nt, Homo sapiens
ucacacaacaccucacuuu

SEQ ID NO: 308124 - RNA, 19 nt, Homo sapiens
ccacaccauugcauauuug

SEQ ID NO: 308125 - RNA, 19 nt, Homo sapiens
gcacguaugagaaaccuau

SEQ ID NO: 308126 - RNA, 19 nt, Homo sapiens
gaacagaugacagaguaga

SEQ ID NO: 308127 - RNA, 19 nt, Homo sapiens
gggagcagaggaauuauga

SEQ ID NO: 308128 - RNA, 19 nt, Homo sapiens
gaaaugacaaguuauucca

SEQ ID NO: 308129 - RNA, 19 nt, Homo sapiens
ccaccugaaugaccuugaa

SEQ ID NO: 308130 - RNA, 19 nt, Homo sapiens
ugacagaguagaacgugua

SEQ ID NO: 308131 - RNA, 19 nt, Homo sapiens
ucacccagguaauggauga

SEQ ID NO: 308132 - RNA, 19 nt, Homo sapiens
uaagaauucuguacuucca

SEQ ID NO: 308133 - RNA, 19 nt, Homo sapiens
cuacagccauccugcacuu

SEQ ID NO: 308134 - RNA, 19 nt, Homo sapiens
gguaaacccauuuugaaua

SEQ ID NO: 308135 - RNA, 19 nt, Homo sapiens
aaaugaugcuuaugaguac

SEQ ID NO: 308136 - RNA, 19 nt, Homo sapiens
guccuaaagccuacaguuu

SEQ ID NO: 308137 - RNA, 19 nt, Homo sapiens
uaaaagaauugcacguaug

SEQ ID NO: 308138 - RNA, 19 nt, Homo sapiens
gaggggagcagaggaauua

SEQ ID NO: 308139 - RNA, 19 nt, Homo sapiens
ucaauacugcugaaacaga

SEQ ID NO: 308140 - RNA, 19 nt, Homo sapiens
aauggaugaugaaguauuc

SEQ ID NO: 308141 - RNA, 19 nt, Homo sapiens
gagcagaggaauuaugaac

SEQ ID NO: 308142 - RNA, 19 nt, Homo sapiens
ccagaagacuguguagcau

SEQ ID NO: 308143 - RNA, 19 nt, Homo sapiens
cacaacaccucacuuuuga

SEQ ID NO: 308144 - RNA, 19 nt, Homo sapiens
acgcagagcccaccugaau

SEQ ID NO: 308145 - RNA, 19 nt, Homo sapiens
cguaugagaaaccuauauu

SEQ ID NO: 308146 - RNA, 19 nt, Homo sapiens
guaaauuguaccuguaaag

SEQ ID NO: 308147 - RNA, 19 nt, Homo sapiens
acagguugcugaaaaguaa

SEQ ID NO: 308148 - RNA, 19 nt, Homo sapiens
agaauucuguacuuccaau

SEQ ID NO: 308149 - RNA, 19 nt, Homo sapiens
gcuuacagguugcugaaaa

SEQ ID NO: 308150 - RNA, 19 nt, Homo sapiens
gcacuucagacuauuuguc

SEQ ID NO: 308151 - RNA, 19 nt, Homo sapiens
agaauugcacguaugagaa

SEQ ID NO: 308152 - RNA, 19 nt, Homo sapiens
caaguuauuccagaccaaa

SEQ ID NO: 308153 - RNA, 19 nt, Homo sapiens
cagaagacuguguagcauu

SEQ ID NO: 308154 - RNA, 19 nt, Homo sapiens
uuuguuggauauggaguua

SEQ ID NO: 308155 - RNA, 19 nt, Homo sapiens
accacaccauugcauauuu

SEQ ID NO: 308156 - RNA, 19 nt, Homo sapiens
aagaauugcacguaugaga

SEQ ID NO: 308157 - RNA, 19 nt, Homo sapiens
cauccuaugcaacaauuau

SEQ ID NO: 308158 - RNA, 19 nt, Homo sapiens
ccuaaagccuacaguuuug

SEQ ID NO: 308159 - RNA, 19 nt, Homo sapiens
ccagguaauggaugaugaa

SEQ ID NO: 308160 - RNA, 19 nt, Homo sapiens
gaagacuguguagcauuug

SEQ ID NO: 308161 - RNA, 19 nt, Homo sapiens
cccagguaauggaugauga

SEQ ID NO: 308162 - RNA, 19 nt, Homo sapiens
caauccagaagacugugua

SEQ ID NO: 308163 - RNA, 19 nt, Homo sapiens
cuaccacaccauugcauau

SEQ ID NO: 308164 - RNA, 19 nt, Homo sapiens
agauugacaagaaagguuu

SEQ ID NO: 308165 - RNA, 19 nt, Homo sapiens
acacaacaccucacuuuug

SEQ ID NO: 308166 - RNA, 19 nt, Homo sapiens
acaaguuauuccagaccaa

SEQ ID NO: 308167 - RNA, 19 nt, Homo sapiens
gcugaaaaguaaauuguac

SEQ ID NO: 308168 - RNA, 19 nt, Homo sapiens
caccauugcauauuugaca

SEQ ID NO: 308169 - RNA, 19 nt, Homo sapiens
auccugcacuucagacuau

SEQ ID NO: 308170 - RNA, 19 nt, Homo sapiens
cauccugcacuucagacua

SEQ ID NO: 308171 - RNA, 19 nt, Homo sapiens
ggccuccuguauuccuuga

SEQ ID NO: 308172 - RNA, 19 nt, Homo sapiens
uagauugacaagaaagguu

SEQ ID NO: 308173 - RNA, 19 nt, Homo sapiens
uggaauuggccuccuguau

SEQ ID NO: 308174 - RNA, 19 nt, Homo sapiens
gguaauggaugaugaagua

SEQ ID NO: 308175 - RNA, 19 nt, Homo sapiens
ggaauuggccuccuguauu

SEQ ID NO: 308176 - RNA, 19 nt, Homo sapiens
caacugcauucuauagauu

SEQ ID NO: 308177 - RNA, 19 nt, Homo sapiens
gcagaggaauuaugaacug

SEQ ID NO: 308178 - RNA, 19 nt, Homo sapiens
gcaacugcauucuauagau

SEQ ID NO: 308179 - RNA, 19 nt, Homo sapiens
gcagagcccaccugaauga

SEQ ID NO: 308180 - RNA, 19 nt, Homo sapiens
ucgaacagaugacagagua

SEQ ID NO: 308181 - RNA, 19 nt, Homo sapiens
agaagacuguguagcauuu

SEQ ID NO: 308182 - RNA, 19 nt, Homo sapiens
gaauugcacguaugagaaa

SEQ ID NO: 308183 - RNA, 19 nt, Homo sapiens
ucacacaacaccucacuuu

SEQ ID NO: 308184 - RNA, 19 nt, Homo sapiens
ccacaccauugcauauuug

SEQ ID NO: 308185 - RNA, 19 nt, Homo sapiens
gcacguaugagaaaccuau

SEQ ID NO: 308186 - RNA, 19 nt, Homo sapiens
gaacagaugacagaguaga

SEQ ID NO: 308187 - RNA, 19 nt, Homo sapiens
gggagcagaggaauuauga

SEQ ID NO: 308188 - RNA, 19 nt, Homo sapiens
aaacuuagcuuuucaaucg

SEQ ID NO: 308189 - RNA, 19 nt, Homo sapiens
ccaccugaaugaccuugaa

SEQ ID NO: 308190 - RNA, 19 nt, Homo sapiens
ugacagaguagaacgugua

SEQ ID NO: 308191 - RNA, 19 nt, Homo sapiens
ucacccagguaauggauga

SEQ ID NO: 308192 - RNA, 19 nt, Homo sapiens
uaagaauucuguacuucca

SEQ ID NO: 308193 - RNA, 19 nt, Homo sapiens
cuacagccauccugcacuu

SEQ ID NO: 308194 - RNA, 19 nt, Homo sapiens
gguaaacccauuuugaaua

SEQ ID NO: 308195 - RNA, 19 nt, Homo sapiens
aaaugaugcuuaugaguac

SEQ ID NO: 308196 - RNA, 19 nt, Homo sapiens
aaagggaauuguauuucug

SEQ ID NO: 308197 - RNA, 19 nt, Homo sapiens
uaaaagaauugcacguaug

SEQ ID NO: 308198 - RNA, 19 nt, Homo sapiens
gaggggagcagaggaauua

SEQ ID NO: 308199 - RNA, 19 nt, Homo sapiens
ucaauacugcugaaacaga

SEQ ID NO: 308200 - RNA, 19 nt, Homo sapiens
aauggaugaugaaguauuc

SEQ ID NO: 308201 - RNA, 19 nt, Homo sapiens
gagcagaggaauuaugaac

SEQ ID NO: 308202 - RNA, 19 nt, Homo sapiens
ccagaagacuguguagcau

SEQ ID NO: 308203 - RNA, 19 nt, Homo sapiens
cacaacaccucacuuuuga

SEQ ID NO: 308204 - RNA, 19 nt, Homo sapiens
acgcagagcccaccugaau

SEQ ID NO: 308205 - RNA, 19 nt, Homo sapiens
cguaugagaaaccuauauu

SEQ ID NO: 308206 - RNA, 19 nt, Homo sapiens
guaaauuguaccuguaaag

SEQ ID NO: 308207 - RNA, 19 nt, Homo sapiens
acagguugcugaaaaguaa

SEQ ID NO: 308208 - RNA, 19 nt, Homo sapiens
agaauucuguacuuccaau

SEQ ID NO: 308209 - RNA, 19 nt, Homo sapiens
gcuuacagguugcugaaaa

SEQ ID NO: 308210 - RNA, 19 nt, Homo sapiens
gcacuucagacuauuuguc

SEQ ID NO: 308211 - RNA, 19 nt, Homo sapiens
gugcuuggcuccacuuagc

SEQ ID NO: 308212 - RNA, 19 nt, Homo sapiens
agaauugcacguaugagaa

SEQ ID NO: 308213 - RNA, 19 nt, Homo sapiens
cagaagacuguguagcauu

SEQ ID NO: 308214 - RNA, 19 nt, Homo sapiens
uuuguuggauauggaguua

SEQ ID NO: 308215 - RNA, 19 nt, Homo sapiens
accacaccauugcauauuu

SEQ ID NO: 308216 - RNA, 19 nt, Homo sapiens
aagaauugcacguaugaga

SEQ ID NO: 308217 - RNA, 19 nt, Homo sapiens
cauccuaugcaacaauuau

SEQ ID NO: 308218 - RNA, 19 nt, Homo sapiens
ccagguaauggaugaugaa

SEQ ID NO: 308219 - RNA, 19 nt, Homo sapiens
gaagacuguguagcauuug

SEQ ID NO: 308220 - RNA, 19 nt, Homo sapiens
cccagguaauggaugauga

SEQ ID NO: 308221 - RNA, 19 nt, Homo sapiens
caauccagaagacugugua

SEQ ID NO: 308222 - RNA, 19 nt, Homo sapiens
cuaccacaccauugcauau

SEQ ID NO: 308223 - RNA, 19 nt, Homo sapiens
agauugacaagaaagguuu

SEQ ID NO: 308224 - RNA, 19 nt, Homo sapiens
acacaacaccucacuuuug

SEQ ID NO: 308225 - RNA, 19 nt, Homo sapiens
gcugaaaaguaaauuguac

SEQ ID NO: 308226 - RNA, 19 nt, Homo sapiens
caccauugcauauuugaca

SEQ ID NO: 308227 - RNA, 19 nt, Homo sapiens
auccugcacuucagacuau

SEQ ID NO: 308228 - RNA, 19 nt, Homo sapiens
cauccugcacuucagacua

SEQ ID NO: 308229 - RNA, 19 nt, Homo sapiens
ggccuccuguauuccuuga

SEQ ID NO: 308230 - RNA, 19 nt, Homo sapiens
uagauugacaagaaagguu

SEQ ID NO: 308231 - RNA, 19 nt, Homo sapiens
uggaauuggccuccuguau

SEQ ID NO: 308232 - RNA, 19 nt, Homo sapiens
gguaauggaugaugaagua

SEQ ID NO: 308233 - RNA, 19 nt, Homo sapiens
caaagcaaauugucuggua

SEQ ID NO: 308234 - RNA, 19 nt, Homo sapiens
caaauugucugguaucaug

SEQ ID NO: 308235 - RNA, 19 nt, Homo sapiens
ggaauuggccuccuguauu

SEQ ID NO: 308236 - RNA, 19 nt, Homo sapiens
caacugcauucuauagauu

SEQ ID NO: 308237 - RNA, 19 nt, Homo sapiens
gcagaggaauuaugaacug

SEQ ID NO: 308238 - RNA, 19 nt, Homo sapiens
gcaacugcauucuauagau

SEQ ID NO: 308239 - RNA, 19 nt, Homo sapiens
gcagagcccaccugaauga

SEQ ID NO: 308240 - RNA, 19 nt, Homo sapiens
ucgaacagaugacagagua

SEQ ID NO: 308241 - RNA, 19 nt, Homo sapiens
agaagacuguguagcauuu

SEQ ID NO: 308242 - RNA, 19 nt, Homo sapiens
gaacaccauuccagaccaa

SEQ ID NO: 308243 - RNA, 19 nt, Homo sapiens
ugucugguaucaugaauuu

SEQ ID NO: 308244 - RNA, 19 nt, Homo sapiens
gaauugcacguaugagaaa

SEQ ID NO: 308245 - RNA, 19 nt, Homo sapiens
ucacacaacaccucacuuu

SEQ ID NO: 308246 - RNA, 19 nt, Homo sapiens
ccacaccauugcauauuug

SEQ ID NO: 308247 - RNA, 19 nt, Homo sapiens
gcacguaugagaaaccuau

SEQ ID NO: 308248 - RNA, 19 nt, Homo sapiens
gaacagaugacagaguaga

SEQ ID NO: 308249 - RNA, 19 nt, Homo sapiens
gggagcagaggaauuauga

SEQ ID NO: 308250 - RNA, 19 nt, Homo sapiens
ccaccugaaugaccuugaa

SEQ ID NO: 308251 - RNA, 19 nt, Homo sapiens
ugacagaguagaacgugua

SEQ ID NO: 308252 - RNA, 19 nt, Homo sapiens
ucacccagguaauggauga

SEQ ID NO: 308253 - RNA, 19 nt, Homo sapiens
uaagaauucuguacuucca

SEQ ID NO: 308254 - RNA, 19 nt, Homo sapiens
cuacagccauccugcacuu

SEQ ID NO: 308255 - RNA, 19 nt, Homo sapiens
gguaaacccauuuugaaua

SEQ ID NO: 308256 - RNA, 19 nt, Homo sapiens
aaaugaugcuuaugaguac

SEQ ID NO: 308257 - RNA, 19 nt, Homo sapiens
aaagcaaauugucugguau

SEQ ID NO: 308258 - RNA, 19 nt, Homo sapiens
uaaaagaauugcacguaug

SEQ ID NO: 308259 - RNA, 19 nt, Homo sapiens
gaggggagcagaggaauua

SEQ ID NO: 308260 - RNA, 19 nt, Homo sapiens
ucaauacugcugaaacaga

SEQ ID NO: 308261 - RNA, 19 nt, Homo sapiens
aauggaugaugaaguauuc

SEQ ID NO: 308262 - RNA, 19 nt, Homo sapiens
gagcagaggaauuaugaac

SEQ ID NO: 308263 - RNA, 19 nt, Homo sapiens
ccagaagacuguguagcau

SEQ ID NO: 308264 - RNA, 19 nt, Homo sapiens
cacaacaccucacuuuuga

SEQ ID NO: 308265 - RNA, 19 nt, Homo sapiens
acgcagagcccaccugaau

SEQ ID NO: 308266 - RNA, 19 nt, Homo sapiens
cguaugagaaaccuauauu

SEQ ID NO: 308267 - RNA, 19 nt, Homo sapiens
guaaauuguaccuguaaag

SEQ ID NO: 308268 - RNA, 19 nt, Homo sapiens
acagguugcugaaaaguaa

SEQ ID NO: 308269 - RNA, 19 nt, Homo sapiens
agaauucuguacuuccaau

SEQ ID NO: 308270 - RNA, 19 nt, Homo sapiens
gcuuacagguugcugaaaa

SEQ ID NO: 308271 - RNA, 19 nt, Homo sapiens
gcacuucagacuauuuguc

SEQ ID NO: 308272 - RNA, 19 nt, Homo sapiens
agaauugcacguaugagaa

SEQ ID NO: 308273 - RNA, 19 nt, Homo sapiens
cagaagacuguguagcauu

SEQ ID NO: 308274 - RNA, 19 nt, Homo sapiens
uuuguuggauauggaguua

SEQ ID NO: 308275 - RNA, 19 nt, Homo sapiens
accacaccauugcauauuu

SEQ ID NO: 308276 - RNA, 19 nt, Homo sapiens
aagaauugcacguaugaga

SEQ ID NO: 308277 - RNA, 19 nt, Homo sapiens
cauccuaugcaacaauuau

SEQ ID NO: 308278 - RNA, 19 nt, Homo sapiens
ccagguaauggaugaugaa

SEQ ID NO: 308279 - RNA, 19 nt, Homo sapiens
gaagacuguguagcauuug

SEQ ID NO: 308280 - RNA, 19 nt, Homo sapiens
cccagguaauggaugauga

SEQ ID NO: 308281 - RNA, 19 nt, Homo sapiens
caauccagaagacugugua

SEQ ID NO: 308282 - RNA, 19 nt, Homo sapiens
cuaccacaccauugcauau

SEQ ID NO: 308283 - RNA, 19 nt, Homo sapiens
agauugacaagaaagguuu

SEQ ID NO: 308284 - RNA, 19 nt, Homo sapiens
acacaacaccucacuuuug

SEQ ID NO: 308285 - RNA, 19 nt, Homo sapiens
gcugaaaaguaaauuguac

SEQ ID NO: 308286 - RNA, 19 nt, Homo sapiens
caccauugcauauuugaca

SEQ ID NO: 308287 - RNA, 19 nt, Homo sapiens
gcaaauugucugguaucau

SEQ ID NO: 308288 - RNA, 19 nt, Homo sapiens
auccugcacuucagacuau

SEQ ID NO: 308289 - RNA, 19 nt, Homo sapiens
cauccugcacuucagacua

SEQ ID NO: 308290 - RNA, 19 nt, Homo sapiens
ggccuccuguauuccuuga

SEQ ID NO: 308291 - RNA, 19 nt, Homo sapiens
uagauugacaagaaagguu

SEQ ID NO: 308292 - RNA, 19 nt, Homo sapiens
uggaauuggccuccuguau

SEQ ID NO: 308293 - RNA, 19 nt, Homo sapiens
caacuuuguuuacccgaua

SEQ ID NO: 308294 - RNA, 19 nt, Homo sapiens
cccgugcgcucuacaaaua

SEQ ID NO: 308295 - RNA, 19 nt, Homo sapiens
gguaauaugguaucauuug

SEQ ID NO: 308296 - RNA, 19 nt, Homo sapiens
gaauaucuggaccucaaua

SEQ ID NO: 308297 - RNA, 19 nt, Homo sapiens
uaaggaaggucagcauuca

SEQ ID NO: 308298 - RNA, 19 nt, Homo sapiens
acaaauaguuccgugagaa

SEQ ID NO: 308299 - RNA, 19 nt, Homo sapiens
gggagaggcuuaaaacaaa

SEQ ID NO: 308300 - RNA, 19 nt, Homo sapiens
uaucuggaccucaauauug

SEQ ID NO: 308301 - RNA, 19 nt, Homo sapiens
caaauaguuccgugagaaa

SEQ ID NO: 308302 - RNA, 19 nt, Homo sapiens
ucaagaagcgccauuuauc

SEQ ID NO: 308303 - RNA, 19 nt, Homo sapiens
gauaaggaaggucagcauu

SEQ ID NO: 308304 - RNA, 19 nt, Homo sapiens
caccagaguuugagagagu

SEQ ID NO: 308305 - RNA, 19 nt, Homo sapiens
gagaguauuucgggcacaa

SEQ ID NO: 308306 - RNA, 19 nt, Homo sapiens
caagaagcgccauuuaucu

SEQ ID NO: 308307 - RNA, 19 nt, Homo sapiens
ggucagcauucaaagucaa

SEQ ID NO: 308308 - RNA, 19 nt, Homo sapiens
ucucuucccuuuaaugcuu

SEQ ID NO: 308309 - RNA, 19 nt, Homo sapiens
aggcggcaauucuaacuuu

SEQ ID NO: 308310 - RNA, 19 nt, Homo sapiens
gggaauugcaaacagcuuu

SEQ ID NO: 308311 - RNA, 19 nt, Homo sapiens
gaaggucagcauucaaagu

SEQ ID NO: 308312 - RNA, 19 nt, Homo sapiens
guggauggcugggugguau

SEQ ID NO: 308313 - RNA, 19 nt, Homo sapiens
gcuggcugcugucucuauu

SEQ ID NO: 308314 - RNA, 19 nt, Homo sapiens
aaacugaggcggcaauucu

SEQ ID NO: 308315 - RNA, 19 nt, Homo sapiens
ccucaauauugccaagaaa

SEQ ID NO: 308316 - RNA, 19 nt, Homo sapiens
gauauucagaagcugcuaa

SEQ ID NO: 308317 - RNA, 19 nt, Homo sapiens
augaauaucuggaccucaa

SEQ ID NO: 308318 - RNA, 19 nt, Homo sapiens
ggaguuuuauccuauauuc

SEQ ID NO: 308319 - RNA, 19 nt, Homo sapiens
guuggaaaggcaagauuaa

SEQ ID NO: 308320 - RNA, 19 nt, Homo sapiens
gucaagaagcgccauuuau

SEQ ID NO: 308321 - RNA, 19 nt, Homo sapiens
guauuucgggcacaacaaa

SEQ ID NO: 308322 - RNA, 19 nt, Homo sapiens
gcugcugucucuauucucu

SEQ ID NO: 308323 - RNA, 19 nt, Homo sapiens
ggaaaggcaagauuaaaau

SEQ ID NO: 308324 - RNA, 19 nt, Homo sapiens
cggccugucagcaaaguua

SEQ ID NO: 308325 - RNA, 19 nt, Homo sapiens
uacaaauaguuccgugaga

SEQ ID NO: 308326 - RNA, 19 nt, Homo sapiens
agucaagaagcgccauuua

SEQ ID NO: 308327 - RNA, 19 nt, Homo sapiens
gaaacugaggcggcaauuc

SEQ ID NO: 308328 - RNA, 19 nt, Homo sapiens
aaacaaacgccggaagcaa

SEQ ID NO: 308329 - RNA, 19 nt, Homo sapiens
ugggucugguguacauaua

SEQ ID NO: 308330 - RNA, 19 nt, Homo sapiens
ggauggcugggugguauuu

SEQ ID NO: 308331 - RNA, 19 nt, Homo sapiens
ugaagguaauaugguauca

SEQ ID NO: 308332 - RNA, 19 nt, Homo sapiens
ccagagcaaaggucauuca

SEQ ID NO: 308333 - RNA, 19 nt, Homo sapiens
aggaaggucagcauucaaa

SEQ ID NO: 308334 - RNA, 19 nt, Homo sapiens
aauauugccaagaaacuga

SEQ ID NO: 308335 - RNA, 19 nt, Homo sapiens
agaguuugagagaguauuu

SEQ ID NO: 308336 - RNA, 19 nt, Homo sapiens
ccugucagcaaaguuauuu

SEQ ID NO: 308337 - RNA, 19 nt, Homo sapiens
gcaacucccagccccauaa

SEQ ID NO: 308338 - RNA, 19 nt, Homo sapiens
cuaggugcccugggaauug

SEQ ID NO: 308339 - RNA, 19 nt, Homo sapiens
ggaaggucagcauucaaag

SEQ ID NO: 308340 - RNA, 19 nt, Homo sapiens
gaagguaauaugguaucau

SEQ ID NO: 308341 - RNA, 19 nt, Homo sapiens
aguuggaaaggcaagauua

SEQ ID NO: 308342 - RNA, 19 nt, Homo sapiens
gacgaguucuuuaugcuua

SEQ ID NO: 308343 - RNA, 19 nt, Homo sapiens
caagauggcuguccucucu

SEQ ID NO: 308344 - RNA, 19 nt, Homo sapiens
ugacuuaccuuuauuucca

SEQ ID NO: 308345 - RNA, 19 nt, Homo sapiens
uggaguauccuaucaugua

SEQ ID NO: 308346 - RNA, 19 nt, Homo sapiens
ccaccuagccaucaauguu

SEQ ID NO: 308347 - RNA, 19 nt, Homo sapiens
ggaguauccuaucauguac

SEQ ID NO: 308348 - RNA, 19 nt, Homo sapiens
gcacaucuucaacugcauu

SEQ ID NO: 308349 - RNA, 19 nt, Homo sapiens
aaaguggaguauccuauca

SEQ ID NO: 308350 - RNA, 19 nt, Homo sapiens
aguguauccucccuucuua

SEQ ID NO: 308351 - RNA, 19 nt, Homo sapiens
ggacgaguucuuuaugcuu

SEQ ID NO: 308352 - RNA, 19 nt, Homo sapiens
agauggcuguccucucuaa

SEQ ID NO: 308353 - RNA, 19 nt, Homo sapiens
gaacccagcaagcguaguc

SEQ ID NO: 308354 - RNA, 19 nt, Homo sapiens
gaaguacaaaguggaguau

SEQ ID NO: 308355 - RNA, 19 nt, Homo sapiens
ggcuuggccuggauuguug

SEQ ID NO: 308356 - RNA, 19 nt, Homo sapiens
ggaauaugguuuugugcuu

SEQ ID NO: 308357 - RNA, 19 nt, Homo sapiens
cagcaucuugguuggguua

SEQ ID NO: 308358 - RNA, 19 nt, Homo sapiens
gcaucuugguuggguuaaa

SEQ ID NO: 308359 - RNA, 19 nt, Homo sapiens
caaaguggaguauccuauc

SEQ ID NO: 308360 - RNA, 19 nt, Homo sapiens
caccuagccaucaauguuu

SEQ ID NO: 308361 - RNA, 19 nt, Homo sapiens
gggcuuggccuggauuguu

SEQ ID NO: 308362 - RNA, 19 nt, Homo sapiens
caacugugugcucugcuuu

SEQ ID NO: 308363 - RNA, 19 nt, Homo sapiens
gaaaaugggcacaucuuca

SEQ ID NO: 308364 - RNA, 19 nt, Homo sapiens
agaaguacaaaguggagua

SEQ ID NO: 308365 - RNA, 19 nt, Homo sapiens
uauccucccuucuuauuuu

SEQ ID NO: 308366 - RNA, 19 nt, Homo sapiens
uaaggaauaugguuuugug

SEQ ID NO: 308367 - RNA, 19 nt, Homo sapiens
augcugccauuaaagaauu

SEQ ID NO: 308368 - RNA, 19 nt, Homo sapiens
gagcccaccagaacacguu

SEQ ID NO: 308369 - RNA, 19 nt, Homo sapiens
ucucuaaggaauaugguuu

SEQ ID NO: 308370 - RNA, 19 nt, Homo sapiens
ucuuuaugcuuauggcuau

SEQ ID NO: 308371 - RNA, 19 nt, Homo sapiens
guauccucccuucuuauuu

SEQ ID NO: 308372 - RNA, 19 nt, Homo sapiens
acaacugugugcucugcuu

SEQ ID NO: 308373 - RNA, 19 nt, Homo sapiens
uguauccucccuucuuauu

SEQ ID NO: 308374 - RNA, 19 nt, Homo sapiens
ccagaacacguuggaagug

SEQ ID NO: 308375 - RNA, 19 nt, Homo sapiens
acaaaguggaguauccuau

SEQ ID NO: 308376 - RNA, 19 nt, Homo sapiens
caucuugguuggguuaaaa

SEQ ID NO: 308377 - RNA, 19 nt, Homo sapiens
cgaguucuuuaugcuuaug

SEQ ID NO: 308378 - RNA, 19 nt, Homo sapiens
aguggaguauccuaucaug

SEQ ID NO: 308379 - RNA, 19 nt, Homo sapiens
ucacauaucugucauuuga

SEQ ID NO: 308380 - RNA, 19 nt, Homo sapiens
caucaugucuggcuaauuu

SEQ ID NO: 308381 - RNA, 19 nt, Homo sapiens
ggacaggcauguucucuga

SEQ ID NO: 308382 - RNA, 19 nt, Homo sapiens
ggaccuggcuggagaagaa

SEQ ID NO: 308383 - RNA, 19 nt, Homo sapiens
ggacacaguucaauucuca

SEQ ID NO: 308384 - RNA, 19 nt, Homo sapiens
aggcuaagcuuguacaaua

SEQ ID NO: 308385 - RNA, 19 nt, Homo sapiens
acaaggagcucccgcagua

SEQ ID NO: 308386 - RNA, 19 nt, Homo sapiens
guaaauagcucagguguac

SEQ ID NO: 308387 - RNA, 19 nt, Homo sapiens
ggaagaagaggcccuauga

SEQ ID NO: 308388 - RNA, 19 nt, Homo sapiens
ucacacacuuuggcuauua

SEQ ID NO: 308389 - RNA, 19 nt, Homo sapiens
ccacugcucugguuaucua

SEQ ID NO: 308390 - RNA, 19 nt, Homo sapiens
gcacauaggaccagaugaa

SEQ ID NO: 308391 - RNA, 19 nt, Homo sapiens
ugacaaggauugcuacugu

SEQ ID NO: 308392 - RNA, 19 nt, Homo sapiens
gcucacauaucugucauuu

SEQ ID NO: 308393 - RNA, 19 nt, Homo sapiens
gaacaggggucuccaguau

SEQ ID NO: 308394 - RNA, 19 nt, Homo sapiens
uaaccacgcuggaccuuga

SEQ ID NO: 308395 - RNA, 19 nt, Homo sapiens
caacaggauucacggauca

SEQ ID NO: 308396 - RNA, 19 nt, Homo sapiens
gaagugaucggugagagua

SEQ ID NO: 308397 - RNA, 19 nt, Homo sapiens
guaugagguuugaggauuu

SEQ ID NO: 308398 - RNA, 19 nt, Homo sapiens
ccaagucccugaaggaugu

SEQ ID NO: 308399 - RNA, 19 nt, Homo sapiens
agaaggugcuugcgaggua

SEQ ID NO: 308400 - RNA, 19 nt, Homo sapiens
uaguugggcuuccucauaa

SEQ ID NO: 308401 - RNA, 19 nt, Homo sapiens
gagaggagcagcagcaaga

SEQ ID NO: 308402 - RNA, 19 nt, Homo sapiens
guucaauucucauuuguca

SEQ ID NO: 308403 - RNA, 19 nt, Homo sapiens
cagcugaaguccuuggaaa

SEQ ID NO: 308404 - RNA, 19 nt, Homo sapiens
ggagaugccagcagaaguu

SEQ ID NO: 308405 - RNA, 19 nt, Homo sapiens
gaaagcuugugcagacuca

SEQ ID NO: 308406 - RNA, 19 nt, Homo sapiens
ccacuucuaugaccagaug

SEQ ID NO: 308407 - RNA, 19 nt, Homo sapiens
ccaacaagcuuccaaaaug

SEQ ID NO: 308408 - RNA, 19 nt, Homo sapiens
ggaauccagugguaugauc

SEQ ID NO: 308409 - RNA, 19 nt, Homo sapiens
uaaccuagccuuagaaguc

SEQ ID NO: 308410 - RNA, 19 nt, Homo sapiens
cauuuauucugcucacaua

SEQ ID NO: 308411 - RNA, 19 nt, Homo sapiens
gugaugcgcuacuuugaga

SEQ ID NO: 308412 - RNA, 19 nt, Homo sapiens
ccuuagaagucacacagua

SEQ ID NO: 308413 - RNA, 19 nt, Homo sapiens
ugaccugggugccuacaaa

SEQ ID NO: 308414 - RNA, 19 nt, Homo sapiens
cgaggaggcuggaauuugg

SEQ ID NO: 308415 - RNA, 19 nt, Homo sapiens
ggucagagccucgaguuau

SEQ ID NO: 308416 - RNA, 19 nt, Homo sapiens
gccaugggcuccugugugu

SEQ ID NO: 308417 - RNA, 19 nt, Homo sapiens
gaagaggcccuaugacaac

SEQ ID NO: 308418 - RNA, 19 nt, Homo sapiens
ccacugaccugcccagcau

SEQ ID NO: 308419 - RNA, 19 nt, Homo sapiens
acaguucaauucucauuug

SEQ ID NO: 308420 - RNA, 19 nt, Homo sapiens
ucacgccacugcacuauag

SEQ ID NO: 308421 - RNA, 19 nt, Homo sapiens
gccagggucucacuauguu

SEQ ID NO: 308422 - RNA, 19 nt, Homo sapiens
ggcuaagcuuguacaauaa

SEQ ID NO: 308423 - RNA, 19 nt, Homo sapiens
gcagaaaagucagaaaaga

SEQ ID NO: 308424 - RNA, 19 nt, Homo sapiens
ccaaagugcugggauuaca

SEQ ID NO: 308425 - RNA, 19 nt, Homo sapiens
gauagagagagaccacuuu

SEQ ID NO: 308426 - RNA, 19 nt, Homo sapiens
ccaaagugcugggauuaca

SEQ ID NO: 308427 - RNA, 19 nt, Homo sapiens
caaggccgacgcccuauuu

SEQ ID NO: 308428 - RNA, 19 nt, Homo sapiens
ggagaaaaccgaccagauu

SEQ ID NO: 308429 - RNA, 19 nt, Homo sapiens
gucagagccucgaguuauu

SEQ ID NO: 308430 - RNA, 19 nt, Homo sapiens
caccucagccucccgaaua

SEQ ID NO: 308431 - RNA, 19 nt, Homo sapiens
cagcagaaguugggcagaa

SEQ ID NO: 308432 - RNA, 19 nt, Homo sapiens
gagccagggucucacuaug

SEQ ID NO: 308433 - RNA, 19 nt, Homo sapiens
cauggaaggugaugaagag

SEQ ID NO: 308434 - RNA, 19 nt, Homo sapiens
ggcgauggccaaaggcuua

SEQ ID NO: 308435 - RNA, 19 nt, Homo sapiens
gcaaggacauuuucaagca

SEQ ID NO: 308436 - RNA, 19 nt, Homo sapiens
gcuguugugugacauggaa

SEQ ID NO: 308437 - RNA, 19 nt, Homo sapiens
uagaagucacacaguauua

SEQ ID NO: 308438 - RNA, 19 nt, Homo sapiens
cagggaggcuuaugccaau

SEQ ID NO: 308439 - RNA, 19 nt, Homo sapiens
ggcaaacgcuaaaugaaaa

SEQ ID NO: 308440 - RNA, 19 nt, Homo sapiens
ccagcccacuucugccaua

SEQ ID NO: 308441 - RNA, 19 nt, Homo sapiens
ccgaauagcugggacuaca

SEQ ID NO: 308442 - RNA, 19 nt, Homo sapiens
cuaguugggcuuccucaua

SEQ ID NO: 308443 - RNA, 19 nt, Homo sapiens
gggcuggucucgaacucuu

SEQ ID NO: 308444 - RNA, 19 nt, Homo sapiens
uggcaaacgcuaaaugaaa

SEQ ID NO: 308445 - RNA, 19 nt, Homo sapiens
gcacguacacacacauaca

SEQ ID NO: 308446 - RNA, 19 nt, Homo sapiens
gcccacuucugccauauuc

SEQ ID NO: 308447 - RNA, 19 nt, Homo sapiens
cugcucugguuaucuaaua

SEQ ID NO: 308448 - RNA, 19 nt, Homo sapiens
gcacaccgggcacucagaa

SEQ ID NO: 308449 - RNA, 19 nt, Homo sapiens
ugagggacccauccaguuu

SEQ ID NO: 308450 - RNA, 19 nt, Homo sapiens
gaaugaaagggcccagaga

SEQ ID NO: 308451 - RNA, 19 nt, Homo sapiens
uguaugagguuugaggauu

SEQ ID NO: 308452 - RNA, 19 nt, Homo sapiens
ccaaagcccaguuaaucuu

SEQ ID NO: 308453 - RNA, 19 nt, Homo sapiens
ggccaaaggcuuaguccaa

SEQ ID NO: 308454 - RNA, 19 nt, Homo sapiens
guacgacuuugucuucucu

SEQ ID NO: 308455 - RNA, 19 nt, Homo sapiens
ugacauggaaggugaugaa

SEQ ID NO: 308456 - RNA, 19 nt, Homo sapiens
gcuccugugucuugcaaug

SEQ ID NO: 308457 - RNA, 19 nt, Homo sapiens
ucagagccucgaguuauua

SEQ ID NO: 308458 - RNA, 19 nt, Homo sapiens
caccaaagcccaguuaauc

SEQ ID NO: 308459 - RNA, 19 nt, Homo sapiens
guauuacuucugcuacaua

SEQ ID NO: 308460 - RNA, 19 nt, Homo sapiens
caugggcucuggcaaaucu

SEQ ID NO: 308461 - RNA, 19 nt, Homo sapiens
gaugagaaagguugaagca

SEQ ID NO: 308462 - RNA, 19 nt, Homo sapiens
ggucagggcaagagcuauu

SEQ ID NO: 308463 - RNA, 19 nt, Homo sapiens
cauaggaccagaugaagug

SEQ ID NO: 308464 - RNA, 19 nt, Homo sapiens
ggugaccucugccugaagu

SEQ ID NO: 308465 - RNA, 19 nt, Homo sapiens
cccaguuaaucuuuaguuu

SEQ ID NO: 308466 - RNA, 19 nt, Homo sapiens
caaaucauaguggcuuaaa

SEQ ID NO: 308467 - RNA, 19 nt, Homo sapiens
gguacccacugcucugguu

SEQ ID NO: 308468 - RNA, 19 nt, Homo sapiens
guucauacccuguuaccau

SEQ ID NO: 308469 - RNA, 19 nt, Homo sapiens
cccaacuggugacugguua

SEQ ID NO: 308470 - RNA, 19 nt, Homo sapiens
agaagaggcccuaugacaa

SEQ ID NO: 308471 - RNA, 19 nt, Homo sapiens
ccaguacgacuuugucuuc

SEQ ID NO: 308472 - RNA, 19 nt, Homo sapiens
gaggugugcucugaucauc

SEQ ID NO: 308473 - RNA, 19 nt, Homo sapiens
ccaggcaggucuugaacuc

SEQ ID NO: 308474 - RNA, 19 nt, Homo sapiens
ggaccuggaugcgcugagu

SEQ ID NO: 308475 - RNA, 19 nt, Homo sapiens
ccaaaggcuuaguccaaca

SEQ ID NO: 308476 - RNA, 19 nt, Homo sapiens
ggccgcagacaucaaagua

SEQ ID NO: 308477 - RNA, 19 nt, Homo sapiens
ugaagcauuuacuuugugu

SEQ ID NO: 308478 - RNA, 19 nt, Homo sapiens
agguucagcuuguaaauag

SEQ ID NO: 308479 - RNA, 19 nt, Homo sapiens
gaaaggcuggccauuauua

SEQ ID NO: 308480 - RNA, 19 nt, Homo sapiens
ggauggugguuucgauuua

SEQ ID NO: 308481 - RNA, 19 nt, Homo sapiens
gugaaaggcuggccauuau

SEQ ID NO: 308482 - RNA, 19 nt, Homo sapiens
gguaagcccuucaauuugu

SEQ ID NO: 308483 - RNA, 19 nt, Homo sapiens
gaaggacaccugccugaga

SEQ ID NO: 308484 - RNA, 19 nt, Homo sapiens
cuucauugcuuaccagaaa

SEQ ID NO: 308485 - RNA, 19 nt, Homo sapiens
caaagaaaaugcagaacaa

SEQ ID NO: 308486 - RNA, 19 nt, Homo sapiens
ggagccaucucuagcuuca

SEQ ID NO: 308487 - RNA, 19 nt, Homo sapiens
caaaucacguguccaucga

SEQ ID NO: 308488 - RNA, 19 nt, Homo sapiens
gauguuuacuaacgaugaa

SEQ ID NO: 308489 - RNA, 19 nt, Homo sapiens
ggcggaugauguuuacuaa

SEQ ID NO: 308490 - RNA, 19 nt, Homo sapiens
caagaaacccacugcaauc

SEQ ID NO: 308491 - RNA, 19 nt, Homo sapiens
cuuaggagaugcuguuguu

SEQ ID NO: 308492 - RNA, 19 nt, Homo sapiens
ggaugacuuugacuuagga

SEQ ID NO: 308493 - RNA, 19 nt, Homo sapiens
gauggugguuucgauuuau

SEQ ID NO: 308494 - RNA, 19 nt, Homo sapiens
guaagcccuucaauuuguu

SEQ ID NO: 308495 - RNA, 19 nt, Homo sapiens
gcgaugugcuuugcuuguu

SEQ ID NO: 308496 - RNA, 19 nt, Homo sapiens
ucucuagcuucauugcuua

SEQ ID NO: 308497 - RNA, 19 nt, Homo sapiens
gggcggaugauguuuacua

SEQ ID NO: 308498 - RNA, 19 nt, Homo sapiens
gauggaggccuucuguuca

SEQ ID NO: 308499 - RNA, 19 nt, Homo sapiens
ugugaaaggcuggccauua

SEQ ID NO: 308500 - RNA, 19 nt, Homo sapiens
gaugauguuuacuaacgau

SEQ ID NO: 308501 - RNA, 19 nt, Homo sapiens
ggaugauguuuacuaacga

SEQ ID NO: 308502 - RNA, 19 nt, Homo sapiens
gcugggcggaugauguuua

SEQ ID NO: 308503 - RNA, 19 nt, Homo sapiens
cacggcggauucuuuguuu

SEQ ID NO: 308504 - RNA, 19 nt, Homo sapiens
acaagaaacccacugcaau

SEQ ID NO: 308505 - RNA, 19 nt, Homo sapiens
gggaugacuuugacuuagg

SEQ ID NO: 308506 - RNA, 19 nt, Homo sapiens
cgaugugcuuugcuuguug

SEQ ID NO: 308507 - RNA, 19 nt, Homo sapiens
ggcguuggcagcaggguua

SEQ ID NO: 308508 - RNA, 19 nt, Homo sapiens
ugacuuaggagaugcuguu

SEQ ID NO: 308509 - RNA, 19 nt, Homo sapiens
ggaggcagccacaggaaag

SEQ ID NO: 308510 - RNA, 19 nt, Homo sapiens
ccaucgagcacgucugaaa

SEQ ID NO: 308511 - RNA, 19 nt, Homo sapiens
uaggagaugcuguuguuga

SEQ ID NO: 308512 - RNA, 19 nt, Homo sapiens
agccaucucuagcuucauu

SEQ ID NO: 308513 - RNA, 19 nt, Homo sapiens
gacuuugacuuaggagaug

SEQ ID NO: 308514 - RNA, 19 nt, Homo sapiens
cggaugauguuuacuaacg

SEQ ID NO: 308515 - RNA, 19 nt, Homo sapiens
gaagauugucggcagaaac

SEQ ID NO: 308516 - RNA, 19 nt, Homo sapiens
aaaggcuggccauuauuaa

SEQ ID NO: 308517 - RNA, 19 nt, Homo sapiens
guucacggcggauucuuug

SEQ ID NO: 308518 - RNA, 19 nt, Homo sapiens
ccacugcaauccccaagaa

SEQ ID NO: 308519 - RNA, 19 nt, Homo sapiens
ugaaaggcuggccauuauu

SEQ ID NO: 308520 - RNA, 19 nt, Homo sapiens
ucacggcggauucuuuguu

SEQ ID NO: 308521 - RNA, 19 nt, Homo sapiens
uuacaaaucacguguccau

SEQ ID NO: 308522 - RNA, 19 nt, Homo sapiens
ggaaaaggaggcagugaug

SEQ ID NO: 308523 - RNA, 19 nt, Homo sapiens
gcccuucaauuuguuucuu

SEQ ID NO: 308524 - RNA, 19 nt, Homo sapiens
agaagauugucggcagaaa

SEQ ID NO: 308525 - RNA, 19 nt, Homo sapiens
cguuucagguggagaagga

SEQ ID NO: 308526 - RNA, 19 nt, Homo sapiens
aggagaugcuguuguugau

SEQ ID NO: 308527 - RNA, 19 nt, Homo sapiens
ucuuucauuuguagggaua

SEQ ID NO: 308528 - RNA, 19 nt, Homo sapiens
guccaucgagcacgucuga

SEQ ID NO: 308529 - RNA, 19 nt, Homo sapiens
gagauggaggccuucuguu

SEQ ID NO: 308530 - RNA, 19 nt, Homo sapiens
cggauggugguuucgauuu

SEQ ID NO: 308531 - RNA, 19 nt, Homo sapiens
ugacuuugacuuaggagau

SEQ ID NO: 308532 - RNA, 19 nt, Homo sapiens
agauggaggccuucuguuc

SEQ ID NO: 308533 - RNA, 19 nt, Homo sapiens
ccaccgaacccacccaaac

SEQ ID NO: 308534 - RNA, 19 nt, Homo sapiens
ggagaugcuguuguugaug

SEQ ID NO: 308535 - RNA, 19 nt, Homo sapiens
gaagauguccugggaaaua

SEQ ID NO: 308536 - RNA, 19 nt, Homo sapiens
gaaggaagaugccaugaag

SEQ ID NO: 308537 - RNA, 19 nt, Homo sapiens
ggaaagugcuggugcuuca

SEQ ID NO: 308538 - RNA, 19 nt, Homo sapiens
ggaaaggaccucaggauga

SEQ ID NO: 308539 - RNA, 19 nt, Homo sapiens
gcucagaccuuggccauga

SEQ ID NO: 308540 - RNA, 19 nt, Homo sapiens
gaacacagcgggaaucaca

SEQ ID NO: 308541 - RNA, 19 nt, Homo sapiens
ccacacagcucggauuuca

SEQ ID NO: 308542 - RNA, 19 nt, Homo sapiens
cagaagauguccugggaaa

SEQ ID NO: 308543 - RNA, 19 nt, Homo sapiens
gaaaggaccucaggaugac

SEQ ID NO: 308544 - RNA, 19 nt, Homo sapiens
ccaugaacgucaggaauuu

SEQ ID NO: 308545 - RNA, 19 nt, Homo sapiens
ggauggaucugugcaguca

SEQ ID NO: 308546 - RNA, 19 nt, Homo sapiens
gagauuagggucugugaga

SEQ ID NO: 308547 - RNA, 19 nt, Homo sapiens
gaacgucaggaauuucuug

SEQ ID NO: 308548 - RNA, 19 nt, Homo sapiens
guuugcagcuguaccauau

SEQ ID NO: 308549 - RNA, 19 nt, Homo sapiens
ucaggaauuucuugaagga

SEQ ID NO: 308550 - RNA, 19 nt, Homo sapiens
gacccuggcucauaucaag

SEQ ID NO: 308551 - RNA, 19 nt, Homo sapiens
ggaacuacggcgauaucua

SEQ ID NO: 308552 - RNA, 19 nt, Homo sapiens
ucugugagauccaugaaga

SEQ ID NO: 308553 - RNA, 19 nt, Homo sapiens
gcucccagcauuucuacua

SEQ ID NO: 308554 - RNA, 19 nt, Homo sapiens
aagauguccugggaaauaa

SEQ ID NO: 308555 - RNA, 19 nt, Homo sapiens
gccaugaacgucaggaauu

SEQ ID NO: 308556 - RNA, 19 nt, Homo sapiens
cgucaggaauuucuugaag

SEQ ID NO: 308557 - RNA, 19 nt, Homo sapiens
gcuucuggcuggcaucuuc

SEQ ID NO: 308558 - RNA, 19 nt, Homo sapiens
accaggagcucccagcauu

SEQ ID NO: 308559 - RNA, 19 nt, Homo sapiens
gaaagaaggcuugcauucc

SEQ ID NO: 308560 - RNA, 19 nt, Homo sapiens
uaguagauaugaggcguuu

SEQ ID NO: 308561 - RNA, 19 nt, Homo sapiens
gaagaccaagacacacuau

SEQ ID NO: 308562 - RNA, 19 nt, Homo sapiens
cccacagucuucguuauaa

SEQ ID NO: 308563 - RNA, 19 nt, Homo sapiens
agaaagaaggcuugcauuc

SEQ ID NO: 308564 - RNA, 19 nt, Homo sapiens
ggagcucccagcauuucua

SEQ ID NO: 308565 - RNA, 19 nt, Homo sapiens
uaucaaggaccagaaagaa

SEQ ID NO: 308566 - RNA, 19 nt, Homo sapiens
uggcuggcaucuucccuuu

SEQ ID NO: 308567 - RNA, 19 nt, Homo sapiens
ugagauccaugaagacaac

SEQ ID NO: 308568 - RNA, 19 nt, Homo sapiens
uauguccguuguuguaaga

SEQ ID NO: 308569 - RNA, 19 nt, Homo sapiens
gacacacuaucacgcuaug

SEQ ID NO: 308570 - RNA, 19 nt, Homo sapiens
ugaaggaagaugccaugaa

SEQ ID NO: 308571 - RNA, 19 nt, Homo sapiens
caccaggauuugccaagga

SEQ ID NO: 308572 - RNA, 19 nt, Homo sapiens
agaccaagacacacuauca

SEQ ID NO: 308573 - RNA, 19 nt, Homo sapiens
cacgagcacuuucccucuu

SEQ ID NO: 308574 - RNA, 19 nt, Homo sapiens
ccaugaagaccaagacaca

SEQ ID NO: 308575 - RNA, 19 nt, Homo sapiens
aagaugccaugaagaccaa

SEQ ID NO: 308576 - RNA, 19 nt, Homo sapiens
cagaaagaaggcuugcauu

SEQ ID NO: 308577 - RNA, 19 nt, Homo sapiens
ccagaaagaaggcuugcau

SEQ ID NO: 308578 - RNA, 19 nt, Homo sapiens
ggacagugggcagaagaug

SEQ ID NO: 308579 - RNA, 19 nt, Homo sapiens
gcuggcaucuucccuuuug

SEQ ID NO: 308580 - RNA, 19 nt, Homo sapiens
gagcucuuccucucccaaa

SEQ ID NO: 308581 - RNA, 19 nt, Homo sapiens
ggagaggagcagagguuca

SEQ ID NO: 308582 - RNA, 19 nt, Homo sapiens
ugaagaccaagacacacua

SEQ ID NO: 308583 - RNA, 19 nt, Homo sapiens
ccacagucuucguuauaac

SEQ ID NO: 308584 - RNA, 19 nt, Homo sapiens
guuggaggcugcaaaaugu

SEQ ID NO: 308585 - RNA, 19 nt, Homo sapiens
ccaggagcucccagcauuu

SEQ ID NO: 308586 - RNA, 19 nt, Homo sapiens
ugcaggaacuacggcgaua

SEQ ID NO: 308587 - RNA, 19 nt, Homo sapiens
gauguccugggaaauaaga

SEQ ID NO: 308588 - RNA, 19 nt, Homo sapiens
guagauaugaggcguuugc

SEQ ID NO: 308589 - RNA, 19 nt, Homo sapiens
gacagugggcagaagaugu

SEQ ID NO: 308590 - RNA, 19 nt, Homo sapiens
gcagaaaugcagggcaaag

SEQ ID NO: 308591 - RNA, 19 nt, Homo sapiens
gauuagggucugugagauc

SEQ ID NO: 308592 - RNA, 19 nt, Homo sapiens
ucauaucaaggaccagaaa

SEQ ID NO: 308593 - RNA, 19 nt, Homo sapiens
guccguuguuguaagaaga

SEQ ID NO: 308594 - RNA, 19 nt, Homo sapiens
ugaggcguuugcagcugua

SEQ ID NO: 308595 - RNA, 19 nt, Homo sapiens
gaccuaugaaacagagaaa

SEQ ID NO: 308596 - RNA, 19 nt, Homo sapiens
guucaccugcuacauggaa

SEQ ID NO: 308597 - RNA, 19 nt, Homo sapiens
gcaggaacuacggcgauau

SEQ ID NO: 308598 - RNA, 19 nt, Homo sapiens
ugacagggaacggaaagga

SEQ ID NO: 308599 - RNA, 19 nt, Homo sapiens
ccucuuggugccucaguuu

SEQ ID NO: 308600 - RNA, 19 nt, Homo sapiens
aaggagaggagcagagguu

SEQ ID NO: 308601 - RNA, 19 nt, Homo sapiens
acgagcacuuucccucuug

SEQ ID NO: 308602 - RNA, 19 nt, Homo sapiens
cagagucauuggcagacau

SEQ ID NO: 308603 - RNA, 19 nt, Homo sapiens
ggacagacuuuccauaugu

SEQ ID NO: 308604 - RNA, 19 nt, Homo sapiens
gcaaagggaucaugaccaa

SEQ ID NO: 308605 - RNA, 19 nt, Homo sapiens
gaaggaagaugccaugaag

SEQ ID NO: 308606 - RNA, 19 nt, Homo sapiens
gcucagaccuuggcuauga

SEQ ID NO: 308607 - RNA, 19 nt, Homo sapiens
caccaugccuguccuauuu

SEQ ID NO: 308608 - RNA, 19 nt, Homo sapiens
ggaggacccugacucauau

SEQ ID NO: 308609 - RNA, 19 nt, Homo sapiens
uaucaugggugaacuuuau

SEQ ID NO: 308610 - RNA, 19 nt, Homo sapiens
gaagggcuguggaagauca

SEQ ID NO: 308611 - RNA, 19 nt, Homo sapiens
cuaugaacgucacaaauuu

SEQ ID NO: 308612 - RNA, 19 nt, Homo sapiens
gcuaugaacgucacaaauu

SEQ ID NO: 308613 - RNA, 19 nt, Homo sapiens
ccuuaacagugccauauua

SEQ ID NO: 308614 - RNA, 19 nt, Homo sapiens
gugaguaucuuggugauga

SEQ ID NO: 308615 - RNA, 19 nt, Homo sapiens
caccgugccuggccuauuu

SEQ ID NO: 308616 - RNA, 19 nt, Homo sapiens
gcaaaguguuaguagguau

SEQ ID NO: 308617 - RNA, 19 nt, Homo sapiens
gaggcuauaugaucaaaca

SEQ ID NO: 308618 - RNA, 19 nt, Homo sapiens
ggauggaucugugcaguca

SEQ ID NO: 308619 - RNA, 19 nt, Homo sapiens
gcuaucuccuauaccaaua

SEQ ID NO: 308620 - RNA, 19 nt, Homo sapiens
cuacagcgauaucugaaau

SEQ ID NO: 308621 - RNA, 19 nt, Homo sapiens
gagauuagggucugugaga

SEQ ID NO: 308622 - RNA, 19 nt, Homo sapiens
ccgaauagcugggauuaca

SEQ ID NO: 308623 - RNA, 19 nt, Homo sapiens
gcacuucucguaccucaga

SEQ ID NO: 308624 - RNA, 19 nt, Homo sapiens
gcuaugccauguuuuguua

SEQ ID NO: 308625 - RNA, 19 nt, Homo sapiens
ggaaggaagaugccaugaa

SEQ ID NO: 308626 - RNA, 19 nt, Homo sapiens
ucacaaauuucuggaagga

SEQ ID NO: 308627 - RNA, 19 nt, Homo sapiens
gugcugggauuacaagaau

SEQ ID NO: 308628 - RNA, 19 nt, Homo sapiens
gaagaucagagcccuuguu

SEQ ID NO: 308629 - RNA, 19 nt, Homo sapiens
uuugaggaaugcagucuua

SEQ ID NO: 308630 - RNA, 19 nt, Homo sapiens
uaucaugaaugcaggaugu

SEQ ID NO: 308631 - RNA, 19 nt, Homo sapiens
gucacaccguuaugcauua

SEQ ID NO: 308632 - RNA, 19 nt, Homo sapiens
ccaaagugcugggauuaca

SEQ ID NO: 308633 - RNA, 19 nt, Homo sapiens
gggugaacuuuaugaguga

SEQ ID NO: 308634 - RNA, 19 nt, Homo sapiens
gacagacuuuccauauguu

SEQ ID NO: 308635 - RNA, 19 nt, Homo sapiens
gaauagcugggauuacaga

SEQ ID NO: 308636 - RNA, 19 nt, Homo sapiens
gaucagagcccuuguucac

SEQ ID NO: 308637 - RNA, 19 nt, Homo sapiens
caucuagagccuauuguuu

SEQ ID NO: 308638 - RNA, 19 nt, Homo sapiens
gaucaugaccaacucaaca

SEQ ID NO: 308639 - RNA, 19 nt, Homo sapiens
gcuacuggguccacugguu

SEQ ID NO: 308640 - RNA, 19 nt, Homo sapiens
aaacuacagcgauaucuga

SEQ ID NO: 308641 - RNA, 19 nt, Homo sapiens
ugcagaaacuacagcgaua

SEQ ID NO: 308642 - RNA, 19 nt, Homo sapiens
ucugugagauccaugaaga

SEQ ID NO: 308643 - RNA, 19 nt, Homo sapiens
caccacacccagcuaauuu

SEQ ID NO: 308644 - RNA, 19 nt, Homo sapiens
ucuagagccuauuguuuga

SEQ ID NO: 308645 - RNA, 19 nt, Homo sapiens
gagcucagaccuuggcuau

SEQ ID NO: 308646 - RNA, 19 nt, Homo sapiens
gaggaaugcagucuuacaa

SEQ ID NO: 308647 - RNA, 19 nt, Homo sapiens
caugugcaguaauuagauu

SEQ ID NO: 308648 - RNA, 19 nt, Homo sapiens
gacccugacucauaucaag

SEQ ID NO: 308649 - RNA, 19 nt, Homo sapiens
gaaacuacagcgauaucug

SEQ ID NO: 308650 - RNA, 19 nt, Homo sapiens
aggaggacccugacucaua

SEQ ID NO: 308651 - RNA, 19 nt, Homo sapiens
acacagagaccgaggacuu

SEQ ID NO: 308652 - RNA, 19 nt, Homo sapiens
uacucugugucuacuauua

SEQ ID NO: 308653 - RNA, 19 nt, Homo sapiens
caacucaacauuccauugg

SEQ ID NO: 308654 - RNA, 19 nt, Homo sapiens
cugcugcuaugccauguuu

SEQ ID NO: 308655 - RNA, 19 nt, Homo sapiens
guuggaugcugcaaagugu

SEQ ID NO: 308656 - RNA, 19 nt, Homo sapiens
ucuguuuccugaccuauga

SEQ ID NO: 308657 - RNA, 19 nt, Homo sapiens
gguucaagcacuucucgua

SEQ ID NO: 308658 - RNA, 19 nt, Homo sapiens
cggacagacuuuccauaug

SEQ ID NO: 308659 - RNA, 19 nt, Homo sapiens
gaagaccaagacacacuau

SEQ ID NO: 308660 - RNA, 19 nt, Homo sapiens
ggucaucuagagccuauug

SEQ ID NO: 308661 - RNA, 19 nt, Homo sapiens
cagcaaauuguuuaucaug

SEQ ID NO: 308662 - RNA, 19 nt, Homo sapiens
ccgaggacuugacagagaa

SEQ ID NO: 308663 - RNA, 19 nt, Homo sapiens
uaccucagacucccgaaua

SEQ ID NO: 308664 - RNA, 19 nt, Homo sapiens
ggcagaggguccagagcuu

SEQ ID NO: 308665 - RNA, 19 nt, Homo sapiens
gcagaaacuacagcgauau

SEQ ID NO: 308666 - RNA, 19 nt, Homo sapiens
gaaaggaggcuugcauucc

SEQ ID NO: 308667 - RNA, 19 nt, Homo sapiens
cagaaaggaggcuugcauu

SEQ ID NO: 308668 - RNA, 19 nt, Homo sapiens
gcugggauuacaagaauga

SEQ ID NO: 308669 - RNA, 19 nt, Homo sapiens
caaguugaccagcccaguu

SEQ ID NO: 308670 - RNA, 19 nt, Homo sapiens
ugacagagaaugggcaaga

SEQ ID NO: 308671 - RNA, 19 nt, Homo sapiens
aggaccagcuuucuuguca

SEQ ID NO: 308672 - RNA, 19 nt, Homo sapiens
uaguagguaugagguguuu

SEQ ID NO: 308673 - RNA, 19 nt, Homo sapiens
gaacuuuaugagugaguau

SEQ ID NO: 308674 - RNA, 19 nt, Homo sapiens
ugaacuuuaugagugagua

SEQ ID NO: 308675 - RNA, 19 nt, Homo sapiens
ccaccacacccagcuaauu

SEQ ID NO: 308676 - RNA, 19 nt, Homo sapiens
guuguuggaugcugcaaag

SEQ ID NO: 308677 - RNA, 19 nt, Homo sapiens
gguaucauuauuucuguug

SEQ ID NO: 308678 - RNA, 19 nt, Homo sapiens
acgaagggcuguggaagau

SEQ ID NO: 308679 - RNA, 19 nt, Homo sapiens
ugcaaaguguuaguaggua

SEQ ID NO: 308680 - RNA, 19 nt, Homo sapiens
ccugaccuaugaaacagaa

SEQ ID NO: 308681 - RNA, 19 nt, Homo sapiens
gcucccggcauuucuacua

SEQ ID NO: 308682 - RNA, 19 nt, Homo sapiens
ccaccaugccuguccuauu

SEQ ID NO: 308683 - RNA, 19 nt, Homo sapiens
caaagugcugggauuacaa

SEQ ID NO: 308684 - RNA, 19 nt, Homo sapiens
gacacacuaucgcgcuaug

SEQ ID NO: 308685 - RNA, 19 nt, Homo sapiens
cgucacaccguuaugcauu

SEQ ID NO: 308686 - RNA, 19 nt, Homo sapiens
ccagcuuucuugucaccuu

SEQ ID NO: 308687 - RNA, 19 nt, Homo sapiens
ucauuggaguuaucuacug

SEQ ID NO: 308688 - RNA, 19 nt, Homo sapiens
ccauauguuucugcugcua

SEQ ID NO: 308689 - RNA, 19 nt, Homo sapiens
caccaggauucgccaagga

SEQ ID NO: 308690 - RNA, 19 nt, Homo sapiens
ccaugaagaccaagacaca

SEQ ID NO: 308691 - RNA, 19 nt, Homo sapiens
aagaugccaugaagaccaa

SEQ ID NO: 308692 - RNA, 19 nt, Homo sapiens
gagugaguaucuuggugau

SEQ ID NO: 308693 - RNA, 19 nt, Homo sapiens
ggacagugggcagaagaug

SEQ ID NO: 308694 - RNA, 19 nt, Homo sapiens
gagccuauuguuugaggaa

SEQ ID NO: 308695 - RNA, 19 nt, Homo sapiens
uggaugcugcaaaguguua

SEQ ID NO: 308696 - RNA, 19 nt, Homo sapiens
gagcucuuccucucccaaa

SEQ ID NO: 308697 - RNA, 19 nt, Homo sapiens
ugccuggccuauuuuauua

SEQ ID NO: 308698 - RNA, 19 nt, Homo sapiens
ugaccagcccaguuucaaa

SEQ ID NO: 308699 - RNA, 19 nt, Homo sapiens
aacagugccauauuaauug

SEQ ID NO: 308700 - RNA, 19 nt, Homo sapiens
ggagaggagcagagguuca

SEQ ID NO: 308701 - RNA, 19 nt, Homo sapiens
ugaagaccaagacacacua

SEQ ID NO: 308702 - RNA, 19 nt, Homo sapiens
gcauuacucugugucuacu

SEQ ID NO: 308703 - RNA, 19 nt, Homo sapiens
gaacugaccugcccuauuu

SEQ ID NO: 308704 - RNA, 19 nt, Homo sapiens
ucucauagcugaugggaua

SEQ ID NO: 308705 - RNA, 19 nt, Homo sapiens
cagcaaagacgacagauua

SEQ ID NO: 308706 - RNA, 19 nt, Homo sapiens
gcugauagcuggaugauag

SEQ ID NO: 308707 - RNA, 19 nt, Homo sapiens
guacgggcuuuaauaauuu

SEQ ID NO: 308708 - RNA, 19 nt, Homo sapiens
gaacaagugucugacgauu

SEQ ID NO: 308709 - RNA, 19 nt, Homo sapiens
caagagagcuuugccugaa

SEQ ID NO: 308710 - RNA, 19 nt, Homo sapiens
agaaugagaugcaauugaa

SEQ ID NO: 308711 - RNA, 19 nt, Homo sapiens
acaaacagccaaccauuua

SEQ ID NO: 308712 - RNA, 19 nt, Homo sapiens
caugauaacuugacaguag

SEQ ID NO: 308713 - RNA, 19 nt, Homo sapiens
agaagaaacugcuagaaug

SEQ ID NO: 308714 - RNA, 19 nt, Homo sapiens
gaaaucaaccucaaugaca

SEQ ID NO: 308715 - RNA, 19 nt, Homo sapiens
ggagugugaucuucucauu

SEQ ID NO: 308716 - RNA, 19 nt, Homo sapiens
caagggacauuguauaaag

SEQ ID NO: 308717 - RNA, 19 nt, Homo sapiens
gaaagccacucacccgaau

SEQ ID NO: 308718 - RNA, 19 nt, Homo sapiens
caaacuggcucagcagauu

SEQ ID NO: 308719 - RNA, 19 nt, Homo sapiens
gcacacagccucugcuuca

SEQ ID NO: 308720 - RNA, 19 nt, Homo sapiens
ggauaauguuggaaagaaa

SEQ ID NO: 308721 - RNA, 19 nt, Homo sapiens
uaacggcucuaucgccuuu

SEQ ID NO: 308722 - RNA, 19 nt, Homo sapiens
ggaaagaaagguugugaau

SEQ ID NO: 308723 - RNA, 19 nt, Homo sapiens
gcacaggcuucaugagugu

SEQ ID NO: 308724 - RNA, 19 nt, Homo sapiens
gugaauauguacuguguga

SEQ ID NO: 308725 - RNA, 19 nt, Homo sapiens
caaagacgacagauuauug

SEQ ID NO: 308726 - RNA, 19 nt, Homo sapiens
gggauaauguuggaaagaa

SEQ ID NO: 308727 - RNA, 19 nt, Homo sapiens
uaagaggcccauaaguuua

SEQ ID NO: 308728 - RNA, 19 nt, Homo sapiens
acaagugucugacgauuau

SEQ ID NO: 308729 - RNA, 19 nt, Homo sapiens
gaagaaacugcuagaaugu

SEQ ID NO: 308730 - RNA, 19 nt, Homo sapiens
gagaagaaacugcuagaau

SEQ ID NO: 308731 - RNA, 19 nt, Homo sapiens
gcaccacuuuggauugauu

SEQ ID NO: 308732 - RNA, 19 nt, Homo sapiens
gagguaggauucuguuuua

SEQ ID NO: 308733 - RNA, 19 nt, Homo sapiens
ugacacauuugacaccuuu

SEQ ID NO: 308734 - RNA, 19 nt, Homo sapiens
uaaguacgggcuuuaauaa

SEQ ID NO: 308735 - RNA, 19 nt, Homo sapiens
gcagugagccugggaaguu

SEQ ID NO: 308736 - RNA, 19 nt, Homo sapiens
gaagaccugugucacuugu

SEQ ID NO: 308737 - RNA, 19 nt, Homo sapiens
uuaagaggcccauaaguuu

SEQ ID NO: 308738 - RNA, 19 nt, Homo sapiens
gcaaggaaauccccauuga

SEQ ID NO: 308739 - RNA, 19 nt, Homo sapiens
gaaguggucauaaguggaa

SEQ ID NO: 308740 - RNA, 19 nt, Homo sapiens
gcaaagacgacagauuauu

SEQ ID NO: 308741 - RNA, 19 nt, Homo sapiens
aaagaaagguugugaaucc

SEQ ID NO: 308742 - RNA, 19 nt, Homo sapiens
aguacgggcuuuaauaauu

SEQ ID NO: 308743 - RNA, 19 nt, Homo sapiens
uaaacuggaucccaaaucu

SEQ ID NO: 308744 - RNA, 19 nt, Homo sapiens
gacaaacagccaaccauuu

SEQ ID NO: 308745 - RNA, 19 nt, Homo sapiens
ccaaaccugucaacauguu

SEQ ID NO: 308746 - RNA, 19 nt, Homo sapiens
ccacucacccgaauaagaa

SEQ ID NO: 308747 - RNA, 19 nt, Homo sapiens
uggaguagcuggaaaugug

SEQ ID NO: 308748 - RNA, 19 nt, Homo sapiens
ugugaccgaugaccaguua

SEQ ID NO: 308749 - RNA, 19 nt, Homo sapiens
caaauagcagcaccacuuu

SEQ ID NO: 308750 - RNA, 19 nt, Homo sapiens
gguuaaggguucuggaaga

SEQ ID NO: 308751 - RNA, 19 nt, Homo sapiens
cuggaaauguguuuauuga

SEQ ID NO: 308752 - RNA, 19 nt, Homo sapiens
gaugagaaggugaauaugu

SEQ ID NO: 308753 - RNA, 19 nt, Homo sapiens
gaagguccucugccaguuu

SEQ ID NO: 308754 - RNA, 19 nt, Homo sapiens
cuuuagaccugugaaauuu

SEQ ID NO: 308755 - RNA, 19 nt, Homo sapiens
ccagaagugucccgaaauc

SEQ ID NO: 308756 - RNA, 19 nt, Homo sapiens
caccagaagugucccgaaa

SEQ ID NO: 308757 - RNA, 19 nt, Homo sapiens
gcauccugcuggacuauga

SEQ ID NO: 308758 - RNA, 19 nt, Homo sapiens
ccauuggucuugcuuacaa

SEQ ID NO: 308759 - RNA, 19 nt, Homo sapiens
cugaaggugucccaugaua

SEQ ID NO: 308760 - RNA, 19 nt, Homo sapiens
ccaaguacaucuucauggu

SEQ ID NO: 308761 - RNA, 19 nt, Homo sapiens
augagaaggugaauaugua

SEQ ID NO: 308762 - RNA, 19 nt, Homo sapiens
agugugaucuucucauuga

SEQ ID NO: 308763 - RNA, 19 nt, Homo sapiens
uggaaacacuggagucaga

SEQ ID NO: 308764 - RNA, 19 nt, Homo sapiens
aaugaaaucucaccagaag

SEQ ID NO: 308765 - RNA, 19 nt, Homo sapiens
cuacagacugcuaagaaua

SEQ ID NO: 308766 - RNA, 19 nt, Homo sapiens
guuaaucugugccuugugu

SEQ ID NO: 308767 - RNA, 19 nt, Homo sapiens
gaaggugaauauguacugu

SEQ ID NO: 308768 - RNA, 19 nt, Homo sapiens
acaaauagcagcaccacuu

SEQ ID NO: 308769 - RNA, 19 nt, Homo sapiens
ccaaaucugcucaucgaaa

SEQ ID NO: 308770 - RNA, 19 nt, Homo sapiens
cagcaccacuuuggauuga

SEQ ID NO: 308771 - RNA, 19 nt, Homo sapiens
gaucagcuuccuuggguuu

SEQ ID NO: 308772 - RNA, 19 nt, Homo sapiens
gaaugucuggauuaccuua

SEQ ID NO: 308773 - RNA, 19 nt, Homo sapiens
cauguucugucacaaauag

SEQ ID NO: 308774 - RNA, 19 nt, Homo sapiens
aaacauguucugucacaaa

SEQ ID NO: 308775 - RNA, 19 nt, Homo sapiens
gaaagaaagguugugaauc

SEQ ID NO: 308776 - RNA, 19 nt, Homo sapiens
gaccuccgaugaugaguuc

SEQ ID NO: 308777 - RNA, 19 nt, Homo sapiens
ugagcgcuaugacaaauug

SEQ ID NO: 308778 - RNA, 19 nt, Homo sapiens
aaacagccaaccauuuaaa

SEQ ID NO: 308779 - RNA, 19 nt, Homo sapiens
caaacagccaaccauuuaa

SEQ ID NO: 308780 - RNA, 19 nt, Homo sapiens
gauaguacccaacaucaag

SEQ ID NO: 308781 - RNA, 19 nt, Homo sapiens
agaaugaucaugcgcguuu

SEQ ID NO: 308782 - RNA, 19 nt, Homo sapiens
agaagucccucuauagucu

SEQ ID NO: 308783 - RNA, 19 nt, Homo sapiens
cuugaaagauguagaaguc

SEQ ID NO: 308784 - RNA, 19 nt, Homo sapiens
gagacacaauagcaaggaa

SEQ ID NO: 308785 - RNA, 19 nt, Homo sapiens
gaaggugucccaugauaac

SEQ ID NO: 308786 - RNA, 19 nt, Homo sapiens
caaaucugcucaucgaaaa

SEQ ID NO: 308787 - RNA, 19 nt, Homo sapiens
caacuaaaauggagagcaa

SEQ ID NO: 308788 - RNA, 19 nt, Homo sapiens
aaacaggcuuucuuacucu

SEQ ID NO: 308789 - RNA, 19 nt, Homo sapiens
gagcuccaguacaccauau

SEQ ID NO: 308790 - RNA, 19 nt, Homo sapiens
gagaugcaauugaaaauag

SEQ ID NO: 308791 - RNA, 19 nt, Homo sapiens
ugaaaucucaccagaagug

SEQ ID NO: 308792 - RNA, 19 nt, Homo sapiens
ggucaugggauucuaaaca

SEQ ID NO: 308793 - RNA, 19 nt, Homo sapiens
ucccaacccucccacaauu

SEQ ID NO: 308794 - RNA, 19 nt, Homo sapiens
gaugggauaauguuggaaa

SEQ ID NO: 308795 - RNA, 19 nt, Homo sapiens
uaccugauaucccaugaug

SEQ ID NO: 308796 - RNA, 19 nt, Homo sapiens
agagaaacauaaucaggau

SEQ ID NO: 308797 - RNA, 19 nt, Homo sapiens
ggugucccaugauaacuug

SEQ ID NO: 308798 - RNA, 19 nt, Homo sapiens
gaugaggcuucgcaaacug

SEQ ID NO: 308799 - RNA, 19 nt, Homo sapiens
gcuuggagcaugaggauga

SEQ ID NO: 308800 - RNA, 19 nt, Homo sapiens
ccggaugggucaugggauu

SEQ ID NO: 308801 - RNA, 19 nt, Homo sapiens
auaaacauguucugucaca

SEQ ID NO: 308802 - RNA, 19 nt, Homo sapiens
gaaugagaugcaauugaaa

SEQ ID NO: 308803 - RNA, 19 nt, Homo sapiens
gaacugaccugcccuauuu

SEQ ID NO: 308804 - RNA, 19 nt, Homo sapiens
ucucauagcugaugggaua

SEQ ID NO: 308805 - RNA, 19 nt, Homo sapiens
cagcaaagacgacagauua

SEQ ID NO: 308806 - RNA, 19 nt, Homo sapiens
gcugauagcuggaugauag

SEQ ID NO: 308807 - RNA, 19 nt, Homo sapiens
guacgggcuuuaauaauuu

SEQ ID NO: 308808 - RNA, 19 nt, Homo sapiens
agaaugagauugcaauuga

SEQ ID NO: 308809 - RNA, 19 nt, Homo sapiens
gaacaagugucugacgauu

SEQ ID NO: 308810 - RNA, 19 nt, Homo sapiens
caagagagcuuugccugaa

SEQ ID NO: 308811 - RNA, 19 nt, Homo sapiens
acaaacagccaaccauuua

SEQ ID NO: 308812 - RNA, 19 nt, Homo sapiens
caugauaacuugacaguag

SEQ ID NO: 308813 - RNA, 19 nt, Homo sapiens
agaagaaacugcuagaaug

SEQ ID NO: 308814 - RNA, 19 nt, Homo sapiens
gaaaucaaccucaaugaca

SEQ ID NO: 308815 - RNA, 19 nt, Homo sapiens
ggagugugaucuucucauu

SEQ ID NO: 308816 - RNA, 19 nt, Homo sapiens
gaaagccacucacccgaau

SEQ ID NO: 308817 - RNA, 19 nt, Homo sapiens
caaacuggcucagcagauu

SEQ ID NO: 308818 - RNA, 19 nt, Homo sapiens
gcacacagccucugcuuca

SEQ ID NO: 308819 - RNA, 19 nt, Homo sapiens
ggauaauguuggaaagaaa

SEQ ID NO: 308820 - RNA, 19 nt, Homo sapiens
uaacggcucuaucgccuuu

SEQ ID NO: 308821 - RNA, 19 nt, Homo sapiens
gcacaggcuucaugagugu

SEQ ID NO: 308822 - RNA, 19 nt, Homo sapiens
gugaauauguacuguguga

SEQ ID NO: 308823 - RNA, 19 nt, Homo sapiens
caaagacgacagauuauug

SEQ ID NO: 308824 - RNA, 19 nt, Homo sapiens
gggauaauguuggaaagaa

SEQ ID NO: 308825 - RNA, 19 nt, Homo sapiens
uaagaggcccauaaguuua

SEQ ID NO: 308826 - RNA, 19 nt, Homo sapiens
acaagugucugacgauuau

SEQ ID NO: 308827 - RNA, 19 nt, Homo sapiens
gaagaaacugcuagaaugu

SEQ ID NO: 308828 - RNA, 19 nt, Homo sapiens
gagaagaaacugcuagaau

SEQ ID NO: 308829 - RNA, 19 nt, Homo sapiens
gagguaggauucuguuuua

SEQ ID NO: 308830 - RNA, 19 nt, Homo sapiens
gaaugagauugcaauugaa

SEQ ID NO: 308831 - RNA, 19 nt, Homo sapiens
ugacacauuugacaccuuu

SEQ ID NO: 308832 - RNA, 19 nt, Homo sapiens
uaaguacgggcuuuaauaa

SEQ ID NO: 308833 - RNA, 19 nt, Homo sapiens
gcagugagccugggaaguu

SEQ ID NO: 308834 - RNA, 19 nt, Homo sapiens
gaagaccugugucacuugu

SEQ ID NO: 308835 - RNA, 19 nt, Homo sapiens
uuaagaggcccauaaguuu

SEQ ID NO: 308836 - RNA, 19 nt, Homo sapiens
gcaaggaaauccccauuga

SEQ ID NO: 308837 - RNA, 19 nt, Homo sapiens
gaaguggucauaaguggaa

SEQ ID NO: 308838 - RNA, 19 nt, Homo sapiens
gcaaagacgacagauuauu

SEQ ID NO: 308839 - RNA, 19 nt, Homo sapiens
gaacuagggcugcaggaau

SEQ ID NO: 308840 - RNA, 19 nt, Homo sapiens
aguacgggcuuuaauaauu

SEQ ID NO: 308841 - RNA, 19 nt, Homo sapiens
uaaacuggaucccaaaucu

SEQ ID NO: 308842 - RNA, 19 nt, Homo sapiens
gacaaacagccaaccauuu

SEQ ID NO: 308843 - RNA, 19 nt, Homo sapiens
ccaaaccugucaacauguu

SEQ ID NO: 308844 - RNA, 19 nt, Homo sapiens
ccacucacccgaauaagaa

SEQ ID NO: 308845 - RNA, 19 nt, Homo sapiens
uggaguagcuggaaaugug

SEQ ID NO: 308846 - RNA, 19 nt, Homo sapiens
ugugaccgaugaccaguua

SEQ ID NO: 308847 - RNA, 19 nt, Homo sapiens
gguuaaggguucuggaaga

SEQ ID NO: 308848 - RNA, 19 nt, Homo sapiens
cuggaaauguguuuauuga

SEQ ID NO: 308849 - RNA, 19 nt, Homo sapiens
gaugagaaggugaauaugu

SEQ ID NO: 308850 - RNA, 19 nt, Homo sapiens
gaagguccucugccaguuu

SEQ ID NO: 308851 - RNA, 19 nt, Homo sapiens
cuuuagaccugugaaauuu

SEQ ID NO: 308852 - RNA, 19 nt, Homo sapiens
ccagaagugucccgaaauc

SEQ ID NO: 308853 - RNA, 19 nt, Homo sapiens
caccagaagugucccgaaa

SEQ ID NO: 308854 - RNA, 19 nt, Homo sapiens
gcauccugcuggacuauga

SEQ ID NO: 308855 - RNA, 19 nt, Homo sapiens
ccauuggucuugcuuacaa

SEQ ID NO: 308856 - RNA, 19 nt, Homo sapiens
cugaaggugucccaugaua

SEQ ID NO: 308857 - RNA, 19 nt, Homo sapiens
ccaaguacaucuucauggu

SEQ ID NO: 308858 - RNA, 19 nt, Homo sapiens
augagaaggugaauaugua

SEQ ID NO: 308859 - RNA, 19 nt, Homo sapiens
agugugaucuucucauuga

SEQ ID NO: 308860 - RNA, 19 nt, Homo sapiens
uggaaacacuggagucaga

SEQ ID NO: 308861 - RNA, 19 nt, Homo sapiens
aaugaaaucucaccagaag

SEQ ID NO: 308862 - RNA, 19 nt, Homo sapiens
cuacagacugcuaagaaua

SEQ ID NO: 308863 - RNA, 19 nt, Homo sapiens
guuaaucugugccuugugu

SEQ ID NO: 308864 - RNA, 19 nt, Homo sapiens
gaaggugaauauguacugu

SEQ ID NO: 308865 - RNA, 19 nt, Homo sapiens
cuacuuauccuuccuuuua

SEQ ID NO: 308866 - RNA, 19 nt, Homo sapiens
ccaaaucugcucaucgaaa

SEQ ID NO: 308867 - RNA, 19 nt, Homo sapiens
gaucagcuuccuuggguuu

SEQ ID NO: 308868 - RNA, 19 nt, Homo sapiens
gaaugucuggauuaccuua

SEQ ID NO: 308869 - RNA, 19 nt, Homo sapiens
gaccuccgaugaugaguuc

SEQ ID NO: 308870 - RNA, 19 nt, Homo sapiens
ugagcgcuaugacaaauug

SEQ ID NO: 308871 - RNA, 19 nt, Homo sapiens
aaacagccaaccauuuaaa

SEQ ID NO: 308872 - RNA, 19 nt, Homo sapiens
caaacagccaaccauuuaa

SEQ ID NO: 308873 - RNA, 19 nt, Homo sapiens
gauaguacccaacaucaag

SEQ ID NO: 308874 - RNA, 19 nt, Homo sapiens
agaaugaucaugcgcguuu

SEQ ID NO: 308875 - RNA, 19 nt, Homo sapiens
gagacacaauagcaaggaa

SEQ ID NO: 308876 - RNA, 19 nt, Homo sapiens
gaaggugucccaugauaac

SEQ ID NO: 308877 - RNA, 19 nt, Homo sapiens
caaaucugcucaucgaaaa

SEQ ID NO: 308878 - RNA, 19 nt, Homo sapiens
caacuaaaauggagagcaa

SEQ ID NO: 308879 - RNA, 19 nt, Homo sapiens
aaacaggcuuucuuacucu

SEQ ID NO: 308880 - RNA, 19 nt, Homo sapiens
gagcuccaguacaccauau

SEQ ID NO: 308881 - RNA, 19 nt, Homo sapiens
ugaaaucucaccagaagug

SEQ ID NO: 308882 - RNA, 19 nt, Homo sapiens
ucccaacccucccacaauu

SEQ ID NO: 308883 - RNA, 19 nt, Homo sapiens
gaugggauaauguuggaaa

SEQ ID NO: 308884 - RNA, 19 nt, Homo sapiens
uaccugauaucccaugaug

SEQ ID NO: 308885 - RNA, 19 nt, Homo sapiens
agagaaacauaaucaggau

SEQ ID NO: 308886 - RNA, 19 nt, Homo sapiens
ggugucccaugauaacuug

SEQ ID NO: 308887 - RNA, 19 nt, Homo sapiens
gaugaggcuucgcaaacug

SEQ ID NO: 308888 - RNA, 19 nt, Homo sapiens
gcuuggagcaugaggauga

SEQ ID NO: 308889 - RNA, 19 nt, Homo sapiens
gagcaagacagagaaugaa

SEQ ID NO: 308890 - RNA, 19 nt, Homo sapiens
gcuagaaugucuggauuac

SEQ ID NO: 308891 - RNA, 19 nt, Homo sapiens
caaccuucauuucaucaca

SEQ ID NO: 308892 - RNA, 19 nt, Homo sapiens
uaaccucaccaaccuuauu

SEQ ID NO: 308893 - RNA, 19 nt, Homo sapiens
ugaauccuuuggccacauu

SEQ ID NO: 308894 - RNA, 19 nt, Homo sapiens
caggauguguuugaaccua

SEQ ID NO: 308895 - RNA, 19 nt, Homo sapiens
uuacaaccuucauuucauc

SEQ ID NO: 308896 - RNA, 19 nt, Homo sapiens
cugggaaguugaagacaaa

SEQ ID NO: 308897 - RNA, 19 nt, Homo sapiens
gcucugcacagcuucauau

SEQ ID NO: 308898 - RNA, 19 nt, Homo sapiens
gagagaagaaacugcuaga

SEQ ID NO: 308899 - RNA, 19 nt, Homo sapiens
aacuagggcugcaggaauu

SEQ ID NO: 308900 - RNA, 19 nt, Homo sapiens
ugagaucauucagcaaaga

SEQ ID NO: 308901 - RNA, 19 nt, Homo sapiens
caaugcaucacgucaagaa

SEQ ID NO: 308902 - RNA, 19 nt, Homo sapiens
gaauaagaagcccuuuaca

SEQ ID NO: 308903 - RNA, 19 nt, Homo sapiens
gaacugaccugcccuauuu

SEQ ID NO: 308904 - RNA, 19 nt, Homo sapiens
ucucauagcugaugggaua

SEQ ID NO: 308905 - RNA, 19 nt, Homo sapiens
cagcaaagacgacagauua

SEQ ID NO: 308906 - RNA, 19 nt, Homo sapiens
gcugauagcuggaugauag

SEQ ID NO: 308907 - RNA, 19 nt, Homo sapiens
guacgggcuuuaauaauuu

SEQ ID NO: 308908 - RNA, 19 nt, Homo sapiens
gaacaagugucugacgauu

SEQ ID NO: 308909 - RNA, 19 nt, Homo sapiens
caagagagcuuugccugaa

SEQ ID NO: 308910 - RNA, 19 nt, Homo sapiens
agaaugagaugcaauugaa

SEQ ID NO: 308911 - RNA, 19 nt, Homo sapiens
acaaacagccaaccauuua

SEQ ID NO: 308912 - RNA, 19 nt, Homo sapiens
caugauaacuugacaguag

SEQ ID NO: 308913 - RNA, 19 nt, Homo sapiens
agaagaaacugcuagaaug

SEQ ID NO: 308914 - RNA, 19 nt, Homo sapiens
gaaaucaaccucaaugaca

SEQ ID NO: 308915 - RNA, 19 nt, Homo sapiens
ggagugugaucuucucauu

SEQ ID NO: 308916 - RNA, 19 nt, Homo sapiens
caagggacauuguauaaag

SEQ ID NO: 308917 - RNA, 19 nt, Homo sapiens
gaaagccacucacccgaau

SEQ ID NO: 308918 - RNA, 19 nt, Homo sapiens
caaacuggcucagcagauu

SEQ ID NO: 308919 - RNA, 19 nt, Homo sapiens
gcacacagccucugcuuca

SEQ ID NO: 308920 - RNA, 19 nt, Homo sapiens
ggauaauguuggaaagaaa

SEQ ID NO: 308921 - RNA, 19 nt, Homo sapiens
uaacggcucuaucgccuuu

SEQ ID NO: 308922 - RNA, 19 nt, Homo sapiens
ggaaagaaagguugugaau

SEQ ID NO: 308923 - RNA, 19 nt, Homo sapiens
gcacaggcuucaugagugu

SEQ ID NO: 308924 - RNA, 19 nt, Homo sapiens
gugaauauguacuguguga

SEQ ID NO: 308925 - RNA, 19 nt, Homo sapiens
caaagacgacagauuauug

SEQ ID NO: 308926 - RNA, 19 nt, Homo sapiens
gggauaauguuggaaagaa

SEQ ID NO: 308927 - RNA, 19 nt, Homo sapiens
uaagaggcccauaaguuua

SEQ ID NO: 308928 - RNA, 19 nt, Homo sapiens
acaagugucugacgauuau

SEQ ID NO: 308929 - RNA, 19 nt, Homo sapiens
gaagaaacugcuagaaugu

SEQ ID NO: 308930 - RNA, 19 nt, Homo sapiens
gagaagaaacugcuagaau

SEQ ID NO: 308931 - RNA, 19 nt, Homo sapiens
gcaccacuuuggauugauu

SEQ ID NO: 308932 - RNA, 19 nt, Homo sapiens
gagguaggauucuguuuua

SEQ ID NO: 308933 - RNA, 19 nt, Homo sapiens
ugacacauuugacaccuuu

SEQ ID NO: 308934 - RNA, 19 nt, Homo sapiens
uaaguacgggcuuuaauaa

SEQ ID NO: 308935 - RNA, 19 nt, Homo sapiens
ggaagcacauggugagaca

SEQ ID NO: 308936 - RNA, 19 nt, Homo sapiens
gcagugagccugggaaguu

SEQ ID NO: 308937 - RNA, 19 nt, Homo sapiens
gaagaccugugucacuugu

SEQ ID NO: 308938 - RNA, 19 nt, Homo sapiens
uuaagaggcccauaaguuu

SEQ ID NO: 308939 - RNA, 19 nt, Homo sapiens
gcaaggaaauccccauuga

SEQ ID NO: 308940 - RNA, 19 nt, Homo sapiens
gaaguggucauaaguggaa

SEQ ID NO: 308941 - RNA, 19 nt, Homo sapiens
gcaaagacgacagauuauu

SEQ ID NO: 308942 - RNA, 19 nt, Homo sapiens
aaagaaagguugugaaucc

SEQ ID NO: 308943 - RNA, 19 nt, Homo sapiens
aguacgggcuuuaauaauu

SEQ ID NO: 308944 - RNA, 19 nt, Homo sapiens
uaaacuggaucccaaaucu

SEQ ID NO: 308945 - RNA, 19 nt, Homo sapiens
gacaaacagccaaccauuu

SEQ ID NO: 308946 - RNA, 19 nt, Homo sapiens
ccaaaccugucaacauguu

SEQ ID NO: 308947 - RNA, 19 nt, Homo sapiens
ccacucacccgaauaagaa

SEQ ID NO: 308948 - RNA, 19 nt, Homo sapiens
uggaguagcuggaaaugug

SEQ ID NO: 308949 - RNA, 19 nt, Homo sapiens
ugugaccgaugaccaguua

SEQ ID NO: 308950 - RNA, 19 nt, Homo sapiens
caaauagcagcaccacuuu

SEQ ID NO: 308951 - RNA, 19 nt, Homo sapiens
gguuaaggguucuggaaga

SEQ ID NO: 308952 - RNA, 19 nt, Homo sapiens
cuggaaauguguuuauuga

SEQ ID NO: 308953 - RNA, 19 nt, Homo sapiens
gaugagaaggugaauaugu

SEQ ID NO: 308954 - RNA, 19 nt, Homo sapiens
gaagguccucugccaguuu

SEQ ID NO: 308955 - RNA, 19 nt, Homo sapiens
cuuuagaccugugaaauuu

SEQ ID NO: 308956 - RNA, 19 nt, Homo sapiens
ccagaagugucccgaaauc

SEQ ID NO: 308957 - RNA, 19 nt, Homo sapiens
caccagaagugucccgaaa

SEQ ID NO: 308958 - RNA, 19 nt, Homo sapiens
gcauccugcuggacuauga

SEQ ID NO: 308959 - RNA, 19 nt, Homo sapiens
cugaaggugucccaugaua

SEQ ID NO: 308960 - RNA, 19 nt, Homo sapiens
ccaaguacaucuucauggu

SEQ ID NO: 308961 - RNA, 19 nt, Homo sapiens
augagaaggugaauaugua

SEQ ID NO: 308962 - RNA, 19 nt, Homo sapiens
agugugaucuucucauuga

SEQ ID NO: 308963 - RNA, 19 nt, Homo sapiens
uggaaacacuggagucaga

SEQ ID NO: 308964 - RNA, 19 nt, Homo sapiens
aaugaaaucucaccagaag

SEQ ID NO: 308965 - RNA, 19 nt, Homo sapiens
cuacagacugcuaagaaua

SEQ ID NO: 308966 - RNA, 19 nt, Homo sapiens
guuaaucugugccuugugu

SEQ ID NO: 308967 - RNA, 19 nt, Homo sapiens
gaaggugaauauguacugu

SEQ ID NO: 308968 - RNA, 19 nt, Homo sapiens
acaaauagcagcaccacuu

SEQ ID NO: 308969 - RNA, 19 nt, Homo sapiens
ccaaaucugcucaucgaaa

SEQ ID NO: 308970 - RNA, 19 nt, Homo sapiens
cagcaccacuuuggauuga

SEQ ID NO: 308971 - RNA, 19 nt, Homo sapiens
gaucagcuuccuuggguuu

SEQ ID NO: 308972 - RNA, 19 nt, Homo sapiens
gaaugucuggauuaccuua

SEQ ID NO: 308973 - RNA, 19 nt, Homo sapiens
cauguucugucacaaauag

SEQ ID NO: 308974 - RNA, 19 nt, Homo sapiens
aaacauguucugucacaaa

SEQ ID NO: 308975 - RNA, 19 nt, Homo sapiens
gaaagaaagguugugaauc

SEQ ID NO: 308976 - RNA, 19 nt, Homo sapiens
gaccuccgaugaugaguuc

SEQ ID NO: 308977 - RNA, 19 nt, Homo sapiens
ugagcgcuaugacaaauug

SEQ ID NO: 308978 - RNA, 19 nt, Homo sapiens
aaacagccaaccauuuaaa

SEQ ID NO: 308979 - RNA, 19 nt, Homo sapiens
caaacagccaaccauuuaa

SEQ ID NO: 308980 - RNA, 19 nt, Homo sapiens
gauaguacccaacaucaag

SEQ ID NO: 308981 - RNA, 19 nt, Homo sapiens
agaaugaucaugcgcguuu

SEQ ID NO: 308982 - RNA, 19 nt, Homo sapiens
agaagucccucuauagucu

SEQ ID NO: 308983 - RNA, 19 nt, Homo sapiens
cuugaaagauguagaaguc

SEQ ID NO: 308984 - RNA, 19 nt, Homo sapiens
gagacacaauagcaaggaa

SEQ ID NO: 308985 - RNA, 19 nt, Homo sapiens
gaaggugucccaugauaac

SEQ ID NO: 308986 - RNA, 19 nt, Homo sapiens
caaaucugcucaucgaaaa

SEQ ID NO: 308987 - RNA, 19 nt, Homo sapiens
caacuaaaauggagagcaa

SEQ ID NO: 308988 - RNA, 19 nt, Homo sapiens
aaacaggcuuucuuacucu

SEQ ID NO: 308989 - RNA, 19 nt, Homo sapiens
gagcuccaguacaccauau

SEQ ID NO: 308990 - RNA, 19 nt, Homo sapiens
gagaugcaauugaaaauag

SEQ ID NO: 308991 - RNA, 19 nt, Homo sapiens
ugaaaucucaccagaagug

SEQ ID NO: 308992 - RNA, 19 nt, Homo sapiens
ggucaugggauucuaaaca

SEQ ID NO: 308993 - RNA, 19 nt, Homo sapiens
ucccaacccucccacaauu

SEQ ID NO: 308994 - RNA, 19 nt, Homo sapiens
gaugggauaauguuggaaa

SEQ ID NO: 308995 - RNA, 19 nt, Homo sapiens
uaccugauaucccaugaug

SEQ ID NO: 308996 - RNA, 19 nt, Homo sapiens
agagaaacauaaucaggau

SEQ ID NO: 308997 - RNA, 19 nt, Homo sapiens
ggugucccaugauaacuug

SEQ ID NO: 308998 - RNA, 19 nt, Homo sapiens
gaugaggcuucgcaaacug

SEQ ID NO: 308999 - RNA, 19 nt, Homo sapiens
gcuuggagcaugaggauga

SEQ ID NO: 309000 - RNA, 19 nt, Homo sapiens
ccggaugggucaugggauu

SEQ ID NO: 309001 - RNA, 19 nt, Homo sapiens
auaaacauguucugucaca

SEQ ID NO: 309002 - RNA, 19 nt, Homo sapiens
gaaugagaugcaauugaaa

SEQ ID NO: 309003 - RNA, 19 nt, Homo sapiens
gggucuacaucaacuauua

SEQ ID NO: 309004 - RNA, 19 nt, Homo sapiens
caucaacuauuacgacaug

SEQ ID NO: 309005 - RNA, 19 nt, Homo sapiens
caacuccaccuucgccuaa

SEQ ID NO: 309006 - RNA, 19 nt, Homo sapiens
ggacagggucuacaucaac

SEQ ID NO: 309007 - RNA, 19 nt, Homo sapiens
gcgcagaaccgcuccuaca

SEQ ID NO: 309008 - RNA, 19 nt, Homo sapiens
gcacagcaucggcaagauc

SEQ ID NO: 309009 - RNA, 19 nt, Homo sapiens
gacagggucuacaucaacu

SEQ ID NO: 309010 - RNA, 19 nt, Homo sapiens
cggacagggucuacaucaa

SEQ ID NO: 309011 - RNA, 19 nt, Homo sapiens
caacuauuacgacaugaac

SEQ ID NO: 309012 - RNA, 19 nt, Homo sapiens
ucaacuauuacgacaugaa

SEQ ID NO: 309013 - RNA, 19 nt, Homo sapiens
ggugaacacucaaugguua

SEQ ID NO: 309014 - RNA, 19 nt, Homo sapiens
ucacacugcugaugauuua

SEQ ID NO: 309015 - RNA, 19 nt, Homo sapiens
aaaggaggauggcauauaa

SEQ ID NO: 309016 - RNA, 19 nt, Homo sapiens
gaaagggaacggugaagua

SEQ ID NO: 309017 - RNA, 19 nt, Homo sapiens
ccacuuaccuugcaucuca

SEQ ID NO: 309018 - RNA, 19 nt, Homo sapiens
ggacacacaaauuaucuua

SEQ ID NO: 309019 - RNA, 19 nt, Homo sapiens
gaauggaguucaaacaugu

SEQ ID NO: 309020 - RNA, 19 nt, Homo sapiens
gaacuccauucuaucacua

SEQ ID NO: 309021 - RNA, 19 nt, Homo sapiens
ccacaugggugaacacuca

SEQ ID NO: 309022 - RNA, 19 nt, Homo sapiens
ccaagcaguuugaaauuga

SEQ ID NO: 309023 - RNA, 19 nt, Homo sapiens
caugauuggugcccaguua

SEQ ID NO: 309024 - RNA, 19 nt, Homo sapiens
guucaaguccugccucuua

SEQ ID NO: 309025 - RNA, 19 nt, Homo sapiens
ucauguaacuucccugaaa

SEQ ID NO: 309026 - RNA, 19 nt, Homo sapiens
gagaccacuucaccaauaa

SEQ ID NO: 309027 - RNA, 19 nt, Homo sapiens
guacuaagcgcuagaggaa

SEQ ID NO: 309028 - RNA, 19 nt, Homo sapiens
agagaccacuucaccaaua

SEQ ID NO: 309029 - RNA, 19 nt, Homo sapiens
ugacuuguauaccuuguaa

SEQ ID NO: 309030 - RNA, 19 nt, Homo sapiens
gguagacaguauauaacua

SEQ ID NO: 309031 - RNA, 19 nt, Homo sapiens
ugucauaugcucugauuua

SEQ ID NO: 309032 - RNA, 19 nt, Homo sapiens
ggcaagagccacaguauau

SEQ ID NO: 309033 - RNA, 19 nt, Homo sapiens
caagagccacaguauauuu

SEQ ID NO: 309034 - RNA, 19 nt, Homo sapiens
cauaugcucugauuuaucu

SEQ ID NO: 309035 - RNA, 19 nt, Homo sapiens
caaaggaggauggcauaua

SEQ ID NO: 309036 - RNA, 19 nt, Homo sapiens
caagucagcucuucuccau

SEQ ID NO: 309037 - RNA, 19 nt, Homo sapiens
cgucuuaucuaaucaugaa

SEQ ID NO: 309038 - RNA, 19 nt, Homo sapiens
guaaaacacuugcggauau

SEQ ID NO: 309039 - RNA, 19 nt, Homo sapiens
ccaagggacuauccaccua

SEQ ID NO: 309040 - RNA, 19 nt, Homo sapiens
gaccagggaugaugcaaca

SEQ ID NO: 309041 - RNA, 19 nt, Homo sapiens
gccaucaaccucuguauuu

SEQ ID NO: 309042 - RNA, 19 nt, Homo sapiens
gaaaucauugcuacacuga

SEQ ID NO: 309043 - RNA, 19 nt, Homo sapiens
gaugugaaggaacugauua

SEQ ID NO: 309044 - RNA, 19 nt, Homo sapiens
gacuacauauugucacuga

SEQ ID NO: 309045 - RNA, 19 nt, Homo sapiens
ggccagaauuuaaaccuau

SEQ ID NO: 309046 - RNA, 19 nt, Homo sapiens
gaagaaagggaacggugaa

SEQ ID NO: 309047 - RNA, 19 nt, Homo sapiens
caagauagccaccgagauc

SEQ ID NO: 309048 - RNA, 19 nt, Homo sapiens
cuacaggccucacacacaa

SEQ ID NO: 309049 - RNA, 19 nt, Homo sapiens
ggaguucaaacaugucuaa

SEQ ID NO: 309050 - RNA, 19 nt, Homo sapiens
cauacacucucaaagcaaa

SEQ ID NO: 309051 - RNA, 19 nt, Homo sapiens
acagguagacaguauauaa

SEQ ID NO: 309052 - RNA, 19 nt, Homo sapiens
aaccaaagacuacauauug

SEQ ID NO: 309053 - RNA, 19 nt, Homo sapiens
gccagaauuuaaaccuaua

SEQ ID NO: 309054 - RNA, 19 nt, Homo sapiens
cggauauucuggacuguuu

SEQ ID NO: 309055 - RNA, 19 nt, Homo sapiens
gccaagcaguuugaaauug

SEQ ID NO: 309056 - RNA, 19 nt, Homo sapiens
ccacagugccuaauaauac

SEQ ID NO: 309057 - RNA, 19 nt, Homo sapiens
aguccugccucuuaaauaa

SEQ ID NO: 309058 - RNA, 19 nt, Homo sapiens
gcugaccacuuuauuucuu

SEQ ID NO: 309059 - RNA, 19 nt, Homo sapiens
gagccaagcaguuugaaau

SEQ ID NO: 309060 - RNA, 19 nt, Homo sapiens
uaaaggcuaugauugucuu

SEQ ID NO: 309061 - RNA, 19 nt, Homo sapiens
gaagaauggaguucaaaca

SEQ ID NO: 309062 - RNA, 19 nt, Homo sapiens
gagagucugugacccacuu

SEQ ID NO: 309063 - RNA, 19 nt, Homo sapiens
gagaguaucugaggcacau

SEQ ID NO: 309064 - RNA, 19 nt, Homo sapiens
aaagaagacuacauaagag

SEQ ID NO: 309065 - RNA, 19 nt, Homo sapiens
caaccaaagacuacauauu

SEQ ID NO: 309066 - RNA, 19 nt, Homo sapiens
gaggauggcauauaauaca

SEQ ID NO: 309067 - RNA, 19 nt, Homo sapiens
ccgaacgucuuaucuaauc

SEQ ID NO: 309068 - RNA, 19 nt, Homo sapiens
gaagcagccaagucgguua

SEQ ID NO: 309069 - RNA, 19 nt, Homo sapiens
ccaccgagauccuuaucga

SEQ ID NO: 309070 - RNA, 19 nt, Homo sapiens
gggcaagagccacaguaua

SEQ ID NO: 309071 - RNA, 19 nt, Homo sapiens
ucucaacguucucgucaaa

SEQ ID NO: 309072 - RNA, 19 nt, Homo sapiens
agaauggaguucaaacaug

SEQ ID NO: 309073 - RNA, 19 nt, Homo sapiens
gcaagagccacaguauauu

SEQ ID NO: 309074 - RNA, 19 nt, Homo sapiens
gcaaguccuaagccuguua

SEQ ID NO: 309075 - RNA, 19 nt, Homo sapiens
ccacccaccaguugaauuu

SEQ ID NO: 309076 - RNA, 19 nt, Homo sapiens
gccaugugauuccaucuug

SEQ ID NO: 309077 - RNA, 19 nt, Homo sapiens
uaagagaccacuucaccaa

SEQ ID NO: 309078 - RNA, 19 nt, Homo sapiens
gauucaugcugauuguuau

SEQ ID NO: 309079 - RNA, 19 nt, Homo sapiens
caaugugucugagagauuc

SEQ ID NO: 309080 - RNA, 19 nt, Homo sapiens
gauugucuuuguucuucua

SEQ ID NO: 309081 - RNA, 19 nt, Homo sapiens
ggaacuccauucuaucacu

SEQ ID NO: 309082 - RNA, 19 nt, Homo sapiens
uauacucacuuucccaaau

SEQ ID NO: 309083 - RNA, 19 nt, Homo sapiens
cagcagaugugaaggaacu

SEQ ID NO: 309084 - RNA, 19 nt, Homo sapiens
ucucacagguagacaguau

SEQ ID NO: 309085 - RNA, 19 nt, Homo sapiens
auacucacuuucccaaauu

SEQ ID NO: 309086 - RNA, 19 nt, Homo sapiens
agggaacggugaaguacua

SEQ ID NO: 309087 - RNA, 19 nt, Homo sapiens
ccaucaaccucuguauuug

SEQ ID NO: 309088 - RNA, 19 nt, Homo sapiens
auccaaacguuaagaauug

SEQ ID NO: 309089 - RNA, 19 nt, Homo sapiens
auacaggagugacuuggaa

SEQ ID NO: 309090 - RNA, 19 nt, Homo sapiens
ugacacacacguuauaauc

SEQ ID NO: 309091 - RNA, 19 nt, Homo sapiens
caaagacuacauauuguca

SEQ ID NO: 309092 - RNA, 19 nt, Homo sapiens
caccaucucccaugaagaa

SEQ ID NO: 309093 - RNA, 19 nt, Homo sapiens
caaccucuguauuugaauc

SEQ ID NO: 309094 - RNA, 19 nt, Homo sapiens
gagaaacaggucagccaaa

SEQ ID NO: 309095 - RNA, 19 nt, Homo sapiens
aaacccagauucagcagau

SEQ ID NO: 309096 - RNA, 19 nt, Homo sapiens
acacacacguuauaaucau

SEQ ID NO: 309097 - RNA, 19 nt, Homo sapiens
acccgaacgucuuaucuaa

SEQ ID NO: 309098 - RNA, 19 nt, Homo sapiens
gagagauucaugcugauug

SEQ ID NO: 309099 - RNA, 19 nt, Homo sapiens
gauggcauauaauacaaag

SEQ ID NO: 309100 - RNA, 19 nt, Homo sapiens
caauaagaagcacguggua

SEQ ID NO: 309101 - RNA, 19 nt, Homo sapiens
uuucagaguuuguauugug

SEQ ID NO: 309102 - RNA, 19 nt, Homo sapiens
gaaacucauuuuaggcaaa

SEQ ID NO: 309103 - RNA, 19 nt, Homo sapiens
auaagaagcacgugguaaa

SEQ ID NO: 309104 - RNA, 19 nt, Homo sapiens
cuuccacagugccuaauaa

SEQ ID NO: 309105 - RNA, 19 nt, Homo sapiens
guucaaacaugucuaaacc

SEQ ID NO: 309106 - RNA, 19 nt, Homo sapiens
cagaguuuguauugugauu

SEQ ID NO: 309107 - RNA, 19 nt, Homo sapiens
ccugucauaugcucugauu

SEQ ID NO: 309108 - RNA, 19 nt, Homo sapiens
agauucaugcugauuguua

SEQ ID NO: 309109 - RNA, 19 nt, Homo sapiens
caauacccaugucuacaca

SEQ ID NO: 309110 - RNA, 19 nt, Homo sapiens
ccucuuacuuauuaucuuc

SEQ ID NO: 309111 - RNA, 19 nt, Homo sapiens
uauccuaucucuccaacca

SEQ ID NO: 309112 - RNA, 19 nt, Homo sapiens
acaaugcagugccuuucuu

SEQ ID NO: 309113 - RNA, 19 nt, Homo sapiens
cauauucgcugaguucuuu

SEQ ID NO: 309114 - RNA, 19 nt, Homo sapiens
ggcauguacuucuuuauuu

SEQ ID NO: 309115 - RNA, 19 nt, Homo sapiens
gcagguggcuauggcauuu

SEQ ID NO: 309116 - RNA, 19 nt, Homo sapiens
gaggaaaccuagcacucaa

SEQ ID NO: 309117 - RNA, 19 nt, Homo sapiens
ccucuucuaugucuucuuu

SEQ ID NO: 309118 - RNA, 19 nt, Homo sapiens
guacgacuuucuucucuuc

SEQ ID NO: 309119 - RNA, 19 nt, Homo sapiens
gggcauguacuucuuuauu

SEQ ID NO: 309120 - RNA, 19 nt, Homo sapiens
gcugugcuguauagcguua

SEQ ID NO: 309121 - RNA, 19 nt, Homo sapiens
caagaguauuucugagaga

SEQ ID NO: 309122 - RNA, 19 nt, Homo sapiens
ucacugggaacuucacuaa

SEQ ID NO: 309123 - RNA, 19 nt, Homo sapiens
gggaaccuguugaacugaa

SEQ ID NO: 309124 - RNA, 19 nt, Homo sapiens
gaauagagggaguagaaag

SEQ ID NO: 309125 - RNA, 19 nt, Homo sapiens
caaacccgaugucuccaau

SEQ ID NO: 309126 - RNA, 19 nt, Homo sapiens
gcaccucuuugggauguau

SEQ ID NO: 309127 - RNA, 19 nt, Homo sapiens
gggcaccucuuugggaugu

SEQ ID NO: 309128 - RNA, 19 nt, Homo sapiens
cugaauagagggaguagaa

SEQ ID NO: 309129 - RNA, 19 nt, Homo sapiens
cuccgugccuucugcuaua

SEQ ID NO: 309130 - RNA, 19 nt, Homo sapiens
ggaaaccuagcacucaaca

SEQ ID NO: 309131 - RNA, 19 nt, Homo sapiens
ucacuaaccacugggugua

SEQ ID NO: 309132 - RNA, 19 nt, Homo sapiens
cgaggaaaccuagcacuca

SEQ ID NO: 309133 - RNA, 19 nt, Homo sapiens
gaaagcuucugaguuuacg

SEQ ID NO: 309134 - RNA, 19 nt, Homo sapiens
gaauccugcccgcuccuuu

SEQ ID NO: 309135 - RNA, 19 nt, Homo sapiens
ggccauauucgcugaguuc

SEQ ID NO: 309136 - RNA, 19 nt, Homo sapiens
gccccuagaugaagaaaga

SEQ ID NO: 309137 - RNA, 19 nt, Homo sapiens
gcagccuccuguacgacuu

SEQ ID NO: 309138 - RNA, 19 nt, Homo sapiens
gaggcggaauggccaacug

SEQ ID NO: 309139 - RNA, 19 nt, Homo sapiens
guucgugcucugcaucuuu

SEQ ID NO: 309140 - RNA, 19 nt, Homo sapiens
ucaauccugcagucacuuu

SEQ ID NO: 309141 - RNA, 19 nt, Homo sapiens
uagagggaguagaaagcuu

SEQ ID NO: 309142 - RNA, 19 nt, Homo sapiens
uuugcugugugaaaucuuu

SEQ ID NO: 309143 - RNA, 19 nt, Homo sapiens
uugccacccucuucuaugu

SEQ ID NO: 309144 - RNA, 19 nt, Homo sapiens
gcuccgugccuucugcuau

SEQ ID NO: 309145 - RNA, 19 nt, Homo sapiens
cgucaauccugcagucacu

SEQ ID NO: 309146 - RNA, 19 nt, Homo sapiens
ggaggggcauguacuucuu

SEQ ID NO: 309147 - RNA, 19 nt, Homo sapiens
ggaaccuguugaacugaac

SEQ ID NO: 309148 - RNA, 19 nt, Homo sapiens
cuccuuugcuccugccauu

SEQ ID NO: 309149 - RNA, 19 nt, Homo sapiens
ugaauagagggaguagaaa

SEQ ID NO: 309150 - RNA, 19 nt, Homo sapiens
gcagaaagguauaauauug

SEQ ID NO: 309151 - RNA, 19 nt, Homo sapiens
ggaagaagcuuguagaagu

SEQ ID NO: 309152 - RNA, 19 nt, Homo sapiens
gaagaagcuuguagaagua

SEQ ID NO: 309153 - RNA, 19 nt, Homo sapiens
ccagaaggauuucauauug

SEQ ID NO: 309154 - RNA, 19 nt, Homo sapiens
gcgaguggcugaacuguuu

SEQ ID NO: 309155 - RNA, 19 nt, Homo sapiens
gcaguggaccucaauguua

SEQ ID NO: 309156 - RNA, 19 nt, Homo sapiens
gaaagaacucugaaagauu

SEQ ID NO: 309157 - RNA, 19 nt, Homo sapiens
ccacagacauucucaagga

SEQ ID NO: 309158 - RNA, 19 nt, Homo sapiens
uaaucaaggucauguagua

SEQ ID NO: 309159 - RNA, 19 nt, Homo sapiens
ugugagagcuuguuucuga

SEQ ID NO: 309160 - RNA, 19 nt, Homo sapiens
ucacagggcucuccaagga

SEQ ID NO: 309161 - RNA, 19 nt, Homo sapiens
aaaggaagauggagacuau

SEQ ID NO: 309162 - RNA, 19 nt, Homo sapiens
gaaacacucuacaccucua

SEQ ID NO: 309163 - RNA, 19 nt, Homo sapiens
guagagaaguugaacacaa

SEQ ID NO: 309164 - RNA, 19 nt, Homo sapiens
ggacugcucuggugcuaga

SEQ ID NO: 309165 - RNA, 19 nt, Homo sapiens
ugaaagaacucugaaagau

SEQ ID NO: 309166 - RNA, 19 nt, Homo sapiens
gggaucauaucauaauuga

SEQ ID NO: 309167 - RNA, 19 nt, Homo sapiens
gaaauucuauggccuacca

SEQ ID NO: 309168 - RNA, 19 nt, Homo sapiens
cagagaagcugcggaagaa

SEQ ID NO: 309169 - RNA, 19 nt, Homo sapiens
gguagaacuuggaauaaau

SEQ ID NO: 309170 - RNA, 19 nt, Homo sapiens
ggauuugaguaguacauuu

SEQ ID NO: 309171 - RNA, 19 nt, Homo sapiens
uagagaaguugaacacaaa

SEQ ID NO: 309172 - RNA, 19 nt, Homo sapiens
gcaaaugauuaucgaguag

SEQ ID NO: 309173 - RNA, 19 nt, Homo sapiens
caaggaaacacaagagaaa

SEQ ID NO: 309174 - RNA, 19 nt, Homo sapiens
gaucuggacuucgaaacuu

SEQ ID NO: 309175 - RNA, 19 nt, Homo sapiens
ccaacaagauugagaagca

SEQ ID NO: 309176 - RNA, 19 nt, Homo sapiens
ucgaguaguuaaccaauuu

SEQ ID NO: 309177 - RNA, 19 nt, Homo sapiens
gagaucuucuggcaaaguu

SEQ ID NO: 309178 - RNA, 19 nt, Homo sapiens
caguggaccucaauguuaa

SEQ ID NO: 309179 - RNA, 19 nt, Homo sapiens
gcugaacuguuuauguuug

SEQ ID NO: 309180 - RNA, 19 nt, Homo sapiens
acacauucgucguaacuuu

SEQ ID NO: 309181 - RNA, 19 nt, Homo sapiens
ucgaugagcucucggauuc

SEQ ID NO: 309182 - RNA, 19 nt, Homo sapiens
gagcgaagauguccgaaaa

SEQ ID NO: 309183 - RNA, 19 nt, Homo sapiens
uggcugaacuguuuauguu

SEQ ID NO: 309184 - RNA, 19 nt, Homo sapiens
aaacuuuccucauggauuc

SEQ ID NO: 309185 - RNA, 19 nt, Homo sapiens
gguauggugcuagauauua

SEQ ID NO: 309186 - RNA, 19 nt, Homo sapiens
gaauccaucuagacaaaca

SEQ ID NO: 309187 - RNA, 19 nt, Homo sapiens
gaauucaaccacagacauu

SEQ ID NO: 309188 - RNA, 19 nt, Homo sapiens
gagguuccuucuauucuga

SEQ ID NO: 309189 - RNA, 19 nt, Homo sapiens
gcucaugguugaagguaug

SEQ ID NO: 309190 - RNA, 19 nt, Homo sapiens
gcaccaugguagagaaguu

SEQ ID NO: 309191 - RNA, 19 nt, Homo sapiens
cagccuauauugcccguuu

SEQ ID NO: 309192 - RNA, 19 nt, Homo sapiens
gauuucauauugcacaaga

SEQ ID NO: 309193 - RNA, 19 nt, Homo sapiens
uaccauauguuccaaauac

SEQ ID NO: 309194 - RNA, 19 nt, Homo sapiens
aauauggugucucgucuuu

SEQ ID NO: 309195 - RNA, 19 nt, Homo sapiens
uggaguacuuugcaaauga

SEQ ID NO: 309196 - RNA, 19 nt, Homo sapiens
cagcugauaugcaacuuca

SEQ ID NO: 309197 - RNA, 19 nt, Homo sapiens
gagaaagacagaauugcuu

SEQ ID NO: 309198 - RNA, 19 nt, Homo sapiens
gugcagaaagguauaauau

SEQ ID NO: 309199 - RNA, 19 nt, Homo sapiens
cagaacacauucgucguaa

SEQ ID NO: 309200 - RNA, 19 nt, Homo sapiens
ccaggugcccuacugauuu

SEQ ID NO: 309201 - RNA, 19 nt, Homo sapiens
uuacuacaguggugugauu

SEQ ID NO: 309202 - RNA, 19 nt, Homo sapiens
gaaacugaaugcucaaaau

SEQ ID NO: 309203 - RNA, 19 nt, Homo sapiens
gcuggucaauugaaauguu

SEQ ID NO: 309204 - RNA, 19 nt, Homo sapiens
ccagaacacauucgucgua

SEQ ID NO: 309205 - RNA, 19 nt, Homo sapiens
gagagcuuguuucugauug

SEQ ID NO: 309206 - RNA, 19 nt, Homo sapiens
ucaaggucauguaguaaug

SEQ ID NO: 309207 - RNA, 19 nt, Homo sapiens
ggaaacacaagagaaauuc

SEQ ID NO: 309208 - RNA, 19 nt, Homo sapiens
ggaguacuuugcaaaugau

SEQ ID NO: 309209 - RNA, 19 nt, Homo sapiens
gaacacauucgucguaacu

SEQ ID NO: 309210 - RNA, 19 nt, Homo sapiens
cgacuuggaucuggacuuc

SEQ ID NO: 309211 - RNA, 19 nt, Homo sapiens
auuguucgcuucuguaauu

SEQ ID NO: 309212 - RNA, 19 nt, Homo sapiens
gcuaacuccuggcaugaug

SEQ ID NO: 309213 - RNA, 19 nt, Homo sapiens
ugcaaaugauuaucgagua

SEQ ID NO: 309214 - RNA, 19 nt, Homo sapiens
caucaggauugccauuuca

SEQ ID NO: 309215 - RNA, 19 nt, Homo sapiens
gagaugauacgagggauga

SEQ ID NO: 309216 - RNA, 19 nt, Homo sapiens
gaaccaauuuucccaacaa

SEQ ID NO: 309217 - RNA, 19 nt, Homo sapiens
uugcugagguuccuucuau

SEQ ID NO: 309218 - RNA, 19 nt, Homo sapiens
gaggcagacuaaaggaaga

SEQ ID NO: 309219 - RNA, 19 nt, Homo sapiens
gcauggaaggccugaauau

SEQ ID NO: 309220 - RNA, 19 nt, Homo sapiens
gcggucgccuccaugguuu

SEQ ID NO: 309221 - RNA, 19 nt, Homo sapiens
ugguagaacuuggaauaaa

SEQ ID NO: 309222 - RNA, 19 nt, Homo sapiens
gagcuuguuucugauuguu

SEQ ID NO: 309223 - RNA, 19 nt, Homo sapiens
ccaauuugccagacauuau

SEQ ID NO: 309224 - RNA, 19 nt, Homo sapiens
cuucuauucugauggagua

SEQ ID NO: 309225 - RNA, 19 nt, Homo sapiens
ccaaggaacgauagcuaaa

SEQ ID NO: 309226 - RNA, 19 nt, Homo sapiens
ggauugccauuucacuauc

SEQ ID NO: 309227 - RNA, 19 nt, Homo sapiens
gucaugcaguuccuugaaa

SEQ ID NO: 309228 - RNA, 19 nt, Homo sapiens
uauggugucucgucuuugu

SEQ ID NO: 309229 - RNA, 19 nt, Homo sapiens
aguaguacauuucuuaugg

SEQ ID NO: 309230 - RNA, 19 nt, Homo sapiens
gagcagacaaaccacauca

SEQ ID NO: 309231 - RNA, 19 nt, Homo sapiens
auggaaggccugaauauuu

SEQ ID NO: 309232 - RNA, 19 nt, Homo sapiens
cacauucgucguaacuuua

SEQ ID NO: 309233 - RNA, 19 nt, Homo sapiens
gaagcuuguagaaguauug

SEQ ID NO: 309234 - RNA, 19 nt, Homo sapiens
cgacuuggcugauuuugug

SEQ ID NO: 309235 - RNA, 19 nt, Homo sapiens
gcucucggauuccuuaugc

SEQ ID NO: 309236 - RNA, 19 nt, Homo sapiens
guucuuaugcugaaucuuc

SEQ ID NO: 309237 - RNA, 19 nt, Homo sapiens
uaucaacucccacuuguag

SEQ ID NO: 309238 - RNA, 19 nt, Homo sapiens
gaugauacgagggaugaaa

SEQ ID NO: 309239 - RNA, 19 nt, Homo sapiens
gugcuagauauuacucuua

SEQ ID NO: 309240 - RNA, 19 nt, Homo sapiens
ggaauucaaccacagacau

SEQ ID NO: 309241 - RNA, 19 nt, Homo sapiens
gagccagcauucagagaag

SEQ ID NO: 309242 - RNA, 19 nt, Homo sapiens
agaaggauuucauauugca

SEQ ID NO: 309243 - RNA, 19 nt, Homo sapiens
ucagagaagcugcggaaga

SEQ ID NO: 309244 - RNA, 19 nt, Homo sapiens
uggaaggccugaauauuuu

SEQ ID NO: 309245 - RNA, 19 nt, Homo sapiens
gcucaaaauuccgaaguaa

SEQ ID NO: 309246 - RNA, 19 nt, Homo sapiens
aagcaucucuuaccagaac

SEQ ID NO: 309247 - RNA, 19 nt, Homo sapiens
caacaagauugagaagcau

SEQ ID NO: 309248 - RNA, 19 nt, Homo sapiens
gagcaguggaccucaaugu

SEQ ID NO: 309249 - RNA, 19 nt, Homo sapiens
aaagagcaguggaccucaa

SEQ ID NO: 309250 - RNA, 19 nt, Homo sapiens
gaacgaagaagaagauuua

SEQ ID NO: 309251 - RNA, 19 nt, Homo sapiens
gaaacagacuuguauauuc

SEQ ID NO: 309252 - RNA, 19 nt, Homo sapiens
gaacaagggaaccaucuua

SEQ ID NO: 309253 - RNA, 19 nt, Homo sapiens
gaacugaauucaccacaga

SEQ ID NO: 309254 - RNA, 19 nt, Homo sapiens
gcagauggaugauguaauc

SEQ ID NO: 309255 - RNA, 19 nt, Homo sapiens
gaaaguagagggagggaua

SEQ ID NO: 309256 - RNA, 19 nt, Homo sapiens
caagagcacuggccaaaga

SEQ ID NO: 309257 - RNA, 19 nt, Homo sapiens
gaccuaaccuguacaacaa

SEQ ID NO: 309258 - RNA, 19 nt, Homo sapiens
acaaaugccuccaaaguau

SEQ ID NO: 309259 - RNA, 19 nt, Homo sapiens
agacggagcacacuuguua

SEQ ID NO: 309260 - RNA, 19 nt, Homo sapiens
gcucauggacuuucccuua

SEQ ID NO: 309261 - RNA, 19 nt, Homo sapiens
gaggaaaucuugggcuuga

SEQ ID NO: 309262 - RNA, 19 nt, Homo sapiens
guaccuuucuaccacuuua

SEQ ID NO: 309263 - RNA, 19 nt, Homo sapiens
acaaauaagugugcaguau

SEQ ID NO: 309264 - RNA, 19 nt, Homo sapiens
gccaguccaucuucaaauu

SEQ ID NO: 309265 - RNA, 19 nt, Homo sapiens
gaacuagguacuuugauuc

SEQ ID NO: 309266 - RNA, 19 nt, Homo sapiens
agaacuagguacuuugauu

SEQ ID NO: 309267 - RNA, 19 nt, Homo sapiens
caaacugcuuccuuucuug

SEQ ID NO: 309268 - RNA, 19 nt, Homo sapiens
cgaagaagaagauuuaaca

SEQ ID NO: 309269 - RNA, 19 nt, Homo sapiens
aaauaaacaugccaaccaa

SEQ ID NO: 309270 - RNA, 19 nt, Homo sapiens
ccuuggaaaucaaauguaa

SEQ ID NO: 309271 - RNA, 19 nt, Homo sapiens
gaauucaccacagacuuua

SEQ ID NO: 309272 - RNA, 19 nt, Homo sapiens
aagcauccguggacuauau

SEQ ID NO: 309273 - RNA, 19 nt, Homo sapiens
gagcucacagcguguauuu

SEQ ID NO: 309274 - RNA, 19 nt, Homo sapiens
gaagggguuuucuugauaa

SEQ ID NO: 309275 - RNA, 19 nt, Homo sapiens
ugacaucauuagccuagaa

SEQ ID NO: 309276 - RNA, 19 nt, Homo sapiens
guaugcagauggaugaugu

SEQ ID NO: 309277 - RNA, 19 nt, Homo sapiens
ugaauucaccacagacuuu

SEQ ID NO: 309278 - RNA, 19 nt, Homo sapiens
ggcagcagguaaagcagua

SEQ ID NO: 309279 - RNA, 19 nt, Homo sapiens
uauaguaccuucucuuugc

SEQ ID NO: 309280 - RNA, 19 nt, Homo sapiens
uacaaaugccuccaaagua

SEQ ID NO: 309281 - RNA, 19 nt, Homo sapiens
caaccugauugaacgaaga

SEQ ID NO: 309282 - RNA, 19 nt, Homo sapiens
uggcuaugcuuacgcuuaa

SEQ ID NO: 309283 - RNA, 19 nt, Homo sapiens
caaauaaacaugccaacca

SEQ ID NO: 309284 - RNA, 19 nt, Homo sapiens
acaaacugcuuccuuucuu

SEQ ID NO: 309285 - RNA, 19 nt, Homo sapiens
gcacaaacugcuuccuuuc

SEQ ID NO: 309286 - RNA, 19 nt, Homo sapiens
cgcacaaacugcuuccuuu

SEQ ID NO: 309287 - RNA, 19 nt, Homo sapiens
gauggauccugcuuugcaa

SEQ ID NO: 309288 - RNA, 19 nt, Homo sapiens
gauggaugauguaaucgau

SEQ ID NO: 309289 - RNA, 19 nt, Homo sapiens
gaauacaggaacuugaaau

SEQ ID NO: 309290 - RNA, 19 nt, Homo sapiens
uggaugauguaaucgauga

SEQ ID NO: 309291 - RNA, 19 nt, Homo sapiens
cuaccacuuuagcaaauaa

SEQ ID NO: 309292 - RNA, 19 nt, Homo sapiens
ggaaacuugauuugagauu

SEQ ID NO: 309293 - RNA, 19 nt, Homo sapiens
caccacagacuuuagcuuu

SEQ ID NO: 309294 - RNA, 19 nt, Homo sapiens
aaauaagugugcaguaucu

SEQ ID NO: 309295 - RNA, 19 nt, Homo sapiens
ggaauuauagaaaguagag

SEQ ID NO: 309296 - RNA, 19 nt, Homo sapiens
cuacaaaugccuccaaagu

SEQ ID NO: 309297 - RNA, 19 nt, Homo sapiens
ugaaucggaucaucaagca

SEQ ID NO: 309298 - RNA, 19 nt, Homo sapiens
ucauggacuuucccuuauu

SEQ ID NO: 309299 - RNA, 19 nt, Homo sapiens
cagaauacaggaacuugaa

SEQ ID NO: 309300 - RNA, 19 nt, Homo sapiens
cagccaaccuucccaacau

SEQ ID NO: 309301 - RNA, 19 nt, Homo sapiens
ggaaaucuugggcuugaug

SEQ ID NO: 309302 - RNA, 19 nt, Homo sapiens
gggguuuucuugauaauuu

SEQ ID NO: 309303 - RNA, 19 nt, Homo sapiens
ugaagggguuuucuugaua

SEQ ID NO: 309304 - RNA, 19 nt, Homo sapiens
gcacugcauucgcacaaac

SEQ ID NO: 309305 - RNA, 19 nt, Homo sapiens
gaagagacggagcacacuu

SEQ ID NO: 309306 - RNA, 19 nt, Homo sapiens
guccugagcuugccauguc

SEQ ID NO: 309307 - RNA, 19 nt, Homo sapiens
ccacagacuuuagcuuucu

SEQ ID NO: 309308 - RNA, 19 nt, Homo sapiens
caaaugccuccaaaguauu

SEQ ID NO: 309309 - RNA, 19 nt, Homo sapiens
uacaggaacuugaaaugca

SEQ ID NO: 309310 - RNA, 19 nt, Homo sapiens
ggacuauauccgaaaguug

SEQ ID NO: 309311 - RNA, 19 nt, Homo sapiens
gauagucuaccgucucuca

SEQ ID NO: 309312 - RNA, 19 nt, Homo sapiens
gugaaacagacuuguauau

SEQ ID NO: 309313 - RNA, 19 nt, Homo sapiens
guacaacaacucucgaucu

SEQ ID NO: 309314 - RNA, 19 nt, Homo sapiens
gcauuuguugcucagaaua

SEQ ID NO: 309315 - RNA, 19 nt, Homo sapiens
gucaaaugauccagacaug

SEQ ID NO: 309316 - RNA, 19 nt, Homo sapiens
uaccgucucucacuggauu

SEQ ID NO: 309317 - RNA, 19 nt, Homo sapiens
ucgggaaacuugauugauc

SEQ ID NO: 309318 - RNA, 19 nt, Homo sapiens
agccuagaaucaaguuaua

SEQ ID NO: 309319 - RNA, 19 nt, Homo sapiens
gggauagucuaccgucucu

SEQ ID NO: 309320 - RNA, 19 nt, Homo sapiens
caaauaagugugcaguauc

SEQ ID NO: 309321 - RNA, 19 nt, Homo sapiens
gauccugcuuugcaaaugg

SEQ ID NO: 309322 - RNA, 19 nt, Homo sapiens
cauggacuuucccuuauuc

SEQ ID NO: 309323 - RNA, 19 nt, Homo sapiens
gugcagacccaccucgaaa

SEQ ID NO: 309324 - RNA, 19 nt, Homo sapiens
ggacuuucccuuauuccau

SEQ ID NO: 309325 - RNA, 19 nt, Homo sapiens
caagggaaccaucuuaaaa

SEQ ID NO: 309326 - RNA, 19 nt, Homo sapiens
ccaccaggccucaccauca

SEQ ID NO: 309327 - RNA, 19 nt, Homo sapiens
ggaaacuugauugaucuuu

SEQ ID NO: 309328 - RNA, 19 nt, Homo sapiens
gcccaggcaugaacacaca

SEQ ID NO: 309329 - RNA, 19 nt, Homo sapiens
ugcuggaaaugcuagaaua

SEQ ID NO: 309330 - RNA, 19 nt, Homo sapiens
gcacacuuguuagcgaauc

SEQ ID NO: 309331 - RNA, 19 nt, Homo sapiens
acaagggaaccaucuuaaa

SEQ ID NO: 309332 - RNA, 19 nt, Homo sapiens
ugaccgcauuaaagaacua

SEQ ID NO: 309333 - RNA, 19 nt, Homo sapiens
cuugauggauccugcuuug

SEQ ID NO: 309334 - RNA, 19 nt, Homo sapiens
ccaaccaaguccugagcuu

SEQ ID NO: 309335 - RNA, 19 nt, Homo sapiens
cggcauuuguugcucagaa

SEQ ID NO: 309336 - RNA, 19 nt, Homo sapiens
gagaacagcaacgcgcaaa

SEQ ID NO: 309337 - RNA, 19 nt, Homo sapiens
ggaacaagggaaccaucuu

SEQ ID NO: 309338 - RNA, 19 nt, Homo sapiens
gcuggaaaugcuagaauau

SEQ ID NO: 309339 - RNA, 19 nt, Homo sapiens
ccuccaaaguauuguacaa

SEQ ID NO: 309340 - RNA, 19 nt, Homo sapiens
gcaguaugagcauggaaga

SEQ ID NO: 309341 - RNA, 19 nt, Homo sapiens
ucacugauccacuccuuuc

SEQ ID NO: 309342 - RNA, 19 nt, Homo sapiens
caacaacaaccucggaacu

SEQ ID NO: 309343 - RNA, 19 nt, Homo sapiens
caucauuagccuagaauca

SEQ ID NO: 309344 - RNA, 19 nt, Homo sapiens
caacuacaaaugccuccaa

SEQ ID NO: 309345 - RNA, 19 nt, Homo sapiens
cuuccuuucuugauucgua

SEQ ID NO: 309346 - RNA, 19 nt, Homo sapiens
gcagaccuaaccuguacaa

SEQ ID NO: 309347 - RNA, 19 nt, Homo sapiens
ugaacgaagaagaagauuu

SEQ ID NO: 309348 - RNA, 19 nt, Homo sapiens
ggauccugcuuugcaaaug

SEQ ID NO: 309349 - RNA, 19 nt, Homo sapiens
ucacgagcguccuguaugc

SEQ ID NO: 309350 - RNA, 19 nt, Homo sapiens
guacaaaucuuacuucaga

SEQ ID NO: 309351 - RNA, 19 nt, Homo sapiens
ucaaagagaugaggaaaua

SEQ ID NO: 309352 - RNA, 19 nt, Homo sapiens
caagaaggcucacuuugug

SEQ ID NO: 309353 - RNA, 19 nt, Homo sapiens
caaauuaaccuuucaggaa

SEQ ID NO: 309354 - RNA, 19 nt, Homo sapiens
acaggaagguuauucuaua

SEQ ID NO: 309355 - RNA, 19 nt, Homo sapiens
uaacuugaauucucucuug

SEQ ID NO: 309356 - RNA, 19 nt, Homo sapiens
uaaguuggcucacaucaug

SEQ ID NO: 309357 - RNA, 19 nt, Homo sapiens
ggacagaguucacauccau

SEQ ID NO: 309358 - RNA, 19 nt, Homo sapiens
gcucaacauugccugaaua

SEQ ID NO: 309359 - RNA, 19 nt, Homo sapiens
gcacuaagucgccaagaaa

SEQ ID NO: 309360 - RNA, 19 nt, Homo sapiens
gaaacugucagaaaugauu

SEQ ID NO: 309361 - RNA, 19 nt, Homo sapiens
caagguaguuccagaaaca

SEQ ID NO: 309362 - RNA, 19 nt, Homo sapiens
gcaaugccuugaaaguuug

SEQ ID NO: 309363 - RNA, 19 nt, Homo sapiens
ccaagaaauugacauggaa

SEQ ID NO: 309364 - RNA, 19 nt, Homo sapiens
aaagaggcauucagcaauu

SEQ ID NO: 309365 - RNA, 19 nt, Homo sapiens
gaccaugucuuuagaaacu

SEQ ID NO: 309366 - RNA, 19 nt, Homo sapiens
ccagaaacauaucucaaga

SEQ ID NO: 309367 - RNA, 19 nt, Homo sapiens
uauaagcaaugccuugaaa

SEQ ID NO: 309368 - RNA, 19 nt, Homo sapiens
gaacgaguguuagaagcaa

SEQ ID NO: 309369 - RNA, 19 nt, Homo sapiens
gaucacaacuuuucugcua

SEQ ID NO: 309370 - RNA, 19 nt, Homo sapiens
aaauugacauggaagauga

SEQ ID NO: 309371 - RNA, 19 nt, Homo sapiens
gaucgauccuauaaaugaa

SEQ ID NO: 309372 - RNA, 19 nt, Homo sapiens
gccaagaaauugacaugga

SEQ ID NO: 309373 - RNA, 19 nt, Homo sapiens
gguaaugugucaaagagau

SEQ ID NO: 309374 - RNA, 19 nt, Homo sapiens
gccguuggcuccagacaaa

SEQ ID NO: 309375 - RNA, 19 nt, Homo sapiens
uagaaacugucagaaauga

SEQ ID NO: 309376 - RNA, 19 nt, Homo sapiens
gaaacaagaaggcucacuu

SEQ ID NO: 309377 - RNA, 19 nt, Homo sapiens
gaccaacuccugcagauga

SEQ ID NO: 309378 - RNA, 19 nt, Homo sapiens
cuugacggguccagaauua

SEQ ID NO: 309379 - RNA, 19 nt, Homo sapiens
guucaacaguccagaguau

SEQ ID NO: 309380 - RNA, 19 nt, Homo sapiens
guaauaguggcuuucauuu

SEQ ID NO: 309381 - RNA, 19 nt, Homo sapiens
gaugaggaaauaagacuuu

SEQ ID NO: 309382 - RNA, 19 nt, Homo sapiens
gaaauugacauggaagaug

SEQ ID NO: 309383 - RNA, 19 nt, Homo sapiens
caggaagguuauucuauau

SEQ ID NO: 309384 - RNA, 19 nt, Homo sapiens
caacaggaagguuauucua

SEQ ID NO: 309385 - RNA, 19 nt, Homo sapiens
cagcagccuucuggaaaua

SEQ ID NO: 309386 - RNA, 19 nt, Homo sapiens
caacauugccugaauaacu

SEQ ID NO: 309387 - RNA, 19 nt, Homo sapiens
agcaaugccuugaaaguuu

SEQ ID NO: 309388 - RNA, 19 nt, Homo sapiens
gaaggaggaguuacuagug

SEQ ID NO: 309389 - RNA, 19 nt, Homo sapiens
uuucugagguuuagcguuu

SEQ ID NO: 309390 - RNA, 19 nt, Homo sapiens
caacuccugcagaugauua

SEQ ID NO: 309391 - RNA, 19 nt, Homo sapiens
aaacaagaaggcucacuuu

SEQ ID NO: 309392 - RNA, 19 nt, Homo sapiens
acacagacaucagguacaa

SEQ ID NO: 309393 - RNA, 19 nt, Homo sapiens
gagcaaagaguccauaaaa

SEQ ID NO: 309394 - RNA, 19 nt, Homo sapiens
ugaagauuaucgcacguuu

SEQ ID NO: 309395 - RNA, 19 nt, Homo sapiens
aauaguggcuuucauuucu

SEQ ID NO: 309396 - RNA, 19 nt, Homo sapiens
caaagaggcauucagcaau

SEQ ID NO: 309397 - RNA, 19 nt, Homo sapiens
uuucuuggcucaauuacaa

SEQ ID NO: 309398 - RNA, 19 nt, Homo sapiens
gaguuacuagugaagauua

SEQ ID NO: 309399 - RNA, 19 nt, Homo sapiens
gcagaaggaggaguuacua

SEQ ID NO: 309400 - RNA, 19 nt, Homo sapiens
ccaaagaggcauucagcaa

SEQ ID NO: 309401 - RNA, 19 nt, Homo sapiens
gacaucagguacaaaucuu

SEQ ID NO: 309402 - RNA, 19 nt, Homo sapiens
ggcacuaagucgccaagaa

SEQ ID NO: 309403 - RNA, 19 nt, Homo sapiens
gagaagaauuagcacaacu

SEQ ID NO: 309404 - RNA, 19 nt, Homo sapiens
caacagaugcaucgaccaa

SEQ ID NO: 309405 - RNA, 19 nt, Homo sapiens
aagaggcauucagcaauua

SEQ ID NO: 309406 - RNA, 19 nt, Homo sapiens
ccagacaaauaaacaugga

SEQ ID NO: 309407 - RNA, 19 nt, Homo sapiens
gaaaggccagccaccaguu

SEQ ID NO: 309408 - RNA, 19 nt, Homo sapiens
gaggagaggaugagaaugg

SEQ ID NO: 309409 - RNA, 19 nt, Homo sapiens
uaguggcuuucauuucuua

SEQ ID NO: 309410 - RNA, 19 nt, Homo sapiens
ccacuuugguaauguguca

SEQ ID NO: 309411 - RNA, 19 nt, Homo sapiens
ccaacauuauccuguguga

SEQ ID NO: 309412 - RNA, 19 nt, Homo sapiens
gugaccaugucuuuagaaa

SEQ ID NO: 309413 - RNA, 19 nt, Homo sapiens
aaugauggcucaggaaugu

SEQ ID NO: 309414 - RNA, 19 nt, Homo sapiens
caaacaaaaugaugggaaa

SEQ ID NO: 309415 - RNA, 19 nt, Homo sapiens
gcaaaugauggcucaggaa

SEQ ID NO: 309416 - RNA, 19 nt, Homo sapiens
gcaaagaguccauaaaaca

SEQ ID NO: 309417 - RNA, 19 nt, Homo sapiens
uauaaggaacacugguuua

SEQ ID NO: 309418 - RNA, 19 nt, Homo sapiens
aaggaggaguuacuaguga

SEQ ID NO: 309419 - RNA, 19 nt, Homo sapiens
cagcauaggguccacuuug

SEQ ID NO: 309420 - RNA, 19 nt, Homo sapiens
acauuauccugugugauua

SEQ ID NO: 309421 - RNA, 19 nt, Homo sapiens
ggagaagaauuagcacaac

SEQ ID NO: 309422 - RNA, 19 nt, Homo sapiens
uuugcagacuagcuaauua

SEQ ID NO: 309423 - RNA, 19 nt, Homo sapiens
gcaagguaguuccagaaac

SEQ ID NO: 309424 - RNA, 19 nt, Homo sapiens
cagcuaaguaugcaaggua

SEQ ID NO: 309425 - RNA, 19 nt, Homo sapiens
ugacauggaagaugaggaa

SEQ ID NO: 309426 - RNA, 19 nt, Homo sapiens
aacauugccugaauaacuu

SEQ ID NO: 309427 - RNA, 19 nt, Homo sapiens
gcccuacgaugggaucauu

SEQ ID NO: 309428 - RNA, 19 nt, Homo sapiens
uaacuuauugcaaggagaa

SEQ ID NO: 309429 - RNA, 19 nt, Homo sapiens
ggaccuaucaggacagagu

SEQ ID NO: 309430 - RNA, 19 nt, Homo sapiens
ugauggcucaggaauguua

SEQ ID NO: 309431 - RNA, 19 nt, Homo sapiens
guccagaauuaauaucaga

SEQ ID NO: 309432 - RNA, 19 nt, Homo sapiens
gcagccuucuggaaauaug

SEQ ID NO: 309433 - RNA, 19 nt, Homo sapiens
aguaaugguucuagaagga

SEQ ID NO: 309434 - RNA, 19 nt, Homo sapiens
guagguaaguuggcucaca

SEQ ID NO: 309435 - RNA, 19 nt, Homo sapiens
aacauuauccugugugauu

SEQ ID NO: 309436 - RNA, 19 nt, Homo sapiens
caaaugauggcucaggaau

SEQ ID NO: 309437 - RNA, 19 nt, Homo sapiens
gacggguccagaauuaaua

SEQ ID NO: 309438 - RNA, 19 nt, Homo sapiens
gugcguuccuaaacucuga

SEQ ID NO: 309439 - RNA, 19 nt, Homo sapiens
acgaugggaucauuauuuc

SEQ ID NO: 309440 - RNA, 19 nt, Homo sapiens
cuacuuuccugauguugau

SEQ ID NO: 309441 - RNA, 19 nt, Homo sapiens
guuguaggacuaaauaaug

SEQ ID NO: 309442 - RNA, 19 nt, Homo sapiens
cauaggguccacuuuggua

SEQ ID NO: 309443 - RNA, 19 nt, Homo sapiens
cuauucagguuauaagcaa

SEQ ID NO: 309444 - RNA, 19 nt, Homo sapiens
uacgaugggaucauuauuu

SEQ ID NO: 309445 - RNA, 19 nt, Homo sapiens
cuaagucgccaagaaauug

SEQ ID NO: 309446 - RNA, 19 nt, Homo sapiens
agacgaagaugaggaggau

SEQ ID NO: 309447 - RNA, 19 nt, Homo sapiens
agaccuggaacgaguguua

SEQ ID NO: 309448 - RNA, 19 nt, Homo sapiens
gaugggaucauuauuucau

SEQ ID NO: 309449 - RNA, 19 nt, Homo sapiens
uguaauaguggcuuucauu

SEQ ID NO: 309450 - RNA, 19 nt, Homo sapiens
guacaaaucuuacuucaga

SEQ ID NO: 309451 - RNA, 19 nt, Homo sapiens
ucaaagagaugaggaaaua

SEQ ID NO: 309452 - RNA, 19 nt, Homo sapiens
gaaacagccuucuggaaau

SEQ ID NO: 309453 - RNA, 19 nt, Homo sapiens
caaauuaaccuuucaggaa

SEQ ID NO: 309454 - RNA, 19 nt, Homo sapiens
acaggaagguuauucuaua

SEQ ID NO: 309455 - RNA, 19 nt, Homo sapiens
uaacuugaauucucucuug

SEQ ID NO: 309456 - RNA, 19 nt, Homo sapiens
uaaguuggcucacaucaug

SEQ ID NO: 309457 - RNA, 19 nt, Homo sapiens
ggacagaguucacauccau

SEQ ID NO: 309458 - RNA, 19 nt, Homo sapiens
gcacuaagucgccaagaaa

SEQ ID NO: 309459 - RNA, 19 nt, Homo sapiens
gaaacugucagaaaugauu

SEQ ID NO: 309460 - RNA, 19 nt, Homo sapiens
caagguaguuccagaaaca

SEQ ID NO: 309461 - RNA, 19 nt, Homo sapiens
gcaaugccuugaaaguuug

SEQ ID NO: 309462 - RNA, 19 nt, Homo sapiens
aaacagccuucuggaaaua

SEQ ID NO: 309463 - RNA, 19 nt, Homo sapiens
ccaagaaauugacauggaa

SEQ ID NO: 309464 - RNA, 19 nt, Homo sapiens
aaagaggcauucagcaauu

SEQ ID NO: 309465 - RNA, 19 nt, Homo sapiens
gaccaugucuuuagaaacu

SEQ ID NO: 309466 - RNA, 19 nt, Homo sapiens
ccagaaacauaucucaaga

SEQ ID NO: 309467 - RNA, 19 nt, Homo sapiens
uauaagcaaugccuugaaa

SEQ ID NO: 309468 - RNA, 19 nt, Homo sapiens
gaacgaguguuagaagcaa

SEQ ID NO: 309469 - RNA, 19 nt, Homo sapiens
gaucacaacuuuucugcua

SEQ ID NO: 309470 - RNA, 19 nt, Homo sapiens
aaauugacauggaagauga

SEQ ID NO: 309471 - RNA, 19 nt, Homo sapiens
gaucgauccuauaaaugaa

SEQ ID NO: 309472 - RNA, 19 nt, Homo sapiens
gccaagaaauugacaugga

SEQ ID NO: 309473 - RNA, 19 nt, Homo sapiens
gguaaugugucaaagagau

SEQ ID NO: 309474 - RNA, 19 nt, Homo sapiens
gccguuggcuccagacaaa

SEQ ID NO: 309475 - RNA, 19 nt, Homo sapiens
uagaaacugucagaaauga

SEQ ID NO: 309476 - RNA, 19 nt, Homo sapiens
gaccaacuccugcagauga

SEQ ID NO: 309477 - RNA, 19 nt, Homo sapiens
cuugacggguccagaauua

SEQ ID NO: 309478 - RNA, 19 nt, Homo sapiens
guucaacaguccagaguau

SEQ ID NO: 309479 - RNA, 19 nt, Homo sapiens
guaauaguggcuuucauuu

SEQ ID NO: 309480 - RNA, 19 nt, Homo sapiens
gaugaggaaauaagacuuu

SEQ ID NO: 309481 - RNA, 19 nt, Homo sapiens
gaaauugacauggaagaug

SEQ ID NO: 309482 - RNA, 19 nt, Homo sapiens
caggaagguuauucuauau

SEQ ID NO: 309483 - RNA, 19 nt, Homo sapiens
caacaggaagguuauucua

SEQ ID NO: 309484 - RNA, 19 nt, Homo sapiens
agcaaugccuugaaaguuu

SEQ ID NO: 309485 - RNA, 19 nt, Homo sapiens
uuucugagguuuagcguuu

SEQ ID NO: 309486 - RNA, 19 nt, Homo sapiens
caacuccugcagaugauua

SEQ ID NO: 309487 - RNA, 19 nt, Homo sapiens
acacagacaucagguacaa

SEQ ID NO: 309488 - RNA, 19 nt, Homo sapiens
gagcaaagaguccauaaaa

SEQ ID NO: 309489 - RNA, 19 nt, Homo sapiens
aauaguggcuuucauuucu

SEQ ID NO: 309490 - RNA, 19 nt, Homo sapiens
caaagaggcauucagcaau

SEQ ID NO: 309491 - RNA, 19 nt, Homo sapiens
uuucuuggcucaauuacaa

SEQ ID NO: 309492 - RNA, 19 nt, Homo sapiens
ccaaagaggcauucagcaa

SEQ ID NO: 309493 - RNA, 19 nt, Homo sapiens
gacaucagguacaaaucuu

SEQ ID NO: 309494 - RNA, 19 nt, Homo sapiens
ggcacuaagucgccaagaa

SEQ ID NO: 309495 - RNA, 19 nt, Homo sapiens
gagaagaauuagcacaacu

SEQ ID NO: 309496 - RNA, 19 nt, Homo sapiens
caacagaugcaucgaccaa

SEQ ID NO: 309497 - RNA, 19 nt, Homo sapiens
aagaggcauucagcaauua

SEQ ID NO: 309498 - RNA, 19 nt, Homo sapiens
gaaaggccagccaccaguu

SEQ ID NO: 309499 - RNA, 19 nt, Homo sapiens
ccagacaaauaaacaugga

SEQ ID NO: 309500 - RNA, 19 nt, Homo sapiens
uaguggcuuucauuucuua

SEQ ID NO: 309501 - RNA, 19 nt, Homo sapiens
ccacuuugguaauguguca

SEQ ID NO: 309502 - RNA, 19 nt, Homo sapiens
ccaacauuauccuguguga

SEQ ID NO: 309503 - RNA, 19 nt, Homo sapiens
gugaccaugucuuuagaaa

SEQ ID NO: 309504 - RNA, 19 nt, Homo sapiens
aaugauggcucaggaaugu

SEQ ID NO: 309505 - RNA, 19 nt, Homo sapiens
caaacaaaaugaugggaaa

SEQ ID NO: 309506 - RNA, 19 nt, Homo sapiens
gcaaaugauggcucaggaa

SEQ ID NO: 309507 - RNA, 19 nt, Homo sapiens
gcaaagaguccauaaaaca

SEQ ID NO: 309508 - RNA, 19 nt, Homo sapiens
uauaaggaacacugguuua

SEQ ID NO: 309509 - RNA, 19 nt, Homo sapiens
cagcauaggguccacuuug

SEQ ID NO: 309510 - RNA, 19 nt, Homo sapiens
acauuauccugugugauua

SEQ ID NO: 309511 - RNA, 19 nt, Homo sapiens
ggagaagaauuagcacaac

SEQ ID NO: 309512 - RNA, 19 nt, Homo sapiens
uuugcagacuagcuaauua

SEQ ID NO: 309513 - RNA, 19 nt, Homo sapiens
gcaagguaguuccagaaac

SEQ ID NO: 309514 - RNA, 19 nt, Homo sapiens
cagcuaaguaugcaaggua

SEQ ID NO: 309515 - RNA, 19 nt, Homo sapiens
ugacauggaagaugaggaa

SEQ ID NO: 309516 - RNA, 19 nt, Homo sapiens
gcccuacgaugggaucauu

SEQ ID NO: 309517 - RNA, 19 nt, Homo sapiens
ggaccuaucaggacagagu

SEQ ID NO: 309518 - RNA, 19 nt, Homo sapiens
ugauggcucaggaauguua

SEQ ID NO: 309519 - RNA, 19 nt, Homo sapiens
guccagaauuaauaucaga

SEQ ID NO: 309520 - RNA, 19 nt, Homo sapiens
aguaaugguucuagaagga

SEQ ID NO: 309521 - RNA, 19 nt, Homo sapiens
guagguaaguuggcucaca

SEQ ID NO: 309522 - RNA, 19 nt, Homo sapiens
aacauuauccugugugauu

SEQ ID NO: 309523 - RNA, 19 nt, Homo sapiens
caaaugauggcucaggaau

SEQ ID NO: 309524 - RNA, 19 nt, Homo sapiens
gacggguccagaauuaaua

SEQ ID NO: 309525 - RNA, 19 nt, Homo sapiens
gugcguuccuaaacucuga

SEQ ID NO: 309526 - RNA, 19 nt, Homo sapiens
acgaugggaucauuauuuc

SEQ ID NO: 309527 - RNA, 19 nt, Homo sapiens
cuacuuuccugauguugau

SEQ ID NO: 309528 - RNA, 19 nt, Homo sapiens
guuguaggacuaaauaaug

SEQ ID NO: 309529 - RNA, 19 nt, Homo sapiens
cauaggguccacuuuggua

SEQ ID NO: 309530 - RNA, 19 nt, Homo sapiens
cuauucagguuauaagcaa

SEQ ID NO: 309531 - RNA, 19 nt, Homo sapiens
uacgaugggaucauuauuu

SEQ ID NO: 309532 - RNA, 19 nt, Homo sapiens
cuaagucgccaagaaauug

SEQ ID NO: 309533 - RNA, 19 nt, Homo sapiens
agacgaagaugaggaggau

SEQ ID NO: 309534 - RNA, 19 nt, Homo sapiens
agaccuggaacgaguguua

SEQ ID NO: 309535 - RNA, 19 nt, Homo sapiens
gaugggaucauuauuucau

SEQ ID NO: 309536 - RNA, 19 nt, Homo sapiens
uguaauaguggcuuucauu

SEQ ID NO: 309537 - RNA, 19 nt, Homo sapiens
cagcugugaccaugucuuu

SEQ ID NO: 309538 - RNA, 19 nt, Homo sapiens
ugaucuaggugaugcuaug

SEQ ID NO: 309539 - RNA, 19 nt, Homo sapiens
ggaacgaguguuagaagca

SEQ ID NO: 309540 - RNA, 19 nt, Homo sapiens
ugaaaucagccuugcacaa

SEQ ID NO: 309541 - RNA, 19 nt, Homo sapiens
caagauaugacacagacau

SEQ ID NO: 309542 - RNA, 19 nt, Homo sapiens
cauggaagaugaggaagca

SEQ ID NO: 309543 - RNA, 19 nt, Homo sapiens
gaauguuagacgaagauga

SEQ ID NO: 309544 - RNA, 19 nt, Homo sapiens
agaagaauuagcacaacua

SEQ ID NO: 309545 - RNA, 19 nt, Homo sapiens
uaucucuacuuuccugaug

SEQ ID NO: 309546 - RNA, 19 nt, Homo sapiens
gcugugaccaugucuuuag

SEQ ID NO: 309547 - RNA, 19 nt, Homo sapiens
uaauaguggcuuucauuuc

SEQ ID NO: 309548 - RNA, 19 nt, Homo sapiens
ccaaauauuagccaaagag

SEQ ID NO: 309549 - RNA, 19 nt, Homo sapiens
gguuuaacuugaauucucu

SEQ ID NO: 309550 - RNA, 19 nt, Homo sapiens
gcacaaagcuugguuauaa

SEQ ID NO: 309551 - RNA, 19 nt, Homo sapiens
gaaaguaggugugaaagaa

SEQ ID NO: 309552 - RNA, 19 nt, Homo sapiens
gaaaguaggugugaaagaa

SEQ ID NO: 309553 - RNA, 19 nt, Homo sapiens
gaaagcagauguagaggaa

SEQ ID NO: 309554 - RNA, 19 nt, Homo sapiens
ccuaagaccugaacuauuu

SEQ ID NO: 309555 - RNA, 19 nt, Homo sapiens
ggagagaucugacaaauac

SEQ ID NO: 309556 - RNA, 19 nt, Homo sapiens
gaauggagcuuacaagauc

SEQ ID NO: 309557 - RNA, 19 nt, Homo sapiens
gaaguucacagucaauuua

SEQ ID NO: 309558 - RNA, 19 nt, Homo sapiens
gaacaccacuucuacacaa

SEQ ID NO: 309559 - RNA, 19 nt, Homo sapiens
caaagaggaacacaaauua

SEQ ID NO: 309560 - RNA, 19 nt, Homo sapiens
gaacuccagugcagaaauu

SEQ ID NO: 309561 - RNA, 19 nt, Homo sapiens
gaaaaucucucuuccaaaa

SEQ ID NO: 309562 - RNA, 19 nt, Homo sapiens
ucaagaagcuccaagcaaa

SEQ ID NO: 309563 - RNA, 19 nt, Homo sapiens
agaaagugcugaugguuua

SEQ ID NO: 309564 - RNA, 19 nt, Homo sapiens
guaaaugggucuguuauug

SEQ ID NO: 309565 - RNA, 19 nt, Homo sapiens
gaacaaauacccacccauu

SEQ ID NO: 309566 - RNA, 19 nt, Homo sapiens
gcagaaaugugcaccaaug

SEQ ID NO: 309567 - RNA, 19 nt, Homo sapiens
caagugaauuuccauguaa

SEQ ID NO: 309568 - RNA, 19 nt, Homo sapiens
ggaaggaagucaacugaau

SEQ ID NO: 309569 - RNA, 19 nt, Homo sapiens
gaaacuaagccacuaauug

SEQ ID NO: 309570 - RNA, 19 nt, Homo sapiens
gaaaguggacguagaagaa

SEQ ID NO: 309571 - RNA, 19 nt, Homo sapiens
aaagaaauuuccagcguua

SEQ ID NO: 309572 - RNA, 19 nt, Homo sapiens
cacaggagauguccaauaa

SEQ ID NO: 309573 - RNA, 19 nt, Homo sapiens
gaacagcaacgacaugaaa

SEQ ID NO: 309574 - RNA, 19 nt, Homo sapiens
gaaagucucugguaaugca

SEQ ID NO: 309575 - RNA, 19 nt, Homo sapiens
gaacacaaauuacaagacu

SEQ ID NO: 309576 - RNA, 19 nt, Homo sapiens
caacaaagaggaacacaaa

SEQ ID NO: 309577 - RNA, 19 nt, Homo sapiens
auacagaacucaugaaaga

SEQ ID NO: 309578 - RNA, 19 nt, Homo sapiens
ggagauguccaauaaagua

SEQ ID NO: 309579 - RNA, 19 nt, Homo sapiens
ggaauauucuguuuaguag

SEQ ID NO: 309580 - RNA, 19 nt, Homo sapiens
ggagccaggugacaucaua

SEQ ID NO: 309581 - RNA, 19 nt, Homo sapiens
ggaaagugcccaagccaua

SEQ ID NO: 309582 - RNA, 19 nt, Homo sapiens
gaagaaaccaaacccagua

SEQ ID NO: 309583 - RNA, 19 nt, Homo sapiens
gaaacgaacaccaucagua

SEQ ID NO: 309584 - RNA, 19 nt, Homo sapiens
agaaagacaucaacacauu

SEQ ID NO: 309585 - RNA, 19 nt, Homo sapiens
gaccugaacuauuugauga

SEQ ID NO: 309586 - RNA, 19 nt, Homo sapiens
gcugagaacucguaaggaa

SEQ ID NO: 309587 - RNA, 19 nt, Homo sapiens
ccaggaagcuuucaacuag

SEQ ID NO: 309588 - RNA, 19 nt, Homo sapiens
gaaagaaagugcugauggu

SEQ ID NO: 309589 - RNA, 19 nt, Homo sapiens
gcagucaaguucacacaaa

SEQ ID NO: 309590 - RNA, 19 nt, Homo sapiens
ggaagaggcccaaucacua

SEQ ID NO: 309591 - RNA, 19 nt, Homo sapiens
gagcuugccugauacagaa

SEQ ID NO: 309592 - RNA, 19 nt, Homo sapiens
ggaagaucuuucaggaaua

SEQ ID NO: 309593 - RNA, 19 nt, Homo sapiens
gaagaaagaguuggaugua

SEQ ID NO: 309594 - RNA, 19 nt, Homo sapiens
ccaagugaauuuccaugua

SEQ ID NO: 309595 - RNA, 19 nt, Homo sapiens
ggaguggaauauucuguuu

SEQ ID NO: 309596 - RNA, 19 nt, Homo sapiens
gcaaaucuccgcaaucaga

SEQ ID NO: 309597 - RNA, 19 nt, Homo sapiens
caaaguagccugcaaaucu

SEQ ID NO: 309598 - RNA, 19 nt, Homo sapiens
ggucuuaguucaguugaua

SEQ ID NO: 309599 - RNA, 19 nt, Homo sapiens
gaauuuccauguaauagga

SEQ ID NO: 309600 - RNA, 19 nt, Homo sapiens
gaagaaaacuuuggauuug

SEQ ID NO: 309601 - RNA, 19 nt, Homo sapiens
ggacguagaagaagaauuc

SEQ ID NO: 309602 - RNA, 19 nt, Homo sapiens
caagacaccuuuggagaaa

SEQ ID NO: 309603 - RNA, 19 nt, Homo sapiens
caagagaaguaucaggaaa

SEQ ID NO: 309604 - RNA, 19 nt, Homo sapiens
ugacagaccucaagagcuu

SEQ ID NO: 309605 - RNA, 19 nt, Homo sapiens
guggaagaguuguaaauuu

SEQ ID NO: 309606 - RNA, 19 nt, Homo sapiens
ccagaaaucuugcugaagu

SEQ ID NO: 309607 - RNA, 19 nt, Homo sapiens
agaccuagcuggcuucaaa

SEQ ID NO: 309608 - RNA, 19 nt, Homo sapiens
gaaagcagacguagaggaa

SEQ ID NO: 309609 - RNA, 19 nt, Homo sapiens
agaaagacaugaaagcauu

SEQ ID NO: 309610 - RNA, 19 nt, Homo sapiens
gaaagcagacguagaggaa

SEQ ID NO: 309611 - RNA, 19 nt, Homo sapiens
agacuuggcuggcuugaaa

SEQ ID NO: 309612 - RNA, 19 nt, Homo sapiens
gaaagcagacguagaggaa

SEQ ID NO: 309613 - RNA, 19 nt, Homo sapiens
agaaagaguuggauguaaa

SEQ ID NO: 309614 - RNA, 19 nt, Homo sapiens
caagugaauucuguaagua

SEQ ID NO: 309615 - RNA, 19 nt, Homo sapiens
gaaaggagaagcaggaaau

SEQ ID NO: 309616 - RNA, 19 nt, Homo sapiens
gaaagcagacacugaagaa

SEQ ID NO: 309617 - RNA, 19 nt, Homo sapiens
cgagaaaacuaccaaaaua

SEQ ID NO: 309618 - RNA, 19 nt, Homo sapiens
aggaauagcugaaauguuc

SEQ ID NO: 309619 - RNA, 19 nt, Homo sapiens
ucaagaaugucaaagaaga

SEQ ID NO: 309620 - RNA, 19 nt, Homo sapiens
aaacuaagccacuaauuga

SEQ ID NO: 309621 - RNA, 19 nt, Homo sapiens
gcuacaaacucguaaggaa

SEQ ID NO: 309622 - RNA, 19 nt, Homo sapiens
ggaacagccucaaccauca

SEQ ID NO: 309623 - RNA, 19 nt, Homo sapiens
acaaagaccuguauacuac

SEQ ID NO: 309624 - RNA, 19 nt, Homo sapiens
gugaugaaauggucuuaaa

SEQ ID NO: 309625 - RNA, 19 nt, Homo sapiens
ggacgcagaagauguaauu

SEQ ID NO: 309626 - RNA, 19 nt, Homo sapiens
ggaccagccaggaaauuua

SEQ ID NO: 309627 - RNA, 19 nt, Homo sapiens
agaaagacaucaacacguu

SEQ ID NO: 309628 - RNA, 19 nt, Homo sapiens
caacuuuggugauuccauu

SEQ ID NO: 309629 - RNA, 19 nt, Homo sapiens
gaagaauccuuagcacuca

SEQ ID NO: 309630 - RNA, 19 nt, Homo sapiens
guaagagcaugaaagcauu

SEQ ID NO: 309631 - RNA, 19 nt, Homo sapiens
gcacacgccuaaaccauca

SEQ ID NO: 309632 - RNA, 19 nt, Homo sapiens
caagaacgccuaaggaaga

SEQ ID NO: 309633 - RNA, 19 nt, Homo sapiens
gcaaugaagagaucaagaa

SEQ ID NO: 309634 - RNA, 19 nt, Homo sapiens
gaagucaacugaauuucca

SEQ ID NO: 309635 - RNA, 19 nt, Homo sapiens
aauaggacauucccauuaa

SEQ ID NO: 309636 - RNA, 19 nt, Homo sapiens
ggaccugguuggcuucaaa

SEQ ID NO: 309637 - RNA, 19 nt, Homo sapiens
caagagaagccucaagaaa

SEQ ID NO: 309638 - RNA, 19 nt, Homo sapiens
gcacaaagcaauggccuaa

SEQ ID NO: 309639 - RNA, 19 nt, Homo sapiens
gaagaucuuucaggaauag

SEQ ID NO: 309640 - RNA, 19 nt, Homo sapiens
gauaaguucuagugcaguu

SEQ ID NO: 309641 - RNA, 19 nt, Homo sapiens
uggaagaguuguaaauuug

SEQ ID NO: 309642 - RNA, 19 nt, Homo sapiens
gaauugaaccugcggaaga

SEQ ID NO: 309643 - RNA, 19 nt, Homo sapiens
uagaagaccugguugacuu

SEQ ID NO: 309644 - RNA, 19 nt, Homo sapiens
caucaaagcguuuaaggaa

SEQ ID NO: 309645 - RNA, 19 nt, Homo sapiens
ggccaaggcucuagaagau

SEQ ID NO: 309646 - RNA, 19 nt, Homo sapiens
gccacaaacuccuaaagaa

SEQ ID NO: 309647 - RNA, 19 nt, Homo sapiens
gagaaagacaucaucauau

SEQ ID NO: 309648 - RNA, 19 nt, Homo sapiens
gaagcuaccuguggaaagu

SEQ ID NO: 309649 - RNA, 19 nt, Homo sapiens
cuacagaguucaggaauau

SEQ ID NO: 309650 - RNA, 19 nt, Homo sapiens
gcaaguaccucauaagaaa

SEQ ID NO: 309651 - RNA, 19 nt, Homo sapiens
ggacccagcuuuaacuuua

SEQ ID NO: 309652 - RNA, 19 nt, Homo sapiens
acacaagguucauuacuua

SEQ ID NO: 309653 - RNA, 19 nt, Homo sapiens
gcaggaauuugacuuguaa

SEQ ID NO: 309654 - RNA, 19 nt, Homo sapiens
gaagauaaccguccaggaa

SEQ ID NO: 309655 - RNA, 19 nt, Homo sapiens
cgaaaggccugcuauaguu

SEQ ID NO: 309656 - RNA, 19 nt, Homo sapiens
gaaagacucugggaugguu

SEQ ID NO: 309657 - RNA, 19 nt, Homo sapiens
caguaaagcugcagugauu

SEQ ID NO: 309658 - RNA, 19 nt, Homo sapiens
gcaaaucucugaaaaguga

SEQ ID NO: 309659 - RNA, 19 nt, Homo sapiens
ggcaucagcucuauucaaa

SEQ ID NO: 309660 - RNA, 19 nt, Homo sapiens
gaacagcaaaucucugaaa

SEQ ID NO: 309661 - RNA, 19 nt, Homo sapiens
ggaggcaaaucuacacauu

SEQ ID NO: 309662 - RNA, 19 nt, Homo sapiens
cauccaauguuaacagaua

SEQ ID NO: 309663 - RNA, 19 nt, Homo sapiens
aaagaaacauucaccuuga

SEQ ID NO: 309664 - RNA, 19 nt, Homo sapiens
gaagaaccauguccaaggu

SEQ ID NO: 309665 - RNA, 19 nt, Homo sapiens
gagaaccaguggacaugua

SEQ ID NO: 309666 - RNA, 19 nt, Homo sapiens
caacacaacuauacagaag

SEQ ID NO: 309667 - RNA, 19 nt, Homo sapiens
guaaauuucuuuccugaca

SEQ ID NO: 309668 - RNA, 19 nt, Homo sapiens
gaaugaaauacacgucuua

SEQ ID NO: 309669 - RNA, 19 nt, Homo sapiens
gaucacaccuaugcucaaa

SEQ ID NO: 309670 - RNA, 19 nt, Homo sapiens
cgaaauugguguuugauca

SEQ ID NO: 309671 - RNA, 19 nt, Homo sapiens
cagcaugacuccuccuaaa

SEQ ID NO: 309672 - RNA, 19 nt, Homo sapiens
gaacuuaguggcauugaug

SEQ ID NO: 309673 - RNA, 19 nt, Homo sapiens
gauguucccuugucgauuc

SEQ ID NO: 309674 - RNA, 19 nt, Homo sapiens
guuaugauguggacucuga

SEQ ID NO: 309675 - RNA, 19 nt, Homo sapiens
ccaccuaccuucccgagaa

SEQ ID NO: 309676 - RNA, 19 nt, Homo sapiens
gcuuucaacugucaaugua

SEQ ID NO: 309677 - RNA, 19 nt, Homo sapiens
gcuauucgccuuugccuaa

SEQ ID NO: 309678 - RNA, 19 nt, Homo sapiens
gauuggacacugcauguua

SEQ ID NO: 309679 - RNA, 19 nt, Homo sapiens
uaaaauaguuccacucuug

SEQ ID NO: 309680 - RNA, 19 nt, Homo sapiens
caucagcucuauucaaauc

SEQ ID NO: 309681 - RNA, 19 nt, Homo sapiens
gguauacuuuccaguuaaa

SEQ ID NO: 309682 - RNA, 19 nt, Homo sapiens
acacagagagcaacuauug

SEQ ID NO: 309683 - RNA, 19 nt, Homo sapiens
ggacaaaccaaaugaccaa

SEQ ID NO: 309684 - RNA, 19 nt, Homo sapiens
ucacaccuaugcucaaaga

SEQ ID NO: 309685 - RNA, 19 nt, Homo sapiens
gaagaagaaccauguccaa

SEQ ID NO: 309686 - RNA, 19 nt, Homo sapiens
ggcaggaauuugacuugua

SEQ ID NO: 309687 - RNA, 19 nt, Homo sapiens
gaauauaagccacgaugga

SEQ ID NO: 309688 - RNA, 19 nt, Homo sapiens
guauaucagucaacaggaa

SEQ ID NO: 309689 - RNA, 19 nt, Homo sapiens
caaguaccgugaacaggaa

SEQ ID NO: 309690 - RNA, 19 nt, Homo sapiens
cagaauaucacauuuggaa

SEQ ID NO: 309691 - RNA, 19 nt, Homo sapiens
ugaugauccugauauagua

SEQ ID NO: 309692 - RNA, 19 nt, Homo sapiens
gaaauacacgucuuaucug

SEQ ID NO: 309693 - RNA, 19 nt, Homo sapiens
caaaccaaaugaccaaucu

SEQ ID NO: 309694 - RNA, 19 nt, Homo sapiens
cuuaaccgaucacaaguuu

SEQ ID NO: 309695 - RNA, 19 nt, Homo sapiens
ucagucaacaggaauauaa

SEQ ID NO: 309696 - RNA, 19 nt, Homo sapiens
ccaaagaugagauuagaug

SEQ ID NO: 309697 - RNA, 19 nt, Homo sapiens
aaugauggcuuguucaauc

SEQ ID NO: 309698 - RNA, 19 nt, Homo sapiens
ugaaauacacgucuuaucu

SEQ ID NO: 309699 - RNA, 19 nt, Homo sapiens
ggccgaaauugguguuuga

SEQ ID NO: 309700 - RNA, 19 nt, Homo sapiens
cagagacuguuucuuuguu

SEQ ID NO: 309701 - RNA, 19 nt, Homo sapiens
caucugguauguugaacuu

SEQ ID NO: 309702 - RNA, 19 nt, Homo sapiens
cuacggugcugacaagaug

SEQ ID NO: 309703 - RNA, 19 nt, Homo sapiens
gauguggacucugaucaug

SEQ ID NO: 309704 - RNA, 19 nt, Homo sapiens
ggauacugcugcugaugga

SEQ ID NO: 309705 - RNA, 19 nt, Homo sapiens
cauugaugauccugauaua

SEQ ID NO: 309706 - RNA, 19 nt, Homo sapiens
guaaagcugcagugauuga

SEQ ID NO: 309707 - RNA, 19 nt, Homo sapiens
gagacuguuucuuuguuug

SEQ ID NO: 309708 - RNA, 19 nt, Homo sapiens
aaccuugucucaacuggua

SEQ ID NO: 309709 - RNA, 19 nt, Homo sapiens
gaucaagcugcaaaggaua

SEQ ID NO: 309710 - RNA, 19 nt, Homo sapiens
uguggacucugaucaugua

SEQ ID NO: 309711 - RNA, 19 nt, Homo sapiens
caacugguauagcaaguac

SEQ ID NO: 309712 - RNA, 19 nt, Homo sapiens
gcauugcaaguaccucaua

SEQ ID NO: 309713 - RNA, 19 nt, Homo sapiens
uacacaagguucauuacuu

SEQ ID NO: 309714 - RNA, 19 nt, Homo sapiens
uaucuggacucagcaaaga

SEQ ID NO: 309715 - RNA, 19 nt, Homo sapiens
gacaggauuuacacagaga

SEQ ID NO: 309716 - RNA, 19 nt, Homo sapiens
gauauucaacggaggcaaa

SEQ ID NO: 309717 - RNA, 19 nt, Homo sapiens
ccaguggcuuaaagaauga

SEQ ID NO: 309718 - RNA, 19 nt, Homo sapiens
aagagucacuggacacaga

SEQ ID NO: 309719 - RNA, 19 nt, Homo sapiens
ucacugaaguuguguagac

SEQ ID NO: 309720 - RNA, 19 nt, Homo sapiens
ccaaaugaccaaucuucaa

SEQ ID NO: 309721 - RNA, 19 nt, Homo sapiens
gauccagaacugaaugaaa

SEQ ID NO: 309722 - RNA, 19 nt, Homo sapiens
gcauguuauuccacucaaa

SEQ ID NO: 309723 - RNA, 19 nt, Homo sapiens
ugacauugauacaaacaca

SEQ ID NO: 309724 - RNA, 19 nt, Homo sapiens
ugaaaaggcuguaaaugau

SEQ ID NO: 309725 - RNA, 19 nt, Homo sapiens
uugguauacuuuccaguua

SEQ ID NO: 309726 - RNA, 19 nt, Homo sapiens
ugaucaagcugcaaaggau

SEQ ID NO: 309727 - RNA, 19 nt, Homo sapiens
ugaaugaaauacacgucuu

SEQ ID NO: 309728 - RNA, 19 nt, Homo sapiens
gguuauugauguccaaaca

SEQ ID NO: 309729 - RNA, 19 nt, Homo sapiens
gcauugaugauccugauau

SEQ ID NO: 309730 - RNA, 19 nt, Homo sapiens
uuuagcaucugguauguug

SEQ ID NO: 309731 - RNA, 19 nt, Homo sapiens
uccaguggcuuaaagaaug

SEQ ID NO: 309732 - RNA, 19 nt, Homo sapiens
gcuaauaaagugaaauugg

SEQ ID NO: 309733 - RNA, 19 nt, Homo sapiens
ucagcucuuugacaccuua

SEQ ID NO: 309734 - RNA, 19 nt, Homo sapiens
gcucgaaaggccugcuaua

SEQ ID NO: 309735 - RNA, 19 nt, Homo sapiens
gagagcaacuauugaucca

SEQ ID NO: 309736 - RNA, 19 nt, Homo sapiens
uaucagauggcaacaagaa

SEQ ID NO: 309737 - RNA, 19 nt, Homo sapiens
gaaauugguguuugaucau

SEQ ID NO: 309738 - RNA, 19 nt, Homo sapiens
agagacuguuucuuuguuu

SEQ ID NO: 309739 - RNA, 19 nt, Homo sapiens
caaaugaccaaucuucaag

SEQ ID NO: 309740 - RNA, 19 nt, Homo sapiens
gcgaggaguugauugaaaa

SEQ ID NO: 309741 - RNA, 19 nt, Homo sapiens
gaaaggccugcuauaguuc

SEQ ID NO: 309742 - RNA, 19 nt, Homo sapiens
cccaucagcuuguauacga

SEQ ID NO: 309743 - RNA, 19 nt, Homo sapiens
ucaguggcuuguuugcuuu

SEQ ID NO: 309744 - RNA, 19 nt, Homo sapiens
cauaugaucuacacuuuug

SEQ ID NO: 309745 - RNA, 19 nt, Homo sapiens
uaaaugauggcuuguucaa

SEQ ID NO: 309746 - RNA, 19 nt, Homo sapiens
uguaaaugauggcuuguuc

SEQ ID NO: 309747 - RNA, 19 nt, Homo sapiens
gcuguuguccaguggcuua

SEQ ID NO: 309748 - RNA, 19 nt, Homo sapiens
cacuguaacugaagaguca

SEQ ID NO: 309749 - RNA, 19 nt, Homo sapiens
gcucuuugacaccuuagua

SEQ ID NO: 309750 - RNA, 19 nt, Homo sapiens
ggaaggagaucaaauguuu

SEQ ID NO: 309751 - RNA, 19 nt, Homo sapiens
ggaagagacuugcucagua

SEQ ID NO: 309752 - RNA, 19 nt, Homo sapiens
ggagaaaccucaacaaagu

SEQ ID NO: 309753 - RNA, 19 nt, Homo sapiens
caaauggugucaaauauga

SEQ ID NO: 309754 - RNA, 19 nt, Homo sapiens
gaagagacuugcucaguau

SEQ ID NO: 309755 - RNA, 19 nt, Homo sapiens
caagaagacuggagaugaa

SEQ ID NO: 309756 - RNA, 19 nt, Homo sapiens
gguccuagcuuuauauugu

SEQ ID NO: 309757 - RNA, 19 nt, Homo sapiens
gaaagaaacuucggucaac

SEQ ID NO: 309758 - RNA, 19 nt, Homo sapiens
ggacaaacuccacaucaaa

SEQ ID NO: 309759 - RNA, 19 nt, Homo sapiens
ggaaagcaaugagagauuc

SEQ ID NO: 309760 - RNA, 19 nt, Homo sapiens
guaauaagcauaagaccaa

SEQ ID NO: 309761 - RNA, 19 nt, Homo sapiens
gaacauggaaggagaucaa

SEQ ID NO: 309762 - RNA, 19 nt, Homo sapiens
aaacuucggucaacuuuca

SEQ ID NO: 309763 - RNA, 19 nt, Homo sapiens
gaaaauaugcgacagauga

SEQ ID NO: 309764 - RNA, 19 nt, Homo sapiens
gagaaacuauaugcagaaa

SEQ ID NO: 309765 - RNA, 19 nt, Homo sapiens
ugaagguccuagcuuuaua

SEQ ID NO: 309766 - RNA, 19 nt, Homo sapiens
ucaugaagguccuagcuuu

SEQ ID NO: 309767 - RNA, 19 nt, Homo sapiens
uaauggugcuggguaauaa

SEQ ID NO: 309768 - RNA, 19 nt, Homo sapiens
gcaacuuucuucugauauc

SEQ ID NO: 309769 - RNA, 19 nt, Homo sapiens
aaagugagguuuugaagua

SEQ ID NO: 309770 - RNA, 19 nt, Homo sapiens
gaugaggaguggcaaagug

SEQ ID NO: 309771 - RNA, 19 nt, Homo sapiens
cgacagaugauaagaaguu

SEQ ID NO: 309772 - RNA, 19 nt, Homo sapiens
caaaggcucaucugugaaa

SEQ ID NO: 309773 - RNA, 19 nt, Homo sapiens
gggacaaacuccacaucaa

SEQ ID NO: 309774 - RNA, 19 nt, Homo sapiens
gaauaaaggaaaccaggaa

SEQ ID NO: 309775 - RNA, 19 nt, Homo sapiens
caacaaaguccagccauug

SEQ ID NO: 309776 - RNA, 19 nt, Homo sapiens
auacagaugucagcucuuu

SEQ ID NO: 309777 - RNA, 19 nt, Homo sapiens
aaccaggaguucaucaaua

SEQ ID NO: 309778 - RNA, 19 nt, Homo sapiens
uggcaacuuucuucugaua

SEQ ID NO: 309779 - RNA, 19 nt, Homo sapiens
guaauggugcuggguaaua

SEQ ID NO: 309780 - RNA, 19 nt, Homo sapiens
ucaacaaaguccagccauu

SEQ ID NO: 309781 - RNA, 19 nt, Homo sapiens
agacagagccagaauguuc

SEQ ID NO: 309782 - RNA, 19 nt, Homo sapiens
ccaugcauuugauuuguuu

SEQ ID NO: 309783 - RNA, 19 nt, Homo sapiens
gaacagcaguuuugaggau

SEQ ID NO: 309784 - RNA, 19 nt, Homo sapiens
agaccaaucucuugcuguu

SEQ ID NO: 309785 - RNA, 19 nt, Homo sapiens
gagaugaaccgccaaaggu

SEQ ID NO: 309786 - RNA, 19 nt, Homo sapiens
gaagguccuagcuuuauau

SEQ ID NO: 309787 - RNA, 19 nt, Homo sapiens
caagacagagccagaaugu

SEQ ID NO: 309788 - RNA, 19 nt, Homo sapiens
ggaaacacuagaaugagaa

SEQ ID NO: 309789 - RNA, 19 nt, Homo sapiens
uuucaggccucaacucaaa

SEQ ID NO: 309790 - RNA, 19 nt, Homo sapiens
uuaaaucaguucuguccuu

SEQ ID NO: 309791 - RNA, 19 nt, Homo sapiens
aaugagagauucugacagu

SEQ ID NO: 309792 - RNA, 19 nt, Homo sapiens
gcaaugagagauucugaca

SEQ ID NO: 309793 - RNA, 19 nt, Homo sapiens
caugaagguccuagcuuua

SEQ ID NO: 309794 - RNA, 19 nt, Homo sapiens
accaaucucuugcuguuaa

SEQ ID NO: 309795 - RNA, 19 nt, Homo sapiens
cuuccucaguuaugacuua

SEQ ID NO: 309796 - RNA, 19 nt, Homo sapiens
ccucaguuaugacuuauuc

SEQ ID NO: 309797 - RNA, 19 nt, Homo sapiens
guagagggagagcucauaa

SEQ ID NO: 309798 - RNA, 19 nt, Homo sapiens
gacagaugauaagaaguuu

SEQ ID NO: 309799 - RNA, 19 nt, Homo sapiens
gggagaaaccucaacaaag

SEQ ID NO: 309800 - RNA, 19 nt, Homo sapiens
ggacgacacaaucuaggaa

SEQ ID NO: 309801 - RNA, 19 nt, Homo sapiens
gcuguuaaaucaguucugu

SEQ ID NO: 309802 - RNA, 19 nt, Homo sapiens
gaagggagaaaccucaaca

SEQ ID NO: 309803 - RNA, 19 nt, Homo sapiens
caguaucucugaugguaga

SEQ ID NO: 309804 - RNA, 19 nt, Homo sapiens
aucaaaggcucaucuguga

SEQ ID NO: 309805 - RNA, 19 nt, Homo sapiens
ugagaaguguuggccauga

SEQ ID NO: 309806 - RNA, 19 nt, Homo sapiens
gaacaagaagacuggagau

SEQ ID NO: 309807 - RNA, 19 nt, Homo sapiens
gaaaccaggaaagcaauga

SEQ ID NO: 309808 - RNA, 19 nt, Homo sapiens
ccaaauggugucaaauaug

SEQ ID NO: 309809 - RNA, 19 nt, Homo sapiens
gagccagaauguucaggau

SEQ ID NO: 309810 - RNA, 19 nt, Homo sapiens
cuuggcaacuuucuucuga

SEQ ID NO: 309811 - RNA, 19 nt, Homo sapiens
aggaaacacuagaaugaga

SEQ ID NO: 309812 - RNA, 19 nt, Homo sapiens
ugaaagcgaugcucaugcu

SEQ ID NO: 309813 - RNA, 19 nt, Homo sapiens
accaggaguucaucaauau

SEQ ID NO: 309814 - RNA, 19 nt, Homo sapiens
acaagaagacuggagauga

SEQ ID NO: 309815 - RNA, 19 nt, Homo sapiens
gccaugcauuugauuuguu

SEQ ID NO: 309816 - RNA, 19 nt, Homo sapiens
cauggaaggagaucaaaug

SEQ ID NO: 309817 - RNA, 19 nt, Homo sapiens
ggacauucauuuuguucuu

SEQ ID NO: 309818 - RNA, 19 nt, Homo sapiens
ccaaucucuugcuguuaaa

SEQ ID NO: 309819 - RNA, 19 nt, Homo sapiens
uaguaauggugcuggguaa

SEQ ID NO: 309820 - RNA, 19 nt, Homo sapiens
gagaaguguuggccaugag

SEQ ID NO: 309821 - RNA, 19 nt, Homo sapiens
aaucguagaggacauaaug

SEQ ID NO: 309822 - RNA, 19 nt, Homo sapiens
ggagaugaaccgccaaagg

SEQ ID NO: 309823 - RNA, 19 nt, Homo sapiens
aauaugcgacagaugauaa

SEQ ID NO: 309824 - RNA, 19 nt, Homo sapiens
gcagaaauuagaaagaaac

SEQ ID NO: 309825 - RNA, 19 nt, Homo sapiens
caaccaggaguucaucaau

SEQ ID NO: 309826 - RNA, 19 nt, Homo sapiens
agaaagaaacuucggucaa

SEQ ID NO: 309827 - RNA, 19 nt, Homo sapiens
acauaaugauggugaagau

SEQ ID NO: 309828 - RNA, 19 nt, Homo sapiens
cauaaucguagaggacaua

SEQ ID NO: 309829 - RNA, 19 nt, Homo sapiens
gacaaacuccacaucaaag

SEQ ID NO: 309830 - RNA, 19 nt, Homo sapiens
gguagagggagagcucaua

SEQ ID NO: 309831 - RNA, 19 nt, Homo sapiens
gaaguguuggccaugagaa

SEQ ID NO: 309832 - RNA, 19 nt, Homo sapiens
ccaggaggaauaaaggaaa

SEQ ID NO: 309833 - RNA, 19 nt, Homo sapiens
caacuuucuucugauaucu

SEQ ID NO: 309834 - RNA, 19 nt, Homo sapiens
gaccaaucucuugcuguua

SEQ ID NO: 309835 - RNA, 19 nt, Homo sapiens
ggaaaccaggaaagcaaug

SEQ ID NO: 309836 - RNA, 19 nt, Homo sapiens
agaaacuucggucaacuuu

SEQ ID NO: 309837 - RNA, 19 nt, Homo sapiens
ugagaaacuauaugcagaa

SEQ ID NO: 309838 - RNA, 19 nt, Homo sapiens
uaaugauggugaagauucu

SEQ ID NO: 309839 - RNA, 19 nt, Homo sapiens
cuucugauaucugaauguu

SEQ ID NO: 309840 - RNA, 19 nt, Homo sapiens
caaaccaggacgacacaau

SEQ ID NO: 309841 - RNA, 19 nt, Homo sapiens
gagaaaauaugcgacagau

SEQ ID NO: 309842 - RNA, 19 nt, Homo sapiens
agggagagcucauaaucgu

SEQ ID NO: 309843 - RNA, 19 nt, Homo sapiens
ccaggaaagcaaugagaga

SEQ ID NO: 309844 - RNA, 19 nt, Homo sapiens
gcucaucugugaaaagcaa

SEQ ID NO: 309845 - RNA, 19 nt, Homo sapiens
gaaacacuagaaugagaag

SEQ ID NO: 309846 - RNA, 19 nt, Homo sapiens
uagaggacauaaugauggu

SEQ ID NO: 309847 - RNA, 19 nt, Homo sapiens
gagaugaagaggucaacca

SEQ ID NO: 309848 - RNA, 19 nt, Homo sapiens
gaagacuggagaugaagag

SEQ ID NO: 309849 - RNA, 19 nt, Homo sapiens
cuucuucucugaguccauu

SEQ ID NO: 309850 - RNA, 19 nt, Homo sapiens
gaaagaagaucuggauauu

SEQ ID NO: 309851 - RNA, 19 nt, Homo sapiens
gaaauuggaugugaggaua

SEQ ID NO: 309852 - RNA, 19 nt, Homo sapiens
ggcauuaguuucucaguua

SEQ ID NO: 309853 - RNA, 19 nt, Homo sapiens
ggaaaugacugcagcuugu

SEQ ID NO: 309854 - RNA, 19 nt, Homo sapiens
gaagaaggcugagaugcuu

SEQ ID NO: 309855 - RNA, 19 nt, Homo sapiens
aagaaggacuugcugaaua

SEQ ID NO: 309856 - RNA, 19 nt, Homo sapiens
ggaagauggucccaaagaa

SEQ ID NO: 309857 - RNA, 19 nt, Homo sapiens
cacaguggauugauuauaa

SEQ ID NO: 309858 - RNA, 19 nt, Homo sapiens
ggaagauucugauguggaa

SEQ ID NO: 309859 - RNA, 19 nt, Homo sapiens
gaaaacagcugauggaaag

SEQ ID NO: 309860 - RNA, 19 nt, Homo sapiens
ggaaagaagaucuggauau

SEQ ID NO: 309861 - RNA, 19 nt, Homo sapiens
gaauguggauguuaaugug

SEQ ID NO: 309862 - RNA, 19 nt, Homo sapiens
aagaagaucuggauauugu

SEQ ID NO: 309863 - RNA, 19 nt, Homo sapiens
gacaguagcugauguuagg

SEQ ID NO: 309864 - RNA, 19 nt, Homo sapiens
ccaccaagcuuagugaaga

SEQ ID NO: 309865 - RNA, 19 nt, Homo sapiens
gaagaugauucccgaaagg

SEQ ID NO: 309866 - RNA, 19 nt, Homo sapiens
gagaagagaggaccuacuu

SEQ ID NO: 309867 - RNA, 19 nt, Homo sapiens
gcauuaguuucucaguuaa

SEQ ID NO: 309868 - RNA, 19 nt, Homo sapiens
gcaaguuacucagauggaa

SEQ ID NO: 309869 - RNA, 19 nt, Homo sapiens
aacagaagcuugaugcauu

SEQ ID NO: 309870 - RNA, 19 nt, Homo sapiens
gcaaacuacucagugaaga

SEQ ID NO: 309871 - RNA, 19 nt, Homo sapiens
uaaccugccugaucuauac

SEQ ID NO: 309872 - RNA, 19 nt, Homo sapiens
ggagaaggaucauuaaccu

SEQ ID NO: 309873 - RNA, 19 nt, Homo sapiens
gaggauaagacagauauuu

SEQ ID NO: 309874 - RNA, 19 nt, Homo sapiens
gcaccgggaucaggaaaga

SEQ ID NO: 309875 - RNA, 19 nt, Homo sapiens
gcacuuccguugagcaucu

SEQ ID NO: 309876 - RNA, 19 nt, Homo sapiens
ggaaguuguuggcagguau

SEQ ID NO: 309877 - RNA, 19 nt, Homo sapiens
agaggaagauggucccaaa

SEQ ID NO: 309878 - RNA, 19 nt, Homo sapiens
ucauuaaccucacuagugu

SEQ ID NO: 309879 - RNA, 19 nt, Homo sapiens
gcagcaagaugaggagaug

SEQ ID NO: 309880 - RNA, 19 nt, Homo sapiens
guaccucaguuuagaaauc

SEQ ID NO: 309881 - RNA, 19 nt, Homo sapiens
gucgagaacugauagaaau

SEQ ID NO: 309882 - RNA, 19 nt, Homo sapiens
ccucaaccguggacaauau

SEQ ID NO: 309883 - RNA, 19 nt, Homo sapiens
cuaaacauuucacagaaga

SEQ ID NO: 309884 - RNA, 19 nt, Homo sapiens
ggaagcaguacauaucuga

SEQ ID NO: 309885 - RNA, 19 nt, Homo sapiens
uaaagaaugcgcuauguuc

SEQ ID NO: 309886 - RNA, 19 nt, Homo sapiens
gaaagccucaguaaagaau

SEQ ID NO: 309887 - RNA, 19 nt, Homo sapiens
cugaauacauuguugaguu

SEQ ID NO: 309888 - RNA, 19 nt, Homo sapiens
cuaguaaacugcaguccuu

SEQ ID NO: 309889 - RNA, 19 nt, Homo sapiens
gaagaucuggauauuguau

SEQ ID NO: 309890 - RNA, 19 nt, Homo sapiens
cacagaagauggaaauauc

SEQ ID NO: 309891 - RNA, 19 nt, Homo sapiens
acagaagcuugaugcauuu

SEQ ID NO: 309892 - RNA, 19 nt, Homo sapiens
ccacaaguauucaagugau

SEQ ID NO: 309893 - RNA, 19 nt, Homo sapiens
ugagagguguuaaauaugg

SEQ ID NO: 309894 - RNA, 19 nt, Homo sapiens
gaagaagaaggcugagaug

SEQ ID NO: 309895 - RNA, 19 nt, Homo sapiens
caaagaaggacuugcugaa

SEQ ID NO: 309896 - RNA, 19 nt, Homo sapiens
ucuaccagauacucauuua

SEQ ID NO: 309897 - RNA, 19 nt, Homo sapiens
gaaaugacugcagcuugua

SEQ ID NO: 309898 - RNA, 19 nt, Homo sapiens
ucagaaaugucagagaaga

SEQ ID NO: 309899 - RNA, 19 nt, Homo sapiens
cuucagaaaugucagagaa

SEQ ID NO: 309900 - RNA, 19 nt, Homo sapiens
ucacagaggauaagacaga

SEQ ID NO: 309901 - RNA, 19 nt, Homo sapiens
ugauagaaauuggauguga

SEQ ID NO: 309902 - RNA, 19 nt, Homo sapiens
gaacugauagaaauuggau

SEQ ID NO: 309903 - RNA, 19 nt, Homo sapiens
gaagauggucccaaagaag

SEQ ID NO: 309904 - RNA, 19 nt, Homo sapiens
cagcuaaugcuaucaaaga

SEQ ID NO: 309905 - RNA, 19 nt, Homo sapiens
gaacagaagcuugaugcau

SEQ ID NO: 309906 - RNA, 19 nt, Homo sapiens
gugcauacagagcaaguua

SEQ ID NO: 309907 - RNA, 19 nt, Homo sapiens
gaaagagacaucgggaaga

SEQ ID NO: 309908 - RNA, 19 nt, Homo sapiens
agucugaccucgucuucua

SEQ ID NO: 309909 - RNA, 19 nt, Homo sapiens
gagggaggccugaaguuga

SEQ ID NO: 309910 - RNA, 19 nt, Homo sapiens
cccagaauguggauguuaa

SEQ ID NO: 309911 - RNA, 19 nt, Homo sapiens
gagagacaguagcugaugu

SEQ ID NO: 309912 - RNA, 19 nt, Homo sapiens
guaaacugcaguccuuuga

SEQ ID NO: 309913 - RNA, 19 nt, Homo sapiens
gaaguugauucagauccaa

SEQ ID NO: 309914 - RNA, 19 nt, Homo sapiens
guaaagaaugcgcuauguu

SEQ ID NO: 309915 - RNA, 19 nt, Homo sapiens
gaugauugagaacuguuua

SEQ ID NO: 309916 - RNA, 19 nt, Homo sapiens
uggaaaugguggaagauga

SEQ ID NO: 309917 - RNA, 19 nt, Homo sapiens
gggcuaggcagcaagauga

SEQ ID NO: 309918 - RNA, 19 nt, Homo sapiens
gaagcuugaugcauuucug

SEQ ID NO: 309919 - RNA, 19 nt, Homo sapiens
ggauuuagccaguauuucu

SEQ ID NO: 309920 - RNA, 19 nt, Homo sapiens
gaggauuuagccaguauuu

SEQ ID NO: 309921 - RNA, 19 nt, Homo sapiens
auacacaguggauugauua

SEQ ID NO: 309922 - RNA, 19 nt, Homo sapiens
gauguguucuucuuucucu

SEQ ID NO: 309923 - RNA, 19 nt, Homo sapiens
ugagaugcuugcagacuau

SEQ ID NO: 309924 - RNA, 19 nt, Homo sapiens
uccgggagauguugcauaa

SEQ ID NO: 309925 - RNA, 19 nt, Homo sapiens
aaagagacaucgggaagau

SEQ ID NO: 309926 - RNA, 19 nt, Homo sapiens
gaugcaaaauccacaagua

SEQ ID NO: 309927 - RNA, 19 nt, Homo sapiens
ccagaugguucguacagau

SEQ ID NO: 309928 - RNA, 19 nt, Homo sapiens
gaaguagugauaaggucua

SEQ ID NO: 309929 - RNA, 19 nt, Homo sapiens
gauauuguaugugaaaggu

SEQ ID NO: 309930 - RNA, 19 nt, Homo sapiens
uauacacaguggauugauu

SEQ ID NO: 309931 - RNA, 19 nt, Homo sapiens
cuaaugcuaucaaagagau

SEQ ID NO: 309932 - RNA, 19 nt, Homo sapiens
ggaaaugguggaagaugau

SEQ ID NO: 309933 - RNA, 19 nt, Homo sapiens
auugagaacuguuuagaug

SEQ ID NO: 309934 - RNA, 19 nt, Homo sapiens
gagaaaagccauagaaaca

SEQ ID NO: 309935 - RNA, 19 nt, Homo sapiens
ucacagaagauggaaauau

SEQ ID NO: 309936 - RNA, 19 nt, Homo sapiens
uaucuucauucuucgacua

SEQ ID NO: 309937 - RNA, 19 nt, Homo sapiens
agaaggacuugcugaauac

SEQ ID NO: 309938 - RNA, 19 nt, Homo sapiens
gcaaaccccuguccaguca

SEQ ID NO: 309939 - RNA, 19 nt, Homo sapiens
gaaaagccauagaaacagu

SEQ ID NO: 309940 - RNA, 19 nt, Homo sapiens
gguuacauauccaaugcaa

SEQ ID NO: 309941 - RNA, 19 nt, Homo sapiens
uggaaagugugcauacaga

SEQ ID NO: 309942 - RNA, 19 nt, Homo sapiens
gauggaaagugugcauaca

SEQ ID NO: 309943 - RNA, 19 nt, Homo sapiens
gagaacugauagaaauugg

SEQ ID NO: 309944 - RNA, 19 nt, Homo sapiens
guucuucuuucucuguauu

SEQ ID NO: 309945 - RNA, 19 nt, Homo sapiens
caaaguguaccaacauaag

SEQ ID NO: 309946 - RNA, 19 nt, Homo sapiens
ugauucagauccaagacaa

SEQ ID NO: 309947 - RNA, 19 nt, Homo sapiens
gaaaugguggaagaugauu

SEQ ID NO: 309948 - RNA, 19 nt, Homo sapiens
ggauaagacagauauuucu

SEQ ID NO: 309949 - RNA, 19 nt, Homo sapiens
ugagaacuguuuagaugca

SEQ ID NO: 309950 - RNA, 19 nt, Homo sapiens
ggacgagccugcccuuuga

SEQ ID NO: 309951 - RNA, 19 nt, Homo sapiens
ucaaugagauggaggaguu

SEQ ID NO: 309952 - RNA, 19 nt, Homo sapiens
ugaacuaccuacacaauga

SEQ ID NO: 309953 - RNA, 19 nt, Homo sapiens
ccacaccucugccuaguga

SEQ ID NO: 309954 - RNA, 19 nt, Homo sapiens
gcacauguuugaugaccuu

SEQ ID NO: 309955 - RNA, 19 nt, Homo sapiens
ggaccgcgguguucgacua

SEQ ID NO: 309956 - RNA, 19 nt, Homo sapiens
aaacaguggucaucaagug

SEQ ID NO: 309957 - RNA, 19 nt, Homo sapiens
caacauaauugcccuuagg

SEQ ID NO: 309958 - RNA, 19 nt, Homo sapiens
gcacaagaccaccaagaug

SEQ ID NO: 309959 - RNA, 19 nt, Homo sapiens
ggcaggauguucacucuau

SEQ ID NO: 309960 - RNA, 19 nt, Homo sapiens
gcaggauguucacucuauu

SEQ ID NO: 309961 - RNA, 19 nt, Homo sapiens
ccacacugcuggacaugga

SEQ ID NO: 309962 - RNA, 19 nt, Homo sapiens
gcucgacggccucuucuuu

SEQ ID NO: 309963 - RNA, 19 nt, Homo sapiens
gcgaggagguggcagucaa

SEQ ID NO: 309964 - RNA, 19 nt, Homo sapiens
gcagugaugucuggagcuu

SEQ ID NO: 309965 - RNA, 19 nt, Homo sapiens
ggagauucagcacauguuu

SEQ ID NO: 309966 - RNA, 19 nt, Homo sapiens
gcuccacccugcagaagga

SEQ ID NO: 309967 - RNA, 19 nt, Homo sapiens
ggcaugaacuaccuacaca

SEQ ID NO: 309968 - RNA, 19 nt, Homo sapiens
gagaaggacccggcaguga

SEQ ID NO: 309969 - RNA, 19 nt, Homo sapiens
acuggaagcuggagauuca

SEQ ID NO: 309970 - RNA, 19 nt, Homo sapiens
cacaagaccaccaagauga

SEQ ID NO: 309971 - RNA, 19 nt, Homo sapiens
ccucuggcuuugagcauaa

SEQ ID NO: 309972 - RNA, 19 nt, Homo sapiens
gaaggcggcagccacauca

SEQ ID NO: 309973 - RNA, 19 nt, Homo sapiens
gaccucaaguccaucaaca

SEQ ID NO: 309974 - RNA, 19 nt, Homo sapiens
gcaaacaguggucaucaag

SEQ ID NO: 309975 - RNA, 19 nt, Homo sapiens
ccuggaaacuggucuccuu

SEQ ID NO: 309976 - RNA, 19 nt, Homo sapiens
gcagacacggugcucaaga

SEQ ID NO: 309977 - RNA, 19 nt, Homo sapiens
cagcagcaguggaggaagu

SEQ ID NO: 309978 - RNA, 19 nt, Homo sapiens
cagacacggugcucaagau

SEQ ID NO: 309979 - RNA, 19 nt, Homo sapiens
gaaggacccggcagugaca

SEQ ID NO: 309980 - RNA, 19 nt, Homo sapiens
gaacuaccuacacaaugau

SEQ ID NO: 309981 - RNA, 19 nt, Homo sapiens
guucacugcugcgcucuga

SEQ ID NO: 309982 - RNA, 19 nt, Homo sapiens
gagauucagcacauguuug

SEQ ID NO: 309983 - RNA, 19 nt, Homo sapiens
cguauggcguggcuaugaa

SEQ ID NO: 309984 - RNA, 19 nt, Homo sapiens
ggaggaagugggacaugga

SEQ ID NO: 309985 - RNA, 19 nt, Homo sapiens
ggauguucacucuauuuau

SEQ ID NO: 309986 - RNA, 19 nt, Homo sapiens
caggauguucacucuauuu

SEQ ID NO: 309987 - RNA, 19 nt, Homo sapiens
gaagcaaacaguggucauc

SEQ ID NO: 309988 - RNA, 19 nt, Homo sapiens
ccaccacccugaccuuugc

SEQ ID NO: 309989 - RNA, 19 nt, Homo sapiens
agucagcccuguuccagau

SEQ ID NO: 309990 - RNA, 19 nt, Homo sapiens
agauucagcacauguuuga

SEQ ID NO: 309991 - RNA, 19 nt, Homo sapiens
gcguauggcguggcuauga

SEQ ID NO: 309992 - RNA, 19 nt, Homo sapiens
caugaacuaccuacacaau

SEQ ID NO: 309993 - RNA, 19 nt, Homo sapiens
aggauguucacucuauuua

SEQ ID NO: 309994 - RNA, 19 nt, Homo sapiens
guccaggccucuccaacuc

SEQ ID NO: 309995 - RNA, 19 nt, Homo sapiens
ggcuugaagucaucgaaca

SEQ ID NO: 309996 - RNA, 19 nt, Homo sapiens
uccaggugcuuucccaaga

SEQ ID NO: 309997 - RNA, 19 nt, Homo sapiens
ccaacauaauugcccuuag

SEQ ID NO: 309998 - RNA, 19 nt, Homo sapiens
gaggagaggagaggcugaa

SEQ ID NO: 309999 - RNA, 19 nt, Homo sapiens
uccacucgcugcaggaaga

SEQ ID NO: 310000 - RNA, 19 nt, Homo sapiens
ggcacaagaccaccaagau

SEQ ID NO: 310001 - RNA, 19 nt, Homo sapiens
gcgcaagggcaacuucaag

SEQ ID NO: 310002 - RNA, 19 nt, Homo sapiens
uggcagaacgugagaugga

SEQ ID NO: 310003 - RNA, 19 nt, Homo sapiens
uucagcacauguuugauga

SEQ ID NO: 310004 - RNA, 19 nt, Homo sapiens
ugaagucaucgaacaguca

SEQ ID NO: 310005 - RNA, 19 nt, Homo sapiens
gcaugaacuaccuacacaa

SEQ ID NO: 310006 - RNA, 19 nt, Homo sapiens
ucuuagcccucugccguuu

SEQ ID NO: 310007 - RNA, 19 nt, Homo sapiens
uugaugaccuucggaccaa

SEQ ID NO: 310008 - RNA, 19 nt, Homo sapiens
ccucaaguccaucaacauc

SEQ ID NO: 310009 - RNA, 19 nt, Homo sapiens
gcagcuagaggagaucauc

SEQ ID NO: 310010 - RNA, 19 nt, Homo sapiens
cucgugaccuucuggacuu

SEQ ID NO: 310011 - RNA, 19 nt, Homo sapiens
caaacaguggucaucaagu

SEQ ID NO: 310012 - RNA, 19 nt, Homo sapiens
gcuggcagaacgugagaug

SEQ ID NO: 310013 - RNA, 19 nt, Homo sapiens
gaucgcguccaggugcuuu

SEQ ID NO: 310014 - RNA, 19 nt, Homo sapiens
gggagaagguggacagauu

SEQ ID NO: 310015 - RNA, 19 nt, Homo sapiens
gaaauuggaaugaggauga

SEQ ID NO: 310016 - RNA, 19 nt, Homo sapiens
uggaagggcugcugaguga

SEQ ID NO: 310017 - RNA, 19 nt, Homo sapiens
gugaggcccugggaauuua

SEQ ID NO: 310018 - RNA, 19 nt, Homo sapiens
ggagaagguggacagauuu

SEQ ID NO: 310019 - RNA, 19 nt, Homo sapiens
ccaagaugguaucccguaa

SEQ ID NO: 310020 - RNA, 19 nt, Homo sapiens
aaagaaaucccugagugua

SEQ ID NO: 310021 - RNA, 19 nt, Homo sapiens
cagcugggcuuggaaggaa

SEQ ID NO: 310022 - RNA, 19 nt, Homo sapiens
gaagggcugcugagugaga

SEQ ID NO: 310023 - RNA, 19 nt, Homo sapiens
gaauaaagggcaaaagaaa

SEQ ID NO: 310024 - RNA, 19 nt, Homo sapiens
gcugacugcuccucuggaa

SEQ ID NO: 310025 - RNA, 19 nt, Homo sapiens
agaaaucccugaguguaug

SEQ ID NO: 310026 - RNA, 19 nt, Homo sapiens
cagcaaauaaagcaugaaa

SEQ ID NO: 310027 - RNA, 19 nt, Homo sapiens
gaagaaaacgaaaugauca

SEQ ID NO: 310028 - RNA, 19 nt, Homo sapiens
caagugaggcccugggaau

SEQ ID NO: 310029 - RNA, 19 nt, Homo sapiens
gaaaaggaacggaauaaag

SEQ ID NO: 310030 - RNA, 19 nt, Homo sapiens
gagaagguggacagauuug

SEQ ID NO: 310031 - RNA, 19 nt, Homo sapiens
ugacugcuccucuggaaau

SEQ ID NO: 310032 - RNA, 19 nt, Homo sapiens
cagaagacaagcagagaga

SEQ ID NO: 310033 - RNA, 19 nt, Homo sapiens
ggaauaaagggcaaaagaa

SEQ ID NO: 310034 - RNA, 19 nt, Homo sapiens
ggaagaagaaaacgaaaug

SEQ ID NO: 310035 - RNA, 19 nt, Homo sapiens
gaacggaauaaagggcaaa

SEQ ID NO: 310036 - RNA, 19 nt, Homo sapiens
gaagacaagcagagagacu

SEQ ID NO: 310037 - RNA, 19 nt, Homo sapiens
aagaaaucccugaguguau

SEQ ID NO: 310038 - RNA, 19 nt, Homo sapiens
aaauuggaaugaggaugaa

SEQ ID NO: 310039 - RNA, 19 nt, Homo sapiens
gcccaucagggaagaagaa

SEQ ID NO: 310040 - RNA, 19 nt, Homo sapiens
ggaaaaggaacggaauaaa

SEQ ID NO: 310041 - RNA, 19 nt, Homo sapiens
caaauuccccuccagcaaa

SEQ ID NO: 310042 - RNA, 19 nt, Homo sapiens
uccagcaaauaaagcauga

SEQ ID NO: 310043 - RNA, 19 nt, Homo sapiens
gugcacgcccuccaagaug

SEQ ID NO: 310044 - RNA, 19 nt, Homo sapiens
aagaugguaucccguaagg

SEQ ID NO: 310045 - RNA, 19 nt, Homo sapiens
gcaaauuccccuccagcaa

SEQ ID NO: 310046 - RNA, 19 nt, Homo sapiens
ggacaccagaagacaagca

SEQ ID NO: 310047 - RNA, 19 nt, Homo sapiens
ccagcaugcagccaaguga

SEQ ID NO: 310048 - RNA, 19 nt, Homo sapiens
gacugcuccucuggaaauu

SEQ ID NO: 310049 - RNA, 19 nt, Homo sapiens
gaagaagaaaacgaaauga

SEQ ID NO: 310050 - RNA, 19 nt, Homo sapiens
gaaaucccugaguguaugg

SEQ ID NO: 310051 - RNA, 19 nt, Homo sapiens
caacugggcugugcagauu

SEQ ID NO: 310052 - RNA, 19 nt, Homo sapiens
gcagugacgucuggaguuu

SEQ ID NO: 310053 - RNA, 19 nt, Homo sapiens
gaagccaaauaaacucaaa

SEQ ID NO: 310054 - RNA, 19 nt, Homo sapiens
gcacagguccuacgggaaa

SEQ ID NO: 310055 - RNA, 19 nt, Homo sapiens
gaagccagaagccaaauaa

SEQ ID NO: 310056 - RNA, 19 nt, Homo sapiens
caugguaccuggauucaga

SEQ ID NO: 310057 - RNA, 19 nt, Homo sapiens
gaucucaaguccaacaaca

SEQ ID NO: 310058 - RNA, 19 nt, Homo sapiens
gaucggcauuggaggcuuu

SEQ ID NO: 310059 - RNA, 19 nt, Homo sapiens
acacuacacugcacaggaa

SEQ ID NO: 310060 - RNA, 19 nt, Homo sapiens
caacaucauugcccucaag

SEQ ID NO: 310061 - RNA, 19 nt, Homo sapiens
uggcguagcuguuaacaag

SEQ ID NO: 310062 - RNA, 19 nt, Homo sapiens
uaggaggagucacagcaua

SEQ ID NO: 310063 - RNA, 19 nt, Homo sapiens
gcacaaaaccacacaaaug

SEQ ID NO: 310064 - RNA, 19 nt, Homo sapiens
gcagggcacagaccaaaga

SEQ ID NO: 310065 - RNA, 19 nt, Homo sapiens
gcacaagacccugaagauc

SEQ ID NO: 310066 - RNA, 19 nt, Homo sapiens
cacaagacccugaagauca

SEQ ID NO: 310067 - RNA, 19 nt, Homo sapiens
gcaugccacucgacuucaa

SEQ ID NO: 310068 - RNA, 19 nt, Homo sapiens
ccucuagggucauggaaug

SEQ ID NO: 310069 - RNA, 19 nt, Homo sapiens
caaaagcugucuccccaaa

SEQ ID NO: 310070 - RNA, 19 nt, Homo sapiens
cagcucaccugcccuacug

SEQ ID NO: 310071 - RNA, 19 nt, Homo sapiens
cuggauggcuccugagguu

SEQ ID NO: 310072 - RNA, 19 nt, Homo sapiens
gagaagguccuccacacau

SEQ ID NO: 310073 - RNA, 19 nt, Homo sapiens
gagcacaagacccugaaga

SEQ ID NO: 310074 - RNA, 19 nt, Homo sapiens
gagcugcgagccaaggaaa

SEQ ID NO: 310075 - RNA, 19 nt, Homo sapiens
ggauggcuccugagguuau

SEQ ID NO: 310076 - RNA, 19 nt, Homo sapiens
guaccuggauucagaugac

SEQ ID NO: 310077 - RNA, 19 nt, Homo sapiens
ucccaggacugcuccagaa

SEQ ID NO: 310078 - RNA, 19 nt, Homo sapiens
cuggaggacucaagcaaug

SEQ ID NO: 310079 - RNA, 19 nt, Homo sapiens
ccuauggcguagcuguuaa

SEQ ID NO: 310080 - RNA, 19 nt, Homo sapiens
gccagaagccaaauaaacu

SEQ ID NO: 310081 - RNA, 19 nt, Homo sapiens
guuccgagccauccaguug

SEQ ID NO: 310082 - RNA, 19 nt, Homo sapiens
ccacaugguaccuggauuc

SEQ ID NO: 310083 - RNA, 19 nt, Homo sapiens
gccuauggcguagcuguua

SEQ ID NO: 310084 - RNA, 19 nt, Homo sapiens
ccauggagcccuugaagag

SEQ ID NO: 310085 - RNA, 19 nt, Homo sapiens
gugacgacauggagcacaa

SEQ ID NO: 310086 - RNA, 19 nt, Homo sapiens
ucucaaguccaacaacauu

SEQ ID NO: 310087 - RNA, 19 nt, Homo sapiens
caucuucccguccaacuau

SEQ ID NO: 310088 - RNA, 19 nt, Homo sapiens
agaagguccuccacacauc

SEQ ID NO: 310089 - RNA, 19 nt, Homo sapiens
gggcacagaccaaagacau

SEQ ID NO: 310090 - RNA, 19 nt, Homo sapiens
gcauugaucccuggagcuu

SEQ ID NO: 310091 - RNA, 19 nt, Homo sapiens
cagcaugccacucgacuuc

SEQ ID NO: 310092 - RNA, 19 nt, Homo sapiens
gcaucuucccguccaacua

SEQ ID NO: 310093 - RNA, 19 nt, Homo sapiens
cgagcacccuggaccuugu

SEQ ID NO: 310094 - RNA, 19 nt, Homo sapiens
gaagcucgggucccuccaa

SEQ ID NO: 310095 - RNA, 19 nt, Homo sapiens
cauugagagugacgacaug

SEQ ID NO: 310096 - RNA, 19 nt, Homo sapiens
ugaagccagaagccaaaua

SEQ ID NO: 310097 - RNA, 19 nt, Homo sapiens
ggaggacucaagcaaugga

SEQ ID NO: 310098 - RNA, 19 nt, Homo sapiens
ggccuugaccggaggagaa

SEQ ID NO: 310099 - RNA, 19 nt, Homo sapiens
agugggagcuagagguguu

SEQ ID NO: 310100 - RNA, 19 nt, Homo sapiens
cuccaaaggcagcggguua

SEQ ID NO: 310101 - RNA, 19 nt, Homo sapiens
cacaaaaccacacaaauga

SEQ ID NO: 310102 - RNA, 19 nt, Homo sapiens
ugggugcccuccuccagaa

SEQ ID NO: 310103 - RNA, 19 nt, Homo sapiens
auugaucccuggagcuuug

SEQ ID NO: 310104 - RNA, 19 nt, Homo sapiens
gagcccuucgcacagcuua

SEQ ID NO: 310105 - RNA, 19 nt, Homo sapiens
ccuccaagcuagccauggu

SEQ ID NO: 310106 - RNA, 19 nt, Homo sapiens
ccacaucugaaaccuguag

SEQ ID NO: 310107 - RNA, 19 nt, Homo sapiens
ggagaaggucccgcaugga

SEQ ID NO: 310108 - RNA, 19 nt, Homo sapiens
ggaggugaucggcauugga

SEQ ID NO: 310109 - RNA, 19 nt, Homo sapiens
acaagacccugaagaucac

SEQ ID NO: 310110 - RNA, 19 nt, Homo sapiens
cauccaccgugaucucaag

SEQ ID NO: 310111 - RNA, 19 nt, Homo sapiens
cccaugugcuggucaacug

SEQ ID NO: 310112 - RNA, 19 nt, Homo sapiens
ccccagcacucaaugguaa

SEQ ID NO: 310113 - RNA, 19 nt, Homo sapiens
cagaaugggaggagaaggu

SEQ ID NO: 310114 - RNA, 19 nt, Homo sapiens
accgugaucucaaguccaa

SEQ ID NO: 310115 - RNA, 19 nt, Homo sapiens
cagaagccaaauaaacuca

SEQ ID NO: 310116 - RNA, 19 nt, Homo sapiens
ggcagugacgucuggaguu

SEQ ID NO: 310117 - RNA, 19 nt, Homo sapiens
ccaacaucauugcccucaa

SEQ ID NO: 310118 - RNA, 19 nt, Homo sapiens
ggaggagucacagcauaca

SEQ ID NO: 310119 - RNA, 19 nt, Homo sapiens
uggacgaagccacauggua

SEQ ID NO: 310120 - RNA, 19 nt, Homo sapiens
ggaggaggugaucggcauu

SEQ ID NO: 310121 - RNA, 19 nt, Homo sapiens
gaggaggugaucggcauug

SEQ ID NO: 310122 - RNA, 19 nt, Homo sapiens
gauaagcucuuuccuauug

SEQ ID NO: 310123 - RNA, 19 nt, Homo sapiens
caauugaccucuucuguua

SEQ ID NO: 310124 - RNA, 19 nt, Homo sapiens
gagauaagaucaagaagaa

SEQ ID NO: 310125 - RNA, 19 nt, Homo sapiens
gaaagugacucaucagaga

SEQ ID NO: 310126 - RNA, 19 nt, Homo sapiens
gaagaaaggugaagacaca

SEQ ID NO: 310127 - RNA, 19 nt, Homo sapiens
ggaaucagcuugagaagga

SEQ ID NO: 310128 - RNA, 19 nt, Homo sapiens
gaagacgacuuauacuauu

SEQ ID NO: 310129 - RNA, 19 nt, Homo sapiens
gcaggcacaucaacaauaa

SEQ ID NO: 310130 - RNA, 19 nt, Homo sapiens
gagaauggauuugaaguuu

SEQ ID NO: 310131 - RNA, 19 nt, Homo sapiens
gaaggaacaccuccacuua

SEQ ID NO: 310132 - RNA, 19 nt, Homo sapiens
caaagaagauagccugaaa

SEQ ID NO: 310133 - RNA, 19 nt, Homo sapiens
ggacugauauuacuucugu

SEQ ID NO: 310134 - RNA, 19 nt, Homo sapiens
gaacagagaacuuaaagau

SEQ ID NO: 310135 - RNA, 19 nt, Homo sapiens
gaacauaugggaucuaguu

SEQ ID NO: 310136 - RNA, 19 nt, Homo sapiens
gcaagcagcugagauguga

SEQ ID NO: 310137 - RNA, 19 nt, Homo sapiens
gcacaguggucucaugauu

SEQ ID NO: 310138 - RNA, 19 nt, Homo sapiens
gaucagaaauucagaguag

SEQ ID NO: 310139 - RNA, 19 nt, Homo sapiens
gaaggaaguuucucaaugg

SEQ ID NO: 310140 - RNA, 19 nt, Homo sapiens
acagagaacuuaaagauug

SEQ ID NO: 310141 - RNA, 19 nt, Homo sapiens
gcaacaagcugcccugcaa

SEQ ID NO: 310142 - RNA, 19 nt, Homo sapiens
gauuaugacccuccaauua

SEQ ID NO: 310143 - RNA, 19 nt, Homo sapiens
ggaacucacuuacgacuau

SEQ ID NO: 310144 - RNA, 19 nt, Homo sapiens
gaaagaacaugucacuaag

SEQ ID NO: 310145 - RNA, 19 nt, Homo sapiens
gcgccaagcucuuugcuaa

SEQ ID NO: 310146 - RNA, 19 nt, Homo sapiens
gaacaagguuugauaugca

SEQ ID NO: 310147 - RNA, 19 nt, Homo sapiens
ucugagagcuccaagauuu

SEQ ID NO: 310148 - RNA, 19 nt, Homo sapiens
gagaggaacucacuuacga

SEQ ID NO: 310149 - RNA, 19 nt, Homo sapiens
gaacaugucacuaagaguu

SEQ ID NO: 310150 - RNA, 19 nt, Homo sapiens
gcucagcucugcaagauug

SEQ ID NO: 310151 - RNA, 19 nt, Homo sapiens
cuacagacccgaaagaaua

SEQ ID NO: 310152 - RNA, 19 nt, Homo sapiens
cacaguaggugauccuuua

SEQ ID NO: 310153 - RNA, 19 nt, Homo sapiens
gccaagcacugucgaaauu

SEQ ID NO: 310154 - RNA, 19 nt, Homo sapiens
ccaggaagcucgaucaaau

SEQ ID NO: 310155 - RNA, 19 nt, Homo sapiens
ggaguucagugaugauauu

SEQ ID NO: 310156 - RNA, 19 nt, Homo sapiens
ggaaagcauuacugagaaa

SEQ ID NO: 310157 - RNA, 19 nt, Homo sapiens
ccacugaauucaaguacua

SEQ ID NO: 310158 - RNA, 19 nt, Homo sapiens
gaugauggcuuucagaucu

SEQ ID NO: 310159 - RNA, 19 nt, Homo sapiens
ugaaucaagugccaaagua

SEQ ID NO: 310160 - RNA, 19 nt, Homo sapiens
gaagcacauugucaucuuu

SEQ ID NO: 310161 - RNA, 19 nt, Homo sapiens
caaaguaguuucccaccaa

SEQ ID NO: 310162 - RNA, 19 nt, Homo sapiens
gauugggucuugacaguaa

SEQ ID NO: 310163 - RNA, 19 nt, Homo sapiens
ggaauauccugccuucaga

SEQ ID NO: 310164 - RNA, 19 nt, Homo sapiens
gguaaacucucuccucuca

SEQ ID NO: 310165 - RNA, 19 nt, Homo sapiens
gcaguuguguuccucauug

SEQ ID NO: 310166 - RNA, 19 nt, Homo sapiens
gaggauggcucuuuuaaaa

SEQ ID NO: 310167 - RNA, 19 nt, Homo sapiens
gaugacggaucacuaaaga

SEQ ID NO: 310168 - RNA, 19 nt, Homo sapiens
uaaugaugcuggucguuua

SEQ ID NO: 310169 - RNA, 19 nt, Homo sapiens
ggacaagaguagagagaga

SEQ ID NO: 310170 - RNA, 19 nt, Homo sapiens
gcaagaagcacaaaguuuc

SEQ ID NO: 310171 - RNA, 19 nt, Homo sapiens
gaucaaaggcgaagugguu

SEQ ID NO: 310172 - RNA, 19 nt, Homo sapiens
ccgaggagcuguccaaaga

SEQ ID NO: 310173 - RNA, 19 nt, Homo sapiens
gaacaccuccacuuacaaa

SEQ ID NO: 310174 - RNA, 19 nt, Homo sapiens
ggacagagagugauacuag

SEQ ID NO: 310175 - RNA, 19 nt, Homo sapiens
cgacuggcaucccauaauu

SEQ ID NO: 310176 - RNA, 19 nt, Homo sapiens
gaaggaaucagcuugagaa

SEQ ID NO: 310177 - RNA, 19 nt, Homo sapiens
gaggacagccagaaauuaa

SEQ ID NO: 310178 - RNA, 19 nt, Homo sapiens
ggcaauaguucuaagcaaa

SEQ ID NO: 310179 - RNA, 19 nt, Homo sapiens
gaugugguuucuaauauga

SEQ ID NO: 310180 - RNA, 19 nt, Homo sapiens
gaugagcaauucuuagguu

SEQ ID NO: 310181 - RNA, 19 nt, Homo sapiens
agaaagaacaugucacuaa

SEQ ID NO: 310182 - RNA, 19 nt, Homo sapiens
caacgaccauguaacaaug

SEQ ID NO: 310183 - RNA, 19 nt, Homo sapiens
gcuggucguuuacuauaua

SEQ ID NO: 310184 - RNA, 19 nt, Homo sapiens
gaaccaagaucuccuucuc

SEQ ID NO: 310185 - RNA, 19 nt, Homo sapiens
aaaggacauuucagaguua

SEQ ID NO: 310186 - RNA, 19 nt, Homo sapiens
gaggagaggaacucacuua

SEQ ID NO: 310187 - RNA, 19 nt, Homo sapiens
gaagaugccuggaagucau

SEQ ID NO: 310188 - RNA, 19 nt, Homo sapiens
aaacugggauucauucuuc

SEQ ID NO: 310189 - RNA, 19 nt, Homo sapiens
ggacagaaaccuaaugcuu

SEQ ID NO: 310190 - RNA, 19 nt, Homo sapiens
caaaguaguugaucauguc

SEQ ID NO: 310191 - RNA, 19 nt, Homo sapiens
guauauacaugcaagauag

SEQ ID NO: 310192 - RNA, 19 nt, Homo sapiens
gaaaauauccacaugauga

SEQ ID NO: 310193 - RNA, 19 nt, Homo sapiens
gcagacaagcuuccaauga

SEQ ID NO: 310194 - RNA, 19 nt, Homo sapiens
gaggcucacucuagaauau

SEQ ID NO: 310195 - RNA, 19 nt, Homo sapiens
ggaaggaaagcauuacuga

SEQ ID NO: 310196 - RNA, 19 nt, Homo sapiens
gaacaugcagccacuuuau

SEQ ID NO: 310197 - RNA, 19 nt, Homo sapiens
gcaaauagagucaacaucu

SEQ ID NO: 310198 - RNA, 19 nt, Homo sapiens
agaaggaucugccaaggaa

SEQ ID NO: 310199 - RNA, 19 nt, Homo sapiens
gcaaacuccucuccagaug

SEQ ID NO: 310200 - RNA, 19 nt, Homo sapiens
cggauaaugucuccaauga

SEQ ID NO: 310201 - RNA, 19 nt, Homo sapiens
gaugaugacuaugagagua

SEQ ID NO: 310202 - RNA, 19 nt, Homo sapiens
caggugagauggugauuga

SEQ ID NO: 310203 - RNA, 19 nt, Homo sapiens
ggaagcagacgaacacuau

SEQ ID NO: 310204 - RNA, 19 nt, Homo sapiens
uagacuagcuguuaucuca

SEQ ID NO: 310205 - RNA, 19 nt, Homo sapiens
auacugagcuccugaaauc

SEQ ID NO: 310206 - RNA, 19 nt, Homo sapiens
ugaagauacugaagucaaa

SEQ ID NO: 310207 - RNA, 19 nt, Homo sapiens
caccuucacuugaccauaa

SEQ ID NO: 310208 - RNA, 19 nt, Homo sapiens
ucaagaaagugacucauca

SEQ ID NO: 310209 - RNA, 19 nt, Homo sapiens
ucuguaaccuugccuagua

SEQ ID NO: 310210 - RNA, 19 nt, Homo sapiens
cagcaagccacaaagauua

SEQ ID NO: 310211 - RNA, 19 nt, Homo sapiens
uaaagcagcucucauuugc

SEQ ID NO: 310212 - RNA, 19 nt, Homo sapiens
gaagaagaggaaaguaauu

SEQ ID NO: 310213 - RNA, 19 nt, Homo sapiens
gagaagagaguaaccauca

SEQ ID NO: 310214 - RNA, 19 nt, Homo sapiens
caacagaucauccauuauc

SEQ ID NO: 310215 - RNA, 19 nt, Homo sapiens
cccaaccacucaugaaaua

SEQ ID NO: 310216 - RNA, 19 nt, Homo sapiens
gaagaguguuuguggacuu

SEQ ID NO: 310217 - RNA, 19 nt, Homo sapiens
gaaccagacucaccaacuc

SEQ ID NO: 310218 - RNA, 19 nt, Homo sapiens
aaacaugucugcagaagag

SEQ ID NO: 310219 - RNA, 19 nt, Homo sapiens
gaacucacuuacgacuaua

SEQ ID NO: 310220 - RNA, 19 nt, Homo sapiens
ccacuaaacccaaaccaaa

SEQ ID NO: 310221 - RNA, 19 nt, Homo sapiens
agaaguaugugcccaauuc

SEQ ID NO: 310222 - RNA, 19 nt, Homo sapiens
gcagcaagccugagaagau

SEQ ID NO: 310223 - RNA, 19 nt, Homo sapiens
ggacgaggccuccuucaag

SEQ ID NO: 310224 - RNA, 19 nt, Homo sapiens
gcaaagacuccgagagcaa

SEQ ID NO: 310225 - RNA, 19 nt, Homo sapiens
caacaccaccuucgacuuc

SEQ ID NO: 310226 - RNA, 19 nt, Homo sapiens
cgaggagacuggccacuuc

SEQ ID NO: 310227 - RNA, 19 nt, Homo sapiens
cgucucgccugcuucauuu

SEQ ID NO: 310228 - RNA, 19 nt, Homo sapiens
ccaagaagcagaagaagag

SEQ ID NO: 310229 - RNA, 19 nt, Homo sapiens
gaaagagaccaagcuggaa

SEQ ID NO: 310230 - RNA, 19 nt, Homo sapiens
gaagggcaccuacgacaag

SEQ ID NO: 310231 - RNA, 19 nt, Homo sapiens
gacgaggccuccuucaagu

SEQ ID NO: 310232 - RNA, 19 nt, Homo sapiens
cacacaaggugaccaagga

SEQ ID NO: 310233 - RNA, 19 nt, Homo sapiens
ccaaggacgccaacaagga

SEQ ID NO: 310234 - RNA, 19 nt, Homo sapiens
cagcaagccugagaagauc

SEQ ID NO: 310235 - RNA, 19 nt, Homo sapiens
ccuacgaccuguuccugaa

SEQ ID NO: 310236 - RNA, 19 nt, Homo sapiens
gagacuggccacuucaaug

SEQ ID NO: 310237 - RNA, 19 nt, Homo sapiens
gcgccaagaagcagaagaa

SEQ ID NO: 310238 - RNA, 19 nt, Homo sapiens
aaagagaccaagcuggaaa

SEQ ID NO: 310239 - RNA, 19 nt, Homo sapiens
caagauggcccugaaagag

SEQ ID NO: 310240 - RNA, 19 nt, Homo sapiens
ccaagauggcccugaaaga

SEQ ID NO: 310241 - RNA, 19 nt, Homo sapiens
ccaucgaggugcacuucaa

SEQ ID NO: 310242 - RNA, 19 nt, Homo sapiens
cgccagccauggacaauca

SEQ ID NO: 310243 - RNA, 19 nt, Homo sapiens
cagcucagacucagacuuc

SEQ ID NO: 310244 - RNA, 19 nt, Homo sapiens
guccgagucugcccaguca

SEQ ID NO: 310245 - RNA, 19 nt, Homo sapiens
gccaagaagcagaagaaga

SEQ ID NO: 310246 - RNA, 19 nt, Homo sapiens
ggagacuggccacuucaau

SEQ ID NO: 310247 - RNA, 19 nt, Homo sapiens
ucaagaagggcaccuacga

SEQ ID NO: 310248 - RNA, 19 nt, Homo sapiens
agacuggccacuucaaugu

SEQ ID NO: 310249 - RNA, 19 nt, Homo sapiens
acaaggaggagccgaggaa

SEQ ID NO: 310250 - RNA, 19 nt, Homo sapiens
gaaggugaaggccgagagu

SEQ ID NO: 310251 - RNA, 19 nt, Homo sapiens
caaagcccagcgccaagaa

SEQ ID NO: 310252 - RNA, 19 nt, Homo sapiens
gcuccaaggacgccaacaa

SEQ ID NO: 310253 - RNA, 19 nt, Homo sapiens
aagauggcccugaaagaga

SEQ ID NO: 310254 - RNA, 19 nt, Homo sapiens
caucgaggugcacuucaaa

SEQ ID NO: 310255 - RNA, 19 nt, Homo sapiens
ccaaagcccagcgccaaga

SEQ ID NO: 310256 - RNA, 19 nt, Homo sapiens
guacgcuggcuucaucaug

SEQ ID NO: 310257 - RNA, 19 nt, Homo sapiens
gaugguaaugcccgaagga

SEQ ID NO: 310258 - RNA, 19 nt, Homo sapiens
ccagacgcgugugcaagga

SEQ ID NO: 310259 - RNA, 19 nt, Homo sapiens
gcucagacuccagcucaga

SEQ ID NO: 310260 - RNA, 19 nt, Homo sapiens
aacccaagauggcccugaa

SEQ ID NO: 310261 - RNA, 19 nt, Homo sapiens
ccagaaccacagccaagga

SEQ ID NO: 310262 - RNA, 19 nt, Homo sapiens
gaggagacuggccacuuca

SEQ ID NO: 310263 - RNA, 19 nt, Homo sapiens
gacuccagguugagcuuca

SEQ ID NO: 310264 - RNA, 19 nt, Homo sapiens
acgacuggaugguguuugu

SEQ ID NO: 310265 - RNA, 19 nt, Homo sapiens
ugaaagggcuagauuauaa

SEQ ID NO: 310266 - RNA, 19 nt, Homo sapiens
uaagagcccugcuaaauaa

SEQ ID NO: 310267 - RNA, 19 nt, Homo sapiens
gaauuuggcugucugauau

SEQ ID NO: 310268 - RNA, 19 nt, Homo sapiens
gaacaguaauugccuggua

SEQ ID NO: 310269 - RNA, 19 nt, Homo sapiens
guacugagguagaucauuu

SEQ ID NO: 310270 - RNA, 19 nt, Homo sapiens
gugcauagaucaauuugua

SEQ ID NO: 310271 - RNA, 19 nt, Homo sapiens
ggacagaagugcaauuuag

SEQ ID NO: 310272 - RNA, 19 nt, Homo sapiens
gaagugcaauuuagcuuaa

SEQ ID NO: 310273 - RNA, 19 nt, Homo sapiens
gaaaucugcuucuuagaga

SEQ ID NO: 310274 - RNA, 19 nt, Homo sapiens
caagaaaggugaccgaaga

SEQ ID NO: 310275 - RNA, 19 nt, Homo sapiens
ggaggaaagucaaaucuug

SEQ ID NO: 310276 - RNA, 19 nt, Homo sapiens
aaacuugccuuauuuggua

SEQ ID NO: 310277 - RNA, 19 nt, Homo sapiens
gaaagaauaugugaucugu

SEQ ID NO: 310278 - RNA, 19 nt, Homo sapiens
guaauugccugguagguuu

SEQ ID NO: 310279 - RNA, 19 nt, Homo sapiens
ggauacaaguugcaaauga

SEQ ID NO: 310280 - RNA, 19 nt, Homo sapiens
ggagggagaaccauauuua

SEQ ID NO: 310281 - RNA, 19 nt, Homo sapiens
gaacaguggcuugauaaua

SEQ ID NO: 310282 - RNA, 19 nt, Homo sapiens
gaaagagacugugauaaca

SEQ ID NO: 310283 - RNA, 19 nt, Homo sapiens
gagaaagggugaagcagaa

SEQ ID NO: 310284 - RNA, 19 nt, Homo sapiens
ggaauaacgugccagcuau

SEQ ID NO: 310285 - RNA, 19 nt, Homo sapiens
uaacaaaugugcauagauc

SEQ ID NO: 310286 - RNA, 19 nt, Homo sapiens
gagcagaccuacuccaaug

SEQ ID NO: 310287 - RNA, 19 nt, Homo sapiens
ugagguagaucauuugaaa

SEQ ID NO: 310288 - RNA, 19 nt, Homo sapiens
gaaaugaggagaaacaguu

SEQ ID NO: 310289 - RNA, 19 nt, Homo sapiens
caaaugaaaugaggagaaa

SEQ ID NO: 310290 - RNA, 19 nt, Homo sapiens
gaggauuaauugcuguuua

SEQ ID NO: 310291 - RNA, 19 nt, Homo sapiens
aaauuuagcugccuuguau

SEQ ID NO: 310292 - RNA, 19 nt, Homo sapiens
gaaagguaguggcugauga

SEQ ID NO: 310293 - RNA, 19 nt, Homo sapiens
gaggaaagcagaagauaaa

SEQ ID NO: 310294 - RNA, 19 nt, Homo sapiens
gaaaguccaugauaaagag

SEQ ID NO: 310295 - RNA, 19 nt, Homo sapiens
gaaaaucacuggccuaugu

SEQ ID NO: 310296 - RNA, 19 nt, Homo sapiens
gggagaaccauauuuauuu

SEQ ID NO: 310297 - RNA, 19 nt, Homo sapiens
gccgaaauauccuuuaauu

SEQ ID NO: 310298 - RNA, 19 nt, Homo sapiens
ggacaaggcaccagaauca

SEQ ID NO: 310299 - RNA, 19 nt, Homo sapiens
gaaagggacucucuaacag

SEQ ID NO: 310300 - RNA, 19 nt, Homo sapiens
gcagaaagagacugugaua

SEQ ID NO: 310301 - RNA, 19 nt, Homo sapiens
gccaagaacugaaccaaug

SEQ ID NO: 310302 - RNA, 19 nt, Homo sapiens
ggaauaagaccacucauag

SEQ ID NO: 310303 - RNA, 19 nt, Homo sapiens
uaacggauguaagguauuu

SEQ ID NO: 310304 - RNA, 19 nt, Homo sapiens
gaaauagaaucacaauagg

SEQ ID NO: 310305 - RNA, 19 nt, Homo sapiens
gaagggaaccaacauuuau

SEQ ID NO: 310306 - RNA, 19 nt, Homo sapiens
gagaggauguagagauuug

SEQ ID NO: 310307 - RNA, 19 nt, Homo sapiens
gauacaaguugcaaaugaa

SEQ ID NO: 310308 - RNA, 19 nt, Homo sapiens
caacaacagugugaucauu

SEQ ID NO: 310309 - RNA, 19 nt, Homo sapiens
cuugugagccuauauauua

SEQ ID NO: 310310 - RNA, 19 nt, Homo sapiens
guucuuugguugucacuua

SEQ ID NO: 310311 - RNA, 19 nt, Homo sapiens
cuagagcgcugcacauuga

SEQ ID NO: 310312 - RNA, 19 nt, Homo sapiens
aagaauaugugaucuguga

SEQ ID NO: 310313 - RNA, 19 nt, Homo sapiens
ccaucgacauguauuguua

SEQ ID NO: 310314 - RNA, 19 nt, Homo sapiens
ggugaaagccagagaauga

SEQ ID NO: 310315 - RNA, 19 nt, Homo sapiens
gagcgaugcuuaucucuca

SEQ ID NO: 310316 - RNA, 19 nt, Homo sapiens
gaaguaacacaaucagaaa

SEQ ID NO: 310317 - RNA, 19 nt, Homo sapiens
gcagaaagcagaguuaaug

SEQ ID NO: 310318 - RNA, 19 nt, Homo sapiens
ggaaagaggagcugucaga

SEQ ID NO: 310319 - RNA, 19 nt, Homo sapiens
gaagagauucugaaggaaa

SEQ ID NO: 310320 - RNA, 19 nt, Homo sapiens
gaagacauuuccagguaga

SEQ ID NO: 310321 - RNA, 19 nt, Homo sapiens
gaaggguuguguucuuuau

SEQ ID NO: 310322 - RNA, 19 nt, Homo sapiens
gaacaagaaacaugaaauc

SEQ ID NO: 310323 - RNA, 19 nt, Homo sapiens
ggucuacaguuauguggua

SEQ ID NO: 310324 - RNA, 19 nt, Homo sapiens
gaacaagccaccugucaau

SEQ ID NO: 310325 - RNA, 19 nt, Homo sapiens
gaaaucccaugugcccaua

SEQ ID NO: 310326 - RNA, 19 nt, Homo sapiens
aaguagagcuggaauuuga

SEQ ID NO: 310327 - RNA, 19 nt, Homo sapiens
gcagugaaaguccaugaua

SEQ ID NO: 310328 - RNA, 19 nt, Homo sapiens
gaaacuguagaucucauua

SEQ ID NO: 310329 - RNA, 19 nt, Homo sapiens
gcacgcaugugucccaaau

SEQ ID NO: 310330 - RNA, 19 nt, Homo sapiens
uaaaggagaguaacuaaug

SEQ ID NO: 310331 - RNA, 19 nt, Homo sapiens
gaaucaggcuuuauuucga

SEQ ID NO: 310332 - RNA, 19 nt, Homo sapiens
gcaccagaaucaggcuuua

SEQ ID NO: 310333 - RNA, 19 nt, Homo sapiens
uuaaauggguguaugaaug

SEQ ID NO: 310334 - RNA, 19 nt, Homo sapiens
gaaaucaaaucacagucau

SEQ ID NO: 310335 - RNA, 19 nt, Homo sapiens
ggaagaagcacagcucuga

SEQ ID NO: 310336 - RNA, 19 nt, Homo sapiens
gggaauaagaccacucaua

SEQ ID NO: 310337 - RNA, 19 nt, Homo sapiens
uauggugaguugacaaaua

SEQ ID NO: 310338 - RNA, 19 nt, Homo sapiens
guccaucuguuauauguaa

SEQ ID NO: 310339 - RNA, 19 nt, Homo sapiens
caugaaaucugcuucuuag

SEQ ID NO: 310340 - RNA, 19 nt, Homo sapiens
auagaggucugaaggauuu

SEQ ID NO: 310341 - RNA, 19 nt, Homo sapiens
gaugagcugucuagucgaa

SEQ ID NO: 310342 - RNA, 19 nt, Homo sapiens
gaauugugccuuugaguga

SEQ ID NO: 310343 - RNA, 19 nt, Homo sapiens
ggagcuuacuguuuuauua

SEQ ID NO: 310344 - RNA, 19 nt, Homo sapiens
cagcaagcauuuaucagaa

SEQ ID NO: 310345 - RNA, 19 nt, Homo sapiens
gaugugugauuccugauga

SEQ ID NO: 310346 - RNA, 19 nt, Homo sapiens
cacaauaggaggagaauuu

SEQ ID NO: 310347 - RNA, 19 nt, Homo sapiens
ggaaauggaagaacacugu

SEQ ID NO: 310348 - RNA, 19 nt, Homo sapiens
gaagcagaaagcagaguua

SEQ ID NO: 310349 - RNA, 19 nt, Homo sapiens
gcaauggaacugcaacuug

SEQ ID NO: 310350 - RNA, 19 nt, Homo sapiens
gggaugcuaggaucaauua

SEQ ID NO: 310351 - RNA, 19 nt, Homo sapiens
uuacuccucugcuuuauga

SEQ ID NO: 310352 - RNA, 19 nt, Homo sapiens
uuaagagcccugcuaaaua

SEQ ID NO: 310353 - RNA, 19 nt, Homo sapiens
cuacuuuggucauuggaua

SEQ ID NO: 310354 - RNA, 19 nt, Homo sapiens
cugaagacauuuccaggua

SEQ ID NO: 310355 - RNA, 19 nt, Homo sapiens
aguagaauuugcacacuua

SEQ ID NO: 310356 - RNA, 19 nt, Homo sapiens
gaacuguggcccuccguaa

SEQ ID NO: 310357 - RNA, 19 nt, Homo sapiens
ccagauggcuaaagugcuu

SEQ ID NO: 310358 - RNA, 19 nt, Homo sapiens
gaagaagggaaccaacauu

SEQ ID NO: 310359 - RNA, 19 nt, Homo sapiens
gaaagccagucauccaagu

SEQ ID NO: 310360 - RNA, 19 nt, Homo sapiens
ucagacagcucaagcaagu

SEQ ID NO: 310361 - RNA, 19 nt, Homo sapiens
guucauggcagcagcaaua

SEQ ID NO: 310362 - RNA, 19 nt, Homo sapiens
ggaaagacgcaaccaggaa

SEQ ID NO: 310363 - RNA, 19 nt, Homo sapiens
agaaaccugcuucgaauua

SEQ ID NO: 310364 - RNA, 19 nt, Homo sapiens
ggccaucuguaaaccauaa

SEQ ID NO: 310365 - RNA, 19 nt, Homo sapiens
caaacaaccuucagcuuua

SEQ ID NO: 310366 - RNA, 19 nt, Homo sapiens
ugaaagaucugcauucuga

SEQ ID NO: 310367 - RNA, 19 nt, Homo sapiens
ucaacacacugccuuauua

SEQ ID NO: 310368 - RNA, 19 nt, Homo sapiens
ggacacagauuaucaacug

SEQ ID NO: 310369 - RNA, 19 nt, Homo sapiens
agaagaaacuggacacuuu

SEQ ID NO: 310370 - RNA, 19 nt, Homo sapiens
uaagaaggcuccuaguaaa

SEQ ID NO: 310371 - RNA, 19 nt, Homo sapiens
gaauugcugucuagccuua

SEQ ID NO: 310372 - RNA, 19 nt, Homo sapiens
ggagaggccuguaaauaga

SEQ ID NO: 310373 - RNA, 19 nt, Homo sapiens
caaagaauccucuaagaaa

SEQ ID NO: 310374 - RNA, 19 nt, Homo sapiens
caaagaauguguaugguau

SEQ ID NO: 310375 - RNA, 19 nt, Homo sapiens
gcucagaggcuuuauuuaa

SEQ ID NO: 310376 - RNA, 19 nt, Homo sapiens
gaagaagaaaucaacguua

SEQ ID NO: 310377 - RNA, 19 nt, Homo sapiens
cagcucaucuucaaaguuu

SEQ ID NO: 310378 - RNA, 19 nt, Homo sapiens
gaaaauaguuccuaagaug

SEQ ID NO: 310379 - RNA, 19 nt, Homo sapiens
ccaaauagccaccuugauu

SEQ ID NO: 310380 - RNA, 19 nt, Homo sapiens
gcaaagauccaccuuacaa

SEQ ID NO: 310381 - RNA, 19 nt, Homo sapiens
cagaugaaguggaggauaa

SEQ ID NO: 310382 - RNA, 19 nt, Homo sapiens
gauaagaaggcuccuagua

SEQ ID NO: 310383 - RNA, 19 nt, Homo sapiens
agaguuagcuuaagugaug

SEQ ID NO: 310384 - RNA, 19 nt, Homo sapiens
gcuaauauuuccagaagga

SEQ ID NO: 310385 - RNA, 19 nt, Homo sapiens
uucaaagccucacaaauua

SEQ ID NO: 310386 - RNA, 19 nt, Homo sapiens
gaauguguaugguaucaug

SEQ ID NO: 310387 - RNA, 19 nt, Homo sapiens
ccagugaccuuacucguau

SEQ ID NO: 310388 - RNA, 19 nt, Homo sapiens
cagcagaucgugaaccuua

SEQ ID NO: 310389 - RNA, 19 nt, Homo sapiens
uagauucagugguucaaua

SEQ ID NO: 310390 - RNA, 19 nt, Homo sapiens
gcauacagauauucuaagu

SEQ ID NO: 310391 - RNA, 19 nt, Homo sapiens
gaaauggagaggccuguaa

SEQ ID NO: 310392 - RNA, 19 nt, Homo sapiens
ccgcuuugauuaugacuua

SEQ ID NO: 310393 - RNA, 19 nt, Homo sapiens
ccaaauaggaucauaugaa

SEQ ID NO: 310394 - RNA, 19 nt, Homo sapiens
caagaaaacucaaagaaug

SEQ ID NO: 310395 - RNA, 19 nt, Homo sapiens
gaacagcucaucuucaaag

SEQ ID NO: 310396 - RNA, 19 nt, Homo sapiens
caucagacauuauaaguac

SEQ ID NO: 310397 - RNA, 19 nt, Homo sapiens
ggaccacucuucucuccaa

SEQ ID NO: 310398 - RNA, 19 nt, Homo sapiens
ucaaacaaccuucagcuuu

SEQ ID NO: 310399 - RNA, 19 nt, Homo sapiens
ggaagaaccuaggaaaguc

SEQ ID NO: 310400 - RNA, 19 nt, Homo sapiens
cacacugccuuauuacaua

SEQ ID NO: 310401 - RNA, 19 nt, Homo sapiens
uuucaaagccucacaaauu

SEQ ID NO: 310402 - RNA, 19 nt, Homo sapiens
aaggagagguuaaagcaaa

SEQ ID NO: 310403 - RNA, 19 nt, Homo sapiens
aagcaaagcaaaucagaua

SEQ ID NO: 310404 - RNA, 19 nt, Homo sapiens
ccuuugaggucuauaauga

SEQ ID NO: 310405 - RNA, 19 nt, Homo sapiens
ccaaagaauccucuaagaa

SEQ ID NO: 310406 - RNA, 19 nt, Homo sapiens
acagaggacuuuaggagaa

SEQ ID NO: 310407 - RNA, 19 nt, Homo sapiens
caauaaacuuguaggacuu

SEQ ID NO: 310408 - RNA, 19 nt, Homo sapiens
cuacagaguuaccuggaaa

SEQ ID NO: 310409 - RNA, 19 nt, Homo sapiens
uaaagaauggugaauguga

SEQ ID NO: 310410 - RNA, 19 nt, Homo sapiens
uaacgacaaugacucugaa

SEQ ID NO: 310411 - RNA, 19 nt, Homo sapiens
gcaaaucagauaagcaaau

SEQ ID NO: 310412 - RNA, 19 nt, Homo sapiens
gacaaugacucugaaaugg

SEQ ID NO: 310413 - RNA, 19 nt, Homo sapiens
ggaggaaucagaugaagug

SEQ ID NO: 310414 - RNA, 19 nt, Homo sapiens
gaagaacucucagccaaaa

SEQ ID NO: 310415 - RNA, 19 nt, Homo sapiens
uucaauaccuguuuaguug

SEQ ID NO: 310416 - RNA, 19 nt, Homo sapiens
gaucgugaaccuuauagaa

SEQ ID NO: 310417 - RNA, 19 nt, Homo sapiens
gcaaauaaagaauggugaa

SEQ ID NO: 310418 - RNA, 19 nt, Homo sapiens
gaaagugagacaucagaga

SEQ ID NO: 310419 - RNA, 19 nt, Homo sapiens
gcagccucuucaugaauua

SEQ ID NO: 310420 - RNA, 19 nt, Homo sapiens
cauagcagccucuucauga

SEQ ID NO: 310421 - RNA, 19 nt, Homo sapiens
ggaaugacaccaucagaca

SEQ ID NO: 310422 - RNA, 19 nt, Homo sapiens
gcagaucgugaaccuuaua

SEQ ID NO: 310423 - RNA, 19 nt, Homo sapiens
aaacaaaaguguaccugua

SEQ ID NO: 310424 - RNA, 19 nt, Homo sapiens
agaguuaccuggaaacauc

SEQ ID NO: 310425 - RNA, 19 nt, Homo sapiens
gaagugaaaaguccaauaa

SEQ ID NO: 310426 - RNA, 19 nt, Homo sapiens
auaagaaggcuccuaguaa

SEQ ID NO: 310427 - RNA, 19 nt, Homo sapiens
gugcaaagauccaccuuac

SEQ ID NO: 310428 - RNA, 19 nt, Homo sapiens
ugucuagccuuagucaaua

SEQ ID NO: 310429 - RNA, 19 nt, Homo sapiens
ucaaagaauguguauggua

SEQ ID NO: 310430 - RNA, 19 nt, Homo sapiens
cgacaaugacucugaaaug

SEQ ID NO: 310431 - RNA, 19 nt, Homo sapiens
caacguuaccgccauuuga

SEQ ID NO: 310432 - RNA, 19 nt, Homo sapiens
auaaaccacugaaagaaga

SEQ ID NO: 310433 - RNA, 19 nt, Homo sapiens
caaggaagaaccuaggaaa

SEQ ID NO: 310434 - RNA, 19 nt, Homo sapiens
cauaugaauugcugucuag

SEQ ID NO: 310435 - RNA, 19 nt, Homo sapiens
ccaaguccuuuaacucguu

SEQ ID NO: 310436 - RNA, 19 nt, Homo sapiens
caucagagaagaagaaauc

SEQ ID NO: 310437 - RNA, 19 nt, Homo sapiens
gaaccuaaacccaugucaa

SEQ ID NO: 310438 - RNA, 19 nt, Homo sapiens
aaagaauucugguccuguu

SEQ ID NO: 310439 - RNA, 19 nt, Homo sapiens
uccacaggaucaucauuua

SEQ ID NO: 310440 - RNA, 19 nt, Homo sapiens
gacaaggcauaccuagaug

SEQ ID NO: 310441 - RNA, 19 nt, Homo sapiens
ccacugauacucacuuguu

SEQ ID NO: 310442 - RNA, 19 nt, Homo sapiens
agauccaccuuacaaagua

SEQ ID NO: 310443 - RNA, 19 nt, Homo sapiens
caaagauccaccuuacaaa

SEQ ID NO: 310444 - RNA, 19 nt, Homo sapiens
gggaagaguuagccuggau

SEQ ID NO: 310445 - RNA, 19 nt, Homo sapiens
ugacaaggcauaccuagau

SEQ ID NO: 310446 - RNA, 19 nt, Homo sapiens
ccagauucuugaagugaaa

SEQ ID NO: 310447 - RNA, 19 nt, Homo sapiens
caaccagauucuugaagug

SEQ ID NO: 310448 - RNA, 19 nt, Homo sapiens
gagaauguccgccaucuac

SEQ ID NO: 310449 - RNA, 19 nt, Homo sapiens
gugguucaauaccuguuua

SEQ ID NO: 310450 - RNA, 19 nt, Homo sapiens
uaaaggagagguuaaagca

SEQ ID NO: 310451 - RNA, 19 nt, Homo sapiens
aaacaaccuucagcuuuau

SEQ ID NO: 310452 - RNA, 19 nt, Homo sapiens
uaacauacagcacuuugug

SEQ ID NO: 310453 - RNA, 19 nt, Homo sapiens
ugaggucuauaaugaaaga

SEQ ID NO: 310454 - RNA, 19 nt, Homo sapiens
gaaaauaaaccacugaaag

SEQ ID NO: 310455 - RNA, 19 nt, Homo sapiens
gacaccaucagacauuaua

SEQ ID NO: 310456 - RNA, 19 nt, Homo sapiens
acaacuggaugcaucaaga

SEQ ID NO: 310457 - RNA, 19 nt, Homo sapiens
aaacuggacacuuucauau

SEQ ID NO: 310458 - RNA, 19 nt, Homo sapiens
gcaaagcaaaucagauaag

SEQ ID NO: 310459 - RNA, 19 nt, Homo sapiens
uagcucagaggcuuuauuu

SEQ ID NO: 310460 - RNA, 19 nt, Homo sapiens
ucuaagaaacccaaagaaa

SEQ ID NO: 310461 - RNA, 19 nt, Homo sapiens
guggagaaaugaaaaguaa

SEQ ID NO: 310462 - RNA, 19 nt, Homo sapiens
uauuccaucuucuccauaa

SEQ ID NO: 310463 - RNA, 19 nt, Homo sapiens
guucaauaccuguuuaguu

SEQ ID NO: 310464 - RNA, 19 nt, Homo sapiens
guucacauaugauucucuu

SEQ ID NO: 310465 - RNA, 19 nt, Homo sapiens
gaaagaaccugaaauaauc

SEQ ID NO: 310466 - RNA, 19 nt, Homo sapiens
gaaggcagauuuguucuua

SEQ ID NO: 310467 - RNA, 19 nt, Homo sapiens
gaaagaagauuggauauag

SEQ ID NO: 310468 - RNA, 19 nt, Homo sapiens
gcuuugagcucuauaauaa

SEQ ID NO: 310469 - RNA, 19 nt, Homo sapiens
gaaaccagcuuuacucgaa

SEQ ID NO: 310470 - RNA, 19 nt, Homo sapiens
ugagaaaccucuaguugua

SEQ ID NO: 310471 - RNA, 19 nt, Homo sapiens
gaaaggaggugcugcagau

SEQ ID NO: 310472 - RNA, 19 nt, Homo sapiens
ggaaagaaccugaaauaau

SEQ ID NO: 310473 - RNA, 19 nt, Homo sapiens
gaacuucucaacuucauua

SEQ ID NO: 310474 - RNA, 19 nt, Homo sapiens
cggagaagcugcccuauuu

SEQ ID NO: 310475 - RNA, 19 nt, Homo sapiens
gaggaaagaaccugaaaua

SEQ ID NO: 310476 - RNA, 19 nt, Homo sapiens
gguggaacauugagaauuu

SEQ ID NO: 310477 - RNA, 19 nt, Homo sapiens
ggagaaagaagauuggaua

SEQ ID NO: 310478 - RNA, 19 nt, Homo sapiens
gaacgaagagcgaggguaa

SEQ ID NO: 310479 - RNA, 19 nt, Homo sapiens
gauacuaccugcaagcauu

SEQ ID NO: 310480 - RNA, 19 nt, Homo sapiens
gaagcugcccuauuuagua

SEQ ID NO: 310481 - RNA, 19 nt, Homo sapiens
gaagggaagugcaguugga

SEQ ID NO: 310482 - RNA, 19 nt, Homo sapiens
caucugaacuucucaacuu

SEQ ID NO: 310483 - RNA, 19 nt, Homo sapiens
agauaaagcuuaccaacuu

SEQ ID NO: 310484 - RNA, 19 nt, Homo sapiens
caacggaucuuauagaaaa

SEQ ID NO: 310485 - RNA, 19 nt, Homo sapiens
cuacagagcgcacacauaa

SEQ ID NO: 310486 - RNA, 19 nt, Homo sapiens
ccaaaugguuuacaagaau

SEQ ID NO: 310487 - RNA, 19 nt, Homo sapiens
gcucuacaguccacuuuaa

SEQ ID NO: 310488 - RNA, 19 nt, Homo sapiens
gauggaggccugaugguua

SEQ ID NO: 310489 - RNA, 19 nt, Homo sapiens
ggagagagcaggagaggaa

SEQ ID NO: 310490 - RNA, 19 nt, Homo sapiens
gcaaaugcaucugaacuuc

SEQ ID NO: 310491 - RNA, 19 nt, Homo sapiens
guuaagggcccaagacaua

SEQ ID NO: 310492 - RNA, 19 nt, Homo sapiens
gcacacagauaguaaucau

SEQ ID NO: 310493 - RNA, 19 nt, Homo sapiens
gaaauugccuggugaugac

SEQ ID NO: 310494 - RNA, 19 nt, Homo sapiens
uagaacagcagccagauua

SEQ ID NO: 310495 - RNA, 19 nt, Homo sapiens
uuacaaaucuucagggaau

SEQ ID NO: 310496 - RNA, 19 nt, Homo sapiens
ccacauaugcacacagaua

SEQ ID NO: 310497 - RNA, 19 nt, Homo sapiens
gaagauuggauauagauga

SEQ ID NO: 310498 - RNA, 19 nt, Homo sapiens
gcagaacucaugacaagaa

SEQ ID NO: 310499 - RNA, 19 nt, Homo sapiens
ggagacaacuuuugauuug

SEQ ID NO: 310500 - RNA, 19 nt, Homo sapiens
gauaaagcuuaccaacuug

SEQ ID NO: 310501 - RNA, 19 nt, Homo sapiens
guaugcaccugaugacauu

SEQ ID NO: 310502 - RNA, 19 nt, Homo sapiens
acauaaaccuggaauuguu

SEQ ID NO: 310503 - RNA, 19 nt, Homo sapiens
aaagggugcuaaagaaauu

SEQ ID NO: 310504 - RNA, 19 nt, Homo sapiens
gaugagaaaccucuaguug

SEQ ID NO: 310505 - RNA, 19 nt, Homo sapiens
gcagagacuugcaguacau

SEQ ID NO: 310506 - RNA, 19 nt, Homo sapiens
gaacaucagcguugguaug

SEQ ID NO: 310507 - RNA, 19 nt, Homo sapiens
ggaacaacagcgaagauaa

SEQ ID NO: 310508 - RNA, 19 nt, Homo sapiens
ccagguacuuggacaauau

SEQ ID NO: 310509 - RNA, 19 nt, Homo sapiens
gcaagacacccaagggaaa

SEQ ID NO: 310510 - RNA, 19 nt, Homo sapiens
caacugaauuggaacaaag

SEQ ID NO: 310511 - RNA, 19 nt, Homo sapiens
ggaguuccauggagugaug

SEQ ID NO: 310512 - RNA, 19 nt, Homo sapiens
gauaacaucugucucuacu

SEQ ID NO: 310513 - RNA, 19 nt, Homo sapiens
gcgcacacauaaagucauu

SEQ ID NO: 310514 - RNA, 19 nt, Homo sapiens
gcauaugccucuggaacaa

SEQ ID NO: 310515 - RNA, 19 nt, Homo sapiens
gaauauagugaaccaaaga

SEQ ID NO: 310516 - RNA, 19 nt, Homo sapiens
cgacuuugcuuaccaugga

SEQ ID NO: 310517 - RNA, 19 nt, Homo sapiens
cuacgacgcugcagaguca

SEQ ID NO: 310518 - RNA, 19 nt, Homo sapiens
ggagaagcugcccuauuua

SEQ ID NO: 310519 - RNA, 19 nt, Homo sapiens
ggagaaauuucgaccugau

SEQ ID NO: 310520 - RNA, 19 nt, Homo sapiens
gaacucaugacaagaacaa

SEQ ID NO: 310521 - RNA, 19 nt, Homo sapiens
cagaaccaguggccaaauu

SEQ ID NO: 310522 - RNA, 19 nt, Homo sapiens
gugaucagcuccucagugu

SEQ ID NO: 310523 - RNA, 19 nt, Homo sapiens
gguucugacucuagagaua

SEQ ID NO: 310524 - RNA, 19 nt, Homo sapiens
cugcugagguuuacaaaga

SEQ ID NO: 310525 - RNA, 19 nt, Homo sapiens
gaugcgcacucaguccuua

SEQ ID NO: 310526 - RNA, 19 nt, Homo sapiens
caucagcguugguaugaga

SEQ ID NO: 310527 - RNA, 19 nt, Homo sapiens
cugaugacauuccaaauau

SEQ ID NO: 310528 - RNA, 19 nt, Homo sapiens
ggaacuggcugcggacugu

SEQ ID NO: 310529 - RNA, 19 nt, Homo sapiens
cgccuucaguuaaguguua

SEQ ID NO: 310530 - RNA, 19 nt, Homo sapiens
gcuggaaacuuugcaacaa

SEQ ID NO: 310531 - RNA, 19 nt, Homo sapiens
gagaauuuaugcagauagu

SEQ ID NO: 310532 - RNA, 19 nt, Homo sapiens
cggcagaacucaugacaag

SEQ ID NO: 310533 - RNA, 19 nt, Homo sapiens
gggaggagauauucauagu

SEQ ID NO: 310534 - RNA, 19 nt, Homo sapiens
ucgaaacgcucgcggagaa

SEQ ID NO: 310535 - RNA, 19 nt, Homo sapiens
gauaguaaucauuccagua

SEQ ID NO: 310536 - RNA, 19 nt, Homo sapiens
gaacaacagcgaagauaac

SEQ ID NO: 310537 - RNA, 19 nt, Homo sapiens
gagaggauuuugcagguua

SEQ ID NO: 310538 - RNA, 19 nt, Homo sapiens
cuucaagccuuauuacaga

SEQ ID NO: 310539 - RNA, 19 nt, Homo sapiens
gcaguugggccauauugaa

SEQ ID NO: 310540 - RNA, 19 nt, Homo sapiens
gauuaucgcaggcaagaaa

SEQ ID NO: 310541 - RNA, 19 nt, Homo sapiens
gcaugaaagugcaguuugg

SEQ ID NO: 310542 - RNA, 19 nt, Homo sapiens
gaugaugaguguccuuuac

SEQ ID NO: 310543 - RNA, 19 nt, Homo sapiens
ccaaauauucccuacaaga

SEQ ID NO: 310544 - RNA, 19 nt, Homo sapiens
gauuggauauagaugagaa

SEQ ID NO: 310545 - RNA, 19 nt, Homo sapiens
gagaaauuucgaccugaua

SEQ ID NO: 310546 - RNA, 19 nt, Homo sapiens
gaaaacaccagcagccaua

SEQ ID NO: 310547 - RNA, 19 nt, Homo sapiens
gcagagaauuucagaucgu

SEQ ID NO: 310548 - RNA, 19 nt, Homo sapiens
ggaauggccaagugacaaa

SEQ ID NO: 310549 - RNA, 19 nt, Homo sapiens
guggaacauugagaauuua

SEQ ID NO: 310550 - RNA, 19 nt, Homo sapiens
caaaguaauggaccugaaa

SEQ ID NO: 310551 - RNA, 19 nt, Homo sapiens
gaacggagaaagagagaag

SEQ ID NO: 310552 - RNA, 19 nt, Homo sapiens
gcaaaucagccuccuaguc

SEQ ID NO: 310553 - RNA, 19 nt, Homo sapiens
ccugaugacauuccaaaua

SEQ ID NO: 310554 - RNA, 19 nt, Homo sapiens
ugucuucaaucagaacuua

SEQ ID NO: 310555 - RNA, 19 nt, Homo sapiens
aaccaaauauucccuacaa

SEQ ID NO: 310556 - RNA, 19 nt, Homo sapiens
ugauucagguggaacauug

SEQ ID NO: 310557 - RNA, 19 nt, Homo sapiens
gaaagucugauagugauau

SEQ ID NO: 310558 - RNA, 19 nt, Homo sapiens
agauaaagcugcuggaaac

SEQ ID NO: 310559 - RNA, 19 nt, Homo sapiens
caacagcgaagauaacauc

SEQ ID NO: 310560 - RNA, 19 nt, Homo sapiens
gggcgucccauguauuuaa

SEQ ID NO: 310561 - RNA, 19 nt, Homo sapiens
ugaaaagggugcuaaagaa

SEQ ID NO: 310562 - RNA, 19 nt, Homo sapiens
gaagcuggccgacaucauc

SEQ ID NO: 310563 - RNA, 19 nt, Homo sapiens
ggagaaagagagaagaaca

SEQ ID NO: 310564 - RNA, 19 nt, Homo sapiens
ccaaguauucacucuauga

SEQ ID NO: 310565 - RNA, 19 nt, Homo sapiens
gaagaggacugauaaugga

SEQ ID NO: 310566 - RNA, 19 nt, Homo sapiens
ggaaaggugugagcaguuu

SEQ ID NO: 310567 - RNA, 19 nt, Homo sapiens
gcaggcaucuacaccagua

SEQ ID NO: 310568 - RNA, 19 nt, Homo sapiens
caugaucgcuucaacaaga

SEQ ID NO: 310569 - RNA, 19 nt, Homo sapiens
gcaaauaccacuucagcaa

SEQ ID NO: 310570 - RNA, 19 nt, Homo sapiens
guaggaggcugcugcguau

SEQ ID NO: 310571 - RNA, 19 nt, Homo sapiens
gagccugcaugaccuguaa

SEQ ID NO: 310572 - RNA, 19 nt, Homo sapiens
agacaggccugaaggagaa

SEQ ID NO: 310573 - RNA, 19 nt, Homo sapiens
ggacaaagaacgccuuaag

SEQ ID NO: 310574 - RNA, 19 nt, Homo sapiens
gagagucugucuuccaugu

SEQ ID NO: 310575 - RNA, 19 nt, Homo sapiens
gcaagagcccuccgggaaa

SEQ ID NO: 310576 - RNA, 19 nt, Homo sapiens
gcauugaagaggacugaua

SEQ ID NO: 310577 - RNA, 19 nt, Homo sapiens
gccauagccugagucauaa

SEQ ID NO: 310578 - RNA, 19 nt, Homo sapiens
agccauagccugagucaua

SEQ ID NO: 310579 - RNA, 19 nt, Homo sapiens
gcacgcaggagaccucuga

SEQ ID NO: 310580 - RNA, 19 nt, Homo sapiens
acaacucgcuguccacuuc

SEQ ID NO: 310581 - RNA, 19 nt, Homo sapiens
aaauaccacuucagcaaga

SEQ ID NO: 310582 - RNA, 19 nt, Homo sapiens
caacaacacaagucucaug

SEQ ID NO: 310583 - RNA, 19 nt, Homo sapiens
guacugcggcuacugcaaa

SEQ ID NO: 310584 - RNA, 19 nt, Homo sapiens
gcaucuacaccaguaauaa

SEQ ID NO: 310585 - RNA, 19 nt, Homo sapiens
aagaacgccuuaagcagaa

SEQ ID NO: 310586 - RNA, 19 nt, Homo sapiens
cuggcuggcucuaccuuua

SEQ ID NO: 310587 - RNA, 19 nt, Homo sapiens
gcucgucgcuguccuucca

SEQ ID NO: 310588 - RNA, 19 nt, Homo sapiens
caagagcccuccgggaaag

SEQ ID NO: 310589 - RNA, 19 nt, Homo sapiens
ccaacgugcucaccaugga

SEQ ID NO: 310590 - RNA, 19 nt, Homo sapiens
uuacagagcagcagagaca

SEQ ID NO: 310591 - RNA, 19 nt, Homo sapiens
acaaagaacgccuuaagca

SEQ ID NO: 310592 - RNA, 19 nt, Homo sapiens
ggaggcugcugcguauguu

SEQ ID NO: 310593 - RNA, 19 nt, Homo sapiens
cauugaagaggacugauaa

SEQ ID NO: 310594 - RNA, 19 nt, Homo sapiens
cauaaagggaagaaacuga

SEQ ID NO: 310595 - RNA, 19 nt, Homo sapiens
ugaagaggacugauaaugg

SEQ ID NO: 310596 - RNA, 19 nt, Homo sapiens
ugaaggagaagaagcacaa

SEQ ID NO: 310597 - RNA, 19 nt, Homo sapiens
cgucaccugugcccaaaug

SEQ ID NO: 310598 - RNA, 19 nt, Homo sapiens
ugcaguacgugccucauga

SEQ ID NO: 310599 - RNA, 19 nt, Homo sapiens
ggcaacaacacaagucuca

SEQ ID NO: 310600 - RNA, 19 nt, Homo sapiens
ggagguggcagugguuuca

SEQ ID NO: 310601 - RNA, 19 nt, Homo sapiens
uuaagcagaagcacaagaa

SEQ ID NO: 310602 - RNA, 19 nt, Homo sapiens
uggcaggcuugcuguguga

SEQ ID NO: 310603 - RNA, 19 nt, Homo sapiens
gggaaaggugugagcaguu

SEQ ID NO: 310604 - RNA, 19 nt, Homo sapiens
ccacgcagcaggagaagca

SEQ ID NO: 310605 - RNA, 19 nt, Homo sapiens
agggaccgcugacaaagga

SEQ ID NO: 310606 - RNA, 19 nt, Homo sapiens
ggcaucuacaccaguaaua

SEQ ID NO: 310607 - RNA, 19 nt, Homo sapiens
gaaggagaagaagcacaaa

SEQ ID NO: 310608 - RNA, 19 nt, Homo sapiens
aaacggaugcccgcacuga

SEQ ID NO: 310609 - RNA, 19 nt, Homo sapiens
agaacccgcuggucuacug

SEQ ID NO: 310610 - RNA, 19 nt, Homo sapiens
cagccagggugagguguga

SEQ ID NO: 310611 - RNA, 19 nt, Homo sapiens
acuguugucuaccagauga

SEQ ID NO: 310612 - RNA, 19 nt, Homo sapiens
cgccauggaugucgacaag

SEQ ID NO: 310613 - RNA, 19 nt, Homo sapiens
uccagcagauccagcagaa

SEQ ID NO: 310614 - RNA, 19 nt, Homo sapiens
ccgagaacccgcuggucua

SEQ ID NO: 310615 - RNA, 19 nt, Homo sapiens
agccagaggaggacaagua

SEQ ID NO: 310616 - RNA, 19 nt, Homo sapiens
ggagguggacaacgucaag

SEQ ID NO: 310617 - RNA, 19 nt, Homo sapiens
cagcagauccagcagaaac

SEQ ID NO: 310618 - RNA, 19 nt, Homo sapiens
gagucgaaaggacaaagaa

SEQ ID NO: 310619 - RNA, 19 nt, Homo sapiens
cagaagaagagucgaaagg

SEQ ID NO: 310620 - RNA, 19 nt, Homo sapiens
ccauggaugucgacaagcu

SEQ ID NO: 310621 - RNA, 19 nt, Homo sapiens
gagcggcugcagauucuca

SEQ ID NO: 310622 - RNA, 19 nt, Homo sapiens
gaagagucgaaaggacaaa

SEQ ID NO: 310623 - RNA, 19 nt, Homo sapiens
agaagaagagucgaaagga

SEQ ID NO: 310624 - RNA, 19 nt, Homo sapiens
ggagggaccgcugacaaag

SEQ ID NO: 310625 - RNA, 19 nt, Homo sapiens
gcagagcuccccugacuuc

SEQ ID NO: 310626 - RNA, 19 nt, Homo sapiens
uggcagugguuucaucucu

SEQ ID NO: 310627 - RNA, 19 nt, Homo sapiens
uggacaacgucaaguacug

SEQ ID NO: 310628 - RNA, 19 nt, Homo sapiens
cugccaggcugucucaaca

SEQ ID NO: 310629 - RNA, 19 nt, Homo sapiens
ccacucagguguuuucucu

SEQ ID NO: 310630 - RNA, 19 nt, Homo sapiens
caucuacaccaguaauaag

SEQ ID NO: 310631 - RNA, 19 nt, Homo sapiens
gacaaagaacgccuuaagc

SEQ ID NO: 310632 - RNA, 19 nt, Homo sapiens
cauccacgcagcaggagaa

SEQ ID NO: 310633 - RNA, 19 nt, Homo sapiens
gcgucaacaucguggagau

SEQ ID NO: 310634 - RNA, 19 nt, Homo sapiens
gcaguacgugccucaugau

SEQ ID NO: 310635 - RNA, 19 nt, Homo sapiens
gggcauugaagaggacuga

SEQ ID NO: 310636 - RNA, 19 nt, Homo sapiens
gguggucuucucuggcuuu

SEQ ID NO: 310637 - RNA, 19 nt, Homo sapiens
gccuuaagcagaagcacaa

SEQ ID NO: 310638 - RNA, 19 nt, Homo sapiens
ggugugugcccucuacauc

SEQ ID NO: 310639 - RNA, 19 nt, Homo sapiens
gccagaagaagagucgaaa

SEQ ID NO: 310640 - RNA, 19 nt, Homo sapiens
ggccagaagaagagucgaa

SEQ ID NO: 310641 - RNA, 19 nt, Homo sapiens
ggagccugcaugaccugua

SEQ ID NO: 310642 - RNA, 19 nt, Homo sapiens
cagaggaggacaaguacuc

SEQ ID NO: 310643 - RNA, 19 nt, Homo sapiens
gagagcagcagggagucaa

SEQ ID NO: 310644 - RNA, 19 nt, Homo sapiens
cuacugcaaauaccacuuc

SEQ ID NO: 310645 - RNA, 19 nt, Homo sapiens
cacgucaccugugcccaaa

SEQ ID NO: 310646 - RNA, 19 nt, Homo sapiens
ggacuggacuucaacuuug

SEQ ID NO: 310647 - RNA, 19 nt, Homo sapiens
aaaggucuaugcagaaaua

SEQ ID NO: 310648 - RNA, 19 nt, Homo sapiens
ggaagugugucaaaucaau

SEQ ID NO: 310649 - RNA, 19 nt, Homo sapiens
ccacgaagcaguucaaaug

SEQ ID NO: 310650 - RNA, 19 nt, Homo sapiens
gcaaugcuguuggaaaugu

SEQ ID NO: 310651 - RNA, 19 nt, Homo sapiens
gagaagcgacugacacuug

SEQ ID NO: 310652 - RNA, 19 nt, Homo sapiens
ggaaggauuuaggauggua

SEQ ID NO: 310653 - RNA, 19 nt, Homo sapiens
cagccacacucuucuauga

SEQ ID NO: 310654 - RNA, 19 nt, Homo sapiens
gcagaaauagguuagaguu

SEQ ID NO: 310655 - RNA, 19 nt, Homo sapiens
gauagugacaugauacaaa

SEQ ID NO: 310656 - RNA, 19 nt, Homo sapiens
ggacccugcuuuagagcua

SEQ ID NO: 310657 - RNA, 19 nt, Homo sapiens
gaccagagaucgcuaacca

SEQ ID NO: 310658 - RNA, 19 nt, Homo sapiens
guucauaucuacucuuuac

SEQ ID NO: 310659 - RNA, 19 nt, Homo sapiens
uggagaaccuggaguguga

SEQ ID NO: 310660 - RNA, 19 nt, Homo sapiens
gaagugugucaaaucaaua

SEQ ID NO: 310661 - RNA, 19 nt, Homo sapiens
cagauuguaucaugugcua

SEQ ID NO: 310662 - RNA, 19 nt, Homo sapiens
cagcuucagucagcaguua

SEQ ID NO: 310663 - RNA, 19 nt, Homo sapiens
gagaaggagggaaggauuu

SEQ ID NO: 310664 - RNA, 19 nt, Homo sapiens
gaagucaccaguggccuua

SEQ ID NO: 310665 - RNA, 19 nt, Homo sapiens
uggauaacaucaucaguga

SEQ ID NO: 310666 - RNA, 19 nt, Homo sapiens
ugacauggauaacaucauc

SEQ ID NO: 310667 - RNA, 19 nt, Homo sapiens
gagaaaggucuaugcagaa

SEQ ID NO: 310668 - RNA, 19 nt, Homo sapiens
caaacacuacagacaauaa

SEQ ID NO: 310669 - RNA, 19 nt, Homo sapiens
caucaucagugaccucaug

SEQ ID NO: 310670 - RNA, 19 nt, Homo sapiens
cagaaugccucaggaucua

SEQ ID NO: 310671 - RNA, 19 nt, Homo sapiens
gaaauaccagcuucaguca

SEQ ID NO: 310672 - RNA, 19 nt, Homo sapiens
gcaaguucaucaagguuca

SEQ ID NO: 310673 - RNA, 19 nt, Homo sapiens
ucagucauaugcagaauuc

SEQ ID NO: 310674 - RNA, 19 nt, Homo sapiens
agaaaggucuaugcagaaa

SEQ ID NO: 310675 - RNA, 19 nt, Homo sapiens
ggccaaaucacccuuagaa

SEQ ID NO: 310676 - RNA, 19 nt, Homo sapiens
agucaugccuggaagcuuu

SEQ ID NO: 310677 - RNA, 19 nt, Homo sapiens
gcgagggacuggacuucaa

SEQ ID NO: 310678 - RNA, 19 nt, Homo sapiens
ccagguagaucccauucug

SEQ ID NO: 310679 - RNA, 19 nt, Homo sapiens
gaauuugggacccugcuuu

SEQ ID NO: 310680 - RNA, 19 nt, Homo sapiens
gggcuuccuuccuccagua

SEQ ID NO: 310681 - RNA, 19 nt, Homo sapiens
agaccuagaucccgacuuc

SEQ ID NO: 310682 - RNA, 19 nt, Homo sapiens
ccacuuaggcuuuguagca

SEQ ID NO: 310683 - RNA, 19 nt, Homo sapiens
gaaccuggagugugacaug

SEQ ID NO: 310684 - RNA, 19 nt, Homo sapiens
cuacccagauuguaucaug

SEQ ID NO: 310685 - RNA, 19 nt, Homo sapiens
cauugaaggccuggaauua

SEQ ID NO: 310686 - RNA, 19 nt, Homo sapiens
aaucucaccucuucccauu

SEQ ID NO: 310687 - RNA, 19 nt, Homo sapiens
caacgaggccaccggcaaa

SEQ ID NO: 310688 - RNA, 19 nt, Homo sapiens
guguucauaucuacucuuu

SEQ ID NO: 310689 - RNA, 19 nt, Homo sapiens
gggacuggacuucaacuuu

SEQ ID NO: 310690 - RNA, 19 nt, Homo sapiens
gcuguuagaugggcucaau

SEQ ID NO: 310691 - RNA, 19 nt, Homo sapiens
uguagagagucuuaucuga

SEQ ID NO: 310692 - RNA, 19 nt, Homo sapiens
uguaucaugugcuagauug

SEQ ID NO: 310693 - RNA, 19 nt, Homo sapiens
cuuagaaggcugcagauaa

SEQ ID NO: 310694 - RNA, 19 nt, Homo sapiens
gagccaggcguguucauau

SEQ ID NO: 310695 - RNA, 19 nt, Homo sapiens
guucgcgacuuucugaaga

SEQ ID NO: 310696 - RNA, 19 nt, Homo sapiens
uacaaacacuacagacaau

SEQ ID NO: 310697 - RNA, 19 nt, Homo sapiens
uuagaaggcugcagauaac

SEQ ID NO: 310698 - RNA, 19 nt, Homo sapiens
gauacaaacacuacagaca

SEQ ID NO: 310699 - RNA, 19 nt, Homo sapiens
gaaggcugcagauaacaga

SEQ ID NO: 310700 - RNA, 19 nt, Homo sapiens
cacagguguugaagaaauu

SEQ ID NO: 310701 - RNA, 19 nt, Homo sapiens
gaaggugccacuccaacga

SEQ ID NO: 310702 - RNA, 19 nt, Homo sapiens
gcacagcaaguucaucaag

SEQ ID NO: 310703 - RNA, 19 nt, Homo sapiens
ugacacuugcccagauuua

SEQ ID NO: 310704 - RNA, 19 nt, Homo sapiens
ccaggcguguucauaucua

SEQ ID NO: 310705 - RNA, 19 nt, Homo sapiens
ggagccaggcguguucaua

SEQ ID NO: 310706 - RNA, 19 nt, Homo sapiens
caauaaaugccuauaacca

SEQ ID NO: 310707 - RNA, 19 nt, Homo sapiens
gggauguggaucagguuua

SEQ ID NO: 310708 - RNA, 19 nt, Homo sapiens
gaccagguauagagaaagg

SEQ ID NO: 310709 - RNA, 19 nt, Homo sapiens
ucaaaugccagcaguguca

SEQ ID NO: 310710 - RNA, 19 nt, Homo sapiens
guacauugaaggccuggaa

SEQ ID NO: 310711 - RNA, 19 nt, Homo sapiens
ccucauuccuucaacuugu

SEQ ID NO: 310712 - RNA, 19 nt, Homo sapiens
guucccacccuuucuauga

SEQ ID NO: 310713 - RNA, 19 nt, Homo sapiens
ggauguggaucagguuuac

SEQ ID NO: 310714 - RNA, 19 nt, Homo sapiens
agaaggagggaaggauuua

SEQ ID NO: 310715 - RNA, 19 nt, Homo sapiens
ggugggagaguacauugaa

SEQ ID NO: 310716 - RNA, 19 nt, Homo sapiens
cagaaauagguuagaguuu

SEQ ID NO: 310717 - RNA, 19 nt, Homo sapiens
ucugaaggcuuugugauag

SEQ ID NO: 310718 - RNA, 19 nt, Homo sapiens
guagcaagaugagcaaugc

SEQ ID NO: 310719 - RNA, 19 nt, Homo sapiens
gcccugcucaccucugaua

SEQ ID NO: 310720 - RNA, 19 nt, Homo sapiens
ccaagaagaaaccaucugu

SEQ ID NO: 310721 - RNA, 19 nt, Homo sapiens
ucaucaagguucacaacga

SEQ ID NO: 310722 - RNA, 19 nt, Homo sapiens
gauuguaucaugugcuaga

SEQ ID NO: 310723 - RNA, 19 nt, Homo sapiens
guaaaguuagguacagaga

SEQ ID NO: 310724 - RNA, 19 nt, Homo sapiens
gaaggauuuaggaugguaa

SEQ ID NO: 310725 - RNA, 19 nt, Homo sapiens
gaagagaaggagggaagga

SEQ ID NO: 310726 - RNA, 19 nt, Homo sapiens
uggaucagguuuacuagca

SEQ ID NO: 310727 - RNA, 19 nt, Homo sapiens
cugagggucugggaaauga

SEQ ID NO: 310728 - RNA, 19 nt, Homo sapiens
cggaccagguauagagaaa

SEQ ID NO: 310729 - RNA, 19 nt, Homo sapiens
ggagagguggggaguaaua

SEQ ID NO: 310730 - RNA, 19 nt, Homo sapiens
auacaaacacuacagacaa

SEQ ID NO: 310731 - RNA, 19 nt, Homo sapiens
gugaagaagccgauaugug

SEQ ID NO: 310732 - RNA, 19 nt, Homo sapiens
gugcuauggugggagagua

SEQ ID NO: 310733 - RNA, 19 nt, Homo sapiens
ggggagagguggggaguaa

SEQ ID NO: 310734 - RNA, 19 nt, Homo sapiens
ugacaugauacaaacacua

SEQ ID NO: 310735 - RNA, 19 nt, Homo sapiens
ggcucaaucucaccucuuc

SEQ ID NO: 310736 - RNA, 19 nt, Homo sapiens
ucugaagacuggcaggaau

SEQ ID NO: 310737 - RNA, 19 nt, Homo sapiens
gaaaggucuaugcagaaau

SEQ ID NO: 310738 - RNA, 19 nt, Homo sapiens
gacugacacuugcccagau

SEQ ID NO: 310739 - RNA, 19 nt, Homo sapiens
ggugcuggcggaggaaaua

SEQ ID NO: 310740 - RNA, 19 nt, Homo sapiens
gggagugugugguguuagg

SEQ ID NO: 310741 - RNA, 19 nt, Homo sapiens
guggugggcagaaugcuuu

SEQ ID NO: 310742 - RNA, 19 nt, Homo sapiens
ucccacccuuucuaugaua

SEQ ID NO: 310743 - RNA, 19 nt, Homo sapiens
uaacccagguccccucauu

SEQ ID NO: 310744 - RNA, 19 nt, Homo sapiens
ugaaggcuuugugauagug

SEQ ID NO: 310745 - RNA, 19 nt, Homo sapiens
ggggaagugugucaaauca

SEQ ID NO: 310746 - RNA, 19 nt, Homo sapiens
aaacugagcuggaaucuaa

SEQ ID NO: 310747 - RNA, 19 nt, Homo sapiens
gcaaacaaauggcuuacuu

SEQ ID NO: 310748 - RNA, 19 nt, Homo sapiens
gaagaaaugaggacaaauu

SEQ ID NO: 310749 - RNA, 19 nt, Homo sapiens
gcaauguccugcaugcaua

SEQ ID NO: 310750 - RNA, 19 nt, Homo sapiens
gcaaacagaugauccaagu

SEQ ID NO: 310751 - RNA, 19 nt, Homo sapiens
gcaaagccauauucuaaau

SEQ ID NO: 310752 - RNA, 19 nt, Homo sapiens
acaaauggcuuacuuacaa

SEQ ID NO: 310753 - RNA, 19 nt, Homo sapiens
ugaggaagaugguaacuaa

SEQ ID NO: 310754 - RNA, 19 nt, Homo sapiens
gaggacaaauuacaucaaa

SEQ ID NO: 310755 - RNA, 19 nt, Homo sapiens
ggagaaaggugcucaagag

SEQ ID NO: 310756 - RNA, 19 nt, Homo sapiens
guaaauaaccacacugaaa

SEQ ID NO: 310757 - RNA, 19 nt, Homo sapiens
cagcaaagccauauucuaa

SEQ ID NO: 310758 - RNA, 19 nt, Homo sapiens
uguguuggcuuuacaaaua

SEQ ID NO: 310759 - RNA, 19 nt, Homo sapiens
cagcuaagauuuaucagaa

SEQ ID NO: 310760 - RNA, 19 nt, Homo sapiens
cagaagaacuuugccuuaa

SEQ ID NO: 310761 - RNA, 19 nt, Homo sapiens
gcacgaaagucaaagaagu

SEQ ID NO: 310762 - RNA, 19 nt, Homo sapiens
gaauagaggccaaauuaau

SEQ ID NO: 310763 - RNA, 19 nt, Homo sapiens
gggaaagccugccucguuu

SEQ ID NO: 310764 - RNA, 19 nt, Homo sapiens
caaagaaguugggaaaguu

SEQ ID NO: 310765 - RNA, 19 nt, Homo sapiens
gguauccggucuuagaaua

SEQ ID NO: 310766 - RNA, 19 nt, Homo sapiens
gaacugaggaagaugguaa

SEQ ID NO: 310767 - RNA, 19 nt, Homo sapiens
gaaaugaggacaaauuaca

SEQ ID NO: 310768 - RNA, 19 nt, Homo sapiens
gcuggagacuauuuaagua

SEQ ID NO: 310769 - RNA, 19 nt, Homo sapiens
gauguuaaaugccuugguu

SEQ ID NO: 310770 - RNA, 19 nt, Homo sapiens
ggacaaauuacaucaaaga

SEQ ID NO: 310771 - RNA, 19 nt, Homo sapiens
gaacagccaauuucucuau

SEQ ID NO: 310772 - RNA, 19 nt, Homo sapiens
cauugaaccugaaauugua

SEQ ID NO: 310773 - RNA, 19 nt, Homo sapiens
caaggaagcagcaaagaaa

SEQ ID NO: 310774 - RNA, 19 nt, Homo sapiens
uagcguccauuucuuauuu

SEQ ID NO: 310775 - RNA, 19 nt, Homo sapiens
uguaagagaugcugacuau

SEQ ID NO: 310776 - RNA, 19 nt, Homo sapiens
ucaaagaacugaggaagau

SEQ ID NO: 310777 - RNA, 19 nt, Homo sapiens
caaagguacuuccaggauu

SEQ ID NO: 310778 - RNA, 19 nt, Homo sapiens
uugaacagcuggugaaauu

SEQ ID NO: 310779 - RNA, 19 nt, Homo sapiens
guacaucgcuccugcaaaa

SEQ ID NO: 310780 - RNA, 19 nt, Homo sapiens
aaacauaugucugucuuug

SEQ ID NO: 310781 - RNA, 19 nt, Homo sapiens
gaagaauacaccaucauga

SEQ ID NO: 310782 - RNA, 19 nt, Homo sapiens
ugaaggaccugaaauaagg

SEQ ID NO: 310783 - RNA, 19 nt, Homo sapiens
uaaaugccuugguuugauu

SEQ ID NO: 310784 - RNA, 19 nt, Homo sapiens
agccauaucuagucaauaa

SEQ ID NO: 310785 - RNA, 19 nt, Homo sapiens
aaagguacuuccaggauuu

SEQ ID NO: 310786 - RNA, 19 nt, Homo sapiens
gaaaauguaucaagcucua

SEQ ID NO: 310787 - RNA, 19 nt, Homo sapiens
aauaacagauccacgcuuu

SEQ ID NO: 310788 - RNA, 19 nt, Homo sapiens
gagaaaagcccgucuguuu

SEQ ID NO: 310789 - RNA, 19 nt, Homo sapiens
ugugaaagcugcacucaga

SEQ ID NO: 310790 - RNA, 19 nt, Homo sapiens
aaagacaccugccuuagug

SEQ ID NO: 310791 - RNA, 19 nt, Homo sapiens
caaauggcuuacuuacaaa

SEQ ID NO: 310792 - RNA, 19 nt, Homo sapiens
caaacaaauggcuuacuua

SEQ ID NO: 310793 - RNA, 19 nt, Homo sapiens
ggaagaugguaacuaagug

SEQ ID NO: 310794 - RNA, 19 nt, Homo sapiens
cgaaagaauuguccugcuu

SEQ ID NO: 310795 - RNA, 19 nt, Homo sapiens
gcuaagauuuaucagaaug

SEQ ID NO: 310796 - RNA, 19 nt, Homo sapiens
gaugguugauucacacuug

SEQ ID NO: 310797 - RNA, 19 nt, Homo sapiens
uagaagaagugauggguau

SEQ ID NO: 310798 - RNA, 19 nt, Homo sapiens
ggaaauggccaucguccuu

SEQ ID NO: 310799 - RNA, 19 nt, Homo sapiens
uaagagaugcugacuauuc

SEQ ID NO: 310800 - RNA, 19 nt, Homo sapiens
uugaauagaggccaaauua

SEQ ID NO: 310801 - RNA, 19 nt, Homo sapiens
ggagacuauuuaaguacua

SEQ ID NO: 310802 - RNA, 19 nt, Homo sapiens
caaccaagcauucauguuc

SEQ ID NO: 310803 - RNA, 19 nt, Homo sapiens
caacuuacggugcacagua

SEQ ID NO: 310804 - RNA, 19 nt, Homo sapiens
ucuaguaucuauuguguug

SEQ ID NO: 310805 - RNA, 19 nt, Homo sapiens
caacaguuucucaaguuua

SEQ ID NO: 310806 - RNA, 19 nt, Homo sapiens
ccagaagaacuuugccuua

SEQ ID NO: 310807 - RNA, 19 nt, Homo sapiens
gaccuagucuuuaaugaag

SEQ ID NO: 310808 - RNA, 19 nt, Homo sapiens
gacugcagcucaccuuuga

SEQ ID NO: 310809 - RNA, 19 nt, Homo sapiens
gcaucagucugccauguau

SEQ ID NO: 310810 - RNA, 19 nt, Homo sapiens
guaucaagcucuacuuuac

SEQ ID NO: 310811 - RNA, 19 nt, Homo sapiens
ugagaucauuuaugucuga

SEQ ID NO: 310812 - RNA, 19 nt, Homo sapiens
ugagaauucugacuuacuu

SEQ ID NO: 310813 - RNA, 19 nt, Homo sapiens
ggaccgaugagaauaacua

SEQ ID NO: 310814 - RNA, 19 nt, Homo sapiens
ccuggaaggugucauuuga

SEQ ID NO: 310815 - RNA, 19 nt, Homo sapiens
uguggcagcugcaaaguuu

SEQ ID NO: 310816 - RNA, 19 nt, Homo sapiens
aaacaacaguacucaagga

SEQ ID NO: 310817 - RNA, 19 nt, Homo sapiens
ggaagcagcaauuaauuag

SEQ ID NO: 310818 - RNA, 19 nt, Homo sapiens
ugagcgaccugcuggaauu

SEQ ID NO: 310819 - RNA, 19 nt, Homo sapiens
guaacuaagugucccaaca

SEQ ID NO: 310820 - RNA, 19 nt, Homo sapiens
ucaaagaaguugggaaagu

SEQ ID NO: 310821 - RNA, 19 nt, Homo sapiens
gcacagcccugcacaugcu

SEQ ID NO: 310822 - RNA, 19 nt, Homo sapiens
ccagggaacuccucugaca

SEQ ID NO: 310823 - RNA, 19 nt, Homo sapiens
aggcagaucuuuaaauaca

SEQ ID NO: 310824 - RNA, 19 nt, Homo sapiens
gaagagaagaugcaucagu

SEQ ID NO: 310825 - RNA, 19 nt, Homo sapiens
gcaacacaacuauuuaugu

SEQ ID NO: 310826 - RNA, 19 nt, Homo sapiens
guccauggguuuauauaug

SEQ ID NO: 310827 - RNA, 19 nt, Homo sapiens
gguaauaaauacacagcau

SEQ ID NO: 310828 - RNA, 19 nt, Homo sapiens
ggauggagauggucugcau

SEQ ID NO: 310829 - RNA, 19 nt, Homo sapiens
gaggaagcagcaauuaauu

SEQ ID NO: 310830 - RNA, 19 nt, Homo sapiens
gaaaagccauaucuaguca

SEQ ID NO: 310831 - RNA, 19 nt, Homo sapiens
ucaacaguuucucaaguuu

SEQ ID NO: 310832 - RNA, 19 nt, Homo sapiens
gcagcucaccuuugaagaa

SEQ ID NO: 310833 - RNA, 19 nt, Homo sapiens
cagguaacuuugcuugauu

SEQ ID NO: 310834 - RNA, 19 nt, Homo sapiens
gcagaucuuuaaauacagu

SEQ ID NO: 310835 - RNA, 19 nt, Homo sapiens
aacauuaccuugucuuuca

SEQ ID NO: 310836 - RNA, 19 nt, Homo sapiens
gaauggauaagaugauguu

SEQ ID NO: 310837 - RNA, 19 nt, Homo sapiens
gaacacgcccuugagauca

SEQ ID NO: 310838 - RNA, 19 nt, Homo sapiens
caucguccuuccacucuaa

SEQ ID NO: 310839 - RNA, 19 nt, Homo sapiens
cuacagagaggaccgauga

SEQ ID NO: 310840 - RNA, 19 nt, Homo sapiens
gcauggagaccgggagaua

SEQ ID NO: 310841 - RNA, 19 nt, Homo sapiens
gcaaagguacuuccaggau

SEQ ID NO: 310842 - RNA, 19 nt, Homo sapiens
caaaggaaauggccaucgu

SEQ ID NO: 310843 - RNA, 19 nt, Homo sapiens
gcaacauuaccuugucuuu

SEQ ID NO: 310844 - RNA, 19 nt, Homo sapiens
ccaaaucacaaacauaugu

SEQ ID NO: 310845 - RNA, 19 nt, Homo sapiens
gcacugaugcaauguaugg

SEQ ID NO: 310846 - RNA, 19 nt, Homo sapiens
gaacaaagaucugugaauu

SEQ ID NO: 310847 - RNA, 19 nt, Homo sapiens
gaagaaggcggaauaauaa

SEQ ID NO: 310848 - RNA, 19 nt, Homo sapiens
gcuagaugcuuuagucuua

SEQ ID NO: 310849 - RNA, 19 nt, Homo sapiens
ggagaagaguuauuauuug

SEQ ID NO: 310850 - RNA, 19 nt, Homo sapiens
gcacagauauuccuuacau

SEQ ID NO: 310851 - RNA, 19 nt, Homo sapiens
gaagauaaauuggcuaauc

SEQ ID NO: 310852 - RNA, 19 nt, Homo sapiens
uaaagaggcugcaugaguu

SEQ ID NO: 310853 - RNA, 19 nt, Homo sapiens
gcaguaguaucaaaugaaa

SEQ ID NO: 310854 - RNA, 19 nt, Homo sapiens
aaaggaagaugaugaaaga

SEQ ID NO: 310855 - RNA, 19 nt, Homo sapiens
ugaagaaggcggaauaaua

SEQ ID NO: 310856 - RNA, 19 nt, Homo sapiens
gcacugaagucaccauuag

SEQ ID NO: 310857 - RNA, 19 nt, Homo sapiens
agagaaagcuuccacagaa

SEQ ID NO: 310858 - RNA, 19 nt, Homo sapiens
gcucaugccuguaauccua

SEQ ID NO: 310859 - RNA, 19 nt, Homo sapiens
ggacaugccaguaguguaa

SEQ ID NO: 310860 - RNA, 19 nt, Homo sapiens
caucagcuguuugcaauua

SEQ ID NO: 310861 - RNA, 19 nt, Homo sapiens
gaaaggauguaacaagagu

SEQ ID NO: 310862 - RNA, 19 nt, Homo sapiens
gaagaaagggaaagugaaa

SEQ ID NO: 310863 - RNA, 19 nt, Homo sapiens
gcagaaagauagcuugagu

SEQ ID NO: 310864 - RNA, 19 nt, Homo sapiens
aaagaacgcugaagaguca

SEQ ID NO: 310865 - RNA, 19 nt, Homo sapiens
gcucaugaguuucggagua

SEQ ID NO: 310866 - RNA, 19 nt, Homo sapiens
agaaagaacucgucacugu

SEQ ID NO: 310867 - RNA, 19 nt, Homo sapiens
ggacaaaucagauguucaa

SEQ ID NO: 310868 - RNA, 19 nt, Homo sapiens
ggaacgggaucguggauug

SEQ ID NO: 310869 - RNA, 19 nt, Homo sapiens
ggucagaaaucuuggauag

SEQ ID NO: 310870 - RNA, 19 nt, Homo sapiens
gagaaagcuuccacagaaa

SEQ ID NO: 310871 - RNA, 19 nt, Homo sapiens
aaacgaggauggcaaagaa

SEQ ID NO: 310872 - RNA, 19 nt, Homo sapiens
gcacgaagccagaucuuug

SEQ ID NO: 310873 - RNA, 19 nt, Homo sapiens
gccuaaagcucuuaaacuu

SEQ ID NO: 310874 - RNA, 19 nt, Homo sapiens
ugaaagugaugauacugua

SEQ ID NO: 310875 - RNA, 19 nt, Homo sapiens
gaacagucuucaccuuuca

SEQ ID NO: 310876 - RNA, 19 nt, Homo sapiens
ucaaugagguuggaagaaa

SEQ ID NO: 310877 - RNA, 19 nt, Homo sapiens
gugagaaccuauaugauga

SEQ ID NO: 310878 - RNA, 19 nt, Homo sapiens
uaucaaacauccaaggaaa

SEQ ID NO: 310879 - RNA, 19 nt, Homo sapiens
gaaacaagucuuugggaaa

SEQ ID NO: 310880 - RNA, 19 nt, Homo sapiens
guaauugugucuggaauga

SEQ ID NO: 310881 - RNA, 19 nt, Homo sapiens
gaagagaucgacauugaug

SEQ ID NO: 310882 - RNA, 19 nt, Homo sapiens
gcagucaccuugcaguaga

SEQ ID NO: 310883 - RNA, 19 nt, Homo sapiens
cggcaaagcagcaucaaua

SEQ ID NO: 310884 - RNA, 19 nt, Homo sapiens
gaaagaugaugaucgacau

SEQ ID NO: 310885 - RNA, 19 nt, Homo sapiens
ccaauaaagccauguauau

SEQ ID NO: 310886 - RNA, 19 nt, Homo sapiens
ccaugucgcugaagcaauu

SEQ ID NO: 310887 - RNA, 19 nt, Homo sapiens
agagugaucugguggauga

SEQ ID NO: 310888 - RNA, 19 nt, Homo sapiens
uggaauaccugcaagaaga

SEQ ID NO: 310889 - RNA, 19 nt, Homo sapiens
gaaaugggauggaaaacuu

SEQ ID NO: 310890 - RNA, 19 nt, Homo sapiens
ggaaauuaauccuccuugu

SEQ ID NO: 310891 - RNA, 19 nt, Homo sapiens
gauaucaucuucugguaca

SEQ ID NO: 310892 - RNA, 19 nt, Homo sapiens
ccacagaaacugaaugcua

SEQ ID NO: 310893 - RNA, 19 nt, Homo sapiens
guucaacaauaccuucuuu

SEQ ID NO: 310894 - RNA, 19 nt, Homo sapiens
aggaagagaucgacauuga

SEQ ID NO: 310895 - RNA, 19 nt, Homo sapiens
gaaaggaacaaacguaucu

SEQ ID NO: 310896 - RNA, 19 nt, Homo sapiens
gcaacuagcugggcacagu

SEQ ID NO: 310897 - RNA, 19 nt, Homo sapiens
ccaaauagccuaggaagug

SEQ ID NO: 310898 - RNA, 19 nt, Homo sapiens
caacaauaccuucuuugaa

SEQ ID NO: 310899 - RNA, 19 nt, Homo sapiens
ggagaagcccucuuggaaa

SEQ ID NO: 310900 - RNA, 19 nt, Homo sapiens
gagagauccucaugucaga

SEQ ID NO: 310901 - RNA, 19 nt, Homo sapiens
aaagagcaguuugcagaua

SEQ ID NO: 310902 - RNA, 19 nt, Homo sapiens
gaaauuaauccuccuugug

SEQ ID NO: 310903 - RNA, 19 nt, Homo sapiens
gaaacuggcccgaaacauc

SEQ ID NO: 310904 - RNA, 19 nt, Homo sapiens
gagaagcccucuuggaaac

SEQ ID NO: 310905 - RNA, 19 nt, Homo sapiens
aaacuucccugcagacugu

SEQ ID NO: 310906 - RNA, 19 nt, Homo sapiens
ggaagaaaucaaugaaaga

SEQ ID NO: 310907 - RNA, 19 nt, Homo sapiens
gggaauguaucuuuguaau

SEQ ID NO: 310908 - RNA, 19 nt, Homo sapiens
gaauuucgcacauaugaug

SEQ ID NO: 310909 - RNA, 19 nt, Homo sapiens
gaagccagaucuuugucuu

SEQ ID NO: 310910 - RNA, 19 nt, Homo sapiens
acaaacagguggagacuca

SEQ ID NO: 310911 - RNA, 19 nt, Homo sapiens
ggaaacgacaaauauagaa

SEQ ID NO: 310912 - RNA, 19 nt, Homo sapiens
cggagaagaguuauuauuu

SEQ ID NO: 310913 - RNA, 19 nt, Homo sapiens
ggugagaaccuauaugaug

SEQ ID NO: 310914 - RNA, 19 nt, Homo sapiens
gaugaugauuggaaagaug

SEQ ID NO: 310915 - RNA, 19 nt, Homo sapiens
gaugcuagaugcuuuaguc

SEQ ID NO: 310916 - RNA, 19 nt, Homo sapiens
ugaacugggugaaugcuuu

SEQ ID NO: 310917 - RNA, 19 nt, Homo sapiens
ugacagaaaugggauggaa

SEQ ID NO: 310918 - RNA, 19 nt, Homo sapiens
aaacgggaauguaucuuug

SEQ ID NO: 310919 - RNA, 19 nt, Homo sapiens
gcuaaucaguauacaagau

SEQ ID NO: 310920 - RNA, 19 nt, Homo sapiens
gaaagugaugauacuguaa

SEQ ID NO: 310921 - RNA, 19 nt, Homo sapiens
ccagcuugcuuuggaguua

SEQ ID NO: 310922 - RNA, 19 nt, Homo sapiens
agauagagcugcugaacug

SEQ ID NO: 310923 - RNA, 19 nt, Homo sapiens
cuaugaaacuccugaccua

SEQ ID NO: 310924 - RNA, 19 nt, Homo sapiens
gcaaagccacggagaagga

SEQ ID NO: 310925 - RNA, 19 nt, Homo sapiens
uaacugcccugcugaaagg

SEQ ID NO: 310926 - RNA, 19 nt, Homo sapiens
gcacaucucccuccagaag

SEQ ID NO: 310927 - RNA, 19 nt, Homo sapiens
uggaaaggauguaacaaga

SEQ ID NO: 310928 - RNA, 19 nt, Homo sapiens
ccugagaaauggucuguug

SEQ ID NO: 310929 - RNA, 19 nt, Homo sapiens
aggaagaccugguuggaaa

SEQ ID NO: 310930 - RNA, 19 nt, Homo sapiens
gaucaaugcuuguaaaaca

SEQ ID NO: 310931 - RNA, 19 nt, Homo sapiens
gaaacgaucaaugcuugua

SEQ ID NO: 310932 - RNA, 19 nt, Homo sapiens
gcuaccugcugcuguuuaa

SEQ ID NO: 310933 - RNA, 19 nt, Homo sapiens
acaaagaucugugaauucu

SEQ ID NO: 310934 - RNA, 19 nt, Homo sapiens
cuaaagcucuuaaacuucu

SEQ ID NO: 310935 - RNA, 19 nt, Homo sapiens
gaagaaagaacucgucacu

SEQ ID NO: 310936 - RNA, 19 nt, Homo sapiens
gaaggcggaauaauaaaug

SEQ ID NO: 310937 - RNA, 19 nt, Homo sapiens
caaacgggaauguaucuuu

SEQ ID NO: 310938 - RNA, 19 nt, Homo sapiens
ccagaagcuucgucuauuc

SEQ ID NO: 310939 - RNA, 19 nt, Homo sapiens
ggucacuucugaaagaguu

SEQ ID NO: 310940 - RNA, 19 nt, Homo sapiens
gcagaucgcuaugaaacuc

SEQ ID NO: 310941 - RNA, 19 nt, Homo sapiens
gggagcagcuucuaguuac

SEQ ID NO: 310942 - RNA, 19 nt, Homo sapiens
gaauaaggaagaccugguu

SEQ ID NO: 310943 - RNA, 19 nt, Homo sapiens
guauauccguguauccuau

SEQ ID NO: 310944 - RNA, 19 nt, Homo sapiens
acuaaugggugucaucuug

SEQ ID NO: 310945 - RNA, 19 nt, Homo sapiens
ggacaggacaaaucagaug

SEQ ID NO: 310946 - RNA, 19 nt, Homo sapiens
ggacaaagaugaguggaua

SEQ ID NO: 310947 - RNA, 19 nt, Homo sapiens
ggaagaagcucucgacaau

SEQ ID NO: 310948 - RNA, 19 nt, Homo sapiens
gaaagacucuauucucaaa

SEQ ID NO: 310949 - RNA, 19 nt, Homo sapiens
gaaaucaugucaacuguga

SEQ ID NO: 310950 - RNA, 19 nt, Homo sapiens
gaaaaggccuuagcaauua

SEQ ID NO: 310951 - RNA, 19 nt, Homo sapiens
gcagggaauuucuaucuaa

SEQ ID NO: 310952 - RNA, 19 nt, Homo sapiens
gcacuggaaucuauaaaga

SEQ ID NO: 310953 - RNA, 19 nt, Homo sapiens
caacuauccugacuucuaa

SEQ ID NO: 310954 - RNA, 19 nt, Homo sapiens
gauggaccuucuagaauua

SEQ ID NO: 310955 - RNA, 19 nt, Homo sapiens
gcacagauccgagaaguuu

SEQ ID NO: 310956 - RNA, 19 nt, Homo sapiens
gaaagaaaguuuagaagcu

SEQ ID NO: 310957 - RNA, 19 nt, Homo sapiens
gaaccaagaucuauaaagc

SEQ ID NO: 310958 - RNA, 19 nt, Homo sapiens
ugaugaaacucacaaauga

SEQ ID NO: 310959 - RNA, 19 nt, Homo sapiens
caacaacuauccugacuuc

SEQ ID NO: 310960 - RNA, 19 nt, Homo sapiens
ccagagaucuucaaaauuu

SEQ ID NO: 310961 - RNA, 19 nt, Homo sapiens
caagaucuauaaagcgaua

SEQ ID NO: 310962 - RNA, 19 nt, Homo sapiens
gaaaagaagugccggguuu

SEQ ID NO: 310963 - RNA, 19 nt, Homo sapiens
gacaauggcagaaacuuua

SEQ ID NO: 310964 - RNA, 19 nt, Homo sapiens
gaaagaagaaagacucuau

SEQ ID NO: 310965 - RNA, 19 nt, Homo sapiens
gggcaaaucugcaccuaug

SEQ ID NO: 310966 - RNA, 19 nt, Homo sapiens
gagaaaacauugcugauaa

SEQ ID NO: 310967 - RNA, 19 nt, Homo sapiens
ggacagcaccuuaauggaa

SEQ ID NO: 310968 - RNA, 19 nt, Homo sapiens
gaagugcauuucugaauag

SEQ ID NO: 310969 - RNA, 19 nt, Homo sapiens
gcaccuccuugucacuuua

SEQ ID NO: 310970 - RNA, 19 nt, Homo sapiens
gaaauucagccaaaguaaa

SEQ ID NO: 310971 - RNA, 19 nt, Homo sapiens
ugaaugcacuggaaucuau

SEQ ID NO: 310972 - RNA, 19 nt, Homo sapiens
gcauaaagcauaaguauac

SEQ ID NO: 310973 - RNA, 19 nt, Homo sapiens
ggaauucucuaaucgaaag

SEQ ID NO: 310974 - RNA, 19 nt, Homo sapiens
gagaaaagguggacaaaga

SEQ ID NO: 310975 - RNA, 19 nt, Homo sapiens
ggaguugucacaucagaua

SEQ ID NO: 310976 - RNA, 19 nt, Homo sapiens
acuagacucuucacuguua

SEQ ID NO: 310977 - RNA, 19 nt, Homo sapiens
cagauagaaucaaucagua

SEQ ID NO: 310978 - RNA, 19 nt, Homo sapiens
gaaagucagauggauauaa

SEQ ID NO: 310979 - RNA, 19 nt, Homo sapiens
ccaggcaauuucaggauua

SEQ ID NO: 310980 - RNA, 19 nt, Homo sapiens
guaaacaacugaagaagcu

SEQ ID NO: 310981 - RNA, 19 nt, Homo sapiens
aggaagaugugguuguuua

SEQ ID NO: 310982 - RNA, 19 nt, Homo sapiens
ggucuaaggucuaucaagu

SEQ ID NO: 310983 - RNA, 19 nt, Homo sapiens
gcacugaugauaagaauuc

SEQ ID NO: 310984 - RNA, 19 nt, Homo sapiens
ggucaaagaaagaaaguuu

SEQ ID NO: 310985 - RNA, 19 nt, Homo sapiens
ccacuagacucuucacugu

SEQ ID NO: 310986 - RNA, 19 nt, Homo sapiens
aaacagcugucucuaacuu

SEQ ID NO: 310987 - RNA, 19 nt, Homo sapiens
ugauggaccuucuagaauu

SEQ ID NO: 310988 - RNA, 19 nt, Homo sapiens
ucucaaaguuuccuaauca

SEQ ID NO: 310989 - RNA, 19 nt, Homo sapiens
gaugggcacuugagaacuu

SEQ ID NO: 310990 - RNA, 19 nt, Homo sapiens
gcaaaucugcaccuaugua

SEQ ID NO: 310991 - RNA, 19 nt, Homo sapiens
gaaccuauaggccagagua

SEQ ID NO: 310992 - RNA, 19 nt, Homo sapiens
gcauuuaucauucuuguug

SEQ ID NO: 310993 - RNA, 19 nt, Homo sapiens
gagccuaucagaauuauau

SEQ ID NO: 310994 - RNA, 19 nt, Homo sapiens
uugcacaacugaauucuaa

SEQ ID NO: 310995 - RNA, 19 nt, Homo sapiens
uggagaaccucuacucaaa

SEQ ID NO: 310996 - RNA, 19 nt, Homo sapiens
gaaucugucucccaguuau

SEQ ID NO: 310997 - RNA, 19 nt, Homo sapiens
uaagugacauuuguaguug

SEQ ID NO: 310998 - RNA, 19 nt, Homo sapiens
acaguugucuagagauaua

SEQ ID NO: 310999 - RNA, 19 nt, Homo sapiens
gaaagauguccuucaagaa

SEQ ID NO: 311000 - RNA, 19 nt, Homo sapiens
ggugcaagcuguccagaga

SEQ ID NO: 311001 - RNA, 19 nt, Homo sapiens
caaccaccguuacaaguau

SEQ ID NO: 311002 - RNA, 19 nt, Homo sapiens
gaacuacaaagaagaugaa

SEQ ID NO: 311003 - RNA, 19 nt, Homo sapiens
gcugaguucuggucaaaga

SEQ ID NO: 311004 - RNA, 19 nt, Homo sapiens
agacauaucucuaauucca

SEQ ID NO: 311005 - RNA, 19 nt, Homo sapiens
ccuuggagcuuacauaguu

SEQ ID NO: 311006 - RNA, 19 nt, Homo sapiens
gcagauagaaucaaucagu

SEQ ID NO: 311007 - RNA, 19 nt, Homo sapiens
ccuguuguauugacuauuu

SEQ ID NO: 311008 - RNA, 19 nt, Homo sapiens
ugaccuaaaucacaaacaa

SEQ ID NO: 311009 - RNA, 19 nt, Homo sapiens
ggacuugaccuaaaucaca

SEQ ID NO: 311010 - RNA, 19 nt, Homo sapiens
gauccaaugcuucuguaua

SEQ ID NO: 311011 - RNA, 19 nt, Homo sapiens
gaaaugauccaaugcuucu

SEQ ID NO: 311012 - RNA, 19 nt, Homo sapiens
ggaggcugguugaaacgua

SEQ ID NO: 311013 - RNA, 19 nt, Homo sapiens
ccaaauaacaaguaccaaa

SEQ ID NO: 311014 - RNA, 19 nt, Homo sapiens
gaagaagcucucgacaaua

SEQ ID NO: 311015 - RNA, 19 nt, Homo sapiens
gaggagcacuuccaaaauu

SEQ ID NO: 311016 - RNA, 19 nt, Homo sapiens
ucaagucaaucauuucuca

SEQ ID NO: 311017 - RNA, 19 nt, Homo sapiens
aaagaugaguggauaagug

SEQ ID NO: 311018 - RNA, 19 nt, Homo sapiens
gaagagugacuaguacaaa

SEQ ID NO: 311019 - RNA, 19 nt, Homo sapiens
caucuuacuugagccuuua

SEQ ID NO: 311020 - RNA, 19 nt, Homo sapiens
ucacaaagaguucuggaaa

SEQ ID NO: 311021 - RNA, 19 nt, Homo sapiens
acacauugccuaacuacua

SEQ ID NO: 311022 - RNA, 19 nt, Homo sapiens
ucacaucagauaagacaua

SEQ ID NO: 311023 - RNA, 19 nt, Homo sapiens
gagugacuaguacaaauua

SEQ ID NO: 311024 - RNA, 19 nt, Homo sapiens
gacagcaccuuaauggaau

SEQ ID NO: 311025 - RNA, 19 nt, Homo sapiens
caaaguaaacaacugaaga

SEQ ID NO: 311026 - RNA, 19 nt, Homo sapiens
caaaguuuccuaaucagaa

SEQ ID NO: 311027 - RNA, 19 nt, Homo sapiens
aaacaguugugaaccaaga

SEQ ID NO: 311028 - RNA, 19 nt, Homo sapiens
guaggugacacuauaguuu

SEQ ID NO: 311029 - RNA, 19 nt, Homo sapiens
uaaggucuaucaagucaau

SEQ ID NO: 311030 - RNA, 19 nt, Homo sapiens
guaucaguauggaaacuuu

SEQ ID NO: 311031 - RNA, 19 nt, Homo sapiens
cgacuuggccucccuucua

SEQ ID NO: 311032 - RNA, 19 nt, Homo sapiens
cuaauuccauccauaaauc

SEQ ID NO: 311033 - RNA, 19 nt, Homo sapiens
gcauaaguauacaguucaa

SEQ ID NO: 311034 - RNA, 19 nt, Homo sapiens
aaagaacuguuuacugcuu

SEQ ID NO: 311035 - RNA, 19 nt, Homo sapiens
aaucauuucucacugugua

SEQ ID NO: 311036 - RNA, 19 nt, Homo sapiens
auacagagccuaucagaau

SEQ ID NO: 311037 - RNA, 19 nt, Homo sapiens
cugaugacauuguuucaaa

SEQ ID NO: 311038 - RNA, 19 nt, Homo sapiens
aaagagagcugaagaaaag

SEQ ID NO: 311039 - RNA, 19 nt, Homo sapiens
uagaugaccucacuuggau

SEQ ID NO: 311040 - RNA, 19 nt, Homo sapiens
gugcugcuguuacuguuaa

SEQ ID NO: 311041 - RNA, 19 nt, Homo sapiens
cauaauggaucuuguaagc

SEQ ID NO: 311042 - RNA, 19 nt, Homo sapiens
gcacaacugaauucuaaau

SEQ ID NO: 311043 - RNA, 19 nt, Homo sapiens
aagaagcucucgacaauac

SEQ ID NO: 311044 - RNA, 19 nt, Homo sapiens
guugggagcugaugaaacu

SEQ ID NO: 311045 - RNA, 19 nt, Homo sapiens
guggauacccuuacccuuu

SEQ ID NO: 311046 - RNA, 19 nt, Homo sapiens
ggacaaagaugaguggaua

SEQ ID NO: 311047 - RNA, 19 nt, Homo sapiens
ggaagaagcucucgacaau

SEQ ID NO: 311048 - RNA, 19 nt, Homo sapiens
gaaagacucuauucucaaa

SEQ ID NO: 311049 - RNA, 19 nt, Homo sapiens
gaaaucaugucaacuguga

SEQ ID NO: 311050 - RNA, 19 nt, Homo sapiens
gaaaaggccuuagcaauua

SEQ ID NO: 311051 - RNA, 19 nt, Homo sapiens
gcagggaauuucuaucuaa

SEQ ID NO: 311052 - RNA, 19 nt, Homo sapiens
gcacuggaaucuauaaaga

SEQ ID NO: 311053 - RNA, 19 nt, Homo sapiens
caacuauccugacuucuaa

SEQ ID NO: 311054 - RNA, 19 nt, Homo sapiens
gauggaccuucuagaauua

SEQ ID NO: 311055 - RNA, 19 nt, Homo sapiens
gcacagauccgagaaguuu

SEQ ID NO: 311056 - RNA, 19 nt, Homo sapiens
gaaagaaaguuuagaagcu

SEQ ID NO: 311057 - RNA, 19 nt, Homo sapiens
gaaccaagaucuauaaagc

SEQ ID NO: 311058 - RNA, 19 nt, Homo sapiens
ugaugaaacucacaaauga

SEQ ID NO: 311059 - RNA, 19 nt, Homo sapiens
caacaacuauccugacuuc

SEQ ID NO: 311060 - RNA, 19 nt, Homo sapiens
ccagagaucuucaaaauuu

SEQ ID NO: 311061 - RNA, 19 nt, Homo sapiens
caagaucuauaaagcgaua

SEQ ID NO: 311062 - RNA, 19 nt, Homo sapiens
gaaaagaagugccggguuu

SEQ ID NO: 311063 - RNA, 19 nt, Homo sapiens
gacaauggcagaaacuuua

SEQ ID NO: 311064 - RNA, 19 nt, Homo sapiens
gaaagaagaaagacucuau

SEQ ID NO: 311065 - RNA, 19 nt, Homo sapiens
gggcaaaucugcaccuaug

SEQ ID NO: 311066 - RNA, 19 nt, Homo sapiens
gagaaaacauugcugauaa

SEQ ID NO: 311067 - RNA, 19 nt, Homo sapiens
ggacagcaccuuaauggaa

SEQ ID NO: 311068 - RNA, 19 nt, Homo sapiens
gaagugcauuucugaauag

SEQ ID NO: 311069 - RNA, 19 nt, Homo sapiens
gcaccuccuugucacuuua

SEQ ID NO: 311070 - RNA, 19 nt, Homo sapiens
gaaauucagccaaaguaaa

SEQ ID NO: 311071 - RNA, 19 nt, Homo sapiens
ugaaugcacuggaaucuau

SEQ ID NO: 311072 - RNA, 19 nt, Homo sapiens
gcauaaagcauaaguauac

SEQ ID NO: 311073 - RNA, 19 nt, Homo sapiens
ggaauucucuaaucgaaag

SEQ ID NO: 311074 - RNA, 19 nt, Homo sapiens
gagaaaagguggacaaaga

SEQ ID NO: 311075 - RNA, 19 nt, Homo sapiens
ggaguugucacaucagaua

SEQ ID NO: 311076 - RNA, 19 nt, Homo sapiens
acuagacucuucacuguua

SEQ ID NO: 311077 - RNA, 19 nt, Homo sapiens
cagauagaaucaaucagua

SEQ ID NO: 311078 - RNA, 19 nt, Homo sapiens
gaaagucagauggauauaa

SEQ ID NO: 311079 - RNA, 19 nt, Homo sapiens
ccaggcaauuucaggauua

SEQ ID NO: 311080 - RNA, 19 nt, Homo sapiens
guaaacaacugaagaagcu

SEQ ID NO: 311081 - RNA, 19 nt, Homo sapiens
aggaagaugugguuguuua

SEQ ID NO: 311082 - RNA, 19 nt, Homo sapiens
ggucuaaggucuaucaagu

SEQ ID NO: 311083 - RNA, 19 nt, Homo sapiens
gcacugaugauaagaauuc

SEQ ID NO: 311084 - RNA, 19 nt, Homo sapiens
ggucaaagaaagaaaguuu

SEQ ID NO: 311085 - RNA, 19 nt, Homo sapiens
ccacuagacucuucacugu

SEQ ID NO: 311086 - RNA, 19 nt, Homo sapiens
aaacagcugucucuaacuu

SEQ ID NO: 311087 - RNA, 19 nt, Homo sapiens
ugauggaccuucuagaauu

SEQ ID NO: 311088 - RNA, 19 nt, Homo sapiens
ucucaaaguuuccuaauca

SEQ ID NO: 311089 - RNA, 19 nt, Homo sapiens
gaugggcacuugagaacuu

SEQ ID NO: 311090 - RNA, 19 nt, Homo sapiens
gcaaaucugcaccuaugua

SEQ ID NO: 311091 - RNA, 19 nt, Homo sapiens
gaaccuauaggccagagua

SEQ ID NO: 311092 - RNA, 19 nt, Homo sapiens
gcauuuaucauucuuguug

SEQ ID NO: 311093 - RNA, 19 nt, Homo sapiens
gagccuaucagaauuauau

SEQ ID NO: 311094 - RNA, 19 nt, Homo sapiens
uugcacaacugaauucuaa

SEQ ID NO: 311095 - RNA, 19 nt, Homo sapiens
uggagaaccucuacucaaa

SEQ ID NO: 311096 - RNA, 19 nt, Homo sapiens
gaaucugucucccaguuau

SEQ ID NO: 311097 - RNA, 19 nt, Homo sapiens
uaagugacauuuguaguug

SEQ ID NO: 311098 - RNA, 19 nt, Homo sapiens
acaguugucuagagauaua

SEQ ID NO: 311099 - RNA, 19 nt, Homo sapiens
gaaagauguccuucaagaa

SEQ ID NO: 311100 - RNA, 19 nt, Homo sapiens
ggugcaagcuguccagaga

SEQ ID NO: 311101 - RNA, 19 nt, Homo sapiens
caaccaccguuacaaguau

SEQ ID NO: 311102 - RNA, 19 nt, Homo sapiens
gaacuacaaagaagaugaa

SEQ ID NO: 311103 - RNA, 19 nt, Homo sapiens
gcugaguucuggucaaaga

SEQ ID NO: 311104 - RNA, 19 nt, Homo sapiens
agacauaucucuaauucca

SEQ ID NO: 311105 - RNA, 19 nt, Homo sapiens
ccuuggagcuuacauaguu

SEQ ID NO: 311106 - RNA, 19 nt, Homo sapiens
gcagauagaaucaaucagu

SEQ ID NO: 311107 - RNA, 19 nt, Homo sapiens
ccuguuguauugacuauuu

SEQ ID NO: 311108 - RNA, 19 nt, Homo sapiens
ugaccuaaaucacaaacaa

SEQ ID NO: 311109 - RNA, 19 nt, Homo sapiens
ggacuugaccuaaaucaca

SEQ ID NO: 311110 - RNA, 19 nt, Homo sapiens
gauccaaugcuucuguaua

SEQ ID NO: 311111 - RNA, 19 nt, Homo sapiens
gaaaugauccaaugcuucu

SEQ ID NO: 311112 - RNA, 19 nt, Homo sapiens
ggaggcugguugaaacgua

SEQ ID NO: 311113 - RNA, 19 nt, Homo sapiens
ccaaauaacaaguaccaaa

SEQ ID NO: 311114 - RNA, 19 nt, Homo sapiens
gaagaagcucucgacaaua

SEQ ID NO: 311115 - RNA, 19 nt, Homo sapiens
gaggagcacuuccaaaauu

SEQ ID NO: 311116 - RNA, 19 nt, Homo sapiens
ucaagucaaucauuucuca

SEQ ID NO: 311117 - RNA, 19 nt, Homo sapiens
aaagaugaguggauaagug

SEQ ID NO: 311118 - RNA, 19 nt, Homo sapiens
gaagagugacuaguacaaa

SEQ ID NO: 311119 - RNA, 19 nt, Homo sapiens
caucuuacuugagccuuua

SEQ ID NO: 311120 - RNA, 19 nt, Homo sapiens
ucacaaagaguucuggaaa

SEQ ID NO: 311121 - RNA, 19 nt, Homo sapiens
acacauugccuaacuacua

SEQ ID NO: 311122 - RNA, 19 nt, Homo sapiens
ucacaucagauaagacaua

SEQ ID NO: 311123 - RNA, 19 nt, Homo sapiens
gagugacuaguacaaauua

SEQ ID NO: 311124 - RNA, 19 nt, Homo sapiens
gacagcaccuuaauggaau

SEQ ID NO: 311125 - RNA, 19 nt, Homo sapiens
caaaguaaacaacugaaga

SEQ ID NO: 311126 - RNA, 19 nt, Homo sapiens
caaaguuuccuaaucagaa

SEQ ID NO: 311127 - RNA, 19 nt, Homo sapiens
aaacaguugugaaccaaga

SEQ ID NO: 311128 - RNA, 19 nt, Homo sapiens
guaggugacacuauaguuu

SEQ ID NO: 311129 - RNA, 19 nt, Homo sapiens
uaaggucuaucaagucaau

SEQ ID NO: 311130 - RNA, 19 nt, Homo sapiens
guaucaguauggaaacuuu

SEQ ID NO: 311131 - RNA, 19 nt, Homo sapiens
cgacuuggccucccuucua

SEQ ID NO: 311132 - RNA, 19 nt, Homo sapiens
cuaauuccauccauaaauc

SEQ ID NO: 311133 - RNA, 19 nt, Homo sapiens
gcauaaguauacaguucaa

SEQ ID NO: 311134 - RNA, 19 nt, Homo sapiens
aaagaacuguuuacugcuu

SEQ ID NO: 311135 - RNA, 19 nt, Homo sapiens
aaucauuucucacugugua

SEQ ID NO: 311136 - RNA, 19 nt, Homo sapiens
auacagagccuaucagaau

SEQ ID NO: 311137 - RNA, 19 nt, Homo sapiens
cugaugacauuguuucaaa

SEQ ID NO: 311138 - RNA, 19 nt, Homo sapiens
aaagagagcugaagaaaag

SEQ ID NO: 311139 - RNA, 19 nt, Homo sapiens
uagaugaccucacuuggau

SEQ ID NO: 311140 - RNA, 19 nt, Homo sapiens
gugcugcuguuacuguuaa

SEQ ID NO: 311141 - RNA, 19 nt, Homo sapiens
cauaauggaucuuguaagc

SEQ ID NO: 311142 - RNA, 19 nt, Homo sapiens
gcacaacugaauucuaaau

SEQ ID NO: 311143 - RNA, 19 nt, Homo sapiens
aagaagcucucgacaauac

SEQ ID NO: 311144 - RNA, 19 nt, Homo sapiens
guugggagcugaugaaacu

SEQ ID NO: 311145 - RNA, 19 nt, Homo sapiens
guggauacccuuacccuuu

SEQ ID NO: 311146 - RNA, 19 nt, Homo sapiens
ggacaaagaugaguggaua

SEQ ID NO: 311147 - RNA, 19 nt, Homo sapiens
ggaagaagcucucgacaau

SEQ ID NO: 311148 - RNA, 19 nt, Homo sapiens
gaaagacucuauucucaaa

SEQ ID NO: 311149 - RNA, 19 nt, Homo sapiens
gaaaucaugucaacuguga

SEQ ID NO: 311150 - RNA, 19 nt, Homo sapiens
gaaaaggccuuagcaauua

SEQ ID NO: 311151 - RNA, 19 nt, Homo sapiens
gcagggaauuucuaucuaa

SEQ ID NO: 311152 - RNA, 19 nt, Homo sapiens
gcacuggaaucuauaaaga

SEQ ID NO: 311153 - RNA, 19 nt, Homo sapiens
caacuauccugacuucuaa

SEQ ID NO: 311154 - RNA, 19 nt, Homo sapiens
gauggaccuucuagaauua

SEQ ID NO: 311155 - RNA, 19 nt, Homo sapiens
gcacagauccgagaaguuu

SEQ ID NO: 311156 - RNA, 19 nt, Homo sapiens
gaaagaaaguuuagaagcu

SEQ ID NO: 311157 - RNA, 19 nt, Homo sapiens
gaaccaagaucuauaaagc

SEQ ID NO: 311158 - RNA, 19 nt, Homo sapiens
ugaugaaacucacaaauga

SEQ ID NO: 311159 - RNA, 19 nt, Homo sapiens
caacaacuauccugacuuc

SEQ ID NO: 311160 - RNA, 19 nt, Homo sapiens
ccagagaucuucaaaauuu

SEQ ID NO: 311161 - RNA, 19 nt, Homo sapiens
caagaucuauaaagcgaua

SEQ ID NO: 311162 - RNA, 19 nt, Homo sapiens
gaaaagaagugccggguuu

SEQ ID NO: 311163 - RNA, 19 nt, Homo sapiens
gacaauggcagaaacuuua

SEQ ID NO: 311164 - RNA, 19 nt, Homo sapiens
gaaagaagaaagacucuau

SEQ ID NO: 311165 - RNA, 19 nt, Homo sapiens
gggcaaaucugcaccuaug

SEQ ID NO: 311166 - RNA, 19 nt, Homo sapiens
gagaaaacauugcugauaa

SEQ ID NO: 311167 - RNA, 19 nt, Homo sapiens
ggacagcaccuuaauggaa

SEQ ID NO: 311168 - RNA, 19 nt, Homo sapiens
gaagugcauuucugaauag

SEQ ID NO: 311169 - RNA, 19 nt, Homo sapiens
gcaccuccuugucacuuua

SEQ ID NO: 311170 - RNA, 19 nt, Homo sapiens
gaaauucagccaaaguaaa

SEQ ID NO: 311171 - RNA, 19 nt, Homo sapiens
ugaaugcacuggaaucuau

SEQ ID NO: 311172 - RNA, 19 nt, Homo sapiens
gcauaaagcauaaguauac

SEQ ID NO: 311173 - RNA, 19 nt, Homo sapiens
ggaagucacgucaggauuu

SEQ ID NO: 311174 - RNA, 19 nt, Homo sapiens
ggaauucucuaaucgaaag

SEQ ID NO: 311175 - RNA, 19 nt, Homo sapiens
gagaaaagguggacaaaga

SEQ ID NO: 311176 - RNA, 19 nt, Homo sapiens
ggaguugucacaucagaua

SEQ ID NO: 311177 - RNA, 19 nt, Homo sapiens
acuagacucuucacuguua

SEQ ID NO: 311178 - RNA, 19 nt, Homo sapiens
gaaagucagauggauauaa

SEQ ID NO: 311179 - RNA, 19 nt, Homo sapiens
cagauagaaucaaucagua

SEQ ID NO: 311180 - RNA, 19 nt, Homo sapiens
ccaggcaauuucaggauua

SEQ ID NO: 311181 - RNA, 19 nt, Homo sapiens
guaaacaacugaagaagcu

SEQ ID NO: 311182 - RNA, 19 nt, Homo sapiens
aggaagaugugguuguuua

SEQ ID NO: 311183 - RNA, 19 nt, Homo sapiens
ggucuaaggucuaucaagu

SEQ ID NO: 311184 - RNA, 19 nt, Homo sapiens
gcacugaugauaagaauuc

SEQ ID NO: 311185 - RNA, 19 nt, Homo sapiens
ggucaaagaaagaaaguuu

SEQ ID NO: 311186 - RNA, 19 nt, Homo sapiens
ccacuagacucuucacugu

SEQ ID NO: 311187 - RNA, 19 nt, Homo sapiens
aaacagcugucucuaacuu

SEQ ID NO: 311188 - RNA, 19 nt, Homo sapiens
ugauggaccuucuagaauu

SEQ ID NO: 311189 - RNA, 19 nt, Homo sapiens
ucucaaaguuuccuaauca

SEQ ID NO: 311190 - RNA, 19 nt, Homo sapiens
gaugggcacuugagaacuu

SEQ ID NO: 311191 - RNA, 19 nt, Homo sapiens
gcaaaucugcaccuaugua

SEQ ID NO: 311192 - RNA, 19 nt, Homo sapiens
gaaccuauaggccagagua

SEQ ID NO: 311193 - RNA, 19 nt, Homo sapiens
gcauuuaucauucuuguug

SEQ ID NO: 311194 - RNA, 19 nt, Homo sapiens
gagccuaucagaauuauau

SEQ ID NO: 311195 - RNA, 19 nt, Homo sapiens
uugcacaacugaauucuaa

SEQ ID NO: 311196 - RNA, 19 nt, Homo sapiens
uggagaaccucuacucaaa

SEQ ID NO: 311197 - RNA, 19 nt, Homo sapiens
gaaucugucucccaguuau

SEQ ID NO: 311198 - RNA, 19 nt, Homo sapiens
uaagugacauuuguaguug

SEQ ID NO: 311199 - RNA, 19 nt, Homo sapiens
acaguugucuagagauaua

SEQ ID NO: 311200 - RNA, 19 nt, Homo sapiens
gaaagauguccuucaagaa

SEQ ID NO: 311201 - RNA, 19 nt, Homo sapiens
ggugcaagcuguccagaga

SEQ ID NO: 311202 - RNA, 19 nt, Homo sapiens
caaccaccguuacaaguau

SEQ ID NO: 311203 - RNA, 19 nt, Homo sapiens
gaacuacaaagaagaugaa

SEQ ID NO: 311204 - RNA, 19 nt, Homo sapiens
gcugaguucuggucaaaga

SEQ ID NO: 311205 - RNA, 19 nt, Homo sapiens
agacauaucucuaauucca

SEQ ID NO: 311206 - RNA, 19 nt, Homo sapiens
ccuuggagcuuacauaguu

SEQ ID NO: 311207 - RNA, 19 nt, Homo sapiens
gcagauagaaucaaucagu

SEQ ID NO: 311208 - RNA, 19 nt, Homo sapiens
ccuguuguauugacuauuu

SEQ ID NO: 311209 - RNA, 19 nt, Homo sapiens
ugaccuaaaucacaaacaa

SEQ ID NO: 311210 - RNA, 19 nt, Homo sapiens
ggacuugaccuaaaucaca

SEQ ID NO: 311211 - RNA, 19 nt, Homo sapiens
gauccaaugcuucuguaua

SEQ ID NO: 311212 - RNA, 19 nt, Homo sapiens
gaaaugauccaaugcuucu

SEQ ID NO: 311213 - RNA, 19 nt, Homo sapiens
ggaggcugguugaaacgua

SEQ ID NO: 311214 - RNA, 19 nt, Homo sapiens
ccaaauaacaaguaccaaa

SEQ ID NO: 311215 - RNA, 19 nt, Homo sapiens
gaagaagcucucgacaaua

SEQ ID NO: 311216 - RNA, 19 nt, Homo sapiens
gaggagcacuuccaaaauu

SEQ ID NO: 311217 - RNA, 19 nt, Homo sapiens
ucaagucaaucauuucuca

SEQ ID NO: 311218 - RNA, 19 nt, Homo sapiens
aaagaugaguggauaagug

SEQ ID NO: 311219 - RNA, 19 nt, Homo sapiens
gaagagugacuaguacaaa

SEQ ID NO: 311220 - RNA, 19 nt, Homo sapiens
caucuuacuugagccuuua

SEQ ID NO: 311221 - RNA, 19 nt, Homo sapiens
ucacaaagaguucuggaaa

SEQ ID NO: 311222 - RNA, 19 nt, Homo sapiens
acacauugccuaacuacua

SEQ ID NO: 311223 - RNA, 19 nt, Homo sapiens
ucacaucagauaagacaua

SEQ ID NO: 311224 - RNA, 19 nt, Homo sapiens
gagugacuaguacaaauua

SEQ ID NO: 311225 - RNA, 19 nt, Homo sapiens
gacagcaccuuaauggaau

SEQ ID NO: 311226 - RNA, 19 nt, Homo sapiens
caaaguaaacaacugaaga

SEQ ID NO: 311227 - RNA, 19 nt, Homo sapiens
caaaguuuccuaaucagaa

SEQ ID NO: 311228 - RNA, 19 nt, Homo sapiens
aaacaguugugaaccaaga

SEQ ID NO: 311229 - RNA, 19 nt, Homo sapiens
guaggugacacuauaguuu

SEQ ID NO: 311230 - RNA, 19 nt, Homo sapiens
uaaggucuaucaagucaau

SEQ ID NO: 311231 - RNA, 19 nt, Homo sapiens
guaucaguauggaaacuuu

SEQ ID NO: 311232 - RNA, 19 nt, Homo sapiens
cgacuuggccucccuucua

SEQ ID NO: 311233 - RNA, 19 nt, Homo sapiens
cuaauuccauccauaaauc

SEQ ID NO: 311234 - RNA, 19 nt, Homo sapiens
gcauaaguauacaguucaa

SEQ ID NO: 311235 - RNA, 19 nt, Homo sapiens
aaagaacuguuuacugcuu

SEQ ID NO: 311236 - RNA, 19 nt, Homo sapiens
aaucauuucucacugugua

SEQ ID NO: 311237 - RNA, 19 nt, Homo sapiens
auacagagccuaucagaau

SEQ ID NO: 311238 - RNA, 19 nt, Homo sapiens
cugaugacauuguuucaaa

SEQ ID NO: 311239 - RNA, 19 nt, Homo sapiens
aaagagagcugaagaaaag

SEQ ID NO: 311240 - RNA, 19 nt, Homo sapiens
uagaugaccucacuuggau

SEQ ID NO: 311241 - RNA, 19 nt, Homo sapiens
gugcugcuguuacuguuaa

SEQ ID NO: 311242 - RNA, 19 nt, Homo sapiens
cauaauggaucuuguaagc

SEQ ID NO: 311243 - RNA, 19 nt, Homo sapiens
gcacaacugaauucuaaau

SEQ ID NO: 311244 - RNA, 19 nt, Homo sapiens
aagaagcucucgacaauac

SEQ ID NO: 311245 - RNA, 19 nt, Homo sapiens
gaggagggcucuggaaguc

SEQ ID NO: 311246 - RNA, 19 nt, Homo sapiens
ggacaaagaugaguggaua

SEQ ID NO: 311247 - RNA, 19 nt, Homo sapiens
ggaagaagcucucgacaau

SEQ ID NO: 311248 - RNA, 19 nt, Homo sapiens
gaaagacucuauucucaaa

SEQ ID NO: 311249 - RNA, 19 nt, Homo sapiens
gaaaucaugucaacuguga

SEQ ID NO: 311250 - RNA, 19 nt, Homo sapiens
gaaaaggccuuagcaauua

SEQ ID NO: 311251 - RNA, 19 nt, Homo sapiens
gcagggaauuucuaucuaa

SEQ ID NO: 311252 - RNA, 19 nt, Homo sapiens
gcacuggaaucuauaaaga

SEQ ID NO: 311253 - RNA, 19 nt, Homo sapiens
caacuauccugacuucuaa

SEQ ID NO: 311254 - RNA, 19 nt, Homo sapiens
gauggaccuucuagaauua

SEQ ID NO: 311255 - RNA, 19 nt, Homo sapiens
gcacagauccgagaaguuu

SEQ ID NO: 311256 - RNA, 19 nt, Homo sapiens
gaaagaaaguuuagaagcu

SEQ ID NO: 311257 - RNA, 19 nt, Homo sapiens
gaaccaagaucuauaaagc

SEQ ID NO: 311258 - RNA, 19 nt, Homo sapiens
ugaugaaacucacaaauga

SEQ ID NO: 311259 - RNA, 19 nt, Homo sapiens
caacaacuauccugacuuc

SEQ ID NO: 311260 - RNA, 19 nt, Homo sapiens
ccagagaucuucaaaauuu

SEQ ID NO: 311261 - RNA, 19 nt, Homo sapiens
caagaucuauaaagcgaua

SEQ ID NO: 311262 - RNA, 19 nt, Homo sapiens
gaaaagaagugccggguuu

SEQ ID NO: 311263 - RNA, 19 nt, Homo sapiens
gacaauggcagaaacuuua

SEQ ID NO: 311264 - RNA, 19 nt, Homo sapiens
gaaagaagaaagacucuau

SEQ ID NO: 311265 - RNA, 19 nt, Homo sapiens
gggcaaaucugcaccuaug

SEQ ID NO: 311266 - RNA, 19 nt, Homo sapiens
gagaaaacauugcugauaa

SEQ ID NO: 311267 - RNA, 19 nt, Homo sapiens
ggacagcaccuuaauggaa

SEQ ID NO: 311268 - RNA, 19 nt, Homo sapiens
gaagugcauuucugaauag

SEQ ID NO: 311269 - RNA, 19 nt, Homo sapiens
gcaccuccuugucacuuua

SEQ ID NO: 311270 - RNA, 19 nt, Homo sapiens
gaaauucagccaaaguaaa

SEQ ID NO: 311271 - RNA, 19 nt, Homo sapiens
ugaaugcacuggaaucuau

SEQ ID NO: 311272 - RNA, 19 nt, Homo sapiens
gcauaaagcauaaguauac

SEQ ID NO: 311273 - RNA, 19 nt, Homo sapiens
ggaauucucuaaucgaaag

SEQ ID NO: 311274 - RNA, 19 nt, Homo sapiens
gagaaaagguggacaaaga

SEQ ID NO: 311275 - RNA, 19 nt, Homo sapiens
ggaguugucacaucagaua

SEQ ID NO: 311276 - RNA, 19 nt, Homo sapiens
acuagacucuucacuguua

SEQ ID NO: 311277 - RNA, 19 nt, Homo sapiens
cagauagaaucaaucagua

SEQ ID NO: 311278 - RNA, 19 nt, Homo sapiens
ccaggcaauuucaggauua

SEQ ID NO: 311279 - RNA, 19 nt, Homo sapiens
guaaacaacugaagaagcu

SEQ ID NO: 311280 - RNA, 19 nt, Homo sapiens
aggaagaugugguuguuua

SEQ ID NO: 311281 - RNA, 19 nt, Homo sapiens
gaaagucagauggauauaa

SEQ ID NO: 311282 - RNA, 19 nt, Homo sapiens
ggucuaaggucuaucaagu

SEQ ID NO: 311283 - RNA, 19 nt, Homo sapiens
gcacugaugauaagaauuc

SEQ ID NO: 311284 - RNA, 19 nt, Homo sapiens
ggucaaagaaagaaaguuu

SEQ ID NO: 311285 - RNA, 19 nt, Homo sapiens
ccacuagacucuucacugu

SEQ ID NO: 311286 - RNA, 19 nt, Homo sapiens
aaacagcugucucuaacuu

SEQ ID NO: 311287 - RNA, 19 nt, Homo sapiens
ugauggaccuucuagaauu

SEQ ID NO: 311288 - RNA, 19 nt, Homo sapiens
ucucaaaguuuccuaauca

SEQ ID NO: 311289 - RNA, 19 nt, Homo sapiens
gaugggcacuugagaacuu

SEQ ID NO: 311290 - RNA, 19 nt, Homo sapiens
gcaaaucugcaccuaugua

SEQ ID NO: 311291 - RNA, 19 nt, Homo sapiens
gaaccuauaggccagagua

SEQ ID NO: 311292 - RNA, 19 nt, Homo sapiens
gcauuuaucauucuuguug

SEQ ID NO: 311293 - RNA, 19 nt, Homo sapiens
gauccgcgcuaccagauug

SEQ ID NO: 311294 - RNA, 19 nt, Homo sapiens
gagccuaucagaauuauau

SEQ ID NO: 311295 - RNA, 19 nt, Homo sapiens
uugcacaacugaauucuaa

SEQ ID NO: 311296 - RNA, 19 nt, Homo sapiens
uggagaaccucuacucaaa

SEQ ID NO: 311297 - RNA, 19 nt, Homo sapiens
gaaucugucucccaguuau

SEQ ID NO: 311298 - RNA, 19 nt, Homo sapiens
uaagugacauuuguaguug

SEQ ID NO: 311299 - RNA, 19 nt, Homo sapiens
acaguugucuagagauaua

SEQ ID NO: 311300 - RNA, 19 nt, Homo sapiens
gaaagauguccuucaagaa

SEQ ID NO: 311301 - RNA, 19 nt, Homo sapiens
ggugcaagcuguccagaga

SEQ ID NO: 311302 - RNA, 19 nt, Homo sapiens
caaccaccguuacaaguau

SEQ ID NO: 311303 - RNA, 19 nt, Homo sapiens
gaacuacaaagaagaugaa

SEQ ID NO: 311304 - RNA, 19 nt, Homo sapiens
gcugaguucuggucaaaga

SEQ ID NO: 311305 - RNA, 19 nt, Homo sapiens
agacauaucucuaauucca

SEQ ID NO: 311306 - RNA, 19 nt, Homo sapiens
ccuuggagcuuacauaguu

SEQ ID NO: 311307 - RNA, 19 nt, Homo sapiens
gcagauagaaucaaucagu

SEQ ID NO: 311308 - RNA, 19 nt, Homo sapiens
ccuguuguauugacuauuu

SEQ ID NO: 311309 - RNA, 19 nt, Homo sapiens
ugaccuaaaucacaaacaa

SEQ ID NO: 311310 - RNA, 19 nt, Homo sapiens
ggacuugaccuaaaucaca

SEQ ID NO: 311311 - RNA, 19 nt, Homo sapiens
gauccaaugcuucuguaua

SEQ ID NO: 311312 - RNA, 19 nt, Homo sapiens
gaaaugauccaaugcuucu

SEQ ID NO: 311313 - RNA, 19 nt, Homo sapiens
ggaggcugguugaaacgua

SEQ ID NO: 311314 - RNA, 19 nt, Homo sapiens
ccaaauaacaaguaccaaa

SEQ ID NO: 311315 - RNA, 19 nt, Homo sapiens
gaagaagcucucgacaaua

SEQ ID NO: 311316 - RNA, 19 nt, Homo sapiens
gaggagcacuuccaaaauu

SEQ ID NO: 311317 - RNA, 19 nt, Homo sapiens
ucaagucaaucauuucuca

SEQ ID NO: 311318 - RNA, 19 nt, Homo sapiens
aaagaugaguggauaagug

SEQ ID NO: 311319 - RNA, 19 nt, Homo sapiens
gaagagugacuaguacaaa

SEQ ID NO: 311320 - RNA, 19 nt, Homo sapiens
caucuuacuugagccuuua

SEQ ID NO: 311321 - RNA, 19 nt, Homo sapiens
ucacaaagaguucuggaaa

SEQ ID NO: 311322 - RNA, 19 nt, Homo sapiens
acacauugccuaacuacua

SEQ ID NO: 311323 - RNA, 19 nt, Homo sapiens
ucacaucagauaagacaua

SEQ ID NO: 311324 - RNA, 19 nt, Homo sapiens
gagugacuaguacaaauua

SEQ ID NO: 311325 - RNA, 19 nt, Homo sapiens
cagguuggcucuucagguu

SEQ ID NO: 311326 - RNA, 19 nt, Homo sapiens
gacagcaccuuaauggaau

SEQ ID NO: 311327 - RNA, 19 nt, Homo sapiens
caaaguaaacaacugaaga

SEQ ID NO: 311328 - RNA, 19 nt, Homo sapiens
caaaguuuccuaaucagaa

SEQ ID NO: 311329 - RNA, 19 nt, Homo sapiens
aaacaguugugaaccaaga

SEQ ID NO: 311330 - RNA, 19 nt, Homo sapiens
guaggugacacuauaguuu

SEQ ID NO: 311331 - RNA, 19 nt, Homo sapiens
uaaggucuaucaagucaau

SEQ ID NO: 311332 - RNA, 19 nt, Homo sapiens
guaucaguauggaaacuuu

SEQ ID NO: 311333 - RNA, 19 nt, Homo sapiens
cgacuuggccucccuucua

SEQ ID NO: 311334 - RNA, 19 nt, Homo sapiens
cuaauuccauccauaaauc

SEQ ID NO: 311335 - RNA, 19 nt, Homo sapiens
gcauaaguauacaguucaa

SEQ ID NO: 311336 - RNA, 19 nt, Homo sapiens
aaagaacuguuuacugcuu

SEQ ID NO: 311337 - RNA, 19 nt, Homo sapiens
aaucauuucucacugugua

SEQ ID NO: 311338 - RNA, 19 nt, Homo sapiens
auacagagccuaucagaau

SEQ ID NO: 311339 - RNA, 19 nt, Homo sapiens
cugaugacauuguuucaaa

SEQ ID NO: 311340 - RNA, 19 nt, Homo sapiens
aaagagagcugaagaaaag

SEQ ID NO: 311341 - RNA, 19 nt, Homo sapiens
uagaugaccucacuuggau

SEQ ID NO: 311342 - RNA, 19 nt, Homo sapiens
gugcugcuguuacuguuaa

SEQ ID NO: 311343 - RNA, 19 nt, Homo sapiens
cauaauggaucuuguaagc

SEQ ID NO: 311344 - RNA, 19 nt, Homo sapiens
gcacaacugaauucuaaau

SEQ ID NO: 311345 - RNA, 19 nt, Homo sapiens
aagaagcucucgacaauac

SEQ ID NO: 311346 - RNA, 19 nt, Homo sapiens
gaagugauguucuuuaaag

SEQ ID NO: 311347 - RNA, 19 nt, Homo sapiens
ggaauaaagucaaccuugu

SEQ ID NO: 311348 - RNA, 19 nt, Homo sapiens
ccacaaaguugaugcaguu

SEQ ID NO: 311349 - RNA, 19 nt, Homo sapiens
ggagguaugaugaauauaa

SEQ ID NO: 311350 - RNA, 19 nt, Homo sapiens
gaugaaagguggaccaaca

SEQ ID NO: 311351 - RNA, 19 nt, Homo sapiens
gcaaaugcaggaauucuuu

SEQ ID NO: 311352 - RNA, 19 nt, Homo sapiens
ggauaacucuucuaacaca

SEQ ID NO: 311353 - RNA, 19 nt, Homo sapiens
gagagcagcuucagugaca

SEQ ID NO: 311354 - RNA, 19 nt, Homo sapiens
ggaauuggccacaaaguug

SEQ ID NO: 311355 - RNA, 19 nt, Homo sapiens
gaacacaugugcagucacu

SEQ ID NO: 311356 - RNA, 19 nt, Homo sapiens
acaguaagcuaaccuuuga

SEQ ID NO: 311357 - RNA, 19 nt, Homo sapiens
gagaaagccuuccaacucu

SEQ ID NO: 311358 - RNA, 19 nt, Homo sapiens
gaauauaaacgaucuaugg

SEQ ID NO: 311359 - RNA, 19 nt, Homo sapiens
ugacaaacauauccuuuca

SEQ ID NO: 311360 - RNA, 19 nt, Homo sapiens
gaacucggccauucucuug

SEQ ID NO: 311361 - RNA, 19 nt, Homo sapiens
caucugaccuacaggauug

SEQ ID NO: 311362 - RNA, 19 nt, Homo sapiens
gaaagagacaggagacaug

SEQ ID NO: 311363 - RNA, 19 nt, Homo sapiens
gaaagugacugggaaacca

SEQ ID NO: 311364 - RNA, 19 nt, Homo sapiens
ugaagcaaaugcaggaauu

SEQ ID NO: 311365 - RNA, 19 nt, Homo sapiens
gaauaaagucaaccuuguu

SEQ ID NO: 311366 - RNA, 19 nt, Homo sapiens
caagggauaacucuucuaa

SEQ ID NO: 311367 - RNA, 19 nt, Homo sapiens
gcuaaccuuugaugcuaua

SEQ ID NO: 311368 - RNA, 19 nt, Homo sapiens
aaagguggaccaacaauuu

SEQ ID NO: 311369 - RNA, 19 nt, Homo sapiens
ggaauucuuugggcugaaa

SEQ ID NO: 311370 - RNA, 19 nt, Homo sapiens
gcugggaagccaucacuua

SEQ ID NO: 311371 - RNA, 19 nt, Homo sapiens
aaugauagcacaugacuuu

SEQ ID NO: 311372 - RNA, 19 nt, Homo sapiens
ggacaucuacagcuccuuu

SEQ ID NO: 311373 - RNA, 19 nt, Homo sapiens
gaaagguggaccaacaauu

SEQ ID NO: 311374 - RNA, 19 nt, Homo sapiens
agagcaagauguggacuua

SEQ ID NO: 311375 - RNA, 19 nt, Homo sapiens
ggaacaagacaauacaaau

SEQ ID NO: 311376 - RNA, 19 nt, Homo sapiens
aaacacaucugaccuacag

SEQ ID NO: 311377 - RNA, 19 nt, Homo sapiens
acuacaaccugaagaauga

SEQ ID NO: 311378 - RNA, 19 nt, Homo sapiens
agaaugugcuacacggaua

SEQ ID NO: 311379 - RNA, 19 nt, Homo sapiens
cuagaacugugaagcauau

SEQ ID NO: 311380 - RNA, 19 nt, Homo sapiens
aaacauauccuuucaagac

SEQ ID NO: 311381 - RNA, 19 nt, Homo sapiens
ggccacaacugccaaaugg

SEQ ID NO: 311382 - RNA, 19 nt, Homo sapiens
uuucagagaguacaacuua

SEQ ID NO: 311383 - RNA, 19 nt, Homo sapiens
ggacaacucuccuuuugau

SEQ ID NO: 311384 - RNA, 19 nt, Homo sapiens
gcagacaucaugauaucuu

SEQ ID NO: 311385 - RNA, 19 nt, Homo sapiens
ucaagcagacaucaugaua

SEQ ID NO: 311386 - RNA, 19 nt, Homo sapiens
gaaaccagaugcugaaacc

SEQ ID NO: 311387 - RNA, 19 nt, Homo sapiens
ggccagaguugcaaagauc

SEQ ID NO: 311388 - RNA, 19 nt, Homo sapiens
gaaaucuugcucaugcuuu

SEQ ID NO: 311389 - RNA, 19 nt, Homo sapiens
agggauaacucuucuaaca

SEQ ID NO: 311390 - RNA, 19 nt, Homo sapiens
acaaacauauccuuucaag

SEQ ID NO: 311391 - RNA, 19 nt, Homo sapiens
aagcuaaccuuugaugcua

SEQ ID NO: 311392 - RNA, 19 nt, Homo sapiens
ccaacaauuucagagagua

SEQ ID NO: 311393 - RNA, 19 nt, Homo sapiens
aagcagacaucaugauauc

SEQ ID NO: 311394 - RNA, 19 nt, Homo sapiens
gcacugagaaagaagacaa

SEQ ID NO: 311395 - RNA, 19 nt, Homo sapiens
ucacugauacacagaauau

SEQ ID NO: 311396 - RNA, 19 nt, Homo sapiens
gaauuggccacaaaguuga

SEQ ID NO: 311397 - RNA, 19 nt, Homo sapiens
gcgcacaaaucccuucuac

SEQ ID NO: 311398 - RNA, 19 nt, Homo sapiens
caaccaggcccagguauug

SEQ ID NO: 311399 - RNA, 19 nt, Homo sapiens
ugauggaccuggaggaaau

SEQ ID NO: 311400 - RNA, 19 nt, Homo sapiens
guuuguggcuuauggauuc

SEQ ID NO: 311401 - RNA, 19 nt, Homo sapiens
cugaagaacugucuauuuu

SEQ ID NO: 311402 - RNA, 19 nt, Homo sapiens
ggaccaacaauuucagaga

SEQ ID NO: 311403 - RNA, 19 nt, Homo sapiens
ggaccuggaggaaaucuug

SEQ ID NO: 311404 - RNA, 19 nt, Homo sapiens
ggaccaugccauugagaaa

SEQ ID NO: 311405 - RNA, 19 nt, Homo sapiens
gauguggagugccugaugu

SEQ ID NO: 311406 - RNA, 19 nt, Homo sapiens
cagacaucaugauaucuuu

SEQ ID NO: 311407 - RNA, 19 nt, Homo sapiens
ugagaaagccuuccaacuc

SEQ ID NO: 311408 - RNA, 19 nt, Homo sapiens
ccuacaggauugaaaauua

SEQ ID NO: 311409 - RNA, 19 nt, Homo sapiens
gaagacaaaggccaguaug

SEQ ID NO: 311410 - RNA, 19 nt, Homo sapiens
gacaguaagcuaaccuuug

SEQ ID NO: 311411 - RNA, 19 nt, Homo sapiens
ccugaagaacugucuauuu

SEQ ID NO: 311412 - RNA, 19 nt, Homo sapiens
gagcucaauuucauuucug

SEQ ID NO: 311413 - RNA, 19 nt, Homo sapiens
uuacgaauuugccgacaga

SEQ ID NO: 311414 - RNA, 19 nt, Homo sapiens
cuggagguaugaugaauau

SEQ ID NO: 311415 - RNA, 19 nt, Homo sapiens
caaccuuguuucuacuguu

SEQ ID NO: 311416 - RNA, 19 nt, Homo sapiens
gauaacucuucuaacacaa

SEQ ID NO: 311417 - RNA, 19 nt, Homo sapiens
gaaaagcggagaaauagug

SEQ ID NO: 311418 - RNA, 19 nt, Homo sapiens
gaaaauuacacgccagauu

SEQ ID NO: 311419 - RNA, 19 nt, Homo sapiens
aagucaaguuuguggcuua

SEQ ID NO: 311420 - RNA, 19 nt, Homo sapiens
gauucuacaugcgcacaaa

SEQ ID NO: 311421 - RNA, 19 nt, Homo sapiens
ggaaaucuugcucaugcuu

SEQ ID NO: 311422 - RNA, 19 nt, Homo sapiens
cagcgacucuagaaacaca

SEQ ID NO: 311423 - RNA, 19 nt, Homo sapiens
cagcuucagugacaaacau

SEQ ID NO: 311424 - RNA, 19 nt, Homo sapiens
gagcagcuucagugacaaa

SEQ ID NO: 311425 - RNA, 19 nt, Homo sapiens
gaacugugaagcauaucga

SEQ ID NO: 311426 - RNA, 19 nt, Homo sapiens
uaaagacagauucuacaug

SEQ ID NO: 311427 - RNA, 19 nt, Homo sapiens
caagcagacaucaugauau

SEQ ID NO: 311428 - RNA, 19 nt, Homo sapiens
ucaaguuuguggcuuaugg

SEQ ID NO: 311429 - RNA, 19 nt, Homo sapiens
cacaaaugguggguacaaa

SEQ ID NO: 311430 - RNA, 19 nt, Homo sapiens
uaucgaugcugcucuuucu

SEQ ID NO: 311431 - RNA, 19 nt, Homo sapiens
ucaaagggaauaaguacug

SEQ ID NO: 311432 - RNA, 19 nt, Homo sapiens
caaggucucugagggucaa

SEQ ID NO: 311433 - RNA, 19 nt, Homo sapiens
aaccuuguuucuacuguuu

SEQ ID NO: 311434 - RNA, 19 nt, Homo sapiens
caaaguugaugcaguuuuc

SEQ ID NO: 311435 - RNA, 19 nt, Homo sapiens
gaugggaggcaaguugaaa

SEQ ID NO: 311436 - RNA, 19 nt, Homo sapiens
gaaacacaagagcaagaug

SEQ ID NO: 311437 - RNA, 19 nt, Homo sapiens
ccaaaaugauagcacauga

SEQ ID NO: 311438 - RNA, 19 nt, Homo sapiens
gaauuugccgacagagaug

SEQ ID NO: 311439 - RNA, 19 nt, Homo sapiens
cgaauuugccgacagagau

SEQ ID NO: 311440 - RNA, 19 nt, Homo sapiens
uaaagucaaccuuguuucu

SEQ ID NO: 311441 - RNA, 19 nt, Homo sapiens
cauauccuuucaagacaga

SEQ ID NO: 311442 - RNA, 19 nt, Homo sapiens
aaacacaagagcaagaugu

SEQ ID NO: 311443 - RNA, 19 nt, Homo sapiens
aaagucaaccuuguuucua

SEQ ID NO: 311444 - RNA, 19 nt, Homo sapiens
gaaaagcagcucaagaaca

SEQ ID NO: 311445 - RNA, 19 nt, Homo sapiens
cuuggacucucccauucua

SEQ ID NO: 311446 - RNA, 19 nt, Homo sapiens
uaaagaagaugcagaaguu

SEQ ID NO: 311447 - RNA, 19 nt, Homo sapiens
ggacagcccugcaaguuuc

SEQ ID NO: 311448 - RNA, 19 nt, Homo sapiens
uacaacagcugcacugaua

SEQ ID NO: 311449 - RNA, 19 nt, Homo sapiens
acaaugaggugaagaagaa

SEQ ID NO: 311450 - RNA, 19 nt, Homo sapiens
gaauaaagacaccuacuga

SEQ ID NO: 311451 - RNA, 19 nt, Homo sapiens
ggugagaucuucuucuuca

SEQ ID NO: 311452 - RNA, 19 nt, Homo sapiens
gacaguggaugaugccuuu

SEQ ID NO: 311453 - RNA, 19 nt, Homo sapiens
gcaaacaggacauuguauu

SEQ ID NO: 311454 - RNA, 19 nt, Homo sapiens
ugggaaaugucaacaagua

SEQ ID NO: 311455 - RNA, 19 nt, Homo sapiens
ggagacaaauucuggagau

SEQ ID NO: 311456 - RNA, 19 nt, Homo sapiens
aagaauagaugcugacugu

SEQ ID NO: 311457 - RNA, 19 nt, Homo sapiens
ggucacagcuacuucuuca

SEQ ID NO: 311458 - RNA, 19 nt, Homo sapiens
gaaaugucaacaaguauga

SEQ ID NO: 311459 - RNA, 19 nt, Homo sapiens
caaacaggacauuguauuu

SEQ ID NO: 311460 - RNA, 19 nt, Homo sapiens
gagacaaauucuggagaua

SEQ ID NO: 311461 - RNA, 19 nt, Homo sapiens
gcgaguggaugccgccuuu

SEQ ID NO: 311462 - RNA, 19 nt, Homo sapiens
caggugaucuugaccagaa

SEQ ID NO: 311463 - RNA, 19 nt, Homo sapiens
acaagaaccagaucacaua

SEQ ID NO: 311464 - RNA, 19 nt, Homo sapiens
gacaaauucuggagauaca

SEQ ID NO: 311465 - RNA, 19 nt, Homo sapiens
gaauagaugcugacuguac

SEQ ID NO: 311466 - RNA, 19 nt, Homo sapiens
ggaaugccauccccgauaa

SEQ ID NO: 311467 - RNA, 19 nt, Homo sapiens
ggagagcugcaaccuguuu

SEQ ID NO: 311468 - RNA, 19 nt, Homo sapiens
ggaaaugucaacaaguaug

SEQ ID NO: 311469 - RNA, 19 nt, Homo sapiens
gaaccuuucuuacauuagc

SEQ ID NO: 311470 - RNA, 19 nt, Homo sapiens
ggagauacaaugaggugaa

SEQ ID NO: 311471 - RNA, 19 nt, Homo sapiens
ucaaggaccgguucauuug

SEQ ID NO: 311472 - RNA, 19 nt, Homo sapiens
aacaggacauuguauuuga

SEQ ID NO: 311473 - RNA, 19 nt, Homo sapiens
guggugagaucuucuucuu

SEQ ID NO: 311474 - RNA, 19 nt, Homo sapiens
ugagaaggauggcaaguac

SEQ ID NO: 311475 - RNA, 19 nt, Homo sapiens
gugcaucucagcccacaua

SEQ ID NO: 311476 - RNA, 19 nt, Homo sapiens
gaaggacacacuaaagaag

SEQ ID NO: 311477 - RNA, 19 nt, Homo sapiens
gauacaaugaggugaagaa

SEQ ID NO: 311478 - RNA, 19 nt, Homo sapiens
gcucgugccuuccaagucu

SEQ ID NO: 311479 - RNA, 19 nt, Homo sapiens
ugcaauaccugaacaccuu

SEQ ID NO: 311480 - RNA, 19 nt, Homo sapiens
gcaguuugcuuuguaugca

SEQ ID NO: 311481 - RNA, 19 nt, Homo sapiens
gcagugcaauaccugaaca

SEQ ID NO: 311482 - RNA, 19 nt, Homo sapiens
caucucagcccacauagug

SEQ ID NO: 311483 - RNA, 19 nt, Homo sapiens
gaguggaugccgccuuuaa

SEQ ID NO: 311484 - RNA, 19 nt, Homo sapiens
aaacaggacauuguauuug

SEQ ID NO: 311485 - RNA, 19 nt, Homo sapiens
ugaaggacacacuaaagaa

SEQ ID NO: 311486 - RNA, 19 nt, Homo sapiens
gggaaugaauacuggaucu

SEQ ID NO: 311487 - RNA, 19 nt, Homo sapiens
ggacuacgaccgcgacaag

SEQ ID NO: 311488 - RNA, 19 nt, Homo sapiens
caugggaaaugucaacaag

SEQ ID NO: 311489 - RNA, 19 nt, Homo sapiens
cagcuaaucagcauucuca

SEQ ID NO: 311490 - RNA, 19 nt, Homo sapiens
ggccugagcucccggaaaa

SEQ ID NO: 311491 - RNA, 19 nt, Homo sapiens
accaagaacuuccgucugu

SEQ ID NO: 311492 - RNA, 19 nt, Homo sapiens
ccacagccaacuacgauga

SEQ ID NO: 311493 - RNA, 19 nt, Homo sapiens
gagauacaaugaggugaag

SEQ ID NO: 311494 - RNA, 19 nt, Homo sapiens
acccagauguggccaacua

SEQ ID NO: 311495 - RNA, 19 nt, Homo sapiens
cuggagaacuagagaagga

SEQ ID NO: 311496 - RNA, 19 nt, Homo sapiens
ugaagagcgugaaguuugg

SEQ ID NO: 311497 - RNA, 19 nt, Homo sapiens
ggaaugaauacuggaucua

SEQ ID NO: 311498 - RNA, 19 nt, Homo sapiens
aggcagacaucaugaucaa

SEQ ID NO: 311499 - RNA, 19 nt, Homo sapiens
ggagaggcagacaucauga

SEQ ID NO: 311500 - RNA, 19 nt, Homo sapiens
cugaagagcgugaaguuug

SEQ ID NO: 311501 - RNA, 19 nt, Homo sapiens
gcagacaucaugaucaacu

SEQ ID NO: 311502 - RNA, 19 nt, Homo sapiens
ggacaagaaccagaucaca

SEQ ID NO: 311503 - RNA, 19 nt, Homo sapiens
ccagacaggugaucuugac

SEQ ID NO: 311504 - RNA, 19 nt, Homo sapiens
gaccacagccaacuacgau

SEQ ID NO: 311505 - RNA, 19 nt, Homo sapiens
gacaagaaccagaucacau

SEQ ID NO: 311506 - RNA, 19 nt, Homo sapiens
aaagauugaugcgguauac

SEQ ID NO: 311507 - RNA, 19 nt, Homo sapiens
gggccucuccugacauuga

SEQ ID NO: 311508 - RNA, 19 nt, Homo sapiens
gaaggacagcccugcaagu

SEQ ID NO: 311509 - RNA, 19 nt, Homo sapiens
gagaaccaaagucugaaga

SEQ ID NO: 311510 - RNA, 19 nt, Homo sapiens
gaaugaauacuggaucuac

SEQ ID NO: 311511 - RNA, 19 nt, Homo sapiens
ucacuuuccugggcaacaa

SEQ ID NO: 311512 - RNA, 19 nt, Homo sapiens
cuucaagggugccuauuac

SEQ ID NO: 311513 - RNA, 19 nt, Homo sapiens
uggcacccauuuacaccua

SEQ ID NO: 311514 - RNA, 19 nt, Homo sapiens
ccuacaacuuugagaagga

SEQ ID NO: 311515 - RNA, 19 nt, Homo sapiens
ccacugcgguuuucucgaa

SEQ ID NO: 311516 - RNA, 19 nt, Homo sapiens
ucacauacaggaucauugg

SEQ ID NO: 311517 - RNA, 19 nt, Homo sapiens
gcaaccuguuugugcugaa

SEQ ID NO: 311518 - RNA, 19 nt, Homo sapiens
caaauucuggagauacaau

SEQ ID NO: 311519 - RNA, 19 nt, Homo sapiens
ccaccuacaacuuugagaa

SEQ ID NO: 311520 - RNA, 19 nt, Homo sapiens
guacaacagcugcacugau

SEQ ID NO: 311521 - RNA, 19 nt, Homo sapiens
acugcuggcugccuuagaa

SEQ ID NO: 311522 - RNA, 19 nt, Homo sapiens
ucacagcuacuucuucaag

SEQ ID NO: 311523 - RNA, 19 nt, Homo sapiens
cgucgcccaucaucaaguu

SEQ ID NO: 311524 - RNA, 19 nt, Homo sapiens
cugcaaacaggacauugua

SEQ ID NO: 311525 - RNA, 19 nt, Homo sapiens
gggagcauggcgauggaua

SEQ ID NO: 311526 - RNA, 19 nt, Homo sapiens
cuaaagaagaugcagaagu

SEQ ID NO: 311527 - RNA, 19 nt, Homo sapiens
gaucuugaccagaauacca

SEQ ID NO: 311528 - RNA, 19 nt, Homo sapiens
ugaauaaagacaccuacug

SEQ ID NO: 311529 - RNA, 19 nt, Homo sapiens
ugacagaaggacucagguu

SEQ ID NO: 311530 - RNA, 19 nt, Homo sapiens
ggaggagaaggcuguguuc

SEQ ID NO: 311531 - RNA, 19 nt, Homo sapiens
gggaaaugucaacaaguau

SEQ ID NO: 311532 - RNA, 19 nt, Homo sapiens
gaagcuggagaaccaaagu

SEQ ID NO: 311533 - RNA, 19 nt, Homo sapiens
gcugaaggacacacuaaag

SEQ ID NO: 311534 - RNA, 19 nt, Homo sapiens
gcuauggaccuugggagaa

SEQ ID NO: 311535 - RNA, 19 nt, Homo sapiens
gacaucaugaucaacuuug

SEQ ID NO: 311536 - RNA, 19 nt, Homo sapiens
cagacaucaugaucaacuu

SEQ ID NO: 311537 - RNA, 19 nt, Homo sapiens
agaauaccaucgagaccau

SEQ ID NO: 311538 - RNA, 19 nt, Homo sapiens
caggaucauuggcuacaca

SEQ ID NO: 311539 - RNA, 19 nt, Homo sapiens
gugcugaaggacacacuaa

SEQ ID NO: 311540 - RNA, 19 nt, Homo sapiens
gcucuucuccuuucacaac

SEQ ID NO: 311541 - RNA, 19 nt, Homo sapiens
cuacagcuaaucagcauuc

SEQ ID NO: 311542 - RNA, 19 nt, Homo sapiens
ucuucaagggugccuauua

SEQ ID NO: 311543 - RNA, 19 nt, Homo sapiens
gaucugcaaacaggacauu

SEQ ID NO: 311544 - RNA, 19 nt, Homo sapiens
gcauucaggagcucuaugg

SEQ ID NO: 311545 - RNA, 19 nt, Homo sapiens
cugaaggacacacuaaaga

SEQ ID NO: 311546 - RNA, 19 nt, Homo sapiens
gcaaauagcugaagacuuu

SEQ ID NO: 311547 - RNA, 19 nt, Homo sapiens
ggagaaauccugaucuuua

SEQ ID NO: 311548 - RNA, 19 nt, Homo sapiens
gagaaauccugaucuuuaa

SEQ ID NO: 311549 - RNA, 19 nt, Homo sapiens
cauacaggauugugaauua

SEQ ID NO: 311550 - RNA, 19 nt, Homo sapiens
gaaccugaauugcauuuga

SEQ ID NO: 311551 - RNA, 19 nt, Homo sapiens
gcuaauaauucuucaccua

SEQ ID NO: 311552 - RNA, 19 nt, Homo sapiens
uaauggagaugcccacuuu

SEQ ID NO: 311553 - RNA, 19 nt, Homo sapiens
caacagggaccaauuuauu

SEQ ID NO: 311554 - RNA, 19 nt, Homo sapiens
gaacaauggacaaaggaua

SEQ ID NO: 311555 - RNA, 19 nt, Homo sapiens
caacauagagcuaaguaaa

SEQ ID NO: 311556 - RNA, 19 nt, Homo sapiens
caaaugggcugcugcuuag

SEQ ID NO: 311557 - RNA, 19 nt, Homo sapiens
aguaacagcuggcuuaauu

SEQ ID NO: 311558 - RNA, 19 nt, Homo sapiens
gaaaaucgaugcagccauu

SEQ ID NO: 311559 - RNA, 19 nt, Homo sapiens
uagagaacauggagacuuu

SEQ ID NO: 311560 - RNA, 19 nt, Homo sapiens
ucaaaugggcugcugcuua

SEQ ID NO: 311561 - RNA, 19 nt, Homo sapiens
gcuugcaccuugucacaua

SEQ ID NO: 311562 - RNA, 19 nt, Homo sapiens
uaaagacgauuugucaguu

SEQ ID NO: 311563 - RNA, 19 nt, Homo sapiens
caacugugauccugcuuug

SEQ ID NO: 311564 - RNA, 19 nt, Homo sapiens
ugagaaagcucugaaaguc

SEQ ID NO: 311565 - RNA, 19 nt, Homo sapiens
ugaaggagaggcugauaua

SEQ ID NO: 311566 - RNA, 19 nt, Homo sapiens
acacacacuuugaagagua

SEQ ID NO: 311567 - RNA, 19 nt, Homo sapiens
cauaugaaguuacuagcaa

SEQ ID NO: 311568 - RNA, 19 nt, Homo sapiens
ccacuuugaugaugaugaa

SEQ ID NO: 311569 - RNA, 19 nt, Homo sapiens
gcaaagaaagugacacaca

SEQ ID NO: 311570 - RNA, 19 nt, Homo sapiens
cuaagucucugugaauuga

SEQ ID NO: 311571 - RNA, 19 nt, Homo sapiens
acagcuggcuuaauuguug

SEQ ID NO: 311572 - RNA, 19 nt, Homo sapiens
gcaaaucccucaggaagcu

SEQ ID NO: 311573 - RNA, 19 nt, Homo sapiens
gaugaacaauggacaaagg

SEQ ID NO: 311574 - RNA, 19 nt, Homo sapiens
ugauggaccuggaaauguu

SEQ ID NO: 311575 - RNA, 19 nt, Homo sapiens
aggagaggcugauauaaug

SEQ ID NO: 311576 - RNA, 19 nt, Homo sapiens
uaaagccaguggaaaugaa

SEQ ID NO: 311577 - RNA, 19 nt, Homo sapiens
gaaggagaggcugauauaa

SEQ ID NO: 311578 - RNA, 19 nt, Homo sapiens
ugacccaaaugcaaagaaa

SEQ ID NO: 311579 - RNA, 19 nt, Homo sapiens
gagaugcccacuuugauga

SEQ ID NO: 311580 - RNA, 19 nt, Homo sapiens
ggaaaacccaccuuacaua

SEQ ID NO: 311581 - RNA, 19 nt, Homo sapiens
uguguagacuauuugcuua

SEQ ID NO: 311582 - RNA, 19 nt, Homo sapiens
uaugggcacuuuaaaugaa

SEQ ID NO: 311583 - RNA, 19 nt, Homo sapiens
gcacaauaugggcacuuua

SEQ ID NO: 311584 - RNA, 19 nt, Homo sapiens
ugaaagagauauguagaag

SEQ ID NO: 311585 - RNA, 19 nt, Homo sapiens
gagauuugaugagaagaga

SEQ ID NO: 311586 - RNA, 19 nt, Homo sapiens
guaucuguguagacuauuu

SEQ ID NO: 311587 - RNA, 19 nt, Homo sapiens
ccaagcaaauagcugaaga

SEQ ID NO: 311588 - RNA, 19 nt, Homo sapiens
acacugaagcuuugaugua

SEQ ID NO: 311589 - RNA, 19 nt, Homo sapiens
ggagaugcccacuuugaug

SEQ ID NO: 311590 - RNA, 19 nt, Homo sapiens
gcagaaguuccuuggauug

SEQ ID NO: 311591 - RNA, 19 nt, Homo sapiens
caucagaggaaaugaggua

SEQ ID NO: 311592 - RNA, 19 nt, Homo sapiens
gcacuuuaaaugaagcuaa

SEQ ID NO: 311593 - RNA, 19 nt, Homo sapiens
uggcuuaauuguugaaaga

SEQ ID NO: 311594 - RNA, 19 nt, Homo sapiens
aagaguaacagcuggcuua

SEQ ID NO: 311595 - RNA, 19 nt, Homo sapiens
gaucuucacaguuggaguu

SEQ ID NO: 311596 - RNA, 19 nt, Homo sapiens
gcauuugaucucuucauuu

SEQ ID NO: 311597 - RNA, 19 nt, Homo sapiens
gaauugcauuugaucucuu

SEQ ID NO: 311598 - RNA, 19 nt, Homo sapiens
gaagaggugacuccacuca

SEQ ID NO: 311599 - RNA, 19 nt, Homo sapiens
gaauuauacaccagauuug

SEQ ID NO: 311600 - RNA, 19 nt, Homo sapiens
cacaauaugggcacuuuaa

SEQ ID NO: 311601 - RNA, 19 nt, Homo sapiens
gaugcagccauuucugaua

SEQ ID NO: 311602 - RNA, 19 nt, Homo sapiens
gaagcuugaaccugaauug

SEQ ID NO: 311603 - RNA, 19 nt, Homo sapiens
gaaauccugaucuuuaaag

SEQ ID NO: 311604 - RNA, 19 nt, Homo sapiens
caccuuacauacaggauug

SEQ ID NO: 311605 - RNA, 19 nt, Homo sapiens
aaagacgauuugucaguug

SEQ ID NO: 311606 - RNA, 19 nt, Homo sapiens
caauaugggcacuuuaaau

SEQ ID NO: 311607 - RNA, 19 nt, Homo sapiens
cuucacaguuggaguuuga

SEQ ID NO: 311608 - RNA, 19 nt, Homo sapiens
gacaacauagagcuaagua

SEQ ID NO: 311609 - RNA, 19 nt, Homo sapiens
aaacuacuacgaccucaaa

SEQ ID NO: 311610 - RNA, 19 nt, Homo sapiens
gacgauuugucaguuguuu

SEQ ID NO: 311611 - RNA, 19 nt, Homo sapiens
gcauagagacaacauagag

SEQ ID NO: 311612 - RNA, 19 nt, Homo sapiens
gaggacaaauacuggagau

SEQ ID NO: 311613 - RNA, 19 nt, Homo sapiens
gcaaggaccucguuuucau

SEQ ID NO: 311614 - RNA, 19 nt, Homo sapiens
guaaagccaguggaaauga

SEQ ID NO: 311615 - RNA, 19 nt, Homo sapiens
ugaagacuuuccagggauu

SEQ ID NO: 311616 - RNA, 19 nt, Homo sapiens
gauacaacagggaccaauu

SEQ ID NO: 311617 - RNA, 19 nt, Homo sapiens
gagcgugaaucuguaucuu

SEQ ID NO: 311618 - RNA, 19 nt, Homo sapiens
ggcacaauaugggcacuuu

SEQ ID NO: 311619 - RNA, 19 nt, Homo sapiens
augcagccauuucugauaa

SEQ ID NO: 311620 - RNA, 19 nt, Homo sapiens
gcuugaaccugaauugcau

SEQ ID NO: 311621 - RNA, 19 nt, Homo sapiens
ggcaagacagcaaggcaua

SEQ ID NO: 311622 - RNA, 19 nt, Homo sapiens
gauccugcuuuguccuuug

SEQ ID NO: 311623 - RNA, 19 nt, Homo sapiens
ggagaggcugauauaauga

SEQ ID NO: 311624 - RNA, 19 nt, Homo sapiens
gcuuaauuguugaaagaga

SEQ ID NO: 311625 - RNA, 19 nt, Homo sapiens
gauuugaugagaagagaaa

SEQ ID NO: 311626 - RNA, 19 nt, Homo sapiens
ggacgccagccaacuguga

SEQ ID NO: 311627 - RNA, 19 nt, Homo sapiens
aauaugggcacuuuaaaug

SEQ ID NO: 311628 - RNA, 19 nt, Homo sapiens
gcaguuugcucagccuauc

SEQ ID NO: 311629 - RNA, 19 nt, Homo sapiens
uaacagcuggcuuaauugu

SEQ ID NO: 311630 - RNA, 19 nt, Homo sapiens
ccaaaugcaaagaaaguga

SEQ ID NO: 311631 - RNA, 19 nt, Homo sapiens
uccgagaaaugcagaaguu

SEQ ID NO: 311632 - RNA, 19 nt, Homo sapiens
ucucguugcugcucaugaa

SEQ ID NO: 311633 - RNA, 19 nt, Homo sapiens
caaaagaugcuguugauuc

SEQ ID NO: 311634 - RNA, 19 nt, Homo sapiens
gguguggaguuccugaugu

SEQ ID NO: 311635 - RNA, 19 nt, Homo sapiens
gaaccugucccuccagaac

SEQ ID NO: 311636 - RNA, 19 nt, Homo sapiens
uacaacagggaccaauuua

SEQ ID NO: 311637 - RNA, 19 nt, Homo sapiens
auacaacagggaccaauuu

SEQ ID NO: 311638 - RNA, 19 nt, Homo sapiens
aaacccaccuuacauacag

SEQ ID NO: 311639 - RNA, 19 nt, Homo sapiens
gacaagugacuguaucugu

SEQ ID NO: 311640 - RNA, 19 nt, Homo sapiens
cacacacuuugaagaguaa

SEQ ID NO: 311641 - RNA, 19 nt, Homo sapiens
gggagaaauccugaucuuu

SEQ ID NO: 311642 - RNA, 19 nt, Homo sapiens
gagacaacauagagcuaag

SEQ ID NO: 311643 - RNA, 19 nt, Homo sapiens
cagugguccuguuguuaaa

SEQ ID NO: 311644 - RNA, 19 nt, Homo sapiens
cagaggaaaugagguacga

SEQ ID NO: 311645 - RNA, 19 nt, Homo sapiens
ugcagaaguuccuuggauu

SEQ ID NO: 311646 - RNA, 19 nt, Homo sapiens
gaacauccauucauucauu

SEQ ID NO: 311647 - RNA, 19 nt, Homo sapiens
gaaacuauauggaaagaga

SEQ ID NO: 311648 - RNA, 19 nt, Homo sapiens
gcgcguagaugucaauaaa

SEQ ID NO: 311649 - RNA, 19 nt, Homo sapiens
ggaaagagaaguaauucaa

SEQ ID NO: 311650 - RNA, 19 nt, Homo sapiens
gggauuaacuuccuguaug

SEQ ID NO: 311651 - RNA, 19 nt, Homo sapiens
ggacauuccucugauccua

SEQ ID NO: 311652 - RNA, 19 nt, Homo sapiens
ggaacaggcucaggacuau

SEQ ID NO: 311653 - RNA, 19 nt, Homo sapiens
gcguagaugucaauaaaug

SEQ ID NO: 311654 - RNA, 19 nt, Homo sapiens
gaaugucuuucacuccuuu

SEQ ID NO: 311655 - RNA, 19 nt, Homo sapiens
gcaauuaugucacccuuuu

SEQ ID NO: 311656 - RNA, 19 nt, Homo sapiens
gcucaggacuaucucaaga

SEQ ID NO: 311657 - RNA, 19 nt, Homo sapiens
ggcagaacauccauucauu

SEQ ID NO: 311658 - RNA, 19 nt, Homo sapiens
gaacuuggccauucuuugg

SEQ ID NO: 311659 - RNA, 19 nt, Homo sapiens
ccacuccauuuagcaauua

SEQ ID NO: 311660 - RNA, 19 nt, Homo sapiens
ugccagauguugcagaaua

SEQ ID NO: 311661 - RNA, 19 nt, Homo sapiens
guuaaacucccgcgucaua

SEQ ID NO: 311662 - RNA, 19 nt, Homo sapiens
ccuacaggaucguaucaua

SEQ ID NO: 311663 - RNA, 19 nt, Homo sapiens
gagaaguaauucaagaaag

SEQ ID NO: 311664 - RNA, 19 nt, Homo sapiens
gggaacugcugacaucaug

SEQ ID NO: 311665 - RNA, 19 nt, Homo sapiens
gauauuaaaggcauucaga

SEQ ID NO: 311666 - RNA, 19 nt, Homo sapiens
uaaaggcauucagaaacua

SEQ ID NO: 311667 - RNA, 19 nt, Homo sapiens
ggagauccccaaaauuuua

SEQ ID NO: 311668 - RNA, 19 nt, Homo sapiens
gagaugcucacuucgauga

SEQ ID NO: 311669 - RNA, 19 nt, Homo sapiens
gaaagagaaguaauucaag

SEQ ID NO: 311670 - RNA, 19 nt, Homo sapiens
cggaggagaugcucacuuc

SEQ ID NO: 311671 - RNA, 19 nt, Homo sapiens
gaauugauaagcacuguuc

SEQ ID NO: 311672 - RNA, 19 nt, Homo sapiens
gggaacaggcucaggacua

SEQ ID NO: 311673 - RNA, 19 nt, Homo sapiens
cgagacuuaccgcauauua

SEQ ID NO: 311674 - RNA, 19 nt, Homo sapiens
uacaggaucguaucauaua

SEQ ID NO: 311675 - RNA, 19 nt, Homo sapiens
ggauuaacuuccuguaugc

SEQ ID NO: 311676 - RNA, 19 nt, Homo sapiens
ucacuucgaugaggaugaa

SEQ ID NO: 311677 - RNA, 19 nt, Homo sapiens
acucgagacuuaccgcaua

SEQ ID NO: 311678 - RNA, 19 nt, Homo sapiens
gauguggagugccagaugu

SEQ ID NO: 311679 - RNA, 19 nt, Homo sapiens
gcagaacauccauucauuc

SEQ ID NO: 311680 - RNA, 19 nt, Homo sapiens
cagaaacuauauggaaaga

SEQ ID NO: 311681 - RNA, 19 nt, Homo sapiens
aaccauagguccaagaaca

SEQ ID NO: 311682 - RNA, 19 nt, Homo sapiens
guagcagucuagggauuaa

SEQ ID NO: 311683 - RNA, 19 nt, Homo sapiens
gguagcagucuagggauua

SEQ ID NO: 311684 - RNA, 19 nt, Homo sapiens
gaacugcugacaucaugau

SEQ ID NO: 311685 - RNA, 19 nt, Homo sapiens
uuaaaggcauucagaaacu

SEQ ID NO: 311686 - RNA, 19 nt, Homo sapiens
ccaaauagcccaaaaugga

SEQ ID NO: 311687 - RNA, 19 nt, Homo sapiens
uacaguggaucgauuagug

SEQ ID NO: 311688 - RNA, 19 nt, Homo sapiens
ccaaaguggucaccuacag

SEQ ID NO: 311689 - RNA, 19 nt, Homo sapiens
cagaacauccauucauuca

SEQ ID NO: 311690 - RNA, 19 nt, Homo sapiens
ggaaacacgcuggcucaug

SEQ ID NO: 311691 - RNA, 19 nt, Homo sapiens
cacgcuggcucaugccuuu

SEQ ID NO: 311692 - RNA, 19 nt, Homo sapiens
ccauuuagcaauuauguca

SEQ ID NO: 311693 - RNA, 19 nt, Homo sapiens
gcagugauguauccaaccu

SEQ ID NO: 311694 - RNA, 19 nt, Homo sapiens
aagccaaacucaaggagau

SEQ ID NO: 311695 - RNA, 19 nt, Homo sapiens
ugucuuauuccaucuauga

SEQ ID NO: 311696 - RNA, 19 nt, Homo sapiens
gaggagaugcucacuucga

SEQ ID NO: 311697 - RNA, 19 nt, Homo sapiens
aucauauacucgagacuua

SEQ ID NO: 311698 - RNA, 19 nt, Homo sapiens
uauuacaguggaucgauua

SEQ ID NO: 311699 - RNA, 19 nt, Homo sapiens
gacauuccucugauccuaa

SEQ ID NO: 311700 - RNA, 19 nt, Homo sapiens
agacuuaccgcauauuaca

SEQ ID NO: 311701 - RNA, 19 nt, Homo sapiens
cuacaggaucguaucauau

SEQ ID NO: 311702 - RNA, 19 nt, Homo sapiens
gugugacugugucuuauuc

SEQ ID NO: 311703 - RNA, 19 nt, Homo sapiens
guaugggacauuccucuga

SEQ ID NO: 311704 - RNA, 19 nt, Homo sapiens
cuauauggaaagagaagua

SEQ ID NO: 311705 - RNA, 19 nt, Homo sapiens
ggaugauauuaaaggcauu

SEQ ID NO: 311706 - RNA, 19 nt, Homo sapiens
gaaauggagauccccaaaa

SEQ ID NO: 311707 - RNA, 19 nt, Homo sapiens
ggacuccuacccauuugau

SEQ ID NO: 311708 - RNA, 19 nt, Homo sapiens
cuuccaaaguggucaccua

SEQ ID NO: 311709 - RNA, 19 nt, Homo sapiens
uaaacucccgcgucauaga

SEQ ID NO: 311710 - RNA, 19 nt, Homo sapiens
cagaauugauaagcacugu

SEQ ID NO: 311711 - RNA, 19 nt, Homo sapiens
aaacuuucccaggaugaua

SEQ ID NO: 311712 - RNA, 19 nt, Homo sapiens
aaauggagauccccaaaau

SEQ ID NO: 311713 - RNA, 19 nt, Homo sapiens
caacaguuuagaagccaaa

SEQ ID NO: 311714 - RNA, 19 nt, Homo sapiens
cuaaugcagugauguaucc

SEQ ID NO: 311715 - RNA, 19 nt, Homo sapiens
gaacgcuggacggauggua

SEQ ID NO: 311716 - RNA, 19 nt, Homo sapiens
aaacucccgcgucauagaa

SEQ ID NO: 311717 - RNA, 19 nt, Homo sapiens
uccauucauucauucauug

SEQ ID NO: 311718 - RNA, 19 nt, Homo sapiens
agugauguauccaaccuau

SEQ ID NO: 311719 - RNA, 19 nt, Homo sapiens
ggugugacugugucuuauu

SEQ ID NO: 311720 - RNA, 19 nt, Homo sapiens
ucacuccuuuuauugguua

SEQ ID NO: 311721 - RNA, 19 nt, Homo sapiens
gcauucagaaacuauaugg

SEQ ID NO: 311722 - RNA, 19 nt, Homo sapiens
uaugggacauuccucugau

SEQ ID NO: 311723 - RNA, 19 nt, Homo sapiens
cugcugacaucaugauugg

SEQ ID NO: 311724 - RNA, 19 nt, Homo sapiens
guggaucgauuagugucaa

SEQ ID NO: 311725 - RNA, 19 nt, Homo sapiens
gccagauguugcagaauac

SEQ ID NO: 311726 - RNA, 19 nt, Homo sapiens
auagaaacuucaggcagaa

SEQ ID NO: 311727 - RNA, 19 nt, Homo sapiens
uaucauauacucgagacuu

SEQ ID NO: 311728 - RNA, 19 nt, Homo sapiens
gguccaagaacaauugucu

SEQ ID NO: 311729 - RNA, 19 nt, Homo sapiens
uucccaggaugauauuaaa

SEQ ID NO: 311730 - RNA, 19 nt, Homo sapiens
cucaugaacuuggccauuc

SEQ ID NO: 311731 - RNA, 19 nt, Homo sapiens
gacggaugguagcagucua

SEQ ID NO: 311732 - RNA, 19 nt, Homo sapiens
ugacaucaugauuggcuuu

SEQ ID NO: 311733 - RNA, 19 nt, Homo sapiens
uccacuccauuuagcaauu

SEQ ID NO: 311734 - RNA, 19 nt, Homo sapiens
ugauguauccaaccuaugg

SEQ ID NO: 311735 - RNA, 19 nt, Homo sapiens
aggagaugcucacuucgau

SEQ ID NO: 311736 - RNA, 19 nt, Homo sapiens
ggaacugcugacaucauga

SEQ ID NO: 311737 - RNA, 19 nt, Homo sapiens
auauuacaguggaucgauu

SEQ ID NO: 311738 - RNA, 19 nt, Homo sapiens
gagacuuaccgcauauuac

SEQ ID NO: 311739 - RNA, 19 nt, Homo sapiens
guugcagaauacucacuau

SEQ ID NO: 311740 - RNA, 19 nt, Homo sapiens
ucaaccauagguccaagaa

SEQ ID NO: 311741 - RNA, 19 nt, Homo sapiens
aaacuccuuuaugguguga

SEQ ID NO: 311742 - RNA, 19 nt, Homo sapiens
ucaggcagaacauccauuc

SEQ ID NO: 311743 - RNA, 19 nt, Homo sapiens
gaaacuucaggcagaacau

SEQ ID NO: 311744 - RNA, 19 nt, Homo sapiens
ggaaauggagauccccaaa

SEQ ID NO: 311745 - RNA, 19 nt, Homo sapiens
ucaugaacuuggccauucu

SEQ ID NO: 311746 - RNA, 19 nt, Homo sapiens
ggaaagaaauguagaugau

SEQ ID NO: 311747 - RNA, 19 nt, Homo sapiens
gcacuaaugugaucguuga

SEQ ID NO: 311748 - RNA, 19 nt, Homo sapiens
gaagaaacauggaccaaca

SEQ ID NO: 311749 - RNA, 19 nt, Homo sapiens
ccaaggauauaucaaacua

SEQ ID NO: 311750 - RNA, 19 nt, Homo sapiens
uuacauaucugacuucuag

SEQ ID NO: 311751 - RNA, 19 nt, Homo sapiens
ucaaagagaaggaaaguaa

SEQ ID NO: 311752 - RNA, 19 nt, Homo sapiens
gaauagagaguaaaguuga

SEQ ID NO: 311753 - RNA, 19 nt, Homo sapiens
gagaaggcauccucagcua

SEQ ID NO: 311754 - RNA, 19 nt, Homo sapiens
cacauuccaucuuacauua

SEQ ID NO: 311755 - RNA, 19 nt, Homo sapiens
gaagacagaggcagagauu

SEQ ID NO: 311756 - RNA, 19 nt, Homo sapiens
gaguaaaguugaugcaguu

SEQ ID NO: 311757 - RNA, 19 nt, Homo sapiens
agaaagagcuaucaaggau

SEQ ID NO: 311758 - RNA, 19 nt, Homo sapiens
auaaauggcuuaacuguag

SEQ ID NO: 311759 - RNA, 19 nt, Homo sapiens
uuaaagaaaugcagcgauu

SEQ ID NO: 311760 - RNA, 19 nt, Homo sapiens
gagauaugauaaccaaaga

SEQ ID NO: 311761 - RNA, 19 nt, Homo sapiens
uaucugacuucuaggauuu

SEQ ID NO: 311762 - RNA, 19 nt, Homo sapiens
ggagccagguuaucccaaa

SEQ ID NO: 311763 - RNA, 19 nt, Homo sapiens
gaccaauucuggagauaug

SEQ ID NO: 311764 - RNA, 19 nt, Homo sapiens
ggaagaauggcacuaaugu

SEQ ID NO: 311765 - RNA, 19 nt, Homo sapiens
ggaaaaguucuaccaauua

SEQ ID NO: 311766 - RNA, 19 nt, Homo sapiens
cuaaauccauuaugacugu

SEQ ID NO: 311767 - RNA, 19 nt, Homo sapiens
gaauggcacuaaugugauc

SEQ ID NO: 311768 - RNA, 19 nt, Homo sapiens
uggcuuaacuguagauaug

SEQ ID NO: 311769 - RNA, 19 nt, Homo sapiens
guauacaggcugcuuauga

SEQ ID NO: 311770 - RNA, 19 nt, Homo sapiens
ggguagaguuugaagagaa

SEQ ID NO: 311771 - RNA, 19 nt, Homo sapiens
ggaauagagaguaaaguug

SEQ ID NO: 311772 - RNA, 19 nt, Homo sapiens
accaagauauuacgcauuu

SEQ ID NO: 311773 - RNA, 19 nt, Homo sapiens
uauacaggcugcuuaugaa

SEQ ID NO: 311774 - RNA, 19 nt, Homo sapiens
uaacuugaccuacaggauu

SEQ ID NO: 311775 - RNA, 19 nt, Homo sapiens
gcacuaacuugaccuacag

SEQ ID NO: 311776 - RNA, 19 nt, Homo sapiens
uaaacaaccuagacaguac

SEQ ID NO: 311777 - RNA, 19 nt, Homo sapiens
uugccuaucugacuucaua

SEQ ID NO: 311778 - RNA, 19 nt, Homo sapiens
ucuuacacauuccaucuua

SEQ ID NO: 311779 - RNA, 19 nt, Homo sapiens
ggcaauaaauggcuuaacu

SEQ ID NO: 311780 - RNA, 19 nt, Homo sapiens
gcaauugacgcagcuguuu

SEQ ID NO: 311781 - RNA, 19 nt, Homo sapiens
ugacaauucuccauuugau

SEQ ID NO: 311782 - RNA, 19 nt, Homo sapiens
caagauauuacgcauuuga

SEQ ID NO: 311783 - RNA, 19 nt, Homo sapiens
gcucugaguggcuaugaua

SEQ ID NO: 311784 - RNA, 19 nt, Homo sapiens
caaagagucgaaaugaauu

SEQ ID NO: 311785 - RNA, 19 nt, Homo sapiens
ggugacaauucuccauuug

SEQ ID NO: 311786 - RNA, 19 nt, Homo sapiens
gcagauaucaacauugcuu

SEQ ID NO: 311787 - RNA, 19 nt, Homo sapiens
cuacaggauucgaaacuau

SEQ ID NO: 311788 - RNA, 19 nt, Homo sapiens
gcagaggcuuauucaguuc

SEQ ID NO: 311789 - RNA, 19 nt, Homo sapiens
ucagagaguuaccagaguu

SEQ ID NO: 311790 - RNA, 19 nt, Homo sapiens
ggucuuugcagauguaauu

SEQ ID NO: 311791 - RNA, 19 nt, Homo sapiens
caucuuacauuagugauuc

SEQ ID NO: 311792 - RNA, 19 nt, Homo sapiens
cuacaaagagucgaaauga

SEQ ID NO: 311793 - RNA, 19 nt, Homo sapiens
gcucaugaauuuggccauu

SEQ ID NO: 311794 - RNA, 19 nt, Homo sapiens
caaggaagaauggcacuaa

SEQ ID NO: 311795 - RNA, 19 nt, Homo sapiens
acaguacccuuggccuuua

SEQ ID NO: 311796 - RNA, 19 nt, Homo sapiens
ggagauaugauaaccaaag

SEQ ID NO: 311797 - RNA, 19 nt, Homo sapiens
cauuaugacuguuguucuu

SEQ ID NO: 311798 - RNA, 19 nt, Homo sapiens
cuucauacaucccucaguu

SEQ ID NO: 311799 - RNA, 19 nt, Homo sapiens
ggaaguucagcaugcauuu

SEQ ID NO: 311800 - RNA, 19 nt, Homo sapiens
ccaacaccuccgcaaauua

SEQ ID NO: 311801 - RNA, 19 nt, Homo sapiens
ugaggaaacucuggacaug

SEQ ID NO: 311802 - RNA, 19 nt, Homo sapiens
acaaagagucgaaaugaau

SEQ ID NO: 311803 - RNA, 19 nt, Homo sapiens
ggaccaacaccuccgcaaa

SEQ ID NO: 311804 - RNA, 19 nt, Homo sapiens
aagaauggcacuaauguga

SEQ ID NO: 311805 - RNA, 19 nt, Homo sapiens
ggugggcucuaaauccauu

SEQ ID NO: 311806 - RNA, 19 nt, Homo sapiens
uacaaagagucgaaaugaa

SEQ ID NO: 311807 - RNA, 19 nt, Homo sapiens
agaggcagauaucaacauu

SEQ ID NO: 311808 - RNA, 19 nt, Homo sapiens
ggcucuaaauccauuauga

SEQ ID NO: 311809 - RNA, 19 nt, Homo sapiens
ucaguggaccaagauauua

SEQ ID NO: 311810 - RNA, 19 nt, Homo sapiens
gaaggcauccucagcuaca

SEQ ID NO: 311811 - RNA, 19 nt, Homo sapiens
ugacuucuaggauuuauug

SEQ ID NO: 311812 - RNA, 19 nt, Homo sapiens
ugcagaggcuuauucaguu

SEQ ID NO: 311813 - RNA, 19 nt, Homo sapiens
gcaauaaauggcuuaacug

SEQ ID NO: 311814 - RNA, 19 nt, Homo sapiens
aagcauaucaggugccuuu

SEQ ID NO: 311815 - RNA, 19 nt, Homo sapiens
gauaugauaaccaaagaca

SEQ ID NO: 311816 - RNA, 19 nt, Homo sapiens
gaccucauuuuccuauuua

SEQ ID NO: 311817 - RNA, 19 nt, Homo sapiens
gaccaacaccuccgcaaau

SEQ ID NO: 311818 - RNA, 19 nt, Homo sapiens
gaaaaguucuaccaauuac

SEQ ID NO: 311819 - RNA, 19 nt, Homo sapiens
gacaguacccuuggccuuu

SEQ ID NO: 311820 - RNA, 19 nt, Homo sapiens
ucccaucacuguauccauu

SEQ ID NO: 311821 - RNA, 19 nt, Homo sapiens
aaucaaauguggcuguauc

SEQ ID NO: 311822 - RNA, 19 nt, Homo sapiens
caauaaauggcuuaacugu

SEQ ID NO: 311823 - RNA, 19 nt, Homo sapiens
uccaaggccuuuccuguau

SEQ ID NO: 311824 - RNA, 19 nt, Homo sapiens
caacaccuccgcaaauuac

SEQ ID NO: 311825 - RNA, 19 nt, Homo sapiens
gaaacucuggacaugauga

SEQ ID NO: 311826 - RNA, 19 nt, Homo sapiens
gaagaauggcacuaaugug

SEQ ID NO: 311827 - RNA, 19 nt, Homo sapiens
ggaggaggccgugugaaga

SEQ ID NO: 311828 - RNA, 19 nt, Homo sapiens
ucuauggacuuucaagcaa

SEQ ID NO: 311829 - RNA, 19 nt, Homo sapiens
ugacaucgauggcauucag

SEQ ID NO: 311830 - RNA, 19 nt, Homo sapiens
gcagauguaauuaguuaag

SEQ ID NO: 311831 - RNA, 19 nt, Homo sapiens
uaaauggcuuaacuguaga

SEQ ID NO: 311832 - RNA, 19 nt, Homo sapiens
aauccuugcucaugccuuu

SEQ ID NO: 311833 - RNA, 19 nt, Homo sapiens
gguuagaaguaaggauuau

SEQ ID NO: 311834 - RNA, 19 nt, Homo sapiens
augauauucugcaagguua

SEQ ID NO: 311835 - RNA, 19 nt, Homo sapiens
ggaccaagcacacccaaac

SEQ ID NO: 311836 - RNA, 19 nt, Homo sapiens
caguaucagucuacaagga

SEQ ID NO: 311837 - RNA, 19 nt, Homo sapiens
cagggucuuugcagaugua

SEQ ID NO: 311838 - RNA, 19 nt, Homo sapiens
gauauuacgcauuugaucu

SEQ ID NO: 311839 - RNA, 19 nt, Homo sapiens
ggaaaccagcaacuacuca

SEQ ID NO: 311840 - RNA, 19 nt, Homo sapiens
auaaacaaccuagacagua

SEQ ID NO: 311841 - RNA, 19 nt, Homo sapiens
uuacuugccuaucugacuu

SEQ ID NO: 311842 - RNA, 19 nt, Homo sapiens
gaggcuuauucaguucuua

SEQ ID NO: 311843 - RNA, 19 nt, Homo sapiens
uguauccacuuucagaaug

SEQ ID NO: 311844 - RNA, 19 nt, Homo sapiens
uaaccaaagacaauucaug

SEQ ID NO: 311845 - RNA, 19 nt, Homo sapiens
gauaaccaaagacaauuca

SEQ ID NO: 311846 - RNA, 19 nt, Homo sapiens
ggaaccagcuguauuuguu

SEQ ID NO: 311847 - RNA, 19 nt, Homo sapiens
guuggaguguuucuaauaa

SEQ ID NO: 311848 - RNA, 19 nt, Homo sapiens
gcgcugggcuuagaucauu

SEQ ID NO: 311849 - RNA, 19 nt, Homo sapiens
ggagccaguuugccggaua

SEQ ID NO: 311850 - RNA, 19 nt, Homo sapiens
gaccaaggauacaguuugu

SEQ ID NO: 311851 - RNA, 19 nt, Homo sapiens
gugcugggcugcugcuuug

SEQ ID NO: 311852 - RNA, 19 nt, Homo sapiens
ggaagaugcugcuguucag

SEQ ID NO: 311853 - RNA, 19 nt, Homo sapiens
ggaccaaggauacaguuug

SEQ ID NO: 311854 - RNA, 19 nt, Homo sapiens
cggcaaugcugaugggaaa

SEQ ID NO: 311855 - RNA, 19 nt, Homo sapiens
gcuaccaccucgaacuuug

SEQ ID NO: 311856 - RNA, 19 nt, Homo sapiens
gggcagauuccaaaccuuu

SEQ ID NO: 311857 - RNA, 19 nt, Homo sapiens
gcuuugcagugccauguaa

SEQ ID NO: 311858 - RNA, 19 nt, Homo sapiens
gcagugcccugaggacuag

SEQ ID NO: 311859 - RNA, 19 nt, Homo sapiens
gcaguaccacggccaacua

SEQ ID NO: 311860 - RNA, 19 nt, Homo sapiens
gcauaaggacgacgugaau

SEQ ID NO: 311861 - RNA, 19 nt, Homo sapiens
gcugggcccucucuucuca

SEQ ID NO: 311862 - RNA, 19 nt, Homo sapiens
aaacuacucggaagacuug

SEQ ID NO: 311863 - RNA, 19 nt, Homo sapiens
gggaaguacuggcgauucu

SEQ ID NO: 311864 - RNA, 19 nt, Homo sapiens
aaacugguauucuguucug

SEQ ID NO: 311865 - RNA, 19 nt, Homo sapiens
gcgcucauguacccuaugu

SEQ ID NO: 311866 - RNA, 19 nt, Homo sapiens
gaauaccuguaccgcuaug

SEQ ID NO: 311867 - RNA, 19 nt, Homo sapiens
ggacacgcacgacgucuuc

SEQ ID NO: 311868 - RNA, 19 nt, Homo sapiens
gggaagaugcugcuguuca

SEQ ID NO: 311869 - RNA, 19 nt, Homo sapiens
gaccugggcagauuccaaa

SEQ ID NO: 311870 - RNA, 19 nt, Homo sapiens
aaacuuggauucucuaacc

SEQ ID NO: 311871 - RNA, 19 nt, Homo sapiens
cuaauaaacuuggauucuc

SEQ ID NO: 311872 - RNA, 19 nt, Homo sapiens
ccaaggauacaguuuguuc

SEQ ID NO: 311873 - RNA, 19 nt, Homo sapiens
ggcuugcccuggugcagua

SEQ ID NO: 311874 - RNA, 19 nt, Homo sapiens
agacaucgucauccaguuu

SEQ ID NO: 311875 - RNA, 19 nt, Homo sapiens
gaacuuugacagcgacaag

SEQ ID NO: 311876 - RNA, 19 nt, Homo sapiens
gaaccagguggaccaagug

SEQ ID NO: 311877 - RNA, 19 nt, Homo sapiens
gcacgacgucuuccaguac

SEQ ID NO: 311878 - RNA, 19 nt, Homo sapiens
ccacuacugugccuuugag

SEQ ID NO: 311879 - RNA, 19 nt, Homo sapiens
aaggaguacucgaccugua

SEQ ID NO: 311880 - RNA, 19 nt, Homo sapiens
uuucgacgaugacgaguug

SEQ ID NO: 311881 - RNA, 19 nt, Homo sapiens
ugaaccagguggaccaagu

SEQ ID NO: 311882 - RNA, 19 nt, Homo sapiens
guucaaggaugggaaguac

SEQ ID NO: 311883 - RNA, 19 nt, Homo sapiens
ggugauugacgacgccuuu

SEQ ID NO: 311884 - RNA, 19 nt, Homo sapiens
acaaacugguauucuguuc

SEQ ID NO: 311885 - RNA, 19 nt, Homo sapiens
ugggcuacgugaccuauga

SEQ ID NO: 311886 - RNA, 19 nt, Homo sapiens
ucagggagacgcccauuuc

SEQ ID NO: 311887 - RNA, 19 nt, Homo sapiens
ucucuucucaccuuuguuu

SEQ ID NO: 311888 - RNA, 19 nt, Homo sapiens
cgcacgacgucuuccagua

SEQ ID NO: 311889 - RNA, 19 nt, Homo sapiens
gcuccuggcacacgccuuu

SEQ ID NO: 311890 - RNA, 19 nt, Homo sapiens
caagcuggacucggucuuu

SEQ ID NO: 311891 - RNA, 19 nt, Homo sapiens
gaaguacuggcgauucucu

SEQ ID NO: 311892 - RNA, 19 nt, Homo sapiens
ggaauaccuguaccgcuau

SEQ ID NO: 311893 - RNA, 19 nt, Homo sapiens
gcagagaugcguggagagu

SEQ ID NO: 311894 - RNA, 19 nt, Homo sapiens
cuuggauucucuaaccuuu

SEQ ID NO: 311895 - RNA, 19 nt, Homo sapiens
ggcccucucuucucaccuu

SEQ ID NO: 311896 - RNA, 19 nt, Homo sapiens
guaccgcuaugguuacacu

SEQ ID NO: 311897 - RNA, 19 nt, Homo sapiens
accacaacaucaccuauug

SEQ ID NO: 311898 - RNA, 19 nt, Homo sapiens
cuacgugaccuaugacauc

SEQ ID NO: 311899 - RNA, 19 nt, Homo sapiens
cuauguaccgcuucacuga

SEQ ID NO: 311900 - RNA, 19 nt, Homo sapiens
gcuuagaucauuccucagu

SEQ ID NO: 311901 - RNA, 19 nt, Homo sapiens
caccacaacaucaccuauu

SEQ ID NO: 311902 - RNA, 19 nt, Homo sapiens
uguuggaguguuucuaaua

SEQ ID NO: 311903 - RNA, 19 nt, Homo sapiens
gggaaccagcuguauuugu

SEQ ID NO: 311904 - RNA, 19 nt, Homo sapiens
guaccacggccaacuacga

SEQ ID NO: 311905 - RNA, 19 nt, Homo sapiens
aagcuggacucggucuuug

SEQ ID NO: 311906 - RNA, 19 nt, Homo sapiens
uugggaaccagcuguauuu

SEQ ID NO: 311907 - RNA, 19 nt, Homo sapiens
gcgcuaccaccucgaacuu

SEQ ID NO: 311908 - RNA, 19 nt, Homo sapiens
gagccaguuugccggauac

SEQ ID NO: 311909 - RNA, 19 nt, Homo sapiens
acacucggguggcagagau

SEQ ID NO: 311910 - RNA, 19 nt, Homo sapiens
ucaaggaugggaaguacug

SEQ ID NO: 311911 - RNA, 19 nt, Homo sapiens
cuggagaccugagaaccaa

SEQ ID NO: 311912 - RNA, 19 nt, Homo sapiens
uggcagaggaauaccugua

SEQ ID NO: 311913 - RNA, 19 nt, Homo sapiens
cacaacaucaccuauugga

SEQ ID NO: 311914 - RNA, 19 nt, Homo sapiens
caacuacgaccgggacaag

SEQ ID NO: 311915 - RNA, 19 nt, Homo sapiens
gacaucgucauccaguuug

SEQ ID NO: 311916 - RNA, 19 nt, Homo sapiens
cagacaucgucauccaguu

SEQ ID NO: 311917 - RNA, 19 nt, Homo sapiens
ccucucuucucaccuuugu

SEQ ID NO: 311918 - RNA, 19 nt, Homo sapiens
ggugcugggcugcugcuuu

SEQ ID NO: 311919 - RNA, 19 nt, Homo sapiens
ggagaccugagaaccaauc

SEQ ID NO: 311920 - RNA, 19 nt, Homo sapiens
ccugcaacgugaacaucuu

SEQ ID NO: 311921 - RNA, 19 nt, Homo sapiens
ugccggaggcgcucaugua

SEQ ID NO: 311922 - RNA, 19 nt, Homo sapiens
ccaguuuccauucaucuuc

SEQ ID NO: 311923 - RNA, 19 nt, Homo sapiens
ggagcacggagacggguau

SEQ ID NO: 311924 - RNA, 19 nt, Homo sapiens
gcagcuggcagaggaauac

SEQ ID NO: 311925 - RNA, 19 nt, Homo sapiens
cgaggcgucuggacaagcu

SEQ ID NO: 311926 - RNA, 19 nt, Homo sapiens
ggccacuacugugccuuug

SEQ ID NO: 311927 - RNA, 19 nt, Homo sapiens
gagcugacucgacggugau

SEQ ID NO: 311928 - RNA, 19 nt, Homo sapiens
agacgcccauuucgacgau

SEQ ID NO: 311929 - RNA, 19 nt, Homo sapiens
gaaauacucaugugcaaua

SEQ ID NO: 311930 - RNA, 19 nt, Homo sapiens
uaagguugaugcuguauua

SEQ ID NO: 311931 - RNA, 19 nt, Homo sapiens
acuaauagcugaugacuuu

SEQ ID NO: 311932 - RNA, 19 nt, Homo sapiens
cauacaggauugugaauua

SEQ ID NO: 311933 - RNA, 19 nt, Homo sapiens
ucacagagcucgcccaguu

SEQ ID NO: 311934 - RNA, 19 nt, Homo sapiens
gcacugaacagaauuaaga

SEQ ID NO: 311935 - RNA, 19 nt, Homo sapiens
gaauugcacugaacagaau

SEQ ID NO: 311936 - RNA, 19 nt, Homo sapiens
gauggugacacacauauua

SEQ ID NO: 311937 - RNA, 19 nt, Homo sapiens
ggacaguaaucucauuguu

SEQ ID NO: 311938 - RNA, 19 nt, Homo sapiens
caucacaguuugaguuuga

SEQ ID NO: 311939 - RNA, 19 nt, Homo sapiens
gauauucacuuugaugaug

SEQ ID NO: 311940 - RNA, 19 nt, Homo sapiens
gagcaaggcuucccuagac

SEQ ID NO: 311941 - RNA, 19 nt, Homo sapiens
gacaguaaucucauuguua

SEQ ID NO: 311942 - RNA, 19 nt, Homo sapiens
cagggaagcuagacacuga

SEQ ID NO: 311943 - RNA, 19 nt, Homo sapiens
ggacacaguuuggcucaug

SEQ ID NO: 311944 - RNA, 19 nt, Homo sapiens
ugagaaagcucugaaaguc

SEQ ID NO: 311945 - RNA, 19 nt, Homo sapiens
gaagacagauauggguguu

SEQ ID NO: 311946 - RNA, 19 nt, Homo sapiens
ugaaggagaggcugauaua

SEQ ID NO: 311947 - RNA, 19 nt, Homo sapiens
gccaagagaugcuguugau

SEQ ID NO: 311948 - RNA, 19 nt, Homo sapiens
gaucaucacaguuugaguu

SEQ ID NO: 311949 - RNA, 19 nt, Homo sapiens
ggcccucucuuccaucaua

SEQ ID NO: 311950 - RNA, 19 nt, Homo sapiens
caagagaugcuguugauuc

SEQ ID NO: 311951 - RNA, 19 nt, Homo sapiens
acaagcagguuauccaaga

SEQ ID NO: 311952 - RNA, 19 nt, Homo sapiens
gaagaaaggacaguaaucu

SEQ ID NO: 311953 - RNA, 19 nt, Homo sapiens
gaguugagccuaagguuga

SEQ ID NO: 311954 - RNA, 19 nt, Homo sapiens
ucacuuugaugaugaugaa

SEQ ID NO: 311955 - RNA, 19 nt, Homo sapiens
aggagaggcugauauaaug

SEQ ID NO: 311956 - RNA, 19 nt, Homo sapiens
gaaaauugaugcagcuguu

SEQ ID NO: 311957 - RNA, 19 nt, Homo sapiens
caagugugauccugcuuug

SEQ ID NO: 311958 - RNA, 19 nt, Homo sapiens
gaaggagaggcugauauaa

SEQ ID NO: 311959 - RNA, 19 nt, Homo sapiens
gaagguaagggcagugaga

SEQ ID NO: 311960 - RNA, 19 nt, Homo sapiens
aggcuucccuagacuaaua

SEQ ID NO: 311961 - RNA, 19 nt, Homo sapiens
ggaaaacccaccuuacaua

SEQ ID NO: 311962 - RNA, 19 nt, Homo sapiens
aagaugagccuugcagaua

SEQ ID NO: 311963 - RNA, 19 nt, Homo sapiens
gaagaugagccuugcagau

SEQ ID NO: 311964 - RNA, 19 nt, Homo sapiens
gaacccugaaccugaauuu

SEQ ID NO: 311965 - RNA, 19 nt, Homo sapiens
acacugaagcuuugaugua

SEQ ID NO: 311966 - RNA, 19 nt, Homo sapiens
aaugaucucuuucgcaguu

SEQ ID NO: 311967 - RNA, 19 nt, Homo sapiens
caucagaggaaaugaggua

SEQ ID NO: 311968 - RNA, 19 nt, Homo sapiens
gagauauucacuuugauga

SEQ ID NO: 311969 - RNA, 19 nt, Homo sapiens
ggagauauucacuuugaug

SEQ ID NO: 311970 - RNA, 19 nt, Homo sapiens
gcccagcaauaccuagaaa

SEQ ID NO: 311971 - RNA, 19 nt, Homo sapiens
aaaggacaguaaucucauu

SEQ ID NO: 311972 - RNA, 19 nt, Homo sapiens
guaagggcagugagaauga

SEQ ID NO: 311973 - RNA, 19 nt, Homo sapiens
gaagaggugacuccacuca

SEQ ID NO: 311974 - RNA, 19 nt, Homo sapiens
gaauuauacaccagauuug

SEQ ID NO: 311975 - RNA, 19 nt, Homo sapiens
ggaauucuucacuugcuuu

SEQ ID NO: 311976 - RNA, 19 nt, Homo sapiens
ugacacacauauuaaagag

SEQ ID NO: 311977 - RNA, 19 nt, Homo sapiens
caucaggcaccaauuuauu

SEQ ID NO: 311978 - RNA, 19 nt, Homo sapiens
caccagauuugccaagaga

SEQ ID NO: 311979 - RNA, 19 nt, Homo sapiens
caccuuacauacaggauug

SEQ ID NO: 311980 - RNA, 19 nt, Homo sapiens
cagaggaaaugagguacaa

SEQ ID NO: 311981 - RNA, 19 nt, Homo sapiens
gaugagccuugcagauauc

SEQ ID NO: 311982 - RNA, 19 nt, Homo sapiens
gcaaggcuucccuagacua

SEQ ID NO: 311983 - RNA, 19 nt, Homo sapiens
gaaaggacaguaaucucau

SEQ ID NO: 311984 - RNA, 19 nt, Homo sapiens
aagaaauacucaugugcaa

SEQ ID NO: 311985 - RNA, 19 nt, Homo sapiens
ccucguugcugcucaugaa

SEQ ID NO: 311986 - RNA, 19 nt, Homo sapiens
agaugagccuugcagauau

SEQ ID NO: 311987 - RNA, 19 nt, Homo sapiens
cauguucugugacugaaga

SEQ ID NO: 311988 - RNA, 19 nt, Homo sapiens
ggagaggcugauauaauga

SEQ ID NO: 311989 - RNA, 19 nt, Homo sapiens
uaggugagagaauguauuu

SEQ ID NO: 311990 - RNA, 19 nt, Homo sapiens
ggagcaaggcuucccuaga

SEQ ID NO: 311991 - RNA, 19 nt, Homo sapiens
gcaauaggugagagaaugu

SEQ ID NO: 311992 - RNA, 19 nt, Homo sapiens
caaggcuucccuagacuaa

SEQ ID NO: 311993 - RNA, 19 nt, Homo sapiens
aaaaggaugugaaacaguu

SEQ ID NO: 311994 - RNA, 19 nt, Homo sapiens
gcaucaggcaccaauuuau

SEQ ID NO: 311995 - RNA, 19 nt, Homo sapiens
auggagauauucacuuuga

SEQ ID NO: 311996 - RNA, 19 nt, Homo sapiens
agaaaggacaguaaucuca

SEQ ID NO: 311997 - RNA, 19 nt, Homo sapiens
guacaagcagguuauccaa

SEQ ID NO: 311998 - RNA, 19 nt, Homo sapiens
aaacccaccuuacauacag

SEQ ID NO: 311999 - RNA, 19 nt, Homo sapiens
uccaaggaaugcagaaguu

SEQ ID NO: 312000 - RNA, 19 nt, Homo sapiens
ugcaauaggugagagaaug

SEQ ID NO: 312001 - RNA, 19 nt, Homo sapiens
ugaauugcacugaacagaa

SEQ ID NO: 312002 - RNA, 19 nt, Homo sapiens
caguggaucaucacaguuu

SEQ ID NO: 312003 - RNA, 19 nt, Homo sapiens
gccuaagguugaugcugua

SEQ ID NO: 312004 - RNA, 19 nt, Homo sapiens
gguaagggcagugagaaug

SEQ ID NO: 312005 - RNA, 19 nt, Homo sapiens
uauccaagaggcauccaua

SEQ ID NO: 312006 - RNA, 19 nt, Homo sapiens
ccaagugugauccugcuuu

SEQ ID NO: 312007 - RNA, 19 nt, Homo sapiens
gugagaaugaugcaucuug

SEQ ID NO: 312008 - RNA, 19 nt, Homo sapiens
caacacugaagcuuugaug

SEQ ID NO: 312009 - RNA, 19 nt, Homo sapiens
agccaacacugaagcuuug

SEQ ID NO: 312010 - RNA, 19 nt, Homo sapiens
cagccaacacugaagcuuu

SEQ ID NO: 312011 - RNA, 19 nt, Homo sapiens
aaggagaggcugauauaau

SEQ ID NO: 312012 - RNA, 19 nt, Homo sapiens
aagagaugcuguugauucu

SEQ ID NO: 312013 - RNA, 19 nt, Homo sapiens
uuagaagaaaggacaguaa

SEQ ID NO: 312014 - RNA, 19 nt, Homo sapiens
gcggacaaauacuggagau

SEQ ID NO: 312015 - RNA, 19 nt, Homo sapiens
gauauaaugaucucuuucg

SEQ ID NO: 312016 - RNA, 19 nt, Homo sapiens
uacuggagauuugaugaaa

SEQ ID NO: 312017 - RNA, 19 nt, Homo sapiens
gaaaacauacuucuuugca

SEQ ID NO: 312018 - RNA, 19 nt, Homo sapiens
gagaaagcucugaaagucu

SEQ ID NO: 312019 - RNA, 19 nt, Homo sapiens
uuacauacaggauugugaa

SEQ ID NO: 312020 - RNA, 19 nt, Homo sapiens
gaagcuagacacugacacu

SEQ ID NO: 312021 - RNA, 19 nt, Homo sapiens
gugacacacauauuaaaga

SEQ ID NO: 312022 - RNA, 19 nt, Homo sapiens
guguggaguuccugacguu

SEQ ID NO: 312023 - RNA, 19 nt, Homo sapiens
ggaggugacagggaagcua

SEQ ID NO: 312024 - RNA, 19 nt, Homo sapiens
agcaauaccuagaaaagua

SEQ ID NO: 312025 - RNA, 19 nt, Homo sapiens
gcugauauaaugaucucuu

SEQ ID NO: 312026 - RNA, 19 nt, Homo sapiens
agacagauauggguguuuu

SEQ ID NO: 312027 - RNA, 19 nt, Homo sapiens
ggauggugacacacauauu

SEQ ID NO: 312028 - RNA, 19 nt, Homo sapiens
cuucuucaguggaucauca

SEQ ID NO: 312029 - RNA, 19 nt, Homo sapiens
guaaauguguguacagugu

SEQ ID NO: 312030 - RNA, 19 nt, Homo sapiens
gaugagaccuggacuaucg

SEQ ID NO: 312031 - RNA, 19 nt, Homo sapiens
cagaagagguucgugcuuu

SEQ ID NO: 312032 - RNA, 19 nt, Homo sapiens
gguggcagcccaugaauuu

SEQ ID NO: 312033 - RNA, 19 nt, Homo sapiens
gggacgaccugccguuuga

SEQ ID NO: 312034 - RNA, 19 nt, Homo sapiens
aaacugaggauugucauua

SEQ ID NO: 312035 - RNA, 19 nt, Homo sapiens
guauaaaccuucuucuucu

SEQ ID NO: 312036 - RNA, 19 nt, Homo sapiens
gcacugcuauccuccaaag

SEQ ID NO: 312037 - RNA, 19 nt, Homo sapiens
gcagaggcccuaaagguau

SEQ ID NO: 312038 - RNA, 19 nt, Homo sapiens
gauagacaccaaugagauu

SEQ ID NO: 312039 - RNA, 19 nt, Homo sapiens
uggcaugacuuaagaggaa

SEQ ID NO: 312040 - RNA, 19 nt, Homo sapiens
gaacuggaguguccuugcu

SEQ ID NO: 312041 - RNA, 19 nt, Homo sapiens
ccaggaugcugauggcuau

SEQ ID NO: 312042 - RNA, 19 nt, Homo sapiens
ggcagaggcccuaaaggua

SEQ ID NO: 312043 - RNA, 19 nt, Homo sapiens
ugccaacacuuuccucuga

SEQ ID NO: 312044 - RNA, 19 nt, Homo sapiens
cagggaggcuuuggcauga

SEQ ID NO: 312045 - RNA, 19 nt, Homo sapiens
ccacgaauaucaggcuaga

SEQ ID NO: 312046 - RNA, 19 nt, Homo sapiens
gcagguggcagcccaugaa

SEQ ID NO: 312047 - RNA, 19 nt, Homo sapiens
ugacaauccuggaaaucug

SEQ ID NO: 312048 - RNA, 19 nt, Homo sapiens
ggaguguccuugcuguauc

SEQ ID NO: 312049 - RNA, 19 nt, Homo sapiens
gcuuuggcaugacuuaaga

SEQ ID NO: 312050 - RNA, 19 nt, Homo sapiens
ggauagacaccaaugagau

SEQ ID NO: 312051 - RNA, 19 nt, Homo sapiens
aaaccuggcugcccugucu

SEQ ID NO: 312052 - RNA, 19 nt, Homo sapiens
uguauaaaccuucuucuuc

SEQ ID NO: 312053 - RNA, 19 nt, Homo sapiens
gaaggugaaggcucuggaa

SEQ ID NO: 312054 - RNA, 19 nt, Homo sapiens
gggccgugcugacaucaug

SEQ ID NO: 312055 - RNA, 19 nt, Homo sapiens
agacggaccucaccuacag

SEQ ID NO: 312056 - RNA, 19 nt, Homo sapiens
cguggguccugacuucuuu

SEQ ID NO: 312057 - RNA, 19 nt, Homo sapiens
gaaguuugacccugugaag

SEQ ID NO: 312058 - RNA, 19 nt, Homo sapiens
gugcugacaucaugaucga

SEQ ID NO: 312059 - RNA, 19 nt, Homo sapiens
gcaccaggcaugggacuga

SEQ ID NO: 312060 - RNA, 19 nt, Homo sapiens
cagaggcccuaaagguaug

SEQ ID NO: 312061 - RNA, 19 nt, Homo sapiens
gggauagacaccaaugaga

SEQ ID NO: 312062 - RNA, 19 nt, Homo sapiens
ggauguccacuucgacuau

SEQ ID NO: 312063 - RNA, 19 nt, Homo sapiens
ugaggauugucauuaaaca

SEQ ID NO: 312064 - RNA, 19 nt, Homo sapiens
aacugaggauugucauuaa

SEQ ID NO: 312065 - RNA, 19 nt, Homo sapiens
agaagagguucgugcuuuc

SEQ ID NO: 312066 - RNA, 19 nt, Homo sapiens
ugacgccacucaccuuuac

SEQ ID NO: 312067 - RNA, 19 nt, Homo sapiens
ccgagaagaacaagaucua

SEQ ID NO: 312068 - RNA, 19 nt, Homo sapiens
cuccaaagccauuguaaau

SEQ ID NO: 312069 - RNA, 19 nt, Homo sapiens
ccuggaggcugcaacauac

SEQ ID NO: 312070 - RNA, 19 nt, Homo sapiens
ucucguggguccugacuuc

SEQ ID NO: 312071 - RNA, 19 nt, Homo sapiens
gguaggugccugcaucugu

SEQ ID NO: 312072 - RNA, 19 nt, Homo sapiens
agaagaacaagaucuacuu

SEQ ID NO: 312073 - RNA, 19 nt, Homo sapiens
gauguccacuucgacuaug

SEQ ID NO: 312074 - RNA, 19 nt, Homo sapiens
guacaaccaccaugacaac

SEQ ID NO: 312075 - RNA, 19 nt, Homo sapiens
gagaagaacaagaucuacu

SEQ ID NO: 312076 - RNA, 19 nt, Homo sapiens
acugaggauugucauuaaa

SEQ ID NO: 312077 - RNA, 19 nt, Homo sapiens
ugauggcuaugccuacuuc

SEQ ID NO: 312078 - RNA, 19 nt, Homo sapiens
ggacgcugccuucgaggau

SEQ ID NO: 312079 - RNA, 19 nt, Homo sapiens
ccugugaggccuccuuuga

SEQ ID NO: 312080 - RNA, 19 nt, Homo sapiens
gguacaaccaccaugacaa

SEQ ID NO: 312081 - RNA, 19 nt, Homo sapiens
ugaucgacuucgccaggua

SEQ ID NO: 312082 - RNA, 19 nt, Homo sapiens
acgaauaucaggcuagaga

SEQ ID NO: 312083 - RNA, 19 nt, Homo sapiens
aaaguucacagucaaaugg

SEQ ID NO: 312084 - RNA, 19 nt, Homo sapiens
cauccgaggcgagcucuuu

SEQ ID NO: 312085 - RNA, 19 nt, Homo sapiens
ccacuucgacuaugaugag

SEQ ID NO: 312086 - RNA, 19 nt, Homo sapiens
gcugcaacauaccucaauc

SEQ ID NO: 312087 - RNA, 19 nt, Homo sapiens
gaggcuuuggcaugacuua

SEQ ID NO: 312088 - RNA, 19 nt, Homo sapiens
gcccgcaaccgacagaaga

SEQ ID NO: 312089 - RNA, 19 nt, Homo sapiens
aaauguguguacagugugu

SEQ ID NO: 312090 - RNA, 19 nt, Homo sapiens
ggacguccaccaccuccau

SEQ ID NO: 312091 - RNA, 19 nt, Homo sapiens
uaaacugaggauugucauu

SEQ ID NO: 312092 - RNA, 19 nt, Homo sapiens
gcuauccuccaaagccauu

SEQ ID NO: 312093 - RNA, 19 nt, Homo sapiens
agaagacggaccucaccua

SEQ ID NO: 312094 - RNA, 19 nt, Homo sapiens
ggaaguuugacccugugaa

SEQ ID NO: 312095 - RNA, 19 nt, Homo sapiens
gauggcagaggcccuaaag

SEQ ID NO: 312096 - RNA, 19 nt, Homo sapiens
gggauguccacuucgacua

SEQ ID NO: 312097 - RNA, 19 nt, Homo sapiens
guguauaaaccuucuucuu

SEQ ID NO: 312098 - RNA, 19 nt, Homo sapiens
gaagagguucgugcuuucu

SEQ ID NO: 312099 - RNA, 19 nt, Homo sapiens
gggaugaccagggcacaga

SEQ ID NO: 312100 - RNA, 19 nt, Homo sapiens
gauugucauuaaacacagu

SEQ ID NO: 312101 - RNA, 19 nt, Homo sapiens
gacaauccuggaaaucugu

SEQ ID NO: 312102 - RNA, 19 nt, Homo sapiens
uggcagaggcccuaaaggu

SEQ ID NO: 312103 - RNA, 19 nt, Homo sapiens
gcagggacuacuggcguuu

SEQ ID NO: 312104 - RNA, 19 nt, Homo sapiens
cuuccaaggugcucaguac

SEQ ID NO: 312105 - RNA, 19 nt, Homo sapiens
ccuccaaagccauuguaaa

SEQ ID NO: 312106 - RNA, 19 nt, Homo sapiens
guaucccuguugugagguu

SEQ ID NO: 312107 - RNA, 19 nt, Homo sapiens
agagacccauggccaucuu

SEQ ID NO: 312108 - RNA, 19 nt, Homo sapiens
gggcguucaacaccuauau

SEQ ID NO: 312109 - RNA, 19 nt, Homo sapiens
cccuggaggcugcaacaua

SEQ ID NO: 312110 - RNA, 19 nt, Homo sapiens
ggcugacaauccuggaaau

SEQ ID NO: 312111 - RNA, 19 nt, Homo sapiens
gcugauggcuaugccuacu

SEQ ID NO: 312112 - RNA, 19 nt, Homo sapiens
ccaaggaucuaaccaauuu

SEQ ID NO: 312113 - RNA, 19 nt, Homo sapiens
gaaaugguguaauuaaugg

SEQ ID NO: 312114 - RNA, 19 nt, Homo sapiens
ggugagagauacuuagaaa

SEQ ID NO: 312115 - RNA, 19 nt, Homo sapiens
uugcuugacucuacuauua

SEQ ID NO: 312116 - RNA, 19 nt, Homo sapiens
gaugacaaauacugguuaa

SEQ ID NO: 312117 - RNA, 19 nt, Homo sapiens
caaagaccaguguuaauuu

SEQ ID NO: 312118 - RNA, 19 nt, Homo sapiens
gaagcaugcucuguaaguu

SEQ ID NO: 312119 - RNA, 19 nt, Homo sapiens
ccaaacugauuaccaagaa

SEQ ID NO: 312120 - RNA, 19 nt, Homo sapiens
guaaguugcuuccuaacau

SEQ ID NO: 312121 - RNA, 19 nt, Homo sapiens
gaugcagucuucuauucua

SEQ ID NO: 312122 - RNA, 19 nt, Homo sapiens
gaugaaaggagacagauga

SEQ ID NO: 312123 - RNA, 19 nt, Homo sapiens
uggcaaagguggaauccua

SEQ ID NO: 312124 - RNA, 19 nt, Homo sapiens
ccaaagaccaguguuaauu

SEQ ID NO: 312125 - RNA, 19 nt, Homo sapiens
ggacugagaaauuauacuu

SEQ ID NO: 312126 - RNA, 19 nt, Homo sapiens
uaacauccuuggacugaga

SEQ ID NO: 312127 - RNA, 19 nt, Homo sapiens
gaaaagcaauagcugguuu

SEQ ID NO: 312128 - RNA, 19 nt, Homo sapiens
ucacuaccgugggaaauaa

SEQ ID NO: 312129 - RNA, 19 nt, Homo sapiens
caaguauggaguaauguua

SEQ ID NO: 312130 - RNA, 19 nt, Homo sapiens
aaacaaacuuccagugaca

SEQ ID NO: 312131 - RNA, 19 nt, Homo sapiens
uuaguucacuucagcuuaa

SEQ ID NO: 312132 - RNA, 19 nt, Homo sapiens
gaaauugaagccagaaauc

SEQ ID NO: 312133 - RNA, 19 nt, Homo sapiens
ggaccuggaucuggcauug

SEQ ID NO: 312134 - RNA, 19 nt, Homo sapiens
agcaauagcugguuugguu

SEQ ID NO: 312135 - RNA, 19 nt, Homo sapiens
caaauuaucccaagagcau

SEQ ID NO: 312136 - RNA, 19 nt, Homo sapiens
uaagaccagagccaaauua

SEQ ID NO: 312137 - RNA, 19 nt, Homo sapiens
gaccaaagaccaguguuaa

SEQ ID NO: 312138 - RNA, 19 nt, Homo sapiens
gaggacgaauucuggacua

SEQ ID NO: 312139 - RNA, 19 nt, Homo sapiens
ggaaacauuauaucaccua

SEQ ID NO: 312140 - RNA, 19 nt, Homo sapiens
guaccacuacuuagagaua

SEQ ID NO: 312141 - RNA, 19 nt, Homo sapiens
gcugaagguuucugagaga

SEQ ID NO: 312142 - RNA, 19 nt, Homo sapiens
uauaucaccuacagaauca

SEQ ID NO: 312143 - RNA, 19 nt, Homo sapiens
ccucucugcugaugacaua

SEQ ID NO: 312144 - RNA, 19 nt, Homo sapiens
guagauaaccaguauugga

SEQ ID NO: 312145 - RNA, 19 nt, Homo sapiens
uccaaaggcuguaauguuc

SEQ ID NO: 312146 - RNA, 19 nt, Homo sapiens
cgagauuggccauuccuua

SEQ ID NO: 312147 - RNA, 19 nt, Homo sapiens
gaagccagaaaucaaguuu

SEQ ID NO: 312148 - RNA, 19 nt, Homo sapiens
gccaaauccugacaauuca

SEQ ID NO: 312149 - RNA, 19 nt, Homo sapiens
caacacauuucgccucucu

SEQ ID NO: 312150 - RNA, 19 nt, Homo sapiens
aaccaacgcuugccaaauc

SEQ ID NO: 312151 - RNA, 19 nt, Homo sapiens
uauacuuacuucuggcaua

SEQ ID NO: 312152 - RNA, 19 nt, Homo sapiens
auaguuaccuucaaagcaa

SEQ ID NO: 312153 - RNA, 19 nt, Homo sapiens
guauggaggaaacauuaua

SEQ ID NO: 312154 - RNA, 19 nt, Homo sapiens
ucuguaaguugcuuccuaa

SEQ ID NO: 312155 - RNA, 19 nt, Homo sapiens
gaugauggacccugguuau

SEQ ID NO: 312156 - RNA, 19 nt, Homo sapiens
gguuaucccaaacugauua

SEQ ID NO: 312157 - RNA, 19 nt, Homo sapiens
ggacccugguuaucccaaa

SEQ ID NO: 312158 - RNA, 19 nt, Homo sapiens
gagccaaauuaucccaaga

SEQ ID NO: 312159 - RNA, 19 nt, Homo sapiens
ccaaaacacugaaaagcaa

SEQ ID NO: 312160 - RNA, 19 nt, Homo sapiens
gggaugcacauuucgauga

SEQ ID NO: 312161 - RNA, 19 nt, Homo sapiens
gaaagugaccgggcaacug

SEQ ID NO: 312162 - RNA, 19 nt, Homo sapiens
ugacauacguggcauucag

SEQ ID NO: 312163 - RNA, 19 nt, Homo sapiens
uuacacaccugacaugaac

SEQ ID NO: 312164 - RNA, 19 nt, Homo sapiens
auacuuacuucuggcauaa

SEQ ID NO: 312165 - RNA, 19 nt, Homo sapiens
gcacuucuugggucugaaa

SEQ ID NO: 312166 - RNA, 19 nt, Homo sapiens
agaccaaagaccaguguua

SEQ ID NO: 312167 - RNA, 19 nt, Homo sapiens
gaaccaacgcuugccaaau

SEQ ID NO: 312168 - RNA, 19 nt, Homo sapiens
gagauuggccauuccuuag

SEQ ID NO: 312169 - RNA, 19 nt, Homo sapiens
uaaaauugaugcagucuuc

SEQ ID NO: 312170 - RNA, 19 nt, Homo sapiens
gaccagagccaaauuaucc

SEQ ID NO: 312171 - RNA, 19 nt, Homo sapiens
ggucuuggccauucuagug

SEQ ID NO: 312172 - RNA, 19 nt, Homo sapiens
ucaccuacagaaucaauaa

SEQ ID NO: 312173 - RNA, 19 nt, Homo sapiens
uuugaagcaugcucuguaa

SEQ ID NO: 312174 - RNA, 19 nt, Homo sapiens
guucacuucagcuuaauaa

SEQ ID NO: 312175 - RNA, 19 nt, Homo sapiens
ggaucuaaccaauuugaau

SEQ ID NO: 312176 - RNA, 19 nt, Homo sapiens
guggaaacuuaaugaagga

SEQ ID NO: 312177 - RNA, 19 nt, Homo sapiens
ugccaaauccugacaauuc

SEQ ID NO: 312178 - RNA, 19 nt, Homo sapiens
ggccauuccuuaggucuug

SEQ ID NO: 312179 - RNA, 19 nt, Homo sapiens
uaaguugcuuccuaacauc

SEQ ID NO: 312180 - RNA, 19 nt, Homo sapiens
ggaaacuuaaugaaggaaa

SEQ ID NO: 312181 - RNA, 19 nt, Homo sapiens
ucacugcuguucacgagau

SEQ ID NO: 312182 - RNA, 19 nt, Homo sapiens
cauuauaucaccuacagaa

SEQ ID NO: 312183 - RNA, 19 nt, Homo sapiens
auaaacaaacuuccaguga

SEQ ID NO: 312184 - RNA, 19 nt, Homo sapiens
aaacucuaauuguccauuc

SEQ ID NO: 312185 - RNA, 19 nt, Homo sapiens
uguaaaccauagguaauga

SEQ ID NO: 312186 - RNA, 19 nt, Homo sapiens
gagcauacauucuuuuggu

SEQ ID NO: 312187 - RNA, 19 nt, Homo sapiens
ccguauggaggaaacauua

SEQ ID NO: 312188 - RNA, 19 nt, Homo sapiens
uccuuggacugagaaauua

SEQ ID NO: 312189 - RNA, 19 nt, Homo sapiens
uaaccaguauuggagguau

SEQ ID NO: 312190 - RNA, 19 nt, Homo sapiens
ggaugcacauuucgaugag

SEQ ID NO: 312191 - RNA, 19 nt, Homo sapiens
guuaguucacuucagcuua

SEQ ID NO: 312192 - RNA, 19 nt, Homo sapiens
cgugggaaauaagaucuuu

SEQ ID NO: 312193 - RNA, 19 nt, Homo sapiens
uccaagaaaugcagcacuu

SEQ ID NO: 312194 - RNA, 19 nt, Homo sapiens
uuacuucuggcauaacuaa

SEQ ID NO: 312195 - RNA, 19 nt, Homo sapiens
ccaauuugaauaugacuuc

SEQ ID NO: 312196 - RNA, 19 nt, Homo sapiens
gcagucuucuauucuaaaa

SEQ ID NO: 312197 - RNA, 19 nt, Homo sapiens
ggaaucgggccuaaaauug

SEQ ID NO: 312198 - RNA, 19 nt, Homo sapiens
cagcacuucuugggucuga

SEQ ID NO: 312199 - RNA, 19 nt, Homo sapiens
ccaaguauggaguaauguu

SEQ ID NO: 312200 - RNA, 19 nt, Homo sapiens
caaggaaucgggccuaaaa

SEQ ID NO: 312201 - RNA, 19 nt, Homo sapiens
ggcauucagucccuguaug

SEQ ID NO: 312202 - RNA, 19 nt, Homo sapiens
gauuggccauuccuuaggu

SEQ ID NO: 312203 - RNA, 19 nt, Homo sapiens
ccuaacauccuuggacuga

SEQ ID NO: 312204 - RNA, 19 nt, Homo sapiens
uugaugcagucuucuauuc

SEQ ID NO: 312205 - RNA, 19 nt, Homo sapiens
gaaucgggccuaaaauuga

SEQ ID NO: 312206 - RNA, 19 nt, Homo sapiens
uauuggagguaugaugaaa

SEQ ID NO: 312207 - RNA, 19 nt, Homo sapiens
gaauucuggacuacacauu

SEQ ID NO: 312208 - RNA, 19 nt, Homo sapiens
ugacuacgcaauccggaaa

SEQ ID NO: 312209 - RNA, 19 nt, Homo sapiens
gcuugacucuacuauuaag

SEQ ID NO: 312210 - RNA, 19 nt, Homo sapiens
ggaggaaacauuauaucac

SEQ ID NO: 312211 - RNA, 19 nt, Homo sapiens
ugaaauugaagccagaaau

SEQ ID NO: 312212 - RNA, 19 nt, Homo sapiens
gaugaaaccuggacaagua

SEQ ID NO: 312213 - RNA, 19 nt, Homo sapiens
gaagauaagugcagcuguu

SEQ ID NO: 312214 - RNA, 19 nt, Homo sapiens
gacuguaacuuccaaauaa

SEQ ID NO: 312215 - RNA, 19 nt, Homo sapiens
ggagaaacaaugaucuuua

SEQ ID NO: 312216 - RNA, 19 nt, Homo sapiens
gaacaagcuucaguaaguu

SEQ ID NO: 312217 - RNA, 19 nt, Homo sapiens
ggagauaugaugauacuaa

SEQ ID NO: 312218 - RNA, 19 nt, Homo sapiens
gaagagcuaucaggagaaa

SEQ ID NO: 312219 - RNA, 19 nt, Homo sapiens
gaauacagcaucuggagua

SEQ ID NO: 312220 - RNA, 19 nt, Homo sapiens
gaagaauguuagaguaaug

SEQ ID NO: 312221 - RNA, 19 nt, Homo sapiens
gaacuauugugcucagaga

SEQ ID NO: 312222 - RNA, 19 nt, Homo sapiens
gauaacaccuuagauguca

SEQ ID NO: 312223 - RNA, 19 nt, Homo sapiens
aaagucugcucucauauaa

SEQ ID NO: 312224 - RNA, 19 nt, Homo sapiens
cagagacacuguugauaaa

SEQ ID NO: 312225 - RNA, 19 nt, Homo sapiens
caacggacccauacaguuu

SEQ ID NO: 312226 - RNA, 19 nt, Homo sapiens
gcacucauguuuccuaucu

SEQ ID NO: 312227 - RNA, 19 nt, Homo sapiens
caccuuagaugucaugaaa

SEQ ID NO: 312228 - RNA, 19 nt, Homo sapiens
caaagucugcucucauaua

SEQ ID NO: 312229 - RNA, 19 nt, Homo sapiens
cacagacacuaacgaaaua

SEQ ID NO: 312230 - RNA, 19 nt, Homo sapiens
gaacuucccaaccguauug

SEQ ID NO: 312231 - RNA, 19 nt, Homo sapiens
gcagagcgcuaccugagau

SEQ ID NO: 312232 - RNA, 19 nt, Homo sapiens
guaaugaaauggaggaucu

SEQ ID NO: 312233 - RNA, 19 nt, Homo sapiens
cuacaaaucucgcgggaau

SEQ ID NO: 312234 - RNA, 19 nt, Homo sapiens
caaaugugacccuuccuua

SEQ ID NO: 312235 - RNA, 19 nt, Homo sapiens
ggaaguguuuauguuguuu

SEQ ID NO: 312236 - RNA, 19 nt, Homo sapiens
ucagagacacuguugauaa

SEQ ID NO: 312237 - RNA, 19 nt, Homo sapiens
ugaaauggaggaucucuaa

SEQ ID NO: 312238 - RNA, 19 nt, Homo sapiens
gcaagacucuccuguucuc

SEQ ID NO: 312239 - RNA, 19 nt, Homo sapiens
cgauguaacuccucugaau

SEQ ID NO: 312240 - RNA, 19 nt, Homo sapiens
gugcagcuguucacuuuga

SEQ ID NO: 312241 - RNA, 19 nt, Homo sapiens
gaccucaucuucaucuuca

SEQ ID NO: 312242 - RNA, 19 nt, Homo sapiens
caaaguguauuaggaagug

SEQ ID NO: 312243 - RNA, 19 nt, Homo sapiens
cucaaagucugcucucaua

SEQ ID NO: 312244 - RNA, 19 nt, Homo sapiens
caaaagcaaugguugauga

SEQ ID NO: 312245 - RNA, 19 nt, Homo sapiens
aggaauuggugauaaagua

SEQ ID NO: 312246 - RNA, 19 nt, Homo sapiens
gcuguucacuuugaggaua

SEQ ID NO: 312247 - RNA, 19 nt, Homo sapiens
ggauaaagaaggaugaugu

SEQ ID NO: 312248 - RNA, 19 nt, Homo sapiens
aaagagcagugguaagaau

SEQ ID NO: 312249 - RNA, 19 nt, Homo sapiens
gaaauuugggagagccaua

SEQ ID NO: 312250 - RNA, 19 nt, Homo sapiens
uaaagacuauccgagacua

SEQ ID NO: 312251 - RNA, 19 nt, Homo sapiens
ggcauaaaguaaauacaug

SEQ ID NO: 312252 - RNA, 19 nt, Homo sapiens
gaaguuaagaagauaagug

SEQ ID NO: 312253 - RNA, 19 nt, Homo sapiens
ucuaaagacuuguauagca

SEQ ID NO: 312254 - RNA, 19 nt, Homo sapiens
aauaguagauguggccuuu

SEQ ID NO: 312255 - RNA, 19 nt, Homo sapiens
gagcaucugauucuuguug

SEQ ID NO: 312256 - RNA, 19 nt, Homo sapiens
agacuuguauagcaugaaa

SEQ ID NO: 312257 - RNA, 19 nt, Homo sapiens
agucugcucucauauaaga

SEQ ID NO: 312258 - RNA, 19 nt, Homo sapiens
uaguagauguggccuuuga

SEQ ID NO: 312259 - RNA, 19 nt, Homo sapiens
acacauggucugucaauga

SEQ ID NO: 312260 - RNA, 19 nt, Homo sapiens
agucacacauuacaaaguu

SEQ ID NO: 312261 - RNA, 19 nt, Homo sapiens
cuaaagagcaucugauucu

SEQ ID NO: 312262 - RNA, 19 nt, Homo sapiens
gaaauggaggaucucuaaa

SEQ ID NO: 312263 - RNA, 19 nt, Homo sapiens
gccuuugaauucuguuuaa

SEQ ID NO: 312264 - RNA, 19 nt, Homo sapiens
aauggaggaucucuaaaga

SEQ ID NO: 312265 - RNA, 19 nt, Homo sapiens
ugaugaagaugauuugucu

SEQ ID NO: 312266 - RNA, 19 nt, Homo sapiens
uuugggcucuuaaugguua

SEQ ID NO: 312267 - RNA, 19 nt, Homo sapiens
gagcacucauguuuccuau

SEQ ID NO: 312268 - RNA, 19 nt, Homo sapiens
uggcauugcugacaucaug

SEQ ID NO: 312269 - RNA, 19 nt, Homo sapiens
gauguaacuccucugaauu

SEQ ID NO: 312270 - RNA, 19 nt, Homo sapiens
gacgauaacaccuuagaug

SEQ ID NO: 312271 - RNA, 19 nt, Homo sapiens
cuggcaaacuugacgauaa

SEQ ID NO: 312272 - RNA, 19 nt, Homo sapiens
uccgagaaaugcagucuuu

SEQ ID NO: 312273 - RNA, 19 nt, Homo sapiens
cuaaagacuuguauagcau

SEQ ID NO: 312274 - RNA, 19 nt, Homo sapiens
ucuggaagguuaucccaaa

SEQ ID NO: 312275 - RNA, 19 nt, Homo sapiens
uaaggagcauggcgacuuc

SEQ ID NO: 312276 - RNA, 19 nt, Homo sapiens
aaaguuugguccgauguaa

SEQ ID NO: 312277 - RNA, 19 nt, Homo sapiens
gauccagucucucuauggu

SEQ ID NO: 312278 - RNA, 19 nt, Homo sapiens
agaggugacuggcaaacuu

SEQ ID NO: 312279 - RNA, 19 nt, Homo sapiens
ugugaucccuugagauaug

SEQ ID NO: 312280 - RNA, 19 nt, Homo sapiens
acacagacacuaacgaaau

SEQ ID NO: 312281 - RNA, 19 nt, Homo sapiens
agacuguaacuuccaaaua

SEQ ID NO: 312282 - RNA, 19 nt, Homo sapiens
acaagggcauaaaguaaau

SEQ ID NO: 312283 - RNA, 19 nt, Homo sapiens
ccacagugccuauugauac

SEQ ID NO: 312284 - RNA, 19 nt, Homo sapiens
gagauaugaugauacuaac

SEQ ID NO: 312285 - RNA, 19 nt, Homo sapiens
gugggugaauacaauguuu

SEQ ID NO: 312286 - RNA, 19 nt, Homo sapiens
cauacuaccauccuacaaa

SEQ ID NO: 312287 - RNA, 19 nt, Homo sapiens
agaagucacacauuacaaa

SEQ ID NO: 312288 - RNA, 19 nt, Homo sapiens
gggcauaaaguaaauacau

SEQ ID NO: 312289 - RNA, 19 nt, Homo sapiens
cuucagagguagaaaauuu

SEQ ID NO: 312290 - RNA, 19 nt, Homo sapiens
ggacaaguaguuccaaagg

SEQ ID NO: 312291 - RNA, 19 nt, Homo sapiens
caugaucucuuuuggaauu

SEQ ID NO: 312292 - RNA, 19 nt, Homo sapiens
ugaugugggugaauacaau

SEQ ID NO: 312293 - RNA, 19 nt, Homo sapiens
ucacacagacacuaacgaa

SEQ ID NO: 312294 - RNA, 19 nt, Homo sapiens
ugggagagccauacauaaa

SEQ ID NO: 312295 - RNA, 19 nt, Homo sapiens
aggcaagacucuccuguuc

SEQ ID NO: 312296 - RNA, 19 nt, Homo sapiens
gcucagagacacuguugau

SEQ ID NO: 312297 - RNA, 19 nt, Homo sapiens
gauguggccuuugaauucu

SEQ ID NO: 312298 - RNA, 19 nt, Homo sapiens
caaaagagcagugguaaga

SEQ ID NO: 312299 - RNA, 19 nt, Homo sapiens
gucaaugagagcauaauuu

SEQ ID NO: 312300 - RNA, 19 nt, Homo sapiens
gaggagaaacaaugaucuu

SEQ ID NO: 312301 - RNA, 19 nt, Homo sapiens
ggagcacucauguuuccua

SEQ ID NO: 312302 - RNA, 19 nt, Homo sapiens
cuuauaaaguggaaguaug

SEQ ID NO: 312303 - RNA, 19 nt, Homo sapiens
caaaggaaaaugucuguaa

SEQ ID NO: 312304 - RNA, 19 nt, Homo sapiens
gcuggaaccacauugaaga

SEQ ID NO: 312305 - RNA, 19 nt, Homo sapiens
uaggaaguguuuauguugu

SEQ ID NO: 312306 - RNA, 19 nt, Homo sapiens
gaagucacacauuacaaag

SEQ ID NO: 312307 - RNA, 19 nt, Homo sapiens
uacaagggcauaaaguaaa

SEQ ID NO: 312308 - RNA, 19 nt, Homo sapiens
caucuggaguaaccguauu

SEQ ID NO: 312309 - RNA, 19 nt, Homo sapiens
cccaggaauuggugauaaa

SEQ ID NO: 312310 - RNA, 19 nt, Homo sapiens
cuaacgaaauaucaaaguc

SEQ ID NO: 312311 - RNA, 19 nt, Homo sapiens
auacuaccauccuacaaau

SEQ ID NO: 312312 - RNA, 19 nt, Homo sapiens
gaaagaaccuugcccaaac

SEQ ID NO: 312313 - RNA, 19 nt, Homo sapiens
gaacaaauacuggaaauuc

SEQ ID NO: 312314 - RNA, 19 nt, Homo sapiens
gaauggaaaugacaucuuc

SEQ ID NO: 312315 - RNA, 19 nt, Homo sapiens
gaggaaggauggcaaauuc

SEQ ID NO: 312316 - RNA, 19 nt, Homo sapiens
cgacagcggucuaggaauu

SEQ ID NO: 312317 - RNA, 19 nt, Homo sapiens
ggucucaaauggcaacaua

SEQ ID NO: 312318 - RNA, 19 nt, Homo sapiens
ccucagaccucgcugguaa

SEQ ID NO: 312319 - RNA, 19 nt, Homo sapiens
cgacuaagcagaagaaaga

SEQ ID NO: 312320 - RNA, 19 nt, Homo sapiens
cuagauuucugucuuguuu

SEQ ID NO: 312321 - RNA, 19 nt, Homo sapiens
gcaaauucgucuucuucaa

SEQ ID NO: 312322 - RNA, 19 nt, Homo sapiens
ggauggacacggagaauuu

SEQ ID NO: 312323 - RNA, 19 nt, Homo sapiens
ucaaauggcaacauaauga

SEQ ID NO: 312324 - RNA, 19 nt, Homo sapiens
caaauucgucuucuucaaa

SEQ ID NO: 312325 - RNA, 19 nt, Homo sapiens
gcacacaaacgaggaauga

SEQ ID NO: 312326 - RNA, 19 nt, Homo sapiens
ggaaugaggaucugaaugg

SEQ ID NO: 312327 - RNA, 19 nt, Homo sapiens
ggccuucuguuccugauaa

SEQ ID NO: 312328 - RNA, 19 nt, Homo sapiens
gaggagacacccacuuuga

SEQ ID NO: 312329 - RNA, 19 nt, Homo sapiens
gaagcaggccgacaucaug

SEQ ID NO: 312330 - RNA, 19 nt, Homo sapiens
ggagauguuugucuucaag

SEQ ID NO: 312331 - RNA, 19 nt, Homo sapiens
gggaacaaauacuggaaau

SEQ ID NO: 312332 - RNA, 19 nt, Homo sapiens
agacaagcauuggguguuu

SEQ ID NO: 312333 - RNA, 19 nt, Homo sapiens
gaaugaggaucugaaugga

SEQ ID NO: 312334 - RNA, 19 nt, Homo sapiens
ggacuaagugggcagaaga

SEQ ID NO: 312335 - RNA, 19 nt, Homo sapiens
acaaggacuuugccucuga

SEQ ID NO: 312336 - RNA, 19 nt, Homo sapiens
gagcagagaaggcacacaa

SEQ ID NO: 312337 - RNA, 19 nt, Homo sapiens
ccuaagaccuugggaggaa

SEQ ID NO: 312338 - RNA, 19 nt, Homo sapiens
gauugaugcugcucucuuc

SEQ ID NO: 312339 - RNA, 19 nt, Homo sapiens
ggaauaaccaagugaugga

SEQ ID NO: 312340 - RNA, 19 nt, Homo sapiens
ggucuucguugcucaguca

SEQ ID NO: 312341 - RNA, 19 nt, Homo sapiens
guagagacccugagacagu

SEQ ID NO: 312342 - RNA, 19 nt, Homo sapiens
cuuaaccucugaacucuga

SEQ ID NO: 312343 - RNA, 19 nt, Homo sapiens
gaucaaggccaauguucga

SEQ ID NO: 312344 - RNA, 19 nt, Homo sapiens
gaugugguguuccagacaa

SEQ ID NO: 312345 - RNA, 19 nt, Homo sapiens
ggaccuacguacccacaca

SEQ ID NO: 312346 - RNA, 19 nt, Homo sapiens
gaggaacaauccccuuuaa

SEQ ID NO: 312347 - RNA, 19 nt, Homo sapiens
gaaauucaacaaccagaag

SEQ ID NO: 312348 - RNA, 19 nt, Homo sapiens
ggaaauucaacaaccagaa

SEQ ID NO: 312349 - RNA, 19 nt, Homo sapiens
gaaaagaggagaagagcaa

SEQ ID NO: 312350 - RNA, 19 nt, Homo sapiens
caaauggcaacauaaugaa

SEQ ID NO: 312351 - RNA, 19 nt, Homo sapiens
gcaaguaacaggcaaagcu

SEQ ID NO: 312352 - RNA, 19 nt, Homo sapiens
aaacaggcacuuugaggaa

SEQ ID NO: 312353 - RNA, 19 nt, Homo sapiens
agaaagaaccuugcccaaa

SEQ ID NO: 312354 - RNA, 19 nt, Homo sapiens
gacauaccuuaaccucuga

SEQ ID NO: 312355 - RNA, 19 nt, Homo sapiens
ggugaggaauaaccaagug

SEQ ID NO: 312356 - RNA, 19 nt, Homo sapiens
augaggaucugaauggaaa

SEQ ID NO: 312357 - RNA, 19 nt, Homo sapiens
caaggacuuugccucugaa

SEQ ID NO: 312358 - RNA, 19 nt, Homo sapiens
ggaacaaauacuggaaauu

SEQ ID NO: 312359 - RNA, 19 nt, Homo sapiens
ggauggggcuuucacaguu

SEQ ID NO: 312360 - RNA, 19 nt, Homo sapiens
ggaggagacacccacuuug

SEQ ID NO: 312361 - RNA, 19 nt, Homo sapiens
accagaagcugaagguaga

SEQ ID NO: 312362 - RNA, 19 nt, Homo sapiens
ucaaaggagacaagcauug

SEQ ID NO: 312363 - RNA, 19 nt, Homo sapiens
gcaacauaaugaaaucacu

SEQ ID NO: 312364 - RNA, 19 nt, Homo sapiens
cauccagggucucaaaugg

SEQ ID NO: 312365 - RNA, 19 nt, Homo sapiens
caaaggugguggccauggu

SEQ ID NO: 312366 - RNA, 19 nt, Homo sapiens
gauggggcuuucacaguua

SEQ ID NO: 312367 - RNA, 19 nt, Homo sapiens
ggaaucuaaucuuguugag

SEQ ID NO: 312368 - RNA, 19 nt, Homo sapiens
gaaggccacagagaaagaa

SEQ ID NO: 312369 - RNA, 19 nt, Homo sapiens
ggucuaggaauucaaguuc

SEQ ID NO: 312370 - RNA, 19 nt, Homo sapiens
gggagauguuugucuucaa

SEQ ID NO: 312371 - RNA, 19 nt, Homo sapiens
guucagugccuaccgaaga

SEQ ID NO: 312372 - RNA, 19 nt, Homo sapiens
cgacaucaugaucuucuuu

SEQ ID NO: 312373 - RNA, 19 nt, Homo sapiens
cggcuagauuucugucuug

SEQ ID NO: 312374 - RNA, 19 nt, Homo sapiens
gacaagcauuggguguuug

SEQ ID NO: 312375 - RNA, 19 nt, Homo sapiens
gggcauccagcaacuuuau

SEQ ID NO: 312376 - RNA, 19 nt, Homo sapiens
ccaguucgccgacuaagca

SEQ ID NO: 312377 - RNA, 19 nt, Homo sapiens
agcauuggguguuugauga

SEQ ID NO: 312378 - RNA, 19 nt, Homo sapiens
gcagagaaggcacacaaac

SEQ ID NO: 312379 - RNA, 19 nt, Homo sapiens
cugugccucucgaauguua

SEQ ID NO: 312380 - RNA, 19 nt, Homo sapiens
gagcucagggcaguggaua

SEQ ID NO: 312381 - RNA, 19 nt, Homo sapiens
accaagugauggauggaua

SEQ ID NO: 312382 - RNA, 19 nt, Homo sapiens
gagaucaaggccaauguuc

SEQ ID NO: 312383 - RNA, 19 nt, Homo sapiens
ccugaaggccacagagaaa

SEQ ID NO: 312384 - RNA, 19 nt, Homo sapiens
ccaggcgacugcucuacug

SEQ ID NO: 312385 - RNA, 19 nt, Homo sapiens
aaauucgucuucuucaaag

SEQ ID NO: 312386 - RNA, 19 nt, Homo sapiens
gaggaauaaccaagugaug

SEQ ID NO: 312387 - RNA, 19 nt, Homo sapiens
gaucugaauggaaaugaca

SEQ ID NO: 312388 - RNA, 19 nt, Homo sapiens
aaagaaccuugcccaaacu

SEQ ID NO: 312389 - RNA, 19 nt, Homo sapiens
cagccucucacuacucuuu

SEQ ID NO: 312390 - RNA, 19 nt, Homo sapiens
agucuucacuuacuucuac

SEQ ID NO: 312391 - RNA, 19 nt, Homo sapiens
gagacaagcauuggguguu

SEQ ID NO: 312392 - RNA, 19 nt, Homo sapiens
ggaacccuguagcuuugug

SEQ ID NO: 312393 - RNA, 19 nt, Homo sapiens
cuaagcagaagaaagauca

SEQ ID NO: 312394 - RNA, 19 nt, Homo sapiens
ggagacacccacuuugacu

SEQ ID NO: 312395 - RNA, 19 nt, Homo sapiens
uggaggagacacccacuuu

SEQ ID NO: 312396 - RNA, 19 nt, Homo sapiens
agauuucugucuuguuugu

SEQ ID NO: 312397 - RNA, 19 nt, Homo sapiens
ccuccuugcuucucucugu

SEQ ID NO: 312398 - RNA, 19 nt, Homo sapiens
gaaccgggcuaccccaagu

SEQ ID NO: 312399 - RNA, 19 nt, Homo sapiens
ccaauggaaagaccuacuu

SEQ ID NO: 312400 - RNA, 19 nt, Homo sapiens
caaaggagacaagcauugg

SEQ ID NO: 312401 - RNA, 19 nt, Homo sapiens
ggaaggauggcaaauucgu

SEQ ID NO: 312402 - RNA, 19 nt, Homo sapiens
gaagagcaaacaggcacuu

SEQ ID NO: 312403 - RNA, 19 nt, Homo sapiens
agagaaggcacacaaacga

SEQ ID NO: 312404 - RNA, 19 nt, Homo sapiens
ggggucaucugcuccuuuu

SEQ ID NO: 312405 - RNA, 19 nt, Homo sapiens
ucaacaaccagaagcugaa

SEQ ID NO: 312406 - RNA, 19 nt, Homo sapiens
cgacagcacgcccuucgau

SEQ ID NO: 312407 - RNA, 19 nt, Homo sapiens
gacaucaugaucuucuuug

SEQ ID NO: 312408 - RNA, 19 nt, Homo sapiens
caagccacccuaagaccuu

SEQ ID NO: 312409 - RNA, 19 nt, Homo sapiens
ggggaacccuguagcuuug

SEQ ID NO: 312410 - RNA, 19 nt, Homo sapiens
gccgacagcggucuaggaa

SEQ ID NO: 312411 - RNA, 19 nt, Homo sapiens
gaggggagauguuugucuu

SEQ ID NO: 312412 - RNA, 19 nt, Homo sapiens
gcacugaccugcauggaaa

SEQ ID NO: 312413 - RNA, 19 nt, Homo sapiens
gcaccuuacuugaccauuu

SEQ ID NO: 312414 - RNA, 19 nt, Homo sapiens
gaaggaggccgacaucaug

SEQ ID NO: 312415 - RNA, 19 nt, Homo sapiens
ggcaggguguuuagaauuu

SEQ ID NO: 312416 - RNA, 19 nt, Homo sapiens
agaacuggcugcggcuuua

SEQ ID NO: 312417 - RNA, 19 nt, Homo sapiens
gcagaggcccacauuggaa

SEQ ID NO: 312418 - RNA, 19 nt, Homo sapiens
uccaggaggugcccuauga

SEQ ID NO: 312419 - RNA, 19 nt, Homo sapiens
gaugagcccuggaccuucu

SEQ ID NO: 312420 - RNA, 19 nt, Homo sapiens
caaccaccaucugaccuuu

SEQ ID NO: 312421 - RNA, 19 nt, Homo sapiens
gaccauuuguuucuguuuc

SEQ ID NO: 312422 - RNA, 19 nt, Homo sapiens
caccuuacuugaccauuug

SEQ ID NO: 312423 - RNA, 19 nt, Homo sapiens
guaaauaaugugcacugaa

SEQ ID NO: 312424 - RNA, 19 nt, Homo sapiens
cgacaucaugguacucuuu

SEQ ID NO: 312425 - RNA, 19 nt, Homo sapiens
gaaccggagagccagcuaa

SEQ ID NO: 312426 - RNA, 19 nt, Homo sapiens
uaacugccaggcucucuuu

SEQ ID NO: 312427 - RNA, 19 nt, Homo sapiens
gauccggcgugcaguguuc

SEQ ID NO: 312428 - RNA, 19 nt, Homo sapiens
ugugggaaaugguacugua

SEQ ID NO: 312429 - RNA, 19 nt, Homo sapiens
gggcaggguguuuagaauu

SEQ ID NO: 312430 - RNA, 19 nt, Homo sapiens
ucuacaagggcaccaaaua

SEQ ID NO: 312431 - RNA, 19 nt, Homo sapiens
cggagaaguugggcuggua

SEQ ID NO: 312432 - RNA, 19 nt, Homo sapiens
guacagcuggcucuacuuc

SEQ ID NO: 312433 - RNA, 19 nt, Homo sapiens
gagaacuggcugcggcuuu

SEQ ID NO: 312434 - RNA, 19 nt, Homo sapiens
acuggaaauucgacaauga

SEQ ID NO: 312435 - RNA, 19 nt, Homo sapiens
gcaccaaauacuggaaauu

SEQ ID NO: 312436 - RNA, 19 nt, Homo sapiens
ggaggccgacaucauggua

SEQ ID NO: 312437 - RNA, 19 nt, Homo sapiens
ccacgaaggagcccauugu

SEQ ID NO: 312438 - RNA, 19 nt, Homo sapiens
ggcaguggauggccgugaa

SEQ ID NO: 312439 - RNA, 19 nt, Homo sapiens
cgccacguguccugcuuua

SEQ ID NO: 312440 - RNA, 19 nt, Homo sapiens
ggagguccaugccgagaac

SEQ ID NO: 312441 - RNA, 19 nt, Homo sapiens
gggccuuccugagcaauga

SEQ ID NO: 312442 - RNA, 19 nt, Homo sapiens
gacagguacuggcgcuuca

SEQ ID NO: 312443 - RNA, 19 nt, Homo sapiens
gggagauguucguguucaa

SEQ ID NO: 312444 - RNA, 19 nt, Homo sapiens
gcauggaaacaaccucuuc

SEQ ID NO: 312445 - RNA, 19 nt, Homo sapiens
caccaaauacuggaaauuc

SEQ ID NO: 312446 - RNA, 19 nt, Homo sapiens
ccacaggccacaccuucuu

SEQ ID NO: 312447 - RNA, 19 nt, Homo sapiens
ccuuuagcauccagaacua

SEQ ID NO: 312448 - RNA, 19 nt, Homo sapiens
uuauuuauguccagguguu

SEQ ID NO: 312449 - RNA, 19 nt, Homo sapiens
ggacagaugccuccuuccu

SEQ ID NO: 312450 - RNA, 19 nt, Homo sapiens
gagaugccucccugagcua

SEQ ID NO: 312451 - RNA, 19 nt, Homo sapiens
ccaaauacuggaaauucga

SEQ ID NO: 312452 - RNA, 19 nt, Homo sapiens
cagcccagccgccauaugu

SEQ ID NO: 312453 - RNA, 19 nt, Homo sapiens
uguaaauaaugugcacuga

SEQ ID NO: 312454 - RNA, 19 nt, Homo sapiens
ccucggcccuugcagagau

SEQ ID NO: 312455 - RNA, 19 nt, Homo sapiens
ucucugggccuuaggaaga

SEQ ID NO: 312456 - RNA, 19 nt, Homo sapiens
ccggugugcucgacgaaga

SEQ ID NO: 312457 - RNA, 19 nt, Homo sapiens
cagccuacaccuacuucua

SEQ ID NO: 312458 - RNA, 19 nt, Homo sapiens
cagaugagcccuggaccuu

SEQ ID NO: 312459 - RNA, 19 nt, Homo sapiens
ggcagaggcccacauugga

SEQ ID NO: 312460 - RNA, 19 nt, Homo sapiens
ccuacgcgcuggugcagau

SEQ ID NO: 312461 - RNA, 19 nt, Homo sapiens
cuacaagggcaccaaauac

SEQ ID NO: 312462 - RNA, 19 nt, Homo sapiens
uggaacaaccaccaucuga

SEQ ID NO: 312463 - RNA, 19 nt, Homo sapiens
gcacugaauaaauuguaca

SEQ ID NO: 312464 - RNA, 19 nt, Homo sapiens
gugcacugaauaaauugua

SEQ ID NO: 312465 - RNA, 19 nt, Homo sapiens
ccagguguuuguuuuguuu

SEQ ID NO: 312466 - RNA, 19 nt, Homo sapiens
gaacuggcugcggcuuuau

SEQ ID NO: 312467 - RNA, 19 nt, Homo sapiens
ggaggaaguggaacaacca

SEQ ID NO: 312468 - RNA, 19 nt, Homo sapiens
cauugaggcuugguuccuu

SEQ ID NO: 312469 - RNA, 19 nt, Homo sapiens
gaccgcuacuggcucuuuc

SEQ ID NO: 312470 - RNA, 19 nt, Homo sapiens
gcagagaugcagcgcuucu

SEQ ID NO: 312471 - RNA, 19 nt, Homo sapiens
gacaucaugguacucuuug

SEQ ID NO: 312472 - RNA, 19 nt, Homo sapiens
gcugguaccacucgaugga

SEQ ID NO: 312473 - RNA, 19 nt, Homo sapiens
cccauacauuuauuucugu

SEQ ID NO: 312474 - RNA, 19 nt, Homo sapiens
gcaggguguuuagaauuuu

SEQ ID NO: 312475 - RNA, 19 nt, Homo sapiens
ccacguguccugcuuuacu

SEQ ID NO: 312476 - RNA, 19 nt, Homo sapiens
ggauggggauggggacuuu

SEQ ID NO: 312477 - RNA, 19 nt, Homo sapiens
gggcaccaaauacuggaaa

SEQ ID NO: 312478 - RNA, 19 nt, Homo sapiens
gguacuggcgcuucaacga

SEQ ID NO: 312479 - RNA, 19 nt, Homo sapiens
gcauugacacggccaucug

SEQ ID NO: 312480 - RNA, 19 nt, Homo sapiens
ugauggcaccgguggcuuu

SEQ ID NO: 312481 - RNA, 19 nt, Homo sapiens
ggagcccauuguggccuaa

SEQ ID NO: 312482 - RNA, 19 nt, Homo sapiens
uuacuugaccauuuguuuc

SEQ ID NO: 312483 - RNA, 19 nt, Homo sapiens
ggcaccaaauacuggaaau

SEQ ID NO: 312484 - RNA, 19 nt, Homo sapiens
gcaaugacgcagccuacac

SEQ ID NO: 312485 - RNA, 19 nt, Homo sapiens
ugaccugcauggaaacaac

SEQ ID NO: 312486 - RNA, 19 nt, Homo sapiens
agaaggaggccgacaucau

SEQ ID NO: 312487 - RNA, 19 nt, Homo sapiens
gcggggagauguucguguu

SEQ ID NO: 312488 - RNA, 19 nt, Homo sapiens
agaugccuccuuccucuuu

SEQ ID NO: 312489 - RNA, 19 nt, Homo sapiens
ccacaccuucuucuuccaa

SEQ ID NO: 312490 - RNA, 19 nt, Homo sapiens
ugacacaguggccaugcuu

SEQ ID NO: 312491 - RNA, 19 nt, Homo sapiens
gcacaucacuuacaguaua

SEQ ID NO: 312492 - RNA, 19 nt, Homo sapiens
gaacguaacuccaaaagua

SEQ ID NO: 312493 - RNA, 19 nt, Homo sapiens
gaaaauggcuuuacguauu

SEQ ID NO: 312494 - RNA, 19 nt, Homo sapiens
gaagcacaguucacuauga

SEQ ID NO: 312495 - RNA, 19 nt, Homo sapiens
gaauguaacuccucugaca

SEQ ID NO: 312496 - RNA, 19 nt, Homo sapiens
gaacggagcaguauuucaa

SEQ ID NO: 312497 - RNA, 19 nt, Homo sapiens
gaaauucaacaaccagaua

SEQ ID NO: 312498 - RNA, 19 nt, Homo sapiens
ggacagcucucccuuugau

SEQ ID NO: 312499 - RNA, 19 nt, Homo sapiens
gcacaugaguggaaauaca

SEQ ID NO: 312500 - RNA, 19 nt, Homo sapiens
ggaaacagacaacuucaaa

SEQ ID NO: 312501 - RNA, 19 nt, Homo sapiens
ggacacagcccaccagaug

SEQ ID NO: 312502 - RNA, 19 nt, Homo sapiens
ggaaaggaguauuggaaau

SEQ ID NO: 312503 - RNA, 19 nt, Homo sapiens
gaaguucccuacagugaau

SEQ ID NO: 312504 - RNA, 19 nt, Homo sapiens
uaacuccucugacauuuga

SEQ ID NO: 312505 - RNA, 19 nt, Homo sapiens
gcauuaacaugacaggaaa

SEQ ID NO: 312506 - RNA, 19 nt, Homo sapiens
gacaagagguagcuccaaa

SEQ ID NO: 312507 - RNA, 19 nt, Homo sapiens
gaaaggaguauuggaaauu

SEQ ID NO: 312508 - RNA, 19 nt, Homo sapiens
uaaagaacguaacuccaaa

SEQ ID NO: 312509 - RNA, 19 nt, Homo sapiens
agagguagcuccaaauuuc

SEQ ID NO: 312510 - RNA, 19 nt, Homo sapiens
gaaacacaauugacuggau

SEQ ID NO: 312511 - RNA, 19 nt, Homo sapiens
gagauauagugaagaaaug

SEQ ID NO: 312512 - RNA, 19 nt, Homo sapiens
ggagacagauauuggagau

SEQ ID NO: 312513 - RNA, 19 nt, Homo sapiens
caaacuaccuaaugaugau

SEQ ID NO: 312514 - RNA, 19 nt, Homo sapiens
acaauugacuggaugaaga

SEQ ID NO: 312515 - RNA, 19 nt, Homo sapiens
caagagcuguuaugcuguu

SEQ ID NO: 312516 - RNA, 19 nt, Homo sapiens
ggagauauagugaagaaau

SEQ ID NO: 312517 - RNA, 19 nt, Homo sapiens
ggauacccaaugcaaauua

SEQ ID NO: 312518 - RNA, 19 nt, Homo sapiens
caaacgugauguggauaua

SEQ ID NO: 312519 - RNA, 19 nt, Homo sapiens
cgaaagcgauaugcauuga

SEQ ID NO: 312520 - RNA, 19 nt, Homo sapiens
agacagaguuaaagaagga

SEQ ID NO: 312521 - RNA, 19 nt, Homo sapiens
caacagacagaguuaaaga

SEQ ID NO: 312522 - RNA, 19 nt, Homo sapiens
ggaccaacagacagaguua

SEQ ID NO: 312523 - RNA, 19 nt, Homo sapiens
gcaggacguuagacuguug

SEQ ID NO: 312524 - RNA, 19 nt, Homo sapiens
gggcugaccuuucaaacca

SEQ ID NO: 312525 - RNA, 19 nt, Homo sapiens
cagcaguucuauggcauua

SEQ ID NO: 312526 - RNA, 19 nt, Homo sapiens
agccauagcuauugucauu

SEQ ID NO: 312527 - RNA, 19 nt, Homo sapiens
acaguucacuaugaucuua

SEQ ID NO: 312528 - RNA, 19 nt, Homo sapiens
gaugagccauggacacuag

SEQ ID NO: 312529 - RNA, 19 nt, Homo sapiens
ugaagaaguucccuacagu

SEQ ID NO: 312530 - RNA, 19 nt, Homo sapiens
caagagguagcuccaaauu

SEQ ID NO: 312531 - RNA, 19 nt, Homo sapiens
ugacuuauuucuuguagca

SEQ ID NO: 312532 - RNA, 19 nt, Homo sapiens
acagacaacuucaaacuac

SEQ ID NO: 312533 - RNA, 19 nt, Homo sapiens
gcggaacggagcaguauuu

SEQ ID NO: 312534 - RNA, 19 nt, Homo sapiens
gccacauacuguacuguaa

SEQ ID NO: 312535 - RNA, 19 nt, Homo sapiens
ugaaagccauagcuauugu

SEQ ID NO: 312536 - RNA, 19 nt, Homo sapiens
gguauugauucagccauuu

SEQ ID NO: 312537 - RNA, 19 nt, Homo sapiens
ggauacaacucuucaaccu

SEQ ID NO: 312538 - RNA, 19 nt, Homo sapiens
aauauuggguguucaagga

SEQ ID NO: 312539 - RNA, 19 nt, Homo sapiens
uaguaucgaugcaguuuau

SEQ ID NO: 312540 - RNA, 19 nt, Homo sapiens
gauguggauauaaccauua

SEQ ID NO: 312541 - RNA, 19 nt, Homo sapiens
caauguggagguuugguua

SEQ ID NO: 312542 - RNA, 19 nt, Homo sapiens
ggagcaguauuucaaugug

SEQ ID NO: 312543 - RNA, 19 nt, Homo sapiens
ugugguaacuugagauuca

SEQ ID NO: 312544 - RNA, 19 nt, Homo sapiens
caagauuccuccaccuaca

SEQ ID NO: 312545 - RNA, 19 nt, Homo sapiens
gcaguucuauggcauuaac

SEQ ID NO: 312546 - RNA, 19 nt, Homo sapiens
gcaaacgugauguggauau

SEQ ID NO: 312547 - RNA, 19 nt, Homo sapiens
ggugggagauuuggaauac

SEQ ID NO: 312548 - RNA, 19 nt, Homo sapiens
gaaacaacagggugaugga

SEQ ID NO: 312549 - RNA, 19 nt, Homo sapiens
cacaucacuuacaguauaa

SEQ ID NO: 312550 - RNA, 19 nt, Homo sapiens
gaaagugugaagacccaaa

SEQ ID NO: 312551 - RNA, 19 nt, Homo sapiens
gaaaauagcgacgggaauu

SEQ ID NO: 312552 - RNA, 19 nt, Homo sapiens
gacaagauuccuccaccua

SEQ ID NO: 312553 - RNA, 19 nt, Homo sapiens
gaagacgguuggauuucgu

SEQ ID NO: 312554 - RNA, 19 nt, Homo sapiens
caagagugggugugaugua

SEQ ID NO: 312555 - RNA, 19 nt, Homo sapiens
ccacauacuguacuguaaa

SEQ ID NO: 312556 - RNA, 19 nt, Homo sapiens
aaaggaguauuggaaauuc

SEQ ID NO: 312557 - RNA, 19 nt, Homo sapiens
ggaagacgguuggauuucg

SEQ ID NO: 312558 - RNA, 19 nt, Homo sapiens
gggcuugccuccuaguauc

SEQ ID NO: 312559 - RNA, 19 nt, Homo sapiens
ucaaacuaccuaaugauga

SEQ ID NO: 312560 - RNA, 19 nt, Homo sapiens
gcuguuaugcuguuuccua

SEQ ID NO: 312561 - RNA, 19 nt, Homo sapiens
acagggugauggauggaua

SEQ ID NO: 312562 - RNA, 19 nt, Homo sapiens
acaaaggaaaggaguauug

SEQ ID NO: 312563 - RNA, 19 nt, Homo sapiens
caagaccucuaccgacagu

SEQ ID NO: 312564 - RNA, 19 nt, Homo sapiens
gaaaauggcaaacgugaug

SEQ ID NO: 312565 - RNA, 19 nt, Homo sapiens
ggacagccauuuuccaaca

SEQ ID NO: 312566 - RNA, 19 nt, Homo sapiens
ccuuaugccuccuuguauu

SEQ ID NO: 312567 - RNA, 19 nt, Homo sapiens
ggccuuaugccuccuugua

SEQ ID NO: 312568 - RNA, 19 nt, Homo sapiens
guucaaggauacaacucuu

SEQ ID NO: 312569 - RNA, 19 nt, Homo sapiens
gcacaguucacuaugaucu

SEQ ID NO: 312570 - RNA, 19 nt, Homo sapiens
aagcacaucacuuacagua

SEQ ID NO: 312571 - RNA, 19 nt, Homo sapiens
aaagcgauaugcauugaca

SEQ ID NO: 312572 - RNA, 19 nt, Homo sapiens
gcucguccauccauugaag

SEQ ID NO: 312573 - RNA, 19 nt, Homo sapiens
ggcauuaacaugacaggaa

SEQ ID NO: 312574 - RNA, 19 nt, Homo sapiens
uaacuaaagaagaggagaa

SEQ ID NO: 312575 - RNA, 19 nt, Homo sapiens
gacaugcucugggauugga

SEQ ID NO: 312576 - RNA, 19 nt, Homo sapiens
ugauguggauauaaccauu

SEQ ID NO: 312577 - RNA, 19 nt, Homo sapiens
uggcaaacgugauguggau

SEQ ID NO: 312578 - RNA, 19 nt, Homo sapiens
ggacagaaacacaauugac

SEQ ID NO: 312579 - RNA, 19 nt, Homo sapiens
caagacaagagcuguuaug

SEQ ID NO: 312580 - RNA, 19 nt, Homo sapiens
acuaugaucuuacucacau

SEQ ID NO: 312581 - RNA, 19 nt, Homo sapiens
uuacguauuucuacaaagg

SEQ ID NO: 312582 - RNA, 19 nt, Homo sapiens
uauuggguguucaaggaua

SEQ ID NO: 312583 - RNA, 19 nt, Homo sapiens
ggauggauacccaaugcaa

SEQ ID NO: 312584 - RNA, 19 nt, Homo sapiens
gggacaugcucugggauug

SEQ ID NO: 312585 - RNA, 19 nt, Homo sapiens
ggaaauccuaaucaugaug

SEQ ID NO: 312586 - RNA, 19 nt, Homo sapiens
gauguguggcagaauguaa

SEQ ID NO: 312587 - RNA, 19 nt, Homo sapiens
ccaguaaaauuucaggauu

SEQ ID NO: 312588 - RNA, 19 nt, Homo sapiens
ugugaaagccauagcuauu

SEQ ID NO: 312589 - RNA, 19 nt, Homo sapiens
gauggauacccaaugcaaa

SEQ ID NO: 312590 - RNA, 19 nt, Homo sapiens
aaacagacaacuucaaacu

SEQ ID NO: 312591 - RNA, 19 nt, Homo sapiens
gcacaucacuuacaguaua

SEQ ID NO: 312592 - RNA, 19 nt, Homo sapiens
caagaccuaugaagaauua

SEQ ID NO: 312593 - RNA, 19 nt, Homo sapiens
gaacguaacuccaaaagua

SEQ ID NO: 312594 - RNA, 19 nt, Homo sapiens
ggaaauggauucuagaaca

SEQ ID NO: 312595 - RNA, 19 nt, Homo sapiens
gcacaagaccuaugaagaa

SEQ ID NO: 312596 - RNA, 19 nt, Homo sapiens
gaaauggauucuagaacaa

SEQ ID NO: 312597 - RNA, 19 nt, Homo sapiens
gaagcacaguucacuauga

SEQ ID NO: 312598 - RNA, 19 nt, Homo sapiens
gaauguaacuccucugaca

SEQ ID NO: 312599 - RNA, 19 nt, Homo sapiens
gaacggagcaguauuucaa

SEQ ID NO: 312600 - RNA, 19 nt, Homo sapiens
ggacagcucucccuuugau

SEQ ID NO: 312601 - RNA, 19 nt, Homo sapiens
ggaaacagacaacuucaaa

SEQ ID NO: 312602 - RNA, 19 nt, Homo sapiens
gaaguucccuacagugaau

SEQ ID NO: 312603 - RNA, 19 nt, Homo sapiens
uaacuccucugacauuuga

SEQ ID NO: 312604 - RNA, 19 nt, Homo sapiens
gcauuaacaugacaggaaa

SEQ ID NO: 312605 - RNA, 19 nt, Homo sapiens
gacaagagguagcuccaaa

SEQ ID NO: 312606 - RNA, 19 nt, Homo sapiens
gggagacacucuaucugua

SEQ ID NO: 312607 - RNA, 19 nt, Homo sapiens
uaaagaacguaacuccaaa

SEQ ID NO: 312608 - RNA, 19 nt, Homo sapiens
agagguagcuccaaauuuc

SEQ ID NO: 312609 - RNA, 19 nt, Homo sapiens
agaauuaucuuccaucaca

SEQ ID NO: 312610 - RNA, 19 nt, Homo sapiens
gaaacacaauugacuggau

SEQ ID NO: 312611 - RNA, 19 nt, Homo sapiens
caaacuaccuaaugaugau

SEQ ID NO: 312612 - RNA, 19 nt, Homo sapiens
caaagaacaaucaggaauu

SEQ ID NO: 312613 - RNA, 19 nt, Homo sapiens
acaauugacuggaugaaga

SEQ ID NO: 312614 - RNA, 19 nt, Homo sapiens
ggagacacucuaucuguaa

SEQ ID NO: 312615 - RNA, 19 nt, Homo sapiens
ggauacccaaugcaaauua

SEQ ID NO: 312616 - RNA, 19 nt, Homo sapiens
caaacgugauguggauaua

SEQ ID NO: 312617 - RNA, 19 nt, Homo sapiens
cgaaagcgauaugcauuga

SEQ ID NO: 312618 - RNA, 19 nt, Homo sapiens
uaucuuccaucacauacua

SEQ ID NO: 312619 - RNA, 19 nt, Homo sapiens
cagcaguucuauggcauua

SEQ ID NO: 312620 - RNA, 19 nt, Homo sapiens
augguuggcucuacaaaua

SEQ ID NO: 312621 - RNA, 19 nt, Homo sapiens
acaguucacuaugaucuua

SEQ ID NO: 312622 - RNA, 19 nt, Homo sapiens
gaagggagacacucuaucu

SEQ ID NO: 312623 - RNA, 19 nt, Homo sapiens
gaugagccauggacacuag

SEQ ID NO: 312624 - RNA, 19 nt, Homo sapiens
cuacaaauaccauuggaaa

SEQ ID NO: 312625 - RNA, 19 nt, Homo sapiens
ugcaugaccucuacauuga

SEQ ID NO: 312626 - RNA, 19 nt, Homo sapiens
ugaagaaguucccuacagu

SEQ ID NO: 312627 - RNA, 19 nt, Homo sapiens
caagagguagcuccaaauu

SEQ ID NO: 312628 - RNA, 19 nt, Homo sapiens
caucacauacuaacaaaga

SEQ ID NO: 312629 - RNA, 19 nt, Homo sapiens
ugacuuauuucuuguagca

SEQ ID NO: 312630 - RNA, 19 nt, Homo sapiens
caugaccucuacauugaaa

SEQ ID NO: 312631 - RNA, 19 nt, Homo sapiens
acagacaacuucaaacuac

SEQ ID NO: 312632 - RNA, 19 nt, Homo sapiens
gcggaacggagcaguauuu

SEQ ID NO: 312633 - RNA, 19 nt, Homo sapiens
gugcaugaccucuacauug

SEQ ID NO: 312634 - RNA, 19 nt, Homo sapiens
caagaugguuggcucuaca

SEQ ID NO: 312635 - RNA, 19 nt, Homo sapiens
uaguaucgaugcaguuuau

SEQ ID NO: 312636 - RNA, 19 nt, Homo sapiens
gauguggauauaaccauua

SEQ ID NO: 312637 - RNA, 19 nt, Homo sapiens
caauguggagguuugguua

SEQ ID NO: 312638 - RNA, 19 nt, Homo sapiens
ggagcaguauuucaaugug

SEQ ID NO: 312639 - RNA, 19 nt, Homo sapiens
ccugugcucucaagacaaa

SEQ ID NO: 312640 - RNA, 19 nt, Homo sapiens
caagauuccuccaccuaca

SEQ ID NO: 312641 - RNA, 19 nt, Homo sapiens
gcaguucuauggcauuaac

SEQ ID NO: 312642 - RNA, 19 nt, Homo sapiens
gagacacucuaucuguaau

SEQ ID NO: 312643 - RNA, 19 nt, Homo sapiens
gcaaacgugauguggauau

SEQ ID NO: 312644 - RNA, 19 nt, Homo sapiens
gaaacaacagggugaugga

SEQ ID NO: 312645 - RNA, 19 nt, Homo sapiens
cacaucacuuacaguauaa

SEQ ID NO: 312646 - RNA, 19 nt, Homo sapiens
gaaaauagcgacgggaauu

SEQ ID NO: 312647 - RNA, 19 nt, Homo sapiens
gaagacgguuggauuucgu

SEQ ID NO: 312648 - RNA, 19 nt, Homo sapiens
gacaagauuccuccaccua

SEQ ID NO: 312649 - RNA, 19 nt, Homo sapiens
ggaagacgguuggauuucg

SEQ ID NO: 312650 - RNA, 19 nt, Homo sapiens
gggcuugccuccuaguauc

SEQ ID NO: 312651 - RNA, 19 nt, Homo sapiens
ucaaacuaccuaaugauga

SEQ ID NO: 312652 - RNA, 19 nt, Homo sapiens
aaaaggccauuuacaauug

SEQ ID NO: 312653 - RNA, 19 nt, Homo sapiens
cacaagaccuaugaagaau

SEQ ID NO: 312654 - RNA, 19 nt, Homo sapiens
acagggugauggauggaua

SEQ ID NO: 312655 - RNA, 19 nt, Homo sapiens
caagaccucuaccgacagu

SEQ ID NO: 312656 - RNA, 19 nt, Homo sapiens
gaaaauggcaaacgugaug

SEQ ID NO: 312657 - RNA, 19 nt, Homo sapiens
gcacaguucacuaugaucu

SEQ ID NO: 312658 - RNA, 19 nt, Homo sapiens
aagcacaucacuuacagua

SEQ ID NO: 312659 - RNA, 19 nt, Homo sapiens
aaagcgauaugcauugaca

SEQ ID NO: 312660 - RNA, 19 nt, Homo sapiens
gcucguccauccauugaag

SEQ ID NO: 312661 - RNA, 19 nt, Homo sapiens
ggcauuaacaugacaggaa

SEQ ID NO: 312662 - RNA, 19 nt, Homo sapiens
gacaugcucugggauugga

SEQ ID NO: 312663 - RNA, 19 nt, Homo sapiens
ugauguggauauaaccauu

SEQ ID NO: 312664 - RNA, 19 nt, Homo sapiens
uggcaaacgugauguggau

SEQ ID NO: 312665 - RNA, 19 nt, Homo sapiens
ggacagaaacacaauugac

SEQ ID NO: 312666 - RNA, 19 nt, Homo sapiens
ggauggauacccaaugcaa

SEQ ID NO: 312667 - RNA, 19 nt, Homo sapiens
gggacaugcucugggauug

SEQ ID NO: 312668 - RNA, 19 nt, Homo sapiens
ggaaauccuaaucaugaug

SEQ ID NO: 312669 - RNA, 19 nt, Homo sapiens
acuaugaucuuacucacau

SEQ ID NO: 312670 - RNA, 19 nt, Homo sapiens
gauguguggcagaauguaa

SEQ ID NO: 312671 - RNA, 19 nt, Homo sapiens
gauggauacccaaugcaaa

SEQ ID NO: 312672 - RNA, 19 nt, Homo sapiens
aaacagacaacuucaaacu

SEQ ID NO: 312673 - RNA, 19 nt, Homo sapiens
ucugacauuugaagaaguu

SEQ ID NO: 312674 - RNA, 19 nt, Homo sapiens
auaaagaacguaacuccaa

SEQ ID NO: 312675 - RNA, 19 nt, Homo sapiens
gagcucguccauccauuga

SEQ ID NO: 312676 - RNA, 19 nt, Homo sapiens
gauacccaaugcaaauuac

SEQ ID NO: 312677 - RNA, 19 nt, Homo sapiens
cuuuaacacucuagcuauu

SEQ ID NO: 312678 - RNA, 19 nt, Homo sapiens
gagccaaacccaacaucug

SEQ ID NO: 312679 - RNA, 19 nt, Homo sapiens
ugauggagagggaggauuu

SEQ ID NO: 312680 - RNA, 19 nt, Homo sapiens
aagcacaguucacuaugau

SEQ ID NO: 312681 - RNA, 19 nt, Homo sapiens
caggaaaaguggacagaaa

SEQ ID NO: 312682 - RNA, 19 nt, Homo sapiens
gguuggauuucgugcauca

SEQ ID NO: 312683 - RNA, 19 nt, Homo sapiens
ggagcucguccauccauug

SEQ ID NO: 312684 - RNA, 19 nt, Homo sapiens
agaaauggcagcacaagca

SEQ ID NO: 312685 - RNA, 19 nt, Homo sapiens
gcauugacaggacagaaau

SEQ ID NO: 312686 - RNA, 19 nt, Homo sapiens
ccaaacccaacaucuguga

SEQ ID NO: 312687 - RNA, 19 nt, Homo sapiens
caacuucaaacuaccuaau

SEQ ID NO: 312688 - RNA, 19 nt, Homo sapiens
cauggaaacagacaacuuc

SEQ ID NO: 312689 - RNA, 19 nt, Homo sapiens
guauuucaauguggagguu

SEQ ID NO: 312690 - RNA, 19 nt, Homo sapiens
ucccuacagugaauuagaa

SEQ ID NO: 312691 - RNA, 19 nt, Homo sapiens
ugacaggacuuauuucuuu

SEQ ID NO: 312692 - RNA, 19 nt, Homo sapiens
gacaggacuuauuucuuua

SEQ ID NO: 312693 - RNA, 19 nt, Homo sapiens
gagggacuguguugacuga

SEQ ID NO: 312694 - RNA, 19 nt, Homo sapiens
ccagaagggugcccaguca

SEQ ID NO: 312695 - RNA, 19 nt, Homo sapiens
acaaugacaggacuuauuu

SEQ ID NO: 312696 - RNA, 19 nt, Homo sapiens
ucacagccaugcagcaguu

SEQ ID NO: 312697 - RNA, 19 nt, Homo sapiens
ggacaauaacguagaggaa

SEQ ID NO: 312698 - RNA, 19 nt, Homo sapiens
caugaccucucccugcuuu

SEQ ID NO: 312699 - RNA, 19 nt, Homo sapiens
gguacuggguguucaagga

SEQ ID NO: 312700 - RNA, 19 nt, Homo sapiens
ggaguggaguggcuaagca

SEQ ID NO: 312701 - RNA, 19 nt, Homo sapiens
guucaaggacaauaacgua

SEQ ID NO: 312702 - RNA, 19 nt, Homo sapiens
gauccgcggugaagcuuuc

SEQ ID NO: 312703 - RNA, 19 nt, Homo sapiens
uaacguagaggaaggauac

SEQ ID NO: 312704 - RNA, 19 nt, Homo sapiens
gaucgucuucuuuaaagga

SEQ ID NO: 312705 - RNA, 19 nt, Homo sapiens
caaggacaauaacguagag

SEQ ID NO: 312706 - RNA, 19 nt, Homo sapiens
gcugguguguggagacuca

SEQ ID NO: 312707 - RNA, 19 nt, Homo sapiens
cacaaugacaggacuuauu

SEQ ID NO: 312708 - RNA, 19 nt, Homo sapiens
cgcaagaggagcugucuaa

SEQ ID NO: 312709 - RNA, 19 nt, Homo sapiens
ccaaguggaacaagaggaa

SEQ ID NO: 312710 - RNA, 19 nt, Homo sapiens
ggacacccacuuugacgau

SEQ ID NO: 312711 - RNA, 19 nt, Homo sapiens
cgacggugccuccuacuuc

SEQ ID NO: 312712 - RNA, 19 nt, Homo sapiens
gcacagaugcaccgcuucu

SEQ ID NO: 312713 - RNA, 19 nt, Homo sapiens
guuacgaggucugcucaug

SEQ ID NO: 312714 - RNA, 19 nt, Homo sapiens
ugcgugcacucauguacua

SEQ ID NO: 312715 - RNA, 19 nt, Homo sapiens
acacagcgcgagcccauga

SEQ ID NO: 312716 - RNA, 19 nt, Homo sapiens
caagaggagcugucuaagg

SEQ ID NO: 312717 - RNA, 19 nt, Homo sapiens
acacccacuuugacgauga

SEQ ID NO: 312718 - RNA, 19 nt, Homo sapiens
ucuccaaggccgaccauaa

SEQ ID NO: 312719 - RNA, 19 nt, Homo sapiens
ucaaggacaauaacguaga

SEQ ID NO: 312720 - RNA, 19 nt, Homo sapiens
gaugcagcacucacuuuga

SEQ ID NO: 312721 - RNA, 19 nt, Homo sapiens
cagaugcagcacucacuuu

SEQ ID NO: 312722 - RNA, 19 nt, Homo sapiens
gacggugccuccuacuucu

SEQ ID NO: 312723 - RNA, 19 nt, Homo sapiens
gaccucucccugcuuugua

SEQ ID NO: 312724 - RNA, 19 nt, Homo sapiens
ccacgggauggaccuguuu

SEQ ID NO: 312725 - RNA, 19 nt, Homo sapiens
gacagguacuggguguuca

SEQ ID NO: 312726 - RNA, 19 nt, Homo sapiens
uuaaggaccagcuguacug

SEQ ID NO: 312727 - RNA, 19 nt, Homo sapiens
uggaguggcuaagcagguu

SEQ ID NO: 312728 - RNA, 19 nt, Homo sapiens
cgacauccagaucgacuuc

SEQ ID NO: 312729 - RNA, 19 nt, Homo sapiens
cuagugagggacuguguug

SEQ ID NO: 312730 - RNA, 19 nt, Homo sapiens
gcaccagcgaccacaagau

SEQ ID NO: 312731 - RNA, 19 nt, Homo sapiens
uacgaggucugcucaugca

SEQ ID NO: 312732 - RNA, 19 nt, Homo sapiens
caaggucuggagcgacauu

SEQ ID NO: 312733 - RNA, 19 nt, Homo sapiens
caccagcgaccacaagauc

SEQ ID NO: 312734 - RNA, 19 nt, Homo sapiens
ggcuaagcagguucgguua

SEQ ID NO: 312735 - RNA, 19 nt, Homo sapiens
gugacgcguuccagaccaa

SEQ ID NO: 312736 - RNA, 19 nt, Homo sapiens
gcccugacgcuaugacaca

SEQ ID NO: 312737 - RNA, 19 nt, Homo sapiens
caagaagaguccagugaua

SEQ ID NO: 312738 - RNA, 19 nt, Homo sapiens
aagcugaggugaacauuua

SEQ ID NO: 312739 - RNA, 19 nt, Homo sapiens
ccuaauagcugaaugaaau

SEQ ID NO: 312740 - RNA, 19 nt, Homo sapiens
gagaaaggcuaucccagaa

SEQ ID NO: 312741 - RNA, 19 nt, Homo sapiens
gacacaaucuuggacauua

SEQ ID NO: 312742 - RNA, 19 nt, Homo sapiens
gaaaggcuaucccagaaau

SEQ ID NO: 312743 - RNA, 19 nt, Homo sapiens
ggauaugucuuccuuuaug

SEQ ID NO: 312744 - RNA, 19 nt, Homo sapiens
gauaagggaugaggaagaa

SEQ ID NO: 312745 - RNA, 19 nt, Homo sapiens
ggagggauaugucuuccuu

SEQ ID NO: 312746 - RNA, 19 nt, Homo sapiens
ccagaaaucucaggucaga

SEQ ID NO: 312747 - RNA, 19 nt, Homo sapiens
cacagugucugguacauuu

SEQ ID NO: 312748 - RNA, 19 nt, Homo sapiens
gcuaugaguuggcaagaug

SEQ ID NO: 312749 - RNA, 19 nt, Homo sapiens
gaccaguacugcaggauug

SEQ ID NO: 312750 - RNA, 19 nt, Homo sapiens
gaagaccuaugcuuucaag

SEQ ID NO: 312751 - RNA, 19 nt, Homo sapiens
uggacuaccugucacaaua

SEQ ID NO: 312752 - RNA, 19 nt, Homo sapiens
ggaugcagcucucuauugg

SEQ ID NO: 312753 - RNA, 19 nt, Homo sapiens
gggaaaggccaaacagaaa

SEQ ID NO: 312754 - RNA, 19 nt, Homo sapiens
gcacugcccuguggucuuc

SEQ ID NO: 312755 - RNA, 19 nt, Homo sapiens
gaaggcacuugcauccuau

SEQ ID NO: 312756 - RNA, 19 nt, Homo sapiens
agaaggcacuugcauccua

SEQ ID NO: 312757 - RNA, 19 nt, Homo sapiens
agggauaugucuuccuuua

SEQ ID NO: 312758 - RNA, 19 nt, Homo sapiens
gguaucaaaugccuuggaa

SEQ ID NO: 312759 - RNA, 19 nt, Homo sapiens
acaaaguucugguuaagga

SEQ ID NO: 312760 - RNA, 19 nt, Homo sapiens
caauauggguaccuacaga

SEQ ID NO: 312761 - RNA, 19 nt, Homo sapiens
acaauggauucacuucuuu

SEQ ID NO: 312762 - RNA, 19 nt, Homo sapiens
gggaagaccuaugcuuuca

SEQ ID NO: 312763 - RNA, 19 nt, Homo sapiens
cgccaaagcucguacuguu

SEQ ID NO: 312764 - RNA, 19 nt, Homo sapiens
acagaagccucuagaagga

SEQ ID NO: 312765 - RNA, 19 nt, Homo sapiens
gaggugcgguggcuauaau

SEQ ID NO: 312766 - RNA, 19 nt, Homo sapiens
gaagcucccugauccuaca

SEQ ID NO: 312767 - RNA, 19 nt, Homo sapiens
ucaaugcucucuccuugga

SEQ ID NO: 312768 - RNA, 19 nt, Homo sapiens
gcaggauuguugcacuaaa

SEQ ID NO: 312769 - RNA, 19 nt, Homo sapiens
gguagaaccuaaccuggau

SEQ ID NO: 312770 - RNA, 19 nt, Homo sapiens
guauaacucuuacaguagu

SEQ ID NO: 312771 - RNA, 19 nt, Homo sapiens
cugaacagcucuuccucua

SEQ ID NO: 312772 - RNA, 19 nt, Homo sapiens
aaagcuaacuccauguuca

SEQ ID NO: 312773 - RNA, 19 nt, Homo sapiens
acacaaucuuggacauuaa

SEQ ID NO: 312774 - RNA, 19 nt, Homo sapiens
ccaaucaaggguuuguuua

SEQ ID NO: 312775 - RNA, 19 nt, Homo sapiens
guccuguucuuccuacaua

SEQ ID NO: 312776 - RNA, 19 nt, Homo sapiens
cacaauggauucacuucuu

SEQ ID NO: 312777 - RNA, 19 nt, Homo sapiens
ggauuugucaagaugguua

SEQ ID NO: 312778 - RNA, 19 nt, Homo sapiens
cagaggauuugucaagaug

SEQ ID NO: 312779 - RNA, 19 nt, Homo sapiens
gaacacaauggauucacuu

SEQ ID NO: 312780 - RNA, 19 nt, Homo sapiens
guguggcgcuacauuaauu

SEQ ID NO: 312781 - RNA, 19 nt, Homo sapiens
ccaaacagaaacccaacua

SEQ ID NO: 312782 - RNA, 19 nt, Homo sapiens
cuagcugucuggcuguaua

SEQ ID NO: 312783 - RNA, 19 nt, Homo sapiens
ugaacuggaugccaugaug

SEQ ID NO: 312784 - RNA, 19 nt, Homo sapiens
gaagcaggaggaucacuug

SEQ ID NO: 312785 - RNA, 19 nt, Homo sapiens
ggacuaccugucacaauau

SEQ ID NO: 312786 - RNA, 19 nt, Homo sapiens
gaagcugaauaggguagaa

SEQ ID NO: 312787 - RNA, 19 nt, Homo sapiens
gacuauguguggacuguau

SEQ ID NO: 312788 - RNA, 19 nt, Homo sapiens
ccagaagacccuuaaauac

SEQ ID NO: 312789 - RNA, 19 nt, Homo sapiens
gaaaacagcauggccagua

SEQ ID NO: 312790 - RNA, 19 nt, Homo sapiens
ccaacugugucaucucuuc

SEQ ID NO: 312791 - RNA, 19 nt, Homo sapiens
gcaagaagaguccagugau

SEQ ID NO: 312792 - RNA, 19 nt, Homo sapiens
ucugguacauuuguguuua

SEQ ID NO: 312793 - RNA, 19 nt, Homo sapiens
caacuccagccaccacuuu

SEQ ID NO: 312794 - RNA, 19 nt, Homo sapiens
caauggauucacuucuuua

SEQ ID NO: 312795 - RNA, 19 nt, Homo sapiens
accagaagacccuuaaaua

SEQ ID NO: 312796 - RNA, 19 nt, Homo sapiens
ucucaggccucuaacacuu

SEQ ID NO: 312797 - RNA, 19 nt, Homo sapiens
gcuaacuccauguucauaa

SEQ ID NO: 312798 - RNA, 19 nt, Homo sapiens
caggauuguugcacuaaau

SEQ ID NO: 312799 - RNA, 19 nt, Homo sapiens
gcucccagcugagguagga

SEQ ID NO: 312800 - RNA, 19 nt, Homo sapiens
gaugguuagcucuuuguuu

SEQ ID NO: 312801 - RNA, 19 nt, Homo sapiens
cauaagagaggacugaaca

SEQ ID NO: 312802 - RNA, 19 nt, Homo sapiens
gcacuaaaugaaauacugu

SEQ ID NO: 312803 - RNA, 19 nt, Homo sapiens
guacgggcauaaccuugga

SEQ ID NO: 312804 - RNA, 19 nt, Homo sapiens
ggcuaucccagaaauauuu

SEQ ID NO: 312805 - RNA, 19 nt, Homo sapiens
gugggaagaccuaugcuuu

SEQ ID NO: 312806 - RNA, 19 nt, Homo sapiens
uggacucccugguucagua

SEQ ID NO: 312807 - RNA, 19 nt, Homo sapiens
gcacagugucugguacauu

SEQ ID NO: 312808 - RNA, 19 nt, Homo sapiens
gucaguggcuggaacaaag

SEQ ID NO: 312809 - RNA, 19 nt, Homo sapiens
gcuaauuaaccuuguugaa

SEQ ID NO: 312810 - RNA, 19 nt, Homo sapiens
ccacagacacaaucuugga

SEQ ID NO: 312811 - RNA, 19 nt, Homo sapiens
gacaagguguggcgcuaca

SEQ ID NO: 312812 - RNA, 19 nt, Homo sapiens
uggauucacuucuuuaagg

SEQ ID NO: 312813 - RNA, 19 nt, Homo sapiens
aagaagaguccagugauaa

SEQ ID NO: 312814 - RNA, 19 nt, Homo sapiens
ggcaagaagaguccaguga

SEQ ID NO: 312815 - RNA, 19 nt, Homo sapiens
gaccagcuugggcaacaua

SEQ ID NO: 312816 - RNA, 19 nt, Homo sapiens
cuacucgccucgaacacaa

SEQ ID NO: 312817 - RNA, 19 nt, Homo sapiens
gaggcaagcugaggugaac

SEQ ID NO: 312818 - RNA, 19 nt, Homo sapiens
gauaugucuuccuuuaugc

SEQ ID NO: 312819 - RNA, 19 nt, Homo sapiens
acagaggauuugucaagau

SEQ ID NO: 312820 - RNA, 19 nt, Homo sapiens
auaauaagggcaucucuau

SEQ ID NO: 312821 - RNA, 19 nt, Homo sapiens
uauaauaagggcaucucua

SEQ ID NO: 312822 - RNA, 19 nt, Homo sapiens
caagcugaggugaacauuu

SEQ ID NO: 312823 - RNA, 19 nt, Homo sapiens
ggaaaggccaaacagaaac

SEQ ID NO: 312824 - RNA, 19 nt, Homo sapiens
gaggauuugucaagauggu

SEQ ID NO: 312825 - RNA, 19 nt, Homo sapiens
ggcauaaccuuggauacca

SEQ ID NO: 312826 - RNA, 19 nt, Homo sapiens
caaccagcagcuucgagua

SEQ ID NO: 312827 - RNA, 19 nt, Homo sapiens
gggaugaggaagaagaaga

SEQ ID NO: 312828 - RNA, 19 nt, Homo sapiens
uaagggaugaggaagaaga

SEQ ID NO: 312829 - RNA, 19 nt, Homo sapiens
gcagagaaggcacuugcau

SEQ ID NO: 312830 - RNA, 19 nt, Homo sapiens
auaagggcaucucuauuag

SEQ ID NO: 312831 - RNA, 19 nt, Homo sapiens
cuacagaagccucuagaag

SEQ ID NO: 312832 - RNA, 19 nt, Homo sapiens
ccaacuccauuuccugucu

SEQ ID NO: 312833 - RNA, 19 nt, Homo sapiens
ccacccacccuuucauuuc

SEQ ID NO: 312834 - RNA, 19 nt, Homo sapiens
gcccucggcugcuaugagu

SEQ ID NO: 312835 - RNA, 19 nt, Homo sapiens
ggcgcuacauuaauuucaa

SEQ ID NO: 312836 - RNA, 19 nt, Homo sapiens
agaagacccuuaaauaccu

SEQ ID NO: 312837 - RNA, 19 nt, Homo sapiens
ggacagaggugacuuguuc

SEQ ID NO: 312838 - RNA, 19 nt, Homo sapiens
gaacacaucuggaaaugca

SEQ ID NO: 312839 - RNA, 19 nt, Homo sapiens
gaaagaagcauccaagaga

SEQ ID NO: 312840 - RNA, 19 nt, Homo sapiens
caagaagaguccagugaua

SEQ ID NO: 312841 - RNA, 19 nt, Homo sapiens
aagcugaggugaacauuua

SEQ ID NO: 312842 - RNA, 19 nt, Homo sapiens
ggagggagaugagaaguuu

SEQ ID NO: 312843 - RNA, 19 nt, Homo sapiens
gagaaaggcuaucccagaa

SEQ ID NO: 312844 - RNA, 19 nt, Homo sapiens
gacacaaucuuggacauua

SEQ ID NO: 312845 - RNA, 19 nt, Homo sapiens
gaaaggcuaucccagaaau

SEQ ID NO: 312846 - RNA, 19 nt, Homo sapiens
ggauaugucuuccuuuaug

SEQ ID NO: 312847 - RNA, 19 nt, Homo sapiens
gauaagggaugaggaagaa

SEQ ID NO: 312848 - RNA, 19 nt, Homo sapiens
gaggagggccuaaucuuaa

SEQ ID NO: 312849 - RNA, 19 nt, Homo sapiens
ggagggauaugucuuccuu

SEQ ID NO: 312850 - RNA, 19 nt, Homo sapiens
ggagugggcuaccuuauac

SEQ ID NO: 312851 - RNA, 19 nt, Homo sapiens
gguauaaaguucaaagcaa

SEQ ID NO: 312852 - RNA, 19 nt, Homo sapiens
uuacccagauugccuguua

SEQ ID NO: 312853 - RNA, 19 nt, Homo sapiens
ugagagaacugggugauga

SEQ ID NO: 312854 - RNA, 19 nt, Homo sapiens
cacagugucugguacauuu

SEQ ID NO: 312855 - RNA, 19 nt, Homo sapiens
gcuaugaguuggcaagaug

SEQ ID NO: 312856 - RNA, 19 nt, Homo sapiens
gaccaguacugcaggauug

SEQ ID NO: 312857 - RNA, 19 nt, Homo sapiens
gaagaccuaugcuuucaag

SEQ ID NO: 312858 - RNA, 19 nt, Homo sapiens
gcagggagagggcaaauug

SEQ ID NO: 312859 - RNA, 19 nt, Homo sapiens
gggaguggcugggaaggua

SEQ ID NO: 312860 - RNA, 19 nt, Homo sapiens
ggaugcagcucucuauugg

SEQ ID NO: 312861 - RNA, 19 nt, Homo sapiens
gggaaaggccaaacagaaa

SEQ ID NO: 312862 - RNA, 19 nt, Homo sapiens
gcacugcccuguggucuuc

SEQ ID NO: 312863 - RNA, 19 nt, Homo sapiens
gaaggcacuugcauccuau

SEQ ID NO: 312864 - RNA, 19 nt, Homo sapiens
agaaggcacuugcauccua

SEQ ID NO: 312865 - RNA, 19 nt, Homo sapiens
agggauaugucuuccuuua

SEQ ID NO: 312866 - RNA, 19 nt, Homo sapiens
gguaucaaaugccuuggaa

SEQ ID NO: 312867 - RNA, 19 nt, Homo sapiens
acaaaguucugguuaagga

SEQ ID NO: 312868 - RNA, 19 nt, Homo sapiens
gggagagggcaaauuguua

SEQ ID NO: 312869 - RNA, 19 nt, Homo sapiens
acaauggauucacuucuuu

SEQ ID NO: 312870 - RNA, 19 nt, Homo sapiens
gggaagaccuaugcuuuca

SEQ ID NO: 312871 - RNA, 19 nt, Homo sapiens
ugaggagggccuaaucuua

SEQ ID NO: 312872 - RNA, 19 nt, Homo sapiens
gagggcaaauuguuaguca

SEQ ID NO: 312873 - RNA, 19 nt, Homo sapiens
gaggugcgguggcuauaau

SEQ ID NO: 312874 - RNA, 19 nt, Homo sapiens
gaagcucccugauccuaca

SEQ ID NO: 312875 - RNA, 19 nt, Homo sapiens
ucaaugcucucuccuugga

SEQ ID NO: 312876 - RNA, 19 nt, Homo sapiens
gcaggauuguugcacuaaa

SEQ ID NO: 312877 - RNA, 19 nt, Homo sapiens
ccuaagcucucuccucuuc

SEQ ID NO: 312878 - RNA, 19 nt, Homo sapiens
gguagaaccuaaccuggau

SEQ ID NO: 312879 - RNA, 19 nt, Homo sapiens
guauaacucuuacaguagu

SEQ ID NO: 312880 - RNA, 19 nt, Homo sapiens
cuacuugaccucugucuuu

SEQ ID NO: 312881 - RNA, 19 nt, Homo sapiens
cugaacagcucuuccucua

SEQ ID NO: 312882 - RNA, 19 nt, Homo sapiens
aaagcuaacuccauguuca

SEQ ID NO: 312883 - RNA, 19 nt, Homo sapiens
acacaaucuuggacauuaa

SEQ ID NO: 312884 - RNA, 19 nt, Homo sapiens
ccaaucaaggguuuguuua

SEQ ID NO: 312885 - RNA, 19 nt, Homo sapiens
uaaggaggcuaguuacagu

SEQ ID NO: 312886 - RNA, 19 nt, Homo sapiens
gagcaacaaagcauucuga

SEQ ID NO: 312887 - RNA, 19 nt, Homo sapiens
guccuguucuuccuacaua

SEQ ID NO: 312888 - RNA, 19 nt, Homo sapiens
ccuaauagcggaaugaaau

SEQ ID NO: 312889 - RNA, 19 nt, Homo sapiens
cacaauggauucacuucuu

SEQ ID NO: 312890 - RNA, 19 nt, Homo sapiens
ggauuugucaagaugguua

SEQ ID NO: 312891 - RNA, 19 nt, Homo sapiens
cagaggauuugucaagaug

SEQ ID NO: 312892 - RNA, 19 nt, Homo sapiens
gaacacaauggauucacuu

SEQ ID NO: 312893 - RNA, 19 nt, Homo sapiens
guguggcgcuacauuaauu

SEQ ID NO: 312894 - RNA, 19 nt, Homo sapiens
agaguucggagccaaauua

SEQ ID NO: 312895 - RNA, 19 nt, Homo sapiens
ccugaggccuggacaaaug

SEQ ID NO: 312896 - RNA, 19 nt, Homo sapiens
ccaaacagaaacccaacua

SEQ ID NO: 312897 - RNA, 19 nt, Homo sapiens
cuagcugucuggcuguaua

SEQ ID NO: 312898 - RNA, 19 nt, Homo sapiens
ggaggagugggcuaccuua

SEQ ID NO: 312899 - RNA, 19 nt, Homo sapiens
gcuaucaccugaggacaga

SEQ ID NO: 312900 - RNA, 19 nt, Homo sapiens
ccaaauuaaagguggcuua

SEQ ID NO: 312901 - RNA, 19 nt, Homo sapiens
ggagugacaugggacuuca

SEQ ID NO: 312902 - RNA, 19 nt, Homo sapiens
ugaacuggaugccaugaug

SEQ ID NO: 312903 - RNA, 19 nt, Homo sapiens
gaagcaggaggaucacuug

SEQ ID NO: 312904 - RNA, 19 nt, Homo sapiens
caagagacagugaacauag

SEQ ID NO: 312905 - RNA, 19 nt, Homo sapiens
gaagcugaauaggguagaa

SEQ ID NO: 312906 - RNA, 19 nt, Homo sapiens
gacuauguguggacuguau

SEQ ID NO: 312907 - RNA, 19 nt, Homo sapiens
gaaaacagcauggccagua

SEQ ID NO: 312908 - RNA, 19 nt, Homo sapiens
ccaacugugucaucucuuc

SEQ ID NO: 312909 - RNA, 19 nt, Homo sapiens
gagaaagaagcauccaaga

SEQ ID NO: 312910 - RNA, 19 nt, Homo sapiens
ccagauugccuguuagaga

SEQ ID NO: 312911 - RNA, 19 nt, Homo sapiens
ggaaaugcagcaagaugga

SEQ ID NO: 312912 - RNA, 19 nt, Homo sapiens
gcaagaagaguccagugau

SEQ ID NO: 312913 - RNA, 19 nt, Homo sapiens
ucugguacauuuguguuua

SEQ ID NO: 312914 - RNA, 19 nt, Homo sapiens
caacuccagccaccacuuu

SEQ ID NO: 312915 - RNA, 19 nt, Homo sapiens
uagaacacaucuggaaaug

SEQ ID NO: 312916 - RNA, 19 nt, Homo sapiens
ccaagagacagugaacaua

SEQ ID NO: 312917 - RNA, 19 nt, Homo sapiens
caauggauucacuucuuua

SEQ ID NO: 312918 - RNA, 19 nt, Homo sapiens
ucucaggccucuaacacuu

SEQ ID NO: 312919 - RNA, 19 nt, Homo sapiens
gggcaaaucccuucuuagg

SEQ ID NO: 312920 - RNA, 19 nt, Homo sapiens
ggagagggcaaauuguuag

SEQ ID NO: 312921 - RNA, 19 nt, Homo sapiens
gaugggcauuccugagaga

SEQ ID NO: 312922 - RNA, 19 nt, Homo sapiens
gcuaacuccauguucauaa

SEQ ID NO: 312923 - RNA, 19 nt, Homo sapiens
caggauuguugcacuaaau

SEQ ID NO: 312924 - RNA, 19 nt, Homo sapiens
agaggugacuuguucuuuc

SEQ ID NO: 312925 - RNA, 19 nt, Homo sapiens
guucggagccaaauuaaag

SEQ ID NO: 312926 - RNA, 19 nt, Homo sapiens
gcucccagcugagguagga

SEQ ID NO: 312927 - RNA, 19 nt, Homo sapiens
gaugguuagcucuuuguuu

SEQ ID NO: 312928 - RNA, 19 nt, Homo sapiens
cauaagagaggacugaaca

SEQ ID NO: 312929 - RNA, 19 nt, Homo sapiens
gcacuaaaugaaauacugu

SEQ ID NO: 312930 - RNA, 19 nt, Homo sapiens
guacgggcauaaccuugga

SEQ ID NO: 312931 - RNA, 19 nt, Homo sapiens
ggcuaucccagaaauauuu

SEQ ID NO: 312932 - RNA, 19 nt, Homo sapiens
gugggaagaccuaugcuuu

SEQ ID NO: 312933 - RNA, 19 nt, Homo sapiens
uggacucccugguucagua

SEQ ID NO: 312934 - RNA, 19 nt, Homo sapiens
gcacagugucugguacauu

SEQ ID NO: 312935 - RNA, 19 nt, Homo sapiens
cuaauagcggaaugaaaua

SEQ ID NO: 312936 - RNA, 19 nt, Homo sapiens
gucaguggcuggaacaaag

SEQ ID NO: 312937 - RNA, 19 nt, Homo sapiens
caagaagaguccagugaua

SEQ ID NO: 312938 - RNA, 19 nt, Homo sapiens
ccuaauagcugaaugaaau

SEQ ID NO: 312939 - RNA, 19 nt, Homo sapiens
gagaaaggcuaucccagaa

SEQ ID NO: 312940 - RNA, 19 nt, Homo sapiens
gacacaaucuuggacauua

SEQ ID NO: 312941 - RNA, 19 nt, Homo sapiens
gaaaggcuaucccagaaau

SEQ ID NO: 312942 - RNA, 19 nt, Homo sapiens
gauaagggaugaggaagaa

SEQ ID NO: 312943 - RNA, 19 nt, Homo sapiens
ccagaaaucucaggucaga

SEQ ID NO: 312944 - RNA, 19 nt, Homo sapiens
cacagugucugguacauuu

SEQ ID NO: 312945 - RNA, 19 nt, Homo sapiens
gcuaugaguuggcaagaug

SEQ ID NO: 312946 - RNA, 19 nt, Homo sapiens
gaccaguacugcaggauug

SEQ ID NO: 312947 - RNA, 19 nt, Homo sapiens
gaagaccuaugcuuucaag

SEQ ID NO: 312948 - RNA, 19 nt, Homo sapiens
uggacuaccugucacaaua

SEQ ID NO: 312949 - RNA, 19 nt, Homo sapiens
ggaugcagcucucuauugg

SEQ ID NO: 312950 - RNA, 19 nt, Homo sapiens
caauauggguaccuacaga

SEQ ID NO: 312951 - RNA, 19 nt, Homo sapiens
acaauggauucacuucuuu

SEQ ID NO: 312952 - RNA, 19 nt, Homo sapiens
gggaagaccuaugcuuuca

SEQ ID NO: 312953 - RNA, 19 nt, Homo sapiens
cgccaaagcucguacuguu

SEQ ID NO: 312954 - RNA, 19 nt, Homo sapiens
acagaagccucuagaagga

SEQ ID NO: 312955 - RNA, 19 nt, Homo sapiens
gcaggauuguugcacuaaa

SEQ ID NO: 312956 - RNA, 19 nt, Homo sapiens
gguagaaccuaaccuggau

SEQ ID NO: 312957 - RNA, 19 nt, Homo sapiens
aaagcuaacuccauguuca

SEQ ID NO: 312958 - RNA, 19 nt, Homo sapiens
acacaaucuuggacauuaa

SEQ ID NO: 312959 - RNA, 19 nt, Homo sapiens
ccaaucaaggguuuguuua

SEQ ID NO: 312960 - RNA, 19 nt, Homo sapiens
guccuguucuuccuacaua

SEQ ID NO: 312961 - RNA, 19 nt, Homo sapiens
cacaauggauucacuucuu

SEQ ID NO: 312962 - RNA, 19 nt, Homo sapiens
cuaacuccauguucauaaa

SEQ ID NO: 312963 - RNA, 19 nt, Homo sapiens
gaacacaauggauucacuu

SEQ ID NO: 312964 - RNA, 19 nt, Homo sapiens
guguggcgcuacauuaauu

SEQ ID NO: 312965 - RNA, 19 nt, Homo sapiens
ccugaggccuggacaaaug

SEQ ID NO: 312966 - RNA, 19 nt, Homo sapiens
ggagugacaugggacuuca

SEQ ID NO: 312967 - RNA, 19 nt, Homo sapiens
ugaacuggaugccaugaug

SEQ ID NO: 312968 - RNA, 19 nt, Homo sapiens
ggacuaccugucacaauau

SEQ ID NO: 312969 - RNA, 19 nt, Homo sapiens
gaagcugaauaggguagaa

SEQ ID NO: 312970 - RNA, 19 nt, Homo sapiens
gacuauguguggacuguau

SEQ ID NO: 312971 - RNA, 19 nt, Homo sapiens
ccagaagacccuuaaauac

SEQ ID NO: 312972 - RNA, 19 nt, Homo sapiens
gaaaacagcauggccagua

SEQ ID NO: 312973 - RNA, 19 nt, Homo sapiens
ccaacugugucaucucuuc

SEQ ID NO: 312974 - RNA, 19 nt, Homo sapiens
gcaagaagaguccagugau

SEQ ID NO: 312975 - RNA, 19 nt, Homo sapiens
ucugguacauuuguguuua

SEQ ID NO: 312976 - RNA, 19 nt, Homo sapiens
caacuccagccaccacuuu

SEQ ID NO: 312977 - RNA, 19 nt, Homo sapiens
caauggauucacuucuuua

SEQ ID NO: 312978 - RNA, 19 nt, Homo sapiens
accagaagacccuuaaaua

SEQ ID NO: 312979 - RNA, 19 nt, Homo sapiens
ucucaggccucuaacacuu

SEQ ID NO: 312980 - RNA, 19 nt, Homo sapiens
gcuaacuccauguucauaa

SEQ ID NO: 312981 - RNA, 19 nt, Homo sapiens
caggauuguugcacuaaau

SEQ ID NO: 312982 - RNA, 19 nt, Homo sapiens
gcacuaaaugaaauacugu

SEQ ID NO: 312983 - RNA, 19 nt, Homo sapiens
guacgggcauaaccuugga

SEQ ID NO: 312984 - RNA, 19 nt, Homo sapiens
ggcuaucccagaaauauuu

SEQ ID NO: 312985 - RNA, 19 nt, Homo sapiens
gugggaagaccuaugcuuu

SEQ ID NO: 312986 - RNA, 19 nt, Homo sapiens
gcacagugucugguacauu

SEQ ID NO: 312987 - RNA, 19 nt, Homo sapiens
gcuaauuaaccuuguugaa

SEQ ID NO: 312988 - RNA, 19 nt, Homo sapiens
ccacagacacaaucuugga

SEQ ID NO: 312989 - RNA, 19 nt, Homo sapiens
gacaagguguggcgcuaca

SEQ ID NO: 312990 - RNA, 19 nt, Homo sapiens
uggauucacuucuuuaagg

SEQ ID NO: 312991 - RNA, 19 nt, Homo sapiens
aagaagaguccagugauaa

SEQ ID NO: 312992 - RNA, 19 nt, Homo sapiens
ggcaagaagaguccaguga

SEQ ID NO: 312993 - RNA, 19 nt, Homo sapiens
cuacucgccucgaacacaa

SEQ ID NO: 312994 - RNA, 19 nt, Homo sapiens
ggcauaaccuuggauacca

SEQ ID NO: 312995 - RNA, 19 nt, Homo sapiens
caaccagcagcuucgagua

SEQ ID NO: 312996 - RNA, 19 nt, Homo sapiens
gggaugaggaagaagaaga

SEQ ID NO: 312997 - RNA, 19 nt, Homo sapiens
uaagggaugaggaagaaga

SEQ ID NO: 312998 - RNA, 19 nt, Homo sapiens
ccaacuccauuuccugucu

SEQ ID NO: 312999 - RNA, 19 nt, Homo sapiens
ccacccacccuuucauuuc

SEQ ID NO: 313000 - RNA, 19 nt, Homo sapiens
gcccucggcugcuaugagu

SEQ ID NO: 313001 - RNA, 19 nt, Homo sapiens
ggcgcuacauuaauuucaa

SEQ ID NO: 313002 - RNA, 19 nt, Homo sapiens
cuacagaagccucuagaag

SEQ ID NO: 313003 - RNA, 19 nt, Homo sapiens
agaagacccuuaaauaccu

SEQ ID NO: 313004 - RNA, 19 nt, Homo sapiens
gacuaccugucacaauaug

SEQ ID NO: 313005 - RNA, 19 nt, Homo sapiens
ggccgagucuacuucuuca

SEQ ID NO: 313006 - RNA, 19 nt, Homo sapiens
gcaagauggccgagucuac

SEQ ID NO: 313007 - RNA, 19 nt, Homo sapiens
gggacuauguguggacugu

SEQ ID NO: 313008 - RNA, 19 nt, Homo sapiens
cugguacauuuguguuuaa

SEQ ID NO: 313009 - RNA, 19 nt, Homo sapiens
gauuguugcacuaaaugaa

SEQ ID NO: 313010 - RNA, 19 nt, Homo sapiens
ggauuguugcacuaaauga

SEQ ID NO: 313011 - RNA, 19 nt, Homo sapiens
acucagauccccuaacuua

SEQ ID NO: 313012 - RNA, 19 nt, Homo sapiens
caagguguggcgcuacauu

SEQ ID NO: 313013 - RNA, 19 nt, Homo sapiens
cuugggcacucccgauauu

SEQ ID NO: 313014 - RNA, 19 nt, Homo sapiens
ccuugagaaucacauuuau

SEQ ID NO: 313015 - RNA, 19 nt, Homo sapiens
gagaagugcuccccuaacu

SEQ ID NO: 313016 - RNA, 19 nt, Homo sapiens
ggacaaaugggagugacau

SEQ ID NO: 313017 - RNA, 19 nt, Homo sapiens
ccagacccuugcaguagug

SEQ ID NO: 313018 - RNA, 19 nt, Homo sapiens
gccagacccuugcaguagu

SEQ ID NO: 313019 - RNA, 19 nt, Homo sapiens
uuggaauccuugagaauca

SEQ ID NO: 313020 - RNA, 19 nt, Homo sapiens
auaccugucugcucaguag

SEQ ID NO: 313021 - RNA, 19 nt, Homo sapiens
gcgcuacauuaauuucaag

SEQ ID NO: 313022 - RNA, 19 nt, Homo sapiens
cgaacacaauggauucacu

SEQ ID NO: 313023 - RNA, 19 nt, Homo sapiens
ccgagugucugcccuuugg

SEQ ID NO: 313024 - RNA, 19 nt, Homo sapiens
ggaagaccuaugcuuucaa

SEQ ID NO: 313025 - RNA, 19 nt, Homo sapiens
ucaaccagaagacccuuaa

SEQ ID NO: 313026 - RNA, 19 nt, Homo sapiens
uuacgggcaagcuaauuaa

SEQ ID NO: 313027 - RNA, 19 nt, Homo sapiens
ucucuucucuggaggucaa

SEQ ID NO: 313028 - RNA, 19 nt, Homo sapiens
ccauuuccugucugucuua

SEQ ID NO: 313029 - RNA, 19 nt, Homo sapiens
gaagugcuccccuaacuca

SEQ ID NO: 313030 - RNA, 19 nt, Homo sapiens
gcugucuacucgccucgaa

SEQ ID NO: 313031 - RNA, 19 nt, Homo sapiens
agaaagaagcaccugacuu

SEQ ID NO: 313032 - RNA, 19 nt, Homo sapiens
aaaacagcauggccaguaa

SEQ ID NO: 313033 - RNA, 19 nt, Homo sapiens
gagcuagcccgaacugacu

SEQ ID NO: 313034 - RNA, 19 nt, Homo sapiens
ucucaggucagcuggauga

SEQ ID NO: 313035 - RNA, 19 nt, Homo sapiens
aagguguggcgcuacauua

SEQ ID NO: 313036 - RNA, 19 nt, Homo sapiens
ccuagaggaucccuucaac

SEQ ID NO: 313037 - RNA, 19 nt, Homo sapiens
gaaagaagcauccaagaga

SEQ ID NO: 313038 - RNA, 19 nt, Homo sapiens
caagaagaguccagugaua

SEQ ID NO: 313039 - RNA, 19 nt, Homo sapiens
ccuaauagcugaaugaaau

SEQ ID NO: 313040 - RNA, 19 nt, Homo sapiens
gagaaaggcuaucccagaa

SEQ ID NO: 313041 - RNA, 19 nt, Homo sapiens
gacacaaucuuggacauua

SEQ ID NO: 313042 - RNA, 19 nt, Homo sapiens
gaaaggcuaucccagaaau

SEQ ID NO: 313043 - RNA, 19 nt, Homo sapiens
gauaagggaugaggaagaa

SEQ ID NO: 313044 - RNA, 19 nt, Homo sapiens
ugagagaacugggugauga

SEQ ID NO: 313045 - RNA, 19 nt, Homo sapiens
cacagugucugguacauuu

SEQ ID NO: 313046 - RNA, 19 nt, Homo sapiens
gcuaugaguuggcaagaug

SEQ ID NO: 313047 - RNA, 19 nt, Homo sapiens
gaccaguacugcaggauug

SEQ ID NO: 313048 - RNA, 19 nt, Homo sapiens
gaagaccuaugcuuucaag

SEQ ID NO: 313049 - RNA, 19 nt, Homo sapiens
gggaguggcugggaaggua

SEQ ID NO: 313050 - RNA, 19 nt, Homo sapiens
gaacuccagccaccacuuu

SEQ ID NO: 313051 - RNA, 19 nt, Homo sapiens
ggaugcagcucucuauugg

SEQ ID NO: 313052 - RNA, 19 nt, Homo sapiens
acaauggauucacuucuuu

SEQ ID NO: 313053 - RNA, 19 nt, Homo sapiens
gggaagaccuaugcuuuca

SEQ ID NO: 313054 - RNA, 19 nt, Homo sapiens
gcaggauuguugcacuaaa

SEQ ID NO: 313055 - RNA, 19 nt, Homo sapiens
gguagaaccuaaccuggau

SEQ ID NO: 313056 - RNA, 19 nt, Homo sapiens
aaagcuaacuccauguuca

SEQ ID NO: 313057 - RNA, 19 nt, Homo sapiens
acacaaucuuggacauuaa

SEQ ID NO: 313058 - RNA, 19 nt, Homo sapiens
ccaaucaaggguuuguuua

SEQ ID NO: 313059 - RNA, 19 nt, Homo sapiens
guccuguucuuccuacaua

SEQ ID NO: 313060 - RNA, 19 nt, Homo sapiens
cacaauggauucacuucuu

SEQ ID NO: 313061 - RNA, 19 nt, Homo sapiens
cuaacuccauguucauaaa

SEQ ID NO: 313062 - RNA, 19 nt, Homo sapiens
gaacacaauggauucacuu

SEQ ID NO: 313063 - RNA, 19 nt, Homo sapiens
guguggcgcuacauuaauu

SEQ ID NO: 313064 - RNA, 19 nt, Homo sapiens
ccugaggccuggacaaaug

SEQ ID NO: 313065 - RNA, 19 nt, Homo sapiens
ggagugacaugggacuuca

SEQ ID NO: 313066 - RNA, 19 nt, Homo sapiens
ugaacuggaugccaugaug

SEQ ID NO: 313067 - RNA, 19 nt, Homo sapiens
gaagcugaauaggguagaa

SEQ ID NO: 313068 - RNA, 19 nt, Homo sapiens
gacuauguguggacuguau

SEQ ID NO: 313069 - RNA, 19 nt, Homo sapiens
caagagacagugaacauag

SEQ ID NO: 313070 - RNA, 19 nt, Homo sapiens
gaaaacagcauggccagua

SEQ ID NO: 313071 - RNA, 19 nt, Homo sapiens
ccaacugugucaucucuuc

SEQ ID NO: 313072 - RNA, 19 nt, Homo sapiens
gcaagaagaguccagugau

SEQ ID NO: 313073 - RNA, 19 nt, Homo sapiens
gagaaagaagcauccaaga

SEQ ID NO: 313074 - RNA, 19 nt, Homo sapiens
ucugguacauuuguguuua

SEQ ID NO: 313075 - RNA, 19 nt, Homo sapiens
ccaagagacagugaacaua

SEQ ID NO: 313076 - RNA, 19 nt, Homo sapiens
caauggauucacuucuuua

SEQ ID NO: 313077 - RNA, 19 nt, Homo sapiens
ucucaggccucuaacacuu

SEQ ID NO: 313078 - RNA, 19 nt, Homo sapiens
gcuaacuccauguucauaa

SEQ ID NO: 313079 - RNA, 19 nt, Homo sapiens
caggauuguugcacuaaau

SEQ ID NO: 313080 - RNA, 19 nt, Homo sapiens
gaugggcauuccugagaga

SEQ ID NO: 313081 - RNA, 19 nt, Homo sapiens
gcacuaaaugaaauacugu

SEQ ID NO: 313082 - RNA, 19 nt, Homo sapiens
guacgggcauaaccuugga

SEQ ID NO: 313083 - RNA, 19 nt, Homo sapiens
ggcuaucccagaaauauuu

SEQ ID NO: 313084 - RNA, 19 nt, Homo sapiens
gugggaagaccuaugcuuu

SEQ ID NO: 313085 - RNA, 19 nt, Homo sapiens
gcacagugucugguacauu

SEQ ID NO: 313086 - RNA, 19 nt, Homo sapiens
gcuaauuaaccuuguugaa

SEQ ID NO: 313087 - RNA, 19 nt, Homo sapiens
ccacagacacaaucuugga

SEQ ID NO: 313088 - RNA, 19 nt, Homo sapiens
gacaagguguggcgcuaca

SEQ ID NO: 313089 - RNA, 19 nt, Homo sapiens
uggauucacuucuuuaagg

SEQ ID NO: 313090 - RNA, 19 nt, Homo sapiens
aagaagaguccagugauaa

SEQ ID NO: 313091 - RNA, 19 nt, Homo sapiens
ggcaagaagaguccaguga

SEQ ID NO: 313092 - RNA, 19 nt, Homo sapiens
gaagguaagggacagugau

SEQ ID NO: 313093 - RNA, 19 nt, Homo sapiens
ggaagguaagggacaguga

SEQ ID NO: 313094 - RNA, 19 nt, Homo sapiens
cuacucgccucgaacacaa

SEQ ID NO: 313095 - RNA, 19 nt, Homo sapiens
ggcauaaccuuggauacca

SEQ ID NO: 313096 - RNA, 19 nt, Homo sapiens
caaccagcagcuucgagua

SEQ ID NO: 313097 - RNA, 19 nt, Homo sapiens
gggaugaggaagaagaaga

SEQ ID NO: 313098 - RNA, 19 nt, Homo sapiens
uaagggaugaggaagaaga

SEQ ID NO: 313099 - RNA, 19 nt, Homo sapiens
ccaacuccauuuccugucu

SEQ ID NO: 313100 - RNA, 19 nt, Homo sapiens
ccacccacccuuucauuuc

SEQ ID NO: 313101 - RNA, 19 nt, Homo sapiens
gcccucggcugcuaugagu

SEQ ID NO: 313102 - RNA, 19 nt, Homo sapiens
ggcgcuacauuaauuucaa

SEQ ID NO: 313103 - RNA, 19 nt, Homo sapiens
ggccgagucuacuucuuca

SEQ ID NO: 313104 - RNA, 19 nt, Homo sapiens
gcaagauggccgagucuac

SEQ ID NO: 313105 - RNA, 19 nt, Homo sapiens
gggacuauguguggacugu

SEQ ID NO: 313106 - RNA, 19 nt, Homo sapiens
gguaugcauuaauuagagu

SEQ ID NO: 313107 - RNA, 19 nt, Homo sapiens
cugguacauuuguguuuaa

SEQ ID NO: 313108 - RNA, 19 nt, Homo sapiens
gauuguugcacuaaaugaa

SEQ ID NO: 313109 - RNA, 19 nt, Homo sapiens
ggauuguugcacuaaauga

SEQ ID NO: 313110 - RNA, 19 nt, Homo sapiens
acucagauccccuaacuua

SEQ ID NO: 313111 - RNA, 19 nt, Homo sapiens
caagguguggcgcuacauu

SEQ ID NO: 313112 - RNA, 19 nt, Homo sapiens
gugaugggcauuccugaga

SEQ ID NO: 313113 - RNA, 19 nt, Homo sapiens
cuugggcacucccgauauu

SEQ ID NO: 313114 - RNA, 19 nt, Homo sapiens
ccuugagaaucacauuuau

SEQ ID NO: 313115 - RNA, 19 nt, Homo sapiens
gagaagugcuccccuaacu

SEQ ID NO: 313116 - RNA, 19 nt, Homo sapiens
ggacaaaugggagugacau

SEQ ID NO: 313117 - RNA, 19 nt, Homo sapiens
ccagacccuugcaguagug

SEQ ID NO: 313118 - RNA, 19 nt, Homo sapiens
gccagacccuugcaguagu

SEQ ID NO: 313119 - RNA, 19 nt, Homo sapiens
uuggaauccuugagaauca

SEQ ID NO: 313120 - RNA, 19 nt, Homo sapiens
auaccugucugcucaguag

SEQ ID NO: 313121 - RNA, 19 nt, Homo sapiens
gcgcuacauuaauuucaag

SEQ ID NO: 313122 - RNA, 19 nt, Homo sapiens
ggacagugaugggcauucc

SEQ ID NO: 313123 - RNA, 19 nt, Homo sapiens
cgaacacaauggauucacu

SEQ ID NO: 313124 - RNA, 19 nt, Homo sapiens
ccgagugucugcccuuugg

SEQ ID NO: 313125 - RNA, 19 nt, Homo sapiens
gagaggacugggucagaga

SEQ ID NO: 313126 - RNA, 19 nt, Homo sapiens
ggaagaccuaugcuuucaa

SEQ ID NO: 313127 - RNA, 19 nt, Homo sapiens
uuacgggcaagcuaauuaa

SEQ ID NO: 313128 - RNA, 19 nt, Homo sapiens
ucucuucucuggaggucaa

SEQ ID NO: 313129 - RNA, 19 nt, Homo sapiens
ccauuuccugucugucuua

SEQ ID NO: 313130 - RNA, 19 nt, Homo sapiens
gaagugcuccccuaacuca

SEQ ID NO: 313131 - RNA, 19 nt, Homo sapiens
ggaguggcugggaagguaa

SEQ ID NO: 313132 - RNA, 19 nt, Homo sapiens
ccuguucaccuuugccuuu

SEQ ID NO: 313133 - RNA, 19 nt, Homo sapiens
gcugucuacucgccucgaa

SEQ ID NO: 313134 - RNA, 19 nt, Homo sapiens
aaaacagcauggccaguaa

SEQ ID NO: 313135 - RNA, 19 nt, Homo sapiens
gagcuagcccgaacugacu

SEQ ID NO: 313136 - RNA, 19 nt, Homo sapiens
aagacgaguucuggacuga

SEQ ID NO: 313137 - RNA, 19 nt, Homo sapiens
ccaaggagauggaggaaga

SEQ ID NO: 313138 - RNA, 19 nt, Homo sapiens
ccaccgcccucuuaaguuu

SEQ ID NO: 313139 - RNA, 19 nt, Homo sapiens
ggagucaggccucacauuu

SEQ ID NO: 313140 - RNA, 19 nt, Homo sapiens
cgccugagcugaauacaga

SEQ ID NO: 313141 - RNA, 19 nt, Homo sapiens
gaggagaccuggacuuuug

SEQ ID NO: 313142 - RNA, 19 nt, Homo sapiens
gaauggcacgcaccuugua

SEQ ID NO: 313143 - RNA, 19 nt, Homo sapiens
caccacuccuggccaauuu

SEQ ID NO: 313144 - RNA, 19 nt, Homo sapiens
agagggaccugccgcgaaa

SEQ ID NO: 313145 - RNA, 19 nt, Homo sapiens
uguguaagguggccuauuc

SEQ ID NO: 313146 - RNA, 19 nt, Homo sapiens
caagggauguaagggauau

SEQ ID NO: 313147 - RNA, 19 nt, Homo sapiens
gggcgacccugacaaguac

SEQ ID NO: 313148 - RNA, 19 nt, Homo sapiens
ucaaacuucugugcacaaa

SEQ ID NO: 313149 - RNA, 19 nt, Homo sapiens
acacucacuuugacgauga

SEQ ID NO: 313150 - RNA, 19 nt, Homo sapiens
ucaaggacauggaccuaca

SEQ ID NO: 313151 - RNA, 19 nt, Homo sapiens
ggaaugagggaaggucuug

SEQ ID NO: 313152 - RNA, 19 nt, Homo sapiens
caugagcuaugcccugaug

SEQ ID NO: 313153 - RNA, 19 nt, Homo sapiens
agucaggccucacauuuca

SEQ ID NO: 313154 - RNA, 19 nt, Homo sapiens
ccgcagcucucacccacuu

SEQ ID NO: 313155 - RNA, 19 nt, Homo sapiens
cgacauccucaucgacuuu

SEQ ID NO: 313156 - RNA, 19 nt, Homo sapiens
ggcaggcuguguucugaga

SEQ ID NO: 313157 - RNA, 19 nt, Homo sapiens
gcgauggccugcagcaacu

SEQ ID NO: 313158 - RNA, 19 nt, Homo sapiens
guucugagagugccugcua

SEQ ID NO: 313159 - RNA, 19 nt, Homo sapiens
acaccugccugacucuuuc

SEQ ID NO: 313160 - RNA, 19 nt, Homo sapiens
ggccagucuugaacucuug

SEQ ID NO: 313161 - RNA, 19 nt, Homo sapiens
acaaguaccgccugucuca

SEQ ID NO: 313162 - RNA, 19 nt, Homo sapiens
cagggaugauggagaguuc

SEQ ID NO: 313163 - RNA, 19 nt, Homo sapiens
gggaagaggcugggagcaa

SEQ ID NO: 313164 - RNA, 19 nt, Homo sapiens
ggacucaagggauguaagg

SEQ ID NO: 313165 - RNA, 19 nt, Homo sapiens
caaaagugcuggguuuaca

SEQ ID NO: 313166 - RNA, 19 nt, Homo sapiens
gaagaagcgaacccugaca

SEQ ID NO: 313167 - RNA, 19 nt, Homo sapiens
gagucaggccucacauuuc

SEQ ID NO: 313168 - RNA, 19 nt, Homo sapiens
ggaggacucaagggaugua

SEQ ID NO: 313169 - RNA, 19 nt, Homo sapiens
gggaucuccuuauguuguc

SEQ ID NO: 313170 - RNA, 19 nt, Homo sapiens
uguaagggauauggcuuga

SEQ ID NO: 313171 - RNA, 19 nt, Homo sapiens
ggacacucacuuugacgau

SEQ ID NO: 313172 - RNA, 19 nt, Homo sapiens
cugcagcaacucuauggua

SEQ ID NO: 313173 - RNA, 19 nt, Homo sapiens
ucaagggauguaagggaua

SEQ ID NO: 313174 - RNA, 19 nt, Homo sapiens
ugggcgacccugacaagua

SEQ ID NO: 313175 - RNA, 19 nt, Homo sapiens
gcggcucaccgguugauga

SEQ ID NO: 313176 - RNA, 19 nt, Homo sapiens
aagcgaacccugacaugga

SEQ ID NO: 313177 - RNA, 19 nt, Homo sapiens
gccugacucuuuccucaca

SEQ ID NO: 313178 - RNA, 19 nt, Homo sapiens
ccggcaggcuguguucuga

SEQ ID NO: 313179 - RNA, 19 nt, Homo sapiens
ccaccacuccuggccaauu

SEQ ID NO: 313180 - RNA, 19 nt, Homo sapiens
ccugagcgccugagcugaa

SEQ ID NO: 313181 - RNA, 19 nt, Homo sapiens
gcagcucucacccacuuuc

SEQ ID NO: 313182 - RNA, 19 nt, Homo sapiens
gaugaggagaccuggacuu

SEQ ID NO: 313183 - RNA, 19 nt, Homo sapiens
ccuagcccaugccuucuuc

SEQ ID NO: 313184 - RNA, 19 nt, Homo sapiens
ccaguguccucugcagcaa

SEQ ID NO: 313185 - RNA, 19 nt, Homo sapiens
gaaagaaauugccaaguua

SEQ ID NO: 313186 - RNA, 19 nt, Homo sapiens
gcuuaaaccugauuucuaa

SEQ ID NO: 313187 - RNA, 19 nt, Homo sapiens
ggcagacacuucaguauua

SEQ ID NO: 313188 - RNA, 19 nt, Homo sapiens
caacuaugcuucuugcuaa

SEQ ID NO: 313189 - RNA, 19 nt, Homo sapiens
gagcaugccuguaguguga

SEQ ID NO: 313190 - RNA, 19 nt, Homo sapiens
ugaaagaaauugccaaguu

SEQ ID NO: 313191 - RNA, 19 nt, Homo sapiens
ggagggagcuuccauccuu

SEQ ID NO: 313192 - RNA, 19 nt, Homo sapiens
gagcgagucuguaaucuga

SEQ ID NO: 313193 - RNA, 19 nt, Homo sapiens
gaaauaccuuccuaaugaa

SEQ ID NO: 313194 - RNA, 19 nt, Homo sapiens
ugaguaaucucccuuuauu

SEQ ID NO: 313195 - RNA, 19 nt, Homo sapiens
gcaugaagcuguaaauuuu

SEQ ID NO: 313196 - RNA, 19 nt, Homo sapiens
ccaaagagcgagucuguaa

SEQ ID NO: 313197 - RNA, 19 nt, Homo sapiens
gagagaggaucaagacaug

SEQ ID NO: 313198 - RNA, 19 nt, Homo sapiens
gcaaacagggcauccaauu

SEQ ID NO: 313199 - RNA, 19 nt, Homo sapiens
caacaaggcaggagaguau

SEQ ID NO: 313200 - RNA, 19 nt, Homo sapiens
gcagacacuucaguauuaa

SEQ ID NO: 313201 - RNA, 19 nt, Homo sapiens
ccauccagauuguaaauaa

SEQ ID NO: 313202 - RNA, 19 nt, Homo sapiens
gaaauugccaaguuaauca

SEQ ID NO: 313203 - RNA, 19 nt, Homo sapiens
uaaagaccauuacuucuca

SEQ ID NO: 313204 - RNA, 19 nt, Homo sapiens
agccaaauaugaccuguua

SEQ ID NO: 313205 - RNA, 19 nt, Homo sapiens
gagcuuccauccuucuuga

SEQ ID NO: 313206 - RNA, 19 nt, Homo sapiens
gacccuagcugaugcugaa

SEQ ID NO: 313207 - RNA, 19 nt, Homo sapiens
caaguuuguuuaagacuga

SEQ ID NO: 313208 - RNA, 19 nt, Homo sapiens
ugaaggagauguauuucga

SEQ ID NO: 313209 - RNA, 19 nt, Homo sapiens
ggaacugccuaguguaaca

SEQ ID NO: 313210 - RNA, 19 nt, Homo sapiens
gaagccauccagauuguaa

SEQ ID NO: 313211 - RNA, 19 nt, Homo sapiens
gaccaaccaucaucucgaa

SEQ ID NO: 313212 - RNA, 19 nt, Homo sapiens
guaaauaacaacccauaug

SEQ ID NO: 313213 - RNA, 19 nt, Homo sapiens
ccaauucuacacucaguua

SEQ ID NO: 313214 - RNA, 19 nt, Homo sapiens
gccaguguauguaaagaaa

SEQ ID NO: 313215 - RNA, 19 nt, Homo sapiens
acauggaccuuuauuccua

SEQ ID NO: 313216 - RNA, 19 nt, Homo sapiens
ugagguaacuguuguaacu

SEQ ID NO: 313217 - RNA, 19 nt, Homo sapiens
caagaggguucaagccaau

SEQ ID NO: 313218 - RNA, 19 nt, Homo sapiens
ggaaauaugcccacuuggu

SEQ ID NO: 313219 - RNA, 19 nt, Homo sapiens
uaacaacccauauggaaau

SEQ ID NO: 313220 - RNA, 19 nt, Homo sapiens
aauaugaccuguuacaaag

SEQ ID NO: 313221 - RNA, 19 nt, Homo sapiens
cuaaguugcuccaggauuc

SEQ ID NO: 313222 - RNA, 19 nt, Homo sapiens
gccaugguguguggaaaua

SEQ ID NO: 313223 - RNA, 19 nt, Homo sapiens
gagagucaaugcaggagau

SEQ ID NO: 313224 - RNA, 19 nt, Homo sapiens
gggcagacacuucaguauu

SEQ ID NO: 313225 - RNA, 19 nt, Homo sapiens
gaaaagccaguguauguaa

SEQ ID NO: 313226 - RNA, 19 nt, Homo sapiens
ucggaaauaugcccacuug

SEQ ID NO: 313227 - RNA, 19 nt, Homo sapiens
caaccaucaucucgaaugu

SEQ ID NO: 313228 - RNA, 19 nt, Homo sapiens
gaaaugcuuaucugaaagu

SEQ ID NO: 313229 - RNA, 19 nt, Homo sapiens
cugcauggcucuuucaaca

SEQ ID NO: 313230 - RNA, 19 nt, Homo sapiens
gugcaggcauugcuccauu

SEQ ID NO: 313231 - RNA, 19 nt, Homo sapiens
gggagugugugcaggcauu

SEQ ID NO: 313232 - RNA, 19 nt, Homo sapiens
gagaaaagccaguguaugu

SEQ ID NO: 313233 - RNA, 19 nt, Homo sapiens
ccugaguaaucucccuuua

SEQ ID NO: 313234 - RNA, 19 nt, Homo sapiens
agacagaaacauuggauga

SEQ ID NO: 313235 - RNA, 19 nt, Homo sapiens
gccuguaauuccaucauuu

SEQ ID NO: 313236 - RNA, 19 nt, Homo sapiens
aaaccagauuucucacuug

SEQ ID NO: 313237 - RNA, 19 nt, Homo sapiens
uaaauaacaacccauaugg

SEQ ID NO: 313238 - RNA, 19 nt, Homo sapiens
gcucuucauuggugggaaa

SEQ ID NO: 313239 - RNA, 19 nt, Homo sapiens
ucucgaaugucaagccaaa

SEQ ID NO: 313240 - RNA, 19 nt, Homo sapiens
gcucuucauacuucuauuu

SEQ ID NO: 313241 - RNA, 19 nt, Homo sapiens
aauaacaacccauauggaa

SEQ ID NO: 313242 - RNA, 19 nt, Homo sapiens
ccaaauaugaccuguuaca

SEQ ID NO: 313243 - RNA, 19 nt, Homo sapiens
gcccggauccugcagguuu

SEQ ID NO: 313244 - RNA, 19 nt, Homo sapiens
gggaagacccuagcugaug

SEQ ID NO: 313245 - RNA, 19 nt, Homo sapiens
gaaaguagugcuuaaaccu

SEQ ID NO: 313246 - RNA, 19 nt, Homo sapiens
aaagugaaaggcuaugaaa

SEQ ID NO: 313247 - RNA, 19 nt, Homo sapiens
gcuccgcuaucaacaacuu

SEQ ID NO: 313248 - RNA, 19 nt, Homo sapiens
agugacaaauggaucgaua

SEQ ID NO: 313249 - RNA, 19 nt, Homo sapiens
cgaaaccccguaucuauua

SEQ ID NO: 313250 - RNA, 19 nt, Homo sapiens
gaucgaugggauuggaaua

SEQ ID NO: 313251 - RNA, 19 nt, Homo sapiens
cagcuuugcucagaucaga

SEQ ID NO: 313252 - RNA, 19 nt, Homo sapiens
aaacagggcauccaauucu

SEQ ID NO: 313253 - RNA, 19 nt, Homo sapiens
gggagacaccaauuucuau

SEQ ID NO: 313254 - RNA, 19 nt, Homo sapiens
ucgaaugucaagccaaaua

SEQ ID NO: 313255 - RNA, 19 nt, Homo sapiens
gagagaccaugccauccau

SEQ ID NO: 313256 - RNA, 19 nt, Homo sapiens
cuguaaagcucuucauugg

SEQ ID NO: 313257 - RNA, 19 nt, Homo sapiens
caaacagggcauccaauuc

SEQ ID NO: 313258 - RNA, 19 nt, Homo sapiens
ggagacaccaauuucuaug

SEQ ID NO: 313259 - RNA, 19 nt, Homo sapiens
caucuuccuucucuucuuc

SEQ ID NO: 313260 - RNA, 19 nt, Homo sapiens
gaugggauuggaauacauu

SEQ ID NO: 313261 - RNA, 19 nt, Homo sapiens
gaguaaucucccuuuauuu

SEQ ID NO: 313262 - RNA, 19 nt, Homo sapiens
ccagugccuuugccaaugu

SEQ ID NO: 313263 - RNA, 19 nt, Homo sapiens
gaaugucaagccaaauaug

SEQ ID NO: 313264 - RNA, 19 nt, Homo sapiens
gguaacuguuguaacuaug

SEQ ID NO: 313265 - RNA, 19 nt, Homo sapiens
ucagaucgaugggauugga

SEQ ID NO: 313266 - RNA, 19 nt, Homo sapiens
uaaagugaaaggcuaugaa

SEQ ID NO: 313267 - RNA, 19 nt, Homo sapiens
caaguuaaucacauuggaa

SEQ ID NO: 313268 - RNA, 19 nt, Homo sapiens
gcucacgccuguaauucca

SEQ ID NO: 313269 - RNA, 19 nt, Homo sapiens
ugaaaugcuuaucugaaag

SEQ ID NO: 313270 - RNA, 19 nt, Homo sapiens
guaacuguuguaacuauga

SEQ ID NO: 313271 - RNA, 19 nt, Homo sapiens
guaacaaugaaaccagauu

SEQ ID NO: 313272 - RNA, 19 nt, Homo sapiens
gcaucuuccuucucuucuu

SEQ ID NO: 313273 - RNA, 19 nt, Homo sapiens
caaauaugaccuguuacaa

SEQ ID NO: 313274 - RNA, 19 nt, Homo sapiens
caucauccauggacagcau

SEQ ID NO: 313275 - RNA, 19 nt, Homo sapiens
ccuggcagcuguagugcuu

SEQ ID NO: 313276 - RNA, 19 nt, Homo sapiens
gagcccaggaguugaagaa

SEQ ID NO: 313277 - RNA, 19 nt, Homo sapiens
gcauccaauucuacacuca

SEQ ID NO: 313278 - RNA, 19 nt, Homo sapiens
gacagaaacauuggaugaa

SEQ ID NO: 313279 - RNA, 19 nt, Homo sapiens
gcgagucccuggagcaacu

SEQ ID NO: 313280 - RNA, 19 nt, Homo sapiens
ugccauccaucaccaaaga

SEQ ID NO: 313281 - RNA, 19 nt, Homo sapiens
ggagagaccaugccaucca

SEQ ID NO: 313282 - RNA, 19 nt, Homo sapiens
uaucugaaaguagugcuua

SEQ ID NO: 313283 - RNA, 19 nt, Homo sapiens
caauuucuauggcaaacag

SEQ ID NO: 313284 - RNA, 19 nt, Homo sapiens
acagaaacauuggaugaag

SEQ ID NO: 313285 - RNA, 19 nt, Homo sapiens
gacaauagcucaugaaauu

SEQ ID NO: 313286 - RNA, 19 nt, Homo sapiens
gaauaguaguucuggaaua

SEQ ID NO: 313287 - RNA, 19 nt, Homo sapiens
ggaaggaguuggaauguuc

SEQ ID NO: 313288 - RNA, 19 nt, Homo sapiens
ggaaguaacugauaucacu

SEQ ID NO: 313289 - RNA, 19 nt, Homo sapiens
ggaaugauuucuccuuaau

SEQ ID NO: 313290 - RNA, 19 nt, Homo sapiens
aaacuugucugccacagua

SEQ ID NO: 313291 - RNA, 19 nt, Homo sapiens
ugucuuaacuucugucuuu

SEQ ID NO: 313292 - RNA, 19 nt, Homo sapiens
uaacgagcgugucuuacua

SEQ ID NO: 313293 - RNA, 19 nt, Homo sapiens
caaagcagguggcaugaau

SEQ ID NO: 313294 - RNA, 19 nt, Homo sapiens
ccaagcaucucacaaagga

SEQ ID NO: 313295 - RNA, 19 nt, Homo sapiens
ggacagagaaagagaauag

SEQ ID NO: 313296 - RNA, 19 nt, Homo sapiens
gcaaaaggauguuauuuca

SEQ ID NO: 313297 - RNA, 19 nt, Homo sapiens
gaugaccucuuuccuuguu

SEQ ID NO: 313298 - RNA, 19 nt, Homo sapiens
caucaacacuuugccaauu

SEQ ID NO: 313299 - RNA, 19 nt, Homo sapiens
caacagauuugggacauuc

SEQ ID NO: 313300 - RNA, 19 nt, Homo sapiens
caacggcgcucuggauaau

SEQ ID NO: 313301 - RNA, 19 nt, Homo sapiens
aaacuuaacucugcugugu

SEQ ID NO: 313302 - RNA, 19 nt, Homo sapiens
ccacguuguuuauuucaaa

SEQ ID NO: 313303 - RNA, 19 nt, Homo sapiens
cgugaugguuaucuauuua

SEQ ID NO: 313304 - RNA, 19 nt, Homo sapiens
gacaggaaguaacugauau

SEQ ID NO: 313305 - RNA, 19 nt, Homo sapiens
gcaccuucuuugacaagua

SEQ ID NO: 313306 - RNA, 19 nt, Homo sapiens
gcaugaacacccacuuuaa

SEQ ID NO: 313307 - RNA, 19 nt, Homo sapiens
uaacuucugucuuugacuu

SEQ ID NO: 313308 - RNA, 19 nt, Homo sapiens
ucacuucacccaaauauau

SEQ ID NO: 313309 - RNA, 19 nt, Homo sapiens
aaacacacccuacacacua

SEQ ID NO: 313310 - RNA, 19 nt, Homo sapiens
acacccacguuguuuauuu

SEQ ID NO: 313311 - RNA, 19 nt, Homo sapiens
gcucugggcucaccauaca

SEQ ID NO: 313312 - RNA, 19 nt, Homo sapiens
gcagaucugggcuuucuaa

SEQ ID NO: 313313 - RNA, 19 nt, Homo sapiens
ugauaucacuucacccaaa

SEQ ID NO: 313314 - RNA, 19 nt, Homo sapiens
ccaaauauauaaccgugau

SEQ ID NO: 313315 - RNA, 19 nt, Homo sapiens
ccacuugaguucucucuuc

SEQ ID NO: 313316 - RNA, 19 nt, Homo sapiens
gaccggaaaggguuaauuu

SEQ ID NO: 313317 - RNA, 19 nt, Homo sapiens
ggcaggagccaaacaauga

SEQ ID NO: 313318 - RNA, 19 nt, Homo sapiens
gaaauccuggagaauagua

SEQ ID NO: 313319 - RNA, 19 nt, Homo sapiens
gauaucacuucacccaaau

SEQ ID NO: 313320 - RNA, 19 nt, Homo sapiens
gagaaagagaauagaauga

SEQ ID NO: 313321 - RNA, 19 nt, Homo sapiens
ggagcaaagugucuuaacu

SEQ ID NO: 313322 - RNA, 19 nt, Homo sapiens
cuaaaacgcuccacuuuga

SEQ ID NO: 313323 - RNA, 19 nt, Homo sapiens
ucaguucccuuccacuuga

SEQ ID NO: 313324 - RNA, 19 nt, Homo sapiens
gagcaugaacacccacuuu

SEQ ID NO: 313325 - RNA, 19 nt, Homo sapiens
aaagugcagucuucuguau

SEQ ID NO: 313326 - RNA, 19 nt, Homo sapiens
cauaauaagacaagaguug

SEQ ID NO: 313327 - RNA, 19 nt, Homo sapiens
gcugcuguauguccaagua

SEQ ID NO: 313328 - RNA, 19 nt, Homo sapiens
aggcaauccuguaaucuuu

SEQ ID NO: 313329 - RNA, 19 nt, Homo sapiens
gguaaucaguacugcauag

SEQ ID NO: 313330 - RNA, 19 nt, Homo sapiens
uaaagcaagugaccugaag

SEQ ID NO: 313331 - RNA, 19 nt, Homo sapiens
uaguaguucuggaauauug

SEQ ID NO: 313332 - RNA, 19 nt, Homo sapiens
aaauggaaauccuggagaa

SEQ ID NO: 313333 - RNA, 19 nt, Homo sapiens
gcacaacggcgcucuggau

SEQ ID NO: 313334 - RNA, 19 nt, Homo sapiens
gcagcaugguguguucuuu

SEQ ID NO: 313335 - RNA, 19 nt, Homo sapiens
guaaagugcagucuucugu

SEQ ID NO: 313336 - RNA, 19 nt, Homo sapiens
guccaaguauuguuauuuc

SEQ ID NO: 313337 - RNA, 19 nt, Homo sapiens
gcgcagauccagcuacaga

SEQ ID NO: 313338 - RNA, 19 nt, Homo sapiens
uauguaaagugcagucuuc

SEQ ID NO: 313339 - RNA, 19 nt, Homo sapiens
ggaagacugugacaauagc

SEQ ID NO: 313340 - RNA, 19 nt, Homo sapiens
gaaaugcuugguuggaaga

SEQ ID NO: 313341 - RNA, 19 nt, Homo sapiens
agacaggaaguaacugaua

SEQ ID NO: 313342 - RNA, 19 nt, Homo sapiens
guauguccaaguauuguua

SEQ ID NO: 313343 - RNA, 19 nt, Homo sapiens
gcagcagcaugguguguuc

SEQ ID NO: 313344 - RNA, 19 nt, Homo sapiens
gggaaggaguuggaauguu

SEQ ID NO: 313345 - RNA, 19 nt, Homo sapiens
ggugaaaguccaauuguca

SEQ ID NO: 313346 - RNA, 19 nt, Homo sapiens
cacaguauguuaccagugu

SEQ ID NO: 313347 - RNA, 19 nt, Homo sapiens
gcugaaggguggcaagaag

SEQ ID NO: 313348 - RNA, 19 nt, Homo sapiens
caacgugaccuucaacaag

SEQ ID NO: 313349 - RNA, 19 nt, Homo sapiens
gcaccucggccaguaaauu

SEQ ID NO: 313350 - RNA, 19 nt, Homo sapiens
gcagcugccucauuaugca

SEQ ID NO: 313351 - RNA, 19 nt, Homo sapiens
gagaauagaaugaaaugac

SEQ ID NO: 313352 - RNA, 19 nt, Homo sapiens
ggcggucccugcauucuga

SEQ ID NO: 313353 - RNA, 19 nt, Homo sapiens
guuaggcaauccuguaauc

SEQ ID NO: 313354 - RNA, 19 nt, Homo sapiens
gcagguggcaugaauugau

SEQ ID NO: 313355 - RNA, 19 nt, Homo sapiens
gaagggagaggagcuuuca

SEQ ID NO: 313356 - RNA, 19 nt, Homo sapiens
ccucagaguuugcagaucu

SEQ ID NO: 313357 - RNA, 19 nt, Homo sapiens
uggaaauccuggagaauag

SEQ ID NO: 313358 - RNA, 19 nt, Homo sapiens
guacaugcccgcugacaag

SEQ ID NO: 313359 - RNA, 19 nt, Homo sapiens
ggaaagaaaacgaaaaugu

SEQ ID NO: 313360 - RNA, 19 nt, Homo sapiens
ggcaucaugucuaacucua

SEQ ID NO: 313361 - RNA, 19 nt, Homo sapiens
agaggaaacugagccagaa

SEQ ID NO: 313362 - RNA, 19 nt, Homo sapiens
aucaacacuuugccaauua

SEQ ID NO: 313363 - RNA, 19 nt, Homo sapiens
ccgugaugguuaucuauuu

SEQ ID NO: 313364 - RNA, 19 nt, Homo sapiens
gaaaguccaauugucauca

SEQ ID NO: 313365 - RNA, 19 nt, Homo sapiens
guaccugcuuaguggcaua

SEQ ID NO: 313366 - RNA, 19 nt, Homo sapiens
gcacgagcuacgccaauga

SEQ ID NO: 313367 - RNA, 19 nt, Homo sapiens
caagagagcgcgugguucu

SEQ ID NO: 313368 - RNA, 19 nt, Homo sapiens
caugguguguucuuugaga

SEQ ID NO: 313369 - RNA, 19 nt, Homo sapiens
uuccugagcaguuaaauaa

SEQ ID NO: 313370 - RNA, 19 nt, Homo sapiens
gcaguguacagcuguuuga

SEQ ID NO: 313371 - RNA, 19 nt, Homo sapiens
gcccuaacuugaaugacaa

SEQ ID NO: 313372 - RNA, 19 nt, Homo sapiens
cgaccucccugcaaacaag

SEQ ID NO: 313373 - RNA, 19 nt, Homo sapiens
ucgacucgcuggaauacaa

SEQ ID NO: 313374 - RNA, 19 nt, Homo sapiens
uaaagugcagucuucugua

SEQ ID NO: 313375 - RNA, 19 nt, Homo sapiens
uuggaagacugugacaaua

SEQ ID NO: 313376 - RNA, 19 nt, Homo sapiens
aaucaguacugcauagcaa

SEQ ID NO: 313377 - RNA, 19 nt, Homo sapiens
ugggagaguugaccguauu

SEQ ID NO: 313378 - RNA, 19 nt, Homo sapiens
gcuagaggacagagaaaga

SEQ ID NO: 313379 - RNA, 19 nt, Homo sapiens
aacgugaccuucaacaaga

SEQ ID NO: 313380 - RNA, 19 nt, Homo sapiens
gacaguaguucgccaaacg

SEQ ID NO: 313381 - RNA, 19 nt, Homo sapiens
ccagaaugaaacagcuuua

SEQ ID NO: 313382 - RNA, 19 nt, Homo sapiens
caaucggacuugagaaggu

SEQ ID NO: 313383 - RNA, 19 nt, Homo sapiens
gguaaucuuggcauacauu

SEQ ID NO: 313384 - RNA, 19 nt, Homo sapiens
ucgcugggcuccuucaaca

SEQ ID NO: 313385 - RNA, 19 nt, Homo sapiens
ggaagaagcuuuagaagug

SEQ ID NO: 313386 - RNA, 19 nt, Homo sapiens
aagaagcucuguaugaaua

SEQ ID NO: 313387 - RNA, 19 nt, Homo sapiens
ggaagaaguggaagaaauu

SEQ ID NO: 313388 - RNA, 19 nt, Homo sapiens
ugaagaagcucuguaugaa

SEQ ID NO: 313389 - RNA, 19 nt, Homo sapiens
uagcagcuguguuaaagua

SEQ ID NO: 313390 - RNA, 19 nt, Homo sapiens
uagaugagcuggagaguuc

SEQ ID NO: 313391 - RNA, 19 nt, Homo sapiens
caaaaugggucaacauauu

SEQ ID NO: 313392 - RNA, 19 nt, Homo sapiens
cagaggauuugacacgaua

SEQ ID NO: 313393 - RNA, 19 nt, Homo sapiens
uaggaagacuuggguauuu

SEQ ID NO: 313394 - RNA, 19 nt, Homo sapiens
ggaccuugcuggaggcuau

SEQ ID NO: 313395 - RNA, 19 nt, Homo sapiens
gagaaacccaaaccuguaa

SEQ ID NO: 313396 - RNA, 19 nt, Homo sapiens
gcagcuguguuaaaguauu

SEQ ID NO: 313397 - RNA, 19 nt, Homo sapiens
caacacaguccuuccacua

SEQ ID NO: 313398 - RNA, 19 nt, Homo sapiens
gcagcccaguuaaccauuu

SEQ ID NO: 313399 - RNA, 19 nt, Homo sapiens
gaaguggaagaaauuguuu

SEQ ID NO: 313400 - RNA, 19 nt, Homo sapiens
ggaagacuuggguauuuaa

SEQ ID NO: 313401 - RNA, 19 nt, Homo sapiens
gaccaacaauguggauuug

SEQ ID NO: 313402 - RNA, 19 nt, Homo sapiens
gaagaagcucuguaugaau

SEQ ID NO: 313403 - RNA, 19 nt, Homo sapiens
gaaguggaacgacaggaaa

SEQ ID NO: 313404 - RNA, 19 nt, Homo sapiens
cagcuguguuaaaguauuu

SEQ ID NO: 313405 - RNA, 19 nt, Homo sapiens
cagcccaguuaaccauuua

SEQ ID NO: 313406 - RNA, 19 nt, Homo sapiens
uggaagaaguggaagaaau

SEQ ID NO: 313407 - RNA, 19 nt, Homo sapiens
gcagauagagacauaugga

SEQ ID NO: 313408 - RNA, 19 nt, Homo sapiens
gcuggaaacugcccugagu

SEQ ID NO: 313409 - RNA, 19 nt, Homo sapiens
ucacagagcacuacaggau

SEQ ID NO: 313410 - RNA, 19 nt, Homo sapiens
aggaagacuuggguauuua

SEQ ID NO: 313411 - RNA, 19 nt, Homo sapiens
gaaccagggagcuagcaaa

SEQ ID NO: 313412 - RNA, 19 nt, Homo sapiens
ugagaaacccaaaccugua

SEQ ID NO: 313413 - RNA, 19 nt, Homo sapiens
gcuggaggcuauacuucuu

SEQ ID NO: 313414 - RNA, 19 nt, Homo sapiens
gaagaaguggaagaaauug

SEQ ID NO: 313415 - RNA, 19 nt, Homo sapiens
guagauuuacuguuuguga

SEQ ID NO: 313416 - RNA, 19 nt, Homo sapiens
gaagacuuggguauuuaaa

SEQ ID NO: 313417 - RNA, 19 nt, Homo sapiens
gguugugacagacuuauaa

SEQ ID NO: 313418 - RNA, 19 nt, Homo sapiens
ggcuauacuucuucucuug

SEQ ID NO: 313419 - RNA, 19 nt, Homo sapiens
guauuuaaaccaugucaga

SEQ ID NO: 313420 - RNA, 19 nt, Homo sapiens
ugaagcugauggugaaugu

SEQ ID NO: 313421 - RNA, 19 nt, Homo sapiens
ugugaaaguuguguagauu

SEQ ID NO: 313422 - RNA, 19 nt, Homo sapiens
caacuugaccaacaaugug

SEQ ID NO: 313423 - RNA, 19 nt, Homo sapiens
gagaugcuaggaagacuug

SEQ ID NO: 313424 - RNA, 19 nt, Homo sapiens
cuucuucucuugcuuguca

SEQ ID NO: 313425 - RNA, 19 nt, Homo sapiens
ugaccaacaauguggauuu

SEQ ID NO: 313426 - RNA, 19 nt, Homo sapiens
gaagaucccacuguugaca

SEQ ID NO: 313427 - RNA, 19 nt, Homo sapiens
uugaagaagcucuguauga

SEQ ID NO: 313428 - RNA, 19 nt, Homo sapiens
agaaaugcaacuugagaaa

SEQ ID NO: 313429 - RNA, 19 nt, Homo sapiens
ggagggaaaccgccaugga

SEQ ID NO: 313430 - RNA, 19 nt, Homo sapiens
ggagauauaccaaaaggaa

SEQ ID NO: 313431 - RNA, 19 nt, Homo sapiens
gaagaagauuuuccuaguc

SEQ ID NO: 313432 - RNA, 19 nt, Homo sapiens
ccaguuaaccauuuauaag

SEQ ID NO: 313433 - RNA, 19 nt, Homo sapiens
acaaggagguugagaucag

SEQ ID NO: 313434 - RNA, 19 nt, Homo sapiens
aaaccgccauggacgauca

SEQ ID NO: 313435 - RNA, 19 nt, Homo sapiens
guacuccacucagaaagag

SEQ ID NO: 313436 - RNA, 19 nt, Homo sapiens
uccacuagcagcuguguua

SEQ ID NO: 313437 - RNA, 19 nt, Homo sapiens
gcacaacacaguccuucca

SEQ ID NO: 313438 - RNA, 19 nt, Homo sapiens
cacugcagauagagacaua

SEQ ID NO: 313439 - RNA, 19 nt, Homo sapiens
agaacuggaagaagcuuua

SEQ ID NO: 313440 - RNA, 19 nt, Homo sapiens
uguuugagguugugacaga

SEQ ID NO: 313441 - RNA, 19 nt, Homo sapiens
gugaaaguuguguagauuu

SEQ ID NO: 313442 - RNA, 19 nt, Homo sapiens
cacgauaagccucaucuga

SEQ ID NO: 313443 - RNA, 19 nt, Homo sapiens
gaaaugcaacuugagaaac

SEQ ID NO: 313444 - RNA, 19 nt, Homo sapiens
gagcuugagaugcuaggaa

SEQ ID NO: 313445 - RNA, 19 nt, Homo sapiens
caauuagaaaugcaacuug

SEQ ID NO: 313446 - RNA, 19 nt, Homo sapiens
uugaagaucccacuguuga

SEQ ID NO: 313447 - RNA, 19 nt, Homo sapiens
ucagaggauuugacacgau

SEQ ID NO: 313448 - RNA, 19 nt, Homo sapiens
gcccaguuaaccauuuaua

SEQ ID NO: 313449 - RNA, 19 nt, Homo sapiens
gcuaggaagacuuggguau

SEQ ID NO: 313450 - RNA, 19 nt, Homo sapiens
gaaaauggagauauaccaa

SEQ ID NO: 313451 - RNA, 19 nt, Homo sapiens
guaagaccaccaaauaucg

SEQ ID NO: 313452 - RNA, 19 nt, Homo sapiens
agaaguggaagaaauuguu

SEQ ID NO: 313453 - RNA, 19 nt, Homo sapiens
gaagauuuuccuagucuaa

SEQ ID NO: 313454 - RNA, 19 nt, Homo sapiens
ugacaaggagguugagauc

SEQ ID NO: 313455 - RNA, 19 nt, Homo sapiens
ccaauuagaaaugcaacuu

SEQ ID NO: 313456 - RNA, 19 nt, Homo sapiens
acaggaaaaugaacaaaga

SEQ ID NO: 313457 - RNA, 19 nt, Homo sapiens
gguacuccacucagaaaga

SEQ ID NO: 313458 - RNA, 19 nt, Homo sapiens
acuagcagcuguguuaaag

SEQ ID NO: 313459 - RNA, 19 nt, Homo sapiens
uguaagaccaccaaauauc

SEQ ID NO: 313460 - RNA, 19 nt, Homo sapiens
gagcacuacaggaugcauu

SEQ ID NO: 313461 - RNA, 19 nt, Homo sapiens
ggaaaccgccauggacgau

SEQ ID NO: 313462 - RNA, 19 nt, Homo sapiens
guguaagaccaccaaauau

SEQ ID NO: 313463 - RNA, 19 nt, Homo sapiens
agagacauauggaccacau

SEQ ID NO: 313464 - RNA, 19 nt, Homo sapiens
uuagaaaugcaacuugaga

SEQ ID NO: 313465 - RNA, 19 nt, Homo sapiens
guguagauuuacuguuugu

SEQ ID NO: 313466 - RNA, 19 nt, Homo sapiens
auauuucacuggcaccuau

SEQ ID NO: 313467 - RNA, 19 nt, Homo sapiens
ggaaaaugaacaaagaaga

SEQ ID NO: 313468 - RNA, 19 nt, Homo sapiens
uagaaaugcaacuugagaa

SEQ ID NO: 313469 - RNA, 19 nt, Homo sapiens
gaacuggaagaagcuuuag

SEQ ID NO: 313470 - RNA, 19 nt, Homo sapiens
aaagcugacucgagaacag

SEQ ID NO: 313471 - RNA, 19 nt, Homo sapiens
caauguggauuuggacaac

SEQ ID NO: 313472 - RNA, 19 nt, Homo sapiens
uauauguguuugagguugu

SEQ ID NO: 313473 - RNA, 19 nt, Homo sapiens
ggggauauauauuugugaa

SEQ ID NO: 313474 - RNA, 19 nt, Homo sapiens
cccaguuaaccauuuauaa

SEQ ID NO: 313475 - RNA, 19 nt, Homo sapiens
uggaagaagcuuuagaagu

SEQ ID NO: 313476 - RNA, 19 nt, Homo sapiens
ggaagaacuggaagaagcu

SEQ ID NO: 313477 - RNA, 19 nt, Homo sapiens
gaggcuauacuucuucucu

SEQ ID NO: 313478 - RNA, 19 nt, Homo sapiens
cuaggaagacuuggguauu

SEQ ID NO: 313479 - RNA, 19 nt, Homo sapiens
gcaacuugagaaacccaaa

SEQ ID NO: 313480 - RNA, 19 nt, Homo sapiens
agaaguggaacgacaggaa

SEQ ID NO: 313481 - RNA, 19 nt, Homo sapiens
cuuugaagaucccacuguu

SEQ ID NO: 313482 - RNA, 19 nt, Homo sapiens
aaaugcaacuugagaaacc

SEQ ID NO: 313483 - RNA, 19 nt, Homo sapiens
gaagaacuggaagaagcuu

SEQ ID NO: 313484 - RNA, 19 nt, Homo sapiens
ggagguugagaucaggaaa

SEQ ID NO: 313485 - RNA, 19 nt, Homo sapiens
caacagcgccauuuaaaua

SEQ ID NO: 313486 - RNA, 19 nt, Homo sapiens
ggaauaaggugucccaaga

SEQ ID NO: 313487 - RNA, 19 nt, Homo sapiens
uaauagaacuugccaaaga

SEQ ID NO: 313488 - RNA, 19 nt, Homo sapiens
caucagaaauggugaauga

SEQ ID NO: 313489 - RNA, 19 nt, Homo sapiens
gcaagcaucuggaacaaug

SEQ ID NO: 313490 - RNA, 19 nt, Homo sapiens
gaaaggagauaaacuucga

SEQ ID NO: 313491 - RNA, 19 nt, Homo sapiens
cagaaauggugaaugaaua

SEQ ID NO: 313492 - RNA, 19 nt, Homo sapiens
ggaagaaggucauuaccau

SEQ ID NO: 313493 - RNA, 19 nt, Homo sapiens
ccaguaagacucaauauuu

SEQ ID NO: 313494 - RNA, 19 nt, Homo sapiens
acaaacaacuuccgcuuaa

SEQ ID NO: 313495 - RNA, 19 nt, Homo sapiens
aaagauaugccaucacuua

SEQ ID NO: 313496 - RNA, 19 nt, Homo sapiens
gacagugacuccaggauuu

SEQ ID NO: 313497 - RNA, 19 nt, Homo sapiens
gaaggaccaaugaauguua

SEQ ID NO: 313498 - RNA, 19 nt, Homo sapiens
uaugaaagcugaaaugcaa

SEQ ID NO: 313499 - RNA, 19 nt, Homo sapiens
gaagaaauguuccccaaaa

SEQ ID NO: 313500 - RNA, 19 nt, Homo sapiens
gaagaagcauccauuaagg

SEQ ID NO: 313501 - RNA, 19 nt, Homo sapiens
gcagguggaugcaagaaga

SEQ ID NO: 313502 - RNA, 19 nt, Homo sapiens
gaaaggauuugagcucaug

SEQ ID NO: 313503 - RNA, 19 nt, Homo sapiens
ggaaauaaaggaagcauca

SEQ ID NO: 313504 - RNA, 19 nt, Homo sapiens
gaagaaggucauuaccaua

SEQ ID NO: 313505 - RNA, 19 nt, Homo sapiens
ggaagaagcauccauuaag

SEQ ID NO: 313506 - RNA, 19 nt, Homo sapiens
guaaaggaguaauggaaau

SEQ ID NO: 313507 - RNA, 19 nt, Homo sapiens
gaaagcaacagcgccauuu

SEQ ID NO: 313508 - RNA, 19 nt, Homo sapiens
gaggaauacaacagaauua

SEQ ID NO: 313509 - RNA, 19 nt, Homo sapiens
caagaggaauacaacagaa

SEQ ID NO: 313510 - RNA, 19 nt, Homo sapiens
gagauaaacuucgacucuu

SEQ ID NO: 313511 - RNA, 19 nt, Homo sapiens
caagaucagucaacuuuac

SEQ ID NO: 313512 - RNA, 19 nt, Homo sapiens
gaaaugcaacaaacaacuu

SEQ ID NO: 313513 - RNA, 19 nt, Homo sapiens
gcaguuuaaucucuccaaa

SEQ ID NO: 313514 - RNA, 19 nt, Homo sapiens
ccaaagauaugccaucacu

SEQ ID NO: 313515 - RNA, 19 nt, Homo sapiens
gauuacagauuugauggaa

SEQ ID NO: 313516 - RNA, 19 nt, Homo sapiens
gcaagaggaauacaacaga

SEQ ID NO: 313517 - RNA, 19 nt, Homo sapiens
ugaagacuauuguggaaga

SEQ ID NO: 313518 - RNA, 19 nt, Homo sapiens
ccaaacagaauuaucgaaa

SEQ ID NO: 313519 - RNA, 19 nt, Homo sapiens
uaccauaucugauuacucu

SEQ ID NO: 313520 - RNA, 19 nt, Homo sapiens
caguaagacucaauauuuc

SEQ ID NO: 313521 - RNA, 19 nt, Homo sapiens
caggauuucugaagacuau

SEQ ID NO: 313522 - RNA, 19 nt, Homo sapiens
caaacaacuuccgcuuaaa

SEQ ID NO: 313523 - RNA, 19 nt, Homo sapiens
ggagauaaacuucgacucu

SEQ ID NO: 313524 - RNA, 19 nt, Homo sapiens
gaaaagagaagucaaaagu

SEQ ID NO: 313525 - RNA, 19 nt, Homo sapiens
gauaugccaucacuuaaaa

SEQ ID NO: 313526 - RNA, 19 nt, Homo sapiens
gaaggucauuaccauaucu

SEQ ID NO: 313527 - RNA, 19 nt, Homo sapiens
gcuauaacaucagaaaugg

SEQ ID NO: 313528 - RNA, 19 nt, Homo sapiens
ccauuaaggccaagcuaua

SEQ ID NO: 313529 - RNA, 19 nt, Homo sapiens
guguauggguuguuuaugu

SEQ ID NO: 313530 - RNA, 19 nt, Homo sapiens
ucagucaacuuuacaagca

SEQ ID NO: 313531 - RNA, 19 nt, Homo sapiens
gaaagagaaauuuguaagg

SEQ ID NO: 313532 - RNA, 19 nt, Homo sapiens
gaagcaagagggaggauuc

SEQ ID NO: 313533 - RNA, 19 nt, Homo sapiens
ucucagcccuuuacaagau

SEQ ID NO: 313534 - RNA, 19 nt, Homo sapiens
gugaaagucuucgacauca

SEQ ID NO: 313535 - RNA, 19 nt, Homo sapiens
ugagaaaggagauaaacuu

SEQ ID NO: 313536 - RNA, 19 nt, Homo sapiens
gugauucuguccuaaacaa

SEQ ID NO: 313537 - RNA, 19 nt, Homo sapiens
guaaggaagaaggucauua

SEQ ID NO: 313538 - RNA, 19 nt, Homo sapiens
gagaaaggagauaaacuuc

SEQ ID NO: 313539 - RNA, 19 nt, Homo sapiens
gcaacagcgccauuuaaau

SEQ ID NO: 313540 - RNA, 19 nt, Homo sapiens
aaagagaagucaaaaguug

SEQ ID NO: 313541 - RNA, 19 nt, Homo sapiens
cuuacuggccuaugauuua

SEQ ID NO: 313542 - RNA, 19 nt, Homo sapiens
gaagacuauuguggaagaa

SEQ ID NO: 313543 - RNA, 19 nt, Homo sapiens
caaggaaggaccaaugaau

SEQ ID NO: 313544 - RNA, 19 nt, Homo sapiens
cccaagaucagucaacuuu

SEQ ID NO: 313545 - RNA, 19 nt, Homo sapiens
cuuguuagcuuucauuucu

SEQ ID NO: 313546 - RNA, 19 nt, Homo sapiens
gccaagcuauaacaucaga

SEQ ID NO: 313547 - RNA, 19 nt, Homo sapiens
uagauuaguuugcuuucug

SEQ ID NO: 313548 - RNA, 19 nt, Homo sapiens
cacaagaagaacacaauuu

SEQ ID NO: 313549 - RNA, 19 nt, Homo sapiens
aaacugacaucggaagcaa

SEQ ID NO: 313550 - RNA, 19 nt, Homo sapiens
caagcuauaacaucagaaa

SEQ ID NO: 313551 - RNA, 19 nt, Homo sapiens
aaacaaggaaggaccaaug

SEQ ID NO: 313552 - RNA, 19 nt, Homo sapiens
caauaucaagugugagaaa

SEQ ID NO: 313553 - RNA, 19 nt, Homo sapiens
gcaagaaacaaacugacau

SEQ ID NO: 313554 - RNA, 19 nt, Homo sapiens
ggaaggaccaaugaauguu

SEQ ID NO: 313555 - RNA, 19 nt, Homo sapiens
aaagcaacagcgccauuua

SEQ ID NO: 313556 - RNA, 19 nt, Homo sapiens
ggucaucaaggccaagaaa

SEQ ID NO: 313557 - RNA, 19 nt, Homo sapiens
uuuaaucucuccaaagcuu

SEQ ID NO: 313558 - RNA, 19 nt, Homo sapiens
gcugaaaugcaacaaacaa

SEQ ID NO: 313559 - RNA, 19 nt, Homo sapiens
ggaccaaugaauguuaauu

SEQ ID NO: 313560 - RNA, 19 nt, Homo sapiens
agauaaacuucgacucuuc

SEQ ID NO: 313561 - RNA, 19 nt, Homo sapiens
uaucaagugugagaaagga

SEQ ID NO: 313562 - RNA, 19 nt, Homo sapiens
caagcaagcaucuggaaca

SEQ ID NO: 313563 - RNA, 19 nt, Homo sapiens
ccaagaucagucaacuuua

SEQ ID NO: 313564 - RNA, 19 nt, Homo sapiens
gucauuaccauaucugauu

SEQ ID NO: 313565 - RNA, 19 nt, Homo sapiens
gaugcaagaagaaauguuc

SEQ ID NO: 313566 - RNA, 19 nt, Homo sapiens
ggaauacaacagaauuaag

SEQ ID NO: 313567 - RNA, 19 nt, Homo sapiens
aaggaccaaugaauguuaa

SEQ ID NO: 313568 - RNA, 19 nt, Homo sapiens
ucugaagacuauuguggaa

SEQ ID NO: 313569 - RNA, 19 nt, Homo sapiens
guauggguuguuuauguua

SEQ ID NO: 313570 - RNA, 19 nt, Homo sapiens
uguauggguuguuuauguu

SEQ ID NO: 313571 - RNA, 19 nt, Homo sapiens
agaaaagacugaagccaaa

SEQ ID NO: 313572 - RNA, 19 nt, Homo sapiens
aauagaacuugccaaagau

SEQ ID NO: 313573 - RNA, 19 nt, Homo sapiens
cauuaaggccaagcuauaa

SEQ ID NO: 313574 - RNA, 19 nt, Homo sapiens
uaguuugcuuucuggaaua

SEQ ID NO: 313575 - RNA, 19 nt, Homo sapiens
gcaaauaaaacucccaaga

SEQ ID NO: 313576 - RNA, 19 nt, Homo sapiens
gaggucccaaacagaauua

SEQ ID NO: 313577 - RNA, 19 nt, Homo sapiens
aagcaacagcgccauuuaa

SEQ ID NO: 313578 - RNA, 19 nt, Homo sapiens
ggugaaugaauacaagaaa

SEQ ID NO: 313579 - RNA, 19 nt, Homo sapiens
uuaguuugcuuucuggaau

SEQ ID NO: 313580 - RNA, 19 nt, Homo sapiens
uaaucucuccaaagcuuua

SEQ ID NO: 313581 - RNA, 19 nt, Homo sapiens
gaaagucuucgacaucaac

SEQ ID NO: 313582 - RNA, 19 nt, Homo sapiens
gcucuaacaagugccauuu

SEQ ID NO: 313583 - RNA, 19 nt, Homo sapiens
aggccaagcuauaacauca

SEQ ID NO: 313584 - RNA, 19 nt, Homo sapiens
gcacccaccgcaagaaaca

SEQ ID NO: 313585 - RNA, 19 nt, Homo sapiens
gcaaaggucuugaauagau

SEQ ID NO: 313586 - RNA, 19 nt, Homo sapiens
ggacagagcugaggauuuc

SEQ ID NO: 313587 - RNA, 19 nt, Homo sapiens
gcacacaucuuaccucuca

SEQ ID NO: 313588 - RNA, 19 nt, Homo sapiens
gaaauaaaccugcacugaa

SEQ ID NO: 313589 - RNA, 19 nt, Homo sapiens
cagcaaaggucuugaauag

SEQ ID NO: 313590 - RNA, 19 nt, Homo sapiens
ggaaggagaaggaauauga

SEQ ID NO: 313591 - RNA, 19 nt, Homo sapiens
aaauaaaccugcacugaaa

SEQ ID NO: 313592 - RNA, 19 nt, Homo sapiens
gaacagagggccagagcua

SEQ ID NO: 313593 - RNA, 19 nt, Homo sapiens
gggaaugccuggaggguaa

SEQ ID NO: 313594 - RNA, 19 nt, Homo sapiens
gaaaucuagugccgaauga

SEQ ID NO: 313595 - RNA, 19 nt, Homo sapiens
gagcacaggugacagauca

SEQ ID NO: 313596 - RNA, 19 nt, Homo sapiens
gaaugacuauguccagauu

SEQ ID NO: 313597 - RNA, 19 nt, Homo sapiens
gaaggaauaugagcaugaa

SEQ ID NO: 313598 - RNA, 19 nt, Homo sapiens
gaacaucugcuguguggaa

SEQ ID NO: 313599 - RNA, 19 nt, Homo sapiens
gcacuugccuggaauaaaa

SEQ ID NO: 313600 - RNA, 19 nt, Homo sapiens
ccagagaaguccacaacaa

SEQ ID NO: 313601 - RNA, 19 nt, Homo sapiens
gaacagaagaaggccaaua

SEQ ID NO: 313602 - RNA, 19 nt, Homo sapiens
gcucccagcugcccuugua

SEQ ID NO: 313603 - RNA, 19 nt, Homo sapiens
gcacagauaccucaucauc

SEQ ID NO: 313604 - RNA, 19 nt, Homo sapiens
caacguggaugacaagaag

SEQ ID NO: 313605 - RNA, 19 nt, Homo sapiens
aagaagacguccaaucuga

SEQ ID NO: 313606 - RNA, 19 nt, Homo sapiens
gcgagacucugauggaaug

SEQ ID NO: 313607 - RNA, 19 nt, Homo sapiens
caaaggucuugaauagauu

SEQ ID NO: 313608 - RNA, 19 nt, Homo sapiens
gagaaguccacaacaaauu

SEQ ID NO: 313609 - RNA, 19 nt, Homo sapiens
gaagucaaauccagugaac

SEQ ID NO: 313610 - RNA, 19 nt, Homo sapiens
aauaagcacuugccuggaa

SEQ ID NO: 313611 - RNA, 19 nt, Homo sapiens
gcuuuggccuuuccuugua

SEQ ID NO: 313612 - RNA, 19 nt, Homo sapiens
cuauugaacuguauucuag

SEQ ID NO: 313613 - RNA, 19 nt, Homo sapiens
gcacaggugacagaucaua

SEQ ID NO: 313614 - RNA, 19 nt, Homo sapiens
gcacuaggacuugguaaga

SEQ ID NO: 313615 - RNA, 19 nt, Homo sapiens
gaaguuggcaccagcugaa

SEQ ID NO: 313616 - RNA, 19 nt, Homo sapiens
ggagagagcccuuuugcua

SEQ ID NO: 313617 - RNA, 19 nt, Homo sapiens
ggaauaugagcaugaaaug

SEQ ID NO: 313618 - RNA, 19 nt, Homo sapiens
gcauagaagccacaucguu

SEQ ID NO: 313619 - RNA, 19 nt, Homo sapiens
gcaaaucuagugccgaaau

SEQ ID NO: 313620 - RNA, 19 nt, Homo sapiens
ggaaauaaagaauccuuag

SEQ ID NO: 313621 - RNA, 19 nt, Homo sapiens
cagcagcaccuuucucuga

SEQ ID NO: 313622 - RNA, 19 nt, Homo sapiens
guaagaugacucugagaaa

SEQ ID NO: 313623 - RNA, 19 nt, Homo sapiens
gacgauggguguugcuguu

SEQ ID NO: 313624 - RNA, 19 nt, Homo sapiens
gaauagauuuucucuggaa

SEQ ID NO: 313625 - RNA, 19 nt, Homo sapiens
ccaguggccuucaguguag

SEQ ID NO: 313626 - RNA, 19 nt, Homo sapiens
acaacaaauuggagaagaa

SEQ ID NO: 313627 - RNA, 19 nt, Homo sapiens
aaagaauccuuagauccua

SEQ ID NO: 313628 - RNA, 19 nt, Homo sapiens
ccacaucguugagacauca

SEQ ID NO: 313629 - RNA, 19 nt, Homo sapiens
ugaaauaaaccugcacuga

SEQ ID NO: 313630 - RNA, 19 nt, Homo sapiens
gcaagcacaucgcccacau

SEQ ID NO: 313631 - RNA, 19 nt, Homo sapiens
caggagggcccaucugaaa

SEQ ID NO: 313632 - RNA, 19 nt, Homo sapiens
gaccaacccugggaccuau

SEQ ID NO: 313633 - RNA, 19 nt, Homo sapiens
gguaagaugacucugagaa

SEQ ID NO: 313634 - RNA, 19 nt, Homo sapiens
ggagggcccaucugaaaga

SEQ ID NO: 313635 - RNA, 19 nt, Homo sapiens
cagagaaguccacaacaaa

SEQ ID NO: 313636 - RNA, 19 nt, Homo sapiens
caaauccagugaacagaag

SEQ ID NO: 313637 - RNA, 19 nt, Homo sapiens
guauguggguguuuauuac

SEQ ID NO: 313638 - RNA, 19 nt, Homo sapiens
agaggaaggagaaggaaua

SEQ ID NO: 313639 - RNA, 19 nt, Homo sapiens
acagauaccucaucaucca

SEQ ID NO: 313640 - RNA, 19 nt, Homo sapiens
ccugaaauauaaacuguag

SEQ ID NO: 313641 - RNA, 19 nt, Homo sapiens
caaaucuagugccgaaauc

SEQ ID NO: 313642 - RNA, 19 nt, Homo sapiens
gcagagcagcagcaccuuu

SEQ ID NO: 313643 - RNA, 19 nt, Homo sapiens
ugagacaucaggaagguaa

SEQ ID NO: 313644 - RNA, 19 nt, Homo sapiens
gauucucuaccaacaauaa

SEQ ID NO: 313645 - RNA, 19 nt, Homo sapiens
gaucggaaccagagaaguc

SEQ ID NO: 313646 - RNA, 19 nt, Homo sapiens
guggguaaagggacaguua

SEQ ID NO: 313647 - RNA, 19 nt, Homo sapiens
ggcaccagcugaagaaguc

SEQ ID NO: 313648 - RNA, 19 nt, Homo sapiens
uguauguggguguuuauua

SEQ ID NO: 313649 - RNA, 19 nt, Homo sapiens
uaagaugacucugagaaaa

SEQ ID NO: 313650 - RNA, 19 nt, Homo sapiens
ggauggacguacuggagau

SEQ ID NO: 313651 - RNA, 19 nt, Homo sapiens
acaagaagacguccaaucu

SEQ ID NO: 313652 - RNA, 19 nt, Homo sapiens
ggacacacacacacacaca

SEQ ID NO: 313653 - RNA, 19 nt, Homo sapiens
gagagcaggaacagaagaa

SEQ ID NO: 313654 - RNA, 19 nt, Homo sapiens
ugacagaucauaggaagug

SEQ ID NO: 313655 - RNA, 19 nt, Homo sapiens
gaagaggaaggagaaggaa

SEQ ID NO: 313656 - RNA, 19 nt, Homo sapiens
guucaugcuccaagacuuu

SEQ ID NO: 313657 - RNA, 19 nt, Homo sapiens
cagagguggcccuuguuua

SEQ ID NO: 313658 - RNA, 19 nt, Homo sapiens
cccaccagcuccacacauu

SEQ ID NO: 313659 - RNA, 19 nt, Homo sapiens
aauaugagcaugaaaugga

SEQ ID NO: 313660 - RNA, 19 nt, Homo sapiens
ggagaaggaauaugagcau

SEQ ID NO: 313661 - RNA, 19 nt, Homo sapiens
cgaaaucuagugccgaaug

SEQ ID NO: 313662 - RNA, 19 nt, Homo sapiens
ucaaauccagugaacagaa

SEQ ID NO: 313663 - RNA, 19 nt, Homo sapiens
ucagcaaaggucuugaaua

SEQ ID NO: 313664 - RNA, 19 nt, Homo sapiens
gcagaacugaagccacuug

SEQ ID NO: 313665 - RNA, 19 nt, Homo sapiens
gaacaggagggcccaucug

SEQ ID NO: 313666 - RNA, 19 nt, Homo sapiens
cacaacaaauuggagaaga

SEQ ID NO: 313667 - RNA, 19 nt, Homo sapiens
ccagagguggcccuuguuu

SEQ ID NO: 313668 - RNA, 19 nt, Homo sapiens
gcacgcacacgcacacauc

SEQ ID NO: 313669 - RNA, 19 nt, Homo sapiens
ccaagaggaggucagcaaa

SEQ ID NO: 313670 - RNA, 19 nt, Homo sapiens
ccuuguauguggguguuua

SEQ ID NO: 313671 - RNA, 19 nt, Homo sapiens
ccacccugcugcacuagga

SEQ ID NO: 313672 - RNA, 19 nt, Homo sapiens
cggcuacugucauggcaaa

SEQ ID NO: 313673 - RNA, 19 nt, Homo sapiens
uaaagaauccuuagauccu

SEQ ID NO: 313674 - RNA, 19 nt, Homo sapiens
accgagacaugaauacuau

SEQ ID NO: 313675 - RNA, 19 nt, Homo sapiens
gggacagagcugaggauuu

SEQ ID NO: 313676 - RNA, 19 nt, Homo sapiens
gcuggcacgugagaagauu

SEQ ID NO: 313677 - RNA, 19 nt, Homo sapiens
caagaagacguccaaucug

SEQ ID NO: 313678 - RNA, 19 nt, Homo sapiens
gacaagaagacguccaauc

SEQ ID NO: 313679 - RNA, 19 nt, Homo sapiens
agacaugaauacuauccau

SEQ ID NO: 313680 - RNA, 19 nt, Homo sapiens
cugcacagauaccucauca

SEQ ID NO: 313681 - RNA, 19 nt, Homo sapiens
ggacuguuccuuauuucuc

SEQ ID NO: 313682 - RNA, 19 nt, Homo sapiens
ggucagcaaaggucuugaa

SEQ ID NO: 313683 - RNA, 19 nt, Homo sapiens
aaaugauucucuaccaaca

SEQ ID NO: 313684 - RNA, 19 nt, Homo sapiens
agaaguccacaacaaauug

SEQ ID NO: 313685 - RNA, 19 nt, Homo sapiens
gcaaacaccugcugaugug

SEQ ID NO: 313686 - RNA, 19 nt, Homo sapiens
cuucugaccucuauaauug

SEQ ID NO: 313687 - RNA, 19 nt, Homo sapiens
ugagagaucugcugucagu

SEQ ID NO: 313688 - RNA, 19 nt, Homo sapiens
aagaagaagugaccaagga

SEQ ID NO: 313689 - RNA, 19 nt, Homo sapiens
gauaguggaucggaaauac

SEQ ID NO: 313690 - RNA, 19 nt, Homo sapiens
ggagauaguggaucggaaa

SEQ ID NO: 313691 - RNA, 19 nt, Homo sapiens
gcuucuagguucugauuga

SEQ ID NO: 313692 - RNA, 19 nt, Homo sapiens
gaucggaaauacagcaucu

SEQ ID NO: 313693 - RNA, 19 nt, Homo sapiens
ugaccaaggaggaguuuaa

SEQ ID NO: 313694 - RNA, 19 nt, Homo sapiens
ggaguacuuugaagauguc

SEQ ID NO: 313695 - RNA, 19 nt, Homo sapiens
cagccugccuggaguacuu

SEQ ID NO: 313696 - RNA, 19 nt, Homo sapiens
caaagcuucuagguucuga

SEQ ID NO: 313697 - RNA, 19 nt, Homo sapiens
ccucuauaauugccacuga

SEQ ID NO: 313698 - RNA, 19 nt, Homo sapiens
ggcaaacaccugcugaugu

SEQ ID NO: 313699 - RNA, 19 nt, Homo sapiens
ccguucaccuuccucaauu

SEQ ID NO: 313700 - RNA, 19 nt, Homo sapiens
gaccaaggaggaguuuaaa

SEQ ID NO: 313701 - RNA, 19 nt, Homo sapiens
uggaguacuuugaagaugu

SEQ ID NO: 313702 - RNA, 19 nt, Homo sapiens
ucaccuuccucaauuccaa

SEQ ID NO: 313703 - RNA, 19 nt, Homo sapiens
uaagagcggcugcuucuac

SEQ ID NO: 313704 - RNA, 19 nt, Homo sapiens
uauaauugccacugagaga

SEQ ID NO: 313705 - RNA, 19 nt, Homo sapiens
ccaaagaagaagugaccaa

SEQ ID NO: 313706 - RNA, 19 nt, Homo sapiens
gggcaaacaccugcugaug

SEQ ID NO: 313707 - RNA, 19 nt, Homo sapiens
agaaagaggaggacuggau

SEQ ID NO: 313708 - RNA, 19 nt, Homo sapiens
gaacacuucagcauacacu

SEQ ID NO: 313709 - RNA, 19 nt, Homo sapiens
uaaacugaaugaacaaccu

SEQ ID NO: 313710 - RNA, 19 nt, Homo sapiens
gucagaaaccggccaagga

SEQ ID NO: 313711 - RNA, 19 nt, Homo sapiens
acugagagaucugcuguca

SEQ ID NO: 313712 - RNA, 19 nt, Homo sapiens
ugucuucugaccucuauaa

SEQ ID NO: 313713 - RNA, 19 nt, Homo sapiens
caagaaggagauaguggau

SEQ ID NO: 313714 - RNA, 19 nt, Homo sapiens
guuaucuggcuucaaauau

SEQ ID NO: 313715 - RNA, 19 nt, Homo sapiens
gcuccuggacucauugcuu

SEQ ID NO: 313716 - RNA, 19 nt, Homo sapiens
gagauaguggaucggaaau

SEQ ID NO: 313717 - RNA, 19 nt, Homo sapiens
ggcaacugcugaugcucau

SEQ ID NO: 313718 - RNA, 19 nt, Homo sapiens
uccgaacacuucagcauac

SEQ ID NO: 313719 - RNA, 19 nt, Homo sapiens
gccguucaccuuccucaau

SEQ ID NO: 313720 - RNA, 19 nt, Homo sapiens
cagaaguacuccgaacacu

SEQ ID NO: 313721 - RNA, 19 nt, Homo sapiens
aguuaucuggcuucaaaua

SEQ ID NO: 313722 - RNA, 19 nt, Homo sapiens
ccaaggagggucccagacu

SEQ ID NO: 313723 - RNA, 19 nt, Homo sapiens
uguaagagcggcugcuucu

SEQ ID NO: 313724 - RNA, 19 nt, Homo sapiens
gaaaggagaugcccuagug

SEQ ID NO: 313725 - RNA, 19 nt, Homo sapiens
gcaggcauguucaguauuu

SEQ ID NO: 313726 - RNA, 19 nt, Homo sapiens
ucaagaagauggucagcua

SEQ ID NO: 313727 - RNA, 19 nt, Homo sapiens
ccagauaacugagaaauca

SEQ ID NO: 313728 - RNA, 19 nt, Homo sapiens
gaggagaucaagcucauua

SEQ ID NO: 313729 - RNA, 19 nt, Homo sapiens
gcacaagcuugccugaaga

SEQ ID NO: 313730 - RNA, 19 nt, Homo sapiens
ccaaacauguggaagaguu

SEQ ID NO: 313731 - RNA, 19 nt, Homo sapiens
caacaagcaaugccagaua

SEQ ID NO: 313732 - RNA, 19 nt, Homo sapiens
gagcugggaugcaauguag

SEQ ID NO: 313733 - RNA, 19 nt, Homo sapiens
gaugugcgcuucauagagu

SEQ ID NO: 313734 - RNA, 19 nt, Homo sapiens
ccgcacagaugucagagua

SEQ ID NO: 313735 - RNA, 19 nt, Homo sapiens
caucagacuugcagccuuu

SEQ ID NO: 313736 - RNA, 19 nt, Homo sapiens
gaugaucucuaaugaccaa

SEQ ID NO: 313737 - RNA, 19 nt, Homo sapiens
uagaguauaugcccuuuga

SEQ ID NO: 313738 - RNA, 19 nt, Homo sapiens
aaacaggccugcugcuaga

SEQ ID NO: 313739 - RNA, 19 nt, Homo sapiens
gcagggacaucguguugga

SEQ ID NO: 313740 - RNA, 19 nt, Homo sapiens
gcacagccaaggccuuuaa

SEQ ID NO: 313741 - RNA, 19 nt, Homo sapiens
ccucacagcgcacaaauaa

SEQ ID NO: 313742 - RNA, 19 nt, Homo sapiens
gcaggaagccagacacaga

SEQ ID NO: 313743 - RNA, 19 nt, Homo sapiens
aagcuacgaugccaacuuu

SEQ ID NO: 313744 - RNA, 19 nt, Homo sapiens
gagcauaucagggaaagaa

SEQ ID NO: 313745 - RNA, 19 nt, Homo sapiens
cagaacaacuaacucaugu

SEQ ID NO: 313746 - RNA, 19 nt, Homo sapiens
gcacagaugucagaguaag

SEQ ID NO: 313747 - RNA, 19 nt, Homo sapiens
ucagaaggcuggucucagu

SEQ ID NO: 313748 - RNA, 19 nt, Homo sapiens
gggcagcuaugguagaugu

SEQ ID NO: 313749 - RNA, 19 nt, Homo sapiens
aagaauggaucccaacuuc

SEQ ID NO: 313750 - RNA, 19 nt, Homo sapiens
gcagaggagcccacuuuga

SEQ ID NO: 313751 - RNA, 19 nt, Homo sapiens
gaugauagauugccuucac

SEQ ID NO: 313752 - RNA, 19 nt, Homo sapiens
ccaagucugugucccauca

SEQ ID NO: 313753 - RNA, 19 nt, Homo sapiens
cagaucagcuucaucacau

SEQ ID NO: 313754 - RNA, 19 nt, Homo sapiens
agaagauggucagcuauaa

SEQ ID NO: 313755 - RNA, 19 nt, Homo sapiens
gaacuuuuccuucucauuu

SEQ ID NO: 313756 - RNA, 19 nt, Homo sapiens
aacaagcaaugccagauaa

SEQ ID NO: 313757 - RNA, 19 nt, Homo sapiens
gcagaaccagcucaagaaa

SEQ ID NO: 313758 - RNA, 19 nt, Homo sapiens
agacucagaugccaacuca

SEQ ID NO: 313759 - RNA, 19 nt, Homo sapiens
ccuuucagcuuaacaguug

SEQ ID NO: 313760 - RNA, 19 nt, Homo sapiens
gaagaauggaucccaacuu

SEQ ID NO: 313761 - RNA, 19 nt, Homo sapiens
gacgucagguuccuuuaau

SEQ ID NO: 313762 - RNA, 19 nt, Homo sapiens
gaagugcaaccucagaugu

SEQ ID NO: 313763 - RNA, 19 nt, Homo sapiens
ucacagcgcacaaauaaag

SEQ ID NO: 313764 - RNA, 19 nt, Homo sapiens
ccuggugccugccaaguuu

SEQ ID NO: 313765 - RNA, 19 nt, Homo sapiens
gaaggaaggcaucgacaag

SEQ ID NO: 313766 - RNA, 19 nt, Homo sapiens
gcacaaauaaagcuacgau

SEQ ID NO: 313767 - RNA, 19 nt, Homo sapiens
uaacugagaaaucauguuc

SEQ ID NO: 313768 - RNA, 19 nt, Homo sapiens
gauaccagcaggcccuuaa

SEQ ID NO: 313769 - RNA, 19 nt, Homo sapiens
caauguaggcugagggaaa

SEQ ID NO: 313770 - RNA, 19 nt, Homo sapiens
gcuaaccucagaacaacua

SEQ ID NO: 313771 - RNA, 19 nt, Homo sapiens
gguggccacuuuauggaaa

SEQ ID NO: 313772 - RNA, 19 nt, Homo sapiens
guuggaagcuccgcacaga

SEQ ID NO: 313773 - RNA, 19 nt, Homo sapiens
agaucaagcucauuagcaa

SEQ ID NO: 313774 - RNA, 19 nt, Homo sapiens
gaguauaugcccuuugaug

SEQ ID NO: 313775 - RNA, 19 nt, Homo sapiens
cagcagaaccagcucaaga

SEQ ID NO: 313776 - RNA, 19 nt, Homo sapiens
gaagucagccugcucuacu

SEQ ID NO: 313777 - RNA, 19 nt, Homo sapiens
agaaccagcucaagaaagg

SEQ ID NO: 313778 - RNA, 19 nt, Homo sapiens
uaaaaucccuggcuuccaa

SEQ ID NO: 313779 - RNA, 19 nt, Homo sapiens
gaauggaucccaacuucuc

SEQ ID NO: 313780 - RNA, 19 nt, Homo sapiens
aagcagaggagcccacuuu

SEQ ID NO: 313781 - RNA, 19 nt, Homo sapiens
gaagauggucagcuauaag

SEQ ID NO: 313782 - RNA, 19 nt, Homo sapiens
gcuacgaugccaacuuuga

SEQ ID NO: 313783 - RNA, 19 nt, Homo sapiens
aagcuugccugaagaaugg

SEQ ID NO: 313784 - RNA, 19 nt, Homo sapiens
ggagcugggaugcaaugua

SEQ ID NO: 313785 - RNA, 19 nt, Homo sapiens
ggacuuccaucgggcuuag

SEQ ID NO: 313786 - RNA, 19 nt, Homo sapiens
gcuauaaggagaugcuaga

SEQ ID NO: 313787 - RNA, 19 nt, Homo sapiens
uuguuuaccuugagcagua

SEQ ID NO: 313788 - RNA, 19 nt, Homo sapiens
ccagcuaaccucagaacaa

SEQ ID NO: 313789 - RNA, 19 nt, Homo sapiens
gagcugcugagaaucauug

SEQ ID NO: 313790 - RNA, 19 nt, Homo sapiens
ggccagaucagcuucauca

SEQ ID NO: 313791 - RNA, 19 nt, Homo sapiens
aagaagauggucagcuaua

SEQ ID NO: 313792 - RNA, 19 nt, Homo sapiens
caauggggcuuccuuucua

SEQ ID NO: 313793 - RNA, 19 nt, Homo sapiens
gaucucuaaugaccaaugg

SEQ ID NO: 313794 - RNA, 19 nt, Homo sapiens
ucagccugcucuacuacua

SEQ ID NO: 313795 - RNA, 19 nt, Homo sapiens
caacauugcagagcccaaa

SEQ ID NO: 313796 - RNA, 19 nt, Homo sapiens
gaaaucuucccaguagaga

SEQ ID NO: 313797 - RNA, 19 nt, Homo sapiens
ccaaccugcugaccacaga

SEQ ID NO: 313798 - RNA, 19 nt, Homo sapiens
gaugaacuccuggacuuug

SEQ ID NO: 313799 - RNA, 19 nt, Homo sapiens
cuugcagccuuucagcuua

SEQ ID NO: 313800 - RNA, 19 nt, Homo sapiens
gcucuacuacuaacaaaca

SEQ ID NO: 313801 - RNA, 19 nt, Homo sapiens
ucagguuccuuuaaucaca

SEQ ID NO: 313802 - RNA, 19 nt, Homo sapiens
ggaaggacgggcagcuaug

SEQ ID NO: 313803 - RNA, 19 nt, Homo sapiens
guauuucccagaugaagaa

SEQ ID NO: 313804 - RNA, 19 nt, Homo sapiens
ccaucgagcugggcuacaa

SEQ ID NO: 313805 - RNA, 19 nt, Homo sapiens
gcugagaaccauagguguu

SEQ ID NO: 313806 - RNA, 19 nt, Homo sapiens
gcaggcgguucuccuugug

SEQ ID NO: 313807 - RNA, 19 nt, Homo sapiens
gagaucaagcucauuagca

SEQ ID NO: 313808 - RNA, 19 nt, Homo sapiens
ccucaaggucugccucuuu

SEQ ID NO: 313809 - RNA, 19 nt, Homo sapiens
ggucagcuauaaggagaug

SEQ ID NO: 313810 - RNA, 19 nt, Homo sapiens
gaagggcugagaaccauag

SEQ ID NO: 313811 - RNA, 19 nt, Homo sapiens
uugcagagcccaaacaugu

SEQ ID NO: 313812 - RNA, 19 nt, Homo sapiens
ucagaacaacuaacucaug

SEQ ID NO: 313813 - RNA, 19 nt, Homo sapiens
cagcuaaccucagaacaac

SEQ ID NO: 313814 - RNA, 19 nt, Homo sapiens
gggacccgcuccauguuca

SEQ ID NO: 313815 - RNA, 19 nt, Homo sapiens
ggugaacuguguggugaug

SEQ ID NO: 313816 - RNA, 19 nt, Homo sapiens
caagcuugccugaagaaug

SEQ ID NO: 313817 - RNA, 19 nt, Homo sapiens
cagcagggacaucguguug

SEQ ID NO: 313818 - RNA, 19 nt, Homo sapiens
gaaggugccagaggaggaa

SEQ ID NO: 313819 - RNA, 19 nt, Homo sapiens
cagaggagcccacuuugag

SEQ ID NO: 313820 - RNA, 19 nt, Homo sapiens
caagcugauuucucaacga

SEQ ID NO: 313821 - RNA, 19 nt, Homo sapiens
agagauuaagcgcucauua

SEQ ID NO: 313822 - RNA, 19 nt, Homo sapiens
gcccaaacauguggaagag

SEQ ID NO: 313823 - RNA, 19 nt, Homo sapiens
acucagaugccaacucaaa

SEQ ID NO: 313824 - RNA, 19 nt, Homo sapiens
gaaaggagaugcccuagug

SEQ ID NO: 313825 - RNA, 19 nt, Homo sapiens
gcaggcauguucaguauuu

SEQ ID NO: 313826 - RNA, 19 nt, Homo sapiens
ucaagaagauggucagcua

SEQ ID NO: 313827 - RNA, 19 nt, Homo sapiens
ccagauaacugagaaauca

SEQ ID NO: 313828 - RNA, 19 nt, Homo sapiens
gaggagaucaagcucauua

SEQ ID NO: 313829 - RNA, 19 nt, Homo sapiens
gcacaagcuugccugaaga

SEQ ID NO: 313830 - RNA, 19 nt, Homo sapiens
ccaaacauguggaagaguu

SEQ ID NO: 313831 - RNA, 19 nt, Homo sapiens
caacaagcaaugccagaua

SEQ ID NO: 313832 - RNA, 19 nt, Homo sapiens
gagcugggaugcaauguag

SEQ ID NO: 313833 - RNA, 19 nt, Homo sapiens
gaugugcgcuucauagagu

SEQ ID NO: 313834 - RNA, 19 nt, Homo sapiens
ccgcacagaugucagagua

SEQ ID NO: 313835 - RNA, 19 nt, Homo sapiens
caucagacuugcagccuuu

SEQ ID NO: 313836 - RNA, 19 nt, Homo sapiens
gaugaucucuaaugaccaa

SEQ ID NO: 313837 - RNA, 19 nt, Homo sapiens
uagaguauaugcccuuuga

SEQ ID NO: 313838 - RNA, 19 nt, Homo sapiens
aaacaggccugcugcuaga

SEQ ID NO: 313839 - RNA, 19 nt, Homo sapiens
gcagggacaucguguugga

SEQ ID NO: 313840 - RNA, 19 nt, Homo sapiens
gcacagccaaggccuuuaa

SEQ ID NO: 313841 - RNA, 19 nt, Homo sapiens
ccucacagcgcacaaauaa

SEQ ID NO: 313842 - RNA, 19 nt, Homo sapiens
gcaggaagccagacacaga

SEQ ID NO: 313843 - RNA, 19 nt, Homo sapiens
aagcuacgaugccaacuuu

SEQ ID NO: 313844 - RNA, 19 nt, Homo sapiens
gagcauaucagggaaagaa

SEQ ID NO: 313845 - RNA, 19 nt, Homo sapiens
cagaacaacuaacucaugu

SEQ ID NO: 313846 - RNA, 19 nt, Homo sapiens
gcacagaugucagaguaag

SEQ ID NO: 313847 - RNA, 19 nt, Homo sapiens
ucagaaggcuggucucagu

SEQ ID NO: 313848 - RNA, 19 nt, Homo sapiens
gggcagcuaugguagaugu

SEQ ID NO: 313849 - RNA, 19 nt, Homo sapiens
aagaauggaucccaacuuc

SEQ ID NO: 313850 - RNA, 19 nt, Homo sapiens
gcagaggagcccacuuuga

SEQ ID NO: 313851 - RNA, 19 nt, Homo sapiens
gaugauagauugccuucac

SEQ ID NO: 313852 - RNA, 19 nt, Homo sapiens
ccaagucugugucccauca

SEQ ID NO: 313853 - RNA, 19 nt, Homo sapiens
cagaucagcuucaucacau

SEQ ID NO: 313854 - RNA, 19 nt, Homo sapiens
agaagauggucagcuauaa

SEQ ID NO: 313855 - RNA, 19 nt, Homo sapiens
gaacuuuuccuucucauuu

SEQ ID NO: 313856 - RNA, 19 nt, Homo sapiens
aacaagcaaugccagauaa

SEQ ID NO: 313857 - RNA, 19 nt, Homo sapiens
gcagaaccagcucaagaaa

SEQ ID NO: 313858 - RNA, 19 nt, Homo sapiens
agacucagaugccaacuca

SEQ ID NO: 313859 - RNA, 19 nt, Homo sapiens
ggugacccaucaaguuauu

SEQ ID NO: 313860 - RNA, 19 nt, Homo sapiens
ccuuucagcuuaacaguug

SEQ ID NO: 313861 - RNA, 19 nt, Homo sapiens
gaagaauggaucccaacuu

SEQ ID NO: 313862 - RNA, 19 nt, Homo sapiens
gacgucagguuccuuuaau

SEQ ID NO: 313863 - RNA, 19 nt, Homo sapiens
gaagugcaaccucagaugu

SEQ ID NO: 313864 - RNA, 19 nt, Homo sapiens
ucacagcgcacaaauaaag

SEQ ID NO: 313865 - RNA, 19 nt, Homo sapiens
ccuggugccugccaaguuu

SEQ ID NO: 313866 - RNA, 19 nt, Homo sapiens
gaaggaaggcaucgacaag

SEQ ID NO: 313867 - RNA, 19 nt, Homo sapiens
gcacaaauaaagcuacgau

SEQ ID NO: 313868 - RNA, 19 nt, Homo sapiens
uaacugagaaaucauguuc

SEQ ID NO: 313869 - RNA, 19 nt, Homo sapiens
gauaccagcaggcccuuaa

SEQ ID NO: 313870 - RNA, 19 nt, Homo sapiens
caauguaggcugagggaaa

SEQ ID NO: 313871 - RNA, 19 nt, Homo sapiens
gcuaaccucagaacaacua

SEQ ID NO: 313872 - RNA, 19 nt, Homo sapiens
gguggccacuuuauggaaa

SEQ ID NO: 313873 - RNA, 19 nt, Homo sapiens
guuggaagcuccgcacaga

SEQ ID NO: 313874 - RNA, 19 nt, Homo sapiens
agaucaagcucauuagcaa

SEQ ID NO: 313875 - RNA, 19 nt, Homo sapiens
gaguauaugcccuuugaug

SEQ ID NO: 313876 - RNA, 19 nt, Homo sapiens
cagcagaaccagcucaaga

SEQ ID NO: 313877 - RNA, 19 nt, Homo sapiens
gaagucagccugcucuacu

SEQ ID NO: 313878 - RNA, 19 nt, Homo sapiens
agaaccagcucaagaaagg

SEQ ID NO: 313879 - RNA, 19 nt, Homo sapiens
uaaaaucccuggcuuccaa

SEQ ID NO: 313880 - RNA, 19 nt, Homo sapiens
gaauggaucccaacuucuc

SEQ ID NO: 313881 - RNA, 19 nt, Homo sapiens
aagcagaggagcccacuuu

SEQ ID NO: 313882 - RNA, 19 nt, Homo sapiens
gaagauggucagcuauaag

SEQ ID NO: 313883 - RNA, 19 nt, Homo sapiens
gcuacgaugccaacuuuga

SEQ ID NO: 313884 - RNA, 19 nt, Homo sapiens
aagcuugccugaagaaugg

SEQ ID NO: 313885 - RNA, 19 nt, Homo sapiens
ggagcugggaugcaaugua

SEQ ID NO: 313886 - RNA, 19 nt, Homo sapiens
ggacuuccaucgggcuuag

SEQ ID NO: 313887 - RNA, 19 nt, Homo sapiens
gcuauaaggagaugcuaga

SEQ ID NO: 313888 - RNA, 19 nt, Homo sapiens
uuguuuaccuugagcagua

SEQ ID NO: 313889 - RNA, 19 nt, Homo sapiens
ccagcuaaccucagaacaa

SEQ ID NO: 313890 - RNA, 19 nt, Homo sapiens
gagcugcugagaaucauug

SEQ ID NO: 313891 - RNA, 19 nt, Homo sapiens
ggccagaucagcuucauca

SEQ ID NO: 313892 - RNA, 19 nt, Homo sapiens
aagaagauggucagcuaua

SEQ ID NO: 313893 - RNA, 19 nt, Homo sapiens
caauggggcuuccuuucua

SEQ ID NO: 313894 - RNA, 19 nt, Homo sapiens
gaucucuaaugaccaaugg

SEQ ID NO: 313895 - RNA, 19 nt, Homo sapiens
ucagccugcucuacuacua

SEQ ID NO: 313896 - RNA, 19 nt, Homo sapiens
caacauugcagagcccaaa

SEQ ID NO: 313897 - RNA, 19 nt, Homo sapiens
ccaaccugcugaccacaga

SEQ ID NO: 313898 - RNA, 19 nt, Homo sapiens
gaaaucuucccaguagaga

SEQ ID NO: 313899 - RNA, 19 nt, Homo sapiens
gaugaacuccuggacuuug

SEQ ID NO: 313900 - RNA, 19 nt, Homo sapiens
cuugcagccuuucagcuua

SEQ ID NO: 313901 - RNA, 19 nt, Homo sapiens
gcucuacuacuaacaaaca

SEQ ID NO: 313902 - RNA, 19 nt, Homo sapiens
ucagguuccuuuaaucaca

SEQ ID NO: 313903 - RNA, 19 nt, Homo sapiens
ggaaggacgggcagcuaug

SEQ ID NO: 313904 - RNA, 19 nt, Homo sapiens
guauuucccagaugaagaa

SEQ ID NO: 313905 - RNA, 19 nt, Homo sapiens
ccaucgagcugggcuacaa

SEQ ID NO: 313906 - RNA, 19 nt, Homo sapiens
gcugagaaccauagguguu

SEQ ID NO: 313907 - RNA, 19 nt, Homo sapiens
gcaggcgguucuccuugug

SEQ ID NO: 313908 - RNA, 19 nt, Homo sapiens
gagaucaagcucauuagca

SEQ ID NO: 313909 - RNA, 19 nt, Homo sapiens
ccucaaggucugccucuuu

SEQ ID NO: 313910 - RNA, 19 nt, Homo sapiens
ggucagcuauaaggagaug

SEQ ID NO: 313911 - RNA, 19 nt, Homo sapiens
gaagggcugagaaccauag

SEQ ID NO: 313912 - RNA, 19 nt, Homo sapiens
uugcagagcccaaacaugu

SEQ ID NO: 313913 - RNA, 19 nt, Homo sapiens
ucagaacaacuaacucaug

SEQ ID NO: 313914 - RNA, 19 nt, Homo sapiens
cagcuaaccucagaacaac

SEQ ID NO: 313915 - RNA, 19 nt, Homo sapiens
gggacccgcuccauguuca

SEQ ID NO: 313916 - RNA, 19 nt, Homo sapiens
ggugaacuguguggugaug

SEQ ID NO: 313917 - RNA, 19 nt, Homo sapiens
caagcuugccugaagaaug

SEQ ID NO: 313918 - RNA, 19 nt, Homo sapiens
cagcagggacaucguguug

SEQ ID NO: 313919 - RNA, 19 nt, Homo sapiens
gaaggugccagaggaggaa

SEQ ID NO: 313920 - RNA, 19 nt, Homo sapiens
cagaggagcccacuuugag

SEQ ID NO: 313921 - RNA, 19 nt, Homo sapiens
caagcugauuucucaacga

SEQ ID NO: 313922 - RNA, 19 nt, Homo sapiens
agagauuaagcgcucauua

SEQ ID NO: 313923 - RNA, 19 nt, Homo sapiens
gcccaaacauguggaagag

SEQ ID NO: 313924 - RNA, 19 nt, Homo sapiens
gaaaggagaugcccuagug

SEQ ID NO: 313925 - RNA, 19 nt, Homo sapiens
ucaagaagauggucagcua

SEQ ID NO: 313926 - RNA, 19 nt, Homo sapiens
ccagauaacugagaaauca

SEQ ID NO: 313927 - RNA, 19 nt, Homo sapiens
gaggagaucaagcucauua

SEQ ID NO: 313928 - RNA, 19 nt, Homo sapiens
gcacaagcuugccugaaga

SEQ ID NO: 313929 - RNA, 19 nt, Homo sapiens
ccaaacauguggaagaguu

SEQ ID NO: 313930 - RNA, 19 nt, Homo sapiens
caacaagcaaugccagaua

SEQ ID NO: 313931 - RNA, 19 nt, Homo sapiens
gagcugggaugcaauguag

SEQ ID NO: 313932 - RNA, 19 nt, Homo sapiens
gaugugcgcuucauagagu

SEQ ID NO: 313933 - RNA, 19 nt, Homo sapiens
ccgcacagaugucagagua

SEQ ID NO: 313934 - RNA, 19 nt, Homo sapiens
caucagacuugcagccuuu

SEQ ID NO: 313935 - RNA, 19 nt, Homo sapiens
gaugaucucuaaugaccaa

SEQ ID NO: 313936 - RNA, 19 nt, Homo sapiens
uagaguauaugcccuuuga

SEQ ID NO: 313937 - RNA, 19 nt, Homo sapiens
aaacaggccugcugcuaga

SEQ ID NO: 313938 - RNA, 19 nt, Homo sapiens
gcagggacaucguguugga

SEQ ID NO: 313939 - RNA, 19 nt, Homo sapiens
gcacagccaaggccuuuaa

SEQ ID NO: 313940 - RNA, 19 nt, Homo sapiens
ccucacagcgcacaaauaa

SEQ ID NO: 313941 - RNA, 19 nt, Homo sapiens
gcaggaagccagacacaga

SEQ ID NO: 313942 - RNA, 19 nt, Homo sapiens
aagcuacgaugccaacuuu

SEQ ID NO: 313943 - RNA, 19 nt, Homo sapiens
gagcauaucagggaaagaa

SEQ ID NO: 313944 - RNA, 19 nt, Homo sapiens
cagaacaacuaacucaugu

SEQ ID NO: 313945 - RNA, 19 nt, Homo sapiens
gcacagaugucagaguaag

SEQ ID NO: 313946 - RNA, 19 nt, Homo sapiens
gcggcagcaugcaaaguua

SEQ ID NO: 313947 - RNA, 19 nt, Homo sapiens
ucagaaggcuggucucagu

SEQ ID NO: 313948 - RNA, 19 nt, Homo sapiens
gggcagcuaugguagaugu

SEQ ID NO: 313949 - RNA, 19 nt, Homo sapiens
aagaauggaucccaacuuc

SEQ ID NO: 313950 - RNA, 19 nt, Homo sapiens
gcagaggagcccacuuuga

SEQ ID NO: 313951 - RNA, 19 nt, Homo sapiens
gaugauagauugccuucac

SEQ ID NO: 313952 - RNA, 19 nt, Homo sapiens
ccaagucugugucccauca

SEQ ID NO: 313953 - RNA, 19 nt, Homo sapiens
cagaucagcuucaucacau

SEQ ID NO: 313954 - RNA, 19 nt, Homo sapiens
agaagauggucagcuauaa

SEQ ID NO: 313955 - RNA, 19 nt, Homo sapiens
gaacuuuuccuucucauuu

SEQ ID NO: 313956 - RNA, 19 nt, Homo sapiens
aacaagcaaugccagauaa

SEQ ID NO: 313957 - RNA, 19 nt, Homo sapiens
gcagaaccagcucaagaaa

SEQ ID NO: 313958 - RNA, 19 nt, Homo sapiens
agacucagaugccaacuca

SEQ ID NO: 313959 - RNA, 19 nt, Homo sapiens
ccuuucagcuuaacaguug

SEQ ID NO: 313960 - RNA, 19 nt, Homo sapiens
gaagaauggaucccaacuu

SEQ ID NO: 313961 - RNA, 19 nt, Homo sapiens
gacgucagguuccuuuaau

SEQ ID NO: 313962 - RNA, 19 nt, Homo sapiens
gaagugcaaccucagaugu

SEQ ID NO: 313963 - RNA, 19 nt, Homo sapiens
ucacagcgcacaaauaaag

SEQ ID NO: 313964 - RNA, 19 nt, Homo sapiens
ccuggugccugccaaguuu

SEQ ID NO: 313965 - RNA, 19 nt, Homo sapiens
gaaggaaggcaucgacaag

SEQ ID NO: 313966 - RNA, 19 nt, Homo sapiens
gcacaaauaaagcuacgau

SEQ ID NO: 313967 - RNA, 19 nt, Homo sapiens
uaacugagaaaucauguuc

SEQ ID NO: 313968 - RNA, 19 nt, Homo sapiens
gauaccagcaggcccuuaa

SEQ ID NO: 313969 - RNA, 19 nt, Homo sapiens
caauguaggcugagggaaa

SEQ ID NO: 313970 - RNA, 19 nt, Homo sapiens
gcuaaccucagaacaacua

SEQ ID NO: 313971 - RNA, 19 nt, Homo sapiens
gguggccacuuuauggaaa

SEQ ID NO: 313972 - RNA, 19 nt, Homo sapiens
guuggaagcuccgcacaga

SEQ ID NO: 313973 - RNA, 19 nt, Homo sapiens
agaucaagcucauuagcaa

SEQ ID NO: 313974 - RNA, 19 nt, Homo sapiens
gaguauaugcccuuugaug

SEQ ID NO: 313975 - RNA, 19 nt, Homo sapiens
cagcagaaccagcucaaga

SEQ ID NO: 313976 - RNA, 19 nt, Homo sapiens
gaagucagccugcucuacu

SEQ ID NO: 313977 - RNA, 19 nt, Homo sapiens
agaaccagcucaagaaagg

SEQ ID NO: 313978 - RNA, 19 nt, Homo sapiens
uaaaaucccuggcuuccaa

SEQ ID NO: 313979 - RNA, 19 nt, Homo sapiens
gaauggaucccaacuucuc

SEQ ID NO: 313980 - RNA, 19 nt, Homo sapiens
aagcagaggagcccacuuu

SEQ ID NO: 313981 - RNA, 19 nt, Homo sapiens
gaagauggucagcuauaag

SEQ ID NO: 313982 - RNA, 19 nt, Homo sapiens
gcuacgaugccaacuuuga

SEQ ID NO: 313983 - RNA, 19 nt, Homo sapiens
aagcuugccugaagaaugg

SEQ ID NO: 313984 - RNA, 19 nt, Homo sapiens
ggagcugggaugcaaugua

SEQ ID NO: 313985 - RNA, 19 nt, Homo sapiens
ggacuuccaucgggcuuag

SEQ ID NO: 313986 - RNA, 19 nt, Homo sapiens
gcuauaaggagaugcuaga

SEQ ID NO: 313987 - RNA, 19 nt, Homo sapiens
uuguuuaccuugagcagua

SEQ ID NO: 313988 - RNA, 19 nt, Homo sapiens
ccagcuaaccucagaacaa

SEQ ID NO: 313989 - RNA, 19 nt, Homo sapiens
gagcugcugagaaucauug

SEQ ID NO: 313990 - RNA, 19 nt, Homo sapiens
ggccagaucagcuucauca

SEQ ID NO: 313991 - RNA, 19 nt, Homo sapiens
aagaagauggucagcuaua

SEQ ID NO: 313992 - RNA, 19 nt, Homo sapiens
gaaaucuucccaguagaga

SEQ ID NO: 313993 - RNA, 19 nt, Homo sapiens
caauggggcuuccuuucua

SEQ ID NO: 313994 - RNA, 19 nt, Homo sapiens
gaucucuaaugaccaaugg

SEQ ID NO: 313995 - RNA, 19 nt, Homo sapiens
ucagccugcucuacuacua

SEQ ID NO: 313996 - RNA, 19 nt, Homo sapiens
caacauugcagagcccaaa

SEQ ID NO: 313997 - RNA, 19 nt, Homo sapiens
ccaaccugcugaccacaga

SEQ ID NO: 313998 - RNA, 19 nt, Homo sapiens
gaugaacuccuggacuuug

SEQ ID NO: 313999 - RNA, 19 nt, Homo sapiens
cuugcagccuuucagcuua

SEQ ID NO: 314000 - RNA, 19 nt, Homo sapiens
gcucuacuacuaacaaaca

SEQ ID NO: 314001 - RNA, 19 nt, Homo sapiens
ucagguuccuuuaaucaca

SEQ ID NO: 314002 - RNA, 19 nt, Homo sapiens
ggaaggacgggcagcuaug

SEQ ID NO: 314003 - RNA, 19 nt, Homo sapiens
ccaucgagcugggcuacaa

SEQ ID NO: 314004 - RNA, 19 nt, Homo sapiens
gcugagaaccauagguguu

SEQ ID NO: 314005 - RNA, 19 nt, Homo sapiens
gcaggcgguucuccuugug

SEQ ID NO: 314006 - RNA, 19 nt, Homo sapiens
gagaucaagcucauuagca

SEQ ID NO: 314007 - RNA, 19 nt, Homo sapiens
ccucaaggucugccucuuu

SEQ ID NO: 314008 - RNA, 19 nt, Homo sapiens
ggucagcuauaaggagaug

SEQ ID NO: 314009 - RNA, 19 nt, Homo sapiens
gaagggcugagaaccauag

SEQ ID NO: 314010 - RNA, 19 nt, Homo sapiens
uugcagagcccaaacaugu

SEQ ID NO: 314011 - RNA, 19 nt, Homo sapiens
ucagaacaacuaacucaug

SEQ ID NO: 314012 - RNA, 19 nt, Homo sapiens
cagcuaaccucagaacaac

SEQ ID NO: 314013 - RNA, 19 nt, Homo sapiens
gggacccgcuccauguuca

SEQ ID NO: 314014 - RNA, 19 nt, Homo sapiens
ggugaacuguguggugaug

SEQ ID NO: 314015 - RNA, 19 nt, Homo sapiens
caagcuugccugaagaaug

SEQ ID NO: 314016 - RNA, 19 nt, Homo sapiens
cagcagggacaucguguug

SEQ ID NO: 314017 - RNA, 19 nt, Homo sapiens
gaaggugccagaggaggaa

SEQ ID NO: 314018 - RNA, 19 nt, Homo sapiens
cagaggagcccacuuugag

SEQ ID NO: 314019 - RNA, 19 nt, Homo sapiens
agagauuaagcgcucauua

SEQ ID NO: 314020 - RNA, 19 nt, Homo sapiens
caagcugauuucucaacga

SEQ ID NO: 314021 - RNA, 19 nt, Homo sapiens
gcccaaacauguggaagag

SEQ ID NO: 314022 - RNA, 19 nt, Homo sapiens
acucagaugccaacucaaa

SEQ ID NO: 314023 - RNA, 19 nt, Homo sapiens
gcagcaugcaaaguuauuu

SEQ ID NO: 314024 - RNA, 19 nt, Homo sapiens
ggaaagauauggaugaagu

SEQ ID NO: 314025 - RNA, 19 nt, Homo sapiens
caagauaaauggguaugua

SEQ ID NO: 314026 - RNA, 19 nt, Homo sapiens
gaagcaagcauaaucauug

SEQ ID NO: 314027 - RNA, 19 nt, Homo sapiens
ggaugaaguugaagagaaa

SEQ ID NO: 314028 - RNA, 19 nt, Homo sapiens
ggaaauauacgaagaguca

SEQ ID NO: 314029 - RNA, 19 nt, Homo sapiens
gggagagcauuguuauuaa

SEQ ID NO: 314030 - RNA, 19 nt, Homo sapiens
gcuaugccauugauacuuu

SEQ ID NO: 314031 - RNA, 19 nt, Homo sapiens
ucagaaagauuuguaguga

SEQ ID NO: 314032 - RNA, 19 nt, Homo sapiens
gcagaacuggaaaguauua

SEQ ID NO: 314033 - RNA, 19 nt, Homo sapiens
caacacacauugagguaug

SEQ ID NO: 314034 - RNA, 19 nt, Homo sapiens
gcaaaccuguaauuauuuc

SEQ ID NO: 314035 - RNA, 19 nt, Homo sapiens
uggcagaacuggaaaguau

SEQ ID NO: 314036 - RNA, 19 nt, Homo sapiens
uauguaggaugaaggguua

SEQ ID NO: 314037 - RNA, 19 nt, Homo sapiens
gaagagucaucaacuugga

SEQ ID NO: 314038 - RNA, 19 nt, Homo sapiens
gaagcacaaucucuuauac

SEQ ID NO: 314039 - RNA, 19 nt, Homo sapiens
aaacuuuacugccgagaaa

SEQ ID NO: 314040 - RNA, 19 nt, Homo sapiens
gcagaaauggccagucaaa

SEQ ID NO: 314041 - RNA, 19 nt, Homo sapiens
gaagucagaaagauuugua

SEQ ID NO: 314042 - RNA, 19 nt, Homo sapiens
ccaccucuuucccagauua

SEQ ID NO: 314043 - RNA, 19 nt, Homo sapiens
ggaugaaggguuauuuaaa

SEQ ID NO: 314044 - RNA, 19 nt, Homo sapiens
gagacgaaauugccguuau

SEQ ID NO: 314045 - RNA, 19 nt, Homo sapiens
ucaagaauaugucgagcuu

SEQ ID NO: 314046 - RNA, 19 nt, Homo sapiens
ggagagcauuguuauuaag

SEQ ID NO: 314047 - RNA, 19 nt, Homo sapiens
guccuuccaugacuaauuu

SEQ ID NO: 314048 - RNA, 19 nt, Homo sapiens
gucauuagcuuagaauaug

SEQ ID NO: 314049 - RNA, 19 nt, Homo sapiens
ugggagagcauuguuauua

SEQ ID NO: 314050 - RNA, 19 nt, Homo sapiens
gcugugagcuaugccauug

SEQ ID NO: 314051 - RNA, 19 nt, Homo sapiens
uagaugaagucucacaguu

SEQ ID NO: 314052 - RNA, 19 nt, Homo sapiens
gauaauauuugcuguucgu

SEQ ID NO: 314053 - RNA, 19 nt, Homo sapiens
uaacaggaguucguucaga

SEQ ID NO: 314054 - RNA, 19 nt, Homo sapiens
uggauuggcugauguuaga

SEQ ID NO: 314055 - RNA, 19 nt, Homo sapiens
gaaauaacaggaguucguu

SEQ ID NO: 314056 - RNA, 19 nt, Homo sapiens
agaaagauuuguagugaca

SEQ ID NO: 314057 - RNA, 19 nt, Homo sapiens
guagugacauuaggcagaa

SEQ ID NO: 314058 - RNA, 19 nt, Homo sapiens
gauagaaacucgacauccu

SEQ ID NO: 314059 - RNA, 19 nt, Homo sapiens
gacuuuaacuagcucagaa

SEQ ID NO: 314060 - RNA, 19 nt, Homo sapiens
agauauggaugaaguugaa

SEQ ID NO: 314061 - RNA, 19 nt, Homo sapiens
cagauaauauuugcuguuc

SEQ ID NO: 314062 - RNA, 19 nt, Homo sapiens
ucuacacccuugaucauuu

SEQ ID NO: 314063 - RNA, 19 nt, Homo sapiens
gauagaaggaggacuguag

SEQ ID NO: 314064 - RNA, 19 nt, Homo sapiens
guaggaagaaauggaauaa

SEQ ID NO: 314065 - RNA, 19 nt, Homo sapiens
uggaugaaguugaagagaa

SEQ ID NO: 314066 - RNA, 19 nt, Homo sapiens
aaaugcaccucauggagaa

SEQ ID NO: 314067 - RNA, 19 nt, Homo sapiens
aaagauaucugugguagac

SEQ ID NO: 314068 - RNA, 19 nt, Homo sapiens
aaauggguauguaggauga

SEQ ID NO: 314069 - RNA, 19 nt, Homo sapiens
cacaaucucuuauacuagu

SEQ ID NO: 314070 - RNA, 19 nt, Homo sapiens
ccauagacuuggcuugguu

SEQ ID NO: 314071 - RNA, 19 nt, Homo sapiens
gaccaccucuuucccagau

SEQ ID NO: 314072 - RNA, 19 nt, Homo sapiens
gagcauuguuauuaaggau

SEQ ID NO: 314073 - RNA, 19 nt, Homo sapiens
ggaggacuguaggaagaaa

SEQ ID NO: 314074 - RNA, 19 nt, Homo sapiens
gauaaauggguauguagga

SEQ ID NO: 314075 - RNA, 19 nt, Homo sapiens
ugaagcacaaucucuuaua

SEQ ID NO: 314076 - RNA, 19 nt, Homo sapiens
gaaaaugaagucagaaaga

SEQ ID NO: 314077 - RNA, 19 nt, Homo sapiens
gaaguugaagagaaaucua

SEQ ID NO: 314078 - RNA, 19 nt, Homo sapiens
gaaagauauggaugaaguu

SEQ ID NO: 314079 - RNA, 19 nt, Homo sapiens
aaggaggacuguaggaaga

SEQ ID NO: 314080 - RNA, 19 nt, Homo sapiens
agcacaaucucuuauacua

SEQ ID NO: 314081 - RNA, 19 nt, Homo sapiens
gugccagguugaaguauug

SEQ ID NO: 314082 - RNA, 19 nt, Homo sapiens
uaugggcccuccucaguga

SEQ ID NO: 314083 - RNA, 19 nt, Homo sapiens
uaggaugaaggguuauuua

SEQ ID NO: 314084 - RNA, 19 nt, Homo sapiens
cuucaucuguggauuucua

SEQ ID NO: 314085 - RNA, 19 nt, Homo sapiens
ccaaggugcccauauggaa

SEQ ID NO: 314086 - RNA, 19 nt, Homo sapiens
agaaauggccagucaaaca

SEQ ID NO: 314087 - RNA, 19 nt, Homo sapiens
uaggaaagauauggaugaa

SEQ ID NO: 314088 - RNA, 19 nt, Homo sapiens
cuacacccuugaucauuug

SEQ ID NO: 314089 - RNA, 19 nt, Homo sapiens
gcacaaucucuuauacuag

SEQ ID NO: 314090 - RNA, 19 nt, Homo sapiens
ggacuacaagaaauaacuu

SEQ ID NO: 314091 - RNA, 19 nt, Homo sapiens
ggaacuaaagauagaagga

SEQ ID NO: 314092 - RNA, 19 nt, Homo sapiens
gcaguguuccauagacuug

SEQ ID NO: 314093 - RNA, 19 nt, Homo sapiens
gaaagauaucugugguaga

SEQ ID NO: 314094 - RNA, 19 nt, Homo sapiens
caaggugcccauauggaaa

SEQ ID NO: 314095 - RNA, 19 nt, Homo sapiens
aggcagaaauggccaguca

SEQ ID NO: 314096 - RNA, 19 nt, Homo sapiens
agacgaaauugccguuauc

SEQ ID NO: 314097 - RNA, 19 nt, Homo sapiens
ccauuucugugccucaaga

SEQ ID NO: 314098 - RNA, 19 nt, Homo sapiens
aagccaaggugcccauaug

SEQ ID NO: 314099 - RNA, 19 nt, Homo sapiens
cagcaaggacggacucguu

SEQ ID NO: 314100 - RNA, 19 nt, Homo sapiens
gaucauuugcaaaccugua

SEQ ID NO: 314101 - RNA, 19 nt, Homo sapiens
cauggagaauucuugugaa

SEQ ID NO: 314102 - RNA, 19 nt, Homo sapiens
gaaauggccagucaaacac

SEQ ID NO: 314103 - RNA, 19 nt, Homo sapiens
ggagauagaaacucgacau

SEQ ID NO: 314104 - RNA, 19 nt, Homo sapiens
aauuguaacucaacacaca

SEQ ID NO: 314105 - RNA, 19 nt, Homo sapiens
ggacggacucguugugaag

SEQ ID NO: 314106 - RNA, 19 nt, Homo sapiens
ggagacgaaauugccguua

SEQ ID NO: 314107 - RNA, 19 nt, Homo sapiens
aauauuugcuguucgucaa

SEQ ID NO: 314108 - RNA, 19 nt, Homo sapiens
uaacuagcucagaaacgua

SEQ ID NO: 314109 - RNA, 19 nt, Homo sapiens
ucauggagaauucuuguga

SEQ ID NO: 314110 - RNA, 19 nt, Homo sapiens
gguaugggcccuccucagu

SEQ ID NO: 314111 - RNA, 19 nt, Homo sapiens
uuucccagauuauucguuu

SEQ ID NO: 314112 - RNA, 19 nt, Homo sapiens
uacgaagagucaucaacuu

SEQ ID NO: 314113 - RNA, 19 nt, Homo sapiens
cuaugccauugauacuuua

SEQ ID NO: 314114 - RNA, 19 nt, Homo sapiens
uuaacuagcucagaaacgu

SEQ ID NO: 314115 - RNA, 19 nt, Homo sapiens
gucaucaacuuggaaagga

SEQ ID NO: 314116 - RNA, 19 nt, Homo sapiens
acauagcaguguuccauag

SEQ ID NO: 314117 - RNA, 19 nt, Homo sapiens
cuaggaaagauauggauga

SEQ ID NO: 314118 - RNA, 19 nt, Homo sapiens
gcugugccagguugaagua

SEQ ID NO: 314119 - RNA, 19 nt, Homo sapiens
guaggaugaaggguuauuu

SEQ ID NO: 314120 - RNA, 19 nt, Homo sapiens
ucagaagcaagcauaauca

SEQ ID NO: 314121 - RNA, 19 nt, Homo sapiens
ggugauuucuccgcucugu

SEQ ID NO: 314122 - RNA, 19 nt, Homo sapiens
ugaaauaacaggaguucgu

SEQ ID NO: 314123 - RNA, 19 nt, Homo sapiens
gcuucagccuggagacgaa

SEQ ID NO: 314124 - RNA, 19 nt, Homo sapiens
ggaaagauauggaugaagu

SEQ ID NO: 314125 - RNA, 19 nt, Homo sapiens
caagauaaauggguaugua

SEQ ID NO: 314126 - RNA, 19 nt, Homo sapiens
gaagcaagcauaaucauug

SEQ ID NO: 314127 - RNA, 19 nt, Homo sapiens
ggaugaaguugaagagaaa

SEQ ID NO: 314128 - RNA, 19 nt, Homo sapiens
ggaaauauacgaagaguca

SEQ ID NO: 314129 - RNA, 19 nt, Homo sapiens
gggagagcauuguuauuaa

SEQ ID NO: 314130 - RNA, 19 nt, Homo sapiens
gcuaugccauugauacuuu

SEQ ID NO: 314131 - RNA, 19 nt, Homo sapiens
ucagaaagauuuguaguga

SEQ ID NO: 314132 - RNA, 19 nt, Homo sapiens
gcagaacuggaaaguauua

SEQ ID NO: 314133 - RNA, 19 nt, Homo sapiens
caacacacauugagguaug

SEQ ID NO: 314134 - RNA, 19 nt, Homo sapiens
uggcagaacuggaaaguau

SEQ ID NO: 314135 - RNA, 19 nt, Homo sapiens
uauguaggaugaaggguua

SEQ ID NO: 314136 - RNA, 19 nt, Homo sapiens
gaagagucaucaacuugga

SEQ ID NO: 314137 - RNA, 19 nt, Homo sapiens
gaagcacaaucucuuauac

SEQ ID NO: 314138 - RNA, 19 nt, Homo sapiens
aaacuuuacugccgagaaa

SEQ ID NO: 314139 - RNA, 19 nt, Homo sapiens
gcagaaauggccagucaaa

SEQ ID NO: 314140 - RNA, 19 nt, Homo sapiens
gaagucagaaagauuugua

SEQ ID NO: 314141 - RNA, 19 nt, Homo sapiens
ggaugaaggguuauuuaaa

SEQ ID NO: 314142 - RNA, 19 nt, Homo sapiens
gagacgaaauugccguuau

SEQ ID NO: 314143 - RNA, 19 nt, Homo sapiens
ucaagaauaugucgagcuu

SEQ ID NO: 314144 - RNA, 19 nt, Homo sapiens
ggagagcauuguuauuaag

SEQ ID NO: 314145 - RNA, 19 nt, Homo sapiens
guccuuccaugacuaauuu

SEQ ID NO: 314146 - RNA, 19 nt, Homo sapiens
gucauuagcuuagaauaug

SEQ ID NO: 314147 - RNA, 19 nt, Homo sapiens
ugggagagcauuguuauua

SEQ ID NO: 314148 - RNA, 19 nt, Homo sapiens
uaacaggaguucguucaga

SEQ ID NO: 314149 - RNA, 19 nt, Homo sapiens
gcugugagcuaugccauug

SEQ ID NO: 314150 - RNA, 19 nt, Homo sapiens
uagaugaagucucacaguu

SEQ ID NO: 314151 - RNA, 19 nt, Homo sapiens
gauaauauuugcuguucgu

SEQ ID NO: 314152 - RNA, 19 nt, Homo sapiens
gaaauaacaggaguucguu

SEQ ID NO: 314153 - RNA, 19 nt, Homo sapiens
uggauuggcugauguuaga

SEQ ID NO: 314154 - RNA, 19 nt, Homo sapiens
agaaagauuuguagugaca

SEQ ID NO: 314155 - RNA, 19 nt, Homo sapiens
guagugacauuaggcagaa

SEQ ID NO: 314156 - RNA, 19 nt, Homo sapiens
gauagaaacucgacauccu

SEQ ID NO: 314157 - RNA, 19 nt, Homo sapiens
gacuuuaacuagcucagaa

SEQ ID NO: 314158 - RNA, 19 nt, Homo sapiens
agauauggaugaaguugaa

SEQ ID NO: 314159 - RNA, 19 nt, Homo sapiens
cagauaauauuugcuguuc

SEQ ID NO: 314160 - RNA, 19 nt, Homo sapiens
gauagaaggaggacuguag

SEQ ID NO: 314161 - RNA, 19 nt, Homo sapiens
guaggaagaaauggaauaa

SEQ ID NO: 314162 - RNA, 19 nt, Homo sapiens
uggaugaaguugaagagaa

SEQ ID NO: 314163 - RNA, 19 nt, Homo sapiens
aaagauaucugugguagac

SEQ ID NO: 314164 - RNA, 19 nt, Homo sapiens
aaauggguauguaggauga

SEQ ID NO: 314165 - RNA, 19 nt, Homo sapiens
cacaaucucuuauacuagu

SEQ ID NO: 314166 - RNA, 19 nt, Homo sapiens
ccauagacuuggcuugguu

SEQ ID NO: 314167 - RNA, 19 nt, Homo sapiens
gagcauuguuauuaaggau

SEQ ID NO: 314168 - RNA, 19 nt, Homo sapiens
ggaggacuguaggaagaaa

SEQ ID NO: 314169 - RNA, 19 nt, Homo sapiens
gauaaauggguauguagga

SEQ ID NO: 314170 - RNA, 19 nt, Homo sapiens
ugaagcacaaucucuuaua

SEQ ID NO: 314171 - RNA, 19 nt, Homo sapiens
gaaaaugaagucagaaaga

SEQ ID NO: 314172 - RNA, 19 nt, Homo sapiens
gaaguugaagagaaaucua

SEQ ID NO: 314173 - RNA, 19 nt, Homo sapiens
gaaagauauggaugaaguu

SEQ ID NO: 314174 - RNA, 19 nt, Homo sapiens
gugccagguugaaguauug

SEQ ID NO: 314175 - RNA, 19 nt, Homo sapiens
aaggaggacuguaggaaga

SEQ ID NO: 314176 - RNA, 19 nt, Homo sapiens
agcacaaucucuuauacua

SEQ ID NO: 314177 - RNA, 19 nt, Homo sapiens
uaugggcccuccucaguga

SEQ ID NO: 314178 - RNA, 19 nt, Homo sapiens
uaggaugaaggguuauuua

SEQ ID NO: 314179 - RNA, 19 nt, Homo sapiens
ccaaggugcccauauggaa

SEQ ID NO: 314180 - RNA, 19 nt, Homo sapiens
agaaauggccagucaaaca

SEQ ID NO: 314181 - RNA, 19 nt, Homo sapiens
uaggaaagauauggaugaa

SEQ ID NO: 314182 - RNA, 19 nt, Homo sapiens
gcacaaucucuuauacuag

SEQ ID NO: 314183 - RNA, 19 nt, Homo sapiens
ggacuacaagaaauaacuu

SEQ ID NO: 314184 - RNA, 19 nt, Homo sapiens
ggaacuaaagauagaagga

SEQ ID NO: 314185 - RNA, 19 nt, Homo sapiens
gcaguguuccauagacuug

SEQ ID NO: 314186 - RNA, 19 nt, Homo sapiens
gaaagauaucugugguaga

SEQ ID NO: 314187 - RNA, 19 nt, Homo sapiens
caaggugcccauauggaaa

SEQ ID NO: 314188 - RNA, 19 nt, Homo sapiens
aggcagaaauggccaguca

SEQ ID NO: 314189 - RNA, 19 nt, Homo sapiens
ccauuucugugccucaaga

SEQ ID NO: 314190 - RNA, 19 nt, Homo sapiens
agacgaaauugccguuauc

SEQ ID NO: 314191 - RNA, 19 nt, Homo sapiens
aagccaaggugcccauaug

SEQ ID NO: 314192 - RNA, 19 nt, Homo sapiens
gaaauggccagucaaacac

SEQ ID NO: 314193 - RNA, 19 nt, Homo sapiens
ggagauagaaacucgacau

SEQ ID NO: 314194 - RNA, 19 nt, Homo sapiens
aauuguaacucaacacaca

SEQ ID NO: 314195 - RNA, 19 nt, Homo sapiens
aauauuugcuguucgucaa

SEQ ID NO: 314196 - RNA, 19 nt, Homo sapiens
ggagacgaaauugccguua

SEQ ID NO: 314197 - RNA, 19 nt, Homo sapiens
uaacuagcucagaaacgua

SEQ ID NO: 314198 - RNA, 19 nt, Homo sapiens
gguaugggcccuccucagu

SEQ ID NO: 314199 - RNA, 19 nt, Homo sapiens
uacgaagagucaucaacuu

SEQ ID NO: 314200 - RNA, 19 nt, Homo sapiens
cuaugccauugauacuuua

SEQ ID NO: 314201 - RNA, 19 nt, Homo sapiens
uuaacuagcucagaaacgu

SEQ ID NO: 314202 - RNA, 19 nt, Homo sapiens
gucaucaacuuggaaagga

SEQ ID NO: 314203 - RNA, 19 nt, Homo sapiens
acauagcaguguuccauag

SEQ ID NO: 314204 - RNA, 19 nt, Homo sapiens
cuaggaaagauauggauga

SEQ ID NO: 314205 - RNA, 19 nt, Homo sapiens
cccaugauuucaaaaguua

SEQ ID NO: 314206 - RNA, 19 nt, Homo sapiens
ugaaauaacaggaguucgu

SEQ ID NO: 314207 - RNA, 19 nt, Homo sapiens
guaggaugaaggguuauuu

SEQ ID NO: 314208 - RNA, 19 nt, Homo sapiens
gcugugccagguugaagua

SEQ ID NO: 314209 - RNA, 19 nt, Homo sapiens
ucagaagcaagcauaauca

SEQ ID NO: 314210 - RNA, 19 nt, Homo sapiens
ggugauuucuccgcucugu

SEQ ID NO: 314211 - RNA, 19 nt, Homo sapiens
gcuucagccuggagacgaa

SEQ ID NO: 314212 - RNA, 19 nt, Homo sapiens
gaccauuucugugccucaa

SEQ ID NO: 314213 - RNA, 19 nt, Homo sapiens
aggaugaaggguuauuuaa

SEQ ID NO: 314214 - RNA, 19 nt, Homo sapiens
ucagugacuuuaacuagcu

SEQ ID NO: 314215 - RNA, 19 nt, Homo sapiens
uguaggaagaaauggaaua

SEQ ID NO: 314216 - RNA, 19 nt, Homo sapiens
ucaucaacuuggaaaggaa

SEQ ID NO: 314217 - RNA, 19 nt, Homo sapiens
agaagcaagcauaaucauu

SEQ ID NO: 314218 - RNA, 19 nt, Homo sapiens
gagauagaaacucgacauc

SEQ ID NO: 314219 - RNA, 19 nt, Homo sapiens
gauuggcugauguuagaaa

SEQ ID NO: 314220 - RNA, 19 nt, Homo sapiens
gcucuguggugcaauaucc

SEQ ID NO: 314221 - RNA, 19 nt, Homo sapiens
caacuuggaaaggaaacaa

SEQ ID NO: 314222 - RNA, 19 nt, Homo sapiens
uggcuugguuccaguguca

SEQ ID NO: 314223 - RNA, 19 nt, Homo sapiens
acugaagcacaaucucuua

SEQ ID NO: 314224 - RNA, 19 nt, Homo sapiens
ggacagagcugcugaaaga

SEQ ID NO: 314225 - RNA, 19 nt, Homo sapiens
caacaugccugcuuuagaa

SEQ ID NO: 314226 - RNA, 19 nt, Homo sapiens
caagcuaggugcuaauuaa

SEQ ID NO: 314227 - RNA, 19 nt, Homo sapiens
cuacauaucuaucagagua

SEQ ID NO: 314228 - RNA, 19 nt, Homo sapiens
cgaaaucccuucugaguga

SEQ ID NO: 314229 - RNA, 19 nt, Homo sapiens
gaagauaacccuguuugua

SEQ ID NO: 314230 - RNA, 19 nt, Homo sapiens
ggagaaaccuacagaauac

SEQ ID NO: 314231 - RNA, 19 nt, Homo sapiens
gaacaagccucuuccuaag

SEQ ID NO: 314232 - RNA, 19 nt, Homo sapiens
gggcacagcugcagcaauu

SEQ ID NO: 314233 - RNA, 19 nt, Homo sapiens
gcuaggugcuaauuaauaa

SEQ ID NO: 314234 - RNA, 19 nt, Homo sapiens
ugagugagcugaagaguga

SEQ ID NO: 314235 - RNA, 19 nt, Homo sapiens
gggagaaaccuacagaaua

SEQ ID NO: 314236 - RNA, 19 nt, Homo sapiens
caaacaagcuaggugcuaa

SEQ ID NO: 314237 - RNA, 19 nt, Homo sapiens
gcaauuccuugaagagcua

SEQ ID NO: 314238 - RNA, 19 nt, Homo sapiens
gaauugauuucccuucuuc

SEQ ID NO: 314239 - RNA, 19 nt, Homo sapiens
gaauugccaugucgcauau

SEQ ID NO: 314240 - RNA, 19 nt, Homo sapiens
ggaauugccaugucgcaua

SEQ ID NO: 314241 - RNA, 19 nt, Homo sapiens
gcagggcaguucagaguga

SEQ ID NO: 314242 - RNA, 19 nt, Homo sapiens
ccaagugucuuccagcuau

SEQ ID NO: 314243 - RNA, 19 nt, Homo sapiens
gcacugcccuccaagaucu

SEQ ID NO: 314244 - RNA, 19 nt, Homo sapiens
guucaucucuacagaaaug

SEQ ID NO: 314245 - RNA, 19 nt, Homo sapiens
ugaacaagccucuuccuaa

SEQ ID NO: 314246 - RNA, 19 nt, Homo sapiens
gcuacgaaaucccuucuga

SEQ ID NO: 314247 - RNA, 19 nt, Homo sapiens
caacaacuacuacuugaug

SEQ ID NO: 314248 - RNA, 19 nt, Homo sapiens
aagauaacccuguuuguaa

SEQ ID NO: 314249 - RNA, 19 nt, Homo sapiens
gcugaaagaugcuauuggu

SEQ ID NO: 314250 - RNA, 19 nt, Homo sapiens
gaaguggaauugccauguc

SEQ ID NO: 314251 - RNA, 19 nt, Homo sapiens
ccacaggucucagaaucuu

SEQ ID NO: 314252 - RNA, 19 nt, Homo sapiens
uaugguaacuuugcaaaug

SEQ ID NO: 314253 - RNA, 19 nt, Homo sapiens
ggacaucucauccaucaag

SEQ ID NO: 314254 - RNA, 19 nt, Homo sapiens
gaaauggcaaggaccaaga

SEQ ID NO: 314255 - RNA, 19 nt, Homo sapiens
gcaccuauaauaccagcua

SEQ ID NO: 314256 - RNA, 19 nt, Homo sapiens
gcaacaugccugcuuuaga

SEQ ID NO: 314257 - RNA, 19 nt, Homo sapiens
cacacucacuggcaucuuu

SEQ ID NO: 314258 - RNA, 19 nt, Homo sapiens
gcagggcaauuccuugaag

SEQ ID NO: 314259 - RNA, 19 nt, Homo sapiens
aauguaagguucucagaug

SEQ ID NO: 314260 - RNA, 19 nt, Homo sapiens
ucacuggcaucuuugcuau

SEQ ID NO: 314261 - RNA, 19 nt, Homo sapiens
acaauuaacugagcauagu

SEQ ID NO: 314262 - RNA, 19 nt, Homo sapiens
ggaauugaaaguagaagau

SEQ ID NO: 314263 - RNA, 19 nt, Homo sapiens
caguagagauggcaagcuu

SEQ ID NO: 314264 - RNA, 19 nt, Homo sapiens
gcaaaacauugaagagaga

SEQ ID NO: 314265 - RNA, 19 nt, Homo sapiens
gcuggaagauaacccuguu

SEQ ID NO: 314266 - RNA, 19 nt, Homo sapiens
gaaaggugacucucaggau

SEQ ID NO: 314267 - RNA, 19 nt, Homo sapiens
gaaaccccaucucuacuaa

SEQ ID NO: 314268 - RNA, 19 nt, Homo sapiens
cagaguauccacuguuuau

SEQ ID NO: 314269 - RNA, 19 nt, Homo sapiens
ccuaagguccuguaaguga

SEQ ID NO: 314270 - RNA, 19 nt, Homo sapiens
gaguauccacuguuuauuc

SEQ ID NO: 314271 - RNA, 19 nt, Homo sapiens
ucuccuaucuacauaucua

SEQ ID NO: 314272 - RNA, 19 nt, Homo sapiens
gauaacccuguuuguaauu

SEQ ID NO: 314273 - RNA, 19 nt, Homo sapiens
gcaggagaaucgcuugaac

SEQ ID NO: 314274 - RNA, 19 nt, Homo sapiens
ggucagacacaaacaaaca

SEQ ID NO: 314275 - RNA, 19 nt, Homo sapiens
gaagagugaggauaugagu

SEQ ID NO: 314276 - RNA, 19 nt, Homo sapiens
gcaaauggugguuguuucu

SEQ ID NO: 314277 - RNA, 19 nt, Homo sapiens
agauaacccuguuuguaau

SEQ ID NO: 314278 - RNA, 19 nt, Homo sapiens
guagagauggcaagcuuau

SEQ ID NO: 314279 - RNA, 19 nt, Homo sapiens
gugcccugcuggaagauaa

SEQ ID NO: 314280 - RNA, 19 nt, Homo sapiens
gagcugaagagugaggaua

SEQ ID NO: 314281 - RNA, 19 nt, Homo sapiens
ggaaucuccucacugaaaa

SEQ ID NO: 314282 - RNA, 19 nt, Homo sapiens
gaauguaagguucucagau

SEQ ID NO: 314283 - RNA, 19 nt, Homo sapiens
ggaagaggaagagugcaaa

SEQ ID NO: 314284 - RNA, 19 nt, Homo sapiens
ggaagauaacccuguuugu

SEQ ID NO: 314285 - RNA, 19 nt, Homo sapiens
gcugaagagugaggauaug

SEQ ID NO: 314286 - RNA, 19 nt, Homo sapiens
caucucauccaucaaguug

SEQ ID NO: 314287 - RNA, 19 nt, Homo sapiens
guaagguucucagaugaag

SEQ ID NO: 314288 - RNA, 19 nt, Homo sapiens
uagccggagugacagagua

SEQ ID NO: 314289 - RNA, 19 nt, Homo sapiens
agccagagcuccuccuugu

SEQ ID NO: 314290 - RNA, 19 nt, Homo sapiens
ccauuucucucuccagucu

SEQ ID NO: 314291 - RNA, 19 nt, Homo sapiens
ccaucaaguugcacacuca

SEQ ID NO: 314292 - RNA, 19 nt, Homo sapiens
ugguucaucucuacagaaa

SEQ ID NO: 314293 - RNA, 19 nt, Homo sapiens
gcacagcugcagcaauuac

SEQ ID NO: 314294 - RNA, 19 nt, Homo sapiens
aaauggugguuguuucuuc

SEQ ID NO: 314295 - RNA, 19 nt, Homo sapiens
ggaauguaagguucucaga

SEQ ID NO: 314296 - RNA, 19 nt, Homo sapiens
gacacaaacaaacaagcua

SEQ ID NO: 314297 - RNA, 19 nt, Homo sapiens
gaucuucccuugggcuuuu

SEQ ID NO: 314298 - RNA, 19 nt, Homo sapiens
aaacugaaaggcaugugaa

SEQ ID NO: 314299 - RNA, 19 nt, Homo sapiens
caauuugcacuuucaggaa

SEQ ID NO: 314300 - RNA, 19 nt, Homo sapiens
guaauugugccgguucuug

SEQ ID NO: 314301 - RNA, 19 nt, Homo sapiens
acaagccucuuccuaaggu

SEQ ID NO: 314302 - RNA, 19 nt, Homo sapiens
gauccugccccacugauua

SEQ ID NO: 314303 - RNA, 19 nt, Homo sapiens
ggugguucaucucuacaga

SEQ ID NO: 314304 - RNA, 19 nt, Homo sapiens
aguauccacuguuuauuca

SEQ ID NO: 314305 - RNA, 19 nt, Homo sapiens
gaaucuuuccuuccucuca

SEQ ID NO: 314306 - RNA, 19 nt, Homo sapiens
gaaaccuacagaauacuag

SEQ ID NO: 314307 - RNA, 19 nt, Homo sapiens
ggaggaaagcccuguacca

SEQ ID NO: 314308 - RNA, 19 nt, Homo sapiens
cucaggauccggaauguaa

SEQ ID NO: 314309 - RNA, 19 nt, Homo sapiens
ucagaguauccacuguuua

SEQ ID NO: 314310 - RNA, 19 nt, Homo sapiens
caugccugcuuuagaaugu

SEQ ID NO: 314311 - RNA, 19 nt, Homo sapiens
gaagagugcaaaacauuga

SEQ ID NO: 314312 - RNA, 19 nt, Homo sapiens
caucagaggacaccuguac

SEQ ID NO: 314313 - RNA, 19 nt, Homo sapiens
gaaaucccuucugagugau

SEQ ID NO: 314314 - RNA, 19 nt, Homo sapiens
gaauugaaaguagaagauc

SEQ ID NO: 314315 - RNA, 19 nt, Homo sapiens
ccaagaggaggcagcaaug

SEQ ID NO: 314316 - RNA, 19 nt, Homo sapiens
gagggaaaggugacucuca

SEQ ID NO: 314317 - RNA, 19 nt, Homo sapiens
ccuguaaucccagcacuuu

SEQ ID NO: 314318 - RNA, 19 nt, Homo sapiens
agaaaccuacagaauacua

SEQ ID NO: 314319 - RNA, 19 nt, Homo sapiens
cuagggugguucaucucua

SEQ ID NO: 314320 - RNA, 19 nt, Homo sapiens
acaagcuaggugcuaauua

SEQ ID NO: 314321 - RNA, 19 nt, Homo sapiens
ggucucagaaucuuuccuu

SEQ ID NO: 314322 - RNA, 19 nt, Homo sapiens
ccagagcuccuccuugucu

SEQ ID NO: 314323 - RNA, 19 nt, Homo sapiens
cuaagguccuguaagugau

SEQ ID NO: 314324 - RNA, 19 nt, Homo sapiens
gaaagugucucaaguacuc

SEQ ID NO: 314325 - RNA, 19 nt, Homo sapiens
gcugggagcuggaggguuu

SEQ ID NO: 314326 - RNA, 19 nt, Homo sapiens
caacgucacuuuacaccaa

SEQ ID NO: 314327 - RNA, 19 nt, Homo sapiens
caggaugucuguaaaauua

SEQ ID NO: 314328 - RNA, 19 nt, Homo sapiens
gcaaagcauugugcacuug

SEQ ID NO: 314329 - RNA, 19 nt, Homo sapiens
uaaagcaagugaacaagug

SEQ ID NO: 314330 - RNA, 19 nt, Homo sapiens
gcaaggcugcgccacgaua

SEQ ID NO: 314331 - RNA, 19 nt, Homo sapiens
uggaagaucugcugugcuu

SEQ ID NO: 314332 - RNA, 19 nt, Homo sapiens
ggaggacaguuaaguuugg

SEQ ID NO: 314333 - RNA, 19 nt, Homo sapiens
gggaaagugucucaaguac

SEQ ID NO: 314334 - RNA, 19 nt, Homo sapiens
gugaacaagugcaccaaga

SEQ ID NO: 314335 - RNA, 19 nt, Homo sapiens
ggaucucaccucuuugaaa

SEQ ID NO: 314336 - RNA, 19 nt, Homo sapiens
gcucugagaaguuggaaga

SEQ ID NO: 314337 - RNA, 19 nt, Homo sapiens
caaguacucacuagauguu

SEQ ID NO: 314338 - RNA, 19 nt, Homo sapiens
ccauaaagcaagugaacaa

SEQ ID NO: 314339 - RNA, 19 nt, Homo sapiens
ugagcaggaugucuguaaa

SEQ ID NO: 314340 - RNA, 19 nt, Homo sapiens
gaacaagugcaccaagaac

SEQ ID NO: 314341 - RNA, 19 nt, Homo sapiens
gugagcaggaugucuguaa

SEQ ID NO: 314342 - RNA, 19 nt, Homo sapiens
gacacccucuuacccucua

SEQ ID NO: 314343 - RNA, 19 nt, Homo sapiens
cgaacaucuugaucaguga

SEQ ID NO: 314344 - RNA, 19 nt, Homo sapiens
caaggcugcgccacgauaa

SEQ ID NO: 314345 - RNA, 19 nt, Homo sapiens
ugggaaagugucucaagua

SEQ ID NO: 314346 - RNA, 19 nt, Homo sapiens
guggaucucaccucuuuga

SEQ ID NO: 314347 - RNA, 19 nt, Homo sapiens
aagccgacauuuauuccuu

SEQ ID NO: 314348 - RNA, 19 nt, Homo sapiens
ugaacaagugcaccaagaa

SEQ ID NO: 314349 - RNA, 19 nt, Homo sapiens
cagcagucccucagagcua

SEQ ID NO: 314350 - RNA, 19 nt, Homo sapiens
cgcaaagcauugugcacuu

SEQ ID NO: 314351 - RNA, 19 nt, Homo sapiens
cugagaaguuggaagaucu

SEQ ID NO: 314352 - RNA, 19 nt, Homo sapiens
gccgacauuuauuccuuug

SEQ ID NO: 314353 - RNA, 19 nt, Homo sapiens
cucaaguacucacuagaug

SEQ ID NO: 314354 - RNA, 19 nt, Homo sapiens
acaguuaaguuugggaaag

SEQ ID NO: 314355 - RNA, 19 nt, Homo sapiens
uagcaucucggcggaguuu

SEQ ID NO: 314356 - RNA, 19 nt, Homo sapiens
gcuuccagacacccucuua

SEQ ID NO: 314357 - RNA, 19 nt, Homo sapiens
caguuaaguuugggaaagu

SEQ ID NO: 314358 - RNA, 19 nt, Homo sapiens
cuggaggacaguuaaguuu

SEQ ID NO: 314359 - RNA, 19 nt, Homo sapiens
ggaaagugucucaaguacu

SEQ ID NO: 314360 - RNA, 19 nt, Homo sapiens
guggcaacgucacuuuaca

SEQ ID NO: 314361 - RNA, 19 nt, Homo sapiens
ucaaguacucacuagaugu

SEQ ID NO: 314362 - RNA, 19 nt, Homo sapiens
caagaaccgacuagcaucu

SEQ ID NO: 314363 - RNA, 19 nt, Homo sapiens
gagcggcagcacauacugu

SEQ ID NO: 314364 - RNA, 19 nt, Homo sapiens
ucugagaaguuggaagauc

SEQ ID NO: 314365 - RNA, 19 nt, Homo sapiens
cgguguacaaggcgacuua

SEQ ID NO: 314366 - RNA, 19 nt, Homo sapiens
ccaauagccuagggaccau

SEQ ID NO: 314367 - RNA, 19 nt, Homo sapiens
aucacucucuggcaaauga

SEQ ID NO: 314368 - RNA, 19 nt, Homo sapiens
ucucaaguacucacuagau

SEQ ID NO: 314369 - RNA, 19 nt, Homo sapiens
ggcaaaugacuaccaagca

SEQ ID NO: 314370 - RNA, 19 nt, Homo sapiens
ccaucacucucuggcaaau

SEQ ID NO: 314371 - RNA, 19 nt, Homo sapiens
cgguugcucugagaaguug

SEQ ID NO: 314372 - RNA, 19 nt, Homo sapiens
gacuucgguugcucugaga

SEQ ID NO: 314373 - RNA, 19 nt, Homo sapiens
ccgcgaacaucuugaucag

SEQ ID NO: 314374 - RNA, 19 nt, Homo sapiens
ugucucaaguacucacuag

SEQ ID NO: 314375 - RNA, 19 nt, Homo sapiens
ucuggcaaaugacuaccaa

SEQ ID NO: 314376 - RNA, 19 nt, Homo sapiens
gcaggaugucuguaaaauu

SEQ ID NO: 314377 - RNA, 19 nt, Homo sapiens
ggguuuggcucgguguaca

SEQ ID NO: 314378 - RNA, 19 nt, Homo sapiens
guguuccuguggccauaaa

SEQ ID NO: 314379 - RNA, 19 nt, Homo sapiens
agaagaagcugcaggaaua

SEQ ID NO: 314380 - RNA, 19 nt, Homo sapiens
gaagguggguucaguagaa

SEQ ID NO: 314381 - RNA, 19 nt, Homo sapiens
ggaaugagcucugaagaca

SEQ ID NO: 314382 - RNA, 19 nt, Homo sapiens
cgacagggcuuucccauca

SEQ ID NO: 314383 - RNA, 19 nt, Homo sapiens
gaauaccgggucuuaauua

SEQ ID NO: 314384 - RNA, 19 nt, Homo sapiens
cuaaccagcucuauuauga

SEQ ID NO: 314385 - RNA, 19 nt, Homo sapiens
gaagggcccugauggcuau

SEQ ID NO: 314386 - RNA, 19 nt, Homo sapiens
cggcaagacugucacguua

SEQ ID NO: 314387 - RNA, 19 nt, Homo sapiens
gaagaaaacucugaaaaca

SEQ ID NO: 314388 - RNA, 19 nt, Homo sapiens
ggaaacagguggagaaaau

SEQ ID NO: 314389 - RNA, 19 nt, Homo sapiens
gcccaaagcccacaucuug

SEQ ID NO: 314390 - RNA, 19 nt, Homo sapiens
gcuaugaccuggaguuaag

SEQ ID NO: 314391 - RNA, 19 nt, Homo sapiens
gcaggaauaccgggucuua

SEQ ID NO: 314392 - RNA, 19 nt, Homo sapiens
gcaagacugucacguuagu

SEQ ID NO: 314393 - RNA, 19 nt, Homo sapiens
ggaauaccgggucuuaauu

SEQ ID NO: 314394 - RNA, 19 nt, Homo sapiens
gcagcuggaucuggacuuu

SEQ ID NO: 314395 - RNA, 19 nt, Homo sapiens
ccaguuugcuuucuacaau

SEQ ID NO: 314396 - RNA, 19 nt, Homo sapiens
ggucagauaucagcaaaca

SEQ ID NO: 314397 - RNA, 19 nt, Homo sapiens
gggcaaagaugagcgugaa

SEQ ID NO: 314398 - RNA, 19 nt, Homo sapiens
gccaugaggcacauuguua

SEQ ID NO: 314399 - RNA, 19 nt, Homo sapiens
ggagucggguucagaagga

SEQ ID NO: 314400 - RNA, 19 nt, Homo sapiens
gacccugacuggaaaguau

SEQ ID NO: 314401 - RNA, 19 nt, Homo sapiens
ugacagggcugaguaucuu

SEQ ID NO: 314402 - RNA, 19 nt, Homo sapiens
gcaacagggacagaauuua

SEQ ID NO: 314403 - RNA, 19 nt, Homo sapiens
acaacucccuguacaagaa

SEQ ID NO: 314404 - RNA, 19 nt, Homo sapiens
uagcagggcugauggaagu

SEQ ID NO: 314405 - RNA, 19 nt, Homo sapiens
cuaaggagaucgcagagau

SEQ ID NO: 314406 - RNA, 19 nt, Homo sapiens
gacgugcgguucccagaaa

SEQ ID NO: 314407 - RNA, 19 nt, Homo sapiens
cccaagagguucaauguag

SEQ ID NO: 314408 - RNA, 19 nt, Homo sapiens
caacagcccauccuucuuc

SEQ ID NO: 314409 - RNA, 19 nt, Homo sapiens
gaaaguauuccuggaguuc

SEQ ID NO: 314410 - RNA, 19 nt, Homo sapiens
gugaagcacuugcccaaag

SEQ ID NO: 314411 - RNA, 19 nt, Homo sapiens
ggaauuggaccgugucaag

SEQ ID NO: 314412 - RNA, 19 nt, Homo sapiens
ugaaguggaggaacuauga

SEQ ID NO: 314413 - RNA, 19 nt, Homo sapiens
gaccuggaguuaaguaugg

SEQ ID NO: 314414 - RNA, 19 nt, Homo sapiens
agaaggagccggcacauuc

SEQ ID NO: 314415 - RNA, 19 nt, Homo sapiens
cgagaugggcagcuccuua

SEQ ID NO: 314416 - RNA, 19 nt, Homo sapiens
acaucaagcugcuaacaau

SEQ ID NO: 314417 - RNA, 19 nt, Homo sapiens
ccaugacccugacuggaaa

SEQ ID NO: 314418 - RNA, 19 nt, Homo sapiens
ucacacacaucuucaucga

SEQ ID NO: 314419 - RNA, 19 nt, Homo sapiens
gccaguguuucgagaguuu

SEQ ID NO: 314420 - RNA, 19 nt, Homo sapiens
aaucuggguuuccuuaaga

SEQ ID NO: 314421 - RNA, 19 nt, Homo sapiens
cagcggcgacuuucaguuu

SEQ ID NO: 314422 - RNA, 19 nt, Homo sapiens
gcauggagccugagagucu

SEQ ID NO: 314423 - RNA, 19 nt, Homo sapiens
gcaacugggacgcaaagaa

SEQ ID NO: 314424 - RNA, 19 nt, Homo sapiens
ccucagaugugaaacucaa

SEQ ID NO: 314425 - RNA, 19 nt, Homo sapiens
gagcggcugcggaccauuu

SEQ ID NO: 314426 - RNA, 19 nt, Homo sapiens
gcccaugacucccuucaag

SEQ ID NO: 314427 - RNA, 19 nt, Homo sapiens
cuacauugcccgcuucuug

SEQ ID NO: 314428 - RNA, 19 nt, Homo sapiens
gaacuccauguccauugua

SEQ ID NO: 314429 - RNA, 19 nt, Homo sapiens
gagaugggcagcuccuuau

SEQ ID NO: 314430 - RNA, 19 nt, Homo sapiens
gagccagaguggaggaaug

SEQ ID NO: 314431 - RNA, 19 nt, Homo sapiens
gaagaggcugccacaguga

SEQ ID NO: 314432 - RNA, 19 nt, Homo sapiens
caauuaagcagguggugaa

SEQ ID NO: 314433 - RNA, 19 nt, Homo sapiens
gcagauggagcaugauauc

SEQ ID NO: 314434 - RNA, 19 nt, Homo sapiens
ggcggaacccagucuguua

SEQ ID NO: 314435 - RNA, 19 nt, Homo sapiens
gaaugaagcuggggucaga

SEQ ID NO: 314436 - RNA, 19 nt, Homo sapiens
caacagggacagaauuuac

SEQ ID NO: 314437 - RNA, 19 nt, Homo sapiens
ccaagcugcuccgcaacua

SEQ ID NO: 314438 - RNA, 19 nt, Homo sapiens
cagcaaacaccacaaguca

SEQ ID NO: 314439 - RNA, 19 nt, Homo sapiens
ccaaggcccugcucaucau

SEQ ID NO: 314440 - RNA, 19 nt, Homo sapiens
caucacauauaagggcuuu

SEQ ID NO: 314441 - RNA, 19 nt, Homo sapiens
uggaggaacugcagaugga

SEQ ID NO: 314442 - RNA, 19 nt, Homo sapiens
gauagaggaaggagagaga

SEQ ID NO: 314443 - RNA, 19 nt, Homo sapiens
gcacagcugaagcccauga

SEQ ID NO: 314444 - RNA, 19 nt, Homo sapiens
gcaaacaccacaagucacu

SEQ ID NO: 314445 - RNA, 19 nt, Homo sapiens
ugacacaucaagcugcuaa

SEQ ID NO: 314446 - RNA, 19 nt, Homo sapiens
gaaccagaacccagcugaa

SEQ ID NO: 314447 - RNA, 19 nt, Homo sapiens
ggacuuuaaucuggguuuc

SEQ ID NO: 314448 - RNA, 19 nt, Homo sapiens
caacugggacgcaaagaag

SEQ ID NO: 314449 - RNA, 19 nt, Homo sapiens
gacuggacauggagacaga

SEQ ID NO: 314450 - RNA, 19 nt, Homo sapiens
uggaugggcugaccuucaa

SEQ ID NO: 314451 - RNA, 19 nt, Homo sapiens
caugauauccggcacuaug

SEQ ID NO: 314452 - RNA, 19 nt, Homo sapiens
uagccaagaucuuuuauga

SEQ ID NO: 314453 - RNA, 19 nt, Homo sapiens
gggacagaauuuacugcaa

SEQ ID NO: 314454 - RNA, 19 nt, Homo sapiens
gccaugacccugacuggaa

SEQ ID NO: 314455 - RNA, 19 nt, Homo sapiens
gccaagaucuuuuaugaca

SEQ ID NO: 314456 - RNA, 19 nt, Homo sapiens
aaugagcucugaagacaca

SEQ ID NO: 314457 - RNA, 19 nt, Homo sapiens
uuccuaaccagcucuauua

SEQ ID NO: 314458 - RNA, 19 nt, Homo sapiens
uuaagcagguggugaagca

SEQ ID NO: 314459 - RNA, 19 nt, Homo sapiens
gaccaccuguuugcccuuu

SEQ ID NO: 314460 - RNA, 19 nt, Homo sapiens
gccggcacauucuacauug

SEQ ID NO: 314461 - RNA, 19 nt, Homo sapiens
caaugaagaccaggaguug

SEQ ID NO: 314462 - RNA, 19 nt, Homo sapiens
gcugauggaaguaaaggaa

SEQ ID NO: 314463 - RNA, 19 nt, Homo sapiens
gggcuaugaccuggaguua

SEQ ID NO: 314464 - RNA, 19 nt, Homo sapiens
ugaacuccauguccauugu

SEQ ID NO: 314465 - RNA, 19 nt, Homo sapiens
ugaaugcuaugaacuccau

SEQ ID NO: 314466 - RNA, 19 nt, Homo sapiens
ggagguuccuggagugacu

SEQ ID NO: 314467 - RNA, 19 nt, Homo sapiens
gaggaacuaugaggugaag

SEQ ID NO: 314468 - RNA, 19 nt, Homo sapiens
gagaaugacacaucaagcu

SEQ ID NO: 314469 - RNA, 19 nt, Homo sapiens
gggcuuucccaucaucuuu

SEQ ID NO: 314470 - RNA, 19 nt, Homo sapiens
uuaauuaccacccucauca

SEQ ID NO: 314471 - RNA, 19 nt, Homo sapiens
gaaggagccggcacauucu

SEQ ID NO: 314472 - RNA, 19 nt, Homo sapiens
cugagagucugguagcuau

SEQ ID NO: 314473 - RNA, 19 nt, Homo sapiens
ucacuucacacacaucuuc

SEQ ID NO: 314474 - RNA, 19 nt, Homo sapiens
caugguaccugaggacauc

SEQ ID NO: 314475 - RNA, 19 nt, Homo sapiens
gggaacaaguaucuucacu

SEQ ID NO: 314476 - RNA, 19 nt, Homo sapiens
ccaagacucgggucagguu

SEQ ID NO: 314477 - RNA, 19 nt, Homo sapiens
agcuggaucuggacuuuaa

SEQ ID NO: 314478 - RNA, 19 nt, Homo sapiens
guggaggaaugagcucuga

SEQ ID NO: 314479 - RNA, 19 nt, Homo sapiens
ggaaugauguugaaucuuu

SEQ ID NO: 314480 - RNA, 19 nt, Homo sapiens
guaaagcaaugccauguua

SEQ ID NO: 314481 - RNA, 19 nt, Homo sapiens
guacacaccugcuuccuua

SEQ ID NO: 314482 - RNA, 19 nt, Homo sapiens
caacaaaggcuauugguuu

SEQ ID NO: 314483 - RNA, 19 nt, Homo sapiens
ggacugaauuuauugugaa

SEQ ID NO: 314484 - RNA, 19 nt, Homo sapiens
gaagucaguuuaccucuca

SEQ ID NO: 314485 - RNA, 19 nt, Homo sapiens
gaagaccaccuaaauauca

SEQ ID NO: 314486 - RNA, 19 nt, Homo sapiens
ggaauuaaaguguaaguug

SEQ ID NO: 314487 - RNA, 19 nt, Homo sapiens
ucaaagacccuaagaauca

SEQ ID NO: 314488 - RNA, 19 nt, Homo sapiens
gaugaaggguguuacaugu

SEQ ID NO: 314489 - RNA, 19 nt, Homo sapiens
ccacauagcucuaaaacuu

SEQ ID NO: 314490 - RNA, 19 nt, Homo sapiens
uuacaucucuucuuccuau

SEQ ID NO: 314491 - RNA, 19 nt, Homo sapiens
gagcuuaccuuuugccuuu

SEQ ID NO: 314492 - RNA, 19 nt, Homo sapiens
ggacugugaccgacuuuaa

SEQ ID NO: 314493 - RNA, 19 nt, Homo sapiens
gcagucagccaauucauau

SEQ ID NO: 314494 - RNA, 19 nt, Homo sapiens
gagauuuacuccaacacaa

SEQ ID NO: 314495 - RNA, 19 nt, Homo sapiens
agagagagaagaaagaaua

SEQ ID NO: 314496 - RNA, 19 nt, Homo sapiens
gaauuugacacaagagaaa

SEQ ID NO: 314497 - RNA, 19 nt, Homo sapiens
gaaagaauacagagagcuu

SEQ ID NO: 314498 - RNA, 19 nt, Homo sapiens
ugaaagggcacuggacuua

SEQ ID NO: 314499 - RNA, 19 nt, Homo sapiens
gcagaggaggcaaauauga

SEQ ID NO: 314500 - RNA, 19 nt, Homo sapiens
ccauuugucuuauaacaug

SEQ ID NO: 314501 - RNA, 19 nt, Homo sapiens
ccaagaggaagucaguuua

SEQ ID NO: 314502 - RNA, 19 nt, Homo sapiens
ggaccgagagcccuaacua

SEQ ID NO: 314503 - RNA, 19 nt, Homo sapiens
gcuuacugcuuugcuaaua

SEQ ID NO: 314504 - RNA, 19 nt, Homo sapiens
uuaaggaucccacgacuuu

SEQ ID NO: 314505 - RNA, 19 nt, Homo sapiens
uaagcaaaccgucaacaaa

SEQ ID NO: 314506 - RNA, 19 nt, Homo sapiens
gcaagauuuucauguguua

SEQ ID NO: 314507 - RNA, 19 nt, Homo sapiens
ucuaugagauuuacuccaa

SEQ ID NO: 314508 - RNA, 19 nt, Homo sapiens
ccuaggaauuaaaguguaa

SEQ ID NO: 314509 - RNA, 19 nt, Homo sapiens
acagagagcuuaccuuuug

SEQ ID NO: 314510 - RNA, 19 nt, Homo sapiens
ugaaagagagagagaagaa

SEQ ID NO: 314511 - RNA, 19 nt, Homo sapiens
gugauucccuggucuacuu

SEQ ID NO: 314512 - RNA, 19 nt, Homo sapiens
uaucaaagacccuaagaau

SEQ ID NO: 314513 - RNA, 19 nt, Homo sapiens
ucucaggucuguuguagga

SEQ ID NO: 314514 - RNA, 19 nt, Homo sapiens
gagaaaagcaggaggaaaa

SEQ ID NO: 314515 - RNA, 19 nt, Homo sapiens
uuacaugugucucuucaau

SEQ ID NO: 314516 - RNA, 19 nt, Homo sapiens
uagcagaggaggcaaauau

SEQ ID NO: 314517 - RNA, 19 nt, Homo sapiens
gaaagagagagagaagaaa

SEQ ID NO: 314518 - RNA, 19 nt, Homo sapiens
ggugggagcgaaagccuua

SEQ ID NO: 314519 - RNA, 19 nt, Homo sapiens
acacaaauaggacugaauu

SEQ ID NO: 314520 - RNA, 19 nt, Homo sapiens
ucacugcuguucuucaugu

SEQ ID NO: 314521 - RNA, 19 nt, Homo sapiens
ugaaggguguuacaugugu

SEQ ID NO: 314522 - RNA, 19 nt, Homo sapiens
ccaguggccuaggaauuaa

SEQ ID NO: 314523 - RNA, 19 nt, Homo sapiens
caacacaaauaggacugaa

SEQ ID NO: 314524 - RNA, 19 nt, Homo sapiens
gauccagccugccuauaag

SEQ ID NO: 314525 - RNA, 19 nt, Homo sapiens
cgagagcccuaacuaaguc

SEQ ID NO: 314526 - RNA, 19 nt, Homo sapiens
gguaauucuucucguccua

SEQ ID NO: 314527 - RNA, 19 nt, Homo sapiens
ggagauuuccuguauagca

SEQ ID NO: 314528 - RNA, 19 nt, Homo sapiens
cauccaaaguauaaaggaa

SEQ ID NO: 314529 - RNA, 19 nt, Homo sapiens
ggucagggauugaaaauag

SEQ ID NO: 314530 - RNA, 19 nt, Homo sapiens
accaucaccuucuggaaua

SEQ ID NO: 314531 - RNA, 19 nt, Homo sapiens
ccaggaagcccucauugug

SEQ ID NO: 314532 - RNA, 19 nt, Homo sapiens
guauagcagucagccaauu

SEQ ID NO: 314533 - RNA, 19 nt, Homo sapiens
cuaguccaguuccugcuua

SEQ ID NO: 314534 - RNA, 19 nt, Homo sapiens
auacagagagcuuaccuuu

SEQ ID NO: 314535 - RNA, 19 nt, Homo sapiens
ggaugaaggguguuacaug

SEQ ID NO: 314536 - RNA, 19 nt, Homo sapiens
gcacuggacuuaguaucag

SEQ ID NO: 314537 - RNA, 19 nt, Homo sapiens
cauguuaugugguugaaag

SEQ ID NO: 314538 - RNA, 19 nt, Homo sapiens
ccuauaaggacaagauaaa

SEQ ID NO: 314539 - RNA, 19 nt, Homo sapiens
gccuaggaauuaaagugua

SEQ ID NO: 314540 - RNA, 19 nt, Homo sapiens
cuaguggaaugauguugaa

SEQ ID NO: 314541 - RNA, 19 nt, Homo sapiens
caggaagcccucauuguga

SEQ ID NO: 314542 - RNA, 19 nt, Homo sapiens
caauucauaugcuuugucu

SEQ ID NO: 314543 - RNA, 19 nt, Homo sapiens
aaagggcacuggacuuagu

SEQ ID NO: 314544 - RNA, 19 nt, Homo sapiens
gaccgagagcccuaacuaa

SEQ ID NO: 314545 - RNA, 19 nt, Homo sapiens
aagcauuguuucccuggua

SEQ ID NO: 314546 - RNA, 19 nt, Homo sapiens
cugaagaccaccuaaauau

SEQ ID NO: 314547 - RNA, 19 nt, Homo sapiens
ugucucugcuggcuucuuu

SEQ ID NO: 314548 - RNA, 19 nt, Homo sapiens
ggaagaauugaaagagaga

SEQ ID NO: 314549 - RNA, 19 nt, Homo sapiens
gagcgaaagccuuaaggau

SEQ ID NO: 314550 - RNA, 19 nt, Homo sapiens
caaucuuacuguacuggaa

SEQ ID NO: 314551 - RNA, 19 nt, Homo sapiens
guccuaaucucaaucuuac

SEQ ID NO: 314552 - RNA, 19 nt, Homo sapiens
ucugaagaccaccuaaaua

SEQ ID NO: 314553 - RNA, 19 nt, Homo sapiens
ugauccagccugccuauaa

SEQ ID NO: 314554 - RNA, 19 nt, Homo sapiens
ucugucaucugucuaccua

SEQ ID NO: 314555 - RNA, 19 nt, Homo sapiens
gaauugaaagagagagaga

SEQ ID NO: 314556 - RNA, 19 nt, Homo sapiens
uaacaugacccagcccuau

SEQ ID NO: 314557 - RNA, 19 nt, Homo sapiens
caucucuucuuccuauguu

SEQ ID NO: 314558 - RNA, 19 nt, Homo sapiens
uaccucauccaaaguauaa

SEQ ID NO: 314559 - RNA, 19 nt, Homo sapiens
ggaccucuguuagucacuu

SEQ ID NO: 314560 - RNA, 19 nt, Homo sapiens
ggaaacgucaccggaauca

SEQ ID NO: 314561 - RNA, 19 nt, Homo sapiens
cguccuaaucucaaucuua

SEQ ID NO: 314562 - RNA, 19 nt, Homo sapiens
guggaaugauguugaaucu

SEQ ID NO: 314563 - RNA, 19 nt, Homo sapiens
cuaaauucagccucauaua

SEQ ID NO: 314564 - RNA, 19 nt, Homo sapiens
gcuacucaguguuugaauc

SEQ ID NO: 314565 - RNA, 19 nt, Homo sapiens
uccaguggccuaggaauua

SEQ ID NO: 314566 - RNA, 19 nt, Homo sapiens
gcuaguggaaugauguuga

SEQ ID NO: 314567 - RNA, 19 nt, Homo sapiens
aaagauauuguuccagcua

SEQ ID NO: 314568 - RNA, 19 nt, Homo sapiens
acaugugucucuucaauac

SEQ ID NO: 314569 - RNA, 19 nt, Homo sapiens
uucaguaucuucugcuuug

SEQ ID NO: 314570 - RNA, 19 nt, Homo sapiens
gugaccgacuuuaagcaaa

SEQ ID NO: 314571 - RNA, 19 nt, Homo sapiens
gaauaucacccuggaggau

SEQ ID NO: 314572 - RNA, 19 nt, Homo sapiens
ucacuuuaccucauccaaa

SEQ ID NO: 314573 - RNA, 19 nt, Homo sapiens
ucacacagcacccugaaag

SEQ ID NO: 314574 - RNA, 19 nt, Homo sapiens
cagcauccuccauaucaaa

SEQ ID NO: 314575 - RNA, 19 nt, Homo sapiens
guccauuugucuuauaaca

SEQ ID NO: 314576 - RNA, 19 nt, Homo sapiens
aaagaauacagagagcuua

SEQ ID NO: 314577 - RNA, 19 nt, Homo sapiens
guuagucacuuuaccucau

SEQ ID NO: 314578 - RNA, 19 nt, Homo sapiens
gaccucuguuagucacuuu

SEQ ID NO: 314579 - RNA, 19 nt, Homo sapiens
ugaagaaaccaaagcaguu

SEQ ID NO: 314580 - RNA, 19 nt, Homo sapiens
ccugaggccucgagugugu

SEQ ID NO: 314581 - RNA, 19 nt, Homo sapiens
ggaaaccccuccgcuucua

SEQ ID NO: 314582 - RNA, 19 nt, Homo sapiens
ccagugagccggcuguagu

SEQ ID NO: 314583 - RNA, 19 nt, Homo sapiens
acacaggccugagcaaagg

SEQ ID NO: 314584 - RNA, 19 nt, Homo sapiens
gcccauaccgcagcaucua

SEQ ID NO: 314585 - RNA, 19 nt, Homo sapiens
ccauaccgcagcaucuauu

SEQ ID NO: 314586 - RNA, 19 nt, Homo sapiens
gcagaugaagaaaccaaag

SEQ ID NO: 314587 - RNA, 19 nt, Homo sapiens
ggccugcccagacaagauu

SEQ ID NO: 314588 - RNA, 19 nt, Homo sapiens
acacacaggccugagcaaa

SEQ ID NO: 314589 - RNA, 19 nt, Homo sapiens
ucaguguggucgacagagu

SEQ ID NO: 314590 - RNA, 19 nt, Homo sapiens
ccgcuuugcagaugaagaa

SEQ ID NO: 314591 - RNA, 19 nt, Homo sapiens
ucgcagcacccuccggaaa

SEQ ID NO: 314592 - RNA, 19 nt, Homo sapiens
aagaagcagcgaccagcua

SEQ ID NO: 314593 - RNA, 19 nt, Homo sapiens
guccggcgacuuccuaaug

SEQ ID NO: 314594 - RNA, 19 nt, Homo sapiens
gcccuggccaucaacaaga

SEQ ID NO: 314595 - RNA, 19 nt, Homo sapiens
cauaccgcagcaucuauuu

SEQ ID NO: 314596 - RNA, 19 nt, Homo sapiens
gaagcagcgaccagcuaga

SEQ ID NO: 314597 - RNA, 19 nt, Homo sapiens
guaccagacuucaccauua

SEQ ID NO: 314598 - RNA, 19 nt, Homo sapiens
cgaaggaccugcugauauu

SEQ ID NO: 314599 - RNA, 19 nt, Homo sapiens
uaaagaaggugccugaguu

SEQ ID NO: 314600 - RNA, 19 nt, Homo sapiens
acaaggagcuggcagagaa

SEQ ID NO: 314601 - RNA, 19 nt, Homo sapiens
gagaccagguaauuucuaa

SEQ ID NO: 314602 - RNA, 19 nt, Homo sapiens
caacauggaggacaucuuu

SEQ ID NO: 314603 - RNA, 19 nt, Homo sapiens
uaggcuagcuguuaaauau

SEQ ID NO: 314604 - RNA, 19 nt, Homo sapiens
ggguaggccuguagacuaa

SEQ ID NO: 314605 - RNA, 19 nt, Homo sapiens
gaaacaacauggaggacau

SEQ ID NO: 314606 - RNA, 19 nt, Homo sapiens
gcaagagaccagguaauuu

SEQ ID NO: 314607 - RNA, 19 nt, Homo sapiens
caagagaccagguaauuuc

SEQ ID NO: 314608 - RNA, 19 nt, Homo sapiens
gagauuguaaccuuucuaa

SEQ ID NO: 314609 - RNA, 19 nt, Homo sapiens
gcuuuaggcuagcuguuaa

SEQ ID NO: 314610 - RNA, 19 nt, Homo sapiens
aaagugcucucaguugaaa

SEQ ID NO: 314611 - RNA, 19 nt, Homo sapiens
gccaguggauugcugagaa

SEQ ID NO: 314612 - RNA, 19 nt, Homo sapiens
ccgcgaguauucccacuuu

SEQ ID NO: 314613 - RNA, 19 nt, Homo sapiens
uaccagacuucaccauuau

SEQ ID NO: 314614 - RNA, 19 nt, Homo sapiens
ugaggagauuguaaccuuu

SEQ ID NO: 314615 - RNA, 19 nt, Homo sapiens
ucgcagaggacaagccuua

SEQ ID NO: 314616 - RNA, 19 nt, Homo sapiens
gggaaaggguaggccugua

SEQ ID NO: 314617 - RNA, 19 nt, Homo sapiens
gaccagguaauuucuaaga

SEQ ID NO: 314618 - RNA, 19 nt, Homo sapiens
ggugauaucggcugcuuug

SEQ ID NO: 314619 - RNA, 19 nt, Homo sapiens
gcaauuaaagaucacuugu

SEQ ID NO: 314620 - RNA, 19 nt, Homo sapiens
gaaaggguaggccuguaga

SEQ ID NO: 314621 - RNA, 19 nt, Homo sapiens
gugaaaugcucagcuauac

SEQ ID NO: 314622 - RNA, 19 nt, Homo sapiens
ggaaaggguaggccuguag

SEQ ID NO: 314623 - RNA, 19 nt, Homo sapiens
ggcuagcuguuaaauaugu

SEQ ID NO: 314624 - RNA, 19 nt, Homo sapiens
caacacggagucaggaaga

SEQ ID NO: 314625 - RNA, 19 nt, Homo sapiens
ccugugcggugcagcagua

SEQ ID NO: 314626 - RNA, 19 nt, Homo sapiens
aauaugugacccagcauua

SEQ ID NO: 314627 - RNA, 19 nt, Homo sapiens
gcagaggacaagccuuaug

SEQ ID NO: 314628 - RNA, 19 nt, Homo sapiens
ggucugauacucccuuugu

SEQ ID NO: 314629 - RNA, 19 nt, Homo sapiens
ugugugaaaugcucagcua

SEQ ID NO: 314630 - RNA, 19 nt, Homo sapiens
gaugaagagugagaagaag

SEQ ID NO: 314631 - RNA, 19 nt, Homo sapiens
gagaugaggcagcaacaca

SEQ ID NO: 314632 - RNA, 19 nt, Homo sapiens
aaagaaggugccugaguuu

SEQ ID NO: 314633 - RNA, 19 nt, Homo sapiens
caaccugcccuuccucuuc

SEQ ID NO: 314634 - RNA, 19 nt, Homo sapiens
caacucuguuccagccuau

SEQ ID NO: 314635 - RNA, 19 nt, Homo sapiens
gacaaccgcaucucacaga

SEQ ID NO: 314636 - RNA, 19 nt, Homo sapiens
caaagugcucucaguugaa

SEQ ID NO: 314637 - RNA, 19 nt, Homo sapiens
gaagguagugacuccugaa

SEQ ID NO: 314638 - RNA, 19 nt, Homo sapiens
ccgaaggaccugcugauau

SEQ ID NO: 314639 - RNA, 19 nt, Homo sapiens
gcaaggacaggcucuuucu

SEQ ID NO: 314640 - RNA, 19 nt, Homo sapiens
ugugaaaugcucagcuaua

SEQ ID NO: 314641 - RNA, 19 nt, Homo sapiens
gugccaacccugugugaaa

SEQ ID NO: 314642 - RNA, 19 nt, Homo sapiens
uugaggagauuguaaccuu

SEQ ID NO: 314643 - RNA, 19 nt, Homo sapiens
gguagugacuccugaacac

SEQ ID NO: 314644 - RNA, 19 nt, Homo sapiens
gaaccugcuuacccugaag

SEQ ID NO: 314645 - RNA, 19 nt, Homo sapiens
cacccaaguucauugaugu

SEQ ID NO: 314646 - RNA, 19 nt, Homo sapiens
acacccaaguucauugaug

SEQ ID NO: 314647 - RNA, 19 nt, Homo sapiens
gaagaagguggugguggaa

SEQ ID NO: 314648 - RNA, 19 nt, Homo sapiens
ugaugaagagugagaagaa

SEQ ID NO: 314649 - RNA, 19 nt, Homo sapiens
ggcuuuaggcuagcuguua

SEQ ID NO: 314650 - RNA, 19 nt, Homo sapiens
gcaguacccaggugauauc

SEQ ID NO: 314651 - RNA, 19 nt, Homo sapiens
aaccgcaucucacagaaga

SEQ ID NO: 314652 - RNA, 19 nt, Homo sapiens
ccacaacccagacaccaau

SEQ ID NO: 314653 - RNA, 19 nt, Homo sapiens
ccagacuucaccauuauga

SEQ ID NO: 314654 - RNA, 19 nt, Homo sapiens
cagcaguacccaggugaua

SEQ ID NO: 314655 - RNA, 19 nt, Homo sapiens
caggacagcuugggcucaa

SEQ ID NO: 314656 - RNA, 19 nt, Homo sapiens
gcagaggaggaaagggaaa

SEQ ID NO: 314657 - RNA, 19 nt, Homo sapiens
gccaggcucuugccaacuc

SEQ ID NO: 314658 - RNA, 19 nt, Homo sapiens
caagccuuaugcagaguug

SEQ ID NO: 314659 - RNA, 19 nt, Homo sapiens
ugaaccugcuuacccugaa

SEQ ID NO: 314660 - RNA, 19 nt, Homo sapiens
gaggagauuguaaccuuuc

SEQ ID NO: 314661 - RNA, 19 nt, Homo sapiens
caauuaaagaucacuugug

SEQ ID NO: 314662 - RNA, 19 nt, Homo sapiens
gagcaagagaccagguaau

SEQ ID NO: 314663 - RNA, 19 nt, Homo sapiens
gagggagcgugaagguagu

SEQ ID NO: 314664 - RNA, 19 nt, Homo sapiens
gccgaaggaccugcugaua

SEQ ID NO: 314665 - RNA, 19 nt, Homo sapiens
cagcaaggacaggcucuuu

SEQ ID NO: 314666 - RNA, 19 nt, Homo sapiens
agaaggugccugaguuuca

SEQ ID NO: 314667 - RNA, 19 nt, Homo sapiens
ggagauuguaaccuuucua

SEQ ID NO: 314668 - RNA, 19 nt, Homo sapiens
uuacacccuuguucuguca

SEQ ID NO: 314669 - RNA, 19 nt, Homo sapiens
ugacacccaaguucauuga

SEQ ID NO: 314670 - RNA, 19 nt, Homo sapiens
agaagguggugguggaaca

SEQ ID NO: 314671 - RNA, 19 nt, Homo sapiens
gagacugcguggagugcau

SEQ ID NO: 314672 - RNA, 19 nt, Homo sapiens
ccaguugaggagauuguaa

SEQ ID NO: 314673 - RNA, 19 nt, Homo sapiens
gaaggaccugcugauauuc

SEQ ID NO: 314674 - RNA, 19 nt, Homo sapiens
ggacagcuugggcucaaag

SEQ ID NO: 314675 - RNA, 19 nt, Homo sapiens
uguagacuaacgcuguuua

SEQ ID NO: 314676 - RNA, 19 nt, Homo sapiens
cagagcaagagaccaggua

SEQ ID NO: 314677 - RNA, 19 nt, Homo sapiens
ccagguggaaccaucuuug

SEQ ID NO: 314678 - RNA, 19 nt, Homo sapiens
cuggcucugucacugaaua

SEQ ID NO: 314679 - RNA, 19 nt, Homo sapiens
ggaagaccccuaccucuca

SEQ ID NO: 314680 - RNA, 19 nt, Homo sapiens
cagcaacacaccugaagca

SEQ ID NO: 314681 - RNA, 19 nt, Homo sapiens
cuaaagaaggugccugagu

SEQ ID NO: 314682 - RNA, 19 nt, Homo sapiens
uuagguauacccuggaaga

SEQ ID NO: 314683 - RNA, 19 nt, Homo sapiens
gcucugucacugaauacaa

SEQ ID NO: 314684 - RNA, 19 nt, Homo sapiens
uggagugcauggcguguuc

SEQ ID NO: 314685 - RNA, 19 nt, Homo sapiens
ccuguagacuaacgcuguu

SEQ ID NO: 314686 - RNA, 19 nt, Homo sapiens
agcaagagaccagguaauu

SEQ ID NO: 314687 - RNA, 19 nt, Homo sapiens
gaggagggagcgugaaggu

SEQ ID NO: 314688 - RNA, 19 nt, Homo sapiens
ccugcugucugcuguaaag

SEQ ID NO: 314689 - RNA, 19 nt, Homo sapiens
gaagaccccuaccucucaa

SEQ ID NO: 314690 - RNA, 19 nt, Homo sapiens
acaaccgcaucucacagaa

SEQ ID NO: 314691 - RNA, 19 nt, Homo sapiens
caggugauaucggcugcuu

SEQ ID NO: 314692 - RNA, 19 nt, Homo sapiens
caaccacaagccagagaug

SEQ ID NO: 314693 - RNA, 19 nt, Homo sapiens
caaagcaauuaaagaucac

SEQ ID NO: 314694 - RNA, 19 nt, Homo sapiens
gcucuugccaacucuguuc

SEQ ID NO: 314695 - RNA, 19 nt, Homo sapiens
aggcacacccuaacaagga

SEQ ID NO: 314696 - RNA, 19 nt, Homo sapiens
aaccugcccuuccucuuca

SEQ ID NO: 314697 - RNA, 19 nt, Homo sapiens
gcaacuaacuguuuacaua

SEQ ID NO: 314698 - RNA, 19 nt, Homo sapiens
ucacuaagcuccuccuuua

SEQ ID NO: 314699 - RNA, 19 nt, Homo sapiens
gauaguaggccuucaauaa

SEQ ID NO: 314700 - RNA, 19 nt, Homo sapiens
gaacccagccuccuugaaa

SEQ ID NO: 314701 - RNA, 19 nt, Homo sapiens
gcuaaacucucgagacuuc

SEQ ID NO: 314702 - RNA, 19 nt, Homo sapiens
gggaaaggaacaugauuua

SEQ ID NO: 314703 - RNA, 19 nt, Homo sapiens
caagagaccuguuaucaac

SEQ ID NO: 314704 - RNA, 19 nt, Homo sapiens
gcacugaucuuacucuacu

SEQ ID NO: 314705 - RNA, 19 nt, Homo sapiens
aauaggaucucguuaauca

SEQ ID NO: 314706 - RNA, 19 nt, Homo sapiens
ugaagaauguguuccuaaa

SEQ ID NO: 314707 - RNA, 19 nt, Homo sapiens
gaaaacaaauccaggacua

SEQ ID NO: 314708 - RNA, 19 nt, Homo sapiens
ccaaaguucuuaucucuag

SEQ ID NO: 314709 - RNA, 19 nt, Homo sapiens
ccaauaggaucucguuaau

SEQ ID NO: 314710 - RNA, 19 nt, Homo sapiens
uauccgaacuacuguuaua

SEQ ID NO: 314711 - RNA, 19 nt, Homo sapiens
ugaagaauguuaccuguca

SEQ ID NO: 314712 - RNA, 19 nt, Homo sapiens
gagcuaaacucucgagacu

SEQ ID NO: 314713 - RNA, 19 nt, Homo sapiens
gguccugccucuuugagua

SEQ ID NO: 314714 - RNA, 19 nt, Homo sapiens
ugacgaggauugagauaau

SEQ ID NO: 314715 - RNA, 19 nt, Homo sapiens
gcacugugaugcuuuaugc

SEQ ID NO: 314716 - RNA, 19 nt, Homo sapiens
ggacauaguaaaugauuca

SEQ ID NO: 314717 - RNA, 19 nt, Homo sapiens
ccuaggacauaguaaauga

SEQ ID NO: 314718 - RNA, 19 nt, Homo sapiens
gcaaagugcaccucaaauc

SEQ ID NO: 314719 - RNA, 19 nt, Homo sapiens
caccucaaaucuucuaauu

SEQ ID NO: 314720 - RNA, 19 nt, Homo sapiens
gguggaagcugccucaucu

SEQ ID NO: 314721 - RNA, 19 nt, Homo sapiens
ccgaacuacuguuauaauu

SEQ ID NO: 314722 - RNA, 19 nt, Homo sapiens
ucacuucuccuuuaaauuc

SEQ ID NO: 314723 - RNA, 19 nt, Homo sapiens
cuacucacuucuccuuuaa

SEQ ID NO: 314724 - RNA, 19 nt, Homo sapiens
gcucagacaucuacuacag

SEQ ID NO: 314725 - RNA, 19 nt, Homo sapiens
caucuauucucugccuuua

SEQ ID NO: 314726 - RNA, 19 nt, Homo sapiens
ccaaguagcugggaguaca

SEQ ID NO: 314727 - RNA, 19 nt, Homo sapiens
ggaacaugauuuauuuguc

SEQ ID NO: 314728 - RNA, 19 nt, Homo sapiens
gacggagccuugccuguug

SEQ ID NO: 314729 - RNA, 19 nt, Homo sapiens
uaguaggccuucaauaaau

SEQ ID NO: 314730 - RNA, 19 nt, Homo sapiens
uuacaguccuucaagauuc

SEQ ID NO: 314731 - RNA, 19 nt, Homo sapiens
ggagaacugcgaagaggaa

SEQ ID NO: 314732 - RNA, 19 nt, Homo sapiens
gaagaauguuaccugucaa

SEQ ID NO: 314733 - RNA, 19 nt, Homo sapiens
ccaaagugcugggauuaca

SEQ ID NO: 314734 - RNA, 19 nt, Homo sapiens
acuacucacuucuccuuua

SEQ ID NO: 314735 - RNA, 19 nt, Homo sapiens
ucagauaccugugaagaag

SEQ ID NO: 314736 - RNA, 19 nt, Homo sapiens
ggaccugccuggagaugca

SEQ ID NO: 314737 - RNA, 19 nt, Homo sapiens
ggaaaggaacaugauuuau

SEQ ID NO: 314738 - RNA, 19 nt, Homo sapiens
gcacagccccagcuaauuu

SEQ ID NO: 314739 - RNA, 19 nt, Homo sapiens
ccucaaaucuucuaauucc

SEQ ID NO: 314740 - RNA, 19 nt, Homo sapiens
ggugaccgcucugcaucua

SEQ ID NO: 314741 - RNA, 19 nt, Homo sapiens
aagcagaccuccccaagua

SEQ ID NO: 314742 - RNA, 19 nt, Homo sapiens
ggugaagaauguguuccua

SEQ ID NO: 314743 - RNA, 19 nt, Homo sapiens
ccuaguagcugggauuaca

SEQ ID NO: 314744 - RNA, 19 nt, Homo sapiens
gcacacuacaggagacuga

SEQ ID NO: 314745 - RNA, 19 nt, Homo sapiens
ggacugcaaugcuuuaccu

SEQ ID NO: 314746 - RNA, 19 nt, Homo sapiens
caagucagcagccaagaug

SEQ ID NO: 314747 - RNA, 19 nt, Homo sapiens
uuaaugucuuugagccuua

SEQ ID NO: 314748 - RNA, 19 nt, Homo sapiens
ccagauggacuaccgaaga

SEQ ID NO: 314749 - RNA, 19 nt, Homo sapiens
ccaagagaccuguuaucaa

SEQ ID NO: 314750 - RNA, 19 nt, Homo sapiens
ccuuggaccugaagaaugu

SEQ ID NO: 314751 - RNA, 19 nt, Homo sapiens
uauauccgaacuacuguua

SEQ ID NO: 314752 - RNA, 19 nt, Homo sapiens
cuaauuccaagauccaaua

SEQ ID NO: 314753 - RNA, 19 nt, Homo sapiens
agacuucucugugaacuuc

SEQ ID NO: 314754 - RNA, 19 nt, Homo sapiens
cagauggacuaccgaagau

SEQ ID NO: 314755 - RNA, 19 nt, Homo sapiens
ucccaaaguguuaggauua

SEQ ID NO: 314756 - RNA, 19 nt, Homo sapiens
caaagugcaccucaaaucu

SEQ ID NO: 314757 - RNA, 19 nt, Homo sapiens
gauggacuaccgaagauug

SEQ ID NO: 314758 - RNA, 19 nt, Homo sapiens
gaauguuaccugucaaugg

SEQ ID NO: 314759 - RNA, 19 nt, Homo sapiens
ccagagaucccaagaacuc

SEQ ID NO: 314760 - RNA, 19 nt, Homo sapiens
auaguaggccuucaauaaa

SEQ ID NO: 314761 - RNA, 19 nt, Homo sapiens
ucauauauccgaacuacug

SEQ ID NO: 314762 - RNA, 19 nt, Homo sapiens
ggauucaauuccuguccuu

SEQ ID NO: 314763 - RNA, 19 nt, Homo sapiens
ggcaggcucauuucacuaa

SEQ ID NO: 314764 - RNA, 19 nt, Homo sapiens
uacuauauguugaccauuc

SEQ ID NO: 314765 - RNA, 19 nt, Homo sapiens
uuccuguccuucacauuua

SEQ ID NO: 314766 - RNA, 19 nt, Homo sapiens
gaaaacaagccuccacuuc

SEQ ID NO: 314767 - RNA, 19 nt, Homo sapiens
ugucugcccucacaauuag

SEQ ID NO: 314768 - RNA, 19 nt, Homo sapiens
guccuaggccaguaccuua

SEQ ID NO: 314769 - RNA, 19 nt, Homo sapiens
gugaagaauguguuccuaa

SEQ ID NO: 314770 - RNA, 19 nt, Homo sapiens
aguaggccuucaauaaauu

SEQ ID NO: 314771 - RNA, 19 nt, Homo sapiens
ccaaucccaucuauucucu

SEQ ID NO: 314772 - RNA, 19 nt, Homo sapiens
ucuagcauuucuuccaauu

SEQ ID NO: 314773 - RNA, 19 nt, Homo sapiens
caccacacacagcuaauuu

SEQ ID NO: 314774 - RNA, 19 nt, Homo sapiens
ugacagcauuauucacauc

SEQ ID NO: 314775 - RNA, 19 nt, Homo sapiens
gaccauuccaaaguucuua

SEQ ID NO: 314776 - RNA, 19 nt, Homo sapiens
cugccaccaugccuaauuu

SEQ ID NO: 314777 - RNA, 19 nt, Homo sapiens
cuaagcuccuccuuuacuu

SEQ ID NO: 314778 - RNA, 19 nt, Homo sapiens
gugggcaucuggaauugga

SEQ ID NO: 314779 - RNA, 19 nt, Homo sapiens
gaagaauguguuccuaaac

SEQ ID NO: 314780 - RNA, 19 nt, Homo sapiens
gagggaaaggaacaugauu

SEQ ID NO: 314781 - RNA, 19 nt, Homo sapiens
cauuuacucuugagacuac

SEQ ID NO: 314782 - RNA, 19 nt, Homo sapiens
cuuccucucuccucuuuga

SEQ ID NO: 314783 - RNA, 19 nt, Homo sapiens
cuacugcugcugacauaaa

SEQ ID NO: 314784 - RNA, 19 nt, Homo sapiens
ccggcugaguguacuagua

SEQ ID NO: 314785 - RNA, 19 nt, Homo sapiens
ucacuugcuucugggauga

SEQ ID NO: 314786 - RNA, 19 nt, Homo sapiens
ccaggauggucucgauauc

SEQ ID NO: 314787 - RNA, 19 nt, Homo sapiens
ugccucagccucccaagua

SEQ ID NO: 314788 - RNA, 19 nt, Homo sapiens
acucacuucuccuuuaaau

SEQ ID NO: 314789 - RNA, 19 nt, Homo sapiens
uccaauaggaucucguuaa

SEQ ID NO: 314790 - RNA, 19 nt, Homo sapiens
aaagugcaccucaaaucuu

SEQ ID NO: 314791 - RNA, 19 nt, Homo sapiens
ugccaaccauuccuaccua

SEQ ID NO: 314792 - RNA, 19 nt, Homo sapiens
gaacugcgaagaggaagag

SEQ ID NO: 314793 - RNA, 19 nt, Homo sapiens
guaggccuucaauaaauuu

SEQ ID NO: 314794 - RNA, 19 nt, Homo sapiens
ucuccaaucccaucuauuc

SEQ ID NO: 314795 - RNA, 19 nt, Homo sapiens
gcccaaggccacagucuca

SEQ ID NO: 314796 - RNA, 19 nt, Homo sapiens
cagcauuauucacauccuu

SEQ ID NO: 314797 - RNA, 19 nt, Homo sapiens
ggaaguaccugcccacgua

SEQ ID NO: 314798 - RNA, 19 nt, Homo sapiens
gcaaauuacccuccuuaaa

SEQ ID NO: 314799 - RNA, 19 nt, Homo sapiens
ucaaggaggucuggcuuua

SEQ ID NO: 314800 - RNA, 19 nt, Homo sapiens
agaaagagauaccaagaug

SEQ ID NO: 314801 - RNA, 19 nt, Homo sapiens
gaggacggcuucucucuuc

SEQ ID NO: 314802 - RNA, 19 nt, Homo sapiens
caacggccaugaggaagua

SEQ ID NO: 314803 - RNA, 19 nt, Homo sapiens
gaacuccuauccuacuuca

SEQ ID NO: 314804 - RNA, 19 nt, Homo sapiens
ccaagcagcugguggacaa

SEQ ID NO: 314805 - RNA, 19 nt, Homo sapiens
gagcaaauuacccuccuua

SEQ ID NO: 314806 - RNA, 19 nt, Homo sapiens
gaaccaaauugcaguggau

SEQ ID NO: 314807 - RNA, 19 nt, Homo sapiens
ccauggaacuccuauccua

SEQ ID NO: 314808 - RNA, 19 nt, Homo sapiens
gggaguguuucauggguua

SEQ ID NO: 314809 - RNA, 19 nt, Homo sapiens
gcccggagcaggacaaaua

SEQ ID NO: 314810 - RNA, 19 nt, Homo sapiens
caaauuacccuccuuaaac

SEQ ID NO: 314811 - RNA, 19 nt, Homo sapiens
caggagcgcucacucaugu

SEQ ID NO: 314812 - RNA, 19 nt, Homo sapiens
ucacugaaguucuccugaa

SEQ ID NO: 314813 - RNA, 19 nt, Homo sapiens
ccacuuguauccucugguu

SEQ ID NO: 314814 - RNA, 19 nt, Homo sapiens
gagcaggucaugaggauug

SEQ ID NO: 314815 - RNA, 19 nt, Homo sapiens
uaugugaccuugagcaaau

SEQ ID NO: 314816 - RNA, 19 nt, Homo sapiens
caagaaagagauaccaaga

SEQ ID NO: 314817 - RNA, 19 nt, Homo sapiens
gcacagcucaggaacuaga

SEQ ID NO: 314818 - RNA, 19 nt, Homo sapiens
aaauuacccuccuuaaaca

SEQ ID NO: 314819 - RNA, 19 nt, Homo sapiens
caucaucgguacccaguuc

SEQ ID NO: 314820 - RNA, 19 nt, Homo sapiens
ccugauuucuugcuuauuc

SEQ ID NO: 314821 - RNA, 19 nt, Homo sapiens
uuucauggguuauguguau

SEQ ID NO: 314822 - RNA, 19 nt, Homo sapiens
gccaacgucuucaccaaug

SEQ ID NO: 314823 - RNA, 19 nt, Homo sapiens
ucaacgcgcucacuuccuu

SEQ ID NO: 314824 - RNA, 19 nt, Homo sapiens
ucauuugugugcucaugua

SEQ ID NO: 314825 - RNA, 19 nt, Homo sapiens
gacuagacguucauuugug

SEQ ID NO: 314826 - RNA, 19 nt, Homo sapiens
ccacguaccguuccuacaa

SEQ ID NO: 314827 - RNA, 19 nt, Homo sapiens
gcauauagaggcaagaaag

SEQ ID NO: 314828 - RNA, 19 nt, Homo sapiens
gugcgaaguauauaaauug

SEQ ID NO: 314829 - RNA, 19 nt, Homo sapiens
ucaccaccgugucuaagaa

SEQ ID NO: 314830 - RNA, 19 nt, Homo sapiens
ggaccugccugcucugaac

SEQ ID NO: 314831 - RNA, 19 nt, Homo sapiens
uuacaucugucaugguuuc

SEQ ID NO: 314832 - RNA, 19 nt, Homo sapiens
caucugucaugguuucuug

SEQ ID NO: 314833 - RNA, 19 nt, Homo sapiens
aauuacaucugucaugguu

SEQ ID NO: 314834 - RNA, 19 nt, Homo sapiens
gauccgggagcgauuguuu

SEQ ID NO: 314835 - RNA, 19 nt, Homo sapiens
guacuaggcgugagaagca

SEQ ID NO: 314836 - RNA, 19 nt, Homo sapiens
gaucaucugcgacaacaca

SEQ ID NO: 314837 - RNA, 19 nt, Homo sapiens
ccaacaacaucgacaucug

SEQ ID NO: 314838 - RNA, 19 nt, Homo sapiens
ggaccacgaccucgacuuc

SEQ ID NO: 314839 - RNA, 19 nt, Homo sapiens
ucagaugcaugguggacuu

SEQ ID NO: 314840 - RNA, 19 nt, Homo sapiens
cuucuucucuucucucaga

SEQ ID NO: 314841 - RNA, 19 nt, Homo sapiens
ggucuggcuuuauccauag

SEQ ID NO: 314842 - RNA, 19 nt, Homo sapiens
gcugugugguugacuuaug

SEQ ID NO: 314843 - RNA, 19 nt, Homo sapiens
gugacuagacguucauuug

SEQ ID NO: 314844 - RNA, 19 nt, Homo sapiens
gagaucuccuugcccuaga

SEQ ID NO: 314845 - RNA, 19 nt, Homo sapiens
guacacuuccugcauugaa

SEQ ID NO: 314846 - RNA, 19 nt, Homo sapiens
gaaauuggcgaggaaacug

SEQ ID NO: 314847 - RNA, 19 nt, Homo sapiens
aaccagcgcuuccaagaca

SEQ ID NO: 314848 - RNA, 19 nt, Homo sapiens
uauuugcucccaauguuua

SEQ ID NO: 314849 - RNA, 19 nt, Homo sapiens
guaugugccauuuauguga

SEQ ID NO: 314850 - RNA, 19 nt, Homo sapiens
ugguccagaucaucacuua

SEQ ID NO: 314851 - RNA, 19 nt, Homo sapiens
uugacaaccugcacgauga

SEQ ID NO: 314852 - RNA, 19 nt, Homo sapiens
cacccugauuucuugcuua

SEQ ID NO: 314853 - RNA, 19 nt, Homo sapiens
cauccaacccuucauguuc

SEQ ID NO: 314854 - RNA, 19 nt, Homo sapiens
gacaaauaccgcaccauca

SEQ ID NO: 314855 - RNA, 19 nt, Homo sapiens
gcucauguaugugcgaagu

SEQ ID NO: 314856 - RNA, 19 nt, Homo sapiens
uuuauuugcucccaauguu

SEQ ID NO: 314857 - RNA, 19 nt, Homo sapiens
aaggaggucuggcuuuauc

SEQ ID NO: 314858 - RNA, 19 nt, Homo sapiens
ucauguaugugcgaaguau

SEQ ID NO: 314859 - RNA, 19 nt, Homo sapiens
ccauuuauuugcucccaau

SEQ ID NO: 314860 - RNA, 19 nt, Homo sapiens
gggcugugugguugacuua

SEQ ID NO: 314861 - RNA, 19 nt, Homo sapiens
gugcugaugagaauacuga

SEQ ID NO: 314862 - RNA, 19 nt, Homo sapiens
ugacuagacguucauuugu

SEQ ID NO: 314863 - RNA, 19 nt, Homo sapiens
gaugagcccagcccuguuc

SEQ ID NO: 314864 - RNA, 19 nt, Homo sapiens
gcaucaccaccgugucuaa

SEQ ID NO: 314865 - RNA, 19 nt, Homo sapiens
acaaccggcuggccacaga

SEQ ID NO: 314866 - RNA, 19 nt, Homo sapiens
ccgcccagcugaauguguu

SEQ ID NO: 314867 - RNA, 19 nt, Homo sapiens
gagcaccuacuacaugcaa

SEQ ID NO: 314868 - RNA, 19 nt, Homo sapiens
caguacacuuccugcauug

SEQ ID NO: 314869 - RNA, 19 nt, Homo sapiens
gcuggaagguggcauugac

SEQ ID NO: 314870 - RNA, 19 nt, Homo sapiens
guaugugcgaaguauauaa

SEQ ID NO: 314871 - RNA, 19 nt, Homo sapiens
gcugaggaaccugaaauug

SEQ ID NO: 314872 - RNA, 19 nt, Homo sapiens
gagcagcccaggagaagag

SEQ ID NO: 314873 - RNA, 19 nt, Homo sapiens
ugaauguguuguccaaguc

SEQ ID NO: 314874 - RNA, 19 nt, Homo sapiens
cauauagaggcaagaaaga

SEQ ID NO: 314875 - RNA, 19 nt, Homo sapiens
aggucuggcuuuauccaua

SEQ ID NO: 314876 - RNA, 19 nt, Homo sapiens
ucaccgggaugugcaacaa

SEQ ID NO: 314877 - RNA, 19 nt, Homo sapiens
gcucccaauguuuaugaua

SEQ ID NO: 314878 - RNA, 19 nt, Homo sapiens
aagaggaacugggccuguu

SEQ ID NO: 314879 - RNA, 19 nt, Homo sapiens
guggugccuuggagggaua

SEQ ID NO: 314880 - RNA, 19 nt, Homo sapiens
ucaaccagcgcuuccaaga

SEQ ID NO: 314881 - RNA, 19 nt, Homo sapiens
ggagcgcucacucauguuc

SEQ ID NO: 314882 - RNA, 19 nt, Homo sapiens
gaccaggagcgcucacuca

SEQ ID NO: 314883 - RNA, 19 nt, Homo sapiens
uuugugugcucauguaugu

SEQ ID NO: 314884 - RNA, 19 nt, Homo sapiens
aaauugcaguggaugagau

SEQ ID NO: 314885 - RNA, 19 nt, Homo sapiens
ccaggaagcccggaagauc

SEQ ID NO: 314886 - RNA, 19 nt, Homo sapiens
uauagaggcaagaaagaga

SEQ ID NO: 314887 - RNA, 19 nt, Homo sapiens
caugcaaggcacuguacua

SEQ ID NO: 314888 - RNA, 19 nt, Homo sapiens
uuauguguaugugccauuu

SEQ ID NO: 314889 - RNA, 19 nt, Homo sapiens
acuagacguucauuugugu

SEQ ID NO: 314890 - RNA, 19 nt, Homo sapiens
ccgggauggugaucgguuu

SEQ ID NO: 314891 - RNA, 19 nt, Homo sapiens
cugaauguguuguccaagu

SEQ ID NO: 314892 - RNA, 19 nt, Homo sapiens
uguauccucugguucuuca

SEQ ID NO: 314893 - RNA, 19 nt, Homo sapiens
agaguuuucuuccuuguaa

SEQ ID NO: 314894 - RNA, 19 nt, Homo sapiens
guucauuugugugcucaug

SEQ ID NO: 314895 - RNA, 19 nt, Homo sapiens
caaauugcaguggaugaga

SEQ ID NO: 314896 - RNA, 19 nt, Homo sapiens
gaauguguuguccaaguca

SEQ ID NO: 314897 - RNA, 19 nt, Homo sapiens
cagcagaacuuucgccuuu

SEQ ID NO: 314898 - RNA, 19 nt, Homo sapiens
gaacaucucugccaaugag

SEQ ID NO: 314899 - RNA, 19 nt, Homo sapiens
ccacugaucuggauuugaa

SEQ ID NO: 314900 - RNA, 19 nt, Homo sapiens
uuacuaagcuuguagaaug

SEQ ID NO: 314901 - RNA, 19 nt, Homo sapiens
gaaagaaaccaaaggaaug

SEQ ID NO: 314902 - RNA, 19 nt, Homo sapiens
gagcgcaguuugacuauga

SEQ ID NO: 314903 - RNA, 19 nt, Homo sapiens
gaacaagauugccauccuu

SEQ ID NO: 314904 - RNA, 19 nt, Homo sapiens
caacaaggaugacagcaau

SEQ ID NO: 314905 - RNA, 19 nt, Homo sapiens
gaugaaacccuuaagaaau

SEQ ID NO: 314906 - RNA, 19 nt, Homo sapiens
gggaaggaguaccacuuua

SEQ ID NO: 314907 - RNA, 19 nt, Homo sapiens
ggaagaagaagaaguacaa

SEQ ID NO: 314908 - RNA, 19 nt, Homo sapiens
ccaguaagguucagucuuc

SEQ ID NO: 314909 - RNA, 19 nt, Homo sapiens
acaaauaucuggccaagca

SEQ ID NO: 314910 - RNA, 19 nt, Homo sapiens
gaagaaguacaaagacaaa

SEQ ID NO: 314911 - RNA, 19 nt, Homo sapiens
caauaaugguguugaugaa

SEQ ID NO: 314912 - RNA, 19 nt, Homo sapiens
gcagaacuuucgccuuuca

SEQ ID NO: 314913 - RNA, 19 nt, Homo sapiens
ggacugaaguuugcuacug

SEQ ID NO: 314914 - RNA, 19 nt, Homo sapiens
gaugagauccuagaaauca

SEQ ID NO: 314915 - RNA, 19 nt, Homo sapiens
ggaagacccuggugcugau

SEQ ID NO: 314916 - RNA, 19 nt, Homo sapiens
gaacuuucgccuuucauug

SEQ ID NO: 314917 - RNA, 19 nt, Homo sapiens
gcaccaaauuugaaacagu

SEQ ID NO: 314918 - RNA, 19 nt, Homo sapiens
ggaaggaguaccacuuuau

SEQ ID NO: 314919 - RNA, 19 nt, Homo sapiens
aaacagggcugcuccaacu

SEQ ID NO: 314920 - RNA, 19 nt, Homo sapiens
gacauuauccagauuauca

SEQ ID NO: 314921 - RNA, 19 nt, Homo sapiens
agaaaucaauggcacaaau

SEQ ID NO: 314922 - RNA, 19 nt, Homo sapiens
gaaaucaauggcacaaaug

SEQ ID NO: 314923 - RNA, 19 nt, Homo sapiens
gcacuacagauguucauga

SEQ ID NO: 314924 - RNA, 19 nt, Homo sapiens
guacaaagacaaauaucug

SEQ ID NO: 314925 - RNA, 19 nt, Homo sapiens
gaugucugcucuagggaaa

SEQ ID NO: 314926 - RNA, 19 nt, Homo sapiens
cggaggagaugacgaggaa

SEQ ID NO: 314927 - RNA, 19 nt, Homo sapiens
cagaagagcccaugggaau

SEQ ID NO: 314928 - RNA, 19 nt, Homo sapiens
agaagaagaaguacaaaga

SEQ ID NO: 314929 - RNA, 19 nt, Homo sapiens
gaagagcccaugggaauca

SEQ ID NO: 314930 - RNA, 19 nt, Homo sapiens
gcggaaagugcgacucaua

SEQ ID NO: 314931 - RNA, 19 nt, Homo sapiens
ugaugaaacccuuaagaaa

SEQ ID NO: 314932 - RNA, 19 nt, Homo sapiens
caaggaagagugaggaaga

SEQ ID NO: 314933 - RNA, 19 nt, Homo sapiens
gaugaaagaaaccaaagga

SEQ ID NO: 314934 - RNA, 19 nt, Homo sapiens
gccagaauccggagaaguu

SEQ ID NO: 314935 - RNA, 19 nt, Homo sapiens
ggucgcagccacauuaaga

SEQ ID NO: 314936 - RNA, 19 nt, Homo sapiens
gaaggaguaccacuuuauc

SEQ ID NO: 314937 - RNA, 19 nt, Homo sapiens
ugaaagaaaccaaaggaau

SEQ ID NO: 314938 - RNA, 19 nt, Homo sapiens
gcagaaggcgaugaaagaa

SEQ ID NO: 314939 - RNA, 19 nt, Homo sapiens
ggaguaccacuuuaucuca

SEQ ID NO: 314940 - RNA, 19 nt, Homo sapiens
gacaggaggugcggaaagu

SEQ ID NO: 314941 - RNA, 19 nt, Homo sapiens
gggcugcuccaacuaguuu

SEQ ID NO: 314942 - RNA, 19 nt, Homo sapiens
gaguaccacuuuaucucaa

SEQ ID NO: 314943 - RNA, 19 nt, Homo sapiens
ggagucagcaggauugauc

SEQ ID NO: 314944 - RNA, 19 nt, Homo sapiens
ugagagcgcaguuugacua

SEQ ID NO: 314945 - RNA, 19 nt, Homo sapiens
caagggugaugcacagcaa

SEQ ID NO: 314946 - RNA, 19 nt, Homo sapiens
gugccugucuccuggguuu

SEQ ID NO: 314947 - RNA, 19 nt, Homo sapiens
gccaagcacagcucgauuu

SEQ ID NO: 314948 - RNA, 19 nt, Homo sapiens
gaagaagaagaaguacaaa

SEQ ID NO: 314949 - RNA, 19 nt, Homo sapiens
gaauggcgaguggcaagua

SEQ ID NO: 314950 - RNA, 19 nt, Homo sapiens
caaggagucagcaggauug

SEQ ID NO: 314951 - RNA, 19 nt, Homo sapiens
aaagaaaccaaaggaauga

SEQ ID NO: 314952 - RNA, 19 nt, Homo sapiens
gacaaaucauucaguggau

SEQ ID NO: 314953 - RNA, 19 nt, Homo sapiens
uugagaaggucacagaaga

SEQ ID NO: 314954 - RNA, 19 nt, Homo sapiens
uaugcuggguauuucauuu

SEQ ID NO: 314955 - RNA, 19 nt, Homo sapiens
ucacuacuuugaccucuca

SEQ ID NO: 314956 - RNA, 19 nt, Homo sapiens
aagaagaaguacaaagaca

SEQ ID NO: 314957 - RNA, 19 nt, Homo sapiens
gcaaggaggcgggacugaa

SEQ ID NO: 314958 - RNA, 19 nt, Homo sapiens
gaaguacuaccaaaaugua

SEQ ID NO: 314959 - RNA, 19 nt, Homo sapiens
guaagguucagucuucuug

SEQ ID NO: 314960 - RNA, 19 nt, Homo sapiens
cuaccaaggcaacauguuu

SEQ ID NO: 314961 - RNA, 19 nt, Homo sapiens
gaagaagaaguacaaagac

SEQ ID NO: 314962 - RNA, 19 nt, Homo sapiens
ggaaagugcgacucauaca

SEQ ID NO: 314963 - RNA, 19 nt, Homo sapiens
agaaugaugucugcucuag

SEQ ID NO: 314964 - RNA, 19 nt, Homo sapiens
ccgaggacauguacaccaa

SEQ ID NO: 314965 - RNA, 19 nt, Homo sapiens
gggacauuauccagauuau

SEQ ID NO: 314966 - RNA, 19 nt, Homo sapiens
agaaggcgaugaaagaaac

SEQ ID NO: 314967 - RNA, 19 nt, Homo sapiens
gguugauucuccugauaga

SEQ ID NO: 314968 - RNA, 19 nt, Homo sapiens
uguguacccugucccauau

SEQ ID NO: 314969 - RNA, 19 nt, Homo sapiens
guaauucccaaccagcaaa

SEQ ID NO: 314970 - RNA, 19 nt, Homo sapiens
caucugugcaauagaauga

SEQ ID NO: 314971 - RNA, 19 nt, Homo sapiens
ggguauuucauuugucuuu

SEQ ID NO: 314972 - RNA, 19 nt, Homo sapiens
uaauucagccaguaagguu

SEQ ID NO: 314973 - RNA, 19 nt, Homo sapiens
cugcagcuauccuaauuca

SEQ ID NO: 314974 - RNA, 19 nt, Homo sapiens
gaaaccaaaggaaugaucu

SEQ ID NO: 314975 - RNA, 19 nt, Homo sapiens
cagaaggcgaugaaagaaa

SEQ ID NO: 314976 - RNA, 19 nt, Homo sapiens
ucauacaguuugagaaggu

SEQ ID NO: 314977 - RNA, 19 nt, Homo sapiens
ggaacaucucugccaauga

SEQ ID NO: 314978 - RNA, 19 nt, Homo sapiens
ucgcauccauugaauacug

SEQ ID NO: 314979 - RNA, 19 nt, Homo sapiens
ggccagaauucuucauggu

SEQ ID NO: 314980 - RNA, 19 nt, Homo sapiens
gaaagugcgacucauacag

SEQ ID NO: 314981 - RNA, 19 nt, Homo sapiens
ccaaggagucagcaggauu

SEQ ID NO: 314982 - RNA, 19 nt, Homo sapiens
ggacaggaggugcggaaag

SEQ ID NO: 314983 - RNA, 19 nt, Homo sapiens
uauccuaauucagccagua

SEQ ID NO: 314984 - RNA, 19 nt, Homo sapiens
gaccaagcgugcaguucuc

SEQ ID NO: 314985 - RNA, 19 nt, Homo sapiens
gaggagaugacgaggaaca

SEQ ID NO: 314986 - RNA, 19 nt, Homo sapiens
caaaucauucaguggauca

SEQ ID NO: 314987 - RNA, 19 nt, Homo sapiens
uguauaugcuggguauuuc

SEQ ID NO: 314988 - RNA, 19 nt, Homo sapiens
ccgccuugcuuuaagacaa

SEQ ID NO: 314989 - RNA, 19 nt, Homo sapiens
ccacccgccuugcuuuaag

SEQ ID NO: 314990 - RNA, 19 nt, Homo sapiens
aggaacaucucugccaaug

SEQ ID NO: 314991 - RNA, 19 nt, Homo sapiens
caaggaggcgggacugaag

SEQ ID NO: 314992 - RNA, 19 nt, Homo sapiens
ccuguacgguggccagaau

SEQ ID NO: 314993 - RNA, 19 nt, Homo sapiens
gaucuggauuugaaaagga

SEQ ID NO: 314994 - RNA, 19 nt, Homo sapiens
cgccuugcuuuaagacaaa

SEQ ID NO: 314995 - RNA, 19 nt, Homo sapiens
cauaagcagaacaagauug

SEQ ID NO: 314996 - RNA, 19 nt, Homo sapiens
guaagaaguacuaccaaaa

SEQ ID NO: 314997 - RNA, 19 nt, Homo sapiens
caucagcccucauuucuua

SEQ ID NO: 314998 - RNA, 19 nt, Homo sapiens
gcacaggucugagcucuau

SEQ ID NO: 314999 - RNA, 19 nt, Homo sapiens
ggaaggagaauaaacagaa

SEQ ID NO: 315000 - RNA, 19 nt, Homo sapiens
gggaagaucuguuguugca

SEQ ID NO: 315001 - RNA, 19 nt, Homo sapiens
gaaagaaugcuguccuaga

SEQ ID NO: 315002 - RNA, 19 nt, Homo sapiens
gaaggagaauaaacagaau

SEQ ID NO: 315003 - RNA, 19 nt, Homo sapiens
gcccucauuucuuauaaua

SEQ ID NO: 315004 - RNA, 19 nt, Homo sapiens
ggaaagcauuugucaagag

SEQ ID NO: 315005 - RNA, 19 nt, Homo sapiens
aaagaaugcuguccuagau

SEQ ID NO: 315006 - RNA, 19 nt, Homo sapiens
agaagcgaaugauguauuu

SEQ ID NO: 315007 - RNA, 19 nt, Homo sapiens
caccaagaaugcagaguuu

SEQ ID NO: 315008 - RNA, 19 nt, Homo sapiens
agaacaagcucaucaugug

SEQ ID NO: 315009 - RNA, 19 nt, Homo sapiens
ggaaagucccauaguaaga

SEQ ID NO: 315010 - RNA, 19 nt, Homo sapiens
gcucccagcuccuuuggaa

SEQ ID NO: 315011 - RNA, 19 nt, Homo sapiens
cgaaguuucuccagauuuc

SEQ ID NO: 315012 - RNA, 19 nt, Homo sapiens
ccagugcgcuuccucuguu

SEQ ID NO: 315013 - RNA, 19 nt, Homo sapiens
ccagauuucuccaaugugu

SEQ ID NO: 315014 - RNA, 19 nt, Homo sapiens
gaagaacaagcucaucaug

SEQ ID NO: 315015 - RNA, 19 nt, Homo sapiens
gaaccacugugugcccauu

SEQ ID NO: 315016 - RNA, 19 nt, Homo sapiens
caucucauccuucauuauu

SEQ ID NO: 315017 - RNA, 19 nt, Homo sapiens
gcacacguauugacuccau

SEQ ID NO: 315018 - RNA, 19 nt, Homo sapiens
gggcagugcugggcucauu

SEQ ID NO: 315019 - RNA, 19 nt, Homo sapiens
gaucuuccuucgaggcauu

SEQ ID NO: 315020 - RNA, 19 nt, Homo sapiens
aagaaagaaugcuguccua

SEQ ID NO: 315021 - RNA, 19 nt, Homo sapiens
caagacagccggagaacau

SEQ ID NO: 315022 - RNA, 19 nt, Homo sapiens
cauggcaccuucacugcua

SEQ ID NO: 315023 - RNA, 19 nt, Homo sapiens
ggaaggaaaugggguguuu

SEQ ID NO: 315024 - RNA, 19 nt, Homo sapiens
gggcaucucauccuucauu

SEQ ID NO: 315025 - RNA, 19 nt, Homo sapiens
cggccgaguuugucccuua

SEQ ID NO: 315026 - RNA, 19 nt, Homo sapiens
gaaagucccauaguaagau

SEQ ID NO: 315027 - RNA, 19 nt, Homo sapiens
ucaagauccugcccagcua

SEQ ID NO: 315028 - RNA, 19 nt, Homo sapiens
ccaagugucuaacuagucu

SEQ ID NO: 315029 - RNA, 19 nt, Homo sapiens
ggcaucucauccuucauua

SEQ ID NO: 315030 - RNA, 19 nt, Homo sapiens
ggucaggguuacagcuuug

SEQ ID NO: 315031 - RNA, 19 nt, Homo sapiens
uguggacucuuguauuuga

SEQ ID NO: 315032 - RNA, 19 nt, Homo sapiens
guccuuggcucaccuggaa

SEQ ID NO: 315033 - RNA, 19 nt, Homo sapiens
ggaaucucauuugcauuug

SEQ ID NO: 315034 - RNA, 19 nt, Homo sapiens
cuaggaaucucauuugcau

SEQ ID NO: 315035 - RNA, 19 nt, Homo sapiens
ucagagcccuugccuccuu

SEQ ID NO: 315036 - RNA, 19 nt, Homo sapiens
ccaagaaugcagaguuuga

SEQ ID NO: 315037 - RNA, 19 nt, Homo sapiens
ggagaagcggaaagcauuu

SEQ ID NO: 315038 - RNA, 19 nt, Homo sapiens
gcagugucauccucaagau

SEQ ID NO: 315039 - RNA, 19 nt, Homo sapiens
gccaagcuaugcccaggaa

SEQ ID NO: 315040 - RNA, 19 nt, Homo sapiens
auuguggacucuuguauuu

SEQ ID NO: 315041 - RNA, 19 nt, Homo sapiens
gcggaaagcauuugucaag

SEQ ID NO: 315042 - RNA, 19 nt, Homo sapiens
cagagucaccuccauaaug

SEQ ID NO: 315043 - RNA, 19 nt, Homo sapiens
gcuacgaacggccgaguuu

SEQ ID NO: 315044 - RNA, 19 nt, Homo sapiens
agaaugcuguccuagaugu

SEQ ID NO: 315045 - RNA, 19 nt, Homo sapiens
ggacuccucccaccucuca

SEQ ID NO: 315046 - RNA, 19 nt, Homo sapiens
ggaaaacccugguacugau

SEQ ID NO: 315047 - RNA, 19 nt, Homo sapiens
ggagaacaucuggguguaa

SEQ ID NO: 315048 - RNA, 19 nt, Homo sapiens
ggaaggggaaggagaauaa

SEQ ID NO: 315049 - RNA, 19 nt, Homo sapiens
cugcagagcuggaccugau

SEQ ID NO: 315050 - RNA, 19 nt, Homo sapiens
ccagggaggugggcauuca

SEQ ID NO: 315051 - RNA, 19 nt, Homo sapiens
gggcuacgggcacuacuuu

SEQ ID NO: 315052 - RNA, 19 nt, Homo sapiens
gagaacaucuggguguaac

SEQ ID NO: 315053 - RNA, 19 nt, Homo sapiens
uagggucacuugccauuuc

SEQ ID NO: 315054 - RNA, 19 nt, Homo sapiens
ucuccucccuugucuuauu

SEQ ID NO: 315055 - RNA, 19 nt, Homo sapiens
cagcccucauuucuuauaa

SEQ ID NO: 315056 - RNA, 19 nt, Homo sapiens
gccgaaguuucuccagauu

SEQ ID NO: 315057 - RNA, 19 nt, Homo sapiens
gcuacgggcacuacuuuga

SEQ ID NO: 315058 - RNA, 19 nt, Homo sapiens
ccauccaauucuugaguuu

SEQ ID NO: 315059 - RNA, 19 nt, Homo sapiens
ccucagccauccaauucuu

SEQ ID NO: 315060 - RNA, 19 nt, Homo sapiens
aggaaucucauuugcauuu

SEQ ID NO: 315061 - RNA, 19 nt, Homo sapiens
gggaggaagcaaaggguuu

SEQ ID NO: 315062 - RNA, 19 nt, Homo sapiens
cauccacuguccauauuca

SEQ ID NO: 315063 - RNA, 19 nt, Homo sapiens
uugcugaccugaggcuaua

SEQ ID NO: 315064 - RNA, 19 nt, Homo sapiens
ugucuccucccuugucuua

SEQ ID NO: 315065 - RNA, 19 nt, Homo sapiens
gaggcgccauuuacacugu

SEQ ID NO: 315066 - RNA, 19 nt, Homo sapiens
ccaccaagaaugcagaguu

SEQ ID NO: 315067 - RNA, 19 nt, Homo sapiens
ggacuugcuccagaucgua

SEQ ID NO: 315068 - RNA, 19 nt, Homo sapiens
uuccuuggauuaaauguga

SEQ ID NO: 315069 - RNA, 19 nt, Homo sapiens
gccauccaauucuugaguu

SEQ ID NO: 315070 - RNA, 19 nt, Homo sapiens
ccagguagcccacuugcau

SEQ ID NO: 315071 - RNA, 19 nt, Homo sapiens
gcucgguccuucccucauc

SEQ ID NO: 315072 - RNA, 19 nt, Homo sapiens
cggaaagcauuugucaaga

SEQ ID NO: 315073 - RNA, 19 nt, Homo sapiens
uggagaagcuacggacaga

SEQ ID NO: 315074 - RNA, 19 nt, Homo sapiens
gaagcuggaggccgugaga

SEQ ID NO: 315075 - RNA, 19 nt, Homo sapiens
cggagaacaucugggugua

SEQ ID NO: 315076 - RNA, 19 nt, Homo sapiens
ggagauggguuggguaccu

SEQ ID NO: 315077 - RNA, 19 nt, Homo sapiens
caagcuaugcccaggaaug

SEQ ID NO: 315078 - RNA, 19 nt, Homo sapiens
ugggugacaucaucaagga

SEQ ID NO: 315079 - RNA, 19 nt, Homo sapiens
gcccuucccuccugucucu

SEQ ID NO: 315080 - RNA, 19 nt, Homo sapiens
uaagggagugggaaggaaa

SEQ ID NO: 315081 - RNA, 19 nt, Homo sapiens
gaaugcuguccuagaugua

SEQ ID NO: 315082 - RNA, 19 nt, Homo sapiens
gcaggagagacguuucaga

SEQ ID NO: 315083 - RNA, 19 nt, Homo sapiens
aaaagaagcgaaugaugua

SEQ ID NO: 315084 - RNA, 19 nt, Homo sapiens
cuccagauuucuccaaugu

SEQ ID NO: 315085 - RNA, 19 nt, Homo sapiens
ugauguauuugaccaccaa

SEQ ID NO: 315086 - RNA, 19 nt, Homo sapiens
ggagcugacaccaaacuca

SEQ ID NO: 315087 - RNA, 19 nt, Homo sapiens
gagaagcggaaagcauuug

SEQ ID NO: 315088 - RNA, 19 nt, Homo sapiens
gaggagaagcggaaagcau

SEQ ID NO: 315089 - RNA, 19 nt, Homo sapiens
gaaucucauuugcauuugc

SEQ ID NO: 315090 - RNA, 19 nt, Homo sapiens
gugugugugugucagguuu

SEQ ID NO: 315091 - RNA, 19 nt, Homo sapiens
ugucagagucaccuccaua

SEQ ID NO: 315092 - RNA, 19 nt, Homo sapiens
aagcgaaugauguauuuga

SEQ ID NO: 315093 - RNA, 19 nt, Homo sapiens
ggauuaaaugugaaagcaa

SEQ ID NO: 315094 - RNA, 19 nt, Homo sapiens
gaggcuauagggucacuug

SEQ ID NO: 315095 - RNA, 19 nt, Homo sapiens
gcuaugcccaggaaugugu

SEQ ID NO: 315096 - RNA, 19 nt, Homo sapiens
ggcgcagccugaagaacaa

SEQ ID NO: 315097 - RNA, 19 nt, Homo sapiens
ggaggaagaucgcuuaaag

SEQ ID NO: 315098 - RNA, 19 nt, Homo sapiens
guagucaguuuguucaaua

SEQ ID NO: 315099 - RNA, 19 nt, Homo sapiens
gaauaucacuuugugucua

SEQ ID NO: 315100 - RNA, 19 nt, Homo sapiens
caaauuccaucaucgagaa

SEQ ID NO: 315101 - RNA, 19 nt, Homo sapiens
gcacaucuuagcuuuauuu

SEQ ID NO: 315102 - RNA, 19 nt, Homo sapiens
guagauguguagucaguuu

SEQ ID NO: 315103 - RNA, 19 nt, Homo sapiens
augagaagcuucgcuauua

SEQ ID NO: 315104 - RNA, 19 nt, Homo sapiens
cuccggagcugcugacuua

SEQ ID NO: 315105 - RNA, 19 nt, Homo sapiens
gagaugagcuccgagaagu

SEQ ID NO: 315106 - RNA, 19 nt, Homo sapiens
gaaagagccaugagaagga

SEQ ID NO: 315107 - RNA, 19 nt, Homo sapiens
ucaaaguggucuuagagaa

SEQ ID NO: 315108 - RNA, 19 nt, Homo sapiens
gcaccucuuuggaucauga

SEQ ID NO: 315109 - RNA, 19 nt, Homo sapiens
gacgggaccuugaagauca

SEQ ID NO: 315110 - RNA, 19 nt, Homo sapiens
gaaggaaggaguggaauau

SEQ ID NO: 315111 - RNA, 19 nt, Homo sapiens
cgacuuacaucacaacaag

SEQ ID NO: 315112 - RNA, 19 nt, Homo sapiens
aagcuucgcuauuaugaaa

SEQ ID NO: 315113 - RNA, 19 nt, Homo sapiens
cagcacaucuuagcuuuau

SEQ ID NO: 315114 - RNA, 19 nt, Homo sapiens
uuaaguagccacugucuuu

SEQ ID NO: 315115 - RNA, 19 nt, Homo sapiens
ggugguagugguuaauuua

SEQ ID NO: 315116 - RNA, 19 nt, Homo sapiens
acgaagagguggccaggua

SEQ ID NO: 315117 - RNA, 19 nt, Homo sapiens
gcagagagggagagaauuc

SEQ ID NO: 315118 - RNA, 19 nt, Homo sapiens
uagagaagcugagcaagga

SEQ ID NO: 315119 - RNA, 19 nt, Homo sapiens
caacaugaauuacuguacu

SEQ ID NO: 315120 - RNA, 19 nt, Homo sapiens
uuuggaagcuaacuuguuu

SEQ ID NO: 315121 - RNA, 19 nt, Homo sapiens
ggaggacucugguuugcau

SEQ ID NO: 315122 - RNA, 19 nt, Homo sapiens
ggacacucagcacaucuua

SEQ ID NO: 315123 - RNA, 19 nt, Homo sapiens
gugcuugccugguaauaga

SEQ ID NO: 315124 - RNA, 19 nt, Homo sapiens
gaagcuaacuuguuuuauc

SEQ ID NO: 315125 - RNA, 19 nt, Homo sapiens
gcuguuucuucaucaauaa

SEQ ID NO: 315126 - RNA, 19 nt, Homo sapiens
ggaacauggugaauauaag

SEQ ID NO: 315127 - RNA, 19 nt, Homo sapiens
caaagagaccugugacugu

SEQ ID NO: 315128 - RNA, 19 nt, Homo sapiens
ugggaagucuuguuuguug

SEQ ID NO: 315129 - RNA, 19 nt, Homo sapiens
ccacgccgcuguuucuuca

SEQ ID NO: 315130 - RNA, 19 nt, Homo sapiens
ccuggaacauggugaauau

SEQ ID NO: 315131 - RNA, 19 nt, Homo sapiens
gaagauucaugagaagcuu

SEQ ID NO: 315132 - RNA, 19 nt, Homo sapiens
caucuuagcuuuauuuccu

SEQ ID NO: 315133 - RNA, 19 nt, Homo sapiens
gcccaugcuuuguuugauu

SEQ ID NO: 315134 - RNA, 19 nt, Homo sapiens
cgcagaauguuuaagcuuu

SEQ ID NO: 315135 - RNA, 19 nt, Homo sapiens
aagcugacccugauucuuu

SEQ ID NO: 315136 - RNA, 19 nt, Homo sapiens
gaaaggggcauaucagaaa

SEQ ID NO: 315137 - RNA, 19 nt, Homo sapiens
gaggcacacuucaccauca

SEQ ID NO: 315138 - RNA, 19 nt, Homo sapiens
aaacguugaucuuaaccuu

SEQ ID NO: 315139 - RNA, 19 nt, Homo sapiens
guaagcagaguuauuuguu

SEQ ID NO: 315140 - RNA, 19 nt, Homo sapiens
uaagugggaagucuuguuu

SEQ ID NO: 315141 - RNA, 19 nt, Homo sapiens
cagaagcacugaaacaacu

SEQ ID NO: 315142 - RNA, 19 nt, Homo sapiens
ugaagugcuugccugguaa

SEQ ID NO: 315143 - RNA, 19 nt, Homo sapiens
gguagugguuaauuuauac

SEQ ID NO: 315144 - RNA, 19 nt, Homo sapiens
gaagucuuguuuguuguug

SEQ ID NO: 315145 - RNA, 19 nt, Homo sapiens
gaacauucgcagucauuuc

SEQ ID NO: 315146 - RNA, 19 nt, Homo sapiens
ggacacagcagccccauuu

SEQ ID NO: 315147 - RNA, 19 nt, Homo sapiens
gaugaggaaucggugaaga

SEQ ID NO: 315148 - RNA, 19 nt, Homo sapiens
ugagaagcuucgcuauuau

SEQ ID NO: 315149 - RNA, 19 nt, Homo sapiens
uaagcagaguuauuuguuc

SEQ ID NO: 315150 - RNA, 19 nt, Homo sapiens
uugaagugcuugccuggua

SEQ ID NO: 315151 - RNA, 19 nt, Homo sapiens
gccagucccugccaugaga

SEQ ID NO: 315152 - RNA, 19 nt, Homo sapiens
uagugacgcuuaguaguuu

SEQ ID NO: 315153 - RNA, 19 nt, Homo sapiens
uuaaacauagugacgcuua

SEQ ID NO: 315154 - RNA, 19 nt, Homo sapiens
aaaguuaaguagccacugu

SEQ ID NO: 315155 - RNA, 19 nt, Homo sapiens
gaacauggugaauauaagg

SEQ ID NO: 315156 - RNA, 19 nt, Homo sapiens
guaaaccauuucugucaag

SEQ ID NO: 315157 - RNA, 19 nt, Homo sapiens
gggugguagugguuaauuu

SEQ ID NO: 315158 - RNA, 19 nt, Homo sapiens
uaaaggagagcaagguguu

SEQ ID NO: 315159 - RNA, 19 nt, Homo sapiens
gcagaauguuuaagcuuuu

SEQ ID NO: 315160 - RNA, 19 nt, Homo sapiens
ccaggaggaagaucgcuua

SEQ ID NO: 315161 - RNA, 19 nt, Homo sapiens
gaugagcuccgagaaguga

SEQ ID NO: 315162 - RNA, 19 nt, Homo sapiens
ggacucugguuugcaugaa

SEQ ID NO: 315163 - RNA, 19 nt, Homo sapiens
gcgcagagagggagagaau

SEQ ID NO: 315164 - RNA, 19 nt, Homo sapiens
gagaagcuucgcuauuaug

SEQ ID NO: 315165 - RNA, 19 nt, Homo sapiens
cuacgucacuguaaaccau

SEQ ID NO: 315166 - RNA, 19 nt, Homo sapiens
gaaaucaccccacacaaug

SEQ ID NO: 315167 - RNA, 19 nt, Homo sapiens
uggaacauggugaauauaa

SEQ ID NO: 315168 - RNA, 19 nt, Homo sapiens
aggaaggaguggaauauca

SEQ ID NO: 315169 - RNA, 19 nt, Homo sapiens
aaagagccaugagaaggaa

SEQ ID NO: 315170 - RNA, 19 nt, Homo sapiens
gacgagaucagccagauuc

SEQ ID NO: 315171 - RNA, 19 nt, Homo sapiens
uaacaucgagcccaugcuu

SEQ ID NO: 315172 - RNA, 19 nt, Homo sapiens
ggaagucuuguuuguuguu

SEQ ID NO: 315173 - RNA, 19 nt, Homo sapiens
gcauuacgggcaccuggua

SEQ ID NO: 315174 - RNA, 19 nt, Homo sapiens
caauaucgaugaggauuuu

SEQ ID NO: 315175 - RNA, 19 nt, Homo sapiens
gggcugugcucaugguaca

SEQ ID NO: 315176 - RNA, 19 nt, Homo sapiens
guauguagacccagagugu

SEQ ID NO: 315177 - RNA, 19 nt, Homo sapiens
gagcccaugcuuuguuuga

SEQ ID NO: 315178 - RNA, 19 nt, Homo sapiens
caguagauguguagucagu

SEQ ID NO: 315179 - RNA, 19 nt, Homo sapiens
gggaacauucgcagucauu

SEQ ID NO: 315180 - RNA, 19 nt, Homo sapiens
ccuaugaucagccuuguga

SEQ ID NO: 315181 - RNA, 19 nt, Homo sapiens
caugagaagcuucgcuauu

SEQ ID NO: 315182 - RNA, 19 nt, Homo sapiens
cccaugcuuuguuugauuu

SEQ ID NO: 315183 - RNA, 19 nt, Homo sapiens
ucaccaucaacaugaauua

SEQ ID NO: 315184 - RNA, 19 nt, Homo sapiens
gaguauaagugggaagucu

SEQ ID NO: 315185 - RNA, 19 nt, Homo sapiens
acacaaugcuuggcacauc

SEQ ID NO: 315186 - RNA, 19 nt, Homo sapiens
caaaguggucuuagagaag

SEQ ID NO: 315187 - RNA, 19 nt, Homo sapiens
ggagccagaagcacugaaa

SEQ ID NO: 315188 - RNA, 19 nt, Homo sapiens
cauggugaauauaaggaaa

SEQ ID NO: 315189 - RNA, 19 nt, Homo sapiens
ccaucaacaugaauuacug

SEQ ID NO: 315190 - RNA, 19 nt, Homo sapiens
uaucggaggacucugguuu

SEQ ID NO: 315191 - RNA, 19 nt, Homo sapiens
ugugcuagaucuugggaaa

SEQ ID NO: 315192 - RNA, 19 nt, Homo sapiens
ccacaaauuccaucaucga

SEQ ID NO: 315193 - RNA, 19 nt, Homo sapiens
ggacgggaccuugaagauc

SEQ ID NO: 315194 - RNA, 19 nt, Homo sapiens
guaacuuuaucccagaaca

SEQ ID NO: 315195 - RNA, 19 nt, Homo sapiens
ugucuaagcaagcauuuga

SEQ ID NO: 315196 - RNA, 19 nt, Homo sapiens
agaaggaaggaguggaaua

SEQ ID NO: 315197 - RNA, 19 nt, Homo sapiens
ggaauuccguugacuuguu

SEQ ID NO: 315198 - RNA, 19 nt, Homo sapiens
gaagagcccugaggagauc

SEQ ID NO: 315199 - RNA, 19 nt, Homo sapiens
gaauuccguugacuuguug

SEQ ID NO: 315200 - RNA, 19 nt, Homo sapiens
caacucagguggcauuugg

SEQ ID NO: 315201 - RNA, 19 nt, Homo sapiens
gaagaaaguggaccugucu

SEQ ID NO: 315202 - RNA, 19 nt, Homo sapiens
uagcuccgcuucugcuuuc

SEQ ID NO: 315203 - RNA, 19 nt, Homo sapiens
agcaaugccuggccuggua

SEQ ID NO: 315204 - RNA, 19 nt, Homo sapiens
cauugaaccuggccacauc

SEQ ID NO: 315205 - RNA, 19 nt, Homo sapiens
gaaaguggaccugucuaag

SEQ ID NO: 315206 - RNA, 19 nt, Homo sapiens
agaaaguggaccugucuaa

SEQ ID NO: 315207 - RNA, 19 nt, Homo sapiens
acgaggacaucaaggagaa

SEQ ID NO: 315208 - RNA, 19 nt, Homo sapiens
caggcgagcucaggugaug

SEQ ID NO: 315209 - RNA, 19 nt, Homo sapiens
ccgagcauuucgcggagua

SEQ ID NO: 315210 - RNA, 19 nt, Homo sapiens
caggaauuccguugacuug

SEQ ID NO: 315211 - RNA, 19 nt, Homo sapiens
ucaaggagaaccuggaauc

SEQ ID NO: 315212 - RNA, 19 nt, Homo sapiens
uaaccaagugcuaaaucuu

SEQ ID NO: 315213 - RNA, 19 nt, Homo sapiens
ucucaaaggccaggaauuc

SEQ ID NO: 315214 - RNA, 19 nt, Homo sapiens
agccagacgugcccaucua

SEQ ID NO: 315215 - RNA, 19 nt, Homo sapiens
gggaagacccacugaagcu

SEQ ID NO: 315216 - RNA, 19 nt, Homo sapiens
guagcuccgcuucugcuuu

SEQ ID NO: 315217 - RNA, 19 nt, Homo sapiens
caucaaggagaaccuggaa

SEQ ID NO: 315218 - RNA, 19 nt, Homo sapiens
auaaccaagugcuaaaucu

SEQ ID NO: 315219 - RNA, 19 nt, Homo sapiens
ccuccuuucuguuuuauuu

SEQ ID NO: 315220 - RNA, 19 nt, Homo sapiens
ccaggaauuccguugacuu

SEQ ID NO: 315221 - RNA, 19 nt, Homo sapiens
ccugguagcuccgcuucug

SEQ ID NO: 315222 - RNA, 19 nt, Homo sapiens
ccugguaccugccgaagcu

SEQ ID NO: 315223 - RNA, 19 nt, Homo sapiens
agaagagcccugaggagau

SEQ ID NO: 315224 - RNA, 19 nt, Homo sapiens
ggccaggaauuccguugac

SEQ ID NO: 315225 - RNA, 19 nt, Homo sapiens
gcauugaaccuggccacau

SEQ ID NO: 315226 - RNA, 19 nt, Homo sapiens
gaccuacgaggacaucaag

SEQ ID NO: 315227 - RNA, 19 nt, Homo sapiens
gaaggcacaucggcucuaa

SEQ ID NO: 315228 - RNA, 19 nt, Homo sapiens
ugaagaagauguuguugga

SEQ ID NO: 315229 - RNA, 19 nt, Homo sapiens
acuaggcacuccauaaaua

SEQ ID NO: 315230 - RNA, 19 nt, Homo sapiens
ggacaacugggccaaacua

SEQ ID NO: 315231 - RNA, 19 nt, Homo sapiens
uuagagcccuugauaauag

SEQ ID NO: 315232 - RNA, 19 nt, Homo sapiens
uauggugccucaguaaaua

SEQ ID NO: 315233 - RNA, 19 nt, Homo sapiens
cagacaaccuccucaaagu

SEQ ID NO: 315234 - RNA, 19 nt, Homo sapiens
gaaccuucaugaccuuauc

SEQ ID NO: 315235 - RNA, 19 nt, Homo sapiens
aaagugggcauaccaguuu

SEQ ID NO: 315236 - RNA, 19 nt, Homo sapiens
aauguacacugacugcuuu

SEQ ID NO: 315237 - RNA, 19 nt, Homo sapiens
agacacauuuguuacucua

SEQ ID NO: 315238 - RNA, 19 nt, Homo sapiens
uaucaacuuuacacccaua

SEQ ID NO: 315239 - RNA, 19 nt, Homo sapiens
caaagugggcauaccaguu

SEQ ID NO: 315240 - RNA, 19 nt, Homo sapiens
ggaggcugguacaagguuu

SEQ ID NO: 315241 - RNA, 19 nt, Homo sapiens
cauacuaggcacuccauaa

SEQ ID NO: 315242 - RNA, 19 nt, Homo sapiens
uggaugcacugaagaagau

SEQ ID NO: 315243 - RNA, 19 nt, Homo sapiens
uucaugaccuuaucaacuu

SEQ ID NO: 315244 - RNA, 19 nt, Homo sapiens
guacacugacugcuuuaga

SEQ ID NO: 315245 - RNA, 19 nt, Homo sapiens
gcucuaagccugccucacu

SEQ ID NO: 315246 - RNA, 19 nt, Homo sapiens
ccaauguguugcuguuauc

SEQ ID NO: 315247 - RNA, 19 nt, Homo sapiens
gggccugggugacauuauc

SEQ ID NO: 315248 - RNA, 19 nt, Homo sapiens
auacuaggcacuccauaaa

SEQ ID NO: 315249 - RNA, 19 nt, Homo sapiens
agaagauguuguuggauca

SEQ ID NO: 315250 - RNA, 19 nt, Homo sapiens
gcacugaagaagauguugu

SEQ ID NO: 315251 - RNA, 19 nt, Homo sapiens
cuccauaaauaucuguuga

SEQ ID NO: 315252 - RNA, 19 nt, Homo sapiens
gcucacccguggaaaguac

SEQ ID NO: 315253 - RNA, 19 nt, Homo sapiens
gagcuuaagaggacuagca

SEQ ID NO: 315254 - RNA, 19 nt, Homo sapiens
ccaaacuacagcgggauua

SEQ ID NO: 315255 - RNA, 19 nt, Homo sapiens
caacugggccaaacuacag

SEQ ID NO: 315256 - RNA, 19 nt, Homo sapiens
uuuauauggugccucagua

SEQ ID NO: 315257 - RNA, 19 nt, Homo sapiens
ucaugaccuuaucaacuuu

SEQ ID NO: 315258 - RNA, 19 nt, Homo sapiens
ccauaaauaucuguugaac

SEQ ID NO: 315259 - RNA, 19 nt, Homo sapiens
acuccuaccuguccuggaa

SEQ ID NO: 315260 - RNA, 19 nt, Homo sapiens
gcuuuagagcccuugauaa

SEQ ID NO: 315261 - RNA, 19 nt, Homo sapiens
cgggaacccuuuauauggu

SEQ ID NO: 315262 - RNA, 19 nt, Homo sapiens
acacccauauccagcaaau

SEQ ID NO: 315263 - RNA, 19 nt, Homo sapiens
gguugccggucagagcuua

SEQ ID NO: 315264 - RNA, 19 nt, Homo sapiens
cugccucacuccaucguuu

SEQ ID NO: 315265 - RNA, 19 nt, Homo sapiens
ucagacaaccuccucaaag

SEQ ID NO: 315266 - RNA, 19 nt, Homo sapiens
ggaaggcacaucggcucua

SEQ ID NO: 315267 - RNA, 19 nt, Homo sapiens
uccaauguguugcuguuau

SEQ ID NO: 315268 - RNA, 19 nt, Homo sapiens
uuuagagcccuugauaaua

SEQ ID NO: 315269 - RNA, 19 nt, Homo sapiens
caccugcaaugcccucuuc

SEQ ID NO: 315270 - RNA, 19 nt, Homo sapiens
uaucaccaacuacuaucua

SEQ ID NO: 315271 - RNA, 19 nt, Homo sapiens
cuuuagagcccuugauaau

SEQ ID NO: 315272 - RNA, 19 nt, Homo sapiens
guguugcuguuaucuggaa

SEQ ID NO: 315273 - RNA, 19 nt, Homo sapiens
caaacuacagcgggauuau

SEQ ID NO: 315274 - RNA, 19 nt, Homo sapiens
gugccucaguaaauauguu

SEQ ID NO: 315275 - RNA, 19 nt, Homo sapiens
ggucagacaaccuccucaa

SEQ ID NO: 315276 - RNA, 19 nt, Homo sapiens
uguccaauguguugcuguu

SEQ ID NO: 315277 - RNA, 19 nt, Homo sapiens
uauauggugccucaguaaa

SEQ ID NO: 315278 - RNA, 19 nt, Homo sapiens
ccgggaacccuuuauaugg

SEQ ID NO: 315279 - RNA, 19 nt, Homo sapiens
caugaccuuaucaacuuua

SEQ ID NO: 315280 - RNA, 19 nt, Homo sapiens
caccaacuacuaucuaugg

SEQ ID NO: 315281 - RNA, 19 nt, Homo sapiens
gaagaagauguuguuggau

SEQ ID NO: 315282 - RNA, 19 nt, Homo sapiens
cuaggcacuccauaaauau

SEQ ID NO: 315283 - RNA, 19 nt, Homo sapiens
guggaugcacugaagaaga

SEQ ID NO: 315284 - RNA, 19 nt, Homo sapiens
gguaggaggcugguacaag

SEQ ID NO: 315285 - RNA, 19 nt, Homo sapiens
uuacacccauauccagcaa

SEQ ID NO: 315286 - RNA, 19 nt, Homo sapiens
uacacugacugcuuuagag

SEQ ID NO: 315287 - RNA, 19 nt, Homo sapiens
aaauguacacugacugcuu

SEQ ID NO: 315288 - RNA, 19 nt, Homo sapiens
agacaaccuccucaaagug

SEQ ID NO: 315289 - RNA, 19 nt, Homo sapiens
ggacuagcaccugcaaugc

SEQ ID NO: 315290 - RNA, 19 nt, Homo sapiens
uuauauggugccucaguaa

SEQ ID NO: 315291 - RNA, 19 nt, Homo sapiens
gccguuguccaauguguug

SEQ ID NO: 315292 - RNA, 19 nt, Homo sapiens
gucagacaaccuccucaaa

SEQ ID NO: 315293 - RNA, 19 nt, Homo sapiens
gccggacucugaccauggu

SEQ ID NO: 315294 - RNA, 19 nt, Homo sapiens
caggacaacugggccaaac

SEQ ID NO: 315295 - RNA, 19 nt, Homo sapiens
ggcacuuaauggacuguca

SEQ ID NO: 315296 - RNA, 19 nt, Homo sapiens
caaaugagccuuaagaaau

SEQ ID NO: 315297 - RNA, 19 nt, Homo sapiens
gcaaaugagccuuaagaaa

SEQ ID NO: 315298 - RNA, 19 nt, Homo sapiens
gauaagaaauagcgguuag

SEQ ID NO: 315299 - RNA, 19 nt, Homo sapiens
ccaaauguccuuaaauguu

SEQ ID NO: 315300 - RNA, 19 nt, Homo sapiens
gagaauggauccucauagg

SEQ ID NO: 315301 - RNA, 19 nt, Homo sapiens
aaaugagccuuaagaaaug

SEQ ID NO: 315302 - RNA, 19 nt, Homo sapiens
ggagagagacagagagaga

SEQ ID NO: 315303 - RNA, 19 nt, Homo sapiens
gcaccaaagcugucaguga

SEQ ID NO: 315304 - RNA, 19 nt, Homo sapiens
gagagaauggauccucaua

SEQ ID NO: 315305 - RNA, 19 nt, Homo sapiens
ccauuucgaucuuccacua

SEQ ID NO: 315306 - RNA, 19 nt, Homo sapiens
gcagagaugccauuucgau

SEQ ID NO: 315307 - RNA, 19 nt, Homo sapiens
ccaaagcugucagugagaa

SEQ ID NO: 315308 - RNA, 19 nt, Homo sapiens
gggcaaaugagccuuaaga

SEQ ID NO: 315309 - RNA, 19 nt, Homo sapiens
cagcagaaccagccucaaa

SEQ ID NO: 315310 - RNA, 19 nt, Homo sapiens
ucucaaaccuccaaauguc

SEQ ID NO: 315311 - RNA, 19 nt, Homo sapiens
gggagucucgcaaggauaa

SEQ ID NO: 315312 - RNA, 19 nt, Homo sapiens
cuccaaauguccuuaaaug

SEQ ID NO: 315313 - RNA, 19 nt, Homo sapiens
acacuucaguauagcauug

SEQ ID NO: 315314 - RNA, 19 nt, Homo sapiens
ugaagagccagcccaagua

SEQ ID NO: 315315 - RNA, 19 nt, Homo sapiens
gugcugcucuucucuucuu

SEQ ID NO: 315316 - RNA, 19 nt, Homo sapiens
ccucucaggucacgcugua

SEQ ID NO: 315317 - RNA, 19 nt, Homo sapiens
cagaggaggcucagugcua

SEQ ID NO: 315318 - RNA, 19 nt, Homo sapiens
gacaauggcacguucacuu

SEQ ID NO: 315319 - RNA, 19 nt, Homo sapiens
gaagagccagcccaaguag

SEQ ID NO: 315320 - RNA, 19 nt, Homo sapiens
gcccaaaggugauggucau

SEQ ID NO: 315321 - RNA, 19 nt, Homo sapiens
ggauaagaaauagcgguua

SEQ ID NO: 315322 - RNA, 19 nt, Homo sapiens
gaggagagagacagagaga

SEQ ID NO: 315323 - RNA, 19 nt, Homo sapiens
cuaggugcuuucccucuuu

SEQ ID NO: 315324 - RNA, 19 nt, Homo sapiens
gauccucacacuucaguau

SEQ ID NO: 315325 - RNA, 19 nt, Homo sapiens
agacucuccuucaggguuu

SEQ ID NO: 315326 - RNA, 19 nt, Homo sapiens
cccaggccaucgugguuua

SEQ ID NO: 315327 - RNA, 19 nt, Homo sapiens
ccuuugagauguaaguuuc

SEQ ID NO: 315328 - RNA, 19 nt, Homo sapiens
ggaccuaggcuccucuuac

SEQ ID NO: 315329 - RNA, 19 nt, Homo sapiens
aauaaacacugacauuucc

SEQ ID NO: 315330 - RNA, 19 nt, Homo sapiens
agaggaggcucagugcuau

SEQ ID NO: 315331 - RNA, 19 nt, Homo sapiens
ggccugaacucggacaagu

SEQ ID NO: 315332 - RNA, 19 nt, Homo sapiens
ucauguggcuuuugcaauu

SEQ ID NO: 315333 - RNA, 19 nt, Homo sapiens
ucaccucccuuugagaugu

SEQ ID NO: 315334 - RNA, 19 nt, Homo sapiens
ucgcaaggauaagaaauag

SEQ ID NO: 315335 - RNA, 19 nt, Homo sapiens
guauauuucuucucaaacc

SEQ ID NO: 315336 - RNA, 19 nt, Homo sapiens
gaccuaggcuccucuuacc

SEQ ID NO: 315337 - RNA, 19 nt, Homo sapiens
agauggagcuacgaaagga

SEQ ID NO: 315338 - RNA, 19 nt, Homo sapiens
caggaaaggacgcgucgaa

SEQ ID NO: 315339 - RNA, 19 nt, Homo sapiens
gcucagugcuauggagaag

SEQ ID NO: 315340 - RNA, 19 nt, Homo sapiens
ggcaaaugagccuuaagaa

SEQ ID NO: 315341 - RNA, 19 nt, Homo sapiens
caggguuuauuuagguuau

SEQ ID NO: 315342 - RNA, 19 nt, Homo sapiens
cuucaggguuuauuuaggu

SEQ ID NO: 315343 - RNA, 19 nt, Homo sapiens
gaacaugaugggccugaac

SEQ ID NO: 315344 - RNA, 19 nt, Homo sapiens
cgccagugcuguaugcaau

SEQ ID NO: 315345 - RNA, 19 nt, Homo sapiens
acaauggcacguucacuug

SEQ ID NO: 315346 - RNA, 19 nt, Homo sapiens
agacagagagagagaaugg

SEQ ID NO: 315347 - RNA, 19 nt, Homo sapiens
ugagauguaaguuucauuc

SEQ ID NO: 315348 - RNA, 19 nt, Homo sapiens
ccagagcacccagaucaga

SEQ ID NO: 315349 - RNA, 19 nt, Homo sapiens
gagauggagcuacgaaagg

SEQ ID NO: 315350 - RNA, 19 nt, Homo sapiens
ggcagacgccagugcugua

SEQ ID NO: 315351 - RNA, 19 nt, Homo sapiens
gagugggucucagaugaca

SEQ ID NO: 315352 - RNA, 19 nt, Homo sapiens
cagaucagacucuccuuca

SEQ ID NO: 315353 - RNA, 19 nt, Homo sapiens
ggucacgcuguaugucuuu

SEQ ID NO: 315354 - RNA, 19 nt, Homo sapiens
caccucccuuugagaugua

SEQ ID NO: 315355 - RNA, 19 nt, Homo sapiens
ccugaacucggacaaguga

SEQ ID NO: 315356 - RNA, 19 nt, Homo sapiens
gcagacgccagugcuguau

SEQ ID NO: 315357 - RNA, 19 nt, Homo sapiens
ccaaaggcccaaaggugau

SEQ ID NO: 315358 - RNA, 19 nt, Homo sapiens
ucuaggugcuuucccucuu

SEQ ID NO: 315359 - RNA, 19 nt, Homo sapiens
cgagauggagcuacgaaag

SEQ ID NO: 315360 - RNA, 19 nt, Homo sapiens
ccacagcagaagcaccaaa

SEQ ID NO: 315361 - RNA, 19 nt, Homo sapiens
ccacuuuggagcacuguuc

SEQ ID NO: 315362 - RNA, 19 nt, Homo sapiens
agauguaaguuucauucca

SEQ ID NO: 315363 - RNA, 19 nt, Homo sapiens
uaggugcuuucccucuuug

SEQ ID NO: 315364 - RNA, 19 nt, Homo sapiens
ucauacacaaccuagacua

SEQ ID NO: 315365 - RNA, 19 nt, Homo sapiens
cacgcuguaugucuuugaa

SEQ ID NO: 315366 - RNA, 19 nt, Homo sapiens
gagagacagagagagagaa

SEQ ID NO: 315367 - RNA, 19 nt, Homo sapiens
cgacagggagguccauggu

SEQ ID NO: 315368 - RNA, 19 nt, Homo sapiens
caauggcacguucacuugu

SEQ ID NO: 315369 - RNA, 19 nt, Homo sapiens
caugacugaggaccaauga

SEQ ID NO: 315370 - RNA, 19 nt, Homo sapiens
caaaggcccaaaggugaug

SEQ ID NO: 315371 - RNA, 19 nt, Homo sapiens
gaacaagccuuccugacua

SEQ ID NO: 315372 - RNA, 19 nt, Homo sapiens
gaagauggguggguuauuu

SEQ ID NO: 315373 - RNA, 19 nt, Homo sapiens
ggacaggacuuucagauau

SEQ ID NO: 315374 - RNA, 19 nt, Homo sapiens
gaagcagucuuucuuauga

SEQ ID NO: 315375 - RNA, 19 nt, Homo sapiens
gaucaaaggagaagauuua

SEQ ID NO: 315376 - RNA, 19 nt, Homo sapiens
caaacaauauggcgauuaa

SEQ ID NO: 315377 - RNA, 19 nt, Homo sapiens
ggacugggcugaaugaugu

SEQ ID NO: 315378 - RNA, 19 nt, Homo sapiens
gacauacgcuuucaacauu

SEQ ID NO: 315379 - RNA, 19 nt, Homo sapiens
gaaaucagcauguguuuau

SEQ ID NO: 315380 - RNA, 19 nt, Homo sapiens
ucaaugcgauucugagaua

SEQ ID NO: 315381 - RNA, 19 nt, Homo sapiens
agugaaagcuuauggaaua

SEQ ID NO: 315382 - RNA, 19 nt, Homo sapiens
ggacguggcuguggauaaa

SEQ ID NO: 315383 - RNA, 19 nt, Homo sapiens
ggaguaauauucacuguuc

SEQ ID NO: 315384 - RNA, 19 nt, Homo sapiens
gaugauaccugcgacagua

SEQ ID NO: 315385 - RNA, 19 nt, Homo sapiens
gaaugauuguguagcuuua

SEQ ID NO: 315386 - RNA, 19 nt, Homo sapiens
aaacugggcuuauggagaa

SEQ ID NO: 315387 - RNA, 19 nt, Homo sapiens
gacaggacuuucagauaua

SEQ ID NO: 315388 - RNA, 19 nt, Homo sapiens
cagacaagcuauuuggaua

SEQ ID NO: 315389 - RNA, 19 nt, Homo sapiens
gauuaugaguguugcauuu

SEQ ID NO: 315390 - RNA, 19 nt, Homo sapiens
uaacaaugcugauuacuac

SEQ ID NO: 315391 - RNA, 19 nt, Homo sapiens
gcaaguagaagaccauuug

SEQ ID NO: 315392 - RNA, 19 nt, Homo sapiens
gauaaacccugggccauga

SEQ ID NO: 315393 - RNA, 19 nt, Homo sapiens
gcaaaccaaaccuguaaua

SEQ ID NO: 315394 - RNA, 19 nt, Homo sapiens
ggaaacaucuaaugaacgu

SEQ ID NO: 315395 - RNA, 19 nt, Homo sapiens
cagauggcuuuguuaaaua

SEQ ID NO: 315396 - RNA, 19 nt, Homo sapiens
caacaccacuuuaaauucu

SEQ ID NO: 315397 - RNA, 19 nt, Homo sapiens
gggccaagcuucucuggaa

SEQ ID NO: 315398 - RNA, 19 nt, Homo sapiens
caauacacuuggacugaua

SEQ ID NO: 315399 - RNA, 19 nt, Homo sapiens
cgacauaacaguaguauca

SEQ ID NO: 315400 - RNA, 19 nt, Homo sapiens
gcacugggcagaaggagua

SEQ ID NO: 315401 - RNA, 19 nt, Homo sapiens
aagccaagguccagaaaua

SEQ ID NO: 315402 - RNA, 19 nt, Homo sapiens
gaacuagugauaugaaaga

SEQ ID NO: 315403 - RNA, 19 nt, Homo sapiens
cagcaacgauucaaacaga

SEQ ID NO: 315404 - RNA, 19 nt, Homo sapiens
gaugcugacuguguuguua

SEQ ID NO: 315405 - RNA, 19 nt, Homo sapiens
aaccaaaccuguaauaaug

SEQ ID NO: 315406 - RNA, 19 nt, Homo sapiens
gaaccacuacugacuauga

SEQ ID NO: 315407 - RNA, 19 nt, Homo sapiens
gaccauguauucaaauuca

SEQ ID NO: 315408 - RNA, 19 nt, Homo sapiens
gaagcuucuuggcauauuu

SEQ ID NO: 315409 - RNA, 19 nt, Homo sapiens
gggauaacaaugcugauua

SEQ ID NO: 315410 - RNA, 19 nt, Homo sapiens
ggauaggauuguucagaaa

SEQ ID NO: 315411 - RNA, 19 nt, Homo sapiens
cauggucacuguuacuaua

SEQ ID NO: 315412 - RNA, 19 nt, Homo sapiens
ugaaaucccugcuacugaa

SEQ ID NO: 315413 - RNA, 19 nt, Homo sapiens
ggaucgcccugaacaguaa

SEQ ID NO: 315414 - RNA, 19 nt, Homo sapiens
gcaagcauuucuuaccuau

SEQ ID NO: 315415 - RNA, 19 nt, Homo sapiens
agacuuagcuagcaucaau

SEQ ID NO: 315416 - RNA, 19 nt, Homo sapiens
caaccaggaugccgaauca

SEQ ID NO: 315417 - RNA, 19 nt, Homo sapiens
gaagacagcacauugcaau

SEQ ID NO: 315418 - RNA, 19 nt, Homo sapiens
caaaguggauuacgugucu

SEQ ID NO: 315419 - RNA, 19 nt, Homo sapiens
caaggaagguuggaauuuc

SEQ ID NO: 315420 - RNA, 19 nt, Homo sapiens
acaaagacuaccaguauua

SEQ ID NO: 315421 - RNA, 19 nt, Homo sapiens
caagacaauccaccaguua

SEQ ID NO: 315422 - RNA, 19 nt, Homo sapiens
guacaugugcagaagaaua

SEQ ID NO: 315423 - RNA, 19 nt, Homo sapiens
ccacuccaauuauuuagaa

SEQ ID NO: 315424 - RNA, 19 nt, Homo sapiens
gauaaucaauacacuugga

SEQ ID NO: 315425 - RNA, 19 nt, Homo sapiens
gaaaauggauggaugauac

SEQ ID NO: 315426 - RNA, 19 nt, Homo sapiens
gcaaggaagguuggaauuu

SEQ ID NO: 315427 - RNA, 19 nt, Homo sapiens
ggacauacgcuuucaacau

SEQ ID NO: 315428 - RNA, 19 nt, Homo sapiens
ggaauuggacuuuauuauc

SEQ ID NO: 315429 - RNA, 19 nt, Homo sapiens
ucacuguucuuccuacaaa

SEQ ID NO: 315430 - RNA, 19 nt, Homo sapiens
ggacaaugcgcgagcguuu

SEQ ID NO: 315431 - RNA, 19 nt, Homo sapiens
gaauaaggcagcugagaau

SEQ ID NO: 315432 - RNA, 19 nt, Homo sapiens
gcaccacaucuaagcauua

SEQ ID NO: 315433 - RNA, 19 nt, Homo sapiens
acagauggcuuuguuaaau

SEQ ID NO: 315434 - RNA, 19 nt, Homo sapiens
ccaaauguccggaggauug

SEQ ID NO: 315435 - RNA, 19 nt, Homo sapiens
gaagacagauaugaacaag

SEQ ID NO: 315436 - RNA, 19 nt, Homo sapiens
gaagcaaaccaaaccugua

SEQ ID NO: 315437 - RNA, 19 nt, Homo sapiens
gcuauucacucaugagaca

SEQ ID NO: 315438 - RNA, 19 nt, Homo sapiens
ugagggcagugaaagcuua

SEQ ID NO: 315439 - RNA, 19 nt, Homo sapiens
gacaagcuauuuggauauu

SEQ ID NO: 315440 - RNA, 19 nt, Homo sapiens
ggaaugauuguguagcuuu

SEQ ID NO: 315441 - RNA, 19 nt, Homo sapiens
guauucaaauucaggguuu

SEQ ID NO: 315442 - RNA, 19 nt, Homo sapiens
uuacaaagacuaccaguau

SEQ ID NO: 315443 - RNA, 19 nt, Homo sapiens
gcaaacaauauggcgauua

SEQ ID NO: 315444 - RNA, 19 nt, Homo sapiens
ccacuggaauucagauaug

SEQ ID NO: 315445 - RNA, 19 nt, Homo sapiens
guuacaagauucacagaga

SEQ ID NO: 315446 - RNA, 19 nt, Homo sapiens
ggaauacaaggaugugaaa

SEQ ID NO: 315447 - RNA, 19 nt, Homo sapiens
gaaaagacgugugcaccua

SEQ ID NO: 315448 - RNA, 19 nt, Homo sapiens
ggaguagucaucauuguga

SEQ ID NO: 315449 - RNA, 19 nt, Homo sapiens
uaacugggcugcugaugag

SEQ ID NO: 315450 - RNA, 19 nt, Homo sapiens
aaucuggucuccauacaaa

SEQ ID NO: 315451 - RNA, 19 nt, Homo sapiens
gaagcaaaguggauuacgu

SEQ ID NO: 315452 - RNA, 19 nt, Homo sapiens
gugaacaccuuaacaacug

SEQ ID NO: 315453 - RNA, 19 nt, Homo sapiens
uaacaaagaggaacagcaa

SEQ ID NO: 315454 - RNA, 19 nt, Homo sapiens
ggauguacuuagauaaugu

SEQ ID NO: 315455 - RNA, 19 nt, Homo sapiens
ggauaacaaugcugauuac

SEQ ID NO: 315456 - RNA, 19 nt, Homo sapiens
gcaaagagaaggaaaccau

SEQ ID NO: 315457 - RNA, 19 nt, Homo sapiens
caaauggcuucguggagaa

SEQ ID NO: 315458 - RNA, 19 nt, Homo sapiens
gcagaugcccggagucaga

SEQ ID NO: 315459 - RNA, 19 nt, Homo sapiens
aaagugaugugccuacuca

SEQ ID NO: 315460 - RNA, 19 nt, Homo sapiens
gaaacaaugaagcuucuug

SEQ ID NO: 315461 - RNA, 19 nt, Homo sapiens
aagcauuucuuaccuauca

SEQ ID NO: 315462 - RNA, 19 nt, Homo sapiens
gagggaaucuggucuccau

SEQ ID NO: 315463 - RNA, 19 nt, Homo sapiens
gcaacaccacuuuaaauuc

SEQ ID NO: 315464 - RNA, 19 nt, Homo sapiens
ggaggugcaucaaaugaag

SEQ ID NO: 315465 - RNA, 19 nt, Homo sapiens
ugaagaugcugacuguguu

SEQ ID NO: 315466 - RNA, 19 nt, Homo sapiens
guguuuaucuggaucuuga

SEQ ID NO: 315467 - RNA, 19 nt, Homo sapiens
ucaagacaauccaccaguu

SEQ ID NO: 315468 - RNA, 19 nt, Homo sapiens
guucuccuguuucauauga

SEQ ID NO: 315469 - RNA, 19 nt, Homo sapiens
ggcaacaccacuuuaaauu

SEQ ID NO: 315470 - RNA, 19 nt, Homo sapiens
aaacugggcuauauuugca

SEQ ID NO: 315471 - RNA, 19 nt, Homo sapiens
gagcauaacuccauaagua

SEQ ID NO: 315472 - RNA, 19 nt, Homo sapiens
gcacaaagauugcgcuaua

SEQ ID NO: 315473 - RNA, 19 nt, Homo sapiens
gaugagaacucuugguuua

SEQ ID NO: 315474 - RNA, 19 nt, Homo sapiens
gaacaaagcagaagguuaa

SEQ ID NO: 315475 - RNA, 19 nt, Homo sapiens
gcuaagaguuuacaguuua

SEQ ID NO: 315476 - RNA, 19 nt, Homo sapiens
guaccuaacuugagcauaa

SEQ ID NO: 315477 - RNA, 19 nt, Homo sapiens
ggaagagccuuuaaaucua

SEQ ID NO: 315478 - RNA, 19 nt, Homo sapiens
ggagaaagaugcagucaga

SEQ ID NO: 315479 - RNA, 19 nt, Homo sapiens
gaaccuaugucuaaauuca

SEQ ID NO: 315480 - RNA, 19 nt, Homo sapiens
gaaaggcucuaucgaaugu

SEQ ID NO: 315481 - RNA, 19 nt, Homo sapiens
guagaagucuuucagauga

SEQ ID NO: 315482 - RNA, 19 nt, Homo sapiens
uaaggaaagugaugacaua

SEQ ID NO: 315483 - RNA, 19 nt, Homo sapiens
guagggaauucuucuguua

SEQ ID NO: 315484 - RNA, 19 nt, Homo sapiens
gaagacaucuguagggaau

SEQ ID NO: 315485 - RNA, 19 nt, Homo sapiens
gcuaaugacucugaugaua

SEQ ID NO: 315486 - RNA, 19 nt, Homo sapiens
gagaagagaucaacuuugg

SEQ ID NO: 315487 - RNA, 19 nt, Homo sapiens
gagcuugacugaccauaaa

SEQ ID NO: 315488 - RNA, 19 nt, Homo sapiens
cgacauuucuucauaggua

SEQ ID NO: 315489 - RNA, 19 nt, Homo sapiens
cagaacagauggcuaauga

SEQ ID NO: 315490 - RNA, 19 nt, Homo sapiens
gaguauagauuuagcagaa

SEQ ID NO: 315491 - RNA, 19 nt, Homo sapiens
ggaauucuucuguuacuua

SEQ ID NO: 315492 - RNA, 19 nt, Homo sapiens
ccuggaaugugucaaauua

SEQ ID NO: 315493 - RNA, 19 nt, Homo sapiens
uaaaguaacccaagccaua

SEQ ID NO: 315494 - RNA, 19 nt, Homo sapiens
uaaaauagcuccaaccaaa

SEQ ID NO: 315495 - RNA, 19 nt, Homo sapiens
uaaaguauccugacaaguu

SEQ ID NO: 315496 - RNA, 19 nt, Homo sapiens
ggagaagauugaagaaaug

SEQ ID NO: 315497 - RNA, 19 nt, Homo sapiens
gaacaggaguaaacaugga

SEQ ID NO: 315498 - RNA, 19 nt, Homo sapiens
ggaaagugaugacauagca

SEQ ID NO: 315499 - RNA, 19 nt, Homo sapiens
ggagguacgucguuucaga

SEQ ID NO: 315500 - RNA, 19 nt, Homo sapiens
guaaaucacuuuggacguu

SEQ ID NO: 315501 - RNA, 19 nt, Homo sapiens
ugauaaaucucuccagcua

SEQ ID NO: 315502 - RNA, 19 nt, Homo sapiens
gcuaguggcucuucucaug

SEQ ID NO: 315503 - RNA, 19 nt, Homo sapiens
ggaggaagaugaauaugca

SEQ ID NO: 315504 - RNA, 19 nt, Homo sapiens
ggcccuaacuucuguaauu

SEQ ID NO: 315505 - RNA, 19 nt, Homo sapiens
gcgaaccuaugucuaaauu

SEQ ID NO: 315506 - RNA, 19 nt, Homo sapiens
gaacaugaguguaaaauag

SEQ ID NO: 315507 - RNA, 19 nt, Homo sapiens
cagaggaaaugauacguuu

SEQ ID NO: 315508 - RNA, 19 nt, Homo sapiens
aggagaagcuguaaagaaa

SEQ ID NO: 315509 - RNA, 19 nt, Homo sapiens
cagaugcacuugaugauga

SEQ ID NO: 315510 - RNA, 19 nt, Homo sapiens
ggaaggcauuguccuguga

SEQ ID NO: 315511 - RNA, 19 nt, Homo sapiens
ugaagaagaugaugaaguc

SEQ ID NO: 315512 - RNA, 19 nt, Homo sapiens
gaagagccuuuaaaucuac

SEQ ID NO: 315513 - RNA, 19 nt, Homo sapiens
uuucagaccuguugguaua

SEQ ID NO: 315514 - RNA, 19 nt, Homo sapiens
caaguaacauuaacucagu

SEQ ID NO: 315515 - RNA, 19 nt, Homo sapiens
guuaguggcugccucauau

SEQ ID NO: 315516 - RNA, 19 nt, Homo sapiens
ggagucugcuucugccuuu

SEQ ID NO: 315517 - RNA, 19 nt, Homo sapiens
gaugaaaggcucuaucgaa

SEQ ID NO: 315518 - RNA, 19 nt, Homo sapiens
ggaaaugauacguuuguaa

SEQ ID NO: 315519 - RNA, 19 nt, Homo sapiens
gcagucagaggaaaugaua

SEQ ID NO: 315520 - RNA, 19 nt, Homo sapiens
gaaugucaaugccaggauu

SEQ ID NO: 315521 - RNA, 19 nt, Homo sapiens
guuacaagcuaagaguuua

SEQ ID NO: 315522 - RNA, 19 nt, Homo sapiens
gaaaugucacuacuaagaa

SEQ ID NO: 315523 - RNA, 19 nt, Homo sapiens
gguagaagaucuuguaaaa

SEQ ID NO: 315524 - RNA, 19 nt, Homo sapiens
ggaauggucacuaaaguau

SEQ ID NO: 315525 - RNA, 19 nt, Homo sapiens
gaaauauucuuaggcagau

SEQ ID NO: 315526 - RNA, 19 nt, Homo sapiens
agaaguaccuaauaguuug

SEQ ID NO: 315527 - RNA, 19 nt, Homo sapiens
gagcuuuguuucaauauca

SEQ ID NO: 315528 - RNA, 19 nt, Homo sapiens
ggaagaugaauaugcauaa

SEQ ID NO: 315529 - RNA, 19 nt, Homo sapiens
gagaagcuguaaagaaaca

SEQ ID NO: 315530 - RNA, 19 nt, Homo sapiens
gaacucuugguuuaacuua

SEQ ID NO: 315531 - RNA, 19 nt, Homo sapiens
uuaggaaugugaccuuuaa

SEQ ID NO: 315532 - RNA, 19 nt, Homo sapiens
gaaaagagguacuaaaugc

SEQ ID NO: 315533 - RNA, 19 nt, Homo sapiens
aaagaucccugagauuauu

SEQ ID NO: 315534 - RNA, 19 nt, Homo sapiens
acacagcgauuucuuaaag

SEQ ID NO: 315535 - RNA, 19 nt, Homo sapiens
ggcauuguccugugaaaua

SEQ ID NO: 315536 - RNA, 19 nt, Homo sapiens
ccagauaauccuaaaguaa

SEQ ID NO: 315537 - RNA, 19 nt, Homo sapiens
ccuggaagcucagugguua

SEQ ID NO: 315538 - RNA, 19 nt, Homo sapiens
gauggcaaccucaacauuu

SEQ ID NO: 315539 - RNA, 19 nt, Homo sapiens
ugaagaggccuaagucaaa

SEQ ID NO: 315540 - RNA, 19 nt, Homo sapiens
cuucauagguagaaacaaa

SEQ ID NO: 315541 - RNA, 19 nt, Homo sapiens
ggcccgacauuucuucaua

SEQ ID NO: 315542 - RNA, 19 nt, Homo sapiens
ugcgacagcuuuacuuuaa

SEQ ID NO: 315543 - RNA, 19 nt, Homo sapiens
cgaaaugucacuacuaaga

SEQ ID NO: 315544 - RNA, 19 nt, Homo sapiens
gcugaugaccuuaugagua

SEQ ID NO: 315545 - RNA, 19 nt, Homo sapiens
caagugaggaugaugauga

SEQ ID NO: 315546 - RNA, 19 nt, Homo sapiens
aaucagauguggaagaaga

SEQ ID NO: 315547 - RNA, 19 nt, Homo sapiens
aaacacagcgauuucuuaa

SEQ ID NO: 315548 - RNA, 19 nt, Homo sapiens
aaaggaagcacaaagauug

SEQ ID NO: 315549 - RNA, 19 nt, Homo sapiens
gcagugcuguccaugaugu

SEQ ID NO: 315550 - RNA, 19 nt, Homo sapiens
ugaaucagauguggaagaa

SEQ ID NO: 315551 - RNA, 19 nt, Homo sapiens
cugaugaccuuaugaguau

SEQ ID NO: 315552 - RNA, 19 nt, Homo sapiens
uaacuucauuccagaacaa

SEQ ID NO: 315553 - RNA, 19 nt, Homo sapiens
guaagagcuuuguuucaau

SEQ ID NO: 315554 - RNA, 19 nt, Homo sapiens
ugagguagaugaaucagau

SEQ ID NO: 315555 - RNA, 19 nt, Homo sapiens
gcccuaacuucuguaauuu

SEQ ID NO: 315556 - RNA, 19 nt, Homo sapiens
gugauacucaugaccauua

SEQ ID NO: 315557 - RNA, 19 nt, Homo sapiens
gagauuauuccuucuucua

SEQ ID NO: 315558 - RNA, 19 nt, Homo sapiens
aagauuguguucccauuaa

SEQ ID NO: 315559 - RNA, 19 nt, Homo sapiens
ccuaauaguuugaacagau

SEQ ID NO: 315560 - RNA, 19 nt, Homo sapiens
ucacagacauacaauagca

SEQ ID NO: 315561 - RNA, 19 nt, Homo sapiens
ugagaaacaugcaagauac

SEQ ID NO: 315562 - RNA, 19 nt, Homo sapiens
gaaagggguugauuuugaa

SEQ ID NO: 315563 - RNA, 19 nt, Homo sapiens
cccgaaaugucacuacuaa

SEQ ID NO: 315564 - RNA, 19 nt, Homo sapiens
uggagaagauugaagaaau

SEQ ID NO: 315565 - RNA, 19 nt, Homo sapiens
gaaaugauacguuuguaac

SEQ ID NO: 315566 - RNA, 19 nt, Homo sapiens
uaacccagauaauccuaaa

SEQ ID NO: 315567 - RNA, 19 nt, Homo sapiens
agucauaccuggaaugugu

SEQ ID NO: 315568 - RNA, 19 nt, Homo sapiens
gcagugggaauuucuagaa

SEQ ID NO: 315569 - RNA, 19 nt, Homo sapiens
caggauuucucauuaacaa

SEQ ID NO: 315570 - RNA, 19 nt, Homo sapiens
gaacagauggcuaaugacu

SEQ ID NO: 315571 - RNA, 19 nt, Homo sapiens
gagcauaacuccauaagua

SEQ ID NO: 315572 - RNA, 19 nt, Homo sapiens
gcacaaagauugcgcuaua

SEQ ID NO: 315573 - RNA, 19 nt, Homo sapiens
gaugagaacucuugguuua

SEQ ID NO: 315574 - RNA, 19 nt, Homo sapiens
gaacaaagcagaagguuaa

SEQ ID NO: 315575 - RNA, 19 nt, Homo sapiens
gcuaagaguuuacaguuua

SEQ ID NO: 315576 - RNA, 19 nt, Homo sapiens
guaccuaacuugagcauaa

SEQ ID NO: 315577 - RNA, 19 nt, Homo sapiens
ggagaaagaugcagucaga

SEQ ID NO: 315578 - RNA, 19 nt, Homo sapiens
gaaccuaugucuaaauuca

SEQ ID NO: 315579 - RNA, 19 nt, Homo sapiens
gaaaggcucuaucgaaugu

SEQ ID NO: 315580 - RNA, 19 nt, Homo sapiens
guagaagucuuucagauga

SEQ ID NO: 315581 - RNA, 19 nt, Homo sapiens
uaaggaaagugaugacaua

SEQ ID NO: 315582 - RNA, 19 nt, Homo sapiens
guagggaauucuucuguua

SEQ ID NO: 315583 - RNA, 19 nt, Homo sapiens
gaagacaucuguagggaau

SEQ ID NO: 315584 - RNA, 19 nt, Homo sapiens
gcuaaugacucugaugaua

SEQ ID NO: 315585 - RNA, 19 nt, Homo sapiens
gagaagagaucaacuuugg

SEQ ID NO: 315586 - RNA, 19 nt, Homo sapiens
gagcuugacugaccauaaa

SEQ ID NO: 315587 - RNA, 19 nt, Homo sapiens
cgacauuucuucauaggua

SEQ ID NO: 315588 - RNA, 19 nt, Homo sapiens
cagaacagauggcuaauga

SEQ ID NO: 315589 - RNA, 19 nt, Homo sapiens
gaguauagauuuagcagaa

SEQ ID NO: 315590 - RNA, 19 nt, Homo sapiens
ggaauucuucuguuacuua

SEQ ID NO: 315591 - RNA, 19 nt, Homo sapiens
ccuggaaugugucaaauua

SEQ ID NO: 315592 - RNA, 19 nt, Homo sapiens
uaaaguaacccaagccaua

SEQ ID NO: 315593 - RNA, 19 nt, Homo sapiens
uaaaauagcuccaaccaaa

SEQ ID NO: 315594 - RNA, 19 nt, Homo sapiens
uaaaguauccugacaaguu

SEQ ID NO: 315595 - RNA, 19 nt, Homo sapiens
ggagaagauugaagaaaug

SEQ ID NO: 315596 - RNA, 19 nt, Homo sapiens
gaacaggaguaaacaugga

SEQ ID NO: 315597 - RNA, 19 nt, Homo sapiens
ggaaagugaugacauagca

SEQ ID NO: 315598 - RNA, 19 nt, Homo sapiens
ggagguacgucguuucaga

SEQ ID NO: 315599 - RNA, 19 nt, Homo sapiens
guaaaucacuuuggacguu

SEQ ID NO: 315600 - RNA, 19 nt, Homo sapiens
ugauaaaucucuccagcua

SEQ ID NO: 315601 - RNA, 19 nt, Homo sapiens
gcuaguggcucuucucaug

SEQ ID NO: 315602 - RNA, 19 nt, Homo sapiens
ggaggaagaugaauaugca

SEQ ID NO: 315603 - RNA, 19 nt, Homo sapiens
ggcccuaacuucuguaauu

SEQ ID NO: 315604 - RNA, 19 nt, Homo sapiens
gcgaaccuaugucuaaauu

SEQ ID NO: 315605 - RNA, 19 nt, Homo sapiens
gaacaugaguguaaaauag

SEQ ID NO: 315606 - RNA, 19 nt, Homo sapiens
cagaggaaaugauacguuu

SEQ ID NO: 315607 - RNA, 19 nt, Homo sapiens
aggagaagcuguaaagaaa

SEQ ID NO: 315608 - RNA, 19 nt, Homo sapiens
cagaugcacuugaugauga

SEQ ID NO: 315609 - RNA, 19 nt, Homo sapiens
ggaaggcauuguccuguga

SEQ ID NO: 315610 - RNA, 19 nt, Homo sapiens
ugaagaagaugaugaaguc

SEQ ID NO: 315611 - RNA, 19 nt, Homo sapiens
uuucagaccuguugguaua

SEQ ID NO: 315612 - RNA, 19 nt, Homo sapiens
caaguaacauuaacucagu

SEQ ID NO: 315613 - RNA, 19 nt, Homo sapiens
guuaguggcugccucauau

SEQ ID NO: 315614 - RNA, 19 nt, Homo sapiens
ggagucugcuucugccuuu

SEQ ID NO: 315615 - RNA, 19 nt, Homo sapiens
gaugaaaggcucuaucgaa

SEQ ID NO: 315616 - RNA, 19 nt, Homo sapiens
ggaaaugauacguuuguaa

SEQ ID NO: 315617 - RNA, 19 nt, Homo sapiens
gcagucagaggaaaugaua

SEQ ID NO: 315618 - RNA, 19 nt, Homo sapiens
gaaugucaaugccaggauu

SEQ ID NO: 315619 - RNA, 19 nt, Homo sapiens
guuacaagcuaagaguuua

SEQ ID NO: 315620 - RNA, 19 nt, Homo sapiens
gaaaugucacuacuaagaa

SEQ ID NO: 315621 - RNA, 19 nt, Homo sapiens
gguagaagaucuuguaaaa

SEQ ID NO: 315622 - RNA, 19 nt, Homo sapiens
ggaauggucacuaaaguau

SEQ ID NO: 315623 - RNA, 19 nt, Homo sapiens
gaaauauucuuaggcagau

SEQ ID NO: 315624 - RNA, 19 nt, Homo sapiens
agaaguaccuaauaguuug

SEQ ID NO: 315625 - RNA, 19 nt, Homo sapiens
gagcuuuguuucaauauca

SEQ ID NO: 315626 - RNA, 19 nt, Homo sapiens
ggaagaugaauaugcauaa

SEQ ID NO: 315627 - RNA, 19 nt, Homo sapiens
gagaagcuguaaagaaaca

SEQ ID NO: 315628 - RNA, 19 nt, Homo sapiens
gaacucuugguuuaacuua

SEQ ID NO: 315629 - RNA, 19 nt, Homo sapiens
uuaggaaugugaccuuuaa

SEQ ID NO: 315630 - RNA, 19 nt, Homo sapiens
gaaaagagguacuaaaugc

SEQ ID NO: 315631 - RNA, 19 nt, Homo sapiens
aaagaucccugagauuauu

SEQ ID NO: 315632 - RNA, 19 nt, Homo sapiens
acacagcgauuucuuaaag

SEQ ID NO: 315633 - RNA, 19 nt, Homo sapiens
ggcauuguccugugaaaua

SEQ ID NO: 315634 - RNA, 19 nt, Homo sapiens
ccagauaauccuaaaguaa

SEQ ID NO: 315635 - RNA, 19 nt, Homo sapiens
ccuggaagcucagugguua

SEQ ID NO: 315636 - RNA, 19 nt, Homo sapiens
gauggcaaccucaacauuu

SEQ ID NO: 315637 - RNA, 19 nt, Homo sapiens
ugaagaggccuaagucaaa

SEQ ID NO: 315638 - RNA, 19 nt, Homo sapiens
cuucauagguagaaacaaa

SEQ ID NO: 315639 - RNA, 19 nt, Homo sapiens
ggcccgacauuucuucaua

SEQ ID NO: 315640 - RNA, 19 nt, Homo sapiens
ugcgacagcuuuacuuuaa

SEQ ID NO: 315641 - RNA, 19 nt, Homo sapiens
cgaaaugucacuacuaaga

SEQ ID NO: 315642 - RNA, 19 nt, Homo sapiens
gcugaugaccuuaugagua

SEQ ID NO: 315643 - RNA, 19 nt, Homo sapiens
caagugaggaugaugauga

SEQ ID NO: 315644 - RNA, 19 nt, Homo sapiens
aaucagauguggaagaaga

SEQ ID NO: 315645 - RNA, 19 nt, Homo sapiens
aaacacagcgauuucuuaa

SEQ ID NO: 315646 - RNA, 19 nt, Homo sapiens
aaaggaagcacaaagauug

SEQ ID NO: 315647 - RNA, 19 nt, Homo sapiens
gcagugcuguccaugaugu

SEQ ID NO: 315648 - RNA, 19 nt, Homo sapiens
ugaaucagauguggaagaa

SEQ ID NO: 315649 - RNA, 19 nt, Homo sapiens
cugaugaccuuaugaguau

SEQ ID NO: 315650 - RNA, 19 nt, Homo sapiens
uaacuucauuccagaacaa

SEQ ID NO: 315651 - RNA, 19 nt, Homo sapiens
guaagagcuuuguuucaau

SEQ ID NO: 315652 - RNA, 19 nt, Homo sapiens
ugagguagaugaaucagau

SEQ ID NO: 315653 - RNA, 19 nt, Homo sapiens
gcccuaacuucuguaauuu

SEQ ID NO: 315654 - RNA, 19 nt, Homo sapiens
gugauacucaugaccauua

SEQ ID NO: 315655 - RNA, 19 nt, Homo sapiens
gagauuauuccuucuucua

SEQ ID NO: 315656 - RNA, 19 nt, Homo sapiens
aagauuguguucccauuaa

SEQ ID NO: 315657 - RNA, 19 nt, Homo sapiens
ccuaauaguuugaacagau

SEQ ID NO: 315658 - RNA, 19 nt, Homo sapiens
ucacagacauacaauagca

SEQ ID NO: 315659 - RNA, 19 nt, Homo sapiens
ugagaaacaugcaagauac

SEQ ID NO: 315660 - RNA, 19 nt, Homo sapiens
gaaagggguugauuuugaa

SEQ ID NO: 315661 - RNA, 19 nt, Homo sapiens
gaaaugauacguuuguaac

SEQ ID NO: 315662 - RNA, 19 nt, Homo sapiens
cccgaaaugucacuacuaa

SEQ ID NO: 315663 - RNA, 19 nt, Homo sapiens
uggagaagauugaagaaau

SEQ ID NO: 315664 - RNA, 19 nt, Homo sapiens
uaacccagauaauccuaaa

SEQ ID NO: 315665 - RNA, 19 nt, Homo sapiens
agucauaccuggaaugugu

SEQ ID NO: 315666 - RNA, 19 nt, Homo sapiens
caggauuucucauuaacaa

SEQ ID NO: 315667 - RNA, 19 nt, Homo sapiens
gaacagauggcuaaugacu

SEQ ID NO: 315668 - RNA, 19 nt, Homo sapiens
gaacaacuuuaaggguaga

SEQ ID NO: 315669 - RNA, 19 nt, Homo sapiens
ccacaucuuuauugaacuu

SEQ ID NO: 315670 - RNA, 19 nt, Homo sapiens
gcauuguccugugaaauau

SEQ ID NO: 315671 - RNA, 19 nt, Homo sapiens
ggacagagauuggcgagaa

SEQ ID NO: 315672 - RNA, 19 nt, Homo sapiens
gaugacaccucucaacaaa

SEQ ID NO: 315673 - RNA, 19 nt, Homo sapiens
uaaaguugcucaucaaguu

SEQ ID NO: 315674 - RNA, 19 nt, Homo sapiens
ggaagcaacugcagagaca

SEQ ID NO: 315675 - RNA, 19 nt, Homo sapiens
caacgagucugccgaagga

SEQ ID NO: 315676 - RNA, 19 nt, Homo sapiens
ccaaggagcuggacacagu

SEQ ID NO: 315677 - RNA, 19 nt, Homo sapiens
ggaauugguuguauagaag

SEQ ID NO: 315678 - RNA, 19 nt, Homo sapiens
gaucaagaccgcugucauu

SEQ ID NO: 315679 - RNA, 19 nt, Homo sapiens
caaagcaaauggagaaugg

SEQ ID NO: 315680 - RNA, 19 nt, Homo sapiens
gggcagaccucuucuacuc

SEQ ID NO: 315681 - RNA, 19 nt, Homo sapiens
ccacguacauuaacaugau

SEQ ID NO: 315682 - RNA, 19 nt, Homo sapiens
acauuuaccucuucgauga

SEQ ID NO: 315683 - RNA, 19 nt, Homo sapiens
cagcaggccuggauucaga

SEQ ID NO: 315684 - RNA, 19 nt, Homo sapiens
gagauggccucaugggaau

SEQ ID NO: 315685 - RNA, 19 nt, Homo sapiens
uggagaggcucaaggagua

SEQ ID NO: 315686 - RNA, 19 nt, Homo sapiens
gaccgaggcuacauucaga

SEQ ID NO: 315687 - RNA, 19 nt, Homo sapiens
gaccuugacuagaaauaga

SEQ ID NO: 315688 - RNA, 19 nt, Homo sapiens
agacgaagauccuuguguu

SEQ ID NO: 315689 - RNA, 19 nt, Homo sapiens
gaaggaagcaaagcaaaug

SEQ ID NO: 315690 - RNA, 19 nt, Homo sapiens
ggccgcagaucuuaaaguu

SEQ ID NO: 315691 - RNA, 19 nt, Homo sapiens
gcagaccucuucuacucuu

SEQ ID NO: 315692 - RNA, 19 nt, Homo sapiens
uuaaggagauggccucaug

SEQ ID NO: 315693 - RNA, 19 nt, Homo sapiens
aaggagaaauccaggagua

SEQ ID NO: 315694 - RNA, 19 nt, Homo sapiens
gaccuccgcuucaagauca

SEQ ID NO: 315695 - RNA, 19 nt, Homo sapiens
caucugaaauggaaaccaa

SEQ ID NO: 315696 - RNA, 19 nt, Homo sapiens
aaauagagacugagaguga

SEQ ID NO: 315697 - RNA, 19 nt, Homo sapiens
gacuagaaauagagacuga

SEQ ID NO: 315698 - RNA, 19 nt, Homo sapiens
gcaacugcaucguucuguu

SEQ ID NO: 315699 - RNA, 19 nt, Homo sapiens
ggaaagaagucggggcaua

SEQ ID NO: 315700 - RNA, 19 nt, Homo sapiens
aauuugaccuugacuagaa

SEQ ID NO: 315701 - RNA, 19 nt, Homo sapiens
ggguaaauauuaaggagau

SEQ ID NO: 315702 - RNA, 19 nt, Homo sapiens
caagcuagaccaugaaugu

SEQ ID NO: 315703 - RNA, 19 nt, Homo sapiens
guacucggaugaagaaguc

SEQ ID NO: 315704 - RNA, 19 nt, Homo sapiens
gagaggaccuggacuucgu

SEQ ID NO: 315705 - RNA, 19 nt, Homo sapiens
caacugcaucguucuguuu

SEQ ID NO: 315706 - RNA, 19 nt, Homo sapiens
ugaacgaaauucucaaugg

SEQ ID NO: 315707 - RNA, 19 nt, Homo sapiens
caacagcaccgcagaacug

SEQ ID NO: 315708 - RNA, 19 nt, Homo sapiens
ggaaggaagcaaagcaaau

SEQ ID NO: 315709 - RNA, 19 nt, Homo sapiens
gaucaaagugcuaaagcuu

SEQ ID NO: 315710 - RNA, 19 nt, Homo sapiens
ggacuuggccacguacauu

SEQ ID NO: 315711 - RNA, 19 nt, Homo sapiens
gcagagaggucuuuucuac

SEQ ID NO: 315712 - RNA, 19 nt, Homo sapiens
ggaucuuucucucccauga

SEQ ID NO: 315713 - RNA, 19 nt, Homo sapiens
ugaaggugcugaagaaguc

SEQ ID NO: 315714 - RNA, 19 nt, Homo sapiens
ggaauuugaccuugacuag

SEQ ID NO: 315715 - RNA, 19 nt, Homo sapiens
cgaagauccuuguguugga

SEQ ID NO: 315716 - RNA, 19 nt, Homo sapiens
gcaucaacaucgccaagau

SEQ ID NO: 315717 - RNA, 19 nt, Homo sapiens
cgaugaagaccaagacgua

SEQ ID NO: 315718 - RNA, 19 nt, Homo sapiens
uggaggaauugguuguaua

SEQ ID NO: 315719 - RNA, 19 nt, Homo sapiens
gaacugcagggccuauaug

SEQ ID NO: 315720 - RNA, 19 nt, Homo sapiens
ggaaaacacaucuuugaaa

SEQ ID NO: 315721 - RNA, 19 nt, Homo sapiens
caaaguaaagaacacgaaa

SEQ ID NO: 315722 - RNA, 19 nt, Homo sapiens
agaaccagaaggccuauua

SEQ ID NO: 315723 - RNA, 19 nt, Homo sapiens
ggacucaggagcacacgaa

SEQ ID NO: 315724 - RNA, 19 nt, Homo sapiens
ccugggagcuggcauucaa

SEQ ID NO: 315725 - RNA, 19 nt, Homo sapiens
gcugguagcccuagugugu

SEQ ID NO: 315726 - RNA, 19 nt, Homo sapiens
guauagaagauccuaguga

SEQ ID NO: 315727 - RNA, 19 nt, Homo sapiens
aggaauugguuguauagaa

SEQ ID NO: 315728 - RNA, 19 nt, Homo sapiens
acacaagggugaucgucuu

SEQ ID NO: 315729 - RNA, 19 nt, Homo sapiens
ggaaacggacgaccucauc

SEQ ID NO: 315730 - RNA, 19 nt, Homo sapiens
uggcugagauggacaaagu

SEQ ID NO: 315731 - RNA, 19 nt, Homo sapiens
gaagucugccuaccuguca

SEQ ID NO: 315732 - RNA, 19 nt, Homo sapiens
cgaaagagaguuccaaggu

SEQ ID NO: 315733 - RNA, 19 nt, Homo sapiens
cugacaagcuagaccauga

SEQ ID NO: 315734 - RNA, 19 nt, Homo sapiens
cauugcaggucaccacgua

SEQ ID NO: 315735 - RNA, 19 nt, Homo sapiens
gaugugggguaaauauuaa

SEQ ID NO: 315736 - RNA, 19 nt, Homo sapiens
gcaagucuuugagaugcuu

SEQ ID NO: 315737 - RNA, 19 nt, Homo sapiens
gaccuggacuucguucuca

SEQ ID NO: 315738 - RNA, 19 nt, Homo sapiens
ucuguuugcugcccuguuu

SEQ ID NO: 315739 - RNA, 19 nt, Homo sapiens
caugggaauuugaccuuga

SEQ ID NO: 315740 - RNA, 19 nt, Homo sapiens
ggaggaauugguuguauag

SEQ ID NO: 315741 - RNA, 19 nt, Homo sapiens
gaaauucucaaugggauca

SEQ ID NO: 315742 - RNA, 19 nt, Homo sapiens
caaagacaaucggaucaag

SEQ ID NO: 315743 - RNA, 19 nt, Homo sapiens
gcaaagacaaucggaucaa

SEQ ID NO: 315744 - RNA, 19 nt, Homo sapiens
ggaagacgaagauccuugu

SEQ ID NO: 315745 - RNA, 19 nt, Homo sapiens
aaggagagaucaucaucga

SEQ ID NO: 315746 - RNA, 19 nt, Homo sapiens
uggaaugucacguggaaua

SEQ ID NO: 315747 - RNA, 19 nt, Homo sapiens
gagcugaaggugcugaaga

SEQ ID NO: 315748 - RNA, 19 nt, Homo sapiens
ggaaggcccuggugaucac

SEQ ID NO: 315749 - RNA, 19 nt, Homo sapiens
cucaugagcuucuucuuca

SEQ ID NO: 315750 - RNA, 19 nt, Homo sapiens
ggaccuguuucgugacauc

SEQ ID NO: 315751 - RNA, 19 nt, Homo sapiens
caucaccucuaacauccuu

SEQ ID NO: 315752 - RNA, 19 nt, Homo sapiens
gcgagugucucccucaaac

SEQ ID NO: 315753 - RNA, 19 nt, Homo sapiens
ccuaaucccugcccagagu

SEQ ID NO: 315754 - RNA, 19 nt, Homo sapiens
ccacgcugcuugcuaccuu

SEQ ID NO: 315755 - RNA, 19 nt, Homo sapiens
gagaugcgaaccacccaaa

SEQ ID NO: 315756 - RNA, 19 nt, Homo sapiens
gaguggaauuccggaacua

SEQ ID NO: 315757 - RNA, 19 nt, Homo sapiens
caaggaguauucagagacu

SEQ ID NO: 315758 - RNA, 19 nt, Homo sapiens
cacaagggaucgccguguu

SEQ ID NO: 315759 - RNA, 19 nt, Homo sapiens
gcgcuggcuuccaacuauu

SEQ ID NO: 315760 - RNA, 19 nt, Homo sapiens
guacugggacuacaugaag

SEQ ID NO: 315761 - RNA, 19 nt, Homo sapiens
gcaaagcaaauggagaaug

SEQ ID NO: 315762 - RNA, 19 nt, Homo sapiens
aagcaaagcaaauggagaa

SEQ ID NO: 315763 - RNA, 19 nt, Homo sapiens
gcagguggacgucaucauc

SEQ ID NO: 315764 - RNA, 19 nt, Homo sapiens
gacuuggccacguacauua

SEQ ID NO: 315765 - RNA, 19 nt, Homo sapiens
ucauggacuuggccacgua

SEQ ID NO: 315766 - RNA, 19 nt, Homo sapiens
gaaggaaugcgccaagacu

SEQ ID NO: 315767 - RNA, 19 nt, Homo sapiens
ggacacgucggaacaaguc

SEQ ID NO: 315768 - RNA, 19 nt, Homo sapiens
gaauuugaccuugacuaga

SEQ ID NO: 315769 - RNA, 19 nt, Homo sapiens
ccaguacucggaugaagaa

SEQ ID NO: 315770 - RNA, 19 nt, Homo sapiens
ggucaagcuuuccguguac

SEQ ID NO: 315771 - RNA, 19 nt, Homo sapiens
gaugacaccucucaacaaa

SEQ ID NO: 315772 - RNA, 19 nt, Homo sapiens
uaaaguugcucaucaaguu

SEQ ID NO: 315773 - RNA, 19 nt, Homo sapiens
ggaagcaacugcagagaca

SEQ ID NO: 315774 - RNA, 19 nt, Homo sapiens
caacgagucugccgaagga

SEQ ID NO: 315775 - RNA, 19 nt, Homo sapiens
ccaaggagcuggacacagu

SEQ ID NO: 315776 - RNA, 19 nt, Homo sapiens
ggaauugguuguauagaag

SEQ ID NO: 315777 - RNA, 19 nt, Homo sapiens
gaucaagaccgcugucauu

SEQ ID NO: 315778 - RNA, 19 nt, Homo sapiens
caaagcaaauggagaaugg

SEQ ID NO: 315779 - RNA, 19 nt, Homo sapiens
gggcagaccucuucuacuc

SEQ ID NO: 315780 - RNA, 19 nt, Homo sapiens
ccacguacauuaacaugau

SEQ ID NO: 315781 - RNA, 19 nt, Homo sapiens
acauuuaccucuucgauga

SEQ ID NO: 315782 - RNA, 19 nt, Homo sapiens
gagauggccucaugggaau

SEQ ID NO: 315783 - RNA, 19 nt, Homo sapiens
uggagaggcucaaggagua

SEQ ID NO: 315784 - RNA, 19 nt, Homo sapiens
gaccgaggcuacauucaga

SEQ ID NO: 315785 - RNA, 19 nt, Homo sapiens
gaccuugacuagaaauaga

SEQ ID NO: 315786 - RNA, 19 nt, Homo sapiens
agacgaagauccuuguguu

SEQ ID NO: 315787 - RNA, 19 nt, Homo sapiens
gaaggaagcaaagcaaaug

SEQ ID NO: 315788 - RNA, 19 nt, Homo sapiens
ggccgcagaucuuaaaguu

SEQ ID NO: 315789 - RNA, 19 nt, Homo sapiens
gcagaccucuucuacucuu

SEQ ID NO: 315790 - RNA, 19 nt, Homo sapiens
uuaaggagauggccucaug

SEQ ID NO: 315791 - RNA, 19 nt, Homo sapiens
aaggagaaauccaggagua

SEQ ID NO: 315792 - RNA, 19 nt, Homo sapiens
gaccuccgcuucaagauca

SEQ ID NO: 315793 - RNA, 19 nt, Homo sapiens
caucugaaauggaaaccaa

SEQ ID NO: 315794 - RNA, 19 nt, Homo sapiens
aaauagagacugagaguga

SEQ ID NO: 315795 - RNA, 19 nt, Homo sapiens
gacuagaaauagagacuga

SEQ ID NO: 315796 - RNA, 19 nt, Homo sapiens
gcaacugcaucguucuguu

SEQ ID NO: 315797 - RNA, 19 nt, Homo sapiens
ggaaagaagucggggcaua

SEQ ID NO: 315798 - RNA, 19 nt, Homo sapiens
aauuugaccuugacuagaa

SEQ ID NO: 315799 - RNA, 19 nt, Homo sapiens
ggguaaauauuaaggagau

SEQ ID NO: 315800 - RNA, 19 nt, Homo sapiens
caagcuagaccaugaaugu

SEQ ID NO: 315801 - RNA, 19 nt, Homo sapiens
guacucggaugaagaaguc

SEQ ID NO: 315802 - RNA, 19 nt, Homo sapiens
gagaggaccuggacuucgu

SEQ ID NO: 315803 - RNA, 19 nt, Homo sapiens
caacugcaucguucuguuu

SEQ ID NO: 315804 - RNA, 19 nt, Homo sapiens
ugaacgaaauucucaaugg

SEQ ID NO: 315805 - RNA, 19 nt, Homo sapiens
caacagcaccgcagaacug

SEQ ID NO: 315806 - RNA, 19 nt, Homo sapiens
ggaaggaagcaaagcaaau

SEQ ID NO: 315807 - RNA, 19 nt, Homo sapiens
gaucaaagugcuaaagcuu

SEQ ID NO: 315808 - RNA, 19 nt, Homo sapiens
ggacuuggccacguacauu

SEQ ID NO: 315809 - RNA, 19 nt, Homo sapiens
gcagagaggucuuuucuac

SEQ ID NO: 315810 - RNA, 19 nt, Homo sapiens
ggaucuuucucucccauga

SEQ ID NO: 315811 - RNA, 19 nt, Homo sapiens
ugaaggugcugaagaaguc

SEQ ID NO: 315812 - RNA, 19 nt, Homo sapiens
ggaauuugaccuugacuag

SEQ ID NO: 315813 - RNA, 19 nt, Homo sapiens
cgaagauccuuguguugga

SEQ ID NO: 315814 - RNA, 19 nt, Homo sapiens
gcaucaacaucgccaagau

SEQ ID NO: 315815 - RNA, 19 nt, Homo sapiens
cgaugaagaccaagacgua

SEQ ID NO: 315816 - RNA, 19 nt, Homo sapiens
uggaggaauugguuguaua

SEQ ID NO: 315817 - RNA, 19 nt, Homo sapiens
gaacugcagggccuauaug

SEQ ID NO: 315818 - RNA, 19 nt, Homo sapiens
ggaaaacacaucuuugaaa

SEQ ID NO: 315819 - RNA, 19 nt, Homo sapiens
caaaguaaagaacacgaaa

SEQ ID NO: 315820 - RNA, 19 nt, Homo sapiens
agaaccagaaggccuauua

SEQ ID NO: 315821 - RNA, 19 nt, Homo sapiens
ggacucaggagcacacgaa

SEQ ID NO: 315822 - RNA, 19 nt, Homo sapiens
ccugggagcuggcauucaa

SEQ ID NO: 315823 - RNA, 19 nt, Homo sapiens
gcugguagcccuagugugu

SEQ ID NO: 315824 - RNA, 19 nt, Homo sapiens
guauagaagauccuaguga

SEQ ID NO: 315825 - RNA, 19 nt, Homo sapiens
aggaauugguuguauagaa

SEQ ID NO: 315826 - RNA, 19 nt, Homo sapiens
acacaagggugaucgucuu

SEQ ID NO: 315827 - RNA, 19 nt, Homo sapiens
ggaaacggacgaccucauc

SEQ ID NO: 315828 - RNA, 19 nt, Homo sapiens
uggcugagauggacaaagu

SEQ ID NO: 315829 - RNA, 19 nt, Homo sapiens
gaagucugccuaccuguca

SEQ ID NO: 315830 - RNA, 19 nt, Homo sapiens
cgaaagagaguuccaaggu

SEQ ID NO: 315831 - RNA, 19 nt, Homo sapiens
cugacaagcuagaccauga

SEQ ID NO: 315832 - RNA, 19 nt, Homo sapiens
cauugcaggucaccacgua

SEQ ID NO: 315833 - RNA, 19 nt, Homo sapiens
gaugugggguaaauauuaa

SEQ ID NO: 315834 - RNA, 19 nt, Homo sapiens
gcaagucuuugagaugcuu

SEQ ID NO: 315835 - RNA, 19 nt, Homo sapiens
gaccuggacuucguucuca

SEQ ID NO: 315836 - RNA, 19 nt, Homo sapiens
ucuguuugcugcccuguuu

SEQ ID NO: 315837 - RNA, 19 nt, Homo sapiens
caugggaauuugaccuuga

SEQ ID NO: 315838 - RNA, 19 nt, Homo sapiens
ggaggaauugguuguauag

SEQ ID NO: 315839 - RNA, 19 nt, Homo sapiens
gaaauucucaaugggauca

SEQ ID NO: 315840 - RNA, 19 nt, Homo sapiens
caaagacaaucggaucaag

SEQ ID NO: 315841 - RNA, 19 nt, Homo sapiens
gcaaagacaaucggaucaa

SEQ ID NO: 315842 - RNA, 19 nt, Homo sapiens
ggaagacgaagauccuugu

SEQ ID NO: 315843 - RNA, 19 nt, Homo sapiens
aaggagagaucaucaucga

SEQ ID NO: 315844 - RNA, 19 nt, Homo sapiens
gagcugaaggugcugaaga

SEQ ID NO: 315845 - RNA, 19 nt, Homo sapiens
ggaaggcccuggugaucac

SEQ ID NO: 315846 - RNA, 19 nt, Homo sapiens
cucaugagcuucuucuuca

SEQ ID NO: 315847 - RNA, 19 nt, Homo sapiens
ggaccuguuucgugacauc

SEQ ID NO: 315848 - RNA, 19 nt, Homo sapiens
uggaaugucacguggaaua

SEQ ID NO: 315849 - RNA, 19 nt, Homo sapiens
caucaccucuaacauccuu

SEQ ID NO: 315850 - RNA, 19 nt, Homo sapiens
gcgagugucucccucaaac

SEQ ID NO: 315851 - RNA, 19 nt, Homo sapiens
ccuaaucccugcccagagu

SEQ ID NO: 315852 - RNA, 19 nt, Homo sapiens
ccacgcugcuugcuaccuu

SEQ ID NO: 315853 - RNA, 19 nt, Homo sapiens
gagaugcgaaccacccaaa

SEQ ID NO: 315854 - RNA, 19 nt, Homo sapiens
gaguggaauuccggaacua

SEQ ID NO: 315855 - RNA, 19 nt, Homo sapiens
caaggaguauucagagacu

SEQ ID NO: 315856 - RNA, 19 nt, Homo sapiens
cacaagggaucgccguguu

SEQ ID NO: 315857 - RNA, 19 nt, Homo sapiens
gcgcuggcuuccaacuauu

SEQ ID NO: 315858 - RNA, 19 nt, Homo sapiens
guacugggacuacaugaag

SEQ ID NO: 315859 - RNA, 19 nt, Homo sapiens
gcaaagcaaauggagaaug

SEQ ID NO: 315860 - RNA, 19 nt, Homo sapiens
aagcaaagcaaauggagaa

SEQ ID NO: 315861 - RNA, 19 nt, Homo sapiens
gcagguggacgucaucauc

SEQ ID NO: 315862 - RNA, 19 nt, Homo sapiens
gacuuggccacguacauua

SEQ ID NO: 315863 - RNA, 19 nt, Homo sapiens
ucauggacuuggccacgua

SEQ ID NO: 315864 - RNA, 19 nt, Homo sapiens
gaaggaaugcgccaagacu

SEQ ID NO: 315865 - RNA, 19 nt, Homo sapiens
ggacacgucggaacaaguc

SEQ ID NO: 315866 - RNA, 19 nt, Homo sapiens
gaauuugaccuugacuaga

SEQ ID NO: 315867 - RNA, 19 nt, Homo sapiens
ccaguacucggaugaagaa

SEQ ID NO: 315868 - RNA, 19 nt, Homo sapiens
ggucaagcuuuccguguac

SEQ ID NO: 315869 - RNA, 19 nt, Homo sapiens
ccaaggggaugcugaagaa

SEQ ID NO: 315870 - RNA, 19 nt, Homo sapiens
cagggaucaugcucacuuu

SEQ ID NO: 315871 - RNA, 19 nt, Homo sapiens
ggacagagauuggcgagaa

SEQ ID NO: 315872 - RNA, 19 nt, Homo sapiens
gaugacaccucucaacaaa

SEQ ID NO: 315873 - RNA, 19 nt, Homo sapiens
uaaaguugcucaucaaguu

SEQ ID NO: 315874 - RNA, 19 nt, Homo sapiens
ggaagcaacugcagagaca

SEQ ID NO: 315875 - RNA, 19 nt, Homo sapiens
caacgagucugccgaagga

SEQ ID NO: 315876 - RNA, 19 nt, Homo sapiens
ccaaggagcuggacacagu

SEQ ID NO: 315877 - RNA, 19 nt, Homo sapiens
ggaauugguuguauagaag

SEQ ID NO: 315878 - RNA, 19 nt, Homo sapiens
gaucaagaccgcugucauu

SEQ ID NO: 315879 - RNA, 19 nt, Homo sapiens
caaagcaaauggagaaugg

SEQ ID NO: 315880 - RNA, 19 nt, Homo sapiens
gggcagaccucuucuacuc

SEQ ID NO: 315881 - RNA, 19 nt, Homo sapiens
ccacguacauuaacaugau

SEQ ID NO: 315882 - RNA, 19 nt, Homo sapiens
cagcaggccuggauucaga

SEQ ID NO: 315883 - RNA, 19 nt, Homo sapiens
gagauggccucaugggaau

SEQ ID NO: 315884 - RNA, 19 nt, Homo sapiens
uggagaggcucaaggagua

SEQ ID NO: 315885 - RNA, 19 nt, Homo sapiens
gaccgaggcuacauucaga

SEQ ID NO: 315886 - RNA, 19 nt, Homo sapiens
gaccuugacuagaaauaga

SEQ ID NO: 315887 - RNA, 19 nt, Homo sapiens
agacgaagauccuuguguu

SEQ ID NO: 315888 - RNA, 19 nt, Homo sapiens
gaaggaagcaaagcaaaug

SEQ ID NO: 315889 - RNA, 19 nt, Homo sapiens
ggccgcagaucuuaaaguu

SEQ ID NO: 315890 - RNA, 19 nt, Homo sapiens
gcagaccucuucuacucuu

SEQ ID NO: 315891 - RNA, 19 nt, Homo sapiens
uuaaggagauggccucaug

SEQ ID NO: 315892 - RNA, 19 nt, Homo sapiens
aaggagaaauccaggagua

SEQ ID NO: 315893 - RNA, 19 nt, Homo sapiens
gaccuccgcuucaagauca

SEQ ID NO: 315894 - RNA, 19 nt, Homo sapiens
caucugaaauggaaaccaa

SEQ ID NO: 315895 - RNA, 19 nt, Homo sapiens
aaauagagacugagaguga

SEQ ID NO: 315896 - RNA, 19 nt, Homo sapiens
gacuagaaauagagacuga

SEQ ID NO: 315897 - RNA, 19 nt, Homo sapiens
gcaacugcaucguucuguu

SEQ ID NO: 315898 - RNA, 19 nt, Homo sapiens
ggaaagaagucggggcaua

SEQ ID NO: 315899 - RNA, 19 nt, Homo sapiens
aauuugaccuugacuagaa

SEQ ID NO: 315900 - RNA, 19 nt, Homo sapiens
ggguaaauauuaaggagau

SEQ ID NO: 315901 - RNA, 19 nt, Homo sapiens
caagcuagaccaugaaugu

SEQ ID NO: 315902 - RNA, 19 nt, Homo sapiens
guacucggaugaagaaguc

SEQ ID NO: 315903 - RNA, 19 nt, Homo sapiens
gagaggaccuggacuucgu

SEQ ID NO: 315904 - RNA, 19 nt, Homo sapiens
caacugcaucguucuguuu

SEQ ID NO: 315905 - RNA, 19 nt, Homo sapiens
ugaacgaaauucucaaugg

SEQ ID NO: 315906 - RNA, 19 nt, Homo sapiens
caacagcaccgcagaacug

SEQ ID NO: 315907 - RNA, 19 nt, Homo sapiens
ggaaggaagcaaagcaaau

SEQ ID NO: 315908 - RNA, 19 nt, Homo sapiens
gaucaaagugcuaaagcuu

SEQ ID NO: 315909 - RNA, 19 nt, Homo sapiens
ggacuuggccacguacauu

SEQ ID NO: 315910 - RNA, 19 nt, Homo sapiens
gcagagaggucuuuucuac

SEQ ID NO: 315911 - RNA, 19 nt, Homo sapiens
ggaucuuucucucccauga

SEQ ID NO: 315912 - RNA, 19 nt, Homo sapiens
ugaaggugcugaagaaguc

SEQ ID NO: 315913 - RNA, 19 nt, Homo sapiens
ggaauuugaccuugacuag

SEQ ID NO: 315914 - RNA, 19 nt, Homo sapiens
cgaagauccuuguguugga

SEQ ID NO: 315915 - RNA, 19 nt, Homo sapiens
gcaucaacaucgccaagau

SEQ ID NO: 315916 - RNA, 19 nt, Homo sapiens
cgaugaagaccaagacgua

SEQ ID NO: 315917 - RNA, 19 nt, Homo sapiens
uggaggaauugguuguaua

SEQ ID NO: 315918 - RNA, 19 nt, Homo sapiens
gaacugcagggccuauaug

SEQ ID NO: 315919 - RNA, 19 nt, Homo sapiens
caaaguaaagaacacgaaa

SEQ ID NO: 315920 - RNA, 19 nt, Homo sapiens
agaaccagaaggccuauua

SEQ ID NO: 315921 - RNA, 19 nt, Homo sapiens
ggacucaggagcacacgaa

SEQ ID NO: 315922 - RNA, 19 nt, Homo sapiens
ccugggagcuggcauucaa

SEQ ID NO: 315923 - RNA, 19 nt, Homo sapiens
gcugguagcccuagugugu

SEQ ID NO: 315924 - RNA, 19 nt, Homo sapiens
guauagaagauccuaguga

SEQ ID NO: 315925 - RNA, 19 nt, Homo sapiens
aggaauugguuguauagaa

SEQ ID NO: 315926 - RNA, 19 nt, Homo sapiens
acacaagggugaucgucuu

SEQ ID NO: 315927 - RNA, 19 nt, Homo sapiens
ggaaacggacgaccucauc

SEQ ID NO: 315928 - RNA, 19 nt, Homo sapiens
uggcugagauggacaaagu

SEQ ID NO: 315929 - RNA, 19 nt, Homo sapiens
gaagucugccuaccuguca

SEQ ID NO: 315930 - RNA, 19 nt, Homo sapiens
cgaaagagaguuccaaggu

SEQ ID NO: 315931 - RNA, 19 nt, Homo sapiens
cugacaagcuagaccauga

SEQ ID NO: 315932 - RNA, 19 nt, Homo sapiens
cauugcaggucaccacgua

SEQ ID NO: 315933 - RNA, 19 nt, Homo sapiens
gaugugggguaaauauuaa

SEQ ID NO: 315934 - RNA, 19 nt, Homo sapiens
gcaagucuuugagaugcuu

SEQ ID NO: 315935 - RNA, 19 nt, Homo sapiens
gaccuggacuucguucuca

SEQ ID NO: 315936 - RNA, 19 nt, Homo sapiens
ucuguuugcugcccuguuu

SEQ ID NO: 315937 - RNA, 19 nt, Homo sapiens
caugggaauuugaccuuga

SEQ ID NO: 315938 - RNA, 19 nt, Homo sapiens
ggaggaauugguuguauag

SEQ ID NO: 315939 - RNA, 19 nt, Homo sapiens
gaaauucucaaugggauca

SEQ ID NO: 315940 - RNA, 19 nt, Homo sapiens
caaagacaaucggaucaag

SEQ ID NO: 315941 - RNA, 19 nt, Homo sapiens
gcaaagacaaucggaucaa

SEQ ID NO: 315942 - RNA, 19 nt, Homo sapiens
ggaagacgaagauccuugu

SEQ ID NO: 315943 - RNA, 19 nt, Homo sapiens
aaggagagaucaucaucga

SEQ ID NO: 315944 - RNA, 19 nt, Homo sapiens
uggaaugucacguggaaua

SEQ ID NO: 315945 - RNA, 19 nt, Homo sapiens
gagcugaaggugcugaaga

SEQ ID NO: 315946 - RNA, 19 nt, Homo sapiens
ggaaggcccuggugaucac

SEQ ID NO: 315947 - RNA, 19 nt, Homo sapiens
cucaugagcuucuucuuca

SEQ ID NO: 315948 - RNA, 19 nt, Homo sapiens
ggaccuguuucgugacauc

SEQ ID NO: 315949 - RNA, 19 nt, Homo sapiens
caucaccucuaacauccuu

SEQ ID NO: 315950 - RNA, 19 nt, Homo sapiens
gcgagugucucccucaaac

SEQ ID NO: 315951 - RNA, 19 nt, Homo sapiens
ccuaaucccugcccagagu

SEQ ID NO: 315952 - RNA, 19 nt, Homo sapiens
ccacgcugcuugcuaccuu

SEQ ID NO: 315953 - RNA, 19 nt, Homo sapiens
gagaugcgaaccacccaaa

SEQ ID NO: 315954 - RNA, 19 nt, Homo sapiens
gaguggaauuccggaacua

SEQ ID NO: 315955 - RNA, 19 nt, Homo sapiens
caaggaguauucagagacu

SEQ ID NO: 315956 - RNA, 19 nt, Homo sapiens
cacaagggaucgccguguu

SEQ ID NO: 315957 - RNA, 19 nt, Homo sapiens
gcgcuggcuuccaacuauu

SEQ ID NO: 315958 - RNA, 19 nt, Homo sapiens
guacugggacuacaugaag

SEQ ID NO: 315959 - RNA, 19 nt, Homo sapiens
gcaaagcaaauggagaaug

SEQ ID NO: 315960 - RNA, 19 nt, Homo sapiens
aagcaaagcaaauggagaa

SEQ ID NO: 315961 - RNA, 19 nt, Homo sapiens
gcagguggacgucaucauc

SEQ ID NO: 315962 - RNA, 19 nt, Homo sapiens
gacuuggccacguacauua

SEQ ID NO: 315963 - RNA, 19 nt, Homo sapiens
ucauggacuuggccacgua

SEQ ID NO: 315964 - RNA, 19 nt, Homo sapiens
gaaggaaugcgccaagacu

SEQ ID NO: 315965 - RNA, 19 nt, Homo sapiens
ggacacgucggaacaaguc

SEQ ID NO: 315966 - RNA, 19 nt, Homo sapiens
gaauuugaccuugacuaga

SEQ ID NO: 315967 - RNA, 19 nt, Homo sapiens
ccaguacucggaugaagaa

SEQ ID NO: 315968 - RNA, 19 nt, Homo sapiens
ggucaagcuuuccguguac

SEQ ID NO: 315969 - RNA, 19 nt, Homo sapiens
cagggaucaugcucacuuu

SEQ ID NO: 315970 - RNA, 19 nt, Homo sapiens
guugguugcuuacaguguu

SEQ ID NO: 315971 - RNA, 19 nt, Homo sapiens
gaugacaccucucaacaaa

SEQ ID NO: 315972 - RNA, 19 nt, Homo sapiens
uaaaguugcucaucaaguu

SEQ ID NO: 315973 - RNA, 19 nt, Homo sapiens
ggaagcaacugcagagaca

SEQ ID NO: 315974 - RNA, 19 nt, Homo sapiens
caacgagucugccgaagga

SEQ ID NO: 315975 - RNA, 19 nt, Homo sapiens
ccaaggagcuggacacagu

SEQ ID NO: 315976 - RNA, 19 nt, Homo sapiens
ggaauugguuguauagaag

SEQ ID NO: 315977 - RNA, 19 nt, Homo sapiens
gaucaagaccgcugucauu

SEQ ID NO: 315978 - RNA, 19 nt, Homo sapiens
caaagcaaauggagaaugg

SEQ ID NO: 315979 - RNA, 19 nt, Homo sapiens
gggcagaccucuucuacuc

SEQ ID NO: 315980 - RNA, 19 nt, Homo sapiens
ccacguacauuaacaugau

SEQ ID NO: 315981 - RNA, 19 nt, Homo sapiens
gagauggccucaugggaau

SEQ ID NO: 315982 - RNA, 19 nt, Homo sapiens
uggagaggcucaaggagua

SEQ ID NO: 315983 - RNA, 19 nt, Homo sapiens
gaccgaggcuacauucaga

SEQ ID NO: 315984 - RNA, 19 nt, Homo sapiens
gaccuugacuagaaauaga

SEQ ID NO: 315985 - RNA, 19 nt, Homo sapiens
agacgaagauccuuguguu

SEQ ID NO: 315986 - RNA, 19 nt, Homo sapiens
gaaggaagcaaagcaaaug

SEQ ID NO: 315987 - RNA, 19 nt, Homo sapiens
ggccgcagaucuuaaaguu

SEQ ID NO: 315988 - RNA, 19 nt, Homo sapiens
gcagaccucuucuacucuu

SEQ ID NO: 315989 - RNA, 19 nt, Homo sapiens
uuaaggagauggccucaug

SEQ ID NO: 315990 - RNA, 19 nt, Homo sapiens
aaggagaaauccaggagua

SEQ ID NO: 315991 - RNA, 19 nt, Homo sapiens
gaccuccgcuucaagauca

SEQ ID NO: 315992 - RNA, 19 nt, Homo sapiens
caucugaaauggaaaccaa

SEQ ID NO: 315993 - RNA, 19 nt, Homo sapiens
aaauagagacugagaguga

SEQ ID NO: 315994 - RNA, 19 nt, Homo sapiens
gacuagaaauagagacuga

SEQ ID NO: 315995 - RNA, 19 nt, Homo sapiens
gcaacugcaucguucuguu

SEQ ID NO: 315996 - RNA, 19 nt, Homo sapiens
ggaaagaagucggggcaua

SEQ ID NO: 315997 - RNA, 19 nt, Homo sapiens
aauuugaccuugacuagaa

SEQ ID NO: 315998 - RNA, 19 nt, Homo sapiens
ggguaaauauuaaggagau

SEQ ID NO: 315999 - RNA, 19 nt, Homo sapiens
caagcuagaccaugaaugu

SEQ ID NO: 316000 - RNA, 19 nt, Homo sapiens
guacucggaugaagaaguc

SEQ ID NO: 316001 - RNA, 19 nt, Homo sapiens
gagaggaccuggacuucgu

SEQ ID NO: 316002 - RNA, 19 nt, Homo sapiens
caacugcaucguucuguuu

SEQ ID NO: 316003 - RNA, 19 nt, Homo sapiens
ugaacgaaauucucaaugg

SEQ ID NO: 316004 - RNA, 19 nt, Homo sapiens
caacagcaccgcagaacug

SEQ ID NO: 316005 - RNA, 19 nt, Homo sapiens
ggaaggaagcaaagcaaau

SEQ ID NO: 316006 - RNA, 19 nt, Homo sapiens
gaucaaagugcuaaagcuu

SEQ ID NO: 316007 - RNA, 19 nt, Homo sapiens
ggacuuggccacguacauu

SEQ ID NO: 316008 - RNA, 19 nt, Homo sapiens
gcagagaggucuuuucuac

SEQ ID NO: 316009 - RNA, 19 nt, Homo sapiens
ggaucuuucucucccauga

SEQ ID NO: 316010 - RNA, 19 nt, Homo sapiens
ugaaggugcugaagaaguc

SEQ ID NO: 316011 - RNA, 19 nt, Homo sapiens
ggaauuugaccuugacuag

SEQ ID NO: 316012 - RNA, 19 nt, Homo sapiens
cgaagauccuuguguugga

SEQ ID NO: 316013 - RNA, 19 nt, Homo sapiens
gcaucaacaucgccaagau

SEQ ID NO: 316014 - RNA, 19 nt, Homo sapiens
cgaugaagaccaagacgua

SEQ ID NO: 316015 - RNA, 19 nt, Homo sapiens
uggaggaauugguuguaua

SEQ ID NO: 316016 - RNA, 19 nt, Homo sapiens
gaacugcagggccuauaug

SEQ ID NO: 316017 - RNA, 19 nt, Homo sapiens
caaaguaaagaacacgaaa

SEQ ID NO: 316018 - RNA, 19 nt, Homo sapiens
agaaccagaaggccuauua

SEQ ID NO: 316019 - RNA, 19 nt, Homo sapiens
ggacucaggagcacacgaa

SEQ ID NO: 316020 - RNA, 19 nt, Homo sapiens
ccugggagcuggcauucaa

SEQ ID NO: 316021 - RNA, 19 nt, Homo sapiens
gcugguagcccuagugugu

SEQ ID NO: 316022 - RNA, 19 nt, Homo sapiens
guauagaagauccuaguga

SEQ ID NO: 316023 - RNA, 19 nt, Homo sapiens
aggaauugguuguauagaa

SEQ ID NO: 316024 - RNA, 19 nt, Homo sapiens
acacaagggugaucgucuu

SEQ ID NO: 316025 - RNA, 19 nt, Homo sapiens
ggaaacggacgaccucauc

SEQ ID NO: 316026 - RNA, 19 nt, Homo sapiens
uggcugagauggacaaagu

SEQ ID NO: 316027 - RNA, 19 nt, Homo sapiens
gaagucugccuaccuguca

SEQ ID NO: 316028 - RNA, 19 nt, Homo sapiens
cgaaagagaguuccaaggu

SEQ ID NO: 316029 - RNA, 19 nt, Homo sapiens
cugacaagcuagaccauga

SEQ ID NO: 316030 - RNA, 19 nt, Homo sapiens
cauugcaggucaccacgua

SEQ ID NO: 316031 - RNA, 19 nt, Homo sapiens
gaugugggguaaauauuaa

SEQ ID NO: 316032 - RNA, 19 nt, Homo sapiens
gcaagucuuugagaugcuu

SEQ ID NO: 316033 - RNA, 19 nt, Homo sapiens
gaccuggacuucguucuca

SEQ ID NO: 316034 - RNA, 19 nt, Homo sapiens
ucuguuugcugcccuguuu

SEQ ID NO: 316035 - RNA, 19 nt, Homo sapiens
caugggaauuugaccuuga

SEQ ID NO: 316036 - RNA, 19 nt, Homo sapiens
ggaggaauugguuguauag

SEQ ID NO: 316037 - RNA, 19 nt, Homo sapiens
gaaauucucaaugggauca

SEQ ID NO: 316038 - RNA, 19 nt, Homo sapiens
caaagacaaucggaucaag

SEQ ID NO: 316039 - RNA, 19 nt, Homo sapiens
gcaaagacaaucggaucaa

SEQ ID NO: 316040 - RNA, 19 nt, Homo sapiens
ggaagacgaagauccuugu

SEQ ID NO: 316041 - RNA, 19 nt, Homo sapiens
aaggagagaucaucaucga

SEQ ID NO: 316042 - RNA, 19 nt, Homo sapiens
gagcugaaggugcugaaga

SEQ ID NO: 316043 - RNA, 19 nt, Homo sapiens
ggaaggcccuggugaucac

SEQ ID NO: 316044 - RNA, 19 nt, Homo sapiens
cucaugagcuucuucuuca

SEQ ID NO: 316045 - RNA, 19 nt, Homo sapiens
ggaccuguuucgugacauc

SEQ ID NO: 316046 - RNA, 19 nt, Homo sapiens
uggaaugucacguggaaua

SEQ ID NO: 316047 - RNA, 19 nt, Homo sapiens
caucaccucuaacauccuu

SEQ ID NO: 316048 - RNA, 19 nt, Homo sapiens
gcgagugucucccucaaac

SEQ ID NO: 316049 - RNA, 19 nt, Homo sapiens
ccuaaucccugcccagagu

SEQ ID NO: 316050 - RNA, 19 nt, Homo sapiens
ccacgcugcuugcuaccuu

SEQ ID NO: 316051 - RNA, 19 nt, Homo sapiens
gagaugcgaaccacccaaa

SEQ ID NO: 316052 - RNA, 19 nt, Homo sapiens
gaguggaauuccggaacua

SEQ ID NO: 316053 - RNA, 19 nt, Homo sapiens
caaggaguauucagagacu

SEQ ID NO: 316054 - RNA, 19 nt, Homo sapiens
cacaagggaucgccguguu

SEQ ID NO: 316055 - RNA, 19 nt, Homo sapiens
gcgcuggcuuccaacuauu

SEQ ID NO: 316056 - RNA, 19 nt, Homo sapiens
guacugggacuacaugaag

SEQ ID NO: 316057 - RNA, 19 nt, Homo sapiens
gcaaagcaaauggagaaug

SEQ ID NO: 316058 - RNA, 19 nt, Homo sapiens
aagcaaagcaaauggagaa

SEQ ID NO: 316059 - RNA, 19 nt, Homo sapiens
gcagguggacgucaucauc

SEQ ID NO: 316060 - RNA, 19 nt, Homo sapiens
gacuuggccacguacauua

SEQ ID NO: 316061 - RNA, 19 nt, Homo sapiens
ucauggacuuggccacgua

SEQ ID NO: 316062 - RNA, 19 nt, Homo sapiens
gaaggaaugcgccaagacu

SEQ ID NO: 316063 - RNA, 19 nt, Homo sapiens
ggacacgucggaacaaguc

SEQ ID NO: 316064 - RNA, 19 nt, Homo sapiens
gaauuugaccuugacuaga

SEQ ID NO: 316065 - RNA, 19 nt, Homo sapiens
ccaguacucggaugaagaa

SEQ ID NO: 316066 - RNA, 19 nt, Homo sapiens
ggucaagcuuuccguguac

SEQ ID NO: 316067 - RNA, 19 nt, Homo sapiens
cagggaucaugcucacuuu

SEQ ID NO: 316068 - RNA, 19 nt, Homo sapiens
guugguugcuuacaguguu

SEQ ID NO: 316069 - RNA, 19 nt, Homo sapiens
cucagugucuuacucauug

SEQ ID NO: 316070 - RNA, 19 nt, Homo sapiens
ucaagcugaugaacgaaau

SEQ ID NO: 316071 - RNA, 19 nt, Homo sapiens
ggacagagauuggcgagaa

SEQ ID NO: 316072 - RNA, 19 nt, Homo sapiens
gaugacaccucucaacaaa

SEQ ID NO: 316073 - RNA, 19 nt, Homo sapiens
uaaaguugcucaucaaguu

SEQ ID NO: 316074 - RNA, 19 nt, Homo sapiens
ggaagcaacugcagagaca

SEQ ID NO: 316075 - RNA, 19 nt, Homo sapiens
caacgagucugccgaagga

SEQ ID NO: 316076 - RNA, 19 nt, Homo sapiens
ccaaggagcuggacacagu

SEQ ID NO: 316077 - RNA, 19 nt, Homo sapiens
ggaauugguuguauagaag

SEQ ID NO: 316078 - RNA, 19 nt, Homo sapiens
gaucaagaccgcugucauu

SEQ ID NO: 316079 - RNA, 19 nt, Homo sapiens
caaagcaaauggagaaugg

SEQ ID NO: 316080 - RNA, 19 nt, Homo sapiens
gggcagaccucuucuacuc

SEQ ID NO: 316081 - RNA, 19 nt, Homo sapiens
ccacguacauuaacaugau

SEQ ID NO: 316082 - RNA, 19 nt, Homo sapiens
acauuuaccucuucgauga

SEQ ID NO: 316083 - RNA, 19 nt, Homo sapiens
cagcaggccuggauucaga

SEQ ID NO: 316084 - RNA, 19 nt, Homo sapiens
gagauggccucaugggaau

SEQ ID NO: 316085 - RNA, 19 nt, Homo sapiens
uggagaggcucaaggagua

SEQ ID NO: 316086 - RNA, 19 nt, Homo sapiens
gaccgaggcuacauucaga

SEQ ID NO: 316087 - RNA, 19 nt, Homo sapiens
gaccuugacuagaaauaga

SEQ ID NO: 316088 - RNA, 19 nt, Homo sapiens
gaaggaagcaaagcaaaug

SEQ ID NO: 316089 - RNA, 19 nt, Homo sapiens
ggccgcagaucuuaaaguu

SEQ ID NO: 316090 - RNA, 19 nt, Homo sapiens
gcagaccucuucuacucuu

SEQ ID NO: 316091 - RNA, 19 nt, Homo sapiens
uuaaggagauggccucaug

SEQ ID NO: 316092 - RNA, 19 nt, Homo sapiens
aaggagaaauccaggagua

SEQ ID NO: 316093 - RNA, 19 nt, Homo sapiens
gaccuccgcuucaagauca

SEQ ID NO: 316094 - RNA, 19 nt, Homo sapiens
caucugaaauggaaaccaa

SEQ ID NO: 316095 - RNA, 19 nt, Homo sapiens
aaauagagacugagaguga

SEQ ID NO: 316096 - RNA, 19 nt, Homo sapiens
gacuagaaauagagacuga

SEQ ID NO: 316097 - RNA, 19 nt, Homo sapiens
gcaacugcaucguucuguu

SEQ ID NO: 316098 - RNA, 19 nt, Homo sapiens
ggaaagaagucggggcaua

SEQ ID NO: 316099 - RNA, 19 nt, Homo sapiens
aauuugaccuugacuagaa

SEQ ID NO: 316100 - RNA, 19 nt, Homo sapiens
ggguaaauauuaaggagau

SEQ ID NO: 316101 - RNA, 19 nt, Homo sapiens
caagcuagaccaugaaugu

SEQ ID NO: 316102 - RNA, 19 nt, Homo sapiens
guacucggaugaagaaguc

SEQ ID NO: 316103 - RNA, 19 nt, Homo sapiens
gagaggaccuggacuucgu

SEQ ID NO: 316104 - RNA, 19 nt, Homo sapiens
caacugcaucguucuguuu

SEQ ID NO: 316105 - RNA, 19 nt, Homo sapiens
ugaacgaaauucucaaugg

SEQ ID NO: 316106 - RNA, 19 nt, Homo sapiens
caacagcaccgcagaacug

SEQ ID NO: 316107 - RNA, 19 nt, Homo sapiens
ggaaggaagcaaagcaaau

SEQ ID NO: 316108 - RNA, 19 nt, Homo sapiens
gaucaaagugcuaaagcuu

SEQ ID NO: 316109 - RNA, 19 nt, Homo sapiens
ggacuuggccacguacauu

SEQ ID NO: 316110 - RNA, 19 nt, Homo sapiens
gcagagaggucuuuucuac

SEQ ID NO: 316111 - RNA, 19 nt, Homo sapiens
ggaucuuucucucccauga

SEQ ID NO: 316112 - RNA, 19 nt, Homo sapiens
ugaaggugcugaagaaguc

SEQ ID NO: 316113 - RNA, 19 nt, Homo sapiens
ggaauuugaccuugacuag

SEQ ID NO: 316114 - RNA, 19 nt, Homo sapiens
gcaucaacaucgccaagau

SEQ ID NO: 316115 - RNA, 19 nt, Homo sapiens
cgaugaagaccaagacgua

SEQ ID NO: 316116 - RNA, 19 nt, Homo sapiens
uggaggaauugguuguaua

SEQ ID NO: 316117 - RNA, 19 nt, Homo sapiens
gaacugcagggccuauaug

SEQ ID NO: 316118 - RNA, 19 nt, Homo sapiens
ggaaaacacaucuuugaaa

SEQ ID NO: 316119 - RNA, 19 nt, Homo sapiens
caaaguaaagaacacgaaa

SEQ ID NO: 316120 - RNA, 19 nt, Homo sapiens
agaaccagaaggccuauua

SEQ ID NO: 316121 - RNA, 19 nt, Homo sapiens
ggacucaggagcacacgaa

SEQ ID NO: 316122 - RNA, 19 nt, Homo sapiens
ccugggagcuggcauucaa

SEQ ID NO: 316123 - RNA, 19 nt, Homo sapiens
gcugguagcccuagugugu

SEQ ID NO: 316124 - RNA, 19 nt, Homo sapiens
guauagaagauccuaguga

SEQ ID NO: 316125 - RNA, 19 nt, Homo sapiens
aggaauugguuguauagaa

SEQ ID NO: 316126 - RNA, 19 nt, Homo sapiens
uggcugagauggacaaagu

SEQ ID NO: 316127 - RNA, 19 nt, Homo sapiens
gaagucugccuaccuguca

SEQ ID NO: 316128 - RNA, 19 nt, Homo sapiens
cgaaagagaguuccaaggu

SEQ ID NO: 316129 - RNA, 19 nt, Homo sapiens
cugacaagcuagaccauga

SEQ ID NO: 316130 - RNA, 19 nt, Homo sapiens
cauugcaggucaccacgua

SEQ ID NO: 316131 - RNA, 19 nt, Homo sapiens
gaugugggguaaauauuaa

SEQ ID NO: 316132 - RNA, 19 nt, Homo sapiens
gcaagucuuugagaugcuu

SEQ ID NO: 316133 - RNA, 19 nt, Homo sapiens
gaccuggacuucguucuca

SEQ ID NO: 316134 - RNA, 19 nt, Homo sapiens
ucuguuugcugcccuguuu

SEQ ID NO: 316135 - RNA, 19 nt, Homo sapiens
caugggaauuugaccuuga

SEQ ID NO: 316136 - RNA, 19 nt, Homo sapiens
ggaggaauugguuguauag

SEQ ID NO: 316137 - RNA, 19 nt, Homo sapiens
gaaauucucaaugggauca

SEQ ID NO: 316138 - RNA, 19 nt, Homo sapiens
caaagacaaucggaucaag

SEQ ID NO: 316139 - RNA, 19 nt, Homo sapiens
gcaaagacaaucggaucaa

SEQ ID NO: 316140 - RNA, 19 nt, Homo sapiens
aaggagagaucaucaucga

SEQ ID NO: 316141 - RNA, 19 nt, Homo sapiens
uggaaugucacguggaaua

SEQ ID NO: 316142 - RNA, 19 nt, Homo sapiens
gagcugaaggugcugaaga

SEQ ID NO: 316143 - RNA, 19 nt, Homo sapiens
ggaaggcccuggugaucac

SEQ ID NO: 316144 - RNA, 19 nt, Homo sapiens
cucaugagcuucuucuuca

SEQ ID NO: 316145 - RNA, 19 nt, Homo sapiens
ggaccuguuucgugacauc

SEQ ID NO: 316146 - RNA, 19 nt, Homo sapiens
caucaccucuaacauccuu

SEQ ID NO: 316147 - RNA, 19 nt, Homo sapiens
gcgagugucucccucaaac

SEQ ID NO: 316148 - RNA, 19 nt, Homo sapiens
ccuaaucccugcccagagu

SEQ ID NO: 316149 - RNA, 19 nt, Homo sapiens
ccacgcugcuugcuaccuu

SEQ ID NO: 316150 - RNA, 19 nt, Homo sapiens
gagaugcgaaccacccaaa

SEQ ID NO: 316151 - RNA, 19 nt, Homo sapiens
gaguggaauuccggaacua

SEQ ID NO: 316152 - RNA, 19 nt, Homo sapiens
caaggaguauucagagacu

SEQ ID NO: 316153 - RNA, 19 nt, Homo sapiens
cacaagggaucgccguguu

SEQ ID NO: 316154 - RNA, 19 nt, Homo sapiens
gcgcuggcuuccaacuauu

SEQ ID NO: 316155 - RNA, 19 nt, Homo sapiens
guacugggacuacaugaag

SEQ ID NO: 316156 - RNA, 19 nt, Homo sapiens
gcaaagcaaauggagaaug

SEQ ID NO: 316157 - RNA, 19 nt, Homo sapiens
aagcaaagcaaauggagaa

SEQ ID NO: 316158 - RNA, 19 nt, Homo sapiens
gcagguggacgucaucauc

SEQ ID NO: 316159 - RNA, 19 nt, Homo sapiens
gacuuggccacguacauua

SEQ ID NO: 316160 - RNA, 19 nt, Homo sapiens
ucauggacuuggccacgua

SEQ ID NO: 316161 - RNA, 19 nt, Homo sapiens
gaaggaaugcgccaagacu

SEQ ID NO: 316162 - RNA, 19 nt, Homo sapiens
ggacacgucggaacaaguc

SEQ ID NO: 316163 - RNA, 19 nt, Homo sapiens
gaauuugaccuugacuaga

SEQ ID NO: 316164 - RNA, 19 nt, Homo sapiens
ccaguacucggaugaagaa

SEQ ID NO: 316165 - RNA, 19 nt, Homo sapiens
ggucaagcuuuccguguac

SEQ ID NO: 316166 - RNA, 19 nt, Homo sapiens
ccaaggggaugcugaagaa

SEQ ID NO: 316167 - RNA, 19 nt, Homo sapiens
cagggaucaugcucacuuu

SEQ ID NO: 316168 - RNA, 19 nt, Homo sapiens
guugguugcuuacaguguu

SEQ ID NO: 316169 - RNA, 19 nt, Homo sapiens
cucagugucuuacucauug

SEQ ID NO: 316170 - RNA, 19 nt, Homo sapiens
ucaagcugaugaacgaaau

SEQ ID NO: 316171 - RNA, 19 nt, Homo sapiens
ggacagagauuggcgagaa

SEQ ID NO: 316172 - RNA, 19 nt, Homo sapiens
gaugacaccucucaacaaa

SEQ ID NO: 316173 - RNA, 19 nt, Homo sapiens
uaaaguugcucaucaaguu

SEQ ID NO: 316174 - RNA, 19 nt, Homo sapiens
ggaagcaacugcagagaca

SEQ ID NO: 316175 - RNA, 19 nt, Homo sapiens
caacgagucugccgaagga

SEQ ID NO: 316176 - RNA, 19 nt, Homo sapiens
ccaaggagcuggacacagu

SEQ ID NO: 316177 - RNA, 19 nt, Homo sapiens
ggaauugguuguauagaag

SEQ ID NO: 316178 - RNA, 19 nt, Homo sapiens
gaucaagaccgcugucauu

SEQ ID NO: 316179 - RNA, 19 nt, Homo sapiens
caaagcaaauggagaaugg

SEQ ID NO: 316180 - RNA, 19 nt, Homo sapiens
gagaaucccugcccagagu

SEQ ID NO: 316181 - RNA, 19 nt, Homo sapiens
gggcagaccucuucuacuc

SEQ ID NO: 316182 - RNA, 19 nt, Homo sapiens
ccacguacauuaacaugau

SEQ ID NO: 316183 - RNA, 19 nt, Homo sapiens
acauuuaccucuucgauga

SEQ ID NO: 316184 - RNA, 19 nt, Homo sapiens
cagcaggccuggauucaga

SEQ ID NO: 316185 - RNA, 19 nt, Homo sapiens
gagauggccucaugggaau

SEQ ID NO: 316186 - RNA, 19 nt, Homo sapiens
uggagaggcucaaggagua

SEQ ID NO: 316187 - RNA, 19 nt, Homo sapiens
gaccgaggcuacauucaga

SEQ ID NO: 316188 - RNA, 19 nt, Homo sapiens
gaccuugacuagaaauaga

SEQ ID NO: 316189 - RNA, 19 nt, Homo sapiens
agacgaagauccuuguguu

SEQ ID NO: 316190 - RNA, 19 nt, Homo sapiens
gaaggaagcaaagcaaaug

SEQ ID NO: 316191 - RNA, 19 nt, Homo sapiens
ggccgcagaucuuaaaguu

SEQ ID NO: 316192 - RNA, 19 nt, Homo sapiens
gcagaccucuucuacucuu

SEQ ID NO: 316193 - RNA, 19 nt, Homo sapiens
uuaaggagauggccucaug

SEQ ID NO: 316194 - RNA, 19 nt, Homo sapiens
aaggagaaauccaggagua

SEQ ID NO: 316195 - RNA, 19 nt, Homo sapiens
gaccuccgcuucaagauca

SEQ ID NO: 316196 - RNA, 19 nt, Homo sapiens
caucugaaauggaaaccaa

SEQ ID NO: 316197 - RNA, 19 nt, Homo sapiens
aaauagagacugagaguga

SEQ ID NO: 316198 - RNA, 19 nt, Homo sapiens
gacuagaaauagagacuga

SEQ ID NO: 316199 - RNA, 19 nt, Homo sapiens
gcaacugcaucguucuguu

SEQ ID NO: 316200 - RNA, 19 nt, Homo sapiens
ggaaagaagucggggcaua

SEQ ID NO: 316201 - RNA, 19 nt, Homo sapiens
aauuugaccuugacuagaa

SEQ ID NO: 316202 - RNA, 19 nt, Homo sapiens
ggguaaauauuaaggagau

SEQ ID NO: 316203 - RNA, 19 nt, Homo sapiens
caagcuagaccaugaaugu

SEQ ID NO: 316204 - RNA, 19 nt, Homo sapiens
guacucggaugaagaaguc

SEQ ID NO: 316205 - RNA, 19 nt, Homo sapiens
gagaggaccuggacuucgu

SEQ ID NO: 316206 - RNA, 19 nt, Homo sapiens
caacugcaucguucuguuu

SEQ ID NO: 316207 - RNA, 19 nt, Homo sapiens
ugaacgaaauucucaaugg

SEQ ID NO: 316208 - RNA, 19 nt, Homo sapiens
caacagcaccgcagaacug

SEQ ID NO: 316209 - RNA, 19 nt, Homo sapiens
ggaaggaagcaaagcaaau

SEQ ID NO: 316210 - RNA, 19 nt, Homo sapiens
gaucaaagugcuaaagcuu

SEQ ID NO: 316211 - RNA, 19 nt, Homo sapiens
ggacuuggccacguacauu

SEQ ID NO: 316212 - RNA, 19 nt, Homo sapiens
gcagagaggucuuuucuac

SEQ ID NO: 316213 - RNA, 19 nt, Homo sapiens
ggaucuuucucucccauga

SEQ ID NO: 316214 - RNA, 19 nt, Homo sapiens
ugaaggugcugaagaaguc

SEQ ID NO: 316215 - RNA, 19 nt, Homo sapiens
ggaauuugaccuugacuag

SEQ ID NO: 316216 - RNA, 19 nt, Homo sapiens
cgaagauccuuguguugga

SEQ ID NO: 316217 - RNA, 19 nt, Homo sapiens
gcaucaacaucgccaagau

SEQ ID NO: 316218 - RNA, 19 nt, Homo sapiens
cgaugaagaccaagacgua

SEQ ID NO: 316219 - RNA, 19 nt, Homo sapiens
uggaggaauugguuguaua

SEQ ID NO: 316220 - RNA, 19 nt, Homo sapiens
gaacugcagggccuauaug

SEQ ID NO: 316221 - RNA, 19 nt, Homo sapiens
ggaaaacacaucuuugaaa

SEQ ID NO: 316222 - RNA, 19 nt, Homo sapiens
caaaguaaagaacacgaaa

SEQ ID NO: 316223 - RNA, 19 nt, Homo sapiens
agaaccagaaggccuauua

SEQ ID NO: 316224 - RNA, 19 nt, Homo sapiens
ggacucaggagcacacgaa

SEQ ID NO: 316225 - RNA, 19 nt, Homo sapiens
ccugggagcuggcauucaa

SEQ ID NO: 316226 - RNA, 19 nt, Homo sapiens
gcugguagcccuagugugu

SEQ ID NO: 316227 - RNA, 19 nt, Homo sapiens
guauagaagauccuaguga

SEQ ID NO: 316228 - RNA, 19 nt, Homo sapiens
aggaauugguuguauagaa

SEQ ID NO: 316229 - RNA, 19 nt, Homo sapiens
acacaagggugaucgucuu

SEQ ID NO: 316230 - RNA, 19 nt, Homo sapiens
ggaaacggacgaccucauc

SEQ ID NO: 316231 - RNA, 19 nt, Homo sapiens
uggcugagauggacaaagu

SEQ ID NO: 316232 - RNA, 19 nt, Homo sapiens
gaagucugccuaccuguca

SEQ ID NO: 316233 - RNA, 19 nt, Homo sapiens
cgaaagagaguuccaaggu

SEQ ID NO: 316234 - RNA, 19 nt, Homo sapiens
cugacaagcuagaccauga

SEQ ID NO: 316235 - RNA, 19 nt, Homo sapiens
cauugcaggucaccacgua

SEQ ID NO: 316236 - RNA, 19 nt, Homo sapiens
gaugugggguaaauauuaa

SEQ ID NO: 316237 - RNA, 19 nt, Homo sapiens
gcaagucuuugagaugcuu

SEQ ID NO: 316238 - RNA, 19 nt, Homo sapiens
gaccuggacuucguucuca

SEQ ID NO: 316239 - RNA, 19 nt, Homo sapiens
ucuguuugcugcccuguuu

SEQ ID NO: 316240 - RNA, 19 nt, Homo sapiens
caugggaauuugaccuuga

SEQ ID NO: 316241 - RNA, 19 nt, Homo sapiens
ggaggaauugguuguauag

SEQ ID NO: 316242 - RNA, 19 nt, Homo sapiens
gaaauucucaaugggauca

SEQ ID NO: 316243 - RNA, 19 nt, Homo sapiens
caaagacaaucggaucaag

SEQ ID NO: 316244 - RNA, 19 nt, Homo sapiens
gcaaagacaaucggaucaa

SEQ ID NO: 316245 - RNA, 19 nt, Homo sapiens
ggaagacgaagauccuugu

SEQ ID NO: 316246 - RNA, 19 nt, Homo sapiens
aaggagagaucaucaucga

SEQ ID NO: 316247 - RNA, 19 nt, Homo sapiens
uggaaugucacguggaaua

SEQ ID NO: 316248 - RNA, 19 nt, Homo sapiens
gagcugaaggugcugaaga

SEQ ID NO: 316249 - RNA, 19 nt, Homo sapiens
ggaaggcccuggugaucac

SEQ ID NO: 316250 - RNA, 19 nt, Homo sapiens
cucaugagcuucuucuuca

SEQ ID NO: 316251 - RNA, 19 nt, Homo sapiens
caucaccucuaacauccuu

SEQ ID NO: 316252 - RNA, 19 nt, Homo sapiens
gcgagugucucccucaaac

SEQ ID NO: 316253 - RNA, 19 nt, Homo sapiens
ccacgcugcuugcuaccuu

SEQ ID NO: 316254 - RNA, 19 nt, Homo sapiens
gagaugcgaaccacccaaa

SEQ ID NO: 316255 - RNA, 19 nt, Homo sapiens
gaguggaauuccggaacua

SEQ ID NO: 316256 - RNA, 19 nt, Homo sapiens
caaggaguauucagagacu

SEQ ID NO: 316257 - RNA, 19 nt, Homo sapiens
cacaagggaucgccguguu

SEQ ID NO: 316258 - RNA, 19 nt, Homo sapiens
gcgcuggcuuccaacuauu

SEQ ID NO: 316259 - RNA, 19 nt, Homo sapiens
guacugggacuacaugaag

SEQ ID NO: 316260 - RNA, 19 nt, Homo sapiens
gcaaagcaaauggagaaug

SEQ ID NO: 316261 - RNA, 19 nt, Homo sapiens
aagcaaagcaaauggagaa

SEQ ID NO: 316262 - RNA, 19 nt, Homo sapiens
gcagguggacgucaucauc

SEQ ID NO: 316263 - RNA, 19 nt, Homo sapiens
gacuuggccacguacauua

SEQ ID NO: 316264 - RNA, 19 nt, Homo sapiens
ucauggacuuggccacgua

SEQ ID NO: 316265 - RNA, 19 nt, Homo sapiens
gaaggaaugcgccaagacu

SEQ ID NO: 316266 - RNA, 19 nt, Homo sapiens
ggacacgucggaacaaguc

SEQ ID NO: 316267 - RNA, 19 nt, Homo sapiens
gaauuugaccuugacuaga

SEQ ID NO: 316268 - RNA, 19 nt, Homo sapiens
ccaguacucggaugaagaa

SEQ ID NO: 316269 - RNA, 19 nt, Homo sapiens
ggucaagcuuuccguguac

SEQ ID NO: 316270 - RNA, 19 nt, Homo sapiens
ccaaggggaugcugaagaa

SEQ ID NO: 316271 - RNA, 19 nt, Homo sapiens
ggacagagauuggcgagaa

SEQ ID NO: 316272 - RNA, 19 nt, Homo sapiens
gaugacaccucucaacaaa

SEQ ID NO: 316273 - RNA, 19 nt, Homo sapiens
uaaaguugcucaucaaguu

SEQ ID NO: 316274 - RNA, 19 nt, Homo sapiens
ggaagcaacugcagagaca

SEQ ID NO: 316275 - RNA, 19 nt, Homo sapiens
caacgagucugccgaagga

SEQ ID NO: 316276 - RNA, 19 nt, Homo sapiens
ccaaggagcuggacacagu

SEQ ID NO: 316277 - RNA, 19 nt, Homo sapiens
ggaauugguuguauagaag

SEQ ID NO: 316278 - RNA, 19 nt, Homo sapiens
gaucaagaccgcugucauu

SEQ ID NO: 316279 - RNA, 19 nt, Homo sapiens
caaagcaaauggagaaugg

SEQ ID NO: 316280 - RNA, 19 nt, Homo sapiens
gggcagaccucuucuacuc

SEQ ID NO: 316281 - RNA, 19 nt, Homo sapiens
ccacguacauuaacaugau

SEQ ID NO: 316282 - RNA, 19 nt, Homo sapiens
acauuuaccucuucgauga

SEQ ID NO: 316283 - RNA, 19 nt, Homo sapiens
cagcaggccuggauucaga

SEQ ID NO: 316284 - RNA, 19 nt, Homo sapiens
gagauggccucaugggaau

SEQ ID NO: 316285 - RNA, 19 nt, Homo sapiens
uggagaggcucaaggagua

SEQ ID NO: 316286 - RNA, 19 nt, Homo sapiens
gaccgaggcuacauucaga

SEQ ID NO: 316287 - RNA, 19 nt, Homo sapiens
gaccuugacuagaaauaga

SEQ ID NO: 316288 - RNA, 19 nt, Homo sapiens
agacgaagauccuuguguu

SEQ ID NO: 316289 - RNA, 19 nt, Homo sapiens
gaaggaagcaaagcaaaug

SEQ ID NO: 316290 - RNA, 19 nt, Homo sapiens
ggccgcagaucuuaaaguu

SEQ ID NO: 316291 - RNA, 19 nt, Homo sapiens
gcagaccucuucuacucuu

SEQ ID NO: 316292 - RNA, 19 nt, Homo sapiens
uuaaggagauggccucaug

SEQ ID NO: 316293 - RNA, 19 nt, Homo sapiens
aaggagaaauccaggagua

SEQ ID NO: 316294 - RNA, 19 nt, Homo sapiens
gaccuccgcuucaagauca

SEQ ID NO: 316295 - RNA, 19 nt, Homo sapiens
caucugaaauggaaaccaa

SEQ ID NO: 316296 - RNA, 19 nt, Homo sapiens
aaauagagacugagaguga

SEQ ID NO: 316297 - RNA, 19 nt, Homo sapiens
gacuagaaauagagacuga

SEQ ID NO: 316298 - RNA, 19 nt, Homo sapiens
gcaacugcaucguucuguu

SEQ ID NO: 316299 - RNA, 19 nt, Homo sapiens
ggaaagaagucggggcaua

SEQ ID NO: 316300 - RNA, 19 nt, Homo sapiens
aauuugaccuugacuagaa

SEQ ID NO: 316301 - RNA, 19 nt, Homo sapiens
ggguaaauauuaaggagau

SEQ ID NO: 316302 - RNA, 19 nt, Homo sapiens
caagcuagaccaugaaugu

SEQ ID NO: 316303 - RNA, 19 nt, Homo sapiens
guacucggaugaagaaguc

SEQ ID NO: 316304 - RNA, 19 nt, Homo sapiens
gagaggaccuggacuucgu

SEQ ID NO: 316305 - RNA, 19 nt, Homo sapiens
caacugcaucguucuguuu

SEQ ID NO: 316306 - RNA, 19 nt, Homo sapiens
ugaacgaaauucucaaugg

SEQ ID NO: 316307 - RNA, 19 nt, Homo sapiens
caacagcaccgcagaacug

SEQ ID NO: 316308 - RNA, 19 nt, Homo sapiens
ggaaggaagcaaagcaaau

SEQ ID NO: 316309 - RNA, 19 nt, Homo sapiens
gaucaaagugcuaaagcuu

SEQ ID NO: 316310 - RNA, 19 nt, Homo sapiens
ggacuuggccacguacauu

SEQ ID NO: 316311 - RNA, 19 nt, Homo sapiens
gcagagaggucuuuucuac

SEQ ID NO: 316312 - RNA, 19 nt, Homo sapiens
ggaucuuucucucccauga

SEQ ID NO: 316313 - RNA, 19 nt, Homo sapiens
ugaaggugcugaagaaguc

SEQ ID NO: 316314 - RNA, 19 nt, Homo sapiens
ggaauuugaccuugacuag

SEQ ID NO: 316315 - RNA, 19 nt, Homo sapiens
cgaagauccuuguguugga

SEQ ID NO: 316316 - RNA, 19 nt, Homo sapiens
gcaucaacaucgccaagau

SEQ ID NO: 316317 - RNA, 19 nt, Homo sapiens
cgaugaagaccaagacgua

SEQ ID NO: 316318 - RNA, 19 nt, Homo sapiens
uggaggaauugguuguaua

SEQ ID NO: 316319 - RNA, 19 nt, Homo sapiens
gaacugcagggccuauaug

SEQ ID NO: 316320 - RNA, 19 nt, Homo sapiens
ggaaaacacaucuuugaaa

SEQ ID NO: 316321 - RNA, 19 nt, Homo sapiens
caaaguaaagaacacgaaa

SEQ ID NO: 316322 - RNA, 19 nt, Homo sapiens
agaaccagaaggccuauua

SEQ ID NO: 316323 - RNA, 19 nt, Homo sapiens
ggacucaggagcacacgaa

SEQ ID NO: 316324 - RNA, 19 nt, Homo sapiens
ccugggagcuggcauucaa

SEQ ID NO: 316325 - RNA, 19 nt, Homo sapiens
gcugguagcccuagugugu

SEQ ID NO: 316326 - RNA, 19 nt, Homo sapiens
guauagaagauccuaguga

SEQ ID NO: 316327 - RNA, 19 nt, Homo sapiens
aggaauugguuguauagaa

SEQ ID NO: 316328 - RNA, 19 nt, Homo sapiens
acacaagggugaucgucuu

SEQ ID NO: 316329 - RNA, 19 nt, Homo sapiens
ggaaacggacgaccucauc

SEQ ID NO: 316330 - RNA, 19 nt, Homo sapiens
uggcugagauggacaaagu

SEQ ID NO: 316331 - RNA, 19 nt, Homo sapiens
gaagucugccuaccuguca

SEQ ID NO: 316332 - RNA, 19 nt, Homo sapiens
cgaaagagaguuccaaggu

SEQ ID NO: 316333 - RNA, 19 nt, Homo sapiens
cugacaagcuagaccauga

SEQ ID NO: 316334 - RNA, 19 nt, Homo sapiens
cauugcaggucaccacgua

SEQ ID NO: 316335 - RNA, 19 nt, Homo sapiens
gaugugggguaaauauuaa

SEQ ID NO: 316336 - RNA, 19 nt, Homo sapiens
gcaagucuuugagaugcuu

SEQ ID NO: 316337 - RNA, 19 nt, Homo sapiens
gaccuggacuucguucuca

SEQ ID NO: 316338 - RNA, 19 nt, Homo sapiens
ucuguuugcugcccuguuu

SEQ ID NO: 316339 - RNA, 19 nt, Homo sapiens
caugggaauuugaccuuga

SEQ ID NO: 316340 - RNA, 19 nt, Homo sapiens
ggaggaauugguuguauag

SEQ ID NO: 316341 - RNA, 19 nt, Homo sapiens
gaaauucucaaugggauca

SEQ ID NO: 316342 - RNA, 19 nt, Homo sapiens
caaagacaaucggaucaag

SEQ ID NO: 316343 - RNA, 19 nt, Homo sapiens
gcaaagacaaucggaucaa

SEQ ID NO: 316344 - RNA, 19 nt, Homo sapiens
ggaagacgaagauccuugu

SEQ ID NO: 316345 - RNA, 19 nt, Homo sapiens
aaggagagaucaucaucga

SEQ ID NO: 316346 - RNA, 19 nt, Homo sapiens
uggaaugucacguggaaua

SEQ ID NO: 316347 - RNA, 19 nt, Homo sapiens
gagcugaaggugcugaaga

SEQ ID NO: 316348 - RNA, 19 nt, Homo sapiens
ggaaggcccuggugaucac

SEQ ID NO: 316349 - RNA, 19 nt, Homo sapiens
cucaugagcuucuucuuca

SEQ ID NO: 316350 - RNA, 19 nt, Homo sapiens
ggaccuguuucgugacauc

SEQ ID NO: 316351 - RNA, 19 nt, Homo sapiens
caucaccucuaacauccuu

SEQ ID NO: 316352 - RNA, 19 nt, Homo sapiens
gcgagugucucccucaaac

SEQ ID NO: 316353 - RNA, 19 nt, Homo sapiens
ccuaaucccugcccagagu

SEQ ID NO: 316354 - RNA, 19 nt, Homo sapiens
ccacgcugcuugcuaccuu

SEQ ID NO: 316355 - RNA, 19 nt, Homo sapiens
gagaugcgaaccacccaaa

SEQ ID NO: 316356 - RNA, 19 nt, Homo sapiens
gaguggaauuccggaacua

SEQ ID NO: 316357 - RNA, 19 nt, Homo sapiens
caaggaguauucagagacu

SEQ ID NO: 316358 - RNA, 19 nt, Homo sapiens
cacaagggaucgccguguu

SEQ ID NO: 316359 - RNA, 19 nt, Homo sapiens
gcgcuggcuuccaacuauu

SEQ ID NO: 316360 - RNA, 19 nt, Homo sapiens
guacugggacuacaugaag

SEQ ID NO: 316361 - RNA, 19 nt, Homo sapiens
gcaaagcaaauggagaaug

SEQ ID NO: 316362 - RNA, 19 nt, Homo sapiens
aagcaaagcaaauggagaa

SEQ ID NO: 316363 - RNA, 19 nt, Homo sapiens
gcagguggacgucaucauc

SEQ ID NO: 316364 - RNA, 19 nt, Homo sapiens
gacuuggccacguacauua

SEQ ID NO: 316365 - RNA, 19 nt, Homo sapiens
ucauggacuuggccacgua

SEQ ID NO: 316366 - RNA, 19 nt, Homo sapiens
gaaggaaugcgccaagacu

SEQ ID NO: 316367 - RNA, 19 nt, Homo sapiens
ggacacgucggaacaaguc

SEQ ID NO: 316368 - RNA, 19 nt, Homo sapiens
gaauuugaccuugacuaga

SEQ ID NO: 316369 - RNA, 19 nt, Homo sapiens
ccaguacucggaugaagaa

SEQ ID NO: 316370 - RNA, 19 nt, Homo sapiens
ggucaagcuuuccguguac

SEQ ID NO: 316371 - RNA, 19 nt, Homo sapiens
gaagugagauuguuucuag

SEQ ID NO: 316372 - RNA, 19 nt, Homo sapiens
ggacucacauugacuacuu

SEQ ID NO: 316373 - RNA, 19 nt, Homo sapiens
ccuauaaucccaacacuua

SEQ ID NO: 316374 - RNA, 19 nt, Homo sapiens
gugcuucucugucaacuaa

SEQ ID NO: 316375 - RNA, 19 nt, Homo sapiens
gcaagcgucuguccuagga

SEQ ID NO: 316376 - RNA, 19 nt, Homo sapiens
caaaggaagugagauuguu

SEQ ID NO: 316377 - RNA, 19 nt, Homo sapiens
ccaagaacccaaacuauau

SEQ ID NO: 316378 - RNA, 19 nt, Homo sapiens
ggaaggauucguugacaaa

SEQ ID NO: 316379 - RNA, 19 nt, Homo sapiens
cuaguggcaugguuuauaa

SEQ ID NO: 316380 - RNA, 19 nt, Homo sapiens
gagaucauguguggcauuu

SEQ ID NO: 316381 - RNA, 19 nt, Homo sapiens
gcacagcauugaagcaagu

SEQ ID NO: 316382 - RNA, 19 nt, Homo sapiens
gauauagaauggacucaca

SEQ ID NO: 316383 - RNA, 19 nt, Homo sapiens
gaucauguguggcauuucu

SEQ ID NO: 316384 - RNA, 19 nt, Homo sapiens
gcuucaggauccagcauua

SEQ ID NO: 316385 - RNA, 19 nt, Homo sapiens
ggaccuauaaucccaacua

SEQ ID NO: 316386 - RNA, 19 nt, Homo sapiens
acaaugaccuucucuaucg

SEQ ID NO: 316387 - RNA, 19 nt, Homo sapiens
gagaaaguaaugauuccua

SEQ ID NO: 316388 - RNA, 19 nt, Homo sapiens
gcucucgguuccucaauga

SEQ ID NO: 316389 - RNA, 19 nt, Homo sapiens
aagaagagcaggaggagua

SEQ ID NO: 316390 - RNA, 19 nt, Homo sapiens
ggacuuccuugagcucuga

SEQ ID NO: 316391 - RNA, 19 nt, Homo sapiens
ugagauuguuucuagcuuu

SEQ ID NO: 316392 - RNA, 19 nt, Homo sapiens
uggagaagauaguagauau

SEQ ID NO: 316393 - RNA, 19 nt, Homo sapiens
ccaagcagaggguaacuaa

SEQ ID NO: 316394 - RNA, 19 nt, Homo sapiens
ggucaggaauucgagacua

SEQ ID NO: 316395 - RNA, 19 nt, Homo sapiens
caagaacccaaacuauauu

SEQ ID NO: 316396 - RNA, 19 nt, Homo sapiens
gagcuaguggcaugguuua

SEQ ID NO: 316397 - RNA, 19 nt, Homo sapiens
gggccacaguuaaaucuga

SEQ ID NO: 316398 - RNA, 19 nt, Homo sapiens
caucauuuguguauacuuc

SEQ ID NO: 316399 - RNA, 19 nt, Homo sapiens
gcaaaggaagugagauugu

SEQ ID NO: 316400 - RNA, 19 nt, Homo sapiens
gaaagcaggaugagcaagu

SEQ ID NO: 316401 - RNA, 19 nt, Homo sapiens
gcuaguggcaugguuuaua

SEQ ID NO: 316402 - RNA, 19 nt, Homo sapiens
uaacugcucuggcacuucu

SEQ ID NO: 316403 - RNA, 19 nt, Homo sapiens
aaugggagauucagaacuu

SEQ ID NO: 316404 - RNA, 19 nt, Homo sapiens
ugggauucuuguucuauua

SEQ ID NO: 316405 - RNA, 19 nt, Homo sapiens
aaacaaugaccuucucuau

SEQ ID NO: 316406 - RNA, 19 nt, Homo sapiens
caacagcuuugagcaguuc

SEQ ID NO: 316407 - RNA, 19 nt, Homo sapiens
ggagaagauaguagauauu

SEQ ID NO: 316408 - RNA, 19 nt, Homo sapiens
uggcauuucucauggauug

SEQ ID NO: 316409 - RNA, 19 nt, Homo sapiens
ggagcucacugugucuuug

SEQ ID NO: 316410 - RNA, 19 nt, Homo sapiens
ccuaaagcaaucugaauuu

SEQ ID NO: 316411 - RNA, 19 nt, Homo sapiens
uaucugggauuggcuuaaa

SEQ ID NO: 316412 - RNA, 19 nt, Homo sapiens
gaccaagaacccaaacuau

SEQ ID NO: 316413 - RNA, 19 nt, Homo sapiens
ccuauaaucccaacuacuu

SEQ ID NO: 316414 - RNA, 19 nt, Homo sapiens
guaaugauuccuaaagcaa

SEQ ID NO: 316415 - RNA, 19 nt, Homo sapiens
ugcaacaaaucuucauuga

SEQ ID NO: 316416 - RNA, 19 nt, Homo sapiens
gcuuugagcaguucauuau

SEQ ID NO: 316417 - RNA, 19 nt, Homo sapiens
gcuaucauuugugaccuaa

SEQ ID NO: 316418 - RNA, 19 nt, Homo sapiens
cagcaaaggaagugagauu

SEQ ID NO: 316419 - RNA, 19 nt, Homo sapiens
gcaaugggcaagcgucugu

SEQ ID NO: 316420 - RNA, 19 nt, Homo sapiens
uagaaaagcugaaccaagu

SEQ ID NO: 316421 - RNA, 19 nt, Homo sapiens
ggaugaagagugccucaga

SEQ ID NO: 316422 - RNA, 19 nt, Homo sapiens
gaugcaagagucagaguga

SEQ ID NO: 316423 - RNA, 19 nt, Homo sapiens
gaggguaacuaaaauacuu

SEQ ID NO: 316424 - RNA, 19 nt, Homo sapiens
gaguauauacgggaggaua

SEQ ID NO: 316425 - RNA, 19 nt, Homo sapiens
guguauacuucauucauuc

SEQ ID NO: 316426 - RNA, 19 nt, Homo sapiens
gcaagugcuuuaguuaacu

SEQ ID NO: 316427 - RNA, 19 nt, Homo sapiens
gagcacagcauugaagcaa

SEQ ID NO: 316428 - RNA, 19 nt, Homo sapiens
accaagaacccaaacuaua

SEQ ID NO: 316429 - RNA, 19 nt, Homo sapiens
gccaugcccucaucaaguc

SEQ ID NO: 316430 - RNA, 19 nt, Homo sapiens
agacuagccuggccaacau

SEQ ID NO: 316431 - RNA, 19 nt, Homo sapiens
ucccuuugcuucaaucuga

SEQ ID NO: 316432 - RNA, 19 nt, Homo sapiens
aaagugugguggagaagau

SEQ ID NO: 316433 - RNA, 19 nt, Homo sapiens
gaacccaaacuauauuagg

SEQ ID NO: 316434 - RNA, 19 nt, Homo sapiens
gcuuagagcacagcauuga

SEQ ID NO: 316435 - RNA, 19 nt, Homo sapiens
aaaggaagugagauuguuu

SEQ ID NO: 316436 - RNA, 19 nt, Homo sapiens
ccgccaagaucaaccugaa

SEQ ID NO: 316437 - RNA, 19 nt, Homo sapiens
gaagagcaggaggaguaua

SEQ ID NO: 316438 - RNA, 19 nt, Homo sapiens
ggaagugagauuguuucua

SEQ ID NO: 316439 - RNA, 19 nt, Homo sapiens
aguaaagugugguggagaa

SEQ ID NO: 316440 - RNA, 19 nt, Homo sapiens
agaccaagaacccaaacua

SEQ ID NO: 316441 - RNA, 19 nt, Homo sapiens
gagauuguuucuagcuuuu

SEQ ID NO: 316442 - RNA, 19 nt, Homo sapiens
guguaggccuggagaaagu

SEQ ID NO: 316443 - RNA, 19 nt, Homo sapiens
caagugcuuuaguuaacug

SEQ ID NO: 316444 - RNA, 19 nt, Homo sapiens
guuucuagcuuuucuguuu

SEQ ID NO: 316445 - RNA, 19 nt, Homo sapiens
gagagcuaguggcaugguu

SEQ ID NO: 316446 - RNA, 19 nt, Homo sapiens
gugcugggccacaguuaaa

SEQ ID NO: 316447 - RNA, 19 nt, Homo sapiens
uuaaugaagcucagugguu

SEQ ID NO: 316448 - RNA, 19 nt, Homo sapiens
uccuugagcucugaaguuu

SEQ ID NO: 316449 - RNA, 19 nt, Homo sapiens
acgaaaagcugcaacaaau

SEQ ID NO: 316450 - RNA, 19 nt, Homo sapiens
gcaaaacccugucucuacu

SEQ ID NO: 316451 - RNA, 19 nt, Homo sapiens
gagacuagccuggccaaca

SEQ ID NO: 316452 - RNA, 19 nt, Homo sapiens
gcacuucuuaggagacaug

SEQ ID NO: 316453 - RNA, 19 nt, Homo sapiens
uagcuuagagcacagcauu

SEQ ID NO: 316454 - RNA, 19 nt, Homo sapiens
acagcaggcucacaguuca

SEQ ID NO: 316455 - RNA, 19 nt, Homo sapiens
ugucuuugcugauccuuca

SEQ ID NO: 316456 - RNA, 19 nt, Homo sapiens
guggagaagauaguagaua

SEQ ID NO: 316457 - RNA, 19 nt, Homo sapiens
ccacuauccuuuccccuaa

SEQ ID NO: 316458 - RNA, 19 nt, Homo sapiens
ugucugagugucauuguuu

SEQ ID NO: 316459 - RNA, 19 nt, Homo sapiens
gaccuauaaucccaacuac

SEQ ID NO: 316460 - RNA, 19 nt, Homo sapiens
gcucuggcacuucuuagga

SEQ ID NO: 316461 - RNA, 19 nt, Homo sapiens
gcagaggguaacuaaaaua

SEQ ID NO: 316462 - RNA, 19 nt, Homo sapiens
cccaaacuauauuagguau

SEQ ID NO: 316463 - RNA, 19 nt, Homo sapiens
ggaaucccgccaagaucaa

SEQ ID NO: 316464 - RNA, 19 nt, Homo sapiens
gucaggaauucgagacuag

SEQ ID NO: 316465 - RNA, 19 nt, Homo sapiens
uguaccagguggaaggauu

SEQ ID NO: 316466 - RNA, 19 nt, Homo sapiens
cugaugagaccuucuuaga

SEQ ID NO: 316467 - RNA, 19 nt, Homo sapiens
cuacuucaauaaugcuauc

SEQ ID NO: 316468 - RNA, 19 nt, Homo sapiens
gaaguuucaccugagaaug

SEQ ID NO: 316469 - RNA, 19 nt, Homo sapiens
guggaaggauucguugaca

SEQ ID NO: 316470 - RNA, 19 nt, Homo sapiens
gugagauuguuucuagcuu

SEQ ID NO: 316471 - RNA, 19 nt, Homo sapiens
gaaggaggaugccaaccaa

SEQ ID NO: 316472 - RNA, 19 nt, Homo sapiens
ggugaaagaucgcaaagca

SEQ ID NO: 316473 - RNA, 19 nt, Homo sapiens
gcaaagcaguggccauucu

SEQ ID NO: 316474 - RNA, 19 nt, Homo sapiens
ugacuucacugcggacuuu

SEQ ID NO: 316475 - RNA, 19 nt, Homo sapiens
gaaacuuaauagccaguau

SEQ ID NO: 316476 - RNA, 19 nt, Homo sapiens
cccuaaagauggaggaaua

SEQ ID NO: 316477 - RNA, 19 nt, Homo sapiens
ccagagcccugcuaucauc

SEQ ID NO: 316478 - RNA, 19 nt, Homo sapiens
ggaccgagccaaugagcuu

SEQ ID NO: 316479 - RNA, 19 nt, Homo sapiens
ccaagugucccuaaagaug

SEQ ID NO: 316480 - RNA, 19 nt, Homo sapiens
gaaucacucucuccuucug

SEQ ID NO: 316481 - RNA, 19 nt, Homo sapiens
gcucugaaaugccaacaac

SEQ ID NO: 316482 - RNA, 19 nt, Homo sapiens
gcaccucaccugcgaagga

SEQ ID NO: 316483 - RNA, 19 nt, Homo sapiens
gcagaaugaguuugacuuc

SEQ ID NO: 316484 - RNA, 19 nt, Homo sapiens
gcccagagcccugcuauca

SEQ ID NO: 316485 - RNA, 19 nt, Homo sapiens
caucacuucccgccaauuu

SEQ ID NO: 316486 - RNA, 19 nt, Homo sapiens
gcccugcuaucaucgauuc

SEQ ID NO: 316487 - RNA, 19 nt, Homo sapiens
gaaugaguuugacuucacu

SEQ ID NO: 316488 - RNA, 19 nt, Homo sapiens
cagaaugaguuugacuuca

SEQ ID NO: 316489 - RNA, 19 nt, Homo sapiens
ucacuucccgccaauuuau

SEQ ID NO: 316490 - RNA, 19 nt, Homo sapiens
ugccaagugucccuaaaga

SEQ ID NO: 316491 - RNA, 19 nt, Homo sapiens
gcagaaucacucucuccuu

SEQ ID NO: 316492 - RNA, 19 nt, Homo sapiens
gaggaugccaaccaagaga

SEQ ID NO: 316493 - RNA, 19 nt, Homo sapiens
uaaagauggaggaauaaag

SEQ ID NO: 316494 - RNA, 19 nt, Homo sapiens
gaugaggaagugcugaugu

SEQ ID NO: 316495 - RNA, 19 nt, Homo sapiens
cgucgaggccugcacuuga

SEQ ID NO: 316496 - RNA, 19 nt, Homo sapiens
ggacccaguggaugaggaa

SEQ ID NO: 316497 - RNA, 19 nt, Homo sapiens
agaaugaguuugacuucac

SEQ ID NO: 316498 - RNA, 19 nt, Homo sapiens
cuaaagauggaggaauaaa

SEQ ID NO: 316499 - RNA, 19 nt, Homo sapiens
acuccaaccuugcggugaa

SEQ ID NO: 316500 - RNA, 19 nt, Homo sapiens
gccaauuuauccaacuucu

SEQ ID NO: 316501 - RNA, 19 nt, Homo sapiens
gagcccugcuaucaucgau

SEQ ID NO: 316502 - RNA, 19 nt, Homo sapiens
ggaggaugccaaccaagag

SEQ ID NO: 316503 - RNA, 19 nt, Homo sapiens
cgaaggaggaugccaacca

SEQ ID NO: 316504 - RNA, 19 nt, Homo sapiens
gucgaggccugcacuugau

SEQ ID NO: 316505 - RNA, 19 nt, Homo sapiens
caaccaccccucccacuaa

SEQ ID NO: 316506 - RNA, 19 nt, Homo sapiens
gggguagccucaaauggaa

SEQ ID NO: 316507 - RNA, 19 nt, Homo sapiens
ucgcaaagcaguggccauu

SEQ ID NO: 316508 - RNA, 19 nt, Homo sapiens
aaagauggaggaauaaagc

SEQ ID NO: 316509 - RNA, 19 nt, Homo sapiens
ccuaaagauggaggaauaa

SEQ ID NO: 316510 - RNA, 19 nt, Homo sapiens
cugcggacuuuccaucuag

SEQ ID NO: 316511 - RNA, 19 nt, Homo sapiens
ugccaaggcucugaaaugc

SEQ ID NO: 316512 - RNA, 19 nt, Homo sapiens
acugcggacuuuccaucua

SEQ ID NO: 316513 - RNA, 19 nt, Homo sapiens
ggcagaaugaguuugacuu

SEQ ID NO: 316514 - RNA, 19 nt, Homo sapiens
ggaugccaaccaagagaug

SEQ ID NO: 316515 - RNA, 19 nt, Homo sapiens
ccgccaauuuauccaacuu

SEQ ID NO: 316516 - RNA, 19 nt, Homo sapiens
cugccaaggcucugaaaug

SEQ ID NO: 316517 - RNA, 19 nt, Homo sapiens
caaagcaguggccauucug

SEQ ID NO: 316518 - RNA, 19 nt, Homo sapiens
ggagguaaaucaacauaua

SEQ ID NO: 316519 - RNA, 19 nt, Homo sapiens
gaauagagcuggaaauaag

SEQ ID NO: 316520 - RNA, 19 nt, Homo sapiens
gcuaaaagcugaaguaaua

SEQ ID NO: 316521 - RNA, 19 nt, Homo sapiens
gaagagaccuuaacuaugc

SEQ ID NO: 316522 - RNA, 19 nt, Homo sapiens
gauaagcuauugucuguaa

SEQ ID NO: 316523 - RNA, 19 nt, Homo sapiens
caaaugcccuuuacugaaa

SEQ ID NO: 316524 - RNA, 19 nt, Homo sapiens
uaagugaugugcugaauuu

SEQ ID NO: 316525 - RNA, 19 nt, Homo sapiens
gcagcaaacuuacaagauu

SEQ ID NO: 316526 - RNA, 19 nt, Homo sapiens
caaagaaucugcagagugu

SEQ ID NO: 316527 - RNA, 19 nt, Homo sapiens
gaagaaaggugucugugau

SEQ ID NO: 316528 - RNA, 19 nt, Homo sapiens
uugcagagcuugcuaauuu

SEQ ID NO: 316529 - RNA, 19 nt, Homo sapiens
gaagaugcagucaacauua

SEQ ID NO: 316530 - RNA, 19 nt, Homo sapiens
gaggagagauugaauuuag

SEQ ID NO: 316531 - RNA, 19 nt, Homo sapiens
ggacaaggaagaauuauau

SEQ ID NO: 316532 - RNA, 19 nt, Homo sapiens
gaucaguucuccaaucuug

SEQ ID NO: 316533 - RNA, 19 nt, Homo sapiens
ucacagcacucaccacuga

SEQ ID NO: 316534 - RNA, 19 nt, Homo sapiens
gaaaggacaaggaagaauu

SEQ ID NO: 316535 - RNA, 19 nt, Homo sapiens
gaaauaaggcauccaagga

SEQ ID NO: 316536 - RNA, 19 nt, Homo sapiens
gugcacaguuuggauauua

SEQ ID NO: 316537 - RNA, 19 nt, Homo sapiens
gagauugaauuuaguggaa

SEQ ID NO: 316538 - RNA, 19 nt, Homo sapiens
ggaaugaagguaauauuga

SEQ ID NO: 316539 - RNA, 19 nt, Homo sapiens
uguagaagaugcagaauug

SEQ ID NO: 316540 - RNA, 19 nt, Homo sapiens
ccagaagaaugguguuaaa

SEQ ID NO: 316541 - RNA, 19 nt, Homo sapiens
gcagaugaauagugcugua

SEQ ID NO: 316542 - RNA, 19 nt, Homo sapiens
gaagugcuaucuggaaaga

SEQ ID NO: 316543 - RNA, 19 nt, Homo sapiens
ggagaaugauugguauuug

SEQ ID NO: 316544 - RNA, 19 nt, Homo sapiens
ggaaagagagcaaggugaa

SEQ ID NO: 316545 - RNA, 19 nt, Homo sapiens
aaucagauaccaacuguua

SEQ ID NO: 316546 - RNA, 19 nt, Homo sapiens
ccaagaaguuucaaagaca

SEQ ID NO: 316547 - RNA, 19 nt, Homo sapiens
gaggcagacuuuacaagaa

SEQ ID NO: 316548 - RNA, 19 nt, Homo sapiens
agaaagcccuggaacuuga

SEQ ID NO: 316549 - RNA, 19 nt, Homo sapiens
ggagaaaggacaaggaaga

SEQ ID NO: 316550 - RNA, 19 nt, Homo sapiens
cccaugggcuaucaacuua

SEQ ID NO: 316551 - RNA, 19 nt, Homo sapiens
gagcaccuguuccauaugu

SEQ ID NO: 316552 - RNA, 19 nt, Homo sapiens
gaaacaacuuuagauaugg

SEQ ID NO: 316553 - RNA, 19 nt, Homo sapiens
ggcaaucucucucaguuug

SEQ ID NO: 316554 - RNA, 19 nt, Homo sapiens
cuaaugacguauacuuuga

SEQ ID NO: 316555 - RNA, 19 nt, Homo sapiens
cagcagaaguguccauugu

SEQ ID NO: 316556 - RNA, 19 nt, Homo sapiens
caacauauauucgacaaac

SEQ ID NO: 316557 - RNA, 19 nt, Homo sapiens
gaccuuaacuaugcuuuau

SEQ ID NO: 316558 - RNA, 19 nt, Homo sapiens
caauauuucuucaggcuau

SEQ ID NO: 316559 - RNA, 19 nt, Homo sapiens
uuacugaucuucguucuga

SEQ ID NO: 316560 - RNA, 19 nt, Homo sapiens
caaggagaaugauugguau

SEQ ID NO: 316561 - RNA, 19 nt, Homo sapiens
guaauggaaugaagguaau

SEQ ID NO: 316562 - RNA, 19 nt, Homo sapiens
gugaggagguuucgacaug

SEQ ID NO: 316563 - RNA, 19 nt, Homo sapiens
guagauauccagaagaaug

SEQ ID NO: 316564 - RNA, 19 nt, Homo sapiens
cagcaaacuuacaagauug

SEQ ID NO: 316565 - RNA, 19 nt, Homo sapiens
caagaaguuucaaagacaa

SEQ ID NO: 316566 - RNA, 19 nt, Homo sapiens
uuagaacucuuaucagaug

SEQ ID NO: 316567 - RNA, 19 nt, Homo sapiens
ugaauucccugauaaugau

SEQ ID NO: 316568 - RNA, 19 nt, Homo sapiens
caaagaggaggaauucuga

SEQ ID NO: 316569 - RNA, 19 nt, Homo sapiens
ggauuccagugcacaguuu

SEQ ID NO: 316570 - RNA, 19 nt, Homo sapiens
aaacugagacagauaauuc

SEQ ID NO: 316571 - RNA, 19 nt, Homo sapiens
gagaaugauugguauuugg

SEQ ID NO: 316572 - RNA, 19 nt, Homo sapiens
ccaaucagauaccaacugu

SEQ ID NO: 316573 - RNA, 19 nt, Homo sapiens
ccucaggucugcaaccaaa

SEQ ID NO: 316574 - RNA, 19 nt, Homo sapiens
aaaggacaaggaagaauua

SEQ ID NO: 316575 - RNA, 19 nt, Homo sapiens
aagaugcagucaacauuaa

SEQ ID NO: 316576 - RNA, 19 nt, Homo sapiens
aagacaagcagcaaacuua

SEQ ID NO: 316577 - RNA, 19 nt, Homo sapiens
gagaaucgcaaggauauga

SEQ ID NO: 316578 - RNA, 19 nt, Homo sapiens
ccagagaucuuggcuugga

SEQ ID NO: 316579 - RNA, 19 nt, Homo sapiens
aaccaugaauuccuuguaa

SEQ ID NO: 316580 - RNA, 19 nt, Homo sapiens
cauaggcaauaauaaguga

SEQ ID NO: 316581 - RNA, 19 nt, Homo sapiens
aaaggugucugugaucaaa

SEQ ID NO: 316582 - RNA, 19 nt, Homo sapiens
ugaauuuaguggaagcuuu

SEQ ID NO: 316583 - RNA, 19 nt, Homo sapiens
gccaguauaugaaauugga

SEQ ID NO: 316584 - RNA, 19 nt, Homo sapiens
ugaaacaaaugcccuuuac

SEQ ID NO: 316585 - RNA, 19 nt, Homo sapiens
gaauagaggagagauugaa

SEQ ID NO: 316586 - RNA, 19 nt, Homo sapiens
gaaucagguugcaguuuca

SEQ ID NO: 316587 - RNA, 19 nt, Homo sapiens
gacauucucuuugguaaca

SEQ ID NO: 316588 - RNA, 19 nt, Homo sapiens
gcagucaacauuaauaagu

SEQ ID NO: 316589 - RNA, 19 nt, Homo sapiens
aagaauagagcuggaaaua

SEQ ID NO: 316590 - RNA, 19 nt, Homo sapiens
cagcuuugcucacguguca

SEQ ID NO: 316591 - RNA, 19 nt, Homo sapiens
gaacagaauagaggagaga

SEQ ID NO: 316592 - RNA, 19 nt, Homo sapiens
gggaaacugagacagauaa

SEQ ID NO: 316593 - RNA, 19 nt, Homo sapiens
ggaccaaaggaauguguuu

SEQ ID NO: 316594 - RNA, 19 nt, Homo sapiens
gugaauucccugauaauga

SEQ ID NO: 316595 - RNA, 19 nt, Homo sapiens
cgaaggagacgcugcaguu

SEQ ID NO: 316596 - RNA, 19 nt, Homo sapiens
gaggacuguuugcaauuga

SEQ ID NO: 316597 - RNA, 19 nt, Homo sapiens
aaacaaaugcccuuuacug

SEQ ID NO: 316598 - RNA, 19 nt, Homo sapiens
gaaccaaugcagacacuca

SEQ ID NO: 316599 - RNA, 19 nt, Homo sapiens
uagaggagagauugaauuu

SEQ ID NO: 316600 - RNA, 19 nt, Homo sapiens
uugaggaguuucaguauau

SEQ ID NO: 316601 - RNA, 19 nt, Homo sapiens
acagcaaauugacuucuuu

SEQ ID NO: 316602 - RNA, 19 nt, Homo sapiens
gaugcagucaacauuaaua

SEQ ID NO: 316603 - RNA, 19 nt, Homo sapiens
gaaauuauuguuggcaguu

SEQ ID NO: 316604 - RNA, 19 nt, Homo sapiens
agaaucagguugcaguuuc

SEQ ID NO: 316605 - RNA, 19 nt, Homo sapiens
gaaacugagacagauaauu

SEQ ID NO: 316606 - RNA, 19 nt, Homo sapiens
ggaguuggguauguggauu

SEQ ID NO: 316607 - RNA, 19 nt, Homo sapiens
gaaucgcaaggauaugaua

SEQ ID NO: 316608 - RNA, 19 nt, Homo sapiens
ggaugccauuguuaaagaa

SEQ ID NO: 316609 - RNA, 19 nt, Homo sapiens
gacccuggcaaacagauua

SEQ ID NO: 316610 - RNA, 19 nt, Homo sapiens
gccaagaaguuucaaagac

SEQ ID NO: 316611 - RNA, 19 nt, Homo sapiens
ugccagaaauggagaauca

SEQ ID NO: 316612 - RNA, 19 nt, Homo sapiens
ugagacagauaauucaaag

SEQ ID NO: 316613 - RNA, 19 nt, Homo sapiens
uugauaagcuauugucugu

SEQ ID NO: 316614 - RNA, 19 nt, Homo sapiens
gaaagagagcaaggugaaa

SEQ ID NO: 316615 - RNA, 19 nt, Homo sapiens
aagaagugcuaucuggaaa

SEQ ID NO: 316616 - RNA, 19 nt, Homo sapiens
agagugugcuaaacagaaa

SEQ ID NO: 316617 - RNA, 19 nt, Homo sapiens
gcaaccaaagauucauuaa

SEQ ID NO: 316618 - RNA, 19 nt, Homo sapiens
ggaaagagcuccuacauaa

SEQ ID NO: 316619 - RNA, 19 nt, Homo sapiens
gaaagagacucaaguauuu

SEQ ID NO: 316620 - RNA, 19 nt, Homo sapiens
ggaauaaggucaugaaauu

SEQ ID NO: 316621 - RNA, 19 nt, Homo sapiens
gcacguagcuacagaaauu

SEQ ID NO: 316622 - RNA, 19 nt, Homo sapiens
caacagaaguucacucuuu

SEQ ID NO: 316623 - RNA, 19 nt, Homo sapiens
gaaagcagcucacaaguca

SEQ ID NO: 316624 - RNA, 19 nt, Homo sapiens
gaaauugacugcccuuuau

SEQ ID NO: 316625 - RNA, 19 nt, Homo sapiens
caucaaagguucucaaauu

SEQ ID NO: 316626 - RNA, 19 nt, Homo sapiens
ccaaauaacuagaggaauu

SEQ ID NO: 316627 - RNA, 19 nt, Homo sapiens
agacuucucuucuucauua

SEQ ID NO: 316628 - RNA, 19 nt, Homo sapiens
caaaauaacucuccaguaa

SEQ ID NO: 316629 - RNA, 19 nt, Homo sapiens
gcaggaaucuauccauuga

SEQ ID NO: 316630 - RNA, 19 nt, Homo sapiens
cccgagagcucaauauuua

SEQ ID NO: 316631 - RNA, 19 nt, Homo sapiens
ggacaggaguuuaugauag

SEQ ID NO: 316632 - RNA, 19 nt, Homo sapiens
ccauuuagaucacaacuuu

SEQ ID NO: 316633 - RNA, 19 nt, Homo sapiens
ugaacaagcugccaaaguu

SEQ ID NO: 316634 - RNA, 19 nt, Homo sapiens
gcaauaauaccugcuguua

SEQ ID NO: 316635 - RNA, 19 nt, Homo sapiens
gaaauugacagaagaaaga

SEQ ID NO: 316636 - RNA, 19 nt, Homo sapiens
ggaaauugacugcccuuua

SEQ ID NO: 316637 - RNA, 19 nt, Homo sapiens
gcaaggaguuauggauuaa

SEQ ID NO: 316638 - RNA, 19 nt, Homo sapiens
caaaagagcuggaaggauu

SEQ ID NO: 316639 - RNA, 19 nt, Homo sapiens
gaaaggauggauaacauuu

SEQ ID NO: 316640 - RNA, 19 nt, Homo sapiens
ugacugcccuuuauacaaa

SEQ ID NO: 316641 - RNA, 19 nt, Homo sapiens
gaauagacuuccacuuugu

SEQ ID NO: 316642 - RNA, 19 nt, Homo sapiens
gaagaaagcagcucacaag

SEQ ID NO: 316643 - RNA, 19 nt, Homo sapiens
cagaacaagucccugauuu

SEQ ID NO: 316644 - RNA, 19 nt, Homo sapiens
cagcagaaauaaucagaaa

SEQ ID NO: 316645 - RNA, 19 nt, Homo sapiens
gaacucugcuguaucuugu

SEQ ID NO: 316646 - RNA, 19 nt, Homo sapiens
ggaacaacauuaaggaauc

SEQ ID NO: 316647 - RNA, 19 nt, Homo sapiens
gauaaugacugauacuucu

SEQ ID NO: 316648 - RNA, 19 nt, Homo sapiens
gaugagauaaugacugaua

SEQ ID NO: 316649 - RNA, 19 nt, Homo sapiens
gagcaagacuccaucucaa

SEQ ID NO: 316650 - RNA, 19 nt, Homo sapiens
ggaauuaccacaugggauu

SEQ ID NO: 316651 - RNA, 19 nt, Homo sapiens
gaaggcacccugugauuga

SEQ ID NO: 316652 - RNA, 19 nt, Homo sapiens
gacaggaguuuaugauaga

SEQ ID NO: 316653 - RNA, 19 nt, Homo sapiens
gagcauuacuuaaagauac

SEQ ID NO: 316654 - RNA, 19 nt, Homo sapiens
guaaagaaaguccaacaaa

SEQ ID NO: 316655 - RNA, 19 nt, Homo sapiens
ugaauagacuuccacuuug

SEQ ID NO: 316656 - RNA, 19 nt, Homo sapiens
cagauuggcuccuauguuc

SEQ ID NO: 316657 - RNA, 19 nt, Homo sapiens
ggaugaugcuguaaauguu

SEQ ID NO: 316658 - RNA, 19 nt, Homo sapiens
gaaaacugcuuccaaauca

SEQ ID NO: 316659 - RNA, 19 nt, Homo sapiens
ucagagagaguaaugauaa

SEQ ID NO: 316660 - RNA, 19 nt, Homo sapiens
ggagauuacugcagaccaa

SEQ ID NO: 316661 - RNA, 19 nt, Homo sapiens
gaagugaucugggaauguc

SEQ ID NO: 316662 - RNA, 19 nt, Homo sapiens
gaaagagcuccuacauaaa

SEQ ID NO: 316663 - RNA, 19 nt, Homo sapiens
gauucgaaacgucaaauua

SEQ ID NO: 316664 - RNA, 19 nt, Homo sapiens
gaaucuauccauugaacua

SEQ ID NO: 316665 - RNA, 19 nt, Homo sapiens
cacaagaccugcagaagug

SEQ ID NO: 316666 - RNA, 19 nt, Homo sapiens
aaagaacucugcuguaucu

SEQ ID NO: 316667 - RNA, 19 nt, Homo sapiens
gaagaaagaagagaccauu

SEQ ID NO: 316668 - RNA, 19 nt, Homo sapiens
ggaguacauuuauggaaga

SEQ ID NO: 316669 - RNA, 19 nt, Homo sapiens
ucaaagaauucaacuugga

SEQ ID NO: 316670 - RNA, 19 nt, Homo sapiens
gaaugcaguuucuucugaa

SEQ ID NO: 316671 - RNA, 19 nt, Homo sapiens
gacaguaaguccaguaaag

SEQ ID NO: 316672 - RNA, 19 nt, Homo sapiens
gagcuggaaggauuaauaa

SEQ ID NO: 316673 - RNA, 19 nt, Homo sapiens
gaaauucaagguguuauug

SEQ ID NO: 316674 - RNA, 19 nt, Homo sapiens
guaaauugcccgacauaga

SEQ ID NO: 316675 - RNA, 19 nt, Homo sapiens
gaaggaauaaggucaugaa

SEQ ID NO: 316676 - RNA, 19 nt, Homo sapiens
gacuuccacuuuguaauua

SEQ ID NO: 316677 - RNA, 19 nt, Homo sapiens
aaauaacucuccaguaaca

SEQ ID NO: 316678 - RNA, 19 nt, Homo sapiens
ggacagaggaguucaacau

SEQ ID NO: 316679 - RNA, 19 nt, Homo sapiens
agaaagagacucaaguauu

SEQ ID NO: 316680 - RNA, 19 nt, Homo sapiens
aaagaaagagacucaagua

SEQ ID NO: 316681 - RNA, 19 nt, Homo sapiens
cuacagaaauugacagaag

SEQ ID NO: 316682 - RNA, 19 nt, Homo sapiens
gagaacaggaucaauaugu

SEQ ID NO: 316683 - RNA, 19 nt, Homo sapiens
auaaagaacucugcuguau

SEQ ID NO: 316684 - RNA, 19 nt, Homo sapiens
gucagaauuucaagcaaua

SEQ ID NO: 316685 - RNA, 19 nt, Homo sapiens
uagagaagccugugauuug

SEQ ID NO: 316686 - RNA, 19 nt, Homo sapiens
caagcuggaugaugcugua

SEQ ID NO: 316687 - RNA, 19 nt, Homo sapiens
gauauaaggugggaguugu

SEQ ID NO: 316688 - RNA, 19 nt, Homo sapiens
gaaagaagagaccauugga

SEQ ID NO: 316689 - RNA, 19 nt, Homo sapiens
ucaaguuucugucuuccua

SEQ ID NO: 316690 - RNA, 19 nt, Homo sapiens
gcacaagaccugcagaagu

SEQ ID NO: 316691 - RNA, 19 nt, Homo sapiens
ucagagaugugaaauccuu

SEQ ID NO: 316692 - RNA, 19 nt, Homo sapiens
gggagcagcuaguccuuga

SEQ ID NO: 316693 - RNA, 19 nt, Homo sapiens
gaacaagcugccaaaguug

SEQ ID NO: 316694 - RNA, 19 nt, Homo sapiens
ggacucugcuucucguuca

SEQ ID NO: 316695 - RNA, 19 nt, Homo sapiens
ggagagauuugcaguucug

SEQ ID NO: 316696 - RNA, 19 nt, Homo sapiens
gauuaaauguggcuaaacu

SEQ ID NO: 316697 - RNA, 19 nt, Homo sapiens
gcagaagaagcgacaauug

SEQ ID NO: 316698 - RNA, 19 nt, Homo sapiens
cagaccaacuguacaagaa

SEQ ID NO: 316699 - RNA, 19 nt, Homo sapiens
gggaaugucuggcaacucu

SEQ ID NO: 316700 - RNA, 19 nt, Homo sapiens
cauuaucacuccuugugua

SEQ ID NO: 316701 - RNA, 19 nt, Homo sapiens
gaacaacauuaaggaaucu

SEQ ID NO: 316702 - RNA, 19 nt, Homo sapiens
gagcacucaugauggaauu

SEQ ID NO: 316703 - RNA, 19 nt, Homo sapiens
gaccaaacauggguggaaa

SEQ ID NO: 316704 - RNA, 19 nt, Homo sapiens
aacugaaacugcagcauua

SEQ ID NO: 316705 - RNA, 19 nt, Homo sapiens
aaagaauucugcugcgauu

SEQ ID NO: 316706 - RNA, 19 nt, Homo sapiens
acacagacuucucuucuuc

SEQ ID NO: 316707 - RNA, 19 nt, Homo sapiens
uaucuuggaugaacuagga

SEQ ID NO: 316708 - RNA, 19 nt, Homo sapiens
ggaucaauaugucccaaau

SEQ ID NO: 316709 - RNA, 19 nt, Homo sapiens
gaaaguaaagaaaguccaa

SEQ ID NO: 316710 - RNA, 19 nt, Homo sapiens
ugacacagcagaaauaauc

SEQ ID NO: 316711 - RNA, 19 nt, Homo sapiens
gaugggugcugcagacaau

SEQ ID NO: 316712 - RNA, 19 nt, Homo sapiens
agcaaggaguuauggauua

SEQ ID NO: 316713 - RNA, 19 nt, Homo sapiens
augcuacacuugaguauuu

SEQ ID NO: 316714 - RNA, 19 nt, Homo sapiens
gacgagcacucaugaugga

SEQ ID NO: 316715 - RNA, 19 nt, Homo sapiens
aaaggacggaguacauuua

SEQ ID NO: 316716 - RNA, 19 nt, Homo sapiens
gaucaauaugucccaaaua

SEQ ID NO: 316717 - RNA, 19 nt, Homo sapiens
gaccaacuguacaagaaga

SEQ ID NO: 316718 - RNA, 19 nt, Homo sapiens
gcagugaggucuaacauaa

SEQ ID NO: 316719 - RNA, 19 nt, Homo sapiens
ggaaugauaucacaacuug

SEQ ID NO: 316720 - RNA, 19 nt, Homo sapiens
ugacaaaucgcucauauua

SEQ ID NO: 316721 - RNA, 19 nt, Homo sapiens
uaaguaaccucaagaagaa

SEQ ID NO: 316722 - RNA, 19 nt, Homo sapiens
acacagagauuguagauga

SEQ ID NO: 316723 - RNA, 19 nt, Homo sapiens
ggaagaagguauuggcauu

SEQ ID NO: 316724 - RNA, 19 nt, Homo sapiens
gcucaugccugcacucuuu

SEQ ID NO: 316725 - RNA, 19 nt, Homo sapiens
ugacauagcaggaaugaua

SEQ ID NO: 316726 - RNA, 19 nt, Homo sapiens
aaacauaccuuggaacuug

SEQ ID NO: 316727 - RNA, 19 nt, Homo sapiens
caaaagagcuuaugcagaa

SEQ ID NO: 316728 - RNA, 19 nt, Homo sapiens
caaggaaccuagaauuuau

SEQ ID NO: 316729 - RNA, 19 nt, Homo sapiens
caagagguuuggaaucaua

SEQ ID NO: 316730 - RNA, 19 nt, Homo sapiens
gaucauaacuggaccaaac

SEQ ID NO: 316731 - RNA, 19 nt, Homo sapiens
ggacuucaaucaguuauau

SEQ ID NO: 316732 - RNA, 19 nt, Homo sapiens
ggucaaugcugcugaauca

SEQ ID NO: 316733 - RNA, 19 nt, Homo sapiens
cgacuucguucuaauauau

SEQ ID NO: 316734 - RNA, 19 nt, Homo sapiens
ggaaaucacaacucaaauu

SEQ ID NO: 316735 - RNA, 19 nt, Homo sapiens
caacuuccuucagaauuua

SEQ ID NO: 316736 - RNA, 19 nt, Homo sapiens
ggacaagucuuagcucugu

SEQ ID NO: 316737 - RNA, 19 nt, Homo sapiens
gaaaggaugccuaaacaug

SEQ ID NO: 316738 - RNA, 19 nt, Homo sapiens
caaaggaaauacuucaaug

SEQ ID NO: 316739 - RNA, 19 nt, Homo sapiens
gacaagagguuuggaauca

SEQ ID NO: 316740 - RNA, 19 nt, Homo sapiens
ccagacaguuuacgaauau

SEQ ID NO: 316741 - RNA, 19 nt, Homo sapiens
agagaaaucuaucacauga

SEQ ID NO: 316742 - RNA, 19 nt, Homo sapiens
gaacauacacagagauugu

SEQ ID NO: 316743 - RNA, 19 nt, Homo sapiens
ccucagagaucagguuaua

SEQ ID NO: 316744 - RNA, 19 nt, Homo sapiens
ucaaggaaccuagaauuua

SEQ ID NO: 316745 - RNA, 19 nt, Homo sapiens
cgaccagaauuuacugaua

SEQ ID NO: 316746 - RNA, 19 nt, Homo sapiens
ggugaucacuaaacuuaaa

SEQ ID NO: 316747 - RNA, 19 nt, Homo sapiens
gaaauaggaauggcaagua

SEQ ID NO: 316748 - RNA, 19 nt, Homo sapiens
ccaaggaaaucacaacuca

SEQ ID NO: 316749 - RNA, 19 nt, Homo sapiens
gcagaggugucaucacuuc

SEQ ID NO: 316750 - RNA, 19 nt, Homo sapiens
gcgcuuagauuguguucaa

SEQ ID NO: 316751 - RNA, 19 nt, Homo sapiens
gaacuuggcagagguacua

SEQ ID NO: 316752 - RNA, 19 nt, Homo sapiens
gaacagacagccaugauag

SEQ ID NO: 316753 - RNA, 19 nt, Homo sapiens
uauuguagcuguuguagaa

SEQ ID NO: 316754 - RNA, 19 nt, Homo sapiens
gaauaucuacugagcuuaa

SEQ ID NO: 316755 - RNA, 19 nt, Homo sapiens
ucaacuuccuucagaauuu

SEQ ID NO: 316756 - RNA, 19 nt, Homo sapiens
cgaaacaaauucaucaaca

SEQ ID NO: 316757 - RNA, 19 nt, Homo sapiens
gcucgaaacucucaauugg

SEQ ID NO: 316758 - RNA, 19 nt, Homo sapiens
gcucaagguucauacuuug

SEQ ID NO: 316759 - RNA, 19 nt, Homo sapiens
aaacacaguugcaucaaau

SEQ ID NO: 316760 - RNA, 19 nt, Homo sapiens
caacucaaauuacgagaca

SEQ ID NO: 316761 - RNA, 19 nt, Homo sapiens
cagauuggaucauauguuc

SEQ ID NO: 316762 - RNA, 19 nt, Homo sapiens
gaacuguaacacaccuuua

SEQ ID NO: 316763 - RNA, 19 nt, Homo sapiens
gaacuuguggauccuuuaa

SEQ ID NO: 316764 - RNA, 19 nt, Homo sapiens
augcaaaggugaucacuaa

SEQ ID NO: 316765 - RNA, 19 nt, Homo sapiens
gugaauaucuacugagcuu

SEQ ID NO: 316766 - RNA, 19 nt, Homo sapiens
gauuguagaugacauagca

SEQ ID NO: 316767 - RNA, 19 nt, Homo sapiens
ccacuaggcuuguucaaac

SEQ ID NO: 316768 - RNA, 19 nt, Homo sapiens
gaauuaguacugaugauga

SEQ ID NO: 316769 - RNA, 19 nt, Homo sapiens
gaccaaacaugaguggaaa

SEQ ID NO: 316770 - RNA, 19 nt, Homo sapiens
guauagcccuaccuaguga

SEQ ID NO: 316771 - RNA, 19 nt, Homo sapiens
agaguacauugaacaguua

SEQ ID NO: 316772 - RNA, 19 nt, Homo sapiens
ccaaaaccuugaauuguua

SEQ ID NO: 316773 - RNA, 19 nt, Homo sapiens
uagaguacauugaacaguu

SEQ ID NO: 316774 - RNA, 19 nt, Homo sapiens
gagaacuacuuaaaggaau

SEQ ID NO: 316775 - RNA, 19 nt, Homo sapiens
caucacaauugucaucuau

SEQ ID NO: 316776 - RNA, 19 nt, Homo sapiens
cuaagggacucacagaaga

SEQ ID NO: 316777 - RNA, 19 nt, Homo sapiens
guaaagaauaccucaagaa

SEQ ID NO: 316778 - RNA, 19 nt, Homo sapiens
aaugaaagaugccaagaau

SEQ ID NO: 316779 - RNA, 19 nt, Homo sapiens
gugaucaacuuccuucaga

SEQ ID NO: 316780 - RNA, 19 nt, Homo sapiens
gagcagcuucuuucuguuu

SEQ ID NO: 316781 - RNA, 19 nt, Homo sapiens
ucaagaagaaguacaaaga

SEQ ID NO: 316782 - RNA, 19 nt, Homo sapiens
gaagaagguauuggcauuu

SEQ ID NO: 316783 - RNA, 19 nt, Homo sapiens
gaccagaauuuacugauac

SEQ ID NO: 316784 - RNA, 19 nt, Homo sapiens
gcaaacugcuuagugagau

SEQ ID NO: 316785 - RNA, 19 nt, Homo sapiens
gaaugaaagaugccaagaa

SEQ ID NO: 316786 - RNA, 19 nt, Homo sapiens
ccagaugacuacagauugu

SEQ ID NO: 316787 - RNA, 19 nt, Homo sapiens
ggaauaaucacacucucuu

SEQ ID NO: 316788 - RNA, 19 nt, Homo sapiens
ucacuacuauccaaaggaa

SEQ ID NO: 316789 - RNA, 19 nt, Homo sapiens
gcagacaacacaacauaug

SEQ ID NO: 316790 - RNA, 19 nt, Homo sapiens
gaauggcaaguauugauuu

SEQ ID NO: 316791 - RNA, 19 nt, Homo sapiens
gaagaaguacaaagaagau

SEQ ID NO: 316792 - RNA, 19 nt, Homo sapiens
ggaccaaacaugaguggaa

SEQ ID NO: 316793 - RNA, 19 nt, Homo sapiens
gaagacaagagguuuggaa

SEQ ID NO: 316794 - RNA, 19 nt, Homo sapiens
gcugcugaaucaaagauaa

SEQ ID NO: 316795 - RNA, 19 nt, Homo sapiens
gagguucaguccaaguauu

SEQ ID NO: 316796 - RNA, 19 nt, Homo sapiens
ggaauggcaaguauugauu

SEQ ID NO: 316797 - RNA, 19 nt, Homo sapiens
gcauuuacacuguuugcua

SEQ ID NO: 316798 - RNA, 19 nt, Homo sapiens
guuaugcuguuugugaaua

SEQ ID NO: 316799 - RNA, 19 nt, Homo sapiens
caauaccuauguuacagaa

SEQ ID NO: 316800 - RNA, 19 nt, Homo sapiens
gauaugcuacugucauuug

SEQ ID NO: 316801 - RNA, 19 nt, Homo sapiens
agacagccaugauagauuc

SEQ ID NO: 316802 - RNA, 19 nt, Homo sapiens
ggaauuccaccaaguuguu

SEQ ID NO: 316803 - RNA, 19 nt, Homo sapiens
caaaggugaucacuaaacu

SEQ ID NO: 316804 - RNA, 19 nt, Homo sapiens
caagaagaaguacaaagaa

SEQ ID NO: 316805 - RNA, 19 nt, Homo sapiens
uaaaacagauugcucuuug

SEQ ID NO: 316806 - RNA, 19 nt, Homo sapiens
gcuaugcagugaggucuaa

SEQ ID NO: 316807 - RNA, 19 nt, Homo sapiens
aaauaggaauggcaaguau

SEQ ID NO: 316808 - RNA, 19 nt, Homo sapiens
ucaauuggauccagacagu

SEQ ID NO: 316809 - RNA, 19 nt, Homo sapiens
ugagagaaaucuaucacau

SEQ ID NO: 316810 - RNA, 19 nt, Homo sapiens
caagaacuacuucaagaug

SEQ ID NO: 316811 - RNA, 19 nt, Homo sapiens
aaggugaucacuaaacuua

SEQ ID NO: 316812 - RNA, 19 nt, Homo sapiens
caacacaacauaugcaaag

SEQ ID NO: 316813 - RNA, 19 nt, Homo sapiens
caagugggauauucagcuu

SEQ ID NO: 316814 - RNA, 19 nt, Homo sapiens
cagaaaagacugaagaaua

SEQ ID NO: 316815 - RNA, 19 nt, Homo sapiens
uuaaguaaccucaagaaga

SEQ ID NO: 316816 - RNA, 19 nt, Homo sapiens
gguauuggcauuuguuaug

SEQ ID NO: 316817 - RNA, 19 nt, Homo sapiens
gaagguauuggcauuuguu

SEQ ID NO: 316818 - RNA, 19 nt, Homo sapiens
caacauagauccugaaauu

SEQ ID NO: 316819 - RNA, 19 nt, Homo sapiens
gaacauagaucaagacacu

SEQ ID NO: 316820 - RNA, 19 nt, Homo sapiens
gcaaggagcuggagaaucu

SEQ ID NO: 316821 - RNA, 19 nt, Homo sapiens
gcccagagcuucuuccuuu

SEQ ID NO: 316822 - RNA, 19 nt, Homo sapiens
gaagaagacauguuuauug

SEQ ID NO: 316823 - RNA, 19 nt, Homo sapiens
ccaaggagcuggaugcauu

SEQ ID NO: 316824 - RNA, 19 nt, Homo sapiens
gcaacgaucuugucuucuu

SEQ ID NO: 316825 - RNA, 19 nt, Homo sapiens
ggacuggacuucauguuuc

SEQ ID NO: 316826 - RNA, 19 nt, Homo sapiens
ggacuucccaguuuccuua

SEQ ID NO: 316827 - RNA, 19 nt, Homo sapiens
gaauaugacucgauuucug

SEQ ID NO: 316828 - RNA, 19 nt, Homo sapiens
aaacuguccuucagccuua

SEQ ID NO: 316829 - RNA, 19 nt, Homo sapiens
ccagugacuuugagauuaa

SEQ ID NO: 316830 - RNA, 19 nt, Homo sapiens
guucagacauguuggugua

SEQ ID NO: 316831 - RNA, 19 nt, Homo sapiens
gccagugacuuugagauua

SEQ ID NO: 316832 - RNA, 19 nt, Homo sapiens
uaacagauuuacacucaga

SEQ ID NO: 316833 - RNA, 19 nt, Homo sapiens
gaaacuggauuuggaagau

SEQ ID NO: 316834 - RNA, 19 nt, Homo sapiens
ucaaggauuugcuaaagaa

SEQ ID NO: 316835 - RNA, 19 nt, Homo sapiens
ggacauugcccaagaguuc

SEQ ID NO: 316836 - RNA, 19 nt, Homo sapiens
gaucuugucuucuucuauc

SEQ ID NO: 316837 - RNA, 19 nt, Homo sapiens
gaagggagcagaacuugug

SEQ ID NO: 316838 - RNA, 19 nt, Homo sapiens
cugauuggcuuccuucuuu

SEQ ID NO: 316839 - RNA, 19 nt, Homo sapiens
ggaagaagacauguuuauu

SEQ ID NO: 316840 - RNA, 19 nt, Homo sapiens
ggguugaacuggaagacua

SEQ ID NO: 316841 - RNA, 19 nt, Homo sapiens
ccaaacaggaugagaauau

SEQ ID NO: 316842 - RNA, 19 nt, Homo sapiens
ucuaacagauuuacacuca

SEQ ID NO: 316843 - RNA, 19 nt, Homo sapiens
gacauuaguggauaaguuu

SEQ ID NO: 316844 - RNA, 19 nt, Homo sapiens
gagaauaugacucgauuuc

SEQ ID NO: 316845 - RNA, 19 nt, Homo sapiens
gaagagcauauaccucaaa

SEQ ID NO: 316846 - RNA, 19 nt, Homo sapiens
uuucuuaacucaacagcua

SEQ ID NO: 316847 - RNA, 19 nt, Homo sapiens
gauggucucucuucucaag

SEQ ID NO: 316848 - RNA, 19 nt, Homo sapiens
agacauuaguggauaaguu

SEQ ID NO: 316849 - RNA, 19 nt, Homo sapiens
cgaaagcagugaacaaugc

SEQ ID NO: 316850 - RNA, 19 nt, Homo sapiens
gguagaggccagugacuuu

SEQ ID NO: 316851 - RNA, 19 nt, Homo sapiens
gaacuggaagacuauaaug

SEQ ID NO: 316852 - RNA, 19 nt, Homo sapiens
caaacaggaugagaauaug

SEQ ID NO: 316853 - RNA, 19 nt, Homo sapiens
ggcacgagcagcugucuua

SEQ ID NO: 316854 - RNA, 19 nt, Homo sapiens
gcaaacaacgccuccuuuc

SEQ ID NO: 316855 - RNA, 19 nt, Homo sapiens
aggagacgcugcugaugua

SEQ ID NO: 316856 - RNA, 19 nt, Homo sapiens
ugacucaucuggugaacau

SEQ ID NO: 316857 - RNA, 19 nt, Homo sapiens
gggaagaagacauguuuau

SEQ ID NO: 316858 - RNA, 19 nt, Homo sapiens
ccaggauacuucaugagaa

SEQ ID NO: 316859 - RNA, 19 nt, Homo sapiens
uaaagaagaaccaaaugga

SEQ ID NO: 316860 - RNA, 19 nt, Homo sapiens
ggaagagcauauaccucaa

SEQ ID NO: 316861 - RNA, 19 nt, Homo sapiens
ggacaaagggagggucaaa

SEQ ID NO: 316862 - RNA, 19 nt, Homo sapiens
gagaagcugcacuaucgua

SEQ ID NO: 316863 - RNA, 19 nt, Homo sapiens
acauagauccugaaauuga

SEQ ID NO: 316864 - RNA, 19 nt, Homo sapiens
cugaugaccugcaccauau

SEQ ID NO: 316865 - RNA, 19 nt, Homo sapiens
gguccuuauugaugaauuu

SEQ ID NO: 316866 - RNA, 19 nt, Homo sapiens
aaucuggacucccguauuc

SEQ ID NO: 316867 - RNA, 19 nt, Homo sapiens
gaacgaaccccuucagaga

SEQ ID NO: 316868 - RNA, 19 nt, Homo sapiens
ggaagacucccggauucua

SEQ ID NO: 316869 - RNA, 19 nt, Homo sapiens
guaggaagacucccggauu

SEQ ID NO: 316870 - RNA, 19 nt, Homo sapiens
cacagucgcugguccuuau

SEQ ID NO: 316871 - RNA, 19 nt, Homo sapiens
ugucuuaacccgaguauug

SEQ ID NO: 316872 - RNA, 19 nt, Homo sapiens
uuacaguguucuacagauu

SEQ ID NO: 316873 - RNA, 19 nt, Homo sapiens
acauagaucaagacacuua

SEQ ID NO: 316874 - RNA, 19 nt, Homo sapiens
gcaccacccaggauucaaa

SEQ ID NO: 316875 - RNA, 19 nt, Homo sapiens
uggcaacgaucuugucuuc

SEQ ID NO: 316876 - RNA, 19 nt, Homo sapiens
gcacagagagccuaaaaga

SEQ ID NO: 316877 - RNA, 19 nt, Homo sapiens
uaggaagacucccggauuc

SEQ ID NO: 316878 - RNA, 19 nt, Homo sapiens
gguagugagucaaugaagu

SEQ ID NO: 316879 - RNA, 19 nt, Homo sapiens
caacgaucuugucuucuuc

SEQ ID NO: 316880 - RNA, 19 nt, Homo sapiens
gcacagucgcugguccuua

SEQ ID NO: 316881 - RNA, 19 nt, Homo sapiens
gagcauauaccucaaacag

SEQ ID NO: 316882 - RNA, 19 nt, Homo sapiens
aaacaacgccuccuuucug

SEQ ID NO: 316883 - RNA, 19 nt, Homo sapiens
guagugagucaaugaaguu

SEQ ID NO: 316884 - RNA, 19 nt, Homo sapiens
acauguugguguaaaguuu

SEQ ID NO: 316885 - RNA, 19 nt, Homo sapiens
gccaugcccucuuuguuuc

SEQ ID NO: 316886 - RNA, 19 nt, Homo sapiens
aaccuggacuugaacguuu

SEQ ID NO: 316887 - RNA, 19 nt, Homo sapiens
uuaugaaacuggauuugga

SEQ ID NO: 316888 - RNA, 19 nt, Homo sapiens
gucaaggauuugcuaaaga

SEQ ID NO: 316889 - RNA, 19 nt, Homo sapiens
ucacacguccgacucauga

SEQ ID NO: 316890 - RNA, 19 nt, Homo sapiens
gagaagcugcucaggcuau

SEQ ID NO: 316891 - RNA, 19 nt, Homo sapiens
caacgccuccuuucuggaa

SEQ ID NO: 316892 - RNA, 19 nt, Homo sapiens
uggcagaggcagagacaua

SEQ ID NO: 316893 - RNA, 19 nt, Homo sapiens
aagaagaaccaaauggaaa

SEQ ID NO: 316894 - RNA, 19 nt, Homo sapiens
cauagauccugaaauugau

SEQ ID NO: 316895 - RNA, 19 nt, Homo sapiens
uuggagggcugcugaaguu

SEQ ID NO: 316896 - RNA, 19 nt, Homo sapiens
gaaccugcccugccucagu

SEQ ID NO: 316897 - RNA, 19 nt, Homo sapiens
aaagaagaaccaaauggaa

SEQ ID NO: 316898 - RNA, 19 nt, Homo sapiens
gacgccaucuucacacgaa

SEQ ID NO: 316899 - RNA, 19 nt, Homo sapiens
ucagacauguugguguaaa

SEQ ID NO: 316900 - RNA, 19 nt, Homo sapiens
ccaccagcauccucugaga

SEQ ID NO: 316901 - RNA, 19 nt, Homo sapiens
gccagacauuaguggauaa

SEQ ID NO: 316902 - RNA, 19 nt, Homo sapiens
cagguaggcuugaucacau

SEQ ID NO: 316903 - RNA, 19 nt, Homo sapiens
ccgccugccuuccauggua

SEQ ID NO: 316904 - RNA, 19 nt, Homo sapiens
gauccuaaccuggacuuga

SEQ ID NO: 316905 - RNA, 19 nt, Homo sapiens
caucagggaagagcauaua

SEQ ID NO: 316906 - RNA, 19 nt, Homo sapiens
gaaccuuugugcccaacuc

SEQ ID NO: 316907 - RNA, 19 nt, Homo sapiens
aggagaagcugcacuaucg

SEQ ID NO: 316908 - RNA, 19 nt, Homo sapiens
ggacucccguauuccuuca

SEQ ID NO: 316909 - RNA, 19 nt, Homo sapiens
ugacuccacuauccacuuc

SEQ ID NO: 316910 - RNA, 19 nt, Homo sapiens
gaaucuggacucccguauu

SEQ ID NO: 316911 - RNA, 19 nt, Homo sapiens
ccauaucgccagccucauu

SEQ ID NO: 316912 - RNA, 19 nt, Homo sapiens
aaccugcccugccucagua

SEQ ID NO: 316913 - RNA, 19 nt, Homo sapiens
ugccagacauuaguggaua

SEQ ID NO: 316914 - RNA, 19 nt, Homo sapiens
aggauuugcuaaagaagaa

SEQ ID NO: 316915 - RNA, 19 nt, Homo sapiens
guuccugggucgaagaaga

SEQ ID NO: 316916 - RNA, 19 nt, Homo sapiens
cuuccucucuuccauuauu

SEQ ID NO: 316917 - RNA, 19 nt, Homo sapiens
ugaaacugcuccagaaagc

SEQ ID NO: 316918 - RNA, 19 nt, Homo sapiens
caacauagauccugaaauu

SEQ ID NO: 316919 - RNA, 19 nt, Homo sapiens
gaacauagaucaagacacu

SEQ ID NO: 316920 - RNA, 19 nt, Homo sapiens
gcaaggagcuggagaaucu

SEQ ID NO: 316921 - RNA, 19 nt, Homo sapiens
gcccagagcuucuuccuuu

SEQ ID NO: 316922 - RNA, 19 nt, Homo sapiens
gaagaagacauguuuauug

SEQ ID NO: 316923 - RNA, 19 nt, Homo sapiens
ccaaggagcuggaugcauu

SEQ ID NO: 316924 - RNA, 19 nt, Homo sapiens
gcaacgaucuugucuucuu

SEQ ID NO: 316925 - RNA, 19 nt, Homo sapiens
ggacuggacuucauguuuc

SEQ ID NO: 316926 - RNA, 19 nt, Homo sapiens
ggacuucccaguuuccuua

SEQ ID NO: 316927 - RNA, 19 nt, Homo sapiens
gaauaugacucgauuucug

SEQ ID NO: 316928 - RNA, 19 nt, Homo sapiens
aaacuguccuucagccuua

SEQ ID NO: 316929 - RNA, 19 nt, Homo sapiens
ccaggagauuuaagauuua

SEQ ID NO: 316930 - RNA, 19 nt, Homo sapiens
ccagugacuuugagauuaa

SEQ ID NO: 316931 - RNA, 19 nt, Homo sapiens
guucagacauguuggugua

SEQ ID NO: 316932 - RNA, 19 nt, Homo sapiens
gccagugacuuugagauua

SEQ ID NO: 316933 - RNA, 19 nt, Homo sapiens
uaacagauuuacacucaga

SEQ ID NO: 316934 - RNA, 19 nt, Homo sapiens
gaaacuggauuuggaagau

SEQ ID NO: 316935 - RNA, 19 nt, Homo sapiens
ucaaggauuugcuaaagaa

SEQ ID NO: 316936 - RNA, 19 nt, Homo sapiens
cccaggagauuuaagauuu

SEQ ID NO: 316937 - RNA, 19 nt, Homo sapiens
ggacauugcccaagaguuc

SEQ ID NO: 316938 - RNA, 19 nt, Homo sapiens
gaucuugucuucuucuauc

SEQ ID NO: 316939 - RNA, 19 nt, Homo sapiens
gaagggagcagaacuugug

SEQ ID NO: 316940 - RNA, 19 nt, Homo sapiens
cugauuggcuuccuucuuu

SEQ ID NO: 316941 - RNA, 19 nt, Homo sapiens
ggaagaagacauguuuauu

SEQ ID NO: 316942 - RNA, 19 nt, Homo sapiens
ggguugaacuggaagacua

SEQ ID NO: 316943 - RNA, 19 nt, Homo sapiens
ccaaacaggaugagaauau

SEQ ID NO: 316944 - RNA, 19 nt, Homo sapiens
ucuaacagauuuacacuca

SEQ ID NO: 316945 - RNA, 19 nt, Homo sapiens
gacauuaguggauaaguuu

SEQ ID NO: 316946 - RNA, 19 nt, Homo sapiens
gagaauaugacucgauuuc

SEQ ID NO: 316947 - RNA, 19 nt, Homo sapiens
gaagagcauauaccucaaa

SEQ ID NO: 316948 - RNA, 19 nt, Homo sapiens
uuucuuaacucaacagcua

SEQ ID NO: 316949 - RNA, 19 nt, Homo sapiens
gauggucucucuucucaag

SEQ ID NO: 316950 - RNA, 19 nt, Homo sapiens
agacauuaguggauaaguu

SEQ ID NO: 316951 - RNA, 19 nt, Homo sapiens
cgaaagcagugaacaaugc

SEQ ID NO: 316952 - RNA, 19 nt, Homo sapiens
gguagaggccagugacuuu

SEQ ID NO: 316953 - RNA, 19 nt, Homo sapiens
gaacuggaagacuauaaug

SEQ ID NO: 316954 - RNA, 19 nt, Homo sapiens
caaacaggaugagaauaug

SEQ ID NO: 316955 - RNA, 19 nt, Homo sapiens
ggcacgagcagcugucuua

SEQ ID NO: 316956 - RNA, 19 nt, Homo sapiens
gcaaacaacgccuccuuuc

SEQ ID NO: 316957 - RNA, 19 nt, Homo sapiens
aggagacgcugcugaugua

SEQ ID NO: 316958 - RNA, 19 nt, Homo sapiens
ugacucaucuggugaacau

SEQ ID NO: 316959 - RNA, 19 nt, Homo sapiens
gggaagaagacauguuuau

SEQ ID NO: 316960 - RNA, 19 nt, Homo sapiens
ccaggauacuucaugagaa

SEQ ID NO: 316961 - RNA, 19 nt, Homo sapiens
uaaagaagaaccaaaugga

SEQ ID NO: 316962 - RNA, 19 nt, Homo sapiens
ggaagagcauauaccucaa

SEQ ID NO: 316963 - RNA, 19 nt, Homo sapiens
ggacaaagggagggucaaa

SEQ ID NO: 316964 - RNA, 19 nt, Homo sapiens
gagaagcugcacuaucgua

SEQ ID NO: 316965 - RNA, 19 nt, Homo sapiens
acauagauccugaaauuga

SEQ ID NO: 316966 - RNA, 19 nt, Homo sapiens
cugaugaccugcaccauau

SEQ ID NO: 316967 - RNA, 19 nt, Homo sapiens
gguccuuauugaugaauuu

SEQ ID NO: 316968 - RNA, 19 nt, Homo sapiens
aaucuggacucccguauuc

SEQ ID NO: 316969 - RNA, 19 nt, Homo sapiens
gaacgaaccccuucagaga

SEQ ID NO: 316970 - RNA, 19 nt, Homo sapiens
ggaagacucccggauucua

SEQ ID NO: 316971 - RNA, 19 nt, Homo sapiens
guaggaagacucccggauu

SEQ ID NO: 316972 - RNA, 19 nt, Homo sapiens
cacagucgcugguccuuau

SEQ ID NO: 316973 - RNA, 19 nt, Homo sapiens
ugucuuaacccgaguauug

SEQ ID NO: 316974 - RNA, 19 nt, Homo sapiens
uuacaguguucuacagauu

SEQ ID NO: 316975 - RNA, 19 nt, Homo sapiens
acauagaucaagacacuua

SEQ ID NO: 316976 - RNA, 19 nt, Homo sapiens
gcaccacccaggauucaaa

SEQ ID NO: 316977 - RNA, 19 nt, Homo sapiens
uggcaacgaucuugucuuc

SEQ ID NO: 316978 - RNA, 19 nt, Homo sapiens
gcacagagagccuaaaaga

SEQ ID NO: 316979 - RNA, 19 nt, Homo sapiens
uaggaagacucccggauuc

SEQ ID NO: 316980 - RNA, 19 nt, Homo sapiens
gguagugagucaaugaagu

SEQ ID NO: 316981 - RNA, 19 nt, Homo sapiens
caacgaucuugucuucuuc

SEQ ID NO: 316982 - RNA, 19 nt, Homo sapiens
gcacagucgcugguccuua

SEQ ID NO: 316983 - RNA, 19 nt, Homo sapiens
gagcauauaccucaaacag

SEQ ID NO: 316984 - RNA, 19 nt, Homo sapiens
aaacaacgccuccuuucug

SEQ ID NO: 316985 - RNA, 19 nt, Homo sapiens
guagugagucaaugaaguu

SEQ ID NO: 316986 - RNA, 19 nt, Homo sapiens
acauguugguguaaaguuu

SEQ ID NO: 316987 - RNA, 19 nt, Homo sapiens
gccaugcccucuuuguuuc

SEQ ID NO: 316988 - RNA, 19 nt, Homo sapiens
aaccuggacuugaacguuu

SEQ ID NO: 316989 - RNA, 19 nt, Homo sapiens
uuaugaaacuggauuugga

SEQ ID NO: 316990 - RNA, 19 nt, Homo sapiens
gucaaggauuugcuaaaga

SEQ ID NO: 316991 - RNA, 19 nt, Homo sapiens
ucacacguccgacucauga

SEQ ID NO: 316992 - RNA, 19 nt, Homo sapiens
gagaagcugcucaggcuau

SEQ ID NO: 316993 - RNA, 19 nt, Homo sapiens
caacgccuccuuucuggaa

SEQ ID NO: 316994 - RNA, 19 nt, Homo sapiens
aagaagaaccaaauggaaa

SEQ ID NO: 316995 - RNA, 19 nt, Homo sapiens
cauagauccugaaauugau

SEQ ID NO: 316996 - RNA, 19 nt, Homo sapiens
uuggagggcugcugaaguu

SEQ ID NO: 316997 - RNA, 19 nt, Homo sapiens
gaaccugcccugccucagu

SEQ ID NO: 316998 - RNA, 19 nt, Homo sapiens
aaagaagaaccaaauggaa

SEQ ID NO: 316999 - RNA, 19 nt, Homo sapiens
gacgccaucuucacacgaa

SEQ ID NO: 317000 - RNA, 19 nt, Homo sapiens
ucagacauguugguguaaa

SEQ ID NO: 317001 - RNA, 19 nt, Homo sapiens
ccaccagcauccucugaga

SEQ ID NO: 317002 - RNA, 19 nt, Homo sapiens
gccagacauuaguggauaa

SEQ ID NO: 317003 - RNA, 19 nt, Homo sapiens
cagguaggcuugaucacau

SEQ ID NO: 317004 - RNA, 19 nt, Homo sapiens
ccgccugccuuccauggua

SEQ ID NO: 317005 - RNA, 19 nt, Homo sapiens
gauccuaaccuggacuuga

SEQ ID NO: 317006 - RNA, 19 nt, Homo sapiens
caucagggaagagcauaua

SEQ ID NO: 317007 - RNA, 19 nt, Homo sapiens
gaaccuuugugcccaacuc

SEQ ID NO: 317008 - RNA, 19 nt, Homo sapiens
aggagaagcugcacuaucg

SEQ ID NO: 317009 - RNA, 19 nt, Homo sapiens
ggacucccguauuccuuca

SEQ ID NO: 317010 - RNA, 19 nt, Homo sapiens
gaaucuggacucccguauu

SEQ ID NO: 317011 - RNA, 19 nt, Homo sapiens
ccauaucgccagccucauu

SEQ ID NO: 317012 - RNA, 19 nt, Homo sapiens
ugacuccacuauccacuuc

SEQ ID NO: 317013 - RNA, 19 nt, Homo sapiens
aaccugcccugccucagua

SEQ ID NO: 317014 - RNA, 19 nt, Homo sapiens
ugccagacauuaguggaua

SEQ ID NO: 317015 - RNA, 19 nt, Homo sapiens
aggauuugcuaaagaagaa

SEQ ID NO: 317016 - RNA, 19 nt, Homo sapiens
guuccugggucgaagaaga

SEQ ID NO: 317017 - RNA, 19 nt, Homo sapiens
cuuccucucuuccauuauu

SEQ ID NO: 317018 - RNA, 19 nt, Homo sapiens
caacauagauccugaaauu

SEQ ID NO: 317019 - RNA, 19 nt, Homo sapiens
gaacauagaucaagacacu

SEQ ID NO: 317020 - RNA, 19 nt, Homo sapiens
gcaaggagcuggagaaucu

SEQ ID NO: 317021 - RNA, 19 nt, Homo sapiens
gcccagagcuucuuccuuu

SEQ ID NO: 317022 - RNA, 19 nt, Homo sapiens
gaagaagacauguuuauug

SEQ ID NO: 317023 - RNA, 19 nt, Homo sapiens
ccaaggagcuggaugcauu

SEQ ID NO: 317024 - RNA, 19 nt, Homo sapiens
gcaacgaucuugucuucuu

SEQ ID NO: 317025 - RNA, 19 nt, Homo sapiens
ggacuggacuucauguuuc

SEQ ID NO: 317026 - RNA, 19 nt, Homo sapiens
ggacuucccaguuuccuua

SEQ ID NO: 317027 - RNA, 19 nt, Homo sapiens
gaauaugacucgauuucug

SEQ ID NO: 317028 - RNA, 19 nt, Homo sapiens
aaacuguccuucagccuua

SEQ ID NO: 317029 - RNA, 19 nt, Homo sapiens
ccagugacuuugagauuaa

SEQ ID NO: 317030 - RNA, 19 nt, Homo sapiens
guucagacauguuggugua

SEQ ID NO: 317031 - RNA, 19 nt, Homo sapiens
gccagugacuuugagauua

SEQ ID NO: 317032 - RNA, 19 nt, Homo sapiens
uaacagauuuacacucaga

SEQ ID NO: 317033 - RNA, 19 nt, Homo sapiens
gaaacuggauuuggaagau

SEQ ID NO: 317034 - RNA, 19 nt, Homo sapiens
ucaaggauuugcuaaagaa

SEQ ID NO: 317035 - RNA, 19 nt, Homo sapiens
ggacauugcccaagaguuc

SEQ ID NO: 317036 - RNA, 19 nt, Homo sapiens
gaucuugucuucuucuauc

SEQ ID NO: 317037 - RNA, 19 nt, Homo sapiens
gaagggagcagaacuugug

SEQ ID NO: 317038 - RNA, 19 nt, Homo sapiens
cugauuggcuuccuucuuu

SEQ ID NO: 317039 - RNA, 19 nt, Homo sapiens
ggaagaagacauguuuauu

SEQ ID NO: 317040 - RNA, 19 nt, Homo sapiens
ggguugaacuggaagacua

SEQ ID NO: 317041 - RNA, 19 nt, Homo sapiens
ccaaacaggaugagaauau

SEQ ID NO: 317042 - RNA, 19 nt, Homo sapiens
ucuaacagauuuacacuca

SEQ ID NO: 317043 - RNA, 19 nt, Homo sapiens
gacauuaguggauaaguuu

SEQ ID NO: 317044 - RNA, 19 nt, Homo sapiens
gagaauaugacucgauuuc

SEQ ID NO: 317045 - RNA, 19 nt, Homo sapiens
gaagagcauauaccucaaa

SEQ ID NO: 317046 - RNA, 19 nt, Homo sapiens
uuucuuaacucaacagcua

SEQ ID NO: 317047 - RNA, 19 nt, Homo sapiens
gauggucucucuucucaag

SEQ ID NO: 317048 - RNA, 19 nt, Homo sapiens
agacauuaguggauaaguu

SEQ ID NO: 317049 - RNA, 19 nt, Homo sapiens
cgaaagcagugaacaaugc

SEQ ID NO: 317050 - RNA, 19 nt, Homo sapiens
gguagaggccagugacuuu

SEQ ID NO: 317051 - RNA, 19 nt, Homo sapiens
gaacuggaagacuauaaug

SEQ ID NO: 317052 - RNA, 19 nt, Homo sapiens
caaacaggaugagaauaug

SEQ ID NO: 317053 - RNA, 19 nt, Homo sapiens
ggcacgagcagcugucuua

SEQ ID NO: 317054 - RNA, 19 nt, Homo sapiens
gcaaacaacgccuccuuuc

SEQ ID NO: 317055 - RNA, 19 nt, Homo sapiens
aggagacgcugcugaugua

SEQ ID NO: 317056 - RNA, 19 nt, Homo sapiens
ugacucaucuggugaacau

SEQ ID NO: 317057 - RNA, 19 nt, Homo sapiens
gggaagaagacauguuuau

SEQ ID NO: 317058 - RNA, 19 nt, Homo sapiens
ccaggauacuucaugagaa

SEQ ID NO: 317059 - RNA, 19 nt, Homo sapiens
uaaagaagaaccaaaugga

SEQ ID NO: 317060 - RNA, 19 nt, Homo sapiens
ggaagagcauauaccucaa

SEQ ID NO: 317061 - RNA, 19 nt, Homo sapiens
ggacaaagggagggucaaa

SEQ ID NO: 317062 - RNA, 19 nt, Homo sapiens
gagaagcugcacuaucgua

SEQ ID NO: 317063 - RNA, 19 nt, Homo sapiens
acauagauccugaaauuga

SEQ ID NO: 317064 - RNA, 19 nt, Homo sapiens
cugaugaccugcaccauau

SEQ ID NO: 317065 - RNA, 19 nt, Homo sapiens
gguccuuauugaugaauuu

SEQ ID NO: 317066 - RNA, 19 nt, Homo sapiens
aaucuggacucccguauuc

SEQ ID NO: 317067 - RNA, 19 nt, Homo sapiens
gaacgaaccccuucagaga

SEQ ID NO: 317068 - RNA, 19 nt, Homo sapiens
ggaagacucccggauucua

SEQ ID NO: 317069 - RNA, 19 nt, Homo sapiens
guaggaagacucccggauu

SEQ ID NO: 317070 - RNA, 19 nt, Homo sapiens
cacagucgcugguccuuau

SEQ ID NO: 317071 - RNA, 19 nt, Homo sapiens
ugucuuaacccgaguauug

SEQ ID NO: 317072 - RNA, 19 nt, Homo sapiens
uuacaguguucuacagauu

SEQ ID NO: 317073 - RNA, 19 nt, Homo sapiens
acauagaucaagacacuua

SEQ ID NO: 317074 - RNA, 19 nt, Homo sapiens
gcaccacccaggauucaaa

SEQ ID NO: 317075 - RNA, 19 nt, Homo sapiens
uggcaacgaucuugucuuc

SEQ ID NO: 317076 - RNA, 19 nt, Homo sapiens
gcacagagagccuaaaaga

SEQ ID NO: 317077 - RNA, 19 nt, Homo sapiens
uaggaagacucccggauuc

SEQ ID NO: 317078 - RNA, 19 nt, Homo sapiens
gguagugagucaaugaagu

SEQ ID NO: 317079 - RNA, 19 nt, Homo sapiens
caacgaucuugucuucuuc

SEQ ID NO: 317080 - RNA, 19 nt, Homo sapiens
gcacagucgcugguccuua

SEQ ID NO: 317081 - RNA, 19 nt, Homo sapiens
gagcauauaccucaaacag

SEQ ID NO: 317082 - RNA, 19 nt, Homo sapiens
aaacaacgccuccuuucug

SEQ ID NO: 317083 - RNA, 19 nt, Homo sapiens
guagugagucaaugaaguu

SEQ ID NO: 317084 - RNA, 19 nt, Homo sapiens
acauguugguguaaaguuu

SEQ ID NO: 317085 - RNA, 19 nt, Homo sapiens
gccaugcccucuuuguuuc

SEQ ID NO: 317086 - RNA, 19 nt, Homo sapiens
aaccuggacuugaacguuu

SEQ ID NO: 317087 - RNA, 19 nt, Homo sapiens
uuaugaaacuggauuugga

SEQ ID NO: 317088 - RNA, 19 nt, Homo sapiens
gucaaggauuugcuaaaga

SEQ ID NO: 317089 - RNA, 19 nt, Homo sapiens
ucacacguccgacucauga

SEQ ID NO: 317090 - RNA, 19 nt, Homo sapiens
gagaagcugcucaggcuau

SEQ ID NO: 317091 - RNA, 19 nt, Homo sapiens
caacgccuccuuucuggaa

SEQ ID NO: 317092 - RNA, 19 nt, Homo sapiens
aagaagaaccaaauggaaa

SEQ ID NO: 317093 - RNA, 19 nt, Homo sapiens
cauagauccugaaauugau

SEQ ID NO: 317094 - RNA, 19 nt, Homo sapiens
uuggagggcugcugaaguu

SEQ ID NO: 317095 - RNA, 19 nt, Homo sapiens
gaaccugcccugccucagu

SEQ ID NO: 317096 - RNA, 19 nt, Homo sapiens
aaagaagaaccaaauggaa

SEQ ID NO: 317097 - RNA, 19 nt, Homo sapiens
gacgccaucuucacacgaa

SEQ ID NO: 317098 - RNA, 19 nt, Homo sapiens
ucagacauguugguguaaa

SEQ ID NO: 317099 - RNA, 19 nt, Homo sapiens
ccaccagcauccucugaga

SEQ ID NO: 317100 - RNA, 19 nt, Homo sapiens
gccagacauuaguggauaa

SEQ ID NO: 317101 - RNA, 19 nt, Homo sapiens
cagguaggcuugaucacau

SEQ ID NO: 317102 - RNA, 19 nt, Homo sapiens
ccgccugccuuccauggua

SEQ ID NO: 317103 - RNA, 19 nt, Homo sapiens
gauccuaaccuggacuuga

SEQ ID NO: 317104 - RNA, 19 nt, Homo sapiens
caucagggaagagcauaua

SEQ ID NO: 317105 - RNA, 19 nt, Homo sapiens
gaaccuuugugcccaacuc

SEQ ID NO: 317106 - RNA, 19 nt, Homo sapiens
ugacuccacuauccacuuc

SEQ ID NO: 317107 - RNA, 19 nt, Homo sapiens
aggagaagcugcacuaucg

SEQ ID NO: 317108 - RNA, 19 nt, Homo sapiens
ggacucccguauuccuuca

SEQ ID NO: 317109 - RNA, 19 nt, Homo sapiens
gaaucuggacucccguauu

SEQ ID NO: 317110 - RNA, 19 nt, Homo sapiens
ccauaucgccagccucauu

SEQ ID NO: 317111 - RNA, 19 nt, Homo sapiens
aaccugcccugccucagua

SEQ ID NO: 317112 - RNA, 19 nt, Homo sapiens
ugccagacauuaguggaua

SEQ ID NO: 317113 - RNA, 19 nt, Homo sapiens
aggauuugcuaaagaagaa

SEQ ID NO: 317114 - RNA, 19 nt, Homo sapiens
guuccugggucgaagaaga

SEQ ID NO: 317115 - RNA, 19 nt, Homo sapiens
cuuccucucuuccauuauu

SEQ ID NO: 317116 - RNA, 19 nt, Homo sapiens
ugaaacugcuccagaaagc

SEQ ID NO: 317117 - RNA, 19 nt, Homo sapiens
ggugcaggcucccuacaca

SEQ ID NO: 317118 - RNA, 19 nt, Homo sapiens
caacauagauccugaaauu

SEQ ID NO: 317119 - RNA, 19 nt, Homo sapiens
gaacauagaucaagacacu

SEQ ID NO: 317120 - RNA, 19 nt, Homo sapiens
gcaaggagcuggagaaucu

SEQ ID NO: 317121 - RNA, 19 nt, Homo sapiens
gcccagagcuucuuccuuu

SEQ ID NO: 317122 - RNA, 19 nt, Homo sapiens
gaagaagacauguuuauug

SEQ ID NO: 317123 - RNA, 19 nt, Homo sapiens
ccaaggagcuggaugcauu

SEQ ID NO: 317124 - RNA, 19 nt, Homo sapiens
gcaacgaucuugucuucuu

SEQ ID NO: 317125 - RNA, 19 nt, Homo sapiens
ggacuggacuucauguuuc

SEQ ID NO: 317126 - RNA, 19 nt, Homo sapiens
ggacuucccaguuuccuua

SEQ ID NO: 317127 - RNA, 19 nt, Homo sapiens
gaauaugacucgauuucug

SEQ ID NO: 317128 - RNA, 19 nt, Homo sapiens
aaacuguccuucagccuua

SEQ ID NO: 317129 - RNA, 19 nt, Homo sapiens
ccagugacuuugagauuaa

SEQ ID NO: 317130 - RNA, 19 nt, Homo sapiens
guucagacauguuggugua

SEQ ID NO: 317131 - RNA, 19 nt, Homo sapiens
gccagugacuuugagauua

SEQ ID NO: 317132 - RNA, 19 nt, Homo sapiens
uaacagauuuacacucaga

SEQ ID NO: 317133 - RNA, 19 nt, Homo sapiens
gaaacuggauuuggaagau

SEQ ID NO: 317134 - RNA, 19 nt, Homo sapiens
ucaaggauuugcuaaagaa

SEQ ID NO: 317135 - RNA, 19 nt, Homo sapiens
ggacauugcccaagaguuc

SEQ ID NO: 317136 - RNA, 19 nt, Homo sapiens
gaucuugucuucuucuauc

SEQ ID NO: 317137 - RNA, 19 nt, Homo sapiens
gaagggagcagaacuugug

SEQ ID NO: 317138 - RNA, 19 nt, Homo sapiens
cugauuggcuuccuucuuu

SEQ ID NO: 317139 - RNA, 19 nt, Homo sapiens
ggaagaagacauguuuauu

SEQ ID NO: 317140 - RNA, 19 nt, Homo sapiens
ggguugaacuggaagacua

SEQ ID NO: 317141 - RNA, 19 nt, Homo sapiens
ccaaacaggaugagaauau

SEQ ID NO: 317142 - RNA, 19 nt, Homo sapiens
ucuaacagauuuacacuca

SEQ ID NO: 317143 - RNA, 19 nt, Homo sapiens
gacauuaguggauaaguuu

SEQ ID NO: 317144 - RNA, 19 nt, Homo sapiens
gagaauaugacucgauuuc

SEQ ID NO: 317145 - RNA, 19 nt, Homo sapiens
gaagagcauauaccucaaa

SEQ ID NO: 317146 - RNA, 19 nt, Homo sapiens
uuucuuaacucaacagcua

SEQ ID NO: 317147 - RNA, 19 nt, Homo sapiens
gauggucucucuucucaag

SEQ ID NO: 317148 - RNA, 19 nt, Homo sapiens
agacauuaguggauaaguu

SEQ ID NO: 317149 - RNA, 19 nt, Homo sapiens
cgaaagcagugaacaaugc

SEQ ID NO: 317150 - RNA, 19 nt, Homo sapiens
gguagaggccagugacuuu

SEQ ID NO: 317151 - RNA, 19 nt, Homo sapiens
gaacuggaagacuauaaug

SEQ ID NO: 317152 - RNA, 19 nt, Homo sapiens
caaacaggaugagaauaug

SEQ ID NO: 317153 - RNA, 19 nt, Homo sapiens
ggcacgagcagcugucuua

SEQ ID NO: 317154 - RNA, 19 nt, Homo sapiens
gcaaacaacgccuccuuuc

SEQ ID NO: 317155 - RNA, 19 nt, Homo sapiens
aggagacgcugcugaugua

SEQ ID NO: 317156 - RNA, 19 nt, Homo sapiens
ugacucaucuggugaacau

SEQ ID NO: 317157 - RNA, 19 nt, Homo sapiens
gggaagaagacauguuuau

SEQ ID NO: 317158 - RNA, 19 nt, Homo sapiens
ccaggauacuucaugagaa

SEQ ID NO: 317159 - RNA, 19 nt, Homo sapiens
uaaagaagaaccaaaugga

SEQ ID NO: 317160 - RNA, 19 nt, Homo sapiens
ggaagagcauauaccucaa

SEQ ID NO: 317161 - RNA, 19 nt, Homo sapiens
ggacaaagggagggucaaa

SEQ ID NO: 317162 - RNA, 19 nt, Homo sapiens
gagaagcugcacuaucgua

SEQ ID NO: 317163 - RNA, 19 nt, Homo sapiens
acauagauccugaaauuga

SEQ ID NO: 317164 - RNA, 19 nt, Homo sapiens
cugaugaccugcaccauau

SEQ ID NO: 317165 - RNA, 19 nt, Homo sapiens
gguccuuauugaugaauuu

SEQ ID NO: 317166 - RNA, 19 nt, Homo sapiens
aaucuggacucccguauuc

SEQ ID NO: 317167 - RNA, 19 nt, Homo sapiens
gaacgaaccccuucagaga

SEQ ID NO: 317168 - RNA, 19 nt, Homo sapiens
ggaagacucccggauucua

SEQ ID NO: 317169 - RNA, 19 nt, Homo sapiens
guaggaagacucccggauu

SEQ ID NO: 317170 - RNA, 19 nt, Homo sapiens
cacagucgcugguccuuau

SEQ ID NO: 317171 - RNA, 19 nt, Homo sapiens
ugucuuaacccgaguauug

SEQ ID NO: 317172 - RNA, 19 nt, Homo sapiens
uuacaguguucuacagauu

SEQ ID NO: 317173 - RNA, 19 nt, Homo sapiens
acauagaucaagacacuua

SEQ ID NO: 317174 - RNA, 19 nt, Homo sapiens
gcaccacccaggauucaaa

SEQ ID NO: 317175 - RNA, 19 nt, Homo sapiens
uggcaacgaucuugucuuc

SEQ ID NO: 317176 - RNA, 19 nt, Homo sapiens
gcacagagagccuaaaaga

SEQ ID NO: 317177 - RNA, 19 nt, Homo sapiens
uaggaagacucccggauuc

SEQ ID NO: 317178 - RNA, 19 nt, Homo sapiens
gguagugagucaaugaagu

SEQ ID NO: 317179 - RNA, 19 nt, Homo sapiens
caacgaucuugucuucuuc

SEQ ID NO: 317180 - RNA, 19 nt, Homo sapiens
gcacagucgcugguccuua

SEQ ID NO: 317181 - RNA, 19 nt, Homo sapiens
gagcauauaccucaaacag

SEQ ID NO: 317182 - RNA, 19 nt, Homo sapiens
aaacaacgccuccuuucug

SEQ ID NO: 317183 - RNA, 19 nt, Homo sapiens
guagugagucaaugaaguu

SEQ ID NO: 317184 - RNA, 19 nt, Homo sapiens
acauguugguguaaaguuu

SEQ ID NO: 317185 - RNA, 19 nt, Homo sapiens
gccaugcccucuuuguuuc

SEQ ID NO: 317186 - RNA, 19 nt, Homo sapiens
aaccuggacuugaacguuu

SEQ ID NO: 317187 - RNA, 19 nt, Homo sapiens
uuaugaaacuggauuugga

SEQ ID NO: 317188 - RNA, 19 nt, Homo sapiens
gucaaggauuugcuaaaga

SEQ ID NO: 317189 - RNA, 19 nt, Homo sapiens
ucacacguccgacucauga

SEQ ID NO: 317190 - RNA, 19 nt, Homo sapiens
gagaagcugcucaggcuau

SEQ ID NO: 317191 - RNA, 19 nt, Homo sapiens
caacgccuccuuucuggaa

SEQ ID NO: 317192 - RNA, 19 nt, Homo sapiens
aagaagaaccaaauggaaa

SEQ ID NO: 317193 - RNA, 19 nt, Homo sapiens
cauagauccugaaauugau

SEQ ID NO: 317194 - RNA, 19 nt, Homo sapiens
uuggagggcugcugaaguu

SEQ ID NO: 317195 - RNA, 19 nt, Homo sapiens
gaaccugcccugccucagu

SEQ ID NO: 317196 - RNA, 19 nt, Homo sapiens
aaagaagaaccaaauggaa

SEQ ID NO: 317197 - RNA, 19 nt, Homo sapiens
gacgccaucuucacacgaa

SEQ ID NO: 317198 - RNA, 19 nt, Homo sapiens
ucagacauguugguguaaa

SEQ ID NO: 317199 - RNA, 19 nt, Homo sapiens
ccaccagcauccucugaga

SEQ ID NO: 317200 - RNA, 19 nt, Homo sapiens
gccagacauuaguggauaa

SEQ ID NO: 317201 - RNA, 19 nt, Homo sapiens
cagguaggcuugaucacau

SEQ ID NO: 317202 - RNA, 19 nt, Homo sapiens
ccgccugccuuccauggua

SEQ ID NO: 317203 - RNA, 19 nt, Homo sapiens
gauccuaaccuggacuuga

SEQ ID NO: 317204 - RNA, 19 nt, Homo sapiens
caucagggaagagcauaua

SEQ ID NO: 317205 - RNA, 19 nt, Homo sapiens
gaaccuuugugcccaacuc

SEQ ID NO: 317206 - RNA, 19 nt, Homo sapiens
ugacuccacuauccacuuc

SEQ ID NO: 317207 - RNA, 19 nt, Homo sapiens
aggagaagcugcacuaucg

SEQ ID NO: 317208 - RNA, 19 nt, Homo sapiens
ggacucccguauuccuuca

SEQ ID NO: 317209 - RNA, 19 nt, Homo sapiens
gaaucuggacucccguauu

SEQ ID NO: 317210 - RNA, 19 nt, Homo sapiens
ccauaucgccagccucauu

SEQ ID NO: 317211 - RNA, 19 nt, Homo sapiens
aaccugcccugccucagua

SEQ ID NO: 317212 - RNA, 19 nt, Homo sapiens
ugccagacauuaguggaua

SEQ ID NO: 317213 - RNA, 19 nt, Homo sapiens
aggauuugcuaaagaagaa

SEQ ID NO: 317214 - RNA, 19 nt, Homo sapiens
guuccugggucgaagaaga

SEQ ID NO: 317215 - RNA, 19 nt, Homo sapiens
cuuccucucuuccauuauu

SEQ ID NO: 317216 - RNA, 19 nt, Homo sapiens
ugaaacugcuccagaaagc

SEQ ID NO: 317217 - RNA, 19 nt, Homo sapiens
ggugcaggcucccuacaca

SEQ ID NO: 317218 - RNA, 19 nt, Homo sapiens
ggaauuaacucuccaaagg

SEQ ID NO: 317219 - RNA, 19 nt, Homo sapiens
gcaauaaucuuuguuacug

SEQ ID NO: 317220 - RNA, 19 nt, Homo sapiens
ccacaucuguaacuucuuu

SEQ ID NO: 317221 - RNA, 19 nt, Homo sapiens
ggagaaagugugugaaauu

SEQ ID NO: 317222 - RNA, 19 nt, Homo sapiens
ggacucaguuggcagacua

SEQ ID NO: 317223 - RNA, 19 nt, Homo sapiens
gugcauagcuggagugaag

SEQ ID NO: 317224 - RNA, 19 nt, Homo sapiens
gagaaagugugugaaauuc

SEQ ID NO: 317225 - RNA, 19 nt, Homo sapiens
uaagaaagcucagccaaag

SEQ ID NO: 317226 - RNA, 19 nt, Homo sapiens
gaacacaaagcaauaaucu

SEQ ID NO: 317227 - RNA, 19 nt, Homo sapiens
uggaggacgugaagcaaua

SEQ ID NO: 317228 - RNA, 19 nt, Homo sapiens
cgacacugcuggacaggaa

SEQ ID NO: 317229 - RNA, 19 nt, Homo sapiens
guaagaaagcucagccaaa

SEQ ID NO: 317230 - RNA, 19 nt, Homo sapiens
gaaggagugucuggugaug

SEQ ID NO: 317231 - RNA, 19 nt, Homo sapiens
ggaauuccguuuucugauu

SEQ ID NO: 317232 - RNA, 19 nt, Homo sapiens
gagaguuaauugucugugu

SEQ ID NO: 317233 - RNA, 19 nt, Homo sapiens
ggaaccaucccguccugua

SEQ ID NO: 317234 - RNA, 19 nt, Homo sapiens
gugaggacaucguggagaa

SEQ ID NO: 317235 - RNA, 19 nt, Homo sapiens
aggaagggcugcgcgaaua

SEQ ID NO: 317236 - RNA, 19 nt, Homo sapiens
uaaauacugugaggugaug

SEQ ID NO: 317237 - RNA, 19 nt, Homo sapiens
gaaccaucccguccuguau

SEQ ID NO: 317238 - RNA, 19 nt, Homo sapiens
uuucgaagccagcaaguua

SEQ ID NO: 317239 - RNA, 19 nt, Homo sapiens
uaaaagagaagcugcauuu

SEQ ID NO: 317240 - RNA, 19 nt, Homo sapiens
gaaagcaaagggcgucuca

SEQ ID NO: 317241 - RNA, 19 nt, Homo sapiens
cguccuguaucauauguaa

SEQ ID NO: 317242 - RNA, 19 nt, Homo sapiens
ccaaaacaauugacccuaa

SEQ ID NO: 317243 - RNA, 19 nt, Homo sapiens
ggcacgagcucgacuccaa

SEQ ID NO: 317244 - RNA, 19 nt, Homo sapiens
gagcacagcccaagauggu

SEQ ID NO: 317245 - RNA, 19 nt, Homo sapiens
ccacagccuucaccaaugg

SEQ ID NO: 317246 - RNA, 19 nt, Homo sapiens
aagagaagcugcauuuuau

SEQ ID NO: 317247 - RNA, 19 nt, Homo sapiens
aaagagaagcugcauuuua

SEQ ID NO: 317248 - RNA, 19 nt, Homo sapiens
gaauuccguuuucugauuu

SEQ ID NO: 317249 - RNA, 19 nt, Homo sapiens
gagaacaaagugucuaucu

SEQ ID NO: 317250 - RNA, 19 nt, Homo sapiens
acaaaaugguggaauguaa

SEQ ID NO: 317251 - RNA, 19 nt, Homo sapiens
auaaagugcuggcgcaauc

SEQ ID NO: 317252 - RNA, 19 nt, Homo sapiens
cugauuugcuuugggauuu

SEQ ID NO: 317253 - RNA, 19 nt, Homo sapiens
cacauucucucacugaagu

SEQ ID NO: 317254 - RNA, 19 nt, Homo sapiens
guucggguuugucacguuu

SEQ ID NO: 317255 - RNA, 19 nt, Homo sapiens
gaauuaacucuccaaaggu

SEQ ID NO: 317256 - RNA, 19 nt, Homo sapiens
gcaaagggcgugggaagag

SEQ ID NO: 317257 - RNA, 19 nt, Homo sapiens
ggacgacgccaugcugaug

SEQ ID NO: 317258 - RNA, 19 nt, Homo sapiens
ucagagcguuggaccuuca

SEQ ID NO: 317259 - RNA, 19 nt, Homo sapiens
gccacagccuucaccaaug

SEQ ID NO: 317260 - RNA, 19 nt, Homo sapiens
gcacgagcucgacuccaaa

SEQ ID NO: 317261 - RNA, 19 nt, Homo sapiens
ugagaacacaaagcaauaa

SEQ ID NO: 317262 - RNA, 19 nt, Homo sapiens
gagaacacaaagcaauaau

SEQ ID NO: 317263 - RNA, 19 nt, Homo sapiens
gagcguuggaccuucauga

SEQ ID NO: 317264 - RNA, 19 nt, Homo sapiens
caucccguccuguaucaua

SEQ ID NO: 317265 - RNA, 19 nt, Homo sapiens
agaacaaagugucuaucug

SEQ ID NO: 317266 - RNA, 19 nt, Homo sapiens
agaaagcucagccaaagga

SEQ ID NO: 317267 - RNA, 19 nt, Homo sapiens
guggagaaagugugugaaa

SEQ ID NO: 317268 - RNA, 19 nt, Homo sapiens
ggacaucguggagaaagug

SEQ ID NO: 317269 - RNA, 19 nt, Homo sapiens
cguuggaccuucaugaaca

SEQ ID NO: 317270 - RNA, 19 nt, Homo sapiens
gagcucgacuccaaaacaa

SEQ ID NO: 317271 - RNA, 19 nt, Homo sapiens
uuucuagguuugugaaugu

SEQ ID NO: 317272 - RNA, 19 nt, Homo sapiens
gcccugcuuuuauuuauuu

SEQ ID NO: 317273 - RNA, 19 nt, Homo sapiens
ggacgugaagcaauauuuu

SEQ ID NO: 317274 - RNA, 19 nt, Homo sapiens
cugagaacacaaagcaaua

SEQ ID NO: 317275 - RNA, 19 nt, Homo sapiens
gaguuaauugucuguguga

SEQ ID NO: 317276 - RNA, 19 nt, Homo sapiens
ccucagacaccguuacugu

SEQ ID NO: 317277 - RNA, 19 nt, Homo sapiens
guaaauacugugaggugau

SEQ ID NO: 317278 - RNA, 19 nt, Homo sapiens
cggaauggacgccuucaug

SEQ ID NO: 317279 - RNA, 19 nt, Homo sapiens
acgccaugcugauguuuga

SEQ ID NO: 317280 - RNA, 19 nt, Homo sapiens
gagaagcugcauuuuauug

SEQ ID NO: 317281 - RNA, 19 nt, Homo sapiens
guucagagcguuggaccuu

SEQ ID NO: 317282 - RNA, 19 nt, Homo sapiens
gguuggggcuucaugguuu

SEQ ID NO: 317283 - RNA, 19 nt, Homo sapiens
uggagaaagugugugaaau

SEQ ID NO: 317284 - RNA, 19 nt, Homo sapiens
ucucuucucuccacaucug

SEQ ID NO: 317285 - RNA, 19 nt, Homo sapiens
gcugaguccugagacacuu

SEQ ID NO: 317286 - RNA, 19 nt, Homo sapiens
cccaccagcugagaacaaa

SEQ ID NO: 317287 - RNA, 19 nt, Homo sapiens
gaaaucaacaacaaaaugg

SEQ ID NO: 317288 - RNA, 19 nt, Homo sapiens
gcaauauuuugagcaguuu

SEQ ID NO: 317289 - RNA, 19 nt, Homo sapiens
gaagccagcaaguuaccau

SEQ ID NO: 317290 - RNA, 19 nt, Homo sapiens
gauaaagugcuggcgcaau

SEQ ID NO: 317291 - RNA, 19 nt, Homo sapiens
caugguuucugcucagucu

SEQ ID NO: 317292 - RNA, 19 nt, Homo sapiens
cuagguuugugaaugugaa

SEQ ID NO: 317293 - RNA, 19 nt, Homo sapiens
gacugaggaccacgaguga

SEQ ID NO: 317294 - RNA, 19 nt, Homo sapiens
uacgccagccggaguuaua

SEQ ID NO: 317295 - RNA, 19 nt, Homo sapiens
ggggaggucucgagucaug

SEQ ID NO: 317296 - RNA, 19 nt, Homo sapiens
gcacgaccccugcaagaug

SEQ ID NO: 317297 - RNA, 19 nt, Homo sapiens
ccugagaacacaaagcaau

SEQ ID NO: 317298 - RNA, 19 nt, Homo sapiens
uagcuucccucucccucau

SEQ ID NO: 317299 - RNA, 19 nt, Homo sapiens
gcccugagaacacaaagca

SEQ ID NO: 317300 - RNA, 19 nt, Homo sapiens
gaauggacgccuucaugcu

SEQ ID NO: 317301 - RNA, 19 nt, Homo sapiens
ggaagggcugcgcgaauac

SEQ ID NO: 317302 - RNA, 19 nt, Homo sapiens
caaaacaauugacccuaag

SEQ ID NO: 317303 - RNA, 19 nt, Homo sapiens
gcugagaacaaagugucua

SEQ ID NO: 317304 - RNA, 19 nt, Homo sapiens
agucaugcccuacggaaug

SEQ ID NO: 317305 - RNA, 19 nt, Homo sapiens
aaugguggaauguaagaaa

SEQ ID NO: 317306 - RNA, 19 nt, Homo sapiens
gguucggguuugucacguu

SEQ ID NO: 317307 - RNA, 19 nt, Homo sapiens
ccaugcugauguuugacaa

SEQ ID NO: 317308 - RNA, 19 nt, Homo sapiens
gguuucggcuucgucacuu

SEQ ID NO: 317309 - RNA, 19 nt, Homo sapiens
ggaggacgugaagcaauau

SEQ ID NO: 317310 - RNA, 19 nt, Homo sapiens
gaggacgugaagcaauauu

SEQ ID NO: 317311 - RNA, 19 nt, Homo sapiens
cuccacaucuguaacuucu

SEQ ID NO: 317312 - RNA, 19 nt, Homo sapiens
gcuucccucucccucauuc

SEQ ID NO: 317313 - RNA, 19 nt, Homo sapiens
ugagcugaguccugagaca

SEQ ID NO: 317314 - RNA, 19 nt, Homo sapiens
gaagcugcauuuuauuggu

SEQ ID NO: 317315 - RNA, 19 nt, Homo sapiens
uggcuacaccuaccaguuc

SEQ ID NO: 317316 - RNA, 19 nt, Homo sapiens
gaaacaaacacccaauaaa

SEQ ID NO: 317317 - RNA, 19 nt, Homo sapiens
ggaaacaaacacccaauaa

SEQ ID NO: 317318 - RNA, 19 nt, Homo sapiens
gaauauguguguccuuuua

SEQ ID NO: 317319 - RNA, 19 nt, Homo sapiens
gcaaacacuugaauaugug

SEQ ID NO: 317320 - RNA, 19 nt, Homo sapiens
gacaugcacuugcuacgaa

SEQ ID NO: 317321 - RNA, 19 nt, Homo sapiens
gggcagcguugugaucuuu

SEQ ID NO: 317322 - RNA, 19 nt, Homo sapiens
gagcaaacacuugaauaug

SEQ ID NO: 317323 - RNA, 19 nt, Homo sapiens
aaacaaacacccaauaaac

SEQ ID NO: 317324 - RNA, 19 nt, Homo sapiens
agcaaacacuugaauaugu

SEQ ID NO: 317325 - RNA, 19 nt, Homo sapiens
gaccuguucugucagugaa

SEQ ID NO: 317326 - RNA, 19 nt, Homo sapiens
ugagcaaacacuugaauau

SEQ ID NO: 317327 - RNA, 19 nt, Homo sapiens
uugaauauguguguccuuu

SEQ ID NO: 317328 - RNA, 19 nt, Homo sapiens
gagauucaaccaggaaaug

SEQ ID NO: 317329 - RNA, 19 nt, Homo sapiens
uagccaugccuaucaguaa

SEQ ID NO: 317330 - RNA, 19 nt, Homo sapiens
gcacuugcuacgaaacaga

SEQ ID NO: 317331 - RNA, 19 nt, Homo sapiens
guagccaugccuaucagua

SEQ ID NO: 317332 - RNA, 19 nt, Homo sapiens
aaagaccuguucugucagu

SEQ ID NO: 317333 - RNA, 19 nt, Homo sapiens
gaguccugcuuaucacaau

SEQ ID NO: 317334 - RNA, 19 nt, Homo sapiens
ggagauucaaccaggaaau

SEQ ID NO: 317335 - RNA, 19 nt, Homo sapiens
ggaguccugcuuaucacaa

SEQ ID NO: 317336 - RNA, 19 nt, Homo sapiens
aggaaacaaacacccaaua

SEQ ID NO: 317337 - RNA, 19 nt, Homo sapiens
ggaucucaaaggaaacaaa

SEQ ID NO: 317338 - RNA, 19 nt, Homo sapiens
agccaugccuaucaguaaa

SEQ ID NO: 317339 - RNA, 19 nt, Homo sapiens
cugcuuaucacaaugaaug

SEQ ID NO: 317340 - RNA, 19 nt, Homo sapiens
acaaacacccaauaaacuc

SEQ ID NO: 317341 - RNA, 19 nt, Homo sapiens
uggagaagaaggacccaaa

SEQ ID NO: 317342 - RNA, 19 nt, Homo sapiens
gaucucaaaggaaacaaac

SEQ ID NO: 317343 - RNA, 19 nt, Homo sapiens
ggagaagaaggacccaaaa

SEQ ID NO: 317344 - RNA, 19 nt, Homo sapiens
gcagcguugugaucuuugc

SEQ ID NO: 317345 - RNA, 19 nt, Homo sapiens
acaugcacuugcuacgaaa

SEQ ID NO: 317346 - RNA, 19 nt, Homo sapiens
gaauauguguguccuuuua

SEQ ID NO: 317347 - RNA, 19 nt, Homo sapiens
gcaaacacuugaauaugug

SEQ ID NO: 317348 - RNA, 19 nt, Homo sapiens
gggcagcguugugaucuuu

SEQ ID NO: 317349 - RNA, 19 nt, Homo sapiens
gagcaaacacuugaauaug

SEQ ID NO: 317350 - RNA, 19 nt, Homo sapiens
caaccaggauguuucuaca

SEQ ID NO: 317351 - RNA, 19 nt, Homo sapiens
agcaaacacuugaauaugu

SEQ ID NO: 317352 - RNA, 19 nt, Homo sapiens
gaccuguucugucagugaa

SEQ ID NO: 317353 - RNA, 19 nt, Homo sapiens
ugagcaaacacuugaauau

SEQ ID NO: 317354 - RNA, 19 nt, Homo sapiens
uugaauauguguguccuuu

SEQ ID NO: 317355 - RNA, 19 nt, Homo sapiens
uagccaugccuaucaguaa

SEQ ID NO: 317356 - RNA, 19 nt, Homo sapiens
guagccaugccuaucagua

SEQ ID NO: 317357 - RNA, 19 nt, Homo sapiens
aaagaccuguucugucagu

SEQ ID NO: 317358 - RNA, 19 nt, Homo sapiens
uuucuacaccuguggguua

SEQ ID NO: 317359 - RNA, 19 nt, Homo sapiens
gaguccugcuuaucacaau

SEQ ID NO: 317360 - RNA, 19 nt, Homo sapiens
gagauucaaccaggauguu

SEQ ID NO: 317361 - RNA, 19 nt, Homo sapiens
ggaguccugcuuaucacaa

SEQ ID NO: 317362 - RNA, 19 nt, Homo sapiens
ggagauucaaccaggaugu

SEQ ID NO: 317363 - RNA, 19 nt, Homo sapiens
agccaugccuaucaguaaa

SEQ ID NO: 317364 - RNA, 19 nt, Homo sapiens
cugcuuaucacaaugaaug

SEQ ID NO: 317365 - RNA, 19 nt, Homo sapiens
uggagaagaaggacccaaa

SEQ ID NO: 317366 - RNA, 19 nt, Homo sapiens
gauucaaccaggauguuuc

SEQ ID NO: 317367 - RNA, 19 nt, Homo sapiens
ggagaagaaggacccaaaa

SEQ ID NO: 317368 - RNA, 19 nt, Homo sapiens
gcagcguugugaucuuugc

SEQ ID NO: 317369 - RNA, 19 nt, Homo sapiens
gcaaaugcccuuacacuua

SEQ ID NO: 317370 - RNA, 19 nt, Homo sapiens
gaacaucucuuucaaugau

SEQ ID NO: 317371 - RNA, 19 nt, Homo sapiens
gcaaaugaauggcucacua

SEQ ID NO: 317372 - RNA, 19 nt, Homo sapiens
gaggauauguucacaccua

SEQ ID NO: 317373 - RNA, 19 nt, Homo sapiens
caaauccucuccagcuaua

SEQ ID NO: 317374 - RNA, 19 nt, Homo sapiens
cagacuaacucccaagaua

SEQ ID NO: 317375 - RNA, 19 nt, Homo sapiens
caucaggacucuugugaaa

SEQ ID NO: 317376 - RNA, 19 nt, Homo sapiens
uaagaaggcucagcaagaa

SEQ ID NO: 317377 - RNA, 19 nt, Homo sapiens
guacucuacugauaucuaa

SEQ ID NO: 317378 - RNA, 19 nt, Homo sapiens
gagcagcccuggagucaug

SEQ ID NO: 317379 - RNA, 19 nt, Homo sapiens
ccaagaagacugccaauga

SEQ ID NO: 317380 - RNA, 19 nt, Homo sapiens
caauaagccuugucguuga

SEQ ID NO: 317381 - RNA, 19 nt, Homo sapiens
gaaggugacugcccaggau

SEQ ID NO: 317382 - RNA, 19 nt, Homo sapiens
gucauacaauccauucuua

SEQ ID NO: 317383 - RNA, 19 nt, Homo sapiens
gagggaaguuugguucuuu

SEQ ID NO: 317384 - RNA, 19 nt, Homo sapiens
gcagcgcauugacgaauuu

SEQ ID NO: 317385 - RNA, 19 nt, Homo sapiens
gcagaaggcccagauggua

SEQ ID NO: 317386 - RNA, 19 nt, Homo sapiens
caaaugcccuuacacuuac

SEQ ID NO: 317387 - RNA, 19 nt, Homo sapiens
guagggcucuggaacuuga

SEQ ID NO: 317388 - RNA, 19 nt, Homo sapiens
gaagaagaagcgugaaaug

SEQ ID NO: 317389 - RNA, 19 nt, Homo sapiens
caacaucuaugagcagaau

SEQ ID NO: 317390 - RNA, 19 nt, Homo sapiens
ggcugaaacucaauaagaa

SEQ ID NO: 317391 - RNA, 19 nt, Homo sapiens
acaccuagcgucaguauuu

SEQ ID NO: 317392 - RNA, 19 nt, Homo sapiens
gaacagcuggccuuggaaa

SEQ ID NO: 317393 - RNA, 19 nt, Homo sapiens
gaaagagggcauucucaau

SEQ ID NO: 317394 - RNA, 19 nt, Homo sapiens
gacaggaccuagauaucuu

SEQ ID NO: 317395 - RNA, 19 nt, Homo sapiens
gaaaagagaggauauguuc

SEQ ID NO: 317396 - RNA, 19 nt, Homo sapiens
ggucuaaagugagcucuau

SEQ ID NO: 317397 - RNA, 19 nt, Homo sapiens
gaccaaaccuagccccuua

SEQ ID NO: 317398 - RNA, 19 nt, Homo sapiens
gaacagcacaaacucaaca

SEQ ID NO: 317399 - RNA, 19 nt, Homo sapiens
uaacucaccuaacucauac

SEQ ID NO: 317400 - RNA, 19 nt, Homo sapiens
ggagauguauggugugaac

SEQ ID NO: 317401 - RNA, 19 nt, Homo sapiens
cucaauccauguucuauuu

SEQ ID NO: 317402 - RNA, 19 nt, Homo sapiens
ggaaauggugccuucaaga

SEQ ID NO: 317403 - RNA, 19 nt, Homo sapiens
gcaaacucagccucaauaa

SEQ ID NO: 317404 - RNA, 19 nt, Homo sapiens
gaaucuguauggcuagaau

SEQ ID NO: 317405 - RNA, 19 nt, Homo sapiens
ccacuucccugggcaaaug

SEQ ID NO: 317406 - RNA, 19 nt, Homo sapiens
ggagauggcccgacagaag

SEQ ID NO: 317407 - RNA, 19 nt, Homo sapiens
ucaauaaggaagugcauaa

SEQ ID NO: 317408 - RNA, 19 nt, Homo sapiens
ucucuucucuguuccauug

SEQ ID NO: 317409 - RNA, 19 nt, Homo sapiens
cguaugcuguccagucuaa

SEQ ID NO: 317410 - RNA, 19 nt, Homo sapiens
caagaagacugccaaugac

SEQ ID NO: 317411 - RNA, 19 nt, Homo sapiens
gcugaagacugccaugagu

SEQ ID NO: 317412 - RNA, 19 nt, Homo sapiens
gagaagaagaagcgugaaa

SEQ ID NO: 317413 - RNA, 19 nt, Homo sapiens
ggagugaaaucaggaacau

SEQ ID NO: 317414 - RNA, 19 nt, Homo sapiens
cuaacucaccuaacucaua

SEQ ID NO: 317415 - RNA, 19 nt, Homo sapiens
ccacugaggcagagaagaa

SEQ ID NO: 317416 - RNA, 19 nt, Homo sapiens
gacagaagaaggagaguga

SEQ ID NO: 317417 - RNA, 19 nt, Homo sapiens
ugaagcagaucgaggaaca

SEQ ID NO: 317418 - RNA, 19 nt, Homo sapiens
ucgcaagccugauaccauu

SEQ ID NO: 317419 - RNA, 19 nt, Homo sapiens
aggaacaucucuuucaaug

SEQ ID NO: 317420 - RNA, 19 nt, Homo sapiens
ucaggaacaucucuuucaa

SEQ ID NO: 317421 - RNA, 19 nt, Homo sapiens
gagcagaaugacagacuaa

SEQ ID NO: 317422 - RNA, 19 nt, Homo sapiens
ccaccuggcugaaacucaa

SEQ ID NO: 317423 - RNA, 19 nt, Homo sapiens
cgaauuugagucuauguaa

SEQ ID NO: 317424 - RNA, 19 nt, Homo sapiens
uaaguuccgugccaaguuc

SEQ ID NO: 317425 - RNA, 19 nt, Homo sapiens
uagagguacuuuccacuug

SEQ ID NO: 317426 - RNA, 19 nt, Homo sapiens
gaagacugccaaugacaug

SEQ ID NO: 317427 - RNA, 19 nt, Homo sapiens
gagauggcccgacagaaga

SEQ ID NO: 317428 - RNA, 19 nt, Homo sapiens
gcuuagagccucccucaau

SEQ ID NO: 317429 - RNA, 19 nt, Homo sapiens
ggcauuggccauucuauug

SEQ ID NO: 317430 - RNA, 19 nt, Homo sapiens
caaaugaauggcucacuau

SEQ ID NO: 317431 - RNA, 19 nt, Homo sapiens
agagaugaguccaagaaga

SEQ ID NO: 317432 - RNA, 19 nt, Homo sapiens
agaaugagcgugugcagaa

SEQ ID NO: 317433 - RNA, 19 nt, Homo sapiens
gaagggcauuggccauucu

SEQ ID NO: 317434 - RNA, 19 nt, Homo sapiens
ggaaauggcagagcugaca

SEQ ID NO: 317435 - RNA, 19 nt, Homo sapiens
cuaagaaggcucagcaaga

SEQ ID NO: 317436 - RNA, 19 nt, Homo sapiens
gggaaauggugccuucaag

SEQ ID NO: 317437 - RNA, 19 nt, Homo sapiens
gcccgacaguccuagcuaa

SEQ ID NO: 317438 - RNA, 19 nt, Homo sapiens
ccagagaugaguccaagaa

SEQ ID NO: 317439 - RNA, 19 nt, Homo sapiens
ggagaaagagaagauugaa

SEQ ID NO: 317440 - RNA, 19 nt, Homo sapiens
gcagagaaggagaaagaga

SEQ ID NO: 317441 - RNA, 19 nt, Homo sapiens
cuuagagccucccucaauu

SEQ ID NO: 317442 - RNA, 19 nt, Homo sapiens
cacuauaggucauacaauc

SEQ ID NO: 317443 - RNA, 19 nt, Homo sapiens
acaccuaacucaccuaacu

SEQ ID NO: 317444 - RNA, 19 nt, Homo sapiens
caggaagacuuggagaaga

SEQ ID NO: 317445 - RNA, 19 nt, Homo sapiens
ccauugaggugcagcagau

SEQ ID NO: 317446 - RNA, 19 nt, Homo sapiens
caauccauguucuauuuca

SEQ ID NO: 317447 - RNA, 19 nt, Homo sapiens
gugcauugcugugaauuag

SEQ ID NO: 317448 - RNA, 19 nt, Homo sapiens
gaaauggugccuucaagac

SEQ ID NO: 317449 - RNA, 19 nt, Homo sapiens
ggagucaaguguggaguag

SEQ ID NO: 317450 - RNA, 19 nt, Homo sapiens
gaugguacaggaagacuug

SEQ ID NO: 317451 - RNA, 19 nt, Homo sapiens
ccaggacacuaaagguuuc

SEQ ID NO: 317452 - RNA, 19 nt, Homo sapiens
cccaucccguuuagaguua

SEQ ID NO: 317453 - RNA, 19 nt, Homo sapiens
gaaaucaggaacaucucuu

SEQ ID NO: 317454 - RNA, 19 nt, Homo sapiens
ggucauacaauccauucuu

SEQ ID NO: 317455 - RNA, 19 nt, Homo sapiens
caugugugcucuucuucuu

SEQ ID NO: 317456 - RNA, 19 nt, Homo sapiens
ucaagaccuucaccaaaca

SEQ ID NO: 317457 - RNA, 19 nt, Homo sapiens
gcccuuacacuuacuguug

SEQ ID NO: 317458 - RNA, 19 nt, Homo sapiens
aggaacagcuggccuugga

SEQ ID NO: 317459 - RNA, 19 nt, Homo sapiens
gaaggagaaagagaagauu

SEQ ID NO: 317460 - RNA, 19 nt, Homo sapiens
cagagaaggagaaagagaa

SEQ ID NO: 317461 - RNA, 19 nt, Homo sapiens
ggaacaucucuuucaauga

SEQ ID NO: 317462 - RNA, 19 nt, Homo sapiens
auaaggaagugcauaaguc

SEQ ID NO: 317463 - RNA, 19 nt, Homo sapiens
ggauguguccgaggaauug

SEQ ID NO: 317464 - RNA, 19 nt, Homo sapiens
gacuuuagggacucaauuu

SEQ ID NO: 317465 - RNA, 19 nt, Homo sapiens
uguaugcggucuaggaaug

SEQ ID NO: 317466 - RNA, 19 nt, Homo sapiens
uggaguagguuggaagcua

SEQ ID NO: 317467 - RNA, 19 nt, Homo sapiens
cgacaguccuagcuaaacu

SEQ ID NO: 317468 - RNA, 19 nt, Homo sapiens
agagguacuuuccacuuga

SEQ ID NO: 317469 - RNA, 19 nt, Homo sapiens
gaacagggcuggauaggua

SEQ ID NO: 317470 - RNA, 19 nt, Homo sapiens
ggaaucagcucaaucuuca

SEQ ID NO: 317471 - RNA, 19 nt, Homo sapiens
gaagugaaaguacugaaua

SEQ ID NO: 317472 - RNA, 19 nt, Homo sapiens
gagaauaccuucaaacaac

SEQ ID NO: 317473 - RNA, 19 nt, Homo sapiens
ccuaagagauguagacaaa

SEQ ID NO: 317474 - RNA, 19 nt, Homo sapiens
ggagaacugucaugaguau

SEQ ID NO: 317475 - RNA, 19 nt, Homo sapiens
cauaacagcuaauaagaga

SEQ ID NO: 317476 - RNA, 19 nt, Homo sapiens
gagaagagaauccagcaua

SEQ ID NO: 317477 - RNA, 19 nt, Homo sapiens
cuucaaagcugcacugauu

SEQ ID NO: 317478 - RNA, 19 nt, Homo sapiens
uaagagauguagacaaaug

SEQ ID NO: 317479 - RNA, 19 nt, Homo sapiens
caaguaagauauugugugu

SEQ ID NO: 317480 - RNA, 19 nt, Homo sapiens
gcaaugagacuacaacuag

SEQ ID NO: 317481 - RNA, 19 nt, Homo sapiens
gcaaagcgauuccuaccau

SEQ ID NO: 317482 - RNA, 19 nt, Homo sapiens
caugacaacugaucaaaga

SEQ ID NO: 317483 - RNA, 19 nt, Homo sapiens
gcugaaauacuaugagaua

SEQ ID NO: 317484 - RNA, 19 nt, Homo sapiens
gacccaagauucauacuau

SEQ ID NO: 317485 - RNA, 19 nt, Homo sapiens
cuuaugggauuacauguua

SEQ ID NO: 317486 - RNA, 19 nt, Homo sapiens
gcagcuaaguaccuuguuu

SEQ ID NO: 317487 - RNA, 19 nt, Homo sapiens
ggaaaucaguaaauuagag

SEQ ID NO: 317488 - RNA, 19 nt, Homo sapiens
gacaacugaucaaagauuu

SEQ ID NO: 317489 - RNA, 19 nt, Homo sapiens
aaucagugcugcuuucuuu

SEQ ID NO: 317490 - RNA, 19 nt, Homo sapiens
ucacaacucuucuuuccuu

SEQ ID NO: 317491 - RNA, 19 nt, Homo sapiens
ggacauaacagcuaauaag

SEQ ID NO: 317492 - RNA, 19 nt, Homo sapiens
cagcagaaauuauggcuau

SEQ ID NO: 317493 - RNA, 19 nt, Homo sapiens
gaugcucugugaaaucaua

SEQ ID NO: 317494 - RNA, 19 nt, Homo sapiens
gaacugucaugaguauuga

SEQ ID NO: 317495 - RNA, 19 nt, Homo sapiens
ggaaugcaauagaugaaau

SEQ ID NO: 317496 - RNA, 19 nt, Homo sapiens
gcucauaccucuucuuacu

SEQ ID NO: 317497 - RNA, 19 nt, Homo sapiens
gaacaagcaauuacaauac

SEQ ID NO: 317498 - RNA, 19 nt, Homo sapiens
gacagagccuuguucuauu

SEQ ID NO: 317499 - RNA, 19 nt, Homo sapiens
caacuaggguguaaauuuu

SEQ ID NO: 317500 - RNA, 19 nt, Homo sapiens
acgaagaauugcucaguua

SEQ ID NO: 317501 - RNA, 19 nt, Homo sapiens
aaacagcccuucccuucaa

SEQ ID NO: 317502 - RNA, 19 nt, Homo sapiens
gcagggcccucuuaagauc

SEQ ID NO: 317503 - RNA, 19 nt, Homo sapiens
gaaauuauggcuaugaaag

SEQ ID NO: 317504 - RNA, 19 nt, Homo sapiens
caauuuauccaacccauuu

SEQ ID NO: 317505 - RNA, 19 nt, Homo sapiens
caagucaucugcacaacug

SEQ ID NO: 317506 - RNA, 19 nt, Homo sapiens
guacaacucacugaucaua

SEQ ID NO: 317507 - RNA, 19 nt, Homo sapiens
caauguaucagcagaaauu

SEQ ID NO: 317508 - RNA, 19 nt, Homo sapiens
ccacauugcuugauuugca

SEQ ID NO: 317509 - RNA, 19 nt, Homo sapiens
caaagcgauuccuaccaua

SEQ ID NO: 317510 - RNA, 19 nt, Homo sapiens
uguaccagaugcugaaaua

SEQ ID NO: 317511 - RNA, 19 nt, Homo sapiens
gaaagaagaacaagugcau

SEQ ID NO: 317512 - RNA, 19 nt, Homo sapiens
gaggaaaucaguaaauuag

SEQ ID NO: 317513 - RNA, 19 nt, Homo sapiens
ccaagagaauaccuucaaa

SEQ ID NO: 317514 - RNA, 19 nt, Homo sapiens
ccgaaucugugaaauuuga

SEQ ID NO: 317515 - RNA, 19 nt, Homo sapiens
agagagaaguggauaaauc

SEQ ID NO: 317516 - RNA, 19 nt, Homo sapiens
guagacaaaugaacaagca

SEQ ID NO: 317517 - RNA, 19 nt, Homo sapiens
acaacucacugaucauauu

SEQ ID NO: 317518 - RNA, 19 nt, Homo sapiens
gaagagaauccagcauauu

SEQ ID NO: 317519 - RNA, 19 nt, Homo sapiens
uguauuaccuggucauuuc

SEQ ID NO: 317520 - RNA, 19 nt, Homo sapiens
caacucacugaucauauua

SEQ ID NO: 317521 - RNA, 19 nt, Homo sapiens
gagucuagaacacaauuua

SEQ ID NO: 317522 - RNA, 19 nt, Homo sapiens
ccauugaccuagagucuug

SEQ ID NO: 317523 - RNA, 19 nt, Homo sapiens
ggacaagucaucugcacaa

SEQ ID NO: 317524 - RNA, 19 nt, Homo sapiens
agauagggaugucauagaa

SEQ ID NO: 317525 - RNA, 19 nt, Homo sapiens
gaggcucuguccuaaauau

SEQ ID NO: 317526 - RNA, 19 nt, Homo sapiens
gugaggcucuguccuaaau

SEQ ID NO: 317527 - RNA, 19 nt, Homo sapiens
gagagaaguggauaaauca

SEQ ID NO: 317528 - RNA, 19 nt, Homo sapiens
ggacacagagcauuuccaa

SEQ ID NO: 317529 - RNA, 19 nt, Homo sapiens
gauauugugugugugaaga

SEQ ID NO: 317530 - RNA, 19 nt, Homo sapiens
agacagagccuuguucuau

SEQ ID NO: 317531 - RNA, 19 nt, Homo sapiens
aaugaauacuggucucuuu

SEQ ID NO: 317532 - RNA, 19 nt, Homo sapiens
cagcucaacuccugaagug

SEQ ID NO: 317533 - RNA, 19 nt, Homo sapiens
gaagaugcucugugaaauc

SEQ ID NO: 317534 - RNA, 19 nt, Homo sapiens
uaggagaacugucaugagu

SEQ ID NO: 317535 - RNA, 19 nt, Homo sapiens
acaacuaggguguaaauuu

SEQ ID NO: 317536 - RNA, 19 nt, Homo sapiens
aagagaauccagcauauuu

SEQ ID NO: 317537 - RNA, 19 nt, Homo sapiens
aagagaaacugaaguccuu

SEQ ID NO: 317538 - RNA, 19 nt, Homo sapiens
caacaggaggacacugaua

SEQ ID NO: 317539 - RNA, 19 nt, Homo sapiens
gcacaacugacuuccaaga

SEQ ID NO: 317540 - RNA, 19 nt, Homo sapiens
gggaucacuuucacaauca

SEQ ID NO: 317541 - RNA, 19 nt, Homo sapiens
caacaagaggaaaucagua

SEQ ID NO: 317542 - RNA, 19 nt, Homo sapiens
agaagagaauccagcauau

SEQ ID NO: 317543 - RNA, 19 nt, Homo sapiens
gcccuucccuucaagagaa

SEQ ID NO: 317544 - RNA, 19 nt, Homo sapiens
gugaagaugcucugugaaa

SEQ ID NO: 317545 - RNA, 19 nt, Homo sapiens
gugugaagaugcucuguga

SEQ ID NO: 317546 - RNA, 19 nt, Homo sapiens
ggaggaacagggcuggaua

SEQ ID NO: 317547 - RNA, 19 nt, Homo sapiens
ucagcucaaucuucaauga

SEQ ID NO: 317548 - RNA, 19 nt, Homo sapiens
cagaaauuauggcuaugaa

SEQ ID NO: 317549 - RNA, 19 nt, Homo sapiens
gcgaagaggaaaugagauu

SEQ ID NO: 317550 - RNA, 19 nt, Homo sapiens
gacauaacagcuaauaaga

SEQ ID NO: 317551 - RNA, 19 nt, Homo sapiens
acagagccuuguucuauug

SEQ ID NO: 317552 - RNA, 19 nt, Homo sapiens
auacuggucucuuuccaaa

SEQ ID NO: 317553 - RNA, 19 nt, Homo sapiens
gcagaaauuauggcuauga

SEQ ID NO: 317554 - RNA, 19 nt, Homo sapiens
aagaauugcucaguuaguu

SEQ ID NO: 317555 - RNA, 19 nt, Homo sapiens
aguaagauauugugugugu

SEQ ID NO: 317556 - RNA, 19 nt, Homo sapiens
ugaaaucuccaaguccuua

SEQ ID NO: 317557 - RNA, 19 nt, Homo sapiens
cuccgaaucugugaaauuu

SEQ ID NO: 317558 - RNA, 19 nt, Homo sapiens
uaagauauuguguguguga

SEQ ID NO: 317559 - RNA, 19 nt, Homo sapiens
gaggaucaaguaagauauu

SEQ ID NO: 317560 - RNA, 19 nt, Homo sapiens
gugaggaucaaguaagaua

SEQ ID NO: 317561 - RNA, 19 nt, Homo sapiens
gaugguaugccucugugua

SEQ ID NO: 317562 - RNA, 19 nt, Homo sapiens
caacucuucuuuccuuuac

SEQ ID NO: 317563 - RNA, 19 nt, Homo sapiens
gucgaggacucccaggaua

SEQ ID NO: 317564 - RNA, 19 nt, Homo sapiens
cccaagauucauacuauua

SEQ ID NO: 317565 - RNA, 19 nt, Homo sapiens
caagaggaaaucaguaaau

SEQ ID NO: 317566 - RNA, 19 nt, Homo sapiens
caauacaucuaagcuauac

SEQ ID NO: 317567 - RNA, 19 nt, Homo sapiens
aagaagaacaagugcauuu

SEQ ID NO: 317568 - RNA, 19 nt, Homo sapiens
ugaagaugcucugugaaau

SEQ ID NO: 317569 - RNA, 19 nt, Homo sapiens
guuuauagcuuccagauua

SEQ ID NO: 317570 - RNA, 19 nt, Homo sapiens
guauaugcaugcugauuua

SEQ ID NO: 317571 - RNA, 19 nt, Homo sapiens
ugacuuauaugcugaauug

SEQ ID NO: 317572 - RNA, 19 nt, Homo sapiens
gcacaaggcagcucacuuu

SEQ ID NO: 317573 - RNA, 19 nt, Homo sapiens
gaagugaaaguacugaaua

SEQ ID NO: 317574 - RNA, 19 nt, Homo sapiens
gagaauaccuucaaacaac

SEQ ID NO: 317575 - RNA, 19 nt, Homo sapiens
gagagaaucuacuaaguuc

SEQ ID NO: 317576 - RNA, 19 nt, Homo sapiens
gaccagcaguugauauuaa

SEQ ID NO: 317577 - RNA, 19 nt, Homo sapiens
gaagagugguuucaacugu

SEQ ID NO: 317578 - RNA, 19 nt, Homo sapiens
ggacuuaauuuacuuugga

SEQ ID NO: 317579 - RNA, 19 nt, Homo sapiens
gagaagagaauccagcaua

SEQ ID NO: 317580 - RNA, 19 nt, Homo sapiens
cuucaaagcugcacugauu

SEQ ID NO: 317581 - RNA, 19 nt, Homo sapiens
caauauggcugaaugaagu

SEQ ID NO: 317582 - RNA, 19 nt, Homo sapiens
caugacaacugaucaaaga

SEQ ID NO: 317583 - RNA, 19 nt, Homo sapiens
gcugaaauacuaugagaua

SEQ ID NO: 317584 - RNA, 19 nt, Homo sapiens
gggagagaaucaucuauug

SEQ ID NO: 317585 - RNA, 19 nt, Homo sapiens
gcagcuaaguaccuuguuu

SEQ ID NO: 317586 - RNA, 19 nt, Homo sapiens
ggaaacacauuaacuccau

SEQ ID NO: 317587 - RNA, 19 nt, Homo sapiens
ggaaaucaguaaauuagag

SEQ ID NO: 317588 - RNA, 19 nt, Homo sapiens
gacaacugaucaaagauuu

SEQ ID NO: 317589 - RNA, 19 nt, Homo sapiens
aaucagugcugcuuucuuu

SEQ ID NO: 317590 - RNA, 19 nt, Homo sapiens
agcauaagcuuaagcauuu

SEQ ID NO: 317591 - RNA, 19 nt, Homo sapiens
gauauuaaagcgcaaauga

SEQ ID NO: 317592 - RNA, 19 nt, Homo sapiens
caaggcagcucacuuugga

SEQ ID NO: 317593 - RNA, 19 nt, Homo sapiens
cagcagaaauuauggcuau

SEQ ID NO: 317594 - RNA, 19 nt, Homo sapiens
ggaaugcaauagaugaaau

SEQ ID NO: 317595 - RNA, 19 nt, Homo sapiens
gaaccuaauagcaccaaua

SEQ ID NO: 317596 - RNA, 19 nt, Homo sapiens
ugaagucagucaacaugua

SEQ ID NO: 317597 - RNA, 19 nt, Homo sapiens
ucacagccguccaacuuaa

SEQ ID NO: 317598 - RNA, 19 nt, Homo sapiens
gaaagcaggacauaugaga

SEQ ID NO: 317599 - RNA, 19 nt, Homo sapiens
acgaagaauugcucaguua

SEQ ID NO: 317600 - RNA, 19 nt, Homo sapiens
gaauuacucuacuguucuu

SEQ ID NO: 317601 - RNA, 19 nt, Homo sapiens
caguauauuuguccagaua

SEQ ID NO: 317602 - RNA, 19 nt, Homo sapiens
gaaaugcauaccaguaauu

SEQ ID NO: 317603 - RNA, 19 nt, Homo sapiens
acaagagccuguucacauu

SEQ ID NO: 317604 - RNA, 19 nt, Homo sapiens
gagagaaucaucuauugaa

SEQ ID NO: 317605 - RNA, 19 nt, Homo sapiens
aaacagcccuucccuucaa

SEQ ID NO: 317606 - RNA, 19 nt, Homo sapiens
ccacuuaugcauagauaua

SEQ ID NO: 317607 - RNA, 19 nt, Homo sapiens
uggagucacuugcacuuua

SEQ ID NO: 317608 - RNA, 19 nt, Homo sapiens
acaagguacugguccaaua

SEQ ID NO: 317609 - RNA, 19 nt, Homo sapiens
gaauugcauuuguuccauu

SEQ ID NO: 317610 - RNA, 19 nt, Homo sapiens
gcagaaagaccagcaguug

SEQ ID NO: 317611 - RNA, 19 nt, Homo sapiens
gaaauuauggcuaugaaag

SEQ ID NO: 317612 - RNA, 19 nt, Homo sapiens
ucuaggacaugguguuuaa

SEQ ID NO: 317613 - RNA, 19 nt, Homo sapiens
caggaaguuuaguuuguua

SEQ ID NO: 317614 - RNA, 19 nt, Homo sapiens
caauguaucagcagaaauu

SEQ ID NO: 317615 - RNA, 19 nt, Homo sapiens
ccacauugcuugauuugca

SEQ ID NO: 317616 - RNA, 19 nt, Homo sapiens
ccagauaauugguggauca

SEQ ID NO: 317617 - RNA, 19 nt, Homo sapiens
ggagucacuugcacuuuau

SEQ ID NO: 317618 - RNA, 19 nt, Homo sapiens
uguaccagaugcugaaaua

SEQ ID NO: 317619 - RNA, 19 nt, Homo sapiens
gaaacacauuaacuccauu

SEQ ID NO: 317620 - RNA, 19 nt, Homo sapiens
gaaagaagaacaagugcau

SEQ ID NO: 317621 - RNA, 19 nt, Homo sapiens
gaggaaaucaguaaauuag

SEQ ID NO: 317622 - RNA, 19 nt, Homo sapiens
ccaagagaauaccuucaaa

SEQ ID NO: 317623 - RNA, 19 nt, Homo sapiens
ccgaaucugugaaauuuga

SEQ ID NO: 317624 - RNA, 19 nt, Homo sapiens
gaaagaccagcaguugaua

SEQ ID NO: 317625 - RNA, 19 nt, Homo sapiens
acugacaacuguuuaauug

SEQ ID NO: 317626 - RNA, 19 nt, Homo sapiens
agagagaaguggauaaauc

SEQ ID NO: 317627 - RNA, 19 nt, Homo sapiens
gaagagaauccagcauauu

SEQ ID NO: 317628 - RNA, 19 nt, Homo sapiens
guuaugcacuuuaaaugga

SEQ ID NO: 317629 - RNA, 19 nt, Homo sapiens
ggagagaaucaucuauuga

SEQ ID NO: 317630 - RNA, 19 nt, Homo sapiens
ggacacagagcauuuccaa

SEQ ID NO: 317631 - RNA, 19 nt, Homo sapiens
gagagaaguggauaaauca

SEQ ID NO: 317632 - RNA, 19 nt, Homo sapiens
ccuaauagcaccaauacaa

SEQ ID NO: 317633 - RNA, 19 nt, Homo sapiens
cagcucaacuccugaagug

SEQ ID NO: 317634 - RNA, 19 nt, Homo sapiens
gacaagagccuguucacau

SEQ ID NO: 317635 - RNA, 19 nt, Homo sapiens
gguccaauauggcugaaug

SEQ ID NO: 317636 - RNA, 19 nt, Homo sapiens
aagagaauccagcauauuu

SEQ ID NO: 317637 - RNA, 19 nt, Homo sapiens
aagagaaacugaaguccuu

SEQ ID NO: 317638 - RNA, 19 nt, Homo sapiens
gguauaugcaugcugauuu

SEQ ID NO: 317639 - RNA, 19 nt, Homo sapiens
guaaacagccuacugaaaa

SEQ ID NO: 317640 - RNA, 19 nt, Homo sapiens
ugaagucucaccacacaua

SEQ ID NO: 317641 - RNA, 19 nt, Homo sapiens
ugaaguuuccuaugacuaa

SEQ ID NO: 317642 - RNA, 19 nt, Homo sapiens
gauaauugguggaucaaaa

SEQ ID NO: 317643 - RNA, 19 nt, Homo sapiens
caacaggaggacacugaua

SEQ ID NO: 317644 - RNA, 19 nt, Homo sapiens
caacaagaggaaaucagua

SEQ ID NO: 317645 - RNA, 19 nt, Homo sapiens
gggaucacuuucacaauca

SEQ ID NO: 317646 - RNA, 19 nt, Homo sapiens
agaagagaauccagcauau

SEQ ID NO: 317647 - RNA, 19 nt, Homo sapiens
gcccuucccuucaagagaa

SEQ ID NO: 317648 - RNA, 19 nt, Homo sapiens
gagaaucaucuauugaaga

SEQ ID NO: 317649 - RNA, 19 nt, Homo sapiens
cagaaauuauggcuaugaa

SEQ ID NO: 317650 - RNA, 19 nt, Homo sapiens
gcgaagaggaaaugagauu

SEQ ID NO: 317651 - RNA, 19 nt, Homo sapiens
gcacuugggaugucugaga

SEQ ID NO: 317652 - RNA, 19 nt, Homo sapiens
gugaaaagcuacccugaaa

SEQ ID NO: 317653 - RNA, 19 nt, Homo sapiens
uagaaaugcauaccaguaa

SEQ ID NO: 317654 - RNA, 19 nt, Homo sapiens
gcagaaauuauggcuauga

SEQ ID NO: 317655 - RNA, 19 nt, Homo sapiens
aagaauugcucaguuaguu

SEQ ID NO: 317656 - RNA, 19 nt, Homo sapiens
caugcugauuuaccacuua

SEQ ID NO: 317657 - RNA, 19 nt, Homo sapiens
cuauauugcuguaugguau

SEQ ID NO: 317658 - RNA, 19 nt, Homo sapiens
ucaacuguuuggagucuuu

SEQ ID NO: 317659 - RNA, 19 nt, Homo sapiens
ggccaaggguaauagaaau

SEQ ID NO: 317660 - RNA, 19 nt, Homo sapiens
cuccgaaucugugaaauuu

SEQ ID NO: 317661 - RNA, 19 nt, Homo sapiens
ugaaaucuccaaguccuua

SEQ ID NO: 317662 - RNA, 19 nt, Homo sapiens
guaacauucuucuacuugu

SEQ ID NO: 317663 - RNA, 19 nt, Homo sapiens
gucgaggacucccaggaua

SEQ ID NO: 317664 - RNA, 19 nt, Homo sapiens
gaagucucaccacacauaa

SEQ ID NO: 317665 - RNA, 19 nt, Homo sapiens
acucuacuguucuuucuuu

SEQ ID NO: 317666 - RNA, 19 nt, Homo sapiens
auucugaaguuuccuauga

SEQ ID NO: 317667 - RNA, 19 nt, Homo sapiens
uaacaggaaguuuaguuug

SEQ ID NO: 317668 - RNA, 19 nt, Homo sapiens
caagaggaaaucaguaaau

SEQ ID NO: 317669 - RNA, 19 nt, Homo sapiens
guuuauagcuuccagauua

SEQ ID NO: 317670 - RNA, 19 nt, Homo sapiens
guauaugcaugcugauuua

SEQ ID NO: 317671 - RNA, 19 nt, Homo sapiens
ugaagucagucaacauuua

SEQ ID NO: 317672 - RNA, 19 nt, Homo sapiens
ugacuuauaugcugaauug

SEQ ID NO: 317673 - RNA, 19 nt, Homo sapiens
gaagugaaaguacugaaua

SEQ ID NO: 317674 - RNA, 19 nt, Homo sapiens
gagaauaccuucaaacaac

SEQ ID NO: 317675 - RNA, 19 nt, Homo sapiens
gagagaaucuacuaaguuc

SEQ ID NO: 317676 - RNA, 19 nt, Homo sapiens
gaccagcaguugauauuaa

SEQ ID NO: 317677 - RNA, 19 nt, Homo sapiens
ggaaacacauuaaguacug

SEQ ID NO: 317678 - RNA, 19 nt, Homo sapiens
gaagagugguuucaacugu

SEQ ID NO: 317679 - RNA, 19 nt, Homo sapiens
ggacuuaauuuacuuugga

SEQ ID NO: 317680 - RNA, 19 nt, Homo sapiens
gagaagagaauccagcaua

SEQ ID NO: 317681 - RNA, 19 nt, Homo sapiens
cuucaaagcugcacugauu

SEQ ID NO: 317682 - RNA, 19 nt, Homo sapiens
caauauggcugaaugaagu

SEQ ID NO: 317683 - RNA, 19 nt, Homo sapiens
caugacaacugaucaaaga

SEQ ID NO: 317684 - RNA, 19 nt, Homo sapiens
gcugaaauacuaugagaua

SEQ ID NO: 317685 - RNA, 19 nt, Homo sapiens
gggagagaaucaucuauug

SEQ ID NO: 317686 - RNA, 19 nt, Homo sapiens
gcagcuaaguaccuuguuu

SEQ ID NO: 317687 - RNA, 19 nt, Homo sapiens
ggaaaucaguaaauuagag

SEQ ID NO: 317688 - RNA, 19 nt, Homo sapiens
gacaacugaucaaagauuu

SEQ ID NO: 317689 - RNA, 19 nt, Homo sapiens
aaucagugcugcuuucuuu

SEQ ID NO: 317690 - RNA, 19 nt, Homo sapiens
agcauaagcuuaagcauuu

SEQ ID NO: 317691 - RNA, 19 nt, Homo sapiens
gauauuaaagcgcaaauga

SEQ ID NO: 317692 - RNA, 19 nt, Homo sapiens
cagcagaaauuauggcuau

SEQ ID NO: 317693 - RNA, 19 nt, Homo sapiens
ggaaugcaauagaugaaau

SEQ ID NO: 317694 - RNA, 19 nt, Homo sapiens
gaaccuaauagcaccaaua

SEQ ID NO: 317695 - RNA, 19 nt, Homo sapiens
ucacagccguccaacuuaa

SEQ ID NO: 317696 - RNA, 19 nt, Homo sapiens
gaaagcaggacauaugaga

SEQ ID NO: 317697 - RNA, 19 nt, Homo sapiens
acgaagaauugcucaguua

SEQ ID NO: 317698 - RNA, 19 nt, Homo sapiens
gaauuacucuacuguucuu

SEQ ID NO: 317699 - RNA, 19 nt, Homo sapiens
caguauauuuguccagaua

SEQ ID NO: 317700 - RNA, 19 nt, Homo sapiens
gaaaugcauaccaguaauu

SEQ ID NO: 317701 - RNA, 19 nt, Homo sapiens
acaagagccuguucacauu

SEQ ID NO: 317702 - RNA, 19 nt, Homo sapiens
gagagaaucaucuauugaa

SEQ ID NO: 317703 - RNA, 19 nt, Homo sapiens
aaacagcccuucccuucaa

SEQ ID NO: 317704 - RNA, 19 nt, Homo sapiens
ccacuuaugcauagauaua

SEQ ID NO: 317705 - RNA, 19 nt, Homo sapiens
uggagucacuugcacuuua

SEQ ID NO: 317706 - RNA, 19 nt, Homo sapiens
gaauugcauuuguuccauu

SEQ ID NO: 317707 - RNA, 19 nt, Homo sapiens
gcagaaagaccagcaguug

SEQ ID NO: 317708 - RNA, 19 nt, Homo sapiens
gaaauuauggcuaugaaag

SEQ ID NO: 317709 - RNA, 19 nt, Homo sapiens
ucuaggacaugguguuuaa

SEQ ID NO: 317710 - RNA, 19 nt, Homo sapiens
caggaaguuuaguuuguua

SEQ ID NO: 317711 - RNA, 19 nt, Homo sapiens
caauguaucagcagaaauu

SEQ ID NO: 317712 - RNA, 19 nt, Homo sapiens
ccacauugcuugauuugca

SEQ ID NO: 317713 - RNA, 19 nt, Homo sapiens
ccagauaauugguggauca

SEQ ID NO: 317714 - RNA, 19 nt, Homo sapiens
ggagucacuugcacuuuau

SEQ ID NO: 317715 - RNA, 19 nt, Homo sapiens
gaaagaagaacaagugcau

SEQ ID NO: 317716 - RNA, 19 nt, Homo sapiens
gaggaaaucaguaaauuag

SEQ ID NO: 317717 - RNA, 19 nt, Homo sapiens
ccaagagaauaccuucaaa

SEQ ID NO: 317718 - RNA, 19 nt, Homo sapiens
uguaccagaugcugaaaua

SEQ ID NO: 317719 - RNA, 19 nt, Homo sapiens
ccgaaucugugaaauuuga

SEQ ID NO: 317720 - RNA, 19 nt, Homo sapiens
agagagaaguggauaaauc

SEQ ID NO: 317721 - RNA, 19 nt, Homo sapiens
gaaagaccagcaguugaua

SEQ ID NO: 317722 - RNA, 19 nt, Homo sapiens
acugacaacuguuuaauug

SEQ ID NO: 317723 - RNA, 19 nt, Homo sapiens
gaagagaauccagcauauu

SEQ ID NO: 317724 - RNA, 19 nt, Homo sapiens
guuaugcacuuuaaaugga

SEQ ID NO: 317725 - RNA, 19 nt, Homo sapiens
ggagagaaucaucuauuga

SEQ ID NO: 317726 - RNA, 19 nt, Homo sapiens
gagagaaguggauaaauca

SEQ ID NO: 317727 - RNA, 19 nt, Homo sapiens
ggacacagagcauuuccaa

SEQ ID NO: 317728 - RNA, 19 nt, Homo sapiens
ccuaauagcaccaauacaa

SEQ ID NO: 317729 - RNA, 19 nt, Homo sapiens
cagcucaacuccugaagug

SEQ ID NO: 317730 - RNA, 19 nt, Homo sapiens
gacaagagccuguucacau

SEQ ID NO: 317731 - RNA, 19 nt, Homo sapiens
gguccaauauggcugaaug

SEQ ID NO: 317732 - RNA, 19 nt, Homo sapiens
aagagaauccagcauauuu

SEQ ID NO: 317733 - RNA, 19 nt, Homo sapiens
aagagaaacugaaguccuu

SEQ ID NO: 317734 - RNA, 19 nt, Homo sapiens
gguauaugcaugcugauuu

SEQ ID NO: 317735 - RNA, 19 nt, Homo sapiens
guaaacagccuacugaaaa

SEQ ID NO: 317736 - RNA, 19 nt, Homo sapiens
caacaggaggacacugaua

SEQ ID NO: 317737 - RNA, 19 nt, Homo sapiens
ugaagucucaccacacaua

SEQ ID NO: 317738 - RNA, 19 nt, Homo sapiens
ugaaguuuccuaugacuaa

SEQ ID NO: 317739 - RNA, 19 nt, Homo sapiens
gauaauugguggaucaaaa

SEQ ID NO: 317740 - RNA, 19 nt, Homo sapiens
caacaagaggaaaucagua

SEQ ID NO: 317741 - RNA, 19 nt, Homo sapiens
gggaucacuuucacaauca

SEQ ID NO: 317742 - RNA, 19 nt, Homo sapiens
agaagagaauccagcauau

SEQ ID NO: 317743 - RNA, 19 nt, Homo sapiens
gcccuucccuucaagagaa

SEQ ID NO: 317744 - RNA, 19 nt, Homo sapiens
gagaaucaucuauugaaga

SEQ ID NO: 317745 - RNA, 19 nt, Homo sapiens
cagaaauuauggcuaugaa

SEQ ID NO: 317746 - RNA, 19 nt, Homo sapiens
gcgaagaggaaaugagauu

SEQ ID NO: 317747 - RNA, 19 nt, Homo sapiens
gcacuugggaugucugaga

SEQ ID NO: 317748 - RNA, 19 nt, Homo sapiens
gugaaaagcuacccugaaa

SEQ ID NO: 317749 - RNA, 19 nt, Homo sapiens
uagaaaugcauaccaguaa

SEQ ID NO: 317750 - RNA, 19 nt, Homo sapiens
gcagaaauuauggcuauga

SEQ ID NO: 317751 - RNA, 19 nt, Homo sapiens
aagaauugcucaguuaguu

SEQ ID NO: 317752 - RNA, 19 nt, Homo sapiens
caugcugauuuaccacuua

SEQ ID NO: 317753 - RNA, 19 nt, Homo sapiens
cuauauugcuguaugguau

SEQ ID NO: 317754 - RNA, 19 nt, Homo sapiens
ucaacuguuuggagucuuu

SEQ ID NO: 317755 - RNA, 19 nt, Homo sapiens
cuccgaaucugugaaauuu

SEQ ID NO: 317756 - RNA, 19 nt, Homo sapiens
ggccaaggguaauagaaau

SEQ ID NO: 317757 - RNA, 19 nt, Homo sapiens
ugaaaucuccaaguccuua

SEQ ID NO: 317758 - RNA, 19 nt, Homo sapiens
guaacauucuucuacuugu

SEQ ID NO: 317759 - RNA, 19 nt, Homo sapiens
gucgaggacucccaggaua

SEQ ID NO: 317760 - RNA, 19 nt, Homo sapiens
gaagucucaccacacauaa

SEQ ID NO: 317761 - RNA, 19 nt, Homo sapiens
acucuacuguucuuucuuu

SEQ ID NO: 317762 - RNA, 19 nt, Homo sapiens
auucugaaguuuccuauga

SEQ ID NO: 317763 - RNA, 19 nt, Homo sapiens
uaacaggaaguuuaguuug

SEQ ID NO: 317764 - RNA, 19 nt, Homo sapiens
auuaaguacugguccaaua

SEQ ID NO: 317765 - RNA, 19 nt, Homo sapiens
caagaggaaaucaguaaau

SEQ ID NO: 317766 - RNA, 19 nt, Homo sapiens
ugagagaaucuacuaaguu

SEQ ID NO: 317767 - RNA, 19 nt, Homo sapiens
gaauguacacuuucugucu

SEQ ID NO: 317768 - RNA, 19 nt, Homo sapiens
gauaugucuuggccacuau

SEQ ID NO: 317769 - RNA, 19 nt, Homo sapiens
ggacagacuuucuacuaug

SEQ ID NO: 317770 - RNA, 19 nt, Homo sapiens
gcugaaauccuucgcuuua

SEQ ID NO: 317771 - RNA, 19 nt, Homo sapiens
gggcaaugcuugugugauu

SEQ ID NO: 317772 - RNA, 19 nt, Homo sapiens
gcccugagcuccaaagaga

SEQ ID NO: 317773 - RNA, 19 nt, Homo sapiens
gguagaagcuaagguguga

SEQ ID NO: 317774 - RNA, 19 nt, Homo sapiens
gcaggaggcuauacuucaa

SEQ ID NO: 317775 - RNA, 19 nt, Homo sapiens
gaaauucugggucuugaaa

SEQ ID NO: 317776 - RNA, 19 nt, Homo sapiens
ucacaaucguggcauuuaa

SEQ ID NO: 317777 - RNA, 19 nt, Homo sapiens
ugaguccgcuugaugaauu

SEQ ID NO: 317778 - RNA, 19 nt, Homo sapiens
gccagugccuuacaauuug

SEQ ID NO: 317779 - RNA, 19 nt, Homo sapiens
gaguggagcugugcgguuu

SEQ ID NO: 317780 - RNA, 19 nt, Homo sapiens
gggacagacuuucuacuau

SEQ ID NO: 317781 - RNA, 19 nt, Homo sapiens
gaugaauucuaaugcuuug

SEQ ID NO: 317782 - RNA, 19 nt, Homo sapiens
aaaugugacuuaucuccua

SEQ ID NO: 317783 - RNA, 19 nt, Homo sapiens
gcacaaaguacaaaggaau

SEQ ID NO: 317784 - RNA, 19 nt, Homo sapiens
ggagguugcuggacaggau

SEQ ID NO: 317785 - RNA, 19 nt, Homo sapiens
ccaaaucuagacauacaua

SEQ ID NO: 317786 - RNA, 19 nt, Homo sapiens
acagaacagucgaaccuuu

SEQ ID NO: 317787 - RNA, 19 nt, Homo sapiens
gcuuagagcuaugagaaau

SEQ ID NO: 317788 - RNA, 19 nt, Homo sapiens
agacauacauaagggcuuu

SEQ ID NO: 317789 - RNA, 19 nt, Homo sapiens
gaggcgcgauggcaaguug

SEQ ID NO: 317790 - RNA, 19 nt, Homo sapiens
gaaaggaguguauucaacu

SEQ ID NO: 317791 - RNA, 19 nt, Homo sapiens
uaccaaaucuagacauaca

SEQ ID NO: 317792 - RNA, 19 nt, Homo sapiens
gcaaguugauaaaauguga

SEQ ID NO: 317793 - RNA, 19 nt, Homo sapiens
cgccagugccuuacaauuu

SEQ ID NO: 317794 - RNA, 19 nt, Homo sapiens
gauuggguuuaccgaagua

SEQ ID NO: 317795 - RNA, 19 nt, Homo sapiens
ggcuauacuucaaauccua

SEQ ID NO: 317796 - RNA, 19 nt, Homo sapiens
cauuuaaagugcacaaagu

SEQ ID NO: 317797 - RNA, 19 nt, Homo sapiens
ccuuugagguuccaguaaa

SEQ ID NO: 317798 - RNA, 19 nt, Homo sapiens
gaauucuaaugcuuugcuu

SEQ ID NO: 317799 - RNA, 19 nt, Homo sapiens
gaugugaguccgcuugaug

SEQ ID NO: 317800 - RNA, 19 nt, Homo sapiens
ugugacuuaucuccuaaua

SEQ ID NO: 317801 - RNA, 19 nt, Homo sapiens
aaaccuacaguccaauaaa

SEQ ID NO: 317802 - RNA, 19 nt, Homo sapiens
caacagaacagucgaaccu

SEQ ID NO: 317803 - RNA, 19 nt, Homo sapiens
ccaaagagaacuaccaaaa

SEQ ID NO: 317804 - RNA, 19 nt, Homo sapiens
uaaagugcacaaaguacaa

SEQ ID NO: 317805 - RNA, 19 nt, Homo sapiens
uuagagcuaugagaaaugu

SEQ ID NO: 317806 - RNA, 19 nt, Homo sapiens
gcaaugcuugugugauuca

SEQ ID NO: 317807 - RNA, 19 nt, Homo sapiens
gggagggacagacuuucua

SEQ ID NO: 317808 - RNA, 19 nt, Homo sapiens
ucaugucaauggcaacaga

SEQ ID NO: 317809 - RNA, 19 nt, Homo sapiens
gacagacuuucuacuaugc

SEQ ID NO: 317810 - RNA, 19 nt, Homo sapiens
gcaacucggccucgaacau

SEQ ID NO: 317811 - RNA, 19 nt, Homo sapiens
aaacguguauagccucagu

SEQ ID NO: 317812 - RNA, 19 nt, Homo sapiens
gauggcaaguugauaaaau

SEQ ID NO: 317813 - RNA, 19 nt, Homo sapiens
gcgauggcaaguugauaaa

SEQ ID NO: 317814 - RNA, 19 nt, Homo sapiens
ggaaauucugggucuugaa

SEQ ID NO: 317815 - RNA, 19 nt, Homo sapiens
cucauucgcugaaauccuu

SEQ ID NO: 317816 - RNA, 19 nt, Homo sapiens
aaugugacuuaucuccuaa

SEQ ID NO: 317817 - RNA, 19 nt, Homo sapiens
ggaacgaccauggcacuca

SEQ ID NO: 317818 - RNA, 19 nt, Homo sapiens
gagcugaaaggaaauucug

SEQ ID NO: 317819 - RNA, 19 nt, Homo sapiens
gcauuuaaagugcacaaag

SEQ ID NO: 317820 - RNA, 19 nt, Homo sapiens
cagcaguaccugagcaaga

SEQ ID NO: 317821 - RNA, 19 nt, Homo sapiens
agccagaacacaugaguuu

SEQ ID NO: 317822 - RNA, 19 nt, Homo sapiens
aaucguggcauuuaaagug

SEQ ID NO: 317823 - RNA, 19 nt, Homo sapiens
ggucuugaaaggaguguau

SEQ ID NO: 317824 - RNA, 19 nt, Homo sapiens
cacaaaguacaaaggaauu

SEQ ID NO: 317825 - RNA, 19 nt, Homo sapiens
guaccagccagaacacaug

SEQ ID NO: 317826 - RNA, 19 nt, Homo sapiens
agagcuaugagaaauguuu

SEQ ID NO: 317827 - RNA, 19 nt, Homo sapiens
gaaauccuucgcuuuacca

SEQ ID NO: 317828 - RNA, 19 nt, Homo sapiens
uagccucagugacucauuc

SEQ ID NO: 317829 - RNA, 19 nt, Homo sapiens
uauuuggaaugggauguuu

SEQ ID NO: 317830 - RNA, 19 nt, Homo sapiens
uggguuuaccgaaguauaa

SEQ ID NO: 317831 - RNA, 19 nt, Homo sapiens
cacaaucguggcauuuaaa

SEQ ID NO: 317832 - RNA, 19 nt, Homo sapiens
agcaguaccugagcaagaa

SEQ ID NO: 317833 - RNA, 19 nt, Homo sapiens
gcuaugagaaauguuuguu

SEQ ID NO: 317834 - RNA, 19 nt, Homo sapiens
caacucggccucgaacauc

SEQ ID NO: 317835 - RNA, 19 nt, Homo sapiens
cagaacagucgaaccuuuc

SEQ ID NO: 317836 - RNA, 19 nt, Homo sapiens
ggcaaugcuugugugauuc

SEQ ID NO: 317837 - RNA, 19 nt, Homo sapiens
agggacagacuuucuacua

SEQ ID NO: 317838 - RNA, 19 nt, Homo sapiens
aaagagaacuaccaaaagg

SEQ ID NO: 317839 - RNA, 19 nt, Homo sapiens
acacaugaguuuugaggaa

SEQ ID NO: 317840 - RNA, 19 nt, Homo sapiens
gagcuaugagaaauguuug

SEQ ID NO: 317841 - RNA, 19 nt, Homo sapiens
gugcacaaaguacaaagga

SEQ ID NO: 317842 - RNA, 19 nt, Homo sapiens
aagacuaccaccagcagua

SEQ ID NO: 317843 - RNA, 19 nt, Homo sapiens
auccuucgcuuuaccaaau

SEQ ID NO: 317844 - RNA, 19 nt, Homo sapiens
acaauuugcaaacguguau

SEQ ID NO: 317845 - RNA, 19 nt, Homo sapiens
guguauagccucagugacu

SEQ ID NO: 317846 - RNA, 19 nt, Homo sapiens
cgcgauggcaaguugauaa

SEQ ID NO: 317847 - RNA, 19 nt, Homo sapiens
aaacuggccaugcagaagu

SEQ ID NO: 317848 - RNA, 19 nt, Homo sapiens
ugacucauucgcugaaauc

SEQ ID NO: 317849 - RNA, 19 nt, Homo sapiens
ggagggacagacuuucuac

SEQ ID NO: 317850 - RNA, 19 nt, Homo sapiens
cagaacacaugaguuuuga

SEQ ID NO: 317851 - RNA, 19 nt, Homo sapiens
aaaggaaauucugggucuu

SEQ ID NO: 317852 - RNA, 19 nt, Homo sapiens
gugacucauucgcugaaau

SEQ ID NO: 317853 - RNA, 19 nt, Homo sapiens
aggaaauucugggucuuga

SEQ ID NO: 317854 - RNA, 19 nt, Homo sapiens
aauaauugcuccccacaug

SEQ ID NO: 317855 - RNA, 19 nt, Homo sapiens
gcgcgauggcaaguugaua

SEQ ID NO: 317856 - RNA, 19 nt, Homo sapiens
uuauacagauuggguuuac

SEQ ID NO: 317857 - RNA, 19 nt, Homo sapiens
ggccuuugagguuccagua

SEQ ID NO: 317858 - RNA, 19 nt, Homo sapiens
uccgcuugaugaauucuaa

SEQ ID NO: 317859 - RNA, 19 nt, Homo sapiens
gaguccgcuugaugaauuc

SEQ ID NO: 317860 - RNA, 19 nt, Homo sapiens
uuaaagugcacaaaguaca

SEQ ID NO: 317861 - RNA, 19 nt, Homo sapiens
guuugggcaaccucgauua

SEQ ID NO: 317862 - RNA, 19 nt, Homo sapiens
cgaccucugccaagcaaau

SEQ ID NO: 317863 - RNA, 19 nt, Homo sapiens
guacggaccugcaucauga

SEQ ID NO: 317864 - RNA, 19 nt, Homo sapiens
gcaaagaccuucgggagaa

SEQ ID NO: 317865 - RNA, 19 nt, Homo sapiens
ggaauggccuggaagagaa

SEQ ID NO: 317866 - RNA, 19 nt, Homo sapiens
gcugugaccucuuccagaa

SEQ ID NO: 317867 - RNA, 19 nt, Homo sapiens
ggaccugcaucaugaacaa

SEQ ID NO: 317868 - RNA, 19 nt, Homo sapiens
gcuucugacucaaugcuua

SEQ ID NO: 317869 - RNA, 19 nt, Homo sapiens
cgacaacuauugccggaau

SEQ ID NO: 317870 - RNA, 19 nt, Homo sapiens
gccacaaguucccgaauga

SEQ ID NO: 317871 - RNA, 19 nt, Homo sapiens
cagaccaggugcaguuuga

SEQ ID NO: 317872 - RNA, 19 nt, Homo sapiens
guaaugacacaguccuaaa

SEQ ID NO: 317873 - RNA, 19 nt, Homo sapiens
gcagaucgagcgagaguuc

SEQ ID NO: 317874 - RNA, 19 nt, Homo sapiens
uaccagauccggcguugua

SEQ ID NO: 317875 - RNA, 19 nt, Homo sapiens
ccaaagguacggguaauga

SEQ ID NO: 317876 - RNA, 19 nt, Homo sapiens
acagucagcuugcggaauc

SEQ ID NO: 317877 - RNA, 19 nt, Homo sapiens
ggcagaugcugaagagugu

SEQ ID NO: 317878 - RNA, 19 nt, Homo sapiens
gaccaaagguacggguaau

SEQ ID NO: 317879 - RNA, 19 nt, Homo sapiens
caagaggccacaacuguca

SEQ ID NO: 317880 - RNA, 19 nt, Homo sapiens
gccaagaggccacaacugu

SEQ ID NO: 317881 - RNA, 19 nt, Homo sapiens
ccagaagaaagacuacgua

SEQ ID NO: 317882 - RNA, 19 nt, Homo sapiens
gcaggaggauguggcagau

SEQ ID NO: 317883 - RNA, 19 nt, Homo sapiens
gguaaugacacaguccuaa

SEQ ID NO: 317884 - RNA, 19 nt, Homo sapiens
aagccgcaguucacguuua

SEQ ID NO: 317885 - RNA, 19 nt, Homo sapiens
ccacaacugucagcugcuu

SEQ ID NO: 317886 - RNA, 19 nt, Homo sapiens
gcgugugucuggugcaaug

SEQ ID NO: 317887 - RNA, 19 nt, Homo sapiens
ccagagcugcggcaucaaa

SEQ ID NO: 317888 - RNA, 19 nt, Homo sapiens
cuaaauguggccuuucuga

SEQ ID NO: 317889 - RNA, 19 nt, Homo sapiens
agagaucugugacccugaa

SEQ ID NO: 317890 - RNA, 19 nt, Homo sapiens
ccgcaucagcaccgauuua

SEQ ID NO: 317891 - RNA, 19 nt, Homo sapiens
gagcggccauggugcuaca

SEQ ID NO: 317892 - RNA, 19 nt, Homo sapiens
gcaccgauuuacgccagaa

SEQ ID NO: 317893 - RNA, 19 nt, Homo sapiens
ggauguggcagaugcugaa

SEQ ID NO: 317894 - RNA, 19 nt, Homo sapiens
uaaauguggccuuucugaa

SEQ ID NO: 317895 - RNA, 19 nt, Homo sapiens
aagccauguuuccucuuua

SEQ ID NO: 317896 - RNA, 19 nt, Homo sapiens
augcacaacuggaggagaa

SEQ ID NO: 317897 - RNA, 19 nt, Homo sapiens
gcugugggcccuuaaugga

SEQ ID NO: 317898 - RNA, 19 nt, Homo sapiens
aaccaggaguguaacauca

SEQ ID NO: 317899 - RNA, 19 nt, Homo sapiens
uaaugacacaguccuaaau

SEQ ID NO: 317900 - RNA, 19 nt, Homo sapiens
gggaccaagugugagauug

SEQ ID NO: 317901 - RNA, 19 nt, Homo sapiens
ggagguccuuggugcuaca

SEQ ID NO: 317902 - RNA, 19 nt, Homo sapiens
caacugcuggguccuggaa

SEQ ID NO: 317903 - RNA, 19 nt, Homo sapiens
ggugcaauggcgaggaaua

SEQ ID NO: 317904 - RNA, 19 nt, Homo sapiens
gguccuuggugcuacacaa

SEQ ID NO: 317905 - RNA, 19 nt, Homo sapiens
gaccaagugugagauugca

SEQ ID NO: 317906 - RNA, 19 nt, Homo sapiens
caaccaggaguguaacauc

SEQ ID NO: 317907 - RNA, 19 nt, Homo sapiens
gaggguggaucggcuggau

SEQ ID NO: 317908 - RNA, 19 nt, Homo sapiens
ccacuccugcugcuucuga

SEQ ID NO: 317909 - RNA, 19 nt, Homo sapiens
ccaggaguguaacaucaag

SEQ ID NO: 317910 - RNA, 19 nt, Homo sapiens
gaccaggugcaguuugaga

SEQ ID NO: 317911 - RNA, 19 nt, Homo sapiens
cggaauggccuggaagaga

SEQ ID NO: 317912 - RNA, 19 nt, Homo sapiens
cgaaugaucacaaguacac

SEQ ID NO: 317913 - RNA, 19 nt, Homo sapiens
gcagcgcucgccauugaau

SEQ ID NO: 317914 - RNA, 19 nt, Homo sapiens
uuccagagcugcggcauca

SEQ ID NO: 317915 - RNA, 19 nt, Homo sapiens
ccagggaccaagugugaga

SEQ ID NO: 317916 - RNA, 19 nt, Homo sapiens
ggucuggacgacaacuauu

SEQ ID NO: 317917 - RNA, 19 nt, Homo sapiens
caugggcccuggugcuaca

SEQ ID NO: 317918 - RNA, 19 nt, Homo sapiens
accaaggucuggacgacaa

SEQ ID NO: 317919 - RNA, 19 nt, Homo sapiens
acaaguucccgaaugauca

SEQ ID NO: 317920 - RNA, 19 nt, Homo sapiens
agaccaaagguacggguaa

SEQ ID NO: 317921 - RNA, 19 nt, Homo sapiens
ggaccaagugugagauugc

SEQ ID NO: 317922 - RNA, 19 nt, Homo sapiens
gacgugugcgggagaguga

SEQ ID NO: 317923 - RNA, 19 nt, Homo sapiens
gcaacucacccuggacagu

SEQ ID NO: 317924 - RNA, 19 nt, Homo sapiens
cgaaccgcaugcacaacug

SEQ ID NO: 317925 - RNA, 19 nt, Homo sapiens
ggccuuggcaggaggaugu

SEQ ID NO: 317926 - RNA, 19 nt, Homo sapiens
cggccauggugcuacacua

SEQ ID NO: 317927 - RNA, 19 nt, Homo sapiens
ucccgaaugaucacaagua

SEQ ID NO: 317928 - RNA, 19 nt, Homo sapiens
guacggguaaugacacagu

SEQ ID NO: 317929 - RNA, 19 nt, Homo sapiens
acaagccgcaguucacguu

SEQ ID NO: 317930 - RNA, 19 nt, Homo sapiens
aguccuaaauguggccuuu

SEQ ID NO: 317931 - RNA, 19 nt, Homo sapiens
aaagguacggguaaugaca

SEQ ID NO: 317932 - RNA, 19 nt, Homo sapiens
gaucugugacccugaacca

SEQ ID NO: 317933 - RNA, 19 nt, Homo sapiens
caaagaccuucgggagaac

SEQ ID NO: 317934 - RNA, 19 nt, Homo sapiens
gacaacuauugccggaauc

SEQ ID NO: 317935 - RNA, 19 nt, Homo sapiens
gggcaaguuccucgaccaa

SEQ ID NO: 317936 - RNA, 19 nt, Homo sapiens
uggacuggauucacaaggu

SEQ ID NO: 317937 - RNA, 19 nt, Homo sapiens
uuugagaaguguggcaaga

SEQ ID NO: 317938 - RNA, 19 nt, Homo sapiens
agccacaaguucccgaaug

SEQ ID NO: 317939 - RNA, 19 nt, Homo sapiens
ggauggagcugcuggcuuu

SEQ ID NO: 317940 - RNA, 19 nt, Homo sapiens
cugcagaccuauagauuua

SEQ ID NO: 317941 - RNA, 19 nt, Homo sapiens
caucuugucuccuacagua

SEQ ID NO: 317942 - RNA, 19 nt, Homo sapiens
gcaccugucucacucuuga

SEQ ID NO: 317943 - RNA, 19 nt, Homo sapiens
caccuaagcuuacugaguu

SEQ ID NO: 317944 - RNA, 19 nt, Homo sapiens
gaaaugagagugcuguguu

SEQ ID NO: 317945 - RNA, 19 nt, Homo sapiens
gaaagaguccauccagcua

SEQ ID NO: 317946 - RNA, 19 nt, Homo sapiens
ccacuugacuuaguucuug

SEQ ID NO: 317947 - RNA, 19 nt, Homo sapiens
ugaaggaccucaucagcuu

SEQ ID NO: 317948 - RNA, 19 nt, Homo sapiens
ggucaaggaugugcugauu

SEQ ID NO: 317949 - RNA, 19 nt, Homo sapiens
uagaggaguuugaguguga

SEQ ID NO: 317950 - RNA, 19 nt, Homo sapiens
uaaacuacuugcuguaugu

SEQ ID NO: 317951 - RNA, 19 nt, Homo sapiens
gccauuaaguuugaguaua

SEQ ID NO: 317952 - RNA, 19 nt, Homo sapiens
caagguggcugacuuuggu

SEQ ID NO: 317953 - RNA, 19 nt, Homo sapiens
ugagagugcuguguuugua

SEQ ID NO: 317954 - RNA, 19 nt, Homo sapiens
gagcaugccauuaaguuug

SEQ ID NO: 317955 - RNA, 19 nt, Homo sapiens
agaagacccugucgugcua

SEQ ID NO: 317956 - RNA, 19 nt, Homo sapiens
gagcuggucaggucacuaa

SEQ ID NO: 317957 - RNA, 19 nt, Homo sapiens
guggagcgcuguugugaau

SEQ ID NO: 317958 - RNA, 19 nt, Homo sapiens
ggccugaccugaagucugu

SEQ ID NO: 317959 - RNA, 19 nt, Homo sapiens
gagcauccuucuccgauag

SEQ ID NO: 317960 - RNA, 19 nt, Homo sapiens
caaccuaguuccacugaag

SEQ ID NO: 317961 - RNA, 19 nt, Homo sapiens
caccaacacugacccuuga

SEQ ID NO: 317962 - RNA, 19 nt, Homo sapiens
gcacuggucuucagcuacu

SEQ ID NO: 317963 - RNA, 19 nt, Homo sapiens
ccaauaaaggaacaaauga

SEQ ID NO: 317964 - RNA, 19 nt, Homo sapiens
ggaguacuauaguguucaa

SEQ ID NO: 317965 - RNA, 19 nt, Homo sapiens
acaggucacugcauuguau

SEQ ID NO: 317966 - RNA, 19 nt, Homo sapiens
aaaugagagugcuguguuu

SEQ ID NO: 317967 - RNA, 19 nt, Homo sapiens
gcaccucgcaugagaugaa

SEQ ID NO: 317968 - RNA, 19 nt, Homo sapiens
ggacagggaguacuauagu

SEQ ID NO: 317969 - RNA, 19 nt, Homo sapiens
cugcguagauggugaaugu

SEQ ID NO: 317970 - RNA, 19 nt, Homo sapiens
gggcugugcuggucaaugg

SEQ ID NO: 317971 - RNA, 19 nt, Homo sapiens
ggagcaugccauuaaguuu

SEQ ID NO: 317972 - RNA, 19 nt, Homo sapiens
ucaggucacuaaacuacuu

SEQ ID NO: 317973 - RNA, 19 nt, Homo sapiens
guagauggugaaugucaua

SEQ ID NO: 317974 - RNA, 19 nt, Homo sapiens
gaacccaucaggucacugu

SEQ ID NO: 317975 - RNA, 19 nt, Homo sapiens
cuacagaaguggccuugca

SEQ ID NO: 317976 - RNA, 19 nt, Homo sapiens
gugcccaacuugccacuga

SEQ ID NO: 317977 - RNA, 19 nt, Homo sapiens
uggcugaggucaaggaugu

SEQ ID NO: 317978 - RNA, 19 nt, Homo sapiens
gaaccaauaaaggaacaaa

SEQ ID NO: 317979 - RNA, 19 nt, Homo sapiens
ggaggaagcagcuaguucu

SEQ ID NO: 317980 - RNA, 19 nt, Homo sapiens
cuaagggcauggcauuuca

SEQ ID NO: 317981 - RNA, 19 nt, Homo sapiens
gcacacaugggcacaaugg

SEQ ID NO: 317982 - RNA, 19 nt, Homo sapiens
gggccaggaaguacuauuu

SEQ ID NO: 317983 - RNA, 19 nt, Homo sapiens
gguccucgacugcagauuu

SEQ ID NO: 317984 - RNA, 19 nt, Homo sapiens
caccauaccgccacauuga

SEQ ID NO: 317985 - RNA, 19 nt, Homo sapiens
cugaggagcaugccauuaa

SEQ ID NO: 317986 - RNA, 19 nt, Homo sapiens
guggaaagcaggugugaga

SEQ ID NO: 317987 - RNA, 19 nt, Homo sapiens
uacaucaacucccacauca

SEQ ID NO: 317988 - RNA, 19 nt, Homo sapiens
caggaccacugcccaccua

SEQ ID NO: 317989 - RNA, 19 nt, Homo sapiens
gaaugugcguccagaacag

SEQ ID NO: 317990 - RNA, 19 nt, Homo sapiens
gacagggaguacuauagug

SEQ ID NO: 317991 - RNA, 19 nt, Homo sapiens
cuaaacuacuugcuguaug

SEQ ID NO: 317992 - RNA, 19 nt, Homo sapiens
guuccugcccuuuaacuuu

SEQ ID NO: 317993 - RNA, 19 nt, Homo sapiens
ucugauguguggucauuug

SEQ ID NO: 317994 - RNA, 19 nt, Homo sapiens
uggagagccugcagaccua

SEQ ID NO: 317995 - RNA, 19 nt, Homo sapiens
gaaggaccucaucagcuuu

SEQ ID NO: 317996 - RNA, 19 nt, Homo sapiens
ccacagagugagccaguga

SEQ ID NO: 317997 - RNA, 19 nt, Homo sapiens
ccucggcccacuugacuua

SEQ ID NO: 317998 - RNA, 19 nt, Homo sapiens
ugccugcgcuggucaguug

SEQ ID NO: 317999 - RNA, 19 nt, Homo sapiens
ucucauugguaucauguug

SEQ ID NO: 318000 - RNA, 19 nt, Homo sapiens
ggaccagguuuuccaggua

SEQ ID NO: 318001 - RNA, 19 nt, Homo sapiens
gacgagucauucacaguca

SEQ ID NO: 318002 - RNA, 19 nt, Homo sapiens
cuaagucgcaucacagaga

SEQ ID NO: 318003 - RNA, 19 nt, Homo sapiens
ugacacgccuugacaacgu

SEQ ID NO: 318004 - RNA, 19 nt, Homo sapiens
ccauugggcacccguguaa

SEQ ID NO: 318005 - RNA, 19 nt, Homo sapiens
acaguggacucagcaguga

SEQ ID NO: 318006 - RNA, 19 nt, Homo sapiens
uggcagagcagaaguuugu

SEQ ID NO: 318007 - RNA, 19 nt, Homo sapiens
cgaaugugcuggcucucau

SEQ ID NO: 318008 - RNA, 19 nt, Homo sapiens
cgacugcacuggucuucag

SEQ ID NO: 318009 - RNA, 19 nt, Homo sapiens
gauggugaaugucauaucc

SEQ ID NO: 318010 - RNA, 19 nt, Homo sapiens
ccacacgggagccuucgua

SEQ ID NO: 318011 - RNA, 19 nt, Homo sapiens
gccaucaagucacuaaguc

SEQ ID NO: 318012 - RNA, 19 nt, Homo sapiens
gaccaggcccagaaucgaa

SEQ ID NO: 318013 - RNA, 19 nt, Homo sapiens
cuaccacggagaauacaua

SEQ ID NO: 318014 - RNA, 19 nt, Homo sapiens
gcaagcacuuccggguaga

SEQ ID NO: 318015 - RNA, 19 nt, Homo sapiens
gcuccaacuucuaccuuca

SEQ ID NO: 318016 - RNA, 19 nt, Homo sapiens
uggacacacuaauugauga

SEQ ID NO: 318017 - RNA, 19 nt, Homo sapiens
guccucgacugcagauuug

SEQ ID NO: 318018 - RNA, 19 nt, Homo sapiens
ccugcaacauguauuuaug

SEQ ID NO: 318019 - RNA, 19 nt, Homo sapiens
gauuuaccaccaagucuga

SEQ ID NO: 318020 - RNA, 19 nt, Homo sapiens
gcucaugcguggccugaac

SEQ ID NO: 318021 - RNA, 19 nt, Homo sapiens
gauucucuguaccaaguga

SEQ ID NO: 318022 - RNA, 19 nt, Homo sapiens
ccaaugugccaucaaguca

SEQ ID NO: 318023 - RNA, 19 nt, Homo sapiens
ggucaggucacuaaacuac

SEQ ID NO: 318024 - RNA, 19 nt, Homo sapiens
uugaauacgugcacagcuu

SEQ ID NO: 318025 - RNA, 19 nt, Homo sapiens
ucaaggaugugcugauucc

SEQ ID NO: 318026 - RNA, 19 nt, Homo sapiens
aaagaguccauccagcuaa

SEQ ID NO: 318027 - RNA, 19 nt, Homo sapiens
guacaggucacugcauugu

SEQ ID NO: 318028 - RNA, 19 nt, Homo sapiens
gccaggaaguacuauuugg

SEQ ID NO: 318029 - RNA, 19 nt, Homo sapiens
uuucagaggcaauagguaa

SEQ ID NO: 318030 - RNA, 19 nt, Homo sapiens
ccuuguuccugcccuuuaa

SEQ ID NO: 318031 - RNA, 19 nt, Homo sapiens
acggugaccugcuccaguu

SEQ ID NO: 318032 - RNA, 19 nt, Homo sapiens
uaagucgcaucacagagau

SEQ ID NO: 318033 - RNA, 19 nt, Homo sapiens
cagaggcaauagguaaaug

SEQ ID NO: 318034 - RNA, 19 nt, Homo sapiens
cccagcaccucgcaugaga

SEQ ID NO: 318035 - RNA, 19 nt, Homo sapiens
cugauucucuguaccaagu

SEQ ID NO: 318036 - RNA, 19 nt, Homo sapiens
cgaauccaaugugccauca

SEQ ID NO: 318037 - RNA, 19 nt, Homo sapiens
cagaaucgaauccaaugug

SEQ ID NO: 318038 - RNA, 19 nt, Homo sapiens
acacgggagccuucguaua

SEQ ID NO: 318039 - RNA, 19 nt, Homo sapiens
gcagagagguuaacagauu

SEQ ID NO: 318040 - RNA, 19 nt, Homo sapiens
gcauuuagaucuacacucu

SEQ ID NO: 318041 - RNA, 19 nt, Homo sapiens
aauccuagcuucuuccauu

SEQ ID NO: 318042 - RNA, 19 nt, Homo sapiens
cagcagaauugacaguuga

SEQ ID NO: 318043 - RNA, 19 nt, Homo sapiens
uaagacaaguucaacaaca

SEQ ID NO: 318044 - RNA, 19 nt, Homo sapiens
cagagagguuaacagauuu

SEQ ID NO: 318045 - RNA, 19 nt, Homo sapiens
gaugaauccuagcuucuuc

SEQ ID NO: 318046 - RNA, 19 nt, Homo sapiens
ggccaugucuccugcauag

SEQ ID NO: 318047 - RNA, 19 nt, Homo sapiens
cugcugacaugacuucuuu

SEQ ID NO: 318048 - RNA, 19 nt, Homo sapiens
gggcagagagguuaacaga

SEQ ID NO: 318049 - RNA, 19 nt, Homo sapiens
agacgcaggugaagauaug

SEQ ID NO: 318050 - RNA, 19 nt, Homo sapiens
uuaguacucuucuagcauu

SEQ ID NO: 318051 - RNA, 19 nt, Homo sapiens
cagauguguugcaaaggua

SEQ ID NO: 318052 - RNA, 19 nt, Homo sapiens
gcuccaguuucaccucuuu

SEQ ID NO: 318053 - RNA, 19 nt, Homo sapiens
ccagccgccuucccuuuaa

SEQ ID NO: 318054 - RNA, 19 nt, Homo sapiens
ccagcagaauugacaguug

SEQ ID NO: 318055 - RNA, 19 nt, Homo sapiens
cuggaagagucccuuagua

SEQ ID NO: 318056 - RNA, 19 nt, Homo sapiens
ccucuuugcucccugaguu

SEQ ID NO: 318057 - RNA, 19 nt, Homo sapiens
aagacaaguucaacaacaa

SEQ ID NO: 318058 - RNA, 19 nt, Homo sapiens
gccagccgccuucccuuua

SEQ ID NO: 318059 - RNA, 19 nt, Homo sapiens
guacucuucuagcauuuag

SEQ ID NO: 318060 - RNA, 19 nt, Homo sapiens
gaauugacaguugaacaga

SEQ ID NO: 318061 - RNA, 19 nt, Homo sapiens
ggaagagucccuuaguacu

SEQ ID NO: 318062 - RNA, 19 nt, Homo sapiens
acagauguguugcaaaggu

SEQ ID NO: 318063 - RNA, 19 nt, Homo sapiens
ggaagaugaauccuagcuu

SEQ ID NO: 318064 - RNA, 19 nt, Homo sapiens
caagaaaagcgcagagaaa

SEQ ID NO: 318065 - RNA, 19 nt, Homo sapiens
aagaugcgcucgucaaagc

SEQ ID NO: 318066 - RNA, 19 nt, Homo sapiens
gaagaugcgcucgucaaag

SEQ ID NO: 318067 - RNA, 19 nt, Homo sapiens
agaagaugcgcucgucaaa

SEQ ID NO: 318068 - RNA, 19 nt, Homo sapiens
agacaaguucaacaacaaa

SEQ ID NO: 318069 - RNA, 19 nt, Homo sapiens
cagaagaugcgcucgucaa

SEQ ID NO: 318070 - RNA, 19 nt, Homo sapiens
gcaaguuccgccagaagca

SEQ ID NO: 318071 - RNA, 19 nt, Homo sapiens
agagagguuaacagauuua

SEQ ID NO: 318072 - RNA, 19 nt, Homo sapiens
gagacgcaggugaagauau

SEQ ID NO: 318073 - RNA, 19 nt, Homo sapiens
gcaagaaaagcgcagagaa

SEQ ID NO: 318074 - RNA, 19 nt, Homo sapiens
cagcauguaccaccugaca

SEQ ID NO: 318075 - RNA, 19 nt, Homo sapiens
aacacaagacgaaccguaa

SEQ ID NO: 318076 - RNA, 19 nt, Homo sapiens
gaaaagcgcagagaaaucg

SEQ ID NO: 318077 - RNA, 19 nt, Homo sapiens
gcuggaagagucccuuagu

SEQ ID NO: 318078 - RNA, 19 nt, Homo sapiens
aagacuagccagccaggaa

SEQ ID NO: 318079 - RNA, 19 nt, Homo sapiens
ccuuaguacucuucuagca

SEQ ID NO: 318080 - RNA, 19 nt, Homo sapiens
uguaccaccugacauagag

SEQ ID NO: 318081 - RNA, 19 nt, Homo sapiens
caaggcaaagagacuacaa

SEQ ID NO: 318082 - RNA, 19 nt, Homo sapiens
uccucaagcugccagaaga

SEQ ID NO: 318083 - RNA, 19 nt, Homo sapiens
caugucuccugcauagcuu

SEQ ID NO: 318084 - RNA, 19 nt, Homo sapiens
gaggccaugucuccugcau

SEQ ID NO: 318085 - RNA, 19 nt, Homo sapiens
cagaauugacaguugaaca

SEQ ID NO: 318086 - RNA, 19 nt, Homo sapiens
uaguacucuucuagcauuu

SEQ ID NO: 318087 - RNA, 19 nt, Homo sapiens
uggaagagucccuuaguac

SEQ ID NO: 318088 - RNA, 19 nt, Homo sapiens
cgacauagcugaaauuugu

SEQ ID NO: 318089 - RNA, 19 nt, Homo sapiens
caaaggcaaugacuuguuu

SEQ ID NO: 318090 - RNA, 19 nt, Homo sapiens
uaaagagggagacaaauua

SEQ ID NO: 318091 - RNA, 19 nt, Homo sapiens
gugcuaaagucaaugauuu

SEQ ID NO: 318092 - RNA, 19 nt, Homo sapiens
ucagauaauuggagaguaa

SEQ ID NO: 318093 - RNA, 19 nt, Homo sapiens
ucacaaagauuggcucuga

SEQ ID NO: 318094 - RNA, 19 nt, Homo sapiens
gaggugagguagaaaauua

SEQ ID NO: 318095 - RNA, 19 nt, Homo sapiens
gagagauuauucaaaguga

SEQ ID NO: 318096 - RNA, 19 nt, Homo sapiens
uguccaaacucacaauuaa

SEQ ID NO: 318097 - RNA, 19 nt, Homo sapiens
aaagggugcuuguacaauu

SEQ ID NO: 318098 - RNA, 19 nt, Homo sapiens
ugagaggaauugaugguuu

SEQ ID NO: 318099 - RNA, 19 nt, Homo sapiens
gcaggcagcguccauauau

SEQ ID NO: 318100 - RNA, 19 nt, Homo sapiens
guacauucauccucacaga

SEQ ID NO: 318101 - RNA, 19 nt, Homo sapiens
gaaauacuagguacauuca

SEQ ID NO: 318102 - RNA, 19 nt, Homo sapiens
gagaaauacuagguacauu

SEQ ID NO: 318103 - RNA, 19 nt, Homo sapiens
gagaggaauugaugguuuc

SEQ ID NO: 318104 - RNA, 19 nt, Homo sapiens
guaaguccauuuguuguau

SEQ ID NO: 318105 - RNA, 19 nt, Homo sapiens
gguauaccuuuaucccuuu

SEQ ID NO: 318106 - RNA, 19 nt, Homo sapiens
gauuauugacuucugcuua

SEQ ID NO: 318107 - RNA, 19 nt, Homo sapiens
gagcgcaaguuccgucaga

SEQ ID NO: 318108 - RNA, 19 nt, Homo sapiens
gaaaauggcugcaaaaccu

SEQ ID NO: 318109 - RNA, 19 nt, Homo sapiens
gaaacaguaccucuccauu

SEQ ID NO: 318110 - RNA, 19 nt, Homo sapiens
guguguaccuguuguaugu

SEQ ID NO: 318111 - RNA, 19 nt, Homo sapiens
gaauugaugguuucugaga

SEQ ID NO: 318112 - RNA, 19 nt, Homo sapiens
caaggcuguugguaacuuu

SEQ ID NO: 318113 - RNA, 19 nt, Homo sapiens
ggagagauuauucaaagug

SEQ ID NO: 318114 - RNA, 19 nt, Homo sapiens
gcaggaggcagaacuggaa

SEQ ID NO: 318115 - RNA, 19 nt, Homo sapiens
auuaguagauccagaaaga

SEQ ID NO: 318116 - RNA, 19 nt, Homo sapiens
uuaaagagggagacaaauu

SEQ ID NO: 318117 - RNA, 19 nt, Homo sapiens
aaacaguaccucuccauug

SEQ ID NO: 318118 - RNA, 19 nt, Homo sapiens
gaguaucuuguaaccauua

SEQ ID NO: 318119 - RNA, 19 nt, Homo sapiens
gcauguaccaccuguccua

SEQ ID NO: 318120 - RNA, 19 nt, Homo sapiens
gaaagggugcuuguacaau

SEQ ID NO: 318121 - RNA, 19 nt, Homo sapiens
ccucacagauugcaaaggu

SEQ ID NO: 318122 - RNA, 19 nt, Homo sapiens
cacaucauauuucugcauu

SEQ ID NO: 318123 - RNA, 19 nt, Homo sapiens
gacagggccacacgacaua

SEQ ID NO: 318124 - RNA, 19 nt, Homo sapiens
aggaauugaugguuucuga

SEQ ID NO: 318125 - RNA, 19 nt, Homo sapiens
accauuaccuauaugcuaa

SEQ ID NO: 318126 - RNA, 19 nt, Homo sapiens
aagauuggcucugaugguu

SEQ ID NO: 318127 - RNA, 19 nt, Homo sapiens
aagggugcuuguacaauuu

SEQ ID NO: 318128 - RNA, 19 nt, Homo sapiens
aaacaaagaaacagacaca

SEQ ID NO: 318129 - RNA, 19 nt, Homo sapiens
gcaaguuccgucagaaaca

SEQ ID NO: 318130 - RNA, 19 nt, Homo sapiens
guugguaacuuuauuucag

SEQ ID NO: 318131 - RNA, 19 nt, Homo sapiens
gauauggagagauuauuca

SEQ ID NO: 318132 - RNA, 19 nt, Homo sapiens
gugcuuguacaauuugaua

SEQ ID NO: 318133 - RNA, 19 nt, Homo sapiens
gcacgcccuuuaccacauc

SEQ ID NO: 318134 - RNA, 19 nt, Homo sapiens
ggaaacacaagaccaaucg

SEQ ID NO: 318135 - RNA, 19 nt, Homo sapiens
aaauaugcuuucucugugu

SEQ ID NO: 318136 - RNA, 19 nt, Homo sapiens
ccaaaggcaaugacuuguu

SEQ ID NO: 318137 - RNA, 19 nt, Homo sapiens
auacuacaguuguuccuau

SEQ ID NO: 318138 - RNA, 19 nt, Homo sapiens
aaggaagaccagaucaaua

SEQ ID NO: 318139 - RNA, 19 nt, Homo sapiens
uaguagauccagaaagaaa

SEQ ID NO: 318140 - RNA, 19 nt, Homo sapiens
ucaaggcuguugguaacuu

SEQ ID NO: 318141 - RNA, 19 nt, Homo sapiens
gaugagaagaauccugaga

SEQ ID NO: 318142 - RNA, 19 nt, Homo sapiens
ugacuucugcuuauggaaa

SEQ ID NO: 318143 - RNA, 19 nt, Homo sapiens
ggaagaccagaucaauaga

SEQ ID NO: 318144 - RNA, 19 nt, Homo sapiens
uaaggaagaccagaucaau

SEQ ID NO: 318145 - RNA, 19 nt, Homo sapiens
guccaaaggcaaugacuug

SEQ ID NO: 318146 - RNA, 19 nt, Homo sapiens
gcgcaaguuccgucagaaa

SEQ ID NO: 318147 - RNA, 19 nt, Homo sapiens
gaagguaaagccauguuuu

SEQ ID NO: 318148 - RNA, 19 nt, Homo sapiens
guuguauguccuaaacuua

SEQ ID NO: 318149 - RNA, 19 nt, Homo sapiens
cagcuucagucucccuuuc

SEQ ID NO: 318150 - RNA, 19 nt, Homo sapiens
acaauuaguagauccagaa

SEQ ID NO: 318151 - RNA, 19 nt, Homo sapiens
gcuguugguaacuuuauuu

SEQ ID NO: 318152 - RNA, 19 nt, Homo sapiens
ucucaaggcuguugguaac

SEQ ID NO: 318153 - RNA, 19 nt, Homo sapiens
aauacuagguacauucauc

SEQ ID NO: 318154 - RNA, 19 nt, Homo sapiens
aaagagggagacaaauuau

SEQ ID NO: 318155 - RNA, 19 nt, Homo sapiens
ugaaagggugcuuguacaa

SEQ ID NO: 318156 - RNA, 19 nt, Homo sapiens
agaaauacuagguacauuc

SEQ ID NO: 318157 - RNA, 19 nt, Homo sapiens
ugagaagaauccugagacu

SEQ ID NO: 318158 - RNA, 19 nt, Homo sapiens
gauuggcucugaugguuuu

SEQ ID NO: 318159 - RNA, 19 nt, Homo sapiens
uaaaaccuguugagaggaa

SEQ ID NO: 318160 - RNA, 19 nt, Homo sapiens
gaaggggacacaucauauu

SEQ ID NO: 318161 - RNA, 19 nt, Homo sapiens
auggagagauuauucaaag

SEQ ID NO: 318162 - RNA, 19 nt, Homo sapiens
ccagaucaauagacuccau

SEQ ID NO: 318163 - RNA, 19 nt, Homo sapiens
aggaagaccagaucaauag

SEQ ID NO: 318164 - RNA, 19 nt, Homo sapiens
cauccuacccguuccauag

SEQ ID NO: 318165 - RNA, 19 nt, Homo sapiens
uguuguauguccuaaacuu

SEQ ID NO: 318166 - RNA, 19 nt, Homo sapiens
ugaggaaacacaagaccaa

SEQ ID NO: 318167 - RNA, 19 nt, Homo sapiens
gccuggaggugagguagaa

SEQ ID NO: 318168 - RNA, 19 nt, Homo sapiens
accaauaccugggaugaga

SEQ ID NO: 318169 - RNA, 19 nt, Homo sapiens
ccacacgacauagcugaaa

SEQ ID NO: 318170 - RNA, 19 nt, Homo sapiens
ugaguaucuuguaaccauu

SEQ ID NO: 318171 - RNA, 19 nt, Homo sapiens
acauucauccucacagauu

SEQ ID NO: 318172 - RNA, 19 nt, Homo sapiens
gcacacagaaaauauuaga

SEQ ID NO: 318173 - RNA, 19 nt, Homo sapiens
uguaaguccauuuguugua

SEQ ID NO: 318174 - RNA, 19 nt, Homo sapiens
acaaagauuggcucugaug

SEQ ID NO: 318175 - RNA, 19 nt, Homo sapiens
guccaaacucacaauuaaa

SEQ ID NO: 318176 - RNA, 19 nt, Homo sapiens
guauaccuuuaucccuuug

SEQ ID NO: 318177 - RNA, 19 nt, Homo sapiens
ucccuccgguauaccuuua

SEQ ID NO: 318178 - RNA, 19 nt, Homo sapiens
augaguaucuuguaaccau

SEQ ID NO: 318179 - RNA, 19 nt, Homo sapiens
cauucauccucacagauug

SEQ ID NO: 318180 - RNA, 19 nt, Homo sapiens
aacaguaccucuccauugc

SEQ ID NO: 318181 - RNA, 19 nt, Homo sapiens
uguguaaguccauuuguug

SEQ ID NO: 318182 - RNA, 19 nt, Homo sapiens
gaagaccagaucaauagac

SEQ ID NO: 318183 - RNA, 19 nt, Homo sapiens
ccagugggauauggcaugu

SEQ ID NO: 318184 - RNA, 19 nt, Homo sapiens
caguacuccugcucugcua

SEQ ID NO: 318185 - RNA, 19 nt, Homo sapiens
uugaaagggugcuuguaca

SEQ ID NO: 318186 - RNA, 19 nt, Homo sapiens
guaaagccauguuuugacu

SEQ ID NO: 318187 - RNA, 19 nt, Homo sapiens
caaguuccgucagaaacag

SEQ ID NO: 318188 - RNA, 19 nt, Homo sapiens
uaacuacccugaccgguuu

SEQ ID NO: 318189 - RNA, 19 nt, Homo sapiens
ucucauaucuugccuagga

SEQ ID NO: 318190 - RNA, 19 nt, Homo sapiens
aaauguaccuccugcaaga

SEQ ID NO: 318191 - RNA, 19 nt, Homo sapiens
gcaaagagugcaaauguac

SEQ ID NO: 318192 - RNA, 19 nt, Homo sapiens
gcaaauguaccuccugcaa

SEQ ID NO: 318193 - RNA, 19 nt, Homo sapiens
auaaauagagcaaccagua

SEQ ID NO: 318194 - RNA, 19 nt, Homo sapiens
ugcaaaggcucaucagaga

SEQ ID NO: 318195 - RNA, 19 nt, Homo sapiens
gaacuccaggcuugucuug

SEQ ID NO: 318196 - RNA, 19 nt, Homo sapiens
ccgguuugcuacauucuuu

SEQ ID NO: 318197 - RNA, 19 nt, Homo sapiens
ccagggcugugucugcaaa

SEQ ID NO: 318198 - RNA, 19 nt, Homo sapiens
gcaaaggcucaucagagaa

SEQ ID NO: 318199 - RNA, 19 nt, Homo sapiens
gcccugacuucucauaucu

SEQ ID NO: 318200 - RNA, 19 nt, Homo sapiens
caaaggcucaucagagaag

SEQ ID NO: 318201 - RNA, 19 nt, Homo sapiens
ccugacuucucauaucuug

SEQ ID NO: 318202 - RNA, 19 nt, Homo sapiens
ugaccgguuugcuacauuc

SEQ ID NO: 318203 - RNA, 19 nt, Homo sapiens
gcccugcucccagacauaa

SEQ ID NO: 318204 - RNA, 19 nt, Homo sapiens
gcucccagacauaaauaga

SEQ ID NO: 318205 - RNA, 19 nt, Homo sapiens
ccgcugcugugccugaugu

SEQ ID NO: 318206 - RNA, 19 nt, Homo sapiens
uaaauagagcaaccaguac

SEQ ID NO: 318207 - RNA, 19 nt, Homo sapiens
aauagagcaaccaguacua

SEQ ID NO: 318208 - RNA, 19 nt, Homo sapiens
ccucauugcccgugucauu

SEQ ID NO: 318209 - RNA, 19 nt, Homo sapiens
ggaacugggcuuucuuugc

SEQ ID NO: 318210 - RNA, 19 nt, Homo sapiens
caggcuuucugcccuaaau

SEQ ID NO: 318211 - RNA, 19 nt, Homo sapiens
ggacacaaaccccaacugu

SEQ ID NO: 318212 - RNA, 19 nt, Homo sapiens
cauucccucuccaggcuuu

SEQ ID NO: 318213 - RNA, 19 nt, Homo sapiens
ggcuuucuuugcccucauu

SEQ ID NO: 318214 - RNA, 19 nt, Homo sapiens
caaauagagugacccguaa

SEQ ID NO: 318215 - RNA, 19 nt, Homo sapiens
ccaaguacaaauagaguga

SEQ ID NO: 318216 - RNA, 19 nt, Homo sapiens
gcucccaaguacaaauaga

SEQ ID NO: 318217 - RNA, 19 nt, Homo sapiens
gcccugcucccaaguacaa

SEQ ID NO: 318218 - RNA, 19 nt, Homo sapiens
gcaaaggggcaucggagaa

SEQ ID NO: 318219 - RNA, 19 nt, Homo sapiens
aaauagagugacccguaaa

SEQ ID NO: 318220 - RNA, 19 nt, Homo sapiens
cuacaacuccgacucauuu

SEQ ID NO: 318221 - RNA, 19 nt, Homo sapiens
gaaaacagaaugacacgua

SEQ ID NO: 318222 - RNA, 19 nt, Homo sapiens
cgacucauuugcuacauuc

SEQ ID NO: 318223 - RNA, 19 nt, Homo sapiens
gcaaaggggcgucagagaa

SEQ ID NO: 318224 - RNA, 19 nt, Homo sapiens
caccucggcuugcaaugga

SEQ ID NO: 318225 - RNA, 19 nt, Homo sapiens
gcccugcugucagaugaaa

SEQ ID NO: 318226 - RNA, 19 nt, Homo sapiens
aaacagaaugacacguaaa

SEQ ID NO: 318227 - RNA, 19 nt, Homo sapiens
ccgacucauuugcuacauu

SEQ ID NO: 318228 - RNA, 19 nt, Homo sapiens
aaaacagaaugacacguaa

SEQ ID NO: 318229 - RNA, 19 nt, Homo sapiens
aaauguaccuccugcaaga

SEQ ID NO: 318230 - RNA, 19 nt, Homo sapiens
cuacaacccugagcauuug

SEQ ID NO: 318231 - RNA, 19 nt, Homo sapiens
gcaaagagugcaaauguac

SEQ ID NO: 318232 - RNA, 19 nt, Homo sapiens
gcaaauguaccuccugcaa

SEQ ID NO: 318233 - RNA, 19 nt, Homo sapiens
gcucccagauguaaacaga

SEQ ID NO: 318234 - RNA, 19 nt, Homo sapiens
guaaacgccauaaacaguu

SEQ ID NO: 318235 - RNA, 19 nt, Homo sapiens
gaccugcucccagauguaa

SEQ ID NO: 318236 - RNA, 19 nt, Homo sapiens
ucuacaacccugagcauuu

SEQ ID NO: 318237 - RNA, 19 nt, Homo sapiens
gcaaaggggcgucggagaa

SEQ ID NO: 318238 - RNA, 19 nt, Homo sapiens
caugggcugugccaagugu

SEQ ID NO: 318239 - RNA, 19 nt, Homo sapiens
uguaaacgccauaaacagu

SEQ ID NO: 318240 - RNA, 19 nt, Homo sapiens
cagaccugcucccagaugu

SEQ ID NO: 318241 - RNA, 19 nt, Homo sapiens
ccagggcugcgucugcaaa

SEQ ID NO: 318242 - RNA, 19 nt, Homo sapiens
gcaaagggacgucagacaa

SEQ ID NO: 318243 - RNA, 19 nt, Homo sapiens
caaagggacgucagacaag

SEQ ID NO: 318244 - RNA, 19 nt, Homo sapiens
aaagggacgucagacaagu

SEQ ID NO: 318245 - RNA, 19 nt, Homo sapiens
gcaaaggggcgucggacaa

SEQ ID NO: 318246 - RNA, 19 nt, Homo sapiens
caaggacugugugugcaaa

SEQ ID NO: 318247 - RNA, 19 nt, Homo sapiens
guggagcacuggagauagu

SEQ ID NO: 318248 - RNA, 19 nt, Homo sapiens
agaggcagcugaggcagaa

SEQ ID NO: 318249 - RNA, 19 nt, Homo sapiens
caagugcgagggaugcaaa

SEQ ID NO: 318250 - RNA, 19 nt, Homo sapiens
uuggaggaaugacaauaaa

SEQ ID NO: 318251 - RNA, 19 nt, Homo sapiens
gcccuguggugaaguguuc

SEQ ID NO: 318252 - RNA, 19 nt, Homo sapiens
gugaaguguuccugguguu

SEQ ID NO: 318253 - RNA, 19 nt, Homo sapiens
gcucagugcccaccuaugc

SEQ ID NO: 318254 - RNA, 19 nt, Homo sapiens
gaagugugccaaggacugu

SEQ ID NO: 318255 - RNA, 19 nt, Homo sapiens
gaccuuggaggaaugacaa

SEQ ID NO: 318256 - RNA, 19 nt, Homo sapiens
cuuggaggaaugacaauaa

SEQ ID NO: 318257 - RNA, 19 nt, Homo sapiens
guguggagcacuggagaua

SEQ ID NO: 318258 - RNA, 19 nt, Homo sapiens
gugagaagugugccaagga

SEQ ID NO: 318259 - RNA, 19 nt, Homo sapiens
gcguccaguugcuugaaga

SEQ ID NO: 318260 - RNA, 19 nt, Homo sapiens
cugcugaccuuggaggaau

SEQ ID NO: 318261 - RNA, 19 nt, Homo sapiens
ccaaggacugugugugcaa

SEQ ID NO: 318262 - RNA, 19 nt, Homo sapiens
ggagguaaauuaugucuua

SEQ ID NO: 318263 - RNA, 19 nt, Homo sapiens
gaagagggcuguacacaug

SEQ ID NO: 318264 - RNA, 19 nt, Homo sapiens
uaucagagaugcauacaaa

SEQ ID NO: 318265 - RNA, 19 nt, Homo sapiens
caaagaguauguuguaaga

SEQ ID NO: 318266 - RNA, 19 nt, Homo sapiens
gcaaaugacuaguaaacau

SEQ ID NO: 318267 - RNA, 19 nt, Homo sapiens
cgagagagguucuuauaga

SEQ ID NO: 318268 - RNA, 19 nt, Homo sapiens
uaagggaguuacaucuuua

SEQ ID NO: 318269 - RNA, 19 nt, Homo sapiens
caaagaaugugaggaagaa

SEQ ID NO: 318270 - RNA, 19 nt, Homo sapiens
gaaaugggacucuuugguu

SEQ ID NO: 318271 - RNA, 19 nt, Homo sapiens
gguaaucucuacuuuccua

SEQ ID NO: 318272 - RNA, 19 nt, Homo sapiens
ggaguuacaucuuuauucu

SEQ ID NO: 318273 - RNA, 19 nt, Homo sapiens
gcugggaacucuacaucua

SEQ ID NO: 318274 - RNA, 19 nt, Homo sapiens
aaaugggacucuuugguua

SEQ ID NO: 318275 - RNA, 19 nt, Homo sapiens
uaaggaggcuggaauuugu

SEQ ID NO: 318276 - RNA, 19 nt, Homo sapiens
ggaggguaaucucuacuuu

SEQ ID NO: 318277 - RNA, 19 nt, Homo sapiens
caagacauuguguguauua

SEQ ID NO: 318278 - RNA, 19 nt, Homo sapiens
ggucagaaacccuccauaa

SEQ ID NO: 318279 - RNA, 19 nt, Homo sapiens
uaaagaagaggaucauuga

SEQ ID NO: 318280 - RNA, 19 nt, Homo sapiens
uuaaagacccugaaagaaa

SEQ ID NO: 318281 - RNA, 19 nt, Homo sapiens
gggacucuuugguuauuua

SEQ ID NO: 318282 - RNA, 19 nt, Homo sapiens
ggacaauggucacaaucga

SEQ ID NO: 318283 - RNA, 19 nt, Homo sapiens
gggaauuccugcuuaacuu

SEQ ID NO: 318284 - RNA, 19 nt, Homo sapiens
ugaagaauauggcccaguu

SEQ ID NO: 318285 - RNA, 19 nt, Homo sapiens
gcgaacaucugggcuuuga

SEQ ID NO: 318286 - RNA, 19 nt, Homo sapiens
aauaaaggguggaggguaa

SEQ ID NO: 318287 - RNA, 19 nt, Homo sapiens
uuaagggaguuacaucuuu

SEQ ID NO: 318288 - RNA, 19 nt, Homo sapiens
uccauaaccugaagaauau

SEQ ID NO: 318289 - RNA, 19 nt, Homo sapiens
ggaauuuguuacgcaagua

SEQ ID NO: 318290 - RNA, 19 nt, Homo sapiens
guaagaaagacaagacauu

SEQ ID NO: 318291 - RNA, 19 nt, Homo sapiens
gcgauauugucauuauuga

SEQ ID NO: 318292 - RNA, 19 nt, Homo sapiens
gaaaagcaaaugacuagua

SEQ ID NO: 318293 - RNA, 19 nt, Homo sapiens
uaaagacccugaaagaaaa

SEQ ID NO: 318294 - RNA, 19 nt, Homo sapiens
gagagagguucuuauagag

SEQ ID NO: 318295 - RNA, 19 nt, Homo sapiens
gagggauacugggauaauu

SEQ ID NO: 318296 - RNA, 19 nt, Homo sapiens
agacacgguugcucuauau

SEQ ID NO: 318297 - RNA, 19 nt, Homo sapiens
caucugggcuuugaaggaa

SEQ ID NO: 318298 - RNA, 19 nt, Homo sapiens
gguaaugaagcagaauuua

SEQ ID NO: 318299 - RNA, 19 nt, Homo sapiens
agagacuccugaaugauuu

SEQ ID NO: 318300 - RNA, 19 nt, Homo sapiens
cagauaggguccacagaau

SEQ ID NO: 318301 - RNA, 19 nt, Homo sapiens
cagaggugguucuugcuaa

SEQ ID NO: 318302 - RNA, 19 nt, Homo sapiens
cgugaagauuggaauaauu

SEQ ID NO: 318303 - RNA, 19 nt, Homo sapiens
cuccauaaccugaagaaua

SEQ ID NO: 318304 - RNA, 19 nt, Homo sapiens
gaacaucugggcuuugaag

SEQ ID NO: 318305 - RNA, 19 nt, Homo sapiens
uaagaaagacaagacauug

SEQ ID NO: 318306 - RNA, 19 nt, Homo sapiens
cuaaagaagaggaucauug

SEQ ID NO: 318307 - RNA, 19 nt, Homo sapiens
ggacuccggugccacucaa

SEQ ID NO: 318308 - RNA, 19 nt, Homo sapiens
gacauuguguguauuagag

SEQ ID NO: 318309 - RNA, 19 nt, Homo sapiens
gaagaauauggcccaguuu

SEQ ID NO: 318310 - RNA, 19 nt, Homo sapiens
ugaagcagaauuuaaguug

SEQ ID NO: 318311 - RNA, 19 nt, Homo sapiens
caaaugacuaguaaacaug

SEQ ID NO: 318312 - RNA, 19 nt, Homo sapiens
uauagagacugcuaagaag

SEQ ID NO: 318313 - RNA, 19 nt, Homo sapiens
gaccucaguccuucuauga

SEQ ID NO: 318314 - RNA, 19 nt, Homo sapiens
gugaagauuggaauaauug

SEQ ID NO: 318315 - RNA, 19 nt, Homo sapiens
aagacacgguugcucuaua

SEQ ID NO: 318316 - RNA, 19 nt, Homo sapiens
auuagagacuccugaauga

SEQ ID NO: 318317 - RNA, 19 nt, Homo sapiens
ggaauuccugcuuaacuug

SEQ ID NO: 318318 - RNA, 19 nt, Homo sapiens
ccucaguccuucuaugaug

SEQ ID NO: 318319 - RNA, 19 nt, Homo sapiens
gaaggaagagggcuguaca

SEQ ID NO: 318320 - RNA, 19 nt, Homo sapiens
uuauagagacugcuaagaa

SEQ ID NO: 318321 - RNA, 19 nt, Homo sapiens
ucagagaugcauacaaaga

SEQ ID NO: 318322 - RNA, 19 nt, Homo sapiens
gaagaaaagcaaaugacua

SEQ ID NO: 318323 - RNA, 19 nt, Homo sapiens
uagagacuccugaaugauu

SEQ ID NO: 318324 - RNA, 19 nt, Homo sapiens
gggcagaaagcuucauguu

SEQ ID NO: 318325 - RNA, 19 nt, Homo sapiens
ccaaagaaugugaggaaga

SEQ ID NO: 318326 - RNA, 19 nt, Homo sapiens
ucagauaggguccacagaa

SEQ ID NO: 318327 - RNA, 19 nt, Homo sapiens
cuucaaaggucaacuacca

SEQ ID NO: 318328 - RNA, 19 nt, Homo sapiens
ccagaggagugugccauau

SEQ ID NO: 318329 - RNA, 19 nt, Homo sapiens
gaaggcagcacaccaucau

SEQ ID NO: 318330 - RNA, 19 nt, Homo sapiens
agaggagugugccauauuc

SEQ ID NO: 318331 - RNA, 19 nt, Homo sapiens
gggcuguacacaugucaua

SEQ ID NO: 318332 - RNA, 19 nt, Homo sapiens
ggaagagggcuguacacau

SEQ ID NO: 318333 - RNA, 19 nt, Homo sapiens
aaaaggauaugguagcauu

SEQ ID NO: 318334 - RNA, 19 nt, Homo sapiens
caucuagcaauuucucuuu

SEQ ID NO: 318335 - RNA, 19 nt, Homo sapiens
ugacaggaccacuaugaga

SEQ ID NO: 318336 - RNA, 19 nt, Homo sapiens
gagaugcauacaaagaauu

SEQ ID NO: 318337 - RNA, 19 nt, Homo sapiens
cagagaugcauacaaagaa

SEQ ID NO: 318338 - RNA, 19 nt, Homo sapiens
gaauuccugcuuaacuuga

SEQ ID NO: 318339 - RNA, 19 nt, Homo sapiens
cagaaacccuccauaaccu

SEQ ID NO: 318340 - RNA, 19 nt, Homo sapiens
gcuaaggaggcuggaauuu

SEQ ID NO: 318341 - RNA, 19 nt, Homo sapiens
uggaauaauugguggaaca

SEQ ID NO: 318342 - RNA, 19 nt, Homo sapiens
cacgguugcucuauauaug

SEQ ID NO: 318343 - RNA, 19 nt, Homo sapiens
agagaugcauacaaagaau

SEQ ID NO: 318344 - RNA, 19 nt, Homo sapiens
cuaguaaacaugugggaaa

SEQ ID NO: 318345 - RNA, 19 nt, Homo sapiens
gauaggguccacagaaugg

SEQ ID NO: 318346 - RNA, 19 nt, Homo sapiens
cuaaggaggcuggaauuug

SEQ ID NO: 318347 - RNA, 19 nt, Homo sapiens
aacgagagagguucuuaua

SEQ ID NO: 318348 - RNA, 19 nt, Homo sapiens
ugauggaagucauucuugu

SEQ ID NO: 318349 - RNA, 19 nt, Homo sapiens
gggaguuacaucuuuauuc

SEQ ID NO: 318350 - RNA, 19 nt, Homo sapiens
cugaaucccuugcaauugg

SEQ ID NO: 318351 - RNA, 19 nt, Homo sapiens
gaacucuacaucuagcaau

SEQ ID NO: 318352 - RNA, 19 nt, Homo sapiens
gaauuuguuacgcaaguau

SEQ ID NO: 318353 - RNA, 19 nt, Homo sapiens
ggagugugccauauuccaa

SEQ ID NO: 318354 - RNA, 19 nt, Homo sapiens
ggcgauauugucauuauug

SEQ ID NO: 318355 - RNA, 19 nt, Homo sapiens
ggagggauacugggauaau

SEQ ID NO: 318356 - RNA, 19 nt, Homo sapiens
ggagggcaauuugguaaaa

SEQ ID NO: 318357 - RNA, 19 nt, Homo sapiens
uauuagagacuccugaaug

SEQ ID NO: 318358 - RNA, 19 nt, Homo sapiens
uuagaaggaagaacugaaa

SEQ ID NO: 318359 - RNA, 19 nt, Homo sapiens
ggaaggcagcacaccauca

SEQ ID NO: 318360 - RNA, 19 nt, Homo sapiens
ccaagacauuaaaguagca

SEQ ID NO: 318361 - RNA, 19 nt, Homo sapiens
ccggcgauauugucauuau

SEQ ID NO: 318362 - RNA, 19 nt, Homo sapiens
ggacgaaccugaucucuua

SEQ ID NO: 318363 - RNA, 19 nt, Homo sapiens
ccaaauaucucaucaacaa

SEQ ID NO: 318364 - RNA, 19 nt, Homo sapiens
agaaaucgcugucgccuua

SEQ ID NO: 318365 - RNA, 19 nt, Homo sapiens
ggcuuucgcucuaagauua

SEQ ID NO: 318366 - RNA, 19 nt, Homo sapiens
cuagcaauaucaaccauua

SEQ ID NO: 318367 - RNA, 19 nt, Homo sapiens
gaaccaaaaugaacgaaaa

SEQ ID NO: 318368 - RNA, 19 nt, Homo sapiens
aaccugaucucuuauacua

SEQ ID NO: 318369 - RNA, 19 nt, Homo sapiens
aaccuucccucuacacuua

SEQ ID NO: 318370 - RNA, 19 nt, Homo sapiens
guacugaucauucuauuuc

SEQ ID NO: 318371 - RNA, 19 nt, Homo sapiens
ccacccaacuaucuauaaa

SEQ ID NO: 318372 - RNA, 19 nt, Homo sapiens
ucuguucgcuucauucauu

SEQ ID NO: 318373 - RNA, 19 nt, Homo sapiens
uaacaaacccugagaacca

SEQ ID NO: 318374 - RNA, 19 nt, Homo sapiens
cuuaucaucuucacaauuc

SEQ ID NO: 318375 - RNA, 19 nt, Homo sapiens
gaaaccaucagccuacuca

SEQ ID NO: 318376 - RNA, 19 nt, Homo sapiens
ccauuaaccuucccucuac

SEQ ID NO: 318377 - RNA, 19 nt, Homo sapiens
ccucuacacuuaucaucuu

SEQ ID NO: 318378 - RNA, 19 nt, Homo sapiens
cgccuaaccgcuaacauua

SEQ ID NO: 318379 - RNA, 19 nt, Homo sapiens
ccaacaaugacuaaucaaa

SEQ ID NO: 318380 - RNA, 19 nt, Homo sapiens
ugcccuagcccacuucuua

SEQ ID NO: 318381 - RNA, 19 nt, Homo sapiens
ccuacucauucaaccaaua

SEQ ID NO: 318382 - RNA, 19 nt, Homo sapiens
caacaaugacuaaucaaac

SEQ ID NO: 318383 - RNA, 19 nt, Homo sapiens
ccauacuccuuacacuauu

SEQ ID NO: 318384 - RNA, 19 nt, Homo sapiens
acacuuaucaucuucacaa

SEQ ID NO: 318385 - RNA, 19 nt, Homo sapiens
ccugaucucuuauacuagu

SEQ ID NO: 318386 - RNA, 19 nt, Homo sapiens
auuauaggcuuucgcucua

SEQ ID NO: 318387 - RNA, 19 nt, Homo sapiens
caaacuaaccucaaaacaa

SEQ ID NO: 318388 - RNA, 19 nt, Homo sapiens
guuauuaucgaaaccauca

SEQ ID NO: 318389 - RNA, 19 nt, Homo sapiens
acccaacaaugacuaauca

SEQ ID NO: 318390 - RNA, 19 nt, Homo sapiens
caaccacccaacuaucuau

SEQ ID NO: 318391 - RNA, 19 nt, Homo sapiens
cgaaccugaucucuuauac

SEQ ID NO: 318392 - RNA, 19 nt, Homo sapiens
ccaaccacccaacuaucua

SEQ ID NO: 318393 - RNA, 19 nt, Homo sapiens
caguacugaucauucuauu

SEQ ID NO: 318394 - RNA, 19 nt, Homo sapiens
gaaaaucuguucgcuucau

SEQ ID NO: 318395 - RNA, 19 nt, Homo sapiens
gcgccacccuagcaauauc

SEQ ID NO: 318396 - RNA, 19 nt, Homo sapiens
cauacuccuuacacuauuc

SEQ ID NO: 318397 - RNA, 19 nt, Homo sapiens
aagcgccacccuagcaaua

SEQ ID NO: 318398 - RNA, 19 nt, Homo sapiens
ggaagcgccacccuagcaa

SEQ ID NO: 318399 - RNA, 19 nt, Homo sapiens
ccuaaccgcuaacauuacu

SEQ ID NO: 318400 - RNA, 19 nt, Homo sapiens
acaccaaccacccaacuau

SEQ ID NO: 318401 - RNA, 19 nt, Homo sapiens
ccaucagccuacucauuca

SEQ ID NO: 318402 - RNA, 19 nt, Homo sapiens
gcccacuucuuaccacaag

SEQ ID NO: 318403 - RNA, 19 nt, Homo sapiens
gaaccugaucucuuauacu

SEQ ID NO: 318404 - RNA, 19 nt, Homo sapiens
gaaaucgcugucgccuuaa

SEQ ID NO: 318405 - RNA, 19 nt, Homo sapiens
cccauacuccuuacacuau

SEQ ID NO: 318406 - RNA, 19 nt, Homo sapiens
gaagcgccacccuagcaau

SEQ ID NO: 318407 - RNA, 19 nt, Homo sapiens
uuauaggcuuucgcucuaa

SEQ ID NO: 318408 - RNA, 19 nt, Homo sapiens
aacaaacccugagaaccaa

SEQ ID NO: 318409 - RNA, 19 nt, Homo sapiens
gccucuaccugcacgacaa

SEQ ID NO: 318410 - RNA, 19 nt, Homo sapiens
ccucaucacccaacuaaaa

SEQ ID NO: 318411 - RNA, 19 nt, Homo sapiens
cuccaaauaucucaucaac

SEQ ID NO: 318412 - RNA, 19 nt, Homo sapiens
uaaccuucccucuacacuu

SEQ ID NO: 318413 - RNA, 19 nt, Homo sapiens
acgccuaaccgcuaacauu

SEQ ID NO: 318414 - RNA, 19 nt, Homo sapiens
cuuacacuauuccucauca

SEQ ID NO: 318415 - RNA, 19 nt, Homo sapiens
cuaaucaaacuaaccucaa

SEQ ID NO: 318416 - RNA, 19 nt, Homo sapiens
aaaucgcugucgccuuaau

SEQ ID NO: 318417 - RNA, 19 nt, Homo sapiens
ccguacgccuaaccgcuaa

SEQ ID NO: 318418 - RNA, 19 nt, Homo sapiens
aaccaucagccuacucauu

SEQ ID NO: 318419 - RNA, 19 nt, Homo sapiens
ccauacuaguuauuaucga

SEQ ID NO: 318420 - RNA, 19 nt, Homo sapiens
uaaaggacgaaccugaucu

SEQ ID NO: 318421 - RNA, 19 nt, Homo sapiens
cuaaaggacgaaccugauc

SEQ ID NO: 318422 - RNA, 19 nt, Homo sapiens
ggacgaaccugaucucuua

SEQ ID NO: 318423 - RNA, 19 nt, Homo sapiens
ccaaauaucucaucaacaa

SEQ ID NO: 318424 - RNA, 19 nt, Homo sapiens
agaaaucgcugucgccuua

SEQ ID NO: 318425 - RNA, 19 nt, Homo sapiens
ggcuuucgcucuaagauua

SEQ ID NO: 318426 - RNA, 19 nt, Homo sapiens
cuagcaauaucaaccauua

SEQ ID NO: 318427 - RNA, 19 nt, Homo sapiens
gaaccaaaaugaacgaaaa

SEQ ID NO: 318428 - RNA, 19 nt, Homo sapiens
aaccugaucucuuauacua

SEQ ID NO: 318429 - RNA, 19 nt, Homo sapiens
aaccuucccucuacacuua

SEQ ID NO: 318430 - RNA, 19 nt, Homo sapiens
guacugaucauucuauuuc

SEQ ID NO: 318431 - RNA, 19 nt, Homo sapiens
ccacccaacuaucuauaaa

SEQ ID NO: 318432 - RNA, 19 nt, Homo sapiens
ucuguucgcuucauucauu

SEQ ID NO: 318433 - RNA, 19 nt, Homo sapiens
uaacaaacccugagaacca

SEQ ID NO: 318434 - RNA, 19 nt, Homo sapiens
cuuaucaucuucacaauuc

SEQ ID NO: 318435 - RNA, 19 nt, Homo sapiens
gaaaccaucagccuacuca

SEQ ID NO: 318436 - RNA, 19 nt, Homo sapiens
ccauuaaccuucccucuac

SEQ ID NO: 318437 - RNA, 19 nt, Homo sapiens
ccucuacacuuaucaucuu

SEQ ID NO: 318438 - RNA, 19 nt, Homo sapiens
cgccuaaccgcuaacauua

SEQ ID NO: 318439 - RNA, 19 nt, Homo sapiens
ccaacaaugacuaaucaaa

SEQ ID NO: 318440 - RNA, 19 nt, Homo sapiens
ugcccuagcccacuucuua

SEQ ID NO: 318441 - RNA, 19 nt, Homo sapiens
ccuacucauucaaccaaua

SEQ ID NO: 318442 - RNA, 19 nt, Homo sapiens
caacaaugacuaaucaaac

SEQ ID NO: 318443 - RNA, 19 nt, Homo sapiens
ccauacuccuuacacuauu

SEQ ID NO: 318444 - RNA, 19 nt, Homo sapiens
acacuuaucaucuucacaa

SEQ ID NO: 318445 - RNA, 19 nt, Homo sapiens
ccugaucucuuauacuagu

SEQ ID NO: 318446 - RNA, 19 nt, Homo sapiens
auuauaggcuuucgcucua

SEQ ID NO: 318447 - RNA, 19 nt, Homo sapiens
caaacuaaccucaaaacaa

SEQ ID NO: 318448 - RNA, 19 nt, Homo sapiens
guuauuaucgaaaccauca

SEQ ID NO: 318449 - RNA, 19 nt, Homo sapiens
acccaacaaugacuaauca

SEQ ID NO: 318450 - RNA, 19 nt, Homo sapiens
caaccacccaacuaucuau

SEQ ID NO: 318451 - RNA, 19 nt, Homo sapiens
cgaaccugaucucuuauac

SEQ ID NO: 318452 - RNA, 19 nt, Homo sapiens
ccaaccacccaacuaucua

SEQ ID NO: 318453 - RNA, 19 nt, Homo sapiens
caguacugaucauucuauu

SEQ ID NO: 318454 - RNA, 19 nt, Homo sapiens
gaaaaucuguucgcuucau

SEQ ID NO: 318455 - RNA, 19 nt, Homo sapiens
gcgccacccuagcaauauc

SEQ ID NO: 318456 - RNA, 19 nt, Homo sapiens
cauacuccuuacacuauuc

SEQ ID NO: 318457 - RNA, 19 nt, Homo sapiens
aagcgccacccuagcaaua

SEQ ID NO: 318458 - RNA, 19 nt, Homo sapiens
ggaagcgccacccuagcaa

SEQ ID NO: 318459 - RNA, 19 nt, Homo sapiens
ccuaaccgcuaacauuacu

SEQ ID NO: 318460 - RNA, 19 nt, Homo sapiens
acaccaaccacccaacuau

SEQ ID NO: 318461 - RNA, 19 nt, Homo sapiens
ccaucagccuacucauuca

SEQ ID NO: 318462 - RNA, 19 nt, Homo sapiens
gcccacuucuuaccacaag

SEQ ID NO: 318463 - RNA, 19 nt, Homo sapiens
gaaccugaucucuuauacu

SEQ ID NO: 318464 - RNA, 19 nt, Homo sapiens
gaaaucgcugucgccuuaa

SEQ ID NO: 318465 - RNA, 19 nt, Homo sapiens
cccauacuccuuacacuau

SEQ ID NO: 318466 - RNA, 19 nt, Homo sapiens
gaagcgccacccuagcaau

SEQ ID NO: 318467 - RNA, 19 nt, Homo sapiens
uuauaggcuuucgcucuaa

SEQ ID NO: 318468 - RNA, 19 nt, Homo sapiens
aacaaacccugagaaccaa

SEQ ID NO: 318469 - RNA, 19 nt, Homo sapiens
gccucuaccugcacgacaa

SEQ ID NO: 318470 - RNA, 19 nt, Homo sapiens
ccucaucacccaacuaaaa

SEQ ID NO: 318471 - RNA, 19 nt, Homo sapiens
cuccaaauaucucaucaac

SEQ ID NO: 318472 - RNA, 19 nt, Homo sapiens
uaaccuucccucuacacuu

SEQ ID NO: 318473 - RNA, 19 nt, Homo sapiens
acgccuaaccgcuaacauu

SEQ ID NO: 318474 - RNA, 19 nt, Homo sapiens
cuuacacuauuccucauca

SEQ ID NO: 318475 - RNA, 19 nt, Homo sapiens
cuaaucaaacuaaccucaa

SEQ ID NO: 318476 - RNA, 19 nt, Homo sapiens
aaaucgcugucgccuuaau

SEQ ID NO: 318477 - RNA, 19 nt, Homo sapiens
ccguacgccuaaccgcuaa

SEQ ID NO: 318478 - RNA, 19 nt, Homo sapiens
aaccaucagccuacucauu

SEQ ID NO: 318479 - RNA, 19 nt, Homo sapiens
ccauacuaguuauuaucga

SEQ ID NO: 318480 - RNA, 19 nt, Homo sapiens
uaaaggacgaaccugaucu

SEQ ID NO: 318481 - RNA, 19 nt, Homo sapiens
cuaaaggacgaaccugauc

SEQ ID NO: 318482 - RNA, 19 nt, Homo sapiens
gaagaacccguauacauaa

SEQ ID NO: 318483 - RNA, 19 nt, Homo sapiens
gaccacaucuacaacguua

SEQ ID NO: 318484 - RNA, 19 nt, Homo sapiens
cgaagaacccguauacaua

SEQ ID NO: 318485 - RNA, 19 nt, Homo sapiens
gaagcaauaugaaaugauc

SEQ ID NO: 318486 - RNA, 19 nt, Homo sapiens
ggucugagcuaugauauca

SEQ ID NO: 318487 - RNA, 19 nt, Homo sapiens
caaagacauuggaacacua

SEQ ID NO: 318488 - RNA, 19 nt, Homo sapiens
gaagaacccuccauaaacc

SEQ ID NO: 318489 - RNA, 19 nt, Homo sapiens
gguauggucugagcuauga

SEQ ID NO: 318490 - RNA, 19 nt, Homo sapiens
gcccaugcauuuguaauaa

SEQ ID NO: 318491 - RNA, 19 nt, Homo sapiens
ucuguaggcucauucauuu

SEQ ID NO: 318492 - RNA, 19 nt, Homo sapiens
gauaucaauuggcuuccua

SEQ ID NO: 318493 - RNA, 19 nt, Homo sapiens
ggaacacuauaccuauuau

SEQ ID NO: 318494 - RNA, 19 nt, Homo sapiens
uagaagaacccuccauaaa

SEQ ID NO: 318495 - RNA, 19 nt, Homo sapiens
cuaccaggcuucggaauaa

SEQ ID NO: 318496 - RNA, 19 nt, Homo sapiens
caccauauauuuacaguag

SEQ ID NO: 318497 - RNA, 19 nt, Homo sapiens
guagaagaacccuccauaa

SEQ ID NO: 318498 - RNA, 19 nt, Homo sapiens
cgucacagcccaugcauuu

SEQ ID NO: 318499 - RNA, 19 nt, Homo sapiens
cgcaugagcuggaguccua

SEQ ID NO: 318500 - RNA, 19 nt, Homo sapiens
gcguaaaucuaacuuucuu

SEQ ID NO: 318501 - RNA, 19 nt, Homo sapiens
caucauaggaggcuucauu

SEQ ID NO: 318502 - RNA, 19 nt, Homo sapiens
ccauuuggauacauaggua

SEQ ID NO: 318503 - RNA, 19 nt, Homo sapiens
agaaccauuuggauacaua

SEQ ID NO: 318504 - RNA, 19 nt, Homo sapiens
gauguucgccgaccguuga

SEQ ID NO: 318505 - RNA, 19 nt, Homo sapiens
gaaaaguccuaauaguaga

SEQ ID NO: 318506 - RNA, 19 nt, Homo sapiens
ggaacagguugaacagucu

SEQ ID NO: 318507 - RNA, 19 nt, Homo sapiens
ccacaaagacauuggaaca

SEQ ID NO: 318508 - RNA, 19 nt, Homo sapiens
ccauaaaccuggagugacu

SEQ ID NO: 318509 - RNA, 19 nt, Homo sapiens
ccacuauguccuaucaaua

SEQ ID NO: 318510 - RNA, 19 nt, Homo sapiens
gugagcacaccauauauuu

SEQ ID NO: 318511 - RNA, 19 nt, Homo sapiens
ccacggaagcaauaugaaa

SEQ ID NO: 318512 - RNA, 19 nt, Homo sapiens
ccauauauuuacaguagga

SEQ ID NO: 318513 - RNA, 19 nt, Homo sapiens
gagcacaccauauauuuac

SEQ ID NO: 318514 - RNA, 19 nt, Homo sapiens
aacauaagcuucugacucu

SEQ ID NO: 318515 - RNA, 19 nt, Homo sapiens
uaacagaccgcaaccucaa

SEQ ID NO: 318516 - RNA, 19 nt, Homo sapiens
caucauaaucggaggcuuu

SEQ ID NO: 318517 - RNA, 19 nt, Homo sapiens
guaacgaccacaucuacaa

SEQ ID NO: 318518 - RNA, 19 nt, Homo sapiens
gcgaaaaguccuaauagua

SEQ ID NO: 318519 - RNA, 19 nt, Homo sapiens
ugagcacaccauauauuua

SEQ ID NO: 318520 - RNA, 19 nt, Homo sapiens
caucuucuccuuacaccua

SEQ ID NO: 318521 - RNA, 19 nt, Homo sapiens
gcauaaacaacauaagcuu

SEQ ID NO: 318522 - RNA, 19 nt, Homo sapiens
cauaguaauacccaucaua

SEQ ID NO: 318523 - RNA, 19 nt, Homo sapiens
cggcguaaaucuaacuuuc

SEQ ID NO: 318524 - RNA, 19 nt, Homo sapiens
gagcuaugauaucaauugg

SEQ ID NO: 318525 - RNA, 19 nt, Homo sapiens
gaggagaccccauucuaua

SEQ ID NO: 318526 - RNA, 19 nt, Homo sapiens
gaagcgaaaaguccuaaua

SEQ ID NO: 318527 - RNA, 19 nt, Homo sapiens
cggaagcaauaugaaauga

SEQ ID NO: 318528 - RNA, 19 nt, Homo sapiens
ccaccggcgucaaaguauu

SEQ ID NO: 318529 - RNA, 19 nt, Homo sapiens
uggaacacuauaccuauua

SEQ ID NO: 318530 - RNA, 19 nt, Homo sapiens
gaacagguugaacagucua

SEQ ID NO: 318531 - RNA, 19 nt, Homo sapiens
gaggcuucauucacugauu

SEQ ID NO: 318532 - RNA, 19 nt, Homo sapiens
gccauaacccaauaccaaa

SEQ ID NO: 318533 - RNA, 19 nt, Homo sapiens
aaaccuggagugacuauau

SEQ ID NO: 318534 - RNA, 19 nt, Homo sapiens
cuacaacguuaucgucaca

SEQ ID NO: 318535 - RNA, 19 nt, Homo sapiens
agaagaacccuccauaaac

SEQ ID NO: 318536 - RNA, 19 nt, Homo sapiens
aaagaaccauuuggauaca

SEQ ID NO: 318537 - RNA, 19 nt, Homo sapiens
uaacuuacuacuccggaaa

SEQ ID NO: 318538 - RNA, 19 nt, Homo sapiens
guaauacccaucauaaucg

SEQ ID NO: 318539 - RNA, 19 nt, Homo sapiens
ccaugcauuuguaauaauc

SEQ ID NO: 318540 - RNA, 19 nt, Homo sapiens
aagaacccguauacauaaa

SEQ ID NO: 318541 - RNA, 19 nt, Homo sapiens
agaccaaaccuacgccaaa

SEQ ID NO: 318542 - RNA, 19 nt, Homo sapiens
ucugagcuaugauaucaau

SEQ ID NO: 318543 - RNA, 19 nt, Homo sapiens
cacagcccaugcauuugua

SEQ ID NO: 318544 - RNA, 19 nt, Homo sapiens
ucacagcccaugcauuugu

SEQ ID NO: 318545 - RNA, 19 nt, Homo sapiens
uaucaucuguaggcucauu

SEQ ID NO: 318546 - RNA, 19 nt, Homo sapiens
aggcuucauucacugauuu

SEQ ID NO: 318547 - RNA, 19 nt, Homo sapiens
guagacacacgagcauauu

SEQ ID NO: 318548 - RNA, 19 nt, Homo sapiens
ugagcuaugauaucaauug

SEQ ID NO: 318549 - RNA, 19 nt, Homo sapiens
cuacaaaccacaaagacau

SEQ ID NO: 318550 - RNA, 19 nt, Homo sapiens
uaacuuucuucccacaaca

SEQ ID NO: 318551 - RNA, 19 nt, Homo sapiens
acacuccacggaagcaaua

SEQ ID NO: 318552 - RNA, 19 nt, Homo sapiens
gccaucaauuucaucacaa

SEQ ID NO: 318553 - RNA, 19 nt, Homo sapiens
acaaagacauuggaacacu

SEQ ID NO: 318554 - RNA, 19 nt, Homo sapiens
ucgaagaacccguauacau

SEQ ID NO: 318555 - RNA, 19 nt, Homo sapiens
gaccaaaccuacgccaaaa

SEQ ID NO: 318556 - RNA, 19 nt, Homo sapiens
aguaauacccaucauaauc

SEQ ID NO: 318557 - RNA, 19 nt, Homo sapiens
ggaagcaauaugaaaugau

SEQ ID NO: 318558 - RNA, 19 nt, Homo sapiens
ccuaccaggcuucggaaua

SEQ ID NO: 318559 - RNA, 19 nt, Homo sapiens
ucggucacccugaaguuua

SEQ ID NO: 318560 - RNA, 19 nt, Homo sapiens
cuaaccaucuucuccuuac

SEQ ID NO: 318561 - RNA, 19 nt, Homo sapiens
gcucauucauuucucuaac

SEQ ID NO: 318562 - RNA, 19 nt, Homo sapiens
gcaguccuacuucuccuau

SEQ ID NO: 318563 - RNA, 19 nt, Homo sapiens
ccguagaccuaaccaucuu

SEQ ID NO: 318564 - RNA, 19 nt, Homo sapiens
cauuggaacacuauaccua

SEQ ID NO: 318565 - RNA, 19 nt, Homo sapiens
cggaggcuuuggcaacuga

SEQ ID NO: 318566 - RNA, 19 nt, Homo sapiens
gaacccguauacauaaaau

SEQ ID NO: 318567 - RNA, 19 nt, Homo sapiens
aguagaagaacccuccaua

SEQ ID NO: 318568 - RNA, 19 nt, Homo sapiens
ccacaucuacaacguuauc

SEQ ID NO: 318569 - RNA, 19 nt, Homo sapiens
cgaaaaguccuaauaguag

SEQ ID NO: 318570 - RNA, 19 nt, Homo sapiens
uuggaacacuauaccuauu

SEQ ID NO: 318571 - RNA, 19 nt, Homo sapiens
ucacugauuuccccuauuc

SEQ ID NO: 318572 - RNA, 19 nt, Homo sapiens
gaccguugacuauucucua

SEQ ID NO: 318573 - RNA, 19 nt, Homo sapiens
ccuaaccaucuucuccuua

SEQ ID NO: 318574 - RNA, 19 nt, Homo sapiens
aaacaacauaagcuucuga

SEQ ID NO: 318575 - RNA, 19 nt, Homo sapiens
cuaccacacauucgaagaa

SEQ ID NO: 318576 - RNA, 19 nt, Homo sapiens
cgccgaccguugacuauuc

SEQ ID NO: 318577 - RNA, 19 nt, Homo sapiens
auaggaggcuucauucacu

SEQ ID NO: 318578 - RNA, 19 nt, Homo sapiens
ugacuauucucuacaaacc

SEQ ID NO: 318579 - RNA, 19 nt, Homo sapiens
ccuauuauucggcgcauga

SEQ ID NO: 318580 - RNA, 19 nt, Homo sapiens
uagacacacgagcauauuu

SEQ ID NO: 318581 - RNA, 19 nt, Homo sapiens
aggaauagacguagacaca

SEQ ID NO: 318582 - RNA, 19 nt, Homo sapiens
uagaagagcuuaucaccuu

SEQ ID NO: 318583 - RNA, 19 nt, Homo sapiens
ggaaauagaaaccgucuga

SEQ ID NO: 318584 - RNA, 19 nt, Homo sapiens
gcaauucccggacgucuaa

SEQ ID NO: 318585 - RNA, 19 nt, Homo sapiens
ucaaugcucugaaaucugu

SEQ ID NO: 318586 - RNA, 19 nt, Homo sapiens
gcccaucguccuagaauua

SEQ ID NO: 318587 - RNA, 19 nt, Homo sapiens
cuacgcauccuuuacauaa

SEQ ID NO: 318588 - RNA, 19 nt, Homo sapiens
gagcuuaucaccuuucaug

SEQ ID NO: 318589 - RNA, 19 nt, Homo sapiens
gaucacgcccucauaauca

SEQ ID NO: 318590 - RNA, 19 nt, Homo sapiens
ggucaaugcucugaaaucu

SEQ ID NO: 318591 - RNA, 19 nt, Homo sapiens
gaaaccgucugaacuaucc

SEQ ID NO: 318592 - RNA, 19 nt, Homo sapiens
cucagacgcucaggaaaua

SEQ ID NO: 318593 - RNA, 19 nt, Homo sapiens
ugaaaucuguggagcaaac

SEQ ID NO: 318594 - RNA, 19 nt, Homo sapiens
gcacaugcagcgcaaguag

SEQ ID NO: 318595 - RNA, 19 nt, Homo sapiens
uagaaaccgucugaacuau

SEQ ID NO: 318596 - RNA, 19 nt, Homo sapiens
auagaaaccgucugaacua

SEQ ID NO: 318597 - RNA, 19 nt, Homo sapiens
uaacagacgaggucaacga

SEQ ID NO: 318598 - RNA, 19 nt, Homo sapiens
cguugacaaucgaguagua

SEQ ID NO: 318599 - RNA, 19 nt, Homo sapiens
aaucuucaacuccuacaua

SEQ ID NO: 318600 - RNA, 19 nt, Homo sapiens
cgacuacggcggacuaauc

SEQ ID NO: 318601 - RNA, 19 nt, Homo sapiens
gaagagcuuaucaccuuuc

SEQ ID NO: 318602 - RNA, 19 nt, Homo sapiens
gcccguauuuacccuauag

SEQ ID NO: 318603 - RNA, 19 nt, Homo sapiens
agaagagcuuaucaccuuu

SEQ ID NO: 318604 - RNA, 19 nt, Homo sapiens
gaaauagaaaccgucugaa

SEQ ID NO: 318605 - RNA, 19 nt, Homo sapiens
ucugaaaucuguggagcaa

SEQ ID NO: 318606 - RNA, 19 nt, Homo sapiens
uccuaacacucacaacaaa

SEQ ID NO: 318607 - RNA, 19 nt, Homo sapiens
guaguacucccgauugaag

SEQ ID NO: 318608 - RNA, 19 nt, Homo sapiens
caucucagacgcucaggaa

SEQ ID NO: 318609 - RNA, 19 nt, Homo sapiens
cuucaacuccuacauacuu

SEQ ID NO: 318610 - RNA, 19 nt, Homo sapiens
uacggucaaugcucugaaa

SEQ ID NO: 318611 - RNA, 19 nt, Homo sapiens
ugacguugacaaucgagua

SEQ ID NO: 318612 - RNA, 19 nt, Homo sapiens
caucguccuagaauuaauu

SEQ ID NO: 318613 - RNA, 19 nt, Homo sapiens
gacuaaucuucaacuccua

SEQ ID NO: 318614 - RNA, 19 nt, Homo sapiens
acgcauccuuuacauaaca

SEQ ID NO: 318615 - RNA, 19 nt, Homo sapiens
cuaauacuaacaucucaga

SEQ ID NO: 318616 - RNA, 19 nt, Homo sapiens
cgucuaaaccaaaccacuu

SEQ ID NO: 318617 - RNA, 19 nt, Homo sapiens
ucucagacgcucaggaaau

SEQ ID NO: 318618 - RNA, 19 nt, Homo sapiens
uaucauagaagagcuuauc

SEQ ID NO: 318619 - RNA, 19 nt, Homo sapiens
gguauacuacggucaaugc

SEQ ID NO: 318620 - RNA, 19 nt, Homo sapiens
gucuaaaccaaaccacuuu

SEQ ID NO: 318621 - RNA, 19 nt, Homo sapiens
cuacggcggacuaaucuuc

SEQ ID NO: 318622 - RNA, 19 nt, Homo sapiens
ggcccguauuuacccuaua

SEQ ID NO: 318623 - RNA, 19 nt, Homo sapiens
ucccggacgucuaaaccaa

SEQ ID NO: 318624 - RNA, 19 nt, Homo sapiens
aauagaaaccgucugaacu

SEQ ID NO: 318625 - RNA, 19 nt, Homo sapiens
ucaacgaucccucccuuac

SEQ ID NO: 318626 - RNA, 19 nt, Homo sapiens
ugaucacgcccucauaauc

SEQ ID NO: 318627 - RNA, 19 nt, Homo sapiens
aaauagaaaccgucugaac

SEQ ID NO: 318628 - RNA, 19 nt, Homo sapiens
ccuacgcauccuuuacaua

SEQ ID NO: 318629 - RNA, 19 nt, Homo sapiens
gaaauugacuccuuuggaa

SEQ ID NO: 318630 - RNA, 19 nt, Homo sapiens
gaagcaagccugugagaua

SEQ ID NO: 318631 - RNA, 19 nt, Homo sapiens
gcagauacagcaucauuua

SEQ ID NO: 318632 - RNA, 19 nt, Homo sapiens
gaagaucugucgucuguuc

SEQ ID NO: 318633 - RNA, 19 nt, Homo sapiens
gaggagcgcuacauggaua

SEQ ID NO: 318634 - RNA, 19 nt, Homo sapiens
gaagaauacugcaagugaa

SEQ ID NO: 318635 - RNA, 19 nt, Homo sapiens
gggaagaucugucgucugu

SEQ ID NO: 318636 - RNA, 19 nt, Homo sapiens
gaagauaugcuccuuuguu

SEQ ID NO: 318637 - RNA, 19 nt, Homo sapiens
gcaagggucaugaagaaua

SEQ ID NO: 318638 - RNA, 19 nt, Homo sapiens
gcaaucacuucauccacua

SEQ ID NO: 318639 - RNA, 19 nt, Homo sapiens
ucucaaggcggauuaauua

SEQ ID NO: 318640 - RNA, 19 nt, Homo sapiens
gcagaaagcaagucaacaa

SEQ ID NO: 318641 - RNA, 19 nt, Homo sapiens
uagcaagggucaugaagaa

SEQ ID NO: 318642 - RNA, 19 nt, Homo sapiens
gaacaggcagaaauauaaa

SEQ ID NO: 318643 - RNA, 19 nt, Homo sapiens
gaagugcugcuccauguuu

SEQ ID NO: 318644 - RNA, 19 nt, Homo sapiens
auacugagcugcuaaaaua

SEQ ID NO: 318645 - RNA, 19 nt, Homo sapiens
caaaguaaaguucuucuga

SEQ ID NO: 318646 - RNA, 19 nt, Homo sapiens
ggaagucugcaucaaagua

SEQ ID NO: 318647 - RNA, 19 nt, Homo sapiens
gaagucugcaucaaaguaa

SEQ ID NO: 318648 - RNA, 19 nt, Homo sapiens
gcaaauucagguucccuua

SEQ ID NO: 318649 - RNA, 19 nt, Homo sapiens
cagaacaggcagaaauaua

SEQ ID NO: 318650 - RNA, 19 nt, Homo sapiens
gcacgaguccagcaaauuc

SEQ ID NO: 318651 - RNA, 19 nt, Homo sapiens
uuaauuagcccaagaaaca

SEQ ID NO: 318652 - RNA, 19 nt, Homo sapiens
guaauauacugagcugcua

SEQ ID NO: 318653 - RNA, 19 nt, Homo sapiens
agaacaggcagaaauauaa

SEQ ID NO: 318654 - RNA, 19 nt, Homo sapiens
ugaagaauacugcaaguga

SEQ ID NO: 318655 - RNA, 19 nt, Homo sapiens
cagcaaauagcaaaugaaa

SEQ ID NO: 318656 - RNA, 19 nt, Homo sapiens
cagaacagaugcccugauc

SEQ ID NO: 318657 - RNA, 19 nt, Homo sapiens
gccaacagcuacauggaau

SEQ ID NO: 318658 - RNA, 19 nt, Homo sapiens
gaaagcaagucaacaaaag

SEQ ID NO: 318659 - RNA, 19 nt, Homo sapiens
gaaagucagucccaaaaca

SEQ ID NO: 318660 - RNA, 19 nt, Homo sapiens
uagccuagcuguucucaag

SEQ ID NO: 318661 - RNA, 19 nt, Homo sapiens
acagcuacauggaaucaaa

SEQ ID NO: 318662 - RNA, 19 nt, Homo sapiens
cagaugcccugaucaccaa

SEQ ID NO: 318663 - RNA, 19 nt, Homo sapiens
ggagacgaguuuccuaagg

SEQ ID NO: 318664 - RNA, 19 nt, Homo sapiens
ugucgucuguucaggauuu

SEQ ID NO: 318665 - RNA, 19 nt, Homo sapiens
guacugauuuagagagaag

SEQ ID NO: 318666 - RNA, 19 nt, Homo sapiens
aagauaugcuccuuuguuc

SEQ ID NO: 318667 - RNA, 19 nt, Homo sapiens
uaaguguugugcucaguau

SEQ ID NO: 318668 - RNA, 19 nt, Homo sapiens
caggauccguaacuugaaa

SEQ ID NO: 318669 - RNA, 19 nt, Homo sapiens
gagguuacguaggcagaaa

SEQ ID NO: 318670 - RNA, 19 nt, Homo sapiens
acgaagauaugcuccuuug

SEQ ID NO: 318671 - RNA, 19 nt, Homo sapiens
cuacauggauaacaacucu

SEQ ID NO: 318672 - RNA, 19 nt, Homo sapiens
gcaucaacaucuauuuguc

SEQ ID NO: 318673 - RNA, 19 nt, Homo sapiens
aagcagggcuagaauugga

SEQ ID NO: 318674 - RNA, 19 nt, Homo sapiens
gcaucaaaguaaaguucuu

SEQ ID NO: 318675 - RNA, 19 nt, Homo sapiens
gaacagaugcccugaucac

SEQ ID NO: 318676 - RNA, 19 nt, Homo sapiens
caagggucaugaagaauac

SEQ ID NO: 318677 - RNA, 19 nt, Homo sapiens
uggaagaggagacgaguuu

SEQ ID NO: 318678 - RNA, 19 nt, Homo sapiens
guaucuaccgcgacgaaua

SEQ ID NO: 318679 - RNA, 19 nt, Homo sapiens
gcagaacaggcagaaauau

SEQ ID NO: 318680 - RNA, 19 nt, Homo sapiens
gaccugggaucugaugaau

SEQ ID NO: 318681 - RNA, 19 nt, Homo sapiens
gauaugcuccuuuguucug

SEQ ID NO: 318682 - RNA, 19 nt, Homo sapiens
caagaacugcguaaguguu

SEQ ID NO: 318683 - RNA, 19 nt, Homo sapiens
auccguaacuugaaauuga

SEQ ID NO: 318684 - RNA, 19 nt, Homo sapiens
gggcacgaguccagcaaau

SEQ ID NO: 318685 - RNA, 19 nt, Homo sapiens
aagugaaacugcagagaga

SEQ ID NO: 318686 - RNA, 19 nt, Homo sapiens
ccucauaacuucgguucga

SEQ ID NO: 318687 - RNA, 19 nt, Homo sapiens
gggagggaguggguugaaa

SEQ ID NO: 318688 - RNA, 19 nt, Homo sapiens
gguagcagcaaauagcaaa

SEQ ID NO: 318689 - RNA, 19 nt, Homo sapiens
ggaccugggaucugaugaa

SEQ ID NO: 318690 - RNA, 19 nt, Homo sapiens
ggauuaauuagcccaagaa

SEQ ID NO: 318691 - RNA, 19 nt, Homo sapiens
cagaaagcaagucaacaaa

SEQ ID NO: 318692 - RNA, 19 nt, Homo sapiens
cagauacagcaucauuuaa

SEQ ID NO: 318693 - RNA, 19 nt, Homo sapiens
gaacccaaagcccagaaug

SEQ ID NO: 318694 - RNA, 19 nt, Homo sapiens
gaaaagcagggcuagaauu

SEQ ID NO: 318695 - RNA, 19 nt, Homo sapiens
aaagucagcuacaaaaguu

SEQ ID NO: 318696 - RNA, 19 nt, Homo sapiens
guaaguguugugcucagua

SEQ ID NO: 318697 - RNA, 19 nt, Homo sapiens
gcagcaucaacaucuauuu

SEQ ID NO: 318698 - RNA, 19 nt, Homo sapiens
cugaagugcugcuccaugu

SEQ ID NO: 318699 - RNA, 19 nt, Homo sapiens
cuacauggaaucaaagugu

SEQ ID NO: 318700 - RNA, 19 nt, Homo sapiens
caacagcuacauggaauca

SEQ ID NO: 318701 - RNA, 19 nt, Homo sapiens
gccagaagcaagccuguga

SEQ ID NO: 318702 - RNA, 19 nt, Homo sapiens
cagcaucaacaucuauuug

SEQ ID NO: 318703 - RNA, 19 nt, Homo sapiens
gcccaagaaacauuauauu

SEQ ID NO: 318704 - RNA, 19 nt, Homo sapiens
uccaagaacugcguaagug

SEQ ID NO: 318705 - RNA, 19 nt, Homo sapiens
cuacgaagauaugcuccuu

SEQ ID NO: 318706 - RNA, 19 nt, Homo sapiens
gggauucuacgaagauaug

SEQ ID NO: 318707 - RNA, 19 nt, Homo sapiens
gugagauacagaaauguuu

SEQ ID NO: 318708 - RNA, 19 nt, Homo sapiens
ugaaauugacuccuuugga

SEQ ID NO: 318709 - RNA, 19 nt, Homo sapiens
gucaggauccguaacuuga

SEQ ID NO: 318710 - RNA, 19 nt, Homo sapiens
aggcagaaauauaaacaca

SEQ ID NO: 318711 - RNA, 19 nt, Homo sapiens
gaacugcguaaguguugug

SEQ ID NO: 318712 - RNA, 19 nt, Homo sapiens
gagaaaagcagggcuagaa

SEQ ID NO: 318713 - RNA, 19 nt, Homo sapiens
gcaauucaccugccuuucc

SEQ ID NO: 318714 - RNA, 19 nt, Homo sapiens
gcuccuagcagcaucaaca

SEQ ID NO: 318715 - RNA, 19 nt, Homo sapiens
cggauuaauuagcccaaga

SEQ ID NO: 318716 - RNA, 19 nt, Homo sapiens
cagaauggcaggagaggau

SEQ ID NO: 318717 - RNA, 19 nt, Homo sapiens
cuagcagcaucaacaucua

SEQ ID NO: 318718 - RNA, 19 nt, Homo sapiens
gcuuuugccugaugacuaa

SEQ ID NO: 318719 - RNA, 19 nt, Homo sapiens
cccaagaaacauuauauuc

SEQ ID NO: 318720 - RNA, 19 nt, Homo sapiens
gcagcaaauagcaaaugaa

SEQ ID NO: 318721 - RNA, 19 nt, Homo sapiens
gcuccauguuuccaccaaa

SEQ ID NO: 318722 - RNA, 19 nt, Homo sapiens
acacggaagucugcaucaa

SEQ ID NO: 318723 - RNA, 19 nt, Homo sapiens
cagcaauucaccugccuuu

SEQ ID NO: 318724 - RNA, 19 nt, Homo sapiens
gaaacugcagagagagguu

SEQ ID NO: 318725 - RNA, 19 nt, Homo sapiens
caugaagaauacugcaagu

SEQ ID NO: 318726 - RNA, 19 nt, Homo sapiens
aggacuugguacugauuua

SEQ ID NO: 318727 - RNA, 19 nt, Homo sapiens
ggcuggaccugggaucuga

SEQ ID NO: 318728 - RNA, 19 nt, Homo sapiens
gcaggcggacguacucugu

SEQ ID NO: 318729 - RNA, 19 nt, Homo sapiens
gaacagaacuuacaaugga

SEQ ID NO: 318730 - RNA, 19 nt, Homo sapiens
gaagaaaucuacuguuuga

SEQ ID NO: 318731 - RNA, 19 nt, Homo sapiens
agaagaaggugcagauuua

SEQ ID NO: 318732 - RNA, 19 nt, Homo sapiens
gcacacaguuugcugcuaa

SEQ ID NO: 318733 - RNA, 19 nt, Homo sapiens
gaaaggucaugauaacaaa

SEQ ID NO: 318734 - RNA, 19 nt, Homo sapiens
guaaagcgguaccaaugua

SEQ ID NO: 318735 - RNA, 19 nt, Homo sapiens
agagugaacuuguggcuua

SEQ ID NO: 318736 - RNA, 19 nt, Homo sapiens
gaaucaauguuccagaauu

SEQ ID NO: 318737 - RNA, 19 nt, Homo sapiens
caucaugggucagaaauuu

SEQ ID NO: 318738 - RNA, 19 nt, Homo sapiens
ggagacaagucauuacguu

SEQ ID NO: 318739 - RNA, 19 nt, Homo sapiens
gcacaaauaggcagcuuaa

SEQ ID NO: 318740 - RNA, 19 nt, Homo sapiens
gaucagaggauacaaauca

SEQ ID NO: 318741 - RNA, 19 nt, Homo sapiens
ggaccacuguucuuauuga

SEQ ID NO: 318742 - RNA, 19 nt, Homo sapiens
gagaugguguugucauuug

SEQ ID NO: 318743 - RNA, 19 nt, Homo sapiens
ucagaaauuugaaggauga

SEQ ID NO: 318744 - RNA, 19 nt, Homo sapiens
gauaggaccacuguucuua

SEQ ID NO: 318745 - RNA, 19 nt, Homo sapiens
gcagcaagccaccaccuua

SEQ ID NO: 318746 - RNA, 19 nt, Homo sapiens
cagcaagcaucuaaaguug

SEQ ID NO: 318747 - RNA, 19 nt, Homo sapiens
gcaaauacuucaccacacu

SEQ ID NO: 318748 - RNA, 19 nt, Homo sapiens
ccaacucuguccuaacuaa

SEQ ID NO: 318749 - RNA, 19 nt, Homo sapiens
ggaaaacguuuaacuguga

SEQ ID NO: 318750 - RNA, 19 nt, Homo sapiens
caugugaacuuggaaacua

SEQ ID NO: 318751 - RNA, 19 nt, Homo sapiens
ggacaggguucaggugaga

SEQ ID NO: 318752 - RNA, 19 nt, Homo sapiens
ggauacaaaucacucacuu

SEQ ID NO: 318753 - RNA, 19 nt, Homo sapiens
aaaggacacucauacaaug

SEQ ID NO: 318754 - RNA, 19 nt, Homo sapiens
gaaauuugaaggaugaaga

SEQ ID NO: 318755 - RNA, 19 nt, Homo sapiens
gcaagcaucuaaaguugag

SEQ ID NO: 318756 - RNA, 19 nt, Homo sapiens
ccacacccaugccaagaaa

SEQ ID NO: 318757 - RNA, 19 nt, Homo sapiens
gaagaaggugcagauuuaa

SEQ ID NO: 318758 - RNA, 19 nt, Homo sapiens
caaaggacacucauacaau

SEQ ID NO: 318759 - RNA, 19 nt, Homo sapiens
gaacuuggaaacuaagguu

SEQ ID NO: 318760 - RNA, 19 nt, Homo sapiens
gagaacagaacuuacaaug

SEQ ID NO: 318761 - RNA, 19 nt, Homo sapiens
ggaagcacauucgaacuca

SEQ ID NO: 318762 - RNA, 19 nt, Homo sapiens
caccagaucagauucauuu

SEQ ID NO: 318763 - RNA, 19 nt, Homo sapiens
caacaacaucaucuacuuu

SEQ ID NO: 318764 - RNA, 19 nt, Homo sapiens
gaaguaaagcgguaccaau

SEQ ID NO: 318765 - RNA, 19 nt, Homo sapiens
gauagaucaugaagcaaug

SEQ ID NO: 318766 - RNA, 19 nt, Homo sapiens
caccagcaaucaucuuuga

SEQ ID NO: 318767 - RNA, 19 nt, Homo sapiens
cgaaggagaagccauuuga

SEQ ID NO: 318768 - RNA, 19 nt, Homo sapiens
cagaagaaggugcagauuu

SEQ ID NO: 318769 - RNA, 19 nt, Homo sapiens
ggucagaaauuugaaggau

SEQ ID NO: 318770 - RNA, 19 nt, Homo sapiens
cacaauggaucagaggaua

SEQ ID NO: 318771 - RNA, 19 nt, Homo sapiens
caucuaaaguugagaaggu

SEQ ID NO: 318772 - RNA, 19 nt, Homo sapiens
uaacaaaggacacucauac

SEQ ID NO: 318773 - RNA, 19 nt, Homo sapiens
acaacaacaucaucuacuu

SEQ ID NO: 318774 - RNA, 19 nt, Homo sapiens
gaaauucagcaucuuuauc

SEQ ID NO: 318775 - RNA, 19 nt, Homo sapiens
ggaaauucagcaucuuuau

SEQ ID NO: 318776 - RNA, 19 nt, Homo sapiens
ggagaagccauuugagugu

SEQ ID NO: 318777 - RNA, 19 nt, Homo sapiens
ggagaacacuugccuuuuc

SEQ ID NO: 318778 - RNA, 19 nt, Homo sapiens
uaggaccacuguucuuauu

SEQ ID NO: 318779 - RNA, 19 nt, Homo sapiens
gcggagaacacuugccuuu

SEQ ID NO: 318780 - RNA, 19 nt, Homo sapiens
acaaugcacuuccacaaca

SEQ ID NO: 318781 - RNA, 19 nt, Homo sapiens
ugaaaggucaugauaacaa

SEQ ID NO: 318782 - RNA, 19 nt, Homo sapiens
gcagcccgcuucagcacaa

SEQ ID NO: 318783 - RNA, 19 nt, Homo sapiens
gugagaugguguugucauu

SEQ ID NO: 318784 - RNA, 19 nt, Homo sapiens
uuaaggaacuauucuuugg

SEQ ID NO: 318785 - RNA, 19 nt, Homo sapiens
uacaaugccugccaucaug

SEQ ID NO: 318786 - RNA, 19 nt, Homo sapiens
ccauggaugugucagaguu

SEQ ID NO: 318787 - RNA, 19 nt, Homo sapiens
gaacaaauucagcaagcau

SEQ ID NO: 318788 - RNA, 19 nt, Homo sapiens
gaacccaccagaagacuca

SEQ ID NO: 318789 - RNA, 19 nt, Homo sapiens
gagcaggaggcaugaggua

SEQ ID NO: 318790 - RNA, 19 nt, Homo sapiens
gaucaucaucaaacaagaa

SEQ ID NO: 318791 - RNA, 19 nt, Homo sapiens
gcucagguuuguggauaaa

SEQ ID NO: 318792 - RNA, 19 nt, Homo sapiens
guaccaggacuuucuguug

SEQ ID NO: 318793 - RNA, 19 nt, Homo sapiens
caacugggcugagcacaac

SEQ ID NO: 318794 - RNA, 19 nt, Homo sapiens
ucugaaggcugcagcaaau

SEQ ID NO: 318795 - RNA, 19 nt, Homo sapiens
gccaagaaauauugaaggu

SEQ ID NO: 318796 - RNA, 19 nt, Homo sapiens
acacuugccuuuucuagua

SEQ ID NO: 318797 - RNA, 19 nt, Homo sapiens
caucuggaacuguuuauga

SEQ ID NO: 318798 - RNA, 19 nt, Homo sapiens
uaaaugaaagggugugguu

SEQ ID NO: 318799 - RNA, 19 nt, Homo sapiens
gagcauccauuuuaaggaa

SEQ ID NO: 318800 - RNA, 19 nt, Homo sapiens
gaacacaguccagacaaca

SEQ ID NO: 318801 - RNA, 19 nt, Homo sapiens
aaacauucagcacucaaua

SEQ ID NO: 318802 - RNA, 19 nt, Homo sapiens
aaagcaggcucuagcaaca

SEQ ID NO: 318803 - RNA, 19 nt, Homo sapiens
ucagcaagcaucuaaaguu

SEQ ID NO: 318804 - RNA, 19 nt, Homo sapiens
gauacaaaucacucacuuu

SEQ ID NO: 318805 - RNA, 19 nt, Homo sapiens
gagacaagucauuacguuu

SEQ ID NO: 318806 - RNA, 19 nt, Homo sapiens
cagauuggccucaguguuc

SEQ ID NO: 318807 - RNA, 19 nt, Homo sapiens
aaucaauguuccagaauuc

SEQ ID NO: 318808 - RNA, 19 nt, Homo sapiens
gaucagauucauuugacaa

SEQ ID NO: 318809 - RNA, 19 nt, Homo sapiens
gcaaagcaggcucuagcaa

SEQ ID NO: 318810 - RNA, 19 nt, Homo sapiens
aaggaacuauucuuuggaa

SEQ ID NO: 318811 - RNA, 19 nt, Homo sapiens
acucuguccuaacuaauaa

SEQ ID NO: 318812 - RNA, 19 nt, Homo sapiens
agagggcuuucaccugaua

SEQ ID NO: 318813 - RNA, 19 nt, Homo sapiens
aaucugaggcugacauuug

SEQ ID NO: 318814 - RNA, 19 nt, Homo sapiens
aagcagagacuccuucaga

SEQ ID NO: 318815 - RNA, 19 nt, Homo sapiens
caugggagaacagaacuua

SEQ ID NO: 318816 - RNA, 19 nt, Homo sapiens
gcacuuccacaacacaaug

SEQ ID NO: 318817 - RNA, 19 nt, Homo sapiens
gaucugaggaagcacauuc

SEQ ID NO: 318818 - RNA, 19 nt, Homo sapiens
ggaacacaguccagacaac

SEQ ID NO: 318819 - RNA, 19 nt, Homo sapiens
guugacugcugucuguuga

SEQ ID NO: 318820 - RNA, 19 nt, Homo sapiens
uaccaggacuuucuguugu

SEQ ID NO: 318821 - RNA, 19 nt, Homo sapiens
cagcaaucaucuuugaauc

SEQ ID NO: 318822 - RNA, 19 nt, Homo sapiens
cagcaagccaccaccuuaa

SEQ ID NO: 318823 - RNA, 19 nt, Homo sapiens
ccagaucagauucauuuga

SEQ ID NO: 318824 - RNA, 19 nt, Homo sapiens
gcacuuuggaggaugaaga

SEQ ID NO: 318825 - RNA, 19 nt, Homo sapiens
caggugagaugguguuguc

SEQ ID NO: 318826 - RNA, 19 nt, Homo sapiens
ugaagaaaucuacuguuug

SEQ ID NO: 318827 - RNA, 19 nt, Homo sapiens
gccaggaccucagcacaau

SEQ ID NO: 318828 - RNA, 19 nt, Homo sapiens
acaaaggacacucauacaa

SEQ ID NO: 318829 - RNA, 19 nt, Homo sapiens
gagagugagugcaagguuu

SEQ ID NO: 318830 - RNA, 19 nt, Homo sapiens
gaaauuccacggguacuuc

SEQ ID NO: 318831 - RNA, 19 nt, Homo sapiens
gaauuagcccucagcagau

SEQ ID NO: 318832 - RNA, 19 nt, Homo sapiens
caucuggaauuaacuggau

SEQ ID NO: 318833 - RNA, 19 nt, Homo sapiens
gggcaaagugcaagaagga

SEQ ID NO: 318834 - RNA, 19 nt, Homo sapiens
agacguggcugcugaacag

SEQ ID NO: 318835 - RNA, 19 nt, Homo sapiens
caggagucgugguuucuug

SEQ ID NO: 318836 - RNA, 19 nt, Homo sapiens
ggagagugagugcaagguu

SEQ ID NO: 318837 - RNA, 19 nt, Homo sapiens
cggguuucaucuggaauua

SEQ ID NO: 318838 - RNA, 19 nt, Homo sapiens
gcacaaggugggccagauc

SEQ ID NO: 318839 - RNA, 19 nt, Homo sapiens
gcaguuggagugggaagaa

SEQ ID NO: 318840 - RNA, 19 nt, Homo sapiens
gguuucaucuggaauuaac

SEQ ID NO: 318841 - RNA, 19 nt, Homo sapiens
ggccagaucguguuugagu

SEQ ID NO: 318842 - RNA, 19 nt, Homo sapiens
gcgcagagccggguuucau

SEQ ID NO: 318843 - RNA, 19 nt, Homo sapiens
gccagaucguguuugaguu

SEQ ID NO: 318844 - RNA, 19 nt, Homo sapiens
gaagggaaaauaaagcuau

SEQ ID NO: 318845 - RNA, 19 nt, Homo sapiens
ccagaucguguuugaguuc

SEQ ID NO: 318846 - RNA, 19 nt, Homo sapiens
cgaguucuccugggcauga

SEQ ID NO: 318847 - RNA, 19 nt, Homo sapiens
ggaggagagcggucugaca

SEQ ID NO: 318848 - RNA, 19 nt, Homo sapiens
gcagagccggguuucaucu

SEQ ID NO: 318849 - RNA, 19 nt, Homo sapiens
ugggccagaucguguuuga

SEQ ID NO: 318850 - RNA, 19 nt, Homo sapiens
ggaagaacccagggaccau

SEQ ID NO: 318851 - RNA, 19 nt, Homo sapiens
uaacuggauggaagggaaa

SEQ ID NO: 318852 - RNA, 19 nt, Homo sapiens
gguuuccacuccugcuuca

SEQ ID NO: 318853 - RNA, 19 nt, Homo sapiens
guacuggagcaaucagauc

SEQ ID NO: 318854 - RNA, 19 nt, Homo sapiens
aauuagcccucagcagaug

SEQ ID NO: 318855 - RNA, 19 nt, Homo sapiens
gaaaguggaugauucagua

SEQ ID NO: 318856 - RNA, 19 nt, Homo sapiens
caacagagaugauuccaau

SEQ ID NO: 318857 - RNA, 19 nt, Homo sapiens
gcaaguaccugguuucaca

SEQ ID NO: 318858 - RNA, 19 nt, Homo sapiens
gaucaaagccacucacauu

SEQ ID NO: 318859 - RNA, 19 nt, Homo sapiens
aaacagauuugcaagauug

SEQ ID NO: 318860 - RNA, 19 nt, Homo sapiens
gcagcuaccuuuagauuca

SEQ ID NO: 318861 - RNA, 19 nt, Homo sapiens
aaucugaggugaugaagua

SEQ ID NO: 318862 - RNA, 19 nt, Homo sapiens
gaaggcugcugaagagauu

SEQ ID NO: 318863 - RNA, 19 nt, Homo sapiens
acacaaagcugaagucuac

SEQ ID NO: 318864 - RNA, 19 nt, Homo sapiens
uaagcuggcucgagaaauu

SEQ ID NO: 318865 - RNA, 19 nt, Homo sapiens
ucaauuaugucccagauga

SEQ ID NO: 318866 - RNA, 19 nt, Homo sapiens
agacaaggcucucuuuaau

SEQ ID NO: 318867 - RNA, 19 nt, Homo sapiens
gaaugaagacucuacugua

SEQ ID NO: 318868 - RNA, 19 nt, Homo sapiens
ugacagugcuuaugaagga

SEQ ID NO: 318869 - RNA, 19 nt, Homo sapiens
cugaagagguagaauuaua

SEQ ID NO: 318870 - RNA, 19 nt, Homo sapiens
aaucaugcaugucuguuua

SEQ ID NO: 318871 - RNA, 19 nt, Homo sapiens
caagugacauugauauauc

SEQ ID NO: 318872 - RNA, 19 nt, Homo sapiens
cagaacaggugaauggauu

SEQ ID NO: 318873 - RNA, 19 nt, Homo sapiens
gaagagauaaacagauuug

SEQ ID NO: 318874 - RNA, 19 nt, Homo sapiens
gcuuggaacucaucaaaga

SEQ ID NO: 318875 - RNA, 19 nt, Homo sapiens
caagacaccuguuccaagu

SEQ ID NO: 318876 - RNA, 19 nt, Homo sapiens
gcaccggccugaugggaaa

SEQ ID NO: 318877 - RNA, 19 nt, Homo sapiens
caaauaagggcgagacuga

SEQ ID NO: 318878 - RNA, 19 nt, Homo sapiens
gagcagaugacauugaauu

SEQ ID NO: 318879 - RNA, 19 nt, Homo sapiens
gaucaaaccuggggcaaua

SEQ ID NO: 318880 - RNA, 19 nt, Homo sapiens
cacauuaaguuaccaagaa

SEQ ID NO: 318881 - RNA, 19 nt, Homo sapiens
gaagaagugaucaaugcua

SEQ ID NO: 318882 - RNA, 19 nt, Homo sapiens
gaaguacauuacaucuuug

SEQ ID NO: 318883 - RNA, 19 nt, Homo sapiens
gaacugacccagacagaca

SEQ ID NO: 318884 - RNA, 19 nt, Homo sapiens
agaauuccauuaacacuga

SEQ ID NO: 318885 - RNA, 19 nt, Homo sapiens
gcuuccagcuccuuuauga

SEQ ID NO: 318886 - RNA, 19 nt, Homo sapiens
ccagaaggguuuguaguga

SEQ ID NO: 318887 - RNA, 19 nt, Homo sapiens
ucccgaagcucaacacaaa

SEQ ID NO: 318888 - RNA, 19 nt, Homo sapiens
ccaggaaaguggaugauuc

SEQ ID NO: 318889 - RNA, 19 nt, Homo sapiens
ggauaccaaugauagauuc

SEQ ID NO: 318890 - RNA, 19 nt, Homo sapiens
gagauaaacagauuugcaa

SEQ ID NO: 318891 - RNA, 19 nt, Homo sapiens
acugacagaugaagagaua

SEQ ID NO: 318892 - RNA, 19 nt, Homo sapiens
uaaagagacuaggcauuga

SEQ ID NO: 318893 - RNA, 19 nt, Homo sapiens
ucagagaauuccauuaaca

SEQ ID NO: 318894 - RNA, 19 nt, Homo sapiens
caaagccacucacauuaag

SEQ ID NO: 318895 - RNA, 19 nt, Homo sapiens
ucaaagccacucacauuaa

SEQ ID NO: 318896 - RNA, 19 nt, Homo sapiens
gcugaaggcugcugaagag

SEQ ID NO: 318897 - RNA, 19 nt, Homo sapiens
ugucagggcucucaagaug

SEQ ID NO: 318898 - RNA, 19 nt, Homo sapiens
ggccauugaugcucggaua

SEQ ID NO: 318899 - RNA, 19 nt, Homo sapiens
agaaggauguggauggauu

SEQ ID NO: 318900 - RNA, 19 nt, Homo sapiens
gcaugucuguuuacuuuag

SEQ ID NO: 318901 - RNA, 19 nt, Homo sapiens
augcaugucuguuuacuuu

SEQ ID NO: 318902 - RNA, 19 nt, Homo sapiens
gaaaggagagcccgucagu

SEQ ID NO: 318903 - RNA, 19 nt, Homo sapiens
gaaacaaaggccaaaguuc

SEQ ID NO: 318904 - RNA, 19 nt, Homo sapiens
aaauuggucugcugucuga

SEQ ID NO: 318905 - RNA, 19 nt, Homo sapiens
gaggugaugaaguacauua

SEQ ID NO: 318906 - RNA, 19 nt, Homo sapiens
caacaucgcacauggcaau

SEQ ID NO: 318907 - RNA, 19 nt, Homo sapiens
ggacggcccaguuugauau

SEQ ID NO: 318908 - RNA, 19 nt, Homo sapiens
cuaccacacugacagauga

SEQ ID NO: 318909 - RNA, 19 nt, Homo sapiens
gaagaucugaaacuaauag

SEQ ID NO: 318910 - RNA, 19 nt, Homo sapiens
aaacagaacaggugaaugg

SEQ ID NO: 318911 - RNA, 19 nt, Homo sapiens
cagacaaggcucucuuuaa

SEQ ID NO: 318912 - RNA, 19 nt, Homo sapiens
gcaaucaagcccaaucuca

SEQ ID NO: 318913 - RNA, 19 nt, Homo sapiens
aaccauaacuuggcaaaga

SEQ ID NO: 318914 - RNA, 19 nt, Homo sapiens
gauaaacagauuugcaaga

SEQ ID NO: 318915 - RNA, 19 nt, Homo sapiens
gaguuaggaaguauaagua

SEQ ID NO: 318916 - RNA, 19 nt, Homo sapiens
ugaggaagaucacgauugg

SEQ ID NO: 318917 - RNA, 19 nt, Homo sapiens
ggacauugauccagaaacc

SEQ ID NO: 318918 - RNA, 19 nt, Homo sapiens
gaagagguagaauuauaug

SEQ ID NO: 318919 - RNA, 19 nt, Homo sapiens
ucaguaacuugaagaaaca

SEQ ID NO: 318920 - RNA, 19 nt, Homo sapiens
uaaauggagugagaagguu

SEQ ID NO: 318921 - RNA, 19 nt, Homo sapiens
gcucggauauuucaugaac

SEQ ID NO: 318922 - RNA, 19 nt, Homo sapiens
gcccaucucuaccagaaug

SEQ ID NO: 318923 - RNA, 19 nt, Homo sapiens
gauauaucacgaucuugua

SEQ ID NO: 318924 - RNA, 19 nt, Homo sapiens
agacaccuguuccaaguga

SEQ ID NO: 318925 - RNA, 19 nt, Homo sapiens
gauaaaaucaggaucauug

SEQ ID NO: 318926 - RNA, 19 nt, Homo sapiens
gaaaccauaacuuggcaaa

SEQ ID NO: 318927 - RNA, 19 nt, Homo sapiens
caaauccgaagguuaaaga

SEQ ID NO: 318928 - RNA, 19 nt, Homo sapiens
uggaugaggagguaaauaa

SEQ ID NO: 318929 - RNA, 19 nt, Homo sapiens
caccacgccuggcaauauu

SEQ ID NO: 318930 - RNA, 19 nt, Homo sapiens
aagcugaagucuacacgaa

SEQ ID NO: 318931 - RNA, 19 nt, Homo sapiens
cauugaugcucggauauuu

SEQ ID NO: 318932 - RNA, 19 nt, Homo sapiens
ggaugaggagguaaauaaa

SEQ ID NO: 318933 - RNA, 19 nt, Homo sapiens
ccuuaauucucaucaugua

SEQ ID NO: 318934 - RNA, 19 nt, Homo sapiens
ggaguuaggaaguauaagu

SEQ ID NO: 318935 - RNA, 19 nt, Homo sapiens
gaaaaugccagaauguuug

SEQ ID NO: 318936 - RNA, 19 nt, Homo sapiens
aaacaaaggccaaaguucu

SEQ ID NO: 318937 - RNA, 19 nt, Homo sapiens
gaagagauugggaucaaag

SEQ ID NO: 318938 - RNA, 19 nt, Homo sapiens
cagaugacauugaauuacu

SEQ ID NO: 318939 - RNA, 19 nt, Homo sapiens
uggcaaagaguguuggaua

SEQ ID NO: 318940 - RNA, 19 nt, Homo sapiens
uuaaagagacuaggcauug

SEQ ID NO: 318941 - RNA, 19 nt, Homo sapiens
acaaggcucucuuuaaucg

SEQ ID NO: 318942 - RNA, 19 nt, Homo sapiens
caucgacuguggaaucaau

SEQ ID NO: 318943 - RNA, 19 nt, Homo sapiens
ugaagacucuacuguacau

SEQ ID NO: 318944 - RNA, 19 nt, Homo sapiens
uuagugacguuccacagaa

SEQ ID NO: 318945 - RNA, 19 nt, Homo sapiens
ggauuauucuaaacagauc

SEQ ID NO: 318946 - RNA, 19 nt, Homo sapiens
ccagagagcagcacaagca

SEQ ID NO: 318947 - RNA, 19 nt, Homo sapiens
ugacagaugaagagauaaa

SEQ ID NO: 318948 - RNA, 19 nt, Homo sapiens
aagaagugaucaaugcuau

SEQ ID NO: 318949 - RNA, 19 nt, Homo sapiens
gugggcagcggacuaauaa

SEQ ID NO: 318950 - RNA, 19 nt, Homo sapiens
cuaaacagaucaccaucca

SEQ ID NO: 318951 - RNA, 19 nt, Homo sapiens
gaacaggugaauggauuau

SEQ ID NO: 318952 - RNA, 19 nt, Homo sapiens
uggagcagaugacauugaa

SEQ ID NO: 318953 - RNA, 19 nt, Homo sapiens
guaaauggagugagaaggu

SEQ ID NO: 318954 - RNA, 19 nt, Homo sapiens
gguggugacuggaauaacu

SEQ ID NO: 318955 - RNA, 19 nt, Homo sapiens
gggaggagcugaccaguga

SEQ ID NO: 318956 - RNA, 19 nt, Homo sapiens
agugagagcuccaaagaua

SEQ ID NO: 318957 - RNA, 19 nt, Homo sapiens
gaagugaguuuggugacua

SEQ ID NO: 318958 - RNA, 19 nt, Homo sapiens
aaagauaguucgagauguu

SEQ ID NO: 318959 - RNA, 19 nt, Homo sapiens
gaccaaagaguuacaucua

SEQ ID NO: 318960 - RNA, 19 nt, Homo sapiens
gaacgaagccagaggaaac

SEQ ID NO: 318961 - RNA, 19 nt, Homo sapiens
gcagugagagcuccaaaga

SEQ ID NO: 318962 - RNA, 19 nt, Homo sapiens
gaaggccuacuuagaguuu

SEQ ID NO: 318963 - RNA, 19 nt, Homo sapiens
ugcaagugcugaagaagua

SEQ ID NO: 318964 - RNA, 19 nt, Homo sapiens
ugaguuuggugacuacuuu

SEQ ID NO: 318965 - RNA, 19 nt, Homo sapiens
ccacagugcugcuucucuu

SEQ ID NO: 318966 - RNA, 19 nt, Homo sapiens
ugacuugccugcccuggaa

SEQ ID NO: 318967 - RNA, 19 nt, Homo sapiens
gcacauccgaagugaguuu

SEQ ID NO: 318968 - RNA, 19 nt, Homo sapiens
gaacuccacucuccuucgu

SEQ ID NO: 318969 - RNA, 19 nt, Homo sapiens
aaaccggaauggucacaaa

SEQ ID NO: 318970 - RNA, 19 nt, Homo sapiens
aaucucaucucaagguuug

SEQ ID NO: 318971 - RNA, 19 nt, Homo sapiens
ccaaagauaguucgagaug

SEQ ID NO: 318972 - RNA, 19 nt, Homo sapiens
ucacgcagcuuuucuuuga

SEQ ID NO: 318973 - RNA, 19 nt, Homo sapiens
aggaggagcugcugaagau

SEQ ID NO: 318974 - RNA, 19 nt, Homo sapiens
gagaccauccugcacauga

SEQ ID NO: 318975 - RNA, 19 nt, Homo sapiens
ggagggaggcuucaacuac

SEQ ID NO: 318976 - RNA, 19 nt, Homo sapiens
ugagggagcugucaaucuc

SEQ ID NO: 318977 - RNA, 19 nt, Homo sapiens
cagaaggccuacuuagagu

SEQ ID NO: 318978 - RNA, 19 nt, Homo sapiens
gagaccuccuccaugauga

SEQ ID NO: 318979 - RNA, 19 nt, Homo sapiens
caacaggcccacccagaau

SEQ ID NO: 318980 - RNA, 19 nt, Homo sapiens
ccagaaggccuacuuagag

SEQ ID NO: 318981 - RNA, 19 nt, Homo sapiens
ugaagcacuugaaggagaa

SEQ ID NO: 318982 - RNA, 19 nt, Homo sapiens
ugacuacuuugacaucugu

SEQ ID NO: 318983 - RNA, 19 nt, Homo sapiens
ugaagcacauccgaaguga

SEQ ID NO: 318984 - RNA, 19 nt, Homo sapiens
ggacuacuaccucuucuac

SEQ ID NO: 318985 - RNA, 19 nt, Homo sapiens
cauuggagcuucucaacag

SEQ ID NO: 318986 - RNA, 19 nt, Homo sapiens
caaagauaguucgagaugu

SEQ ID NO: 318987 - RNA, 19 nt, Homo sapiens
ucaaccugguggacaauga

SEQ ID NO: 318988 - RNA, 19 nt, Homo sapiens
gacacauucuuccgcuuug

SEQ ID NO: 318989 - RNA, 19 nt, Homo sapiens
guacauccacgacaacuac

SEQ ID NO: 318990 - RNA, 19 nt, Homo sapiens
gcgccgagaggaagaugua

SEQ ID NO: 318991 - RNA, 19 nt, Homo sapiens
ugacacauucuuccgcuuu

SEQ ID NO: 318992 - RNA, 19 nt, Homo sapiens
cuaagcagcugggccugaa

SEQ ID NO: 318993 - RNA, 19 nt, Homo sapiens
gcaccaucauccaguacau

SEQ ID NO: 318994 - RNA, 19 nt, Homo sapiens
ugaagucuuuguucuuuac

SEQ ID NO: 318995 - RNA, 19 nt, Homo sapiens
ugccaggccuccacuucua

SEQ ID NO: 318996 - RNA, 19 nt, Homo sapiens
cgagacagcggaagcacuu

SEQ ID NO: 318997 - RNA, 19 nt, Homo sapiens
gaggagcugcugaagaugu

SEQ ID NO: 318998 - RNA, 19 nt, Homo sapiens
aggcugaccugaagcacuu

SEQ ID NO: 318999 - RNA, 19 nt, Homo sapiens
ucaacaggcccacccagaa

SEQ ID NO: 319000 - RNA, 19 nt, Homo sapiens
aguacgagcuccggguuaa

SEQ ID NO: 319001 - RNA, 19 nt, Homo sapiens
ccaaggaggagcugcugaa

SEQ ID NO: 319002 - RNA, 19 nt, Homo sapiens
caguggaccuggugaagca

SEQ ID NO: 319003 - RNA, 19 nt, Homo sapiens
ccuccagaccaaagaguua

SEQ ID NO: 319004 - RNA, 19 nt, Homo sapiens
ggaagacacauuggagcuu

SEQ ID NO: 319005 - RNA, 19 nt, Homo sapiens
acaucuguguggcagguua

SEQ ID NO: 319006 - RNA, 19 nt, Homo sapiens
cagcugggccugaagaaca

SEQ ID NO: 319007 - RNA, 19 nt, Homo sapiens
ucaaucucaucucaagguu

SEQ ID NO: 319008 - RNA, 19 nt, Homo sapiens
ccggaauggucacaaagug

SEQ ID NO: 319009 - RNA, 19 nt, Homo sapiens
ggugguggaagacacauug

SEQ ID NO: 319010 - RNA, 19 nt, Homo sapiens
ggagaaccaaaccggaaug

SEQ ID NO: 319011 - RNA, 19 nt, Homo sapiens
gugaagcacauccgaagug

SEQ ID NO: 319012 - RNA, 19 nt, Homo sapiens
cuuugaggcugacacauuc

SEQ ID NO: 319013 - RNA, 19 nt, Homo sapiens
gguucucccuggaauucuu

SEQ ID NO: 319014 - RNA, 19 nt, Homo sapiens
aagugucuuugaagucuuu

SEQ ID NO: 319015 - RNA, 19 nt, Homo sapiens
ucuggcaggugguggaaga

SEQ ID NO: 319016 - RNA, 19 nt, Homo sapiens
uuaauuaccaccuugucaa

SEQ ID NO: 319017 - RNA, 19 nt, Homo sapiens
acucacagcccaacaucaa

SEQ ID NO: 319018 - RNA, 19 nt, Homo sapiens
caacucacagcccaacauc

SEQ ID NO: 319019 - RNA, 19 nt, Homo sapiens
gcgagauggcuaccacaga

SEQ ID NO: 319020 - RNA, 19 nt, Homo sapiens
caagugguucucccuggaa

SEQ ID NO: 319021 - RNA, 19 nt, Homo sapiens
gcuuugaggcugaccugaa

SEQ ID NO: 319022 - RNA, 19 nt, Homo sapiens
uccaguacauccacgacaa

SEQ ID NO: 319023 - RNA, 19 nt, Homo sapiens
uaauuaccaccuugucaau

SEQ ID NO: 319024 - RNA, 19 nt, Homo sapiens
guuaauuaccaccuuguca

SEQ ID NO: 319025 - RNA, 19 nt, Homo sapiens
acaacuacuuccuggucaa

SEQ ID NO: 319026 - RNA, 19 nt, Homo sapiens
auuaccaccuugucaaugu

SEQ ID NO: 319027 - RNA, 19 nt, Homo sapiens
ucagcuucauguucuggaa

SEQ ID NO: 319028 - RNA, 19 nt, Homo sapiens
cagggcauccucaccauca

SEQ ID NO: 319029 - RNA, 19 nt, Homo sapiens
gggagaaccaaaccggaau

SEQ ID NO: 319030 - RNA, 19 nt, Homo sapiens
ccggagccauggugaacga

SEQ ID NO: 319031 - RNA, 19 nt, Homo sapiens
ggccaucugcacaaagcua

SEQ ID NO: 319032 - RNA, 19 nt, Homo sapiens
ugagagcuccaaagauagu

SEQ ID NO: 319033 - RNA, 19 nt, Homo sapiens
cgaagugaguuuggugacu

SEQ ID NO: 319034 - RNA, 19 nt, Homo sapiens
aagcacauccgaagugagu

SEQ ID NO: 319035 - RNA, 19 nt, Homo sapiens
ccacaugggaaccuaguac

SEQ ID NO: 319036 - RNA, 19 nt, Homo sapiens
ccacccagaaugcgagaga

SEQ ID NO: 319037 - RNA, 19 nt, Homo sapiens
gcaggugguggaagacaca

SEQ ID NO: 319038 - RNA, 19 nt, Homo sapiens
ucuuugaggcugacacauu

SEQ ID NO: 319039 - RNA, 19 nt, Homo sapiens
gugacuacuuugacaucug

SEQ ID NO: 319040 - RNA, 19 nt, Homo sapiens
ccuuugcccuguggauuga

SEQ ID NO: 319041 - RNA, 19 nt, Homo sapiens
uccagaaggccuacuuaga

SEQ ID NO: 319042 - RNA, 19 nt, Homo sapiens
gccaucugcacaaagcuaa

SEQ ID NO: 319043 - RNA, 19 nt, Homo sapiens
caaucucaucucaagguuu

SEQ ID NO: 319044 - RNA, 19 nt, Homo sapiens
auuggaaucuggugacaag

SEQ ID NO: 319045 - RNA, 19 nt, Homo sapiens
ggaaagagauucaaaugua

SEQ ID NO: 319046 - RNA, 19 nt, Homo sapiens
gaaacaaacuguagaaucu

SEQ ID NO: 319047 - RNA, 19 nt, Homo sapiens
gaacacugauauugacaua

SEQ ID NO: 319048 - RNA, 19 nt, Homo sapiens
gaggaaauaugaacaagaa

SEQ ID NO: 319049 - RNA, 19 nt, Homo sapiens
gaacaguaauagagucuuu

SEQ ID NO: 319050 - RNA, 19 nt, Homo sapiens
ggaagcagacucacauuua

SEQ ID NO: 319051 - RNA, 19 nt, Homo sapiens
gagacagaauuguuuguua

SEQ ID NO: 319052 - RNA, 19 nt, Homo sapiens
gcgauaaucugauggcuuu

SEQ ID NO: 319053 - RNA, 19 nt, Homo sapiens
cgacauuacuugacaaauu

SEQ ID NO: 319054 - RNA, 19 nt, Homo sapiens
gcagaaauguuagaauuga

SEQ ID NO: 319055 - RNA, 19 nt, Homo sapiens
ugacauagauucacuggaa

SEQ ID NO: 319056 - RNA, 19 nt, Homo sapiens
caaagaagcacaucagaaa

SEQ ID NO: 319057 - RNA, 19 nt, Homo sapiens
uaaccuugcugaaacauuu

SEQ ID NO: 319058 - RNA, 19 nt, Homo sapiens
ucaaagaagugauaacgaa

SEQ ID NO: 319059 - RNA, 19 nt, Homo sapiens
ccauaaagaugacauuuca

SEQ ID NO: 319060 - RNA, 19 nt, Homo sapiens
aaaguacgcuuaauguuug

SEQ ID NO: 319061 - RNA, 19 nt, Homo sapiens
gaaagcagaucccaauggu

SEQ ID NO: 319062 - RNA, 19 nt, Homo sapiens
gaagcagacucacauuuag

SEQ ID NO: 319063 - RNA, 19 nt, Homo sapiens
ggauuguggucucaguuua

SEQ ID NO: 319064 - RNA, 19 nt, Homo sapiens
gaacugagcagcagauuac

SEQ ID NO: 319065 - RNA, 19 nt, Homo sapiens
gaaagagauucaaauguac

SEQ ID NO: 319066 - RNA, 19 nt, Homo sapiens
ggaaaucucaguuaucuuc

SEQ ID NO: 319067 - RNA, 19 nt, Homo sapiens
gaagaaggaccauggaaau

SEQ ID NO: 319068 - RNA, 19 nt, Homo sapiens
gaacaaauacccuuaaagc

SEQ ID NO: 319069 - RNA, 19 nt, Homo sapiens
guagaaguauggauuggaa

SEQ ID NO: 319070 - RNA, 19 nt, Homo sapiens
ggauuggaaugacuauuga

SEQ ID NO: 319071 - RNA, 19 nt, Homo sapiens
cuagcuaccuucucuguaa

SEQ ID NO: 319072 - RNA, 19 nt, Homo sapiens
gagaucaauucuacgguuu

SEQ ID NO: 319073 - RNA, 19 nt, Homo sapiens
gaugaagucuggaucaaag

SEQ ID NO: 319074 - RNA, 19 nt, Homo sapiens
ggagaaaggucaggaggau

SEQ ID NO: 319075 - RNA, 19 nt, Homo sapiens
ggaagaaggaccauggaaa

SEQ ID NO: 319076 - RNA, 19 nt, Homo sapiens
acacugauauugacauaga

SEQ ID NO: 319077 - RNA, 19 nt, Homo sapiens
agagaaacaugaaccagaa

SEQ ID NO: 319078 - RNA, 19 nt, Homo sapiens
guaauggacauguaauuug

SEQ ID NO: 319079 - RNA, 19 nt, Homo sapiens
gaaagcccgugagaaguau

SEQ ID NO: 319080 - RNA, 19 nt, Homo sapiens
ugaaacaccauaaagauga

SEQ ID NO: 319081 - RNA, 19 nt, Homo sapiens
gguguuauauauggcuuua

SEQ ID NO: 319082 - RNA, 19 nt, Homo sapiens
ggaaggaacaguaauagag

SEQ ID NO: 319083 - RNA, 19 nt, Homo sapiens
ggaacugagcagcagauua

SEQ ID NO: 319084 - RNA, 19 nt, Homo sapiens
ugacaaagcugaggcugau

SEQ ID NO: 319085 - RNA, 19 nt, Homo sapiens
caaauguacuuucugugau

SEQ ID NO: 319086 - RNA, 19 nt, Homo sapiens
ucaaauguacuuucuguga

SEQ ID NO: 319087 - RNA, 19 nt, Homo sapiens
ugagaaguauggccaucua

SEQ ID NO: 319088 - RNA, 19 nt, Homo sapiens
ucaaagaagagcauuaaga

SEQ ID NO: 319089 - RNA, 19 nt, Homo sapiens
gauguuaaccuugcugaaa

SEQ ID NO: 319090 - RNA, 19 nt, Homo sapiens
gguuguagcugcagaugau

SEQ ID NO: 319091 - RNA, 19 nt, Homo sapiens
gauauaagugcaaaugaug

SEQ ID NO: 319092 - RNA, 19 nt, Homo sapiens
cgagugugaacuagaauua

SEQ ID NO: 319093 - RNA, 19 nt, Homo sapiens
gaaggcagggaugaaguua

SEQ ID NO: 319094 - RNA, 19 nt, Homo sapiens
caguuuagaugaagacaau

SEQ ID NO: 319095 - RNA, 19 nt, Homo sapiens
agaaagcccgugagaagua

SEQ ID NO: 319096 - RNA, 19 nt, Homo sapiens
gcgaaaggaacacaaagaa

SEQ ID NO: 319097 - RNA, 19 nt, Homo sapiens
ggaaauaugaacaagaaca

SEQ ID NO: 319098 - RNA, 19 nt, Homo sapiens
agacucacauuuagaugaa

SEQ ID NO: 319099 - RNA, 19 nt, Homo sapiens
gaugugguaugugaagauu

SEQ ID NO: 319100 - RNA, 19 nt, Homo sapiens
aggcagggaugaaguuaaa

SEQ ID NO: 319101 - RNA, 19 nt, Homo sapiens
ggagaacuugcuacgauuu

SEQ ID NO: 319102 - RNA, 19 nt, Homo sapiens
ggugaggcaucuauacuag

SEQ ID NO: 319103 - RNA, 19 nt, Homo sapiens
gugaaugcaggcaauguua

SEQ ID NO: 319104 - RNA, 19 nt, Homo sapiens
caucuacuguggaagaaga

SEQ ID NO: 319105 - RNA, 19 nt, Homo sapiens
gaaggaacaguaauagagu

SEQ ID NO: 319106 - RNA, 19 nt, Homo sapiens
ccauggaaaucucaguuau

SEQ ID NO: 319107 - RNA, 19 nt, Homo sapiens
gaaggaccauggaaaucuc

SEQ ID NO: 319108 - RNA, 19 nt, Homo sapiens
uaaacuaacccguaaugga

SEQ ID NO: 319109 - RNA, 19 nt, Homo sapiens
gaugcacagguuccuauua

SEQ ID NO: 319110 - RNA, 19 nt, Homo sapiens
gaugaaacaaacuguagaa

SEQ ID NO: 319111 - RNA, 19 nt, Homo sapiens
gaaguuaaaguggaguaaa

SEQ ID NO: 319112 - RNA, 19 nt, Homo sapiens
gcuacgauuucacacuauu

SEQ ID NO: 319113 - RNA, 19 nt, Homo sapiens
uaauggacauguaauuugg

SEQ ID NO: 319114 - RNA, 19 nt, Homo sapiens
uaauagagucuuucacaga

SEQ ID NO: 319115 - RNA, 19 nt, Homo sapiens
ugccaaagaugcacagguu

SEQ ID NO: 319116 - RNA, 19 nt, Homo sapiens
gaaugacuauugaggaacu

SEQ ID NO: 319117 - RNA, 19 nt, Homo sapiens
ggaauggauuguggucuca

SEQ ID NO: 319118 - RNA, 19 nt, Homo sapiens
gccauuaacuagcgguaug

SEQ ID NO: 319119 - RNA, 19 nt, Homo sapiens
ucagaaagcccgugagaag

SEQ ID NO: 319120 - RNA, 19 nt, Homo sapiens
uggaaugacuauugaggaa

SEQ ID NO: 319121 - RNA, 19 nt, Homo sapiens
gaaguauggauuggaauga

SEQ ID NO: 319122 - RNA, 19 nt, Homo sapiens
gggcugcuuuaucucagua

SEQ ID NO: 319123 - RNA, 19 nt, Homo sapiens
caaagaagagcauuaagac

SEQ ID NO: 319124 - RNA, 19 nt, Homo sapiens
caauauggaauuucaagug

SEQ ID NO: 319125 - RNA, 19 nt, Homo sapiens
ucauuaaccucauugaaac

SEQ ID NO: 319126 - RNA, 19 nt, Homo sapiens
guuguugacuggaggaaau

SEQ ID NO: 319127 - RNA, 19 nt, Homo sapiens
ugugguaugugaagauuau

SEQ ID NO: 319128 - RNA, 19 nt, Homo sapiens
accagaagcuacugaaguu

SEQ ID NO: 319129 - RNA, 19 nt, Homo sapiens
ggagacagaauuguuuguu

SEQ ID NO: 319130 - RNA, 19 nt, Homo sapiens
uauacuagcuaccuucucu

SEQ ID NO: 319131 - RNA, 19 nt, Homo sapiens
uaauuuaccgucuuguuga

SEQ ID NO: 319132 - RNA, 19 nt, Homo sapiens
uaaaggugauguugauggu

SEQ ID NO: 319133 - RNA, 19 nt, Homo sapiens
ggaggaaauaugaacaaga

SEQ ID NO: 319134 - RNA, 19 nt, Homo sapiens
gccaagggcacgugaaguu

SEQ ID NO: 319135 - RNA, 19 nt, Homo sapiens
cgucuggguucuagucuug

SEQ ID NO: 319136 - RNA, 19 nt, Homo sapiens
gggaaagagauucaaaugu

SEQ ID NO: 319137 - RNA, 19 nt, Homo sapiens
cuacagcuauaauucaaag

SEQ ID NO: 319138 - RNA, 19 nt, Homo sapiens
gcugcuggcuuacgaugug

SEQ ID NO: 319139 - RNA, 19 nt, Homo sapiens
uaacuagcgguaugacauu

SEQ ID NO: 319140 - RNA, 19 nt, Homo sapiens
caagugggagacagaauug

SEQ ID NO: 319141 - RNA, 19 nt, Homo sapiens
gaaacaccauaaagaugac

SEQ ID NO: 319142 - RNA, 19 nt, Homo sapiens
cguaauggacauguaauuu

SEQ ID NO: 319143 - RNA, 19 nt, Homo sapiens
gaaauaugaacaagaacag

SEQ ID NO: 319144 - RNA, 19 nt, Homo sapiens
ugaaacaaacuguagaauc

SEQ ID NO: 319145 - RNA, 19 nt, Homo sapiens
cuaaagaccugcuguaaua

SEQ ID NO: 319146 - RNA, 19 nt, Homo sapiens
agaaauagcuguauagaug

SEQ ID NO: 319147 - RNA, 19 nt, Homo sapiens
gaagagauauguuugagau

SEQ ID NO: 319148 - RNA, 19 nt, Homo sapiens
gagaaugagucuauuaaga

SEQ ID NO: 319149 - RNA, 19 nt, Homo sapiens
gagaaacacuaaucacuga

SEQ ID NO: 319150 - RNA, 19 nt, Homo sapiens
gaacauaucaagcucguuu

SEQ ID NO: 319151 - RNA, 19 nt, Homo sapiens
caucaugaguggugacuua

SEQ ID NO: 319152 - RNA, 19 nt, Homo sapiens
cauuagagcucgaaauaaa

SEQ ID NO: 319153 - RNA, 19 nt, Homo sapiens
gcaagguguuuaaguaauu

SEQ ID NO: 319154 - RNA, 19 nt, Homo sapiens
gaaacggauucuucucuaa

SEQ ID NO: 319155 - RNA, 19 nt, Homo sapiens
ggugugaucucgagaauug

SEQ ID NO: 319156 - RNA, 19 nt, Homo sapiens
aaagcaagguguuuaagua

SEQ ID NO: 319157 - RNA, 19 nt, Homo sapiens
ggaaacggauucuucucua

SEQ ID NO: 319158 - RNA, 19 nt, Homo sapiens
gcacaguucuauuugcuau

SEQ ID NO: 319159 - RNA, 19 nt, Homo sapiens
gaagaaaggagcugagaug

SEQ ID NO: 319160 - RNA, 19 nt, Homo sapiens
gacaggagccauucaagua

SEQ ID NO: 319161 - RNA, 19 nt, Homo sapiens
guacauguguugagcguau

SEQ ID NO: 319162 - RNA, 19 nt, Homo sapiens
ggaaaacccugacaccuuu

SEQ ID NO: 319163 - RNA, 19 nt, Homo sapiens
cgagaaagacagaagguua

SEQ ID NO: 319164 - RNA, 19 nt, Homo sapiens
ugaaagugaugaugcauau

SEQ ID NO: 319165 - RNA, 19 nt, Homo sapiens
gggaagaguuuacaucaca

SEQ ID NO: 319166 - RNA, 19 nt, Homo sapiens
guucagugcuugugcauug

SEQ ID NO: 319167 - RNA, 19 nt, Homo sapiens
ggacauuguuuauccuaau

SEQ ID NO: 319168 - RNA, 19 nt, Homo sapiens
guggauggauggacaguuu

SEQ ID NO: 319169 - RNA, 19 nt, Homo sapiens
gaauaugugccuucuagaa

SEQ ID NO: 319170 - RNA, 19 nt, Homo sapiens
gacagaagguuacagaaag

SEQ ID NO: 319171 - RNA, 19 nt, Homo sapiens
ucaaguagcagacaaaguu

SEQ ID NO: 319172 - RNA, 19 nt, Homo sapiens
caucucaaauacaguagua

SEQ ID NO: 319173 - RNA, 19 nt, Homo sapiens
gcugaccguucuccuauuu

SEQ ID NO: 319174 - RNA, 19 nt, Homo sapiens
uaagacaucucaaauacag

SEQ ID NO: 319175 - RNA, 19 nt, Homo sapiens
gaaauagcuguauagauga

SEQ ID NO: 319176 - RNA, 19 nt, Homo sapiens
ucucuaagaugaauccaaa

SEQ ID NO: 319177 - RNA, 19 nt, Homo sapiens
ggacauaaauuugcaucuc

SEQ ID NO: 319178 - RNA, 19 nt, Homo sapiens
uaaaugcaguggccaacaa

SEQ ID NO: 319179 - RNA, 19 nt, Homo sapiens
acuaaucacugacaaagaa

SEQ ID NO: 319180 - RNA, 19 nt, Homo sapiens
uaagaugaauccaaaugug

SEQ ID NO: 319181 - RNA, 19 nt, Homo sapiens
gauauauguuuguggaaug

SEQ ID NO: 319182 - RNA, 19 nt, Homo sapiens
gaauaggucauggugauaa

SEQ ID NO: 319183 - RNA, 19 nt, Homo sapiens
ggaaacgaaauaaagauga

SEQ ID NO: 319184 - RNA, 19 nt, Homo sapiens
ugaaucugcucgagaaaga

SEQ ID NO: 319185 - RNA, 19 nt, Homo sapiens
ggccacagcagaagagaua

SEQ ID NO: 319186 - RNA, 19 nt, Homo sapiens
gacagggcccaguuaaaua

SEQ ID NO: 319187 - RNA, 19 nt, Homo sapiens
ggauauauguuuguggaau

SEQ ID NO: 319188 - RNA, 19 nt, Homo sapiens
gcagaagagauauguuuga

SEQ ID NO: 319189 - RNA, 19 nt, Homo sapiens
guaccaggccguuugcuuu

SEQ ID NO: 319190 - RNA, 19 nt, Homo sapiens
uuaaguaauugccagcuuu

SEQ ID NO: 319191 - RNA, 19 nt, Homo sapiens
ggcgauagcugacuuucau

SEQ ID NO: 319192 - RNA, 19 nt, Homo sapiens
ccgauuugguacuuucuua

SEQ ID NO: 319193 - RNA, 19 nt, Homo sapiens
uggaucaucuguauaguug

SEQ ID NO: 319194 - RNA, 19 nt, Homo sapiens
cagcagaagagauauguuu

SEQ ID NO: 319195 - RNA, 19 nt, Homo sapiens
gaaguauuguguuuaugca

SEQ ID NO: 319196 - RNA, 19 nt, Homo sapiens
agagagcacuguccaagga

SEQ ID NO: 319197 - RNA, 19 nt, Homo sapiens
gggcuuaauugaaacaaca

SEQ ID NO: 319198 - RNA, 19 nt, Homo sapiens
uaaaggcgauagcugacuu

SEQ ID NO: 319199 - RNA, 19 nt, Homo sapiens
ggaagaguuuacaucacaa

SEQ ID NO: 319200 - RNA, 19 nt, Homo sapiens
caaguaagacaucucaaau

SEQ ID NO: 319201 - RNA, 19 nt, Homo sapiens
ccaaguaagacaucucaaa

SEQ ID NO: 319202 - RNA, 19 nt, Homo sapiens
auaugugccuucuagaaua

SEQ ID NO: 319203 - RNA, 19 nt, Homo sapiens
gaauuccagugcugucaug

SEQ ID NO: 319204 - RNA, 19 nt, Homo sapiens
aaucaccauuggagaauaa

SEQ ID NO: 319205 - RNA, 19 nt, Homo sapiens
gaccugcuguaauaaaugu

SEQ ID NO: 319206 - RNA, 19 nt, Homo sapiens
gaggacgucucgagaugga

SEQ ID NO: 319207 - RNA, 19 nt, Homo sapiens
ggauucuucucuaauacuu

SEQ ID NO: 319208 - RNA, 19 nt, Homo sapiens
gauuguguguggcaaaugu

SEQ ID NO: 319209 - RNA, 19 nt, Homo sapiens
cauugaaggguucgaaaua

SEQ ID NO: 319210 - RNA, 19 nt, Homo sapiens
guagaagaaucucauuggu

SEQ ID NO: 319211 - RNA, 19 nt, Homo sapiens
gaacuuuucuucuuagaca

SEQ ID NO: 319212 - RNA, 19 nt, Homo sapiens
caucacaaauuaucgucuu

SEQ ID NO: 319213 - RNA, 19 nt, Homo sapiens
aguaagacaucucaaauac

SEQ ID NO: 319214 - RNA, 19 nt, Homo sapiens
ggaggaggauaugaaagug

SEQ ID NO: 319215 - RNA, 19 nt, Homo sapiens
gaugcaagacccagcguaa

SEQ ID NO: 319216 - RNA, 19 nt, Homo sapiens
cugcaucaacuucuaaaua

SEQ ID NO: 319217 - RNA, 19 nt, Homo sapiens
ugggugaauuacuacauua

SEQ ID NO: 319218 - RNA, 19 nt, Homo sapiens
agacagaagguuacagaaa

SEQ ID NO: 319219 - RNA, 19 nt, Homo sapiens
ugacagggcccaguuaaau

SEQ ID NO: 319220 - RNA, 19 nt, Homo sapiens
gcauuagagcucgaaauaa

SEQ ID NO: 319221 - RNA, 19 nt, Homo sapiens
cgcauuagagcucgaaaua

SEQ ID NO: 319222 - RNA, 19 nt, Homo sapiens
ugaaggacauuguuuaucc

SEQ ID NO: 319223 - RNA, 19 nt, Homo sapiens
uaucauaacgccgaacuuu

SEQ ID NO: 319224 - RNA, 19 nt, Homo sapiens
aacggauucuucucuaaua

SEQ ID NO: 319225 - RNA, 19 nt, Homo sapiens
gaagaguuuacaucacaaa

SEQ ID NO: 319226 - RNA, 19 nt, Homo sapiens
caagguguuuaaguaauug

SEQ ID NO: 319227 - RNA, 19 nt, Homo sapiens
ccauguagaacuugaacua

SEQ ID NO: 319228 - RNA, 19 nt, Homo sapiens
ugugcaaacucacuucuga

SEQ ID NO: 319229 - RNA, 19 nt, Homo sapiens
uauaguugccgauuuggua

SEQ ID NO: 319230 - RNA, 19 nt, Homo sapiens
aaauuugcaucucgaauag

SEQ ID NO: 319231 - RNA, 19 nt, Homo sapiens
cagggagacuaauaaacaa

SEQ ID NO: 319232 - RNA, 19 nt, Homo sapiens
ucagggagacuaauaaaca

SEQ ID NO: 319233 - RNA, 19 nt, Homo sapiens
ccagugcugucauggauuc

SEQ ID NO: 319234 - RNA, 19 nt, Homo sapiens
gacuaaagaccugcuguaa

SEQ ID NO: 319235 - RNA, 19 nt, Homo sapiens
agacaucucaaauacagua

SEQ ID NO: 319236 - RNA, 19 nt, Homo sapiens
ucgaauaggucauggugau

SEQ ID NO: 319237 - RNA, 19 nt, Homo sapiens
gaugaccuccggagaguug

SEQ ID NO: 319238 - RNA, 19 nt, Homo sapiens
gcucacagucugccauuau

SEQ ID NO: 319239 - RNA, 19 nt, Homo sapiens
guaaagacaugagaaaccu

SEQ ID NO: 319240 - RNA, 19 nt, Homo sapiens
uggcaauaaugacuaaaga

SEQ ID NO: 319241 - RNA, 19 nt, Homo sapiens
aaagcuaaggcucgaguua

SEQ ID NO: 319242 - RNA, 19 nt, Homo sapiens
gagcaucauccuuagaaau

SEQ ID NO: 319243 - RNA, 19 nt, Homo sapiens
gcuagagcaucauccuuag

SEQ ID NO: 319244 - RNA, 19 nt, Homo sapiens
gagaaauagcuguauagau

SEQ ID NO: 319245 - RNA, 19 nt, Homo sapiens
caaacaaucucauaugaag

SEQ ID NO: 319246 - RNA, 19 nt, Homo sapiens
caccaucgcucuucuacua

SEQ ID NO: 319247 - RNA, 19 nt, Homo sapiens
gaacuagucucaggcuuca

SEQ ID NO: 319248 - RNA, 19 nt, Homo sapiens
acaagaacaccucugauua

SEQ ID NO: 319249 - RNA, 19 nt, Homo sapiens
gagcaucaaacucaaacua

SEQ ID NO: 319250 - RNA, 19 nt, Homo sapiens
acuaauaaguggcuccuuu

SEQ ID NO: 319251 - RNA, 19 nt, Homo sapiens
cccaaacaaucucauauga

SEQ ID NO: 319252 - RNA, 19 nt, Homo sapiens
ugauuuaucuccacacuag

SEQ ID NO: 319253 - RNA, 19 nt, Homo sapiens
gaacucuacacaacauauu

SEQ ID NO: 319254 - RNA, 19 nt, Homo sapiens
cuaauaaguggcuccuuua

SEQ ID NO: 319255 - RNA, 19 nt, Homo sapiens
cacccuagcauuacuuaua

SEQ ID NO: 319256 - RNA, 19 nt, Homo sapiens
uuuaaccucuccacccuua

SEQ ID NO: 319257 - RNA, 19 nt, Homo sapiens
uaaacacccucaccacuac

SEQ ID NO: 319258 - RNA, 19 nt, Homo sapiens
caagaacaccucugauuac

SEQ ID NO: 319259 - RNA, 19 nt, Homo sapiens
caacauauuuugucaccaa

SEQ ID NO: 319260 - RNA, 19 nt, Homo sapiens
cacaagaacaccucugauu

SEQ ID NO: 319261 - RNA, 19 nt, Homo sapiens
gaagucacccuagccauca

SEQ ID NO: 319262 - RNA, 19 nt, Homo sapiens
ccaaacaaucucauaugaa

SEQ ID NO: 319263 - RNA, 19 nt, Homo sapiens
gccgaauacacaaacauua

SEQ ID NO: 319264 - RNA, 19 nt, Homo sapiens
ccgcuacgaccaacucaua

SEQ ID NO: 319265 - RNA, 19 nt, Homo sapiens
ucaugacccuuggccauaa

SEQ ID NO: 319266 - RNA, 19 nt, Homo sapiens
uaauaaguggcuccuuuaa

SEQ ID NO: 319267 - RNA, 19 nt, Homo sapiens
cuucauagccgaauacaca

SEQ ID NO: 319268 - RNA, 19 nt, Homo sapiens
gauuacuccugccaucaug

SEQ ID NO: 319269 - RNA, 19 nt, Homo sapiens
acccuucgcugacgccaua

SEQ ID NO: 319270 - RNA, 19 nt, Homo sapiens
ucuaggcuauauacaacua

SEQ ID NO: 319271 - RNA, 19 nt, Homo sapiens
auaaacacccucaccacua

SEQ ID NO: 319272 - RNA, 19 nt, Homo sapiens
gcaguagcccaaacaaucu

SEQ ID NO: 319273 - RNA, 19 nt, Homo sapiens
gaucagggugagcaucaaa

SEQ ID NO: 319274 - RNA, 19 nt, Homo sapiens
uagccuagccguuuacuca

SEQ ID NO: 319275 - RNA, 19 nt, Homo sapiens
ccgaauacacaaacauuau

SEQ ID NO: 319276 - RNA, 19 nt, Homo sapiens
ccucaccacuacaaucuuc

SEQ ID NO: 319277 - RNA, 19 nt, Homo sapiens
ccauaaaacucuucaccaa

SEQ ID NO: 319278 - RNA, 19 nt, Homo sapiens
caacucauacaccuccuau

SEQ ID NO: 319279 - RNA, 19 nt, Homo sapiens
gcccaaacaaucucauaug

SEQ ID NO: 319280 - RNA, 19 nt, Homo sapiens
gagcaguagcccaaacaau

SEQ ID NO: 319281 - RNA, 19 nt, Homo sapiens
acccuagcauuacuuauau

SEQ ID NO: 319282 - RNA, 19 nt, Homo sapiens
ggccuccuauuuauucuag

SEQ ID NO: 319283 - RNA, 19 nt, Homo sapiens
ucccuguucuuaugaauuc

SEQ ID NO: 319284 - RNA, 19 nt, Homo sapiens
caucgcucuucuacuauga

SEQ ID NO: 319285 - RNA, 19 nt, Homo sapiens
ccaucgcucuucuacuaug

SEQ ID NO: 319286 - RNA, 19 nt, Homo sapiens
auuacaaucuccagcauuc

SEQ ID NO: 319287 - RNA, 19 nt, Homo sapiens
ccugaacucuacacaacau

SEQ ID NO: 319288 - RNA, 19 nt, Homo sapiens
ggaguccgaacuagucuca

SEQ ID NO: 319289 - RNA, 19 nt, Homo sapiens
cacccuagccaucauucua

SEQ ID NO: 319290 - RNA, 19 nt, Homo sapiens
auaaguggcuccuuuaacc

SEQ ID NO: 319291 - RNA, 19 nt, Homo sapiens
gccuagccguuuacucaau

SEQ ID NO: 319292 - RNA, 19 nt, Homo sapiens
cuauauacaacuacgcaaa

SEQ ID NO: 319293 - RNA, 19 nt, Homo sapiens
cauuguacccauucuaauc

SEQ ID NO: 319294 - RNA, 19 nt, Homo sapiens
agccaucauucuacuauca

SEQ ID NO: 319295 - RNA, 19 nt, Homo sapiens
ccauuacaaucuccagcau

SEQ ID NO: 319296 - RNA, 19 nt, Homo sapiens
ccuagcauuacuuauauga

SEQ ID NO: 319297 - RNA, 19 nt, Homo sapiens
aagaacaccucugauuacu

SEQ ID NO: 319298 - RNA, 19 nt, Homo sapiens
uagcccaaacaaucucaua

SEQ ID NO: 319299 - RNA, 19 nt, Homo sapiens
caaccuccuacuccucauu

SEQ ID NO: 319300 - RNA, 19 nt, Homo sapiens
ugaacucuacacaacauau

SEQ ID NO: 319301 - RNA, 19 nt, Homo sapiens
caugacccuuggccauaau

SEQ ID NO: 319302 - RNA, 19 nt, Homo sapiens
accacucacccuagcauua

SEQ ID NO: 319303 - RNA, 19 nt, Homo sapiens
ccuaaugcuuaccgaacga

SEQ ID NO: 319304 - RNA, 19 nt, Homo sapiens
uaaccucuccacccuuauc

SEQ ID NO: 319305 - RNA, 19 nt, Homo sapiens
ccuagccguuuacucaauc

SEQ ID NO: 319306 - RNA, 19 nt, Homo sapiens
ccacucacccuagcauuac

SEQ ID NO: 319307 - RNA, 19 nt, Homo sapiens
ucaccaagacccuacuucu

SEQ ID NO: 319308 - RNA, 19 nt, Homo sapiens
ccuccuacuccucauugua

SEQ ID NO: 319309 - RNA, 19 nt, Homo sapiens
auaaaacucuucaccaaag

SEQ ID NO: 319310 - RNA, 19 nt, Homo sapiens
ccacauaggaugaauaaua

SEQ ID NO: 319311 - RNA, 19 nt, Homo sapiens
ccaaaucucucccucacua

SEQ ID NO: 319312 - RNA, 19 nt, Homo sapiens
gcuauccucuucaacaaua

SEQ ID NO: 319313 - RNA, 19 nt, Homo sapiens
gaaacaagcuaacaugacu

SEQ ID NO: 319314 - RNA, 19 nt, Homo sapiens
gaaauaaacaugcuagcuu

SEQ ID NO: 319315 - RNA, 19 nt, Homo sapiens
gcaagcaaccgcauccaua

SEQ ID NO: 319316 - RNA, 19 nt, Homo sapiens
caucuacucuaccaucuuu

SEQ ID NO: 319317 - RNA, 19 nt, Homo sapiens
caaugaaccauaaccaaua

SEQ ID NO: 319318 - RNA, 19 nt, Homo sapiens
ucuaauagcuauccucuuc

SEQ ID NO: 319319 - RNA, 19 nt, Homo sapiens
gaguaggccuagaaauaaa

SEQ ID NO: 319320 - RNA, 19 nt, Homo sapiens
ccaauacuaccaaucaaua

SEQ ID NO: 319321 - RNA, 19 nt, Homo sapiens
gcgcuaagcucgcacugau

SEQ ID NO: 319322 - RNA, 19 nt, Homo sapiens
uuagcauacuccucaauua

SEQ ID NO: 319323 - RNA, 19 nt, Homo sapiens
aagcugccaucaaguauuu

SEQ ID NO: 319324 - RNA, 19 nt, Homo sapiens
gcuaagcucgcacugauuu

SEQ ID NO: 319325 - RNA, 19 nt, Homo sapiens
cacauaggaugaauaauag

SEQ ID NO: 319326 - RNA, 19 nt, Homo sapiens
caucauagcaggcaguuga

SEQ ID NO: 319327 - RNA, 19 nt, Homo sapiens
caagcaaccgcauccauaa

SEQ ID NO: 319328 - RNA, 19 nt, Homo sapiens
ugaguaggccuagaaauaa

SEQ ID NO: 319329 - RNA, 19 nt, Homo sapiens
cacagaagcugccaucaag

SEQ ID NO: 319330 - RNA, 19 nt, Homo sapiens
cugaguaggccuagaaaua

SEQ ID NO: 319331 - RNA, 19 nt, Homo sapiens
cuaccuaucuccccuuuua

SEQ ID NO: 319332 - RNA, 19 nt, Homo sapiens
ugacuaacacccuuaauuc

SEQ ID NO: 319333 - RNA, 19 nt, Homo sapiens
uaaccaauacuaccaauca

SEQ ID NO: 319334 - RNA, 19 nt, Homo sapiens
cagaagcugccaucaagua

SEQ ID NO: 319335 - RNA, 19 nt, Homo sapiens
ccuaacauaaccauucuua

SEQ ID NO: 319336 - RNA, 19 nt, Homo sapiens
uaauagcuauccucuucaa

SEQ ID NO: 319337 - RNA, 19 nt, Homo sapiens
guacaacccuaacauaacc

SEQ ID NO: 319338 - RNA, 19 nt, Homo sapiens
gaagcugccaucaaguauu

SEQ ID NO: 319339 - RNA, 19 nt, Homo sapiens
ccacagaagcugccaucaa

SEQ ID NO: 319340 - RNA, 19 nt, Homo sapiens
uagcuauccucuucaacaa

SEQ ID NO: 319341 - RNA, 19 nt, Homo sapiens
caagcuaacaugacuaaca

SEQ ID NO: 319342 - RNA, 19 nt, Homo sapiens
gggccauuaucgaagaauu

SEQ ID NO: 319343 - RNA, 19 nt, Homo sapiens
gacaaugaaccauaaccaa

SEQ ID NO: 319344 - RNA, 19 nt, Homo sapiens
ccacgcuacuccuaccuau

SEQ ID NO: 319345 - RNA, 19 nt, Homo sapiens
uagcaguucuaccguacaa

SEQ ID NO: 319346 - RNA, 19 nt, Homo sapiens
caguugagguggauuaaac

SEQ ID NO: 319347 - RNA, 19 nt, Homo sapiens
uaaccucuacuucuaccua

SEQ ID NO: 319348 - RNA, 19 nt, Homo sapiens
uauacucuccggacaauga

SEQ ID NO: 319349 - RNA, 19 nt, Homo sapiens
ccguacaacccuaacauaa

SEQ ID NO: 319350 - RNA, 19 nt, Homo sapiens
ucaauuacccacauaggau

SEQ ID NO: 319351 - RNA, 19 nt, Homo sapiens
ggacaaugaaccauaacca

SEQ ID NO: 319352 - RNA, 19 nt, Homo sapiens
cuaacacccuuaauuccau

SEQ ID NO: 319353 - RNA, 19 nt, Homo sapiens
cauaauccuucuaauagcu

SEQ ID NO: 319354 - RNA, 19 nt, Homo sapiens
uccauaauccuucuaauag

SEQ ID NO: 319355 - RNA, 19 nt, Homo sapiens
gcauccauaauccuucuaa

SEQ ID NO: 319356 - RNA, 19 nt, Homo sapiens
ccaaucaauacucaucauu

SEQ ID NO: 319357 - RNA, 19 nt, Homo sapiens
gaaccauaaccaauacuac

SEQ ID NO: 319358 - RNA, 19 nt, Homo sapiens
acaaugaaccauaaccaau

SEQ ID NO: 319359 - RNA, 19 nt, Homo sapiens
uccuuaaccucuacuucua

SEQ ID NO: 319360 - RNA, 19 nt, Homo sapiens
gcaggcaguugagguggau

SEQ ID NO: 319361 - RNA, 19 nt, Homo sapiens
ucaaucuuauccaucauag

SEQ ID NO: 319362 - RNA, 19 nt, Homo sapiens
cauaaccaauacuaccaau

SEQ ID NO: 319363 - RNA, 19 nt, Homo sapiens
caauauacucuccggacaa

SEQ ID NO: 319364 - RNA, 19 nt, Homo sapiens
aaugacaguuugaacauac

SEQ ID NO: 319365 - RNA, 19 nt, Homo sapiens
aauauacucuccggacaau

SEQ ID NO: 319366 - RNA, 19 nt, Homo sapiens
ccccauaucuaacaacgua

SEQ ID NO: 319367 - RNA, 19 nt, Homo sapiens
gcaguugagguggauuaaa

SEQ ID NO: 319368 - RNA, 19 nt, Homo sapiens
caaaucucucccucacuaa

SEQ ID NO: 319369 - RNA, 19 nt, Homo sapiens
gcaauaaaacuaggaauag

SEQ ID NO: 319370 - RNA, 19 nt, Homo sapiens
ugaaccauaaccaauacua

SEQ ID NO: 319371 - RNA, 19 nt, Homo sapiens
uccggacaaugaaccauaa

SEQ ID NO: 319372 - RNA, 19 nt, Homo sapiens
uaucuccccuuuuauacua

SEQ ID NO: 319373 - RNA, 19 nt, Homo sapiens
gaugaauaauagcaguucu

SEQ ID NO: 319374 - RNA, 19 nt, Homo sapiens
gcaaccgcauccauaaucc

SEQ ID NO: 319375 - RNA, 19 nt, Homo sapiens
gccaccaucacccuccuua

SEQ ID NO: 319376 - RNA, 19 nt, Homo sapiens
aaugaaccauaaccaauac

SEQ ID NO: 319377 - RNA, 19 nt, Homo sapiens
ccauaucuaacaacguaaa

SEQ ID NO: 319378 - RNA, 19 nt, Homo sapiens
aaacaauagccucaucauc

SEQ ID NO: 319379 - RNA, 19 nt, Homo sapiens
ggaugaauaauagcaguuc

SEQ ID NO: 319380 - RNA, 19 nt, Homo sapiens
ccauaauccuucuaauagc

SEQ ID NO: 319381 - RNA, 19 nt, Homo sapiens
aacaagcuaacaugacuaa

SEQ ID NO: 319382 - RNA, 19 nt, Homo sapiens
aaucuuauccaucauagca

SEQ ID NO: 319383 - RNA, 19 nt, Homo sapiens
ucacccuccuuaaccucua

SEQ ID NO: 319384 - RNA, 19 nt, Homo sapiens
aagcuaacaugacuaacac

SEQ ID NO: 319385 - RNA, 19 nt, Homo sapiens
aaacaagcuaacaugacua

SEQ ID NO: 319386 - RNA, 19 nt, Homo sapiens
ccuaacuacuaccgcauuc

SEQ ID NO: 319387 - RNA, 19 nt, Homo sapiens
ucuccucacucucucaauc

SEQ ID NO: 319388 - RNA, 19 nt, Homo sapiens
cuaaucuacuccaccucaa

SEQ ID NO: 319389 - RNA, 19 nt, Homo sapiens
uagcauacuccucaauuac

SEQ ID NO: 319390 - RNA, 19 nt, Homo sapiens
caacccgucaucuacucua

SEQ ID NO: 319391 - RNA, 19 nt, Homo sapiens
caucauccccaccaucaua

SEQ ID NO: 319392 - RNA, 19 nt, Homo sapiens
ccugaaacaagcuaacaug

SEQ ID NO: 319393 - RNA, 19 nt, Homo sapiens
ccucacucucucaaucuua

SEQ ID NO: 319394 - RNA, 19 nt, Homo sapiens
cuucuucucacaugacaaa

SEQ ID NO: 319395 - RNA, 19 nt, Homo sapiens
uaaacccucguuccacaga

SEQ ID NO: 319396 - RNA, 19 nt, Homo sapiens
cugaaacaagcuaacauga

SEQ ID NO: 319397 - RNA, 19 nt, Homo sapiens
ccgcauuccuacuacucaa

SEQ ID NO: 319398 - RNA, 19 nt, Homo sapiens
acccacauaggaugaauaa

SEQ ID NO: 319399 - RNA, 19 nt, Homo sapiens
cauccggccugcuucuucu

SEQ ID NO: 319400 - RNA, 19 nt, Homo sapiens
aaccaauacuaccaaucaa

SEQ ID NO: 319401 - RNA, 19 nt, Homo sapiens
cauccauaauccuucuaau

SEQ ID NO: 319402 - RNA, 19 nt, Homo sapiens
aaaucucucccucacuaaa

SEQ ID NO: 319403 - RNA, 19 nt, Homo sapiens
uauuccaguucuaaccaaa

SEQ ID NO: 319404 - RNA, 19 nt, Homo sapiens
ccaccucaaucacacuacu

SEQ ID NO: 319405 - RNA, 19 nt, Homo sapiens
ggccauuaucgaagaauuc

SEQ ID NO: 319406 - RNA, 19 nt, Homo sapiens
ugaaacaagcuaacaugac

SEQ ID NO: 319407 - RNA, 19 nt, Homo sapiens
aaacccucguuccacagaa

SEQ ID NO: 319408 - RNA, 19 nt, Homo sapiens
cuuagcauacuccucaauu

SEQ ID NO: 319409 - RNA, 19 nt, Homo sapiens
cucacucucucaaucuuau

SEQ ID NO: 319410 - RNA, 19 nt, Homo sapiens
caacuaaccugccacuaau

SEQ ID NO: 319411 - RNA, 19 nt, Homo sapiens
uaugucaucccucuuauua

SEQ ID NO: 319412 - RNA, 19 nt, Homo sapiens
ugucaucccucuuauuaau

SEQ ID NO: 319413 - RNA, 19 nt, Homo sapiens
ccgcgucccuuucuccaua

SEQ ID NO: 319414 - RNA, 19 nt, Homo sapiens
acaacuaaccugccacuaa

SEQ ID NO: 319415 - RNA, 19 nt, Homo sapiens
caacacccuccuagccuua

SEQ ID NO: 319416 - RNA, 19 nt, Homo sapiens
ccuccuagccuuacuacua

SEQ ID NO: 319417 - RNA, 19 nt, Homo sapiens
caacucaacggcuacauag

SEQ ID NO: 319418 - RNA, 19 nt, Homo sapiens
cuccuagccuuacuacuaa

SEQ ID NO: 319419 - RNA, 19 nt, Homo sapiens
gccuaugagugacuacaaa

SEQ ID NO: 319420 - RNA, 19 nt, Homo sapiens
cccuaagucuggccuauga

SEQ ID NO: 319421 - RNA, 19 nt, Homo sapiens
agaaauugcccuccuuuua

SEQ ID NO: 319422 - RNA, 19 nt, Homo sapiens
ucaucccucuuauuaauca

SEQ ID NO: 319423 - RNA, 19 nt, Homo sapiens
cucaacggcuacauagaaa

SEQ ID NO: 319424 - RNA, 19 nt, Homo sapiens
acaacucaacggcuacaua

SEQ ID NO: 319425 - RNA, 19 nt, Homo sapiens
gaaauugcccuccuuuuac

SEQ ID NO: 319426 - RNA, 19 nt, Homo sapiens
acucaacggcuacauagaa

SEQ ID NO: 319427 - RNA, 19 nt, Homo sapiens
guuaugucaucccucuuau

SEQ ID NO: 319428 - RNA, 19 nt, Homo sapiens
caugagcccuacaaacaac

SEQ ID NO: 319429 - RNA, 19 nt, Homo sapiens
ccaugagcccuacaaacaa

SEQ ID NO: 319430 - RNA, 19 nt, Homo sapiens
uaguagcuauuaccuucuu

SEQ ID NO: 319431 - RNA, 19 nt, Homo sapiens
cuagaaauugcccuccuuu

SEQ ID NO: 319432 - RNA, 19 nt, Homo sapiens
aguuaugucaucccucuua

SEQ ID NO: 319433 - RNA, 19 nt, Homo sapiens
ucuagaaauugcccuccuu

SEQ ID NO: 319434 - RNA, 19 nt, Homo sapiens
accaugagcccuacaaaca

SEQ ID NO: 319435 - RNA, 19 nt, Homo sapiens
aauaaucaacacccuccua

SEQ ID NO: 319436 - RNA, 19 nt, Homo sapiens
ccuagccuuacuacuaaua

SEQ ID NO: 319437 - RNA, 19 nt, Homo sapiens
guagcuauuaccuucuuau

SEQ ID NO: 319438 - RNA, 19 nt, Homo sapiens
gcacauacuuccuauucua

SEQ ID NO: 319439 - RNA, 19 nt, Homo sapiens
ccacagaacuaaucauauu

SEQ ID NO: 319440 - RNA, 19 nt, Homo sapiens
cauuauagcuacucucaua

SEQ ID NO: 319441 - RNA, 19 nt, Homo sapiens
uaaaaucgcucauugcaua

SEQ ID NO: 319442 - RNA, 19 nt, Homo sapiens
auacuaaucucccuacaaa

SEQ ID NO: 319443 - RNA, 19 nt, Homo sapiens
caacacccacucccucuua

SEQ ID NO: 319444 - RNA, 19 nt, Homo sapiens
aaauaucacucuccuacuu

SEQ ID NO: 319445 - RNA, 19 nt, Homo sapiens
augacuagcuuacacaaua

SEQ ID NO: 319446 - RNA, 19 nt, Homo sapiens
caucucacuucuaggaaua

SEQ ID NO: 319447 - RNA, 19 nt, Homo sapiens
ccucauauccucccuacua

SEQ ID NO: 319448 - RNA, 19 nt, Homo sapiens
gccaauaacuuaauaugac

SEQ ID NO: 319449 - RNA, 19 nt, Homo sapiens
gaacgcaggcacauacuuc

SEQ ID NO: 319450 - RNA, 19 nt, Homo sapiens
ucacucacccaccacauua

SEQ ID NO: 319451 - RNA, 19 nt, Homo sapiens
aaacuaggcggcuauggua

SEQ ID NO: 319452 - RNA, 19 nt, Homo sapiens
caacacauauggccuagac

SEQ ID NO: 319453 - RNA, 19 nt, Homo sapiens
uauacucccucuacauauu

SEQ ID NO: 319454 - RNA, 19 nt, Homo sapiens
ucaaggacuucaaacucua

SEQ ID NO: 319455 - RNA, 19 nt, Homo sapiens
cgacaucauuaccggguuu

SEQ ID NO: 319456 - RNA, 19 nt, Homo sapiens
caaacucuacucccacuaa

SEQ ID NO: 319457 - RNA, 19 nt, Homo sapiens
ucaaacuccugagccaaua

SEQ ID NO: 319458 - RNA, 19 nt, Homo sapiens
aggcggcuaugguauaaua

SEQ ID NO: 319459 - RNA, 19 nt, Homo sapiens
aaacuaaucgucccaacaa

SEQ ID NO: 319460 - RNA, 19 nt, Homo sapiens
ccaccacauuaacaacaua

SEQ ID NO: 319461 - RNA, 19 nt, Homo sapiens
ccuauacucccucuacaua

SEQ ID NO: 319462 - RNA, 19 nt, Homo sapiens
agaacucucugugcuagua

SEQ ID NO: 319463 - RNA, 19 nt, Homo sapiens
gcaggcacauacuuccuau

SEQ ID NO: 319464 - RNA, 19 nt, Homo sapiens
gcauuuaccaucucacuuc

SEQ ID NO: 319465 - RNA, 19 nt, Homo sapiens
gcgcagucauucucauaau

SEQ ID NO: 319466 - RNA, 19 nt, Homo sapiens
ggccuagacuacguacaua

SEQ ID NO: 319467 - RNA, 19 nt, Homo sapiens
uaacagccauucucaucca

SEQ ID NO: 319468 - RNA, 19 nt, Homo sapiens
uaaaccuacuccaaugcua

SEQ ID NO: 319469 - RNA, 19 nt, Homo sapiens
cuacauauuuaccacaaca

SEQ ID NO: 319470 - RNA, 19 nt, Homo sapiens
cuccugagccaauaacuua

SEQ ID NO: 319471 - RNA, 19 nt, Homo sapiens
ccaaaucaacaacaaccua

SEQ ID NO: 319472 - RNA, 19 nt, Homo sapiens
ccacugacaugacuuucca

SEQ ID NO: 319473 - RNA, 19 nt, Homo sapiens
uuacaggacucaacauacu

SEQ ID NO: 319474 - RNA, 19 nt, Homo sapiens
cuaggcggcuaugguauaa

SEQ ID NO: 319475 - RNA, 19 nt, Homo sapiens
caaaucaacaacaaccuau

SEQ ID NO: 319476 - RNA, 19 nt, Homo sapiens
uagccaauauugugccuau

SEQ ID NO: 319477 - RNA, 19 nt, Homo sapiens
gaccuaaaaucgcucauug

SEQ ID NO: 319478 - RNA, 19 nt, Homo sapiens
ccacuuaugacucccuaaa

SEQ ID NO: 319479 - RNA, 19 nt, Homo sapiens
gagccaauaacuuaauaug

SEQ ID NO: 319480 - RNA, 19 nt, Homo sapiens
ucacuaaacauucuacuac

SEQ ID NO: 319481 - RNA, 19 nt, Homo sapiens
cuaccucucuauacuaauc

SEQ ID NO: 319482 - RNA, 19 nt, Homo sapiens
ggcaagccaacgccacuua

SEQ ID NO: 319483 - RNA, 19 nt, Homo sapiens
acacauauggccuagacua

SEQ ID NO: 319484 - RNA, 19 nt, Homo sapiens
cgucccaacaauuauauua

SEQ ID NO: 319485 - RNA, 19 nt, Homo sapiens
cuacguacauaaccuaaac

SEQ ID NO: 319486 - RNA, 19 nt, Homo sapiens
ugacuagcuuacacaauag

SEQ ID NO: 319487 - RNA, 19 nt, Homo sapiens
cugagccaauaacuuaaua

SEQ ID NO: 319488 - RNA, 19 nt, Homo sapiens
uauugugccuauugccaua

SEQ ID NO: 319489 - RNA, 19 nt, Homo sapiens
aauaucacucuccuacuua

SEQ ID NO: 319490 - RNA, 19 nt, Homo sapiens
gaacucucugugcuaguaa

SEQ ID NO: 319491 - RNA, 19 nt, Homo sapiens
uaaccuaaaccuacuccaa

SEQ ID NO: 319492 - RNA, 19 nt, Homo sapiens
ccuagaaggaauaauacua

SEQ ID NO: 319493 - RNA, 19 nt, Homo sapiens
uuacuauucugccuagcaa

SEQ ID NO: 319494 - RNA, 19 nt, Homo sapiens
guaguaacagccauucuca

SEQ ID NO: 319495 - RNA, 19 nt, Homo sapiens
uuacggacuccacuuauga

SEQ ID NO: 319496 - RNA, 19 nt, Homo sapiens
aaaccuacuccaaugcuaa

SEQ ID NO: 319497 - RNA, 19 nt, Homo sapiens
gcucauugcauacucuuca

SEQ ID NO: 319498 - RNA, 19 nt, Homo sapiens
cccaagaacuaucaaacuc

SEQ ID NO: 319499 - RNA, 19 nt, Homo sapiens
aaacucuacucccacuaau

SEQ ID NO: 319500 - RNA, 19 nt, Homo sapiens
auaauacgccucacacuca

SEQ ID NO: 319501 - RNA, 19 nt, Homo sapiens
gcaagccaacgccacuuau

SEQ ID NO: 319502 - RNA, 19 nt, Homo sapiens
caacaacaaccuauuuagc

SEQ ID NO: 319503 - RNA, 19 nt, Homo sapiens
ccucuuagccaauauugug

SEQ ID NO: 319504 - RNA, 19 nt, Homo sapiens
gcaucauaauccucucuca

SEQ ID NO: 319505 - RNA, 19 nt, Homo sapiens
uaauaugacuagcuuacac

SEQ ID NO: 319506 - RNA, 19 nt, Homo sapiens
cuaaacauucuacuacuca

SEQ ID NO: 319507 - RNA, 19 nt, Homo sapiens
acccuaggcucacuaaaca

SEQ ID NO: 319508 - RNA, 19 nt, Homo sapiens
ccaucucacuucuaggaau

SEQ ID NO: 319509 - RNA, 19 nt, Homo sapiens
acucacagucgcaucauaa

SEQ ID NO: 319510 - RNA, 19 nt, Homo sapiens
caaacuccugagccaauaa

SEQ ID NO: 319511 - RNA, 19 nt, Homo sapiens
ccuacaaaucuccuuaauu

SEQ ID NO: 319512 - RNA, 19 nt, Homo sapiens
aaucgucccaacaauuaua

SEQ ID NO: 319513 - RNA, 19 nt, Homo sapiens
caacauaaaacccucauuc

SEQ ID NO: 319514 - RNA, 19 nt, Homo sapiens
cauauggccuagacuacgu

SEQ ID NO: 319515 - RNA, 19 nt, Homo sapiens
gaggcauaauuauaacaag

SEQ ID NO: 319516 - RNA, 19 nt, Homo sapiens
ccuaggcucacuaaacauu

SEQ ID NO: 319517 - RNA, 19 nt, Homo sapiens
acuaaucucccuacaaauc

SEQ ID NO: 319518 - RNA, 19 nt, Homo sapiens
caucauaauccucucucaa

SEQ ID NO: 319519 - RNA, 19 nt, Homo sapiens
ccuauucuacacccuagua

SEQ ID NO: 319520 - RNA, 19 nt, Homo sapiens
auacuagcauuuaccaucu

SEQ ID NO: 319521 - RNA, 19 nt, Homo sapiens
cuuacauccucauuacuau

SEQ ID NO: 319522 - RNA, 19 nt, Homo sapiens
ucucacugcccaagaacua

SEQ ID NO: 319523 - RNA, 19 nt, Homo sapiens
uaacauucacagccacaga

SEQ ID NO: 319524 - RNA, 19 nt, Homo sapiens
cucuaccucucuauacuaa

SEQ ID NO: 319525 - RNA, 19 nt, Homo sapiens
augccuagaaggaauaaua

SEQ ID NO: 319526 - RNA, 19 nt, Homo sapiens
cucaaggacuucaaacucu

SEQ ID NO: 319527 - RNA, 19 nt, Homo sapiens
uaauacgccucacacucau

SEQ ID NO: 319528 - RNA, 19 nt, Homo sapiens
cccuaaagcccaugucgaa

SEQ ID NO: 319529 - RNA, 19 nt, Homo sapiens
agccacagaacuaaucaua

SEQ ID NO: 319530 - RNA, 19 nt, Homo sapiens
gcagucauucucauaaucg

SEQ ID NO: 319531 - RNA, 19 nt, Homo sapiens
caacacccuaggcucacua

SEQ ID NO: 319532 - RNA, 19 nt, Homo sapiens
auucacagccacagaacua

SEQ ID NO: 319533 - RNA, 19 nt, Homo sapiens
ucaacaacaaccuauuuag

SEQ ID NO: 319534 - RNA, 19 nt, Homo sapiens
acuaaucgucccaacaauu

SEQ ID NO: 319535 - RNA, 19 nt, Homo sapiens
ucacccaccacauuaacaa

SEQ ID NO: 319536 - RNA, 19 nt, Homo sapiens
agacuacguacauaaccua

SEQ ID NO: 319537 - RNA, 19 nt, Homo sapiens
cacucacagucgcaucaua

SEQ ID NO: 319538 - RNA, 19 nt, Homo sapiens
gcacauacuuccuauucua

SEQ ID NO: 319539 - RNA, 19 nt, Homo sapiens
ccacagaacuaaucauauu

SEQ ID NO: 319540 - RNA, 19 nt, Homo sapiens
cauuauagcuacucucaua

SEQ ID NO: 319541 - RNA, 19 nt, Homo sapiens
uaaaaucgcucauugcaua

SEQ ID NO: 319542 - RNA, 19 nt, Homo sapiens
auacuaaucucccuacaaa

SEQ ID NO: 319543 - RNA, 19 nt, Homo sapiens
caacacccacucccucuua

SEQ ID NO: 319544 - RNA, 19 nt, Homo sapiens
aaauaucacucuccuacuu

SEQ ID NO: 319545 - RNA, 19 nt, Homo sapiens
augacuagcuuacacaaua

SEQ ID NO: 319546 - RNA, 19 nt, Homo sapiens
caucucacuucuaggaaua

SEQ ID NO: 319547 - RNA, 19 nt, Homo sapiens
ccucauauccucccuacua

SEQ ID NO: 319548 - RNA, 19 nt, Homo sapiens
gccaauaacuuaauaugac

SEQ ID NO: 319549 - RNA, 19 nt, Homo sapiens
gaacgcaggcacauacuuc

SEQ ID NO: 319550 - RNA, 19 nt, Homo sapiens
ucacucacccaccacauua

SEQ ID NO: 319551 - RNA, 19 nt, Homo sapiens
aaacuaggcggcuauggua

SEQ ID NO: 319552 - RNA, 19 nt, Homo sapiens
caacacauauggccuagac

SEQ ID NO: 319553 - RNA, 19 nt, Homo sapiens
uauacucccucuacauauu

SEQ ID NO: 319554 - RNA, 19 nt, Homo sapiens
ucaaggacuucaaacucua

SEQ ID NO: 319555 - RNA, 19 nt, Homo sapiens
cgacaucauuaccggguuu

SEQ ID NO: 319556 - RNA, 19 nt, Homo sapiens
caaacucuacucccacuaa

SEQ ID NO: 319557 - RNA, 19 nt, Homo sapiens
ucaaacuccugagccaaua

SEQ ID NO: 319558 - RNA, 19 nt, Homo sapiens
aggcggcuaugguauaaua

SEQ ID NO: 319559 - RNA, 19 nt, Homo sapiens
aaacuaaucgucccaacaa

SEQ ID NO: 319560 - RNA, 19 nt, Homo sapiens
ccaccacauuaacaacaua

SEQ ID NO: 319561 - RNA, 19 nt, Homo sapiens
ccuauacucccucuacaua

SEQ ID NO: 319562 - RNA, 19 nt, Homo sapiens
agaacucucugugcuagua

SEQ ID NO: 319563 - RNA, 19 nt, Homo sapiens
gcaggcacauacuuccuau

SEQ ID NO: 319564 - RNA, 19 nt, Homo sapiens
gcauuuaccaucucacuuc

SEQ ID NO: 319565 - RNA, 19 nt, Homo sapiens
gcgcagucauucucauaau

SEQ ID NO: 319566 - RNA, 19 nt, Homo sapiens
ggccuagacuacguacaua

SEQ ID NO: 319567 - RNA, 19 nt, Homo sapiens
uaacagccauucucaucca

SEQ ID NO: 319568 - RNA, 19 nt, Homo sapiens
uaaaccuacuccaaugcua

SEQ ID NO: 319569 - RNA, 19 nt, Homo sapiens
cuacauauuuaccacaaca

SEQ ID NO: 319570 - RNA, 19 nt, Homo sapiens
cuccugagccaauaacuua

SEQ ID NO: 319571 - RNA, 19 nt, Homo sapiens
ccaaaucaacaacaaccua

SEQ ID NO: 319572 - RNA, 19 nt, Homo sapiens
ccacugacaugacuuucca

SEQ ID NO: 319573 - RNA, 19 nt, Homo sapiens
uuacaggacucaacauacu

SEQ ID NO: 319574 - RNA, 19 nt, Homo sapiens
cuaggcggcuaugguauaa

SEQ ID NO: 319575 - RNA, 19 nt, Homo sapiens
caaaucaacaacaaccuau

SEQ ID NO: 319576 - RNA, 19 nt, Homo sapiens
uagccaauauugugccuau

SEQ ID NO: 319577 - RNA, 19 nt, Homo sapiens
gaccuaaaaucgcucauug

SEQ ID NO: 319578 - RNA, 19 nt, Homo sapiens
ccacuuaugacucccuaaa

SEQ ID NO: 319579 - RNA, 19 nt, Homo sapiens
gagccaauaacuuaauaug

SEQ ID NO: 319580 - RNA, 19 nt, Homo sapiens
ucacuaaacauucuacuac

SEQ ID NO: 319581 - RNA, 19 nt, Homo sapiens
cuaccucucuauacuaauc

SEQ ID NO: 319582 - RNA, 19 nt, Homo sapiens
ggcaagccaacgccacuua

SEQ ID NO: 319583 - RNA, 19 nt, Homo sapiens
acacauauggccuagacua

SEQ ID NO: 319584 - RNA, 19 nt, Homo sapiens
cgucccaacaauuauauua

SEQ ID NO: 319585 - RNA, 19 nt, Homo sapiens
cuacguacauaaccuaaac

SEQ ID NO: 319586 - RNA, 19 nt, Homo sapiens
ugacuagcuuacacaauag

SEQ ID NO: 319587 - RNA, 19 nt, Homo sapiens
cugagccaauaacuuaaua

SEQ ID NO: 319588 - RNA, 19 nt, Homo sapiens
uauugugccuauugccaua

SEQ ID NO: 319589 - RNA, 19 nt, Homo sapiens
aauaucacucuccuacuua

SEQ ID NO: 319590 - RNA, 19 nt, Homo sapiens
gaacucucugugcuaguaa

SEQ ID NO: 319591 - RNA, 19 nt, Homo sapiens
uaaccuaaaccuacuccaa

SEQ ID NO: 319592 - RNA, 19 nt, Homo sapiens
ccuagaaggaauaauacua

SEQ ID NO: 319593 - RNA, 19 nt, Homo sapiens
uuacuauucugccuagcaa

SEQ ID NO: 319594 - RNA, 19 nt, Homo sapiens
guaguaacagccauucuca

SEQ ID NO: 319595 - RNA, 19 nt, Homo sapiens
uuacggacuccacuuauga

SEQ ID NO: 319596 - RNA, 19 nt, Homo sapiens
aaaccuacuccaaugcuaa

SEQ ID NO: 319597 - RNA, 19 nt, Homo sapiens
gcucauugcauacucuuca

SEQ ID NO: 319598 - RNA, 19 nt, Homo sapiens
cccaagaacuaucaaacuc

SEQ ID NO: 319599 - RNA, 19 nt, Homo sapiens
aaacucuacucccacuaau

SEQ ID NO: 319600 - RNA, 19 nt, Homo sapiens
auaauacgccucacacuca

SEQ ID NO: 319601 - RNA, 19 nt, Homo sapiens
gcaagccaacgccacuuau

SEQ ID NO: 319602 - RNA, 19 nt, Homo sapiens
caacaacaaccuauuuagc

SEQ ID NO: 319603 - RNA, 19 nt, Homo sapiens
ccucuuagccaauauugug

SEQ ID NO: 319604 - RNA, 19 nt, Homo sapiens
gcaucauaauccucucuca

SEQ ID NO: 319605 - RNA, 19 nt, Homo sapiens
uaauaugacuagcuuacac

SEQ ID NO: 319606 - RNA, 19 nt, Homo sapiens
cuaaacauucuacuacuca

SEQ ID NO: 319607 - RNA, 19 nt, Homo sapiens
acccuaggcucacuaaaca

SEQ ID NO: 319608 - RNA, 19 nt, Homo sapiens
ccaucucacuucuaggaau

SEQ ID NO: 319609 - RNA, 19 nt, Homo sapiens
acucacagucgcaucauaa

SEQ ID NO: 319610 - RNA, 19 nt, Homo sapiens
caaacuccugagccaauaa

SEQ ID NO: 319611 - RNA, 19 nt, Homo sapiens
ccuacaaaucuccuuaauu

SEQ ID NO: 319612 - RNA, 19 nt, Homo sapiens
aaucgucccaacaauuaua

SEQ ID NO: 319613 - RNA, 19 nt, Homo sapiens
caacauaaaacccucauuc

SEQ ID NO: 319614 - RNA, 19 nt, Homo sapiens
cauauggccuagacuacgu

SEQ ID NO: 319615 - RNA, 19 nt, Homo sapiens
gaggcauaauuauaacaag

SEQ ID NO: 319616 - RNA, 19 nt, Homo sapiens
ccuaggcucacuaaacauu

SEQ ID NO: 319617 - RNA, 19 nt, Homo sapiens
acuaaucucccuacaaauc

SEQ ID NO: 319618 - RNA, 19 nt, Homo sapiens
caucauaauccucucucaa

SEQ ID NO: 319619 - RNA, 19 nt, Homo sapiens
ccuauucuacacccuagua

SEQ ID NO: 319620 - RNA, 19 nt, Homo sapiens
auacuagcauuuaccaucu

SEQ ID NO: 319621 - RNA, 19 nt, Homo sapiens
cuuacauccucauuacuau

SEQ ID NO: 319622 - RNA, 19 nt, Homo sapiens
ucucacugcccaagaacua

SEQ ID NO: 319623 - RNA, 19 nt, Homo sapiens
uaacauucacagccacaga

SEQ ID NO: 319624 - RNA, 19 nt, Homo sapiens
cucuaccucucuauacuaa

SEQ ID NO: 319625 - RNA, 19 nt, Homo sapiens
augccuagaaggaauaaua

SEQ ID NO: 319626 - RNA, 19 nt, Homo sapiens
cucaaggacuucaaacucu

SEQ ID NO: 319627 - RNA, 19 nt, Homo sapiens
uaauacgccucacacucau

SEQ ID NO: 319628 - RNA, 19 nt, Homo sapiens
cccuaaagcccaugucgaa

SEQ ID NO: 319629 - RNA, 19 nt, Homo sapiens
agccacagaacuaaucaua

SEQ ID NO: 319630 - RNA, 19 nt, Homo sapiens
gcagucauucucauaaucg

SEQ ID NO: 319631 - RNA, 19 nt, Homo sapiens
caacacccuaggcucacua

SEQ ID NO: 319632 - RNA, 19 nt, Homo sapiens
auucacagccacagaacua

SEQ ID NO: 319633 - RNA, 19 nt, Homo sapiens
ucaacaacaaccuauuuag

SEQ ID NO: 319634 - RNA, 19 nt, Homo sapiens
acuaaucgucccaacaauu

SEQ ID NO: 319635 - RNA, 19 nt, Homo sapiens
ucacccaccacauuaacaa

SEQ ID NO: 319636 - RNA, 19 nt, Homo sapiens
agacuacguacauaaccua

SEQ ID NO: 319637 - RNA, 19 nt, Homo sapiens
cacucacagucgcaucaua

SEQ ID NO: 319638 - RNA, 19 nt, Homo sapiens
gaccuaaccugacuagaaa

SEQ ID NO: 319639 - RNA, 19 nt, Homo sapiens
gcaaacauaucauacacaa

SEQ ID NO: 319640 - RNA, 19 nt, Homo sapiens
caacaaauagcccuucuaa

SEQ ID NO: 319641 - RNA, 19 nt, Homo sapiens
caggauuucucauuacuaa

SEQ ID NO: 319642 - RNA, 19 nt, Homo sapiens
caucgaaaccgcaaacaua

SEQ ID NO: 319643 - RNA, 19 nt, Homo sapiens
ccacuaauccaaacucuaa

SEQ ID NO: 319644 - RNA, 19 nt, Homo sapiens
gcauccaccuuuauuauca

SEQ ID NO: 319645 - RNA, 19 nt, Homo sapiens
cuucaaagccauacuauuu

SEQ ID NO: 319646 - RNA, 19 nt, Homo sapiens
aggcaaaucagcccaauua

SEQ ID NO: 319647 - RNA, 19 nt, Homo sapiens
gccuauagcacucgaauaa

SEQ ID NO: 319648 - RNA, 19 nt, Homo sapiens
caaaucagcccaauuaggu

SEQ ID NO: 319649 - RNA, 19 nt, Homo sapiens
ugagagggcguaggaauua

SEQ ID NO: 319650 - RNA, 19 nt, Homo sapiens
aauccaaacucuaacacua

SEQ ID NO: 319651 - RNA, 19 nt, Homo sapiens
acaaauagcccuucuaaac

SEQ ID NO: 319652 - RNA, 19 nt, Homo sapiens
caacacagcagccauucaa

SEQ ID NO: 319653 - RNA, 19 nt, Homo sapiens
cuagacuacuucuccauaa

SEQ ID NO: 319654 - RNA, 19 nt, Homo sapiens
uaacagcccuagaccucaa

SEQ ID NO: 319655 - RNA, 19 nt, Homo sapiens
aaacucagacccaaacauu

SEQ ID NO: 319656 - RNA, 19 nt, Homo sapiens
uccacaaccuuaacaauga

SEQ ID NO: 319657 - RNA, 19 nt, Homo sapiens
gaaaauagcccacuaaucc

SEQ ID NO: 319658 - RNA, 19 nt, Homo sapiens
ccacaaccuuaacaaugaa

SEQ ID NO: 319659 - RNA, 19 nt, Homo sapiens
ccuguagcauuguucguua

SEQ ID NO: 319660 - RNA, 19 nt, Homo sapiens
ucccuaagcuucaaacuag

SEQ ID NO: 319661 - RNA, 19 nt, Homo sapiens
caacccagcucucccuaag

SEQ ID NO: 319662 - RNA, 19 nt, Homo sapiens
cuacuccacucaagcacua

SEQ ID NO: 319663 - RNA, 19 nt, Homo sapiens
caaccucccucaccauugg

SEQ ID NO: 319664 - RNA, 19 nt, Homo sapiens
gacuacuucuccauaauau

SEQ ID NO: 319665 - RNA, 19 nt, Homo sapiens
caacauacucggauucuac

SEQ ID NO: 319666 - RNA, 19 nt, Homo sapiens
gccugagcccuaucuauua

SEQ ID NO: 319667 - RNA, 19 nt, Homo sapiens
aaccauaccucucacuuca

SEQ ID NO: 319668 - RNA, 19 nt, Homo sapiens
agacuacuucuccauaaua

SEQ ID NO: 319669 - RNA, 19 nt, Homo sapiens
aaacuuuacuuccucucuu

SEQ ID NO: 319670 - RNA, 19 nt, Homo sapiens
agaccuaaccugacuagaa

SEQ ID NO: 319671 - RNA, 19 nt, Homo sapiens
cgaaaccgcaaacauauca

SEQ ID NO: 319672 - RNA, 19 nt, Homo sapiens
ccaaagaccacaucaucga

SEQ ID NO: 319673 - RNA, 19 nt, Homo sapiens
cagcagccauucaagcaau

SEQ ID NO: 319674 - RNA, 19 nt, Homo sapiens
acucagacccaaacauuaa

SEQ ID NO: 319675 - RNA, 19 nt, Homo sapiens
ggauuucucauuacuaaca

SEQ ID NO: 319676 - RNA, 19 nt, Homo sapiens
gcaaaucagcccaauuagg

SEQ ID NO: 319677 - RNA, 19 nt, Homo sapiens
auucaucccuguagcauug

SEQ ID NO: 319678 - RNA, 19 nt, Homo sapiens
cauccuaacccuacuccua

SEQ ID NO: 319679 - RNA, 19 nt, Homo sapiens
cucaagcacuauaguugua

SEQ ID NO: 319680 - RNA, 19 nt, Homo sapiens
cauccucgccuuagcauga

SEQ ID NO: 319681 - RNA, 19 nt, Homo sapiens
acccaaacauuaaucaguu

SEQ ID NO: 319682 - RNA, 19 nt, Homo sapiens
cuacuucuccauaauauuc

SEQ ID NO: 319683 - RNA, 19 nt, Homo sapiens
uagcauuguucguuacaug

SEQ ID NO: 319684 - RNA, 19 nt, Homo sapiens
gcuucaaacuagacuacuu

SEQ ID NO: 319685 - RNA, 19 nt, Homo sapiens
caaauagcccuucuaaacg

SEQ ID NO: 319686 - RNA, 19 nt, Homo sapiens
gcaggauuucucauuacua

SEQ ID NO: 319687 - RNA, 19 nt, Homo sapiens
aaaccgcaaacauaucaua

SEQ ID NO: 319688 - RNA, 19 nt, Homo sapiens
caaagaccacaucaucgaa

SEQ ID NO: 319689 - RNA, 19 nt, Homo sapiens
aacccugacuucccuaauu

SEQ ID NO: 319690 - RNA, 19 nt, Homo sapiens
gagagggcguaggaauuau

SEQ ID NO: 319691 - RNA, 19 nt, Homo sapiens
caaccuauuccaacuguuc

SEQ ID NO: 319692 - RNA, 19 nt, Homo sapiens
cauaauauucaucccugua

SEQ ID NO: 319693 - RNA, 19 nt, Homo sapiens
gugccuagaccaagaaguu

SEQ ID NO: 319694 - RNA, 19 nt, Homo sapiens
uaucuaggccuucuuacga

SEQ ID NO: 319695 - RNA, 19 nt, Homo sapiens
ccaacauacucggauucua

SEQ ID NO: 319696 - RNA, 19 nt, Homo sapiens
aauaggaggacuacucaaa

SEQ ID NO: 319697 - RNA, 19 nt, Homo sapiens
caugagacccacaacaaau

SEQ ID NO: 319698 - RNA, 19 nt, Homo sapiens
caaccaaccacaccuagca

SEQ ID NO: 319699 - RNA, 19 nt, Homo sapiens
ccacucaagcacuauaguu

SEQ ID NO: 319700 - RNA, 19 nt, Homo sapiens
gcaggcaaaucagcccaau

SEQ ID NO: 319701 - RNA, 19 nt, Homo sapiens
cgccugagcccuaucuauu

SEQ ID NO: 319702 - RNA, 19 nt, Homo sapiens
gaccaagaaguuauuaucu

SEQ ID NO: 319703 - RNA, 19 nt, Homo sapiens
ggaagccuauucgcaggau

SEQ ID NO: 319704 - RNA, 19 nt, Homo sapiens
uagacuacuucuccauaau

SEQ ID NO: 319705 - RNA, 19 nt, Homo sapiens
ucaugugccuagaccaaga

SEQ ID NO: 319706 - RNA, 19 nt, Homo sapiens
ccuuaacaaugaacaagau

SEQ ID NO: 319707 - RNA, 19 nt, Homo sapiens
ucaugagacccacaacaaa

SEQ ID NO: 319708 - RNA, 19 nt, Homo sapiens
ccgagcagaugccaacaca

SEQ ID NO: 319709 - RNA, 19 nt, Homo sapiens
cuaacaaccuauuccaacu

SEQ ID NO: 319710 - RNA, 19 nt, Homo sapiens
acaaacgccugagcccuau

SEQ ID NO: 319711 - RNA, 19 nt, Homo sapiens
uagcauuccugcacaucug

SEQ ID NO: 319712 - RNA, 19 nt, Homo sapiens
gauuuauccuacacuccaa

SEQ ID NO: 319713 - RNA, 19 nt, Homo sapiens
uagcaugauuuauccuaca

SEQ ID NO: 319714 - RNA, 19 nt, Homo sapiens
cuuccucucuuucuucuuc

SEQ ID NO: 319715 - RNA, 19 nt, Homo sapiens
uucgcaggauuucucauua

SEQ ID NO: 319716 - RNA, 19 nt, Homo sapiens
aaagaccacaucaucgaaa

SEQ ID NO: 319717 - RNA, 19 nt, Homo sapiens
gcagaaaauagcccacuaa

SEQ ID NO: 319718 - RNA, 19 nt, Homo sapiens
gaagccuauucgcaggauu

SEQ ID NO: 319719 - RNA, 19 nt, Homo sapiens
ccauaccucucacuucaac

SEQ ID NO: 319720 - RNA, 19 nt, Homo sapiens
caucaaccaaccacaccua

SEQ ID NO: 319721 - RNA, 19 nt, Homo sapiens
caacucaugagacccacaa

SEQ ID NO: 319722 - RNA, 19 nt, Homo sapiens
gacccaaacauuaaucagu

SEQ ID NO: 319723 - RNA, 19 nt, Homo sapiens
uccaaacucuaacacuaug

SEQ ID NO: 319724 - RNA, 19 nt, Homo sapiens
gcugagagggcguaggaau

SEQ ID NO: 319725 - RNA, 19 nt, Homo sapiens
ccacccucguuaacccuaa

SEQ ID NO: 319726 - RNA, 19 nt, Homo sapiens
aacuuuacuuccucucuuu

SEQ ID NO: 319727 - RNA, 19 nt, Homo sapiens
ucgcauccaccuuuauuau

SEQ ID NO: 319728 - RNA, 19 nt, Homo sapiens
ccugagcccuaucuauuac

SEQ ID NO: 319729 - RNA, 19 nt, Homo sapiens
gagggcguaggaauuauau

SEQ ID NO: 319730 - RNA, 19 nt, Homo sapiens
caauauucaugugccuaga

SEQ ID NO: 319731 - RNA, 19 nt, Homo sapiens
ccaccuuuauuaucagucu

SEQ ID NO: 319732 - RNA, 19 nt, Homo sapiens
uacccacgccuucuucaaa

SEQ ID NO: 319733 - RNA, 19 nt, Homo sapiens
uucaagcaauccuauacaa

SEQ ID NO: 319734 - RNA, 19 nt, Homo sapiens
uaacaaccuauuccaacug

SEQ ID NO: 319735 - RNA, 19 nt, Homo sapiens
cauugucgcauccaccuuu

SEQ ID NO: 319736 - RNA, 19 nt, Homo sapiens
augagacccacaacaaaua

SEQ ID NO: 319737 - RNA, 19 nt, Homo sapiens
agagggcguaggaauuaua

SEQ ID NO: 319738 - RNA, 19 nt, Homo sapiens
guaggaagcugaauaauuu

SEQ ID NO: 319739 - RNA, 19 nt, Homo sapiens
cuacagcgauggcuauuga

SEQ ID NO: 319740 - RNA, 19 nt, Homo sapiens
ggucggguguguuauuauu

SEQ ID NO: 319741 - RNA, 19 nt, Homo sapiens
gaguguggguuuaguaaug

SEQ ID NO: 319742 - RNA, 19 nt, Homo sapiens
ucuaagccuucuccuauuu

SEQ ID NO: 319743 - RNA, 19 nt, Homo sapiens
gagguuauauggguuuaau

SEQ ID NO: 319744 - RNA, 19 nt, Homo sapiens
gaaugaugguugucuuugg

SEQ ID NO: 319745 - RNA, 19 nt, Homo sapiens
cgauggcuauugaggagua

SEQ ID NO: 319746 - RNA, 19 nt, Homo sapiens
guggucggguguguuauua

SEQ ID NO: 319747 - RNA, 19 nt, Homo sapiens
gguguggucggguguguua

SEQ ID NO: 319748 - RNA, 19 nt, Homo sapiens
uuaugggcguugauuagua

SEQ ID NO: 319749 - RNA, 19 nt, Homo sapiens
uguaggaagcugaauaauu

SEQ ID NO: 319750 - RNA, 19 nt, Homo sapiens
ggaaugaugguugucuuug

SEQ ID NO: 319751 - RNA, 19 nt, Homo sapiens
gggaaugaugguugucuuu

SEQ ID NO: 319752 - RNA, 19 nt, Homo sapiens
gauuaugggcguugauuag

SEQ ID NO: 319753 - RNA, 19 nt, Homo sapiens
gauguaugcuuuguuucug

SEQ ID NO: 319754 - RNA, 19 nt, Homo sapiens
uaagccuucuccuauuuau

SEQ ID NO: 319755 - RNA, 19 nt, Homo sapiens
gguuauauggguuuaauag

SEQ ID NO: 319756 - RNA, 19 nt, Homo sapiens
cuucuaagccuucuccuau

SEQ ID NO: 319757 - RNA, 19 nt, Homo sapiens
gggagguuauauggguuua

SEQ ID NO: 319758 - RNA, 19 nt, Homo sapiens
ugaugguugucuuuggaua

SEQ ID NO: 319759 - RNA, 19 nt, Homo sapiens
gguguguuauuauucugaa

SEQ ID NO: 319760 - RNA, 19 nt, Homo sapiens
cuaagccuucuccuauuua

SEQ ID NO: 319761 - RNA, 19 nt, Homo sapiens
guuacugguugaacauugu

SEQ ID NO: 319762 - RNA, 19 nt, Homo sapiens
gggcguugauuaguaguag

SEQ ID NO: 319763 - RNA, 19 nt, Homo sapiens
aaugaugguugucuuugga

SEQ ID NO: 319764 - RNA, 19 nt, Homo sapiens
uaugggcguugauuaguag

SEQ ID NO: 319765 - RNA, 19 nt, Homo sapiens
ugauuaugggcguugauua

SEQ ID NO: 319766 - RNA, 19 nt, Homo sapiens
gaugguugucuuuggauau

SEQ ID NO: 319767 - RNA, 19 nt, Homo sapiens
ggguggugguugugguaaa

SEQ ID NO: 319768 - RNA, 19 nt, Homo sapiens
ucuguugaguguggguuua

SEQ ID NO: 319769 - RNA, 19 nt, Homo sapiens
ggagaggggucaggguuga

SEQ ID NO: 319770 - RNA, 19 nt, Homo sapiens
gauuggugcugugggugaa

SEQ ID NO: 319771 - RNA, 19 nt, Homo sapiens
augguugucuuuggauaua

SEQ ID NO: 319772 - RNA, 19 nt, Homo sapiens
uaguguaggaagcugaaua

SEQ ID NO: 319773 - RNA, 19 nt, Homo sapiens
aguguaggaagcugaauaa

SEQ ID NO: 319774 - RNA, 19 nt, Homo sapiens
uguaugcuuuguuucuguu

SEQ ID NO: 319775 - RNA, 19 nt, Homo sapiens
ugcugugggugaaagagua

SEQ ID NO: 319776 - RNA, 19 nt, Homo sapiens
guugaguguggguuuagua

SEQ ID NO: 319777 - RNA, 19 nt, Homo sapiens
ggugguugugguaaacuuu

SEQ ID NO: 319778 - RNA, 19 nt, Homo sapiens
cauuguuuguugguguaua

SEQ ID NO: 319779 - RNA, 19 nt, Homo sapiens
guaguuacugguugaacau

SEQ ID NO: 319780 - RNA, 19 nt, Homo sapiens
gcguugauuaguaguaguu

SEQ ID NO: 319781 - RNA, 19 nt, Homo sapiens
guaugauuaugggcguuga

SEQ ID NO: 319782 - RNA, 19 nt, Homo sapiens
ggucagggguugaggucuu

SEQ ID NO: 319783 - RNA, 19 nt, Homo sapiens
gaacaucaguuucugugaa

SEQ ID NO: 319784 - RNA, 19 nt, Homo sapiens
gaaacuacguggagaagau

SEQ ID NO: 319785 - RNA, 19 nt, Homo sapiens
gaaccagugugucaucauu

SEQ ID NO: 319786 - RNA, 19 nt, Homo sapiens
ccaaauuccugcagaggua

SEQ ID NO: 319787 - RNA, 19 nt, Homo sapiens
gcaaaucuuuaucgaacuu

SEQ ID NO: 319788 - RNA, 19 nt, Homo sapiens
gaacaugcuuaucgacugu

SEQ ID NO: 319789 - RNA, 19 nt, Homo sapiens
gcaccaaggucuuugucaa

SEQ ID NO: 319790 - RNA, 19 nt, Homo sapiens
ccaaugagagccucguuua

SEQ ID NO: 319791 - RNA, 19 nt, Homo sapiens
gcuccaagaucaagaaaca

SEQ ID NO: 319792 - RNA, 19 nt, Homo sapiens
gcaucaacuucgucaauga

SEQ ID NO: 319793 - RNA, 19 nt, Homo sapiens
ugacaccggacuacuauua

SEQ ID NO: 319794 - RNA, 19 nt, Homo sapiens
acaacaaggucgucuguga

SEQ ID NO: 319795 - RNA, 19 nt, Homo sapiens
ggacuccaauccaguacuu

SEQ ID NO: 319796 - RNA, 19 nt, Homo sapiens
gaagcuggauggagacaag

SEQ ID NO: 319797 - RNA, 19 nt, Homo sapiens
ucaagcagaugcccuacuu

SEQ ID NO: 319798 - RNA, 19 nt, Homo sapiens
gcucugugcucaucucugu

SEQ ID NO: 319799 - RNA, 19 nt, Homo sapiens
ucggugugcuggacauuua

SEQ ID NO: 319800 - RNA, 19 nt, Homo sapiens
ggcaagaucuccaacuucu

SEQ ID NO: 319801 - RNA, 19 nt, Homo sapiens
gcaaguacuuugagaucca

SEQ ID NO: 319802 - RNA, 19 nt, Homo sapiens
ccaggugugugaagucuug

SEQ ID NO: 319803 - RNA, 19 nt, Homo sapiens
ugaacgaggucauugagau

SEQ ID NO: 319804 - RNA, 19 nt, Homo sapiens
gaagcugcagcaaaucuuu

SEQ ID NO: 319805 - RNA, 19 nt, Homo sapiens
ugucaucacuaaggcaaua

SEQ ID NO: 319806 - RNA, 19 nt, Homo sapiens
caacaauuccagccgcuuu

SEQ ID NO: 319807 - RNA, 19 nt, Homo sapiens
gaagguccagcacgucaaa

SEQ ID NO: 319808 - RNA, 19 nt, Homo sapiens
gggauacugccuucucuuu

SEQ ID NO: 319809 - RNA, 19 nt, Homo sapiens
gaagaagggaccugagaag

SEQ ID NO: 319810 - RNA, 19 nt, Homo sapiens
ggaggaguaugugcaggaa

SEQ ID NO: 319811 - RNA, 19 nt, Homo sapiens
ccucagagcacaacacaga

SEQ ID NO: 319812 - RNA, 19 nt, Homo sapiens
ccaacugccaugugauuaa

SEQ ID NO: 319813 - RNA, 19 nt, Homo sapiens
ccaacauccugcugaacaa

SEQ ID NO: 319814 - RNA, 19 nt, Homo sapiens
gcuucgagaucuuccagaa

SEQ ID NO: 319815 - RNA, 19 nt, Homo sapiens
caaccgugcuaugcagaaa

SEQ ID NO: 319816 - RNA, 19 nt, Homo sapiens
gaaccugggccucaugaca

SEQ ID NO: 319817 - RNA, 19 nt, Homo sapiens
gaguggagcugggaagaca

SEQ ID NO: 319818 - RNA, 19 nt, Homo sapiens
gcagcgaguccaucaaugu

SEQ ID NO: 319819 - RNA, 19 nt, Homo sapiens
gagaaccagugugucauca

SEQ ID NO: 319820 - RNA, 19 nt, Homo sapiens
gauacugccuucucuuucg

SEQ ID NO: 319821 - RNA, 19 nt, Homo sapiens
gaacgaggucauugagauc

SEQ ID NO: 319822 - RNA, 19 nt, Homo sapiens
augagaagcugcagcaaau

SEQ ID NO: 319823 - RNA, 19 nt, Homo sapiens
ggacgacagaagcgacuuu

SEQ ID NO: 319824 - RNA, 19 nt, Homo sapiens
gaacuuccacaucuacuac

SEQ ID NO: 319825 - RNA, 19 nt, Homo sapiens
uaacaagcgugacuuugcu

SEQ ID NO: 319826 - RNA, 19 nt, Homo sapiens
cagcgacacacuacaguuu

SEQ ID NO: 319827 - RNA, 19 nt, Homo sapiens
ccaaguguguguaugugau

SEQ ID NO: 319828 - RNA, 19 nt, Homo sapiens
caacaacaaggucgucugu

SEQ ID NO: 319829 - RNA, 19 nt, Homo sapiens
gcagcaaaucuuuaucgaa

SEQ ID NO: 319830 - RNA, 19 nt, Homo sapiens
ccucccaacugccauguga

SEQ ID NO: 319831 - RNA, 19 nt, Homo sapiens
acauggagcccgaccagua

SEQ ID NO: 319832 - RNA, 19 nt, Homo sapiens
cuacauccgcugcaucaaa

SEQ ID NO: 319833 - RNA, 19 nt, Homo sapiens
guccagcacgucaaagaua

SEQ ID NO: 319834 - RNA, 19 nt, Homo sapiens
gacaacauguaccggaaca

SEQ ID NO: 319835 - RNA, 19 nt, Homo sapiens
gacuacaucuucaccuaca

SEQ ID NO: 319836 - RNA, 19 nt, Homo sapiens
cagcaucaaucggaacuuc

SEQ ID NO: 319837 - RNA, 19 nt, Homo sapiens
ucucuucuccgaccucaua

SEQ ID NO: 319838 - RNA, 19 nt, Homo sapiens
ugagugcuaugcagguuau

SEQ ID NO: 319839 - RNA, 19 nt, Homo sapiens
aagcgugacuuugcucauu

SEQ ID NO: 319840 - RNA, 19 nt, Homo sapiens
caacacagaauuccucaac

SEQ ID NO: 319841 - RNA, 19 nt, Homo sapiens
ccaagacugugcgcaacaa

SEQ ID NO: 319842 - RNA, 19 nt, Homo sapiens
gcacgucaaagauaucauc

SEQ ID NO: 319843 - RNA, 19 nt, Homo sapiens
guccugugcuguuggcaaa

SEQ ID NO: 319844 - RNA, 19 nt, Homo sapiens
acacagaauuccucaacgu

SEQ ID NO: 319845 - RNA, 19 nt, Homo sapiens
cucauucugucaucacuaa

SEQ ID NO: 319846 - RNA, 19 nt, Homo sapiens
caacgugaacgaggucauu

SEQ ID NO: 319847 - RNA, 19 nt, Homo sapiens
guacgugggccaagaugug

SEQ ID NO: 319848 - RNA, 19 nt, Homo sapiens
gaucaccgaagacgccauu

SEQ ID NO: 319849 - RNA, 19 nt, Homo sapiens
uggaauaccugggccugaa

SEQ ID NO: 319850 - RNA, 19 nt, Homo sapiens
cgacagaagcgacuuuggu

SEQ ID NO: 319851 - RNA, 19 nt, Homo sapiens
caucauuaguggagagagu

SEQ ID NO: 319852 - RNA, 19 nt, Homo sapiens
gaugacauggugcuucuuc

SEQ ID NO: 319853 - RNA, 19 nt, Homo sapiens
gagaagcugcagcaaaucu

SEQ ID NO: 319854 - RNA, 19 nt, Homo sapiens
ucaacuucgucaaugagaa

SEQ ID NO: 319855 - RNA, 19 nt, Homo sapiens
ggauacugccuucucuuuc

SEQ ID NO: 319856 - RNA, 19 nt, Homo sapiens
gaagaagaaaguggacauc

SEQ ID NO: 319857 - RNA, 19 nt, Homo sapiens
gcgcagcgaguccaucaau

SEQ ID NO: 319858 - RNA, 19 nt, Homo sapiens
ggaacaucaguuucuguga

SEQ ID NO: 319859 - RNA, 19 nt, Homo sapiens
caugacaccggacuacuau

SEQ ID NO: 319860 - RNA, 19 nt, Homo sapiens
ucaugacaccggacuacua

SEQ ID NO: 319861 - RNA, 19 nt, Homo sapiens
acgacuacaucuucaccua

SEQ ID NO: 319862 - RNA, 19 nt, Homo sapiens
ugaagaagggaccugagaa

SEQ ID NO: 319863 - RNA, 19 nt, Homo sapiens
gugaagaagggaccugaga

SEQ ID NO: 319864 - RNA, 19 nt, Homo sapiens
ggcgagagaaagugaagaa

SEQ ID NO: 319865 - RNA, 19 nt, Homo sapiens
gccgccaguucgccaaauu

SEQ ID NO: 319866 - RNA, 19 nt, Homo sapiens
cgagaggaaccgagacguu

SEQ ID NO: 319867 - RNA, 19 nt, Homo sapiens
ccaauccaguacuucaaca

SEQ ID NO: 319868 - RNA, 19 nt, Homo sapiens
uuaucgaacuuacccugaa

SEQ ID NO: 319869 - RNA, 19 nt, Homo sapiens
agaagcgacuuuggugaga

SEQ ID NO: 319870 - RNA, 19 nt, Homo sapiens
caucggcucugugcucauc

SEQ ID NO: 319871 - RNA, 19 nt, Homo sapiens
gggcaagaucuccaacuuc

SEQ ID NO: 319872 - RNA, 19 nt, Homo sapiens
caaguguguguaugugauu

SEQ ID NO: 319873 - RNA, 19 nt, Homo sapiens
ucaagaaacaagccaacga

SEQ ID NO: 319874 - RNA, 19 nt, Homo sapiens
ucaccuacaucggcucugu

SEQ ID NO: 319875 - RNA, 19 nt, Homo sapiens
ggaaacuacguggagaaga

SEQ ID NO: 319876 - RNA, 19 nt, Homo sapiens
gcacgcgacaggacgacuu

SEQ ID NO: 319877 - RNA, 19 nt, Homo sapiens
agaagggccagguguguga

SEQ ID NO: 319878 - RNA, 19 nt, Homo sapiens
uccaguacuucaacaacaa

SEQ ID NO: 319879 - RNA, 19 nt, Homo sapiens
cauggacgacuacaucuuc

SEQ ID NO: 319880 - RNA, 19 nt, Homo sapiens
aaugagaagcugcagcaaa

SEQ ID NO: 319881 - RNA, 19 nt, Homo sapiens
gccaaugagagccucguuu

SEQ ID NO: 319882 - RNA, 19 nt, Homo sapiens
cagagcacaacacagaauu

SEQ ID NO: 319883 - RNA, 19 nt, Homo sapiens
gggaaaggcugaacauaaa

SEQ ID NO: 319884 - RNA, 19 nt, Homo sapiens
gaaggagugugcaaacuuu

SEQ ID NO: 319885 - RNA, 19 nt, Homo sapiens
cagaauguauggagaguua

SEQ ID NO: 319886 - RNA, 19 nt, Homo sapiens
ccacaggacuucaggaauu

SEQ ID NO: 319887 - RNA, 19 nt, Homo sapiens
gugcugaugucgauauuua

SEQ ID NO: 319888 - RNA, 19 nt, Homo sapiens
gccaguacauuccaacuua

SEQ ID NO: 319889 - RNA, 19 nt, Homo sapiens
gcaaccagauaaagaacua

SEQ ID NO: 319890 - RNA, 19 nt, Homo sapiens
guuaauggcucaucaacaa

SEQ ID NO: 319891 - RNA, 19 nt, Homo sapiens
gaccaacaauaauguagua

SEQ ID NO: 319892 - RNA, 19 nt, Homo sapiens
caagagaaguacagaaugu

SEQ ID NO: 319893 - RNA, 19 nt, Homo sapiens
ggugaaaccugaccgcaaa

SEQ ID NO: 319894 - RNA, 19 nt, Homo sapiens
gcucacaccuguaaucuca

SEQ ID NO: 319895 - RNA, 19 nt, Homo sapiens
caacuuaggcuacagaaug

SEQ ID NO: 319896 - RNA, 19 nt, Homo sapiens
gaaaccgucuccacugaug

SEQ ID NO: 319897 - RNA, 19 nt, Homo sapiens
guuacuacauggcguauuu

SEQ ID NO: 319898 - RNA, 19 nt, Homo sapiens
gaacgcaggaaacaucuuu

SEQ ID NO: 319899 - RNA, 19 nt, Homo sapiens
uauggagaguuacauguua

SEQ ID NO: 319900 - RNA, 19 nt, Homo sapiens
gaauacaggagaauuauag

SEQ ID NO: 319901 - RNA, 19 nt, Homo sapiens
gaauauggauccugguucu

SEQ ID NO: 319902 - RNA, 19 nt, Homo sapiens
guaauugcauucuucuuca

SEQ ID NO: 319903 - RNA, 19 nt, Homo sapiens
guaagcugcugaaugcauu

SEQ ID NO: 319904 - RNA, 19 nt, Homo sapiens
ucauagucaucuucuguua

SEQ ID NO: 319905 - RNA, 19 nt, Homo sapiens
gaaugagacucugcccaaa

SEQ ID NO: 319906 - RNA, 19 nt, Homo sapiens
ggaauacaggagaauuaua

SEQ ID NO: 319907 - RNA, 19 nt, Homo sapiens
guaaauggaacaaacaaug

SEQ ID NO: 319908 - RNA, 19 nt, Homo sapiens
ccacugaugaccaacaaua

SEQ ID NO: 319909 - RNA, 19 nt, Homo sapiens
agaguaagcugcugaaugc

SEQ ID NO: 319910 - RNA, 19 nt, Homo sapiens
gcaagaacucccucugcua

SEQ ID NO: 319911 - RNA, 19 nt, Homo sapiens
ccuguaaucucagcacuuu

SEQ ID NO: 319912 - RNA, 19 nt, Homo sapiens
ggaacaagaagcucaggaa

SEQ ID NO: 319913 - RNA, 19 nt, Homo sapiens
ggaaggagugugcaaacuu

SEQ ID NO: 319914 - RNA, 19 nt, Homo sapiens
gaucauagucaucuucugu

SEQ ID NO: 319915 - RNA, 19 nt, Homo sapiens
gagaguaagcugcugaaug

SEQ ID NO: 319916 - RNA, 19 nt, Homo sapiens
guaaaugagugccacaaaa

SEQ ID NO: 319917 - RNA, 19 nt, Homo sapiens
ccgauaggguuaaauggaa

SEQ ID NO: 319918 - RNA, 19 nt, Homo sapiens
uaaaugagcaaauggaaca

SEQ ID NO: 319919 - RNA, 19 nt, Homo sapiens
gaaggaauacaggagaauu

SEQ ID NO: 319920 - RNA, 19 nt, Homo sapiens
caucuucuguuaccugaga

SEQ ID NO: 319921 - RNA, 19 nt, Homo sapiens
aaagguggacuccguuuaa

SEQ ID NO: 319922 - RNA, 19 nt, Homo sapiens
uaucugcacugccaaguca

SEQ ID NO: 319923 - RNA, 19 nt, Homo sapiens
gagugccucuuauuacaga

SEQ ID NO: 319924 - RNA, 19 nt, Homo sapiens
gugagugccucuuauuaca

SEQ ID NO: 319925 - RNA, 19 nt, Homo sapiens
gguaauugcauucuucuuc

SEQ ID NO: 319926 - RNA, 19 nt, Homo sapiens
caaaagggguaauugcauu

SEQ ID NO: 319927 - RNA, 19 nt, Homo sapiens
gcuacgugcuccucauaug

SEQ ID NO: 319928 - RNA, 19 nt, Homo sapiens
gaaaggcugaacauaaauc

SEQ ID NO: 319929 - RNA, 19 nt, Homo sapiens
gggugagugccucuuauua

SEQ ID NO: 319930 - RNA, 19 nt, Homo sapiens
ugccauaguuucugagcua

SEQ ID NO: 319931 - RNA, 19 nt, Homo sapiens
gcaugcaaccagauaaaga

SEQ ID NO: 319932 - RNA, 19 nt, Homo sapiens
gcagagugguggaggaaac

SEQ ID NO: 319933 - RNA, 19 nt, Homo sapiens
cacaggacuucaggaauuu

SEQ ID NO: 319934 - RNA, 19 nt, Homo sapiens
ccgcaaacccaaacugaaa

SEQ ID NO: 319935 - RNA, 19 nt, Homo sapiens
gagaauauggauccugguu

SEQ ID NO: 319936 - RNA, 19 nt, Homo sapiens
gugcagggacucuccagua

SEQ ID NO: 319937 - RNA, 19 nt, Homo sapiens
ccacaaccaacaccacaaa

SEQ ID NO: 319938 - RNA, 19 nt, Homo sapiens
cgauaggguuaaauggaaa

SEQ ID NO: 319939 - RNA, 19 nt, Homo sapiens
aaggaauacaggagaauua

SEQ ID NO: 319940 - RNA, 19 nt, Homo sapiens
gcuauacucauggucauaa

SEQ ID NO: 319941 - RNA, 19 nt, Homo sapiens
agggaaaggcugaacauaa

SEQ ID NO: 319942 - RNA, 19 nt, Homo sapiens
ggaaaggcugaacauaaau

SEQ ID NO: 319943 - RNA, 19 nt, Homo sapiens
gaugaccaacaauaaugua

SEQ ID NO: 319944 - RNA, 19 nt, Homo sapiens
ucaaguacgacaaacugua

SEQ ID NO: 319945 - RNA, 19 nt, Homo sapiens
ggcggagccuuaacaagug

SEQ ID NO: 319946 - RNA, 19 nt, Homo sapiens
gguggaaccugggcuaucu

SEQ ID NO: 319947 - RNA, 19 nt, Homo sapiens
gucaucggcuccauauuca

SEQ ID NO: 319948 - RNA, 19 nt, Homo sapiens
gagggaaaggcugaacaua

SEQ ID NO: 319949 - RNA, 19 nt, Homo sapiens
guauggagaguuacauguu

SEQ ID NO: 319950 - RNA, 19 nt, Homo sapiens
cgucaucggcuccauauuc

SEQ ID NO: 319951 - RNA, 19 nt, Homo sapiens
cauguuaacugaggaaugc

SEQ ID NO: 319952 - RNA, 19 nt, Homo sapiens
guaaagguggacuccguuu

SEQ ID NO: 319953 - RNA, 19 nt, Homo sapiens
cagccaggguguucuuugu

SEQ ID NO: 319954 - RNA, 19 nt, Homo sapiens
uucaacagcugccucaaug

SEQ ID NO: 319955 - RNA, 19 nt, Homo sapiens
ccagauaaagaacuaaauc

SEQ ID NO: 319956 - RNA, 19 nt, Homo sapiens
ccuuucagcuggcagaguu

SEQ ID NO: 319957 - RNA, 19 nt, Homo sapiens
gaccgcaaacccaaacuga

SEQ ID NO: 319958 - RNA, 19 nt, Homo sapiens
cagggacucuccaguacga

SEQ ID NO: 319959 - RNA, 19 nt, Homo sapiens
gagacugaguuaggagaau

SEQ ID NO: 319960 - RNA, 19 nt, Homo sapiens
caacaccacaaaccuuuca

SEQ ID NO: 319961 - RNA, 19 nt, Homo sapiens
ggaacaaacaaugaaagug

SEQ ID NO: 319962 - RNA, 19 nt, Homo sapiens
cuaacgacguggccgauag

SEQ ID NO: 319963 - RNA, 19 nt, Homo sapiens
aacuuaggcuacagaauga

SEQ ID NO: 319964 - RNA, 19 nt, Homo sapiens
uuggguagcuauacucaug

SEQ ID NO: 319965 - RNA, 19 nt, Homo sapiens
auuauagucucgcucugua

SEQ ID NO: 319966 - RNA, 19 nt, Homo sapiens
ucuguuaccugagaauaug

SEQ ID NO: 319967 - RNA, 19 nt, Homo sapiens
gccacagucucaaguacga

SEQ ID NO: 319968 - RNA, 19 nt, Homo sapiens
caugcaaccagauaaagaa

SEQ ID NO: 319969 - RNA, 19 nt, Homo sapiens
auaaauguuugccgcucua

SEQ ID NO: 319970 - RNA, 19 nt, Homo sapiens
ggcuguuuguggccaguua

SEQ ID NO: 319971 - RNA, 19 nt, Homo sapiens
ggaauuuugucaccauguu

SEQ ID NO: 319972 - RNA, 19 nt, Homo sapiens
gucaagagaaguacagaau

SEQ ID NO: 319973 - RNA, 19 nt, Homo sapiens
ccaguacauuccaacuuag

SEQ ID NO: 319974 - RNA, 19 nt, Homo sapiens
cgagaucgcgccaguacau

SEQ ID NO: 319975 - RNA, 19 nt, Homo sapiens
ggagacugaguuaggagaa

SEQ ID NO: 319976 - RNA, 19 nt, Homo sapiens
ugaaaucccaucucuaaaa

SEQ ID NO: 319977 - RNA, 19 nt, Homo sapiens
gaggugggcagaucaacug

SEQ ID NO: 319978 - RNA, 19 nt, Homo sapiens
ucaacaaucacaaccacaa

SEQ ID NO: 319979 - RNA, 19 nt, Homo sapiens
cuacauggcguauuucaac

SEQ ID NO: 319980 - RNA, 19 nt, Homo sapiens
gugcaugcaaccagauaaa

SEQ ID NO: 319981 - RNA, 19 nt, Homo sapiens
gcuggcagaguuagcauug

SEQ ID NO: 319982 - RNA, 19 nt, Homo sapiens
ggugagugccucuuauuac

SEQ ID NO: 319983 - RNA, 19 nt, Homo sapiens
gcuacuuacuggcuuauuu

SEQ ID NO: 319984 - RNA, 19 nt, Homo sapiens
ucacugccaucgccauuaa

SEQ ID NO: 319985 - RNA, 19 nt, Homo sapiens
gaaaggacagaaugaggaa

SEQ ID NO: 319986 - RNA, 19 nt, Homo sapiens
cagaagagcccaacuccuu

SEQ ID NO: 319987 - RNA, 19 nt, Homo sapiens
gacuggaacuugguaacua

SEQ ID NO: 319988 - RNA, 19 nt, Homo sapiens
caucggcucugucuucaau

SEQ ID NO: 319989 - RNA, 19 nt, Homo sapiens
gcacacaagaccaaggaaa

SEQ ID NO: 319990 - RNA, 19 nt, Homo sapiens
gggccacacuguccuguug

SEQ ID NO: 319991 - RNA, 19 nt, Homo sapiens
ccacggcacugcauucaag

SEQ ID NO: 319992 - RNA, 19 nt, Homo sapiens
gaaagagagaggucaguag

SEQ ID NO: 319993 - RNA, 19 nt, Homo sapiens
ccaggcagaugcucucuag

SEQ ID NO: 319994 - RNA, 19 nt, Homo sapiens
caaggaaaggacagaauga

SEQ ID NO: 319995 - RNA, 19 nt, Homo sapiens
uaugggcucuugaaccaaa

SEQ ID NO: 319996 - RNA, 19 nt, Homo sapiens
ucucauagcugacccucau

SEQ ID NO: 319997 - RNA, 19 nt, Homo sapiens
ggagcuuucuaaccauguu

SEQ ID NO: 319998 - RNA, 19 nt, Homo sapiens
gggagagucugcgauguca

SEQ ID NO: 319999 - RNA, 19 nt, Homo sapiens
guacgacccacgcaucuau

SEQ ID NO: 320000 - RNA, 19 nt, Homo sapiens
ggccagcgccuuugugaug

SEQ ID NO: 320001 - RNA, 19 nt, Homo sapiens
ugaaagagagaggucagua

SEQ ID NO: 320002 - RNA, 19 nt, Homo sapiens
ccaaggaaaggacagaaug

SEQ ID NO: 320003 - RNA, 19 nt, Homo sapiens
cuagcuacuuacuggcuua

SEQ ID NO: 320004 - RNA, 19 nt, Homo sapiens
ggaaaggccuggggcagaa

SEQ ID NO: 320005 - RNA, 19 nt, Homo sapiens
gcccaacuccuucucauag

SEQ ID NO: 320006 - RNA, 19 nt, Homo sapiens
gggauuuggugcacacaag

SEQ ID NO: 320007 - RNA, 19 nt, Homo sapiens
gaacccacggcacugcauu

SEQ ID NO: 320008 - RNA, 19 nt, Homo sapiens
ucuaugggcucuugaacca

SEQ ID NO: 320009 - RNA, 19 nt, Homo sapiens
ggaacgcagguaauuuguu

SEQ ID NO: 320010 - RNA, 19 nt, Homo sapiens
ccauuaaccgcuacugcua

SEQ ID NO: 320011 - RNA, 19 nt, Homo sapiens
gagcccaacuccuucucau

SEQ ID NO: 320012 - RNA, 19 nt, Homo sapiens
uugcggagcuuucuaacca

SEQ ID NO: 320013 - RNA, 19 nt, Homo sapiens
gggcuccacuuaacugcau

SEQ ID NO: 320014 - RNA, 19 nt, Homo sapiens
ggcucugucuucaauauca

SEQ ID NO: 320015 - RNA, 19 nt, Homo sapiens
ccggaacgcagguaauuug

SEQ ID NO: 320016 - RNA, 19 nt, Homo sapiens
gggacaagcagcccaucaa

SEQ ID NO: 320017 - RNA, 19 nt, Homo sapiens
gacaaacucaugaaauggu

SEQ ID NO: 320018 - RNA, 19 nt, Homo sapiens
gaugcucucuagccuggau

SEQ ID NO: 320019 - RNA, 19 nt, Homo sapiens
gagcugggcagggaagaga

SEQ ID NO: 320020 - RNA, 19 nt, Homo sapiens
agaaauggcuccccagauc

SEQ ID NO: 320021 - RNA, 19 nt, Homo sapiens
cugcacaucugccucaucu

SEQ ID NO: 320022 - RNA, 19 nt, Homo sapiens
auuugucacuagcuacuua

SEQ ID NO: 320023 - RNA, 19 nt, Homo sapiens
cgucaucggcucugucuuc

SEQ ID NO: 320024 - RNA, 19 nt, Homo sapiens
ggacaagcagcccaucaac

SEQ ID NO: 320025 - RNA, 19 nt, Homo sapiens
ccucguggccaucuucuau

SEQ ID NO: 320026 - RNA, 19 nt, Homo sapiens
gaucucuuccuguuagcaa

SEQ ID NO: 320027 - RNA, 19 nt, Homo sapiens
cagguaauuuguucuuggu

SEQ ID NO: 320028 - RNA, 19 nt, Homo sapiens
gacuugcggagcuuucuaa

SEQ ID NO: 320029 - RNA, 19 nt, Homo sapiens
ggauuuggugcacacaaga

SEQ ID NO: 320030 - RNA, 19 nt, Homo sapiens
gggagagagucugcugcaa

SEQ ID NO: 320031 - RNA, 19 nt, Homo sapiens
ucguggccaucuucuauga

SEQ ID NO: 320032 - RNA, 19 nt, Homo sapiens
guaggacuggaacuuggua

SEQ ID NO: 320033 - RNA, 19 nt, Homo sapiens
gcacaccagcagcaugaca

SEQ ID NO: 320034 - RNA, 19 nt, Homo sapiens
gcagggaauacaagaggau

SEQ ID NO: 320035 - RNA, 19 nt, Homo sapiens
cuuacuggcuuauuucaac

SEQ ID NO: 320036 - RNA, 19 nt, Homo sapiens
ggacuggaacuugguaacu

SEQ ID NO: 320037 - RNA, 19 nt, Homo sapiens
ccauguuugugguguuugu

SEQ ID NO: 320038 - RNA, 19 nt, Homo sapiens
ucggcucugucuucaauau

SEQ ID NO: 320039 - RNA, 19 nt, Homo sapiens
cuacuuacuggcuuauuuc

SEQ ID NO: 320040 - RNA, 19 nt, Homo sapiens
cugcugggcuccacuuaac

SEQ ID NO: 320041 - RNA, 19 nt, Homo sapiens
gguggugucuuggggauuu

SEQ ID NO: 320042 - RNA, 19 nt, Homo sapiens
uggccuugcugcccaacuu

SEQ ID NO: 320043 - RNA, 19 nt, Homo sapiens
ccagcagcaugacaaacuc

SEQ ID NO: 320044 - RNA, 19 nt, Homo sapiens
cauugucuaugggcucuug

SEQ ID NO: 320045 - RNA, 19 nt, Homo sapiens
gagcuuucuaaccauguuu

SEQ ID NO: 320046 - RNA, 19 nt, Homo sapiens
uaaccgcuacugcuacauc

SEQ ID NO: 320047 - RNA, 19 nt, Homo sapiens
gugcacacaagaccaagga

SEQ ID NO: 320048 - RNA, 19 nt, Homo sapiens
caucaacgccauggguuca

SEQ ID NO: 320049 - RNA, 19 nt, Homo sapiens
ugaaauggugggagagagu

SEQ ID NO: 320050 - RNA, 19 nt, Homo sapiens
ccagcuccacccaucauug

SEQ ID NO: 320051 - RNA, 19 nt, Homo sapiens
uuacuggcuuauuucaaca

SEQ ID NO: 320052 - RNA, 19 nt, Homo sapiens
gcacaccccucugcacauc

SEQ ID NO: 320053 - RNA, 19 nt, Homo sapiens
gcacagcguuuacauauuu

SEQ ID NO: 320054 - RNA, 19 nt, Homo sapiens
caacaacguucuuaguuua

SEQ ID NO: 320055 - RNA, 19 nt, Homo sapiens
gaagacagcuuuguuauag

SEQ ID NO: 320056 - RNA, 19 nt, Homo sapiens
ggaaaugccugcaagcaaa

SEQ ID NO: 320057 - RNA, 19 nt, Homo sapiens
gaaguaaccugaacaucuu

SEQ ID NO: 320058 - RNA, 19 nt, Homo sapiens
guagauaucucuggaaauu

SEQ ID NO: 320059 - RNA, 19 nt, Homo sapiens
caacuggucucucauuaaa

SEQ ID NO: 320060 - RNA, 19 nt, Homo sapiens
aaacugaccugugauauuu

SEQ ID NO: 320061 - RNA, 19 nt, Homo sapiens
gcucagaccugucaccuuu

SEQ ID NO: 320062 - RNA, 19 nt, Homo sapiens
ggacugaauuuccuacaaa

SEQ ID NO: 320063 - RNA, 19 nt, Homo sapiens
ggauguaucugcuggcuuu

SEQ ID NO: 320064 - RNA, 19 nt, Homo sapiens
gaaaggacuuauucugcua

SEQ ID NO: 320065 - RNA, 19 nt, Homo sapiens
gaacaucuuucaguacauu

SEQ ID NO: 320066 - RNA, 19 nt, Homo sapiens
gaagaagaccuuaaacaga

SEQ ID NO: 320067 - RNA, 19 nt, Homo sapiens
gaugaaggauguaaauguu

SEQ ID NO: 320068 - RNA, 19 nt, Homo sapiens
caacguggauguggccuua

SEQ ID NO: 320069 - RNA, 19 nt, Homo sapiens
gaaacugaccugugauauu

SEQ ID NO: 320070 - RNA, 19 nt, Homo sapiens
gaaauggucgcucacaauu

SEQ ID NO: 320071 - RNA, 19 nt, Homo sapiens
aagaagaccuuaaacagaa

SEQ ID NO: 320072 - RNA, 19 nt, Homo sapiens
ucaacaacguucuuaguuu

SEQ ID NO: 320073 - RNA, 19 nt, Homo sapiens
caagagaacucagagaugu

SEQ ID NO: 320074 - RNA, 19 nt, Homo sapiens
uagccaacuucaagaauua

SEQ ID NO: 320075 - RNA, 19 nt, Homo sapiens
gagcacagcguuuacauau

SEQ ID NO: 320076 - RNA, 19 nt, Homo sapiens
caagauugaugucuggaaa

SEQ ID NO: 320077 - RNA, 19 nt, Homo sapiens
gagguuaugucucucagaa

SEQ ID NO: 320078 - RNA, 19 nt, Homo sapiens
ucacacaacuggucucuca

SEQ ID NO: 320079 - RNA, 19 nt, Homo sapiens
cagagaaacuguuaugauc

SEQ ID NO: 320080 - RNA, 19 nt, Homo sapiens
gaagcaggcccaagauuga

SEQ ID NO: 320081 - RNA, 19 nt, Homo sapiens
gcaaagaccuacgcuccuu

SEQ ID NO: 320082 - RNA, 19 nt, Homo sapiens
gaucaaauuuggguauaug

SEQ ID NO: 320083 - RNA, 19 nt, Homo sapiens
gcaauggaguuuagcuugu

SEQ ID NO: 320084 - RNA, 19 nt, Homo sapiens
uaagauagaagacagcuuu

SEQ ID NO: 320085 - RNA, 19 nt, Homo sapiens
ccaaacacguucccuaauc

SEQ ID NO: 320086 - RNA, 19 nt, Homo sapiens
caaacacguucccuaauca

SEQ ID NO: 320087 - RNA, 19 nt, Homo sapiens
gaguuuagcuugugguauc

SEQ ID NO: 320088 - RNA, 19 nt, Homo sapiens
gcaugcagauggacaagga

SEQ ID NO: 320089 - RNA, 19 nt, Homo sapiens
ggaaaccaguacagaaaca

SEQ ID NO: 320090 - RNA, 19 nt, Homo sapiens
gaaaguugugucagaauga

SEQ ID NO: 320091 - RNA, 19 nt, Homo sapiens
gagaaacuguuaugaucau

SEQ ID NO: 320092 - RNA, 19 nt, Homo sapiens
acuggucucucauuaaaua

SEQ ID NO: 320093 - RNA, 19 nt, Homo sapiens
ugugaaagcuggccuggaa

SEQ ID NO: 320094 - RNA, 19 nt, Homo sapiens
gaucaucacugggacacuu

SEQ ID NO: 320095 - RNA, 19 nt, Homo sapiens
ugaaggauguaaauguuga

SEQ ID NO: 320096 - RNA, 19 nt, Homo sapiens
guagccaggugguuauuga

SEQ ID NO: 320097 - RNA, 19 nt, Homo sapiens
guucaaagguucuauuggu

SEQ ID NO: 320098 - RNA, 19 nt, Homo sapiens
gauguggccuuacuaugga

SEQ ID NO: 320099 - RNA, 19 nt, Homo sapiens
cacaacuggucucucauua

SEQ ID NO: 320100 - RNA, 19 nt, Homo sapiens
cuaaguacuugcucucuga

SEQ ID NO: 320101 - RNA, 19 nt, Homo sapiens
cuacaucugucaccaccua

SEQ ID NO: 320102 - RNA, 19 nt, Homo sapiens
gguacagucagaauaguua

SEQ ID NO: 320103 - RNA, 19 nt, Homo sapiens
ggaaauggucgcucacaau

SEQ ID NO: 320104 - RNA, 19 nt, Homo sapiens
gauagaagacagcuuuguu

SEQ ID NO: 320105 - RNA, 19 nt, Homo sapiens
gaccuacgcuccuucaucu

SEQ ID NO: 320106 - RNA, 19 nt, Homo sapiens
aaauaacgaugaaggaugu

SEQ ID NO: 320107 - RNA, 19 nt, Homo sapiens
guacuccacugaaguucuu

SEQ ID NO: 320108 - RNA, 19 nt, Homo sapiens
aaugaaggcugcaaacuca

SEQ ID NO: 320109 - RNA, 19 nt, Homo sapiens
gaagaaagaagagauccuu

SEQ ID NO: 320110 - RNA, 19 nt, Homo sapiens
gaaauuagagcugaagaca

SEQ ID NO: 320111 - RNA, 19 nt, Homo sapiens
gaugaccaguugauccaaa

SEQ ID NO: 320112 - RNA, 19 nt, Homo sapiens
guagaaggcacauagaaau

SEQ ID NO: 320113 - RNA, 19 nt, Homo sapiens
uagggugacugugguaaua

SEQ ID NO: 320114 - RNA, 19 nt, Homo sapiens
caacggauacagugauuug

SEQ ID NO: 320115 - RNA, 19 nt, Homo sapiens
gaaauuguaaagugaccua

SEQ ID NO: 320116 - RNA, 19 nt, Homo sapiens
gguagaaggcacauagaaa

SEQ ID NO: 320117 - RNA, 19 nt, Homo sapiens
aauggucgcucacaauuau

SEQ ID NO: 320118 - RNA, 19 nt, Homo sapiens
aguggaagcuaagaaguua

SEQ ID NO: 320119 - RNA, 19 nt, Homo sapiens
gacaucagagaaacuguua

SEQ ID NO: 320120 - RNA, 19 nt, Homo sapiens
agagauccuucaaauacua

SEQ ID NO: 320121 - RNA, 19 nt, Homo sapiens
ggacugcgaagaaagaaga

SEQ ID NO: 320122 - RNA, 19 nt, Homo sapiens
ggccuuggauucaugcaaa

SEQ ID NO: 320123 - RNA, 19 nt, Homo sapiens
ggacuccucuuuugugaaa

SEQ ID NO: 320124 - RNA, 19 nt, Homo sapiens
uaacugaugaggugaagaa

SEQ ID NO: 320125 - RNA, 19 nt, Homo sapiens
ucagaaaguugugucagaa

SEQ ID NO: 320126 - RNA, 19 nt, Homo sapiens
caauguauaugaagcucuu

SEQ ID NO: 320127 - RNA, 19 nt, Homo sapiens
gaagcuccauucaggcaau

SEQ ID NO: 320128 - RNA, 19 nt, Homo sapiens
gaccucagacucauuagaa

SEQ ID NO: 320129 - RNA, 19 nt, Homo sapiens
ggucuugggugucaguuca

SEQ ID NO: 320130 - RNA, 19 nt, Homo sapiens
uagaaggcacauagaaaua

SEQ ID NO: 320131 - RNA, 19 nt, Homo sapiens
ugaaagaguccacuucuca

SEQ ID NO: 320132 - RNA, 19 nt, Homo sapiens
gaaacuuccuggccuucau

SEQ ID NO: 320133 - RNA, 19 nt, Homo sapiens
uaucgaagcagaaauuaga

SEQ ID NO: 320134 - RNA, 19 nt, Homo sapiens
gaaggcacauagaaauaac

SEQ ID NO: 320135 - RNA, 19 nt, Homo sapiens
guauaugaagcucuugaua

SEQ ID NO: 320136 - RNA, 19 nt, Homo sapiens
gguaauaaccacugacauc

SEQ ID NO: 320137 - RNA, 19 nt, Homo sapiens
ugccuacacuggcuacaua

SEQ ID NO: 320138 - RNA, 19 nt, Homo sapiens
ucagaccucagacucauua

SEQ ID NO: 320139 - RNA, 19 nt, Homo sapiens
agaagacagcuuuguuaua

SEQ ID NO: 320140 - RNA, 19 nt, Homo sapiens
agauaucucuggaaauugu

SEQ ID NO: 320141 - RNA, 19 nt, Homo sapiens
aauguggcaugacuaagua

SEQ ID NO: 320142 - RNA, 19 nt, Homo sapiens
gaaagcguauuagcaggau

SEQ ID NO: 320143 - RNA, 19 nt, Homo sapiens
gaagaccuuaaacagaaua

SEQ ID NO: 320144 - RNA, 19 nt, Homo sapiens
uagcugugcuugcugaaga

SEQ ID NO: 320145 - RNA, 19 nt, Homo sapiens
auagaagacagcuuuguua

SEQ ID NO: 320146 - RNA, 19 nt, Homo sapiens
ggauguggccuuacuaugg

SEQ ID NO: 320147 - RNA, 19 nt, Homo sapiens
gaaugaaggcugcaaacuc

SEQ ID NO: 320148 - RNA, 19 nt, Homo sapiens
ccucaggacugcgaagaaa

SEQ ID NO: 320149 - RNA, 19 nt, Homo sapiens
cgaagcaggcccaagauug

SEQ ID NO: 320150 - RNA, 19 nt, Homo sapiens
ccaaugagguagauaucuc

SEQ ID NO: 320151 - RNA, 19 nt, Homo sapiens
uuagccaacuucaagaauu

SEQ ID NO: 320152 - RNA, 19 nt, Homo sapiens
ugucagccauccucuuuga

SEQ ID NO: 320153 - RNA, 19 nt, Homo sapiens
gaagaagccuuguguguug

SEQ ID NO: 320154 - RNA, 19 nt, Homo sapiens
ggagagcgcuguaauguug

SEQ ID NO: 320155 - RNA, 19 nt, Homo sapiens
gaacauaguuggaguaguc

SEQ ID NO: 320156 - RNA, 19 nt, Homo sapiens
gagauuagcuauaaggauu

SEQ ID NO: 320157 - RNA, 19 nt, Homo sapiens
gagagaaaguuacuguuaa

SEQ ID NO: 320158 - RNA, 19 nt, Homo sapiens
ccacaaagcagauauaauu

SEQ ID NO: 320159 - RNA, 19 nt, Homo sapiens
ggagagaaaguuacuguua

SEQ ID NO: 320160 - RNA, 19 nt, Homo sapiens
acaaauaacugaugaagga

SEQ ID NO: 320161 - RNA, 19 nt, Homo sapiens
gagaagcucuuacguuaug

SEQ ID NO: 320162 - RNA, 19 nt, Homo sapiens
ggugauaaguuccaaauau

SEQ ID NO: 320163 - RNA, 19 nt, Homo sapiens
agacagaggucguuugauu

SEQ ID NO: 320164 - RNA, 19 nt, Homo sapiens
gaagaaaccagagugcuua

SEQ ID NO: 320165 - RNA, 19 nt, Homo sapiens
guugauaucuuacucauug

SEQ ID NO: 320166 - RNA, 19 nt, Homo sapiens
cugagaagcucuuacguua

SEQ ID NO: 320167 - RNA, 19 nt, Homo sapiens
ggaggaauguguaagaaug

SEQ ID NO: 320168 - RNA, 19 nt, Homo sapiens
gagaaggccaggaagauua

SEQ ID NO: 320169 - RNA, 19 nt, Homo sapiens
ccaaggaaauggagagauu

SEQ ID NO: 320170 - RNA, 19 nt, Homo sapiens
cagaagagcuccaugaaag

SEQ ID NO: 320171 - RNA, 19 nt, Homo sapiens
gaucucaucuggaauaaag

SEQ ID NO: 320172 - RNA, 19 nt, Homo sapiens
gggagaagcuaaacgaaga

SEQ ID NO: 320173 - RNA, 19 nt, Homo sapiens
auagguagaugccaaguua

SEQ ID NO: 320174 - RNA, 19 nt, Homo sapiens
gaggagauacuuacccuua

SEQ ID NO: 320175 - RNA, 19 nt, Homo sapiens
ccaagcaccuaaaggauuu

SEQ ID NO: 320176 - RNA, 19 nt, Homo sapiens
ccaggaaggucuacgauga

SEQ ID NO: 320177 - RNA, 19 nt, Homo sapiens
gcaacaagccucaaacuca

SEQ ID NO: 320178 - RNA, 19 nt, Homo sapiens
aaacugggcuuuaauccaa

SEQ ID NO: 320179 - RNA, 19 nt, Homo sapiens
gaaaugagaccuuuuauug

SEQ ID NO: 320180 - RNA, 19 nt, Homo sapiens
cagccuauguccucuguua

SEQ ID NO: 320181 - RNA, 19 nt, Homo sapiens
gaaauggcccugucgaaga

SEQ ID NO: 320182 - RNA, 19 nt, Homo sapiens
gaugaaacgccuucuauga

SEQ ID NO: 320183 - RNA, 19 nt, Homo sapiens
ugagugaacuacagcuaua

SEQ ID NO: 320184 - RNA, 19 nt, Homo sapiens
gaacaauggcuauucaugu

SEQ ID NO: 320185 - RNA, 19 nt, Homo sapiens
gaaaugaggagagaaaguu

SEQ ID NO: 320186 - RNA, 19 nt, Homo sapiens
cagaaacacugaagccauu

SEQ ID NO: 320187 - RNA, 19 nt, Homo sapiens
gaagacagaggucguuuga

SEQ ID NO: 320188 - RNA, 19 nt, Homo sapiens
ugaaagaguucgccgagaa

SEQ ID NO: 320189 - RNA, 19 nt, Homo sapiens
caacuuguaugccauuaau

SEQ ID NO: 320190 - RNA, 19 nt, Homo sapiens
ucuaaaggcuggacuaaau

SEQ ID NO: 320191 - RNA, 19 nt, Homo sapiens
guccuuggcugcaauaauu

SEQ ID NO: 320192 - RNA, 19 nt, Homo sapiens
gaucauaucagggaaauug

SEQ ID NO: 320193 - RNA, 19 nt, Homo sapiens
gaaucuaggaggccacuua

SEQ ID NO: 320194 - RNA, 19 nt, Homo sapiens
caacagaaacagacacaaa

SEQ ID NO: 320195 - RNA, 19 nt, Homo sapiens
ggaaaugagugaacuacag

SEQ ID NO: 320196 - RNA, 19 nt, Homo sapiens
caagggaagugcauuguca

SEQ ID NO: 320197 - RNA, 19 nt, Homo sapiens
caagugcaaugaccagauu

SEQ ID NO: 320198 - RNA, 19 nt, Homo sapiens
ggagagggauuugucauca

SEQ ID NO: 320199 - RNA, 19 nt, Homo sapiens
cauaagauuugcaaagguu

SEQ ID NO: 320200 - RNA, 19 nt, Homo sapiens
gaaacucacccgugcauau

SEQ ID NO: 320201 - RNA, 19 nt, Homo sapiens
ggcauuagguuaacagaau

SEQ ID NO: 320202 - RNA, 19 nt, Homo sapiens
gaucaaggaaguuugcuaa

SEQ ID NO: 320203 - RNA, 19 nt, Homo sapiens
ugaaauguaugucugucua

SEQ ID NO: 320204 - RNA, 19 nt, Homo sapiens
gugcauauguugaccuuug

SEQ ID NO: 320205 - RNA, 19 nt, Homo sapiens
ccaaaugcuucuaaauaug

SEQ ID NO: 320206 - RNA, 19 nt, Homo sapiens
ggacaagugggcagcauaa

SEQ ID NO: 320207 - RNA, 19 nt, Homo sapiens
ugcaauaauuuccgaguua

SEQ ID NO: 320208 - RNA, 19 nt, Homo sapiens
uuacagacuugaacauuug

SEQ ID NO: 320209 - RNA, 19 nt, Homo sapiens
gaagaugauccacaacuug

SEQ ID NO: 320210 - RNA, 19 nt, Homo sapiens
aggaucagguugaggauua

SEQ ID NO: 320211 - RNA, 19 nt, Homo sapiens
ggaaaucauggaagaauau

SEQ ID NO: 320212 - RNA, 19 nt, Homo sapiens
gaaauggagagauuagcua

SEQ ID NO: 320213 - RNA, 19 nt, Homo sapiens
ccuaauauccuaaccauug

SEQ ID NO: 320214 - RNA, 19 nt, Homo sapiens
ugaaacgccuucuaugaug

SEQ ID NO: 320215 - RNA, 19 nt, Homo sapiens
cagggacgaucguugauaa

SEQ ID NO: 320216 - RNA, 19 nt, Homo sapiens
ugaauuaggaccacaauga

SEQ ID NO: 320217 - RNA, 19 nt, Homo sapiens
gugauaaguuccaaauaug

SEQ ID NO: 320218 - RNA, 19 nt, Homo sapiens
gggauaugauacagacuaa

SEQ ID NO: 320219 - RNA, 19 nt, Homo sapiens
ggaggagacucgacaacau

SEQ ID NO: 320220 - RNA, 19 nt, Homo sapiens
guucccagcuguuagauga

SEQ ID NO: 320221 - RNA, 19 nt, Homo sapiens
ggucaggaauuuaaagauc

SEQ ID NO: 320222 - RNA, 19 nt, Homo sapiens
cgacauaggcaagaacaua

SEQ ID NO: 320223 - RNA, 19 nt, Homo sapiens
ggacuggaauggaggaaca

SEQ ID NO: 320224 - RNA, 19 nt, Homo sapiens
gaccagauuuugcaacuua

SEQ ID NO: 320225 - RNA, 19 nt, Homo sapiens
cuagagcccuucaggauug

SEQ ID NO: 320226 - RNA, 19 nt, Homo sapiens
cuaaauggcugcagaacuc

SEQ ID NO: 320227 - RNA, 19 nt, Homo sapiens
gcagaagagcuccaugaaa

SEQ ID NO: 320228 - RNA, 19 nt, Homo sapiens
gcacggagccauacuacug

SEQ ID NO: 320229 - RNA, 19 nt, Homo sapiens
gaagaacgccuugaguaug

SEQ ID NO: 320230 - RNA, 19 nt, Homo sapiens
gcagauaucauugaaacaa

SEQ ID NO: 320231 - RNA, 19 nt, Homo sapiens
ggacaggagcacauaggua

SEQ ID NO: 320232 - RNA, 19 nt, Homo sapiens
aaagguaacugauaaacca

SEQ ID NO: 320233 - RNA, 19 nt, Homo sapiens
caacuugagaagacauuua

SEQ ID NO: 320234 - RNA, 19 nt, Homo sapiens
gugagaagaugauccacaa

SEQ ID NO: 320235 - RNA, 19 nt, Homo sapiens
gcaaaggacuuaaaauuac

SEQ ID NO: 320236 - RNA, 19 nt, Homo sapiens
gauuaugcauugaggaaga

SEQ ID NO: 320237 - RNA, 19 nt, Homo sapiens
gauugaagcuggguuaaag

SEQ ID NO: 320238 - RNA, 19 nt, Homo sapiens
ccagaacaauggcuauuca

SEQ ID NO: 320239 - RNA, 19 nt, Homo sapiens
acaagcagguguuuauaug

SEQ ID NO: 320240 - RNA, 19 nt, Homo sapiens
gagcaaggccuaugaggau

SEQ ID NO: 320241 - RNA, 19 nt, Homo sapiens
agacaggaauuaagagguu

SEQ ID NO: 320242 - RNA, 19 nt, Homo sapiens
gggcagauaucauugaaac

SEQ ID NO: 320243 - RNA, 19 nt, Homo sapiens
guaauuacccacagaagga

SEQ ID NO: 320244 - RNA, 19 nt, Homo sapiens
uggcugagguugagaaaug

SEQ ID NO: 320245 - RNA, 19 nt, Homo sapiens
gaugaauacuuugaggaaa

SEQ ID NO: 320246 - RNA, 19 nt, Homo sapiens
gucaauagcauuagucuga

SEQ ID NO: 320247 - RNA, 19 nt, Homo sapiens
gcuuacaaguguuuacuau

SEQ ID NO: 320248 - RNA, 19 nt, Homo sapiens
caagaugguuaagucaauu

SEQ ID NO: 320249 - RNA, 19 nt, Homo sapiens
uaaaggacaagaugguuaa

SEQ ID NO: 320250 - RNA, 19 nt, Homo sapiens
gcucacugcuugcuuguca

SEQ ID NO: 320251 - RNA, 19 nt, Homo sapiens
ccgagaagcucaccaugug

SEQ ID NO: 320252 - RNA, 19 nt, Homo sapiens
ugaacacacugauuaguca

SEQ ID NO: 320253 - RNA, 19 nt, Homo sapiens
gcaaaggcuuccugaaaua

SEQ ID NO: 320254 - RNA, 19 nt, Homo sapiens
ggacagaccuugugaaguc

SEQ ID NO: 320255 - RNA, 19 nt, Homo sapiens
ucacaagccucucugaaua

SEQ ID NO: 320256 - RNA, 19 nt, Homo sapiens
gaucuuaacucaucuaaag

SEQ ID NO: 320257 - RNA, 19 nt, Homo sapiens
gcaaagagguuggaguuga

SEQ ID NO: 320258 - RNA, 19 nt, Homo sapiens
guacaaagccuacuccaaa

SEQ ID NO: 320259 - RNA, 19 nt, Homo sapiens
gggauuaucuauucagaaa

SEQ ID NO: 320260 - RNA, 19 nt, Homo sapiens
uaacagugauucugaggua

SEQ ID NO: 320261 - RNA, 19 nt, Homo sapiens
ccagagaacuucacagaga

SEQ ID NO: 320262 - RNA, 19 nt, Homo sapiens
caaagaauauggccaagga

SEQ ID NO: 320263 - RNA, 19 nt, Homo sapiens
ggagguuucuguuacuaua

SEQ ID NO: 320264 - RNA, 19 nt, Homo sapiens
gagauuggaucauuuaaca

SEQ ID NO: 320265 - RNA, 19 nt, Homo sapiens
gagagaaacuccaagaaca

SEQ ID NO: 320266 - RNA, 19 nt, Homo sapiens
ugaaagaaauggcauaauc

SEQ ID NO: 320267 - RNA, 19 nt, Homo sapiens
ggauuuaucuaucaccauu

SEQ ID NO: 320268 - RNA, 19 nt, Homo sapiens
cgacacagcccgcaaguuu

SEQ ID NO: 320269 - RNA, 19 nt, Homo sapiens
gacugcagcuugaagauaa

SEQ ID NO: 320270 - RNA, 19 nt, Homo sapiens
gcagaucuucacuguauua

SEQ ID NO: 320271 - RNA, 19 nt, Homo sapiens
uuugauagcuugggauuua

SEQ ID NO: 320272 - RNA, 19 nt, Homo sapiens
gcagugugcuggaccuaaa

SEQ ID NO: 320273 - RNA, 19 nt, Homo sapiens
gcagaugacuguguagguu

SEQ ID NO: 320274 - RNA, 19 nt, Homo sapiens
caaagagguuggaguugaa

SEQ ID NO: 320275 - RNA, 19 nt, Homo sapiens
caaaguauguacaagacaa

SEQ ID NO: 320276 - RNA, 19 nt, Homo sapiens
ccaauccaauguuguaauu

SEQ ID NO: 320277 - RNA, 19 nt, Homo sapiens
ggacauuugcauucaauuu

SEQ ID NO: 320278 - RNA, 19 nt, Homo sapiens
ggagaacggccauauuuau

SEQ ID NO: 320279 - RNA, 19 nt, Homo sapiens
gaacaacacccagauggaa

SEQ ID NO: 320280 - RNA, 19 nt, Homo sapiens
gcucgaacaucuuccuaaa

SEQ ID NO: 320281 - RNA, 19 nt, Homo sapiens
gcauauggauuuaucuauc

SEQ ID NO: 320282 - RNA, 19 nt, Homo sapiens
gaacaucuuccuaaacuuc

SEQ ID NO: 320283 - RNA, 19 nt, Homo sapiens
gcaaguuuguuaaggaaau

SEQ ID NO: 320284 - RNA, 19 nt, Homo sapiens
gauaaucuuucuccacugu

SEQ ID NO: 320285 - RNA, 19 nt, Homo sapiens
gugccaaaccuuuaaauuu

SEQ ID NO: 320286 - RNA, 19 nt, Homo sapiens
caggauauuuggucauaaa

SEQ ID NO: 320287 - RNA, 19 nt, Homo sapiens
gcauauaccugcgggaugu

SEQ ID NO: 320288 - RNA, 19 nt, Homo sapiens
cugcagaucuucacuguau

SEQ ID NO: 320289 - RNA, 19 nt, Homo sapiens
caaaggccaucgcagaaga

SEQ ID NO: 320290 - RNA, 19 nt, Homo sapiens
gaugaggagguuucuguua

SEQ ID NO: 320291 - RNA, 19 nt, Homo sapiens
gaacagcaaccaauccaau

SEQ ID NO: 320292 - RNA, 19 nt, Homo sapiens
uaacucaucuaaagguuuc

SEQ ID NO: 320293 - RNA, 19 nt, Homo sapiens
ccacucugcugguagaauu

SEQ ID NO: 320294 - RNA, 19 nt, Homo sapiens
guuuagaacuugugguuga

SEQ ID NO: 320295 - RNA, 19 nt, Homo sapiens
gaauauggccaaggaugua

SEQ ID NO: 320296 - RNA, 19 nt, Homo sapiens
caggagaacggccauauuu

SEQ ID NO: 320297 - RNA, 19 nt, Homo sapiens
cggcgugguuucacuguua

SEQ ID NO: 320298 - RNA, 19 nt, Homo sapiens
uuacguaucuucuaucuac

SEQ ID NO: 320299 - RNA, 19 nt, Homo sapiens
gaaauccgagcaauuccua

SEQ ID NO: 320300 - RNA, 19 nt, Homo sapiens
gaguggagauuggaucauu

SEQ ID NO: 320301 - RNA, 19 nt, Homo sapiens
gaaagaaauggcauaaucu

SEQ ID NO: 320302 - RNA, 19 nt, Homo sapiens
caacaaauucuuuccacuu

SEQ ID NO: 320303 - RNA, 19 nt, Homo sapiens
ggaaauacagaaccaaaca

SEQ ID NO: 320304 - RNA, 19 nt, Homo sapiens
caugggaucuuaacucauc

SEQ ID NO: 320305 - RNA, 19 nt, Homo sapiens
cccagaauauuuacaggua

SEQ ID NO: 320306 - RNA, 19 nt, Homo sapiens
aaacacugccgguugauuu

SEQ ID NO: 320307 - RNA, 19 nt, Homo sapiens
uuucuccacuguucuaaua

SEQ ID NO: 320308 - RNA, 19 nt, Homo sapiens
gaaagccaaguaucuguga

SEQ ID NO: 320309 - RNA, 19 nt, Homo sapiens
ggacauggaguggagauug

SEQ ID NO: 320310 - RNA, 19 nt, Homo sapiens
ugaaaacccuggccacuuu

SEQ ID NO: 320311 - RNA, 19 nt, Homo sapiens
ugugcaagcucaaguuuau

SEQ ID NO: 320312 - RNA, 19 nt, Homo sapiens
gaggagguuucuguuacua

SEQ ID NO: 320313 - RNA, 19 nt, Homo sapiens
ccauaaagaaugcucauau

SEQ ID NO: 320314 - RNA, 19 nt, Homo sapiens
gauguauacccauaaagaa

SEQ ID NO: 320315 - RNA, 19 nt, Homo sapiens
ggccaaggauguacaugau

SEQ ID NO: 320316 - RNA, 19 nt, Homo sapiens
gauguucucuccaguucau

SEQ ID NO: 320317 - RNA, 19 nt, Homo sapiens
gggauguucucuccaguuc

SEQ ID NO: 320318 - RNA, 19 nt, Homo sapiens
ggaagauaauugauaaacg

SEQ ID NO: 320319 - RNA, 19 nt, Homo sapiens
ugcaaaggcuuccugaaau

SEQ ID NO: 320320 - RNA, 19 nt, Homo sapiens
ggaggaaagccaaguaucu

SEQ ID NO: 320321 - RNA, 19 nt, Homo sapiens
agaugacuguguagguuua

SEQ ID NO: 320322 - RNA, 19 nt, Homo sapiens
aaauuucacucugggcaua

SEQ ID NO: 320323 - RNA, 19 nt, Homo sapiens
ggcauaaggauagggauua

SEQ ID NO: 320324 - RNA, 19 nt, Homo sapiens
aaauaaaggcagacacaaa

SEQ ID NO: 320325 - RNA, 19 nt, Homo sapiens
uaaacgacuucaagagcuu

SEQ ID NO: 320326 - RNA, 19 nt, Homo sapiens
ucuccacuguucuaauaua

SEQ ID NO: 320327 - RNA, 19 nt, Homo sapiens
caauuuacagguaccagua

SEQ ID NO: 320328 - RNA, 19 nt, Homo sapiens
gaagugaugaggagguuuc

SEQ ID NO: 320329 - RNA, 19 nt, Homo sapiens
ggccaucgcagaagaaaug

SEQ ID NO: 320330 - RNA, 19 nt, Homo sapiens
gaacaacaaauucuuucca

SEQ ID NO: 320331 - RNA, 19 nt, Homo sapiens
uuacaugccuugaagugau

SEQ ID NO: 320332 - RNA, 19 nt, Homo sapiens
gcagugaacagcaaccaau

SEQ ID NO: 320333 - RNA, 19 nt, Homo sapiens
agucagagcugcuacacau

SEQ ID NO: 320334 - RNA, 19 nt, Homo sapiens
gaguagcucauucuuguga

SEQ ID NO: 320335 - RNA, 19 nt, Homo sapiens
ccuaucagcgccuccuuua

SEQ ID NO: 320336 - RNA, 19 nt, Homo sapiens
guggagauuggaucauuua

SEQ ID NO: 320337 - RNA, 19 nt, Homo sapiens
caggaaagcuccauuuugu

SEQ ID NO: 320338 - RNA, 19 nt, Homo sapiens
gaucugcccuaacagugau

SEQ ID NO: 320339 - RNA, 19 nt, Homo sapiens
agagagcacugcguccuuu

SEQ ID NO: 320340 - RNA, 19 nt, Homo sapiens
cuucugagauucgaugauu

SEQ ID NO: 320341 - RNA, 19 nt, Homo sapiens
aagucgagcuucugagauu

SEQ ID NO: 320342 - RNA, 19 nt, Homo sapiens
gaccuaaaauacugacuuu

SEQ ID NO: 320343 - RNA, 19 nt, Homo sapiens
gggcauauggauuuaucua

SEQ ID NO: 320344 - RNA, 19 nt, Homo sapiens
cagcaaaguauguacaaga

SEQ ID NO: 320345 - RNA, 19 nt, Homo sapiens
ucgaacaucuuccuaaacu

SEQ ID NO: 320346 - RNA, 19 nt, Homo sapiens
caacuuacuacgaaugaug

SEQ ID NO: 320347 - RNA, 19 nt, Homo sapiens
gaaaggauucugagguuuu

SEQ ID NO: 320348 - RNA, 19 nt, Homo sapiens
gugaauccgauaaguauga

SEQ ID NO: 320349 - RNA, 19 nt, Homo sapiens
guguggagaugcaaagaau

SEQ ID NO: 320350 - RNA, 19 nt, Homo sapiens
ggagcaaugugguuguuuu

SEQ ID NO: 320351 - RNA, 19 nt, Homo sapiens
uaaaggcagacacaaagaa

SEQ ID NO: 320352 - RNA, 19 nt, Homo sapiens
ggacaagaggagauaagug

SEQ ID NO: 320353 - RNA, 19 nt, Homo sapiens
gcaaaggcuuccugaaaua

SEQ ID NO: 320354 - RNA, 19 nt, Homo sapiens
ggacagaccuugugaaguc

SEQ ID NO: 320355 - RNA, 19 nt, Homo sapiens
ucacaagccucucugaaua

SEQ ID NO: 320356 - RNA, 19 nt, Homo sapiens
gaucuuaacucaucuaaag

SEQ ID NO: 320357 - RNA, 19 nt, Homo sapiens
gcaaagagguuggaguuga

SEQ ID NO: 320358 - RNA, 19 nt, Homo sapiens
guacaaagccuacuccaaa

SEQ ID NO: 320359 - RNA, 19 nt, Homo sapiens
gggauuaucuauucagaaa

SEQ ID NO: 320360 - RNA, 19 nt, Homo sapiens
uaacagugauucugaggua

SEQ ID NO: 320361 - RNA, 19 nt, Homo sapiens
ccagagaacuucacagaga

SEQ ID NO: 320362 - RNA, 19 nt, Homo sapiens
caaagaauauggccaagga

SEQ ID NO: 320363 - RNA, 19 nt, Homo sapiens
ggagguuucuguuacuaua

SEQ ID NO: 320364 - RNA, 19 nt, Homo sapiens
gagauuggaucauuuaaca

SEQ ID NO: 320365 - RNA, 19 nt, Homo sapiens
gagagaaacuccaagaaca

SEQ ID NO: 320366 - RNA, 19 nt, Homo sapiens
ugaaagaaauggcauaauc

SEQ ID NO: 320367 - RNA, 19 nt, Homo sapiens
ggauuuaucuaucaccauu

SEQ ID NO: 320368 - RNA, 19 nt, Homo sapiens
cgacacagcccgcaaguuu

SEQ ID NO: 320369 - RNA, 19 nt, Homo sapiens
gacugcagcuugaagauaa

SEQ ID NO: 320370 - RNA, 19 nt, Homo sapiens
gcagaucuucacuguauua

SEQ ID NO: 320371 - RNA, 19 nt, Homo sapiens
uuugauagcuugggauuua

SEQ ID NO: 320372 - RNA, 19 nt, Homo sapiens
gcagugugcuggaccuaaa

SEQ ID NO: 320373 - RNA, 19 nt, Homo sapiens
gcagaugacuguguagguu

SEQ ID NO: 320374 - RNA, 19 nt, Homo sapiens
caaagagguuggaguugaa

SEQ ID NO: 320375 - RNA, 19 nt, Homo sapiens
caaaguauguacaagacaa

SEQ ID NO: 320376 - RNA, 19 nt, Homo sapiens
ccaauccaauguuguaauu

SEQ ID NO: 320377 - RNA, 19 nt, Homo sapiens
ggacauuugcauucaauuu

SEQ ID NO: 320378 - RNA, 19 nt, Homo sapiens
ggagaacggccauauuuau

SEQ ID NO: 320379 - RNA, 19 nt, Homo sapiens
gaacaacacccagauggaa

SEQ ID NO: 320380 - RNA, 19 nt, Homo sapiens
gcucgaacaucuuccuaaa

SEQ ID NO: 320381 - RNA, 19 nt, Homo sapiens
gcauauggauuuaucuauc

SEQ ID NO: 320382 - RNA, 19 nt, Homo sapiens
gaacaucuuccuaaacuuc

SEQ ID NO: 320383 - RNA, 19 nt, Homo sapiens
gcaaguuuguuaaggaaau

SEQ ID NO: 320384 - RNA, 19 nt, Homo sapiens
gauaaucuuucuccacugu

SEQ ID NO: 320385 - RNA, 19 nt, Homo sapiens
gugccaaaccuuuaaauuu

SEQ ID NO: 320386 - RNA, 19 nt, Homo sapiens
caggauauuuggucauaaa

SEQ ID NO: 320387 - RNA, 19 nt, Homo sapiens
gcauauaccugcgggaugu

SEQ ID NO: 320388 - RNA, 19 nt, Homo sapiens
cugcagaucuucacuguau

SEQ ID NO: 320389 - RNA, 19 nt, Homo sapiens
caaaggccaucgcagaaga

SEQ ID NO: 320390 - RNA, 19 nt, Homo sapiens
gaugaggagguuucuguua

SEQ ID NO: 320391 - RNA, 19 nt, Homo sapiens
gaacagcaaccaauccaau

SEQ ID NO: 320392 - RNA, 19 nt, Homo sapiens
uaacucaucuaaagguuuc

SEQ ID NO: 320393 - RNA, 19 nt, Homo sapiens
ccacucugcugguagaauu

SEQ ID NO: 320394 - RNA, 19 nt, Homo sapiens
guuuagaacuugugguuga

SEQ ID NO: 320395 - RNA, 19 nt, Homo sapiens
gaauauggccaaggaugua

SEQ ID NO: 320396 - RNA, 19 nt, Homo sapiens
caggagaacggccauauuu

SEQ ID NO: 320397 - RNA, 19 nt, Homo sapiens
uuacguaucuucuaucuac

SEQ ID NO: 320398 - RNA, 19 nt, Homo sapiens
gaagucgcguugugcaguu

SEQ ID NO: 320399 - RNA, 19 nt, Homo sapiens
gaaauccgagcaauuccua

SEQ ID NO: 320400 - RNA, 19 nt, Homo sapiens
gaguggagauuggaucauu

SEQ ID NO: 320401 - RNA, 19 nt, Homo sapiens
gaaagaaauggcauaaucu

SEQ ID NO: 320402 - RNA, 19 nt, Homo sapiens
caacaaauucuuuccacuu

SEQ ID NO: 320403 - RNA, 19 nt, Homo sapiens
ggaaauacagaaccaaaca

SEQ ID NO: 320404 - RNA, 19 nt, Homo sapiens
caugggaucuuaacucauc

SEQ ID NO: 320405 - RNA, 19 nt, Homo sapiens
cccagaauauuuacaggua

SEQ ID NO: 320406 - RNA, 19 nt, Homo sapiens
aaacacugccgguugauuu

SEQ ID NO: 320407 - RNA, 19 nt, Homo sapiens
uuucuccacuguucuaaua

SEQ ID NO: 320408 - RNA, 19 nt, Homo sapiens
gaaagccaaguaucuguga

SEQ ID NO: 320409 - RNA, 19 nt, Homo sapiens
ggacauggaguggagauug

SEQ ID NO: 320410 - RNA, 19 nt, Homo sapiens
gaggagguuucuguuacua

SEQ ID NO: 320411 - RNA, 19 nt, Homo sapiens
ugaaaacccuggccacuuu

SEQ ID NO: 320412 - RNA, 19 nt, Homo sapiens
ugugcaagcucaaguuuau

SEQ ID NO: 320413 - RNA, 19 nt, Homo sapiens
ccauaaagaaugcucauau

SEQ ID NO: 320414 - RNA, 19 nt, Homo sapiens
gauguauacccauaaagaa

SEQ ID NO: 320415 - RNA, 19 nt, Homo sapiens
ggccaaggauguacaugau

SEQ ID NO: 320416 - RNA, 19 nt, Homo sapiens
gauguucucuccaguucau

SEQ ID NO: 320417 - RNA, 19 nt, Homo sapiens
gggauguucucuccaguuc

SEQ ID NO: 320418 - RNA, 19 nt, Homo sapiens
ggaagauaauugauaaacg

SEQ ID NO: 320419 - RNA, 19 nt, Homo sapiens
ugcaaaggcuuccugaaau

SEQ ID NO: 320420 - RNA, 19 nt, Homo sapiens
ggaggaaagccaaguaucu

SEQ ID NO: 320421 - RNA, 19 nt, Homo sapiens
agaugacuguguagguuua

SEQ ID NO: 320422 - RNA, 19 nt, Homo sapiens
aaauuucacucugggcaua

SEQ ID NO: 320423 - RNA, 19 nt, Homo sapiens
ggcauaaggauagggauua

SEQ ID NO: 320424 - RNA, 19 nt, Homo sapiens
aaauaaaggcagacacaaa

SEQ ID NO: 320425 - RNA, 19 nt, Homo sapiens
uaaacgacuucaagagcuu

SEQ ID NO: 320426 - RNA, 19 nt, Homo sapiens
uuacaugccuugaagugau

SEQ ID NO: 320427 - RNA, 19 nt, Homo sapiens
ucuccacuguucuaauaua

SEQ ID NO: 320428 - RNA, 19 nt, Homo sapiens
caauuuacagguaccagua

SEQ ID NO: 320429 - RNA, 19 nt, Homo sapiens
gaagugaugaggagguuuc

SEQ ID NO: 320430 - RNA, 19 nt, Homo sapiens
ggccaucgcagaagaaaug

SEQ ID NO: 320431 - RNA, 19 nt, Homo sapiens
gaacaacaaauucuuucca

SEQ ID NO: 320432 - RNA, 19 nt, Homo sapiens
gcagugaacagcaaccaau

SEQ ID NO: 320433 - RNA, 19 nt, Homo sapiens
agucagagcugcuacacau

SEQ ID NO: 320434 - RNA, 19 nt, Homo sapiens
gaguagcucauucuuguga

SEQ ID NO: 320435 - RNA, 19 nt, Homo sapiens
ccuaucagcgccuccuuua

SEQ ID NO: 320436 - RNA, 19 nt, Homo sapiens
guggagauuggaucauuua

SEQ ID NO: 320437 - RNA, 19 nt, Homo sapiens
caggaaagcuccauuuugu

SEQ ID NO: 320438 - RNA, 19 nt, Homo sapiens
gaucugcccuaacagugau

SEQ ID NO: 320439 - RNA, 19 nt, Homo sapiens
gcgcaagguugguggaagu

SEQ ID NO: 320440 - RNA, 19 nt, Homo sapiens
agagagcacugcguccuuu

SEQ ID NO: 320441 - RNA, 19 nt, Homo sapiens
cuucugagauucgaugauu

SEQ ID NO: 320442 - RNA, 19 nt, Homo sapiens
aagucgagcuucugagauu

SEQ ID NO: 320443 - RNA, 19 nt, Homo sapiens
gaccuaaaauacugacuuu

SEQ ID NO: 320444 - RNA, 19 nt, Homo sapiens
gggcauauggauuuaucua

SEQ ID NO: 320445 - RNA, 19 nt, Homo sapiens
cagcaaaguauguacaaga

SEQ ID NO: 320446 - RNA, 19 nt, Homo sapiens
ucgaacaucuuccuaaacu

SEQ ID NO: 320447 - RNA, 19 nt, Homo sapiens
caacuuacuacgaaugaug

SEQ ID NO: 320448 - RNA, 19 nt, Homo sapiens
gaaaggauucugagguuuu

SEQ ID NO: 320449 - RNA, 19 nt, Homo sapiens
guguggagaugcaaagaau

SEQ ID NO: 320450 - RNA, 19 nt, Homo sapiens
gugaauccgauaaguauga

SEQ ID NO: 320451 - RNA, 19 nt, Homo sapiens
ggagcaaugugguuguuuu

SEQ ID NO: 320452 - RNA, 19 nt, Homo sapiens
uaaaggcagacacaaagaa

SEQ ID NO: 320453 - RNA, 19 nt, Homo sapiens
gaaguacaaugcugauuau

SEQ ID NO: 320454 - RNA, 19 nt, Homo sapiens
guacaaugcugauuaugau

SEQ ID NO: 320455 - RNA, 19 nt, Homo sapiens
ggauagacaccaagaacua

SEQ ID NO: 320456 - RNA, 19 nt, Homo sapiens
ggaugaagaggaaugauuu

SEQ ID NO: 320457 - RNA, 19 nt, Homo sapiens
aggaagagcuggagaagga

SEQ ID NO: 320458 - RNA, 19 nt, Homo sapiens
agaaguacaaugcugauua

SEQ ID NO: 320459 - RNA, 19 nt, Homo sapiens
gcagagcccuucaggaacu

SEQ ID NO: 320460 - RNA, 19 nt, Homo sapiens
gcugaccuaugccagauuu

SEQ ID NO: 320461 - RNA, 19 nt, Homo sapiens
ugaggaggaugaagaggaa

SEQ ID NO: 320462 - RNA, 19 nt, Homo sapiens
caaccucugugccuauugu

SEQ ID NO: 320463 - RNA, 19 nt, Homo sapiens
gggcauggcugaggaggau

SEQ ID NO: 320464 - RNA, 19 nt, Homo sapiens
ggauggagcugagguacca

SEQ ID NO: 320465 - RNA, 19 nt, Homo sapiens
gaucaucacccaccuucga

SEQ ID NO: 320466 - RNA, 19 nt, Homo sapiens
uggcagagcccuucaggaa

SEQ ID NO: 320467 - RNA, 19 nt, Homo sapiens
gaaaagagaaguacaaugc

SEQ ID NO: 320468 - RNA, 19 nt, Homo sapiens
agacugaggaggagccaua

SEQ ID NO: 320469 - RNA, 19 nt, Homo sapiens
gugcugccacccagaauaa

SEQ ID NO: 320470 - RNA, 19 nt, Homo sapiens
ccacugaagguacacaaga

SEQ ID NO: 320471 - RNA, 19 nt, Homo sapiens
guacccacauucucagucu

SEQ ID NO: 320472 - RNA, 19 nt, Homo sapiens
uuucuacucucaugcauuc

SEQ ID NO: 320473 - RNA, 19 nt, Homo sapiens
gaugaagaggaaugauuug

SEQ ID NO: 320474 - RNA, 19 nt, Homo sapiens
caucucaguuccacacaag

SEQ ID NO: 320475 - RNA, 19 nt, Homo sapiens
cagcaggcccagagacuga

SEQ ID NO: 320476 - RNA, 19 nt, Homo sapiens
ggaggaugaagaggaauga

SEQ ID NO: 320477 - RNA, 19 nt, Homo sapiens
gcagacacccuggccuuca

SEQ ID NO: 320478 - RNA, 19 nt, Homo sapiens
caagaacuacguggaagug

SEQ ID NO: 320479 - RNA, 19 nt, Homo sapiens
gcaugcagcggcaguacau

SEQ ID NO: 320480 - RNA, 19 nt, Homo sapiens
aguacaaugcugauuauga

SEQ ID NO: 320481 - RNA, 19 nt, Homo sapiens
gagaaguacaaugcugauu

SEQ ID NO: 320482 - RNA, 19 nt, Homo sapiens
gcauggcugaggaggauga

SEQ ID NO: 320483 - RNA, 19 nt, Homo sapiens
cacugaagguacacaagau

SEQ ID NO: 320484 - RNA, 19 nt, Homo sapiens
ggccugaggacgaggaaga

SEQ ID NO: 320485 - RNA, 19 nt, Homo sapiens
caccaagaacuacguggaa

SEQ ID NO: 320486 - RNA, 19 nt, Homo sapiens
gugcugaccuaugccagau

SEQ ID NO: 320487 - RNA, 19 nt, Homo sapiens
gugcuccacugaagguaca

SEQ ID NO: 320488 - RNA, 19 nt, Homo sapiens
caaugcugauuaugaucug

SEQ ID NO: 320489 - RNA, 19 nt, Homo sapiens
gagaggcucgggagugucu

SEQ ID NO: 320490 - RNA, 19 nt, Homo sapiens
cagacacccuggccuucau

SEQ ID NO: 320491 - RNA, 19 nt, Homo sapiens
ugaagaggaaugauuuguc

SEQ ID NO: 320492 - RNA, 19 nt, Homo sapiens
gauagacaccaagaacuac

SEQ ID NO: 320493 - RNA, 19 nt, Homo sapiens
cauucucagucucuacuuc

SEQ ID NO: 320494 - RNA, 19 nt, Homo sapiens
gcagcggcaguacauggaa

SEQ ID NO: 320495 - RNA, 19 nt, Homo sapiens
gcagaggcuaugcccuuuc

SEQ ID NO: 320496 - RNA, 19 nt, Homo sapiens
ugcagaggcuaugcccuuu

SEQ ID NO: 320497 - RNA, 19 nt, Homo sapiens
uggcugaggaggaugaaga

SEQ ID NO: 320498 - RNA, 19 nt, Homo sapiens
gaagcagccucucgauaua

SEQ ID NO: 320499 - RNA, 19 nt, Homo sapiens
ggaagcagccucucgauau

SEQ ID NO: 320500 - RNA, 19 nt, Homo sapiens
gaucuguggugguacaauu

SEQ ID NO: 320501 - RNA, 19 nt, Homo sapiens
gauauaaccugacgaucuc

SEQ ID NO: 320502 - RNA, 19 nt, Homo sapiens
gcaguucaaucaguauaaa

SEQ ID NO: 320503 - RNA, 19 nt, Homo sapiens
ucacagugcuuacaguugu

SEQ ID NO: 320504 - RNA, 19 nt, Homo sapiens
agacgcaguucaaucagua

SEQ ID NO: 320505 - RNA, 19 nt, Homo sapiens
gagaagguaccaucaaugu

SEQ ID NO: 320506 - RNA, 19 nt, Homo sapiens
gccaggaucugugguggua

SEQ ID NO: 320507 - RNA, 19 nt, Homo sapiens
gccauugucuaucucauug

SEQ ID NO: 320508 - RNA, 19 nt, Homo sapiens
gaagaaugcuuugucuacu

SEQ ID NO: 320509 - RNA, 19 nt, Homo sapiens
accaagagcugcagagaga

SEQ ID NO: 320510 - RNA, 19 nt, Homo sapiens
cugggccucuccaauauua

SEQ ID NO: 320511 - RNA, 19 nt, Homo sapiens
cuacugagaagaaugcuuu

SEQ ID NO: 320512 - RNA, 19 nt, Homo sapiens
ccacuucugccaacuugua

SEQ ID NO: 320513 - RNA, 19 nt, Homo sapiens
gugcccagcucuacugaga

SEQ ID NO: 320514 - RNA, 19 nt, Homo sapiens
gagaagaaugcuuugucua

SEQ ID NO: 320515 - RNA, 19 nt, Homo sapiens
gaugugccauuuccuuucu

SEQ ID NO: 320516 - RNA, 19 nt, Homo sapiens
ccgagaagguaccaucaau

SEQ ID NO: 320517 - RNA, 19 nt, Homo sapiens
ugagaagaaugcuuugucu

SEQ ID NO: 320518 - RNA, 19 nt, Homo sapiens
gcuggucuguguucugguu

SEQ ID NO: 320519 - RNA, 19 nt, Homo sapiens
gagacgcaguucaaucagu

SEQ ID NO: 320520 - RNA, 19 nt, Homo sapiens
gaucguagccccuaugaga

SEQ ID NO: 320521 - RNA, 19 nt, Homo sapiens
cgauauaaccugacgaucu

SEQ ID NO: 320522 - RNA, 19 nt, Homo sapiens
uuucugggccucuccaaua

SEQ ID NO: 320523 - RNA, 19 nt, Homo sapiens
gagacgguuucugcaggua

SEQ ID NO: 320524 - RNA, 19 nt, Homo sapiens
gcccagcucuacugagaag

SEQ ID NO: 320525 - RNA, 19 nt, Homo sapiens
gcagcagccucucuuacac

SEQ ID NO: 320526 - RNA, 19 nt, Homo sapiens
cgugagugaugugccauuu

SEQ ID NO: 320527 - RNA, 19 nt, Homo sapiens
cacccagucuccuuucuuc

SEQ ID NO: 320528 - RNA, 19 nt, Homo sapiens
cggaagcagccucucgaua

SEQ ID NO: 320529 - RNA, 19 nt, Homo sapiens
gagcugcagagagacauuu

SEQ ID NO: 320530 - RNA, 19 nt, Homo sapiens
gcaccgacuacuaccaaga

SEQ ID NO: 320531 - RNA, 19 nt, Homo sapiens
gacgguuucugcagguaau

SEQ ID NO: 320532 - RNA, 19 nt, Homo sapiens
gugaugugccauuuccuuu

SEQ ID NO: 320533 - RNA, 19 nt, Homo sapiens
gcacccagucuccuuucuu

SEQ ID NO: 320534 - RNA, 19 nt, Homo sapiens
aagaaugcuuugucuacug

SEQ ID NO: 320535 - RNA, 19 nt, Homo sapiens
cagccucucuuacacaaac

SEQ ID NO: 320536 - RNA, 19 nt, Homo sapiens
gacgucagcgugagugaug

SEQ ID NO: 320537 - RNA, 19 nt, Homo sapiens
agaagaaugcuuugucuac

SEQ ID NO: 320538 - RNA, 19 nt, Homo sapiens
ggcagcagccucucuuaca

SEQ ID NO: 320539 - RNA, 19 nt, Homo sapiens
ggccauugucuaucucauu

SEQ ID NO: 320540 - RNA, 19 nt, Homo sapiens
ccacacccaugggcgcuau

SEQ ID NO: 320541 - RNA, 19 nt, Homo sapiens
gauaccuaccauccuauga

SEQ ID NO: 320542 - RNA, 19 nt, Homo sapiens
uggagacgcaguucaauca

SEQ ID NO: 320543 - RNA, 19 nt, Homo sapiens
cgagaagguaccaucaaug

SEQ ID NO: 320544 - RNA, 19 nt, Homo sapiens
gacuucggcuacccagaga

SEQ ID NO: 320545 - RNA, 19 nt, Homo sapiens
caggaucuguggugguaca

SEQ ID NO: 320546 - RNA, 19 nt, Homo sapiens
ccagcucuacugagaagaa

SEQ ID NO: 320547 - RNA, 19 nt, Homo sapiens
ugagugaugugccauuucc

SEQ ID NO: 320548 - RNA, 19 nt, Homo sapiens
cagcaccgacuacuaccaa

SEQ ID NO: 320549 - RNA, 19 nt, Homo sapiens
ccucuccaauauuaaguuc

SEQ ID NO: 320550 - RNA, 19 nt, Homo sapiens
caagagcugcagagagaca

SEQ ID NO: 320551 - RNA, 19 nt, Homo sapiens
acgggcagcuggacaucuu

SEQ ID NO: 320552 - RNA, 19 nt, Homo sapiens
ugguugcgcuggccauugu

SEQ ID NO: 320553 - RNA, 19 nt, Homo sapiens
aagcagccucucgauauaa

SEQ ID NO: 320554 - RNA, 19 nt, Homo sapiens
cagcucuacugagaagaau

SEQ ID NO: 320555 - RNA, 19 nt, Homo sapiens
gaacuacgcuccuggcuuu

SEQ ID NO: 320556 - RNA, 19 nt, Homo sapiens
ggacggagcugaaguugga

SEQ ID NO: 320557 - RNA, 19 nt, Homo sapiens
gcaaauaugacacguguaa

SEQ ID NO: 320558 - RNA, 19 nt, Homo sapiens
caagauacgugucaauugu

SEQ ID NO: 320559 - RNA, 19 nt, Homo sapiens
gccaggagaucaccaauga

SEQ ID NO: 320560 - RNA, 19 nt, Homo sapiens
gaaggcggcucccacauca

SEQ ID NO: 320561 - RNA, 19 nt, Homo sapiens
gacaaacagugguguguga

SEQ ID NO: 320562 - RNA, 19 nt, Homo sapiens
gaagaccaguuuggaaaug

SEQ ID NO: 320563 - RNA, 19 nt, Homo sapiens
gccagaaggugcaguguga

SEQ ID NO: 320564 - RNA, 19 nt, Homo sapiens
gaagaacaacugcacauuc

SEQ ID NO: 320565 - RNA, 19 nt, Homo sapiens
gacaccugcugcaacauua

SEQ ID NO: 320566 - RNA, 19 nt, Homo sapiens
ggagacaccuguuauuucg

SEQ ID NO: 320567 - RNA, 19 nt, Homo sapiens
gaacaacugcacauucuuc

SEQ ID NO: 320568 - RNA, 19 nt, Homo sapiens
uacaagaggugcaaauaug

SEQ ID NO: 320569 - RNA, 19 nt, Homo sapiens
gcacugcccuacaagaagu

SEQ ID NO: 320570 - RNA, 19 nt, Homo sapiens
ggaaugcccuugcguccau

SEQ ID NO: 320571 - RNA, 19 nt, Homo sapiens
caauaacuccuccuacauu

SEQ ID NO: 320572 - RNA, 19 nt, Homo sapiens
gaacuucaacggccuggaa

SEQ ID NO: 320573 - RNA, 19 nt, Homo sapiens
acaacgaccuguauucuuc

SEQ ID NO: 320574 - RNA, 19 nt, Homo sapiens
caaguccgauggcagugua

SEQ ID NO: 320575 - RNA, 19 nt, Homo sapiens
gaagagcccacgugcaaau

SEQ ID NO: 320576 - RNA, 19 nt, Homo sapiens
guacguuggaguucuauaa

SEQ ID NO: 320577 - RNA, 19 nt, Homo sapiens
acucccagcucuccaauaa

SEQ ID NO: 320578 - RNA, 19 nt, Homo sapiens
ccaagaccguccucaugaa

SEQ ID NO: 320579 - RNA, 19 nt, Homo sapiens
cagaagagcccacgugcaa

SEQ ID NO: 320580 - RNA, 19 nt, Homo sapiens
gcagugugaugucucuguu

SEQ ID NO: 320581 - RNA, 19 nt, Homo sapiens
guaacugucagaacaauga

SEQ ID NO: 320582 - RNA, 19 nt, Homo sapiens
caaccacccuucugaguac

SEQ ID NO: 320583 - RNA, 19 nt, Homo sapiens
caaaccagguggagacaca

SEQ ID NO: 320584 - RNA, 19 nt, Homo sapiens
aauaacuccuccuacauuu

SEQ ID NO: 320585 - RNA, 19 nt, Homo sapiens
caagaaugaagaccaguuu

SEQ ID NO: 320586 - RNA, 19 nt, Homo sapiens
ggaccaccguguucaucaa

SEQ ID NO: 320587 - RNA, 19 nt, Homo sapiens
gccacuacaucaccuuuga

SEQ ID NO: 320588 - RNA, 19 nt, Homo sapiens
ucaaccagcugcaggugaa

SEQ ID NO: 320589 - RNA, 19 nt, Homo sapiens
aguccuugcuuuccaauaa

SEQ ID NO: 320590 - RNA, 19 nt, Homo sapiens
gagcugaaguuggaagaca

SEQ ID NO: 320591 - RNA, 19 nt, Homo sapiens
cagaaggcaccguauauga

SEQ ID NO: 320592 - RNA, 19 nt, Homo sapiens
gcuguacguuggaguucua

SEQ ID NO: 320593 - RNA, 19 nt, Homo sapiens
agacaaguguggcugcuau

SEQ ID NO: 320594 - RNA, 19 nt, Homo sapiens
ccaaggccaucaagaucuu

SEQ ID NO: 320595 - RNA, 19 nt, Homo sapiens
gagcgaugccuacaccaaa

SEQ ID NO: 320596 - RNA, 19 nt, Homo sapiens
ucacugcccucgacagcuu

SEQ ID NO: 320597 - RNA, 19 nt, Homo sapiens
ccgacgggcugauggauga

SEQ ID NO: 320598 - RNA, 19 nt, Homo sapiens
ggugcucccuccugaagaa

SEQ ID NO: 320599 - RNA, 19 nt, Homo sapiens
cagacgcacuguaucauca

SEQ ID NO: 320600 - RNA, 19 nt, Homo sapiens
gaucaagaccgugcauaug

SEQ ID NO: 320601 - RNA, 19 nt, Homo sapiens
gacaggagaacgagacuug

SEQ ID NO: 320602 - RNA, 19 nt, Homo sapiens
caccauguauccugauguu

SEQ ID NO: 320603 - RNA, 19 nt, Homo sapiens
ccaccaaccagcacuacua

SEQ ID NO: 320604 - RNA, 19 nt, Homo sapiens
gcaagaaugaagaccaguu

SEQ ID NO: 320605 - RNA, 19 nt, Homo sapiens
aggaggaucugaagaagug

SEQ ID NO: 320606 - RNA, 19 nt, Homo sapiens
agaaugcgguggucuucaa

SEQ ID NO: 320607 - RNA, 19 nt, Homo sapiens
cggacaagguggacaacaa

SEQ ID NO: 320608 - RNA, 19 nt, Homo sapiens
gaaugaagaccaguuugga

SEQ ID NO: 320609 - RNA, 19 nt, Homo sapiens
gagcuggacuucgggaaca

SEQ ID NO: 320610 - RNA, 19 nt, Homo sapiens
ggaggacggagcugaaguu

SEQ ID NO: 320611 - RNA, 19 nt, Homo sapiens
ugcuggagcuggacacuaa

SEQ ID NO: 320612 - RNA, 19 nt, Homo sapiens
ggcuuccucucuucagaua

SEQ ID NO: 320613 - RNA, 19 nt, Homo sapiens
cccaauggaugcugcaaga

SEQ ID NO: 320614 - RNA, 19 nt, Homo sapiens
ucuaacaacuacuccucua

SEQ ID NO: 320615 - RNA, 19 nt, Homo sapiens
ccaauaagcaccacaacca

SEQ ID NO: 320616 - RNA, 19 nt, Homo sapiens
uguaagaagugugaacaga

SEQ ID NO: 320617 - RNA, 19 nt, Homo sapiens
ucaaccacccuucugagua

SEQ ID NO: 320618 - RNA, 19 nt, Homo sapiens
aaacaguggugugugaugu

SEQ ID NO: 320619 - RNA, 19 nt, Homo sapiens
acaacggccugcagagcua

SEQ ID NO: 320620 - RNA, 19 nt, Homo sapiens
gcacggacaagguggacaa

SEQ ID NO: 320621 - RNA, 19 nt, Homo sapiens
gcccgguucuccaguuuau

SEQ ID NO: 320622 - RNA, 19 nt, Homo sapiens
caaugugcccagagaguuu

SEQ ID NO: 320623 - RNA, 19 nt, Homo sapiens
ucaagaccgugcauaugau

SEQ ID NO: 320624 - RNA, 19 nt, Homo sapiens
aaacccaacuuucacaaac

SEQ ID NO: 320625 - RNA, 19 nt, Homo sapiens
ggucugacuggaucaauga

SEQ ID NO: 320626 - RNA, 19 nt, Homo sapiens
gcacgggcaucaucgucau

SEQ ID NO: 320627 - RNA, 19 nt, Homo sapiens
gauucgaagugaagagcaa

SEQ ID NO: 320628 - RNA, 19 nt, Homo sapiens
caagaggaccaccguguuc

SEQ ID NO: 320629 - RNA, 19 nt, Homo sapiens
gcccuugcguccauaacaa

SEQ ID NO: 320630 - RNA, 19 nt, Homo sapiens
cuuccucucuucagauauu

SEQ ID NO: 320631 - RNA, 19 nt, Homo sapiens
caacuacgagaucaacguu

SEQ ID NO: 320632 - RNA, 19 nt, Homo sapiens
gcuccuacguggcuguuca

SEQ ID NO: 320633 - RNA, 19 nt, Homo sapiens
gcugcuggcugacaagaag

SEQ ID NO: 320634 - RNA, 19 nt, Homo sapiens
caccguauaugacgacauc

SEQ ID NO: 320635 - RNA, 19 nt, Homo sapiens
cgacaccugcugcaacauu

SEQ ID NO: 320636 - RNA, 19 nt, Homo sapiens
ggacaggcccaucuaugag

SEQ ID NO: 320637 - RNA, 19 nt, Homo sapiens
gcagugcagcauccucaaa

SEQ ID NO: 320638 - RNA, 19 nt, Homo sapiens
gcccagaaggcaccguaua

SEQ ID NO: 320639 - RNA, 19 nt, Homo sapiens
agaccguccucaugaauca

SEQ ID NO: 320640 - RNA, 19 nt, Homo sapiens
gccgacaccugcugcaaca

SEQ ID NO: 320641 - RNA, 19 nt, Homo sapiens
caacacaguccugguggaa

SEQ ID NO: 320642 - RNA, 19 nt, Homo sapiens
ucgugaagguggaguguga

SEQ ID NO: 320643 - RNA, 19 nt, Homo sapiens
gggcagcuaacaucucuug

SEQ ID NO: 320644 - RNA, 19 nt, Homo sapiens
guguuacgacuacaagaua

SEQ ID NO: 320645 - RNA, 19 nt, Homo sapiens
gaccauuuggacuguguua

SEQ ID NO: 320646 - RNA, 19 nt, Homo sapiens
uuacaagaggugcaaauau

SEQ ID NO: 320647 - RNA, 19 nt, Homo sapiens
gcgagcagugugucuguaa

SEQ ID NO: 320648 - RNA, 19 nt, Homo sapiens
ggaacaugcagaagaucaa

SEQ ID NO: 320649 - RNA, 19 nt, Homo sapiens
gcgugaagauccacaacca

SEQ ID NO: 320650 - RNA, 19 nt, Homo sapiens
ggagugcuguaagaagugu

SEQ ID NO: 320651 - RNA, 19 nt, Homo sapiens
ucacgggaaugcugaguac

SEQ ID NO: 320652 - RNA, 19 nt, Homo sapiens
ugacaaccaccaccacaga

SEQ ID NO: 320653 - RNA, 19 nt, Homo sapiens
guugcuggcccauggauaa

SEQ ID NO: 320654 - RNA, 19 nt, Homo sapiens
agauacgugucaauuguug

SEQ ID NO: 320655 - RNA, 19 nt, Homo sapiens
gaacuucccuuaagaguca

SEQ ID NO: 320656 - RNA, 19 nt, Homo sapiens
ggaaugaccuggcagauca

SEQ ID NO: 320657 - RNA, 19 nt, Homo sapiens
ggagauggcuauuucgaaa

SEQ ID NO: 320658 - RNA, 19 nt, Homo sapiens
ccaagucgcuggagccauu

SEQ ID NO: 320659 - RNA, 19 nt, Homo sapiens
ugagcacgcugaaggcuua

SEQ ID NO: 320660 - RNA, 19 nt, Homo sapiens
caaccuagaacuucccuua

SEQ ID NO: 320661 - RNA, 19 nt, Homo sapiens
gggaacaacuucaguccaa

SEQ ID NO: 320662 - RNA, 19 nt, Homo sapiens
gcagagagccaguguuugu

SEQ ID NO: 320663 - RNA, 19 nt, Homo sapiens
uaaccagacugugacauuu

SEQ ID NO: 320664 - RNA, 19 nt, Homo sapiens
ggugauggcccuaaguuaa

SEQ ID NO: 320665 - RNA, 19 nt, Homo sapiens
gcaagaagugccaagauug

SEQ ID NO: 320666 - RNA, 19 nt, Homo sapiens
gggccagguucuccuauuu

SEQ ID NO: 320667 - RNA, 19 nt, Homo sapiens
gagaaugaauacugggaau

SEQ ID NO: 320668 - RNA, 19 nt, Homo sapiens
ggacuguggucugccauug

SEQ ID NO: 320669 - RNA, 19 nt, Homo sapiens
gaaaacagcccacugaugu

SEQ ID NO: 320670 - RNA, 19 nt, Homo sapiens
gaccaucauuuccaccauu

SEQ ID NO: 320671 - RNA, 19 nt, Homo sapiens
gaacuccuccuuccugcuu

SEQ ID NO: 320672 - RNA, 19 nt, Homo sapiens
gggaagaaaggcccaacua

SEQ ID NO: 320673 - RNA, 19 nt, Homo sapiens
gaaugaauacugggaauca

SEQ ID NO: 320674 - RNA, 19 nt, Homo sapiens
ccuagaacuucccuuaaga

SEQ ID NO: 320675 - RNA, 19 nt, Homo sapiens
caaugguggucgugugauu

SEQ ID NO: 320676 - RNA, 19 nt, Homo sapiens
uccaagggcugcaguucua

SEQ ID NO: 320677 - RNA, 19 nt, Homo sapiens
ggccuaggcuaccucaaga

SEQ ID NO: 320678 - RNA, 19 nt, Homo sapiens
gugaauuacugcuacaauc

SEQ ID NO: 320679 - RNA, 19 nt, Homo sapiens
ggagaugcuuuuccacuuu

SEQ ID NO: 320680 - RNA, 19 nt, Homo sapiens
ggagagguaucgcccugau

SEQ ID NO: 320681 - RNA, 19 nt, Homo sapiens
ccucaagacucaccucauc

SEQ ID NO: 320682 - RNA, 19 nt, Homo sapiens
gaaaagggaaggugacuga

SEQ ID NO: 320683 - RNA, 19 nt, Homo sapiens
ggagugaggagcccaggaa

SEQ ID NO: 320684 - RNA, 19 nt, Homo sapiens
gccauucacucuggagauu

SEQ ID NO: 320685 - RNA, 19 nt, Homo sapiens
gcagggacgacgggacuua

SEQ ID NO: 320686 - RNA, 19 nt, Homo sapiens
ccuaugcccuguuucucua

SEQ ID NO: 320687 - RNA, 19 nt, Homo sapiens
gggaagacgugcgcgaugu

SEQ ID NO: 320688 - RNA, 19 nt, Homo sapiens
gggcagaccacgcugauuc

SEQ ID NO: 320689 - RNA, 19 nt, Homo sapiens
caccgucacugaagacaga

SEQ ID NO: 320690 - RNA, 19 nt, Homo sapiens
caacggguguaucgguguu

SEQ ID NO: 320691 - RNA, 19 nt, Homo sapiens
gaauuacugcuacaaucaa

SEQ ID NO: 320692 - RNA, 19 nt, Homo sapiens
gcaagcaucggacuucaca

SEQ ID NO: 320693 - RNA, 19 nt, Homo sapiens
gcuccugggcugaacauuu

SEQ ID NO: 320694 - RNA, 19 nt, Homo sapiens
ccagcugccuuccaacuuc

SEQ ID NO: 320695 - RNA, 19 nt, Homo sapiens
ugacaagcccuaccucugu

SEQ ID NO: 320696 - RNA, 19 nt, Homo sapiens
cauccuuaccgcacauuua

SEQ ID NO: 320697 - RNA, 19 nt, Homo sapiens
ccacccauuuccaguguga

SEQ ID NO: 320698 - RNA, 19 nt, Homo sapiens
gaaacucgacgcguucuuc

SEQ ID NO: 320699 - RNA, 19 nt, Homo sapiens
cagaugcgauggcuacaag

SEQ ID NO: 320700 - RNA, 19 nt, Homo sapiens
caaggccacugcuacaucu

SEQ ID NO: 320701 - RNA, 19 nt, Homo sapiens
gccaguguuuguacaauca

SEQ ID NO: 320702 - RNA, 19 nt, Homo sapiens
agcaagaagugccaagauu

SEQ ID NO: 320703 - RNA, 19 nt, Homo sapiens
gcaccgacuuggagcucuu

SEQ ID NO: 320704 - RNA, 19 nt, Homo sapiens
uaguggagauggcuauuuc

SEQ ID NO: 320705 - RNA, 19 nt, Homo sapiens
uaggcuaccucaagacuca

SEQ ID NO: 320706 - RNA, 19 nt, Homo sapiens
gggcuacugugaccaugga

SEQ ID NO: 320707 - RNA, 19 nt, Homo sapiens
acuuggagcucuuugagaa

SEQ ID NO: 320708 - RNA, 19 nt, Homo sapiens
ggaagaaaggcccaacuac

SEQ ID NO: 320709 - RNA, 19 nt, Homo sapiens
ggucaaugcccacgccuau

SEQ ID NO: 320710 - RNA, 19 nt, Homo sapiens
ggauuagaaagaucacaaa

SEQ ID NO: 320711 - RNA, 19 nt, Homo sapiens
caaguggaacgaaucgauu

SEQ ID NO: 320712 - RNA, 19 nt, Homo sapiens
ggagcucuuuccuguguca

SEQ ID NO: 320713 - RNA, 19 nt, Homo sapiens
cuccugggcugaacauuug

SEQ ID NO: 320714 - RNA, 19 nt, Homo sapiens
gaucaucuucccagaguca

SEQ ID NO: 320715 - RNA, 19 nt, Homo sapiens
gcacacacacacacacaca

SEQ ID NO: 320716 - RNA, 19 nt, Homo sapiens
ucaaggagaaugaauacug

SEQ ID NO: 320717 - RNA, 19 nt, Homo sapiens
gcacauuuaaggcgccauu

SEQ ID NO: 320718 - RNA, 19 nt, Homo sapiens
gcucuuuccugugucagaa

SEQ ID NO: 320719 - RNA, 19 nt, Homo sapiens
caggccgagucuuggauua

SEQ ID NO: 320720 - RNA, 19 nt, Homo sapiens
guucuucggcaucuucuuu

SEQ ID NO: 320721 - RNA, 19 nt, Homo sapiens
gaagacgugcgcgauguga

SEQ ID NO: 320722 - RNA, 19 nt, Homo sapiens
ucauugacuuccugaacaa

SEQ ID NO: 320723 - RNA, 19 nt, Homo sapiens
agugugaccuguucccauu

SEQ ID NO: 320724 - RNA, 19 nt, Homo sapiens
agacucaccucauccuuac

SEQ ID NO: 320725 - RNA, 19 nt, Homo sapiens
ugaauuacugcuacaauca

SEQ ID NO: 320726 - RNA, 19 nt, Homo sapiens
aguccugcccugugaauua

SEQ ID NO: 320727 - RNA, 19 nt, Homo sapiens
ggccgagucuuggauuaga

SEQ ID NO: 320728 - RNA, 19 nt, Homo sapiens
gcagacacacccacagaag

SEQ ID NO: 320729 - RNA, 19 nt, Homo sapiens
gggaggccauaaagaucaa

SEQ ID NO: 320730 - RNA, 19 nt, Homo sapiens
ggagagaaaagggugauua

SEQ ID NO: 320731 - RNA, 19 nt, Homo sapiens
aagacucaccucauccuua

SEQ ID NO: 320732 - RNA, 19 nt, Homo sapiens
gugagcaccugagcaugaa

SEQ ID NO: 320733 - RNA, 19 nt, Homo sapiens
gagccaguguuuguacaau

SEQ ID NO: 320734 - RNA, 19 nt, Homo sapiens
gagagccaguguuuguaca

SEQ ID NO: 320735 - RNA, 19 nt, Homo sapiens
gcagcguccuuggcaguug

SEQ ID NO: 320736 - RNA, 19 nt, Homo sapiens
aaaugcuucugcacacaaa

SEQ ID NO: 320737 - RNA, 19 nt, Homo sapiens
cgacgggacuuacgauucc

SEQ ID NO: 320738 - RNA, 19 nt, Homo sapiens
ggaauacgagacguucuau

SEQ ID NO: 320739 - RNA, 19 nt, Homo sapiens
ugucaggauucuucaagga

SEQ ID NO: 320740 - RNA, 19 nt, Homo sapiens
acaacaccgucacugaaga

SEQ ID NO: 320741 - RNA, 19 nt, Homo sapiens
guccaacugucaaccuaga

SEQ ID NO: 320742 - RNA, 19 nt, Homo sapiens
acgccacccucaaucagua

SEQ ID NO: 320743 - RNA, 19 nt, Homo sapiens
gaacauuugaucuccaacu

SEQ ID NO: 320744 - RNA, 19 nt, Homo sapiens
cucaugggcuucucuagug

SEQ ID NO: 320745 - RNA, 19 nt, Homo sapiens
gcuccucucuccgugauuc

SEQ ID NO: 320746 - RNA, 19 nt, Homo sapiens
gaacaacuucaguccaacu

SEQ ID NO: 320747 - RNA, 19 nt, Homo sapiens
gcuccgaggaugccuguga

SEQ ID NO: 320748 - RNA, 19 nt, Homo sapiens
ccacaucaccaccuuggau

SEQ ID NO: 320749 - RNA, 19 nt, Homo sapiens
aaccaguccugcccuguga

SEQ ID NO: 320750 - RNA, 19 nt, Homo sapiens
gcccacccauuuccagugu

SEQ ID NO: 320751 - RNA, 19 nt, Homo sapiens
ucaguuacaccuucaaugg

SEQ ID NO: 320752 - RNA, 19 nt, Homo sapiens
agacacacccacagaagga

SEQ ID NO: 320753 - RNA, 19 nt, Homo sapiens
gccauaaagaucaaacaug

SEQ ID NO: 320754 - RNA, 19 nt, Homo sapiens
gguggaggcguucuuauac

SEQ ID NO: 320755 - RNA, 19 nt, Homo sapiens
gaacuucccuuaagaguca

SEQ ID NO: 320756 - RNA, 19 nt, Homo sapiens
ggaaugaccuggcagauca

SEQ ID NO: 320757 - RNA, 19 nt, Homo sapiens
gaacugcccucaacaucaa

SEQ ID NO: 320758 - RNA, 19 nt, Homo sapiens
caacauggccuuccucauu

SEQ ID NO: 320759 - RNA, 19 nt, Homo sapiens
caucaaagguguucagaau

SEQ ID NO: 320760 - RNA, 19 nt, Homo sapiens
gcacaggaauggcgucuuc

SEQ ID NO: 320761 - RNA, 19 nt, Homo sapiens
ccaagucgcuggagccauu

SEQ ID NO: 320762 - RNA, 19 nt, Homo sapiens
gggcuuacaucuccacaaa

SEQ ID NO: 320763 - RNA, 19 nt, Homo sapiens
caggagagcccaccacaua

SEQ ID NO: 320764 - RNA, 19 nt, Homo sapiens
ugagcacgcugaaggcuua

SEQ ID NO: 320765 - RNA, 19 nt, Homo sapiens
caaccuagaacuucccuua

SEQ ID NO: 320766 - RNA, 19 nt, Homo sapiens
gggaacaacuucaguccaa

SEQ ID NO: 320767 - RNA, 19 nt, Homo sapiens
gcaaaggccacacaacuug

SEQ ID NO: 320768 - RNA, 19 nt, Homo sapiens
gcagagagccaguguuugu

SEQ ID NO: 320769 - RNA, 19 nt, Homo sapiens
gaaggacaaucaccagcaa

SEQ ID NO: 320770 - RNA, 19 nt, Homo sapiens
aauaacagcuggacaggaa

SEQ ID NO: 320771 - RNA, 19 nt, Homo sapiens
uaaccagacugugacauuu

SEQ ID NO: 320772 - RNA, 19 nt, Homo sapiens
aaacagaacugcccucaac

SEQ ID NO: 320773 - RNA, 19 nt, Homo sapiens
ggacauaucagcuucaucu

SEQ ID NO: 320774 - RNA, 19 nt, Homo sapiens
gcacucgcccucagaaauu

SEQ ID NO: 320775 - RNA, 19 nt, Homo sapiens
ggugauggcccuaaguuaa

SEQ ID NO: 320776 - RNA, 19 nt, Homo sapiens
gcaagaagugccaagauug

SEQ ID NO: 320777 - RNA, 19 nt, Homo sapiens
ggagacaucacuaucugua

SEQ ID NO: 320778 - RNA, 19 nt, Homo sapiens
uaccucagcuuccacagua

SEQ ID NO: 320779 - RNA, 19 nt, Homo sapiens
gaccucagcagucucaaua

SEQ ID NO: 320780 - RNA, 19 nt, Homo sapiens
gaggacacauuaauaacug

SEQ ID NO: 320781 - RNA, 19 nt, Homo sapiens
gggccagguucuccuauuu

SEQ ID NO: 320782 - RNA, 19 nt, Homo sapiens
ggccaacucuguaguguca

SEQ ID NO: 320783 - RNA, 19 nt, Homo sapiens
ggaaacaucaggaaugaca

SEQ ID NO: 320784 - RNA, 19 nt, Homo sapiens
gaggagacaucacuaucug

SEQ ID NO: 320785 - RNA, 19 nt, Homo sapiens
gacaaucaccagcaacuuu

SEQ ID NO: 320786 - RNA, 19 nt, Homo sapiens
gacauucccuucuggugaa

SEQ ID NO: 320787 - RNA, 19 nt, Homo sapiens
cagaguaucucaaaucaac

SEQ ID NO: 320788 - RNA, 19 nt, Homo sapiens
gcaacuuucucaaggacuu

SEQ ID NO: 320789 - RNA, 19 nt, Homo sapiens
gcacggagaccaccagcaa

SEQ ID NO: 320790 - RNA, 19 nt, Homo sapiens
gagaaugaauacugggaau

SEQ ID NO: 320791 - RNA, 19 nt, Homo sapiens
ggacuguggucugccauug

SEQ ID NO: 320792 - RNA, 19 nt, Homo sapiens
gaaaacagcccacugaugu

SEQ ID NO: 320793 - RNA, 19 nt, Homo sapiens
ccacacaacuuggucacaa

SEQ ID NO: 320794 - RNA, 19 nt, Homo sapiens
ccaggugugucucaagaaa

SEQ ID NO: 320795 - RNA, 19 nt, Homo sapiens
acagaggacacauuaauaa

SEQ ID NO: 320796 - RNA, 19 nt, Homo sapiens
caacccaaguggaacaguu

SEQ ID NO: 320797 - RNA, 19 nt, Homo sapiens
gaccaucauuuccaccauu

SEQ ID NO: 320798 - RNA, 19 nt, Homo sapiens
caacggcaccaucaacaaa

SEQ ID NO: 320799 - RNA, 19 nt, Homo sapiens
ccacuucaacuccuucuuu

SEQ ID NO: 320800 - RNA, 19 nt, Homo sapiens
ccacagaggacacauuaau

SEQ ID NO: 320801 - RNA, 19 nt, Homo sapiens
ccacggcccucaucagcaa

SEQ ID NO: 320802 - RNA, 19 nt, Homo sapiens
gaacuccuccuuccugcuu

SEQ ID NO: 320803 - RNA, 19 nt, Homo sapiens
gggaagaaaggcccaacua

SEQ ID NO: 320804 - RNA, 19 nt, Homo sapiens
ccaguucucuaccuccaaa

SEQ ID NO: 320805 - RNA, 19 nt, Homo sapiens
ucaaagguguucagaaugc

SEQ ID NO: 320806 - RNA, 19 nt, Homo sapiens
gaaugaauacugggaauca

SEQ ID NO: 320807 - RNA, 19 nt, Homo sapiens
ccuagaacuucccuuaaga

SEQ ID NO: 320808 - RNA, 19 nt, Homo sapiens
caaugguggucgugugauu

SEQ ID NO: 320809 - RNA, 19 nt, Homo sapiens
uccaagggcugcaguucua

SEQ ID NO: 320810 - RNA, 19 nt, Homo sapiens
gcagaccacacaagaauca

SEQ ID NO: 320811 - RNA, 19 nt, Homo sapiens
ucacaccgguuacaacauc

SEQ ID NO: 320812 - RNA, 19 nt, Homo sapiens
ggccuaggcuaccucaaga

SEQ ID NO: 320813 - RNA, 19 nt, Homo sapiens
gugaauuacugcuacaauc

SEQ ID NO: 320814 - RNA, 19 nt, Homo sapiens
ggagaugcuuuuccacuuu

SEQ ID NO: 320815 - RNA, 19 nt, Homo sapiens
ggagagguaucgcccugau

SEQ ID NO: 320816 - RNA, 19 nt, Homo sapiens
uuccaaaguuucaaccaua

SEQ ID NO: 320817 - RNA, 19 nt, Homo sapiens
agacagcuccuccagauga

SEQ ID NO: 320818 - RNA, 19 nt, Homo sapiens
ccucaagacucaccucauc

SEQ ID NO: 320819 - RNA, 19 nt, Homo sapiens
cgacaagguuuucaucaaa

SEQ ID NO: 320820 - RNA, 19 nt, Homo sapiens
gaaggacaauggacaucag

SEQ ID NO: 320821 - RNA, 19 nt, Homo sapiens
ccucuaaggucucagcaau

SEQ ID NO: 320822 - RNA, 19 nt, Homo sapiens
aggugugucucaagaaaua

SEQ ID NO: 320823 - RNA, 19 nt, Homo sapiens
ccacaggacggccucauga

SEQ ID NO: 320824 - RNA, 19 nt, Homo sapiens
gaaccacagaggacacauu

SEQ ID NO: 320825 - RNA, 19 nt, Homo sapiens
agcaauacauuccugguaa

SEQ ID NO: 320826 - RNA, 19 nt, Homo sapiens
caacaacagcgacacuaga

SEQ ID NO: 320827 - RNA, 19 nt, Homo sapiens
gaaaagggaaggugacuga

SEQ ID NO: 320828 - RNA, 19 nt, Homo sapiens
ggagugaggagcccaggaa

SEQ ID NO: 320829 - RNA, 19 nt, Homo sapiens
gccauucacucuggagauu

SEQ ID NO: 320830 - RNA, 19 nt, Homo sapiens
gcagggacgacgggacuua

SEQ ID NO: 320831 - RNA, 19 nt, Homo sapiens
ccuaugcccuguuucucua

SEQ ID NO: 320832 - RNA, 19 nt, Homo sapiens
caccauaagugcagcaaca

SEQ ID NO: 320833 - RNA, 19 nt, Homo sapiens
ggaaccauuucugcaauca

SEQ ID NO: 320834 - RNA, 19 nt, Homo sapiens
ggauucaacccaaguggaa

SEQ ID NO: 320835 - RNA, 19 nt, Homo sapiens
cacagaggacacauuaaua

SEQ ID NO: 320836 - RNA, 19 nt, Homo sapiens
gggaagacgugcgcgaugu

SEQ ID NO: 320837 - RNA, 19 nt, Homo sapiens
gggcagaccacgcugauuc

SEQ ID NO: 320838 - RNA, 19 nt, Homo sapiens
caccgucacugaagacaga

SEQ ID NO: 320839 - RNA, 19 nt, Homo sapiens
cagugugacucagaugaua

SEQ ID NO: 320840 - RNA, 19 nt, Homo sapiens
ucagagaagauaacaguga

SEQ ID NO: 320841 - RNA, 19 nt, Homo sapiens
gaauuacugcuacaaucaa

SEQ ID NO: 320842 - RNA, 19 nt, Homo sapiens
gcaagcaucggacuucaca

SEQ ID NO: 320843 - RNA, 19 nt, Homo sapiens
caacaggugcugccacuag

SEQ ID NO: 320844 - RNA, 19 nt, Homo sapiens
caacggguguaucgguguu

SEQ ID NO: 320845 - RNA, 19 nt, Homo sapiens
gcuccugggcugaacauuu

SEQ ID NO: 320846 - RNA, 19 nt, Homo sapiens
ccagcugccuuccaacuuc

SEQ ID NO: 320847 - RNA, 19 nt, Homo sapiens
ugacaagcccuaccucugu

SEQ ID NO: 320848 - RNA, 19 nt, Homo sapiens
caggagagacgacaagguu

SEQ ID NO: 320849 - RNA, 19 nt, Homo sapiens
ucaggaggcacgucacuuu

SEQ ID NO: 320850 - RNA, 19 nt, Homo sapiens
ggacgcacccaccauaagu

SEQ ID NO: 320851 - RNA, 19 nt, Homo sapiens
cauccuuaccgcacauuua

SEQ ID NO: 320852 - RNA, 19 nt, Homo sapiens
gaaacucgacgcguucuuc

SEQ ID NO: 320853 - RNA, 19 nt, Homo sapiens
cagaugcgauggcuacaag

SEQ ID NO: 320854 - RNA, 19 nt, Homo sapiens
ccacccauuuccaguguga

SEQ ID NO: 320855 - RNA, 19 nt, Homo sapiens
gaacuucccuuaagaguca

SEQ ID NO: 320856 - RNA, 19 nt, Homo sapiens
ggaaugaccuggcagauca

SEQ ID NO: 320857 - RNA, 19 nt, Homo sapiens
ggagauggcuauuucgaaa

SEQ ID NO: 320858 - RNA, 19 nt, Homo sapiens
ccaagucgcuggagccauu

SEQ ID NO: 320859 - RNA, 19 nt, Homo sapiens
ugagcacgcugaaggcuua

SEQ ID NO: 320860 - RNA, 19 nt, Homo sapiens
caaccuagaacuucccuua

SEQ ID NO: 320861 - RNA, 19 nt, Homo sapiens
gggaacaacuucaguccaa

SEQ ID NO: 320862 - RNA, 19 nt, Homo sapiens
gcagagagccaguguuugu

SEQ ID NO: 320863 - RNA, 19 nt, Homo sapiens
uaaccagacugugacauuu

SEQ ID NO: 320864 - RNA, 19 nt, Homo sapiens
ggugauggcccuaaguuaa

SEQ ID NO: 320865 - RNA, 19 nt, Homo sapiens
gcaagaagugccaagauug

SEQ ID NO: 320866 - RNA, 19 nt, Homo sapiens
gggccagguucuccuauuu

SEQ ID NO: 320867 - RNA, 19 nt, Homo sapiens
gagaaugaauacugggaau

SEQ ID NO: 320868 - RNA, 19 nt, Homo sapiens
ggacuguggucugccauug

SEQ ID NO: 320869 - RNA, 19 nt, Homo sapiens
gaaaacagcccacugaugu

SEQ ID NO: 320870 - RNA, 19 nt, Homo sapiens
gaacuccuccuuccugcuu

SEQ ID NO: 320871 - RNA, 19 nt, Homo sapiens
gggaagaaaggcccaacua

SEQ ID NO: 320872 - RNA, 19 nt, Homo sapiens
gaaugaauacugggaauca

SEQ ID NO: 320873 - RNA, 19 nt, Homo sapiens
ccuagaacuucccuuaaga

SEQ ID NO: 320874 - RNA, 19 nt, Homo sapiens
caaugguggucgugugauu

SEQ ID NO: 320875 - RNA, 19 nt, Homo sapiens
uccaagggcugcaguucua

SEQ ID NO: 320876 - RNA, 19 nt, Homo sapiens
ggccuaggcuaccucaaga

SEQ ID NO: 320877 - RNA, 19 nt, Homo sapiens
gugaauuacugcuacaauc

SEQ ID NO: 320878 - RNA, 19 nt, Homo sapiens
ggagaugcuuuuccacuuu

SEQ ID NO: 320879 - RNA, 19 nt, Homo sapiens
ggagagguaucgcccugau

SEQ ID NO: 320880 - RNA, 19 nt, Homo sapiens
ccucaagacucaccucauc

SEQ ID NO: 320881 - RNA, 19 nt, Homo sapiens
gaaaagggaaggugacuga

SEQ ID NO: 320882 - RNA, 19 nt, Homo sapiens
ggagugaggagcccaggaa

SEQ ID NO: 320883 - RNA, 19 nt, Homo sapiens
gccauucacucuggagauu

SEQ ID NO: 320884 - RNA, 19 nt, Homo sapiens
gcagggacgacgggacuua

SEQ ID NO: 320885 - RNA, 19 nt, Homo sapiens
ccuaugcccuguuucucua

SEQ ID NO: 320886 - RNA, 19 nt, Homo sapiens
gggaagacgugcgcgaugu

SEQ ID NO: 320887 - RNA, 19 nt, Homo sapiens
gggcagaccacgcugauuc

SEQ ID NO: 320888 - RNA, 19 nt, Homo sapiens
gaauuacugcuacaaucaa

SEQ ID NO: 320889 - RNA, 19 nt, Homo sapiens
caacggguguaucgguguu

SEQ ID NO: 320890 - RNA, 19 nt, Homo sapiens
gcaagcaucggacuucaca

SEQ ID NO: 320891 - RNA, 19 nt, Homo sapiens
gcuccugggcugaacauuu

SEQ ID NO: 320892 - RNA, 19 nt, Homo sapiens
ccagcugccuuccaacuuc

SEQ ID NO: 320893 - RNA, 19 nt, Homo sapiens
ugacaagcccuaccucugu

SEQ ID NO: 320894 - RNA, 19 nt, Homo sapiens
cauccuuaccgcacauuua

SEQ ID NO: 320895 - RNA, 19 nt, Homo sapiens
ccacccauuuccaguguga

SEQ ID NO: 320896 - RNA, 19 nt, Homo sapiens
gaaacucgacgcguucuuc

SEQ ID NO: 320897 - RNA, 19 nt, Homo sapiens
cagaugcgauggcuacaag

SEQ ID NO: 320898 - RNA, 19 nt, Homo sapiens
caaggccacugcuacaucu

SEQ ID NO: 320899 - RNA, 19 nt, Homo sapiens
gccaguguuuguacaauca

SEQ ID NO: 320900 - RNA, 19 nt, Homo sapiens
agcaagaagugccaagauu

SEQ ID NO: 320901 - RNA, 19 nt, Homo sapiens
gcaccgacuuggagcucuu

SEQ ID NO: 320902 - RNA, 19 nt, Homo sapiens
uaguggagauggcuauuuc

SEQ ID NO: 320903 - RNA, 19 nt, Homo sapiens
uaggcuaccucaagacuca

SEQ ID NO: 320904 - RNA, 19 nt, Homo sapiens
gggcuacugugaccaugga

SEQ ID NO: 320905 - RNA, 19 nt, Homo sapiens
acuuggagcucuuugagaa

SEQ ID NO: 320906 - RNA, 19 nt, Homo sapiens
ggaagaaaggcccaacuac

SEQ ID NO: 320907 - RNA, 19 nt, Homo sapiens
ggucaaugcccacgccuau

SEQ ID NO: 320908 - RNA, 19 nt, Homo sapiens
ggauuagaaagaucacaaa

SEQ ID NO: 320909 - RNA, 19 nt, Homo sapiens
caaguggaacgaaucgauu

SEQ ID NO: 320910 - RNA, 19 nt, Homo sapiens
ggagcucuuuccuguguca

SEQ ID NO: 320911 - RNA, 19 nt, Homo sapiens
cuccugggcugaacauuug

SEQ ID NO: 320912 - RNA, 19 nt, Homo sapiens
gaucaucuucccagaguca

SEQ ID NO: 320913 - RNA, 19 nt, Homo sapiens
gcacacacacacacacaca

SEQ ID NO: 320914 - RNA, 19 nt, Homo sapiens
ucaaggagaaugaauacug

SEQ ID NO: 320915 - RNA, 19 nt, Homo sapiens
gcacauuuaaggcgccauu

SEQ ID NO: 320916 - RNA, 19 nt, Homo sapiens
gcucuuuccugugucagaa

SEQ ID NO: 320917 - RNA, 19 nt, Homo sapiens
caggccgagucuuggauua

SEQ ID NO: 320918 - RNA, 19 nt, Homo sapiens
guucuucggcaucuucuuu

SEQ ID NO: 320919 - RNA, 19 nt, Homo sapiens
gaagacgugcgcgauguga

SEQ ID NO: 320920 - RNA, 19 nt, Homo sapiens
ucauugacuuccugaacaa

SEQ ID NO: 320921 - RNA, 19 nt, Homo sapiens
agugugaccuguucccauu

SEQ ID NO: 320922 - RNA, 19 nt, Homo sapiens
agacucaccucauccuuac

SEQ ID NO: 320923 - RNA, 19 nt, Homo sapiens
ugaauuacugcuacaauca

SEQ ID NO: 320924 - RNA, 19 nt, Homo sapiens
aguccugcccugugaauua

SEQ ID NO: 320925 - RNA, 19 nt, Homo sapiens
ggccgagucuuggauuaga

SEQ ID NO: 320926 - RNA, 19 nt, Homo sapiens
gcagacacacccacagaag

SEQ ID NO: 320927 - RNA, 19 nt, Homo sapiens
gggaggccauaaagaucaa

SEQ ID NO: 320928 - RNA, 19 nt, Homo sapiens
aagacucaccucauccuua

SEQ ID NO: 320929 - RNA, 19 nt, Homo sapiens
ggagagaaaagggugauua

SEQ ID NO: 320930 - RNA, 19 nt, Homo sapiens
gugagcaccugagcaugaa

SEQ ID NO: 320931 - RNA, 19 nt, Homo sapiens
gagccaguguuuguacaau

SEQ ID NO: 320932 - RNA, 19 nt, Homo sapiens
gagagccaguguuuguaca

SEQ ID NO: 320933 - RNA, 19 nt, Homo sapiens
gcagcguccuuggcaguug

SEQ ID NO: 320934 - RNA, 19 nt, Homo sapiens
aaaugcuucugcacacaaa

SEQ ID NO: 320935 - RNA, 19 nt, Homo sapiens
cgacgggacuuacgauucc

SEQ ID NO: 320936 - RNA, 19 nt, Homo sapiens
ggaauacgagacguucuau

SEQ ID NO: 320937 - RNA, 19 nt, Homo sapiens
ugucaggauucuucaagga

SEQ ID NO: 320938 - RNA, 19 nt, Homo sapiens
guccaacugucaaccuaga

SEQ ID NO: 320939 - RNA, 19 nt, Homo sapiens
acgccacccucaaucagua

SEQ ID NO: 320940 - RNA, 19 nt, Homo sapiens
gaacauuugaucuccaacu

SEQ ID NO: 320941 - RNA, 19 nt, Homo sapiens
cucaugggcuucucuagug

SEQ ID NO: 320942 - RNA, 19 nt, Homo sapiens
gcuccucucuccgugauuc

SEQ ID NO: 320943 - RNA, 19 nt, Homo sapiens
gaacaacuucaguccaacu

SEQ ID NO: 320944 - RNA, 19 nt, Homo sapiens
gcuccgaggaugccuguga

SEQ ID NO: 320945 - RNA, 19 nt, Homo sapiens
ccacaucaccaccuuggau

SEQ ID NO: 320946 - RNA, 19 nt, Homo sapiens
aaccaguccugcccuguga

SEQ ID NO: 320947 - RNA, 19 nt, Homo sapiens
gcccacccauuuccagugu

SEQ ID NO: 320948 - RNA, 19 nt, Homo sapiens
ucaguuacaccuucaaugg

SEQ ID NO: 320949 - RNA, 19 nt, Homo sapiens
cccaggaguuucccucuuc

SEQ ID NO: 320950 - RNA, 19 nt, Homo sapiens
agacacacccacagaagga

SEQ ID NO: 320951 - RNA, 19 nt, Homo sapiens
gccauaaagaucaaacaug

SEQ ID NO: 320952 - RNA, 19 nt, Homo sapiens
gguggaggcguucuuauac

SEQ ID NO: 320953 - RNA, 19 nt, Homo sapiens
ggugguggaggcguucuua

SEQ ID NO: 320954 - RNA, 19 nt, Homo sapiens
gaacgccacccucaaucag

SEQ ID NO: 320955 - RNA, 19 nt, Homo sapiens
gaacuucccuuaagaguca

SEQ ID NO: 320956 - RNA, 19 nt, Homo sapiens
ggaaugaccuggcagauca

SEQ ID NO: 320957 - RNA, 19 nt, Homo sapiens
gaacugcccucaacaucaa

SEQ ID NO: 320958 - RNA, 19 nt, Homo sapiens
caacauggccuuccucauu

SEQ ID NO: 320959 - RNA, 19 nt, Homo sapiens
caucaaagguguucagaau

SEQ ID NO: 320960 - RNA, 19 nt, Homo sapiens
gcacaggaauggcgucuuc

SEQ ID NO: 320961 - RNA, 19 nt, Homo sapiens
ccaagucgcuggagccauu

SEQ ID NO: 320962 - RNA, 19 nt, Homo sapiens
gggcuuacaucuccacaaa

SEQ ID NO: 320963 - RNA, 19 nt, Homo sapiens
caggagagcccaccacaua

SEQ ID NO: 320964 - RNA, 19 nt, Homo sapiens
ugagcacgcugaaggcuua

SEQ ID NO: 320965 - RNA, 19 nt, Homo sapiens
caaccuagaacuucccuua

SEQ ID NO: 320966 - RNA, 19 nt, Homo sapiens
gggaacaacuucaguccaa

SEQ ID NO: 320967 - RNA, 19 nt, Homo sapiens
gcaaaggccacacaacuug

SEQ ID NO: 320968 - RNA, 19 nt, Homo sapiens
gcagagagccaguguuugu

SEQ ID NO: 320969 - RNA, 19 nt, Homo sapiens
gaaggacaaucaccagcaa

SEQ ID NO: 320970 - RNA, 19 nt, Homo sapiens
aauaacagcuggacaggaa

SEQ ID NO: 320971 - RNA, 19 nt, Homo sapiens
uaaccagacugugacauuu

SEQ ID NO: 320972 - RNA, 19 nt, Homo sapiens
aaacagaacugcccucaac

SEQ ID NO: 320973 - RNA, 19 nt, Homo sapiens
ggacauaucagcuucaucu

SEQ ID NO: 320974 - RNA, 19 nt, Homo sapiens
gcacucgcccucagaaauu

SEQ ID NO: 320975 - RNA, 19 nt, Homo sapiens
ggugauggcccuaaguuaa

SEQ ID NO: 320976 - RNA, 19 nt, Homo sapiens
gcaagaagugccaagauug

SEQ ID NO: 320977 - RNA, 19 nt, Homo sapiens
ggagacaucacuaucugua

SEQ ID NO: 320978 - RNA, 19 nt, Homo sapiens
uaccucagcuuccacagua

SEQ ID NO: 320979 - RNA, 19 nt, Homo sapiens
gaccucagcagucucaaua

SEQ ID NO: 320980 - RNA, 19 nt, Homo sapiens
gaggacacauuaauaacug

SEQ ID NO: 320981 - RNA, 19 nt, Homo sapiens
gggccagguucuccuauuu

SEQ ID NO: 320982 - RNA, 19 nt, Homo sapiens
ggccaacucuguaguguca

SEQ ID NO: 320983 - RNA, 19 nt, Homo sapiens
ggaaacaucaggaaugaca

SEQ ID NO: 320984 - RNA, 19 nt, Homo sapiens
gaggagacaucacuaucug

SEQ ID NO: 320985 - RNA, 19 nt, Homo sapiens
gacaaucaccagcaacuuu

SEQ ID NO: 320986 - RNA, 19 nt, Homo sapiens
gacauucccuucuggugaa

SEQ ID NO: 320987 - RNA, 19 nt, Homo sapiens
cagaguaucucaaaucaac

SEQ ID NO: 320988 - RNA, 19 nt, Homo sapiens
gcaacuuucucaaggacuu

SEQ ID NO: 320989 - RNA, 19 nt, Homo sapiens
gcacggagaccaccagcaa

SEQ ID NO: 320990 - RNA, 19 nt, Homo sapiens
gagaaugaauacugggaau

SEQ ID NO: 320991 - RNA, 19 nt, Homo sapiens
ggacuguggucugccauug

SEQ ID NO: 320992 - RNA, 19 nt, Homo sapiens
gaaaacagcccacugaugu

SEQ ID NO: 320993 - RNA, 19 nt, Homo sapiens
ccacacaacuuggucacaa

SEQ ID NO: 320994 - RNA, 19 nt, Homo sapiens
ccaggugugucucaagaaa

SEQ ID NO: 320995 - RNA, 19 nt, Homo sapiens
acagaggacacauuaauaa

SEQ ID NO: 320996 - RNA, 19 nt, Homo sapiens
caacccaaguggaacaguu

SEQ ID NO: 320997 - RNA, 19 nt, Homo sapiens
gaccaucauuuccaccauu

SEQ ID NO: 320998 - RNA, 19 nt, Homo sapiens
caacggcaccaucaacaaa

SEQ ID NO: 320999 - RNA, 19 nt, Homo sapiens
ccacuucaacuccuucuuu

SEQ ID NO: 321000 - RNA, 19 nt, Homo sapiens
ccacagaggacacauuaau

SEQ ID NO: 321001 - RNA, 19 nt, Homo sapiens
ccacggcccucaucagcaa

SEQ ID NO: 321002 - RNA, 19 nt, Homo sapiens
gaacuccuccuuccugcuu

SEQ ID NO: 321003 - RNA, 19 nt, Homo sapiens
gggaagaaaggcccaacua

SEQ ID NO: 321004 - RNA, 19 nt, Homo sapiens
ccaguucucuaccuccaaa

SEQ ID NO: 321005 - RNA, 19 nt, Homo sapiens
ucaaagguguucagaaugc

SEQ ID NO: 321006 - RNA, 19 nt, Homo sapiens
gaaugaauacugggaauca

SEQ ID NO: 321007 - RNA, 19 nt, Homo sapiens
ccuagaacuucccuuaaga

SEQ ID NO: 321008 - RNA, 19 nt, Homo sapiens
caaugguggucgugugauu

SEQ ID NO: 321009 - RNA, 19 nt, Homo sapiens
uccaagggcugcaguucua

SEQ ID NO: 321010 - RNA, 19 nt, Homo sapiens
gcagaccacacaagaauca

SEQ ID NO: 321011 - RNA, 19 nt, Homo sapiens
ucacaccgguuacaacauc

SEQ ID NO: 321012 - RNA, 19 nt, Homo sapiens
ggccuaggcuaccucaaga

SEQ ID NO: 321013 - RNA, 19 nt, Homo sapiens
gugaauuacugcuacaauc

SEQ ID NO: 321014 - RNA, 19 nt, Homo sapiens
ggagaugcuuuuccacuuu

SEQ ID NO: 321015 - RNA, 19 nt, Homo sapiens
ggagagguaucgcccugau

SEQ ID NO: 321016 - RNA, 19 nt, Homo sapiens
uuccaaaguuucaaccaua

SEQ ID NO: 321017 - RNA, 19 nt, Homo sapiens
agacagcuccuccagauga

SEQ ID NO: 321018 - RNA, 19 nt, Homo sapiens
ccucaagacucaccucauc

SEQ ID NO: 321019 - RNA, 19 nt, Homo sapiens
cgacaagguuuucaucaaa

SEQ ID NO: 321020 - RNA, 19 nt, Homo sapiens
gaaggacaauggacaucag

SEQ ID NO: 321021 - RNA, 19 nt, Homo sapiens
ccucuaaggucucagcaau

SEQ ID NO: 321022 - RNA, 19 nt, Homo sapiens
aggugugucucaagaaaua

SEQ ID NO: 321023 - RNA, 19 nt, Homo sapiens
ccacaggacggccucauga

SEQ ID NO: 321024 - RNA, 19 nt, Homo sapiens
gaaccacagaggacacauu

SEQ ID NO: 321025 - RNA, 19 nt, Homo sapiens
agcaauacauuccugguaa

SEQ ID NO: 321026 - RNA, 19 nt, Homo sapiens
caacaacagcgacacuaga

SEQ ID NO: 321027 - RNA, 19 nt, Homo sapiens
gaaaagggaaggugacuga

SEQ ID NO: 321028 - RNA, 19 nt, Homo sapiens
ggagugaggagcccaggaa

SEQ ID NO: 321029 - RNA, 19 nt, Homo sapiens
gccauucacucuggagauu

SEQ ID NO: 321030 - RNA, 19 nt, Homo sapiens
gcagggacgacgggacuua

SEQ ID NO: 321031 - RNA, 19 nt, Homo sapiens
ccuaugcccuguuucucua

SEQ ID NO: 321032 - RNA, 19 nt, Homo sapiens
caccauaagugcagcaaca

SEQ ID NO: 321033 - RNA, 19 nt, Homo sapiens
ggaaccauuucugcaauca

SEQ ID NO: 321034 - RNA, 19 nt, Homo sapiens
ggauucaacccaaguggaa

SEQ ID NO: 321035 - RNA, 19 nt, Homo sapiens
cacagaggacacauuaaua

SEQ ID NO: 321036 - RNA, 19 nt, Homo sapiens
gggaagacgugcgcgaugu

SEQ ID NO: 321037 - RNA, 19 nt, Homo sapiens
gggcagaccacgcugauuc

SEQ ID NO: 321038 - RNA, 19 nt, Homo sapiens
caccgucacugaagacaga

SEQ ID NO: 321039 - RNA, 19 nt, Homo sapiens
cagugugacucagaugaua

SEQ ID NO: 321040 - RNA, 19 nt, Homo sapiens
ucagagaagauaacaguga

SEQ ID NO: 321041 - RNA, 19 nt, Homo sapiens
gaauuacugcuacaaucaa

SEQ ID NO: 321042 - RNA, 19 nt, Homo sapiens
gcaagcaucggacuucaca

SEQ ID NO: 321043 - RNA, 19 nt, Homo sapiens
caacaggugcugccacuag

SEQ ID NO: 321044 - RNA, 19 nt, Homo sapiens
caacggguguaucgguguu

SEQ ID NO: 321045 - RNA, 19 nt, Homo sapiens
gcuccugggcugaacauuu

SEQ ID NO: 321046 - RNA, 19 nt, Homo sapiens
ccagcugccuuccaacuuc

SEQ ID NO: 321047 - RNA, 19 nt, Homo sapiens
ugacaagcccuaccucugu

SEQ ID NO: 321048 - RNA, 19 nt, Homo sapiens
caggagagacgacaagguu

SEQ ID NO: 321049 - RNA, 19 nt, Homo sapiens
ucaggaggcacgucacuuu

SEQ ID NO: 321050 - RNA, 19 nt, Homo sapiens
ggacgcacccaccauaagu

SEQ ID NO: 321051 - RNA, 19 nt, Homo sapiens
cauccuuaccgcacauuua

SEQ ID NO: 321052 - RNA, 19 nt, Homo sapiens
gaaacucgacgcguucuuc

SEQ ID NO: 321053 - RNA, 19 nt, Homo sapiens
cagaugcgauggcuacaag

SEQ ID NO: 321054 - RNA, 19 nt, Homo sapiens
ccacccauuuccaguguga

SEQ ID NO: 321055 - RNA, 19 nt, Homo sapiens
gaacuucccuuaagaguca

SEQ ID NO: 321056 - RNA, 19 nt, Homo sapiens
ggaaugaccuggcagauca

SEQ ID NO: 321057 - RNA, 19 nt, Homo sapiens
gaacugcccucaacaucaa

SEQ ID NO: 321058 - RNA, 19 nt, Homo sapiens
caacauggccuuccucauu

SEQ ID NO: 321059 - RNA, 19 nt, Homo sapiens
caucaaagguguucagaau

SEQ ID NO: 321060 - RNA, 19 nt, Homo sapiens
gcacaggaauggcgucuuc

SEQ ID NO: 321061 - RNA, 19 nt, Homo sapiens
ccaagucgcuggagccauu

SEQ ID NO: 321062 - RNA, 19 nt, Homo sapiens
gggcuuacaucuccacaaa

SEQ ID NO: 321063 - RNA, 19 nt, Homo sapiens
caggagagcccaccacaua

SEQ ID NO: 321064 - RNA, 19 nt, Homo sapiens
ugagcacgcugaaggcuua

SEQ ID NO: 321065 - RNA, 19 nt, Homo sapiens
caaccuagaacuucccuua

SEQ ID NO: 321066 - RNA, 19 nt, Homo sapiens
gggaacaacuucaguccaa

SEQ ID NO: 321067 - RNA, 19 nt, Homo sapiens
gcaaaggccacacaacuug

SEQ ID NO: 321068 - RNA, 19 nt, Homo sapiens
gcagagagccaguguuugu

SEQ ID NO: 321069 - RNA, 19 nt, Homo sapiens
gaaggacaaucaccagcaa

SEQ ID NO: 321070 - RNA, 19 nt, Homo sapiens
aauaacagcuggacaggaa

SEQ ID NO: 321071 - RNA, 19 nt, Homo sapiens
uaaccagacugugacauuu

SEQ ID NO: 321072 - RNA, 19 nt, Homo sapiens
aaacagaacugcccucaac

SEQ ID NO: 321073 - RNA, 19 nt, Homo sapiens
ggacauaucagcuucaucu

SEQ ID NO: 321074 - RNA, 19 nt, Homo sapiens
gcacucgcccucagaaauu

SEQ ID NO: 321075 - RNA, 19 nt, Homo sapiens
ggugauggcccuaaguuaa

SEQ ID NO: 321076 - RNA, 19 nt, Homo sapiens
gcaagaagugccaagauug

SEQ ID NO: 321077 - RNA, 19 nt, Homo sapiens
ggagacaucacuaucugua

SEQ ID NO: 321078 - RNA, 19 nt, Homo sapiens
uaccucagcuuccacagua

SEQ ID NO: 321079 - RNA, 19 nt, Homo sapiens
gaccucagcagucucaaua

SEQ ID NO: 321080 - RNA, 19 nt, Homo sapiens
gaggacacauuaauaacug

SEQ ID NO: 321081 - RNA, 19 nt, Homo sapiens
gggccagguucuccuauuu

SEQ ID NO: 321082 - RNA, 19 nt, Homo sapiens
ggccaacucuguaguguca

SEQ ID NO: 321083 - RNA, 19 nt, Homo sapiens
ggaaacaucaggaaugaca

SEQ ID NO: 321084 - RNA, 19 nt, Homo sapiens
gaggagacaucacuaucug

SEQ ID NO: 321085 - RNA, 19 nt, Homo sapiens
gacaaucaccagcaacuuu

SEQ ID NO: 321086 - RNA, 19 nt, Homo sapiens
gacauucccuucuggugaa

SEQ ID NO: 321087 - RNA, 19 nt, Homo sapiens
cagaguaucucaaaucaac

SEQ ID NO: 321088 - RNA, 19 nt, Homo sapiens
gcaacuuucucaaggacuu

SEQ ID NO: 321089 - RNA, 19 nt, Homo sapiens
gcacggagaccaccagcaa

SEQ ID NO: 321090 - RNA, 19 nt, Homo sapiens
gagaaugaauacugggaau

SEQ ID NO: 321091 - RNA, 19 nt, Homo sapiens
ggacuguggucugccauug

SEQ ID NO: 321092 - RNA, 19 nt, Homo sapiens
gaaaacagcccacugaugu

SEQ ID NO: 321093 - RNA, 19 nt, Homo sapiens
ccacacaacuuggucacaa

SEQ ID NO: 321094 - RNA, 19 nt, Homo sapiens
ccaggugugucucaagaaa

SEQ ID NO: 321095 - RNA, 19 nt, Homo sapiens
acagaggacacauuaauaa

SEQ ID NO: 321096 - RNA, 19 nt, Homo sapiens
caacccaaguggaacaguu

SEQ ID NO: 321097 - RNA, 19 nt, Homo sapiens
gaccaucauuuccaccauu

SEQ ID NO: 321098 - RNA, 19 nt, Homo sapiens
caacggcaccaucaacaaa

SEQ ID NO: 321099 - RNA, 19 nt, Homo sapiens
ccacuucaacuccuucuuu

SEQ ID NO: 321100 - RNA, 19 nt, Homo sapiens
ccacagaggacacauuaau

SEQ ID NO: 321101 - RNA, 19 nt, Homo sapiens
ccacggcccucaucagcaa

SEQ ID NO: 321102 - RNA, 19 nt, Homo sapiens
gaacuccuccuuccugcuu

SEQ ID NO: 321103 - RNA, 19 nt, Homo sapiens
gggaagaaaggcccaacua

SEQ ID NO: 321104 - RNA, 19 nt, Homo sapiens
ccaguucucuaccuccaaa

SEQ ID NO: 321105 - RNA, 19 nt, Homo sapiens
ucaaagguguucagaaugc

SEQ ID NO: 321106 - RNA, 19 nt, Homo sapiens
gaaugaauacugggaauca

SEQ ID NO: 321107 - RNA, 19 nt, Homo sapiens
ccuagaacuucccuuaaga

SEQ ID NO: 321108 - RNA, 19 nt, Homo sapiens
caaugguggucgugugauu

SEQ ID NO: 321109 - RNA, 19 nt, Homo sapiens
uccaagggcugcaguucua

SEQ ID NO: 321110 - RNA, 19 nt, Homo sapiens
gcagaccacacaagaauca

SEQ ID NO: 321111 - RNA, 19 nt, Homo sapiens
ucacaccgguuacaacauc

SEQ ID NO: 321112 - RNA, 19 nt, Homo sapiens
ggccuaggcuaccucaaga

SEQ ID NO: 321113 - RNA, 19 nt, Homo sapiens
gugaauuacugcuacaauc

SEQ ID NO: 321114 - RNA, 19 nt, Homo sapiens
ggagaugcuuuuccacuuu

SEQ ID NO: 321115 - RNA, 19 nt, Homo sapiens
ggagagguaucgcccugau

SEQ ID NO: 321116 - RNA, 19 nt, Homo sapiens
uuccaaaguuucaaccaua

SEQ ID NO: 321117 - RNA, 19 nt, Homo sapiens
agacagcuccuccagauga

SEQ ID NO: 321118 - RNA, 19 nt, Homo sapiens
ccucaagacucaccucauc

SEQ ID NO: 321119 - RNA, 19 nt, Homo sapiens
cgacaagguuuucaucaaa

SEQ ID NO: 321120 - RNA, 19 nt, Homo sapiens
gaaggacaauggacaucag

SEQ ID NO: 321121 - RNA, 19 nt, Homo sapiens
ccucuaaggucucagcaau

SEQ ID NO: 321122 - RNA, 19 nt, Homo sapiens
aggugugucucaagaaaua

SEQ ID NO: 321123 - RNA, 19 nt, Homo sapiens
ccacaggacggccucauga

SEQ ID NO: 321124 - RNA, 19 nt, Homo sapiens
gaaccacagaggacacauu

SEQ ID NO: 321125 - RNA, 19 nt, Homo sapiens
agcaauacauuccugguaa

SEQ ID NO: 321126 - RNA, 19 nt, Homo sapiens
caacaacagcgacacuaga

SEQ ID NO: 321127 - RNA, 19 nt, Homo sapiens
gaaaagggaaggugacuga

SEQ ID NO: 321128 - RNA, 19 nt, Homo sapiens
ggagugaggagcccaggaa

SEQ ID NO: 321129 - RNA, 19 nt, Homo sapiens
gccauucacucuggagauu

SEQ ID NO: 321130 - RNA, 19 nt, Homo sapiens
gcagggacgacgggacuua

SEQ ID NO: 321131 - RNA, 19 nt, Homo sapiens
ccuaugcccuguuucucua

SEQ ID NO: 321132 - RNA, 19 nt, Homo sapiens
caccauaagugcagcaaca

SEQ ID NO: 321133 - RNA, 19 nt, Homo sapiens
ggaaccauuucugcaauca

SEQ ID NO: 321134 - RNA, 19 nt, Homo sapiens
ggauucaacccaaguggaa

SEQ ID NO: 321135 - RNA, 19 nt, Homo sapiens
cacagaggacacauuaaua

SEQ ID NO: 321136 - RNA, 19 nt, Homo sapiens
gggaagacgugcgcgaugu

SEQ ID NO: 321137 - RNA, 19 nt, Homo sapiens
gggcagaccacgcugauuc

SEQ ID NO: 321138 - RNA, 19 nt, Homo sapiens
caccgucacugaagacaga

SEQ ID NO: 321139 - RNA, 19 nt, Homo sapiens
cagugugacucagaugaua

SEQ ID NO: 321140 - RNA, 19 nt, Homo sapiens
ucagagaagauaacaguga

SEQ ID NO: 321141 - RNA, 19 nt, Homo sapiens
gaauuacugcuacaaucaa

SEQ ID NO: 321142 - RNA, 19 nt, Homo sapiens
gcaagcaucggacuucaca

SEQ ID NO: 321143 - RNA, 19 nt, Homo sapiens
caacaggugcugccacuag

SEQ ID NO: 321144 - RNA, 19 nt, Homo sapiens
caacggguguaucgguguu

SEQ ID NO: 321145 - RNA, 19 nt, Homo sapiens
gcuccugggcugaacauuu

SEQ ID NO: 321146 - RNA, 19 nt, Homo sapiens
ccagcugccuuccaacuuc

SEQ ID NO: 321147 - RNA, 19 nt, Homo sapiens
ugacaagcccuaccucugu

SEQ ID NO: 321148 - RNA, 19 nt, Homo sapiens
caggagagacgacaagguu

SEQ ID NO: 321149 - RNA, 19 nt, Homo sapiens
ucaggaggcacgucacuuu

SEQ ID NO: 321150 - RNA, 19 nt, Homo sapiens
ggacgcacccaccauaagu

SEQ ID NO: 321151 - RNA, 19 nt, Homo sapiens
cauccuuaccgcacauuua

SEQ ID NO: 321152 - RNA, 19 nt, Homo sapiens
gaaacucgacgcguucuuc

SEQ ID NO: 321153 - RNA, 19 nt, Homo sapiens
cagaugcgauggcuacaag

SEQ ID NO: 321154 - RNA, 19 nt, Homo sapiens
ccacccauuuccaguguga

SEQ ID NO: 321155 - RNA, 19 nt, Homo sapiens
ggacauaccuuuaaaccuu

SEQ ID NO: 321156 - RNA, 19 nt, Homo sapiens
acacacagcugaagaauaa

SEQ ID NO: 321157 - RNA, 19 nt, Homo sapiens
guagacacguguaagauua

SEQ ID NO: 321158 - RNA, 19 nt, Homo sapiens
gaaauuacacugaaaguug

SEQ ID NO: 321159 - RNA, 19 nt, Homo sapiens
gcagaugacugauuuggaa

SEQ ID NO: 321160 - RNA, 19 nt, Homo sapiens
ggacuuugcuggagguuaa

SEQ ID NO: 321161 - RNA, 19 nt, Homo sapiens
auacgaaacuccacaaaua

SEQ ID NO: 321162 - RNA, 19 nt, Homo sapiens
gaagguaauugccaaauca

SEQ ID NO: 321163 - RNA, 19 nt, Homo sapiens
gaauggaacuccuggcaaa

SEQ ID NO: 321164 - RNA, 19 nt, Homo sapiens
caucucaucugcuguauuu

SEQ ID NO: 321165 - RNA, 19 nt, Homo sapiens
gcagaaggcugguuaacug

SEQ ID NO: 321166 - RNA, 19 nt, Homo sapiens
uaaaggaggucaucuggaa

SEQ ID NO: 321167 - RNA, 19 nt, Homo sapiens
gugaauaacugaaguaaca

SEQ ID NO: 321168 - RNA, 19 nt, Homo sapiens
gaaacuaugucuggagaaa

SEQ ID NO: 321169 - RNA, 19 nt, Homo sapiens
uaaagugaaugaagaggua

SEQ ID NO: 321170 - RNA, 19 nt, Homo sapiens
caaagaggaugaagaagau

SEQ ID NO: 321171 - RNA, 19 nt, Homo sapiens
aaagagagacuuacuauug

SEQ ID NO: 321172 - RNA, 19 nt, Homo sapiens
gaugaugauugcacgguua

SEQ ID NO: 321173 - RNA, 19 nt, Homo sapiens
gagcuuaguuguguuuaaa

SEQ ID NO: 321174 - RNA, 19 nt, Homo sapiens
gcucagagauccuuaugau

SEQ ID NO: 321175 - RNA, 19 nt, Homo sapiens
ggaagcccauggcaucuuu

SEQ ID NO: 321176 - RNA, 19 nt, Homo sapiens
ccacaaauaagaagaguaa

SEQ ID NO: 321177 - RNA, 19 nt, Homo sapiens
gugaauuagugccaucuua

SEQ ID NO: 321178 - RNA, 19 nt, Homo sapiens
agagugaguugauaucuaa

SEQ ID NO: 321179 - RNA, 19 nt, Homo sapiens
gaucucagcuucaauacag

SEQ ID NO: 321180 - RNA, 19 nt, Homo sapiens
uaacauggauucauuacgu

SEQ ID NO: 321181 - RNA, 19 nt, Homo sapiens
gaagauacacauuccaguu

SEQ ID NO: 321182 - RNA, 19 nt, Homo sapiens
guaaagcuuuggauucaga

SEQ ID NO: 321183 - RNA, 19 nt, Homo sapiens
gaaguucgauguaugaaaa

SEQ ID NO: 321184 - RNA, 19 nt, Homo sapiens
uguagaagcuguaagaaau

SEQ ID NO: 321185 - RNA, 19 nt, Homo sapiens
gaagagauucugcccugua

SEQ ID NO: 321186 - RNA, 19 nt, Homo sapiens
gcgagugcccucugauuua

SEQ ID NO: 321187 - RNA, 19 nt, Homo sapiens
gaauguagaagcuguaaga

SEQ ID NO: 321188 - RNA, 19 nt, Homo sapiens
guagauuagugaacagaaa

SEQ ID NO: 321189 - RNA, 19 nt, Homo sapiens
gaacucagaagucaagaga

SEQ ID NO: 321190 - RNA, 19 nt, Homo sapiens
gccugaaacuucuaaauau

SEQ ID NO: 321191 - RNA, 19 nt, Homo sapiens
gauuuggucuuauuucuuc

SEQ ID NO: 321192 - RNA, 19 nt, Homo sapiens
ggaaaggaauguagaagcu

SEQ ID NO: 321193 - RNA, 19 nt, Homo sapiens
uacgagaacuaguaaauug

SEQ ID NO: 321194 - RNA, 19 nt, Homo sapiens
uguuugagcugcuauauau

SEQ ID NO: 321195 - RNA, 19 nt, Homo sapiens
gcacgccuguguccucauu

SEQ ID NO: 321196 - RNA, 19 nt, Homo sapiens
ggaagguaauugccaaauc

SEQ ID NO: 321197 - RNA, 19 nt, Homo sapiens
uaacugaaguaacacuaga

SEQ ID NO: 321198 - RNA, 19 nt, Homo sapiens
gaacaaauaggcccugaag

SEQ ID NO: 321199 - RNA, 19 nt, Homo sapiens
gaccggagcaguauagaaa

SEQ ID NO: 321200 - RNA, 19 nt, Homo sapiens
aagagagacuuacuauuga

SEQ ID NO: 321201 - RNA, 19 nt, Homo sapiens
guacauuacucaguuggaa

SEQ ID NO: 321202 - RNA, 19 nt, Homo sapiens
ggucagaagacaucucuaa

SEQ ID NO: 321203 - RNA, 19 nt, Homo sapiens
ggaaugcaguggagaugau

SEQ ID NO: 321204 - RNA, 19 nt, Homo sapiens
ccauugugcuccugcauuu

SEQ ID NO: 321205 - RNA, 19 nt, Homo sapiens
aaaggcaguuugucuacua

SEQ ID NO: 321206 - RNA, 19 nt, Homo sapiens
ccaaagaggaugaagaaga

SEQ ID NO: 321207 - RNA, 19 nt, Homo sapiens
gcaaaugaaggauacuuga

SEQ ID NO: 321208 - RNA, 19 nt, Homo sapiens
ugugcgagguuacuacuua

SEQ ID NO: 321209 - RNA, 19 nt, Homo sapiens
gagagcagauccuguuuac

SEQ ID NO: 321210 - RNA, 19 nt, Homo sapiens
cagcuuaguucaagaagug

SEQ ID NO: 321211 - RNA, 19 nt, Homo sapiens
gcaaauuuguacauucaca

SEQ ID NO: 321212 - RNA, 19 nt, Homo sapiens
gcucaaauuugucaucagu

SEQ ID NO: 321213 - RNA, 19 nt, Homo sapiens
gacugcagaugacugauuu

SEQ ID NO: 321214 - RNA, 19 nt, Homo sapiens
cgagugcccucugauuuaa

SEQ ID NO: 321215 - RNA, 19 nt, Homo sapiens
aaacagagcuuuuggaauc

SEQ ID NO: 321216 - RNA, 19 nt, Homo sapiens
gacauaccuuuaaaccuuu

SEQ ID NO: 321217 - RNA, 19 nt, Homo sapiens
gcacaguggcuuacaugaa

SEQ ID NO: 321218 - RNA, 19 nt, Homo sapiens
ggaaauaacaauguaguuc

SEQ ID NO: 321219 - RNA, 19 nt, Homo sapiens
gguagucuaucacuucgaa

SEQ ID NO: 321220 - RNA, 19 nt, Homo sapiens
gaaugaagagguagccaaa

SEQ ID NO: 321221 - RNA, 19 nt, Homo sapiens
uaucuucucucacuuguuc

SEQ ID NO: 321222 - RNA, 19 nt, Homo sapiens
gaguauguaucuucucuca

SEQ ID NO: 321223 - RNA, 19 nt, Homo sapiens
ugaaguaacacuagacuga

SEQ ID NO: 321224 - RNA, 19 nt, Homo sapiens
gaaacuccacaaauaagaa

SEQ ID NO: 321225 - RNA, 19 nt, Homo sapiens
ucaccaacuuucuuucaaa

SEQ ID NO: 321226 - RNA, 19 nt, Homo sapiens
ggacuuacucgcaaaugaa

SEQ ID NO: 321227 - RNA, 19 nt, Homo sapiens
agacaucucuaacccaaga

SEQ ID NO: 321228 - RNA, 19 nt, Homo sapiens
caugguaucuuucuguugu

SEQ ID NO: 321229 - RNA, 19 nt, Homo sapiens
cauuagugccuguagauua

SEQ ID NO: 321230 - RNA, 19 nt, Homo sapiens
ggauucagaugcuguugug

SEQ ID NO: 321231 - RNA, 19 nt, Homo sapiens
acucagaagucaagagauu

SEQ ID NO: 321232 - RNA, 19 nt, Homo sapiens
cacaacagcuugauacucu

SEQ ID NO: 321233 - RNA, 19 nt, Homo sapiens
gcagguagucuaucacuuc

SEQ ID NO: 321234 - RNA, 19 nt, Homo sapiens
caacaaguaauacagaaga

SEQ ID NO: 321235 - RNA, 19 nt, Homo sapiens
ucagagauccuuaugaugu

SEQ ID NO: 321236 - RNA, 19 nt, Homo sapiens
caguugcggucuuguagua

SEQ ID NO: 321237 - RNA, 19 nt, Homo sapiens
ucaaauuugucaucaguca

SEQ ID NO: 321238 - RNA, 19 nt, Homo sapiens
caucaguugccaauuguua

SEQ ID NO: 321239 - RNA, 19 nt, Homo sapiens
gaauuugcaucugacuuug

SEQ ID NO: 321240 - RNA, 19 nt, Homo sapiens
caccagacuuuaccaguga

SEQ ID NO: 321241 - RNA, 19 nt, Homo sapiens
guagacacuaugugaauaa

SEQ ID NO: 321242 - RNA, 19 nt, Homo sapiens
cagaagaaguaacacaaca

SEQ ID NO: 321243 - RNA, 19 nt, Homo sapiens
guguaaagcuuuggauuca

SEQ ID NO: 321244 - RNA, 19 nt, Homo sapiens
ggaauuagaagagggagaa

SEQ ID NO: 321245 - RNA, 19 nt, Homo sapiens
agacuuuaccagugaauua

SEQ ID NO: 321246 - RNA, 19 nt, Homo sapiens
ggaaauuacacugaaaguu

SEQ ID NO: 321247 - RNA, 19 nt, Homo sapiens
ccucauugcuccaaacugu

SEQ ID NO: 321248 - RNA, 19 nt, Homo sapiens
agaacugacuugcaagcua

SEQ ID NO: 321249 - RNA, 19 nt, Homo sapiens
uauguggguuccaguagua

SEQ ID NO: 321250 - RNA, 19 nt, Homo sapiens
gagcugcuauauauuugug

SEQ ID NO: 321251 - RNA, 19 nt, Homo sapiens
gaaacugugauauaagguu

SEQ ID NO: 321252 - RNA, 19 nt, Homo sapiens
guauguaucuucucucacu

SEQ ID NO: 321253 - RNA, 19 nt, Homo sapiens
gacacuaugugaauaacug

SEQ ID NO: 321254 - RNA, 19 nt, Homo sapiens
guuggaagguggcacaguu

SEQ ID NO: 321255 - RNA, 19 nt, Homo sapiens
gaagaagccucggcagaua

SEQ ID NO: 321256 - RNA, 19 nt, Homo sapiens
guaauaaucuccaucaugu

SEQ ID NO: 321257 - RNA, 19 nt, Homo sapiens
ggaaugaacugaaaguagu

SEQ ID NO: 321258 - RNA, 19 nt, Homo sapiens
uaaagaugcucaaagaaga

SEQ ID NO: 321259 - RNA, 19 nt, Homo sapiens
gagccuggauuaaucauga

SEQ ID NO: 321260 - RNA, 19 nt, Homo sapiens
gagauuuccuggacuagaa

SEQ ID NO: 321261 - RNA, 19 nt, Homo sapiens
caguaaagaugcucaaaga

SEQ ID NO: 321262 - RNA, 19 nt, Homo sapiens
ggagugcaguccuggagua

SEQ ID NO: 321263 - RNA, 19 nt, Homo sapiens
ugagagagcucgucaacau

SEQ ID NO: 321264 - RNA, 19 nt, Homo sapiens
gaacugagaaacuuccaaa

SEQ ID NO: 321265 - RNA, 19 nt, Homo sapiens
ggaaggguguuucaagcaa

SEQ ID NO: 321266 - RNA, 19 nt, Homo sapiens
ucugagcucuuacuagaua

SEQ ID NO: 321267 - RNA, 19 nt, Homo sapiens
ggaguaaaccacagaaaga

SEQ ID NO: 321268 - RNA, 19 nt, Homo sapiens
cacagugacuugucuauga

SEQ ID NO: 321269 - RNA, 19 nt, Homo sapiens
caaugugccugcucuuuga

SEQ ID NO: 321270 - RNA, 19 nt, Homo sapiens
guaaaccacagaaagauaa

SEQ ID NO: 321271 - RNA, 19 nt, Homo sapiens
gaggagcuguggagaguug

SEQ ID NO: 321272 - RNA, 19 nt, Homo sapiens
guaaugcaguccuggcaaa

SEQ ID NO: 321273 - RNA, 19 nt, Homo sapiens
uaccauaacuacucucuau

SEQ ID NO: 321274 - RNA, 19 nt, Homo sapiens
gcagcaagcuucccagcau

SEQ ID NO: 321275 - RNA, 19 nt, Homo sapiens
gcaaaagaauggcugguaa

SEQ ID NO: 321276 - RNA, 19 nt, Homo sapiens
gaauugcaguucuugaauc

SEQ ID NO: 321277 - RNA, 19 nt, Homo sapiens
ugccacaucuagauuauaa

SEQ ID NO: 321278 - RNA, 19 nt, Homo sapiens
aagaauggcugguaaugga

SEQ ID NO: 321279 - RNA, 19 nt, Homo sapiens
gcagacuacuacaaagcua

SEQ ID NO: 321280 - RNA, 19 nt, Homo sapiens
ccacugguacauauucuua

SEQ ID NO: 321281 - RNA, 19 nt, Homo sapiens
gcagacagacccaguuuca

SEQ ID NO: 321282 - RNA, 19 nt, Homo sapiens
gcaauauuugugcuucuua

SEQ ID NO: 321283 - RNA, 19 nt, Homo sapiens
guccagcuuugcaauauuu

SEQ ID NO: 321284 - RNA, 19 nt, Homo sapiens
uggcauggcuuaccucuca

SEQ ID NO: 321285 - RNA, 19 nt, Homo sapiens
guaaagaugcucaaagaag

SEQ ID NO: 321286 - RNA, 19 nt, Homo sapiens
ucaccacacugccuucuga

SEQ ID NO: 321287 - RNA, 19 nt, Homo sapiens
caucaccacuccucuugaa

SEQ ID NO: 321288 - RNA, 19 nt, Homo sapiens
gcgagaacaugguggugaa

SEQ ID NO: 321289 - RNA, 19 nt, Homo sapiens
cuucugagcucuuacuaga

SEQ ID NO: 321290 - RNA, 19 nt, Homo sapiens
gacagcauauuccaaagug

SEQ ID NO: 321291 - RNA, 19 nt, Homo sapiens
ggaagaugcaggacaguau

SEQ ID NO: 321292 - RNA, 19 nt, Homo sapiens
cagcggaacugagaaacuu

SEQ ID NO: 321293 - RNA, 19 nt, Homo sapiens
ggaugccgcuccuucugaa

SEQ ID NO: 321294 - RNA, 19 nt, Homo sapiens
ugaaagaccgagugauuga

SEQ ID NO: 321295 - RNA, 19 nt, Homo sapiens
aagugaagaugaaaccuaa

SEQ ID NO: 321296 - RNA, 19 nt, Homo sapiens
agacagugaugauggcauu

SEQ ID NO: 321297 - RNA, 19 nt, Homo sapiens
ugaaacaguggaugccuua

SEQ ID NO: 321298 - RNA, 19 nt, Homo sapiens
ucaccuacauacuccauga

SEQ ID NO: 321299 - RNA, 19 nt, Homo sapiens
ggccuggaaugaacugaaa

SEQ ID NO: 321300 - RNA, 19 nt, Homo sapiens
ucugggagcuugaggauuc

SEQ ID NO: 321301 - RNA, 19 nt, Homo sapiens
gggaggagcuguggagagu

SEQ ID NO: 321302 - RNA, 19 nt, Homo sapiens
ucacuaugguggcaguaaa

SEQ ID NO: 321303 - RNA, 19 nt, Homo sapiens
ggagagggagcguuuggaa

SEQ ID NO: 321304 - RNA, 19 nt, Homo sapiens
cgucaacauuccacuggua

SEQ ID NO: 321305 - RNA, 19 nt, Homo sapiens
gcugaggcuuuguugugua

SEQ ID NO: 321306 - RNA, 19 nt, Homo sapiens
caagugaagaugaaaccua

SEQ ID NO: 321307 - RNA, 19 nt, Homo sapiens
aaacgacgcuaucccuauc

SEQ ID NO: 321308 - RNA, 19 nt, Homo sapiens
ccacuccucuugaaacagu

SEQ ID NO: 321309 - RNA, 19 nt, Homo sapiens
ccauaacuacucucuauug

SEQ ID NO: 321310 - RNA, 19 nt, Homo sapiens
ccaaugacguccucaaagc

SEQ ID NO: 321311 - RNA, 19 nt, Homo sapiens
gaggauucauaacguacaa

SEQ ID NO: 321312 - RNA, 19 nt, Homo sapiens
ccaucagugucuuggauaa

SEQ ID NO: 321313 - RNA, 19 nt, Homo sapiens
uaacucgcccucccauaaa

SEQ ID NO: 321314 - RNA, 19 nt, Homo sapiens
agacccaguuucaccagua

SEQ ID NO: 321315 - RNA, 19 nt, Homo sapiens
gauccgagaugcauuugcu

SEQ ID NO: 321316 - RNA, 19 nt, Homo sapiens
cuacuccuauucccauuug

SEQ ID NO: 321317 - RNA, 19 nt, Homo sapiens
uggugaagcuggaaguuga

SEQ ID NO: 321318 - RNA, 19 nt, Homo sapiens
gcaguccuaccauguacua

SEQ ID NO: 321319 - RNA, 19 nt, Homo sapiens
gugcaguccuggaguagug

SEQ ID NO: 321320 - RNA, 19 nt, Homo sapiens
gcaggacaguaucgaugug

SEQ ID NO: 321321 - RNA, 19 nt, Homo sapiens
ccugagauuuccuggacua

SEQ ID NO: 321322 - RNA, 19 nt, Homo sapiens
ccaaugugccugcucuuug

SEQ ID NO: 321323 - RNA, 19 nt, Homo sapiens
gcgugagccuggauuaauc

SEQ ID NO: 321324 - RNA, 19 nt, Homo sapiens
gaagcuggaaguugagguu

SEQ ID NO: 321325 - RNA, 19 nt, Homo sapiens
ccguggagcuguacaaucu

SEQ ID NO: 321326 - RNA, 19 nt, Homo sapiens
cuacaaagcuaaugaaaac

SEQ ID NO: 321327 - RNA, 19 nt, Homo sapiens
gcuuaccucucagaacgua

SEQ ID NO: 321328 - RNA, 19 nt, Homo sapiens
caggcuuacuucccuauga

SEQ ID NO: 321329 - RNA, 19 nt, Homo sapiens
cuccaugacuguaauaauc

SEQ ID NO: 321330 - RNA, 19 nt, Homo sapiens
ggacagcauauuccaaagu

SEQ ID NO: 321331 - RNA, 19 nt, Homo sapiens
guggagcccugcaagugaa

SEQ ID NO: 321332 - RNA, 19 nt, Homo sapiens
aacaguggaugccuuaguu

SEQ ID NO: 321333 - RNA, 19 nt, Homo sapiens
ggugaaaauugccgacuuu

SEQ ID NO: 321334 - RNA, 19 nt, Homo sapiens
aagagaaucagcagcagua

SEQ ID NO: 321335 - RNA, 19 nt, Homo sapiens
ugaggaggcccaagagcua

SEQ ID NO: 321336 - RNA, 19 nt, Homo sapiens
ucaagacugcagcuguuua

SEQ ID NO: 321337 - RNA, 19 nt, Homo sapiens
ugugaaagaccgagugauu

SEQ ID NO: 321338 - RNA, 19 nt, Homo sapiens
gcuccugaaucccacaaug

SEQ ID NO: 321339 - RNA, 19 nt, Homo sapiens
ggagcuugaggauucauaa

SEQ ID NO: 321340 - RNA, 19 nt, Homo sapiens
gaacugugagugucuaagg

SEQ ID NO: 321341 - RNA, 19 nt, Homo sapiens
caucggagagggagcguuu

SEQ ID NO: 321342 - RNA, 19 nt, Homo sapiens
gagagagcucgucaacauu

SEQ ID NO: 321343 - RNA, 19 nt, Homo sapiens
caagacugcagcuguuuau

SEQ ID NO: 321344 - RNA, 19 nt, Homo sapiens
uugaauacauggccuaugg

SEQ ID NO: 321345 - RNA, 19 nt, Homo sapiens
gaauuugacaacccuaaca

SEQ ID NO: 321346 - RNA, 19 nt, Homo sapiens
gcaguaaagaugcucaaag

SEQ ID NO: 321347 - RNA, 19 nt, Homo sapiens
acacaugcauagcuaccaa

SEQ ID NO: 321348 - RNA, 19 nt, Homo sapiens
gaagaugcaggacaguauc

SEQ ID NO: 321349 - RNA, 19 nt, Homo sapiens
aaagcaguccuaccaugua

SEQ ID NO: 321350 - RNA, 19 nt, Homo sapiens
gaauggaguaaaccacaga

SEQ ID NO: 321351 - RNA, 19 nt, Homo sapiens
gcauagcuaccaauaagca

SEQ ID NO: 321352 - RNA, 19 nt, Homo sapiens
augcauagcuaccaauaag

SEQ ID NO: 321353 - RNA, 19 nt, Homo sapiens
acucaagacugcagcuguu

SEQ ID NO: 321354 - RNA, 19 nt, Homo sapiens
auaacucgcccucccauaa

SEQ ID NO: 321355 - RNA, 19 nt, Homo sapiens
ggacuuaccugaagaacuu

SEQ ID NO: 321356 - RNA, 19 nt, Homo sapiens
gcagcaaucuguauaauau

SEQ ID NO: 321357 - RNA, 19 nt, Homo sapiens
gaugagagcugguagaaga

SEQ ID NO: 321358 - RNA, 19 nt, Homo sapiens
gcaauaaguucuauaagga

SEQ ID NO: 321359 - RNA, 19 nt, Homo sapiens
ucaagaggguucauaaauu

SEQ ID NO: 321360 - RNA, 19 nt, Homo sapiens
ggaaugaauuucuauaugg

SEQ ID NO: 321361 - RNA, 19 nt, Homo sapiens
caagaggguucauaaauuc

SEQ ID NO: 321362 - RNA, 19 nt, Homo sapiens
caggaucccuacaauaaua

SEQ ID NO: 321363 - RNA, 19 nt, Homo sapiens
uauaguaacuggagaagaa

SEQ ID NO: 321364 - RNA, 19 nt, Homo sapiens
ggaaauauccuggcucuug

SEQ ID NO: 321365 - RNA, 19 nt, Homo sapiens
gaccauauccuaccaugua

SEQ ID NO: 321366 - RNA, 19 nt, Homo sapiens
guaaagcuaugucuucaau

SEQ ID NO: 321367 - RNA, 19 nt, Homo sapiens
caagaacucuggacaaugg

SEQ ID NO: 321368 - RNA, 19 nt, Homo sapiens
gaacucaucaaagaacuua

SEQ ID NO: 321369 - RNA, 19 nt, Homo sapiens
acucugggcucacuuaaua

SEQ ID NO: 321370 - RNA, 19 nt, Homo sapiens
uggaaugucucacaaauga

SEQ ID NO: 321371 - RNA, 19 nt, Homo sapiens
cagcagggauuaucaguug

SEQ ID NO: 321372 - RNA, 19 nt, Homo sapiens
gagcauaucgccaggaauu

SEQ ID NO: 321373 - RNA, 19 nt, Homo sapiens
gaacauaaagcgaaugauc

SEQ ID NO: 321374 - RNA, 19 nt, Homo sapiens
gaaguucuggcaauugaua

SEQ ID NO: 321375 - RNA, 19 nt, Homo sapiens
gcaccaagguugucuuucu

SEQ ID NO: 321376 - RNA, 19 nt, Homo sapiens
gagagauacuauggacuua

SEQ ID NO: 321377 - RNA, 19 nt, Homo sapiens
gguauuuggugaacauaaa

SEQ ID NO: 321378 - RNA, 19 nt, Homo sapiens
gauggaaugucucacaaau

SEQ ID NO: 321379 - RNA, 19 nt, Homo sapiens
gaacacacaaaucaucauu

SEQ ID NO: 321380 - RNA, 19 nt, Homo sapiens
ggaaauagcaaagaugaga

SEQ ID NO: 321381 - RNA, 19 nt, Homo sapiens
gauuaucaguugccuuuga

SEQ ID NO: 321382 - RNA, 19 nt, Homo sapiens
cggaagggaucucuauaaa

SEQ ID NO: 321383 - RNA, 19 nt, Homo sapiens
gaauuucuguuugaaguug

SEQ ID NO: 321384 - RNA, 19 nt, Homo sapiens
gggaauaccuaaacuucga

SEQ ID NO: 321385 - RNA, 19 nt, Homo sapiens
aaucacagaugcccugaaa

SEQ ID NO: 321386 - RNA, 19 nt, Homo sapiens
cagcagggaucaagcuuug

SEQ ID NO: 321387 - RNA, 19 nt, Homo sapiens
gaagcagcaaucuguauaa

SEQ ID NO: 321388 - RNA, 19 nt, Homo sapiens
guucuuacaugauggaaug

SEQ ID NO: 321389 - RNA, 19 nt, Homo sapiens
acacacaaaucaucauuca

SEQ ID NO: 321390 - RNA, 19 nt, Homo sapiens
gagcaggaucccuacaaua

SEQ ID NO: 321391 - RNA, 19 nt, Homo sapiens
gcaaagaugagagcuggua

SEQ ID NO: 321392 - RNA, 19 nt, Homo sapiens
ggaagaaagcaauaaguuc

SEQ ID NO: 321393 - RNA, 19 nt, Homo sapiens
guacauacaguuucacuuc

SEQ ID NO: 321394 - RNA, 19 nt, Homo sapiens
uggagaaaguaaagagaua

SEQ ID NO: 321395 - RNA, 19 nt, Homo sapiens
cagcaaagcacaugccaaa

SEQ ID NO: 321396 - RNA, 19 nt, Homo sapiens
gaagggaucucuauaaaac

SEQ ID NO: 321397 - RNA, 19 nt, Homo sapiens
gggauuaucaguugccuuu

SEQ ID NO: 321398 - RNA, 19 nt, Homo sapiens
gaguaaagcuaugucuuca

SEQ ID NO: 321399 - RNA, 19 nt, Homo sapiens
gaucaaagaagagaguaaa

SEQ ID NO: 321400 - RNA, 19 nt, Homo sapiens
cgaaacaggcagauugaaa

SEQ ID NO: 321401 - RNA, 19 nt, Homo sapiens
gauaccaccucaggauuau

SEQ ID NO: 321402 - RNA, 19 nt, Homo sapiens
uaaagcgaaugaucgaaug

SEQ ID NO: 321403 - RNA, 19 nt, Homo sapiens
uagcggagauggaaauauc

SEQ ID NO: 321404 - RNA, 19 nt, Homo sapiens
ggaucaagcuuuggcugaa

SEQ ID NO: 321405 - RNA, 19 nt, Homo sapiens
ggauuggaguacucuagaa

SEQ ID NO: 321406 - RNA, 19 nt, Homo sapiens
ggagaaaguaaagagauaa

SEQ ID NO: 321407 - RNA, 19 nt, Homo sapiens
gaagacaagcuagaauaga

SEQ ID NO: 321408 - RNA, 19 nt, Homo sapiens
uaccuaaacuucgaauuga

SEQ ID NO: 321409 - RNA, 19 nt, Homo sapiens
gggagguucuuacaugaug

SEQ ID NO: 321410 - RNA, 19 nt, Homo sapiens
ucaauuaguggauaccaua

SEQ ID NO: 321411 - RNA, 19 nt, Homo sapiens
caaagcacaugccaaaauu

SEQ ID NO: 321412 - RNA, 19 nt, Homo sapiens
gauggaauuccuuuagaaa

SEQ ID NO: 321413 - RNA, 19 nt, Homo sapiens
aaacccagaagaccuaaua

SEQ ID NO: 321414 - RNA, 19 nt, Homo sapiens
ggccuggugucaugcuaua

SEQ ID NO: 321415 - RNA, 19 nt, Homo sapiens
gaaugucucacaaaugaug

SEQ ID NO: 321416 - RNA, 19 nt, Homo sapiens
ugaugaagcuuuggguuug

SEQ ID NO: 321417 - RNA, 19 nt, Homo sapiens
ggaauuuggagaaaguaaa

SEQ ID NO: 321418 - RNA, 19 nt, Homo sapiens
agaaugugcugcccgaaga

SEQ ID NO: 321419 - RNA, 19 nt, Homo sapiens
gaaccauccaugaaaauua

SEQ ID NO: 321420 - RNA, 19 nt, Homo sapiens
ugauaccaccucaggauua

SEQ ID NO: 321421 - RNA, 19 nt, Homo sapiens
ccaggaauuuggagaaagu

SEQ ID NO: 321422 - RNA, 19 nt, Homo sapiens
aagacaagcuagaauagau

SEQ ID NO: 321423 - RNA, 19 nt, Homo sapiens
ccgaagacaagcuagaaua

SEQ ID NO: 321424 - RNA, 19 nt, Homo sapiens
ugauggaauuccuuuagaa

SEQ ID NO: 321425 - RNA, 19 nt, Homo sapiens
gagggaauaccuaaacuuc

SEQ ID NO: 321426 - RNA, 19 nt, Homo sapiens
gaagagaguaaagcuaugu

SEQ ID NO: 321427 - RNA, 19 nt, Homo sapiens
caaaucaucauucaagaag

SEQ ID NO: 321428 - RNA, 19 nt, Homo sapiens
guacugcaauagaagcaau

SEQ ID NO: 321429 - RNA, 19 nt, Homo sapiens
ggaugcaucucgggcaaga

SEQ ID NO: 321430 - RNA, 19 nt, Homo sapiens
gaagaaauggguggaaugg

SEQ ID NO: 321431 - RNA, 19 nt, Homo sapiens
caaaaucucuucuucuaag

SEQ ID NO: 321432 - RNA, 19 nt, Homo sapiens
uuccaguucuugcaaauuu

SEQ ID NO: 321433 - RNA, 19 nt, Homo sapiens
cgacacaucguggcuauga

SEQ ID NO: 321434 - RNA, 19 nt, Homo sapiens
cagauauucuugucaugug

SEQ ID NO: 321435 - RNA, 19 nt, Homo sapiens
uuccugaacucaucaaaga

SEQ ID NO: 321436 - RNA, 19 nt, Homo sapiens
gcauaucgccaggaauuug

SEQ ID NO: 321437 - RNA, 19 nt, Homo sapiens
gaaacaggcagauugaaaa

SEQ ID NO: 321438 - RNA, 19 nt, Homo sapiens
gacuaugaauggagcaguu

SEQ ID NO: 321439 - RNA, 19 nt, Homo sapiens
cauacaguuucacuucaaa

SEQ ID NO: 321440 - RNA, 19 nt, Homo sapiens
ucaggugcuugaugauauu

SEQ ID NO: 321441 - RNA, 19 nt, Homo sapiens
acacaaaucaucauucaag

SEQ ID NO: 321442 - RNA, 19 nt, Homo sapiens
gaguugcuauugacacugu

SEQ ID NO: 321443 - RNA, 19 nt, Homo sapiens
uaacaucugcuaucaagag

SEQ ID NO: 321444 - RNA, 19 nt, Homo sapiens
aaagguauuuggugaacau

SEQ ID NO: 321445 - RNA, 19 nt, Homo sapiens
uaaauaaguaccaguugga

SEQ ID NO: 321446 - RNA, 19 nt, Homo sapiens
gaguaaauaaguaccaguu

SEQ ID NO: 321447 - RNA, 19 nt, Homo sapiens
cacaaaucaucauucaaga

SEQ ID NO: 321448 - RNA, 19 nt, Homo sapiens
agaagcagcaaucuguaua

SEQ ID NO: 321449 - RNA, 19 nt, Homo sapiens
ccagucaguucuuauuucu

SEQ ID NO: 321450 - RNA, 19 nt, Homo sapiens
gccaggaacacacaaauca

SEQ ID NO: 321451 - RNA, 19 nt, Homo sapiens
gcaggaucccuacaauaau

SEQ ID NO: 321452 - RNA, 19 nt, Homo sapiens
gcaguuauuccaguucuug

SEQ ID NO: 321453 - RNA, 19 nt, Homo sapiens
gagcaguuauuccaguucu

SEQ ID NO: 321454 - RNA, 19 nt, Homo sapiens
ccuaccauguauaccuuua

SEQ ID NO: 321455 - RNA, 19 nt, Homo sapiens
ccacugugaucaacuacua

SEQ ID NO: 321456 - RNA, 19 nt, Homo sapiens
agacguagcugaagucaca

SEQ ID NO: 321457 - RNA, 19 nt, Homo sapiens
ggucucacaucuccacuga

SEQ ID NO: 321458 - RNA, 19 nt, Homo sapiens
agaauccuguuguuaguaa

SEQ ID NO: 321459 - RNA, 19 nt, Homo sapiens
acaucaagcugacauauca

SEQ ID NO: 321460 - RNA, 19 nt, Homo sapiens
gccaggagauuucaaccaa

SEQ ID NO: 321461 - RNA, 19 nt, Homo sapiens
caacagugcagcccaguga

SEQ ID NO: 321462 - RNA, 19 nt, Homo sapiens
gaagacgggcagaagauga

SEQ ID NO: 321463 - RNA, 19 nt, Homo sapiens
gcagaagcaugcuaagaac

SEQ ID NO: 321464 - RNA, 19 nt, Homo sapiens
caagcugacauaucaagua

SEQ ID NO: 321465 - RNA, 19 nt, Homo sapiens
ggcagaagcaugcuaagaa

SEQ ID NO: 321466 - RNA, 19 nt, Homo sapiens
uauaugggcuggccuugga

SEQ ID NO: 321467 - RNA, 19 nt, Homo sapiens
ggagaagacgggcagaaga

SEQ ID NO: 321468 - RNA, 19 nt, Homo sapiens
ggaggcagaagcaugcuaa

SEQ ID NO: 321469 - RNA, 19 nt, Homo sapiens
agcaaguccuggauaauuu

SEQ ID NO: 321470 - RNA, 19 nt, Homo sapiens
cagcaaguccuggauaauu

SEQ ID NO: 321471 - RNA, 19 nt, Homo sapiens
cggaagaggugguauugca

SEQ ID NO: 321472 - RNA, 19 nt, Homo sapiens
aagcugacauaucaaguau

SEQ ID NO: 321473 - RNA, 19 nt, Homo sapiens
gagaagacgggcagaagau

SEQ ID NO: 321474 - RNA, 19 nt, Homo sapiens
cauaccaucuauucagaga

SEQ ID NO: 321475 - RNA, 19 nt, Homo sapiens
ugagaauccuguuguuagu

SEQ ID NO: 321476 - RNA, 19 nt, Homo sapiens
gagaauccuguuguuagua

SEQ ID NO: 321477 - RNA, 19 nt, Homo sapiens
ccggauggaugcagaagug

SEQ ID NO: 321478 - RNA, 19 nt, Homo sapiens
guccacaccuucucucaca

SEQ ID NO: 321479 - RNA, 19 nt, Homo sapiens
ugugguggauggcaacgua

SEQ ID NO: 321480 - RNA, 19 nt, Homo sapiens
gaauccuguuguuaguaaa

SEQ ID NO: 321481 - RNA, 19 nt, Homo sapiens
ggaccuguauggguuccaa

SEQ ID NO: 321482 - RNA, 19 nt, Homo sapiens
ggaccuaccauggagaaga

SEQ ID NO: 321483 - RNA, 19 nt, Homo sapiens
gcaaguccuggauaauuuc

SEQ ID NO: 321484 - RNA, 19 nt, Homo sapiens
caccuucucucacaucaag

SEQ ID NO: 321485 - RNA, 19 nt, Homo sapiens
aguccuggauaauuucuuu

SEQ ID NO: 321486 - RNA, 19 nt, Homo sapiens
gggcagaagaugagaugga

SEQ ID NO: 321487 - RNA, 19 nt, Homo sapiens
aaacgggaccuaccaugga

SEQ ID NO: 321488 - RNA, 19 nt, Homo sapiens
ccugagaauccuguuguua

SEQ ID NO: 321489 - RNA, 19 nt, Homo sapiens
agacccagguugccacugu

SEQ ID NO: 321490 - RNA, 19 nt, Homo sapiens
ccaagcagccauggagcua

SEQ ID NO: 321491 - RNA, 19 nt, Homo sapiens
uggaggaggugaaucaacu

SEQ ID NO: 321492 - RNA, 19 nt, Homo sapiens
gaagcaugcuaagaacaac

SEQ ID NO: 321493 - RNA, 19 nt, Homo sapiens
gaccuaccauggagaagac

SEQ ID NO: 321494 - RNA, 19 nt, Homo sapiens
agaagcaugcuaagaacaa

SEQ ID NO: 321495 - RNA, 19 nt, Homo sapiens
uggcaggacugugggaguu

SEQ ID NO: 321496 - RNA, 19 nt, Homo sapiens
gaaggugguagaggagcua

SEQ ID NO: 321497 - RNA, 19 nt, Homo sapiens
gaaguggucacaggaagca

SEQ ID NO: 321498 - RNA, 19 nt, Homo sapiens
aggccucugucuccucaua

SEQ ID NO: 321499 - RNA, 19 nt, Homo sapiens
ugacgcaggaggaauuuca

SEQ ID NO: 321500 - RNA, 19 nt, Homo sapiens
gagcgcagaggcuuugaag

SEQ ID NO: 321501 - RNA, 19 nt, Homo sapiens
cccagcagcacccuuguuu

SEQ ID NO: 321502 - RNA, 19 nt, Homo sapiens
ccagugacaccucugaaag

SEQ ID NO: 321503 - RNA, 19 nt, Homo sapiens
cauugccucuaucgccuuu

SEQ ID NO: 321504 - RNA, 19 nt, Homo sapiens
ggccugggcuacuauucuc

SEQ ID NO: 321505 - RNA, 19 nt, Homo sapiens
ucacaucaagcugacauau

SEQ ID NO: 321506 - RNA, 19 nt, Homo sapiens
ccagagcgcagaggcuuug

SEQ ID NO: 321507 - RNA, 19 nt, Homo sapiens
cucauaccaucuauucaga

SEQ ID NO: 321508 - RNA, 19 nt, Homo sapiens
cuacacagcuggggccauu

SEQ ID NO: 321509 - RNA, 19 nt, Homo sapiens
uugccacugugaucaacua

SEQ ID NO: 321510 - RNA, 19 nt, Homo sapiens
cugagaauccuguuguuag

SEQ ID NO: 321511 - RNA, 19 nt, Homo sapiens
ugugggccaucaugaggaa

SEQ ID NO: 321512 - RNA, 19 nt, Homo sapiens
gagaaacgggaccuaccau

SEQ ID NO: 321513 - RNA, 19 nt, Homo sapiens
ccaagccuucugccuguga

SEQ ID NO: 321514 - RNA, 19 nt, Homo sapiens
ccagagaguggagcaggaa

SEQ ID NO: 321515 - RNA, 19 nt, Homo sapiens
gccggaagaggugguauug

SEQ ID NO: 321516 - RNA, 19 nt, Homo sapiens
gagcucggaaggugguaga

SEQ ID NO: 321517 - RNA, 19 nt, Homo sapiens
aaacugcgccaucgucacu

SEQ ID NO: 321518 - RNA, 19 nt, Homo sapiens
caacagccgucaucagcaa

SEQ ID NO: 321519 - RNA, 19 nt, Homo sapiens
gcccaucucuuaccucaau

SEQ ID NO: 321520 - RNA, 19 nt, Homo sapiens
caacaucgcggucaucaag

SEQ ID NO: 321521 - RNA, 19 nt, Homo sapiens
cagcaucgcucggcaagug

SEQ ID NO: 321522 - RNA, 19 nt, Homo sapiens
gaccggauuuggcugaaug

SEQ ID NO: 321523 - RNA, 19 nt, Homo sapiens
uggcaucggugaacaacuu

SEQ ID NO: 321524 - RNA, 19 nt, Homo sapiens
caccagcgcuuugccaaga

SEQ ID NO: 321525 - RNA, 19 nt, Homo sapiens
ggugagcgcugagaagaag

SEQ ID NO: 321526 - RNA, 19 nt, Homo sapiens
gcuaugcccaguucucuga

SEQ ID NO: 321527 - RNA, 19 nt, Homo sapiens
ccaccugccucgacaccuu

SEQ ID NO: 321528 - RNA, 19 nt, Homo sapiens
acaucgcggucaucaagua

SEQ ID NO: 321529 - RNA, 19 nt, Homo sapiens
gaaggacagcaaccaguuc

SEQ ID NO: 321530 - RNA, 19 nt, Homo sapiens
ucgcccagcugaccaugaa

SEQ ID NO: 321531 - RNA, 19 nt, Homo sapiens
ggucaaauacaucauuguc

SEQ ID NO: 321532 - RNA, 19 nt, Homo sapiens
ugaaggacagcaaccaguu

SEQ ID NO: 321533 - RNA, 19 nt, Homo sapiens
ggaccggauuuggcugaau

SEQ ID NO: 321534 - RNA, 19 nt, Homo sapiens
ggaccauggccucggagaa

SEQ ID NO: 321535 - RNA, 19 nt, Homo sapiens
gggcugaagggcuuucuca

SEQ ID NO: 321536 - RNA, 19 nt, Homo sapiens
gaccauggccucggagaag

SEQ ID NO: 321537 - RNA, 19 nt, Homo sapiens
gagcugguucugcccauca

SEQ ID NO: 321538 - RNA, 19 nt, Homo sapiens
cgacacuguggcugaguuu

SEQ ID NO: 321539 - RNA, 19 nt, Homo sapiens
ccagcgcuuugccaagaug

SEQ ID NO: 321540 - RNA, 19 nt, Homo sapiens
gggcaagcgcgaugaagag

SEQ ID NO: 321541 - RNA, 19 nt, Homo sapiens
ggagcuagggagcggaugu

SEQ ID NO: 321542 - RNA, 19 nt, Homo sapiens
gaauggagacacguuucug

SEQ ID NO: 321543 - RNA, 19 nt, Homo sapiens
gcucgaauggagacacguu

SEQ ID NO: 321544 - RNA, 19 nt, Homo sapiens
ucuacggcguggagaguga

SEQ ID NO: 321545 - RNA, 19 nt, Homo sapiens
gcacguggcaucggugaac

SEQ ID NO: 321546 - RNA, 19 nt, Homo sapiens
gggaauaaaccagcauugc

SEQ ID NO: 321547 - RNA, 19 nt, Homo sapiens
gagucacacuggccugaac

SEQ ID NO: 321548 - RNA, 19 nt, Homo sapiens
gcaccaggaccaguuaaaa

SEQ ID NO: 321549 - RNA, 19 nt, Homo sapiens
gaaacaggcugcucaaguu

SEQ ID NO: 321550 - RNA, 19 nt, Homo sapiens
gaaaguggaccucagcuua

SEQ ID NO: 321551 - RNA, 19 nt, Homo sapiens
gggaagauuucauccuuaa

SEQ ID NO: 321552 - RNA, 19 nt, Homo sapiens
gaacauuccuccggcuuca

SEQ ID NO: 321553 - RNA, 19 nt, Homo sapiens
gaccucagcuuacccaaca

SEQ ID NO: 321554 - RNA, 19 nt, Homo sapiens
gcaguguggccuugguuua

SEQ ID NO: 321555 - RNA, 19 nt, Homo sapiens
uggaagagcucauugacau

SEQ ID NO: 321556 - RNA, 19 nt, Homo sapiens
gaagauuucauccuuaaag

SEQ ID NO: 321557 - RNA, 19 nt, Homo sapiens
caaggaggauuuggagcua

SEQ ID NO: 321558 - RNA, 19 nt, Homo sapiens
cagcagcccuccugacugu

SEQ ID NO: 321559 - RNA, 19 nt, Homo sapiens
gcuggccuuucuuuacuua

SEQ ID NO: 321560 - RNA, 19 nt, Homo sapiens
cggugggccugguuaaaua

SEQ ID NO: 321561 - RNA, 19 nt, Homo sapiens
uggagaacaugccguggua

SEQ ID NO: 321562 - RNA, 19 nt, Homo sapiens
gaggauuuggagcuaauua

SEQ ID NO: 321563 - RNA, 19 nt, Homo sapiens
gcuguauccuugaacuuga

SEQ ID NO: 321564 - RNA, 19 nt, Homo sapiens
cgugguacauggcaaggua

SEQ ID NO: 321565 - RNA, 19 nt, Homo sapiens
gaaagucauccuucaugga

SEQ ID NO: 321566 - RNA, 19 nt, Homo sapiens
gagccuggauaucguagug

SEQ ID NO: 321567 - RNA, 19 nt, Homo sapiens
ucacaacacccaccucaga

SEQ ID NO: 321568 - RNA, 19 nt, Homo sapiens
ccacagcaaugggaaagug

SEQ ID NO: 321569 - RNA, 19 nt, Homo sapiens
gaaccagcaccaucugaau

SEQ ID NO: 321570 - RNA, 19 nt, Homo sapiens
uggccuuucuuuacuuaua

SEQ ID NO: 321571 - RNA, 19 nt, Homo sapiens
caagguagcacuggcugua

SEQ ID NO: 321572 - RNA, 19 nt, Homo sapiens
ccugagagguuuguggaaa

SEQ ID NO: 321573 - RNA, 19 nt, Homo sapiens
gagaggagcccacgacacu

SEQ ID NO: 321574 - RNA, 19 nt, Homo sapiens
caggagccauguugucaga

SEQ ID NO: 321575 - RNA, 19 nt, Homo sapiens
gggaaagucauccuucaug

SEQ ID NO: 321576 - RNA, 19 nt, Homo sapiens
ggugguggcuguggcauca

SEQ ID NO: 321577 - RNA, 19 nt, Homo sapiens
gcacuuggcccuucuaccu

SEQ ID NO: 321578 - RNA, 19 nt, Homo sapiens
agggaagauuucauccuua

SEQ ID NO: 321579 - RNA, 19 nt, Homo sapiens
ggagccauguugucagaag

SEQ ID NO: 321580 - RNA, 19 nt, Homo sapiens
gagcaaguggagaagcuaa

SEQ ID NO: 321581 - RNA, 19 nt, Homo sapiens
caaagucccucgcaauacc

SEQ ID NO: 321582 - RNA, 19 nt, Homo sapiens
cuccugaccucaauagaug

SEQ ID NO: 321583 - RNA, 19 nt, Homo sapiens
ggaaaguggaccucagcuu

SEQ ID NO: 321584 - RNA, 19 nt, Homo sapiens
ggcuuugacugcuuggaaa

SEQ ID NO: 321585 - RNA, 19 nt, Homo sapiens
ggaagauuucauccuuaaa

SEQ ID NO: 321586 - RNA, 19 nt, Homo sapiens
ccucagagcaaguggagaa

SEQ ID NO: 321587 - RNA, 19 nt, Homo sapiens
gcacuuucuuccgaucugu

SEQ ID NO: 321588 - RNA, 19 nt, Homo sapiens
aguguggccuugguuuaua

SEQ ID NO: 321589 - RNA, 19 nt, Homo sapiens
ggaagagcucauugacaug

SEQ ID NO: 321590 - RNA, 19 nt, Homo sapiens
gugcuggccuuucuuuacu

SEQ ID NO: 321591 - RNA, 19 nt, Homo sapiens
gcacuggcuguauccuuga

SEQ ID NO: 321592 - RNA, 19 nt, Homo sapiens
gauggcaaauggggaauaa

SEQ ID NO: 321593 - RNA, 19 nt, Homo sapiens
gagaacaugccgugguaca

SEQ ID NO: 321594 - RNA, 19 nt, Homo sapiens
ccuuguggcuggcgucaga

SEQ ID NO: 321595 - RNA, 19 nt, Homo sapiens
accaaagucccucgcaaua

SEQ ID NO: 321596 - RNA, 19 nt, Homo sapiens
uaacaagugggccuuccaa

SEQ ID NO: 321597 - RNA, 19 nt, Homo sapiens
agaaacaggcugcucaagu

SEQ ID NO: 321598 - RNA, 19 nt, Homo sapiens
gauuuggagcuaauuaaca

SEQ ID NO: 321599 - RNA, 19 nt, Homo sapiens
ggugggccugguuaaauaa

SEQ ID NO: 321600 - RNA, 19 nt, Homo sapiens
gaccagcuguggcuuugac

SEQ ID NO: 321601 - RNA, 19 nt, Homo sapiens
uaccaucaagggaagauuu

SEQ ID NO: 321602 - RNA, 19 nt, Homo sapiens
gagccauguugucagaagu

SEQ ID NO: 321603 - RNA, 19 nt, Homo sapiens
uggaaaagauggcaaaugg

SEQ ID NO: 321604 - RNA, 19 nt, Homo sapiens
cauguugucagaaguccua

SEQ ID NO: 321605 - RNA, 19 nt, Homo sapiens
gcggugggccugguuaaau

SEQ ID NO: 321606 - RNA, 19 nt, Homo sapiens
agucauccuucauggagaa

SEQ ID NO: 321607 - RNA, 19 nt, Homo sapiens
gcaauaccagggcccuugu

SEQ ID NO: 321608 - RNA, 19 nt, Homo sapiens
gcugugcuggccuuucuuu

SEQ ID NO: 321609 - RNA, 19 nt, Homo sapiens
guguggccuugguuuauau

SEQ ID NO: 321610 - RNA, 19 nt, Homo sapiens
gguggaccaaggaggauuu

SEQ ID NO: 321611 - RNA, 19 nt, Homo sapiens
gcuguggcuuugacugcuu

SEQ ID NO: 321612 - RNA, 19 nt, Homo sapiens
ucccaaacccgcugaagga

SEQ ID NO: 321613 - RNA, 19 nt, Homo sapiens
ugaaccagcaccaucugaa

SEQ ID NO: 321614 - RNA, 19 nt, Homo sapiens
cugcucaaguucccagaga

SEQ ID NO: 321615 - RNA, 19 nt, Homo sapiens
acuuauaccuguccaucug

SEQ ID NO: 321616 - RNA, 19 nt, Homo sapiens
gcaaguggagaagcuaaag

SEQ ID NO: 321617 - RNA, 19 nt, Homo sapiens
ucacuggacacaagcuuuc

SEQ ID NO: 321618 - RNA, 19 nt, Homo sapiens
ggccuuucuuuacuuauac

SEQ ID NO: 321619 - RNA, 19 nt, Homo sapiens
cagagcaaguggagaagcu

SEQ ID NO: 321620 - RNA, 19 nt, Homo sapiens
gcucaaguucccagagauc

SEQ ID NO: 321621 - RNA, 19 nt, Homo sapiens
aaacaggcugcucaaguuc

SEQ ID NO: 321622 - RNA, 19 nt, Homo sapiens
ccaaagucccucgcaauac

SEQ ID NO: 321623 - RNA, 19 nt, Homo sapiens
ggauuuggagcuaauuaac

SEQ ID NO: 321624 - RNA, 19 nt, Homo sapiens
gcagcccuccugacugugu

SEQ ID NO: 321625 - RNA, 19 nt, Homo sapiens
guuuauaugcacuuucuuc

SEQ ID NO: 321626 - RNA, 19 nt, Homo sapiens
guggcucacucagcacuug

SEQ ID NO: 321627 - RNA, 19 nt, Homo sapiens
caccaaagucccucgcaau

SEQ ID NO: 321628 - RNA, 19 nt, Homo sapiens
aaggaggauuuggagcuaa

SEQ ID NO: 321629 - RNA, 19 nt, Homo sapiens
ggcuguauccuugaacuug

SEQ ID NO: 321630 - RNA, 19 nt, Homo sapiens
gauguggccaggcuucagu

SEQ ID NO: 321631 - RNA, 19 nt, Homo sapiens
uggcugugcuggccuuucu

SEQ ID NO: 321632 - RNA, 19 nt, Homo sapiens
gaacguauauuagagcuua

SEQ ID NO: 321633 - RNA, 19 nt, Homo sapiens
gaagaaggguuacaugauu

SEQ ID NO: 321634 - RNA, 19 nt, Homo sapiens
ggacaucacugcucucaug

SEQ ID NO: 321635 - RNA, 19 nt, Homo sapiens
gaaggaagaugguuguuuc

SEQ ID NO: 321636 - RNA, 19 nt, Homo sapiens
ucacagauguuucgauaaa

SEQ ID NO: 321637 - RNA, 19 nt, Homo sapiens
caaaggaacugaagacaag

SEQ ID NO: 321638 - RNA, 19 nt, Homo sapiens
gaacaucacagcuuauuuc

SEQ ID NO: 321639 - RNA, 19 nt, Homo sapiens
gagaucagcucccgagaug

SEQ ID NO: 321640 - RNA, 19 nt, Homo sapiens
agaaggagcuggaagaaga

SEQ ID NO: 321641 - RNA, 19 nt, Homo sapiens
ucaagacacucaucaagaa

SEQ ID NO: 321642 - RNA, 19 nt, Homo sapiens
gaagaaacuugugaacgaa

SEQ ID NO: 321643 - RNA, 19 nt, Homo sapiens
gaagacauucggcuguuua

SEQ ID NO: 321644 - RNA, 19 nt, Homo sapiens
ugaagaaacuugugaacga

SEQ ID NO: 321645 - RNA, 19 nt, Homo sapiens
ccaaggaggugcaggagaa

SEQ ID NO: 321646 - RNA, 19 nt, Homo sapiens
gcaaggagaggaaacugua

SEQ ID NO: 321647 - RNA, 19 nt, Homo sapiens
gaccagagcucgggcaaga

SEQ ID NO: 321648 - RNA, 19 nt, Homo sapiens
gaaggaacguauauuagag

SEQ ID NO: 321649 - RNA, 19 nt, Homo sapiens
caaggagacucaccagaga

SEQ ID NO: 321650 - RNA, 19 nt, Homo sapiens
gggaaucagucaugagcua

SEQ ID NO: 321651 - RNA, 19 nt, Homo sapiens
ggagaggcaaggucaguua

SEQ ID NO: 321652 - RNA, 19 nt, Homo sapiens
ggaagacauucggcuguuu

SEQ ID NO: 321653 - RNA, 19 nt, Homo sapiens
gagcaugagugccgugugu

SEQ ID NO: 321654 - RNA, 19 nt, Homo sapiens
cacaugagcuggcgggauu

SEQ ID NO: 321655 - RNA, 19 nt, Homo sapiens
ccacaaauggaguacaaua

SEQ ID NO: 321656 - RNA, 19 nt, Homo sapiens
acacauaucuguaaaucuc

SEQ ID NO: 321657 - RNA, 19 nt, Homo sapiens
gguauaagaucaagacacu

SEQ ID NO: 321658 - RNA, 19 nt, Homo sapiens
gcucugugauaccauuuaa

SEQ ID NO: 321659 - RNA, 19 nt, Homo sapiens
gaaugggaaucagucauga

SEQ ID NO: 321660 - RNA, 19 nt, Homo sapiens
uuucacagauguuucgaua

SEQ ID NO: 321661 - RNA, 19 nt, Homo sapiens
gacacgaguuccacaaaug

SEQ ID NO: 321662 - RNA, 19 nt, Homo sapiens
cgacauaccggaagacgaa

SEQ ID NO: 321663 - RNA, 19 nt, Homo sapiens
cagaggagcuacaaaagua

SEQ ID NO: 321664 - RNA, 19 nt, Homo sapiens
gagacucaccagagaauaa

SEQ ID NO: 321665 - RNA, 19 nt, Homo sapiens
uauaaugucccuucacaaa

SEQ ID NO: 321666 - RNA, 19 nt, Homo sapiens
gagaauaacagaggagcua

SEQ ID NO: 321667 - RNA, 19 nt, Homo sapiens
gacauuggguauaagauca

SEQ ID NO: 321668 - RNA, 19 nt, Homo sapiens
ccagcgagcucaucacaca

SEQ ID NO: 321669 - RNA, 19 nt, Homo sapiens
gagcagaacaagagagaga

SEQ ID NO: 321670 - RNA, 19 nt, Homo sapiens
gcaaaucaaggcacuggaa

SEQ ID NO: 321671 - RNA, 19 nt, Homo sapiens
ugccaggcuuugugaauua

SEQ ID NO: 321672 - RNA, 19 nt, Homo sapiens
caagaaggccauaaaauuu

SEQ ID NO: 321673 - RNA, 19 nt, Homo sapiens
caucacacauaucuguaaa

SEQ ID NO: 321674 - RNA, 19 nt, Homo sapiens
uauuagagcuuacuuugca

SEQ ID NO: 321675 - RNA, 19 nt, Homo sapiens
gagaaccacccauauuuca

SEQ ID NO: 321676 - RNA, 19 nt, Homo sapiens
agacacucaucaagaagua

SEQ ID NO: 321677 - RNA, 19 nt, Homo sapiens
ggaaugggaaucagucaug

SEQ ID NO: 321678 - RNA, 19 nt, Homo sapiens
ggacuacgagauugagauu

SEQ ID NO: 321679 - RNA, 19 nt, Homo sapiens
ugaaggaacguauauuaga

SEQ ID NO: 321680 - RNA, 19 nt, Homo sapiens
cguuagccguggugauuua

SEQ ID NO: 321681 - RNA, 19 nt, Homo sapiens
ucacacauaucuguaaauc

SEQ ID NO: 321682 - RNA, 19 nt, Homo sapiens
ccauuuaacuuguugacau

SEQ ID NO: 321683 - RNA, 19 nt, Homo sapiens
gagagaaggagcuggaaga

SEQ ID NO: 321684 - RNA, 19 nt, Homo sapiens
cgacacgaguuccacaaau

SEQ ID NO: 321685 - RNA, 19 nt, Homo sapiens
gaaacugacacaugcugaa

SEQ ID NO: 321686 - RNA, 19 nt, Homo sapiens
ccugaaaucuggagugaag

SEQ ID NO: 321687 - RNA, 19 nt, Homo sapiens
ccgaagcccugcagagaga

SEQ ID NO: 321688 - RNA, 19 nt, Homo sapiens
gauaccauuuaacuuguug

SEQ ID NO: 321689 - RNA, 19 nt, Homo sapiens
caacagacucuuccaugga

SEQ ID NO: 321690 - RNA, 19 nt, Homo sapiens
ugaauuacaggacauuuga

SEQ ID NO: 321691 - RNA, 19 nt, Homo sapiens
gcaguuugguuucuagcau

SEQ ID NO: 321692 - RNA, 19 nt, Homo sapiens
caucacugcucucaugcaa

SEQ ID NO: 321693 - RNA, 19 nt, Homo sapiens
cugcugacauuggguauaa

SEQ ID NO: 321694 - RNA, 19 nt, Homo sapiens
gaucauccaguucuucaug

SEQ ID NO: 321695 - RNA, 19 nt, Homo sapiens
gaucaagacacucaucaag

SEQ ID NO: 321696 - RNA, 19 nt, Homo sapiens
ucuccucucucuguaauaa

SEQ ID NO: 321697 - RNA, 19 nt, Homo sapiens
gcucaucacacauaucugu

SEQ ID NO: 321698 - RNA, 19 nt, Homo sapiens
aagaaggguuacaugauug

SEQ ID NO: 321699 - RNA, 19 nt, Homo sapiens
gauaugguccggcuugcuu

SEQ ID NO: 321700 - RNA, 19 nt, Homo sapiens
gaagagccggcuguggaua

SEQ ID NO: 321701 - RNA, 19 nt, Homo sapiens
ggacaaaggaacugaagac

SEQ ID NO: 321702 - RNA, 19 nt, Homo sapiens
gaaggagcuggaagaagaa

SEQ ID NO: 321703 - RNA, 19 nt, Homo sapiens
cacaaauggaguacaauaa

SEQ ID NO: 321704 - RNA, 19 nt, Homo sapiens
guaaaucucugccccuguu

SEQ ID NO: 321705 - RNA, 19 nt, Homo sapiens
gugauaccauuuaacuugu

SEQ ID NO: 321706 - RNA, 19 nt, Homo sapiens
gcaaagaaggaagaugguu

SEQ ID NO: 321707 - RNA, 19 nt, Homo sapiens
gagcucaucacacauaucu

SEQ ID NO: 321708 - RNA, 19 nt, Homo sapiens
gaucagcucccgagauguc

SEQ ID NO: 321709 - RNA, 19 nt, Homo sapiens
gaugguuguuuccgaagug

SEQ ID NO: 321710 - RNA, 19 nt, Homo sapiens
ugacacaugcugaacauca

SEQ ID NO: 321711 - RNA, 19 nt, Homo sapiens
ugugauaccauuuaacuug

SEQ ID NO: 321712 - RNA, 19 nt, Homo sapiens
ucaagaaggccauaaaauu

SEQ ID NO: 321713 - RNA, 19 nt, Homo sapiens
aaacugaagaaacuuguga

SEQ ID NO: 321714 - RNA, 19 nt, Homo sapiens
gggcaagagcuccguguug

SEQ ID NO: 321715 - RNA, 19 nt, Homo sapiens
uaacagaggagcuacaaaa

SEQ ID NO: 321716 - RNA, 19 nt, Homo sapiens
ggaaucagucaugagcuaa

SEQ ID NO: 321717 - RNA, 19 nt, Homo sapiens
acuacgagauugagauuuc

SEQ ID NO: 321718 - RNA, 19 nt, Homo sapiens
cagcuuauuuccucauuuu

SEQ ID NO: 321719 - RNA, 19 nt, Homo sapiens
uugagaaccacccauauuu

SEQ ID NO: 321720 - RNA, 19 nt, Homo sapiens
uauaagaucaagacacuca

SEQ ID NO: 321721 - RNA, 19 nt, Homo sapiens
aauagaccuuccuggcaua

SEQ ID NO: 321722 - RNA, 19 nt, Homo sapiens
gaugcccgcuggugcugaa

SEQ ID NO: 321723 - RNA, 19 nt, Homo sapiens
ugaagacauuagagcagaa

SEQ ID NO: 321724 - RNA, 19 nt, Homo sapiens
ggaagagccggcuguggau

SEQ ID NO: 321725 - RNA, 19 nt, Homo sapiens
gagcugccaggcuuuguga

SEQ ID NO: 321726 - RNA, 19 nt, Homo sapiens
ugaagaaggguuacaugau

SEQ ID NO: 321727 - RNA, 19 nt, Homo sapiens
cagaguggcugugggcaau

SEQ ID NO: 321728 - RNA, 19 nt, Homo sapiens
agaaacuugugaacgaaga

SEQ ID NO: 321729 - RNA, 19 nt, Homo sapiens
guuacaugauugucaagug

SEQ ID NO: 321730 - RNA, 19 nt, Homo sapiens
ggaaggaaugggaaucagu

SEQ ID NO: 321731 - RNA, 19 nt, Homo sapiens
gcgagcucaucacacauau

SEQ ID NO: 321732 - RNA, 19 nt, Homo sapiens
gcaaggagcuucugggauu

SEQ ID NO: 321733 - RNA, 19 nt, Homo sapiens
gaaaggagccugagugauu

SEQ ID NO: 321734 - RNA, 19 nt, Homo sapiens
gcaaagagauccacugaag

SEQ ID NO: 321735 - RNA, 19 nt, Homo sapiens
gaucaaggcucucaucaag

SEQ ID NO: 321736 - RNA, 19 nt, Homo sapiens
gcagcgagcuugucaggaa

SEQ ID NO: 321737 - RNA, 19 nt, Homo sapiens
ggagauaccugaggcuauu

SEQ ID NO: 321738 - RNA, 19 nt, Homo sapiens
cagaaagacuuaccacuga

SEQ ID NO: 321739 - RNA, 19 nt, Homo sapiens
caaaugauguuuccuccaa

SEQ ID NO: 321740 - RNA, 19 nt, Homo sapiens
gaucagauuuacaguguug

SEQ ID NO: 321741 - RNA, 19 nt, Homo sapiens
gaucggaggugccaaguag

SEQ ID NO: 321742 - RNA, 19 nt, Homo sapiens
ggacauuuagugacuguua

SEQ ID NO: 321743 - RNA, 19 nt, Homo sapiens
uaaaugacaucucacugaa

SEQ ID NO: 321744 - RNA, 19 nt, Homo sapiens
gagcacgauugaagacaua

SEQ ID NO: 321745 - RNA, 19 nt, Homo sapiens
gaaauuauccagcaagcuu

SEQ ID NO: 321746 - RNA, 19 nt, Homo sapiens
ucaaggcucucaucaagaa

SEQ ID NO: 321747 - RNA, 19 nt, Homo sapiens
gaccagagcucgggcaaga

SEQ ID NO: 321748 - RNA, 19 nt, Homo sapiens
ggagaaagagauacacaaa

SEQ ID NO: 321749 - RNA, 19 nt, Homo sapiens
gcacagcaccugcagcauu

SEQ ID NO: 321750 - RNA, 19 nt, Homo sapiens
ucaaacacauccauauuuc

SEQ ID NO: 321751 - RNA, 19 nt, Homo sapiens
caagaagggcuacaugauu

SEQ ID NO: 321752 - RNA, 19 nt, Homo sapiens
aaccagaucccauuuauaa

SEQ ID NO: 321753 - RNA, 19 nt, Homo sapiens
agaaagccauggaaauuau

SEQ ID NO: 321754 - RNA, 19 nt, Homo sapiens
ccacugaacucaucaugca

SEQ ID NO: 321755 - RNA, 19 nt, Homo sapiens
aagaagggcuacaugauug

SEQ ID NO: 321756 - RNA, 19 nt, Homo sapiens
gaccaaaccagaucuaaug

SEQ ID NO: 321757 - RNA, 19 nt, Homo sapiens
gggccaaacucuucuguca

SEQ ID NO: 321758 - RNA, 19 nt, Homo sapiens
ccagaucccauuuauaauu

SEQ ID NO: 321759 - RNA, 19 nt, Homo sapiens
ccaaccagaucccauuuau

SEQ ID NO: 321760 - RNA, 19 nt, Homo sapiens
gaaaguccgagaagagauu

SEQ ID NO: 321761 - RNA, 19 nt, Homo sapiens
gaagaaaguccgagaagag

SEQ ID NO: 321762 - RNA, 19 nt, Homo sapiens
gcaaacgucucgccaacca

SEQ ID NO: 321763 - RNA, 19 nt, Homo sapiens
cagaaagccauggaaauua

SEQ ID NO: 321764 - RNA, 19 nt, Homo sapiens
ccagaaagccauggaaauu

SEQ ID NO: 321765 - RNA, 19 nt, Homo sapiens
gagcuuccauuguucuguu

SEQ ID NO: 321766 - RNA, 19 nt, Homo sapiens
ggaugccgcuucugcuuug

SEQ ID NO: 321767 - RNA, 19 nt, Homo sapiens
gcccaggccuuggacauuu

SEQ ID NO: 321768 - RNA, 19 nt, Homo sapiens
guuacaguguccuaagaua

SEQ ID NO: 321769 - RNA, 19 nt, Homo sapiens
cacagaauaugaaguugaa

SEQ ID NO: 321770 - RNA, 19 nt, Homo sapiens
gccaaggacuucaacuuuc

SEQ ID NO: 321771 - RNA, 19 nt, Homo sapiens
gcauuguaacugcuuaaua

SEQ ID NO: 321772 - RNA, 19 nt, Homo sapiens
gaauuuaccggcucacuca

SEQ ID NO: 321773 - RNA, 19 nt, Homo sapiens
ccagcaagcuuucauuaac

SEQ ID NO: 321774 - RNA, 19 nt, Homo sapiens
gaaugagacccguuuauac

SEQ ID NO: 321775 - RNA, 19 nt, Homo sapiens
gggaaggucugggucaaau

SEQ ID NO: 321776 - RNA, 19 nt, Homo sapiens
ggauggcucuccaguccuu

SEQ ID NO: 321777 - RNA, 19 nt, Homo sapiens
cagaucccauuuauaauuc

SEQ ID NO: 321778 - RNA, 19 nt, Homo sapiens
agaaugagacccguuuaua

SEQ ID NO: 321779 - RNA, 19 nt, Homo sapiens
ggaaacaggagccaaccaa

SEQ ID NO: 321780 - RNA, 19 nt, Homo sapiens
acgaaugagugcuguguaa

SEQ ID NO: 321781 - RNA, 19 nt, Homo sapiens
gaaggucugggucaaauuc

SEQ ID NO: 321782 - RNA, 19 nt, Homo sapiens
agaaggagaagaaguugua

SEQ ID NO: 321783 - RNA, 19 nt, Homo sapiens
augaugagcuuccauuguu

SEQ ID NO: 321784 - RNA, 19 nt, Homo sapiens
ugaagaaaguccgagaaga

SEQ ID NO: 321785 - RNA, 19 nt, Homo sapiens
agaaagagauacacaaagc

SEQ ID NO: 321786 - RNA, 19 nt, Homo sapiens
cuucuuguuucccugauua

SEQ ID NO: 321787 - RNA, 19 nt, Homo sapiens
cacagcaccugcagcauug

SEQ ID NO: 321788 - RNA, 19 nt, Homo sapiens
caaccagaucccauuuaua

SEQ ID NO: 321789 - RNA, 19 nt, Homo sapiens
gggacgccuucacagaaua

SEQ ID NO: 321790 - RNA, 19 nt, Homo sapiens
aagaucagauuuacagugu

SEQ ID NO: 321791 - RNA, 19 nt, Homo sapiens
ggagaaugagacccguuua

SEQ ID NO: 321792 - RNA, 19 nt, Homo sapiens
gcaaccaagaaagaaauua

SEQ ID NO: 321793 - RNA, 19 nt, Homo sapiens
ugagaccgcuaccaagaga

SEQ ID NO: 321794 - RNA, 19 nt, Homo sapiens
guaaugagucuucgguuuc

SEQ ID NO: 321795 - RNA, 19 nt, Homo sapiens
ccaaggacuucaacuuucu

SEQ ID NO: 321796 - RNA, 19 nt, Homo sapiens
aguaaugagucuucgguuu

SEQ ID NO: 321797 - RNA, 19 nt, Homo sapiens
caaggagcuucugggauuu

SEQ ID NO: 321798 - RNA, 19 nt, Homo sapiens
gagaaugagacccguuuau

SEQ ID NO: 321799 - RNA, 19 nt, Homo sapiens
guuaguagaaggagaagaa

SEQ ID NO: 321800 - RNA, 19 nt, Homo sapiens
gaacucaucaugcauaucc

SEQ ID NO: 321801 - RNA, 19 nt, Homo sapiens
gagaaaagcgucaugaaug

SEQ ID NO: 321802 - RNA, 19 nt, Homo sapiens
gaacgaaugagugcugugu

SEQ ID NO: 321803 - RNA, 19 nt, Homo sapiens
cagcaaagagauccacuga

SEQ ID NO: 321804 - RNA, 19 nt, Homo sapiens
agaaagccaugaugcagau

SEQ ID NO: 321805 - RNA, 19 nt, Homo sapiens
gccaaacucuucugucacu

SEQ ID NO: 321806 - RNA, 19 nt, Homo sapiens
ccaccugaaugccuacuuc

SEQ ID NO: 321807 - RNA, 19 nt, Homo sapiens
gacuucaacuuucucacuu

SEQ ID NO: 321808 - RNA, 19 nt, Homo sapiens
cgacuggcagaaagacuua

SEQ ID NO: 321809 - RNA, 19 nt, Homo sapiens
gcuacaugauugugaagug

SEQ ID NO: 321810 - RNA, 19 nt, Homo sapiens
gaauggagcagaugguuuu

SEQ ID NO: 321811 - RNA, 19 nt, Homo sapiens
agaaagacuuaccacugaa

SEQ ID NO: 321812 - RNA, 19 nt, Homo sapiens
cagaaaggagccugaguga

SEQ ID NO: 321813 - RNA, 19 nt, Homo sapiens
gaaugagugcuguguaagu

SEQ ID NO: 321814 - RNA, 19 nt, Homo sapiens
gcguacucauucauucuaa

SEQ ID NO: 321815 - RNA, 19 nt, Homo sapiens
cagagaaggacgcugcuuu

SEQ ID NO: 321816 - RNA, 19 nt, Homo sapiens
uacaagacauuugagauca

SEQ ID NO: 321817 - RNA, 19 nt, Homo sapiens
ggacaggaccaucgguauc

SEQ ID NO: 321818 - RNA, 19 nt, Homo sapiens
aaaggagccugagugauuc

SEQ ID NO: 321819 - RNA, 19 nt, Homo sapiens
auaaaugacaucucacuga

SEQ ID NO: 321820 - RNA, 19 nt, Homo sapiens
ucacagaauaugaaguuga

SEQ ID NO: 321821 - RNA, 19 nt, Homo sapiens
caagacauuugagaucauc

SEQ ID NO: 321822 - RNA, 19 nt, Homo sapiens
uaggcauacuugcaacuaa

SEQ ID NO: 321823 - RNA, 19 nt, Homo sapiens
gaaggagaagaaguuguaa

SEQ ID NO: 321824 - RNA, 19 nt, Homo sapiens
ccaggaggccgacaagaug

SEQ ID NO: 321825 - RNA, 19 nt, Homo sapiens
gguguccgcuggugcugaa

SEQ ID NO: 321826 - RNA, 19 nt, Homo sapiens
cccaggccuuggacauuua

SEQ ID NO: 321827 - RNA, 19 nt, Homo sapiens
gggagaaugagacccguuu

SEQ ID NO: 321828 - RNA, 19 nt, Homo sapiens
uaagggagagccaccagaa

SEQ ID NO: 321829 - RNA, 19 nt, Homo sapiens
cgccaaggacuucaacuuu

SEQ ID NO: 321830 - RNA, 19 nt, Homo sapiens
caguuacaguguccuaaga

SEQ ID NO: 321831 - RNA, 19 nt, Homo sapiens
accaagagaagaauccuua

SEQ ID NO: 321832 - RNA, 19 nt, Homo sapiens
caacagaucuacacacaau

SEQ ID NO: 321833 - RNA, 19 nt, Homo sapiens
gaucaacuauuucuucaga

SEQ ID NO: 321834 - RNA, 19 nt, Homo sapiens
guaaagauuugcuuccauu

SEQ ID NO: 321835 - RNA, 19 nt, Homo sapiens
gcagaaaacuugugugaaa

SEQ ID NO: 321836 - RNA, 19 nt, Homo sapiens
ccucacaccucacucuuua

SEQ ID NO: 321837 - RNA, 19 nt, Homo sapiens
guucagcacuugucucauu

SEQ ID NO: 321838 - RNA, 19 nt, Homo sapiens
gaugcagucuccucuuuaa

SEQ ID NO: 321839 - RNA, 19 nt, Homo sapiens
gaaguggacaauauaagua

SEQ ID NO: 321840 - RNA, 19 nt, Homo sapiens
gcuggaggcugccgaguuu

SEQ ID NO: 321841 - RNA, 19 nt, Homo sapiens
gcacuuugaugucaugugu

SEQ ID NO: 321842 - RNA, 19 nt, Homo sapiens
ggaccuguauuuaagcaaa

SEQ ID NO: 321843 - RNA, 19 nt, Homo sapiens
gaacauggcuacgccucuu

SEQ ID NO: 321844 - RNA, 19 nt, Homo sapiens
ugaagaagcugaaagaaaa

SEQ ID NO: 321845 - RNA, 19 nt, Homo sapiens
gaugucauguguucccuuu

SEQ ID NO: 321846 - RNA, 19 nt, Homo sapiens
caucugauaucuauaguag

SEQ ID NO: 321847 - RNA, 19 nt, Homo sapiens
gcacacaacacuugguuug

SEQ ID NO: 321848 - RNA, 19 nt, Homo sapiens
cuacaaggccuaugaguau

SEQ ID NO: 321849 - RNA, 19 nt, Homo sapiens
ucagaggaccuguauuuaa

SEQ ID NO: 321850 - RNA, 19 nt, Homo sapiens
ucacugggccaauucaaua

SEQ ID NO: 321851 - RNA, 19 nt, Homo sapiens
ggagaaguggacaauauaa

SEQ ID NO: 321852 - RNA, 19 nt, Homo sapiens
ccaaggagaacaaauauuc

SEQ ID NO: 321853 - RNA, 19 nt, Homo sapiens
cagaggaccuguauuuaag

SEQ ID NO: 321854 - RNA, 19 nt, Homo sapiens
ccaaagcacacaucaagaa

SEQ ID NO: 321855 - RNA, 19 nt, Homo sapiens
gcacuugucucauuuuaau

SEQ ID NO: 321856 - RNA, 19 nt, Homo sapiens
acaaugagcuggaaaagaa

SEQ ID NO: 321857 - RNA, 19 nt, Homo sapiens
uaauuucaguccuguaguu

SEQ ID NO: 321858 - RNA, 19 nt, Homo sapiens
ugaaagggaucaucaugca

SEQ ID NO: 321859 - RNA, 19 nt, Homo sapiens
ggaacgagaacagagauuu

SEQ ID NO: 321860 - RNA, 19 nt, Homo sapiens
ggucugggcuagguagaaa

SEQ ID NO: 321861 - RNA, 19 nt, Homo sapiens
ggagaacaaauauucagaa

SEQ ID NO: 321862 - RNA, 19 nt, Homo sapiens
ucacaccucacucuuuaua

SEQ ID NO: 321863 - RNA, 19 nt, Homo sapiens
gagcucaucugcgccuuug

SEQ ID NO: 321864 - RNA, 19 nt, Homo sapiens
gccaacagaucuacacaca

SEQ ID NO: 321865 - RNA, 19 nt, Homo sapiens
caugacagccucuauccua

SEQ ID NO: 321866 - RNA, 19 nt, Homo sapiens
caccagcacugccaacaga

SEQ ID NO: 321867 - RNA, 19 nt, Homo sapiens
gaagaggacauuggagaug

SEQ ID NO: 321868 - RNA, 19 nt, Homo sapiens
caaagcacacaucaagaaa

SEQ ID NO: 321869 - RNA, 19 nt, Homo sapiens
gaguugugcacgcagauua

SEQ ID NO: 321870 - RNA, 19 nt, Homo sapiens
gagauggaacgaauacgaa

SEQ ID NO: 321871 - RNA, 19 nt, Homo sapiens
ggagauggaacgaauacga

SEQ ID NO: 321872 - RNA, 19 nt, Homo sapiens
ugaaguggauguugaaagc

SEQ ID NO: 321873 - RNA, 19 nt, Homo sapiens
agcaccagcucgagaauuu

SEQ ID NO: 321874 - RNA, 19 nt, Homo sapiens
gagcgagagugugaacaug

SEQ ID NO: 321875 - RNA, 19 nt, Homo sapiens
caucaugcagcucaacuuu

SEQ ID NO: 321876 - RNA, 19 nt, Homo sapiens
gaacccagcaugacauaac

SEQ ID NO: 321877 - RNA, 19 nt, Homo sapiens
caucugcgccuuuguuuag

SEQ ID NO: 321878 - RNA, 19 nt, Homo sapiens
gacagccucuauccuacaa

SEQ ID NO: 321879 - RNA, 19 nt, Homo sapiens
aauauucacugggccaauu

SEQ ID NO: 321880 - RNA, 19 nt, Homo sapiens
agauugaaguggauguuga

SEQ ID NO: 321881 - RNA, 19 nt, Homo sapiens
ucaacuauuucuucagauc

SEQ ID NO: 321882 - RNA, 19 nt, Homo sapiens
uuucuagccugcacuuuga

SEQ ID NO: 321883 - RNA, 19 nt, Homo sapiens
ucaugcagcucaacuuucu

SEQ ID NO: 321884 - RNA, 19 nt, Homo sapiens
agacucccaugaagccuuu

SEQ ID NO: 321885 - RNA, 19 nt, Homo sapiens
ggugcuauuguuacucuua

SEQ ID NO: 321886 - RNA, 19 nt, Homo sapiens
acaccucacucuuuauagu

SEQ ID NO: 321887 - RNA, 19 nt, Homo sapiens
ccuacaaggccuaugagua

SEQ ID NO: 321888 - RNA, 19 nt, Homo sapiens
guauuaaucuuggauagcu

SEQ ID NO: 321889 - RNA, 19 nt, Homo sapiens
gaguagacacauuuaagga

SEQ ID NO: 321890 - RNA, 19 nt, Homo sapiens
auggagaaguggacaauau

SEQ ID NO: 321891 - RNA, 19 nt, Homo sapiens
ugucauguguucccuuugu

SEQ ID NO: 321892 - RNA, 19 nt, Homo sapiens
ugaagccuguggaugauca

SEQ ID NO: 321893 - RNA, 19 nt, Homo sapiens
gaacgagaacagagauuuu

SEQ ID NO: 321894 - RNA, 19 nt, Homo sapiens
gaaacuugaagaagcugaa

SEQ ID NO: 321895 - RNA, 19 nt, Homo sapiens
acacuugguuugcucaaca

SEQ ID NO: 321896 - RNA, 19 nt, Homo sapiens
gcucaucugcgccuuuguu

SEQ ID NO: 321897 - RNA, 19 nt, Homo sapiens
gggugaagaugaucaacgu

SEQ ID NO: 321898 - RNA, 19 nt, Homo sapiens
ugggacaguuuaucaugaa

SEQ ID NO: 321899 - RNA, 19 nt, Homo sapiens
gggagcaguccaugcauga

SEQ ID NO: 321900 - RNA, 19 nt, Homo sapiens
gaggaccuguauuuaagca

SEQ ID NO: 321901 - RNA, 19 nt, Homo sapiens
uggagaaguggacaauaua

SEQ ID NO: 321902 - RNA, 19 nt, Homo sapiens
cagauuagcaggccaaggu

SEQ ID NO: 321903 - RNA, 19 nt, Homo sapiens
uugaagaagcugaaagaaa

SEQ ID NO: 321904 - RNA, 19 nt, Homo sapiens
agauagggcugggcaagga

SEQ ID NO: 321905 - RNA, 19 nt, Homo sapiens
acagaucuacacacaauga

SEQ ID NO: 321906 - RNA, 19 nt, Homo sapiens
uacauugaguagacacauu

SEQ ID NO: 321907 - RNA, 19 nt, Homo sapiens
caaggagaacaaauauuca

SEQ ID NO: 321908 - RNA, 19 nt, Homo sapiens
gucagaggaccuguauuua

SEQ ID NO: 321909 - RNA, 19 nt, Homo sapiens
aagcacacaucaagaaacu

SEQ ID NO: 321910 - RNA, 19 nt, Homo sapiens
guuuggacuuuguauacuu

SEQ ID NO: 321911 - RNA, 19 nt, Homo sapiens
gucaaacuuucauucacuu

SEQ ID NO: 321912 - RNA, 19 nt, Homo sapiens
gagaaguggacaauauaag

SEQ ID NO: 321913 - RNA, 19 nt, Homo sapiens
uggaucaacuauuucuuca

SEQ ID NO: 321914 - RNA, 19 nt, Homo sapiens
gcucgagaauuuggaacga

SEQ ID NO: 321915 - RNA, 19 nt, Homo sapiens
ccacugugcaggugcuauu

SEQ ID NO: 321916 - RNA, 19 nt, Homo sapiens
caugaagccuguggaugau

SEQ ID NO: 321917 - RNA, 19 nt, Homo sapiens
uuggauagcuaauaaugag

SEQ ID NO: 321918 - RNA, 19 nt, Homo sapiens
ugaugcagucuccucuuua

SEQ ID NO: 321919 - RNA, 19 nt, Homo sapiens
gauugaaguggauguugaa

SEQ ID NO: 321920 - RNA, 19 nt, Homo sapiens
uaaaguggcgacuggaaca

SEQ ID NO: 321921 - RNA, 19 nt, Homo sapiens
ccuguggcccucucccuua

SEQ ID NO: 321922 - RNA, 19 nt, Homo sapiens
cagcacuugucucauuuua

SEQ ID NO: 321923 - RNA, 19 nt, Homo sapiens
ggagcgagagugugaacau

SEQ ID NO: 321924 - RNA, 19 nt, Homo sapiens
ccauggagcgggugaagau

SEQ ID NO: 321925 - RNA, 19 nt, Homo sapiens
gcuguuuggacuuuguaua

SEQ ID NO: 321926 - RNA, 19 nt, Homo sapiens
aaccuuauccugcauuguu

SEQ ID NO: 321927 - RNA, 19 nt, Homo sapiens
cugggacaguuuaucauga

SEQ ID NO: 321928 - RNA, 19 nt, Homo sapiens
augaugcagucuccucuuu

SEQ ID NO: 321929 - RNA, 19 nt, Homo sapiens
uagaacccagcaugacaua

SEQ ID NO: 321930 - RNA, 19 nt, Homo sapiens
cauagaacccagcaugaca

SEQ ID NO: 321931 - RNA, 19 nt, Homo sapiens
ugucaaacuuucauucacu

SEQ ID NO: 321932 - RNA, 19 nt, Homo sapiens
gaucaacuauuucuucaga

SEQ ID NO: 321933 - RNA, 19 nt, Homo sapiens
guaaagauuugcuuccauu

SEQ ID NO: 321934 - RNA, 19 nt, Homo sapiens
gcagaaaacuugugugaaa

SEQ ID NO: 321935 - RNA, 19 nt, Homo sapiens
ccucacaccucacucuuua

SEQ ID NO: 321936 - RNA, 19 nt, Homo sapiens
guucagcacuugucucauu

SEQ ID NO: 321937 - RNA, 19 nt, Homo sapiens
gaaguggacaauauaagua

SEQ ID NO: 321938 - RNA, 19 nt, Homo sapiens
gcacuuugaugucaugugu

SEQ ID NO: 321939 - RNA, 19 nt, Homo sapiens
ggaccuguauuuaagcaaa

SEQ ID NO: 321940 - RNA, 19 nt, Homo sapiens
gaacauggcuacgccucuu

SEQ ID NO: 321941 - RNA, 19 nt, Homo sapiens
ugaagaagcugaaagaaaa

SEQ ID NO: 321942 - RNA, 19 nt, Homo sapiens
gaugucauguguucccuuu

SEQ ID NO: 321943 - RNA, 19 nt, Homo sapiens
caucugauaucuauaguag

SEQ ID NO: 321944 - RNA, 19 nt, Homo sapiens
gcacacaacacuugguuug

SEQ ID NO: 321945 - RNA, 19 nt, Homo sapiens
cuacaaggccuaugaguau

SEQ ID NO: 321946 - RNA, 19 nt, Homo sapiens
ucagaggaccuguauuuaa

SEQ ID NO: 321947 - RNA, 19 nt, Homo sapiens
ucacugggccaauucaaua

SEQ ID NO: 321948 - RNA, 19 nt, Homo sapiens
ggagaaguggacaauauaa

SEQ ID NO: 321949 - RNA, 19 nt, Homo sapiens
ccaaggagaacaaauauuc

SEQ ID NO: 321950 - RNA, 19 nt, Homo sapiens
cagaggaccuguauuuaag

SEQ ID NO: 321951 - RNA, 19 nt, Homo sapiens
ccaaagcacacaucaagaa

SEQ ID NO: 321952 - RNA, 19 nt, Homo sapiens
gcacuugucucauuuuaau

SEQ ID NO: 321953 - RNA, 19 nt, Homo sapiens
uaauuucaguccuguaguu

SEQ ID NO: 321954 - RNA, 19 nt, Homo sapiens
ugaaagggaucaucaugca

SEQ ID NO: 321955 - RNA, 19 nt, Homo sapiens
ggaacgagaacagagauuu

SEQ ID NO: 321956 - RNA, 19 nt, Homo sapiens
ggucugggcuagguagaaa

SEQ ID NO: 321957 - RNA, 19 nt, Homo sapiens
ggagaacaaauauucagaa

SEQ ID NO: 321958 - RNA, 19 nt, Homo sapiens
ucacaccucacucuuuaua

SEQ ID NO: 321959 - RNA, 19 nt, Homo sapiens
gagcucaucugcgccuuug

SEQ ID NO: 321960 - RNA, 19 nt, Homo sapiens
caugacagccucuauccua

SEQ ID NO: 321961 - RNA, 19 nt, Homo sapiens
caccagcacugccaacaga

SEQ ID NO: 321962 - RNA, 19 nt, Homo sapiens
gaagaggacauuggagaug

SEQ ID NO: 321963 - RNA, 19 nt, Homo sapiens
caaagcacacaucaagaaa

SEQ ID NO: 321964 - RNA, 19 nt, Homo sapiens
gcacccaagucuaagucaa

SEQ ID NO: 321965 - RNA, 19 nt, Homo sapiens
gaguugugcacgcagauua

SEQ ID NO: 321966 - RNA, 19 nt, Homo sapiens
gagauggaacgaauacgaa

SEQ ID NO: 321967 - RNA, 19 nt, Homo sapiens
ggagauggaacgaauacga

SEQ ID NO: 321968 - RNA, 19 nt, Homo sapiens
ugaaguggauguugaaagc

SEQ ID NO: 321969 - RNA, 19 nt, Homo sapiens
agcaccagcucgagaauuu

SEQ ID NO: 321970 - RNA, 19 nt, Homo sapiens
caucaugcagcucaacuuu

SEQ ID NO: 321971 - RNA, 19 nt, Homo sapiens
caucugcgccuuuguuuag

SEQ ID NO: 321972 - RNA, 19 nt, Homo sapiens
gaacccagcaugacauaac

SEQ ID NO: 321973 - RNA, 19 nt, Homo sapiens
gacagccucuauccuacaa

SEQ ID NO: 321974 - RNA, 19 nt, Homo sapiens
aauauucacugggccaauu

SEQ ID NO: 321975 - RNA, 19 nt, Homo sapiens
agauugaaguggauguuga

SEQ ID NO: 321976 - RNA, 19 nt, Homo sapiens
ucaacuauuucuucagauc

SEQ ID NO: 321977 - RNA, 19 nt, Homo sapiens
uuucuagccugcacuuuga

SEQ ID NO: 321978 - RNA, 19 nt, Homo sapiens
ucaugcagcucaacuuucu

SEQ ID NO: 321979 - RNA, 19 nt, Homo sapiens
agacucccaugaagccuuu

SEQ ID NO: 321980 - RNA, 19 nt, Homo sapiens
ggugcuauuguuacucuua

SEQ ID NO: 321981 - RNA, 19 nt, Homo sapiens
acaccucacucuuuauagu

SEQ ID NO: 321982 - RNA, 19 nt, Homo sapiens
ccuacaaggccuaugagua

SEQ ID NO: 321983 - RNA, 19 nt, Homo sapiens
guauuaaucuuggauagcu

SEQ ID NO: 321984 - RNA, 19 nt, Homo sapiens
gaguagacacauuuaagga

SEQ ID NO: 321985 - RNA, 19 nt, Homo sapiens
auggagaaguggacaauau

SEQ ID NO: 321986 - RNA, 19 nt, Homo sapiens
ugucauguguucccuuugu

SEQ ID NO: 321987 - RNA, 19 nt, Homo sapiens
ugaagccuguggaugauca

SEQ ID NO: 321988 - RNA, 19 nt, Homo sapiens
gcucaucugcgccuuuguu

SEQ ID NO: 321989 - RNA, 19 nt, Homo sapiens
gaacgagaacagagauuuu

SEQ ID NO: 321990 - RNA, 19 nt, Homo sapiens
gaaacuugaagaagcugaa

SEQ ID NO: 321991 - RNA, 19 nt, Homo sapiens
acacuugguuugcucaaca

SEQ ID NO: 321992 - RNA, 19 nt, Homo sapiens
ugggacaguuuaucaugaa

SEQ ID NO: 321993 - RNA, 19 nt, Homo sapiens
gggagcaguccaugcauga

SEQ ID NO: 321994 - RNA, 19 nt, Homo sapiens
gaggaccuguauuuaagca

SEQ ID NO: 321995 - RNA, 19 nt, Homo sapiens
uggagaaguggacaauaua

SEQ ID NO: 321996 - RNA, 19 nt, Homo sapiens
cagauuagcaggccaaggu

SEQ ID NO: 321997 - RNA, 19 nt, Homo sapiens
uugaagaagcugaaagaaa

SEQ ID NO: 321998 - RNA, 19 nt, Homo sapiens
agauagggcugggcaagga

SEQ ID NO: 321999 - RNA, 19 nt, Homo sapiens
uacauugaguagacacauu

SEQ ID NO: 322000 - RNA, 19 nt, Homo sapiens
caaggagaacaaauauuca

SEQ ID NO: 322001 - RNA, 19 nt, Homo sapiens
gucagaggaccuguauuua

SEQ ID NO: 322002 - RNA, 19 nt, Homo sapiens
aagcacacaucaagaaacu

SEQ ID NO: 322003 - RNA, 19 nt, Homo sapiens
guuuggacuuuguauacuu

SEQ ID NO: 322004 - RNA, 19 nt, Homo sapiens
gucaaacuuucauucacuu

SEQ ID NO: 322005 - RNA, 19 nt, Homo sapiens
gagaaguggacaauauaag

SEQ ID NO: 322006 - RNA, 19 nt, Homo sapiens
uggaucaacuauuucuuca

SEQ ID NO: 322007 - RNA, 19 nt, Homo sapiens
gcucgagaauuuggaacga

SEQ ID NO: 322008 - RNA, 19 nt, Homo sapiens
ccacugugcaggugcuauu

SEQ ID NO: 322009 - RNA, 19 nt, Homo sapiens
caugaagccuguggaugau

SEQ ID NO: 322010 - RNA, 19 nt, Homo sapiens
uuggauagcuaauaaugag

SEQ ID NO: 322011 - RNA, 19 nt, Homo sapiens
gauugaaguggauguugaa

SEQ ID NO: 322012 - RNA, 19 nt, Homo sapiens
uaaaguggcgacuggaaca

SEQ ID NO: 322013 - RNA, 19 nt, Homo sapiens
ccuguggcccucucccuua

SEQ ID NO: 322014 - RNA, 19 nt, Homo sapiens
cagcacuugucucauuuua

SEQ ID NO: 322015 - RNA, 19 nt, Homo sapiens
gcuguuuggacuuuguaua

SEQ ID NO: 322016 - RNA, 19 nt, Homo sapiens
aaccuuauccugcauuguu

SEQ ID NO: 322017 - RNA, 19 nt, Homo sapiens
cugggacaguuuaucauga

SEQ ID NO: 322018 - RNA, 19 nt, Homo sapiens
uagaacccagcaugacaua

SEQ ID NO: 322019 - RNA, 19 nt, Homo sapiens
cauagaacccagcaugaca

SEQ ID NO: 322020 - RNA, 19 nt, Homo sapiens
ugucaaacuuucauucacu

SEQ ID NO: 322021 - RNA, 19 nt, Homo sapiens
gagauugaaguggauguug

SEQ ID NO: 322022 - RNA, 19 nt, Homo sapiens
uuucaguccuguaguuuua

SEQ ID NO: 322023 - RNA, 19 nt, Homo sapiens
caggugcuauuguuacucu

SEQ ID NO: 322024 - RNA, 19 nt, Homo sapiens
gagcaguccaugcaugaca

SEQ ID NO: 322025 - RNA, 19 nt, Homo sapiens
acauugaguagacacauuu

SEQ ID NO: 322026 - RNA, 19 nt, Homo sapiens
uggcuacgccucuucauuc

SEQ ID NO: 322027 - RNA, 19 nt, Homo sapiens
uauccuacaaggccuauga

SEQ ID NO: 322028 - RNA, 19 nt, Homo sapiens
guaccaccagcaucaguga

SEQ ID NO: 322029 - RNA, 19 nt, Homo sapiens
agaaguggacaauauaagu

SEQ ID NO: 322030 - RNA, 19 nt, Homo sapiens
ggagauugaaguggauguu

SEQ ID NO: 322031 - RNA, 19 nt, Homo sapiens
gauggaacgaauacgaaug

SEQ ID NO: 322032 - RNA, 19 nt, Homo sapiens
gcagaaacacuccaauuua

SEQ ID NO: 322033 - RNA, 19 nt, Homo sapiens
guaaauacgugaaugcauu

SEQ ID NO: 322034 - RNA, 19 nt, Homo sapiens
gcacugaacuuuugagaua

SEQ ID NO: 322035 - RNA, 19 nt, Homo sapiens
gaagaacagucauuugaug

SEQ ID NO: 322036 - RNA, 19 nt, Homo sapiens
acagaugacuggaaaguua

SEQ ID NO: 322037 - RNA, 19 nt, Homo sapiens
ggaaaugccuucuuuaacu

SEQ ID NO: 322038 - RNA, 19 nt, Homo sapiens
uuagaaagcucuccaagaa

SEQ ID NO: 322039 - RNA, 19 nt, Homo sapiens
gaaacuugguguuagguaa

SEQ ID NO: 322040 - RNA, 19 nt, Homo sapiens
gaaaugccuucuuuaacuu

SEQ ID NO: 322041 - RNA, 19 nt, Homo sapiens
gaagaggaagacagaauua

SEQ ID NO: 322042 - RNA, 19 nt, Homo sapiens
cagaaacacuccaauuuau

SEQ ID NO: 322043 - RNA, 19 nt, Homo sapiens
ugauagagcuuguacagaa

SEQ ID NO: 322044 - RNA, 19 nt, Homo sapiens
aaauaaagaugugcccuua

SEQ ID NO: 322045 - RNA, 19 nt, Homo sapiens
gaggaagacagaauuauuu

SEQ ID NO: 322046 - RNA, 19 nt, Homo sapiens
ugaagaagcugguggaaca

SEQ ID NO: 322047 - RNA, 19 nt, Homo sapiens
gcacuaguauuucagacuu

SEQ ID NO: 322048 - RNA, 19 nt, Homo sapiens
ggaccacccuuacugaaga

SEQ ID NO: 322049 - RNA, 19 nt, Homo sapiens
ccgaaacguuggucuguua

SEQ ID NO: 322050 - RNA, 19 nt, Homo sapiens
gaacagaugggcagaaauc

SEQ ID NO: 322051 - RNA, 19 nt, Homo sapiens
ucuguuagcuugcuuuaaa

SEQ ID NO: 322052 - RNA, 19 nt, Homo sapiens
uagaagaucugcaggaugu

SEQ ID NO: 322053 - RNA, 19 nt, Homo sapiens
gaacaccacuccacuccau

SEQ ID NO: 322054 - RNA, 19 nt, Homo sapiens
gaaaagaaacuugguguua

SEQ ID NO: 322055 - RNA, 19 nt, Homo sapiens
gaaccugcauccuguggaa

SEQ ID NO: 322056 - RNA, 19 nt, Homo sapiens
ugaagacaauguucucaaa

SEQ ID NO: 322057 - RNA, 19 nt, Homo sapiens
gaaagcgccucgccagcaa

SEQ ID NO: 322058 - RNA, 19 nt, Homo sapiens
gauagagcuuguacagaaa

SEQ ID NO: 322059 - RNA, 19 nt, Homo sapiens
ccaauuaucucccgaaucg

SEQ ID NO: 322060 - RNA, 19 nt, Homo sapiens
gguguuagguaauugacua

SEQ ID NO: 322061 - RNA, 19 nt, Homo sapiens
gaacagaauggaacagaug

SEQ ID NO: 322062 - RNA, 19 nt, Homo sapiens
gaaacacuccaauuuauag

SEQ ID NO: 322063 - RNA, 19 nt, Homo sapiens
ccaagugcauuuaguugaa

SEQ ID NO: 322064 - RNA, 19 nt, Homo sapiens
caaagaagaagaucagaga

SEQ ID NO: 322065 - RNA, 19 nt, Homo sapiens
ucucaaagcauuuacagua

SEQ ID NO: 322066 - RNA, 19 nt, Homo sapiens
uaacaacgacuauuccuau

SEQ ID NO: 322067 - RNA, 19 nt, Homo sapiens
caacaccauuucauagaga

SEQ ID NO: 322068 - RNA, 19 nt, Homo sapiens
gcgaauaaaggaauuagaa

SEQ ID NO: 322069 - RNA, 19 nt, Homo sapiens
ccacauuucugaagcacaa

SEQ ID NO: 322070 - RNA, 19 nt, Homo sapiens
cagaagaacagucauuuga

SEQ ID NO: 322071 - RNA, 19 nt, Homo sapiens
gggaacagaugggcagaaa

SEQ ID NO: 322072 - RNA, 19 nt, Homo sapiens
gacacccucucaucuagua

SEQ ID NO: 322073 - RNA, 19 nt, Homo sapiens
caagaacuccuacaccauu

SEQ ID NO: 322074 - RNA, 19 nt, Homo sapiens
ccucauuggucacaaauug

SEQ ID NO: 322075 - RNA, 19 nt, Homo sapiens
caacgacuauuccuauuac

SEQ ID NO: 322076 - RNA, 19 nt, Homo sapiens
ccacuggaauucuacaaug

SEQ ID NO: 322077 - RNA, 19 nt, Homo sapiens
gaugaggacuuugagaugu

SEQ ID NO: 322078 - RNA, 19 nt, Homo sapiens
gaaauacgguccgaaacgu

SEQ ID NO: 322079 - RNA, 19 nt, Homo sapiens
ggagauguguguuguucau

SEQ ID NO: 322080 - RNA, 19 nt, Homo sapiens
gacauugaagguacauuua

SEQ ID NO: 322081 - RNA, 19 nt, Homo sapiens
acaggaaucugaugaaucu

SEQ ID NO: 322082 - RNA, 19 nt, Homo sapiens
caaaaugucuccagucaug

SEQ ID NO: 322083 - RNA, 19 nt, Homo sapiens
cagaaacugugguugauag

SEQ ID NO: 322084 - RNA, 19 nt, Homo sapiens
gccaguuguuaauaucuua

SEQ ID NO: 322085 - RNA, 19 nt, Homo sapiens
gaacagaugacuggaaagu

SEQ ID NO: 322086 - RNA, 19 nt, Homo sapiens
ggaacagaauggaacagau

SEQ ID NO: 322087 - RNA, 19 nt, Homo sapiens
gaacauuugaugcaagaug

SEQ ID NO: 322088 - RNA, 19 nt, Homo sapiens
uugcauggauccuguguuu

SEQ ID NO: 322089 - RNA, 19 nt, Homo sapiens
caguagagcuuggacagaa

SEQ ID NO: 322090 - RNA, 19 nt, Homo sapiens
aagcauuacucuaagugua

SEQ ID NO: 322091 - RNA, 19 nt, Homo sapiens
ggacgcuggucaugugaga

SEQ ID NO: 322092 - RNA, 19 nt, Homo sapiens
gugcaccuguuuccuguuu

SEQ ID NO: 322093 - RNA, 19 nt, Homo sapiens
caacacagaaccacacaug

SEQ ID NO: 322094 - RNA, 19 nt, Homo sapiens
cagagacacuauaaugaug

SEQ ID NO: 322095 - RNA, 19 nt, Homo sapiens
aaacguuggucuguuauug

SEQ ID NO: 322096 - RNA, 19 nt, Homo sapiens
gaagaagaucagagaguga

SEQ ID NO: 322097 - RNA, 19 nt, Homo sapiens
uggaacagaugacuggaaa

SEQ ID NO: 322098 - RNA, 19 nt, Homo sapiens
gagcuuggacagaaagaaa

SEQ ID NO: 322099 - RNA, 19 nt, Homo sapiens
guaauugacuaugcacuag

SEQ ID NO: 322100 - RNA, 19 nt, Homo sapiens
gauauaucauuccucaaca

SEQ ID NO: 322101 - RNA, 19 nt, Homo sapiens
aaacaggaaucugaugaau

SEQ ID NO: 322102 - RNA, 19 nt, Homo sapiens
gcagugacgaggaugauga

SEQ ID NO: 322103 - RNA, 19 nt, Homo sapiens
gagacacuauaaugaugaa

SEQ ID NO: 322104 - RNA, 19 nt, Homo sapiens
uccauacccuguagcguua

SEQ ID NO: 322105 - RNA, 19 nt, Homo sapiens
cuaaguguauggucucaga

SEQ ID NO: 322106 - RNA, 19 nt, Homo sapiens
gguaauugacuaugcacua

SEQ ID NO: 322107 - RNA, 19 nt, Homo sapiens
guuacaacaccauuucaua

SEQ ID NO: 322108 - RNA, 19 nt, Homo sapiens
gggcagaaaucgcaaagcu

SEQ ID NO: 322109 - RNA, 19 nt, Homo sapiens
guguguagccugacuguuu

SEQ ID NO: 322110 - RNA, 19 nt, Homo sapiens
ugacauugaagguacauuu

SEQ ID NO: 322111 - RNA, 19 nt, Homo sapiens
gaagaugaagacaauguuc

SEQ ID NO: 322112 - RNA, 19 nt, Homo sapiens
caaccgagaaugagcuaaa

SEQ ID NO: 322113 - RNA, 19 nt, Homo sapiens
gaauccagaaguuaagaaa

SEQ ID NO: 322114 - RNA, 19 nt, Homo sapiens
guagacaugcugcuaguau

SEQ ID NO: 322115 - RNA, 19 nt, Homo sapiens
cagucaagcucguaaauac

SEQ ID NO: 322116 - RNA, 19 nt, Homo sapiens
uagaauugcuccuaauguc

SEQ ID NO: 322117 - RNA, 19 nt, Homo sapiens
ugaagacccugagaaggaa

SEQ ID NO: 322118 - RNA, 19 nt, Homo sapiens
uaaagaugugcccuuauuu

SEQ ID NO: 322119 - RNA, 19 nt, Homo sapiens
caagauggccagcacugaa

SEQ ID NO: 322120 - RNA, 19 nt, Homo sapiens
gauguguguuguucauguu

SEQ ID NO: 322121 - RNA, 19 nt, Homo sapiens
gaauuguagccaguuguua

SEQ ID NO: 322122 - RNA, 19 nt, Homo sapiens
agaaagcucuccaagaacu

SEQ ID NO: 322123 - RNA, 19 nt, Homo sapiens
gaauugcuccuaaugucaa

SEQ ID NO: 322124 - RNA, 19 nt, Homo sapiens
ugacuugggauauaucauu

SEQ ID NO: 322125 - RNA, 19 nt, Homo sapiens
ccuauuaccacauuucuga

SEQ ID NO: 322126 - RNA, 19 nt, Homo sapiens
acaacgacuauuccuauua

SEQ ID NO: 322127 - RNA, 19 nt, Homo sapiens
gaagaucugcaggauguga

SEQ ID NO: 322128 - RNA, 19 nt, Homo sapiens
ucagacacccucucaucua

SEQ ID NO: 322129 - RNA, 19 nt, Homo sapiens
gcaccgauggcagaaagua

SEQ ID NO: 322130 - RNA, 19 nt, Homo sapiens
gacagaagaggaagacaga

SEQ ID NO: 322131 - RNA, 19 nt, Homo sapiens
cgaggaugaugaggacuuu

SEQ ID NO: 322132 - RNA, 19 nt, Homo sapiens
gaagaaggauggugcagaa

SEQ ID NO: 322133 - RNA, 19 nt, Homo sapiens
ggagaugacugguguauca

SEQ ID NO: 322134 - RNA, 19 nt, Homo sapiens
gaaggauggugcagaaauu

SEQ ID NO: 322135 - RNA, 19 nt, Homo sapiens
cauagaaccuccaaagauu

SEQ ID NO: 322136 - RNA, 19 nt, Homo sapiens
gcacucugcugcuuugaaa

SEQ ID NO: 322137 - RNA, 19 nt, Homo sapiens
gugcagaaauugauaagaa

SEQ ID NO: 322138 - RNA, 19 nt, Homo sapiens
aaacacaucuugaucauag

SEQ ID NO: 322139 - RNA, 19 nt, Homo sapiens
uaagagagccuccaauuau

SEQ ID NO: 322140 - RNA, 19 nt, Homo sapiens
acaaagaucugauugacaa

SEQ ID NO: 322141 - RNA, 19 nt, Homo sapiens
gaauuagaguugaggguaa

SEQ ID NO: 322142 - RNA, 19 nt, Homo sapiens
ccaaacagcuggaagauac

SEQ ID NO: 322143 - RNA, 19 nt, Homo sapiens
guaagagagccuccaauua

SEQ ID NO: 322144 - RNA, 19 nt, Homo sapiens
gaaaguuggugaagauauc

SEQ ID NO: 322145 - RNA, 19 nt, Homo sapiens
ggaaggcaguggccggaua

SEQ ID NO: 322146 - RNA, 19 nt, Homo sapiens
ggaaggagacucuuuaaag

SEQ ID NO: 322147 - RNA, 19 nt, Homo sapiens
uaagaauggugaagagauu

SEQ ID NO: 322148 - RNA, 19 nt, Homo sapiens
ugauauagcugaaagagau

SEQ ID NO: 322149 - RNA, 19 nt, Homo sapiens
gcagcacucuggucauuga

SEQ ID NO: 322150 - RNA, 19 nt, Homo sapiens
aaagaaaucugccugaagu

SEQ ID NO: 322151 - RNA, 19 nt, Homo sapiens
caucagaucugcuuucaag

SEQ ID NO: 322152 - RNA, 19 nt, Homo sapiens
gcuaugugcuagaguauug

SEQ ID NO: 322153 - RNA, 19 nt, Homo sapiens
ugacagaggugggagauga

SEQ ID NO: 322154 - RNA, 19 nt, Homo sapiens
ggaggacaaucaucugcua

SEQ ID NO: 322155 - RNA, 19 nt, Homo sapiens
ucaaaugguucaaaggaaa

SEQ ID NO: 322156 - RNA, 19 nt, Homo sapiens
ccugaugccuacaauguua

SEQ ID NO: 322157 - RNA, 19 nt, Homo sapiens
ccacugagcucuucguaag

SEQ ID NO: 322158 - RNA, 19 nt, Homo sapiens
caggagaacuugacuuuag

SEQ ID NO: 322159 - RNA, 19 nt, Homo sapiens
ccaaugcccucacugaaga

SEQ ID NO: 322160 - RNA, 19 nt, Homo sapiens
gcacucuggucauugauau

SEQ ID NO: 322161 - RNA, 19 nt, Homo sapiens
ggagagaguggaauuagaa

SEQ ID NO: 322162 - RNA, 19 nt, Homo sapiens
caagagaaguggagaaggu

SEQ ID NO: 322163 - RNA, 19 nt, Homo sapiens
aggcguaccuccaaacaua

SEQ ID NO: 322164 - RNA, 19 nt, Homo sapiens
agaugaaggugauuaugua

SEQ ID NO: 322165 - RNA, 19 nt, Homo sapiens
gaagaugaugccaauguaa

SEQ ID NO: 322166 - RNA, 19 nt, Homo sapiens
ggacuacuccaaacauuga

SEQ ID NO: 322167 - RNA, 19 nt, Homo sapiens
acaaucaucugcuaaacuu

SEQ ID NO: 322168 - RNA, 19 nt, Homo sapiens
ugaagaugaugccaaugua

SEQ ID NO: 322169 - RNA, 19 nt, Homo sapiens
gaaauaugaucugcaaguc

SEQ ID NO: 322170 - RNA, 19 nt, Homo sapiens
gagggaaggagacucuuua

SEQ ID NO: 322171 - RNA, 19 nt, Homo sapiens
gaagauacaacugcuuauu

SEQ ID NO: 322172 - RNA, 19 nt, Homo sapiens
caagaaauucgacccagua

SEQ ID NO: 322173 - RNA, 19 nt, Homo sapiens
gaacaagccaagcagaaug

SEQ ID NO: 322174 - RNA, 19 nt, Homo sapiens
uuacugucauugagcauua

SEQ ID NO: 322175 - RNA, 19 nt, Homo sapiens
gcuagaguauugcuuugaa

SEQ ID NO: 322176 - RNA, 19 nt, Homo sapiens
gcagaauauucaguaauga

SEQ ID NO: 322177 - RNA, 19 nt, Homo sapiens
cagagaauccuguuuauca

SEQ ID NO: 322178 - RNA, 19 nt, Homo sapiens
ucaagaggaugcaggagaa

SEQ ID NO: 322179 - RNA, 19 nt, Homo sapiens
ggauggaccuggccagcaa

SEQ ID NO: 322180 - RNA, 19 nt, Homo sapiens
caaaguugcuauuguggau

SEQ ID NO: 322181 - RNA, 19 nt, Homo sapiens
ugccauagcugguuacaau

SEQ ID NO: 322182 - RNA, 19 nt, Homo sapiens
caagacaccugaagcaaac

SEQ ID NO: 322183 - RNA, 19 nt, Homo sapiens
gcaucaagguuaaaguugu

SEQ ID NO: 322184 - RNA, 19 nt, Homo sapiens
ugacagugauugcaggaaa

SEQ ID NO: 322185 - RNA, 19 nt, Homo sapiens
gaagaaccaaguaaagaga

SEQ ID NO: 322186 - RNA, 19 nt, Homo sapiens
gcuggcagauccaaaguug

SEQ ID NO: 322187 - RNA, 19 nt, Homo sapiens
gauacaggauguucagcaa

SEQ ID NO: 322188 - RNA, 19 nt, Homo sapiens
ggaaauaugaucugcaagu

SEQ ID NO: 322189 - RNA, 19 nt, Homo sapiens
gagccacucugggaaauau

SEQ ID NO: 322190 - RNA, 19 nt, Homo sapiens
gaccagaauuaacuuggaa

SEQ ID NO: 322191 - RNA, 19 nt, Homo sapiens
gggaaggauccacaaguua

SEQ ID NO: 322192 - RNA, 19 nt, Homo sapiens
ugacaccucugacugauca

SEQ ID NO: 322193 - RNA, 19 nt, Homo sapiens
cagaugauucagaguauua

SEQ ID NO: 322194 - RNA, 19 nt, Homo sapiens
gacagaugauucagaguau

SEQ ID NO: 322195 - RNA, 19 nt, Homo sapiens
gaucagacuguaaaucuug

SEQ ID NO: 322196 - RNA, 19 nt, Homo sapiens
ugacagaugauucagagua

SEQ ID NO: 322197 - RNA, 19 nt, Homo sapiens
gaaaucugguugaaaugag

SEQ ID NO: 322198 - RNA, 19 nt, Homo sapiens
gaagcugucaaucugguua

SEQ ID NO: 322199 - RNA, 19 nt, Homo sapiens
gcaaacaaagaucugauug

SEQ ID NO: 322200 - RNA, 19 nt, Homo sapiens
gaggugaaaugguauaaaa

SEQ ID NO: 322201 - RNA, 19 nt, Homo sapiens
gacagccggugaugagaaa

SEQ ID NO: 322202 - RNA, 19 nt, Homo sapiens
cacaaaggaugccagagaa

SEQ ID NO: 322203 - RNA, 19 nt, Homo sapiens
gaaauucgacccaguacca

SEQ ID NO: 322204 - RNA, 19 nt, Homo sapiens
uaaagagagugcagugauc

SEQ ID NO: 322205 - RNA, 19 nt, Homo sapiens
gaagagcauggaaugguuu

SEQ ID NO: 322206 - RNA, 19 nt, Homo sapiens
ccagcgagcccaaguacua

SEQ ID NO: 322207 - RNA, 19 nt, Homo sapiens
gccaacagaugcaaagauc

SEQ ID NO: 322208 - RNA, 19 nt, Homo sapiens
ggaugaggcugaauuuuga

SEQ ID NO: 322209 - RNA, 19 nt, Homo sapiens
ugccaaaguucauguuauu

SEQ ID NO: 322210 - RNA, 19 nt, Homo sapiens
gaaggugauuauguauuug

SEQ ID NO: 322211 - RNA, 19 nt, Homo sapiens
ggaaggauccacaaguuag

SEQ ID NO: 322212 - RNA, 19 nt, Homo sapiens
gaaaagaaaucugccugaa

SEQ ID NO: 322213 - RNA, 19 nt, Homo sapiens
gaucauagagggagcaaca

SEQ ID NO: 322214 - RNA, 19 nt, Homo sapiens
gggagagaguggaauuaga

SEQ ID NO: 322215 - RNA, 19 nt, Homo sapiens
ggaggaacagugaaaguug

SEQ ID NO: 322216 - RNA, 19 nt, Homo sapiens
uuacucagccuuugguuaa

SEQ ID NO: 322217 - RNA, 19 nt, Homo sapiens
ucaaucugguuauaccuuu

SEQ ID NO: 322218 - RNA, 19 nt, Homo sapiens
caaacaaagaucugauuga

SEQ ID NO: 322219 - RNA, 19 nt, Homo sapiens
gaguauugcuuugaaggaa

SEQ ID NO: 322220 - RNA, 19 nt, Homo sapiens
gaaggcaguggccggauaa

SEQ ID NO: 322221 - RNA, 19 nt, Homo sapiens
ugacagcuguucauuugau

SEQ ID NO: 322222 - RNA, 19 nt, Homo sapiens
uuugacagcuguucauuug

SEQ ID NO: 322223 - RNA, 19 nt, Homo sapiens
gaaggaggccggaacuaca

SEQ ID NO: 322224 - RNA, 19 nt, Homo sapiens
ccaaaguucauguuauuga

SEQ ID NO: 322225 - RNA, 19 nt, Homo sapiens
uaaacuuaguguugacuug

SEQ ID NO: 322226 - RNA, 19 nt, Homo sapiens
gagaguggaauuagaaugu

SEQ ID NO: 322227 - RNA, 19 nt, Homo sapiens
uaugggaguugcugaagaa

SEQ ID NO: 322228 - RNA, 19 nt, Homo sapiens
guaugaagacuuugauuuc

SEQ ID NO: 322229 - RNA, 19 nt, Homo sapiens
aauaugaucugcaagucaa

SEQ ID NO: 322230 - RNA, 19 nt, Homo sapiens
cuggauaguugcaaacaaa

SEQ ID NO: 322231 - RNA, 19 nt, Homo sapiens
uagcagcacucuggucauu

SEQ ID NO: 322232 - RNA, 19 nt, Homo sapiens
ggaagucucuggcucuuga

SEQ ID NO: 322233 - RNA, 19 nt, Homo sapiens
gaacaaacaggacacauug

SEQ ID NO: 322234 - RNA, 19 nt, Homo sapiens
gaaacgagccugccuuaca

SEQ ID NO: 322235 - RNA, 19 nt, Homo sapiens
ggugugaccugaguaaauu

SEQ ID NO: 322236 - RNA, 19 nt, Homo sapiens
ggaacaaacaggacacauu

SEQ ID NO: 322237 - RNA, 19 nt, Homo sapiens
aaacgagccugccuuacaa

SEQ ID NO: 322238 - RNA, 19 nt, Homo sapiens
ggacacaggaggcuucuug

SEQ ID NO: 322239 - RNA, 19 nt, Homo sapiens
ucaucgagcugguuaagaa

SEQ ID NO: 322240 - RNA, 19 nt, Homo sapiens
cccaagagcacaccuguua

SEQ ID NO: 322241 - RNA, 19 nt, Homo sapiens
agaacgcccuggagaagua

SEQ ID NO: 322242 - RNA, 19 nt, Homo sapiens
aagaaucacuggaacucua

SEQ ID NO: 322243 - RNA, 19 nt, Homo sapiens
ggacacugauugccaagca

SEQ ID NO: 322244 - RNA, 19 nt, Homo sapiens
acaaugcugugaagaauca

SEQ ID NO: 322245 - RNA, 19 nt, Homo sapiens
uaagaaguauggcacaaag

SEQ ID NO: 322246 - RNA, 19 nt, Homo sapiens
cagaaacgagccugccuua

SEQ ID NO: 322247 - RNA, 19 nt, Homo sapiens
gccaugugcugcccuguug

SEQ ID NO: 322248 - RNA, 19 nt, Homo sapiens
gggccgagaucgccaagau

SEQ ID NO: 322249 - RNA, 19 nt, Homo sapiens
uaaccgcacugaccagcaa

SEQ ID NO: 322250 - RNA, 19 nt, Homo sapiens
gcaagugcaaggucaaaug

SEQ ID NO: 322251 - RNA, 19 nt, Homo sapiens
agacaaugcugugaagaau

SEQ ID NO: 322252 - RNA, 19 nt, Homo sapiens
uaaaauugccucucucuuu

SEQ ID NO: 322253 - RNA, 19 nt, Homo sapiens
ugucagguaucaaagaaga

SEQ ID NO: 322254 - RNA, 19 nt, Homo sapiens
gcagaggacaguaucaaca

SEQ ID NO: 322255 - RNA, 19 nt, Homo sapiens
gaccaaagaggaagaccaa

SEQ ID NO: 322256 - RNA, 19 nt, Homo sapiens
gagcccauucucauguuua

SEQ ID NO: 322257 - RNA, 19 nt, Homo sapiens
uggaugagcugcacuacca

SEQ ID NO: 322258 - RNA, 19 nt, Homo sapiens
gaccagcaaugccaguaca

SEQ ID NO: 322259 - RNA, 19 nt, Homo sapiens
ucucagacccugcuuagga

SEQ ID NO: 322260 - RNA, 19 nt, Homo sapiens
uuucugaacuucuggaaca

SEQ ID NO: 322261 - RNA, 19 nt, Homo sapiens
aaaauugccucucucuuug

SEQ ID NO: 322262 - RNA, 19 nt, Homo sapiens
ucaaagaagacaacagcuu

SEQ ID NO: 322263 - RNA, 19 nt, Homo sapiens
gagcagagggauagcaagu

SEQ ID NO: 322264 - RNA, 19 nt, Homo sapiens
ucaagaaaguccggaaguc

SEQ ID NO: 322265 - RNA, 19 nt, Homo sapiens
ccgagaagcagaagaggaa

SEQ ID NO: 322266 - RNA, 19 nt, Homo sapiens
ucaagaacgcccuggagaa

SEQ ID NO: 322267 - RNA, 19 nt, Homo sapiens
cuggaacucuaccaucaaa

SEQ ID NO: 322268 - RNA, 19 nt, Homo sapiens
cacuggaacucuaccauca

SEQ ID NO: 322269 - RNA, 19 nt, Homo sapiens
ucgagcugguuaagaagua

SEQ ID NO: 322270 - RNA, 19 nt, Homo sapiens
aaagucaucgagcugguua

SEQ ID NO: 322271 - RNA, 19 nt, Homo sapiens
ccagagcccuuggaggaau

SEQ ID NO: 322272 - RNA, 19 nt, Homo sapiens
gaacaccagagcccuugga

SEQ ID NO: 322273 - RNA, 19 nt, Homo sapiens
cagacaaugcugugaagaa

SEQ ID NO: 322274 - RNA, 19 nt, Homo sapiens
cgagaucgccaagauguug

SEQ ID NO: 322275 - RNA, 19 nt, Homo sapiens
ggaggaggaccgcaucauc

SEQ ID NO: 322276 - RNA, 19 nt, Homo sapiens
caagagcacaccuguuaag

SEQ ID NO: 322277 - RNA, 19 nt, Homo sapiens
ggaaaacagugaggaggaa

SEQ ID NO: 322278 - RNA, 19 nt, Homo sapiens
guuaagaaguauggcacaa

SEQ ID NO: 322279 - RNA, 19 nt, Homo sapiens
gcucaaccagggcuucuug

SEQ ID NO: 322280 - RNA, 19 nt, Homo sapiens
caagaacgcccuggagaag

SEQ ID NO: 322281 - RNA, 19 nt, Homo sapiens
gaggaggaccgcaucaucu

SEQ ID NO: 322282 - RNA, 19 nt, Homo sapiens
gggaagcagugccgugaac

SEQ ID NO: 322283 - RNA, 19 nt, Homo sapiens
ccaagagcacaccuguuaa

SEQ ID NO: 322284 - RNA, 19 nt, Homo sapiens
gcaccagucuguccuuccu

SEQ ID NO: 322285 - RNA, 19 nt, Homo sapiens
cuccgucccuccuaccaua

SEQ ID NO: 322286 - RNA, 19 nt, Homo sapiens
cgagcccauucucauguuu

SEQ ID NO: 322287 - RNA, 19 nt, Homo sapiens
cagaggacaguaucaacaa

SEQ ID NO: 322288 - RNA, 19 nt, Homo sapiens
cugaagcccuggacuugau

SEQ ID NO: 322289 - RNA, 19 nt, Homo sapiens
caucuuguccugagguguu

SEQ ID NO: 322290 - RNA, 19 nt, Homo sapiens
gcacuaccaggacacagau

SEQ ID NO: 322291 - RNA, 19 nt, Homo sapiens
gucucuggcucuugacauu

SEQ ID NO: 322292 - RNA, 19 nt, Homo sapiens
guuaagacccugcccuucu

SEQ ID NO: 322293 - RNA, 19 nt, Homo sapiens
cagagcccuuggaggaauu

SEQ ID NO: 322294 - RNA, 19 nt, Homo sapiens
gcccaucgguacagaucug

SEQ ID NO: 322295 - RNA, 19 nt, Homo sapiens
cagcagccaccacaucgaa

SEQ ID NO: 322296 - RNA, 19 nt, Homo sapiens
caagaaaguccggaagucu

SEQ ID NO: 322297 - RNA, 19 nt, Homo sapiens
acaaacaggacacauugga

SEQ ID NO: 322298 - RNA, 19 nt, Homo sapiens
ucacgagcccauucucaug

SEQ ID NO: 322299 - RNA, 19 nt, Homo sapiens
gcugcgaggaucuggauga

SEQ ID NO: 322300 - RNA, 19 nt, Homo sapiens
gaacuucuggaacaaacag

SEQ ID NO: 322301 - RNA, 19 nt, Homo sapiens
gaggacaguaucaacaaca

SEQ ID NO: 322302 - RNA, 19 nt, Homo sapiens
gccgagaucgccaagaugu

SEQ ID NO: 322303 - RNA, 19 nt, Homo sapiens
gcaccuggaggaggacuug

SEQ ID NO: 322304 - RNA, 19 nt, Homo sapiens
caaggacggccuccagagu

SEQ ID NO: 322305 - RNA, 19 nt, Homo sapiens
caagugcaaggucaaaugg

SEQ ID NO: 322306 - RNA, 19 nt, Homo sapiens
caucaucgaggacgacauc

SEQ ID NO: 322307 - RNA, 19 nt, Homo sapiens
ccacugcaccgggacaaga

SEQ ID NO: 322308 - RNA, 19 nt, Homo sapiens
gaagcgugaggaccaggaa

SEQ ID NO: 322309 - RNA, 19 nt, Homo sapiens
ggacagcaggacuggaagu

SEQ ID NO: 322310 - RNA, 19 nt, Homo sapiens
aggcagcaguggcccagaa

SEQ ID NO: 322311 - RNA, 19 nt, Homo sapiens
ccacacugcccaagucucu

SEQ ID NO: 322312 - RNA, 19 nt, Homo sapiens
uuaagacccugcccuucuc

SEQ ID NO: 322313 - RNA, 19 nt, Homo sapiens
ggaaggcuccccaccagaa

SEQ ID NO: 322314 - RNA, 19 nt, Homo sapiens
ccaaagaggaagaccaaaa

SEQ ID NO: 322315 - RNA, 19 nt, Homo sapiens
gaagaaucacuggaacucu

SEQ ID NO: 322316 - RNA, 19 nt, Homo sapiens
ucucuauccuugccgacaa

SEQ ID NO: 322317 - RNA, 19 nt, Homo sapiens
agucuguccuuccuggauu

SEQ ID NO: 322318 - RNA, 19 nt, Homo sapiens
guacagguggcugagaguu

SEQ ID NO: 322319 - RNA, 19 nt, Homo sapiens
ggaaggccagggaagucuu

SEQ ID NO: 322320 - RNA, 19 nt, Homo sapiens
acccugaggugaagaaguc

SEQ ID NO: 322321 - RNA, 19 nt, Homo sapiens
caucucagacccugcuuag

SEQ ID NO: 322322 - RNA, 19 nt, Homo sapiens
gguucuagccucucugaag

SEQ ID NO: 322323 - RNA, 19 nt, Homo sapiens
gccauggaccaaagaggaa

SEQ ID NO: 322324 - RNA, 19 nt, Homo sapiens
gaaguacuccauggacaac

SEQ ID NO: 322325 - RNA, 19 nt, Homo sapiens
agaaguacuccauggacaa

SEQ ID NO: 322326 - RNA, 19 nt, Homo sapiens
gaucgagucggacccugau

SEQ ID NO: 322327 - RNA, 19 nt, Homo sapiens
gagcccaucgguacagauc

SEQ ID NO: 322328 - RNA, 19 nt, Homo sapiens
uuaagaaguauggcacaaa

SEQ ID NO: 322329 - RNA, 19 nt, Homo sapiens
ggugcuaacaacaaaguuc

SEQ ID NO: 322330 - RNA, 19 nt, Homo sapiens
aggaggugcugcguucuga

SEQ ID NO: 322331 - RNA, 19 nt, Homo sapiens
gacagcaggacuggaaguu

SEQ ID NO: 322332 - RNA, 19 nt, Homo sapiens
ggaugaagcugaacuuuga

SEQ ID NO: 322333 - RNA, 19 nt, Homo sapiens
caaagaaccuccaguccua

SEQ ID NO: 322334 - RNA, 19 nt, Homo sapiens
ggaaggagcucccagacaa

SEQ ID NO: 322335 - RNA, 19 nt, Homo sapiens
ggacguggcuuccaucuuc

SEQ ID NO: 322336 - RNA, 19 nt, Homo sapiens
gcaaguacguguuugagaa

SEQ ID NO: 322337 - RNA, 19 nt, Homo sapiens
gaugaaagaugguguggaa

SEQ ID NO: 322338 - RNA, 19 nt, Homo sapiens
gaagggagaugagguauuc

SEQ ID NO: 322339 - RNA, 19 nt, Homo sapiens
gcaagaggaucaccauuuc

SEQ ID NO: 322340 - RNA, 19 nt, Homo sapiens
gaacguaacaggcacacua

SEQ ID NO: 322341 - RNA, 19 nt, Homo sapiens
ucaaaccguucgaguauaa

SEQ ID NO: 322342 - RNA, 19 nt, Homo sapiens
ugaaguagcugucaaggau

SEQ ID NO: 322343 - RNA, 19 nt, Homo sapiens
ucacagagaccaccuauga

SEQ ID NO: 322344 - RNA, 19 nt, Homo sapiens
ggaugacgcugccuaugaa

SEQ ID NO: 322345 - RNA, 19 nt, Homo sapiens
gaucccaaguuccugauaa

SEQ ID NO: 322346 - RNA, 19 nt, Homo sapiens
gaagagcgaguacgagaaa

SEQ ID NO: 322347 - RNA, 19 nt, Homo sapiens
gauaaccaauuaccaagga

SEQ ID NO: 322348 - RNA, 19 nt, Homo sapiens
cgaggugucugaugagaaa

SEQ ID NO: 322349 - RNA, 19 nt, Homo sapiens
gggaagaccucagagaaug

SEQ ID NO: 322350 - RNA, 19 nt, Homo sapiens
caagaagagugcagcauuc

SEQ ID NO: 322351 - RNA, 19 nt, Homo sapiens
gaaaaucgccuuccaguau

SEQ ID NO: 322352 - RNA, 19 nt, Homo sapiens
gaaagaugacgaugaccua

SEQ ID NO: 322353 - RNA, 19 nt, Homo sapiens
gaucaccauuucccaugua

SEQ ID NO: 322354 - RNA, 19 nt, Homo sapiens
gaacaucugugggcucagu

SEQ ID NO: 322355 - RNA, 19 nt, Homo sapiens
gcuaucaggucauaaccaa

SEQ ID NO: 322356 - RNA, 19 nt, Homo sapiens
ggacagaggcaacaagauc

SEQ ID NO: 322357 - RNA, 19 nt, Homo sapiens
ucaguggccuguugaagaa

SEQ ID NO: 322358 - RNA, 19 nt, Homo sapiens
ggauuucaguggccuguug

SEQ ID NO: 322359 - RNA, 19 nt, Homo sapiens
gaaagaugguguggaacug

SEQ ID NO: 322360 - RNA, 19 nt, Homo sapiens
gaaccuccaguccuaauug

SEQ ID NO: 322361 - RNA, 19 nt, Homo sapiens
ggaguacguucccaagcaa

SEQ ID NO: 322362 - RNA, 19 nt, Homo sapiens
ucaccgagcucuucgucaa

SEQ ID NO: 322363 - RNA, 19 nt, Homo sapiens
ccaaguuccugauaaccaa

SEQ ID NO: 322364 - RNA, 19 nt, Homo sapiens
aaagaaagaugacgaugac

SEQ ID NO: 322365 - RNA, 19 nt, Homo sapiens
gcaugaacaccaagccuuu

SEQ ID NO: 322366 - RNA, 19 nt, Homo sapiens
gcagcagcuuugugauuga

SEQ ID NO: 322367 - RNA, 19 nt, Homo sapiens
gagggagacuacacguuug

SEQ ID NO: 322368 - RNA, 19 nt, Homo sapiens
ggugaaggccucagaacaa

SEQ ID NO: 322369 - RNA, 19 nt, Homo sapiens
gugcagcauucacaaagaa

SEQ ID NO: 322370 - RNA, 19 nt, Homo sapiens
gaagagugcagcauucaca

SEQ ID NO: 322371 - RNA, 19 nt, Homo sapiens
ucaaggaugagaaguguuu

SEQ ID NO: 322372 - RNA, 19 nt, Homo sapiens
caaagaagagcgaguacga

SEQ ID NO: 322373 - RNA, 19 nt, Homo sapiens
ccggauggcucccaaguuc

SEQ ID NO: 322374 - RNA, 19 nt, Homo sapiens
gaaaagaagucggauacug

SEQ ID NO: 322375 - RNA, 19 nt, Homo sapiens
uaaacgugauggugaagga

SEQ ID NO: 322376 - RNA, 19 nt, Homo sapiens
ugagggagacuacacguuu

SEQ ID NO: 322377 - RNA, 19 nt, Homo sapiens
agacaggaaucaccuucaa

SEQ ID NO: 322378 - RNA, 19 nt, Homo sapiens
gaaggagcucccagacaaa

SEQ ID NO: 322379 - RNA, 19 nt, Homo sapiens
gggcaaagaagagcgagua

SEQ ID NO: 322380 - RNA, 19 nt, Homo sapiens
agaaugcgauugugguugu

SEQ ID NO: 322381 - RNA, 19 nt, Homo sapiens
caguggaggugucagaaga

SEQ ID NO: 322382 - RNA, 19 nt, Homo sapiens
ugacgcugccuaugaagua

SEQ ID NO: 322383 - RNA, 19 nt, Homo sapiens
gaacuuugaggucuucaca

SEQ ID NO: 322384 - RNA, 19 nt, Homo sapiens
ggaagaagaagggcucuca

SEQ ID NO: 322385 - RNA, 19 nt, Homo sapiens
gcaagagccaccaaagauc

SEQ ID NO: 322386 - RNA, 19 nt, Homo sapiens
gaacugacucgggaggauu

SEQ ID NO: 322387 - RNA, 19 nt, Homo sapiens
ucaagaagagugcagcauu

SEQ ID NO: 322388 - RNA, 19 nt, Homo sapiens
gcaagugguauaagaaugg

SEQ ID NO: 322389 - RNA, 19 nt, Homo sapiens
gugcagaucgagaacauga

SEQ ID NO: 322390 - RNA, 19 nt, Homo sapiens
gcugaagggagaugaggua

SEQ ID NO: 322391 - RNA, 19 nt, Homo sapiens
ggaacugacucgggaggau

SEQ ID NO: 322392 - RNA, 19 nt, Homo sapiens
ugagaacguugguaagaag

SEQ ID NO: 322393 - RNA, 19 nt, Homo sapiens
gcagcaaguacguguuuga

SEQ ID NO: 322394 - RNA, 19 nt, Homo sapiens
gaacggccaggagaucaaa

SEQ ID NO: 322395 - RNA, 19 nt, Homo sapiens
ggaugaagaacaagaugga

SEQ ID NO: 322396 - RNA, 19 nt, Homo sapiens
agaauccucuuccgaguag

SEQ ID NO: 322397 - RNA, 19 nt, Homo sapiens
ggcaagugguauaagaaug

SEQ ID NO: 322398 - RNA, 19 nt, Homo sapiens
caggugagcuggauuucag

SEQ ID NO: 322399 - RNA, 19 nt, Homo sapiens
caaagaugaugggaacagu

SEQ ID NO: 322400 - RNA, 19 nt, Homo sapiens
ccacaacuccgccagcaau

SEQ ID NO: 322401 - RNA, 19 nt, Homo sapiens
ggaucaccauuucccaugu

SEQ ID NO: 322402 - RNA, 19 nt, Homo sapiens
ucgcggaucugacggugaa

SEQ ID NO: 322403 - RNA, 19 nt, Homo sapiens
ucccaggacuguguucuuu

SEQ ID NO: 322404 - RNA, 19 nt, Homo sapiens
gcaggacccgcaucgagaa

SEQ ID NO: 322405 - RNA, 19 nt, Homo sapiens
acaagcuggugaucgauga

SEQ ID NO: 322406 - RNA, 19 nt, Homo sapiens
caggugauguggaugaaag

SEQ ID NO: 322407 - RNA, 19 nt, Homo sapiens
cuaauugucacaccucuug

SEQ ID NO: 322408 - RNA, 19 nt, Homo sapiens
ggauccagccuaccaagug

SEQ ID NO: 322409 - RNA, 19 nt, Homo sapiens
aagguggucuggaugaaga

SEQ ID NO: 322410 - RNA, 19 nt, Homo sapiens
cagaauccucuuccgagua

SEQ ID NO: 322411 - RNA, 19 nt, Homo sapiens
ggaaggcuccgaggaaugg

SEQ ID NO: 322412 - RNA, 19 nt, Homo sapiens
gcgaggacguggcuuccau

SEQ ID NO: 322413 - RNA, 19 nt, Homo sapiens
ggcagagucuagaaagcuu

SEQ ID NO: 322414 - RNA, 19 nt, Homo sapiens
cggaugacgcugccuauga

SEQ ID NO: 322415 - RNA, 19 nt, Homo sapiens
ugacagcuguggcuucaac

SEQ ID NO: 322416 - RNA, 19 nt, Homo sapiens
ugaagaacaagauggaaau

SEQ ID NO: 322417 - RNA, 19 nt, Homo sapiens
cgaagguggucuggaugaa

SEQ ID NO: 322418 - RNA, 19 nt, Homo sapiens
cgugggcaaugaauacuau

SEQ ID NO: 322419 - RNA, 19 nt, Homo sapiens
uaucaggucauaaccaaug

SEQ ID NO: 322420 - RNA, 19 nt, Homo sapiens
ccaggacuguguucuuucu

SEQ ID NO: 322421 - RNA, 19 nt, Homo sapiens
guauaaggagcaugacuuc

SEQ ID NO: 322422 - RNA, 19 nt, Homo sapiens
cuucaaaccguucgaguau

SEQ ID NO: 322423 - RNA, 19 nt, Homo sapiens
auggguaccugguggagua

SEQ ID NO: 322424 - RNA, 19 nt, Homo sapiens
gauaguggaggaugugaca

SEQ ID NO: 322425 - RNA, 19 nt, Homo sapiens
uuugaggucuucacagaga

SEQ ID NO: 322426 - RNA, 19 nt, Homo sapiens
ugcagcagcuuugugauug

SEQ ID NO: 322427 - RNA, 19 nt, Homo sapiens
gugaaggccucagaacaag

SEQ ID NO: 322428 - RNA, 19 nt, Homo sapiens
ugucaaggaugagaagugu

SEQ ID NO: 322429 - RNA, 19 nt, Homo sapiens
aaguagcugucaaggauga

SEQ ID NO: 322430 - RNA, 19 nt, Homo sapiens
gaggcaacaagaucaaguu

SEQ ID NO: 322431 - RNA, 19 nt, Homo sapiens
gaagaacaagauggaaauc

SEQ ID NO: 322432 - RNA, 19 nt, Homo sapiens
gcacggagcucuuugugaa

SEQ ID NO: 322433 - RNA, 19 nt, Homo sapiens
acaagaagcugcuguguga

SEQ ID NO: 322434 - RNA, 19 nt, Homo sapiens
ucaaauggcucaagaaugg

SEQ ID NO: 322435 - RNA, 19 nt, Homo sapiens
gcacagccuuucagaagaa

SEQ ID NO: 322436 - RNA, 19 nt, Homo sapiens
gggaggagaccuucaaaua

SEQ ID NO: 322437 - RNA, 19 nt, Homo sapiens
gcaggaaccucccaagauc

SEQ ID NO: 322438 - RNA, 19 nt, Homo sapiens
gaccaggcaucaccuauga

SEQ ID NO: 322439 - RNA, 19 nt, Homo sapiens
gcagaaagccgacaagaag

SEQ ID NO: 322440 - RNA, 19 nt, Homo sapiens
gcaagaagaagaagagcua

SEQ ID NO: 322441 - RNA, 19 nt, Homo sapiens
ccaaggagcccgucuuuau

SEQ ID NO: 322442 - RNA, 19 nt, Homo sapiens
gaauaugguuggcuuuagu

SEQ ID NO: 322443 - RNA, 19 nt, Homo sapiens
ucaaauaccgguucaagaa

SEQ ID NO: 322444 - RNA, 19 nt, Homo sapiens
gcauaaaggugucccacau

SEQ ID NO: 322445 - RNA, 19 nt, Homo sapiens
aaagauaagugcagucaca

SEQ ID NO: 322446 - RNA, 19 nt, Homo sapiens
gagcaaaggccacaagauc

SEQ ID NO: 322447 - RNA, 19 nt, Homo sapiens
aaaagaagcuggaggugua

SEQ ID NO: 322448 - RNA, 19 nt, Homo sapiens
ccagagggcugcucagagu

SEQ ID NO: 322449 - RNA, 19 nt, Homo sapiens
ggaugcagcugaacuucga

SEQ ID NO: 322450 - RNA, 19 nt, Homo sapiens
gggcagagaaggaagauga

SEQ ID NO: 322451 - RNA, 19 nt, Homo sapiens
gguuguagcuggaaauaag

SEQ ID NO: 322452 - RNA, 19 nt, Homo sapiens
gagcacagccuuucagaag

SEQ ID NO: 322453 - RNA, 19 nt, Homo sapiens
gaagaagagcacagccuuu

SEQ ID NO: 322454 - RNA, 19 nt, Homo sapiens
gaggucaaauggcucaaga

SEQ ID NO: 322455 - RNA, 19 nt, Homo sapiens
uaagugcagucacagagaa

SEQ ID NO: 322456 - RNA, 19 nt, Homo sapiens
ggaguuugagugugaagua

SEQ ID NO: 322457 - RNA, 19 nt, Homo sapiens
ggaggagaccuucaaauac

SEQ ID NO: 322458 - RNA, 19 nt, Homo sapiens
ggaacuggcugaccaugac

SEQ ID NO: 322459 - RNA, 19 nt, Homo sapiens
gccagaccauucagaagaa

SEQ ID NO: 322460 - RNA, 19 nt, Homo sapiens
ggguggaguuugaguguga

SEQ ID NO: 322461 - RNA, 19 nt, Homo sapiens
ccagcaaggucuaucuguu

SEQ ID NO: 322462 - RNA, 19 nt, Homo sapiens
ugacagagcacacaucgau

SEQ ID NO: 322463 - RNA, 19 nt, Homo sapiens
gcagagacaccaccugauc

SEQ ID NO: 322464 - RNA, 19 nt, Homo sapiens
gaggagaccuucaaauacc

SEQ ID NO: 322465 - RNA, 19 nt, Homo sapiens
acacaucgauacuggugaa

SEQ ID NO: 322466 - RNA, 19 nt, Homo sapiens
ccaccaaggacaaauuuga

SEQ ID NO: 322467 - RNA, 19 nt, Homo sapiens
ccuaugagccacccaacua

SEQ ID NO: 322468 - RNA, 19 nt, Homo sapiens
gaagccagucucagccuuu

SEQ ID NO: 322469 - RNA, 19 nt, Homo sapiens
cagaauaugguuggcuuua

SEQ ID NO: 322470 - RNA, 19 nt, Homo sapiens
ugccagagcucaucauugg

SEQ ID NO: 322471 - RNA, 19 nt, Homo sapiens
caucgauacuggugaagga

SEQ ID NO: 322472 - RNA, 19 nt, Homo sapiens
cagccaagcuccacuucau

SEQ ID NO: 322473 - RNA, 19 nt, Homo sapiens
gcagcaaguacaucuuuga

SEQ ID NO: 322474 - RNA, 19 nt, Homo sapiens
acacugggauucuggacuu

SEQ ID NO: 322475 - RNA, 19 nt, Homo sapiens
cugcagggccaccaacuua

SEQ ID NO: 322476 - RNA, 19 nt, Homo sapiens
caaaggaccaggcgguguu

SEQ ID NO: 322477 - RNA, 19 nt, Homo sapiens
ggucaaauggcucaagaau

SEQ ID NO: 322478 - RNA, 19 nt, Homo sapiens
gcgcaucgccuuccaguac

SEQ ID NO: 322479 - RNA, 19 nt, Homo sapiens
ggauguaugugugacaagu

SEQ ID NO: 322480 - RNA, 19 nt, Homo sapiens
ucaccgucuuggagcauua

SEQ ID NO: 322481 - RNA, 19 nt, Homo sapiens
ccacccaccuggcaguaga

SEQ ID NO: 322482 - RNA, 19 nt, Homo sapiens
uccacaaacugaccauuga

SEQ ID NO: 322483 - RNA, 19 nt, Homo sapiens
gcaagaagccacggucagu

SEQ ID NO: 322484 - RNA, 19 nt, Homo sapiens
ggaaaccccucccuacugu

SEQ ID NO: 322485 - RNA, 19 nt, Homo sapiens
gaggugagcauccgcaaca

SEQ ID NO: 322486 - RNA, 19 nt, Homo sapiens
ggaccaggcgguguucaaa

SEQ ID NO: 322487 - RNA, 19 nt, Homo sapiens
gcaugaggcgcgaugagaa

SEQ ID NO: 322488 - RNA, 19 nt, Homo sapiens
gcgaugaguggguguuuga

SEQ ID NO: 322489 - RNA, 19 nt, Homo sapiens
acagagggcacacggcaua

SEQ ID NO: 322490 - RNA, 19 nt, Homo sapiens
ggcagcggguggaguuuga

SEQ ID NO: 322491 - RNA, 19 nt, Homo sapiens
ggucauagaggcagagaag

SEQ ID NO: 322492 - RNA, 19 nt, Homo sapiens
aagauuuccugguucaaga

SEQ ID NO: 322493 - RNA, 19 nt, Homo sapiens
gccaggagauccagaugag

SEQ ID NO: 322494 - RNA, 19 nt, Homo sapiens
ugaaccuucucaucccuuu

SEQ ID NO: 322495 - RNA, 19 nt, Homo sapiens
guguguggcugaagaaugg

SEQ ID NO: 322496 - RNA, 19 nt, Homo sapiens
gaguuugagugugaaguau

SEQ ID NO: 322497 - RNA, 19 nt, Homo sapiens
caaggagcccgucuuuauc

SEQ ID NO: 322498 - RNA, 19 nt, Homo sapiens
aagccagucucagccuuua

SEQ ID NO: 322499 - RNA, 19 nt, Homo sapiens
ggaagccccuggaucuuug

SEQ ID NO: 322500 - RNA, 19 nt, Homo sapiens
ggcaggaaccucccaagau

SEQ ID NO: 322501 - RNA, 19 nt, Homo sapiens
caagaaggacgggcagaga

SEQ ID NO: 322502 - RNA, 19 nt, Homo sapiens
ccgcugagcugggagaaag

SEQ ID NO: 322503 - RNA, 19 nt, Homo sapiens
gaagagcacagccuuucag

SEQ ID NO: 322504 - RNA, 19 nt, Homo sapiens
cagcaaggucuaucuguuc

SEQ ID NO: 322505 - RNA, 19 nt, Homo sapiens
gcuaugucuucccaauguu

SEQ ID NO: 322506 - RNA, 19 nt, Homo sapiens
gaaggaagccccuggaucu

SEQ ID NO: 322507 - RNA, 19 nt, Homo sapiens
ccaaggacaaauuugaaug

SEQ ID NO: 322508 - RNA, 19 nt, Homo sapiens
uaugagccacccaacuaua

SEQ ID NO: 322509 - RNA, 19 nt, Homo sapiens
caccaaggagcccgucuuu

SEQ ID NO: 322510 - RNA, 19 nt, Homo sapiens
gacagagcacacaucgaua

SEQ ID NO: 322511 - RNA, 19 nt, Homo sapiens
ggcagcaaguacaucuuug

SEQ ID NO: 322512 - RNA, 19 nt, Homo sapiens
cagaugagcggcagcaagu

SEQ ID NO: 322513 - RNA, 19 nt, Homo sapiens
gcucagcagcucucaaugg

SEQ ID NO: 322514 - RNA, 19 nt, Homo sapiens
cggcagcaaguacaucuuu

SEQ ID NO: 322515 - RNA, 19 nt, Homo sapiens
gcugaacuucgaccugauu

SEQ ID NO: 322516 - RNA, 19 nt, Homo sapiens
caucagccagugcucauug

SEQ ID NO: 322517 - RNA, 19 nt, Homo sapiens
aagcguacccugaccauca

SEQ ID NO: 322518 - RNA, 19 nt, Homo sapiens
ccuccaaggucaaguucga

SEQ ID NO: 322519 - RNA, 19 nt, Homo sapiens
gcuacagcguggaguacug

SEQ ID NO: 322520 - RNA, 19 nt, Homo sapiens
gaguggguguuugacaaga

SEQ ID NO: 322521 - RNA, 19 nt, Homo sapiens
caaauaccgguucaagaag

SEQ ID NO: 322522 - RNA, 19 nt, Homo sapiens
gacaucagcgccagcaaca

SEQ ID NO: 322523 - RNA, 19 nt, Homo sapiens
caccaaggacaaauuugaa

SEQ ID NO: 322524 - RNA, 19 nt, Homo sapiens
gggaucagcagggcaguug

SEQ ID NO: 322525 - RNA, 19 nt, Homo sapiens
gcagggccaccaacuuaca

SEQ ID NO: 322526 - RNA, 19 nt, Homo sapiens
cccaagauuuccugguuca

SEQ ID NO: 322527 - RNA, 19 nt, Homo sapiens
cagaaagccgacaagaaga

SEQ ID NO: 322528 - RNA, 19 nt, Homo sapiens
gaagccgccuguggucaag

SEQ ID NO: 322529 - RNA, 19 nt, Homo sapiens
caucagcgccagcaacaag

SEQ ID NO: 322530 - RNA, 19 nt, Homo sapiens
ccauuggccucuucgugau

SEQ ID NO: 322531 - RNA, 19 nt, Homo sapiens
ugcuaugucuucccaaugu

SEQ ID NO: 322532 - RNA, 19 nt, Homo sapiens
gggaagcacucaaauaaag

SEQ ID NO: 322533 - RNA, 19 nt, Homo sapiens
ggaggaggcugugaugaga

SEQ ID NO: 322534 - RNA, 19 nt, Homo sapiens
ccaaggagcucgcccacau

SEQ ID NO: 322535 - RNA, 19 nt, Homo sapiens
gugggaagcacucaaauaa

SEQ ID NO: 322536 - RNA, 19 nt, Homo sapiens
ggugggaagcacucaaaua

SEQ ID NO: 322537 - RNA, 19 nt, Homo sapiens
caccaggccuacagucaaa

SEQ ID NO: 322538 - RNA, 19 nt, Homo sapiens
gaggagaccgcaucugaau

SEQ ID NO: 322539 - RNA, 19 nt, Homo sapiens
auaaagaugcgugguguua

SEQ ID NO: 322540 - RNA, 19 nt, Homo sapiens
ggaagcacucaaauaaaga

SEQ ID NO: 322541 - RNA, 19 nt, Homo sapiens
gcuggaaggcgcagagauu

SEQ ID NO: 322542 - RNA, 19 nt, Homo sapiens
caccaucucugaccucauc

SEQ ID NO: 322543 - RNA, 19 nt, Homo sapiens
gcgcgugucugcagugagu

SEQ ID NO: 322544 - RNA, 19 nt, Homo sapiens
ggagaccgcaucugaaucu

SEQ ID NO: 322545 - RNA, 19 nt, Homo sapiens
guccagaacucaggaaugg

SEQ ID NO: 322546 - RNA, 19 nt, Homo sapiens
gaagcacucaaauaaagau

SEQ ID NO: 322547 - RNA, 19 nt, Homo sapiens
cagucaaacuccagagaug

SEQ ID NO: 322548 - RNA, 19 nt, Homo sapiens
ccaaccaccugcaccaucu

SEQ ID NO: 322549 - RNA, 19 nt, Homo sapiens
ggacuccauccucuucauu

SEQ ID NO: 322550 - RNA, 19 nt, Homo sapiens
uaucagaguccaccagaga

SEQ ID NO: 322551 - RNA, 19 nt, Homo sapiens
gagaaguggcaguaucaga

SEQ ID NO: 322552 - RNA, 19 nt, Homo sapiens
uaaagaugcgugguguuaa

SEQ ID NO: 322553 - RNA, 19 nt, Homo sapiens
ggaaggcgcagagauugga

SEQ ID NO: 322554 - RNA, 19 nt, Homo sapiens
aaagaugcgugguguuaac

SEQ ID NO: 322555 - RNA, 19 nt, Homo sapiens
gaaguggcaguaucagagu

SEQ ID NO: 322556 - RNA, 19 nt, Homo sapiens
gggcugcaaugcugcucuu

SEQ ID NO: 322557 - RNA, 19 nt, Homo sapiens
guucugcagugucgagcuu

SEQ ID NO: 322558 - RNA, 19 nt, Homo sapiens
gauauugcugccaaaccua

SEQ ID NO: 322559 - RNA, 19 nt, Homo sapiens
gaaaaccuguguggacuca

SEQ ID NO: 322560 - RNA, 19 nt, Homo sapiens
gaugcgugguguuaacagu

SEQ ID NO: 322561 - RNA, 19 nt, Homo sapiens
cagacuaacugggcucaag

SEQ ID NO: 322562 - RNA, 19 nt, Homo sapiens
gccgcacacugaagaguca

SEQ ID NO: 322563 - RNA, 19 nt, Homo sapiens
ccaccugcaccaucucuga

SEQ ID NO: 322564 - RNA, 19 nt, Homo sapiens
ccggagaaguggcaguauc

SEQ ID NO: 322565 - RNA, 19 nt, Homo sapiens
ccaccaggccuacagucaa

SEQ ID NO: 322566 - RNA, 19 nt, Homo sapiens
cuacagcacccaguuguuc

SEQ ID NO: 322567 - RNA, 19 nt, Homo sapiens
ccacauccgagagaacauu

SEQ ID NO: 322568 - RNA, 19 nt, Homo sapiens
gggaggaggcugugaugag

SEQ ID NO: 322569 - RNA, 19 nt, Homo sapiens
ucauugacauccuggugau

SEQ ID NO: 322570 - RNA, 19 nt, Homo sapiens
ggaccagcccauccacauc

SEQ ID NO: 322571 - RNA, 19 nt, Homo sapiens
ggaggccaaggcagucauu

SEQ ID NO: 322572 - RNA, 19 nt, Homo sapiens
ucacugugcgcguggaaga

SEQ ID NO: 322573 - RNA, 19 nt, Homo sapiens
ugggaagcacucaaauaaa

SEQ ID NO: 322574 - RNA, 19 nt, Homo sapiens
cggagaaguggcaguauca

SEQ ID NO: 322575 - RNA, 19 nt, Homo sapiens
ccugcaaggccauaaaugu

SEQ ID NO: 322576 - RNA, 19 nt, Homo sapiens
ccagaaggcagauauugcu

SEQ ID NO: 322577 - RNA, 19 nt, Homo sapiens
gagacggucaaccugcaaa

SEQ ID NO: 322578 - RNA, 19 nt, Homo sapiens
cuccagagaugcccaagac

SEQ ID NO: 322579 - RNA, 19 nt, Homo sapiens
ugggcuacauggugcagaa

SEQ ID NO: 322580 - RNA, 19 nt, Homo sapiens
gcuacagcacccaguuguu

SEQ ID NO: 322581 - RNA, 19 nt, Homo sapiens
gaggauaucuggaagaaau

SEQ ID NO: 322582 - RNA, 19 nt, Homo sapiens
cagagaagcuggccuccua

SEQ ID NO: 322583 - RNA, 19 nt, Homo sapiens
ccacgaaacuuugcccaua

SEQ ID NO: 322584 - RNA, 19 nt, Homo sapiens
cuaacucgcuguaguaauu

SEQ ID NO: 322585 - RNA, 19 nt, Homo sapiens
ucaaaugcaugaucaaaug

SEQ ID NO: 322586 - RNA, 19 nt, Homo sapiens
gaagaaaucgauguuguuu

SEQ ID NO: 322587 - RNA, 19 nt, Homo sapiens
gagaacaguugaaacacaa

SEQ ID NO: 322588 - RNA, 19 nt, Homo sapiens
acugaaagauuuagccaua

SEQ ID NO: 322589 - RNA, 19 nt, Homo sapiens
gaacuuguuucaaaugcau

SEQ ID NO: 322590 - RNA, 19 nt, Homo sapiens
acacaaacuugaacagcua

SEQ ID NO: 322591 - RNA, 19 nt, Homo sapiens
acaagaagaugaggaagaa

SEQ ID NO: 322592 - RNA, 19 nt, Homo sapiens
ggagggaucgcgcugagua

SEQ ID NO: 322593 - RNA, 19 nt, Homo sapiens
uaaacugccucaaauugga

SEQ ID NO: 322594 - RNA, 19 nt, Homo sapiens
gaaacgacgagaacaguug

SEQ ID NO: 322595 - RNA, 19 nt, Homo sapiens
ggaagaaaucgauguuguu

SEQ ID NO: 322596 - RNA, 19 nt, Homo sapiens
ccacacaucagcacaacua

SEQ ID NO: 322597 - RNA, 19 nt, Homo sapiens
ggaacaagaagaugaggaa

SEQ ID NO: 322598 - RNA, 19 nt, Homo sapiens
gcgaggauaucuggaagaa

SEQ ID NO: 322599 - RNA, 19 nt, Homo sapiens
ggaucgcgcugaguauaaa

SEQ ID NO: 322600 - RNA, 19 nt, Homo sapiens
cgacgagaccuucaucaaa

SEQ ID NO: 322601 - RNA, 19 nt, Homo sapiens
gaacagcuacggaacucuu

SEQ ID NO: 322602 - RNA, 19 nt, Homo sapiens
gaacacacaacgucuugga

SEQ ID NO: 322603 - RNA, 19 nt, Homo sapiens
gacagcagcucgcccaagu

SEQ ID NO: 322604 - RNA, 19 nt, Homo sapiens
gacgagaccuucaucaaaa

SEQ ID NO: 322605 - RNA, 19 nt, Homo sapiens
aauguaaacugccucaaau

SEQ ID NO: 322606 - RNA, 19 nt, Homo sapiens
cgagaacaguugaaacaca

SEQ ID NO: 322607 - RNA, 19 nt, Homo sapiens
acagaaauguccugagcaa

SEQ ID NO: 322608 - RNA, 19 nt, Homo sapiens
ccgccaagcucgucucaga

SEQ ID NO: 322609 - RNA, 19 nt, Homo sapiens
aaauuggacuuugggcaua

SEQ ID NO: 322610 - RNA, 19 nt, Homo sapiens
ugagacagaucagcaacaa

SEQ ID NO: 322611 - RNA, 19 nt, Homo sapiens
gaacuaugaccucgacuac

SEQ ID NO: 322612 - RNA, 19 nt, Homo sapiens
ggaacuaugaccucgacua

SEQ ID NO: 322613 - RNA, 19 nt, Homo sapiens
uaauguaaacugccucaaa

SEQ ID NO: 322614 - RNA, 19 nt, Homo sapiens
gaaagauuuagccauaaug

SEQ ID NO: 322615 - RNA, 19 nt, Homo sapiens
gaucaaaugcaaccucaca

SEQ ID NO: 322616 - RNA, 19 nt, Homo sapiens
gacgagaacaguugaaaca

SEQ ID NO: 322617 - RNA, 19 nt, Homo sapiens
uaucuaacucgcuguagua

SEQ ID NO: 322618 - RNA, 19 nt, Homo sapiens
ggaaacgacgagaacaguu

SEQ ID NO: 322619 - RNA, 19 nt, Homo sapiens
gggaucgcgcugaguauaa

SEQ ID NO: 322620 - RNA, 19 nt, Homo sapiens
gcuuguaccugcaggaucu

SEQ ID NO: 322621 - RNA, 19 nt, Homo sapiens
guaaacugccucaaauugg

SEQ ID NO: 322622 - RNA, 19 nt, Homo sapiens
acuaugaccucgacuacga

SEQ ID NO: 322623 - RNA, 19 nt, Homo sapiens
aacguuagcuucaccaaca

SEQ ID NO: 322624 - RNA, 19 nt, Homo sapiens
cugcuuagacgcuggauuu

SEQ ID NO: 322625 - RNA, 19 nt, Homo sapiens
uguaaacugccucaaauug

SEQ ID NO: 322626 - RNA, 19 nt, Homo sapiens
agaaauguccugagcaauc

SEQ ID NO: 322627 - RNA, 19 nt, Homo sapiens
aaaucgauguuguuucugu

SEQ ID NO: 322628 - RNA, 19 nt, Homo sapiens
aggaagaaaucgauguugu

SEQ ID NO: 322629 - RNA, 19 nt, Homo sapiens
ucaccaacaggaacuauga

SEQ ID NO: 322630 - RNA, 19 nt, Homo sapiens
cagcgacucugaggaggaa

SEQ ID NO: 322631 - RNA, 19 nt, Homo sapiens
gaggcuauucugcccauuu

SEQ ID NO: 322632 - RNA, 19 nt, Homo sapiens
agcaaaagcucauuucuga

SEQ ID NO: 322633 - RNA, 19 nt, Homo sapiens
gcgaacacacaacgucuug

SEQ ID NO: 322634 - RNA, 19 nt, Homo sapiens
gcacuuugcacuggaacuu

SEQ ID NO: 322635 - RNA, 19 nt, Homo sapiens
cugaaagauuuagccauaa

SEQ ID NO: 322636 - RNA, 19 nt, Homo sapiens
gugaccagaucccggaguu

SEQ ID NO: 322637 - RNA, 19 nt, Homo sapiens
ucagaggcuuggcgggaaa

SEQ ID NO: 322638 - RNA, 19 nt, Homo sapiens
cacgaaacuuugcccauag

SEQ ID NO: 322639 - RNA, 19 nt, Homo sapiens
cuaccaggcugcgcgcaaa

SEQ ID NO: 322640 - RNA, 19 nt, Homo sapiens
aaugcaaccucacaaccuu

SEQ ID NO: 322641 - RNA, 19 nt, Homo sapiens
guugaaacacaaacuugaa

SEQ ID NO: 322642 - RNA, 19 nt, Homo sapiens
ggagauccggagcgaauag

SEQ ID NO: 322643 - RNA, 19 nt, Homo sapiens
ccaggacccgcuucucuga

SEQ ID NO: 322644 - RNA, 19 nt, Homo sapiens
gaaacacaaacuugaacag

SEQ ID NO: 322645 - RNA, 19 nt, Homo sapiens
cgauguuguuucuguggaa

SEQ ID NO: 322646 - RNA, 19 nt, Homo sapiens
ggacgacgagaccuucauc

SEQ ID NO: 322647 - RNA, 19 nt, Homo sapiens
aggcuauucugcccauuug

SEQ ID NO: 322648 - RNA, 19 nt, Homo sapiens
aacgauuccuucuaacaga

SEQ ID NO: 322649 - RNA, 19 nt, Homo sapiens
gucaagaggcgaacacaca

SEQ ID NO: 322650 - RNA, 19 nt, Homo sapiens
gggucaaguuggacagugu

SEQ ID NO: 322651 - RNA, 19 nt, Homo sapiens
gaggaagaaaucgauguug

SEQ ID NO: 322652 - RNA, 19 nt, Homo sapiens
aggacccgcuucucugaaa

SEQ ID NO: 322653 - RNA, 19 nt, Homo sapiens
gcacuggaacuuacaacac

SEQ ID NO: 322654 - RNA, 19 nt, Homo sapiens
aagaagaugaggaagaaau

SEQ ID NO: 322655 - RNA, 19 nt, Homo sapiens
ggaggaacaagaagaugag

SEQ ID NO: 322656 - RNA, 19 nt, Homo sapiens
aaacgacgagaacaguuga

SEQ ID NO: 322657 - RNA, 19 nt, Homo sapiens
ugaggaagaaaucgauguu

SEQ ID NO: 322658 - RNA, 19 nt, Homo sapiens
gcgacgaggaggagaacuu

SEQ ID NO: 322659 - RNA, 19 nt, Homo sapiens
gaacaguugaaacacaaac

SEQ ID NO: 322660 - RNA, 19 nt, Homo sapiens
ucaagaggcgaacacacaa

SEQ ID NO: 322661 - RNA, 19 nt, Homo sapiens
ggacccgcuucucugaaag

SEQ ID NO: 322662 - RNA, 19 nt, Homo sapiens
gagucuggaucaccuucug

SEQ ID NO: 322663 - RNA, 19 nt, Homo sapiens
ccgcauccacgaaacuuug

SEQ ID NO: 322664 - RNA, 19 nt, Homo sapiens
aauuggacuuugggcauaa

SEQ ID NO: 322665 - RNA, 19 nt, Homo sapiens
gggagauccggagcgaaua

SEQ ID NO: 322666 - RNA, 19 nt, Homo sapiens
ggauaucuggaagaaauuc

SEQ ID NO: 322667 - RNA, 19 nt, Homo sapiens
uguuucaaaugcaugauca

SEQ ID NO: 322668 - RNA, 19 nt, Homo sapiens
ggaaaaguaaggaaaacga

SEQ ID NO: 322669 - RNA, 19 nt, Homo sapiens
caaaagcucauuucugaag

SEQ ID NO: 322670 - RNA, 19 nt, Homo sapiens
ccagaucccggaguuggaa

SEQ ID NO: 322671 - RNA, 19 nt, Homo sapiens
ugaggaggaacaagaagau

SEQ ID NO: 322672 - RNA, 19 nt, Homo sapiens
cggugcagccguauuucua

SEQ ID NO: 322673 - RNA, 19 nt, Homo sapiens
acucggugcagccguauuu

SEQ ID NO: 322674 - RNA, 19 nt, Homo sapiens
uuaucuaacucgcuguagu

SEQ ID NO: 322675 - RNA, 19 nt, Homo sapiens
aaacgauuccuucuaacag

SEQ ID NO: 322676 - RNA, 19 nt, Homo sapiens
gaaaacgauuccuucuaac

SEQ ID NO: 322677 - RNA, 19 nt, Homo sapiens
ugaaacacaaacuugaaca

SEQ ID NO: 322678 - RNA, 19 nt, Homo sapiens
aaagcucauuucugaagag

SEQ ID NO: 322679 - RNA, 19 nt, Homo sapiens
gaucagcaacaaccgaaaa

SEQ ID NO: 322680 - RNA, 19 nt, Homo sapiens
aacaagaagaugaggaaga

SEQ ID NO: 322681 - RNA, 19 nt, Homo sapiens
gaacuacgccuccaucaua

SEQ ID NO: 322682 - RNA, 19 nt, Homo sapiens
ccaguuggcuuuacuuuaa

SEQ ID NO: 322683 - RNA, 19 nt, Homo sapiens
aaacugaggcuuagagaua

SEQ ID NO: 322684 - RNA, 19 nt, Homo sapiens
ccacuaaacuacauuguuc

SEQ ID NO: 322685 - RNA, 19 nt, Homo sapiens
gcacguggguguguuggua

SEQ ID NO: 322686 - RNA, 19 nt, Homo sapiens
gaggacaucuggaagaaau

SEQ ID NO: 322687 - RNA, 19 nt, Homo sapiens
aaaccuaggucuccaguug

SEQ ID NO: 322688 - RNA, 19 nt, Homo sapiens
gcuuagagauagacaauca

SEQ ID NO: 322689 - RNA, 19 nt, Homo sapiens
aauaauaaaugcccucuuc

SEQ ID NO: 322690 - RNA, 19 nt, Homo sapiens
ugugguagcuuaucuuaga

SEQ ID NO: 322691 - RNA, 19 nt, Homo sapiens
gagcggacauggacuacga

SEQ ID NO: 322692 - RNA, 19 nt, Homo sapiens
gauagacaaucacuacaag

SEQ ID NO: 322693 - RNA, 19 nt, Homo sapiens
gaagaagccgagagccuuu

SEQ ID NO: 322694 - RNA, 19 nt, Homo sapiens
ccaggcaccucuuccuuga

SEQ ID NO: 322695 - RNA, 19 nt, Homo sapiens
gcgaggacaucuggaagaa

SEQ ID NO: 322696 - RNA, 19 nt, Homo sapiens
gacuguggcuagugacaaa

SEQ ID NO: 322697 - RNA, 19 nt, Homo sapiens
ggcugaagcugcccgugua

SEQ ID NO: 322698 - RNA, 19 nt, Homo sapiens
ggcauuggcucuucucaag

SEQ ID NO: 322699 - RNA, 19 nt, Homo sapiens
uaaauuaggaccaagaaag

SEQ ID NO: 322700 - RNA, 19 nt, Homo sapiens
gagccagccucccuuugau

SEQ ID NO: 322701 - RNA, 19 nt, Homo sapiens
ccaagaaagcucacuguag

SEQ ID NO: 322702 - RNA, 19 nt, Homo sapiens
caccuugccuugcuguuug

SEQ ID NO: 322703 - RNA, 19 nt, Homo sapiens
ggucaggcauuggcucuuc

SEQ ID NO: 322704 - RNA, 19 nt, Homo sapiens
gcacuauuucuacgacuau

SEQ ID NO: 322705 - RNA, 19 nt, Homo sapiens
acucguaccagcacuauuu

SEQ ID NO: 322706 - RNA, 19 nt, Homo sapiens
uguagacuguggcuaguga

SEQ ID NO: 322707 - RNA, 19 nt, Homo sapiens
cagccucccuuugaugauu

SEQ ID NO: 322708 - RNA, 19 nt, Homo sapiens
gcgcuuagagaggacaaua

SEQ ID NO: 322709 - RNA, 19 nt, Homo sapiens
ggacaucuggaagaaauuc

SEQ ID NO: 322710 - RNA, 19 nt, Homo sapiens
cuacauuguucuuauucug

SEQ ID NO: 322711 - RNA, 19 nt, Homo sapiens
ggucaaggcaguagaacuc

SEQ ID NO: 322712 - RNA, 19 nt, Homo sapiens
gacagggagggaagaauga

SEQ ID NO: 322713 - RNA, 19 nt, Homo sapiens
uuccuacacuugagagaaa

SEQ ID NO: 322714 - RNA, 19 nt, Homo sapiens
ggugaggguuggcgcuuag

SEQ ID NO: 322715 - RNA, 19 nt, Homo sapiens
gcugcucccuggcauucaa

SEQ ID NO: 322716 - RNA, 19 nt, Homo sapiens
ggaaugggguauggaaguu

SEQ ID NO: 322717 - RNA, 19 nt, Homo sapiens
gcaccucuuccuugauguu

SEQ ID NO: 322718 - RNA, 19 nt, Homo sapiens
gggucuuugugguagcuua

SEQ ID NO: 322719 - RNA, 19 nt, Homo sapiens
aggcaccucuuccuugaug

SEQ ID NO: 322720 - RNA, 19 nt, Homo sapiens
ccagcuuucugccaucuag

SEQ ID NO: 322721 - RNA, 19 nt, Homo sapiens
ggaacuacgccuccaucau

SEQ ID NO: 322722 - RNA, 19 nt, Homo sapiens
agacagggagggaagaaug

SEQ ID NO: 322723 - RNA, 19 nt, Homo sapiens
gccacuaaacuacauuguu

SEQ ID NO: 322724 - RNA, 19 nt, Homo sapiens
agagauagacaaucacuac

SEQ ID NO: 322725 - RNA, 19 nt, Homo sapiens
ccacuuaccacucgugcau

SEQ ID NO: 322726 - RNA, 19 nt, Homo sapiens
gaccaagaaagcucacugu

SEQ ID NO: 322727 - RNA, 19 nt, Homo sapiens
gcccuccucucccauccuu

SEQ ID NO: 322728 - RNA, 19 nt, Homo sapiens
gugguagcuuaucuuagaa

SEQ ID NO: 322729 - RNA, 19 nt, Homo sapiens
uguggcuagugacaaauaa

SEQ ID NO: 322730 - RNA, 19 nt, Homo sapiens
cccuggcauucaacaaaua

SEQ ID NO: 322731 - RNA, 19 nt, Homo sapiens
gagacacuccaaaccugaa

SEQ ID NO: 322732 - RNA, 19 nt, Homo sapiens
gccagccucccuuugauga

SEQ ID NO: 322733 - RNA, 19 nt, Homo sapiens
uuuacacgaccauuugaua

SEQ ID NO: 322734 - RNA, 19 nt, Homo sapiens
cguaccagcacuauuucua

SEQ ID NO: 322735 - RNA, 19 nt, Homo sapiens
gaggguuggcgcuuagaga

SEQ ID NO: 322736 - RNA, 19 nt, Homo sapiens
cuuagaagcacuacaccuu

SEQ ID NO: 322737 - RNA, 19 nt, Homo sapiens
agacaaucacuacaaguca

SEQ ID NO: 322738 - RNA, 19 nt, Homo sapiens
gagauagacaaucacuaca

SEQ ID NO: 322739 - RNA, 19 nt, Homo sapiens
uaagagacacuccaaaccu

SEQ ID NO: 322740 - RNA, 19 nt, Homo sapiens
ggacaauacugggguugga

SEQ ID NO: 322741 - RNA, 19 nt, Homo sapiens
uucuuauucuggcaucuua

SEQ ID NO: 322742 - RNA, 19 nt, Homo sapiens
guaccagcacuauuucuac

SEQ ID NO: 322743 - RNA, 19 nt, Homo sapiens
ccaagcgacucggguaagg

SEQ ID NO: 322744 - RNA, 19 nt, Homo sapiens
agauagacaaucacuacaa

SEQ ID NO: 322745 - RNA, 19 nt, Homo sapiens
agccaaagccuucguccuu

SEQ ID NO: 322746 - RNA, 19 nt, Homo sapiens
ggcaaucugugggcuacau

SEQ ID NO: 322747 - RNA, 19 nt, Homo sapiens
uaauaaaugcccucuucuc

SEQ ID NO: 322748 - RNA, 19 nt, Homo sapiens
agccucccuuugaugauua

SEQ ID NO: 322749 - RNA, 19 nt, Homo sapiens
ggcuagugacaaauaaauu

SEQ ID NO: 322750 - RNA, 19 nt, Homo sapiens
uccaguuggcuuuacuuua

SEQ ID NO: 322751 - RNA, 19 nt, Homo sapiens
ggacuguaagggauugaag

SEQ ID NO: 322752 - RNA, 19 nt, Homo sapiens
gcccaagcgacucggguaa

SEQ ID NO: 322753 - RNA, 19 nt, Homo sapiens
uuacacgaccauuugauag

SEQ ID NO: 322754 - RNA, 19 nt, Homo sapiens
ccuccacacccgugagaaa

SEQ ID NO: 322755 - RNA, 19 nt, Homo sapiens
ggcauucaacaaauauuca

SEQ ID NO: 322756 - RNA, 19 nt, Homo sapiens
caucuccgccucucuuugg

SEQ ID NO: 322757 - RNA, 19 nt, Homo sapiens
guccugagauggaaaagug

SEQ ID NO: 322758 - RNA, 19 nt, Homo sapiens
acaccuugccuugcuguuu

SEQ ID NO: 322759 - RNA, 19 nt, Homo sapiens
uagacaaucacuacaaguc

SEQ ID NO: 322760 - RNA, 19 nt, Homo sapiens
ucccuggcauucaacaaau

SEQ ID NO: 322761 - RNA, 19 nt, Homo sapiens
cauuggcucuucucaagcu

SEQ ID NO: 322762 - RNA, 19 nt, Homo sapiens
ggccaucuccgccucucuu

SEQ ID NO: 322763 - RNA, 19 nt, Homo sapiens
uaaggaagaugaagagauu

SEQ ID NO: 322764 - RNA, 19 nt, Homo sapiens
gaggaaaucucacacucua

SEQ ID NO: 322765 - RNA, 19 nt, Homo sapiens
uaagagaacuucgucugua

SEQ ID NO: 322766 - RNA, 19 nt, Homo sapiens
gggaaaggaugauaaggaa

SEQ ID NO: 322767 - RNA, 19 nt, Homo sapiens
ccaaacccauccauuauga

SEQ ID NO: 322768 - RNA, 19 nt, Homo sapiens
gaacccagcccucagcuuu

SEQ ID NO: 322769 - RNA, 19 nt, Homo sapiens
gaggacaucuggaagaaau

SEQ ID NO: 322770 - RNA, 19 nt, Homo sapiens
gaaaucgacgugacaguaa

SEQ ID NO: 322771 - RNA, 19 nt, Homo sapiens
uauaaaggcuugcauucuu

SEQ ID NO: 322772 - RNA, 19 nt, Homo sapiens
gaaaggaugauaaggaaga

SEQ ID NO: 322773 - RNA, 19 nt, Homo sapiens
gaacuacgccucccucauc

SEQ ID NO: 322774 - RNA, 19 nt, Homo sapiens
caagggacuuugucucauu

SEQ ID NO: 322775 - RNA, 19 nt, Homo sapiens
gcaccugccucucaucuca

SEQ ID NO: 322776 - RNA, 19 nt, Homo sapiens
gguaacuucugaacccuaa

SEQ ID NO: 322777 - RNA, 19 nt, Homo sapiens
guuggaaaccuuacauaua

SEQ ID NO: 322778 - RNA, 19 nt, Homo sapiens
gaggauggcuacggagaaa

SEQ ID NO: 322779 - RNA, 19 nt, Homo sapiens
gcaugaaucucuuccacau

SEQ ID NO: 322780 - RNA, 19 nt, Homo sapiens
gcucgaagccggcaaccua

SEQ ID NO: 322781 - RNA, 19 nt, Homo sapiens
ugaucaacguggaccauua

SEQ ID NO: 322782 - RNA, 19 nt, Homo sapiens
gcucuaggguuuccaaagu

SEQ ID NO: 322783 - RNA, 19 nt, Homo sapiens
ggaagaaauucgaguuggu

SEQ ID NO: 322784 - RNA, 19 nt, Homo sapiens
ggagaacuguaacacuuuc

SEQ ID NO: 322785 - RNA, 19 nt, Homo sapiens
gcugacagaugguaugcaa

SEQ ID NO: 322786 - RNA, 19 nt, Homo sapiens
gaagaugaagagauuguga

SEQ ID NO: 322787 - RNA, 19 nt, Homo sapiens
ggaacuuucugucuucaca

SEQ ID NO: 322788 - RNA, 19 nt, Homo sapiens
caccacgccuagcuaauuu

SEQ ID NO: 322789 - RNA, 19 nt, Homo sapiens
gagggaacuuucugucuuc

SEQ ID NO: 322790 - RNA, 19 nt, Homo sapiens
aagagaacuucgucuguaa

SEQ ID NO: 322791 - RNA, 19 nt, Homo sapiens
caaggccacggaauacuua

SEQ ID NO: 322792 - RNA, 19 nt, Homo sapiens
gcaagagacggaaugauca

SEQ ID NO: 322793 - RNA, 19 nt, Homo sapiens
caugaaaacuuguuccuuu

SEQ ID NO: 322794 - RNA, 19 nt, Homo sapiens
ucaaugcugugacucagaa

SEQ ID NO: 322795 - RNA, 19 nt, Homo sapiens
gcgaggacaucuggaagaa

SEQ ID NO: 322796 - RNA, 19 nt, Homo sapiens
ugagggaacuuucugucuu

SEQ ID NO: 322797 - RNA, 19 nt, Homo sapiens
caaccuagcgcccaucuuc

SEQ ID NO: 322798 - RNA, 19 nt, Homo sapiens
ggagagcuguugggacuca

SEQ ID NO: 322799 - RNA, 19 nt, Homo sapiens
ggaaaucucacacucuaca

SEQ ID NO: 322800 - RNA, 19 nt, Homo sapiens
gccugaccauucugucuua

SEQ ID NO: 322801 - RNA, 19 nt, Homo sapiens
aaacccauccauuaugaua

SEQ ID NO: 322802 - RNA, 19 nt, Homo sapiens
caacuaugcugccccuuuu

SEQ ID NO: 322803 - RNA, 19 nt, Homo sapiens
aaacccagcucucucucuu

SEQ ID NO: 322804 - RNA, 19 nt, Homo sapiens
gaucaacguucgcgguucu

SEQ ID NO: 322805 - RNA, 19 nt, Homo sapiens
ugacucagaacauuuaaga

SEQ ID NO: 322806 - RNA, 19 nt, Homo sapiens
caauauaaaggcuugcauu

SEQ ID NO: 322807 - RNA, 19 nt, Homo sapiens
gcccaaacccauccauuau

SEQ ID NO: 322808 - RNA, 19 nt, Homo sapiens
ggagguuaauggcaugauc

SEQ ID NO: 322809 - RNA, 19 nt, Homo sapiens
auaaaggcuugcauucuug

SEQ ID NO: 322810 - RNA, 19 nt, Homo sapiens
gcaggacacucuggacagu

SEQ ID NO: 322811 - RNA, 19 nt, Homo sapiens
auccuugacugaugaauuu

SEQ ID NO: 322812 - RNA, 19 nt, Homo sapiens
gcaagcaagccaacaugga

SEQ ID NO: 322813 - RNA, 19 nt, Homo sapiens
gggagaacuguaacacuuu

SEQ ID NO: 322814 - RNA, 19 nt, Homo sapiens
acucguaccaucacuauuu

SEQ ID NO: 322815 - RNA, 19 nt, Homo sapiens
ccagugcacaaacaauaua

SEQ ID NO: 322816 - RNA, 19 nt, Homo sapiens
ccaccacgccuagcuaauu

SEQ ID NO: 322817 - RNA, 19 nt, Homo sapiens
agggagaacuguaacacuu

SEQ ID NO: 322818 - RNA, 19 nt, Homo sapiens
gaacauuuaagagaacuuc

SEQ ID NO: 322819 - RNA, 19 nt, Homo sapiens
ucuaggguuuccaaaguaa

SEQ ID NO: 322820 - RNA, 19 nt, Homo sapiens
gccagcugcucuaggguuu

SEQ ID NO: 322821 - RNA, 19 nt, Homo sapiens
ucauguggguaacuucuga

SEQ ID NO: 322822 - RNA, 19 nt, Homo sapiens
cagcuuuggucuccuggaa

SEQ ID NO: 322823 - RNA, 19 nt, Homo sapiens
cucacuaucuccaaagaaa

SEQ ID NO: 322824 - RNA, 19 nt, Homo sapiens
ccaaaguaaugauccuagu

SEQ ID NO: 322825 - RNA, 19 nt, Homo sapiens
agaaaucgacgugacagua

SEQ ID NO: 322826 - RNA, 19 nt, Homo sapiens
gaauuugaaguucuacuag

SEQ ID NO: 322827 - RNA, 19 nt, Homo sapiens
ccucugggcucucuucucu

SEQ ID NO: 322828 - RNA, 19 nt, Homo sapiens
ucugggcucucuucucuga

SEQ ID NO: 322829 - RNA, 19 nt, Homo sapiens
ucucuucccugacuuaugg

SEQ ID NO: 322830 - RNA, 19 nt, Homo sapiens
aaaucgacgugacaguaaa

SEQ ID NO: 322831 - RNA, 19 nt, Homo sapiens
gagcaagcaagccaacaug

SEQ ID NO: 322832 - RNA, 19 nt, Homo sapiens
gaguuggaaaccuuacaua

SEQ ID NO: 322833 - RNA, 19 nt, Homo sapiens
gaccauuaccucacuguca

SEQ ID NO: 322834 - RNA, 19 nt, Homo sapiens
cagcuugucauguggguaa

SEQ ID NO: 322835 - RNA, 19 nt, Homo sapiens
ugccugagccuuccgagua

SEQ ID NO: 322836 - RNA, 19 nt, Homo sapiens
cucagaacauuuaagagaa

SEQ ID NO: 322837 - RNA, 19 nt, Homo sapiens
ggaccaagaagaaguacca

SEQ ID NO: 322838 - RNA, 19 nt, Homo sapiens
ggacaucuggaagaaauuc

SEQ ID NO: 322839 - RNA, 19 nt, Homo sapiens
gucuugaccuccugaccua

SEQ ID NO: 322840 - RNA, 19 nt, Homo sapiens
acucagaacauuuaagaga

SEQ ID NO: 322841 - RNA, 19 nt, Homo sapiens
ucagagacuugaucaacgu

SEQ ID NO: 322842 - RNA, 19 nt, Homo sapiens
acgccuagcuaauuucugu

SEQ ID NO: 322843 - RNA, 19 nt, Homo sapiens
gagcucugcuuagccaauc

SEQ ID NO: 322844 - RNA, 19 nt, Homo sapiens
ugacagaugguaugcaaca

SEQ ID NO: 322845 - RNA, 19 nt, Homo sapiens
gagccucccaccuguagaa

SEQ ID NO: 322846 - RNA, 19 nt, Homo sapiens
ccgcagguuagaaauauuu

SEQ ID NO: 322847 - RNA, 19 nt, Homo sapiens
gagacggaaugaucaacgu

SEQ ID NO: 322848 - RNA, 19 nt, Homo sapiens
cugccuccaugauagauuu

SEQ ID NO: 322849 - RNA, 19 nt, Homo sapiens
gcugugacucagaacauuu

SEQ ID NO: 322850 - RNA, 19 nt, Homo sapiens
ggaggaaaucucacacucu

SEQ ID NO: 322851 - RNA, 19 nt, Homo sapiens
cgacggcaauugcagaaaa

SEQ ID NO: 322852 - RNA, 19 nt, Homo sapiens
aaaguaaugauccuaguca

SEQ ID NO: 322853 - RNA, 19 nt, Homo sapiens
caagagacggaaugaucaa

SEQ ID NO: 322854 - RNA, 19 nt, Homo sapiens
gaaucugggccucucugaa

SEQ ID NO: 322855 - RNA, 19 nt, Homo sapiens
gaacuguaacacuuucucu

SEQ ID NO: 322856 - RNA, 19 nt, Homo sapiens
ucagaacauuuaagagaac

SEQ ID NO: 322857 - RNA, 19 nt, Homo sapiens
ugcaacaggugguggaugu

SEQ ID NO: 322858 - RNA, 19 nt, Homo sapiens
agaagaaguaccacagcua

SEQ ID NO: 322859 - RNA, 19 nt, Homo sapiens
ccucccaccuguagaaagu

SEQ ID NO: 322860 - RNA, 19 nt, Homo sapiens
gaacuuucugucuucacaa

SEQ ID NO: 322861 - RNA, 19 nt, Homo sapiens
cuucgucuguaaguaauuu

SEQ ID NO: 322862 - RNA, 19 nt, Homo sapiens
gaucaacguggaccauuac

SEQ ID NO: 322863 - RNA, 19 nt, Homo sapiens
gaagucaccuuguguguuc

SEQ ID NO: 322864 - RNA, 19 nt, Homo sapiens
ggaaguucauaccuaagua

SEQ ID NO: 322865 - RNA, 19 nt, Homo sapiens
gaacccagaccucgaguuu

SEQ ID NO: 322866 - RNA, 19 nt, Homo sapiens
gcaaaguucuguguuuaau

SEQ ID NO: 322867 - RNA, 19 nt, Homo sapiens
ucacggagaugcugcuuga

SEQ ID NO: 322868 - RNA, 19 nt, Homo sapiens
gaauguugguuuacuuuca

SEQ ID NO: 322869 - RNA, 19 nt, Homo sapiens
gaaaaugaguugugaaagu

SEQ ID NO: 322870 - RNA, 19 nt, Homo sapiens
gaggacaucuggaagaagu

SEQ ID NO: 322871 - RNA, 19 nt, Homo sapiens
guuaaucucuguuauguac

SEQ ID NO: 322872 - RNA, 19 nt, Homo sapiens
uaaauaccauugacacauc

SEQ ID NO: 322873 - RNA, 19 nt, Homo sapiens
ccaaggcugucaccacauu

SEQ ID NO: 322874 - RNA, 19 nt, Homo sapiens
agaggaagaugaagaggaa

SEQ ID NO: 322875 - RNA, 19 nt, Homo sapiens
caacagaaagucauuccuu

SEQ ID NO: 322876 - RNA, 19 nt, Homo sapiens
gagcugauccucaaacgau

SEQ ID NO: 322877 - RNA, 19 nt, Homo sapiens
ugaagaugaugaagaggaa

SEQ ID NO: 322878 - RNA, 19 nt, Homo sapiens
gggaggacaucuggaagaa

SEQ ID NO: 322879 - RNA, 19 nt, Homo sapiens
guauuagacuggaaguuca

SEQ ID NO: 322880 - RNA, 19 nt, Homo sapiens
guucauaccuaaguacugu

SEQ ID NO: 322881 - RNA, 19 nt, Homo sapiens
gacuggaaguucauaccua

SEQ ID NO: 322882 - RNA, 19 nt, Homo sapiens
ccacagaagaagauaaaga

SEQ ID NO: 322883 - RNA, 19 nt, Homo sapiens
acccagaccucgaguuuga

SEQ ID NO: 322884 - RNA, 19 nt, Homo sapiens
aaugcaaaguucuguguuu

SEQ ID NO: 322885 - RNA, 19 nt, Homo sapiens
gaggacacccugagcgauu

SEQ ID NO: 322886 - RNA, 19 nt, Homo sapiens
ugaugaagaugaugaagag

SEQ ID NO: 322887 - RNA, 19 nt, Homo sapiens
augcaaaguucuguguuua

SEQ ID NO: 322888 - RNA, 19 nt, Homo sapiens
uccagcagaugccacauaa

SEQ ID NO: 322889 - RNA, 19 nt, Homo sapiens
gcaguaggaccaccagugu

SEQ ID NO: 322890 - RNA, 19 nt, Homo sapiens
cggagaugcugcuugagaa

SEQ ID NO: 322891 - RNA, 19 nt, Homo sapiens
ggacaucuggaagaaguuu

SEQ ID NO: 322892 - RNA, 19 nt, Homo sapiens
ugacgcugauacauaacua

SEQ ID NO: 322893 - RNA, 19 nt, Homo sapiens
caaacaacagaaagucauu

SEQ ID NO: 322894 - RNA, 19 nt, Homo sapiens
cggaguugguaaagaauga

SEQ ID NO: 322895 - RNA, 19 nt, Homo sapiens
acuggaaguucauaccuaa

SEQ ID NO: 322896 - RNA, 19 nt, Homo sapiens
gaagaugaagaggaagaaa

SEQ ID NO: 322897 - RNA, 19 nt, Homo sapiens
gguaaugagagguggcuuu

SEQ ID NO: 322898 - RNA, 19 nt, Homo sapiens
agaacuggguaaaugcaaa

SEQ ID NO: 322899 - RNA, 19 nt, Homo sapiens
guaaauaccauugacacau

SEQ ID NO: 322900 - RNA, 19 nt, Homo sapiens
caugacagcgcuaaacguu

SEQ ID NO: 322901 - RNA, 19 nt, Homo sapiens
caucuuauagcacuuugaa

SEQ ID NO: 322902 - RNA, 19 nt, Homo sapiens
ugccggaguugguaaagaa

SEQ ID NO: 322903 - RNA, 19 nt, Homo sapiens
guauacauccuggguaaug

SEQ ID NO: 322904 - RNA, 19 nt, Homo sapiens
gaccacaaggcccucagua

SEQ ID NO: 322905 - RNA, 19 nt, Homo sapiens
ggaagaugaagaggaagaa

SEQ ID NO: 322906 - RNA, 19 nt, Homo sapiens
gaaauaccucauguuuaug

SEQ ID NO: 322907 - RNA, 19 nt, Homo sapiens
uauuuagugcugcaucuua

SEQ ID NO: 322908 - RNA, 19 nt, Homo sapiens
uaaaugcaaaguucugugu

SEQ ID NO: 322909 - RNA, 19 nt, Homo sapiens
cauaagggguuugccauuu

SEQ ID NO: 322910 - RNA, 19 nt, Homo sapiens
gaacuggguaaaugcaaag

SEQ ID NO: 322911 - RNA, 19 nt, Homo sapiens
uauacauccuggguaauga

SEQ ID NO: 322912 - RNA, 19 nt, Homo sapiens
uuguauacauccuggguaa

SEQ ID NO: 322913 - RNA, 19 nt, Homo sapiens
ucacugugcgucccaagaa

SEQ ID NO: 322914 - RNA, 19 nt, Homo sapiens
cuggguaaaugcaaaguuc

SEQ ID NO: 322915 - RNA, 19 nt, Homo sapiens
cagcagaugccacauaagg

SEQ ID NO: 322916 - RNA, 19 nt, Homo sapiens
gcuagacgcuucucaaaac

SEQ ID NO: 322917 - RNA, 19 nt, Homo sapiens
cagaugaugaagaugauga

SEQ ID NO: 322918 - RNA, 19 nt, Homo sapiens
uaaucucuguuauguacug

SEQ ID NO: 322919 - RNA, 19 nt, Homo sapiens
gcagaaaccacaacauccu

SEQ ID NO: 322920 - RNA, 19 nt, Homo sapiens
acacugccuguauacuuua

SEQ ID NO: 322921 - RNA, 19 nt, Homo sapiens
gaaguucauaccuaaguac

SEQ ID NO: 322922 - RNA, 19 nt, Homo sapiens
ccacauucaccaucacugu

SEQ ID NO: 322923 - RNA, 19 nt, Homo sapiens
aaaucgacguggucacugu

SEQ ID NO: 322924 - RNA, 19 nt, Homo sapiens
ccaaacaacagaaagucau

SEQ ID NO: 322925 - RNA, 19 nt, Homo sapiens
cacguccgcucaagagugu

SEQ ID NO: 322926 - RNA, 19 nt, Homo sapiens
ugaugaagaggaagaugaa

SEQ ID NO: 322927 - RNA, 19 nt, Homo sapiens
cgagcugggucacggagau

SEQ ID NO: 322928 - RNA, 19 nt, Homo sapiens
gcggaaagaagcccucagu

SEQ ID NO: 322929 - RNA, 19 nt, Homo sapiens
ccacgugccggaguuggua

SEQ ID NO: 322930 - RNA, 19 nt, Homo sapiens
acagugagcgucgcagaaa

SEQ ID NO: 322931 - RNA, 19 nt, Homo sapiens
gacagugagcgucgcagaa

SEQ ID NO: 322932 - RNA, 19 nt, Homo sapiens
ccaagguggucauuuugaa

SEQ ID NO: 322933 - RNA, 19 nt, Homo sapiens
ccgccaagguggucauuuu

SEQ ID NO: 322934 - RNA, 19 nt, Homo sapiens
guaugaaaaugaguuguga

SEQ ID NO: 322935 - RNA, 19 nt, Homo sapiens
aaauggugcuuaaguucca

SEQ ID NO: 322936 - RNA, 19 nt, Homo sapiens
uauauuuagugcugcaucu

SEQ ID NO: 322937 - RNA, 19 nt, Homo sapiens
uuuccuagccuguuucuuc

SEQ ID NO: 322938 - RNA, 19 nt, Homo sapiens
ucauaccuaaguacuguaa

SEQ ID NO: 322939 - RNA, 19 nt, Homo sapiens
ccaccucaccuccaugaca

SEQ ID NO: 322940 - RNA, 19 nt, Homo sapiens
ugcaaaguucuguguuuaa

SEQ ID NO: 322941 - RNA, 19 nt, Homo sapiens
ugaagucaccuuguguguu

SEQ ID NO: 322942 - RNA, 19 nt, Homo sapiens
ucgcagaaaccacaacauc

SEQ ID NO: 322943 - RNA, 19 nt, Homo sapiens
ugaagaggaagaugaagag

SEQ ID NO: 322944 - RNA, 19 nt, Homo sapiens
cacagaagaagauaaagag

SEQ ID NO: 322945 - RNA, 19 nt, Homo sapiens
gugccggaguugguaaaga

SEQ ID NO: 322946 - RNA, 19 nt, Homo sapiens
agaugaagaggaagaaauc

SEQ ID NO: 322947 - RNA, 19 nt, Homo sapiens
ggcaagacagcagcaguug

SEQ ID NO: 322948 - RNA, 19 nt, Homo sapiens
gucaccacauucaccauca

SEQ ID NO: 322949 - RNA, 19 nt, Homo sapiens
gguaaaugcaaaguucugu

SEQ ID NO: 322950 - RNA, 19 nt, Homo sapiens
ugaggagcauguuuuguau

SEQ ID NO: 322951 - RNA, 19 nt, Homo sapiens
uaagggguuugccauuuga

SEQ ID NO: 322952 - RNA, 19 nt, Homo sapiens
aagaugaagaggaagaaau

SEQ ID NO: 322953 - RNA, 19 nt, Homo sapiens
cggcguuccuccuccaaca

SEQ ID NO: 322954 - RNA, 19 nt, Homo sapiens
gaagagagcugcuuaaacu

SEQ ID NO: 322955 - RNA, 19 nt, Homo sapiens
gagaguagcuguguuugaa

SEQ ID NO: 322956 - RNA, 19 nt, Homo sapiens
ccagagcaauuuauacuuu

SEQ ID NO: 322957 - RNA, 19 nt, Homo sapiens
gcacauacagacucacaua

SEQ ID NO: 322958 - RNA, 19 nt, Homo sapiens
gacccuaaauccaauagaa

SEQ ID NO: 322959 - RNA, 19 nt, Homo sapiens
cgacugaaguugugugugu

SEQ ID NO: 322960 - RNA, 19 nt, Homo sapiens
cggaggagauggacuuuga

SEQ ID NO: 322961 - RNA, 19 nt, Homo sapiens
acaaacagcgaccauauaa

SEQ ID NO: 322962 - RNA, 19 nt, Homo sapiens
acaaugaacugcagacaca

SEQ ID NO: 322963 - RNA, 19 nt, Homo sapiens
uaucuugcauccugaguuu

SEQ ID NO: 322964 - RNA, 19 nt, Homo sapiens
cagacaaacuaucgacuga

SEQ ID NO: 322965 - RNA, 19 nt, Homo sapiens
gcacaugggcacauacaga

SEQ ID NO: 322966 - RNA, 19 nt, Homo sapiens
gauccuggccucuggcaua

SEQ ID NO: 322967 - RNA, 19 nt, Homo sapiens
ggaggaaucugugcucuac

SEQ ID NO: 322968 - RNA, 19 nt, Homo sapiens
gaaaggacccaauguacca

SEQ ID NO: 322969 - RNA, 19 nt, Homo sapiens
acaaggcaaugaagaaaga

SEQ ID NO: 322970 - RNA, 19 nt, Homo sapiens
gcacucaucuauuccuuuu

SEQ ID NO: 322971 - RNA, 19 nt, Homo sapiens
uaaacucacacaacaauga

SEQ ID NO: 322972 - RNA, 19 nt, Homo sapiens
gacaaacuaucgacugaag

SEQ ID NO: 322973 - RNA, 19 nt, Homo sapiens
uaucuuugcuccacuuuca

SEQ ID NO: 322974 - RNA, 19 nt, Homo sapiens
ggagauggacuuugaguac

SEQ ID NO: 322975 - RNA, 19 nt, Homo sapiens
gagcaaggaaugugacuuc

SEQ ID NO: 322976 - RNA, 19 nt, Homo sapiens
ggaaucugugcucuacuua

SEQ ID NO: 322977 - RNA, 19 nt, Homo sapiens
guacaaggcaaugaagaaa

SEQ ID NO: 322978 - RNA, 19 nt, Homo sapiens
gcauaucuuugcuccacuu

SEQ ID NO: 322979 - RNA, 19 nt, Homo sapiens
gcaccagcauacacacguu

SEQ ID NO: 322980 - RNA, 19 nt, Homo sapiens
gcauaugccugagcguuuc

SEQ ID NO: 322981 - RNA, 19 nt, Homo sapiens
gaguagcuguguuugaauc

SEQ ID NO: 322982 - RNA, 19 nt, Homo sapiens
cagcugagacuaagaagga

SEQ ID NO: 322983 - RNA, 19 nt, Homo sapiens
cuagugagcucaucgaaaa

SEQ ID NO: 322984 - RNA, 19 nt, Homo sapiens
gcaccugugucuggucuau

SEQ ID NO: 322985 - RNA, 19 nt, Homo sapiens
agaggcaucuucuacaugu

SEQ ID NO: 322986 - RNA, 19 nt, Homo sapiens
ugagggagccuaaccaugu

SEQ ID NO: 322987 - RNA, 19 nt, Homo sapiens
auacagacacacacauaua

SEQ ID NO: 322988 - RNA, 19 nt, Homo sapiens
uugauugccuuacaaaguu

SEQ ID NO: 322989 - RNA, 19 nt, Homo sapiens
gcagcuggacaucacauuu

SEQ ID NO: 322990 - RNA, 19 nt, Homo sapiens
gaugccaacuucacagaca

SEQ ID NO: 322991 - RNA, 19 nt, Homo sapiens
gcacagagagaggaagaga

SEQ ID NO: 322992 - RNA, 19 nt, Homo sapiens
ugauugccuuacaaaguua

SEQ ID NO: 322993 - RNA, 19 nt, Homo sapiens
gagcuuucccaccaacuuu

SEQ ID NO: 322994 - RNA, 19 nt, Homo sapiens
gacccaauguaccaguauu

SEQ ID NO: 322995 - RNA, 19 nt, Homo sapiens
gaaaccaaacucuggaaag

SEQ ID NO: 322996 - RNA, 19 nt, Homo sapiens
cuacuuaccucucaauucc

SEQ ID NO: 322997 - RNA, 19 nt, Homo sapiens
cgacugcucgagcugcuua

SEQ ID NO: 322998 - RNA, 19 nt, Homo sapiens
ccucucaucugcaucuuuc

SEQ ID NO: 322999 - RNA, 19 nt, Homo sapiens
ggaagagagcugcuuaaac

SEQ ID NO: 323000 - RNA, 19 nt, Homo sapiens
aaaccaaacucuggaaagg

SEQ ID NO: 323001 - RNA, 19 nt, Homo sapiens
aaacagcgaccauauaaaa

SEQ ID NO: 323002 - RNA, 19 nt, Homo sapiens
guaccuugauugccuuaca

SEQ ID NO: 323003 - RNA, 19 nt, Homo sapiens
uugaaucccuguaggaaau

SEQ ID NO: 323004 - RNA, 19 nt, Homo sapiens
ccagcgacauccaguuugu

SEQ ID NO: 323005 - RNA, 19 nt, Homo sapiens
gaggaagagagcugcuuaa

SEQ ID NO: 323006 - RNA, 19 nt, Homo sapiens
uacaaacagcgaccauaua

SEQ ID NO: 323007 - RNA, 19 nt, Homo sapiens
gggaugagucacuguaaug

SEQ ID NO: 323008 - RNA, 19 nt, Homo sapiens
gauggacuuugaguacuug

SEQ ID NO: 323009 - RNA, 19 nt, Homo sapiens
gugguugucucugaugauu

SEQ ID NO: 323010 - RNA, 19 nt, Homo sapiens
gccgauauuugccauucuu

SEQ ID NO: 323011 - RNA, 19 nt, Homo sapiens
acacacaggcaccagcaua

SEQ ID NO: 323012 - RNA, 19 nt, Homo sapiens
caccaacuuuguaccuuga

SEQ ID NO: 323013 - RNA, 19 nt, Homo sapiens
ggaugagucacuguaauga

SEQ ID NO: 323014 - RNA, 19 nt, Homo sapiens
uaggaaauggugaagcaua

SEQ ID NO: 323015 - RNA, 19 nt, Homo sapiens
caaacagcgaccauauaaa

SEQ ID NO: 323016 - RNA, 19 nt, Homo sapiens
uuacaaacagcgaccauau

SEQ ID NO: 323017 - RNA, 19 nt, Homo sapiens
gaccagcugagacuaagaa

SEQ ID NO: 323018 - RNA, 19 nt, Homo sapiens
gguugucucugaugauuac

SEQ ID NO: 323019 - RNA, 19 nt, Homo sapiens
ccaauguaccaguauuuau

SEQ ID NO: 323020 - RNA, 19 nt, Homo sapiens
caacuuuguaccuugauug

SEQ ID NO: 323021 - RNA, 19 nt, Homo sapiens
gaccccaucuugagccuua

SEQ ID NO: 323022 - RNA, 19 nt, Homo sapiens
gcagcuucuuccacaguga

SEQ ID NO: 323023 - RNA, 19 nt, Homo sapiens
ucaaguacaaggcaaugaa

SEQ ID NO: 323024 - RNA, 19 nt, Homo sapiens
ugacuuccagaccaaauuu

SEQ ID NO: 323025 - RNA, 19 nt, Homo sapiens
gagaaaagccgauauuugc

SEQ ID NO: 323026 - RNA, 19 nt, Homo sapiens
acauacagacacacacaua

SEQ ID NO: 323027 - RNA, 19 nt, Homo sapiens
ccaacuuuguaccuugauu

SEQ ID NO: 323028 - RNA, 19 nt, Homo sapiens
uguaggaaauggugaagca

SEQ ID NO: 323029 - RNA, 19 nt, Homo sapiens
gccugucucuguucuugaa

SEQ ID NO: 323030 - RNA, 19 nt, Homo sapiens
gcauccugaguuuauaaua

SEQ ID NO: 323031 - RNA, 19 nt, Homo sapiens
gagauggacuuugaguacu

SEQ ID NO: 323032 - RNA, 19 nt, Homo sapiens
agaggaagagagcugcuua

SEQ ID NO: 323033 - RNA, 19 nt, Homo sapiens
aggaaucugugcucuacuu

SEQ ID NO: 323034 - RNA, 19 nt, Homo sapiens
gcuagugagcucaucgaaa

SEQ ID NO: 323035 - RNA, 19 nt, Homo sapiens
aaauugggcacucaucuau

SEQ ID NO: 323036 - RNA, 19 nt, Homo sapiens
gagggagccuaaccauguc

SEQ ID NO: 323037 - RNA, 19 nt, Homo sapiens
ucuugagccuuauuuccua

SEQ ID NO: 323038 - RNA, 19 nt, Homo sapiens
gagaugccaacuucacaga

SEQ ID NO: 323039 - RNA, 19 nt, Homo sapiens
ucuggucuauugcuaguga

SEQ ID NO: 323040 - RNA, 19 nt, Homo sapiens
gagaaggugccauggucuu

SEQ ID NO: 323041 - RNA, 19 nt, Homo sapiens
gaacagcuaggugggaaag

SEQ ID NO: 323042 - RNA, 19 nt, Homo sapiens
cauacagacucacauacag

SEQ ID NO: 323043 - RNA, 19 nt, Homo sapiens
uaucagccaggacacuaua

SEQ ID NO: 323044 - RNA, 19 nt, Homo sapiens
agaaggugccauggucuua

SEQ ID NO: 323045 - RNA, 19 nt, Homo sapiens
cccaauguaccaguauuua

SEQ ID NO: 323046 - RNA, 19 nt, Homo sapiens
gggcacucaucuauuccuu

SEQ ID NO: 323047 - RNA, 19 nt, Homo sapiens
ccaggacacuauagaacag

SEQ ID NO: 323048 - RNA, 19 nt, Homo sapiens
gaugauccggcaacuggaa

SEQ ID NO: 323049 - RNA, 19 nt, Homo sapiens
augauuaccugcagagcaa

SEQ ID NO: 323050 - RNA, 19 nt, Homo sapiens
aaacucacacaacaaugaa

SEQ ID NO: 323051 - RNA, 19 nt, Homo sapiens
gugggcacaugggcacaua

SEQ ID NO: 323052 - RNA, 19 nt, Homo sapiens
augagucacuguaaugaug

SEQ ID NO: 323053 - RNA, 19 nt, Homo sapiens
ccuggccucuggcauauuc

SEQ ID NO: 323054 - RNA, 19 nt, Homo sapiens
cuacaucucucuucaggaa

SEQ ID NO: 323055 - RNA, 19 nt, Homo sapiens
gcaggucguuggagacuga

SEQ ID NO: 323056 - RNA, 19 nt, Homo sapiens
gggcugaaguugcucugua

SEQ ID NO: 323057 - RNA, 19 nt, Homo sapiens
gagaugggaagcauagaua

SEQ ID NO: 323058 - RNA, 19 nt, Homo sapiens
gagacuugguugaaacuug

SEQ ID NO: 323059 - RNA, 19 nt, Homo sapiens
guuggagacugaagagaaa

SEQ ID NO: 323060 - RNA, 19 nt, Homo sapiens
ggagugagacugacugcaa

SEQ ID NO: 323061 - RNA, 19 nt, Homo sapiens
uaugagggccuuguaauaa

SEQ ID NO: 323062 - RNA, 19 nt, Homo sapiens
ggauuauaauugcaacaug

SEQ ID NO: 323063 - RNA, 19 nt, Homo sapiens
ccaguuugcgaauuaauaa

SEQ ID NO: 323064 - RNA, 19 nt, Homo sapiens
acucccaguuugcgaauua

SEQ ID NO: 323065 - RNA, 19 nt, Homo sapiens
gagcugagcgucugcauac

SEQ ID NO: 323066 - RNA, 19 nt, Homo sapiens
guacgagucggccaaguug

SEQ ID NO: 323067 - RNA, 19 nt, Homo sapiens
aaacuugguugguccuugu

SEQ ID NO: 323068 - RNA, 19 nt, Homo sapiens
cuaugagggccuuguaaua

SEQ ID NO: 323069 - RNA, 19 nt, Homo sapiens
ugucuucccuuccuacaga

SEQ ID NO: 323070 - RNA, 19 nt, Homo sapiens
cggccaaguugaugaaugu

SEQ ID NO: 323071 - RNA, 19 nt, Homo sapiens
ugagggccuuguaauaaau

SEQ ID NO: 323072 - RNA, 19 nt, Homo sapiens
gaccacacuuugggacuug

SEQ ID NO: 323073 - RNA, 19 nt, Homo sapiens
cgagagacuugguugaaac

SEQ ID NO: 323074 - RNA, 19 nt, Homo sapiens
ugacaucgcccugcaaauc

SEQ ID NO: 323075 - RNA, 19 nt, Homo sapiens
ggagcugagcgucugcaua

SEQ ID NO: 323076 - RNA, 19 nt, Homo sapiens
augagggccuuguaauaaa

SEQ ID NO: 323077 - RNA, 19 nt, Homo sapiens
agaaagagagagaggagaa

SEQ ID NO: 323078 - RNA, 19 nt, Homo sapiens
gcaacaugacgcuggaaga

SEQ ID NO: 323079 - RNA, 19 nt, Homo sapiens
ccacugucuucccuuccua

SEQ ID NO: 323080 - RNA, 19 nt, Homo sapiens
gagcgagaugggaagcaua

SEQ ID NO: 323081 - RNA, 19 nt, Homo sapiens
cgacaagaccacacuuugg

SEQ ID NO: 323082 - RNA, 19 nt, Homo sapiens
ggccagcuacugcgaagaa

SEQ ID NO: 323083 - RNA, 19 nt, Homo sapiens
ugacaacgacaucaacauc

SEQ ID NO: 323084 - RNA, 19 nt, Homo sapiens
acgagagacuugguugaaa

SEQ ID NO: 323085 - RNA, 19 nt, Homo sapiens
gaugggaagcauagauauc

SEQ ID NO: 323086 - RNA, 19 nt, Homo sapiens
caacaugacgcuggaagag

SEQ ID NO: 323087 - RNA, 19 nt, Homo sapiens
gcgaauuaauaagagacaa

SEQ ID NO: 323088 - RNA, 19 nt, Homo sapiens
guuauucgaaccacugaga

SEQ ID NO: 323089 - RNA, 19 nt, Homo sapiens
gaaagagagagaggagaag

SEQ ID NO: 323090 - RNA, 19 nt, Homo sapiens
ugguggagguggccagcua

SEQ ID NO: 323091 - RNA, 19 nt, Homo sapiens
gcucggauuuugcaauuuc

SEQ ID NO: 323092 - RNA, 19 nt, Homo sapiens
guuacuugcacuuguuauu

SEQ ID NO: 323093 - RNA, 19 nt, Homo sapiens
cccaguuugcgaauuaaua

SEQ ID NO: 323094 - RNA, 19 nt, Homo sapiens
gagggccuuguaauaaauu

SEQ ID NO: 323095 - RNA, 19 nt, Homo sapiens
cuacuaugagggccuugua

SEQ ID NO: 323096 - RNA, 19 nt, Homo sapiens
cacggaggguccagacugu

SEQ ID NO: 323097 - RNA, 19 nt, Homo sapiens
cgagaugggaagcauagau

SEQ ID NO: 323098 - RNA, 19 nt, Homo sapiens
agaccacacuuugggacuu

SEQ ID NO: 323099 - RNA, 19 nt, Homo sapiens
gcauacgagagacuugguu

SEQ ID NO: 323100 - RNA, 19 nt, Homo sapiens
gcacuuguuauucgaacca

SEQ ID NO: 323101 - RNA, 19 nt, Homo sapiens
ggcugaaguugcucuguac

SEQ ID NO: 323102 - RNA, 19 nt, Homo sapiens
gcugagcgucugcauacga

SEQ ID NO: 323103 - RNA, 19 nt, Homo sapiens
gccagcuacugcgaagaaa

SEQ ID NO: 323104 - RNA, 19 nt, Homo sapiens
uuuguuacuugcacuuguu

SEQ ID NO: 323105 - RNA, 19 nt, Homo sapiens
ucgacaagaccacacuuug

SEQ ID NO: 323106 - RNA, 19 nt, Homo sapiens
cguuggagacugaagagaa

SEQ ID NO: 323107 - RNA, 19 nt, Homo sapiens
uuacuugcacuuguuauuc

SEQ ID NO: 323108 - RNA, 19 nt, Homo sapiens
cugaagagaaagagagaga

SEQ ID NO: 323109 - RNA, 19 nt, Homo sapiens
ggucguuggagacugaaga

SEQ ID NO: 323110 - RNA, 19 nt, Homo sapiens
gcugugacaacgacaucaa

SEQ ID NO: 323111 - RNA, 19 nt, Homo sapiens
gagaaucaguuaaauggaa

SEQ ID NO: 323112 - RNA, 19 nt, Homo sapiens
gagagcagguggagaacua

SEQ ID NO: 323113 - RNA, 19 nt, Homo sapiens
gaggguagcuuguucgaau

SEQ ID NO: 323114 - RNA, 19 nt, Homo sapiens
aagauuaccuugccacuuu

SEQ ID NO: 323115 - RNA, 19 nt, Homo sapiens
caagacaacauguacauaa

SEQ ID NO: 323116 - RNA, 19 nt, Homo sapiens
gacaacauguacauaaaga

SEQ ID NO: 323117 - RNA, 19 nt, Homo sapiens
guuccaggcuuaucuauca

SEQ ID NO: 323118 - RNA, 19 nt, Homo sapiens
caugugcuaugaacuaauu

SEQ ID NO: 323119 - RNA, 19 nt, Homo sapiens
caaaaugucucugguguuu

SEQ ID NO: 323120 - RNA, 19 nt, Homo sapiens
gaacuaauuuucuggucua

SEQ ID NO: 323121 - RNA, 19 nt, Homo sapiens
gcuuaucuaucaugugcua

SEQ ID NO: 323122 - RNA, 19 nt, Homo sapiens
gcuucuaguuccaggcuua

SEQ ID NO: 323123 - RNA, 19 nt, Homo sapiens
ugagagagcagguggagaa

SEQ ID NO: 323124 - RNA, 19 nt, Homo sapiens
ggaucuggcuucucucucu

SEQ ID NO: 323125 - RNA, 19 nt, Homo sapiens
gcuggucacugccucaugu

SEQ ID NO: 323126 - RNA, 19 nt, Homo sapiens
aaaugucucugguguuuag

SEQ ID NO: 323127 - RNA, 19 nt, Homo sapiens
guggaucauuucaagauau

SEQ ID NO: 323128 - RNA, 19 nt, Homo sapiens
caaccaggcuuucgaaacc

SEQ ID NO: 323129 - RNA, 19 nt, Homo sapiens
ggaggcgccugaagaaggu

SEQ ID NO: 323130 - RNA, 19 nt, Homo sapiens
ggaaugccauccgcuacau

SEQ ID NO: 323131 - RNA, 19 nt, Homo sapiens
aauaguacuuuguggauca

SEQ ID NO: 323132 - RNA, 19 nt, Homo sapiens
gauugaggguagcuuguuc

SEQ ID NO: 323133 - RNA, 19 nt, Homo sapiens
caaaccaagacaacaugua

SEQ ID NO: 323134 - RNA, 19 nt, Homo sapiens
gaucaccuccucagagcaa

SEQ ID NO: 323135 - RNA, 19 nt, Homo sapiens
aaauguauaugccacagau

SEQ ID NO: 323136 - RNA, 19 nt, Homo sapiens
gcaaagccugcaagaggaa

SEQ ID NO: 323137 - RNA, 19 nt, Homo sapiens
gcuucucucucuccaguug

SEQ ID NO: 323138 - RNA, 19 nt, Homo sapiens
cuacgacggcuccugcaua

SEQ ID NO: 323139 - RNA, 19 nt, Homo sapiens
agauuaccuugccacuuua

SEQ ID NO: 323140 - RNA, 19 nt, Homo sapiens
guucgaaugcuuaacuuau

SEQ ID NO: 323141 - RNA, 19 nt, Homo sapiens
gcagguggagaacuacuau

SEQ ID NO: 323142 - RNA, 19 nt, Homo sapiens
uguggaucauuucaagaua

SEQ ID NO: 323143 - RNA, 19 nt, Homo sapiens
uuaccuugccacuuuauaa

SEQ ID NO: 323144 - RNA, 19 nt, Homo sapiens
ccaagacaacauguacaua

SEQ ID NO: 323145 - RNA, 19 nt, Homo sapiens
caggagggccuaauacaca

SEQ ID NO: 323146 - RNA, 19 nt, Homo sapiens
ucgagagccugcaggaguu

SEQ ID NO: 323147 - RNA, 19 nt, Homo sapiens
uagcuuguucgaaugcuua

SEQ ID NO: 323148 - RNA, 19 nt, Homo sapiens
ccuugccacuuuauaagaa

SEQ ID NO: 323149 - RNA, 19 nt, Homo sapiens
gguguuuagagcuuuauuu

SEQ ID NO: 323150 - RNA, 19 nt, Homo sapiens
uaauacacaggacgaagaa

SEQ ID NO: 323151 - RNA, 19 nt, Homo sapiens
cuaauacacaggacgaaga

SEQ ID NO: 323152 - RNA, 19 nt, Homo sapiens
ggucaaccaggcuuucgaa

SEQ ID NO: 323153 - RNA, 19 nt, Homo sapiens
gcggaaggcagccacuaug

SEQ ID NO: 323154 - RNA, 19 nt, Homo sapiens
gcuaugaacuaauuuucug

SEQ ID NO: 323155 - RNA, 19 nt, Homo sapiens
ugcaggaguugcugagaga

SEQ ID NO: 323156 - RNA, 19 nt, Homo sapiens
gaaggucaaccaggcuuuc

SEQ ID NO: 323157 - RNA, 19 nt, Homo sapiens
ucugguguuuagagcuuua

SEQ ID NO: 323158 - RNA, 19 nt, Homo sapiens
aaaccaagacaacauguac

SEQ ID NO: 323159 - RNA, 19 nt, Homo sapiens
gauggcaugcccgaaugua

SEQ ID NO: 323160 - RNA, 19 nt, Homo sapiens
guacuuuguggaucauuuc

SEQ ID NO: 323161 - RNA, 19 nt, Homo sapiens
guagcuuguucgaaugcuu

SEQ ID NO: 323162 - RNA, 19 nt, Homo sapiens
ccaggcuuaucuaucaugu

SEQ ID NO: 323163 - RNA, 19 nt, Homo sapiens
aguacuuuguggaucauuu

SEQ ID NO: 323164 - RNA, 19 nt, Homo sapiens
ccaguugccagcaccgauu

SEQ ID NO: 323165 - RNA, 19 nt, Homo sapiens
uguauaugccacagauaaa

SEQ ID NO: 323166 - RNA, 19 nt, Homo sapiens
gauugcuuauccaacauag

SEQ ID NO: 323167 - RNA, 19 nt, Homo sapiens
uacgacggcuccugcauac

SEQ ID NO: 323168 - RNA, 19 nt, Homo sapiens
uuucuggucuauaugacuu

SEQ ID NO: 323169 - RNA, 19 nt, Homo sapiens
caaauguauaugccacaga

SEQ ID NO: 323170 - RNA, 19 nt, Homo sapiens
cugauggcaugcccgaaug

SEQ ID NO: 323171 - RNA, 19 nt, Homo sapiens
gcaggauggacgugaugga

SEQ ID NO: 323172 - RNA, 19 nt, Homo sapiens
agacaacauguacauaaag

SEQ ID NO: 323173 - RNA, 19 nt, Homo sapiens
ucagcaggauggacgugau

SEQ ID NO: 323174 - RNA, 19 nt, Homo sapiens
ggagacacauucacaaaga

SEQ ID NO: 323175 - RNA, 19 nt, Homo sapiens
gaaaggaggaggcuaaaga

SEQ ID NO: 323176 - RNA, 19 nt, Homo sapiens
uaacugagccugcgcuuga

SEQ ID NO: 323177 - RNA, 19 nt, Homo sapiens
gaaggaggagcaaguauug

SEQ ID NO: 323178 - RNA, 19 nt, Homo sapiens
gugggaaaguugcauuuaa

SEQ ID NO: 323179 - RNA, 19 nt, Homo sapiens
ggaaggaggagcaaguauu

SEQ ID NO: 323180 - RNA, 19 nt, Homo sapiens
uagauuaggucacauuaca

SEQ ID NO: 323181 - RNA, 19 nt, Homo sapiens
cgaggauccugguauugua

SEQ ID NO: 323182 - RNA, 19 nt, Homo sapiens
gauaacggcuaaggaagga

SEQ ID NO: 323183 - RNA, 19 nt, Homo sapiens
gagacacauucacaaagaa

SEQ ID NO: 323184 - RNA, 19 nt, Homo sapiens
cuacagacccaaacaagaa

SEQ ID NO: 323185 - RNA, 19 nt, Homo sapiens
ggaaggagacacauucaca

SEQ ID NO: 323186 - RNA, 19 nt, Homo sapiens
gaaggagacacauucacaa

SEQ ID NO: 323187 - RNA, 19 nt, Homo sapiens
gcuuaggucuagccucauu

SEQ ID NO: 323188 - RNA, 19 nt, Homo sapiens
gcgaguggcuuaggucuag

SEQ ID NO: 323189 - RNA, 19 nt, Homo sapiens
gauuaggucacauuacauu

SEQ ID NO: 323190 - RNA, 19 nt, Homo sapiens
gcuccuauuucuucuacuu

SEQ ID NO: 323191 - RNA, 19 nt, Homo sapiens
ggaggaggcuaaagaaaau

SEQ ID NO: 323192 - RNA, 19 nt, Homo sapiens
gugcgaggauccugguauu

SEQ ID NO: 323193 - RNA, 19 nt, Homo sapiens
aggaagugguggagaagua

SEQ ID NO: 323194 - RNA, 19 nt, Homo sapiens
ggccaaguguuuccgauca

SEQ ID NO: 323195 - RNA, 19 nt, Homo sapiens
gcacugaagcggcgaacug

SEQ ID NO: 323196 - RNA, 19 nt, Homo sapiens
ugggaaaguugcauuuaau

SEQ ID NO: 323197 - RNA, 19 nt, Homo sapiens
ggagcgccaucagcuauau

SEQ ID NO: 323198 - RNA, 19 nt, Homo sapiens
ggaagugguggagaaguaa

SEQ ID NO: 323199 - RNA, 19 nt, Homo sapiens
ggaggagcaaguauugauu

SEQ ID NO: 323200 - RNA, 19 nt, Homo sapiens
ugugcacgcucaaaugaaa

SEQ ID NO: 323201 - RNA, 19 nt, Homo sapiens
gaggauccugguauuguaa

SEQ ID NO: 323202 - RNA, 19 nt, Homo sapiens
ccaaguguuuccgaucauu

SEQ ID NO: 323203 - RNA, 19 nt, Homo sapiens
gcaagaccugcaagagaaa

SEQ ID NO: 323204 - RNA, 19 nt, Homo sapiens
uggaggaagugguggagaa

SEQ ID NO: 323205 - RNA, 19 nt, Homo sapiens
caguucagaucgagucaga

SEQ ID NO: 323206 - RNA, 19 nt, Homo sapiens
gaggagcaaguauugauuc

SEQ ID NO: 323207 - RNA, 19 nt, Homo sapiens
cgacagcagcggagaggaa

SEQ ID NO: 323208 - RNA, 19 nt, Homo sapiens
ggucuagccucauuuuguu

SEQ ID NO: 323209 - RNA, 19 nt, Homo sapiens
gcuacagacccaaacaaga

SEQ ID NO: 323210 - RNA, 19 nt, Homo sapiens
ccaaggaggagaacaugau

SEQ ID NO: 323211 - RNA, 19 nt, Homo sapiens
gaacccagaccgaaaaguu

SEQ ID NO: 323212 - RNA, 19 nt, Homo sapiens
aaaggaggaggcuaaagaa

SEQ ID NO: 323213 - RNA, 19 nt, Homo sapiens
gcgaggauccugguauugu

SEQ ID NO: 323214 - RNA, 19 nt, Homo sapiens
gacccuuccuggccuaauc

SEQ ID NO: 323215 - RNA, 19 nt, Homo sapiens
cgugauaacggcuaaggaa

SEQ ID NO: 323216 - RNA, 19 nt, Homo sapiens
aggagaacaugaugaugga

SEQ ID NO: 323217 - RNA, 19 nt, Homo sapiens
guugugcacgcucaaauga

SEQ ID NO: 323218 - RNA, 19 nt, Homo sapiens
gcggagcgccaucagcuau

SEQ ID NO: 323219 - RNA, 19 nt, Homo sapiens
uuccuggccuaauccuuua

SEQ ID NO: 323220 - RNA, 19 nt, Homo sapiens
gaaaauugcgaaaucuguu

SEQ ID NO: 323221 - RNA, 19 nt, Homo sapiens
ugaaagggaaggagacaca

SEQ ID NO: 323222 - RNA, 19 nt, Homo sapiens
uaaggaaggaggagcaagu

SEQ ID NO: 323223 - RNA, 19 nt, Homo sapiens
agacacauucacaaagaaa

SEQ ID NO: 323224 - RNA, 19 nt, Homo sapiens
ggagugaugguaccuuguc

SEQ ID NO: 323225 - RNA, 19 nt, Homo sapiens
caaggaggagaacaugaug

SEQ ID NO: 323226 - RNA, 19 nt, Homo sapiens
aaggagacacauucacaaa

SEQ ID NO: 323227 - RNA, 19 nt, Homo sapiens
uugaaacuggcuccuauuu

SEQ ID NO: 323228 - RNA, 19 nt, Homo sapiens
gcgaaaggaggaggcuaaa

SEQ ID NO: 323229 - RNA, 19 nt, Homo sapiens
aaagggaaggagacacauu

SEQ ID NO: 323230 - RNA, 19 nt, Homo sapiens
cuuccuggccuaauccuuu

SEQ ID NO: 323231 - RNA, 19 nt, Homo sapiens
gaacugcgaguggcuuagg

SEQ ID NO: 323232 - RNA, 19 nt, Homo sapiens
uuaggaacccagaccgaaa

SEQ ID NO: 323233 - RNA, 19 nt, Homo sapiens
gaacaugaugauggaccuu

SEQ ID NO: 323234 - RNA, 19 nt, Homo sapiens
ggucacauuacauuaacau

SEQ ID NO: 323235 - RNA, 19 nt, Homo sapiens
uaggucacauuacauuaac

SEQ ID NO: 323236 - RNA, 19 nt, Homo sapiens
agccugcgcuugagaccuu

SEQ ID NO: 323237 - RNA, 19 nt, Homo sapiens
gaaagggaaggagacacau

SEQ ID NO: 323238 - RNA, 19 nt, Homo sapiens
gccaaguguuuccgaucau

SEQ ID NO: 323239 - RNA, 19 nt, Homo sapiens
cgcgaaaggaggaggcuaa

SEQ ID NO: 323240 - RNA, 19 nt, Homo sapiens
aaacuggcuccuauuucuu

SEQ ID NO: 323241 - RNA, 19 nt, Homo sapiens
ccuuucggcuuugggcuuu

SEQ ID NO: 323242 - RNA, 19 nt, Homo sapiens
uugaguccaucacccaguu

SEQ ID NO: 323243 - RNA, 19 nt, Homo sapiens
ggaggagaacaugaugaug

SEQ ID NO: 323244 - RNA, 19 nt, Homo sapiens
ugucugaucugggcuugca

SEQ ID NO: 323245 - RNA, 19 nt, Homo sapiens
gcacagaacuauuuaagau

SEQ ID NO: 323246 - RNA, 19 nt, Homo sapiens
gaaagaguguccaucuaua

SEQ ID NO: 323247 - RNA, 19 nt, Homo sapiens
ggaaagagcuggaagaaaa

SEQ ID NO: 323248 - RNA, 19 nt, Homo sapiens
gaaggacaauucaucgaua

SEQ ID NO: 323249 - RNA, 19 nt, Homo sapiens
gcagggagguucacacaaa

SEQ ID NO: 323250 - RNA, 19 nt, Homo sapiens
gaaaugagcggucugcaaa

SEQ ID NO: 323251 - RNA, 19 nt, Homo sapiens
ccaaagcugucuacgauaa

SEQ ID NO: 323252 - RNA, 19 nt, Homo sapiens
ggaaaggugugaccagcua

SEQ ID NO: 323253 - RNA, 19 nt, Homo sapiens
gcugaaaggugaccaaaga

SEQ ID NO: 323254 - RNA, 19 nt, Homo sapiens
ugaauaagcugaugaccaa

SEQ ID NO: 323255 - RNA, 19 nt, Homo sapiens
gaaggaagaauuugagaaa

SEQ ID NO: 323256 - RNA, 19 nt, Homo sapiens
gaagagaaaccacauuaga

SEQ ID NO: 323257 - RNA, 19 nt, Homo sapiens
gcuuugagaucuuugauuu

SEQ ID NO: 323258 - RNA, 19 nt, Homo sapiens
gaagccagaucuaauugaa

SEQ ID NO: 323259 - RNA, 19 nt, Homo sapiens
gagaaucagucuaucuuga

SEQ ID NO: 323260 - RNA, 19 nt, Homo sapiens
gcacugaaguugcugacaa

SEQ ID NO: 323261 - RNA, 19 nt, Homo sapiens
ggaagaagcagauccagaa

SEQ ID NO: 323262 - RNA, 19 nt, Homo sapiens
agaagaagcuggagacaga

SEQ ID NO: 323263 - RNA, 19 nt, Homo sapiens
gaagaucaacugagugaaa

SEQ ID NO: 323264 - RNA, 19 nt, Homo sapiens
caacaugaaggaagaauuu

SEQ ID NO: 323265 - RNA, 19 nt, Homo sapiens
gaaacuggcuucugcugau

SEQ ID NO: 323266 - RNA, 19 nt, Homo sapiens
aaacagaagugugaagaaa

SEQ ID NO: 323267 - RNA, 19 nt, Homo sapiens
gaagaagcaugcagauagu

SEQ ID NO: 323268 - RNA, 19 nt, Homo sapiens
ggaaagggcugacauugcu

SEQ ID NO: 323269 - RNA, 19 nt, Homo sapiens
aagcaaaggugaaauccua

SEQ ID NO: 323270 - RNA, 19 nt, Homo sapiens
gaggaagaccgcaagaaua

SEQ ID NO: 323271 - RNA, 19 nt, Homo sapiens
ugaagaaacucaugcugaa

SEQ ID NO: 323272 - RNA, 19 nt, Homo sapiens
ggaagaagcaugcagauag

SEQ ID NO: 323273 - RNA, 19 nt, Homo sapiens
gaggaaagcgcauccauga

SEQ ID NO: 323274 - RNA, 19 nt, Homo sapiens
aaagcaagauugaagauga

SEQ ID NO: 323275 - RNA, 19 nt, Homo sapiens
gaaagacauugaugaccuu

SEQ ID NO: 323276 - RNA, 19 nt, Homo sapiens
caugaacccucccaaauau

SEQ ID NO: 323277 - RNA, 19 nt, Homo sapiens
ccauuaggcucaagaagaa

SEQ ID NO: 323278 - RNA, 19 nt, Homo sapiens
gaaauugaccagaugaaga

SEQ ID NO: 323279 - RNA, 19 nt, Homo sapiens
ggccaaagcugucuacgau

SEQ ID NO: 323280 - RNA, 19 nt, Homo sapiens
gaagcaaguugagcaagaa

SEQ ID NO: 323281 - RNA, 19 nt, Homo sapiens
ggacauugcuggcuuugag

SEQ ID NO: 323282 - RNA, 19 nt, Homo sapiens
gcugaaagaagcuaucaua

SEQ ID NO: 323283 - RNA, 19 nt, Homo sapiens
gaucaacugagugaaauua

SEQ ID NO: 323284 - RNA, 19 nt, Homo sapiens
gauacaagguguuaaaugc

SEQ ID NO: 323285 - RNA, 19 nt, Homo sapiens
aaagaaaggugguaagaag

SEQ ID NO: 323286 - RNA, 19 nt, Homo sapiens
gaucaugucuaacaagaag

SEQ ID NO: 323287 - RNA, 19 nt, Homo sapiens
gaccaaagcuaaaaucaaa

SEQ ID NO: 323288 - RNA, 19 nt, Homo sapiens
caagaagccagaucuaauu

SEQ ID NO: 323289 - RNA, 19 nt, Homo sapiens
ggaagacugugaacaccaa

SEQ ID NO: 323290 - RNA, 19 nt, Homo sapiens
agaggaaacuggaggauga

SEQ ID NO: 323291 - RNA, 19 nt, Homo sapiens
cuggagaagucuagaguua

SEQ ID NO: 323292 - RNA, 19 nt, Homo sapiens
gaagaagaaggaagaaguu

SEQ ID NO: 323293 - RNA, 19 nt, Homo sapiens
gcauccagcuugaguugaa

SEQ ID NO: 323294 - RNA, 19 nt, Homo sapiens
cugcugauauugaaacaua

SEQ ID NO: 323295 - RNA, 19 nt, Homo sapiens
ccaugaacccucccaaaua

SEQ ID NO: 323296 - RNA, 19 nt, Homo sapiens
ggaacucacuuaccaaacu

SEQ ID NO: 323297 - RNA, 19 nt, Homo sapiens
ugaggaaucuuuagaccaa

SEQ ID NO: 323298 - RNA, 19 nt, Homo sapiens
gcaaacaagccuuuacuca

SEQ ID NO: 323299 - RNA, 19 nt, Homo sapiens
ugaaggaucuuuggaacaa

SEQ ID NO: 323300 - RNA, 19 nt, Homo sapiens
ccaccaacccauacgauua

SEQ ID NO: 323301 - RNA, 19 nt, Homo sapiens
ccaagaaggccaucacuga

SEQ ID NO: 323302 - RNA, 19 nt, Homo sapiens
ucagggagaauuugaauaa

SEQ ID NO: 323303 - RNA, 19 nt, Homo sapiens
gaaagaaaggugguaagaa

SEQ ID NO: 323304 - RNA, 19 nt, Homo sapiens
agaacaagcuguaugaaca

SEQ ID NO: 323305 - RNA, 19 nt, Homo sapiens
gcaucaacuucaccaauga

SEQ ID NO: 323306 - RNA, 19 nt, Homo sapiens
cagcauugaugaccaagaa

SEQ ID NO: 323307 - RNA, 19 nt, Homo sapiens
gaagaccgcaagaauauuc

SEQ ID NO: 323308 - RNA, 19 nt, Homo sapiens
agauugagaugaacaagaa

SEQ ID NO: 323309 - RNA, 19 nt, Homo sapiens
gaagcuguauuucaagauc

SEQ ID NO: 323310 - RNA, 19 nt, Homo sapiens
gaaaggugaccaaagaaau

SEQ ID NO: 323311 - RNA, 19 nt, Homo sapiens
ggugaaauccuacaagaga

SEQ ID NO: 323312 - RNA, 19 nt, Homo sapiens
aaacaagccuuuacucaac

SEQ ID NO: 323313 - RNA, 19 nt, Homo sapiens
gaaaaggacacacuaguuu

SEQ ID NO: 323314 - RNA, 19 nt, Homo sapiens
caacuucaccaaugagaaa

SEQ ID NO: 323315 - RNA, 19 nt, Homo sapiens
ugaaggaacucacuuacca

SEQ ID NO: 323316 - RNA, 19 nt, Homo sapiens
caaacaagccuuuacucaa

SEQ ID NO: 323317 - RNA, 19 nt, Homo sapiens
ggaaagaaaggugguaaga

SEQ ID NO: 323318 - RNA, 19 nt, Homo sapiens
gcaaacagaaucaggugaa

SEQ ID NO: 323319 - RNA, 19 nt, Homo sapiens
gaaacuggaggaugaaugu

SEQ ID NO: 323320 - RNA, 19 nt, Homo sapiens
gaacaagcuguaugaacaa

SEQ ID NO: 323321 - RNA, 19 nt, Homo sapiens
gaaauucugggcuuuacuu

SEQ ID NO: 323322 - RNA, 19 nt, Homo sapiens
caagagacaagcugaagaa

SEQ ID NO: 323323 - RNA, 19 nt, Homo sapiens
gaacucacuuaccaaacug

SEQ ID NO: 323324 - RNA, 19 nt, Homo sapiens
gauaagauccuggcagaau

SEQ ID NO: 323325 - RNA, 19 nt, Homo sapiens
ugacaacuccucucgcuuu

SEQ ID NO: 323326 - RNA, 19 nt, Homo sapiens
ccaaagaaaugcacaaaau

SEQ ID NO: 323327 - RNA, 19 nt, Homo sapiens
aagaagaacuuggaacaga

SEQ ID NO: 323328 - RNA, 19 nt, Homo sapiens
cugaggagcugaagaagga

SEQ ID NO: 323329 - RNA, 19 nt, Homo sapiens
aggcaucucuugaacauga

SEQ ID NO: 323330 - RNA, 19 nt, Homo sapiens
gaaacagaagugugaagaa

SEQ ID NO: 323331 - RNA, 19 nt, Homo sapiens
caaaugugcuucccuugag

SEQ ID NO: 323332 - RNA, 19 nt, Homo sapiens
gaucaaugcugagcugaca

SEQ ID NO: 323333 - RNA, 19 nt, Homo sapiens
acagacaccuccuucaaga

SEQ ID NO: 323334 - RNA, 19 nt, Homo sapiens
gaauugaagcccagaacaa

SEQ ID NO: 323335 - RNA, 19 nt, Homo sapiens
ggagaagucuagaguuacu

SEQ ID NO: 323336 - RNA, 19 nt, Homo sapiens
gacaaugccuaucaguuca

SEQ ID NO: 323337 - RNA, 19 nt, Homo sapiens
ugagugaaauuaagaccaa

SEQ ID NO: 323338 - RNA, 19 nt, Homo sapiens
ccggauggaucuagaaaga

SEQ ID NO: 323339 - RNA, 19 nt, Homo sapiens
aagaagagcuggcuaagac

SEQ ID NO: 323340 - RNA, 19 nt, Homo sapiens
ccaaagaagagcuggcuaa

SEQ ID NO: 323341 - RNA, 19 nt, Homo sapiens
ccaagcgugucauccagua

SEQ ID NO: 323342 - RNA, 19 nt, Homo sapiens
caacugagugaaauuaaga

SEQ ID NO: 323343 - RNA, 19 nt, Homo sapiens
agaaagaguuugaaaugag

SEQ ID NO: 323344 - RNA, 19 nt, Homo sapiens
gacucuggcucuccucuuu

SEQ ID NO: 323345 - RNA, 19 nt, Homo sapiens
gcacugagcuguucaagau

SEQ ID NO: 323346 - RNA, 19 nt, Homo sapiens
aaacauaucugcuagagaa

SEQ ID NO: 323347 - RNA, 19 nt, Homo sapiens
ggaagaagauagaaagaau

SEQ ID NO: 323348 - RNA, 19 nt, Homo sapiens
caaaggaacuucgauaaga

SEQ ID NO: 323349 - RNA, 19 nt, Homo sapiens
gcacagaaguugcugacaa

SEQ ID NO: 323350 - RNA, 19 nt, Homo sapiens
ggaaaggugugaccagcua

SEQ ID NO: 323351 - RNA, 19 nt, Homo sapiens
gaacugauggccacagaua

SEQ ID NO: 323352 - RNA, 19 nt, Homo sapiens
ugagugaacugaaaucaaa

SEQ ID NO: 323353 - RNA, 19 nt, Homo sapiens
gaagagaaaccacauuaga

SEQ ID NO: 323354 - RNA, 19 nt, Homo sapiens
caagaaaggugguaagaag

SEQ ID NO: 323355 - RNA, 19 nt, Homo sapiens
gagcagcugugcaucaauu

SEQ ID NO: 323356 - RNA, 19 nt, Homo sapiens
ccacgaacccauaugauua

SEQ ID NO: 323357 - RNA, 19 nt, Homo sapiens
ggaagaagcagauccagaa

SEQ ID NO: 323358 - RNA, 19 nt, Homo sapiens
agaagaagcuggagacaga

SEQ ID NO: 323359 - RNA, 19 nt, Homo sapiens
caaaugugcuucccucgaa

SEQ ID NO: 323360 - RNA, 19 nt, Homo sapiens
gaagaagaaggaagaaauu

SEQ ID NO: 323361 - RNA, 19 nt, Homo sapiens
ggaaggaacuggaagaaaa

SEQ ID NO: 323362 - RNA, 19 nt, Homo sapiens
cagauuacaucgaauaaga

SEQ ID NO: 323363 - RNA, 19 nt, Homo sapiens
gcaaaggaaauaaagcaua

SEQ ID NO: 323364 - RNA, 19 nt, Homo sapiens
gaagaagcaugcagauagu

SEQ ID NO: 323365 - RNA, 19 nt, Homo sapiens
caaaggaaauaaagcauag

SEQ ID NO: 323366 - RNA, 19 nt, Homo sapiens
uagauaaacuucaggcaaa

SEQ ID NO: 323367 - RNA, 19 nt, Homo sapiens
ggaagaagcaugcagauag

SEQ ID NO: 323368 - RNA, 19 nt, Homo sapiens
aaagcaagauugaagauga

SEQ ID NO: 323369 - RNA, 19 nt, Homo sapiens
gaaagacauugaugaccuu

SEQ ID NO: 323370 - RNA, 19 nt, Homo sapiens
gcaagaaggccucugagaa

SEQ ID NO: 323371 - RNA, 19 nt, Homo sapiens
caugaacccucccaaauau

SEQ ID NO: 323372 - RNA, 19 nt, Homo sapiens
caacaccaaucuagcuaaa

SEQ ID NO: 323373 - RNA, 19 nt, Homo sapiens
ccauuaggcucaagaagaa

SEQ ID NO: 323374 - RNA, 19 nt, Homo sapiens
gaaaucagcaaucugcaaa

SEQ ID NO: 323375 - RNA, 19 nt, Homo sapiens
ucauuucccucuguaauua

SEQ ID NO: 323376 - RNA, 19 nt, Homo sapiens
gcugagagaaguuaucaua

SEQ ID NO: 323377 - RNA, 19 nt, Homo sapiens
ugaacaagcugaugaccaa

SEQ ID NO: 323378 - RNA, 19 nt, Homo sapiens
acaccaaucuagcuaaauu

SEQ ID NO: 323379 - RNA, 19 nt, Homo sapiens
gaaauugaccagcugaaga

SEQ ID NO: 323380 - RNA, 19 nt, Homo sapiens
gaaacaaguggaacaagaa

SEQ ID NO: 323381 - RNA, 19 nt, Homo sapiens
aaacagaaaugugaggaaa

SEQ ID NO: 323382 - RNA, 19 nt, Homo sapiens
gaccaaagcuaaaaucaaa

SEQ ID NO: 323383 - RNA, 19 nt, Homo sapiens
gaaaaggucuccauuuaca

SEQ ID NO: 323384 - RNA, 19 nt, Homo sapiens
ggaagacugugaacaccaa

SEQ ID NO: 323385 - RNA, 19 nt, Homo sapiens
agaggaaacuggaggauga

SEQ ID NO: 323386 - RNA, 19 nt, Homo sapiens
gaaggcauccgcaucugua

SEQ ID NO: 323387 - RNA, 19 nt, Homo sapiens
gcaucaauuucaccaauga

SEQ ID NO: 323388 - RNA, 19 nt, Homo sapiens
cagcaucgaugaucaggaa

SEQ ID NO: 323389 - RNA, 19 nt, Homo sapiens
acaaguggcugccugugua

SEQ ID NO: 323390 - RNA, 19 nt, Homo sapiens
gcauccagcuugaguugaa

SEQ ID NO: 323391 - RNA, 19 nt, Homo sapiens
cugcugauauugaaacaua

SEQ ID NO: 323392 - RNA, 19 nt, Homo sapiens
ccaugaacccucccaaaua

SEQ ID NO: 323393 - RNA, 19 nt, Homo sapiens
gagcgacucugacagugaa

SEQ ID NO: 323394 - RNA, 19 nt, Homo sapiens
ccaaagccgucuacgagaa

SEQ ID NO: 323395 - RNA, 19 nt, Homo sapiens
aagaaaaggucuccauuua

SEQ ID NO: 323396 - RNA, 19 nt, Homo sapiens
ccaagaaggccaucacuga

SEQ ID NO: 323397 - RNA, 19 nt, Homo sapiens
gcagaaggagggaaacgua

SEQ ID NO: 323398 - RNA, 19 nt, Homo sapiens
aaggagagguugagaguga

SEQ ID NO: 323399 - RNA, 19 nt, Homo sapiens
agauugagaugaacaagaa

SEQ ID NO: 323400 - RNA, 19 nt, Homo sapiens
ggaaacgcaugcugagcuu

SEQ ID NO: 323401 - RNA, 19 nt, Homo sapiens
aauaucagauccuucauga

SEQ ID NO: 323402 - RNA, 19 nt, Homo sapiens
gaaaccagaacuuauugaa

SEQ ID NO: 323403 - RNA, 19 nt, Homo sapiens
ugaaggaacucacuuacca

SEQ ID NO: 323404 - RNA, 19 nt, Homo sapiens
agaaacaaguggaacaaga

SEQ ID NO: 323405 - RNA, 19 nt, Homo sapiens
gauaaagaaugccuaugag

SEQ ID NO: 323406 - RNA, 19 nt, Homo sapiens
ugacaacgccuaucaguuc

SEQ ID NO: 323407 - RNA, 19 nt, Homo sapiens
agucauaagugaagaguga

SEQ ID NO: 323408 - RNA, 19 nt, Homo sapiens
caagggaaaccuagagaaa

SEQ ID NO: 323409 - RNA, 19 nt, Homo sapiens
gcauucaauugcagaagaa

SEQ ID NO: 323410 - RNA, 19 nt, Homo sapiens
gaaacuggaggaugaaugu

SEQ ID NO: 323411 - RNA, 19 nt, Homo sapiens
aaacuggcaucugcugaua

SEQ ID NO: 323412 - RNA, 19 nt, Homo sapiens
gauaagauccuggcagaau

SEQ ID NO: 323413 - RNA, 19 nt, Homo sapiens
gaauuaaagaggcaacuug

SEQ ID NO: 323414 - RNA, 19 nt, Homo sapiens
ccaacugagugaacugaaa

SEQ ID NO: 323415 - RNA, 19 nt, Homo sapiens
ugacaacuccucucgcuuu

SEQ ID NO: 323416 - RNA, 19 nt, Homo sapiens
gccgggagguucacacaaa

SEQ ID NO: 323417 - RNA, 19 nt, Homo sapiens
cugaggagcugaagaagga

SEQ ID NO: 323418 - RNA, 19 nt, Homo sapiens
aggcaucucuugaacauga

SEQ ID NO: 323419 - RNA, 19 nt, Homo sapiens
gagggaaacguauccauga

SEQ ID NO: 323420 - RNA, 19 nt, Homo sapiens
gaucaaugcugagcugaca

SEQ ID NO: 323421 - RNA, 19 nt, Homo sapiens
acagacaccuccuucaaga

SEQ ID NO: 323422 - RNA, 19 nt, Homo sapiens
gggcuuuacuaaugaagaa

SEQ ID NO: 323423 - RNA, 19 nt, Homo sapiens
gaucaggucuuccccauga

SEQ ID NO: 323424 - RNA, 19 nt, Homo sapiens
cagaauaggcccuuugaug

SEQ ID NO: 323425 - RNA, 19 nt, Homo sapiens
uaucagauccuucaugaau

SEQ ID NO: 323426 - RNA, 19 nt, Homo sapiens
gaguacccauccucacuuu

SEQ ID NO: 323427 - RNA, 19 nt, Homo sapiens
ccaagcgugucauccagua

SEQ ID NO: 323428 - RNA, 19 nt, Homo sapiens
gcauugaggcccagaauag

SEQ ID NO: 323429 - RNA, 19 nt, Homo sapiens
ggaaacguauccaugaacu

SEQ ID NO: 323430 - RNA, 19 nt, Homo sapiens
ggaacagauugcagaagga

SEQ ID NO: 323431 - RNA, 19 nt, Homo sapiens
ugaccuugcuaguaaugua

SEQ ID NO: 323432 - RNA, 19 nt, Homo sapiens
gggaggccaucuucuguau

SEQ ID NO: 323433 - RNA, 19 nt, Homo sapiens
caaugaguaugucaccaaa

SEQ ID NO: 323434 - RNA, 19 nt, Homo sapiens
ccaagaccgugaggaauga

SEQ ID NO: 323435 - RNA, 19 nt, Homo sapiens
ucaaaggucugcgcaaaca

SEQ ID NO: 323436 - RNA, 19 nt, Homo sapiens
gaagaagcagauccagaaa

SEQ ID NO: 323437 - RNA, 19 nt, Homo sapiens
gcaaaggaacuucgauaag

SEQ ID NO: 323438 - RNA, 19 nt, Homo sapiens
gcaggcagcugaggaacau

SEQ ID NO: 323439 - RNA, 19 nt, Homo sapiens
gaggauauggccaugauga

SEQ ID NO: 323440 - RNA, 19 nt, Homo sapiens
uagaggagaugcgagauga

SEQ ID NO: 323441 - RNA, 19 nt, Homo sapiens
ccacacccaguauaaauuu

SEQ ID NO: 323442 - RNA, 19 nt, Homo sapiens
caagaaggccucugagaag

SEQ ID NO: 323443 - RNA, 19 nt, Homo sapiens
gaaauuacuucuggcaaaa

SEQ ID NO: 323444 - RNA, 19 nt, Homo sapiens
agagugagaugaagaugga

SEQ ID NO: 323445 - RNA, 19 nt, Homo sapiens
ggaagaaugugcugagauu

SEQ ID NO: 323446 - RNA, 19 nt, Homo sapiens
gaaagaagcuaccacaucu

SEQ ID NO: 323447 - RNA, 19 nt, Homo sapiens
gcacugagcucuucaaacu

SEQ ID NO: 323448 - RNA, 19 nt, Homo sapiens
ugaacaagcugaugucaaa

SEQ ID NO: 323449 - RNA, 19 nt, Homo sapiens
gaagaaaguugccaagaag

SEQ ID NO: 323450 - RNA, 19 nt, Homo sapiens
ggaggaggcugaugaacaa

SEQ ID NO: 323451 - RNA, 19 nt, Homo sapiens
gcacagaaguggcugacaa

SEQ ID NO: 323452 - RNA, 19 nt, Homo sapiens
gaacuacucacccucauuu

SEQ ID NO: 323453 - RNA, 19 nt, Homo sapiens
caagaagccugagcucaua

SEQ ID NO: 323454 - RNA, 19 nt, Homo sapiens
cugcagauauugaaacuua

SEQ ID NO: 323455 - RNA, 19 nt, Homo sapiens
gaacuuagagcaggagaua

SEQ ID NO: 323456 - RNA, 19 nt, Homo sapiens
agauagagcucaacaagaa

SEQ ID NO: 323457 - RNA, 19 nt, Homo sapiens
gaaagacugugaacaccaa

SEQ ID NO: 323458 - RNA, 19 nt, Homo sapiens
ggaagaagcagauccagaa

SEQ ID NO: 323459 - RNA, 19 nt, Homo sapiens
agaagaagcuggagacaga

SEQ ID NO: 323460 - RNA, 19 nt, Homo sapiens
caagugaaaucagaaauug

SEQ ID NO: 323461 - RNA, 19 nt, Homo sapiens
gauagcagaucucacagaa

SEQ ID NO: 323462 - RNA, 19 nt, Homo sapiens
uauuagaucuggagaauga

SEQ ID NO: 323463 - RNA, 19 nt, Homo sapiens
ggaaagcucccuagaacaa

SEQ ID NO: 323464 - RNA, 19 nt, Homo sapiens
ccaaacgggucauccagua

SEQ ID NO: 323465 - RNA, 19 nt, Homo sapiens
gaaauuggaaggagacuug

SEQ ID NO: 323466 - RNA, 19 nt, Homo sapiens
gaaagacauugaugaccuu

SEQ ID NO: 323467 - RNA, 19 nt, Homo sapiens
ggaaggagcuagaggaaaa

SEQ ID NO: 323468 - RNA, 19 nt, Homo sapiens
ucauagagcugcugcuuau

SEQ ID NO: 323469 - RNA, 19 nt, Homo sapiens
gagagugugucgaaaucua

SEQ ID NO: 323470 - RNA, 19 nt, Homo sapiens
ggaagaagcaugcggauag

SEQ ID NO: 323471 - RNA, 19 nt, Homo sapiens
agaagaaaguugccaagaa

SEQ ID NO: 323472 - RNA, 19 nt, Homo sapiens
gcucagcgccuucaagauu

SEQ ID NO: 323473 - RNA, 19 nt, Homo sapiens
gcuuugaaaucuuugagua

SEQ ID NO: 323474 - RNA, 19 nt, Homo sapiens
ugacacaagugaaaucaga

SEQ ID NO: 323475 - RNA, 19 nt, Homo sapiens
gaagaaggcccuccaagag

SEQ ID NO: 323476 - RNA, 19 nt, Homo sapiens
agaggaaacuggaggauga

SEQ ID NO: 323477 - RNA, 19 nt, Homo sapiens
cggaggagcugaagaagga

SEQ ID NO: 323478 - RNA, 19 nt, Homo sapiens
uagcagaucucacagaaca

SEQ ID NO: 323479 - RNA, 19 nt, Homo sapiens
gaugguugauguugaaaga

SEQ ID NO: 323480 - RNA, 19 nt, Homo sapiens
acgaaaggcucaagaagaa

SEQ ID NO: 323481 - RNA, 19 nt, Homo sapiens
cggcauagcugcuccuuuc

SEQ ID NO: 323482 - RNA, 19 nt, Homo sapiens
caaacaggauucucuaugg

SEQ ID NO: 323483 - RNA, 19 nt, Homo sapiens
gaagaggacaggaagaaug

SEQ ID NO: 323484 - RNA, 19 nt, Homo sapiens
gggcaagaaugaggaaauu

SEQ ID NO: 323485 - RNA, 19 nt, Homo sapiens
guacaacauucgcucauuc

SEQ ID NO: 323486 - RNA, 19 nt, Homo sapiens
cagguuggcuggagaagaa

SEQ ID NO: 323487 - RNA, 19 nt, Homo sapiens
ccacgagagugaagaguga

SEQ ID NO: 323488 - RNA, 19 nt, Homo sapiens
ucaaggagcugacguacca

SEQ ID NO: 323489 - RNA, 19 nt, Homo sapiens
gaagaggaacuaccagaga

SEQ ID NO: 323490 - RNA, 19 nt, Homo sapiens
cggguuagaugaaacaauu

SEQ ID NO: 323491 - RNA, 19 nt, Homo sapiens
gcaucaacuucaccaauga

SEQ ID NO: 323492 - RNA, 19 nt, Homo sapiens
acaaguggcugccggugua

SEQ ID NO: 323493 - RNA, 19 nt, Homo sapiens
ucaacaagcuccgcgcuaa

SEQ ID NO: 323494 - RNA, 19 nt, Homo sapiens
gcucaagaguccauauuag

SEQ ID NO: 323495 - RNA, 19 nt, Homo sapiens
gaggcucacuucucacuga

SEQ ID NO: 323496 - RNA, 19 nt, Homo sapiens
caacuucaccaaugagaaa

SEQ ID NO: 323497 - RNA, 19 nt, Homo sapiens
ggacauugcaggcuuugaa

SEQ ID NO: 323498 - RNA, 19 nt, Homo sapiens
gaaggaccguuacacaucu

SEQ ID NO: 323499 - RNA, 19 nt, Homo sapiens
ggacucaaaggaagaauau

SEQ ID NO: 323500 - RNA, 19 nt, Homo sapiens
cgagaaggaugaagagauc

SEQ ID NO: 323501 - RNA, 19 nt, Homo sapiens
auagaaagauugccgagaa

SEQ ID NO: 323502 - RNA, 19 nt, Homo sapiens
acaagcugaugucaaauuu

SEQ ID NO: 323503 - RNA, 19 nt, Homo sapiens
caaacugucucugcccuuu

SEQ ID NO: 323504 - RNA, 19 nt, Homo sapiens
gaaaaccaguccauucuga

SEQ ID NO: 323505 - RNA, 19 nt, Homo sapiens
ugacaacgccuaucaguuc

SEQ ID NO: 323506 - RNA, 19 nt, Homo sapiens
aaagcaaaguggaagauga

SEQ ID NO: 323507 - RNA, 19 nt, Homo sapiens
gaacaaggacccucugaac

SEQ ID NO: 323508 - RNA, 19 nt, Homo sapiens
auacgaagcuuccaagaca

SEQ ID NO: 323509 - RNA, 19 nt, Homo sapiens
gaccaacccuuacgacuac

SEQ ID NO: 323510 - RNA, 19 nt, Homo sapiens
ugcaggaucugguggauaa

SEQ ID NO: 323511 - RNA, 19 nt, Homo sapiens
ucaugcagcuccagaguga

SEQ ID NO: 323512 - RNA, 19 nt, Homo sapiens
cauauuagaucuggagaau

SEQ ID NO: 323513 - RNA, 19 nt, Homo sapiens
agagagagcugaagaugag

SEQ ID NO: 323514 - RNA, 19 nt, Homo sapiens
ggcagaggcucacuucuca

SEQ ID NO: 323515 - RNA, 19 nt, Homo sapiens
caacagacaccuccuucaa

SEQ ID NO: 323516 - RNA, 19 nt, Homo sapiens
gagugaaaguugggaauga

SEQ ID NO: 323517 - RNA, 19 nt, Homo sapiens
ccaagacugugaggaauga

SEQ ID NO: 323518 - RNA, 19 nt, Homo sapiens
gaugaucuauaccuacuca

SEQ ID NO: 323519 - RNA, 19 nt, Homo sapiens
uccgagagcuggaguuuga

SEQ ID NO: 323520 - RNA, 19 nt, Homo sapiens
acagacaccuccuucaaga

SEQ ID NO: 323521 - RNA, 19 nt, Homo sapiens
gaaggucacuguggaaacu

SEQ ID NO: 323522 - RNA, 19 nt, Homo sapiens
gaacuggagaaaucaagaa

SEQ ID NO: 323523 - RNA, 19 nt, Homo sapiens
gaagaagcaugcggauagu

SEQ ID NO: 323524 - RNA, 19 nt, Homo sapiens
ccacggagaacaagguuaa

SEQ ID NO: 323525 - RNA, 19 nt, Homo sapiens
uggaggaucugaugguuga

SEQ ID NO: 323526 - RNA, 19 nt, Homo sapiens
gcagauagagcucaacaag

SEQ ID NO: 323527 - RNA, 19 nt, Homo sapiens
gaauugaggagcuggaaga

SEQ ID NO: 323528 - RNA, 19 nt, Homo sapiens
gaagaagacaaagucaauu

SEQ ID NO: 323529 - RNA, 19 nt, Homo sapiens
ucuaccagauucuuucuaa

SEQ ID NO: 323530 - RNA, 19 nt, Homo sapiens
uggauaaacugcaagugaa

SEQ ID NO: 323531 - RNA, 19 nt, Homo sapiens
uuaagggccugaggaagua

SEQ ID NO: 323532 - RNA, 19 nt, Homo sapiens
gaagaagcagauccagaaa

SEQ ID NO: 323533 - RNA, 19 nt, Homo sapiens
cgaggaagccuuagaucaa

SEQ ID NO: 323534 - RNA, 19 nt, Homo sapiens
ccacacagaagucucguuu

SEQ ID NO: 323535 - RNA, 19 nt, Homo sapiens
gacgaaaggcucaagaaga

SEQ ID NO: 323536 - RNA, 19 nt, Homo sapiens
uggcauccauugauauuga

SEQ ID NO: 323537 - RNA, 19 nt, Homo sapiens
gagcaggacagaagauaug

SEQ ID NO: 323538 - RNA, 19 nt, Homo sapiens
ucaagaacaagcuguauga

SEQ ID NO: 323539 - RNA, 19 nt, Homo sapiens
ccaguacuuugcaacaauu

SEQ ID NO: 323540 - RNA, 19 nt, Homo sapiens
aaagucaaguccuacaaga

SEQ ID NO: 323541 - RNA, 19 nt, Homo sapiens
gaauccagcuugaauugac

SEQ ID NO: 323542 - RNA, 19 nt, Homo sapiens
ccagcuggcucucgaggaa

SEQ ID NO: 323543 - RNA, 19 nt, Homo sapiens
gcagaucucacagaacaaa

SEQ ID NO: 323544 - RNA, 19 nt, Homo sapiens
agaggcagcuggaggaaga

SEQ ID NO: 323545 - RNA, 19 nt, Homo sapiens
gaaagaagcuaccacauau

SEQ ID NO: 323546 - RNA, 19 nt, Homo sapiens
ggaaagaugugaucaguug

SEQ ID NO: 323547 - RNA, 19 nt, Homo sapiens
ugagagagcuugaaaguga

SEQ ID NO: 323548 - RNA, 19 nt, Homo sapiens
ucaaugaccuugcuaguaa

SEQ ID NO: 323549 - RNA, 19 nt, Homo sapiens
guucagagcucaagaaaga

SEQ ID NO: 323550 - RNA, 19 nt, Homo sapiens
aaacauaucugcuagagaa

SEQ ID NO: 323551 - RNA, 19 nt, Homo sapiens
gcacugagcuguucaaggu

SEQ ID NO: 323552 - RNA, 19 nt, Homo sapiens
cagcaacgcuuaauaaaug

SEQ ID NO: 323553 - RNA, 19 nt, Homo sapiens
ggagggagaucuuaaugaa

SEQ ID NO: 323554 - RNA, 19 nt, Homo sapiens
gcauagcucucgauaagaa

SEQ ID NO: 323555 - RNA, 19 nt, Homo sapiens
gcucaaaucucucugcuau

SEQ ID NO: 323556 - RNA, 19 nt, Homo sapiens
agaaacaacuugaucauga

SEQ ID NO: 323557 - RNA, 19 nt, Homo sapiens
ugaauaagcugaugaccaa

SEQ ID NO: 323558 - RNA, 19 nt, Homo sapiens
cuagagaagucccgaguua

SEQ ID NO: 323559 - RNA, 19 nt, Homo sapiens
aaaccaaagucaaagcuua

SEQ ID NO: 323560 - RNA, 19 nt, Homo sapiens
caaaugugcuucucuugaa

SEQ ID NO: 323561 - RNA, 19 nt, Homo sapiens
gaaggaagaauuugagaaa

SEQ ID NO: 323562 - RNA, 19 nt, Homo sapiens
gcaaugaguucguaaccaa

SEQ ID NO: 323563 - RNA, 19 nt, Homo sapiens
gaccaagucuucuccauga

SEQ ID NO: 323564 - RNA, 19 nt, Homo sapiens
agaagaagcuggaaacaga

SEQ ID NO: 323565 - RNA, 19 nt, Homo sapiens
ccaaagaaaugcacgaaau

SEQ ID NO: 323566 - RNA, 19 nt, Homo sapiens
ggaaagaacuagaagaaaa

SEQ ID NO: 323567 - RNA, 19 nt, Homo sapiens
gcuuugagaucuuugauuu

SEQ ID NO: 323568 - RNA, 19 nt, Homo sapiens
gcgcagagcuaaccugaug

SEQ ID NO: 323569 - RNA, 19 nt, Homo sapiens
uaucaaauccuguccaaua

SEQ ID NO: 323570 - RNA, 19 nt, Homo sapiens
ggaagaagcagauccagaa

SEQ ID NO: 323571 - RNA, 19 nt, Homo sapiens
aaagugagguggaaaguga

SEQ ID NO: 323572 - RNA, 19 nt, Homo sapiens
gagcagcaacgcuuaauaa

SEQ ID NO: 323573 - RNA, 19 nt, Homo sapiens
caacaugaaggaagaauuu

SEQ ID NO: 323574 - RNA, 19 nt, Homo sapiens
gcugggaacucuagaagaa

SEQ ID NO: 323575 - RNA, 19 nt, Homo sapiens
ugaaguaguugucugcuuu

SEQ ID NO: 323576 - RNA, 19 nt, Homo sapiens
caacauccgugcuuucaug

SEQ ID NO: 323577 - RNA, 19 nt, Homo sapiens
gcacggaaguugcugacaa

SEQ ID NO: 323578 - RNA, 19 nt, Homo sapiens
gaucaaaucaucagugcua

SEQ ID NO: 323579 - RNA, 19 nt, Homo sapiens
ggaagacugugaacacgaa

SEQ ID NO: 323580 - RNA, 19 nt, Homo sapiens
ugaaagaagcuaccacaua

SEQ ID NO: 323581 - RNA, 19 nt, Homo sapiens
cugcagauauugaaacaua

SEQ ID NO: 323582 - RNA, 19 nt, Homo sapiens
agucaaagcuuacaagaga

SEQ ID NO: 323583 - RNA, 19 nt, Homo sapiens
gaagaaugccuacgaggaa

SEQ ID NO: 323584 - RNA, 19 nt, Homo sapiens
gaaagacauugaugaccuu

SEQ ID NO: 323585 - RNA, 19 nt, Homo sapiens
gaagaaaugcgagaugaaa

SEQ ID NO: 323586 - RNA, 19 nt, Homo sapiens
caugaacccucccaaauau

SEQ ID NO: 323587 - RNA, 19 nt, Homo sapiens
cacaacagauugaagaauu

SEQ ID NO: 323588 - RNA, 19 nt, Homo sapiens
ggaccagcuuagugaaaua

SEQ ID NO: 323589 - RNA, 19 nt, Homo sapiens
gaggaggaccgcaagaaua

SEQ ID NO: 323590 - RNA, 19 nt, Homo sapiens
ggaagaagcacgcagauag

SEQ ID NO: 323591 - RNA, 19 nt, Homo sapiens
ggacauugcuggcuuugag

SEQ ID NO: 323592 - RNA, 19 nt, Homo sapiens
caaauccuguccaauaaga

SEQ ID NO: 323593 - RNA, 19 nt, Homo sapiens
agucauaagugaagaguaa

SEQ ID NO: 323594 - RNA, 19 nt, Homo sapiens
gaaagcauauccaugaacu

SEQ ID NO: 323595 - RNA, 19 nt, Homo sapiens
gauacaagguucuaaaugc

SEQ ID NO: 323596 - RNA, 19 nt, Homo sapiens
ccaaagccaucuacgagaa

SEQ ID NO: 323597 - RNA, 19 nt, Homo sapiens
gaagaacucgaucagcuaa

SEQ ID NO: 323598 - RNA, 19 nt, Homo sapiens
agaggaaacuggaggauga

SEQ ID NO: 323599 - RNA, 19 nt, Homo sapiens
caaacuggcuucugcagau

SEQ ID NO: 323600 - RNA, 19 nt, Homo sapiens
gaggaacaauccaauguca

SEQ ID NO: 323601 - RNA, 19 nt, Homo sapiens
gaugcaggcugaaguugaa

SEQ ID NO: 323602 - RNA, 19 nt, Homo sapiens
gaaaugaugcucugaggau

SEQ ID NO: 323603 - RNA, 19 nt, Homo sapiens
gaaggcacguuuacacaca

SEQ ID NO: 323604 - RNA, 19 nt, Homo sapiens
aaccagagcucauugaaau

SEQ ID NO: 323605 - RNA, 19 nt, Homo sapiens
ccaugaacccucccaaaua

SEQ ID NO: 323606 - RNA, 19 nt, Homo sapiens
ggagauuucugaccugaca

SEQ ID NO: 323607 - RNA, 19 nt, Homo sapiens
ucaaagagguaacugaaag

SEQ ID NO: 323608 - RNA, 19 nt, Homo sapiens
gcagaugccuuggcugaug

SEQ ID NO: 323609 - RNA, 19 nt, Homo sapiens
ccaagaaggccaucacuga

SEQ ID NO: 323610 - RNA, 19 nt, Homo sapiens
gaggaaccaucucagaguu

SEQ ID NO: 323611 - RNA, 19 nt, Homo sapiens
ucagggagaauuugaauaa

SEQ ID NO: 323612 - RNA, 19 nt, Homo sapiens
agaacaagcuguaugaaca

SEQ ID NO: 323613 - RNA, 19 nt, Homo sapiens
acaaguggcugccggugua

SEQ ID NO: 323614 - RNA, 19 nt, Homo sapiens
ggacaaauugcaaaccaaa

SEQ ID NO: 323615 - RNA, 19 nt, Homo sapiens
gaagcuguauuucaagauc

SEQ ID NO: 323616 - RNA, 19 nt, Homo sapiens
ggaaguugcugacaaagcu

SEQ ID NO: 323617 - RNA, 19 nt, Homo sapiens
gaaacaacuugaucaugag

SEQ ID NO: 323618 - RNA, 19 nt, Homo sapiens
gaacuuacaacaggagauu

SEQ ID NO: 323619 - RNA, 19 nt, Homo sapiens
caaacaagcauuuacacaa

SEQ ID NO: 323620 - RNA, 19 nt, Homo sapiens
agagugagcugaagaugga

SEQ ID NO: 323621 - RNA, 19 nt, Homo sapiens
ugaaggaucucuggaacaa

SEQ ID NO: 323622 - RNA, 19 nt, Homo sapiens
gaggaaagaugugaucagu

SEQ ID NO: 323623 - RNA, 19 nt, Homo sapiens
aaagcuagcucaacucauc

SEQ ID NO: 323624 - RNA, 19 nt, Homo sapiens
ugaaggaacucacuuacca

SEQ ID NO: 323625 - RNA, 19 nt, Homo sapiens
gaauugaagcucagaacaa

SEQ ID NO: 323626 - RNA, 19 nt, Homo sapiens
gagcugauggccacagaua

SEQ ID NO: 323627 - RNA, 19 nt, Homo sapiens
ggacuugguggacaaauug

SEQ ID NO: 323628 - RNA, 19 nt, Homo sapiens
gaaggacacucagcuacau

SEQ ID NO: 323629 - RNA, 19 nt, Homo sapiens
gaagagcagcaacgcuuaa

SEQ ID NO: 323630 - RNA, 19 nt, Homo sapiens
gaaacuggaggaugaaugu

SEQ ID NO: 323631 - RNA, 19 nt, Homo sapiens
uagaagaaaugcgagauga

SEQ ID NO: 323632 - RNA, 19 nt, Homo sapiens
gaacaagcuguaugaacaa

SEQ ID NO: 323633 - RNA, 19 nt, Homo sapiens
uagaaacacacaaggaaua

SEQ ID NO: 323634 - RNA, 19 nt, Homo sapiens
acaaacagcaacuuaauga

SEQ ID NO: 323635 - RNA, 19 nt, Homo sapiens
ugaaagagcugaggaugag

SEQ ID NO: 323636 - RNA, 19 nt, Homo sapiens
caaugaagacucuggcuuu

SEQ ID NO: 323637 - RNA, 19 nt, Homo sapiens
caacagacaccuccuucaa

SEQ ID NO: 323638 - RNA, 19 nt, Homo sapiens
caacuucaccaacgagaaa

SEQ ID NO: 323639 - RNA, 19 nt, Homo sapiens
gaagcuaccacauauuuua

SEQ ID NO: 323640 - RNA, 19 nt, Homo sapiens
ugacaacuccucucgcuuu

SEQ ID NO: 323641 - RNA, 19 nt, Homo sapiens
gaaagaaaaugugaccaaa

SEQ ID NO: 323642 - RNA, 19 nt, Homo sapiens
ugaagaggcugaggaacaa

SEQ ID NO: 323643 - RNA, 19 nt, Homo sapiens
cugaggagcugaagaagga

SEQ ID NO: 323644 - RNA, 19 nt, Homo sapiens
aaacagaaguaugaggaaa

SEQ ID NO: 323645 - RNA, 19 nt, Homo sapiens
gcaaggagcuggaggagaa

SEQ ID NO: 323646 - RNA, 19 nt, Homo sapiens
gaggaaaucucggaccuua

SEQ ID NO: 323647 - RNA, 19 nt, Homo sapiens
ggagaaagcuggcgucuac

SEQ ID NO: 323648 - RNA, 19 nt, Homo sapiens
agaaggaguuugacauuaa

SEQ ID NO: 323649 - RNA, 19 nt, Homo sapiens
gcauugaccucaucgagaa

SEQ ID NO: 323650 - RNA, 19 nt, Homo sapiens
cagaggagcugaagaagga

SEQ ID NO: 323651 - RNA, 19 nt, Homo sapiens
gaagaaggaguuugacauu

SEQ ID NO: 323652 - RNA, 19 nt, Homo sapiens
gagggacaguucauugaua

SEQ ID NO: 323653 - RNA, 19 nt, Homo sapiens
gcaagaagcagcugcagaa

SEQ ID NO: 323654 - RNA, 19 nt, Homo sapiens
gaaacuaccacaucuucua

SEQ ID NO: 323655 - RNA, 19 nt, Homo sapiens
ggaagacggugacugugaa

SEQ ID NO: 323656 - RNA, 19 nt, Homo sapiens
acaguaagauugaggauga

SEQ ID NO: 323657 - RNA, 19 nt, Homo sapiens
gaaggaguuugacauuaau

SEQ ID NO: 323658 - RNA, 19 nt, Homo sapiens
ggaagacugugaacaccaa

SEQ ID NO: 323659 - RNA, 19 nt, Homo sapiens
gaggaaagaaugugcauga

SEQ ID NO: 323660 - RNA, 19 nt, Homo sapiens
gaacaagacaaccucaaug

SEQ ID NO: 323661 - RNA, 19 nt, Homo sapiens
gagagaaacuaccacaucu

SEQ ID NO: 323662 - RNA, 19 nt, Homo sapiens
gcccaacgcucccucaaug

SEQ ID NO: 323663 - RNA, 19 nt, Homo sapiens
gaaagugggcaacgaguau

SEQ ID NO: 323664 - RNA, 19 nt, Homo sapiens
ucaaggagcucaccuacca

SEQ ID NO: 323665 - RNA, 19 nt, Homo sapiens
gcucagcucucuggacauu

SEQ ID NO: 323666 - RNA, 19 nt, Homo sapiens
acaaguggcugccggugua

SEQ ID NO: 323667 - RNA, 19 nt, Homo sapiens
acaccaaccuguccaaguu

SEQ ID NO: 323668 - RNA, 19 nt, Homo sapiens
cagagaaacuuugacaaga

SEQ ID NO: 323669 - RNA, 19 nt, Homo sapiens
aagaaggaguuugacauua

SEQ ID NO: 323670 - RNA, 19 nt, Homo sapiens
caacagagaacaaggugaa

SEQ ID NO: 323671 - RNA, 19 nt, Homo sapiens
ggacauucauugacuuugg

SEQ ID NO: 323672 - RNA, 19 nt, Homo sapiens
gagaaacuuugacaagauc

SEQ ID NO: 323673 - RNA, 19 nt, Homo sapiens
ucgcuaagcugaccaagga

SEQ ID NO: 323674 - RNA, 19 nt, Homo sapiens
caagacaaccucaaugaug

SEQ ID NO: 323675 - RNA, 19 nt, Homo sapiens
gaccacccauccucacuuu

SEQ ID NO: 323676 - RNA, 19 nt, Homo sapiens
ucaacaagcuaaugaccaa

SEQ ID NO: 323677 - RNA, 19 nt, Homo sapiens
ccacugacaugaccuucaa

SEQ ID NO: 323678 - RNA, 19 nt, Homo sapiens
ggagauggcugggcuggau

SEQ ID NO: 323679 - RNA, 19 nt, Homo sapiens
ucaaagagacgcuggagaa

SEQ ID NO: 323680 - RNA, 19 nt, Homo sapiens
gcagaaacgccgaggagaa

SEQ ID NO: 323681 - RNA, 19 nt, Homo sapiens
ggacugaggagcucgaaga

SEQ ID NO: 323682 - RNA, 19 nt, Homo sapiens
cagcagaacaguaagauug

SEQ ID NO: 323683 - RNA, 19 nt, Homo sapiens
ccaaggcaguguaugagaa

SEQ ID NO: 323684 - RNA, 19 nt, Homo sapiens
cgacaacuccucccgcuuu

SEQ ID NO: 323685 - RNA, 19 nt, Homo sapiens
gagcuggaguccucacaga

SEQ ID NO: 323686 - RNA, 19 nt, Homo sapiens
gcagagaaacuuugacaag

SEQ ID NO: 323687 - RNA, 19 nt, Homo sapiens
gaccgagaauggagaguug

SEQ ID NO: 323688 - RNA, 19 nt, Homo sapiens
aaacaaggauccucucaac

SEQ ID NO: 323689 - RNA, 19 nt, Homo sapiens
gaugaccgaugcccagaug

SEQ ID NO: 323690 - RNA, 19 nt, Homo sapiens
ccaagcgugucauccagua

SEQ ID NO: 323691 - RNA, 19 nt, Homo sapiens
ggagaaggaggaaagaaug

SEQ ID NO: 323692 - RNA, 19 nt, Homo sapiens
uuaaucagcagaacaguaa

SEQ ID NO: 323693 - RNA, 19 nt, Homo sapiens
gcgcagagacggagaagga

SEQ ID NO: 323694 - RNA, 19 nt, Homo sapiens
gagaaacuaccacaucuuc

SEQ ID NO: 323695 - RNA, 19 nt, Homo sapiens
cagaagaaacugaaggaaa

SEQ ID NO: 323696 - RNA, 19 nt, Homo sapiens
ccaacaaucccuacgacua

SEQ ID NO: 323697 - RNA, 19 nt, Homo sapiens
gcugaaagcugagagaaac

SEQ ID NO: 323698 - RNA, 19 nt, Homo sapiens
agaccuaccugcuggagaa

SEQ ID NO: 323699 - RNA, 19 nt, Homo sapiens
cgacaacgccuaucaguac

SEQ ID NO: 323700 - RNA, 19 nt, Homo sapiens
agaaugagauagaggacuu

SEQ ID NO: 323701 - RNA, 19 nt, Homo sapiens
ucaagagccuccagagcuu

SEQ ID NO: 323702 - RNA, 19 nt, Homo sapiens
aggcaaaccuggagaaagu

SEQ ID NO: 323703 - RNA, 19 nt, Homo sapiens
agaagaaacugaaggaaaa

SEQ ID NO: 323704 - RNA, 19 nt, Homo sapiens
gaagaaaagcuuaagaaga

SEQ ID NO: 323705 - RNA, 19 nt, Homo sapiens
ggaacaagacaaccucaau

SEQ ID NO: 323706 - RNA, 19 nt, Homo sapiens
gccaaccuguaauaaauau

SEQ ID NO: 323707 - RNA, 19 nt, Homo sapiens
gccaagagccgugacauug

SEQ ID NO: 323708 - RNA, 19 nt, Homo sapiens
agagaaacuuugacaagau

SEQ ID NO: 323709 - RNA, 19 nt, Homo sapiens
ucacaaccaguacaaguuu

SEQ ID NO: 323710 - RNA, 19 nt, Homo sapiens
ucagcucucuggacauuga

SEQ ID NO: 323711 - RNA, 19 nt, Homo sapiens
gagcaggagcugauugaga

SEQ ID NO: 323712 - RNA, 19 nt, Homo sapiens
gaaccuaacagaggagaug

SEQ ID NO: 323713 - RNA, 19 nt, Homo sapiens
ggagcucacugccaagaag

SEQ ID NO: 323714 - RNA, 19 nt, Homo sapiens
gcuggcuucugcagacaua

SEQ ID NO: 323715 - RNA, 19 nt, Homo sapiens
gaaggaggaccagguguug

SEQ ID NO: 323716 - RNA, 19 nt, Homo sapiens
ggaccuuacugagcagcua

SEQ ID NO: 323717 - RNA, 19 nt, Homo sapiens
cugcagcccuggacaagaa

SEQ ID NO: 323718 - RNA, 19 nt, Homo sapiens
agaucgagaugaacaagaa

SEQ ID NO: 323719 - RNA, 19 nt, Homo sapiens
gggcuaagguggagaagcu

SEQ ID NO: 323720 - RNA, 19 nt, Homo sapiens
guaaaggagaugaaugaga

SEQ ID NO: 323721 - RNA, 19 nt, Homo sapiens
gggaugcccugcugguaau

SEQ ID NO: 323722 - RNA, 19 nt, Homo sapiens
gaaaaucucaacaagcuaa

SEQ ID NO: 323723 - RNA, 19 nt, Homo sapiens
caagaagcagagaaacuuu

SEQ ID NO: 323724 - RNA, 19 nt, Homo sapiens
ggagaagaaagcucuacaa

SEQ ID NO: 323725 - RNA, 19 nt, Homo sapiens
gggaagacggugacuguga

SEQ ID NO: 323726 - RNA, 19 nt, Homo sapiens
gcucauggccacucucuuc

SEQ ID NO: 323727 - RNA, 19 nt, Homo sapiens
uggacaagcugcaacugaa

SEQ ID NO: 323728 - RNA, 19 nt, Homo sapiens
ccagacagaggaagacaaa

SEQ ID NO: 323729 - RNA, 19 nt, Homo sapiens
uuaagaagaaggaguuuga

SEQ ID NO: 323730 - RNA, 19 nt, Homo sapiens
gagaagaaagcucuacaag

SEQ ID NO: 323731 - RNA, 19 nt, Homo sapiens
gaacauucgggccuucaug

SEQ ID NO: 323732 - RNA, 19 nt, Homo sapiens
caagagccgugacauuggu

SEQ ID NO: 323733 - RNA, 19 nt, Homo sapiens
gauucuccgugaagggaua

SEQ ID NO: 323734 - RNA, 19 nt, Homo sapiens
ugagauagaggacuugaug

SEQ ID NO: 323735 - RNA, 19 nt, Homo sapiens
uggcugggcuggaugaaau

SEQ ID NO: 323736 - RNA, 19 nt, Homo sapiens
gaucacaaccaguacaagu

SEQ ID NO: 323737 - RNA, 19 nt, Homo sapiens
ggaaaucucggaccuuacu

SEQ ID NO: 323738 - RNA, 19 nt, Homo sapiens
agcagaagcuggagaagga

SEQ ID NO: 323739 - RNA, 19 nt, Homo sapiens
aagagacgcuggagaaguc

SEQ ID NO: 323740 - RNA, 19 nt, Homo sapiens
ucaagccgcugcugaagag

SEQ ID NO: 323741 - RNA, 19 nt, Homo sapiens
uugccaaccuguaauaaau

SEQ ID NO: 323742 - RNA, 19 nt, Homo sapiens
caagaaccuucaggaggaa

SEQ ID NO: 323743 - RNA, 19 nt, Homo sapiens
uggagaagcugcgcucaga

SEQ ID NO: 323744 - RNA, 19 nt, Homo sapiens
aagcaaaggaggcaagaaa

SEQ ID NO: 323745 - RNA, 19 nt, Homo sapiens
gcacagagcucuucaaacu

SEQ ID NO: 323746 - RNA, 19 nt, Homo sapiens
gcaaggagcuggaggagaa

SEQ ID NO: 323747 - RNA, 19 nt, Homo sapiens
gaacaaggauccucucaau

SEQ ID NO: 323748 - RNA, 19 nt, Homo sapiens
gcaaguggaugaucuggaa

SEQ ID NO: 323749 - RNA, 19 nt, Homo sapiens
agagagagauuaucacauu

SEQ ID NO: 323750 - RNA, 19 nt, Homo sapiens
gcauugaccucaucgagaa

SEQ ID NO: 323751 - RNA, 19 nt, Homo sapiens
gcacgaagggcuugaauga

SEQ ID NO: 323752 - RNA, 19 nt, Homo sapiens
cagaggagcugaagaagga

SEQ ID NO: 323753 - RNA, 19 nt, Homo sapiens
gagggacaguucauugaua

SEQ ID NO: 323754 - RNA, 19 nt, Homo sapiens
ccaagagggucauccagua

SEQ ID NO: 323755 - RNA, 19 nt, Homo sapiens
gcaagaagcagcugcagaa

SEQ ID NO: 323756 - RNA, 19 nt, Homo sapiens
gaagcagaauaaagcaauu

SEQ ID NO: 323757 - RNA, 19 nt, Homo sapiens
ugaacaagcugaugaccaa

SEQ ID NO: 323758 - RNA, 19 nt, Homo sapiens
ggaagacagucaacaccaa

SEQ ID NO: 323759 - RNA, 19 nt, Homo sapiens
gagagagauuaucacauuu

SEQ ID NO: 323760 - RNA, 19 nt, Homo sapiens
acaaggauccucucaauga

SEQ ID NO: 323761 - RNA, 19 nt, Homo sapiens
guuggcaucugcagacaua

SEQ ID NO: 323762 - RNA, 19 nt, Homo sapiens
gcaagacagugaccgugaa

SEQ ID NO: 323763 - RNA, 19 nt, Homo sapiens
ucaaggagcucaccuacca

SEQ ID NO: 323764 - RNA, 19 nt, Homo sapiens
gcggaaagacuauccauga

SEQ ID NO: 323765 - RNA, 19 nt, Homo sapiens
acaaguggcugccggugua

SEQ ID NO: 323766 - RNA, 19 nt, Homo sapiens
acaccaaccuguccaaguu

SEQ ID NO: 323767 - RNA, 19 nt, Homo sapiens
caacagagaacaaggugaa

SEQ ID NO: 323768 - RNA, 19 nt, Homo sapiens
gcugaagagugcagaaaga

SEQ ID NO: 323769 - RNA, 19 nt, Homo sapiens
ggacauucauugacuuugg

SEQ ID NO: 323770 - RNA, 19 nt, Homo sapiens
gcacagccaugggagauuc

SEQ ID NO: 323771 - RNA, 19 nt, Homo sapiens
gaaagcagagagagauuau

SEQ ID NO: 323772 - RNA, 19 nt, Homo sapiens
agaaugagaucgaggacuu

SEQ ID NO: 323773 - RNA, 19 nt, Homo sapiens
ggagauggcugggcuggau

SEQ ID NO: 323774 - RNA, 19 nt, Homo sapiens
ucaaagaggcgcuagagaa

SEQ ID NO: 323775 - RNA, 19 nt, Homo sapiens
gggcaaauccgccaacuuc

SEQ ID NO: 323776 - RNA, 19 nt, Homo sapiens
ugaagaggcugacaagucu

SEQ ID NO: 323777 - RNA, 19 nt, Homo sapiens
acagagcucuucaaacuca

SEQ ID NO: 323778 - RNA, 19 nt, Homo sapiens
gcaaaggcaaggccaagaa

SEQ ID NO: 323779 - RNA, 19 nt, Homo sapiens
cagaggaacuucgacaaga

SEQ ID NO: 323780 - RNA, 19 nt, Homo sapiens
gagaaacacgcaacagaga

SEQ ID NO: 323781 - RNA, 19 nt, Homo sapiens
agauucagcuggaggcuaa

SEQ ID NO: 323782 - RNA, 19 nt, Homo sapiens
ggacgaagccgagcagauc

SEQ ID NO: 323783 - RNA, 19 nt, Homo sapiens
gcaggaaugcugaggagaa

SEQ ID NO: 323784 - RNA, 19 nt, Homo sapiens
cgacaacgccuaucaguac

SEQ ID NO: 323785 - RNA, 19 nt, Homo sapiens
ugcgggagcuggagaauga

SEQ ID NO: 323786 - RNA, 19 nt, Homo sapiens
gaggugugcucgccagaau

SEQ ID NO: 323787 - RNA, 19 nt, Homo sapiens
ucaagagccuccagagcuu

SEQ ID NO: 323788 - RNA, 19 nt, Homo sapiens
acgcaaggauugaggauga

SEQ ID NO: 323789 - RNA, 19 nt, Homo sapiens
ggaguucacacgccucaaa

SEQ ID NO: 323790 - RNA, 19 nt, Homo sapiens
ggaagaggagugcauguuc

SEQ ID NO: 323791 - RNA, 19 nt, Homo sapiens
ccaguacuuugcuguuauu

SEQ ID NO: 323792 - RNA, 19 nt, Homo sapiens
gccaagagccgugacauug

SEQ ID NO: 323793 - RNA, 19 nt, Homo sapiens
aggcugagcuggaggaguu

SEQ ID NO: 323794 - RNA, 19 nt, Homo sapiens
uggaagaccagaugaauga

SEQ ID NO: 323795 - RNA, 19 nt, Homo sapiens
ucacaaccaguacaaguuu

SEQ ID NO: 323796 - RNA, 19 nt, Homo sapiens
gaaagugggcaaugaguac

SEQ ID NO: 323797 - RNA, 19 nt, Homo sapiens
ggaagcagaauaaagcaau

SEQ ID NO: 323798 - RNA, 19 nt, Homo sapiens
ggaggaagcagaauaaagc

SEQ ID NO: 323799 - RNA, 19 nt, Homo sapiens
gagcaggagcugauugaga

SEQ ID NO: 323800 - RNA, 19 nt, Homo sapiens
gagacucccugcugguaau

SEQ ID NO: 323801 - RNA, 19 nt, Homo sapiens
gagcucauggccacugaua

SEQ ID NO: 323802 - RNA, 19 nt, Homo sapiens
gcagagagagauuaucaca

SEQ ID NO: 323803 - RNA, 19 nt, Homo sapiens
gggcccagcuggaguucaa

SEQ ID NO: 323804 - RNA, 19 nt, Homo sapiens
cugcagcccuggacaagaa

SEQ ID NO: 323805 - RNA, 19 nt, Homo sapiens
ggacguagagcgcuccaau

SEQ ID NO: 323806 - RNA, 19 nt, Homo sapiens
agaucgagaugaacaagaa

SEQ ID NO: 323807 - RNA, 19 nt, Homo sapiens
gggcuaagguggagaagcu

SEQ ID NO: 323808 - RNA, 19 nt, Homo sapiens
ggaaggaucccuggagcaa

SEQ ID NO: 323809 - RNA, 19 nt, Homo sapiens
acgagaggcuggaggauga

SEQ ID NO: 323810 - RNA, 19 nt, Homo sapiens
gcaaugaguacgucaccaa

SEQ ID NO: 323811 - RNA, 19 nt, Homo sapiens
gcaagaggcccaccaacag

SEQ ID NO: 323812 - RNA, 19 nt, Homo sapiens
ucagcucccuggacauuga

SEQ ID NO: 323813 - RNA, 19 nt, Homo sapiens
gcacccuguuugccaacua

SEQ ID NO: 323814 - RNA, 19 nt, Homo sapiens
ccaccgacaugaccuucaa

SEQ ID NO: 323815 - RNA, 19 nt, Homo sapiens
cuucgugccugaugacaaa

SEQ ID NO: 323816 - RNA, 19 nt, Homo sapiens
gaacauucgggccuucaug

SEQ ID NO: 323817 - RNA, 19 nt, Homo sapiens
gggcugaugcgccuauuga

SEQ ID NO: 323818 - RNA, 19 nt, Homo sapiens
ugaaagcagagagagauua

SEQ ID NO: 323819 - RNA, 19 nt, Homo sapiens
ggaguagcuuugccacauc

SEQ ID NO: 323820 - RNA, 19 nt, Homo sapiens
aaagggacaucgaugaucu

SEQ ID NO: 323821 - RNA, 19 nt, Homo sapiens
caaagaggcgcuagagaag

SEQ ID NO: 323822 - RNA, 19 nt, Homo sapiens
gaucacaaccaguacaagu

SEQ ID NO: 323823 - RNA, 19 nt, Homo sapiens
caaaggcaaggccaagaaa

SEQ ID NO: 323824 - RNA, 19 nt, Homo sapiens
gcacugaagaggcugacaa

SEQ ID NO: 323825 - RNA, 19 nt, Homo sapiens
ugaaugaggaguagcuuug

SEQ ID NO: 323826 - RNA, 19 nt, Homo sapiens
ugucccagcuccagacuga

SEQ ID NO: 323827 - RNA, 19 nt, Homo sapiens
gaagauggagcugcaguca

SEQ ID NO: 323828 - RNA, 19 nt, Homo sapiens
uggaacaucuggagaccuu

SEQ ID NO: 323829 - RNA, 19 nt, Homo sapiens
cagcacagagcucuucaaa

SEQ ID NO: 323830 - RNA, 19 nt, Homo sapiens
gaggcaagcucaccuacac

SEQ ID NO: 323831 - RNA, 19 nt, Homo sapiens
agcagaagcuggagaagga

SEQ ID NO: 323832 - RNA, 19 nt, Homo sapiens
ucaagccgcugcugaagag

SEQ ID NO: 323833 - RNA, 19 nt, Homo sapiens
uaccaaauccugucuaaca

SEQ ID NO: 323834 - RNA, 19 nt, Homo sapiens
gaacaucuggagaccuuca

SEQ ID NO: 323835 - RNA, 19 nt, Homo sapiens
aggcuaaccuggagaagau

SEQ ID NO: 323836 - RNA, 19 nt, Homo sapiens
uggagaagcugcgcucaga

SEQ ID NO: 323837 - RNA, 19 nt, Homo sapiens
aaggaucccuggagcaaga

SEQ ID NO: 323838 - RNA, 19 nt, Homo sapiens
gucgugggcuuguaucaga

SEQ ID NO: 323839 - RNA, 19 nt, Homo sapiens
gggugaaagugggcaauga

SEQ ID NO: 323840 - RNA, 19 nt, Homo sapiens
ccaacaaccccuacgauua

SEQ ID NO: 323841 - RNA, 19 nt, Homo sapiens
gaaggaggaccaggugaug

SEQ ID NO: 323842 - RNA, 19 nt, Homo sapiens
gcucucaacgcaaggauug

SEQ ID NO: 323843 - RNA, 19 nt, Homo sapiens
gaguauggcaagacaguga

SEQ ID NO: 323844 - RNA, 19 nt, Homo sapiens
ugaaagugggcaaugagua

SEQ ID NO: 323845 - RNA, 19 nt, Homo sapiens
gaaagaagcuaccauauuu

SEQ ID NO: 323846 - RNA, 19 nt, Homo sapiens
gaagaaaggugcuaagaaa

SEQ ID NO: 323847 - RNA, 19 nt, Homo sapiens
gcacugagcuguucaaggu

SEQ ID NO: 323848 - RNA, 19 nt, Homo sapiens
ggacauugcuggcuuugaa

SEQ ID NO: 323849 - RNA, 19 nt, Homo sapiens
gagaaaguguccaucuaua

SEQ ID NO: 323850 - RNA, 19 nt, Homo sapiens
gcagauagcuuggcugaug

SEQ ID NO: 323851 - RNA, 19 nt, Homo sapiens
gaccaagucuucccuauga

SEQ ID NO: 323852 - RNA, 19 nt, Homo sapiens
ggacuugguagauaaauua

SEQ ID NO: 323853 - RNA, 19 nt, Homo sapiens
ggaaagaagcuaccauauu

SEQ ID NO: 323854 - RNA, 19 nt, Homo sapiens
gcacagaagucgcugacaa

SEQ ID NO: 323855 - RNA, 19 nt, Homo sapiens
ggaaggagaucugaaugaa

SEQ ID NO: 323856 - RNA, 19 nt, Homo sapiens
ugagcaagcuguagaaauu

SEQ ID NO: 323857 - RNA, 19 nt, Homo sapiens
cagaauaccagucucauua

SEQ ID NO: 323858 - RNA, 19 nt, Homo sapiens
cagaauccuuugcuaaaua

SEQ ID NO: 323859 - RNA, 19 nt, Homo sapiens
gcaagaagcugaggaacau

SEQ ID NO: 323860 - RNA, 19 nt, Homo sapiens
gaaaguguccaucuauaaa

SEQ ID NO: 323861 - RNA, 19 nt, Homo sapiens
gaagccagaucuaauugaa

SEQ ID NO: 323862 - RNA, 19 nt, Homo sapiens
gaaagacugugaacaccaa

SEQ ID NO: 323863 - RNA, 19 nt, Homo sapiens
caagagaaaugugaaauuc

SEQ ID NO: 323864 - RNA, 19 nt, Homo sapiens
gcaaguagaacaagagaaa

SEQ ID NO: 323865 - RNA, 19 nt, Homo sapiens
ggaagaagcagauccagaa

SEQ ID NO: 323866 - RNA, 19 nt, Homo sapiens
ggaccuggcugccugcauu

SEQ ID NO: 323867 - RNA, 19 nt, Homo sapiens
gcuggcaucugcugauaua

SEQ ID NO: 323868 - RNA, 19 nt, Homo sapiens
agaagaagaucaaagaguu

SEQ ID NO: 323869 - RNA, 19 nt, Homo sapiens
gaucacaguucccaguauu

SEQ ID NO: 323870 - RNA, 19 nt, Homo sapiens
ugaagaagaucgcaagaau

SEQ ID NO: 323871 - RNA, 19 nt, Homo sapiens
gaaauucaacuacagaaga

SEQ ID NO: 323872 - RNA, 19 nt, Homo sapiens
gaaagacauugaugaccuu

SEQ ID NO: 323873 - RNA, 19 nt, Homo sapiens
ucaaagaggugacugaaag

SEQ ID NO: 323874 - RNA, 19 nt, Homo sapiens
gaggaacaauccaaugcua

SEQ ID NO: 323875 - RNA, 19 nt, Homo sapiens
gugcagcccuugauaagaa

SEQ ID NO: 323876 - RNA, 19 nt, Homo sapiens
ggaaggagcuagaggaaaa

SEQ ID NO: 323877 - RNA, 19 nt, Homo sapiens
cagaagauguugcaaagga

SEQ ID NO: 323878 - RNA, 19 nt, Homo sapiens
gaaaguaaccguaaagacu

SEQ ID NO: 323879 - RNA, 19 nt, Homo sapiens
gaagagaaaccacacuaga

SEQ ID NO: 323880 - RNA, 19 nt, Homo sapiens
gaggaaagcaaauucauga

SEQ ID NO: 323881 - RNA, 19 nt, Homo sapiens
gaagguggagcaacucuaa

SEQ ID NO: 323882 - RNA, 19 nt, Homo sapiens
gccgagagguucacacaaa

SEQ ID NO: 323883 - RNA, 19 nt, Homo sapiens
gaaccaugccaaucgcuua

SEQ ID NO: 323884 - RNA, 19 nt, Homo sapiens
uaucagaucacuuccaaua

SEQ ID NO: 323885 - RNA, 19 nt, Homo sapiens
gaagagcacuauacaaagc

SEQ ID NO: 323886 - RNA, 19 nt, Homo sapiens
gaaauugaccagcugaaga

SEQ ID NO: 323887 - RNA, 19 nt, Homo sapiens
gaacaagagaaaugugaaa

SEQ ID NO: 323888 - RNA, 19 nt, Homo sapiens
gaacacaagcugucuguag

SEQ ID NO: 323889 - RNA, 19 nt, Homo sapiens
gugaagagcacuauacaaa

SEQ ID NO: 323890 - RNA, 19 nt, Homo sapiens
aggcgaaggugaaaucaua

SEQ ID NO: 323891 - RNA, 19 nt, Homo sapiens
gaagaucgcaagaauguuc

SEQ ID NO: 323892 - RNA, 19 nt, Homo sapiens
gcagaauccuuugcuaaau

SEQ ID NO: 323893 - RNA, 19 nt, Homo sapiens
gagauuagaagcagaaaug

SEQ ID NO: 323894 - RNA, 19 nt, Homo sapiens
guauccagcuugaguuaaa

SEQ ID NO: 323895 - RNA, 19 nt, Homo sapiens
gaaggcauccgcaucugua

SEQ ID NO: 323896 - RNA, 19 nt, Homo sapiens
uugaagagcugaaacauca

SEQ ID NO: 323897 - RNA, 19 nt, Homo sapiens
gacagaagcgggugaauau

SEQ ID NO: 323898 - RNA, 19 nt, Homo sapiens
gaagaaaugagagaugaaa

SEQ ID NO: 323899 - RNA, 19 nt, Homo sapiens
gagagaagaagaaggauga

SEQ ID NO: 323900 - RNA, 19 nt, Homo sapiens
ccaagcgugucauccaaua

SEQ ID NO: 323901 - RNA, 19 nt, Homo sapiens
ccaaagccgucuacgagaa

SEQ ID NO: 323902 - RNA, 19 nt, Homo sapiens
ccaauacuuugcaacaauu

SEQ ID NO: 323903 - RNA, 19 nt, Homo sapiens
ccaagaaggccaucacuga

SEQ ID NO: 323904 - RNA, 19 nt, Homo sapiens
uaaaccaagucaagucuga

SEQ ID NO: 323905 - RNA, 19 nt, Homo sapiens
gggagcagauugacaacuu

SEQ ID NO: 323906 - RNA, 19 nt, Homo sapiens
ucgaauggaucuagaaaga

SEQ ID NO: 323907 - RNA, 19 nt, Homo sapiens
uaagaagccagaucuaauu

SEQ ID NO: 323908 - RNA, 19 nt, Homo sapiens
acaaguggcugccggugua

SEQ ID NO: 323909 - RNA, 19 nt, Homo sapiens
caaagaaggagggaaagua

SEQ ID NO: 323910 - RNA, 19 nt, Homo sapiens
ucaagaggcugaagaaagg

SEQ ID NO: 323911 - RNA, 19 nt, Homo sapiens
aaggagaucugaaugaaau

SEQ ID NO: 323912 - RNA, 19 nt, Homo sapiens
agagugagcugaagaugga

SEQ ID NO: 323913 - RNA, 19 nt, Homo sapiens
ggugguggcugccuacaga

SEQ ID NO: 323914 - RNA, 19 nt, Homo sapiens
cagaggcuguuaaagguuu

SEQ ID NO: 323915 - RNA, 19 nt, Homo sapiens
gaagaaguaauccaagaau

SEQ ID NO: 323916 - RNA, 19 nt, Homo sapiens
ggaagaaguaauccaagaa

SEQ ID NO: 323917 - RNA, 19 nt, Homo sapiens
gaaggagaucugaaugaaa

SEQ ID NO: 323918 - RNA, 19 nt, Homo sapiens
gcugaaacaucaacuagag

SEQ ID NO: 323919 - RNA, 19 nt, Homo sapiens
gcuuuagucucucagcuuu

SEQ ID NO: 323920 - RNA, 19 nt, Homo sapiens
gaaacuucuugcaucuauu

SEQ ID NO: 323921 - RNA, 19 nt, Homo sapiens
caacuucaccaacgagaaa

SEQ ID NO: 323922 - RNA, 19 nt, Homo sapiens
ugacaacuccucucgcuuu

SEQ ID NO: 323923 - RNA, 19 nt, Homo sapiens
gagggaaaguaaccguaaa

SEQ ID NO: 323924 - RNA, 19 nt, Homo sapiens
cugaggagcugaagaagga

SEQ ID NO: 323925 - RNA, 19 nt, Homo sapiens
aaggaaagauucugcguau

SEQ ID NO: 323926 - RNA, 19 nt, Homo sapiens
aggcaucucuugaacauga

SEQ ID NO: 323927 - RNA, 19 nt, Homo sapiens
gaagaaugucuaugaggaa

SEQ ID NO: 323928 - RNA, 19 nt, Homo sapiens
cagaauggaagcagaagua

SEQ ID NO: 323929 - RNA, 19 nt, Homo sapiens
caaaugugcuucccuugag

SEQ ID NO: 323930 - RNA, 19 nt, Homo sapiens
gaucaaugcugagcugaca

SEQ ID NO: 323931 - RNA, 19 nt, Homo sapiens
ggaaaggugugagcaacug

SEQ ID NO: 323932 - RNA, 19 nt, Homo sapiens
gguagaauaucagaagaug

SEQ ID NO: 323933 - RNA, 19 nt, Homo sapiens
ucagaucacuuccaauaag

SEQ ID NO: 323934 - RNA, 19 nt, Homo sapiens
gcggaaagaagcuaccaua

SEQ ID NO: 323935 - RNA, 19 nt, Homo sapiens
gacaaugccuaucaguuca

SEQ ID NO: 323936 - RNA, 19 nt, Homo sapiens
cuaugaacccuccgaaaua

SEQ ID NO: 323937 - RNA, 19 nt, Homo sapiens
gaagaagaucgcaagaaug

SEQ ID NO: 323938 - RNA, 19 nt, Homo sapiens
gaucaacucgaaacgcuaa

SEQ ID NO: 323939 - RNA, 19 nt, Homo sapiens
aacagaagcuggagaagga

SEQ ID NO: 323940 - RNA, 19 nt, Homo sapiens
gaagaagaucaaagaguug

SEQ ID NO: 323941 - RNA, 19 nt, Homo sapiens
ggagggaaaguaaccguaa

SEQ ID NO: 323942 - RNA, 19 nt, Homo sapiens
gcagauagcagcgcgaaga

SEQ ID NO: 323943 - RNA, 19 nt, Homo sapiens
ggugaaaucauacaagaga

SEQ ID NO: 323944 - RNA, 19 nt, Homo sapiens
aaagaaggagggaaaguaa

SEQ ID NO: 323945 - RNA, 19 nt, Homo sapiens
gaaacaaacucucaaauca

SEQ ID NO: 323946 - RNA, 19 nt, Homo sapiens
gaagucagcucccuaaaga

SEQ ID NO: 323947 - RNA, 19 nt, Homo sapiens
gcacagagcuggccgacaa

SEQ ID NO: 323948 - RNA, 19 nt, Homo sapiens
ggaagaagcuggagaugga

SEQ ID NO: 323949 - RNA, 19 nt, Homo sapiens
ggccaaaccugccgaauaa

SEQ ID NO: 323950 - RNA, 19 nt, Homo sapiens
gagccaacauugagacuua

SEQ ID NO: 323951 - RNA, 19 nt, Homo sapiens
ccaagaaggucauccagua

SEQ ID NO: 323952 - RNA, 19 nt, Homo sapiens
gaacggaccuuccacaucu

SEQ ID NO: 323953 - RNA, 19 nt, Homo sapiens
ggaagaaggugaaggugaa

SEQ ID NO: 323954 - RNA, 19 nt, Homo sapiens
gaagaccgaucuccuguug

SEQ ID NO: 323955 - RNA, 19 nt, Homo sapiens
ccacugagcaucacaauaa

SEQ ID NO: 323956 - RNA, 19 nt, Homo sapiens
gaacauggcccucaagaag

SEQ ID NO: 323957 - RNA, 19 nt, Homo sapiens
gagcagcugugcaucaauu

SEQ ID NO: 323958 - RNA, 19 nt, Homo sapiens
cuacaaagcucugaauuca

SEQ ID NO: 323959 - RNA, 19 nt, Homo sapiens
agaagaagcugaaggaugu

SEQ ID NO: 323960 - RNA, 19 nt, Homo sapiens
caaaggagcccuggcguua

SEQ ID NO: 323961 - RNA, 19 nt, Homo sapiens
gaccaucucugccaaguau

SEQ ID NO: 323962 - RNA, 19 nt, Homo sapiens
gaacaagcaugaggcaaug

SEQ ID NO: 323963 - RNA, 19 nt, Homo sapiens
ccaagaccgugaagaauga

SEQ ID NO: 323964 - RNA, 19 nt, Homo sapiens
ccaagcagcugaaggacaa

SEQ ID NO: 323965 - RNA, 19 nt, Homo sapiens
acaagaaccugcccaucua

SEQ ID NO: 323966 - RNA, 19 nt, Homo sapiens
agaagaagaugcagcagaa

SEQ ID NO: 323967 - RNA, 19 nt, Homo sapiens
gaucaccgacgucaucaua

SEQ ID NO: 323968 - RNA, 19 nt, Homo sapiens
ggaaacaaacucucaaauc

SEQ ID NO: 323969 - RNA, 19 nt, Homo sapiens
ccaaagagaacgagaagaa

SEQ ID NO: 323970 - RNA, 19 nt, Homo sapiens
ccaccaaccucacagaaga

SEQ ID NO: 323971 - RNA, 19 nt, Homo sapiens
caacaaggcucuggacaag

SEQ ID NO: 323972 - RNA, 19 nt, Homo sapiens
acacggagcugaucaacga

SEQ ID NO: 323973 - RNA, 19 nt, Homo sapiens
acaaggagcuuaaggucaa

SEQ ID NO: 323974 - RNA, 19 nt, Homo sapiens
agaggaagcuccagaagga

SEQ ID NO: 323975 - RNA, 19 nt, Homo sapiens
ccagcaagcucaccaagga

SEQ ID NO: 323976 - RNA, 19 nt, Homo sapiens
uagaagagaucugccauga

SEQ ID NO: 323977 - RNA, 19 nt, Homo sapiens
ccaguccucugacaaguuu

SEQ ID NO: 323978 - RNA, 19 nt, Homo sapiens
gaacauggauccccugaau

SEQ ID NO: 323979 - RNA, 19 nt, Homo sapiens
gaucuugugucuacucuag

SEQ ID NO: 323980 - RNA, 19 nt, Homo sapiens
ccaagaagcaggaauuaga

SEQ ID NO: 323981 - RNA, 19 nt, Homo sapiens
gaagaucaccgacgucauc

SEQ ID NO: 323982 - RNA, 19 nt, Homo sapiens
guaucaaugugaccgauuu

SEQ ID NO: 323983 - RNA, 19 nt, Homo sapiens
agaagaagcugaagagcau

SEQ ID NO: 323984 - RNA, 19 nt, Homo sapiens
gacaggagcuggagaagac

SEQ ID NO: 323985 - RNA, 19 nt, Homo sapiens
agaagaagcagaagaaguu

SEQ ID NO: 323986 - RNA, 19 nt, Homo sapiens
ggaauaaagcugagaagca

SEQ ID NO: 323987 - RNA, 19 nt, Homo sapiens
aaagcugauuucugcauua

SEQ ID NO: 323988 - RNA, 19 nt, Homo sapiens
caaagcugauuucugcauu

SEQ ID NO: 323989 - RNA, 19 nt, Homo sapiens
cgacugggcugccaagaag

SEQ ID NO: 323990 - RNA, 19 nt, Homo sapiens
ggaggaacgccgagcagua

SEQ ID NO: 323991 - RNA, 19 nt, Homo sapiens
cugaagagauuguggaaau

SEQ ID NO: 323992 - RNA, 19 nt, Homo sapiens
caacacagcugcccaaaag

SEQ ID NO: 323993 - RNA, 19 nt, Homo sapiens
caaggagcguuacuacuca

SEQ ID NO: 323994 - RNA, 19 nt, Homo sapiens
ggucaucaauccuuacaag

SEQ ID NO: 323995 - RNA, 19 nt, Homo sapiens
ucacugccuuuguuuagaa

SEQ ID NO: 323996 - RNA, 19 nt, Homo sapiens
gcaagcugccgauaaguau

SEQ ID NO: 323997 - RNA, 19 nt, Homo sapiens
cgaagcgggugaaagcaaa

SEQ ID NO: 323998 - RNA, 19 nt, Homo sapiens
ucucugaacuccaggaaga

SEQ ID NO: 323999 - RNA, 19 nt, Homo sapiens
gggcucaucuacaccuauu

SEQ ID NO: 324000 - RNA, 19 nt, Homo sapiens
ggacgaagccaucaaacag

SEQ ID NO: 324001 - RNA, 19 nt, Homo sapiens
agaagcagcuggucagaca

SEQ ID NO: 324002 - RNA, 19 nt, Homo sapiens
gcucauggcagagaaauug

SEQ ID NO: 324003 - RNA, 19 nt, Homo sapiens
acgaguggcugaugaagaa

SEQ ID NO: 324004 - RNA, 19 nt, Homo sapiens
gcaaauucauucgcaucaa

SEQ ID NO: 324005 - RNA, 19 nt, Homo sapiens
ucacaucuaugccaucaca

SEQ ID NO: 324006 - RNA, 19 nt, Homo sapiens
aacaaacucucaaaucaug

SEQ ID NO: 324007 - RNA, 19 nt, Homo sapiens
aaugaucacugacuuggaa

SEQ ID NO: 324008 - RNA, 19 nt, Homo sapiens
ucgccaagcucaagaacaa

SEQ ID NO: 324009 - RNA, 19 nt, Homo sapiens
agaaggagcggaacacuga

SEQ ID NO: 324010 - RNA, 19 nt, Homo sapiens
ucacuggucuacacugguu

SEQ ID NO: 324011 - RNA, 19 nt, Homo sapiens
ugagauggauggacagaca

SEQ ID NO: 324012 - RNA, 19 nt, Homo sapiens
ccagguggccgacaugaaa

SEQ ID NO: 324013 - RNA, 19 nt, Homo sapiens
gaaagcaaaccucgagaag

SEQ ID NO: 324014 - RNA, 19 nt, Homo sapiens
caagaagcaggaauuagaa

SEQ ID NO: 324015 - RNA, 19 nt, Homo sapiens
ucaauuacaccaaugagaa

SEQ ID NO: 324016 - RNA, 19 nt, Homo sapiens
gcaagaagaggcacgagau

SEQ ID NO: 324017 - RNA, 19 nt, Homo sapiens
gagcaucacaauaaagaga

SEQ ID NO: 324018 - RNA, 19 nt, Homo sapiens
uaaaaugucucaagugcaa

SEQ ID NO: 324019 - RNA, 19 nt, Homo sapiens
ggagauggaggaccuuaug

SEQ ID NO: 324020 - RNA, 19 nt, Homo sapiens
agaggaagcugcccagaag

SEQ ID NO: 324021 - RNA, 19 nt, Homo sapiens
agaugcagcuggccaagaa

SEQ ID NO: 324022 - RNA, 19 nt, Homo sapiens
aaaagaaacugcuggaaga

SEQ ID NO: 324023 - RNA, 19 nt, Homo sapiens
gagcgagaccugaagauca

SEQ ID NO: 324024 - RNA, 19 nt, Homo sapiens
caagguggauuacaaagcu

SEQ ID NO: 324025 - RNA, 19 nt, Homo sapiens
uaaagagaaccaugugcua

SEQ ID NO: 324026 - RNA, 19 nt, Homo sapiens
gcacugucaaguccaagua

SEQ ID NO: 324027 - RNA, 19 nt, Homo sapiens
caacagcagcggcaaagga

SEQ ID NO: 324028 - RNA, 19 nt, Homo sapiens
gaagaggaggagaaaucua

SEQ ID NO: 324029 - RNA, 19 nt, Homo sapiens
gaucugccaugaccuagag

SEQ ID NO: 324030 - RNA, 19 nt, Homo sapiens
cuaaagagcaggcugacuu

SEQ ID NO: 324031 - RNA, 19 nt, Homo sapiens
gaagagauuguggaaaugu

SEQ ID NO: 324032 - RNA, 19 nt, Homo sapiens
gaagaagcagaagaaguuu

SEQ ID NO: 324033 - RNA, 19 nt, Homo sapiens
gaggugaacauccugaaga

SEQ ID NO: 324034 - RNA, 19 nt, Homo sapiens
uaaaggaaacaaacucuca

SEQ ID NO: 324035 - RNA, 19 nt, Homo sapiens
cuacacugguugccgaauu

SEQ ID NO: 324036 - RNA, 19 nt, Homo sapiens
gugaacauccugaagaaga

SEQ ID NO: 324037 - RNA, 19 nt, Homo sapiens
gugcaucaauuacaccaau

SEQ ID NO: 324038 - RNA, 19 nt, Homo sapiens
ccuuccacaucuucuauua

SEQ ID NO: 324039 - RNA, 19 nt, Homo sapiens
cgugcaaccuggagaagaa

SEQ ID NO: 324040 - RNA, 19 nt, Homo sapiens
gcugacgaguggcugauga

SEQ ID NO: 324041 - RNA, 19 nt, Homo sapiens
gaaggacaaagcugauuuc

SEQ ID NO: 324042 - RNA, 19 nt, Homo sapiens
gcgagggcaucgaguggaa

SEQ ID NO: 324043 - RNA, 19 nt, Homo sapiens
agaccgaucuccuguugga

SEQ ID NO: 324044 - RNA, 19 nt, Homo sapiens
cugaggaggugaagaggaa

SEQ ID NO: 324045 - RNA, 19 nt, Homo sapiens
uaacacagcugcucagaaa

SEQ ID NO: 324046 - RNA, 19 nt, Homo sapiens
ggacagagcugaggcagaa

SEQ ID NO: 324047 - RNA, 19 nt, Homo sapiens
ccaagaaggucauucagua

SEQ ID NO: 324048 - RNA, 19 nt, Homo sapiens
gcaacgagcuggccacaga

SEQ ID NO: 324049 - RNA, 19 nt, Homo sapiens
ucaagaaacuggaggauga

SEQ ID NO: 324050 - RNA, 19 nt, Homo sapiens
gcaauucuguuuacaugaa

SEQ ID NO: 324051 - RNA, 19 nt, Homo sapiens
ggagaggauuagugacuua

SEQ ID NO: 324052 - RNA, 19 nt, Homo sapiens
gagcagcuauccauauuga

SEQ ID NO: 324053 - RNA, 19 nt, Homo sapiens
ggauauagcuggauuugag

SEQ ID NO: 324054 - RNA, 19 nt, Homo sapiens
ggacguagaguuauugaaa

SEQ ID NO: 324055 - RNA, 19 nt, Homo sapiens
acaagaagcugaaggaaau

SEQ ID NO: 324056 - RNA, 19 nt, Homo sapiens
aaacaucucuuccaaauac

SEQ ID NO: 324057 - RNA, 19 nt, Homo sapiens
gaggaaauuugaucaguug

SEQ ID NO: 324058 - RNA, 19 nt, Homo sapiens
ccaagucgcugaagcagaa

SEQ ID NO: 324059 - RNA, 19 nt, Homo sapiens
agagacagcuucacgagua

SEQ ID NO: 324060 - RNA, 19 nt, Homo sapiens
gaugagaaguuccucuuug

SEQ ID NO: 324061 - RNA, 19 nt, Homo sapiens
gcucaaagccgaaauggaa

SEQ ID NO: 324062 - RNA, 19 nt, Homo sapiens
caacgaagccuccgugcua

SEQ ID NO: 324063 - RNA, 19 nt, Homo sapiens
gaaccaaggccagugaaua

SEQ ID NO: 324064 - RNA, 19 nt, Homo sapiens
uuaaggagcuggaacagaa

SEQ ID NO: 324065 - RNA, 19 nt, Homo sapiens
gggcggagcucaaugacaa

SEQ ID NO: 324066 - RNA, 19 nt, Homo sapiens
gaacaaagcccuggacaag

SEQ ID NO: 324067 - RNA, 19 nt, Homo sapiens
gaagaacaaugcccugaag

SEQ ID NO: 324068 - RNA, 19 nt, Homo sapiens
ccaaagagaaugagaagaa

SEQ ID NO: 324069 - RNA, 19 nt, Homo sapiens
caggaaugcugcacuguuu

SEQ ID NO: 324070 - RNA, 19 nt, Homo sapiens
ccaagcagcucaaggacaa

SEQ ID NO: 324071 - RNA, 19 nt, Homo sapiens
ugagagggcucgcaaacaa

SEQ ID NO: 324072 - RNA, 19 nt, Homo sapiens
caaagagaaugagaagaaa

SEQ ID NO: 324073 - RNA, 19 nt, Homo sapiens
agaagaagcugcaggacuu

SEQ ID NO: 324074 - RNA, 19 nt, Homo sapiens
ccauuaagcuggccaagga

SEQ ID NO: 324075 - RNA, 19 nt, Homo sapiens
gaucaaagcccuggaacuu

SEQ ID NO: 324076 - RNA, 19 nt, Homo sapiens
gagccaacauugagaccua

SEQ ID NO: 324077 - RNA, 19 nt, Homo sapiens
gagcuauaauugcaucauu

SEQ ID NO: 324078 - RNA, 19 nt, Homo sapiens
cagaggagcuggccaguag

SEQ ID NO: 324079 - RNA, 19 nt, Homo sapiens
cagagcagcuugagcaguu

SEQ ID NO: 324080 - RNA, 19 nt, Homo sapiens
gaagaaggcccuggaugaa

SEQ ID NO: 324081 - RNA, 19 nt, Homo sapiens
gcacggcccagaagaauga

SEQ ID NO: 324082 - RNA, 19 nt, Homo sapiens
gcaagaaagacacaaguau

SEQ ID NO: 324083 - RNA, 19 nt, Homo sapiens
aaacaagcaugaaucuaug

SEQ ID NO: 324084 - RNA, 19 nt, Homo sapiens
ggaggcaacugcagagaca

SEQ ID NO: 324085 - RNA, 19 nt, Homo sapiens
ucacagggaugcuuaacga

SEQ ID NO: 324086 - RNA, 19 nt, Homo sapiens
gaagauggcccagcagaug

SEQ ID NO: 324087 - RNA, 19 nt, Homo sapiens
ggaauuaaugugacagauu

SEQ ID NO: 324088 - RNA, 19 nt, Homo sapiens
gggagaaagucaccgaaau

SEQ ID NO: 324089 - RNA, 19 nt, Homo sapiens
gaugaaaucgcucagaaga

SEQ ID NO: 324090 - RNA, 19 nt, Homo sapiens
gagaggacauuccacaucu

SEQ ID NO: 324091 - RNA, 19 nt, Homo sapiens
cugcaaaccuuuccaacuu

SEQ ID NO: 324092 - RNA, 19 nt, Homo sapiens
ggagaaagucaccgaaaug

SEQ ID NO: 324093 - RNA, 19 nt, Homo sapiens
cugggaagguggacuauaa

SEQ ID NO: 324094 - RNA, 19 nt, Homo sapiens
gaacuggaagugcggcuaa

SEQ ID NO: 324095 - RNA, 19 nt, Homo sapiens
auaaacaccugcccaucua

SEQ ID NO: 324096 - RNA, 19 nt, Homo sapiens
caacaacaacccagaacaa

SEQ ID NO: 324097 - RNA, 19 nt, Homo sapiens
gcaggaggccagagagaaa

SEQ ID NO: 324098 - RNA, 19 nt, Homo sapiens
uccacaagcugcagaauga

SEQ ID NO: 324099 - RNA, 19 nt, Homo sapiens
guacuucucagggcuaaua

SEQ ID NO: 324100 - RNA, 19 nt, Homo sapiens
ccaguucuaucaauggauu

SEQ ID NO: 324101 - RNA, 19 nt, Homo sapiens
gcaagauggccgagcagua

SEQ ID NO: 324102 - RNA, 19 nt, Homo sapiens
gacaagaagcugaaggaaa

SEQ ID NO: 324103 - RNA, 19 nt, Homo sapiens
ugaagaaggcccuggauga

SEQ ID NO: 324104 - RNA, 19 nt, Homo sapiens
gagcgagauuugaagauca

SEQ ID NO: 324105 - RNA, 19 nt, Homo sapiens
ugacagauuucaccagauc

SEQ ID NO: 324106 - RNA, 19 nt, Homo sapiens
acaaugcccugaagaagau

SEQ ID NO: 324107 - RNA, 19 nt, Homo sapiens
uggaugaucagaacaauaa

SEQ ID NO: 324108 - RNA, 19 nt, Homo sapiens
gaggagauacugcaugaga

SEQ ID NO: 324109 - RNA, 19 nt, Homo sapiens
gugccuggcugaccaagaa

SEQ ID NO: 324110 - RNA, 19 nt, Homo sapiens
gaaggucacgguugggaaa

SEQ ID NO: 324111 - RNA, 19 nt, Homo sapiens
cgacaacuccucacgauuc

SEQ ID NO: 324112 - RNA, 19 nt, Homo sapiens
cgaccugguuguugauuug

SEQ ID NO: 324113 - RNA, 19 nt, Homo sapiens
agaaggcccuggaugaaga

SEQ ID NO: 324114 - RNA, 19 nt, Homo sapiens
gaacaaugcccugaagaag

SEQ ID NO: 324115 - RNA, 19 nt, Homo sapiens
ccucaucuauacaagaauu

SEQ ID NO: 324116 - RNA, 19 nt, Homo sapiens
ucgcagagcucaagaugca

SEQ ID NO: 324117 - RNA, 19 nt, Homo sapiens
ccaaggagcggcagcagaa

SEQ ID NO: 324118 - RNA, 19 nt, Homo sapiens
ggagcgagauuugaagauc

SEQ ID NO: 324119 - RNA, 19 nt, Homo sapiens
ggcgagaugugguacagaa

SEQ ID NO: 324120 - RNA, 19 nt, Homo sapiens
ucucagggcuaauauauac

SEQ ID NO: 324121 - RNA, 19 nt, Homo sapiens
gauccgagcucgccaucca

SEQ ID NO: 324122 - RNA, 19 nt, Homo sapiens
gcaagaagaggcacgagau

SEQ ID NO: 324123 - RNA, 19 nt, Homo sapiens
cgucaggccuuugagaauu

SEQ ID NO: 324124 - RNA, 19 nt, Homo sapiens
aagcggaccucgagaagga

SEQ ID NO: 324125 - RNA, 19 nt, Homo sapiens
ugaaaucgcucagaagaac

SEQ ID NO: 324126 - RNA, 19 nt, Homo sapiens
agaugcagcuggccaagaa

SEQ ID NO: 324127 - RNA, 19 nt, Homo sapiens
ggacauuccacaucuuuua

SEQ ID NO: 324128 - RNA, 19 nt, Homo sapiens
gaggacauuccacaucuuu

SEQ ID NO: 324129 - RNA, 19 nt, Homo sapiens
gcaaauucauccgcaucaa

SEQ ID NO: 324130 - RNA, 19 nt, Homo sapiens
agcaggagguggaacauaa

SEQ ID NO: 324131 - RNA, 19 nt, Homo sapiens
uggaggagauacugcauga

SEQ ID NO: 324132 - RNA, 19 nt, Homo sapiens
guacagaaagcucagacaa

SEQ ID NO: 324133 - RNA, 19 nt, Homo sapiens
gaaaguuugccaccucaug

SEQ ID NO: 324134 - RNA, 19 nt, Homo sapiens
ggacuucgaggcugcaaug

SEQ ID NO: 324135 - RNA, 19 nt, Homo sapiens
ggaaauuugaucaguuguu

SEQ ID NO: 324136 - RNA, 19 nt, Homo sapiens
gaccagauggccaagauga

SEQ ID NO: 324137 - RNA, 19 nt, Homo sapiens
ugacuucccugcucaaugc

SEQ ID NO: 324138 - RNA, 19 nt, Homo sapiens
gagcagcugugcaucaacu

SEQ ID NO: 324139 - RNA, 19 nt, Homo sapiens
ggagcucaaugacaaaguc

SEQ ID NO: 324140 - RNA, 19 nt, Homo sapiens
caagaaagacacaaguauc

SEQ ID NO: 324141 - RNA, 19 nt, Homo sapiens
aaccaaggccagugaauaa

SEQ ID NO: 324142 - RNA, 19 nt, Homo sapiens
gcagaagggccaacucagu

SEQ ID NO: 324143 - RNA, 19 nt, Homo sapiens
gacgcagacuucaauggaa

SEQ ID NO: 324144 - RNA, 19 nt, Homo sapiens
gaggugaacgcacucaaga

SEQ ID NO: 324145 - RNA, 19 nt, Homo sapiens
uaacacagcugcucagaaa

SEQ ID NO: 324146 - RNA, 19 nt, Homo sapiens
ggacagagcugaggcagaa

SEQ ID NO: 324147 - RNA, 19 nt, Homo sapiens
ccaagaaggucauucagua

SEQ ID NO: 324148 - RNA, 19 nt, Homo sapiens
gcaacgagcuggccacaga

SEQ ID NO: 324149 - RNA, 19 nt, Homo sapiens
ucaagaaacuggaggauga

SEQ ID NO: 324150 - RNA, 19 nt, Homo sapiens
gcaauucuguuuacaugaa

SEQ ID NO: 324151 - RNA, 19 nt, Homo sapiens
ggagaggauuagugacuua

SEQ ID NO: 324152 - RNA, 19 nt, Homo sapiens
gagcagcuauccauauuga

SEQ ID NO: 324153 - RNA, 19 nt, Homo sapiens
ggauauagcuggauuugag

SEQ ID NO: 324154 - RNA, 19 nt, Homo sapiens
ggacguagaguuauugaaa

SEQ ID NO: 324155 - RNA, 19 nt, Homo sapiens
acaagaagcugaaggaaau

SEQ ID NO: 324156 - RNA, 19 nt, Homo sapiens
aaacaucucuuccaaauac

SEQ ID NO: 324157 - RNA, 19 nt, Homo sapiens
gaggaaauuugaucaguug

SEQ ID NO: 324158 - RNA, 19 nt, Homo sapiens
ccaagucgcugaagcagaa

SEQ ID NO: 324159 - RNA, 19 nt, Homo sapiens
agagacagcuucacgagua

SEQ ID NO: 324160 - RNA, 19 nt, Homo sapiens
gaugagaaguuccucuuug

SEQ ID NO: 324161 - RNA, 19 nt, Homo sapiens
gcucaaagccgaaauggaa

SEQ ID NO: 324162 - RNA, 19 nt, Homo sapiens
caacgaagccuccgugcua

SEQ ID NO: 324163 - RNA, 19 nt, Homo sapiens
gaaccaaggccagugaaua

SEQ ID NO: 324164 - RNA, 19 nt, Homo sapiens
uuaaggagcuggaacagaa

SEQ ID NO: 324165 - RNA, 19 nt, Homo sapiens
gggcggagcucaaugacaa

SEQ ID NO: 324166 - RNA, 19 nt, Homo sapiens
gaacaaagcccuggacaag

SEQ ID NO: 324167 - RNA, 19 nt, Homo sapiens
gaagaacaaugcccugaag

SEQ ID NO: 324168 - RNA, 19 nt, Homo sapiens
ccaaagagaaugagaagaa

SEQ ID NO: 324169 - RNA, 19 nt, Homo sapiens
caggaaugcugcacuguuu

SEQ ID NO: 324170 - RNA, 19 nt, Homo sapiens
ccaagcagcucaaggacaa

SEQ ID NO: 324171 - RNA, 19 nt, Homo sapiens
ugagagggcucgcaaacaa

SEQ ID NO: 324172 - RNA, 19 nt, Homo sapiens
caaagagaaugagaagaaa

SEQ ID NO: 324173 - RNA, 19 nt, Homo sapiens
agaagaagcugcaggacuu

SEQ ID NO: 324174 - RNA, 19 nt, Homo sapiens
ccauuaagcuggccaagga

SEQ ID NO: 324175 - RNA, 19 nt, Homo sapiens
gaucaaagcccuggaacuu

SEQ ID NO: 324176 - RNA, 19 nt, Homo sapiens
gagccaacauugagaccua

SEQ ID NO: 324177 - RNA, 19 nt, Homo sapiens
gagcuauaauugcaucauu

SEQ ID NO: 324178 - RNA, 19 nt, Homo sapiens
cagaggagcuggccaguag

SEQ ID NO: 324179 - RNA, 19 nt, Homo sapiens
cagagcagcuugagcaguu

SEQ ID NO: 324180 - RNA, 19 nt, Homo sapiens
gaagaaggcccuggaugaa

SEQ ID NO: 324181 - RNA, 19 nt, Homo sapiens
gcacggcccagaagaauga

SEQ ID NO: 324182 - RNA, 19 nt, Homo sapiens
gcaagaaagacacaaguau

SEQ ID NO: 324183 - RNA, 19 nt, Homo sapiens
aaacaagcaugaaucuaug

SEQ ID NO: 324184 - RNA, 19 nt, Homo sapiens
ggaggcaacugcagagaca

SEQ ID NO: 324185 - RNA, 19 nt, Homo sapiens
ucacagggaugcuuaacga

SEQ ID NO: 324186 - RNA, 19 nt, Homo sapiens
gaagauggcccagcagaug

SEQ ID NO: 324187 - RNA, 19 nt, Homo sapiens
ggaauuaaugugacagauu

SEQ ID NO: 324188 - RNA, 19 nt, Homo sapiens
gggagaaagucaccgaaau

SEQ ID NO: 324189 - RNA, 19 nt, Homo sapiens
gaugaaaucgcucagaaga

SEQ ID NO: 324190 - RNA, 19 nt, Homo sapiens
gagaggacauuccacaucu

SEQ ID NO: 324191 - RNA, 19 nt, Homo sapiens
cugcaaaccuuuccaacuu

SEQ ID NO: 324192 - RNA, 19 nt, Homo sapiens
ggagaaagucaccgaaaug

SEQ ID NO: 324193 - RNA, 19 nt, Homo sapiens
cugggaagguggacuauaa

SEQ ID NO: 324194 - RNA, 19 nt, Homo sapiens
gaacuggaagugcggcuaa

SEQ ID NO: 324195 - RNA, 19 nt, Homo sapiens
auaaacaccugcccaucua

SEQ ID NO: 324196 - RNA, 19 nt, Homo sapiens
caacaacaacccagaacaa

SEQ ID NO: 324197 - RNA, 19 nt, Homo sapiens
gcaggaggccagagagaaa

SEQ ID NO: 324198 - RNA, 19 nt, Homo sapiens
uccacaagcugcagaauga

SEQ ID NO: 324199 - RNA, 19 nt, Homo sapiens
guacuucucagggcuaaua

SEQ ID NO: 324200 - RNA, 19 nt, Homo sapiens
ccaguucuaucaauggauu

SEQ ID NO: 324201 - RNA, 19 nt, Homo sapiens
gcaagauggccgagcagua

SEQ ID NO: 324202 - RNA, 19 nt, Homo sapiens
gacaagaagcugaaggaaa

SEQ ID NO: 324203 - RNA, 19 nt, Homo sapiens
ugaagaaggcccuggauga

SEQ ID NO: 324204 - RNA, 19 nt, Homo sapiens
gagcgagauuugaagauca

SEQ ID NO: 324205 - RNA, 19 nt, Homo sapiens
ugacagauuucaccagauc

SEQ ID NO: 324206 - RNA, 19 nt, Homo sapiens
acaaugcccugaagaagau

SEQ ID NO: 324207 - RNA, 19 nt, Homo sapiens
uggaugaucagaacaauaa

SEQ ID NO: 324208 - RNA, 19 nt, Homo sapiens
gaggagauacugcaugaga

SEQ ID NO: 324209 - RNA, 19 nt, Homo sapiens
gugccuggcugaccaagaa

SEQ ID NO: 324210 - RNA, 19 nt, Homo sapiens
gaaggucacgguugggaaa

SEQ ID NO: 324211 - RNA, 19 nt, Homo sapiens
cgacaacuccucacgauuc

SEQ ID NO: 324212 - RNA, 19 nt, Homo sapiens
cgaccugguuguugauuug

SEQ ID NO: 324213 - RNA, 19 nt, Homo sapiens
agaaggcccuggaugaaga

SEQ ID NO: 324214 - RNA, 19 nt, Homo sapiens
gaacaaugcccugaagaag

SEQ ID NO: 324215 - RNA, 19 nt, Homo sapiens
ccucaucuauacaagaauu

SEQ ID NO: 324216 - RNA, 19 nt, Homo sapiens
ucgcagagcucaagaugca

SEQ ID NO: 324217 - RNA, 19 nt, Homo sapiens
ccaaggagcggcagcagaa

SEQ ID NO: 324218 - RNA, 19 nt, Homo sapiens
ggagcgagauuugaagauc

SEQ ID NO: 324219 - RNA, 19 nt, Homo sapiens
ggcgagaugugguacagaa

SEQ ID NO: 324220 - RNA, 19 nt, Homo sapiens
ucucagggcuaauauauac

SEQ ID NO: 324221 - RNA, 19 nt, Homo sapiens
acaggaaacuucgcaguga

SEQ ID NO: 324222 - RNA, 19 nt, Homo sapiens
gauccgagcucgccaucca

SEQ ID NO: 324223 - RNA, 19 nt, Homo sapiens
gcaagaagaggcacgagau

SEQ ID NO: 324224 - RNA, 19 nt, Homo sapiens
cgucaggccuuugagaauu

SEQ ID NO: 324225 - RNA, 19 nt, Homo sapiens
aagcggaccucgagaagga

SEQ ID NO: 324226 - RNA, 19 nt, Homo sapiens
ugaaaucgcucagaagaac

SEQ ID NO: 324227 - RNA, 19 nt, Homo sapiens
agaugcagcuggccaagaa

SEQ ID NO: 324228 - RNA, 19 nt, Homo sapiens
ggacauuccacaucuuuua

SEQ ID NO: 324229 - RNA, 19 nt, Homo sapiens
gaggacauuccacaucuuu

SEQ ID NO: 324230 - RNA, 19 nt, Homo sapiens
gcaaauucauccgcaucaa

SEQ ID NO: 324231 - RNA, 19 nt, Homo sapiens
agcaggagguggaacauaa

SEQ ID NO: 324232 - RNA, 19 nt, Homo sapiens
uggaggagauacugcauga

SEQ ID NO: 324233 - RNA, 19 nt, Homo sapiens
guacagaaagcucagacaa

SEQ ID NO: 324234 - RNA, 19 nt, Homo sapiens
gaaaguuugccaccucaug

SEQ ID NO: 324235 - RNA, 19 nt, Homo sapiens
ggacuucgaggcugcaaug

SEQ ID NO: 324236 - RNA, 19 nt, Homo sapiens
ggaaauuugaucaguuguu

SEQ ID NO: 324237 - RNA, 19 nt, Homo sapiens
gaccagauggccaagauga

SEQ ID NO: 324238 - RNA, 19 nt, Homo sapiens
ugacuucccugcucaaugc

SEQ ID NO: 324239 - RNA, 19 nt, Homo sapiens
gagcagcugugcaucaacu

SEQ ID NO: 324240 - RNA, 19 nt, Homo sapiens
ggagcucaaugacaaaguc

SEQ ID NO: 324241 - RNA, 19 nt, Homo sapiens
caagaaagacacaaguauc

SEQ ID NO: 324242 - RNA, 19 nt, Homo sapiens
aaccaaggccagugaauaa

SEQ ID NO: 324243 - RNA, 19 nt, Homo sapiens
gcagaagggccaacucagu

SEQ ID NO: 324244 - RNA, 19 nt, Homo sapiens
gacgcagacuucaauggaa

SEQ ID NO: 324245 - RNA, 19 nt, Homo sapiens
caagcaccauucuuuauua

SEQ ID NO: 324246 - RNA, 19 nt, Homo sapiens
gaauggagcucucaagaac

SEQ ID NO: 324247 - RNA, 19 nt, Homo sapiens
caaagugucugcugcucua

SEQ ID NO: 324248 - RNA, 19 nt, Homo sapiens
aagacuggcuggaaacuua

SEQ ID NO: 324249 - RNA, 19 nt, Homo sapiens
gcacaaaucccaccaaugc

SEQ ID NO: 324250 - RNA, 19 nt, Homo sapiens
gaacaauuucugccuauga

SEQ ID NO: 324251 - RNA, 19 nt, Homo sapiens
gaaagaggaagaaguggaa

SEQ ID NO: 324252 - RNA, 19 nt, Homo sapiens
gcaccauucuuuauuaucu

SEQ ID NO: 324253 - RNA, 19 nt, Homo sapiens
caucaugucuaucugaaug

SEQ ID NO: 324254 - RNA, 19 nt, Homo sapiens
caaagaaagacgugaagaa

SEQ ID NO: 324255 - RNA, 19 nt, Homo sapiens
ccagaucuguuuaccauca

SEQ ID NO: 324256 - RNA, 19 nt, Homo sapiens
gaacaggugauuccaagau

SEQ ID NO: 324257 - RNA, 19 nt, Homo sapiens
gacaaacucuccagaucug

SEQ ID NO: 324258 - RNA, 19 nt, Homo sapiens
gaugaaagaggaagaagug

SEQ ID NO: 324259 - RNA, 19 nt, Homo sapiens
ucaggaaaguucugggaaa

SEQ ID NO: 324260 - RNA, 19 nt, Homo sapiens
ggccaccuaugaagacuuu

SEQ ID NO: 324261 - RNA, 19 nt, Homo sapiens
aaagaaagacgugaagaaa

SEQ ID NO: 324262 - RNA, 19 nt, Homo sapiens
ccaagaaaauugaguuuga

SEQ ID NO: 324263 - RNA, 19 nt, Homo sapiens
uaggaagacuggcuggaaa

SEQ ID NO: 324264 - RNA, 19 nt, Homo sapiens
gcagaggucaggaaaguuc

SEQ ID NO: 324265 - RNA, 19 nt, Homo sapiens
ccaagcaccauucuuuauu

SEQ ID NO: 324266 - RNA, 19 nt, Homo sapiens
gggcacaaaucccaccaau

SEQ ID NO: 324267 - RNA, 19 nt, Homo sapiens
ggaccaggccaccuaugaa

SEQ ID NO: 324268 - RNA, 19 nt, Homo sapiens
cuaaggaacagcaggauga

SEQ ID NO: 324269 - RNA, 19 nt, Homo sapiens
aauccaagcaccauucuuu

SEQ ID NO: 324270 - RNA, 19 nt, Homo sapiens
ccaggucggugauguccuu

SEQ ID NO: 324271 - RNA, 19 nt, Homo sapiens
gcaaugaagagcugaaugc

SEQ ID NO: 324272 - RNA, 19 nt, Homo sapiens
gauggcaggucaagaagac

SEQ ID NO: 324273 - RNA, 19 nt, Homo sapiens
caagcauuguuuaggaaga

SEQ ID NO: 324274 - RNA, 19 nt, Homo sapiens
ugaauggagcucucaagaa

SEQ ID NO: 324275 - RNA, 19 nt, Homo sapiens
gugcugaacuccgccaugu

SEQ ID NO: 324276 - RNA, 19 nt, Homo sapiens
ggaacagcaggaugaauuc

SEQ ID NO: 324277 - RNA, 19 nt, Homo sapiens
acacugggcuguggaucaa

SEQ ID NO: 324278 - RNA, 19 nt, Homo sapiens
ccauuaagaucgaguucuc

SEQ ID NO: 324279 - RNA, 19 nt, Homo sapiens
ugaccucucugccauuaag

SEQ ID NO: 324280 - RNA, 19 nt, Homo sapiens
cagccaaacccaaagaaga

SEQ ID NO: 324281 - RNA, 19 nt, Homo sapiens
cuacgaagcuuuugucaag

SEQ ID NO: 324282 - RNA, 19 nt, Homo sapiens
agaaagacgugaagaaacc

SEQ ID NO: 324283 - RNA, 19 nt, Homo sapiens
gaacagcaggaugaauuca

SEQ ID NO: 324284 - RNA, 19 nt, Homo sapiens
gaucgaguucucuaaggaa

SEQ ID NO: 324285 - RNA, 19 nt, Homo sapiens
gcaagccauuuccaacaac

SEQ ID NO: 324286 - RNA, 19 nt, Homo sapiens
agagcugaaugccaagaaa

SEQ ID NO: 324287 - RNA, 19 nt, Homo sapiens
uaaucacacccaugacaaa

SEQ ID NO: 324288 - RNA, 19 nt, Homo sapiens
acaaggaccaggccaccua

SEQ ID NO: 324289 - RNA, 19 nt, Homo sapiens
aggaacagcaggaugaauu

SEQ ID NO: 324290 - RNA, 19 nt, Homo sapiens
guucaagacugagcaacuc

SEQ ID NO: 324291 - RNA, 19 nt, Homo sapiens
ucacacccaugacaaacuc

SEQ ID NO: 324292 - RNA, 19 nt, Homo sapiens
ucaaauccaagcaccauuc

SEQ ID NO: 324293 - RNA, 19 nt, Homo sapiens
cuccagaucuguuuaccau

SEQ ID NO: 324294 - RNA, 19 nt, Homo sapiens
caaacucuccagaucuguu

SEQ ID NO: 324295 - RNA, 19 nt, Homo sapiens
gaagacuggcuggaaacuu

SEQ ID NO: 324296 - RNA, 19 nt, Homo sapiens
caagccauuuccaacaaca

SEQ ID NO: 324297 - RNA, 19 nt, Homo sapiens
ugcaagccauuuccaacaa

SEQ ID NO: 324298 - RNA, 19 nt, Homo sapiens
gaauucauaccacacaaac

SEQ ID NO: 324299 - RNA, 19 nt, Homo sapiens
gaaggcaauggcacaguca

SEQ ID NO: 324300 - RNA, 19 nt, Homo sapiens
ggucggugauguccuucga

SEQ ID NO: 324301 - RNA, 19 nt, Homo sapiens
gcucuagaugagaagaaua

SEQ ID NO: 324302 - RNA, 19 nt, Homo sapiens
ugacaaacucuccagaucu

SEQ ID NO: 324303 - RNA, 19 nt, Homo sapiens
ccaauggcugcaucaacua

SEQ ID NO: 324304 - RNA, 19 nt, Homo sapiens
uccaauggcugcaucaacu

SEQ ID NO: 324305 - RNA, 19 nt, Homo sapiens
cugcugcucuagaugagaa

SEQ ID NO: 324306 - RNA, 19 nt, Homo sapiens
caaugcagaggucaggaaa

SEQ ID NO: 324307 - RNA, 19 nt, Homo sapiens
caaccaccauccucuucca

SEQ ID NO: 324308 - RNA, 19 nt, Homo sapiens
agaucgaguucucuaagga

SEQ ID NO: 324309 - RNA, 19 nt, Homo sapiens
uaagaucgaguucucuaag

SEQ ID NO: 324310 - RNA, 19 nt, Homo sapiens
ugaauucauaccacacaaa

SEQ ID NO: 324311 - RNA, 19 nt, Homo sapiens
auugaccucucugccauua

SEQ ID NO: 324312 - RNA, 19 nt, Homo sapiens
auggagcucucaagaacaa

SEQ ID NO: 324313 - RNA, 19 nt, Homo sapiens
aacaauuucugccuaugau

SEQ ID NO: 324314 - RNA, 19 nt, Homo sapiens
gaagagcugaaugccaaga

SEQ ID NO: 324315 - RNA, 19 nt, Homo sapiens
aaauggcaccaaagaaaga

SEQ ID NO: 324316 - RNA, 19 nt, Homo sapiens
uaagccaggucggugaugu

SEQ ID NO: 324317 - RNA, 19 nt, Homo sapiens
caaucuggacgguucaaga

SEQ ID NO: 324318 - RNA, 19 nt, Homo sapiens
acagcaggaugaauucaag

SEQ ID NO: 324319 - RNA, 19 nt, Homo sapiens
ccaaagaaagacgugaaga

SEQ ID NO: 324320 - RNA, 19 nt, Homo sapiens
ccuaugaagacuuuguuga

SEQ ID NO: 324321 - RNA, 19 nt, Homo sapiens
ugaauucaaggaggcauuu

SEQ ID NO: 324322 - RNA, 19 nt, Homo sapiens
uaccaugaaucaacgaaac

SEQ ID NO: 324323 - RNA, 19 nt, Homo sapiens
gcaucaacuacgaagcuuu

SEQ ID NO: 324324 - RNA, 19 nt, Homo sapiens
gaccaggccaccuaugaag

SEQ ID NO: 324325 - RNA, 19 nt, Homo sapiens
ccaaugcagaggucaggaa

SEQ ID NO: 324326 - RNA, 19 nt, Homo sapiens
agccaaacccaaagaagaa

SEQ ID NO: 324327 - RNA, 19 nt, Homo sapiens
aaagaugaaagaggaagaa

SEQ ID NO: 324328 - RNA, 19 nt, Homo sapiens
agucaugggugcugaacuc

SEQ ID NO: 324329 - RNA, 19 nt, Homo sapiens
ugaacaauuucugccuaug

SEQ ID NO: 324330 - RNA, 19 nt, Homo sapiens
uugaacaauuucugccuau

SEQ ID NO: 324331 - RNA, 19 nt, Homo sapiens
caggaaaguucugggaaac

SEQ ID NO: 324332 - RNA, 19 nt, Homo sapiens
auucauaccacacaaacaa

SEQ ID NO: 324333 - RNA, 19 nt, Homo sapiens
ugacagaacaggugauucc

SEQ ID NO: 324334 - RNA, 19 nt, Homo sapiens
gacacugggcuguggauca

SEQ ID NO: 324335 - RNA, 19 nt, Homo sapiens
ggucaagaagacuccaaug

SEQ ID NO: 324336 - RNA, 19 nt, Homo sapiens
augcagaggucaggaaagu

SEQ ID NO: 324337 - RNA, 19 nt, Homo sapiens
cuggacgguucaagacuga

SEQ ID NO: 324338 - RNA, 19 nt, Homo sapiens
caccaaagaaagacgugaa

SEQ ID NO: 324339 - RNA, 19 nt, Homo sapiens
caugaaucaacgaaacauu

SEQ ID NO: 324340 - RNA, 19 nt, Homo sapiens
augacaaacucuccagauc

SEQ ID NO: 324341 - RNA, 19 nt, Homo sapiens
uaaggaacagcaggaugaa

SEQ ID NO: 324342 - RNA, 19 nt, Homo sapiens
uuaagaucgaguucucuaa

SEQ ID NO: 324343 - RNA, 19 nt, Homo sapiens
agaaguggaagcccugaug

SEQ ID NO: 324344 - RNA, 19 nt, Homo sapiens
ucucugccauuaagaucga

SEQ ID NO: 324345 - RNA, 19 nt, Homo sapiens
caagcagccuucuuuauua

SEQ ID NO: 324346 - RNA, 19 nt, Homo sapiens
gaauggagcucucaagaac

SEQ ID NO: 324347 - RNA, 19 nt, Homo sapiens
aagacuggcuggaaacuua

SEQ ID NO: 324348 - RNA, 19 nt, Homo sapiens
gcacaaaucccaccaaugc

SEQ ID NO: 324349 - RNA, 19 nt, Homo sapiens
gaacaauuucugccuauga

SEQ ID NO: 324350 - RNA, 19 nt, Homo sapiens
ccaagcagccuucuuuauu

SEQ ID NO: 324351 - RNA, 19 nt, Homo sapiens
gaaagaggaagaaguggaa

SEQ ID NO: 324352 - RNA, 19 nt, Homo sapiens
acaaaugucugcugcucua

SEQ ID NO: 324353 - RNA, 19 nt, Homo sapiens
caucaugucuaucugaaug

SEQ ID NO: 324354 - RNA, 19 nt, Homo sapiens
ccagaucuguuuaccauca

SEQ ID NO: 324355 - RNA, 19 nt, Homo sapiens
gaacaggugauuccaagau

SEQ ID NO: 324356 - RNA, 19 nt, Homo sapiens
ccagauugcugaauucaag

SEQ ID NO: 324357 - RNA, 19 nt, Homo sapiens
gacaaacucuccagaucug

SEQ ID NO: 324358 - RNA, 19 nt, Homo sapiens
gaugaaagaggaagaagug

SEQ ID NO: 324359 - RNA, 19 nt, Homo sapiens
gagcagcccucaacucacu

SEQ ID NO: 324360 - RNA, 19 nt, Homo sapiens
ucaggaaaguucugggaaa

SEQ ID NO: 324361 - RNA, 19 nt, Homo sapiens
ggccaccuaugaagacuuu

SEQ ID NO: 324362 - RNA, 19 nt, Homo sapiens
ccaagaaaauugaguuuga

SEQ ID NO: 324363 - RNA, 19 nt, Homo sapiens
uaggaagacuggcuggaaa

SEQ ID NO: 324364 - RNA, 19 nt, Homo sapiens
gcagaggucaggaaaguuc

SEQ ID NO: 324365 - RNA, 19 nt, Homo sapiens
gggcacaaaucccaccaau

SEQ ID NO: 324366 - RNA, 19 nt, Homo sapiens
ucaacucacucuucagcuu

SEQ ID NO: 324367 - RNA, 19 nt, Homo sapiens
ggaccaggccaccuaugaa

SEQ ID NO: 324368 - RNA, 19 nt, Homo sapiens
ccaggucggugauguccuu

SEQ ID NO: 324369 - RNA, 19 nt, Homo sapiens
aagcagccuucuuuauuau

SEQ ID NO: 324370 - RNA, 19 nt, Homo sapiens
gcccucaacucacucuuca

SEQ ID NO: 324371 - RNA, 19 nt, Homo sapiens
gcaaugaagagcugaaugc

SEQ ID NO: 324372 - RNA, 19 nt, Homo sapiens
gcagccuucuuuauuaucu

SEQ ID NO: 324373 - RNA, 19 nt, Homo sapiens
gauggcaggucaagaagac

SEQ ID NO: 324374 - RNA, 19 nt, Homo sapiens
aggcauuucuccuguuuga

SEQ ID NO: 324375 - RNA, 19 nt, Homo sapiens
aauccaagcagccuucuuu

SEQ ID NO: 324376 - RNA, 19 nt, Homo sapiens
caagcauuguuuaggaaga

SEQ ID NO: 324377 - RNA, 19 nt, Homo sapiens
ugaauggagcucucaagaa

SEQ ID NO: 324378 - RNA, 19 nt, Homo sapiens
gugcugaacuccgccaugu

SEQ ID NO: 324379 - RNA, 19 nt, Homo sapiens
gcauuucuccuguuugaca

SEQ ID NO: 324380 - RNA, 19 nt, Homo sapiens
ugaccagauugcugaauuc

SEQ ID NO: 324381 - RNA, 19 nt, Homo sapiens
cuacgaagcuuuugucaag

SEQ ID NO: 324382 - RNA, 19 nt, Homo sapiens
gcaagccauuuccaacaac

SEQ ID NO: 324383 - RNA, 19 nt, Homo sapiens
agagcugaaugccaagaaa

SEQ ID NO: 324384 - RNA, 19 nt, Homo sapiens
cugaccagauugcugaauu

SEQ ID NO: 324385 - RNA, 19 nt, Homo sapiens
uaaucacacccaugacaaa

SEQ ID NO: 324386 - RNA, 19 nt, Homo sapiens
acaaggaccaggccaccua

SEQ ID NO: 324387 - RNA, 19 nt, Homo sapiens
guucaagacugagcaacuc

SEQ ID NO: 324388 - RNA, 19 nt, Homo sapiens
ucacacccaugacaaacuc

SEQ ID NO: 324389 - RNA, 19 nt, Homo sapiens
cuccagaucuguuuaccau

SEQ ID NO: 324390 - RNA, 19 nt, Homo sapiens
caaacucuccagaucuguu

SEQ ID NO: 324391 - RNA, 19 nt, Homo sapiens
gaagacuggcuggaaacuu

SEQ ID NO: 324392 - RNA, 19 nt, Homo sapiens
caagccauuuccaacaaca

SEQ ID NO: 324393 - RNA, 19 nt, Homo sapiens
ugcaagccauuuccaacaa

SEQ ID NO: 324394 - RNA, 19 nt, Homo sapiens
gaauucauaccacacaaac

SEQ ID NO: 324395 - RNA, 19 nt, Homo sapiens
gaaggcaauggcacaguca

SEQ ID NO: 324396 - RNA, 19 nt, Homo sapiens
ggucggugauguccuucga

SEQ ID NO: 324397 - RNA, 19 nt, Homo sapiens
gcucuagaugagaagaaua

SEQ ID NO: 324398 - RNA, 19 nt, Homo sapiens
ugacaaacucuccagaucu

SEQ ID NO: 324399 - RNA, 19 nt, Homo sapiens
ccaauggcugcaucaacua

SEQ ID NO: 324400 - RNA, 19 nt, Homo sapiens
uccaauggcugcaucaacu

SEQ ID NO: 324401 - RNA, 19 nt, Homo sapiens
cugcugcucuagaugagaa

SEQ ID NO: 324402 - RNA, 19 nt, Homo sapiens
cggagcagcccucaacuca

SEQ ID NO: 324403 - RNA, 19 nt, Homo sapiens
caaugcagaggucaggaaa

SEQ ID NO: 324404 - RNA, 19 nt, Homo sapiens
uaagccaggucggugaugu

SEQ ID NO: 324405 - RNA, 19 nt, Homo sapiens
ugaauucauaccacacaaa

SEQ ID NO: 324406 - RNA, 19 nt, Homo sapiens
auggagcucucaagaacaa

SEQ ID NO: 324407 - RNA, 19 nt, Homo sapiens
aacaauuucugccuaugau

SEQ ID NO: 324408 - RNA, 19 nt, Homo sapiens
gaagagcugaaugccaaga

SEQ ID NO: 324409 - RNA, 19 nt, Homo sapiens
cagccuucuuuauuaucua

SEQ ID NO: 324410 - RNA, 19 nt, Homo sapiens
ugaauucaaggaggcauuu

SEQ ID NO: 324411 - RNA, 19 nt, Homo sapiens
caaucuggacgguucaaga

SEQ ID NO: 324412 - RNA, 19 nt, Homo sapiens
ccuaugaagacuuuguuga

SEQ ID NO: 324413 - RNA, 19 nt, Homo sapiens
uaccaugaaucaacgaaac

SEQ ID NO: 324414 - RNA, 19 nt, Homo sapiens
cccagccgcuccaucaugu

SEQ ID NO: 324415 - RNA, 19 nt, Homo sapiens
ccaaugcagaggucaggaa

SEQ ID NO: 324416 - RNA, 19 nt, Homo sapiens
gcaucaacuacgaagcuuu

SEQ ID NO: 324417 - RNA, 19 nt, Homo sapiens
gaccaggccaccuaugaag

SEQ ID NO: 324418 - RNA, 19 nt, Homo sapiens
caggaaaguucugggaaac

SEQ ID NO: 324419 - RNA, 19 nt, Homo sapiens
aaagaugaaagaggaagaa

SEQ ID NO: 324420 - RNA, 19 nt, Homo sapiens
agucaugggugcugaacuc

SEQ ID NO: 324421 - RNA, 19 nt, Homo sapiens
ugaacaauuucugccuaug

SEQ ID NO: 324422 - RNA, 19 nt, Homo sapiens
uugaacaauuucugccuau

SEQ ID NO: 324423 - RNA, 19 nt, Homo sapiens
auucauaccacacaaacaa

SEQ ID NO: 324424 - RNA, 19 nt, Homo sapiens
ggucaagaagacuccaaug

SEQ ID NO: 324425 - RNA, 19 nt, Homo sapiens
ugacagaacaggugauucc

SEQ ID NO: 324426 - RNA, 19 nt, Homo sapiens
augcagaggucaggaaagu

SEQ ID NO: 324427 - RNA, 19 nt, Homo sapiens
aaugucugcugcucuagau

SEQ ID NO: 324428 - RNA, 19 nt, Homo sapiens
cuggacgguucaagacuga

SEQ ID NO: 324429 - RNA, 19 nt, Homo sapiens
caugaaucaacgaaacauu

SEQ ID NO: 324430 - RNA, 19 nt, Homo sapiens
augacaaacucuccagauc

SEQ ID NO: 324431 - RNA, 19 nt, Homo sapiens
agaaguggaagcccugaug

SEQ ID NO: 324432 - RNA, 19 nt, Homo sapiens
ccuaugaugcaagccauuu

SEQ ID NO: 324433 - RNA, 19 nt, Homo sapiens
ugucugcugcucuagauga

SEQ ID NO: 324434 - RNA, 19 nt, Homo sapiens
caugacaaacucuccagau

SEQ ID NO: 324435 - RNA, 19 nt, Homo sapiens
gaccagauugcugaauuca

SEQ ID NO: 324436 - RNA, 19 nt, Homo sapiens
caaggaccaggccaccuau

SEQ ID NO: 324437 - RNA, 19 nt, Homo sapiens
gaacagggauggcuucauu

SEQ ID NO: 324438 - RNA, 19 nt, Homo sapiens
ccaauuaacuuuacugugu

SEQ ID NO: 324439 - RNA, 19 nt, Homo sapiens
gcugaaggcugauuacguu

SEQ ID NO: 324440 - RNA, 19 nt, Homo sapiens
ugacgugacuggaaacuug

SEQ ID NO: 324441 - RNA, 19 nt, Homo sapiens
aacaggaggucguguauuu

SEQ ID NO: 324442 - RNA, 19 nt, Homo sapiens
cagaggccauguuccaaua

SEQ ID NO: 324443 - RNA, 19 nt, Homo sapiens
gagaagagaaggacuagga

SEQ ID NO: 324444 - RNA, 19 nt, Homo sapiens
ggaggagguugaccagaug

SEQ ID NO: 324445 - RNA, 19 nt, Homo sapiens
gaggccauguuccaauaaa

SEQ ID NO: 324446 - RNA, 19 nt, Homo sapiens
acaagaaccuggugcacau

SEQ ID NO: 324447 - RNA, 19 nt, Homo sapiens
aaaccauucucaacgcauu

SEQ ID NO: 324448 - RNA, 19 nt, Homo sapiens
caacgcauucaaaguguuu

SEQ ID NO: 324449 - RNA, 19 nt, Homo sapiens
uaagaaagcaaagaagaga

SEQ ID NO: 324450 - RNA, 19 nt, Homo sapiens
caucaucacccacggagaa

SEQ ID NO: 324451 - RNA, 19 nt, Homo sapiens
caccauggcaccuaagaaa

SEQ ID NO: 324452 - RNA, 19 nt, Homo sapiens
gaucugagagacaccuuug

SEQ ID NO: 324453 - RNA, 19 nt, Homo sapiens
ggucacgacauuucucuga

SEQ ID NO: 324454 - RNA, 19 nt, Homo sapiens
ugacaagaacgaucugaga

SEQ ID NO: 324455 - RNA, 19 nt, Homo sapiens
agacccaaauccaggaauu

SEQ ID NO: 324456 - RNA, 19 nt, Homo sapiens
ucacuaucauggaccagaa

SEQ ID NO: 324457 - RNA, 19 nt, Homo sapiens
uguauuuggucacgacauu

SEQ ID NO: 324458 - RNA, 19 nt, Homo sapiens
gaggcuccggguccaauua

SEQ ID NO: 324459 - RNA, 19 nt, Homo sapiens
gggauggcuucauugacaa

SEQ ID NO: 324460 - RNA, 19 nt, Homo sapiens
gagcggacccugaggaaac

SEQ ID NO: 324461 - RNA, 19 nt, Homo sapiens
agggauggcuucauugaca

SEQ ID NO: 324462 - RNA, 19 nt, Homo sapiens
ccuaagaaagcaaagaaga

SEQ ID NO: 324463 - RNA, 19 nt, Homo sapiens
caacguguucuccauguuc

SEQ ID NO: 324464 - RNA, 19 nt, Homo sapiens
uaaacaggaggucguguau

SEQ ID NO: 324465 - RNA, 19 nt, Homo sapiens
ccauguggcugccccauuu

SEQ ID NO: 324466 - RNA, 19 nt, Homo sapiens
ucucaacgcauucaaagug

SEQ ID NO: 324467 - RNA, 19 nt, Homo sapiens
ccaacguguucuccauguu

SEQ ID NO: 324468 - RNA, 19 nt, Homo sapiens
gaaccuggugcacaucauc

SEQ ID NO: 324469 - RNA, 19 nt, Homo sapiens
cuggaaacuuggacuacaa

SEQ ID NO: 324470 - RNA, 19 nt, Homo sapiens
aggaggagguugaccagau

SEQ ID NO: 324471 - RNA, 19 nt, Homo sapiens
caccuaagaaagcaaagaa

SEQ ID NO: 324472 - RNA, 19 nt, Homo sapiens
gucacgacauuucucugaa

SEQ ID NO: 324473 - RNA, 19 nt, Homo sapiens
ucaacgcauucaaaguguu

SEQ ID NO: 324474 - RNA, 19 nt, Homo sapiens
gcaccuaagaaagcaaaga

SEQ ID NO: 324475 - RNA, 19 nt, Homo sapiens
acaagaacgaucugagaga

SEQ ID NO: 324476 - RNA, 19 nt, Homo sapiens
auaaacaggaggucgugua

SEQ ID NO: 324477 - RNA, 19 nt, Homo sapiens
ugacuggaaacuuggacua

SEQ ID NO: 324478 - RNA, 19 nt, Homo sapiens
guguuccucucaauguuug

SEQ ID NO: 324479 - RNA, 19 nt, Homo sapiens
uuacuguguuccucucaau

SEQ ID NO: 324480 - RNA, 19 nt, Homo sapiens
ccagaggccauguuccaau

SEQ ID NO: 324481 - RNA, 19 nt, Homo sapiens
ugauuacguucgggaaaug

SEQ ID NO: 324482 - RNA, 19 nt, Homo sapiens
gcugauuacguucgggaaa

SEQ ID NO: 324483 - RNA, 19 nt, Homo sapiens
acagggauggcuucauuga

SEQ ID NO: 324484 - RNA, 19 nt, Homo sapiens
gggcucgucuuugcagagu

SEQ ID NO: 324485 - RNA, 19 nt, Homo sapiens
ggagguugaccagauguuc

SEQ ID NO: 324486 - RNA, 19 nt, Homo sapiens
ggagcggacccugaggaaa

SEQ ID NO: 324487 - RNA, 19 nt, Homo sapiens
cuuccaccauggcaccuaa

SEQ ID NO: 324488 - RNA, 19 nt, Homo sapiens
cuaagaaagcaaagaagag

SEQ ID NO: 324489 - RNA, 19 nt, Homo sapiens
cugauuacguucgggaaau

SEQ ID NO: 324490 - RNA, 19 nt, Homo sapiens
ccggguccaauuaacuuua

SEQ ID NO: 324491 - RNA, 19 nt, Homo sapiens
aaacaggaggucguguauu

SEQ ID NO: 324492 - RNA, 19 nt, Homo sapiens
caucaacuaugaagcauuu

SEQ ID NO: 324493 - RNA, 19 nt, Homo sapiens
cuaaggaggucgaguuuga

SEQ ID NO: 324494 - RNA, 19 nt, Homo sapiens
ccaagaugauggacuuuga

SEQ ID NO: 324495 - RNA, 19 nt, Homo sapiens
gugagaggcugacagaaga

SEQ ID NO: 324496 - RNA, 19 nt, Homo sapiens
aggaagagcucaauaccaa

SEQ ID NO: 324497 - RNA, 19 nt, Homo sapiens
gaagagcucaauaccaaga

SEQ ID NO: 324498 - RNA, 19 nt, Homo sapiens
ugauggacuuugaaacuuu

SEQ ID NO: 324499 - RNA, 19 nt, Homo sapiens
guucacaccugagcagauu

SEQ ID NO: 324500 - RNA, 19 nt, Homo sapiens
gaugauggacuuugaaacu

SEQ ID NO: 324501 - RNA, 19 nt, Homo sapiens
cgucucaucucccaugugu

SEQ ID NO: 324502 - RNA, 19 nt, Homo sapiens
aagacgaaguggagaaguu

SEQ ID NO: 324503 - RNA, 19 nt, Homo sapiens
cagcacauuuccaagaaca

SEQ ID NO: 324504 - RNA, 19 nt, Homo sapiens
auaccaagaugauggacuu

SEQ ID NO: 324505 - RNA, 19 nt, Homo sapiens
ucucaucucccauguguga

SEQ ID NO: 324506 - RNA, 19 nt, Homo sapiens
cugagcagauugaagaguu

SEQ ID NO: 324507 - RNA, 19 nt, Homo sapiens
caccugagcagauugaaga

SEQ ID NO: 324508 - RNA, 19 nt, Homo sapiens
aggcugugcuuaccuguga

SEQ ID NO: 324509 - RNA, 19 nt, Homo sapiens
ugucaugggugcugagcuu

SEQ ID NO: 324510 - RNA, 19 nt, Homo sapiens
ggugagaggcugacagaag

SEQ ID NO: 324511 - RNA, 19 nt, Homo sapiens
ggacacaggcaccuaugag

SEQ ID NO: 324512 - RNA, 19 nt, Homo sapiens
ccacgugguugccgucucu

SEQ ID NO: 324513 - RNA, 19 nt, Homo sapiens
gagcucaauaccaagauga

SEQ ID NO: 324514 - RNA, 19 nt, Homo sapiens
caagaugauggacuuugaa

SEQ ID NO: 324515 - RNA, 19 nt, Homo sapiens
agacaggaagagcucaaua

SEQ ID NO: 324516 - RNA, 19 nt, Homo sapiens
ggcaagaggacuccaaugg

SEQ ID NO: 324517 - RNA, 19 nt, Homo sapiens
caaggacacaggcaccuau

SEQ ID NO: 324518 - RNA, 19 nt, Homo sapiens
uuaccaagacuccugcaaa

SEQ ID NO: 324519 - RNA, 19 nt, Homo sapiens
caacuaugaagcauuugug

SEQ ID NO: 324520 - RNA, 19 nt, Homo sapiens
guugauggcugggcaagag

SEQ ID NO: 324521 - RNA, 19 nt, Homo sapiens
gcugacagaagacgaagug

SEQ ID NO: 324522 - RNA, 19 nt, Homo sapiens
uccagcacauuuccaagaa

SEQ ID NO: 324523 - RNA, 19 nt, Homo sapiens
ccaauggcugcaucaacua

SEQ ID NO: 324524 - RNA, 19 nt, Homo sapiens
uccaauggcugcaucaacu

SEQ ID NO: 324525 - RNA, 19 nt, Homo sapiens
gaggggagccuuaccaaga

SEQ ID NO: 324526 - RNA, 19 nt, Homo sapiens
agccagagcccaagaagga

SEQ ID NO: 324527 - RNA, 19 nt, Homo sapiens
gacaggaagagcucaauac

SEQ ID NO: 324528 - RNA, 19 nt, Homo sapiens
uaccaagacuccugcaaaa

SEQ ID NO: 324529 - RNA, 19 nt, Homo sapiens
gcccuaaggaggucgaguu

SEQ ID NO: 324530 - RNA, 19 nt, Homo sapiens
guuugaugcuuccaagauc

SEQ ID NO: 324531 - RNA, 19 nt, Homo sapiens
gcacauuuccaagaacaag

SEQ ID NO: 324532 - RNA, 19 nt, Homo sapiens
cagaagacgaaguggagaa

SEQ ID NO: 324533 - RNA, 19 nt, Homo sapiens
aaacuuuccugccuaugcu

SEQ ID NO: 324534 - RNA, 19 nt, Homo sapiens
ccaagugugagaugaagau

SEQ ID NO: 324535 - RNA, 19 nt, Homo sapiens
ucacaccugagcagauuga

SEQ ID NO: 324536 - RNA, 19 nt, Homo sapiens
cuaaaccucgugcccagaa

SEQ ID NO: 324537 - RNA, 19 nt, Homo sapiens
cuaugaagcauuugugaag

SEQ ID NO: 324538 - RNA, 19 nt, Homo sapiens
ugagcagauugaagaguuc

SEQ ID NO: 324539 - RNA, 19 nt, Homo sapiens
gaggcugacagaagacgaa

SEQ ID NO: 324540 - RNA, 19 nt, Homo sapiens
caauggcugcaucaacuau

SEQ ID NO: 324541 - RNA, 19 nt, Homo sapiens
gggcaauggcacugucaug

SEQ ID NO: 324542 - RNA, 19 nt, Homo sapiens
gaggucgaguuugaugcuu

SEQ ID NO: 324543 - RNA, 19 nt, Homo sapiens
gcaucaacuaugaagcauu

SEQ ID NO: 324544 - RNA, 19 nt, Homo sapiens
aagaugauggacuuugaaa

SEQ ID NO: 324545 - RNA, 19 nt, Homo sapiens
caagacaggaagagcucaa

SEQ ID NO: 324546 - RNA, 19 nt, Homo sapiens
ggaagccaagacaggaaga

SEQ ID NO: 324547 - RNA, 19 nt, Homo sapiens
ucaauaccaagaugaugga

SEQ ID NO: 324548 - RNA, 19 nt, Homo sapiens
gcucaauaccaagaugaug

SEQ ID NO: 324549 - RNA, 19 nt, Homo sapiens
caacauggcucccaagaag

SEQ ID NO: 324550 - RNA, 19 nt, Homo sapiens
ccaagaagccugagccuaa

SEQ ID NO: 324551 - RNA, 19 nt, Homo sapiens
gaagaugacugaggcugaa

SEQ ID NO: 324552 - RNA, 19 nt, Homo sapiens
caucaauuaugaagccuuu

SEQ ID NO: 324553 - RNA, 19 nt, Homo sapiens
ggucaugggugcugagcuu

SEQ ID NO: 324554 - RNA, 19 nt, Homo sapiens
gcccaagccugaagagaug

SEQ ID NO: 324555 - RNA, 19 nt, Homo sapiens
ccaagaguguaaagauaga

SEQ ID NO: 324556 - RNA, 19 nt, Homo sapiens
ggcccucccuguuaauaaa

SEQ ID NO: 324557 - RNA, 19 nt, Homo sapiens
agagaugaaugucaagaug

SEQ ID NO: 324558 - RNA, 19 nt, Homo sapiens
ccaaagaucccaacaagac

SEQ ID NO: 324559 - RNA, 19 nt, Homo sapiens
cugaagagaugaaugucaa

SEQ ID NO: 324560 - RNA, 19 nt, Homo sapiens
ggccagaacccuaccaaug

SEQ ID NO: 324561 - RNA, 19 nt, Homo sapiens
gcacauuucccgcaacaag

SEQ ID NO: 324562 - RNA, 19 nt, Homo sapiens
ucacuccucugccaaagau

SEQ ID NO: 324563 - RNA, 19 nt, Homo sapiens
gcuguuagcugggcaagag

SEQ ID NO: 324564 - RNA, 19 nt, Homo sapiens
gaagagaugaaugucaaga

SEQ ID NO: 324565 - RNA, 19 nt, Homo sapiens
ccacgucucucgguuucuu

SEQ ID NO: 324566 - RNA, 19 nt, Homo sapiens
ugaaguggagcagcuguua

SEQ ID NO: 324567 - RNA, 19 nt, Homo sapiens
caagaagccugagccuaag

SEQ ID NO: 324568 - RNA, 19 nt, Homo sapiens
gucucucgguuucuucuua

SEQ ID NO: 324569 - RNA, 19 nt, Homo sapiens
ugccaaagaucccaacaag

SEQ ID NO: 324570 - RNA, 19 nt, Homo sapiens
gccauaccagggugaguua

SEQ ID NO: 324571 - RNA, 19 nt, Homo sapiens
gagagaugaagaucaccua

SEQ ID NO: 324572 - RNA, 19 nt, Homo sapiens
cagcacauuucccgcaaca

SEQ ID NO: 324573 - RNA, 19 nt, Homo sapiens
gaucacuccucugccaaag

SEQ ID NO: 324574 - RNA, 19 nt, Homo sapiens
gggcaccuaugaggacuuc

SEQ ID NO: 324575 - RNA, 19 nt, Homo sapiens
ugggagagaagaugacuga

SEQ ID NO: 324576 - RNA, 19 nt, Homo sapiens
gacaacauggcucccaaga

SEQ ID NO: 324577 - RNA, 19 nt, Homo sapiens
gaaguggagcagcuguuag

SEQ ID NO: 324578 - RNA, 19 nt, Homo sapiens
caaagaucccaacaagaca

SEQ ID NO: 324579 - RNA, 19 nt, Homo sapiens
acaaggagcagggcaccua

SEQ ID NO: 324580 - RNA, 19 nt, Homo sapiens
gccagaacccuaccaaugc

SEQ ID NO: 324581 - RNA, 19 nt, Homo sapiens
gcaagcccaagccugaaga

SEQ ID NO: 324582 - RNA, 19 nt, Homo sapiens
cauaccagggugaguuaaa

SEQ ID NO: 324583 - RNA, 19 nt, Homo sapiens
uuaugaagccuuugucaag

SEQ ID NO: 324584 - RNA, 19 nt, Homo sapiens
ucaauuaugaagccuuugu

SEQ ID NO: 324585 - RNA, 19 nt, Homo sapiens
ccccaagaguguaaagaua

SEQ ID NO: 324586 - RNA, 19 nt, Homo sapiens
ucacugccgaccagauuga

SEQ ID NO: 324587 - RNA, 19 nt, Homo sapiens
aaagaucccaacaagacaa

SEQ ID NO: 324588 - RNA, 19 nt, Homo sapiens
gccaaagaucccaacaaga

SEQ ID NO: 324589 - RNA, 19 nt, Homo sapiens
agccugagccuaagaagga

SEQ ID NO: 324590 - RNA, 19 nt, Homo sapiens
ggacuuugagacguucuug

SEQ ID NO: 324591 - RNA, 19 nt, Homo sapiens
cgacuggagagaugaagau

SEQ ID NO: 324592 - RNA, 19 nt, Homo sapiens
aggcugggcucugggauuc

SEQ ID NO: 324593 - RNA, 19 nt, Homo sapiens
gaguguaaagauagacuuc

SEQ ID NO: 324594 - RNA, 19 nt, Homo sapiens
cgccacgucucucgguuuc

SEQ ID NO: 324595 - RNA, 19 nt, Homo sapiens
caaggagcagggcaccuau

SEQ ID NO: 324596 - RNA, 19 nt, Homo sapiens
gaaccgagauggcuucauu

SEQ ID NO: 324597 - RNA, 19 nt, Homo sapiens
gcaggaagaccaagaagaa

SEQ ID NO: 324598 - RNA, 19 nt, Homo sapiens
cgagauggcuucauugaca

SEQ ID NO: 324599 - RNA, 19 nt, Homo sapiens
cagagagccucauccaaug

SEQ ID NO: 324600 - RNA, 19 nt, Homo sapiens
ccagagagccucauccaau

SEQ ID NO: 324601 - RNA, 19 nt, Homo sapiens
cggaagagguggaccagau

SEQ ID NO: 324602 - RNA, 19 nt, Homo sapiens
gagauggcuucauugacaa

SEQ ID NO: 324603 - RNA, 19 nt, Homo sapiens
caacaaggaguacaucaag

SEQ ID NO: 324604 - RNA, 19 nt, Homo sapiens
ccgaggagaccauucuuaa

SEQ ID NO: 324605 - RNA, 19 nt, Homo sapiens
ggaagaccaagaagaagga

SEQ ID NO: 324606 - RNA, 19 nt, Homo sapiens
cauccaaugucuucuccaa

SEQ ID NO: 324607 - RNA, 19 nt, Homo sapiens
gcgcucagcuacgugauca

SEQ ID NO: 324608 - RNA, 19 nt, Homo sapiens
gcaagaccaacgucaagga

SEQ ID NO: 324609 - RNA, 19 nt, Homo sapiens
ucacacucauggaucagaa

SEQ ID NO: 324610 - RNA, 19 nt, Homo sapiens
ggaagagguggaccagaug

SEQ ID NO: 324611 - RNA, 19 nt, Homo sapiens
caaugucuucuccaacuuu

SEQ ID NO: 324612 - RNA, 19 nt, Homo sapiens
ccaaugucuucuccaacuu

SEQ ID NO: 324613 - RNA, 19 nt, Homo sapiens
gaagagguggaccagaugu

SEQ ID NO: 324614 - RNA, 19 nt, Homo sapiens
gucccaggcugacaagaug

SEQ ID NO: 324615 - RNA, 19 nt, Homo sapiens
gccgaggagaccauucuua

SEQ ID NO: 324616 - RNA, 19 nt, Homo sapiens
cccaucaacuucaccaugu

SEQ ID NO: 324617 - RNA, 19 nt, Homo sapiens
gaggagaccauucuuaacg

SEQ ID NO: 324618 - RNA, 19 nt, Homo sapiens
ccaguucgccuccaucgau

SEQ ID NO: 324619 - RNA, 19 nt, Homo sapiens
ucaagcgucugcugauguc

SEQ ID NO: 324620 - RNA, 19 nt, Homo sapiens
acaaggaggaccugaagga

SEQ ID NO: 324621 - RNA, 19 nt, Homo sapiens
aaggaggcauucacacuca

SEQ ID NO: 324622 - RNA, 19 nt, Homo sapiens
cauucacacucauggauca

SEQ ID NO: 324623 - RNA, 19 nt, Homo sapiens
gagcuuaagaugggcaaga

SEQ ID NO: 324624 - RNA, 19 nt, Homo sapiens
ucaacaaggaguacaucaa

SEQ ID NO: 324625 - RNA, 19 nt, Homo sapiens
gggcagacgcaucaaagca

SEQ ID NO: 324626 - RNA, 19 nt, Homo sapiens
ggaccugaaggacaccuau

SEQ ID NO: 324627 - RNA, 19 nt, Homo sapiens
gggcaagaccaacgucaag

SEQ ID NO: 324628 - RNA, 19 nt, Homo sapiens
ggaaaaucaacaaggagua

SEQ ID NO: 324629 - RNA, 19 nt, Homo sapiens
ggaaagggaaaaucaacaa

SEQ ID NO: 324630 - RNA, 19 nt, Homo sapiens
ugacaaggaggaccugaag

SEQ ID NO: 324631 - RNA, 19 nt, Homo sapiens
uggacgccaugcucaaaga

SEQ ID NO: 324632 - RNA, 19 nt, Homo sapiens
ggaggagaaggaggaguga

SEQ ID NO: 324633 - RNA, 19 nt, Homo sapiens
guucaaggaggcauucaca

SEQ ID NO: 324634 - RNA, 19 nt, Homo sapiens
uccaaugucuucuccaacu

SEQ ID NO: 324635 - RNA, 19 nt, Homo sapiens
ccagcaggaagaccaagaa

SEQ ID NO: 324636 - RNA, 19 nt, Homo sapiens
gcuggacgccaugcucaaa

SEQ ID NO: 324637 - RNA, 19 nt, Homo sapiens
ggaccagauguuccaguuc

SEQ ID NO: 324638 - RNA, 19 nt, Homo sapiens
gaagaccaagaagaaggaa

SEQ ID NO: 324639 - RNA, 19 nt, Homo sapiens
ggaggcauucacacucaug

SEQ ID NO: 324640 - RNA, 19 nt, Homo sapiens
aaugucuucuccaacuuug

SEQ ID NO: 324641 - RNA, 19 nt, Homo sapiens
ucaaggaggcauucacacu

SEQ ID NO: 324642 - RNA, 19 nt, Homo sapiens
ggacagcaaugguuguauc

SEQ ID NO: 324643 - RNA, 19 nt, Homo sapiens
ugaaggugcuggacuuuga

SEQ ID NO: 324644 - RNA, 19 nt, Homo sapiens
cgucagcauucaccaaaua

SEQ ID NO: 324645 - RNA, 19 nt, Homo sapiens
uaucaacuaugaagcguuu

SEQ ID NO: 324646 - RNA, 19 nt, Homo sapiens
gugaugagaugaaugugaa

SEQ ID NO: 324647 - RNA, 19 nt, Homo sapiens
gagcugagcagucaagaug

SEQ ID NO: 324648 - RNA, 19 nt, Homo sapiens
cagcaacuuucccaucuug

SEQ ID NO: 324649 - RNA, 19 nt, Homo sapiens
cgucaugggugcugaaauc

SEQ ID NO: 324650 - RNA, 19 nt, Homo sapiens
caucuugucucucuuggau

SEQ ID NO: 324651 - RNA, 19 nt, Homo sapiens
caagagugaugagaugaau

SEQ ID NO: 324652 - RNA, 19 nt, Homo sapiens
ccggagagcugagcaguca

SEQ ID NO: 324653 - RNA, 19 nt, Homo sapiens
gcugagcagucaagaugug

SEQ ID NO: 324654 - RNA, 19 nt, Homo sapiens
guaucuagccuaaaguuuc

SEQ ID NO: 324655 - RNA, 19 nt, Homo sapiens
ggacuucggguguuugaca

SEQ ID NO: 324656 - RNA, 19 nt, Homo sapiens
gaacaggugauggcaagau

SEQ ID NO: 324657 - RNA, 19 nt, Homo sapiens
gaggacagcaaugguugua

SEQ ID NO: 324658 - RNA, 19 nt, Homo sapiens
gagcagucaagauguguga

SEQ ID NO: 324659 - RNA, 19 nt, Homo sapiens
ccaaauaaacuugcucucu

SEQ ID NO: 324660 - RNA, 19 nt, Homo sapiens
ucuugucucucuuggauga

SEQ ID NO: 324661 - RNA, 19 nt, Homo sapiens
gcuggacuuugagcacuuu

SEQ ID NO: 324662 - RNA, 19 nt, Homo sapiens
gcauucaccaaauaaacuu

SEQ ID NO: 324663 - RNA, 19 nt, Homo sapiens
cugaauggcugaggaccuu

SEQ ID NO: 324664 - RNA, 19 nt, Homo sapiens
ccaagagugaugagaugaa

SEQ ID NO: 324665 - RNA, 19 nt, Homo sapiens
cugaggaccuucccagucu

SEQ ID NO: 324666 - RNA, 19 nt, Homo sapiens
ucccuaggcuuucuugucu

SEQ ID NO: 324667 - RNA, 19 nt, Homo sapiens
caugaggacagcaaugguu

SEQ ID NO: 324668 - RNA, 19 nt, Homo sapiens
agacaguggccaagaacaa

SEQ ID NO: 324669 - RNA, 19 nt, Homo sapiens
ccuaggcuuucuugucuca

SEQ ID NO: 324670 - RNA, 19 nt, Homo sapiens
gccuuucccugugugaauu

SEQ ID NO: 324671 - RNA, 19 nt, Homo sapiens
ggagagcugagcagucaag

SEQ ID NO: 324672 - RNA, 19 nt, Homo sapiens
gcaacuuucccaucuuguc

SEQ ID NO: 324673 - RNA, 19 nt, Homo sapiens
ucagcaacuuucccaucuu

SEQ ID NO: 324674 - RNA, 19 nt, Homo sapiens
ggacuuugagcacuuucug

SEQ ID NO: 324675 - RNA, 19 nt, Homo sapiens
gacuucggguguuugacaa

SEQ ID NO: 324676 - RNA, 19 nt, Homo sapiens
agagugaugagaugaaugu

SEQ ID NO: 324677 - RNA, 19 nt, Homo sapiens
gccgucagcauucaccaaa

SEQ ID NO: 324678 - RNA, 19 nt, Homo sapiens
caacuuucccaucuugucu

SEQ ID NO: 324679 - RNA, 19 nt, Homo sapiens
gaccagaccgcagaguuca

SEQ ID NO: 324680 - RNA, 19 nt, Homo sapiens
ugcagacaguggccaagaa

SEQ ID NO: 324681 - RNA, 19 nt, Homo sapiens
gaagcguuugugaggcaua

SEQ ID NO: 324682 - RNA, 19 nt, Homo sapiens
ccagggcaccuaugaggau

SEQ ID NO: 324683 - RNA, 19 nt, Homo sapiens
gacagcaaugguuguauca

SEQ ID NO: 324684 - RNA, 19 nt, Homo sapiens
uuucuugucucagcaacuu

SEQ ID NO: 324685 - RNA, 19 nt, Homo sapiens
gcagacaguggccaagaac

SEQ ID NO: 324686 - RNA, 19 nt, Homo sapiens
gucagcauucaccaaauaa

SEQ ID NO: 324687 - RNA, 19 nt, Homo sapiens
uaucuagccuaaaguuucc

SEQ ID NO: 324688 - RNA, 19 nt, Homo sapiens
caaggaccagggcaccuau

SEQ ID NO: 324689 - RNA, 19 nt, Homo sapiens
acaaggaccagggcaccua

SEQ ID NO: 324690 - RNA, 19 nt, Homo sapiens
ggacagcaaugguuguauc

SEQ ID NO: 324691 - RNA, 19 nt, Homo sapiens
ugaaggugcuggacuuuga

SEQ ID NO: 324692 - RNA, 19 nt, Homo sapiens
gugaugagaugaaugugaa

SEQ ID NO: 324693 - RNA, 19 nt, Homo sapiens
gagcugagcagucaagaug

SEQ ID NO: 324694 - RNA, 19 nt, Homo sapiens
cagcaacuuucccaucuug

SEQ ID NO: 324695 - RNA, 19 nt, Homo sapiens
cgucaugggugcugaaauc

SEQ ID NO: 324696 - RNA, 19 nt, Homo sapiens
caucuugucucucuuggau

SEQ ID NO: 324697 - RNA, 19 nt, Homo sapiens
caagagugaugagaugaau

SEQ ID NO: 324698 - RNA, 19 nt, Homo sapiens
ccggagagcugagcaguca

SEQ ID NO: 324699 - RNA, 19 nt, Homo sapiens
gcugagcagucaagaugug

SEQ ID NO: 324700 - RNA, 19 nt, Homo sapiens
guaucuagccuaaaguuuc

SEQ ID NO: 324701 - RNA, 19 nt, Homo sapiens
ggacuucggguguuugaca

SEQ ID NO: 324702 - RNA, 19 nt, Homo sapiens
gaacaggugauggcaagau

SEQ ID NO: 324703 - RNA, 19 nt, Homo sapiens
gaggacagcaaugguugua

SEQ ID NO: 324704 - RNA, 19 nt, Homo sapiens
gagcagucaagauguguga

SEQ ID NO: 324705 - RNA, 19 nt, Homo sapiens
ccaaauaaacuugcucucu

SEQ ID NO: 324706 - RNA, 19 nt, Homo sapiens
ucuugucucucuuggauga

SEQ ID NO: 324707 - RNA, 19 nt, Homo sapiens
gcuggacuuugagcacuuu

SEQ ID NO: 324708 - RNA, 19 nt, Homo sapiens
cugaauggcugaggaccuu

SEQ ID NO: 324709 - RNA, 19 nt, Homo sapiens
ccaagagugaugagaugaa

SEQ ID NO: 324710 - RNA, 19 nt, Homo sapiens
cugaggaccuucccagucu

SEQ ID NO: 324711 - RNA, 19 nt, Homo sapiens
ucccuaggcuuucuugucu

SEQ ID NO: 324712 - RNA, 19 nt, Homo sapiens
caugaggacagcaaugguu

SEQ ID NO: 324713 - RNA, 19 nt, Homo sapiens
agacaguggccaagaacaa

SEQ ID NO: 324714 - RNA, 19 nt, Homo sapiens
ccuaggcuuucuugucuca

SEQ ID NO: 324715 - RNA, 19 nt, Homo sapiens
gccuuucccugugugaauu

SEQ ID NO: 324716 - RNA, 19 nt, Homo sapiens
aaacuugcucucugggaaa

SEQ ID NO: 324717 - RNA, 19 nt, Homo sapiens
gcaacuuucccaucuuguc

SEQ ID NO: 324718 - RNA, 19 nt, Homo sapiens
ucagcaacuuucccaucuu

SEQ ID NO: 324719 - RNA, 19 nt, Homo sapiens
ggacuuugagcacuuucug

SEQ ID NO: 324720 - RNA, 19 nt, Homo sapiens
ggagagcugagcagucaag

SEQ ID NO: 324721 - RNA, 19 nt, Homo sapiens
gacuucggguguuugacaa

SEQ ID NO: 324722 - RNA, 19 nt, Homo sapiens
agagugaugagaugaaugu

SEQ ID NO: 324723 - RNA, 19 nt, Homo sapiens
caacuuucccaucuugucu

SEQ ID NO: 324724 - RNA, 19 nt, Homo sapiens
gaccagaccgcagaguuca

SEQ ID NO: 324725 - RNA, 19 nt, Homo sapiens
ugcagacaguggccaagaa

SEQ ID NO: 324726 - RNA, 19 nt, Homo sapiens
ccagggcaccuaugaggau

SEQ ID NO: 324727 - RNA, 19 nt, Homo sapiens
gacagcaaugguuguauca

SEQ ID NO: 324728 - RNA, 19 nt, Homo sapiens
uuucuugucucagcaacuu

SEQ ID NO: 324729 - RNA, 19 nt, Homo sapiens
gcagacaguggccaagaac

SEQ ID NO: 324730 - RNA, 19 nt, Homo sapiens
uaucuagccuaaaguuucc

SEQ ID NO: 324731 - RNA, 19 nt, Homo sapiens
caaggaccagggcaccuau

SEQ ID NO: 324732 - RNA, 19 nt, Homo sapiens
acaaggaccagggcaccua

SEQ ID NO: 324733 - RNA, 19 nt, Homo sapiens
ggacagcaaugguuguauc

SEQ ID NO: 324734 - RNA, 19 nt, Homo sapiens
ugaaggugcuggacuuuga

SEQ ID NO: 324735 - RNA, 19 nt, Homo sapiens
uaucaacuaugaagcguuu

SEQ ID NO: 324736 - RNA, 19 nt, Homo sapiens
gugaugagaugaaugugaa

SEQ ID NO: 324737 - RNA, 19 nt, Homo sapiens
cagcaacuuucccaucuug

SEQ ID NO: 324738 - RNA, 19 nt, Homo sapiens
cgucaugggugcugaaauc

SEQ ID NO: 324739 - RNA, 19 nt, Homo sapiens
caucuugucucucuuggau

SEQ ID NO: 324740 - RNA, 19 nt, Homo sapiens
caagagugaugagaugaau

SEQ ID NO: 324741 - RNA, 19 nt, Homo sapiens
guaucuagccuaaaguuuc

SEQ ID NO: 324742 - RNA, 19 nt, Homo sapiens
ggacuucggguguuugaca

SEQ ID NO: 324743 - RNA, 19 nt, Homo sapiens
gaacaggugauggcaagau

SEQ ID NO: 324744 - RNA, 19 nt, Homo sapiens
gaggacagcaaugguugua

SEQ ID NO: 324745 - RNA, 19 nt, Homo sapiens
ccaaauaaacuugcucucu

SEQ ID NO: 324746 - RNA, 19 nt, Homo sapiens
ucuugucucucuuggauga

SEQ ID NO: 324747 - RNA, 19 nt, Homo sapiens
gcuggacuuugagcacuuu

SEQ ID NO: 324748 - RNA, 19 nt, Homo sapiens
cugaauggcugaggaccuu

SEQ ID NO: 324749 - RNA, 19 nt, Homo sapiens
ccaagagugaugagaugaa

SEQ ID NO: 324750 - RNA, 19 nt, Homo sapiens
cugaggaccuucccagucu

SEQ ID NO: 324751 - RNA, 19 nt, Homo sapiens
ucccuaggcuuucuugucu

SEQ ID NO: 324752 - RNA, 19 nt, Homo sapiens
caugaggacagcaaugguu

SEQ ID NO: 324753 - RNA, 19 nt, Homo sapiens
agacaguggccaagaacaa

SEQ ID NO: 324754 - RNA, 19 nt, Homo sapiens
ccuaggcuuucuugucuca

SEQ ID NO: 324755 - RNA, 19 nt, Homo sapiens
gccuuucccugugugaauu

SEQ ID NO: 324756 - RNA, 19 nt, Homo sapiens
aaacuugcucucugggaaa

SEQ ID NO: 324757 - RNA, 19 nt, Homo sapiens
gcaacuuucccaucuuguc

SEQ ID NO: 324758 - RNA, 19 nt, Homo sapiens
ucagcaacuuucccaucuu

SEQ ID NO: 324759 - RNA, 19 nt, Homo sapiens
ggacuuugagcacuuucug

SEQ ID NO: 324760 - RNA, 19 nt, Homo sapiens
gacuucggguguuugacaa

SEQ ID NO: 324761 - RNA, 19 nt, Homo sapiens
agagugaugagaugaaugu

SEQ ID NO: 324762 - RNA, 19 nt, Homo sapiens
caacuuucccaucuugucu

SEQ ID NO: 324763 - RNA, 19 nt, Homo sapiens
ugcagacaguggccaagaa

SEQ ID NO: 324764 - RNA, 19 nt, Homo sapiens
gaccagaccgcagaguuca

SEQ ID NO: 324765 - RNA, 19 nt, Homo sapiens
gaagcguuugugaggcaua

SEQ ID NO: 324766 - RNA, 19 nt, Homo sapiens
ccagggcaccuaugaggau

SEQ ID NO: 324767 - RNA, 19 nt, Homo sapiens
gacagcaaugguuguauca

SEQ ID NO: 324768 - RNA, 19 nt, Homo sapiens
uuucuugucucagcaacuu

SEQ ID NO: 324769 - RNA, 19 nt, Homo sapiens
gcagacaguggccaagaac

SEQ ID NO: 324770 - RNA, 19 nt, Homo sapiens
uaucuagccuaaaguuucc

SEQ ID NO: 324771 - RNA, 19 nt, Homo sapiens
caaggaccagggcaccuau

SEQ ID NO: 324772 - RNA, 19 nt, Homo sapiens
acaaggaccagggcaccua

SEQ ID NO: 324773 - RNA, 19 nt, Homo sapiens
ggacagcaaugguuguauc

SEQ ID NO: 324774 - RNA, 19 nt, Homo sapiens
ugaaggugcuggacuuuga

SEQ ID NO: 324775 - RNA, 19 nt, Homo sapiens
cgucagcauucaccaaaua

SEQ ID NO: 324776 - RNA, 19 nt, Homo sapiens
uaucaacuaugaagcguuu

SEQ ID NO: 324777 - RNA, 19 nt, Homo sapiens
gugaugagaugaaugugaa

SEQ ID NO: 324778 - RNA, 19 nt, Homo sapiens
gagcugagcagucaagaug

SEQ ID NO: 324779 - RNA, 19 nt, Homo sapiens
cagcaacuuucccaucuug

SEQ ID NO: 324780 - RNA, 19 nt, Homo sapiens
cgucaugggugcugaaauc

SEQ ID NO: 324781 - RNA, 19 nt, Homo sapiens
caucuugucucucuuggau

SEQ ID NO: 324782 - RNA, 19 nt, Homo sapiens
caagagugaugagaugaau

SEQ ID NO: 324783 - RNA, 19 nt, Homo sapiens
ccggagagcugagcaguca

SEQ ID NO: 324784 - RNA, 19 nt, Homo sapiens
gcugagcagucaagaugug

SEQ ID NO: 324785 - RNA, 19 nt, Homo sapiens
guaucuagccuaaaguuuc

SEQ ID NO: 324786 - RNA, 19 nt, Homo sapiens
ggacuucggguguuugaca

SEQ ID NO: 324787 - RNA, 19 nt, Homo sapiens
gaacaggugauggcaagau

SEQ ID NO: 324788 - RNA, 19 nt, Homo sapiens
gaggacagcaaugguugua

SEQ ID NO: 324789 - RNA, 19 nt, Homo sapiens
gagcagucaagauguguga

SEQ ID NO: 324790 - RNA, 19 nt, Homo sapiens
ccaaauaaacuugcucucu

SEQ ID NO: 324791 - RNA, 19 nt, Homo sapiens
ucuugucucucuuggauga

SEQ ID NO: 324792 - RNA, 19 nt, Homo sapiens
gcuggacuuugagcacuuu

SEQ ID NO: 324793 - RNA, 19 nt, Homo sapiens
gcauucaccaaauaaacuu

SEQ ID NO: 324794 - RNA, 19 nt, Homo sapiens
cugaauggcugaggaccuu

SEQ ID NO: 324795 - RNA, 19 nt, Homo sapiens
ccaagagugaugagaugaa

SEQ ID NO: 324796 - RNA, 19 nt, Homo sapiens
cugaggaccuucccagucu

SEQ ID NO: 324797 - RNA, 19 nt, Homo sapiens
ucccuaggcuuucuugucu

SEQ ID NO: 324798 - RNA, 19 nt, Homo sapiens
caugaggacagcaaugguu

SEQ ID NO: 324799 - RNA, 19 nt, Homo sapiens
agacaguggccaagaacaa

SEQ ID NO: 324800 - RNA, 19 nt, Homo sapiens
ccuaggcuuucuugucuca

SEQ ID NO: 324801 - RNA, 19 nt, Homo sapiens
gccuuucccugugugaauu

SEQ ID NO: 324802 - RNA, 19 nt, Homo sapiens
ggagagcugagcagucaag

SEQ ID NO: 324803 - RNA, 19 nt, Homo sapiens
gcaacuuucccaucuuguc

SEQ ID NO: 324804 - RNA, 19 nt, Homo sapiens
ucagcaacuuucccaucuu

SEQ ID NO: 324805 - RNA, 19 nt, Homo sapiens
ggacuuugagcacuuucug

SEQ ID NO: 324806 - RNA, 19 nt, Homo sapiens
gacuucggguguuugacaa

SEQ ID NO: 324807 - RNA, 19 nt, Homo sapiens
agagugaugagaugaaugu

SEQ ID NO: 324808 - RNA, 19 nt, Homo sapiens
gccgucagcauucaccaaa

SEQ ID NO: 324809 - RNA, 19 nt, Homo sapiens
caacuuucccaucuugucu

SEQ ID NO: 324810 - RNA, 19 nt, Homo sapiens
ugcagacaguggccaagaa

SEQ ID NO: 324811 - RNA, 19 nt, Homo sapiens
gaagcguuugugaggcaua

SEQ ID NO: 324812 - RNA, 19 nt, Homo sapiens
ccagggcaccuaugaggau

SEQ ID NO: 324813 - RNA, 19 nt, Homo sapiens
gacagcaaugguuguauca

SEQ ID NO: 324814 - RNA, 19 nt, Homo sapiens
uuucuugucucagcaacuu

SEQ ID NO: 324815 - RNA, 19 nt, Homo sapiens
gcagacaguggccaagaac

SEQ ID NO: 324816 - RNA, 19 nt, Homo sapiens
gucagcauucaccaaauaa

SEQ ID NO: 324817 - RNA, 19 nt, Homo sapiens
uaucuagccuaaaguuucc

SEQ ID NO: 324818 - RNA, 19 nt, Homo sapiens
caaggaccagggcaccuau

SEQ ID NO: 324819 - RNA, 19 nt, Homo sapiens
acaaggaccagggcaccua

SEQ ID NO: 324820 - RNA, 19 nt, Homo sapiens
cccaagcacugaguucaag

SEQ ID NO: 324821 - RNA, 19 nt, Homo sapiens
gggaacugcucuuuaauua

SEQ ID NO: 324822 - RNA, 19 nt, Homo sapiens
ggacaggucuuucgacuug

SEQ ID NO: 324823 - RNA, 19 nt, Homo sapiens
gaaauccgcuagcaaagaa

SEQ ID NO: 324824 - RNA, 19 nt, Homo sapiens
agaaagacguuaagaauga

SEQ ID NO: 324825 - RNA, 19 nt, Homo sapiens
ggaaaagccucauguaaaa

SEQ ID NO: 324826 - RNA, 19 nt, Homo sapiens
gcaaucugcugaagaaaga

SEQ ID NO: 324827 - RNA, 19 nt, Homo sapiens
ggaaggaacuagccacaug

SEQ ID NO: 324828 - RNA, 19 nt, Homo sapiens
ccaagaaacucuccaagga

SEQ ID NO: 324829 - RNA, 19 nt, Homo sapiens
aagaagaacucaagaaaga

SEQ ID NO: 324830 - RNA, 19 nt, Homo sapiens
gacgggaacugcucuuuaa

SEQ ID NO: 324831 - RNA, 19 nt, Homo sapiens
ggaagaagagugaaacaaa

SEQ ID NO: 324832 - RNA, 19 nt, Homo sapiens
gaacauggaggccaagaaa

SEQ ID NO: 324833 - RNA, 19 nt, Homo sapiens
gaagaagagugaaacaaag

SEQ ID NO: 324834 - RNA, 19 nt, Homo sapiens
gaauauaaguuccguguac

SEQ ID NO: 324835 - RNA, 19 nt, Homo sapiens
gaaauuaccagcagagaau

SEQ ID NO: 324836 - RNA, 19 nt, Homo sapiens
gaagaugugucccaagcuu

SEQ ID NO: 324837 - RNA, 19 nt, Homo sapiens
caaagaagaacucaagaaa

SEQ ID NO: 324838 - RNA, 19 nt, Homo sapiens
ggacagaggcuuauacaag

SEQ ID NO: 324839 - RNA, 19 nt, Homo sapiens
caagaaagacguuaagaau

SEQ ID NO: 324840 - RNA, 19 nt, Homo sapiens
cagcauccauggcuaauga

SEQ ID NO: 324841 - RNA, 19 nt, Homo sapiens
uaagaccauucgcgauuua

SEQ ID NO: 324842 - RNA, 19 nt, Homo sapiens
ggacgggaacugcucuuua

SEQ ID NO: 324843 - RNA, 19 nt, Homo sapiens
ggaucaagcucaucgacuu

SEQ ID NO: 324844 - RNA, 19 nt, Homo sapiens
caaagacccuaucggaaga

SEQ ID NO: 324845 - RNA, 19 nt, Homo sapiens
ggaagacuguccucuaugg

SEQ ID NO: 324846 - RNA, 19 nt, Homo sapiens
gacagaggcuuauacaagu

SEQ ID NO: 324847 - RNA, 19 nt, Homo sapiens
gcaaagaagaacucaagaa

SEQ ID NO: 324848 - RNA, 19 nt, Homo sapiens
ggaagaggaagaagaguga

SEQ ID NO: 324849 - RNA, 19 nt, Homo sapiens
gcaaucaacguguauggaa

SEQ ID NO: 324850 - RNA, 19 nt, Homo sapiens
gacaaucaauacugaacaa

SEQ ID NO: 324851 - RNA, 19 nt, Homo sapiens
guacauggcaagaaggaaa

SEQ ID NO: 324852 - RNA, 19 nt, Homo sapiens
ccaaggaccggaugaagaa

SEQ ID NO: 324853 - RNA, 19 nt, Homo sapiens
ccaaggauuucaucagcaa

SEQ ID NO: 324854 - RNA, 19 nt, Homo sapiens
gcagugcuguacaguccua

SEQ ID NO: 324855 - RNA, 19 nt, Homo sapiens
gaaauuuggacaggucuuu

SEQ ID NO: 324856 - RNA, 19 nt, Homo sapiens
agaaugaugugaacugcaa

SEQ ID NO: 324857 - RNA, 19 nt, Homo sapiens
gaaagacguuaagaaugau

SEQ ID NO: 324858 - RNA, 19 nt, Homo sapiens
cugaagugaucaacuauga

SEQ ID NO: 324859 - RNA, 19 nt, Homo sapiens
caaccucacugucguggau

SEQ ID NO: 324860 - RNA, 19 nt, Homo sapiens
cugaagagccgaaggauga

SEQ ID NO: 324861 - RNA, 19 nt, Homo sapiens
gagagucaguggagcuguu

SEQ ID NO: 324862 - RNA, 19 nt, Homo sapiens
gaacucaagaaagacguua

SEQ ID NO: 324863 - RNA, 19 nt, Homo sapiens
gagauuagcaucaugaacu

SEQ ID NO: 324864 - RNA, 19 nt, Homo sapiens
ccaaggcaguggagaguuc

SEQ ID NO: 324865 - RNA, 19 nt, Homo sapiens
ggaugacgaugccaaguac

SEQ ID NO: 324866 - RNA, 19 nt, Homo sapiens
gggaugacgaugccaagua

SEQ ID NO: 324867 - RNA, 19 nt, Homo sapiens
agauuugacugcaagauug

SEQ ID NO: 324868 - RNA, 19 nt, Homo sapiens
ggagacaacgauaacgaaa

SEQ ID NO: 324869 - RNA, 19 nt, Homo sapiens
guggaugccuuugaagaaa

SEQ ID NO: 324870 - RNA, 19 nt, Homo sapiens
auuaggaucugggaaauuu

SEQ ID NO: 324871 - RNA, 19 nt, Homo sapiens
agaaggagcccgagguuga

SEQ ID NO: 324872 - RNA, 19 nt, Homo sapiens
auucggagcuccucacuga

SEQ ID NO: 324873 - RNA, 19 nt, Homo sapiens
gagcgugagugcaucaagu

SEQ ID NO: 324874 - RNA, 19 nt, Homo sapiens
gcaaugccaagccugauga

SEQ ID NO: 324875 - RNA, 19 nt, Homo sapiens
cuaagaccauucgcgauuu

SEQ ID NO: 324876 - RNA, 19 nt, Homo sapiens
gaucaagcucaucgacuuu

SEQ ID NO: 324877 - RNA, 19 nt, Homo sapiens
caucaugugugucaacaag

SEQ ID NO: 324878 - RNA, 19 nt, Homo sapiens
cgacauugaggagagauua

SEQ ID NO: 324879 - RNA, 19 nt, Homo sapiens
acacacugcugguggagaa

SEQ ID NO: 324880 - RNA, 19 nt, Homo sapiens
gcugcaagauguucaugug

SEQ ID NO: 324881 - RNA, 19 nt, Homo sapiens
ucaagaaagacguuaagaa

SEQ ID NO: 324882 - RNA, 19 nt, Homo sapiens
agaaguacauggcaagaag

SEQ ID NO: 324883 - RNA, 19 nt, Homo sapiens
ugaaagauaccaagaacau

SEQ ID NO: 324884 - RNA, 19 nt, Homo sapiens
ggucaucugcuacauccua

SEQ ID NO: 324885 - RNA, 19 nt, Homo sapiens
ggacagugacaaucaauac

SEQ ID NO: 324886 - RNA, 19 nt, Homo sapiens
guaaaacccuauuucucua

SEQ ID NO: 324887 - RNA, 19 nt, Homo sapiens
gcagggaccacagauaaug

SEQ ID NO: 324888 - RNA, 19 nt, Homo sapiens
ggaacugcucuuuaauuau

SEQ ID NO: 324889 - RNA, 19 nt, Homo sapiens
gcaggagauuagcaucaug

SEQ ID NO: 324890 - RNA, 19 nt, Homo sapiens
aaagaaaacucgaaaaguc

SEQ ID NO: 324891 - RNA, 19 nt, Homo sapiens
gaaaagaaaacucgaaaag

SEQ ID NO: 324892 - RNA, 19 nt, Homo sapiens
gcacugcggcugcuacaca

SEQ ID NO: 324893 - RNA, 19 nt, Homo sapiens
gcagcaagcucaccauccu

SEQ ID NO: 324894 - RNA, 19 nt, Homo sapiens
ucuggacgcugaauggaaa

SEQ ID NO: 324895 - RNA, 19 nt, Homo sapiens
ugaaacaaagccagagaaa

SEQ ID NO: 324896 - RNA, 19 nt, Homo sapiens
ugucaacagucuuggagaa

SEQ ID NO: 324897 - RNA, 19 nt, Homo sapiens
acugcaagauugaaggaua

SEQ ID NO: 324898 - RNA, 19 nt, Homo sapiens
gcaccaggaucaagcucau

SEQ ID NO: 324899 - RNA, 19 nt, Homo sapiens
ucacaacgguaggagagaa

SEQ ID NO: 324900 - RNA, 19 nt, Homo sapiens
caacaagacguggaaggaa

SEQ ID NO: 324901 - RNA, 19 nt, Homo sapiens
gcuaggaacugagagugau

SEQ ID NO: 324902 - RNA, 19 nt, Homo sapiens
acaaguguguagccaagaa

SEQ ID NO: 324903 - RNA, 19 nt, Homo sapiens
gaaagauaccaagaacaug

SEQ ID NO: 324904 - RNA, 19 nt, Homo sapiens
gcugaagaaagauaugaaa

SEQ ID NO: 324905 - RNA, 19 nt, Homo sapiens
ggaugaaguuccgaaagca

SEQ ID NO: 324906 - RNA, 19 nt, Homo sapiens
ccugaaauccgcuagcaaa

SEQ ID NO: 324907 - RNA, 19 nt, Homo sapiens
gaagaaguacauggcaaga

SEQ ID NO: 324908 - RNA, 19 nt, Homo sapiens
cuccugaagugaucaacua

SEQ ID NO: 324909 - RNA, 19 nt, Homo sapiens
ccagauagacuacgaugag

SEQ ID NO: 324910 - RNA, 19 nt, Homo sapiens
cauucgcgauuuagaaguu

SEQ ID NO: 324911 - RNA, 19 nt, Homo sapiens
caaggcauauucagcaaaa

SEQ ID NO: 324912 - RNA, 19 nt, Homo sapiens
acaggucuuucgacuugua

SEQ ID NO: 324913 - RNA, 19 nt, Homo sapiens
gaccauucgcgauuuagaa

SEQ ID NO: 324914 - RNA, 19 nt, Homo sapiens
ccaaccagcccgcucaaug

SEQ ID NO: 324915 - RNA, 19 nt, Homo sapiens
gaaaccuuggccaacguua

SEQ ID NO: 324916 - RNA, 19 nt, Homo sapiens
uuggaagacuguccucuau

SEQ ID NO: 324917 - RNA, 19 nt, Homo sapiens
agacgaggcagccaacuga

SEQ ID NO: 324918 - RNA, 19 nt, Homo sapiens
ugccugaccacgaauauaa

SEQ ID NO: 324919 - RNA, 19 nt, Homo sapiens
agaaggaaauggcagaaaa

SEQ ID NO: 324920 - RNA, 19 nt, Homo sapiens
ucuaagaccauucgcgauu

SEQ ID NO: 324921 - RNA, 19 nt, Homo sapiens
ggaaagaggugaccaaugu

SEQ ID NO: 324922 - RNA, 19 nt, Homo sapiens
gggaacugcucuuuaauua

SEQ ID NO: 324923 - RNA, 19 nt, Homo sapiens
ggacaggucuuucgacuug

SEQ ID NO: 324924 - RNA, 19 nt, Homo sapiens
gaaauccgcuagcaaagaa

SEQ ID NO: 324925 - RNA, 19 nt, Homo sapiens
agaaagacguuaagaauga

SEQ ID NO: 324926 - RNA, 19 nt, Homo sapiens
gccaauaggucauuuguga

SEQ ID NO: 324927 - RNA, 19 nt, Homo sapiens
gcaaagcccucugcaaaga

SEQ ID NO: 324928 - RNA, 19 nt, Homo sapiens
ggaaaagccucauguaaaa

SEQ ID NO: 324929 - RNA, 19 nt, Homo sapiens
gcaaucugcugaagaaaga

SEQ ID NO: 324930 - RNA, 19 nt, Homo sapiens
ggaaggaacuagccacaug

SEQ ID NO: 324931 - RNA, 19 nt, Homo sapiens
gcauugagguuuaugaaga

SEQ ID NO: 324932 - RNA, 19 nt, Homo sapiens
ccaagaaacucuccaagga

SEQ ID NO: 324933 - RNA, 19 nt, Homo sapiens
aagaagaacucaagaaaga

SEQ ID NO: 324934 - RNA, 19 nt, Homo sapiens
gacgggaacugcucuuuaa

SEQ ID NO: 324935 - RNA, 19 nt, Homo sapiens
ggaagaagagugaaacaaa

SEQ ID NO: 324936 - RNA, 19 nt, Homo sapiens
gaacauggaggccaagaaa

SEQ ID NO: 324937 - RNA, 19 nt, Homo sapiens
gaagaagagugaaacaaag

SEQ ID NO: 324938 - RNA, 19 nt, Homo sapiens
gaauauaaguuccguguac

SEQ ID NO: 324939 - RNA, 19 nt, Homo sapiens
gaaauuaccagcagagaau

SEQ ID NO: 324940 - RNA, 19 nt, Homo sapiens
gaagaugugucccaagcuu

SEQ ID NO: 324941 - RNA, 19 nt, Homo sapiens
caaagacacuggccacuuc

SEQ ID NO: 324942 - RNA, 19 nt, Homo sapiens
caaagaagaacucaagaaa

SEQ ID NO: 324943 - RNA, 19 nt, Homo sapiens
ggacugcgcuguuauugag

SEQ ID NO: 324944 - RNA, 19 nt, Homo sapiens
ggacagaggcuuauacaag

SEQ ID NO: 324945 - RNA, 19 nt, Homo sapiens
caagaaagacguuaagaau

SEQ ID NO: 324946 - RNA, 19 nt, Homo sapiens
cagcauccauggcuaauga

SEQ ID NO: 324947 - RNA, 19 nt, Homo sapiens
ggacgauucuccugcaaga

SEQ ID NO: 324948 - RNA, 19 nt, Homo sapiens
uaagaccauucgcgauuua

SEQ ID NO: 324949 - RNA, 19 nt, Homo sapiens
ggacgggaacugcucuuua

SEQ ID NO: 324950 - RNA, 19 nt, Homo sapiens
ggaucaagcucaucgacuu

SEQ ID NO: 324951 - RNA, 19 nt, Homo sapiens
caaagacccuaucggaaga

SEQ ID NO: 324952 - RNA, 19 nt, Homo sapiens
ggaagacuguccucuaugg

SEQ ID NO: 324953 - RNA, 19 nt, Homo sapiens
gacagaggcuuauacaagu

SEQ ID NO: 324954 - RNA, 19 nt, Homo sapiens
gcaaagaagaacucaagaa

SEQ ID NO: 324955 - RNA, 19 nt, Homo sapiens
ggaaaggcuugccgugaug

SEQ ID NO: 324956 - RNA, 19 nt, Homo sapiens
ucacuuggcugcugaaugg

SEQ ID NO: 324957 - RNA, 19 nt, Homo sapiens
ccagagggauucagcauuc

SEQ ID NO: 324958 - RNA, 19 nt, Homo sapiens
caauucagaugucaggaaa

SEQ ID NO: 324959 - RNA, 19 nt, Homo sapiens
ggaaauccauggagucaac

SEQ ID NO: 324960 - RNA, 19 nt, Homo sapiens
ggaagaggaagaagaguga

SEQ ID NO: 324961 - RNA, 19 nt, Homo sapiens
ucagaggacuuccacuuug

SEQ ID NO: 324962 - RNA, 19 nt, Homo sapiens
gcaaucaacguguauggaa

SEQ ID NO: 324963 - RNA, 19 nt, Homo sapiens
gacaaucaauacugaacaa

SEQ ID NO: 324964 - RNA, 19 nt, Homo sapiens
gggccucucugaucucaaa

SEQ ID NO: 324965 - RNA, 19 nt, Homo sapiens
gcaugcagguucuggaaau

SEQ ID NO: 324966 - RNA, 19 nt, Homo sapiens
gaaggacugcgcuguuauu

SEQ ID NO: 324967 - RNA, 19 nt, Homo sapiens
guggaucccucaagaguug

SEQ ID NO: 324968 - RNA, 19 nt, Homo sapiens
ucaccuggcucaagggaaa

SEQ ID NO: 324969 - RNA, 19 nt, Homo sapiens
gaaggcagcauugagguuu

SEQ ID NO: 324970 - RNA, 19 nt, Homo sapiens
ggagugcccaccaaaguuu

SEQ ID NO: 324971 - RNA, 19 nt, Homo sapiens
gccaagauguugugagcaa

SEQ ID NO: 324972 - RNA, 19 nt, Homo sapiens
ugaccaauguaaucucaaa

SEQ ID NO: 324973 - RNA, 19 nt, Homo sapiens
gaaagaggugaccaaugua

SEQ ID NO: 324974 - RNA, 19 nt, Homo sapiens
guacauggcaagaaggaaa

SEQ ID NO: 324975 - RNA, 19 nt, Homo sapiens
ccaaggaccggaugaagaa

SEQ ID NO: 324976 - RNA, 19 nt, Homo sapiens
ccaaggauuucaucagcaa

SEQ ID NO: 324977 - RNA, 19 nt, Homo sapiens
gcagugcuguacaguccua

SEQ ID NO: 324978 - RNA, 19 nt, Homo sapiens
gaacucagcacagccuuug

SEQ ID NO: 324979 - RNA, 19 nt, Homo sapiens
cagaggacuuccacuuuga

SEQ ID NO: 324980 - RNA, 19 nt, Homo sapiens
gaaauuuggacaggucuuu

SEQ ID NO: 324981 - RNA, 19 nt, Homo sapiens
agaaugaugugaacugcaa

SEQ ID NO: 324982 - RNA, 19 nt, Homo sapiens
gaaagacguuaagaaugau

SEQ ID NO: 324983 - RNA, 19 nt, Homo sapiens
ucgaggugcuucagaauga

SEQ ID NO: 324984 - RNA, 19 nt, Homo sapiens
cugaaggacugcgcuguua

SEQ ID NO: 324985 - RNA, 19 nt, Homo sapiens
gaacuuuccauccaagguu

SEQ ID NO: 324986 - RNA, 19 nt, Homo sapiens
cugaagugaucaacuauga

SEQ ID NO: 324987 - RNA, 19 nt, Homo sapiens
caaccucacugucguggau

SEQ ID NO: 324988 - RNA, 19 nt, Homo sapiens
ggucaaagaaggacagaug

SEQ ID NO: 324989 - RNA, 19 nt, Homo sapiens
cugaagagccgaaggauga

SEQ ID NO: 324990 - RNA, 19 nt, Homo sapiens
gagagucaguggagcuguu

SEQ ID NO: 324991 - RNA, 19 nt, Homo sapiens
gaacucaagaaagacguua

SEQ ID NO: 324992 - RNA, 19 nt, Homo sapiens
ccaauguaaucucaaagga

SEQ ID NO: 324993 - RNA, 19 nt, Homo sapiens
gagauuagcaucaugaacu

SEQ ID NO: 324994 - RNA, 19 nt, Homo sapiens
ccaaggcaguggagaguuc

SEQ ID NO: 324995 - RNA, 19 nt, Homo sapiens
gaaccucugcaucaaagaa

SEQ ID NO: 324996 - RNA, 19 nt, Homo sapiens
ggaugacgaugccaaguac

SEQ ID NO: 324997 - RNA, 19 nt, Homo sapiens
gggaugacgaugccaagua

SEQ ID NO: 324998 - RNA, 19 nt, Homo sapiens
agauuugacugcaagauug

SEQ ID NO: 324999 - RNA, 19 nt, Homo sapiens
ggagacaacgauaacgaaa

SEQ ID NO: 325000 - RNA, 19 nt, Homo sapiens
guggaugccuuugaagaaa

SEQ ID NO: 325001 - RNA, 19 nt, Homo sapiens
auuaggaucugggaaauuu

SEQ ID NO: 325002 - RNA, 19 nt, Homo sapiens
agaaggagcccgagguuga

SEQ ID NO: 325003 - RNA, 19 nt, Homo sapiens
auucggagcuccucacuga

SEQ ID NO: 325004 - RNA, 19 nt, Homo sapiens
gagcgugagugcaucaagu

SEQ ID NO: 325005 - RNA, 19 nt, Homo sapiens
gcaaugccaagccugauga

SEQ ID NO: 325006 - RNA, 19 nt, Homo sapiens
uggcaaagcccucugcaaa

SEQ ID NO: 325007 - RNA, 19 nt, Homo sapiens
gggaaaguauaccugugaa

SEQ ID NO: 325008 - RNA, 19 nt, Homo sapiens
cuaagaccauucgcgauuu

SEQ ID NO: 325009 - RNA, 19 nt, Homo sapiens
gaucaagcucaucgacuuu

SEQ ID NO: 325010 - RNA, 19 nt, Homo sapiens
caucaugugugucaacaag

SEQ ID NO: 325011 - RNA, 19 nt, Homo sapiens
cgacauugaggagagauua

SEQ ID NO: 325012 - RNA, 19 nt, Homo sapiens
acacacugcugguggagaa

SEQ ID NO: 325013 - RNA, 19 nt, Homo sapiens
gcugcaagauguucaugug

SEQ ID NO: 325014 - RNA, 19 nt, Homo sapiens
ucaagaaagacguuaagaa

SEQ ID NO: 325015 - RNA, 19 nt, Homo sapiens
caacaaacaacagagaaga

SEQ ID NO: 325016 - RNA, 19 nt, Homo sapiens
gaugucagcugaacuuucc

SEQ ID NO: 325017 - RNA, 19 nt, Homo sapiens
ggaguugacaguagaagga

SEQ ID NO: 325018 - RNA, 19 nt, Homo sapiens
agaaguacauggcaagaag

SEQ ID NO: 325019 - RNA, 19 nt, Homo sapiens
ugaaagauaccaagaacau

SEQ ID NO: 325020 - RNA, 19 nt, Homo sapiens
ggucaucugcuacauccua

SEQ ID NO: 325021 - RNA, 19 nt, Homo sapiens
ggaaagaggugaccaaugu

SEQ ID NO: 325022 - RNA, 19 nt, Homo sapiens
gggaacugcucuuuaauua

SEQ ID NO: 325023 - RNA, 19 nt, Homo sapiens
ggacaggucuuucgacuug

SEQ ID NO: 325024 - RNA, 19 nt, Homo sapiens
gaaauccgcuagcaaagaa

SEQ ID NO: 325025 - RNA, 19 nt, Homo sapiens
agaaagacguuaagaauga

SEQ ID NO: 325026 - RNA, 19 nt, Homo sapiens
gccaauaggucauuuguga

SEQ ID NO: 325027 - RNA, 19 nt, Homo sapiens
gcaaagcccucugcaaaga

SEQ ID NO: 325028 - RNA, 19 nt, Homo sapiens
ggaaaagccucauguaaaa

SEQ ID NO: 325029 - RNA, 19 nt, Homo sapiens
gcaaucugcugaagaaaga

SEQ ID NO: 325030 - RNA, 19 nt, Homo sapiens
ggaaggaacuagccacaug

SEQ ID NO: 325031 - RNA, 19 nt, Homo sapiens
ccaagaaacucuccaagga

SEQ ID NO: 325032 - RNA, 19 nt, Homo sapiens
aagaagaacucaagaaaga

SEQ ID NO: 325033 - RNA, 19 nt, Homo sapiens
gacgggaacugcucuuuaa

SEQ ID NO: 325034 - RNA, 19 nt, Homo sapiens
ggaagaagagugaaacaaa

SEQ ID NO: 325035 - RNA, 19 nt, Homo sapiens
gaacauggaggccaagaaa

SEQ ID NO: 325036 - RNA, 19 nt, Homo sapiens
gaagaagagugaaacaaag

SEQ ID NO: 325037 - RNA, 19 nt, Homo sapiens
gaauauaaguuccguguac

SEQ ID NO: 325038 - RNA, 19 nt, Homo sapiens
gaaauuaccagcagagaau

SEQ ID NO: 325039 - RNA, 19 nt, Homo sapiens
gaagaugugucccaagcuu

SEQ ID NO: 325040 - RNA, 19 nt, Homo sapiens
caaagacacuggccacuuc

SEQ ID NO: 325041 - RNA, 19 nt, Homo sapiens
caaagaagaacucaagaaa

SEQ ID NO: 325042 - RNA, 19 nt, Homo sapiens
ggacugcgcuguuauugag

SEQ ID NO: 325043 - RNA, 19 nt, Homo sapiens
ggacagaggcuuauacaag

SEQ ID NO: 325044 - RNA, 19 nt, Homo sapiens
caagaaagacguuaagaau

SEQ ID NO: 325045 - RNA, 19 nt, Homo sapiens
cagcauccauggcuaauga

SEQ ID NO: 325046 - RNA, 19 nt, Homo sapiens
ggacgauucuccugcaaga

SEQ ID NO: 325047 - RNA, 19 nt, Homo sapiens
uaagaccauucgcgauuua

SEQ ID NO: 325048 - RNA, 19 nt, Homo sapiens
ggacgggaacugcucuuua

SEQ ID NO: 325049 - RNA, 19 nt, Homo sapiens
ggaucaagcucaucgacuu

SEQ ID NO: 325050 - RNA, 19 nt, Homo sapiens
caaagacccuaucggaaga

SEQ ID NO: 325051 - RNA, 19 nt, Homo sapiens
ggaagacuguccucuaugg

SEQ ID NO: 325052 - RNA, 19 nt, Homo sapiens
gacagaggcuuauacaagu

SEQ ID NO: 325053 - RNA, 19 nt, Homo sapiens
gcaaagaagaacucaagaa

SEQ ID NO: 325054 - RNA, 19 nt, Homo sapiens
ucacuuggcugcugaaugg

SEQ ID NO: 325055 - RNA, 19 nt, Homo sapiens
ccagagggauucagcauuc

SEQ ID NO: 325056 - RNA, 19 nt, Homo sapiens
caauucagaugucaggaaa

SEQ ID NO: 325057 - RNA, 19 nt, Homo sapiens
ggaaauccauggagucaac

SEQ ID NO: 325058 - RNA, 19 nt, Homo sapiens
ggaagaggaagaagaguga

SEQ ID NO: 325059 - RNA, 19 nt, Homo sapiens
ucagaggacuuccacuuug

SEQ ID NO: 325060 - RNA, 19 nt, Homo sapiens
gcaaucaacguguauggaa

SEQ ID NO: 325061 - RNA, 19 nt, Homo sapiens
gacaaucaauacugaacaa

SEQ ID NO: 325062 - RNA, 19 nt, Homo sapiens
gggccucucugaucucaaa

SEQ ID NO: 325063 - RNA, 19 nt, Homo sapiens
gcaugcagguucuggaaau

SEQ ID NO: 325064 - RNA, 19 nt, Homo sapiens
guggaucccucaagaguug

SEQ ID NO: 325065 - RNA, 19 nt, Homo sapiens
gaaggacugcgcuguuauu

SEQ ID NO: 325066 - RNA, 19 nt, Homo sapiens
ucaccuggcucaagggaaa

SEQ ID NO: 325067 - RNA, 19 nt, Homo sapiens
ggagugcccaccaaaguuu

SEQ ID NO: 325068 - RNA, 19 nt, Homo sapiens
gccaagauguugugagcaa

SEQ ID NO: 325069 - RNA, 19 nt, Homo sapiens
ugaccaauguaaucucaaa

SEQ ID NO: 325070 - RNA, 19 nt, Homo sapiens
gaaagaggugaccaaugua

SEQ ID NO: 325071 - RNA, 19 nt, Homo sapiens
guacauggcaagaaggaaa

SEQ ID NO: 325072 - RNA, 19 nt, Homo sapiens
ccaaggaccggaugaagaa

SEQ ID NO: 325073 - RNA, 19 nt, Homo sapiens
ccaaggauuucaucagcaa

SEQ ID NO: 325074 - RNA, 19 nt, Homo sapiens
gcagugcuguacaguccua

SEQ ID NO: 325075 - RNA, 19 nt, Homo sapiens
gaacucagcacagccuuug

SEQ ID NO: 325076 - RNA, 19 nt, Homo sapiens
cagaggacuuccacuuuga

SEQ ID NO: 325077 - RNA, 19 nt, Homo sapiens
gaaauuuggacaggucuuu

SEQ ID NO: 325078 - RNA, 19 nt, Homo sapiens
agaaugaugugaacugcaa

SEQ ID NO: 325079 - RNA, 19 nt, Homo sapiens
gaaagacguuaagaaugau

SEQ ID NO: 325080 - RNA, 19 nt, Homo sapiens
ucgaggugcuucagaauga

SEQ ID NO: 325081 - RNA, 19 nt, Homo sapiens
cugaaggacugcgcuguua

SEQ ID NO: 325082 - RNA, 19 nt, Homo sapiens
gaacuuuccauccaagguu

SEQ ID NO: 325083 - RNA, 19 nt, Homo sapiens
cugaagugaucaacuauga

SEQ ID NO: 325084 - RNA, 19 nt, Homo sapiens
caaccucacugucguggau

SEQ ID NO: 325085 - RNA, 19 nt, Homo sapiens
ggucaaagaaggacagaug

SEQ ID NO: 325086 - RNA, 19 nt, Homo sapiens
cugaagagccgaaggauga

SEQ ID NO: 325087 - RNA, 19 nt, Homo sapiens
gagagucaguggagcuguu

SEQ ID NO: 325088 - RNA, 19 nt, Homo sapiens
gaacucaagaaagacguua

SEQ ID NO: 325089 - RNA, 19 nt, Homo sapiens
ccaauguaaucucaaagga

SEQ ID NO: 325090 - RNA, 19 nt, Homo sapiens
gagauuagcaucaugaacu

SEQ ID NO: 325091 - RNA, 19 nt, Homo sapiens
gaaccucugcaucaaagaa

SEQ ID NO: 325092 - RNA, 19 nt, Homo sapiens
ccaaggcaguggagaguuc

SEQ ID NO: 325093 - RNA, 19 nt, Homo sapiens
ggaugacgaugccaaguac

SEQ ID NO: 325094 - RNA, 19 nt, Homo sapiens
gggaugacgaugccaagua

SEQ ID NO: 325095 - RNA, 19 nt, Homo sapiens
agauuugacugcaagauug

SEQ ID NO: 325096 - RNA, 19 nt, Homo sapiens
ggagacaacgauaacgaaa

SEQ ID NO: 325097 - RNA, 19 nt, Homo sapiens
guggaugccuuugaagaaa

SEQ ID NO: 325098 - RNA, 19 nt, Homo sapiens
auuaggaucugggaaauuu

SEQ ID NO: 325099 - RNA, 19 nt, Homo sapiens
agaaggagcccgagguuga

SEQ ID NO: 325100 - RNA, 19 nt, Homo sapiens
auucggagcuccucacuga

SEQ ID NO: 325101 - RNA, 19 nt, Homo sapiens
gagcgugagugcaucaagu

SEQ ID NO: 325102 - RNA, 19 nt, Homo sapiens
gcaaugccaagccugauga

SEQ ID NO: 325103 - RNA, 19 nt, Homo sapiens
uggcaaagcccucugcaaa

SEQ ID NO: 325104 - RNA, 19 nt, Homo sapiens
gggaaaguauaccugugaa

SEQ ID NO: 325105 - RNA, 19 nt, Homo sapiens
caacaaacaacagagaaga

SEQ ID NO: 325106 - RNA, 19 nt, Homo sapiens
cuaagaccauucgcgauuu

SEQ ID NO: 325107 - RNA, 19 nt, Homo sapiens
gaucaagcucaucgacuuu

SEQ ID NO: 325108 - RNA, 19 nt, Homo sapiens
caucaugugugucaacaag

SEQ ID NO: 325109 - RNA, 19 nt, Homo sapiens
cgacauugaggagagauua

SEQ ID NO: 325110 - RNA, 19 nt, Homo sapiens
acacacugcugguggagaa

SEQ ID NO: 325111 - RNA, 19 nt, Homo sapiens
gcugcaagauguucaugug

SEQ ID NO: 325112 - RNA, 19 nt, Homo sapiens
ucaagaaagacguuaagaa

SEQ ID NO: 325113 - RNA, 19 nt, Homo sapiens
gugaagggcuugccgugau

SEQ ID NO: 325114 - RNA, 19 nt, Homo sapiens
gaugucagcugaacuuucc

SEQ ID NO: 325115 - RNA, 19 nt, Homo sapiens
ggaguugacaguagaagga

SEQ ID NO: 325116 - RNA, 19 nt, Homo sapiens
agaaguacauggcaagaag

SEQ ID NO: 325117 - RNA, 19 nt, Homo sapiens
ugaaagauaccaagaacau

SEQ ID NO: 325118 - RNA, 19 nt, Homo sapiens
ggucaucugcuacauccua

SEQ ID NO: 325119 - RNA, 19 nt, Homo sapiens
ggacagugacaaucaauac

SEQ ID NO: 325120 - RNA, 19 nt, Homo sapiens
gcaaagacacuggccacuu

SEQ ID NO: 325121 - RNA, 19 nt, Homo sapiens
ggaaagaggugaccaaugu

SEQ ID NO: 325122 - RNA, 19 nt, Homo sapiens
gggaacugcucuuuaauua

SEQ ID NO: 325123 - RNA, 19 nt, Homo sapiens
ggacaggucuuucgacuug

SEQ ID NO: 325124 - RNA, 19 nt, Homo sapiens
gaaauccgcuagcaaagaa

SEQ ID NO: 325125 - RNA, 19 nt, Homo sapiens
agaaagacguuaagaauga

SEQ ID NO: 325126 - RNA, 19 nt, Homo sapiens
gccaauaggucauuuguga

SEQ ID NO: 325127 - RNA, 19 nt, Homo sapiens
gcaaagcccucugcaaaga

SEQ ID NO: 325128 - RNA, 19 nt, Homo sapiens
ggaaaagccucauguaaaa

SEQ ID NO: 325129 - RNA, 19 nt, Homo sapiens
ggaaggaacuagccacaug

SEQ ID NO: 325130 - RNA, 19 nt, Homo sapiens
gcauugagguuuaugaaga

SEQ ID NO: 325131 - RNA, 19 nt, Homo sapiens
ccaagaaacucuccaagga

SEQ ID NO: 325132 - RNA, 19 nt, Homo sapiens
aagaagaacucaagaaaga

SEQ ID NO: 325133 - RNA, 19 nt, Homo sapiens
gacgggaacugcucuuuaa

SEQ ID NO: 325134 - RNA, 19 nt, Homo sapiens
ggaagaagagugaaacaaa

SEQ ID NO: 325135 - RNA, 19 nt, Homo sapiens
gaacauggaggccaagaaa

SEQ ID NO: 325136 - RNA, 19 nt, Homo sapiens
gaagaagagugaaacaaag

SEQ ID NO: 325137 - RNA, 19 nt, Homo sapiens
gaauauaaguuccguguac

SEQ ID NO: 325138 - RNA, 19 nt, Homo sapiens
gaaauuaccagcagagaau

SEQ ID NO: 325139 - RNA, 19 nt, Homo sapiens
gaagaugugucccaagcuu

SEQ ID NO: 325140 - RNA, 19 nt, Homo sapiens
caaagacacuggccacuuc

SEQ ID NO: 325141 - RNA, 19 nt, Homo sapiens
caaagaagaacucaagaaa

SEQ ID NO: 325142 - RNA, 19 nt, Homo sapiens
ggacugcgcuguuauugag

SEQ ID NO: 325143 - RNA, 19 nt, Homo sapiens
ggacagaggcuuauacaag

SEQ ID NO: 325144 - RNA, 19 nt, Homo sapiens
caagaaagacguuaagaau

SEQ ID NO: 325145 - RNA, 19 nt, Homo sapiens
cagcauccauggcuaauga

SEQ ID NO: 325146 - RNA, 19 nt, Homo sapiens
ggacgauucuccugcaaga

SEQ ID NO: 325147 - RNA, 19 nt, Homo sapiens
uaagaccauucgcgauuua

SEQ ID NO: 325148 - RNA, 19 nt, Homo sapiens
ggacgggaacugcucuuua

SEQ ID NO: 325149 - RNA, 19 nt, Homo sapiens
ggaucaagcucaucgacuu

SEQ ID NO: 325150 - RNA, 19 nt, Homo sapiens
caaagacccuaucggaaga

SEQ ID NO: 325151 - RNA, 19 nt, Homo sapiens
ggaagacuguccucuaugg

SEQ ID NO: 325152 - RNA, 19 nt, Homo sapiens
gacagaggcuuauacaagu

SEQ ID NO: 325153 - RNA, 19 nt, Homo sapiens
gcaaagaagaacucaagaa

SEQ ID NO: 325154 - RNA, 19 nt, Homo sapiens
ggaaaggcuugccgugaug

SEQ ID NO: 325155 - RNA, 19 nt, Homo sapiens
ucacuuggcugcugaaugg

SEQ ID NO: 325156 - RNA, 19 nt, Homo sapiens
ccagagggauucagcauuc

SEQ ID NO: 325157 - RNA, 19 nt, Homo sapiens
caauucagaugucaggaaa

SEQ ID NO: 325158 - RNA, 19 nt, Homo sapiens
ggaaauccauggagucaac

SEQ ID NO: 325159 - RNA, 19 nt, Homo sapiens
ggaagaggaagaagaguga

SEQ ID NO: 325160 - RNA, 19 nt, Homo sapiens
ucagaggacuuccacuuug

SEQ ID NO: 325161 - RNA, 19 nt, Homo sapiens
gcaaucaacguguauggaa

SEQ ID NO: 325162 - RNA, 19 nt, Homo sapiens
gacaaucaauacugaacaa

SEQ ID NO: 325163 - RNA, 19 nt, Homo sapiens
gggccucucugaucucaaa

SEQ ID NO: 325164 - RNA, 19 nt, Homo sapiens
gcaugcagguucuggaaau

SEQ ID NO: 325165 - RNA, 19 nt, Homo sapiens
guggaucccucaagaguug

SEQ ID NO: 325166 - RNA, 19 nt, Homo sapiens
gaaggacugcgcuguuauu

SEQ ID NO: 325167 - RNA, 19 nt, Homo sapiens
ucaccuggcucaagggaaa

SEQ ID NO: 325168 - RNA, 19 nt, Homo sapiens
gaaggcagcauugagguuu

SEQ ID NO: 325169 - RNA, 19 nt, Homo sapiens
ggagugcccaccaaaguuu

SEQ ID NO: 325170 - RNA, 19 nt, Homo sapiens
gccaagauguugugagcaa

SEQ ID NO: 325171 - RNA, 19 nt, Homo sapiens
ugaccaauguaaucucaaa

SEQ ID NO: 325172 - RNA, 19 nt, Homo sapiens
gaaagaggugaccaaugua

SEQ ID NO: 325173 - RNA, 19 nt, Homo sapiens
guacauggcaagaaggaaa

SEQ ID NO: 325174 - RNA, 19 nt, Homo sapiens
ccaaggaccggaugaagaa

SEQ ID NO: 325175 - RNA, 19 nt, Homo sapiens
gcagugcuguacaguccua

SEQ ID NO: 325176 - RNA, 19 nt, Homo sapiens
gaacucagcacagccuuug

SEQ ID NO: 325177 - RNA, 19 nt, Homo sapiens
cagaggacuuccacuuuga

SEQ ID NO: 325178 - RNA, 19 nt, Homo sapiens
gaaauuuggacaggucuuu

SEQ ID NO: 325179 - RNA, 19 nt, Homo sapiens
agaaugaugugaacugcaa

SEQ ID NO: 325180 - RNA, 19 nt, Homo sapiens
gaaagacguuaagaaugau

SEQ ID NO: 325181 - RNA, 19 nt, Homo sapiens
ucgaggugcuucagaauga

SEQ ID NO: 325182 - RNA, 19 nt, Homo sapiens
cugaaggacugcgcuguua

SEQ ID NO: 325183 - RNA, 19 nt, Homo sapiens
gaacuuuccauccaagguu

SEQ ID NO: 325184 - RNA, 19 nt, Homo sapiens
cugaagugaucaacuauga

SEQ ID NO: 325185 - RNA, 19 nt, Homo sapiens
caaccucacugucguggau

SEQ ID NO: 325186 - RNA, 19 nt, Homo sapiens
ggucaaagaaggacagaug

SEQ ID NO: 325187 - RNA, 19 nt, Homo sapiens
cugaagagccgaaggauga

SEQ ID NO: 325188 - RNA, 19 nt, Homo sapiens
gagagucaguggagcuguu

SEQ ID NO: 325189 - RNA, 19 nt, Homo sapiens
gaacucaagaaagacguua

SEQ ID NO: 325190 - RNA, 19 nt, Homo sapiens
ccaauguaaucucaaagga

SEQ ID NO: 325191 - RNA, 19 nt, Homo sapiens
gagauuagcaucaugaacu

SEQ ID NO: 325192 - RNA, 19 nt, Homo sapiens
gaaccucugcaucaaagaa

SEQ ID NO: 325193 - RNA, 19 nt, Homo sapiens
ccaaggcaguggagaguuc

SEQ ID NO: 325194 - RNA, 19 nt, Homo sapiens
ggaugacgaugccaaguac

SEQ ID NO: 325195 - RNA, 19 nt, Homo sapiens
gggaugacgaugccaagua

SEQ ID NO: 325196 - RNA, 19 nt, Homo sapiens
agauuugacugcaagauug

SEQ ID NO: 325197 - RNA, 19 nt, Homo sapiens
guggaugccuuugaagaaa

SEQ ID NO: 325198 - RNA, 19 nt, Homo sapiens
auuaggaucugggaaauuu

SEQ ID NO: 325199 - RNA, 19 nt, Homo sapiens
agaaggagcccgagguuga

SEQ ID NO: 325200 - RNA, 19 nt, Homo sapiens
auucggagcuccucacuga

SEQ ID NO: 325201 - RNA, 19 nt, Homo sapiens
gagcgugagugcaucaagu

SEQ ID NO: 325202 - RNA, 19 nt, Homo sapiens
gcaaugccaagccugauga

SEQ ID NO: 325203 - RNA, 19 nt, Homo sapiens
uggcaaagcccucugcaaa

SEQ ID NO: 325204 - RNA, 19 nt, Homo sapiens
gggaaaguauaccugugaa

SEQ ID NO: 325205 - RNA, 19 nt, Homo sapiens
caacaaacaacagagaaga

SEQ ID NO: 325206 - RNA, 19 nt, Homo sapiens
cuaagaccauucgcgauuu

SEQ ID NO: 325207 - RNA, 19 nt, Homo sapiens
gaucaagcucaucgacuuu

SEQ ID NO: 325208 - RNA, 19 nt, Homo sapiens
caucaugugugucaacaag

SEQ ID NO: 325209 - RNA, 19 nt, Homo sapiens
cgacauugaggagagauua

SEQ ID NO: 325210 - RNA, 19 nt, Homo sapiens
acacacugcugguggagaa

SEQ ID NO: 325211 - RNA, 19 nt, Homo sapiens
gcugcaagauguucaugug

SEQ ID NO: 325212 - RNA, 19 nt, Homo sapiens
ucaagaaagacguuaagaa

SEQ ID NO: 325213 - RNA, 19 nt, Homo sapiens
gaugucagcugaacuuucc

SEQ ID NO: 325214 - RNA, 19 nt, Homo sapiens
ggaguugacaguagaagga

SEQ ID NO: 325215 - RNA, 19 nt, Homo sapiens
agaaguacauggcaagaag

SEQ ID NO: 325216 - RNA, 19 nt, Homo sapiens
ugaaagauaccaagaacau

SEQ ID NO: 325217 - RNA, 19 nt, Homo sapiens
ggucaucugcuacauccua

SEQ ID NO: 325218 - RNA, 19 nt, Homo sapiens
ggacagugacaaucaauac

SEQ ID NO: 325219 - RNA, 19 nt, Homo sapiens
caggugacauggcacagaa

SEQ ID NO: 325220 - RNA, 19 nt, Homo sapiens
gcaaagacacuggccacuu

SEQ ID NO: 325221 - RNA, 19 nt, Homo sapiens
ggaaagaggugaccaaugu

SEQ ID NO: 325222 - RNA, 19 nt, Homo sapiens
gggaacugcucuuuaauua

SEQ ID NO: 325223 - RNA, 19 nt, Homo sapiens
ggacaggucuuucgacuug

SEQ ID NO: 325224 - RNA, 19 nt, Homo sapiens
gaaauccgcuagcaaagaa

SEQ ID NO: 325225 - RNA, 19 nt, Homo sapiens
agaaagacguuaagaauga

SEQ ID NO: 325226 - RNA, 19 nt, Homo sapiens
gccaauaggucauuuguga

SEQ ID NO: 325227 - RNA, 19 nt, Homo sapiens
gcaaagcccucugcaaaga

SEQ ID NO: 325228 - RNA, 19 nt, Homo sapiens
ggaaaagccucauguaaaa

SEQ ID NO: 325229 - RNA, 19 nt, Homo sapiens
ggaaggaacuagccacaug

SEQ ID NO: 325230 - RNA, 19 nt, Homo sapiens
ccaagaaacucuccaagga

SEQ ID NO: 325231 - RNA, 19 nt, Homo sapiens
aagaagaacucaagaaaga

SEQ ID NO: 325232 - RNA, 19 nt, Homo sapiens
gacgggaacugcucuuuaa

SEQ ID NO: 325233 - RNA, 19 nt, Homo sapiens
ggaagaagagugaaacaaa

SEQ ID NO: 325234 - RNA, 19 nt, Homo sapiens
gaacauggaggccaagaaa

SEQ ID NO: 325235 - RNA, 19 nt, Homo sapiens
gaagaagagugaaacaaag

SEQ ID NO: 325236 - RNA, 19 nt, Homo sapiens
gaauauaaguuccguguac

SEQ ID NO: 325237 - RNA, 19 nt, Homo sapiens
gaaauuaccagcagagaau

SEQ ID NO: 325238 - RNA, 19 nt, Homo sapiens
gaagaugugucccaagcuu

SEQ ID NO: 325239 - RNA, 19 nt, Homo sapiens
caaagacacuggccacuuc

SEQ ID NO: 325240 - RNA, 19 nt, Homo sapiens
caaagaagaacucaagaaa

SEQ ID NO: 325241 - RNA, 19 nt, Homo sapiens
ggacugcgcuguuauugag

SEQ ID NO: 325242 - RNA, 19 nt, Homo sapiens
ggacagaggcuuauacaag

SEQ ID NO: 325243 - RNA, 19 nt, Homo sapiens
caagaaagacguuaagaau

SEQ ID NO: 325244 - RNA, 19 nt, Homo sapiens
cagcauccauggcuaauga

SEQ ID NO: 325245 - RNA, 19 nt, Homo sapiens
ggacgauucuccugcaaga

SEQ ID NO: 325246 - RNA, 19 nt, Homo sapiens
uaagaccauucgcgauuua

SEQ ID NO: 325247 - RNA, 19 nt, Homo sapiens
ggacgggaacugcucuuua

SEQ ID NO: 325248 - RNA, 19 nt, Homo sapiens
ggaucaagcucaucgacuu

SEQ ID NO: 325249 - RNA, 19 nt, Homo sapiens
caaagacccuaucggaaga

SEQ ID NO: 325250 - RNA, 19 nt, Homo sapiens
ggaagacuguccucuaugg

SEQ ID NO: 325251 - RNA, 19 nt, Homo sapiens
gacagaggcuuauacaagu

SEQ ID NO: 325252 - RNA, 19 nt, Homo sapiens
gcaaagaagaacucaagaa

SEQ ID NO: 325253 - RNA, 19 nt, Homo sapiens
ucacuuggcugcugaaugg

SEQ ID NO: 325254 - RNA, 19 nt, Homo sapiens
ccagagggauucagcauuc

SEQ ID NO: 325255 - RNA, 19 nt, Homo sapiens
caauucagaugucaggaaa

SEQ ID NO: 325256 - RNA, 19 nt, Homo sapiens
ggaaauccauggagucaac

SEQ ID NO: 325257 - RNA, 19 nt, Homo sapiens
ggaagaggaagaagaguga

SEQ ID NO: 325258 - RNA, 19 nt, Homo sapiens
ucagaggacuuccacuuug

SEQ ID NO: 325259 - RNA, 19 nt, Homo sapiens
gcaaucaacguguauggaa

SEQ ID NO: 325260 - RNA, 19 nt, Homo sapiens
gacaaucaauacugaacaa

SEQ ID NO: 325261 - RNA, 19 nt, Homo sapiens
gggccucucugaucucaaa

SEQ ID NO: 325262 - RNA, 19 nt, Homo sapiens
gcaugcagguucuggaaau

SEQ ID NO: 325263 - RNA, 19 nt, Homo sapiens
guggaucccucaagaguug

SEQ ID NO: 325264 - RNA, 19 nt, Homo sapiens
gaaggacugcgcuguuauu

SEQ ID NO: 325265 - RNA, 19 nt, Homo sapiens
ucaccuggcucaagggaaa

SEQ ID NO: 325266 - RNA, 19 nt, Homo sapiens
ggagugcccaccaaaguuu

SEQ ID NO: 325267 - RNA, 19 nt, Homo sapiens
gccaagauguugugagcaa

SEQ ID NO: 325268 - RNA, 19 nt, Homo sapiens
ugaccaauguaaucucaaa

SEQ ID NO: 325269 - RNA, 19 nt, Homo sapiens
gaaagaggugaccaaugua

SEQ ID NO: 325270 - RNA, 19 nt, Homo sapiens
guacauggcaagaaggaaa

SEQ ID NO: 325271 - RNA, 19 nt, Homo sapiens
ccaaggaccggaugaagaa

SEQ ID NO: 325272 - RNA, 19 nt, Homo sapiens
gcagugcuguacaguccua

SEQ ID NO: 325273 - RNA, 19 nt, Homo sapiens
gaacucagcacagccuuug

SEQ ID NO: 325274 - RNA, 19 nt, Homo sapiens
cagaggacuuccacuuuga

SEQ ID NO: 325275 - RNA, 19 nt, Homo sapiens
gaaauuuggacaggucuuu

SEQ ID NO: 325276 - RNA, 19 nt, Homo sapiens
agaaugaugugaacugcaa

SEQ ID NO: 325277 - RNA, 19 nt, Homo sapiens
gaaagacguuaagaaugau

SEQ ID NO: 325278 - RNA, 19 nt, Homo sapiens
ucgaggugcuucagaauga

SEQ ID NO: 325279 - RNA, 19 nt, Homo sapiens
cugaaggacugcgcuguua

SEQ ID NO: 325280 - RNA, 19 nt, Homo sapiens
gaacuuuccauccaagguu

SEQ ID NO: 325281 - RNA, 19 nt, Homo sapiens
cugaagugaucaacuauga

SEQ ID NO: 325282 - RNA, 19 nt, Homo sapiens
caaccucacugucguggau

SEQ ID NO: 325283 - RNA, 19 nt, Homo sapiens
ggucaaagaaggacagaug

SEQ ID NO: 325284 - RNA, 19 nt, Homo sapiens
cugaagagccgaaggauga

SEQ ID NO: 325285 - RNA, 19 nt, Homo sapiens
gagagucaguggagcuguu

SEQ ID NO: 325286 - RNA, 19 nt, Homo sapiens
gaacucaagaaagacguua

SEQ ID NO: 325287 - RNA, 19 nt, Homo sapiens
ccaauguaaucucaaagga

SEQ ID NO: 325288 - RNA, 19 nt, Homo sapiens
gagauuagcaucaugaacu

SEQ ID NO: 325289 - RNA, 19 nt, Homo sapiens
ccaaggcaguggagaguuc

SEQ ID NO: 325290 - RNA, 19 nt, Homo sapiens
gaaccucugcaucaaagaa

SEQ ID NO: 325291 - RNA, 19 nt, Homo sapiens
ggaugacgaugccaaguac

SEQ ID NO: 325292 - RNA, 19 nt, Homo sapiens
gggaugacgaugccaagua

SEQ ID NO: 325293 - RNA, 19 nt, Homo sapiens
agauuugacugcaagauug

SEQ ID NO: 325294 - RNA, 19 nt, Homo sapiens
guggaugccuuugaagaaa

SEQ ID NO: 325295 - RNA, 19 nt, Homo sapiens
auuaggaucugggaaauuu

SEQ ID NO: 325296 - RNA, 19 nt, Homo sapiens
agaaggagcccgagguuga

SEQ ID NO: 325297 - RNA, 19 nt, Homo sapiens
auucggagcuccucacuga

SEQ ID NO: 325298 - RNA, 19 nt, Homo sapiens
gagcgugagugcaucaagu

SEQ ID NO: 325299 - RNA, 19 nt, Homo sapiens
gcaaugccaagccugauga

SEQ ID NO: 325300 - RNA, 19 nt, Homo sapiens
uggcaaagcccucugcaaa

SEQ ID NO: 325301 - RNA, 19 nt, Homo sapiens
gggaaaguauaccugugaa

SEQ ID NO: 325302 - RNA, 19 nt, Homo sapiens
caacaaacaacagagaaga

SEQ ID NO: 325303 - RNA, 19 nt, Homo sapiens
cuaagaccauucgcgauuu

SEQ ID NO: 325304 - RNA, 19 nt, Homo sapiens
gaucaagcucaucgacuuu

SEQ ID NO: 325305 - RNA, 19 nt, Homo sapiens
caucaugugugucaacaag

SEQ ID NO: 325306 - RNA, 19 nt, Homo sapiens
cgacauugaggagagauua

SEQ ID NO: 325307 - RNA, 19 nt, Homo sapiens
acacacugcugguggagaa

SEQ ID NO: 325308 - RNA, 19 nt, Homo sapiens
gcugcaagauguucaugug

SEQ ID NO: 325309 - RNA, 19 nt, Homo sapiens
ucaagaaagacguuaagaa

SEQ ID NO: 325310 - RNA, 19 nt, Homo sapiens
gugaagggcuugccgugau

SEQ ID NO: 325311 - RNA, 19 nt, Homo sapiens
gaugucagcugaacuuucc

SEQ ID NO: 325312 - RNA, 19 nt, Homo sapiens
ggaguugacaguagaagga

SEQ ID NO: 325313 - RNA, 19 nt, Homo sapiens
agaaguacauggcaagaag

SEQ ID NO: 325314 - RNA, 19 nt, Homo sapiens
ugaaagauaccaagaacau

SEQ ID NO: 325315 - RNA, 19 nt, Homo sapiens
ggucaucugcuacauccua

SEQ ID NO: 325316 - RNA, 19 nt, Homo sapiens
ggacagugacaaucaauac

SEQ ID NO: 325317 - RNA, 19 nt, Homo sapiens
caggugacauggcacagaa

SEQ ID NO: 325318 - RNA, 19 nt, Homo sapiens
gcaaagacacuggccacuu

SEQ ID NO: 325319 - RNA, 19 nt, Homo sapiens
ggacagaugggacgauucu

SEQ ID NO: 325320 - RNA, 19 nt, Homo sapiens
guaaaacccuauuucucua

SEQ ID NO: 325321 - RNA, 19 nt, Homo sapiens
ggaaagaggugaccaaugu

SEQ ID NO: 325322 - RNA, 19 nt, Homo sapiens
gggaacugcucuuuaauua

SEQ ID NO: 325323 - RNA, 19 nt, Homo sapiens
gaaauccgcuagcaaagaa

SEQ ID NO: 325324 - RNA, 19 nt, Homo sapiens
agaaagacguuaagaauga

SEQ ID NO: 325325 - RNA, 19 nt, Homo sapiens
gccaauaggucauuuguga

SEQ ID NO: 325326 - RNA, 19 nt, Homo sapiens
gcaaagcccucugcaaaga

SEQ ID NO: 325327 - RNA, 19 nt, Homo sapiens
ggaaaagccucauguaaaa

SEQ ID NO: 325328 - RNA, 19 nt, Homo sapiens
gcaaucugcugaagaaaga

SEQ ID NO: 325329 - RNA, 19 nt, Homo sapiens
ggaaggaacuagccacaug

SEQ ID NO: 325330 - RNA, 19 nt, Homo sapiens
gcauugagguuuaugaaga

SEQ ID NO: 325331 - RNA, 19 nt, Homo sapiens
ccaagaaacucuccaagga

SEQ ID NO: 325332 - RNA, 19 nt, Homo sapiens
aagaagaacucaagaaaga

SEQ ID NO: 325333 - RNA, 19 nt, Homo sapiens
gacgggaacugcucuuuaa

SEQ ID NO: 325334 - RNA, 19 nt, Homo sapiens
ggaagaagagugaaacaaa

SEQ ID NO: 325335 - RNA, 19 nt, Homo sapiens
gaacauggaggccaagaaa

SEQ ID NO: 325336 - RNA, 19 nt, Homo sapiens
gaagaagagugaaacaaag

SEQ ID NO: 325337 - RNA, 19 nt, Homo sapiens
gaauauaaguuccguguac

SEQ ID NO: 325338 - RNA, 19 nt, Homo sapiens
gaaauuaccagcagagaau

SEQ ID NO: 325339 - RNA, 19 nt, Homo sapiens
gaagaugugucccaagcuu

SEQ ID NO: 325340 - RNA, 19 nt, Homo sapiens
caaagacacuggccacuuc

SEQ ID NO: 325341 - RNA, 19 nt, Homo sapiens
caaagaagaacucaagaaa

SEQ ID NO: 325342 - RNA, 19 nt, Homo sapiens
ggacugcgcuguuauugag

SEQ ID NO: 325343 - RNA, 19 nt, Homo sapiens
ggacagaggcuuauacaag

SEQ ID NO: 325344 - RNA, 19 nt, Homo sapiens
caagaaagacguuaagaau

SEQ ID NO: 325345 - RNA, 19 nt, Homo sapiens
cagcauccauggcuaauga

SEQ ID NO: 325346 - RNA, 19 nt, Homo sapiens
ggacgauucuccugcaaga

SEQ ID NO: 325347 - RNA, 19 nt, Homo sapiens
uaagaccauucgcgauuua

SEQ ID NO: 325348 - RNA, 19 nt, Homo sapiens
ggacgggaacugcucuuua

SEQ ID NO: 325349 - RNA, 19 nt, Homo sapiens
ggaucaagcucaucgacuu

SEQ ID NO: 325350 - RNA, 19 nt, Homo sapiens
caaagacccuaucggaaga

SEQ ID NO: 325351 - RNA, 19 nt, Homo sapiens
ggaagacuguccucuaugg

SEQ ID NO: 325352 - RNA, 19 nt, Homo sapiens
gacagaggcuuauacaagu

SEQ ID NO: 325353 - RNA, 19 nt, Homo sapiens
gcaaagaagaacucaagaa

SEQ ID NO: 325354 - RNA, 19 nt, Homo sapiens
ggaaaggcuugccgugaug

SEQ ID NO: 325355 - RNA, 19 nt, Homo sapiens
ucacuuggcugcugaaugg

SEQ ID NO: 325356 - RNA, 19 nt, Homo sapiens
ccagagggauucagcauuc

SEQ ID NO: 325357 - RNA, 19 nt, Homo sapiens
caauucagaugucaggaaa

SEQ ID NO: 325358 - RNA, 19 nt, Homo sapiens
ggaaauccauggagucaac

SEQ ID NO: 325359 - RNA, 19 nt, Homo sapiens
ggaagaggaagaagaguga

SEQ ID NO: 325360 - RNA, 19 nt, Homo sapiens
ucagaggacuuccacuuug

SEQ ID NO: 325361 - RNA, 19 nt, Homo sapiens
gcaaucaacguguauggaa

SEQ ID NO: 325362 - RNA, 19 nt, Homo sapiens
gacaaucaauacugaacaa

SEQ ID NO: 325363 - RNA, 19 nt, Homo sapiens
gggccucucugaucucaaa

SEQ ID NO: 325364 - RNA, 19 nt, Homo sapiens
gcaugcagguucuggaaau

SEQ ID NO: 325365 - RNA, 19 nt, Homo sapiens
guggaucccucaagaguug

SEQ ID NO: 325366 - RNA, 19 nt, Homo sapiens
gaaggacugcgcuguuauu

SEQ ID NO: 325367 - RNA, 19 nt, Homo sapiens
ucaccuggcucaagggaaa

SEQ ID NO: 325368 - RNA, 19 nt, Homo sapiens
gaaggcagcauugagguuu

SEQ ID NO: 325369 - RNA, 19 nt, Homo sapiens
ggagugcccaccaaaguuu

SEQ ID NO: 325370 - RNA, 19 nt, Homo sapiens
gccaagauguugugagcaa

SEQ ID NO: 325371 - RNA, 19 nt, Homo sapiens
ugaccaauguaaucucaaa

SEQ ID NO: 325372 - RNA, 19 nt, Homo sapiens
gaaagaggugaccaaugua

SEQ ID NO: 325373 - RNA, 19 nt, Homo sapiens
guacauggcaagaaggaaa

SEQ ID NO: 325374 - RNA, 19 nt, Homo sapiens
ccaaggaccggaugaagaa

SEQ ID NO: 325375 - RNA, 19 nt, Homo sapiens
ccaaggauuucaucagcaa

SEQ ID NO: 325376 - RNA, 19 nt, Homo sapiens
gagauuaggaucgcuguuu

SEQ ID NO: 325377 - RNA, 19 nt, Homo sapiens
gcagugcuguacaguccua

SEQ ID NO: 325378 - RNA, 19 nt, Homo sapiens
gaacucagcacagccuuug

SEQ ID NO: 325379 - RNA, 19 nt, Homo sapiens
cagaggacuuccacuuuga

SEQ ID NO: 325380 - RNA, 19 nt, Homo sapiens
agaaugaugugaacugcaa

SEQ ID NO: 325381 - RNA, 19 nt, Homo sapiens
gaaagacguuaagaaugau

SEQ ID NO: 325382 - RNA, 19 nt, Homo sapiens
ucgaggugcuucagaauga

SEQ ID NO: 325383 - RNA, 19 nt, Homo sapiens
cugaaggacugcgcuguua

SEQ ID NO: 325384 - RNA, 19 nt, Homo sapiens
gaacuuuccauccaagguu

SEQ ID NO: 325385 - RNA, 19 nt, Homo sapiens
cugaagugaucaacuauga

SEQ ID NO: 325386 - RNA, 19 nt, Homo sapiens
caaccucacugucguggau

SEQ ID NO: 325387 - RNA, 19 nt, Homo sapiens
ggucaaagaaggacagaug

SEQ ID NO: 325388 - RNA, 19 nt, Homo sapiens
cugaagagccgaaggauga

SEQ ID NO: 325389 - RNA, 19 nt, Homo sapiens
gagagucaguggagcuguu

SEQ ID NO: 325390 - RNA, 19 nt, Homo sapiens
gaacucaagaaagacguua

SEQ ID NO: 325391 - RNA, 19 nt, Homo sapiens
ccaauguaaucucaaagga

SEQ ID NO: 325392 - RNA, 19 nt, Homo sapiens
ccaaggcaguggagaguuc

SEQ ID NO: 325393 - RNA, 19 nt, Homo sapiens
gaaccucugcaucaaagaa

SEQ ID NO: 325394 - RNA, 19 nt, Homo sapiens
ggaugacgaugccaaguac

SEQ ID NO: 325395 - RNA, 19 nt, Homo sapiens
gggaugacgaugccaagua

SEQ ID NO: 325396 - RNA, 19 nt, Homo sapiens
agauuugacugcaagauug

SEQ ID NO: 325397 - RNA, 19 nt, Homo sapiens
ggagacaacgauaacgaaa

SEQ ID NO: 325398 - RNA, 19 nt, Homo sapiens
agaaggagcccgagguuga

SEQ ID NO: 325399 - RNA, 19 nt, Homo sapiens
auucggagcuccucacuga

SEQ ID NO: 325400 - RNA, 19 nt, Homo sapiens
gagcgugagugcaucaagu

SEQ ID NO: 325401 - RNA, 19 nt, Homo sapiens
gcaaugccaagccugauga

SEQ ID NO: 325402 - RNA, 19 nt, Homo sapiens
uggcaaagcccucugcaaa

SEQ ID NO: 325403 - RNA, 19 nt, Homo sapiens
gggaaaguauaccugugaa

SEQ ID NO: 325404 - RNA, 19 nt, Homo sapiens
caacaaacaacagagaaga

SEQ ID NO: 325405 - RNA, 19 nt, Homo sapiens
cuaagaccauucgcgauuu

SEQ ID NO: 325406 - RNA, 19 nt, Homo sapiens
gaucaagcucaucgacuuu

SEQ ID NO: 325407 - RNA, 19 nt, Homo sapiens
caucaugugugucaacaag

SEQ ID NO: 325408 - RNA, 19 nt, Homo sapiens
cgacauugaggagagauua

SEQ ID NO: 325409 - RNA, 19 nt, Homo sapiens
acacacugcugguggagaa

SEQ ID NO: 325410 - RNA, 19 nt, Homo sapiens
gcugcaagauguucaugug

SEQ ID NO: 325411 - RNA, 19 nt, Homo sapiens
ucaagaaagacguuaagaa

SEQ ID NO: 325412 - RNA, 19 nt, Homo sapiens
gaugucagcugaacuuucc

SEQ ID NO: 325413 - RNA, 19 nt, Homo sapiens
ggaguugacaguagaagga

SEQ ID NO: 325414 - RNA, 19 nt, Homo sapiens
agaaguacauggcaagaag

SEQ ID NO: 325415 - RNA, 19 nt, Homo sapiens
ugaaagauaccaagaacau

SEQ ID NO: 325416 - RNA, 19 nt, Homo sapiens
ggucaucugcuacauccua

SEQ ID NO: 325417 - RNA, 19 nt, Homo sapiens
ggacagugacaaucaauac

SEQ ID NO: 325418 - RNA, 19 nt, Homo sapiens
caggugacauggcacagaa

SEQ ID NO: 325419 - RNA, 19 nt, Homo sapiens
gcaaagacacuggccacuu

SEQ ID NO: 325420 - RNA, 19 nt, Homo sapiens
acauacagcugcacugcuu

SEQ ID NO: 325421 - RNA, 19 nt, Homo sapiens
gggaacugcucuuuaauua

SEQ ID NO: 325422 - RNA, 19 nt, Homo sapiens
ggacaggucuuucgacuug

SEQ ID NO: 325423 - RNA, 19 nt, Homo sapiens
gaaauccgcuagcaaagaa

SEQ ID NO: 325424 - RNA, 19 nt, Homo sapiens
agaaagacguuaagaauga

SEQ ID NO: 325425 - RNA, 19 nt, Homo sapiens
ggaaaagccucauguaaaa

SEQ ID NO: 325426 - RNA, 19 nt, Homo sapiens
gcaaucugcugaagaaaga

SEQ ID NO: 325427 - RNA, 19 nt, Homo sapiens
ggaaggaacuagccacaug

SEQ ID NO: 325428 - RNA, 19 nt, Homo sapiens
ccaagaaacucuccaagga

SEQ ID NO: 325429 - RNA, 19 nt, Homo sapiens
aagaagaacucaagaaaga

SEQ ID NO: 325430 - RNA, 19 nt, Homo sapiens
gacgggaacugcucuuuaa

SEQ ID NO: 325431 - RNA, 19 nt, Homo sapiens
ggaagaagagugaaacaaa

SEQ ID NO: 325432 - RNA, 19 nt, Homo sapiens
gaacauggaggccaagaaa

SEQ ID NO: 325433 - RNA, 19 nt, Homo sapiens
gaagaagagugaaacaaag

SEQ ID NO: 325434 - RNA, 19 nt, Homo sapiens
gaauauaaguuccguguac

SEQ ID NO: 325435 - RNA, 19 nt, Homo sapiens
gaaauuaccagcagagaau

SEQ ID NO: 325436 - RNA, 19 nt, Homo sapiens
gaagaugugucccaagcuu

SEQ ID NO: 325437 - RNA, 19 nt, Homo sapiens
caaagaagaacucaagaaa

SEQ ID NO: 325438 - RNA, 19 nt, Homo sapiens
ggacagaggcuuauacaag

SEQ ID NO: 325439 - RNA, 19 nt, Homo sapiens
caagaaagacguuaagaau

SEQ ID NO: 325440 - RNA, 19 nt, Homo sapiens
cagcauccauggcuaauga

SEQ ID NO: 325441 - RNA, 19 nt, Homo sapiens
uaagaccauucgcgauuua

SEQ ID NO: 325442 - RNA, 19 nt, Homo sapiens
ggacgggaacugcucuuua

SEQ ID NO: 325443 - RNA, 19 nt, Homo sapiens
caaagacccuaucggaaga

SEQ ID NO: 325444 - RNA, 19 nt, Homo sapiens
ggaucaagcucaucgacuu

SEQ ID NO: 325445 - RNA, 19 nt, Homo sapiens
ggaagacuguccucuaugg

SEQ ID NO: 325446 - RNA, 19 nt, Homo sapiens
gacagaggcuuauacaagu

SEQ ID NO: 325447 - RNA, 19 nt, Homo sapiens
gcaaagaagaacucaagaa

SEQ ID NO: 325448 - RNA, 19 nt, Homo sapiens
ggaagaggaagaagaguga

SEQ ID NO: 325449 - RNA, 19 nt, Homo sapiens
gcaaucaacguguauggaa

SEQ ID NO: 325450 - RNA, 19 nt, Homo sapiens
gacaaucaauacugaacaa

SEQ ID NO: 325451 - RNA, 19 nt, Homo sapiens
guacauggcaagaaggaaa

SEQ ID NO: 325452 - RNA, 19 nt, Homo sapiens
ccaaggaccggaugaagaa

SEQ ID NO: 325453 - RNA, 19 nt, Homo sapiens
ccaaggauuucaucagcaa

SEQ ID NO: 325454 - RNA, 19 nt, Homo sapiens
gcagugcuguacaguccua

SEQ ID NO: 325455 - RNA, 19 nt, Homo sapiens
gaaauuuggacaggucuuu

SEQ ID NO: 325456 - RNA, 19 nt, Homo sapiens
agaaugaugugaacugcaa

SEQ ID NO: 325457 - RNA, 19 nt, Homo sapiens
gaaagacguuaagaaugau

SEQ ID NO: 325458 - RNA, 19 nt, Homo sapiens
cugaagugaucaacuauga

SEQ ID NO: 325459 - RNA, 19 nt, Homo sapiens
caaccucacugucguggau

SEQ ID NO: 325460 - RNA, 19 nt, Homo sapiens
cugaagagccgaaggauga

SEQ ID NO: 325461 - RNA, 19 nt, Homo sapiens
gagagucaguggagcuguu

SEQ ID NO: 325462 - RNA, 19 nt, Homo sapiens
gaacucaagaaagacguua

SEQ ID NO: 325463 - RNA, 19 nt, Homo sapiens
gagauuagcaucaugaacu

SEQ ID NO: 325464 - RNA, 19 nt, Homo sapiens
ccaaggcaguggagaguuc

SEQ ID NO: 325465 - RNA, 19 nt, Homo sapiens
ggaugacgaugccaaguac

SEQ ID NO: 325466 - RNA, 19 nt, Homo sapiens
gggaugacgaugccaagua

SEQ ID NO: 325467 - RNA, 19 nt, Homo sapiens
agauuugacugcaagauug

SEQ ID NO: 325468 - RNA, 19 nt, Homo sapiens
ggagacaacgauaacgaaa

SEQ ID NO: 325469 - RNA, 19 nt, Homo sapiens
guggaugccuuugaagaaa

SEQ ID NO: 325470 - RNA, 19 nt, Homo sapiens
auuaggaucugggaaauuu

SEQ ID NO: 325471 - RNA, 19 nt, Homo sapiens
agaaggagcccgagguuga

SEQ ID NO: 325472 - RNA, 19 nt, Homo sapiens
auucggagcuccucacuga

SEQ ID NO: 325473 - RNA, 19 nt, Homo sapiens
gagcgugagugcaucaagu

SEQ ID NO: 325474 - RNA, 19 nt, Homo sapiens
gcaaugccaagccugauga

SEQ ID NO: 325475 - RNA, 19 nt, Homo sapiens
cuaagaccauucgcgauuu

SEQ ID NO: 325476 - RNA, 19 nt, Homo sapiens
gaucaagcucaucgacuuu

SEQ ID NO: 325477 - RNA, 19 nt, Homo sapiens
caucaugugugucaacaag

SEQ ID NO: 325478 - RNA, 19 nt, Homo sapiens
cgacauugaggagagauua

SEQ ID NO: 325479 - RNA, 19 nt, Homo sapiens
acacacugcugguggagaa

SEQ ID NO: 325480 - RNA, 19 nt, Homo sapiens
gcugcaagauguucaugug

SEQ ID NO: 325481 - RNA, 19 nt, Homo sapiens
ucaagaaagacguuaagaa

SEQ ID NO: 325482 - RNA, 19 nt, Homo sapiens
agaaguacauggcaagaag

SEQ ID NO: 325483 - RNA, 19 nt, Homo sapiens
ugaaagauaccaagaacau

SEQ ID NO: 325484 - RNA, 19 nt, Homo sapiens
ggucaucugcuacauccua

SEQ ID NO: 325485 - RNA, 19 nt, Homo sapiens
ggacagugacaaucaauac

SEQ ID NO: 325486 - RNA, 19 nt, Homo sapiens
guaaaacccuauuucucua

SEQ ID NO: 325487 - RNA, 19 nt, Homo sapiens
gcagggaccacagauaaug

SEQ ID NO: 325488 - RNA, 19 nt, Homo sapiens
ggaacugcucuuuaauuau

SEQ ID NO: 325489 - RNA, 19 nt, Homo sapiens
gcaggagauuagcaucaug

SEQ ID NO: 325490 - RNA, 19 nt, Homo sapiens
aaagaaaacucgaaaaguc

SEQ ID NO: 325491 - RNA, 19 nt, Homo sapiens
gaaaagaaaacucgaaaag

SEQ ID NO: 325492 - RNA, 19 nt, Homo sapiens
gcacugcggcugcuacaca

SEQ ID NO: 325493 - RNA, 19 nt, Homo sapiens
gcagcaagcucaccauccu

SEQ ID NO: 325494 - RNA, 19 nt, Homo sapiens
ugaaacaaagccagagaaa

SEQ ID NO: 325495 - RNA, 19 nt, Homo sapiens
ugucaacagucuuggagaa

SEQ ID NO: 325496 - RNA, 19 nt, Homo sapiens
acugcaagauugaaggaua

SEQ ID NO: 325497 - RNA, 19 nt, Homo sapiens
gcaccaggaucaagcucau

SEQ ID NO: 325498 - RNA, 19 nt, Homo sapiens
ucacaacgguaggagagaa

SEQ ID NO: 325499 - RNA, 19 nt, Homo sapiens
caacaagacguggaaggaa

SEQ ID NO: 325500 - RNA, 19 nt, Homo sapiens
gcuaggaacugagagugau

SEQ ID NO: 325501 - RNA, 19 nt, Homo sapiens
acaaguguguagccaagaa

SEQ ID NO: 325502 - RNA, 19 nt, Homo sapiens
aaguggaggugucagauga

SEQ ID NO: 325503 - RNA, 19 nt, Homo sapiens
gaaagauaccaagaacaug

SEQ ID NO: 325504 - RNA, 19 nt, Homo sapiens
gcugaagaaagauaugaaa

SEQ ID NO: 325505 - RNA, 19 nt, Homo sapiens
gaaguggaggugucagaug

SEQ ID NO: 325506 - RNA, 19 nt, Homo sapiens
ccugaaauccgcuagcaaa

SEQ ID NO: 325507 - RNA, 19 nt, Homo sapiens
ggaugaaguuccgaaagca

SEQ ID NO: 325508 - RNA, 19 nt, Homo sapiens
ucuggacgcugaacggaaa

SEQ ID NO: 325509 - RNA, 19 nt, Homo sapiens
gaagaaguacauggcaaga

SEQ ID NO: 325510 - RNA, 19 nt, Homo sapiens
cuccugaagugaucaacua

SEQ ID NO: 325511 - RNA, 19 nt, Homo sapiens
ccagauagacuacgaugag

SEQ ID NO: 325512 - RNA, 19 nt, Homo sapiens
cauucgcgauuuagaaguu

SEQ ID NO: 325513 - RNA, 19 nt, Homo sapiens
caaggcauauucagcaaaa

SEQ ID NO: 325514 - RNA, 19 nt, Homo sapiens
acaggucuuucgacuugua

SEQ ID NO: 325515 - RNA, 19 nt, Homo sapiens
gaacggaaagacccucaag

SEQ ID NO: 325516 - RNA, 19 nt, Homo sapiens
gaccauucgcgauuuagaa

SEQ ID NO: 325517 - RNA, 19 nt, Homo sapiens
ccaaccagcccgcucaaug

SEQ ID NO: 325518 - RNA, 19 nt, Homo sapiens
gaaaccuuggccaacguua

SEQ ID NO: 325519 - RNA, 19 nt, Homo sapiens
uuggaagacuguccucuau

SEQ ID NO: 325520 - RNA, 19 nt, Homo sapiens
ggugucagaugaugaugag

SEQ ID NO: 325521 - RNA, 19 nt, Homo sapiens
gggaacugcucuuuaauua

SEQ ID NO: 325522 - RNA, 19 nt, Homo sapiens
ggaaaagccucauguaaaa

SEQ ID NO: 325523 - RNA, 19 nt, Homo sapiens
gacgggaacugcucuuuaa

SEQ ID NO: 325524 - RNA, 19 nt, Homo sapiens
ggaagaagagugaaacaaa

SEQ ID NO: 325525 - RNA, 19 nt, Homo sapiens
gaagaagagugaaacaaag

SEQ ID NO: 325526 - RNA, 19 nt, Homo sapiens
gaagaugugucccaagcuu

SEQ ID NO: 325527 - RNA, 19 nt, Homo sapiens
uaagaccauucgcgauuua

SEQ ID NO: 325528 - RNA, 19 nt, Homo sapiens
ggacgggaacugcucuuua

SEQ ID NO: 325529 - RNA, 19 nt, Homo sapiens
ggaagacuguccucuaugg

SEQ ID NO: 325530 - RNA, 19 nt, Homo sapiens
ggaagaggaagaagaguga

SEQ ID NO: 325531 - RNA, 19 nt, Homo sapiens
guccaacccucgugucuau

SEQ ID NO: 325532 - RNA, 19 nt, Homo sapiens
ggaugacgaugccaaguac

SEQ ID NO: 325533 - RNA, 19 nt, Homo sapiens
gggaugacgaugccaagua

SEQ ID NO: 325534 - RNA, 19 nt, Homo sapiens
agauuugacugcaagauug

SEQ ID NO: 325535 - RNA, 19 nt, Homo sapiens
cuaagaccauucgcgauuu

SEQ ID NO: 325536 - RNA, 19 nt, Homo sapiens
guaaaacccuauuucucua

SEQ ID NO: 325537 - RNA, 19 nt, Homo sapiens
ggaacugcucuuuaauuau

SEQ ID NO: 325538 - RNA, 19 nt, Homo sapiens
gaccuuguuuagucacauu

SEQ ID NO: 325539 - RNA, 19 nt, Homo sapiens
ugaaacaaagccagagaaa

SEQ ID NO: 325540 - RNA, 19 nt, Homo sapiens
ugucaacagucuuggagaa

SEQ ID NO: 325541 - RNA, 19 nt, Homo sapiens
acugcaagauugaaggaua

SEQ ID NO: 325542 - RNA, 19 nt, Homo sapiens
gaacaucuucugacacacu

SEQ ID NO: 325543 - RNA, 19 nt, Homo sapiens
cugaacaucuucugacaca

SEQ ID NO: 325544 - RNA, 19 nt, Homo sapiens
gaguugaagcacuguauga

SEQ ID NO: 325545 - RNA, 19 nt, Homo sapiens
ggcagaaccucggcucuca

SEQ ID NO: 325546 - RNA, 19 nt, Homo sapiens
ccagauagacuacgaugag

SEQ ID NO: 325547 - RNA, 19 nt, Homo sapiens
cauucgcgauuuagaaguu

SEQ ID NO: 325548 - RNA, 19 nt, Homo sapiens
ccaacccucgugucuauuu

SEQ ID NO: 325549 - RNA, 19 nt, Homo sapiens
gaccauucgcgauuuagaa

SEQ ID NO: 325550 - RNA, 19 nt, Homo sapiens
ccaaccagcccgcucaaug

SEQ ID NO: 325551 - RNA, 19 nt, Homo sapiens
gccugcaguugcuuuauau

SEQ ID NO: 325552 - RNA, 19 nt, Homo sapiens
uuggaagacuguccucuau

SEQ ID NO: 325553 - RNA, 19 nt, Homo sapiens
guugaagcacuguaugaaa

SEQ ID NO: 325554 - RNA, 19 nt, Homo sapiens
ucuaagaccauucgcgauu

SEQ ID NO: 325555 - RNA, 19 nt, Homo sapiens
gcugugagagccauuggaa

SEQ ID NO: 325556 - RNA, 19 nt, Homo sapiens
cgggaacugcucuuuaauu

SEQ ID NO: 325557 - RNA, 19 nt, Homo sapiens
agccugcaguugcuuuaua

SEQ ID NO: 325558 - RNA, 19 nt, Homo sapiens
cugcaguugcuuuauauaa

SEQ ID NO: 325559 - RNA, 19 nt, Homo sapiens
ugugagagccauuggaaga

SEQ ID NO: 325560 - RNA, 19 nt, Homo sapiens
aaacaaagccagagaaaag

SEQ ID NO: 325561 - RNA, 19 nt, Homo sapiens
uagauuugacugcaagauu

SEQ ID NO: 325562 - RNA, 19 nt, Homo sapiens
cacauuaacgcacacauca

SEQ ID NO: 325563 - RNA, 19 nt, Homo sapiens
gauuugacugcaagauuga

SEQ ID NO: 325564 - RNA, 19 nt, Homo sapiens
ucaacagggucaccaacca

SEQ ID NO: 325565 - RNA, 19 nt, Homo sapiens
uccauucucugaacaucuu

SEQ ID NO: 325566 - RNA, 19 nt, Homo sapiens
aaaagcaguuucuaaguca

SEQ ID NO: 325567 - RNA, 19 nt, Homo sapiens
gaaacaaagccagagaaaa

SEQ ID NO: 325568 - RNA, 19 nt, Homo sapiens
ggaguugaagcacuguaug

SEQ ID NO: 325569 - RNA, 19 nt, Homo sapiens
aagcaguuucuaagucaua

SEQ ID NO: 325570 - RNA, 19 nt, Homo sapiens
caaccagcccgcucaaugc

SEQ ID NO: 325571 - RNA, 19 nt, Homo sapiens
gugaaacaaagccagagaa

SEQ ID NO: 325572 - RNA, 19 nt, Homo sapiens
aaacccuauuucucuaaga

SEQ ID NO: 325573 - RNA, 19 nt, Homo sapiens
gaggaagaagagugaaaca

SEQ ID NO: 325574 - RNA, 19 nt, Homo sapiens
gaagaggaagaagagugaa

SEQ ID NO: 325575 - RNA, 19 nt, Homo sapiens
uugaagcacuguaugaaaa

SEQ ID NO: 325576 - RNA, 19 nt, Homo sapiens
gggaguugaagcacuguau

SEQ ID NO: 325577 - RNA, 19 nt, Homo sapiens
ugucucauguugaccuugu

SEQ ID NO: 325578 - RNA, 19 nt, Homo sapiens
cuauuucucuaagaccauu

SEQ ID NO: 325579 - RNA, 19 nt, Homo sapiens
ucacauuaacgcacacauc

SEQ ID NO: 325580 - RNA, 19 nt, Homo sapiens
cauuaacgcacacaucagu

SEQ ID NO: 325581 - RNA, 19 nt, Homo sapiens
aggaaaagccucauguaaa

SEQ ID NO: 325582 - RNA, 19 nt, Homo sapiens
gggaacugcucuuuaauua

SEQ ID NO: 325583 - RNA, 19 nt, Homo sapiens
ggaaaagccucauguaaaa

SEQ ID NO: 325584 - RNA, 19 nt, Homo sapiens
gacgggaacugcucuuuaa

SEQ ID NO: 325585 - RNA, 19 nt, Homo sapiens
ggaagaagagugaaacaaa

SEQ ID NO: 325586 - RNA, 19 nt, Homo sapiens
gaagaagagugaaacaaag

SEQ ID NO: 325587 - RNA, 19 nt, Homo sapiens
gaagaugugucccaagcuu

SEQ ID NO: 325588 - RNA, 19 nt, Homo sapiens
uaagaccauucgcgauuua

SEQ ID NO: 325589 - RNA, 19 nt, Homo sapiens
ggacgggaacugcucuuua

SEQ ID NO: 325590 - RNA, 19 nt, Homo sapiens
ggaagacuguccucuaugg

SEQ ID NO: 325591 - RNA, 19 nt, Homo sapiens
ggaagaggaagaagaguga

SEQ ID NO: 325592 - RNA, 19 nt, Homo sapiens
guccaacccucgugucuau

SEQ ID NO: 325593 - RNA, 19 nt, Homo sapiens
ggaugacgaugccaaguac

SEQ ID NO: 325594 - RNA, 19 nt, Homo sapiens
gggaugacgaugccaagua

SEQ ID NO: 325595 - RNA, 19 nt, Homo sapiens
agauuugacugcaagauug

SEQ ID NO: 325596 - RNA, 19 nt, Homo sapiens
cuaagaccauucgcgauuu

SEQ ID NO: 325597 - RNA, 19 nt, Homo sapiens
guaaaacccuauuucucua

SEQ ID NO: 325598 - RNA, 19 nt, Homo sapiens
ggaacugcucuuuaauuau

SEQ ID NO: 325599 - RNA, 19 nt, Homo sapiens
gaccuuguuuagucacauu

SEQ ID NO: 325600 - RNA, 19 nt, Homo sapiens
ugaaacaaagccagagaaa

SEQ ID NO: 325601 - RNA, 19 nt, Homo sapiens
ugucaacagucuuggagaa

SEQ ID NO: 325602 - RNA, 19 nt, Homo sapiens
acugcaagauugaaggaua

SEQ ID NO: 325603 - RNA, 19 nt, Homo sapiens
gaacaucuucugacacacu

SEQ ID NO: 325604 - RNA, 19 nt, Homo sapiens
cugaacaucuucugacaca

SEQ ID NO: 325605 - RNA, 19 nt, Homo sapiens
gaguugaagcacuguauga

SEQ ID NO: 325606 - RNA, 19 nt, Homo sapiens
ggcagaaccucggcucuca

SEQ ID NO: 325607 - RNA, 19 nt, Homo sapiens
ccagauagacuacgaugag

SEQ ID NO: 325608 - RNA, 19 nt, Homo sapiens
cauucgcgauuuagaaguu

SEQ ID NO: 325609 - RNA, 19 nt, Homo sapiens
ccaacccucgugucuauuu

SEQ ID NO: 325610 - RNA, 19 nt, Homo sapiens
gaccauucgcgauuuagaa

SEQ ID NO: 325611 - RNA, 19 nt, Homo sapiens
ccaaccagcccgcucaaug

SEQ ID NO: 325612 - RNA, 19 nt, Homo sapiens
gccugcaguugcuuuauau

SEQ ID NO: 325613 - RNA, 19 nt, Homo sapiens
uuggaagacuguccucuau

SEQ ID NO: 325614 - RNA, 19 nt, Homo sapiens
guugaagcacuguaugaaa

SEQ ID NO: 325615 - RNA, 19 nt, Homo sapiens
aaacuagaaucugaagaag

SEQ ID NO: 325616 - RNA, 19 nt, Homo sapiens
ucuaagaccauucgcgauu

SEQ ID NO: 325617 - RNA, 19 nt, Homo sapiens
gcugugagagccauuggaa

SEQ ID NO: 325618 - RNA, 19 nt, Homo sapiens
cgggaacugcucuuuaauu

SEQ ID NO: 325619 - RNA, 19 nt, Homo sapiens
agccugcaguugcuuuaua

SEQ ID NO: 325620 - RNA, 19 nt, Homo sapiens
cugcaguugcuuuauauaa

SEQ ID NO: 325621 - RNA, 19 nt, Homo sapiens
ugugagagccauuggaaga

SEQ ID NO: 325622 - RNA, 19 nt, Homo sapiens
aaacaaagccagagaaaag

SEQ ID NO: 325623 - RNA, 19 nt, Homo sapiens
cacauuaacgcacacauca

SEQ ID NO: 325624 - RNA, 19 nt, Homo sapiens
uagauuugacugcaagauu

SEQ ID NO: 325625 - RNA, 19 nt, Homo sapiens
gauuugacugcaagauuga

SEQ ID NO: 325626 - RNA, 19 nt, Homo sapiens
ucaacagggucaccaacca

SEQ ID NO: 325627 - RNA, 19 nt, Homo sapiens
uccauucucugaacaucuu

SEQ ID NO: 325628 - RNA, 19 nt, Homo sapiens
aaaagcaguuucuaaguca

SEQ ID NO: 325629 - RNA, 19 nt, Homo sapiens
gaaacaaagccagagaaaa

SEQ ID NO: 325630 - RNA, 19 nt, Homo sapiens
ggaguugaagcacuguaug

SEQ ID NO: 325631 - RNA, 19 nt, Homo sapiens
aagcaguuucuaagucaua

SEQ ID NO: 325632 - RNA, 19 nt, Homo sapiens
caaccagcccgcucaaugc

SEQ ID NO: 325633 - RNA, 19 nt, Homo sapiens
gugaaacaaagccagagaa

SEQ ID NO: 325634 - RNA, 19 nt, Homo sapiens
aaacccuauuucucuaaga

SEQ ID NO: 325635 - RNA, 19 nt, Homo sapiens
gaggaagaagagugaaaca

SEQ ID NO: 325636 - RNA, 19 nt, Homo sapiens
gaagaggaagaagagugaa

SEQ ID NO: 325637 - RNA, 19 nt, Homo sapiens
uugaagcacuguaugaaaa

SEQ ID NO: 325638 - RNA, 19 nt, Homo sapiens
gggaguugaagcacuguau

SEQ ID NO: 325639 - RNA, 19 nt, Homo sapiens
ugucucauguugaccuugu

SEQ ID NO: 325640 - RNA, 19 nt, Homo sapiens
cuauuucucuaagaccauu

SEQ ID NO: 325641 - RNA, 19 nt, Homo sapiens
ucacauuaacgcacacauc

SEQ ID NO: 325642 - RNA, 19 nt, Homo sapiens
cauuaacgcacacaucagu

SEQ ID NO: 325643 - RNA, 19 nt, Homo sapiens
aggaaaagccucauguaaa

SEQ ID NO: 325644 - RNA, 19 nt, Homo sapiens
ggacaaagguggacuacuu

SEQ ID NO: 325645 - RNA, 19 nt, Homo sapiens
gauaaaggcauccguguua

SEQ ID NO: 325646 - RNA, 19 nt, Homo sapiens
gaaaugcuaugggaagaua

SEQ ID NO: 325647 - RNA, 19 nt, Homo sapiens
ggacaugccucuccuggaa

SEQ ID NO: 325648 - RNA, 19 nt, Homo sapiens
gauaauagcuuugagcaau

SEQ ID NO: 325649 - RNA, 19 nt, Homo sapiens
caaacuaucugcuugagaa

SEQ ID NO: 325650 - RNA, 19 nt, Homo sapiens
gcaagcuggugaugucuua

SEQ ID NO: 325651 - RNA, 19 nt, Homo sapiens
caaggacagugaaguuaua

SEQ ID NO: 325652 - RNA, 19 nt, Homo sapiens
ggaaggcccgaaagaauua

SEQ ID NO: 325653 - RNA, 19 nt, Homo sapiens
agacaaagaucuucauuag

SEQ ID NO: 325654 - RNA, 19 nt, Homo sapiens
gaaagaagagcaagaggaa

SEQ ID NO: 325655 - RNA, 19 nt, Homo sapiens
acaaggagauuuauaccua

SEQ ID NO: 325656 - RNA, 19 nt, Homo sapiens
ggauuaaacuacccuugaa

SEQ ID NO: 325657 - RNA, 19 nt, Homo sapiens
gcaaauauuuccggucaga

SEQ ID NO: 325658 - RNA, 19 nt, Homo sapiens
caacaauuccucccgauuu

SEQ ID NO: 325659 - RNA, 19 nt, Homo sapiens
gauagugaaucgaaucaau

SEQ ID NO: 325660 - RNA, 19 nt, Homo sapiens
ggagauuuauaccuacauu

SEQ ID NO: 325661 - RNA, 19 nt, Homo sapiens
guagagauccugagggaaa

SEQ ID NO: 325662 - RNA, 19 nt, Homo sapiens
gggcuugaauucagaagaa

SEQ ID NO: 325663 - RNA, 19 nt, Homo sapiens
cagaguucauugccaaaua

SEQ ID NO: 325664 - RNA, 19 nt, Homo sapiens
guaaugggaguccuugaua

SEQ ID NO: 325665 - RNA, 19 nt, Homo sapiens
ucacugcacugaauguuau

SEQ ID NO: 325666 - RNA, 19 nt, Homo sapiens
gaaggucaaucguggcaau

SEQ ID NO: 325667 - RNA, 19 nt, Homo sapiens
cgaaagaauuaucgcaaau

SEQ ID NO: 325668 - RNA, 19 nt, Homo sapiens
ugacaagaauaaugaccua

SEQ ID NO: 325669 - RNA, 19 nt, Homo sapiens
ugacauccauggugcuaaa

SEQ ID NO: 325670 - RNA, 19 nt, Homo sapiens
gcaagaggaauauaagaga

SEQ ID NO: 325671 - RNA, 19 nt, Homo sapiens
gaacuuccacaucuucuau

SEQ ID NO: 325672 - RNA, 19 nt, Homo sapiens
cagccucucugcacacuaa

SEQ ID NO: 325673 - RNA, 19 nt, Homo sapiens
ugaaggcccugaagcuuga

SEQ ID NO: 325674 - RNA, 19 nt, Homo sapiens
ggaauguggugaucucagu

SEQ ID NO: 325675 - RNA, 19 nt, Homo sapiens
aagaagagcaagaggaaua

SEQ ID NO: 325676 - RNA, 19 nt, Homo sapiens
gcgcauggcuuggggauua

SEQ ID NO: 325677 - RNA, 19 nt, Homo sapiens
gcagcuggccacacucaua

SEQ ID NO: 325678 - RNA, 19 nt, Homo sapiens
cagcagguguucauagaga

SEQ ID NO: 325679 - RNA, 19 nt, Homo sapiens
gcaccuggccucacuggaa

SEQ ID NO: 325680 - RNA, 19 nt, Homo sapiens
gaggucaguucucuucaga

SEQ ID NO: 325681 - RNA, 19 nt, Homo sapiens
caacgugaccagcuuuauu

SEQ ID NO: 325682 - RNA, 19 nt, Homo sapiens
gagaguggaucagggaaga

SEQ ID NO: 325683 - RNA, 19 nt, Homo sapiens
ccgaaagaauuaucgcaaa

SEQ ID NO: 325684 - RNA, 19 nt, Homo sapiens
gagcuggccuuuggcaaga

SEQ ID NO: 325685 - RNA, 19 nt, Homo sapiens
gaauaaugaccuacucuuc

SEQ ID NO: 325686 - RNA, 19 nt, Homo sapiens
ugaaccagcucuucuccaa

SEQ ID NO: 325687 - RNA, 19 nt, Homo sapiens
gagaugacccugaaagaag

SEQ ID NO: 325688 - RNA, 19 nt, Homo sapiens
gaccaagggccaugugauu

SEQ ID NO: 325689 - RNA, 19 nt, Homo sapiens
gagauuucauccaccauuc

SEQ ID NO: 325690 - RNA, 19 nt, Homo sapiens
gagcauaaucagcgaggua

SEQ ID NO: 325691 - RNA, 19 nt, Homo sapiens
gggacgcccuggcuaagaa

SEQ ID NO: 325692 - RNA, 19 nt, Homo sapiens
ccaaauaucaagacuauac

SEQ ID NO: 325693 - RNA, 19 nt, Homo sapiens
ccucaaggaugggcucuuu

SEQ ID NO: 325694 - RNA, 19 nt, Homo sapiens
guugguggcugaugaguuc

SEQ ID NO: 325695 - RNA, 19 nt, Homo sapiens
ggaggagauucgacaagug

SEQ ID NO: 325696 - RNA, 19 nt, Homo sapiens
ugccaaauaucaagacuau

SEQ ID NO: 325697 - RNA, 19 nt, Homo sapiens
gcaagagguuccgggauca

SEQ ID NO: 325698 - RNA, 19 nt, Homo sapiens
gaagagcaagaggaauaua

SEQ ID NO: 325699 - RNA, 19 nt, Homo sapiens
ugauugaacugcugaccaa

SEQ ID NO: 325700 - RNA, 19 nt, Homo sapiens
aagguggacuacuuugaua

SEQ ID NO: 325701 - RNA, 19 nt, Homo sapiens
gguggucacugcacugaau

SEQ ID NO: 325702 - RNA, 19 nt, Homo sapiens
gggauuaaacuacccuuga

SEQ ID NO: 325703 - RNA, 19 nt, Homo sapiens
gggaagguguugagaaggu

SEQ ID NO: 325704 - RNA, 19 nt, Homo sapiens
gagguauccuggccauguu

SEQ ID NO: 325705 - RNA, 19 nt, Homo sapiens
uaaugggaguccuugauau

SEQ ID NO: 325706 - RNA, 19 nt, Homo sapiens
acaagagcaugguacagaa

SEQ ID NO: 325707 - RNA, 19 nt, Homo sapiens
gugaccagcuuuauugaca

SEQ ID NO: 325708 - RNA, 19 nt, Homo sapiens
ggucagcgagcaugugauu

SEQ ID NO: 325709 - RNA, 19 nt, Homo sapiens
gagcaaagucacccagaau

SEQ ID NO: 325710 - RNA, 19 nt, Homo sapiens
gugaucaacuacugcaaug

SEQ ID NO: 325711 - RNA, 19 nt, Homo sapiens
gcaguugcuuccuccugaa

SEQ ID NO: 325712 - RNA, 19 nt, Homo sapiens
ccucaucuccucuugguuu

SEQ ID NO: 325713 - RNA, 19 nt, Homo sapiens
gagcaagaggaauauaaga

SEQ ID NO: 325714 - RNA, 19 nt, Homo sapiens
caagaauaaugaccuacuc

SEQ ID NO: 325715 - RNA, 19 nt, Homo sapiens
agaguucauugccaaauau

SEQ ID NO: 325716 - RNA, 19 nt, Homo sapiens
ggggaaacaugcaaaagaa

SEQ ID NO: 325717 - RNA, 19 nt, Homo sapiens
gaaggcauaccguggacaa

SEQ ID NO: 325718 - RNA, 19 nt, Homo sapiens
cuaucugaaucaugaagua

SEQ ID NO: 325719 - RNA, 19 nt, Homo sapiens
aggagucacugcucaagaa

SEQ ID NO: 325720 - RNA, 19 nt, Homo sapiens
uaaaacauguggcuuggaa

SEQ ID NO: 325721 - RNA, 19 nt, Homo sapiens
gauccaggcuuuugugaga

SEQ ID NO: 325722 - RNA, 19 nt, Homo sapiens
ugacuccacuuuccuagca

SEQ ID NO: 325723 - RNA, 19 nt, Homo sapiens
cuucagggcuguacagagu

SEQ ID NO: 325724 - RNA, 19 nt, Homo sapiens
ccaagaccauucgcaacaa

SEQ ID NO: 325725 - RNA, 19 nt, Homo sapiens
ggaaaggagagcaggugaa

SEQ ID NO: 325726 - RNA, 19 nt, Homo sapiens
ucacagacaccaagaaguc

SEQ ID NO: 325727 - RNA, 19 nt, Homo sapiens
gaaagagucagauccucau

SEQ ID NO: 325728 - RNA, 19 nt, Homo sapiens
uaagcaggcaucucucaaa

SEQ ID NO: 325729 - RNA, 19 nt, Homo sapiens
ggagagguguucgggagau

SEQ ID NO: 325730 - RNA, 19 nt, Homo sapiens
ucagcgagcaugugauuga

SEQ ID NO: 325731 - RNA, 19 nt, Homo sapiens
cucuuuagcuugcaucuga

SEQ ID NO: 325732 - RNA, 19 nt, Homo sapiens
caagaagucccaggccaaa

SEQ ID NO: 325733 - RNA, 19 nt, Homo sapiens
uggcagaggccgugaagaa

SEQ ID NO: 325734 - RNA, 19 nt, Homo sapiens
gugaaguuauacccuaguu

SEQ ID NO: 325735 - RNA, 19 nt, Homo sapiens
gcccucaccuuggcagauu

SEQ ID NO: 325736 - RNA, 19 nt, Homo sapiens
uaaaggcauccguguuauu

SEQ ID NO: 325737 - RNA, 19 nt, Homo sapiens
gacaaagaucuucauuaga

SEQ ID NO: 325738 - RNA, 19 nt, Homo sapiens
gcagcgaggucaguucucu

SEQ ID NO: 325739 - RNA, 19 nt, Homo sapiens
agaugacccugaaagaaga

SEQ ID NO: 325740 - RNA, 19 nt, Homo sapiens
gagauggugggcuugaauu

SEQ ID NO: 325741 - RNA, 19 nt, Homo sapiens
ccagcuuuauugacaagaa

SEQ ID NO: 325742 - RNA, 19 nt, Homo sapiens
cauacaacgugaccagcuu

SEQ ID NO: 325743 - RNA, 19 nt, Homo sapiens
augccuaucugaaucauga

SEQ ID NO: 325744 - RNA, 19 nt, Homo sapiens
uaaagaacaugguguggaa

SEQ ID NO: 325745 - RNA, 19 nt, Homo sapiens
ggcaacauauggagcguua

SEQ ID NO: 325746 - RNA, 19 nt, Homo sapiens
gggaacccguccaguauuu

SEQ ID NO: 325747 - RNA, 19 nt, Homo sapiens
gcacucggcuugguacaga

SEQ ID NO: 325748 - RNA, 19 nt, Homo sapiens
ucaaagaaucccauuauga

SEQ ID NO: 325749 - RNA, 19 nt, Homo sapiens
gcucaaagaaucccauuau

SEQ ID NO: 325750 - RNA, 19 nt, Homo sapiens
auacgaagcuuuccugcaa

SEQ ID NO: 325751 - RNA, 19 nt, Homo sapiens
gccaaagucuccuccauca

SEQ ID NO: 325752 - RNA, 19 nt, Homo sapiens
ggauauuuauggcuucgaa

SEQ ID NO: 325753 - RNA, 19 nt, Homo sapiens
gcuacaagccagaagagua

SEQ ID NO: 325754 - RNA, 19 nt, Homo sapiens
caaagaaucccauuaugag

SEQ ID NO: 325755 - RNA, 19 nt, Homo sapiens
ggaccaggcugugaugauc

SEQ ID NO: 325756 - RNA, 19 nt, Homo sapiens
gcagagugaccacgugauu

SEQ ID NO: 325757 - RNA, 19 nt, Homo sapiens
ggcagagccuggccacaaa

SEQ ID NO: 325758 - RNA, 19 nt, Homo sapiens
agaaccagcucaaguaucu

SEQ ID NO: 325759 - RNA, 19 nt, Homo sapiens
caaacccaaugaugccaaa

SEQ ID NO: 325760 - RNA, 19 nt, Homo sapiens
uggagaagcuggaggauac

SEQ ID NO: 325761 - RNA, 19 nt, Homo sapiens
ggaaggcagccaagaggaa

SEQ ID NO: 325762 - RNA, 19 nt, Homo sapiens
ucgaaguguuucagcauaa

SEQ ID NO: 325763 - RNA, 19 nt, Homo sapiens
uaauuacccucagagugua

SEQ ID NO: 325764 - RNA, 19 nt, Homo sapiens
ccacagaccugaccuuccu

SEQ ID NO: 325765 - RNA, 19 nt, Homo sapiens
agaaggccguggcuaguga

SEQ ID NO: 325766 - RNA, 19 nt, Homo sapiens
gaacaugguguggaaauac

SEQ ID NO: 325767 - RNA, 19 nt, Homo sapiens
agaacaugguguggaaaua

SEQ ID NO: 325768 - RNA, 19 nt, Homo sapiens
gacaagaagcggccagaga

SEQ ID NO: 325769 - RNA, 19 nt, Homo sapiens
uaacagcuuugagcaguuc

SEQ ID NO: 325770 - RNA, 19 nt, Homo sapiens
ccgagaaccagcucaagua

SEQ ID NO: 325771 - RNA, 19 nt, Homo sapiens
guggccacauccucaguua

SEQ ID NO: 325772 - RNA, 19 nt, Homo sapiens
gugaacagcaucaacauca

SEQ ID NO: 325773 - RNA, 19 nt, Homo sapiens
uggagauccugcagucuaa

SEQ ID NO: 325774 - RNA, 19 nt, Homo sapiens
aaacaaugaccuucucuuc

SEQ ID NO: 325775 - RNA, 19 nt, Homo sapiens
gaccagaggaccaggaaau

SEQ ID NO: 325776 - RNA, 19 nt, Homo sapiens
caagcaccauccacacuuc

SEQ ID NO: 325777 - RNA, 19 nt, Homo sapiens
gaacuuccacaucuucuac

SEQ ID NO: 325778 - RNA, 19 nt, Homo sapiens
ucaguuaccuccuggaaaa

SEQ ID NO: 325779 - RNA, 19 nt, Homo sapiens
agucggagcaggaggaaua

SEQ ID NO: 325780 - RNA, 19 nt, Homo sapiens
acaggucgcuggccuccaa

SEQ ID NO: 325781 - RNA, 19 nt, Homo sapiens
gaagcccaccugcaauuuc

SEQ ID NO: 325782 - RNA, 19 nt, Homo sapiens
gaccauguguagcucaaag

SEQ ID NO: 325783 - RNA, 19 nt, Homo sapiens
gaacccguccaguauuuca

SEQ ID NO: 325784 - RNA, 19 nt, Homo sapiens
gaaguggaggaccugcuaa

SEQ ID NO: 325785 - RNA, 19 nt, Homo sapiens
caaagucuccuccaucaac

SEQ ID NO: 325786 - RNA, 19 nt, Homo sapiens
gaagggccagugugccaaa

SEQ ID NO: 325787 - RNA, 19 nt, Homo sapiens
gcuggaggccuuuggaaau

SEQ ID NO: 325788 - RNA, 19 nt, Homo sapiens
uuaccaaagagucgaauuu

SEQ ID NO: 325789 - RNA, 19 nt, Homo sapiens
ugaacagcaucaacaucaa

SEQ ID NO: 325790 - RNA, 19 nt, Homo sapiens
guacagcgugcggacauaa

SEQ ID NO: 325791 - RNA, 19 nt, Homo sapiens
ggaggacgccaaagucaag

SEQ ID NO: 325792 - RNA, 19 nt, Homo sapiens
ucaagggcaagaaggauaa

SEQ ID NO: 325793 - RNA, 19 nt, Homo sapiens
cugcgggaguugugcauaa

SEQ ID NO: 325794 - RNA, 19 nt, Homo sapiens
gcgagaggccucagagcuu

SEQ ID NO: 325795 - RNA, 19 nt, Homo sapiens
guggagauccugcagucua

SEQ ID NO: 325796 - RNA, 19 nt, Homo sapiens
gagaccauguguagcucaa

SEQ ID NO: 325797 - RNA, 19 nt, Homo sapiens
uuaaggagaccauguguag

SEQ ID NO: 325798 - RNA, 19 nt, Homo sapiens
ccaagacccuccggaacga

SEQ ID NO: 325799 - RNA, 19 nt, Homo sapiens
auaauuacccucagagugu

SEQ ID NO: 325800 - RNA, 19 nt, Homo sapiens
ggccguggcuagugagauc

SEQ ID NO: 325801 - RNA, 19 nt, Homo sapiens
ccaaagagucgaauuucca

SEQ ID NO: 325802 - RNA, 19 nt, Homo sapiens
guacccaggcucuucauca

SEQ ID NO: 325803 - RNA, 19 nt, Homo sapiens
gaccgaagccaccaagaag

SEQ ID NO: 325804 - RNA, 19 nt, Homo sapiens
caucaaccagggcagcaua

SEQ ID NO: 325805 - RNA, 19 nt, Homo sapiens
gaacagcaucaacaucaac

SEQ ID NO: 325806 - RNA, 19 nt, Homo sapiens
agagugaccacgugauuga

SEQ ID NO: 325807 - RNA, 19 nt, Homo sapiens
gccagaagaguacaagaug

SEQ ID NO: 325808 - RNA, 19 nt, Homo sapiens
ucgggcuccuggauauuua

SEQ ID NO: 325809 - RNA, 19 nt, Homo sapiens
ccagcagguucgggaagua

SEQ ID NO: 325810 - RNA, 19 nt, Homo sapiens
ucccaacgcccaaagcuuu

SEQ ID NO: 325811 - RNA, 19 nt, Homo sapiens
agggcaagaaggauaauua

SEQ ID NO: 325812 - RNA, 19 nt, Homo sapiens
ggaggaaggcagccaagag

SEQ ID NO: 325813 - RNA, 19 nt, Homo sapiens
gagcuggcuuugccuaucg

SEQ ID NO: 325814 - RNA, 19 nt, Homo sapiens
cgugggaacccguccagua

SEQ ID NO: 325815 - RNA, 19 nt, Homo sapiens
cgagaagcccugacacaca

SEQ ID NO: 325816 - RNA, 19 nt, Homo sapiens
acuggaaggucgucaggaa

SEQ ID NO: 325817 - RNA, 19 nt, Homo sapiens
gaugugcaguuugacuuca

SEQ ID NO: 325818 - RNA, 19 nt, Homo sapiens
cggugccuguugugaaaua

SEQ ID NO: 325819 - RNA, 19 nt, Homo sapiens
cgggaguugugcauaaaga

SEQ ID NO: 325820 - RNA, 19 nt, Homo sapiens
gugggaacccguccaguau

SEQ ID NO: 325821 - RNA, 19 nt, Homo sapiens
gcagaaggccguggcuagu

SEQ ID NO: 325822 - RNA, 19 nt, Homo sapiens
gaccggguuucuggacaaa

SEQ ID NO: 325823 - RNA, 19 nt, Homo sapiens
cgagaaccagcucaaguau

SEQ ID NO: 325824 - RNA, 19 nt, Homo sapiens
ggccagcguccuucauuug

SEQ ID NO: 325825 - RNA, 19 nt, Homo sapiens
ugaaguggaggaccugcua

SEQ ID NO: 325826 - RNA, 19 nt, Homo sapiens
caaccugaccggaaucucu

SEQ ID NO: 325827 - RNA, 19 nt, Homo sapiens
aaggauaauuacccucaga

SEQ ID NO: 325828 - RNA, 19 nt, Homo sapiens
agaaucucaucuacaccua

SEQ ID NO: 325829 - RNA, 19 nt, Homo sapiens
gcuggaggauacugucaag

SEQ ID NO: 325830 - RNA, 19 nt, Homo sapiens
uuaagggcaucaucucgau

SEQ ID NO: 325831 - RNA, 19 nt, Homo sapiens
uccaguauuucaacaacaa

SEQ ID NO: 325832 - RNA, 19 nt, Homo sapiens
uggccagcguccuucauuu

SEQ ID NO: 325833 - RNA, 19 nt, Homo sapiens
gaucagccaucugcaucca

SEQ ID NO: 325834 - RNA, 19 nt, Homo sapiens
agaaauuccuccgggugaa

SEQ ID NO: 325835 - RNA, 19 nt, Homo sapiens
ccgcaaauacgaagcuuuc

SEQ ID NO: 325836 - RNA, 19 nt, Homo sapiens
cuacguccgcugcaucaaa

SEQ ID NO: 325837 - RNA, 19 nt, Homo sapiens
cucaaagaaucccauuaug

SEQ ID NO: 325838 - RNA, 19 nt, Homo sapiens
ugaccggguuucuggacaa

SEQ ID NO: 325839 - RNA, 19 nt, Homo sapiens
acaacaaaaucaucuguga

SEQ ID NO: 325840 - RNA, 19 nt, Homo sapiens
caucaauuacugcaacgaa

SEQ ID NO: 325841 - RNA, 19 nt, Homo sapiens
cgaagcccaccugcaauuu

SEQ ID NO: 325842 - RNA, 19 nt, Homo sapiens
ccgaagcccaccugcaauu

SEQ ID NO: 325843 - RNA, 19 nt, Homo sapiens
gagccuggccacaaagauc

SEQ ID NO: 325844 - RNA, 19 nt, Homo sapiens
gaacggaucuugucugugu

SEQ ID NO: 325845 - RNA, 19 nt, Homo sapiens
gcaaaggugucuaccagua

SEQ ID NO: 325846 - RNA, 19 nt, Homo sapiens
gaaauacguucaaaugaga

SEQ ID NO: 325847 - RNA, 19 nt, Homo sapiens
gcaauacgcuugaacugaa

SEQ ID NO: 325848 - RNA, 19 nt, Homo sapiens
ccaaauauaucaugagcua

SEQ ID NO: 325849 - RNA, 19 nt, Homo sapiens
gaagaaauacguucaaaug

SEQ ID NO: 325850 - RNA, 19 nt, Homo sapiens
ucaagcagaugccauauuu

SEQ ID NO: 325851 - RNA, 19 nt, Homo sapiens
gaaagaccaugaagaauac

SEQ ID NO: 325852 - RNA, 19 nt, Homo sapiens
ggagaaagaccaugaagaa

SEQ ID NO: 325853 - RNA, 19 nt, Homo sapiens
guagaaacauguaugaaug

SEQ ID NO: 325854 - RNA, 19 nt, Homo sapiens
gaaacaguauuaacaggaa

SEQ ID NO: 325855 - RNA, 19 nt, Homo sapiens
gaaccaaggcuucaucauu

SEQ ID NO: 325856 - RNA, 19 nt, Homo sapiens
gcaacuaccucugaaauuc

SEQ ID NO: 325857 - RNA, 19 nt, Homo sapiens
ggaagaauauguucaagag

SEQ ID NO: 325858 - RNA, 19 nt, Homo sapiens
caccaugcauuaagauuua

SEQ ID NO: 325859 - RNA, 19 nt, Homo sapiens
gaagguauccuaugacaug

SEQ ID NO: 325860 - RNA, 19 nt, Homo sapiens
ccacuguacucauucauaa

SEQ ID NO: 325861 - RNA, 19 nt, Homo sapiens
gcaagaguaugacaguuug

SEQ ID NO: 325862 - RNA, 19 nt, Homo sapiens
gaauguggcugggcccaua

SEQ ID NO: 325863 - RNA, 19 nt, Homo sapiens
gcacauuucuuucaucucu

SEQ ID NO: 325864 - RNA, 19 nt, Homo sapiens
gagaaaguaugauggguau

SEQ ID NO: 325865 - RNA, 19 nt, Homo sapiens
ggaguaaaguguucaucaa

SEQ ID NO: 325866 - RNA, 19 nt, Homo sapiens
ucaccagcauggacuauua

SEQ ID NO: 325867 - RNA, 19 nt, Homo sapiens
ccucagaccucuuauugaa

SEQ ID NO: 325868 - RNA, 19 nt, Homo sapiens
agaaagaccaugaagaaua

SEQ ID NO: 325869 - RNA, 19 nt, Homo sapiens
gagaaccagugcgucauua

SEQ ID NO: 325870 - RNA, 19 nt, Homo sapiens
acagaaacaugaucauuga

SEQ ID NO: 325871 - RNA, 19 nt, Homo sapiens
ggacacccauugaguacuu

SEQ ID NO: 325872 - RNA, 19 nt, Homo sapiens
ggucuuugauuucuuggua

SEQ ID NO: 325873 - RNA, 19 nt, Homo sapiens
caacaacuccagccgauuu

SEQ ID NO: 325874 - RNA, 19 nt, Homo sapiens
ucucaacucuuucccuaua

SEQ ID NO: 325875 - RNA, 19 nt, Homo sapiens
gagagaaggagaaacagua

SEQ ID NO: 325876 - RNA, 19 nt, Homo sapiens
gaaacaagccaaugaccuu

SEQ ID NO: 325877 - RNA, 19 nt, Homo sapiens
gguaaagcaucaagucgaa

SEQ ID NO: 325878 - RNA, 19 nt, Homo sapiens
auacauggaugacuacauu

SEQ ID NO: 325879 - RNA, 19 nt, Homo sapiens
gaccuggacugcccaagaa

SEQ ID NO: 325880 - RNA, 19 nt, Homo sapiens
agaaggagaaacaguauua

SEQ ID NO: 325881 - RNA, 19 nt, Homo sapiens
uaaagaaacaagccaauga

SEQ ID NO: 325882 - RNA, 19 nt, Homo sapiens
agagauacauggaugacua

SEQ ID NO: 325883 - RNA, 19 nt, Homo sapiens
uaaguaguauuccacugua

SEQ ID NO: 325884 - RNA, 19 nt, Homo sapiens
gagaagugccuuuaguuga

SEQ ID NO: 325885 - RNA, 19 nt, Homo sapiens
gggcacugguuuacacuuu

SEQ ID NO: 325886 - RNA, 19 nt, Homo sapiens
agaagugccuuuaguugaa

SEQ ID NO: 325887 - RNA, 19 nt, Homo sapiens
caugagcacuucaacaguu

SEQ ID NO: 325888 - RNA, 19 nt, Homo sapiens
cagacgaacucagcuuuaa

SEQ ID NO: 325889 - RNA, 19 nt, Homo sapiens
gcaagagggagaagauuga

SEQ ID NO: 325890 - RNA, 19 nt, Homo sapiens
ucuaugcccuugcagauaa

SEQ ID NO: 325891 - RNA, 19 nt, Homo sapiens
acaagggccuggugaaaga

SEQ ID NO: 325892 - RNA, 19 nt, Homo sapiens
aaagagaacauucgaguga

SEQ ID NO: 325893 - RNA, 19 nt, Homo sapiens
agacaucuauggcuuugaa

SEQ ID NO: 325894 - RNA, 19 nt, Homo sapiens
gaaugugauugggaucuuu

SEQ ID NO: 325895 - RNA, 19 nt, Homo sapiens
uaaagcaucaagucgaaua

SEQ ID NO: 325896 - RNA, 19 nt, Homo sapiens
caucuauggcuuugaaaua

SEQ ID NO: 325897 - RNA, 19 nt, Homo sapiens
aaacaucagcuucaaagaa

SEQ ID NO: 325898 - RNA, 19 nt, Homo sapiens
ccaaggagcggcacaguau

SEQ ID NO: 325899 - RNA, 19 nt, Homo sapiens
uuaaagaugugcucugcuu

SEQ ID NO: 325900 - RNA, 19 nt, Homo sapiens
guauuccacuguacucauu

SEQ ID NO: 325901 - RNA, 19 nt, Homo sapiens
gguagccucuucauaggaa

SEQ ID NO: 325902 - RNA, 19 nt, Homo sapiens
cccaagaacucccguccua

SEQ ID NO: 325903 - RNA, 19 nt, Homo sapiens
ggaaacaucagcuucaaag

SEQ ID NO: 325904 - RNA, 19 nt, Homo sapiens
auacaagguugaugacauu

SEQ ID NO: 325905 - RNA, 19 nt, Homo sapiens
gagcacauuucuuucaucu

SEQ ID NO: 325906 - RNA, 19 nt, Homo sapiens
aaaccaccaugcauuaaga

SEQ ID NO: 325907 - RNA, 19 nt, Homo sapiens
aaagguagccucuucauag

SEQ ID NO: 325908 - RNA, 19 nt, Homo sapiens
aaccaaggcuucaucauuc

SEQ ID NO: 325909 - RNA, 19 nt, Homo sapiens
caauaaagccauggagaaa

SEQ ID NO: 325910 - RNA, 19 nt, Homo sapiens
gcagauaauauguacagaa

SEQ ID NO: 325911 - RNA, 19 nt, Homo sapiens
gccuggagcuauucuggua

SEQ ID NO: 325912 - RNA, 19 nt, Homo sapiens
cagacacagucaccaagua

SEQ ID NO: 325913 - RNA, 19 nt, Homo sapiens
agaaauacguucaaaugag

SEQ ID NO: 325914 - RNA, 19 nt, Homo sapiens
gggaagguauccuaugaca

SEQ ID NO: 325915 - RNA, 19 nt, Homo sapiens
auaaagccauggagaaaga

SEQ ID NO: 325916 - RNA, 19 nt, Homo sapiens
gcugagaagugccuuuagu

SEQ ID NO: 325917 - RNA, 19 nt, Homo sapiens
cuuguaggcuucuaucaaa

SEQ ID NO: 325918 - RNA, 19 nt, Homo sapiens
ucaguacuaugcaggauga

SEQ ID NO: 325919 - RNA, 19 nt, Homo sapiens
gaugagagagagaaaguau

SEQ ID NO: 325920 - RNA, 19 nt, Homo sapiens
gaacccuccuggcaucaug

SEQ ID NO: 325921 - RNA, 19 nt, Homo sapiens
caugaagaauacaacauug

SEQ ID NO: 325922 - RNA, 19 nt, Homo sapiens
caggaccgguugaaagaaa

SEQ ID NO: 325923 - RNA, 19 nt, Homo sapiens
agacucuucucaacucuuu

SEQ ID NO: 325924 - RNA, 19 nt, Homo sapiens
gguagaaacauguaugaau

SEQ ID NO: 325925 - RNA, 19 nt, Homo sapiens
gaaggagaaacaguauuaa

SEQ ID NO: 325926 - RNA, 19 nt, Homo sapiens
ugagagagagaaaguauga

SEQ ID NO: 325927 - RNA, 19 nt, Homo sapiens
gaagagaugagagagagaa

SEQ ID NO: 325928 - RNA, 19 nt, Homo sapiens
gaguaaaguguucaucaaa

SEQ ID NO: 325929 - RNA, 19 nt, Homo sapiens
cccauugaguacuuuaaua

SEQ ID NO: 325930 - RNA, 19 nt, Homo sapiens
guacagaaacaugaucauu

SEQ ID NO: 325931 - RNA, 19 nt, Homo sapiens
ggaagaaauacguucaaau

SEQ ID NO: 325932 - RNA, 19 nt, Homo sapiens
gcaguuccaccaaggguuu

SEQ ID NO: 325933 - RNA, 19 nt, Homo sapiens
gagcaagaguaugacaguu

SEQ ID NO: 325934 - RNA, 19 nt, Homo sapiens
ucagaccucuuauugaaca

SEQ ID NO: 325935 - RNA, 19 nt, Homo sapiens
uggguaugcucgagugaua

SEQ ID NO: 325936 - RNA, 19 nt, Homo sapiens
cuacagagguaugccauuc

SEQ ID NO: 325937 - RNA, 19 nt, Homo sapiens
ugagcacccugaugaaaug

SEQ ID NO: 325938 - RNA, 19 nt, Homo sapiens
guuaaaugcuguacuuacu

SEQ ID NO: 325939 - RNA, 19 nt, Homo sapiens
gagccuggauuuccucaag

SEQ ID NO: 325940 - RNA, 19 nt, Homo sapiens
gguaugccauucugaccaa

SEQ ID NO: 325941 - RNA, 19 nt, Homo sapiens
gaagaagagauacauggau

SEQ ID NO: 325942 - RNA, 19 nt, Homo sapiens
ucaauaaagccauggagaa

SEQ ID NO: 325943 - RNA, 19 nt, Homo sapiens
gagcggaguuuucacauau

SEQ ID NO: 325944 - RNA, 19 nt, Homo sapiens
gaagaaagaccacaaauua

SEQ ID NO: 325945 - RNA, 19 nt, Homo sapiens
gaacaaaugugcacucuuu

SEQ ID NO: 325946 - RNA, 19 nt, Homo sapiens
gaaauaaacuggcaauaug

SEQ ID NO: 325947 - RNA, 19 nt, Homo sapiens
gcacugaguuugaauggua

SEQ ID NO: 325948 - RNA, 19 nt, Homo sapiens
aaacaaagcuuucaucauc

SEQ ID NO: 325949 - RNA, 19 nt, Homo sapiens
gcacaaagcagucaucauu

SEQ ID NO: 325950 - RNA, 19 nt, Homo sapiens
gaacaugggugauauggau

SEQ ID NO: 325951 - RNA, 19 nt, Homo sapiens
gugcagaacuggaauauga

SEQ ID NO: 325952 - RNA, 19 nt, Homo sapiens
gcaagaauguguuagagaa

SEQ ID NO: 325953 - RNA, 19 nt, Homo sapiens
gaacaaagacuacaaaugc

SEQ ID NO: 325954 - RNA, 19 nt, Homo sapiens
ggaaagaccuggagcaaac

SEQ ID NO: 325955 - RNA, 19 nt, Homo sapiens
caacacaucucgccagaau

SEQ ID NO: 325956 - RNA, 19 nt, Homo sapiens
uaucaaaucugaaggaaga

SEQ ID NO: 325957 - RNA, 19 nt, Homo sapiens
gagaaacuaucauaucuuc

SEQ ID NO: 325958 - RNA, 19 nt, Homo sapiens
gaucaucugcucuggauua

SEQ ID NO: 325959 - RNA, 19 nt, Homo sapiens
ggaaguauauugagauugg

SEQ ID NO: 325960 - RNA, 19 nt, Homo sapiens
acaagaaucugaugaauag

SEQ ID NO: 325961 - RNA, 19 nt, Homo sapiens
aaaguaaggucguugcuaa

SEQ ID NO: 325962 - RNA, 19 nt, Homo sapiens
aaacacaucuuuccuguca

SEQ ID NO: 325963 - RNA, 19 nt, Homo sapiens
gaagguaccucuggacaug

SEQ ID NO: 325964 - RNA, 19 nt, Homo sapiens
gagagaaacuaucauaucu

SEQ ID NO: 325965 - RNA, 19 nt, Homo sapiens
gaggguggcugcugagaaa

SEQ ID NO: 325966 - RNA, 19 nt, Homo sapiens
caacgagucugaauauauc

SEQ ID NO: 325967 - RNA, 19 nt, Homo sapiens
cagagcagcugguaucaaa

SEQ ID NO: 325968 - RNA, 19 nt, Homo sapiens
caaaggagauggcacauac

SEQ ID NO: 325969 - RNA, 19 nt, Homo sapiens
ccaaggagcugccucacuu

SEQ ID NO: 325970 - RNA, 19 nt, Homo sapiens
gaacacugccucaccaauu

SEQ ID NO: 325971 - RNA, 19 nt, Homo sapiens
ggagagcuguggcugguuu

SEQ ID NO: 325972 - RNA, 19 nt, Homo sapiens
gcacaagcauacauugguu

SEQ ID NO: 325973 - RNA, 19 nt, Homo sapiens
agaaugagcuaaaugaguu

SEQ ID NO: 325974 - RNA, 19 nt, Homo sapiens
cgucggagcucuacacaaa

SEQ ID NO: 325975 - RNA, 19 nt, Homo sapiens
agaaagaugugcugaguga

SEQ ID NO: 325976 - RNA, 19 nt, Homo sapiens
uagcaacacucauccuuaa

SEQ ID NO: 325977 - RNA, 19 nt, Homo sapiens
ccacauaucuuugcaguag

SEQ ID NO: 325978 - RNA, 19 nt, Homo sapiens
augaacagcugccuauuua

SEQ ID NO: 325979 - RNA, 19 nt, Homo sapiens
gaaaggauuuggaauacca

SEQ ID NO: 325980 - RNA, 19 nt, Homo sapiens
ggaaaucucccuagaauac

SEQ ID NO: 325981 - RNA, 19 nt, Homo sapiens
caauuugauuccaggauua

SEQ ID NO: 325982 - RNA, 19 nt, Homo sapiens
caauaugcaugucuucaaa

SEQ ID NO: 325983 - RNA, 19 nt, Homo sapiens
gcaaauggccagagaugaa

SEQ ID NO: 325984 - RNA, 19 nt, Homo sapiens
gaacagcugccuauuuaug

SEQ ID NO: 325985 - RNA, 19 nt, Homo sapiens
cugauuaucucccaaauga

SEQ ID NO: 325986 - RNA, 19 nt, Homo sapiens
aaugacagauuccacaaua

SEQ ID NO: 325987 - RNA, 19 nt, Homo sapiens
gaaacuaaccaaucuggaa

SEQ ID NO: 325988 - RNA, 19 nt, Homo sapiens
cauggacacucauagauuu

SEQ ID NO: 325989 - RNA, 19 nt, Homo sapiens
ggaaaugcagauaacuuua

SEQ ID NO: 325990 - RNA, 19 nt, Homo sapiens
gacaagaaucugaugaaua

SEQ ID NO: 325991 - RNA, 19 nt, Homo sapiens
gcaacgagucugaauauau

SEQ ID NO: 325992 - RNA, 19 nt, Homo sapiens
cagaaacuauggagaagaa

SEQ ID NO: 325993 - RNA, 19 nt, Homo sapiens
gcaaacucguucagagaaa

SEQ ID NO: 325994 - RNA, 19 nt, Homo sapiens
agaaauagguaucgcaaga

SEQ ID NO: 325995 - RNA, 19 nt, Homo sapiens
caaguggccuaucuagaaa

SEQ ID NO: 325996 - RNA, 19 nt, Homo sapiens
gcauauauccuguucaugu

SEQ ID NO: 325997 - RNA, 19 nt, Homo sapiens
ccaauaggcuccuggaauc

SEQ ID NO: 325998 - RNA, 19 nt, Homo sapiens
gcagaaagaugugcugagu

SEQ ID NO: 325999 - RNA, 19 nt, Homo sapiens
caaauuccauggacacuca

SEQ ID NO: 326000 - RNA, 19 nt, Homo sapiens
gcaaaguuaccugaauuua

SEQ ID NO: 326001 - RNA, 19 nt, Homo sapiens
cagcaaaguuaccugaauu

SEQ ID NO: 326002 - RNA, 19 nt, Homo sapiens
ggccagagaugaacgaaau

SEQ ID NO: 326003 - RNA, 19 nt, Homo sapiens
gaugagcuguuguuaggaa

SEQ ID NO: 326004 - RNA, 19 nt, Homo sapiens
gcucuuucgugcuguguua

SEQ ID NO: 326005 - RNA, 19 nt, Homo sapiens
ggacagaggaaccaaguga

SEQ ID NO: 326006 - RNA, 19 nt, Homo sapiens
gaggagagaaacuaucaua

SEQ ID NO: 326007 - RNA, 19 nt, Homo sapiens
gagaagucauuaacuggaa

SEQ ID NO: 326008 - RNA, 19 nt, Homo sapiens
gaacauccuucagccaaug

SEQ ID NO: 326009 - RNA, 19 nt, Homo sapiens
gagaagagggcuuuaugaa

SEQ ID NO: 326010 - RNA, 19 nt, Homo sapiens
gaagaagaaagaccacaaa

SEQ ID NO: 326011 - RNA, 19 nt, Homo sapiens
gaacucgaccuuaaugaug

SEQ ID NO: 326012 - RNA, 19 nt, Homo sapiens
uaaccaaucuggaaggaau

SEQ ID NO: 326013 - RNA, 19 nt, Homo sapiens
gacaugucauuguuccuua

SEQ ID NO: 326014 - RNA, 19 nt, Homo sapiens
gcagaucgauacaaacaag

SEQ ID NO: 326015 - RNA, 19 nt, Homo sapiens
gcuagacauuuacggauuu

SEQ ID NO: 326016 - RNA, 19 nt, Homo sapiens
ccagaacuauuucaagaug

SEQ ID NO: 326017 - RNA, 19 nt, Homo sapiens
aaacagcacucuuuuauug

SEQ ID NO: 326018 - RNA, 19 nt, Homo sapiens
gcacuaaacaggagaaugg

SEQ ID NO: 326019 - RNA, 19 nt, Homo sapiens
gaagccauuuguucuaugu

SEQ ID NO: 326020 - RNA, 19 nt, Homo sapiens
gagaagaaguuaguagaag

SEQ ID NO: 326021 - RNA, 19 nt, Homo sapiens
cgcaggagguacaagauua

SEQ ID NO: 326022 - RNA, 19 nt, Homo sapiens
gaugcuaccagaacuauuu

SEQ ID NO: 326023 - RNA, 19 nt, Homo sapiens
gcaagaagaauauaugaag

SEQ ID NO: 326024 - RNA, 19 nt, Homo sapiens
gaaccucucugcaucuucu

SEQ ID NO: 326025 - RNA, 19 nt, Homo sapiens
gaauuuguauacuccaguu

SEQ ID NO: 326026 - RNA, 19 nt, Homo sapiens
ucaaguggccuaucuagaa

SEQ ID NO: 326027 - RNA, 19 nt, Homo sapiens
ggagagaaacuaucauauc

SEQ ID NO: 326028 - RNA, 19 nt, Homo sapiens
gaagaggaagcgaaaguug

SEQ ID NO: 326029 - RNA, 19 nt, Homo sapiens
cuauuguucuucagucuua

SEQ ID NO: 326030 - RNA, 19 nt, Homo sapiens
caaauuggagcaagaagaa

SEQ ID NO: 326031 - RNA, 19 nt, Homo sapiens
gcuggaacaugaaacgauu

SEQ ID NO: 326032 - RNA, 19 nt, Homo sapiens
ggagaagagggcuuuauga

SEQ ID NO: 326033 - RNA, 19 nt, Homo sapiens
gucaagaacuagaaucaga

SEQ ID NO: 326034 - RNA, 19 nt, Homo sapiens
ugacauacuuguuggugaa

SEQ ID NO: 326035 - RNA, 19 nt, Homo sapiens
gaagagaugacccuuaugg

SEQ ID NO: 326036 - RNA, 19 nt, Homo sapiens
gaagaaguuaguagaagaa

SEQ ID NO: 326037 - RNA, 19 nt, Homo sapiens
uagacgagcugccacuauu

SEQ ID NO: 326038 - RNA, 19 nt, Homo sapiens
uaccagaacuauuucaaga

SEQ ID NO: 326039 - RNA, 19 nt, Homo sapiens
ggaaggaaaggauuuggaa

SEQ ID NO: 326040 - RNA, 19 nt, Homo sapiens
gugccaauaugagaacuua

SEQ ID NO: 326041 - RNA, 19 nt, Homo sapiens
gaaaacagaugaugaugca

SEQ ID NO: 326042 - RNA, 19 nt, Homo sapiens
ggagaagaaguuaguagaa

SEQ ID NO: 326043 - RNA, 19 nt, Homo sapiens
cagcugguaucaaaucuga

SEQ ID NO: 326044 - RNA, 19 nt, Homo sapiens
gaagauaacuguucacuaa

SEQ ID NO: 326045 - RNA, 19 nt, Homo sapiens
ccauauaacuggaguaaua

SEQ ID NO: 326046 - RNA, 19 nt, Homo sapiens
gaaagagccuuaauguauu

SEQ ID NO: 326047 - RNA, 19 nt, Homo sapiens
ggaauauugugcugaauua

SEQ ID NO: 326048 - RNA, 19 nt, Homo sapiens
caaagucuguuacugauua

SEQ ID NO: 326049 - RNA, 19 nt, Homo sapiens
ccaaagaaaugucagaauu

SEQ ID NO: 326050 - RNA, 19 nt, Homo sapiens
gaagagaaauacugaaaca

SEQ ID NO: 326051 - RNA, 19 nt, Homo sapiens
ggagcaagcuuuauucguu

SEQ ID NO: 326052 - RNA, 19 nt, Homo sapiens
gcaaagaggaaagaaauua

SEQ ID NO: 326053 - RNA, 19 nt, Homo sapiens
uaacuggacugaauucaaa

SEQ ID NO: 326054 - RNA, 19 nt, Homo sapiens
gaacaaauccagaaagaau

SEQ ID NO: 326055 - RNA, 19 nt, Homo sapiens
gaacaagaacucuaucaaa

SEQ ID NO: 326056 - RNA, 19 nt, Homo sapiens
gaauaaaucugcucagucu

SEQ ID NO: 326057 - RNA, 19 nt, Homo sapiens
gaacaaauggccaaagaaa

SEQ ID NO: 326058 - RNA, 19 nt, Homo sapiens
gaaaagagcucaguuguug

SEQ ID NO: 326059 - RNA, 19 nt, Homo sapiens
cagauaaacuugcaagauu

SEQ ID NO: 326060 - RNA, 19 nt, Homo sapiens
gaggauuuguuucacauua

SEQ ID NO: 326061 - RNA, 19 nt, Homo sapiens
gaucaaggcacuaauguuu

SEQ ID NO: 326062 - RNA, 19 nt, Homo sapiens
gcaauaaagucauaucaag

SEQ ID NO: 326063 - RNA, 19 nt, Homo sapiens
ucaagaaucuggaaauuuc

SEQ ID NO: 326064 - RNA, 19 nt, Homo sapiens
uaagauaccugacugaauc

SEQ ID NO: 326065 - RNA, 19 nt, Homo sapiens
gagcuuacauucuuacaau

SEQ ID NO: 326066 - RNA, 19 nt, Homo sapiens
gaucaagaaucuggaaauu

SEQ ID NO: 326067 - RNA, 19 nt, Homo sapiens
agaaagagccuuaauguau

SEQ ID NO: 326068 - RNA, 19 nt, Homo sapiens
caaagaaacugacaaacag

SEQ ID NO: 326069 - RNA, 19 nt, Homo sapiens
ccacacugcuccauaauau

SEQ ID NO: 326070 - RNA, 19 nt, Homo sapiens
gagaaaugauggaacaaga

SEQ ID NO: 326071 - RNA, 19 nt, Homo sapiens
gaucaacacuuuacaucug

SEQ ID NO: 326072 - RNA, 19 nt, Homo sapiens
gaguagagguccugcugua

SEQ ID NO: 326073 - RNA, 19 nt, Homo sapiens
ggaugaaacuugagaugga

SEQ ID NO: 326074 - RNA, 19 nt, Homo sapiens
uaaggcagguucuaugaaa

SEQ ID NO: 326075 - RNA, 19 nt, Homo sapiens
acaaagacccucagaguaa

SEQ ID NO: 326076 - RNA, 19 nt, Homo sapiens
caucaaaccuaacuuaaag

SEQ ID NO: 326077 - RNA, 19 nt, Homo sapiens
aaagaagguuuagguguua

SEQ ID NO: 326078 - RNA, 19 nt, Homo sapiens
cagaagcaauaaagucaua

SEQ ID NO: 326079 - RNA, 19 nt, Homo sapiens
caagacaguuugaagaaau

SEQ ID NO: 326080 - RNA, 19 nt, Homo sapiens
gcuuugggcuuaaaugaaa

SEQ ID NO: 326081 - RNA, 19 nt, Homo sapiens
uaugaaagauccucugcua

SEQ ID NO: 326082 - RNA, 19 nt, Homo sapiens
ggaaaucuaagaacaagaa

SEQ ID NO: 326083 - RNA, 19 nt, Homo sapiens
gaaaggcggaugaaacuug

SEQ ID NO: 326084 - RNA, 19 nt, Homo sapiens
gaaaaugacuacaaguuug

SEQ ID NO: 326085 - RNA, 19 nt, Homo sapiens
gugauaagagguacuaaua

SEQ ID NO: 326086 - RNA, 19 nt, Homo sapiens
acacaaaccucgcauugau

SEQ ID NO: 326087 - RNA, 19 nt, Homo sapiens
gaaacugacaaacagauuu

SEQ ID NO: 326088 - RNA, 19 nt, Homo sapiens
ucaaaugucagcagcuuua

SEQ ID NO: 326089 - RNA, 19 nt, Homo sapiens
ucaggacuguauagauuua

SEQ ID NO: 326090 - RNA, 19 nt, Homo sapiens
caucaacuauugcaaugaa

SEQ ID NO: 326091 - RNA, 19 nt, Homo sapiens
gaaagauccucugcuagau

SEQ ID NO: 326092 - RNA, 19 nt, Homo sapiens
agaaauuccuagugucuuu

SEQ ID NO: 326093 - RNA, 19 nt, Homo sapiens
ccacaaauaacaacaaaga

SEQ ID NO: 326094 - RNA, 19 nt, Homo sapiens
caaaggaacaguuauaaag

SEQ ID NO: 326095 - RNA, 19 nt, Homo sapiens
cauuugaguucaccagaua

SEQ ID NO: 326096 - RNA, 19 nt, Homo sapiens
cccgacagcuuaacaauug

SEQ ID NO: 326097 - RNA, 19 nt, Homo sapiens
gcaucaaaccuaacuuaaa

SEQ ID NO: 326098 - RNA, 19 nt, Homo sapiens
cauuguaucuggagaauca

SEQ ID NO: 326099 - RNA, 19 nt, Homo sapiens
ccaaguuguuucauugauu

SEQ ID NO: 326100 - RNA, 19 nt, Homo sapiens
uggaacaggucaagauauu

SEQ ID NO: 326101 - RNA, 19 nt, Homo sapiens
ccucaugucuuugcaauug

SEQ ID NO: 326102 - RNA, 19 nt, Homo sapiens
gauaacuguucacuaaugu

SEQ ID NO: 326103 - RNA, 19 nt, Homo sapiens
caauugaacccuugaauca

SEQ ID NO: 326104 - RNA, 19 nt, Homo sapiens
guacaaagacccucagagu

SEQ ID NO: 326105 - RNA, 19 nt, Homo sapiens
aagccgagcucaucaguga

SEQ ID NO: 326106 - RNA, 19 nt, Homo sapiens
aaucuaagcuggcaguuca

SEQ ID NO: 326107 - RNA, 19 nt, Homo sapiens
aauaauagcagucgauuug

SEQ ID NO: 326108 - RNA, 19 nt, Homo sapiens
gaauccauacuuugacaua

SEQ ID NO: 326109 - RNA, 19 nt, Homo sapiens
ugugugagcugaaucuuga

SEQ ID NO: 326110 - RNA, 19 nt, Homo sapiens
gaauaugaugcacugguua

SEQ ID NO: 326111 - RNA, 19 nt, Homo sapiens
gaauguggcuuugcaagag

SEQ ID NO: 326112 - RNA, 19 nt, Homo sapiens
ggaggaaucccaacagcaa

SEQ ID NO: 326113 - RNA, 19 nt, Homo sapiens
gaucuucgaguaaguuuga

SEQ ID NO: 326114 - RNA, 19 nt, Homo sapiens
ugaaagauccucugcuaga

SEQ ID NO: 326115 - RNA, 19 nt, Homo sapiens
ccaagacaguuugaagaaa

SEQ ID NO: 326116 - RNA, 19 nt, Homo sapiens
gaacaauucaccucagcaa

SEQ ID NO: 326117 - RNA, 19 nt, Homo sapiens
gcggagaaaugauggaaca

SEQ ID NO: 326118 - RNA, 19 nt, Homo sapiens
gaagaagaagagagaaaga

SEQ ID NO: 326119 - RNA, 19 nt, Homo sapiens
gaugaaacuugagauggaa

SEQ ID NO: 326120 - RNA, 19 nt, Homo sapiens
gaugacaagccaccacuuu

SEQ ID NO: 326121 - RNA, 19 nt, Homo sapiens
caacccaguuuguggagaa

SEQ ID NO: 326122 - RNA, 19 nt, Homo sapiens
gaagugcauuauguggaua

SEQ ID NO: 326123 - RNA, 19 nt, Homo sapiens
cuagauacuuugcuaacaa

SEQ ID NO: 326124 - RNA, 19 nt, Homo sapiens
ggacaagaccaccucaugu

SEQ ID NO: 326125 - RNA, 19 nt, Homo sapiens
uuguagaccuguuucauaa

SEQ ID NO: 326126 - RNA, 19 nt, Homo sapiens
gauguauucugugauaaga

SEQ ID NO: 326127 - RNA, 19 nt, Homo sapiens
aacaugagcuuacauucuu

SEQ ID NO: 326128 - RNA, 19 nt, Homo sapiens
gcaacgugcuccaaagucu

SEQ ID NO: 326129 - RNA, 19 nt, Homo sapiens
acaaauggccaaagaaaug

SEQ ID NO: 326130 - RNA, 19 nt, Homo sapiens
gaaaggcugaggcguauuc

SEQ ID NO: 326131 - RNA, 19 nt, Homo sapiens
cagaaaggcugaggcguau

SEQ ID NO: 326132 - RNA, 19 nt, Homo sapiens
ggagaugugugagcugaau

SEQ ID NO: 326133 - RNA, 19 nt, Homo sapiens
agagaagaauuucauagga

SEQ ID NO: 326134 - RNA, 19 nt, Homo sapiens
cggaacaaauggccaaaga

SEQ ID NO: 326135 - RNA, 19 nt, Homo sapiens
gcaggaagaggaagcagaa

SEQ ID NO: 326136 - RNA, 19 nt, Homo sapiens
guucagggauggugucugu

SEQ ID NO: 326137 - RNA, 19 nt, Homo sapiens
aaagguaccucugaaagug

SEQ ID NO: 326138 - RNA, 19 nt, Homo sapiens
gauuucagaugggcaauau

SEQ ID NO: 326139 - RNA, 19 nt, Homo sapiens
gaucuguguucaaggcaaa

SEQ ID NO: 326140 - RNA, 19 nt, Homo sapiens
guguguugcugucagaaua

SEQ ID NO: 326141 - RNA, 19 nt, Homo sapiens
guacuuagguagggugugu

SEQ ID NO: 326142 - RNA, 19 nt, Homo sapiens
uggcuuaacuggacugaau

SEQ ID NO: 326143 - RNA, 19 nt, Homo sapiens
gagcuggcccugaggauug

SEQ ID NO: 326144 - RNA, 19 nt, Homo sapiens
gaagagaucuaaguauguu

SEQ ID NO: 326145 - RNA, 19 nt, Homo sapiens
gcgcgaagauugagcagua

SEQ ID NO: 326146 - RNA, 19 nt, Homo sapiens
gcaagcagcugacccacaa

SEQ ID NO: 326147 - RNA, 19 nt, Homo sapiens
gcauaaagcauguuucauu

SEQ ID NO: 326148 - RNA, 19 nt, Homo sapiens
ggucacaacuguaggaaga

SEQ ID NO: 326149 - RNA, 19 nt, Homo sapiens
gagccaaacuucccugaga

SEQ ID NO: 326150 - RNA, 19 nt, Homo sapiens
aagaggauguggucaguua

SEQ ID NO: 326151 - RNA, 19 nt, Homo sapiens
gaaaguacaucgacaucca

SEQ ID NO: 326152 - RNA, 19 nt, Homo sapiens
gggcagcacucguggauug

SEQ ID NO: 326153 - RNA, 19 nt, Homo sapiens
ccgagaaguuugucaagua

SEQ ID NO: 326154 - RNA, 19 nt, Homo sapiens
gagcacauccgccaguaua

SEQ ID NO: 326155 - RNA, 19 nt, Homo sapiens
ggaccucucugaguauaaa

SEQ ID NO: 326156 - RNA, 19 nt, Homo sapiens
ugaagacgcuggagaagug

SEQ ID NO: 326157 - RNA, 19 nt, Homo sapiens
gcacagacaccaccauguu

SEQ ID NO: 326158 - RNA, 19 nt, Homo sapiens
uaauugccaucaacaagua

SEQ ID NO: 326159 - RNA, 19 nt, Homo sapiens
gagaagaucccugugauga

SEQ ID NO: 326160 - RNA, 19 nt, Homo sapiens
gcacaagaccacccagauu

SEQ ID NO: 326161 - RNA, 19 nt, Homo sapiens
ggacggguguguacuuugu

SEQ ID NO: 326162 - RNA, 19 nt, Homo sapiens
cauaaagcauguuucauuc

SEQ ID NO: 326163 - RNA, 19 nt, Homo sapiens
gcaguacuuuguagacuau

SEQ ID NO: 326164 - RNA, 19 nt, Homo sapiens
aaaccaagaucuuucugaa

SEQ ID NO: 326165 - RNA, 19 nt, Homo sapiens
gaccagugcugcaucauca

SEQ ID NO: 326166 - RNA, 19 nt, Homo sapiens
caacugggccucugauguu

SEQ ID NO: 326167 - RNA, 19 nt, Homo sapiens
cggaagagaucuaaguaug

SEQ ID NO: 326168 - RNA, 19 nt, Homo sapiens
gcaagaagacguacaagag

SEQ ID NO: 326169 - RNA, 19 nt, Homo sapiens
caacgcacaucaagccuau

SEQ ID NO: 326170 - RNA, 19 nt, Homo sapiens
ugaagcagcugaccgacaa

SEQ ID NO: 326171 - RNA, 19 nt, Homo sapiens
guauaaauuugccaaguuc

SEQ ID NO: 326172 - RNA, 19 nt, Homo sapiens
ggacaugauugccaacaag

SEQ ID NO: 326173 - RNA, 19 nt, Homo sapiens
ccaagaagccaaucauguu

SEQ ID NO: 326174 - RNA, 19 nt, Homo sapiens
ggacaaccacgcacuccua

SEQ ID NO: 326175 - RNA, 19 nt, Homo sapiens
gcaucaacuucgccaauga

SEQ ID NO: 326176 - RNA, 19 nt, Homo sapiens
cugaugagcugccugacua

SEQ ID NO: 326177 - RNA, 19 nt, Homo sapiens
ggccauggguaacugcaua

SEQ ID NO: 326178 - RNA, 19 nt, Homo sapiens
uuagaugugucuccuguuu

SEQ ID NO: 326179 - RNA, 19 nt, Homo sapiens
gaacugaugcccagaaggu

SEQ ID NO: 326180 - RNA, 19 nt, Homo sapiens
ucacugggcugcucugauc

SEQ ID NO: 326181 - RNA, 19 nt, Homo sapiens
gccaugagccugucaauca

SEQ ID NO: 326182 - RNA, 19 nt, Homo sapiens
gcugacaacugcuacuuca

SEQ ID NO: 326183 - RNA, 19 nt, Homo sapiens
gagcuguccuucccagaga

SEQ ID NO: 326184 - RNA, 19 nt, Homo sapiens
gacuauggcucugagauga

SEQ ID NO: 326185 - RNA, 19 nt, Homo sapiens
gaggagcgccugagaagga

SEQ ID NO: 326186 - RNA, 19 nt, Homo sapiens
gcaucaagcccaaugaguu

SEQ ID NO: 326187 - RNA, 19 nt, Homo sapiens
caagaucaacgcagcaauu

SEQ ID NO: 326188 - RNA, 19 nt, Homo sapiens
ccugagauccuccuaauug

SEQ ID NO: 326189 - RNA, 19 nt, Homo sapiens
ggauucagccucuuuguca

SEQ ID NO: 326190 - RNA, 19 nt, Homo sapiens
ucaagaagcccaugcuguu

SEQ ID NO: 326191 - RNA, 19 nt, Homo sapiens
gaucaacgcagcaauuuac

SEQ ID NO: 326192 - RNA, 19 nt, Homo sapiens
ccaagaccauccgcaauga

SEQ ID NO: 326193 - RNA, 19 nt, Homo sapiens
gcucaagucuacccugauc

SEQ ID NO: 326194 - RNA, 19 nt, Homo sapiens
gaaucaagaggacaaucua

SEQ ID NO: 326195 - RNA, 19 nt, Homo sapiens
ggaagagaucuaaguaugu

SEQ ID NO: 326196 - RNA, 19 nt, Homo sapiens
ggagagagagugagagaca

SEQ ID NO: 326197 - RNA, 19 nt, Homo sapiens
gaacaucaucucccucauc

SEQ ID NO: 326198 - RNA, 19 nt, Homo sapiens
ucaccaagaucuccaacug

SEQ ID NO: 326199 - RNA, 19 nt, Homo sapiens
ucauugcugugcucaagua

SEQ ID NO: 326200 - RNA, 19 nt, Homo sapiens
guaacugcauaaccuguga

SEQ ID NO: 326201 - RNA, 19 nt, Homo sapiens
caaagcugauccugcaguu

SEQ ID NO: 326202 - RNA, 19 nt, Homo sapiens
gacaagagacacacacaga

SEQ ID NO: 326203 - RNA, 19 nt, Homo sapiens
cacaagaccacccagauuu

SEQ ID NO: 326204 - RNA, 19 nt, Homo sapiens
ccaggcaccuaguggcuuu

SEQ ID NO: 326205 - RNA, 19 nt, Homo sapiens
ggaccauggugauucuuca

SEQ ID NO: 326206 - RNA, 19 nt, Homo sapiens
caccucaucuacacguaua

SEQ ID NO: 326207 - RNA, 19 nt, Homo sapiens
gaacgcaacgcacaucaag

SEQ ID NO: 326208 - RNA, 19 nt, Homo sapiens
caaucuagcucuccauacu

SEQ ID NO: 326209 - RNA, 19 nt, Homo sapiens
uggaugaccuccugacuuc

SEQ ID NO: 326210 - RNA, 19 nt, Homo sapiens
gauuccaucuuccacuauu

SEQ ID NO: 326211 - RNA, 19 nt, Homo sapiens
ucaaguacaugggcgacua

SEQ ID NO: 326212 - RNA, 19 nt, Homo sapiens
caaagaggauguggucagu

SEQ ID NO: 326213 - RNA, 19 nt, Homo sapiens
ccaccaaccucaucuacca

SEQ ID NO: 326214 - RNA, 19 nt, Homo sapiens
cagaggaggugaccaagag

SEQ ID NO: 326215 - RNA, 19 nt, Homo sapiens
caacuuccuuugacuuucu

SEQ ID NO: 326216 - RNA, 19 nt, Homo sapiens
uaccagguguucuucauga

SEQ ID NO: 326217 - RNA, 19 nt, Homo sapiens
ggaauugugcccucacuca

SEQ ID NO: 326218 - RNA, 19 nt, Homo sapiens
gcaccaaggccaaggacuu

SEQ ID NO: 326219 - RNA, 19 nt, Homo sapiens
guacaucgacauccacuuc

SEQ ID NO: 326220 - RNA, 19 nt, Homo sapiens
caacugcuacuucaacaug

SEQ ID NO: 326221 - RNA, 19 nt, Homo sapiens
ugacuuuguucgacacuug

SEQ ID NO: 326222 - RNA, 19 nt, Homo sapiens
caagaagccaaucauguug

SEQ ID NO: 326223 - RNA, 19 nt, Homo sapiens
guaugaggcacgcacauuu

SEQ ID NO: 326224 - RNA, 19 nt, Homo sapiens
gagggagacagaccacuuu

SEQ ID NO: 326225 - RNA, 19 nt, Homo sapiens
gacaaucuagcucuccaua

SEQ ID NO: 326226 - RNA, 19 nt, Homo sapiens
caagggagaccucaucauc

SEQ ID NO: 326227 - RNA, 19 nt, Homo sapiens
uuaugaagccuacaaauuc

SEQ ID NO: 326228 - RNA, 19 nt, Homo sapiens
caagagacacacacagaga

SEQ ID NO: 326229 - RNA, 19 nt, Homo sapiens
gaguauaaauuugccaagu

SEQ ID NO: 326230 - RNA, 19 nt, Homo sapiens
ccaacaagcccaugaacau

SEQ ID NO: 326231 - RNA, 19 nt, Homo sapiens
uaaagcauguuucauucuc

SEQ ID NO: 326232 - RNA, 19 nt, Homo sapiens
gggcauaaagcauguuuca

SEQ ID NO: 326233 - RNA, 19 nt, Homo sapiens
ccacugggauagaggaauc

SEQ ID NO: 326234 - RNA, 19 nt, Homo sapiens
cuccugacuuccuacauua

SEQ ID NO: 326235 - RNA, 19 nt, Homo sapiens
ccuccugacuuccuacauu

SEQ ID NO: 326236 - RNA, 19 nt, Homo sapiens
acucaucccuucaccaaga

SEQ ID NO: 326237 - RNA, 19 nt, Homo sapiens
ucaaacagccacugcucua

SEQ ID NO: 326238 - RNA, 19 nt, Homo sapiens
ugggcaaccugcaguauga

SEQ ID NO: 326239 - RNA, 19 nt, Homo sapiens
gugaggaucagaagaagaa

SEQ ID NO: 326240 - RNA, 19 nt, Homo sapiens
ugacagacuggauaaagaa

SEQ ID NO: 326241 - RNA, 19 nt, Homo sapiens
ccaccaggcugcuccucaa

SEQ ID NO: 326242 - RNA, 19 nt, Homo sapiens
ugacgaggccuucgaagug

SEQ ID NO: 326243 - RNA, 19 nt, Homo sapiens
cagaagaagagcaguguga

SEQ ID NO: 326244 - RNA, 19 nt, Homo sapiens
gaaagaagcuuagcccuua

SEQ ID NO: 326245 - RNA, 19 nt, Homo sapiens
gauaauaccugcugcauaa

SEQ ID NO: 326246 - RNA, 19 nt, Homo sapiens
gaacauacauuacggauau

SEQ ID NO: 326247 - RNA, 19 nt, Homo sapiens
gaagagaaguacaguauaa

SEQ ID NO: 326248 - RNA, 19 nt, Homo sapiens
gaacaaaggcuaagagaaa

SEQ ID NO: 326249 - RNA, 19 nt, Homo sapiens
gaacggaacuaucauguau

SEQ ID NO: 326250 - RNA, 19 nt, Homo sapiens
ggaauuaccuaaaucagaa

SEQ ID NO: 326251 - RNA, 19 nt, Homo sapiens
ggauacagcuccaaauauu

SEQ ID NO: 326252 - RNA, 19 nt, Homo sapiens
gcaaagacagcucauaaua

SEQ ID NO: 326253 - RNA, 19 nt, Homo sapiens
gaaguuggauuggugaaua

SEQ ID NO: 326254 - RNA, 19 nt, Homo sapiens
caaauagucuaccuacuuu

SEQ ID NO: 326255 - RNA, 19 nt, Homo sapiens
gcacaaacuuucuuauuca

SEQ ID NO: 326256 - RNA, 19 nt, Homo sapiens
gagcuaggguagaauauaa

SEQ ID NO: 326257 - RNA, 19 nt, Homo sapiens
ccaagucucuucuucauuu

SEQ ID NO: 326258 - RNA, 19 nt, Homo sapiens
ggagagagcccauggaauu

SEQ ID NO: 326259 - RNA, 19 nt, Homo sapiens
guaaacaaaucucaccuuu

SEQ ID NO: 326260 - RNA, 19 nt, Homo sapiens
gcacgacuuugaacauaua

SEQ ID NO: 326261 - RNA, 19 nt, Homo sapiens
ugaaugaccuagauaauga

SEQ ID NO: 326262 - RNA, 19 nt, Homo sapiens
aaagaagccuuaaacagua

SEQ ID NO: 326263 - RNA, 19 nt, Homo sapiens
ccuguaaacucucaaauaa

SEQ ID NO: 326264 - RNA, 19 nt, Homo sapiens
gaggagaccuugacuagug

SEQ ID NO: 326265 - RNA, 19 nt, Homo sapiens
ggaaggaauucaaagagaa

SEQ ID NO: 326266 - RNA, 19 nt, Homo sapiens
gcacauggcugcuauuugc

SEQ ID NO: 326267 - RNA, 19 nt, Homo sapiens
gaacaccucuuucugaucu

SEQ ID NO: 326268 - RNA, 19 nt, Homo sapiens
gcaggaagaugugcuugua

SEQ ID NO: 326269 - RNA, 19 nt, Homo sapiens
ggaauuugguggagaagaa

SEQ ID NO: 326270 - RNA, 19 nt, Homo sapiens
gaaaucagaaagaagcuua

SEQ ID NO: 326271 - RNA, 19 nt, Homo sapiens
gaacucaucucaauacacu

SEQ ID NO: 326272 - RNA, 19 nt, Homo sapiens
gcaaguguauucaaacaau

SEQ ID NO: 326273 - RNA, 19 nt, Homo sapiens
gaaaacaaauucccaacua

SEQ ID NO: 326274 - RNA, 19 nt, Homo sapiens
agacaagcaucuguuauua

SEQ ID NO: 326275 - RNA, 19 nt, Homo sapiens
aagaagagaugcuauuuga

SEQ ID NO: 326276 - RNA, 19 nt, Homo sapiens
ggaagacacuaaucgaaug

SEQ ID NO: 326277 - RNA, 19 nt, Homo sapiens
cauaagaagugcugucuga

SEQ ID NO: 326278 - RNA, 19 nt, Homo sapiens
gaagacagcaagaaggaua

SEQ ID NO: 326279 - RNA, 19 nt, Homo sapiens
gaaggagacuugcaguuuc

SEQ ID NO: 326280 - RNA, 19 nt, Homo sapiens
ggaaguccaugccaaucua

SEQ ID NO: 326281 - RNA, 19 nt, Homo sapiens
ggauauggaucucuggaaa

SEQ ID NO: 326282 - RNA, 19 nt, Homo sapiens
cagcauaucuuuaaauugg

SEQ ID NO: 326283 - RNA, 19 nt, Homo sapiens
caaagacagcucauaauaa

SEQ ID NO: 326284 - RNA, 19 nt, Homo sapiens
cagcagaaauggagagauu

SEQ ID NO: 326285 - RNA, 19 nt, Homo sapiens
agacagagcugggaugauu

SEQ ID NO: 326286 - RNA, 19 nt, Homo sapiens
gaucagcauuccaucuuaa

SEQ ID NO: 326287 - RNA, 19 nt, Homo sapiens
aaacauugcuagacaaguu

SEQ ID NO: 326288 - RNA, 19 nt, Homo sapiens
caaagaagccuuaaacagu

SEQ ID NO: 326289 - RNA, 19 nt, Homo sapiens
gcauuuaucucugggauga

SEQ ID NO: 326290 - RNA, 19 nt, Homo sapiens
caacaggacugcuucaucu

SEQ ID NO: 326291 - RNA, 19 nt, Homo sapiens
gugauugagucucuuauaa

SEQ ID NO: 326292 - RNA, 19 nt, Homo sapiens
gcucagagaauuugaauau

SEQ ID NO: 326293 - RNA, 19 nt, Homo sapiens
auacaaggcucgucucaaa

SEQ ID NO: 326294 - RNA, 19 nt, Homo sapiens
gaacagauucgccagcaaa

SEQ ID NO: 326295 - RNA, 19 nt, Homo sapiens
ggagccugcuuucauuaua

SEQ ID NO: 326296 - RNA, 19 nt, Homo sapiens
gauggagccugcuuucauu

SEQ ID NO: 326297 - RNA, 19 nt, Homo sapiens
gagaagauuugagacauga

SEQ ID NO: 326298 - RNA, 19 nt, Homo sapiens
gaaggaggagcuaacauuu

SEQ ID NO: 326299 - RNA, 19 nt, Homo sapiens
gauuccagcucaucaguuu

SEQ ID NO: 326300 - RNA, 19 nt, Homo sapiens
gcaaagccuucaagacaau

SEQ ID NO: 326301 - RNA, 19 nt, Homo sapiens
agacgacgcuuugaagaua

SEQ ID NO: 326302 - RNA, 19 nt, Homo sapiens
gcccuuagcucccugaaga

SEQ ID NO: 326303 - RNA, 19 nt, Homo sapiens
gaguuugggucaacacuuu

SEQ ID NO: 326304 - RNA, 19 nt, Homo sapiens
cgacagcacuuacaagauc

SEQ ID NO: 326305 - RNA, 19 nt, Homo sapiens
gagccugcuuucauuauaa

SEQ ID NO: 326306 - RNA, 19 nt, Homo sapiens
uagcagagguaaaggaauu

SEQ ID NO: 326307 - RNA, 19 nt, Homo sapiens
gaagguauuuaucgaaagu

SEQ ID NO: 326308 - RNA, 19 nt, Homo sapiens
acacaauggucacaucuuu

SEQ ID NO: 326309 - RNA, 19 nt, Homo sapiens
ccaaagaaacaaacuauug

SEQ ID NO: 326310 - RNA, 19 nt, Homo sapiens
acacaaguauccaaagaaa

SEQ ID NO: 326311 - RNA, 19 nt, Homo sapiens
ccacaauagucaauccuaa

SEQ ID NO: 326312 - RNA, 19 nt, Homo sapiens
ugaaaugcauggacuguau

SEQ ID NO: 326313 - RNA, 19 nt, Homo sapiens
caagaaggauacacuagug

SEQ ID NO: 326314 - RNA, 19 nt, Homo sapiens
gggaagcucuuacuuugga

SEQ ID NO: 326315 - RNA, 19 nt, Homo sapiens
gcaccuccuugcuugauaa

SEQ ID NO: 326316 - RNA, 19 nt, Homo sapiens
gaauauagaacugaaggua

SEQ ID NO: 326317 - RNA, 19 nt, Homo sapiens
gaacaagaggaauauagaa

SEQ ID NO: 326318 - RNA, 19 nt, Homo sapiens
gaagagaugcuauuugaag

SEQ ID NO: 326319 - RNA, 19 nt, Homo sapiens
cgggaugacuccauugaua

SEQ ID NO: 326320 - RNA, 19 nt, Homo sapiens
ggaaggagaagauuugaga

SEQ ID NO: 326321 - RNA, 19 nt, Homo sapiens
ggaacuaucauguauucua

SEQ ID NO: 326322 - RNA, 19 nt, Homo sapiens
gggacaggauccaauauga

SEQ ID NO: 326323 - RNA, 19 nt, Homo sapiens
aaagguggguguugaacua

SEQ ID NO: 326324 - RNA, 19 nt, Homo sapiens
ggagaagauuugagacaug

SEQ ID NO: 326325 - RNA, 19 nt, Homo sapiens
gaagaacgucgcaggauga

SEQ ID NO: 326326 - RNA, 19 nt, Homo sapiens
gcauauggcuaagacugua

SEQ ID NO: 326327 - RNA, 19 nt, Homo sapiens
cagaagguauuuaucgaaa

SEQ ID NO: 326328 - RNA, 19 nt, Homo sapiens
aaggagagauuaccaaguu

SEQ ID NO: 326329 - RNA, 19 nt, Homo sapiens
gagacaagcaucuguuauu

SEQ ID NO: 326330 - RNA, 19 nt, Homo sapiens
cagcaucagugcccaguuu

SEQ ID NO: 326331 - RNA, 19 nt, Homo sapiens
ugccuuggcuguuguauuu

SEQ ID NO: 326332 - RNA, 19 nt, Homo sapiens
gaucaacucucccgaacuc

SEQ ID NO: 326333 - RNA, 19 nt, Homo sapiens
gaauacuguucuucuuuga

SEQ ID NO: 326334 - RNA, 19 nt, Homo sapiens
cagauggucuacagaauug

SEQ ID NO: 326335 - RNA, 19 nt, Homo sapiens
gaaauggagagauuacuau

SEQ ID NO: 326336 - RNA, 19 nt, Homo sapiens
caugaaugcucuaaaugaa

SEQ ID NO: 326337 - RNA, 19 nt, Homo sapiens
ggauugcucugcaggaaga

SEQ ID NO: 326338 - RNA, 19 nt, Homo sapiens
acuaguggauguuguauuu

SEQ ID NO: 326339 - RNA, 19 nt, Homo sapiens
gcuaaacacugagaaggaa

SEQ ID NO: 326340 - RNA, 19 nt, Homo sapiens
cgaauuagccgugaaaguu

SEQ ID NO: 326341 - RNA, 19 nt, Homo sapiens
caaauauucuuuccaggau

SEQ ID NO: 326342 - RNA, 19 nt, Homo sapiens
cagaggagcuuagagauuc

SEQ ID NO: 326343 - RNA, 19 nt, Homo sapiens
cauuguagcucuucugaga

SEQ ID NO: 326344 - RNA, 19 nt, Homo sapiens
gaaccgaaaugucaagauu

SEQ ID NO: 326345 - RNA, 19 nt, Homo sapiens
cagcauaacuugaagauug

SEQ ID NO: 326346 - RNA, 19 nt, Homo sapiens
ccaaguacgugaagaugua

SEQ ID NO: 326347 - RNA, 19 nt, Homo sapiens
ucaagcagccugaagauua

SEQ ID NO: 326348 - RNA, 19 nt, Homo sapiens
gggaggaccugaagcauga

SEQ ID NO: 326349 - RNA, 19 nt, Homo sapiens
gcucucaggucgacucuaa

SEQ ID NO: 326350 - RNA, 19 nt, Homo sapiens
gcaaagcucagaagaagaa

SEQ ID NO: 326351 - RNA, 19 nt, Homo sapiens
gagcugucgucgagaaaua

SEQ ID NO: 326352 - RNA, 19 nt, Homo sapiens
caacgucacuuauaagaag

SEQ ID NO: 326353 - RNA, 19 nt, Homo sapiens
ggaagagcgccaagaauuu

SEQ ID NO: 326354 - RNA, 19 nt, Homo sapiens
ucaaguaccuggacgaguu

SEQ ID NO: 326355 - RNA, 19 nt, Homo sapiens
gagaggaacuaccaugugu

SEQ ID NO: 326356 - RNA, 19 nt, Homo sapiens
acaaggaucugauggagaa

SEQ ID NO: 326357 - RNA, 19 nt, Homo sapiens
augagcagcugcaguauua

SEQ ID NO: 326358 - RNA, 19 nt, Homo sapiens
caagucagcuaccuagaga

SEQ ID NO: 326359 - RNA, 19 nt, Homo sapiens
ccaaugagcagcugcagua

SEQ ID NO: 326360 - RNA, 19 nt, Homo sapiens
gagcagugccucuccuaua

SEQ ID NO: 326361 - RNA, 19 nt, Homo sapiens
cagggaaggugaaauauca

SEQ ID NO: 326362 - RNA, 19 nt, Homo sapiens
ggacuuugaugaccugugu

SEQ ID NO: 326363 - RNA, 19 nt, Homo sapiens
ggagccagcuuucaucauc

SEQ ID NO: 326364 - RNA, 19 nt, Homo sapiens
caagcagccugaagauuau

SEQ ID NO: 326365 - RNA, 19 nt, Homo sapiens
ccaaugagcucaaguaccu

SEQ ID NO: 326366 - RNA, 19 nt, Homo sapiens
cagaggagcuggagaaugc

SEQ ID NO: 326367 - RNA, 19 nt, Homo sapiens
ugaaauaucagaucaagga

SEQ ID NO: 326368 - RNA, 19 nt, Homo sapiens
gaggaacuaccauguguuu

SEQ ID NO: 326369 - RNA, 19 nt, Homo sapiens
cgagaaauaucugcuugaa

SEQ ID NO: 326370 - RNA, 19 nt, Homo sapiens
caacaacuccagccgguuu

SEQ ID NO: 326371 - RNA, 19 nt, Homo sapiens
caaggucucugaagaaacu

SEQ ID NO: 326372 - RNA, 19 nt, Homo sapiens
ggaaauacaaagugaagau

SEQ ID NO: 326373 - RNA, 19 nt, Homo sapiens
gaggagcugucgucgagaa

SEQ ID NO: 326374 - RNA, 19 nt, Homo sapiens
aagaugaccugccacaaga

SEQ ID NO: 326375 - RNA, 19 nt, Homo sapiens
gagcagaggagcuggagaa

SEQ ID NO: 326376 - RNA, 19 nt, Homo sapiens
ggcaaggucucugaagaaa

SEQ ID NO: 326377 - RNA, 19 nt, Homo sapiens
ggagagugcccucagagaa

SEQ ID NO: 326378 - RNA, 19 nt, Homo sapiens
ucaagagcaucaaaggauu

SEQ ID NO: 326379 - RNA, 19 nt, Homo sapiens
gaagagcgccaagaauuuc

SEQ ID NO: 326380 - RNA, 19 nt, Homo sapiens
ggaagaagaaccgaaaugu

SEQ ID NO: 326381 - RNA, 19 nt, Homo sapiens
ggaacuaccauguguuuua

SEQ ID NO: 326382 - RNA, 19 nt, Homo sapiens
ucaaggagcagaugaggaa

SEQ ID NO: 326383 - RNA, 19 nt, Homo sapiens
gcacaacgggcacguguuc

SEQ ID NO: 326384 - RNA, 19 nt, Homo sapiens
ugaaacccuucuagucgua

SEQ ID NO: 326385 - RNA, 19 nt, Homo sapiens
ggaacagcuuugagcaguu

SEQ ID NO: 326386 - RNA, 19 nt, Homo sapiens
gcagaaggcagaagagaag

SEQ ID NO: 326387 - RNA, 19 nt, Homo sapiens
gaagaagaaccgaaauguc

SEQ ID NO: 326388 - RNA, 19 nt, Homo sapiens
ggacggcaccaaauguuau

SEQ ID NO: 326389 - RNA, 19 nt, Homo sapiens
aagaagaaccgaaauguca

SEQ ID NO: 326390 - RNA, 19 nt, Homo sapiens
gcagaucauuccaaagaac

SEQ ID NO: 326391 - RNA, 19 nt, Homo sapiens
agaagaacauggacuacau

SEQ ID NO: 326392 - RNA, 19 nt, Homo sapiens
gggagaagaacauggacua

SEQ ID NO: 326393 - RNA, 19 nt, Homo sapiens
gcauccaucucaucagcaa

SEQ ID NO: 326394 - RNA, 19 nt, Homo sapiens
gcagaugaggaaauacaaa

SEQ ID NO: 326395 - RNA, 19 nt, Homo sapiens
cagucaagcuggagaacuu

SEQ ID NO: 326396 - RNA, 19 nt, Homo sapiens
caaggaaccaggaggcaaa

SEQ ID NO: 326397 - RNA, 19 nt, Homo sapiens
ggacaagagcaaaccaugu

SEQ ID NO: 326398 - RNA, 19 nt, Homo sapiens
aagcagaucauuccaaaga

SEQ ID NO: 326399 - RNA, 19 nt, Homo sapiens
ggaccugaagcaugacuuu

SEQ ID NO: 326400 - RNA, 19 nt, Homo sapiens
gaaauacaaagugaagaug

SEQ ID NO: 326401 - RNA, 19 nt, Homo sapiens
aggagcagaugaggaaaua

SEQ ID NO: 326402 - RNA, 19 nt, Homo sapiens
ucagagaaguggcgggaau

SEQ ID NO: 326403 - RNA, 19 nt, Homo sapiens
agacaucccuuaacaagcu

SEQ ID NO: 326404 - RNA, 19 nt, Homo sapiens
caacaagaaggacguggaa

SEQ ID NO: 326405 - RNA, 19 nt, Homo sapiens
ugggcaacgucacuuauaa

SEQ ID NO: 326406 - RNA, 19 nt, Homo sapiens
gaacuaccauguguuuuau

SEQ ID NO: 326407 - RNA, 19 nt, Homo sapiens
gagcagaugaggaaauaca

SEQ ID NO: 326408 - RNA, 19 nt, Homo sapiens
ggugaaauaucagaucaag

SEQ ID NO: 326409 - RNA, 19 nt, Homo sapiens
gagaaauaucugcuugaaa

SEQ ID NO: 326410 - RNA, 19 nt, Homo sapiens
caagacagcccacaacaac

SEQ ID NO: 326411 - RNA, 19 nt, Homo sapiens
gcguggagaugcugaucaa

SEQ ID NO: 326412 - RNA, 19 nt, Homo sapiens
gacaagagcaaaccaugug

SEQ ID NO: 326413 - RNA, 19 nt, Homo sapiens
gaucaagagcaucaaagga

SEQ ID NO: 326414 - RNA, 19 nt, Homo sapiens
cgaaaaggcugcagguaug

SEQ ID NO: 326415 - RNA, 19 nt, Homo sapiens
aauaucagaucaaggacuu

SEQ ID NO: 326416 - RNA, 19 nt, Homo sapiens
gcuggaagcuuuuggaaau

SEQ ID NO: 326417 - RNA, 19 nt, Homo sapiens
guccugugcuggaagcuuu

SEQ ID NO: 326418 - RNA, 19 nt, Homo sapiens
caagaugaccugccacaag

SEQ ID NO: 326419 - RNA, 19 nt, Homo sapiens
cagaagacgcccauugaga

SEQ ID NO: 326420 - RNA, 19 nt, Homo sapiens
ggagagcagagaagaugaa

SEQ ID NO: 326421 - RNA, 19 nt, Homo sapiens
ccaagucccugaaacucau

SEQ ID NO: 326422 - RNA, 19 nt, Homo sapiens
ucgcagggaaggugaaaua

SEQ ID NO: 326423 - RNA, 19 nt, Homo sapiens
gaaggugaagcgagaaauc

SEQ ID NO: 326424 - RNA, 19 nt, Homo sapiens
gcaacgucacuuauaagaa

SEQ ID NO: 326425 - RNA, 19 nt, Homo sapiens
ccucggacgucaucaagga

SEQ ID NO: 326426 - RNA, 19 nt, Homo sapiens
gaaccagugcaucguguau

SEQ ID NO: 326427 - RNA, 19 nt, Homo sapiens
uuaaguuccugcccaucua

SEQ ID NO: 326428 - RNA, 19 nt, Homo sapiens
gaagccaccaccaugaaga

SEQ ID NO: 326429 - RNA, 19 nt, Homo sapiens
ggcugaaagucacgagaaa

SEQ ID NO: 326430 - RNA, 19 nt, Homo sapiens
gaaggugaaauaucagauc

SEQ ID NO: 326431 - RNA, 19 nt, Homo sapiens
gccaagaauuucagcucaa

SEQ ID NO: 326432 - RNA, 19 nt, Homo sapiens
aggaagagcgccaagaauu

SEQ ID NO: 326433 - RNA, 19 nt, Homo sapiens
gggugagucuccuggaaga

SEQ ID NO: 326434 - RNA, 19 nt, Homo sapiens
aaaugaagauagacaagag

SEQ ID NO: 326435 - RNA, 19 nt, Homo sapiens
cgaggaagagcgccaagaa

SEQ ID NO: 326436 - RNA, 19 nt, Homo sapiens
uggagaugcugaucaagga

SEQ ID NO: 326437 - RNA, 19 nt, Homo sapiens
gugagaagcgcaccaagga

SEQ ID NO: 326438 - RNA, 19 nt, Homo sapiens
aaagccagcuguccagaag

SEQ ID NO: 326439 - RNA, 19 nt, Homo sapiens
aaaagcagaucauuccaaa

SEQ ID NO: 326440 - RNA, 19 nt, Homo sapiens
aacaugaggacaauaagua

SEQ ID NO: 326441 - RNA, 19 nt, Homo sapiens
gcacaacaucggcuacaca

SEQ ID NO: 326442 - RNA, 19 nt, Homo sapiens
aacaaaagaucuacacgua

SEQ ID NO: 326443 - RNA, 19 nt, Homo sapiens
gccugaagauuauuucuac

SEQ ID NO: 326444 - RNA, 19 nt, Homo sapiens
ggaaaggaauuaucacaua

SEQ ID NO: 326445 - RNA, 19 nt, Homo sapiens
ggacauaaaucucaacuug

SEQ ID NO: 326446 - RNA, 19 nt, Homo sapiens
gcuauagucucaauuguua

SEQ ID NO: 326447 - RNA, 19 nt, Homo sapiens
guauuaagcugucaacuuu

SEQ ID NO: 326448 - RNA, 19 nt, Homo sapiens
cgucguagcugaugucuua

SEQ ID NO: 326449 - RNA, 19 nt, Homo sapiens
gagaagauauucaaagaga

SEQ ID NO: 326450 - RNA, 19 nt, Homo sapiens
gaacagagauacauuucga

SEQ ID NO: 326451 - RNA, 19 nt, Homo sapiens
gagaagacauccuguguug

SEQ ID NO: 326452 - RNA, 19 nt, Homo sapiens
ggacugcgcuggaacaaug

SEQ ID NO: 326453 - RNA, 19 nt, Homo sapiens
gaacaaggcaccuguaaau

SEQ ID NO: 326454 - RNA, 19 nt, Homo sapiens
gaaccacgcugccaccaaa

SEQ ID NO: 326455 - RNA, 19 nt, Homo sapiens
gaagaaacuuggccuccua

SEQ ID NO: 326456 - RNA, 19 nt, Homo sapiens
gcaggaacauguuugcuuu

SEQ ID NO: 326457 - RNA, 19 nt, Homo sapiens
caacaacucuagucgcuuu

SEQ ID NO: 326458 - RNA, 19 nt, Homo sapiens
caaaggacccugacauuaa

SEQ ID NO: 326459 - RNA, 19 nt, Homo sapiens
caaggcaccuguaaauaaa

SEQ ID NO: 326460 - RNA, 19 nt, Homo sapiens
ggacuuugauuccagguuu

SEQ ID NO: 326461 - RNA, 19 nt, Homo sapiens
gaagaugccagaccaguuu

SEQ ID NO: 326462 - RNA, 19 nt, Homo sapiens
gaagacauccuguguugaa

SEQ ID NO: 326463 - RNA, 19 nt, Homo sapiens
gaagaacagagauacauuu

SEQ ID NO: 326464 - RNA, 19 nt, Homo sapiens
gcgggagaauuguagauua

SEQ ID NO: 326465 - RNA, 19 nt, Homo sapiens
cuucauugauccuguauua

SEQ ID NO: 326466 - RNA, 19 nt, Homo sapiens
gaguugcaguuaacaauuu

SEQ ID NO: 326467 - RNA, 19 nt, Homo sapiens
aagguuagcuucuaucauu

SEQ ID NO: 326468 - RNA, 19 nt, Homo sapiens
acaauucccuggauuacua

SEQ ID NO: 326469 - RNA, 19 nt, Homo sapiens
gauauugacuggauagaca

SEQ ID NO: 326470 - RNA, 19 nt, Homo sapiens
gagaaugccuggacuugau

SEQ ID NO: 326471 - RNA, 19 nt, Homo sapiens
gaaucagucuggaugugua

SEQ ID NO: 326472 - RNA, 19 nt, Homo sapiens
ggaaugacaugaaucaacu

SEQ ID NO: 326473 - RNA, 19 nt, Homo sapiens
ggaacccgauccuucgaua

SEQ ID NO: 326474 - RNA, 19 nt, Homo sapiens
gaggaugguugcacaaaga

SEQ ID NO: 326475 - RNA, 19 nt, Homo sapiens
gaagaaagagaaagagaga

SEQ ID NO: 326476 - RNA, 19 nt, Homo sapiens
gacaauugcuggcagagaa

SEQ ID NO: 326477 - RNA, 19 nt, Homo sapiens
gcucgacgcuguuugaugu

SEQ ID NO: 326478 - RNA, 19 nt, Homo sapiens
ggaagauauugacuggaua

SEQ ID NO: 326479 - RNA, 19 nt, Homo sapiens
aaaggacccugacauuaaa

SEQ ID NO: 326480 - RNA, 19 nt, Homo sapiens
gaagaaacaggaagaggaa

SEQ ID NO: 326481 - RNA, 19 nt, Homo sapiens
agaaacgucuuaacacuug

SEQ ID NO: 326482 - RNA, 19 nt, Homo sapiens
ggaguuugcauuuauguuu

SEQ ID NO: 326483 - RNA, 19 nt, Homo sapiens
gaagaacaguccgaagaug

SEQ ID NO: 326484 - RNA, 19 nt, Homo sapiens
ggaagaagaaagagaaaga

SEQ ID NO: 326485 - RNA, 19 nt, Homo sapiens
gcuggaacaugaagaaaga

SEQ ID NO: 326486 - RNA, 19 nt, Homo sapiens
ugaacgagcuauucuugaa

SEQ ID NO: 326487 - RNA, 19 nt, Homo sapiens
cgacaaagccauugaaagu

SEQ ID NO: 326488 - RNA, 19 nt, Homo sapiens
aauacgcucucuucacuua

SEQ ID NO: 326489 - RNA, 19 nt, Homo sapiens
gagaauccuuggaacagaa

SEQ ID NO: 326490 - RNA, 19 nt, Homo sapiens
gggaagauauugacuggau

SEQ ID NO: 326491 - RNA, 19 nt, Homo sapiens
cgaaagcacuaaauugauc

SEQ ID NO: 326492 - RNA, 19 nt, Homo sapiens
caggauaccuugaaaugug

SEQ ID NO: 326493 - RNA, 19 nt, Homo sapiens
caaccaggauaccuugaaa

SEQ ID NO: 326494 - RNA, 19 nt, Homo sapiens
ucaaaggacccugacauua

SEQ ID NO: 326495 - RNA, 19 nt, Homo sapiens
gaacucggaugugguggaa

SEQ ID NO: 326496 - RNA, 19 nt, Homo sapiens
gaagaacgcgcucaaacug

SEQ ID NO: 326497 - RNA, 19 nt, Homo sapiens
caugaaagguggccugaug

SEQ ID NO: 326498 - RNA, 19 nt, Homo sapiens
gacagacuauggucaggua

SEQ ID NO: 326499 - RNA, 19 nt, Homo sapiens
acaaggcaccuguaaauaa

SEQ ID NO: 326500 - RNA, 19 nt, Homo sapiens
caacacuaaucgaccguaa

SEQ ID NO: 326501 - RNA, 19 nt, Homo sapiens
ggacuugauugagaagaaa

SEQ ID NO: 326502 - RNA, 19 nt, Homo sapiens
cgacaucuuuggauuugaa

SEQ ID NO: 326503 - RNA, 19 nt, Homo sapiens
uggcagggcuggaacauga

SEQ ID NO: 326504 - RNA, 19 nt, Homo sapiens
uaagcagccuacaagauaa

SEQ ID NO: 326505 - RNA, 19 nt, Homo sapiens
gcagagcuauagucucaau

SEQ ID NO: 326506 - RNA, 19 nt, Homo sapiens
ggagaugcaccacuggaua

SEQ ID NO: 326507 - RNA, 19 nt, Homo sapiens
cuggagaggugcaauauga

SEQ ID NO: 326508 - RNA, 19 nt, Homo sapiens
acgagaaacuucaggagua

SEQ ID NO: 326509 - RNA, 19 nt, Homo sapiens
gggcacagguuuccuucaa

SEQ ID NO: 326510 - RNA, 19 nt, Homo sapiens
gacaaucagugaccaggaa

SEQ ID NO: 326511 - RNA, 19 nt, Homo sapiens
agagauacauuucgagaug

SEQ ID NO: 326512 - RNA, 19 nt, Homo sapiens
ggauuagugugggaagaua

SEQ ID NO: 326513 - RNA, 19 nt, Homo sapiens
cuggauagauuacagauau

SEQ ID NO: 326514 - RNA, 19 nt, Homo sapiens
uuaacagucugcacaguuu

SEQ ID NO: 326515 - RNA, 19 nt, Homo sapiens
ccagugaggugguggaugu

SEQ ID NO: 326516 - RNA, 19 nt, Homo sapiens
gaacacauccucucuuuug

SEQ ID NO: 326517 - RNA, 19 nt, Homo sapiens
gucgagggauucucaagua

SEQ ID NO: 326518 - RNA, 19 nt, Homo sapiens
gaggaggacccauacauga

SEQ ID NO: 326519 - RNA, 19 nt, Homo sapiens
ggaggaagaagaaagagaa

SEQ ID NO: 326520 - RNA, 19 nt, Homo sapiens
gaaacgggaggaagaagaa

SEQ ID NO: 326521 - RNA, 19 nt, Homo sapiens
gcuaagagaaagccgauuu

SEQ ID NO: 326522 - RNA, 19 nt, Homo sapiens
cauggaagcuuucggcaau

SEQ ID NO: 326523 - RNA, 19 nt, Homo sapiens
aaauuugccuugucccuuu

SEQ ID NO: 326524 - RNA, 19 nt, Homo sapiens
cguguugacuccauuguuu

SEQ ID NO: 326525 - RNA, 19 nt, Homo sapiens
ggaggaaauuucagggaau

SEQ ID NO: 326526 - RNA, 19 nt, Homo sapiens
guccaugucugacccaauu

SEQ ID NO: 326527 - RNA, 19 nt, Homo sapiens
gaacaauggauaacuucuu

SEQ ID NO: 326528 - RNA, 19 nt, Homo sapiens
gagaugcaccacuggauaa

SEQ ID NO: 326529 - RNA, 19 nt, Homo sapiens
gaagaggacuuugauucca

SEQ ID NO: 326530 - RNA, 19 nt, Homo sapiens
gaccagcgaugacucuuca

SEQ ID NO: 326531 - RNA, 19 nt, Homo sapiens
auaagcagccuacaagaua

SEQ ID NO: 326532 - RNA, 19 nt, Homo sapiens
acaaagaggugaagaacag

SEQ ID NO: 326533 - RNA, 19 nt, Homo sapiens
gaauauagccgggaaggau

SEQ ID NO: 326534 - RNA, 19 nt, Homo sapiens
caauggacgugaugcaguu

SEQ ID NO: 326535 - RNA, 19 nt, Homo sapiens
cgaagaccguguacaacaa

SEQ ID NO: 326536 - RNA, 19 nt, Homo sapiens
ggucagguauucacuuaca

SEQ ID NO: 326537 - RNA, 19 nt, Homo sapiens
ggacagcaggaacauguuu

SEQ ID NO: 326538 - RNA, 19 nt, Homo sapiens
gaagaaacgggaggaagaa

SEQ ID NO: 326539 - RNA, 19 nt, Homo sapiens
auaaagugcugaugaggaa

SEQ ID NO: 326540 - RNA, 19 nt, Homo sapiens
gaacgagcuauucuugaaa

SEQ ID NO: 326541 - RNA, 19 nt, Homo sapiens
ucaacagucuuuggaauug

SEQ ID NO: 326542 - RNA, 19 nt, Homo sapiens
gcggcuccaucauguauaa

SEQ ID NO: 326543 - RNA, 19 nt, Homo sapiens
ucaaguaucucaaguucca

SEQ ID NO: 326544 - RNA, 19 nt, Homo sapiens
gaacaaaccugggagacaa

SEQ ID NO: 326545 - RNA, 19 nt, Homo sapiens
gaacugaaguccgagcuaa

SEQ ID NO: 326546 - RNA, 19 nt, Homo sapiens
ccagaacugucauaagaua

SEQ ID NO: 326547 - RNA, 19 nt, Homo sapiens
ccauugcucuugcauguua

SEQ ID NO: 326548 - RNA, 19 nt, Homo sapiens
ucacauaacccuuuacauu

SEQ ID NO: 326549 - RNA, 19 nt, Homo sapiens
gagaacagcagaaacaauu

SEQ ID NO: 326550 - RNA, 19 nt, Homo sapiens
gcacguugcugcagcuuug

SEQ ID NO: 326551 - RNA, 19 nt, Homo sapiens
aagcauaacuucuaaagga

SEQ ID NO: 326552 - RNA, 19 nt, Homo sapiens
guccagaacugucauaaga

SEQ ID NO: 326553 - RNA, 19 nt, Homo sapiens
caacuuugcuuaugacaca

SEQ ID NO: 326554 - RNA, 19 nt, Homo sapiens
gaagagaagaagcgacuaa

SEQ ID NO: 326555 - RNA, 19 nt, Homo sapiens
ucaagaaccgcuauaagua

SEQ ID NO: 326556 - RNA, 19 nt, Homo sapiens
ggucucacauaacccuuua

SEQ ID NO: 326557 - RNA, 19 nt, Homo sapiens
gggcguagacaauuucaua

SEQ ID NO: 326558 - RNA, 19 nt, Homo sapiens
acaguugggucucacauaa

SEQ ID NO: 326559 - RNA, 19 nt, Homo sapiens
cagcaucgaauauaaguaa

SEQ ID NO: 326560 - RNA, 19 nt, Homo sapiens
gcauuuaugggauguuuaa

SEQ ID NO: 326561 - RNA, 19 nt, Homo sapiens
cagcagcacccaacgcuua

SEQ ID NO: 326562 - RNA, 19 nt, Homo sapiens
uaucuucugucagcauuua

SEQ ID NO: 326563 - RNA, 19 nt, Homo sapiens
gcaggccucugggucauuu

SEQ ID NO: 326564 - RNA, 19 nt, Homo sapiens
ugaacauggucacuuauga

SEQ ID NO: 326565 - RNA, 19 nt, Homo sapiens
ugacuuggcuguggaugaa

SEQ ID NO: 326566 - RNA, 19 nt, Homo sapiens
ccaugucagucauccauaa

SEQ ID NO: 326567 - RNA, 19 nt, Homo sapiens
gcagcaugauugacuacaa

SEQ ID NO: 326568 - RNA, 19 nt, Homo sapiens
caccggauguggagaacua

SEQ ID NO: 326569 - RNA, 19 nt, Homo sapiens
cccuuuacauugugaaaua

SEQ ID NO: 326570 - RNA, 19 nt, Homo sapiens
caccaagccucugcaauga

SEQ ID NO: 326571 - RNA, 19 nt, Homo sapiens
cacauaacccuuuacauug

SEQ ID NO: 326572 - RNA, 19 nt, Homo sapiens
ggacaguucccguauucuu

SEQ ID NO: 326573 - RNA, 19 nt, Homo sapiens
gaccucaucagccaguuua

SEQ ID NO: 326574 - RNA, 19 nt, Homo sapiens
gcguagacaauuucauaua

SEQ ID NO: 326575 - RNA, 19 nt, Homo sapiens
gccaaugccuucaucaucu

SEQ ID NO: 326576 - RNA, 19 nt, Homo sapiens
ggccaaaggugccauuguc

SEQ ID NO: 326577 - RNA, 19 nt, Homo sapiens
acauaacccuuuacauugu

SEQ ID NO: 326578 - RNA, 19 nt, Homo sapiens
uaagaugcauuuacuacag

SEQ ID NO: 326579 - RNA, 19 nt, Homo sapiens
ccagaaggaugaacauggu

SEQ ID NO: 326580 - RNA, 19 nt, Homo sapiens
gaaggccaaugaccagagu

SEQ ID NO: 326581 - RNA, 19 nt, Homo sapiens
gcuguaaggcauaauaguu

SEQ ID NO: 326582 - RNA, 19 nt, Homo sapiens
cagcauuuaugggauguuu

SEQ ID NO: 326583 - RNA, 19 nt, Homo sapiens
acuugaacauggucacuua

SEQ ID NO: 326584 - RNA, 19 nt, Homo sapiens
ucaccaagccucugcaaug

SEQ ID NO: 326585 - RNA, 19 nt, Homo sapiens
ccaccaggcuccagagaag

SEQ ID NO: 326586 - RNA, 19 nt, Homo sapiens
ccaucuaacuauucaggaa

SEQ ID NO: 326587 - RNA, 19 nt, Homo sapiens
ugacauaguucaaguuuuc

SEQ ID NO: 326588 - RNA, 19 nt, Homo sapiens
gcacagguaucagcaagac

SEQ ID NO: 326589 - RNA, 19 nt, Homo sapiens
uggccagcaucgaauauaa

SEQ ID NO: 326590 - RNA, 19 nt, Homo sapiens
gagcagagccaggccaugu

SEQ ID NO: 326591 - RNA, 19 nt, Homo sapiens
acaucaagcucuccaagau

SEQ ID NO: 326592 - RNA, 19 nt, Homo sapiens
uaagauaugagcugaauac

SEQ ID NO: 326593 - RNA, 19 nt, Homo sapiens
gcaaguaugguguguggau

SEQ ID NO: 326594 - RNA, 19 nt, Homo sapiens
gaacagcagaaacaauuac

SEQ ID NO: 326595 - RNA, 19 nt, Homo sapiens
caagucaguucuggaggaa

SEQ ID NO: 326596 - RNA, 19 nt, Homo sapiens
uaugggauguuuaaugaca

SEQ ID NO: 326597 - RNA, 19 nt, Homo sapiens
agacaaacauccguaagca

SEQ ID NO: 326598 - RNA, 19 nt, Homo sapiens
guuccugcuucccgaauuu

SEQ ID NO: 326599 - RNA, 19 nt, Homo sapiens
ggauguggagaacuaguuu

SEQ ID NO: 326600 - RNA, 19 nt, Homo sapiens
uacuacaguuggcuucuaa

SEQ ID NO: 326601 - RNA, 19 nt, Homo sapiens
aaccauugcucuugcaugu

SEQ ID NO: 326602 - RNA, 19 nt, Homo sapiens
caaaagcuguaaggcauaa

SEQ ID NO: 326603 - RNA, 19 nt, Homo sapiens
caagaaccgcuauaaguac

SEQ ID NO: 326604 - RNA, 19 nt, Homo sapiens
gacaguucccguauucuug

SEQ ID NO: 326605 - RNA, 19 nt, Homo sapiens
aaagcuguaaggcauaaua

SEQ ID NO: 326606 - RNA, 19 nt, Homo sapiens
gaugcuaccgucaacuuug

SEQ ID NO: 326607 - RNA, 19 nt, Homo sapiens
aaacauccguaagcaguca

SEQ ID NO: 326608 - RNA, 19 nt, Homo sapiens
gaaguccgagcuaacugaa

SEQ ID NO: 326609 - RNA, 19 nt, Homo sapiens
cugagggcguagacaauuu

SEQ ID NO: 326610 - RNA, 19 nt, Homo sapiens
ggagguagcaaggcugaga

SEQ ID NO: 326611 - RNA, 19 nt, Homo sapiens
gaaucuggaacucgaacaa

SEQ ID NO: 326612 - RNA, 19 nt, Homo sapiens
aaacugaacccagagaauc

SEQ ID NO: 326613 - RNA, 19 nt, Homo sapiens
agaacagcagaaacaauua

SEQ ID NO: 326614 - RNA, 19 nt, Homo sapiens
ggaacugaaguccgagcua

SEQ ID NO: 326615 - RNA, 19 nt, Homo sapiens
gagcgggaccagcuggaaa

SEQ ID NO: 326616 - RNA, 19 nt, Homo sapiens
cauaacccuuuacauugug

SEQ ID NO: 326617 - RNA, 19 nt, Homo sapiens
gcagagccaggccauguca

SEQ ID NO: 326618 - RNA, 19 nt, Homo sapiens
caaacugaacccagagaau

SEQ ID NO: 326619 - RNA, 19 nt, Homo sapiens
cagcaccgaugaggccaaa

SEQ ID NO: 326620 - RNA, 19 nt, Homo sapiens
caggagaccacguggagaa

SEQ ID NO: 326621 - RNA, 19 nt, Homo sapiens
gaaguuucuacguggaauu

SEQ ID NO: 326622 - RNA, 19 nt, Homo sapiens
gccaggagguuggaaagca

SEQ ID NO: 326623 - RNA, 19 nt, Homo sapiens
gucagucauccauaacuua

SEQ ID NO: 326624 - RNA, 19 nt, Homo sapiens
uuacuacaguuggcuucua

SEQ ID NO: 326625 - RNA, 19 nt, Homo sapiens
gaaaagccuccaagcugua

SEQ ID NO: 326626 - RNA, 19 nt, Homo sapiens
gacaucaagcucuccaaga

SEQ ID NO: 326627 - RNA, 19 nt, Homo sapiens
ccaaugccuucaucaucug

SEQ ID NO: 326628 - RNA, 19 nt, Homo sapiens
gggagacaaacauccguaa

SEQ ID NO: 326629 - RNA, 19 nt, Homo sapiens
gagaccacguggagaaucg

SEQ ID NO: 326630 - RNA, 19 nt, Homo sapiens
agaacuaguuuggguagga

SEQ ID NO: 326631 - RNA, 19 nt, Homo sapiens
agucaguucuggaggaaga

SEQ ID NO: 326632 - RNA, 19 nt, Homo sapiens
acaguuggcuucuaaugcu

SEQ ID NO: 326633 - RNA, 19 nt, Homo sapiens
gcaucgaauauaaguaaga

SEQ ID NO: 326634 - RNA, 19 nt, Homo sapiens
ggucaccaucuaacuauuc

SEQ ID NO: 326635 - RNA, 19 nt, Homo sapiens
acagcagcaugauugacua

SEQ ID NO: 326636 - RNA, 19 nt, Homo sapiens
uaaguacagcagcaugauu

SEQ ID NO: 326637 - RNA, 19 nt, Homo sapiens
uauaaguacagcagcauga

SEQ ID NO: 326638 - RNA, 19 nt, Homo sapiens
aagaaccgcuauaaguaca

SEQ ID NO: 326639 - RNA, 19 nt, Homo sapiens
agugaaggcugagaaggaa

SEQ ID NO: 326640 - RNA, 19 nt, Homo sapiens
cuucuaagguucacauacu

SEQ ID NO: 326641 - RNA, 19 nt, Homo sapiens
ugucagucauccauaacuu

SEQ ID NO: 326642 - RNA, 19 nt, Homo sapiens
agaauacaguugggucuca

SEQ ID NO: 326643 - RNA, 19 nt, Homo sapiens
uguaaggcauaauaguuuc

SEQ ID NO: 326644 - RNA, 19 nt, Homo sapiens
ggccagagcugaaccuuga

SEQ ID NO: 326645 - RNA, 19 nt, Homo sapiens
gcacuccggucccaaaugu

SEQ ID NO: 326646 - RNA, 19 nt, Homo sapiens
cagggaauuuguacguuua

SEQ ID NO: 326647 - RNA, 19 nt, Homo sapiens
caacggacgacuucuauga

SEQ ID NO: 326648 - RNA, 19 nt, Homo sapiens
guaaauaagaguugcuuug

SEQ ID NO: 326649 - RNA, 19 nt, Homo sapiens
gcaacgccauccgcuauau

SEQ ID NO: 326650 - RNA, 19 nt, Homo sapiens
gcacgucgagcaauccaaa

SEQ ID NO: 326651 - RNA, 19 nt, Homo sapiens
gggaauuuguacguuuaua

SEQ ID NO: 326652 - RNA, 19 nt, Homo sapiens
acagggaauuuguacguuu

SEQ ID NO: 326653 - RNA, 19 nt, Homo sapiens
gggaugcaccgguuauuug

SEQ ID NO: 326654 - RNA, 19 nt, Homo sapiens
guaaaugaggccuuugaga

SEQ ID NO: 326655 - RNA, 19 nt, Homo sapiens
ccacaacggacgacuucua

SEQ ID NO: 326656 - RNA, 19 nt, Homo sapiens
gggcuguauuuaucucuga

SEQ ID NO: 326657 - RNA, 19 nt, Homo sapiens
cccaaaagauugaacuuaa

SEQ ID NO: 326658 - RNA, 19 nt, Homo sapiens
ccaaauguagcagguguaa

SEQ ID NO: 326659 - RNA, 19 nt, Homo sapiens
uggcggacgugccuucuga

SEQ ID NO: 326660 - RNA, 19 nt, Homo sapiens
gcgcaacgccauccgcuau

SEQ ID NO: 326661 - RNA, 19 nt, Homo sapiens
ggaccugcgcuucuucgaa

SEQ ID NO: 326662 - RNA, 19 nt, Homo sapiens
ggaauuuguacguuuauac

SEQ ID NO: 326663 - RNA, 19 nt, Homo sapiens
ccgaagagcacucgcacuu

SEQ ID NO: 326664 - RNA, 19 nt, Homo sapiens
cgaaggcgccuacuacaac

SEQ ID NO: 326665 - RNA, 19 nt, Homo sapiens
caaaauaaaggcgcuaauu

SEQ ID NO: 326666 - RNA, 19 nt, Homo sapiens
gcuacgaaggcgccuacua

SEQ ID NO: 326667 - RNA, 19 nt, Homo sapiens
gcucaggugaucaaaauaa

SEQ ID NO: 326668 - RNA, 19 nt, Homo sapiens
ggagaggcgggagaacuga

SEQ ID NO: 326669 - RNA, 19 nt, Homo sapiens
cuacgaaggcgccuacuac

SEQ ID NO: 326670 - RNA, 19 nt, Homo sapiens
aaaugaggccuuugagaca

SEQ ID NO: 326671 - RNA, 19 nt, Homo sapiens
gauauaccaggugcucuga

SEQ ID NO: 326672 - RNA, 19 nt, Homo sapiens
uaaauaagaguugcuuugc

SEQ ID NO: 326673 - RNA, 19 nt, Homo sapiens
cacaacggacgacuucuau

SEQ ID NO: 326674 - RNA, 19 nt, Homo sapiens
caaggacacagcgcgguuu

SEQ ID NO: 326675 - RNA, 19 nt, Homo sapiens
ucuaugacgacccguguuu

SEQ ID NO: 326676 - RNA, 19 nt, Homo sapiens
ccgacggcaugauggacua

SEQ ID NO: 326677 - RNA, 19 nt, Homo sapiens
gccaggauauggagcuacu

SEQ ID NO: 326678 - RNA, 19 nt, Homo sapiens
ggaugcaccgguuauuugg

SEQ ID NO: 326679 - RNA, 19 nt, Homo sapiens
guagcagguguaaccguaa

SEQ ID NO: 326680 - RNA, 19 nt, Homo sapiens
gggcuagguucagcuuucu

SEQ ID NO: 326681 - RNA, 19 nt, Homo sapiens
gguaggagaggcgggagaa

SEQ ID NO: 326682 - RNA, 19 nt, Homo sapiens
cgggaugcaccgguuauuu

SEQ ID NO: 326683 - RNA, 19 nt, Homo sapiens
gagaggcgggagaacugaa

SEQ ID NO: 326684 - RNA, 19 nt, Homo sapiens
gcaagcgcaagaccaccaa

SEQ ID NO: 326685 - RNA, 19 nt, Homo sapiens
uagacugccuguccagcau

SEQ ID NO: 326686 - RNA, 19 nt, Homo sapiens
ggcucucucugcuccuuug

SEQ ID NO: 326687 - RNA, 19 nt, Homo sapiens
ucauucagcugccuccuua

SEQ ID NO: 326688 - RNA, 19 nt, Homo sapiens
ccucauccauguaagguua

SEQ ID NO: 326689 - RNA, 19 nt, Homo sapiens
caacugagauugucuucca

SEQ ID NO: 326690 - RNA, 19 nt, Homo sapiens
gagaagcgcaggcucaaga

SEQ ID NO: 326691 - RNA, 19 nt, Homo sapiens
ccacagaugccacuacuuc

SEQ ID NO: 326692 - RNA, 19 nt, Homo sapiens
ggccugcccugaauugaga

SEQ ID NO: 326693 - RNA, 19 nt, Homo sapiens
gcagugccauccaguacau

SEQ ID NO: 326694 - RNA, 19 nt, Homo sapiens
gcucacggcugacccuaca

SEQ ID NO: 326695 - RNA, 19 nt, Homo sapiens
ggggugauuucuuuuguua

SEQ ID NO: 326696 - RNA, 19 nt, Homo sapiens
ggucuccugugcugaaguu

SEQ ID NO: 326697 - RNA, 19 nt, Homo sapiens
gaaccccgcuucuaugaug

SEQ ID NO: 326698 - RNA, 19 nt, Homo sapiens
uuucguguguuguuuguaa

SEQ ID NO: 326699 - RNA, 19 nt, Homo sapiens
caaggucuccugugcugaa

SEQ ID NO: 326700 - RNA, 19 nt, Homo sapiens
ggacagcaucacaguggaa

SEQ ID NO: 326701 - RNA, 19 nt, Homo sapiens
gcccugaccuggacaagcu

SEQ ID NO: 326702 - RNA, 19 nt, Homo sapiens
gggcguguaagguguguaa

SEQ ID NO: 326703 - RNA, 19 nt, Homo sapiens
gaugaaaccaugcccaacu

SEQ ID NO: 326704 - RNA, 19 nt, Homo sapiens
aacaaagcaucgugugguu

SEQ ID NO: 326705 - RNA, 19 nt, Homo sapiens
gcccugaauugagagagaa

SEQ ID NO: 326706 - RNA, 19 nt, Homo sapiens
gugcacgucuccuguucug

SEQ ID NO: 326707 - RNA, 19 nt, Homo sapiens
aaaccaugcccaacugaga

SEQ ID NO: 326708 - RNA, 19 nt, Homo sapiens
uggcuggccugcccugaau

SEQ ID NO: 326709 - RNA, 19 nt, Homo sapiens
ggccacagaugccacuacu

SEQ ID NO: 326710 - RNA, 19 nt, Homo sapiens
caaagcaucgugugguuuu

SEQ ID NO: 326711 - RNA, 19 nt, Homo sapiens
ucgaggcccugaagagaag

SEQ ID NO: 326712 - RNA, 19 nt, Homo sapiens
guaagguguguaagaggaa

SEQ ID NO: 326713 - RNA, 19 nt, Homo sapiens
cguguaagguguguaagag

SEQ ID NO: 326714 - RNA, 19 nt, Homo sapiens
gcguguaagguguguaaga

SEQ ID NO: 326715 - RNA, 19 nt, Homo sapiens
agaugccacuacuucugua

SEQ ID NO: 326716 - RNA, 19 nt, Homo sapiens
ccagugguuuuauguuuug

SEQ ID NO: 326717 - RNA, 19 nt, Homo sapiens
gcgcagugccauccaguac

SEQ ID NO: 326718 - RNA, 19 nt, Homo sapiens
gcuggccugcccugaauug

SEQ ID NO: 326719 - RNA, 19 nt, Homo sapiens
ggcucaagaaggugaauga

SEQ ID NO: 326720 - RNA, 19 nt, Homo sapiens
gggagaagcgcaggcucaa

SEQ ID NO: 326721 - RNA, 19 nt, Homo sapiens
gcacauaacugucuccuua

SEQ ID NO: 326722 - RNA, 19 nt, Homo sapiens
caagaaaucuccacuaauu

SEQ ID NO: 326723 - RNA, 19 nt, Homo sapiens
gaacuaggcuugcauaugu

SEQ ID NO: 326724 - RNA, 19 nt, Homo sapiens
gaagaagcaugucgaauuu

SEQ ID NO: 326725 - RNA, 19 nt, Homo sapiens
gaagauaaaucacaaccua

SEQ ID NO: 326726 - RNA, 19 nt, Homo sapiens
gaagagggauccaauaaga

SEQ ID NO: 326727 - RNA, 19 nt, Homo sapiens
caagaaagauuugcugaua

SEQ ID NO: 326728 - RNA, 19 nt, Homo sapiens
cagcaaauauggacaauaa

SEQ ID NO: 326729 - RNA, 19 nt, Homo sapiens
gaacguaugaugagacuua

SEQ ID NO: 326730 - RNA, 19 nt, Homo sapiens
gacaagaaaucuccacuaa

SEQ ID NO: 326731 - RNA, 19 nt, Homo sapiens
ggagaaagauaguaaagga

SEQ ID NO: 326732 - RNA, 19 nt, Homo sapiens
gaagaggcaucgacuuuga

SEQ ID NO: 326733 - RNA, 19 nt, Homo sapiens
caacuaaacaggccaaaua

SEQ ID NO: 326734 - RNA, 19 nt, Homo sapiens
gaaagaaggagaagauaaa

SEQ ID NO: 326735 - RNA, 19 nt, Homo sapiens
ggagauacaccuuuagaua

SEQ ID NO: 326736 - RNA, 19 nt, Homo sapiens
aaagagacguugauuauug

SEQ ID NO: 326737 - RNA, 19 nt, Homo sapiens
gaacauaugcuuucacugu

SEQ ID NO: 326738 - RNA, 19 nt, Homo sapiens
gaacgaagagcucuagaaa

SEQ ID NO: 326739 - RNA, 19 nt, Homo sapiens
gaagaacggaucaugcuua

SEQ ID NO: 326740 - RNA, 19 nt, Homo sapiens
gaucagaguuauaagcaaa

SEQ ID NO: 326741 - RNA, 19 nt, Homo sapiens
acaccuacaucaccuauua

SEQ ID NO: 326742 - RNA, 19 nt, Homo sapiens
aaacagagauucuucaagu

SEQ ID NO: 326743 - RNA, 19 nt, Homo sapiens
caaaugcccucuuaucuag

SEQ ID NO: 326744 - RNA, 19 nt, Homo sapiens
ugacucaacugacuuuaaa

SEQ ID NO: 326745 - RNA, 19 nt, Homo sapiens
gacauuaacugaucuucaa

SEQ ID NO: 326746 - RNA, 19 nt, Homo sapiens
gcuaaauaguggucauaua

SEQ ID NO: 326747 - RNA, 19 nt, Homo sapiens
gaagagcucuagaaagaag

SEQ ID NO: 326748 - RNA, 19 nt, Homo sapiens
acgaagagcucuagaaaga

SEQ ID NO: 326749 - RNA, 19 nt, Homo sapiens
guaauggaauugcacauau

SEQ ID NO: 326750 - RNA, 19 nt, Homo sapiens
gaacaaauucuagcugaaa

SEQ ID NO: 326751 - RNA, 19 nt, Homo sapiens
ggcagagucuucuauguuu

SEQ ID NO: 326752 - RNA, 19 nt, Homo sapiens
gcacaagcacuacuacaaa

SEQ ID NO: 326753 - RNA, 19 nt, Homo sapiens
gaaagaaggaugagucuag

SEQ ID NO: 326754 - RNA, 19 nt, Homo sapiens
ggaacuaacagaucuuaaa

SEQ ID NO: 326755 - RNA, 19 nt, Homo sapiens
ggagugacauuaacugauc

SEQ ID NO: 326756 - RNA, 19 nt, Homo sapiens
ccaaaguaaugcuaugaaa

SEQ ID NO: 326757 - RNA, 19 nt, Homo sapiens
ggaauugcacauauuagua

SEQ ID NO: 326758 - RNA, 19 nt, Homo sapiens
gcaccaggcuugcauugau

SEQ ID NO: 326759 - RNA, 19 nt, Homo sapiens
uaaagagggucagaaagaa

SEQ ID NO: 326760 - RNA, 19 nt, Homo sapiens
gagauacaccuuuagauau

SEQ ID NO: 326761 - RNA, 19 nt, Homo sapiens
gaagacaguuacucaacau

SEQ ID NO: 326762 - RNA, 19 nt, Homo sapiens
agaagcagcucgaaaggaa

SEQ ID NO: 326763 - RNA, 19 nt, Homo sapiens
gaccauuguuucauguuaa

SEQ ID NO: 326764 - RNA, 19 nt, Homo sapiens
caucugacauugaagagaa

SEQ ID NO: 326765 - RNA, 19 nt, Homo sapiens
ccaaaugcccucuuaucua

SEQ ID NO: 326766 - RNA, 19 nt, Homo sapiens
acaaagagacguugauuau

SEQ ID NO: 326767 - RNA, 19 nt, Homo sapiens
gaacggaucaugcuuagag

SEQ ID NO: 326768 - RNA, 19 nt, Homo sapiens
ugauaguacucaaccauaa

SEQ ID NO: 326769 - RNA, 19 nt, Homo sapiens
agaaagauuugcugauaga

SEQ ID NO: 326770 - RNA, 19 nt, Homo sapiens
gaucauacaguuacuuaga

SEQ ID NO: 326771 - RNA, 19 nt, Homo sapiens
cggauuccauuucuagaua

SEQ ID NO: 326772 - RNA, 19 nt, Homo sapiens
ggagaaagaaggagaagau

SEQ ID NO: 326773 - RNA, 19 nt, Homo sapiens
gcagugaccauuccuguug

SEQ ID NO: 326774 - RNA, 19 nt, Homo sapiens
gcaaauauggacaauaauc

SEQ ID NO: 326775 - RNA, 19 nt, Homo sapiens
ucaaaugucugcuaaugca

SEQ ID NO: 326776 - RNA, 19 nt, Homo sapiens
uaucugaaauggaagaaga

SEQ ID NO: 326777 - RNA, 19 nt, Homo sapiens
cagaagagggauccaauaa

SEQ ID NO: 326778 - RNA, 19 nt, Homo sapiens
ggauaguacugagaaagaa

SEQ ID NO: 326779 - RNA, 19 nt, Homo sapiens
guuuacagcuccagcauau

SEQ ID NO: 326780 - RNA, 19 nt, Homo sapiens
gcagacaaccagaggcuaa

SEQ ID NO: 326781 - RNA, 19 nt, Homo sapiens
aagaagaucuacaggaguu

SEQ ID NO: 326782 - RNA, 19 nt, Homo sapiens
ccucuucacuuucuacuau

SEQ ID NO: 326783 - RNA, 19 nt, Homo sapiens
ggacaagaaaucuccacua

SEQ ID NO: 326784 - RNA, 19 nt, Homo sapiens
ccagagacaagaaagauuu

SEQ ID NO: 326785 - RNA, 19 nt, Homo sapiens
cgacaucaauuacgccaau

SEQ ID NO: 326786 - RNA, 19 nt, Homo sapiens
agaagaagcaugucgaauu

SEQ ID NO: 326787 - RNA, 19 nt, Homo sapiens
gacacaagauagugaugaa

SEQ ID NO: 326788 - RNA, 19 nt, Homo sapiens
ugaagaagaugaggaagau

SEQ ID NO: 326789 - RNA, 19 nt, Homo sapiens
aaagguugaugaagaagaa

SEQ ID NO: 326790 - RNA, 19 nt, Homo sapiens
guagcugauuguauuauug

SEQ ID NO: 326791 - RNA, 19 nt, Homo sapiens
cauuugagguuagaucuuu

SEQ ID NO: 326792 - RNA, 19 nt, Homo sapiens
gcucuucugugauuauugu

SEQ ID NO: 326793 - RNA, 19 nt, Homo sapiens
ucaagaccauuguuucaug

SEQ ID NO: 326794 - RNA, 19 nt, Homo sapiens
ucagaaacaucuagagaag

SEQ ID NO: 326795 - RNA, 19 nt, Homo sapiens
ccacaacccugacuacaac

SEQ ID NO: 326796 - RNA, 19 nt, Homo sapiens
guagaagacaagaugauuu

SEQ ID NO: 326797 - RNA, 19 nt, Homo sapiens
cuaaagagggucagaaaga

SEQ ID NO: 326798 - RNA, 19 nt, Homo sapiens
uuacagcuccagcauauaa

SEQ ID NO: 326799 - RNA, 19 nt, Homo sapiens
agaccauuguuucauguua

SEQ ID NO: 326800 - RNA, 19 nt, Homo sapiens
guaacccaguggaccauaa

SEQ ID NO: 326801 - RNA, 19 nt, Homo sapiens
gaaggaucaacguaucaua

SEQ ID NO: 326802 - RNA, 19 nt, Homo sapiens
gaaaucacagcaucuaaag

SEQ ID NO: 326803 - RNA, 19 nt, Homo sapiens
uaacuaaugccaacacuuc

SEQ ID NO: 326804 - RNA, 19 nt, Homo sapiens
gugaagaggcaucgacuuu

SEQ ID NO: 326805 - RNA, 19 nt, Homo sapiens
ggagcccuaucuuuacaaa

SEQ ID NO: 326806 - RNA, 19 nt, Homo sapiens
gaacgacgacgaccaagag

SEQ ID NO: 326807 - RNA, 19 nt, Homo sapiens
caguacaucugacauugaa

SEQ ID NO: 326808 - RNA, 19 nt, Homo sapiens
caacaaagugggccaaaca

SEQ ID NO: 326809 - RNA, 19 nt, Homo sapiens
gcacuguuauugccaugug

SEQ ID NO: 326810 - RNA, 19 nt, Homo sapiens
ugaaaccaguucuacauca

SEQ ID NO: 326811 - RNA, 19 nt, Homo sapiens
gaagaugacucggaaucag

SEQ ID NO: 326812 - RNA, 19 nt, Homo sapiens
uguagcagaugaagacauu

SEQ ID NO: 326813 - RNA, 19 nt, Homo sapiens
ucuguaaucuucacauuca

SEQ ID NO: 326814 - RNA, 19 nt, Homo sapiens
gagaaagaaggagaagaua

SEQ ID NO: 326815 - RNA, 19 nt, Homo sapiens
cagagauucuucaaguuug

SEQ ID NO: 326816 - RNA, 19 nt, Homo sapiens
caacacuucuaguacacaa

SEQ ID NO: 326817 - RNA, 19 nt, Homo sapiens
aauaaucagucacagaaga

SEQ ID NO: 326818 - RNA, 19 nt, Homo sapiens
gcaagggguugauauagaa

SEQ ID NO: 326819 - RNA, 19 nt, Homo sapiens
ggaacgaagagcucuagaa

SEQ ID NO: 326820 - RNA, 19 nt, Homo sapiens
caacacagggagugacauu

SEQ ID NO: 326821 - RNA, 19 nt, Homo sapiens
gcacaaaccuaaucaauca

SEQ ID NO: 326822 - RNA, 19 nt, Homo sapiens
ggaaugaggugauuucuga

SEQ ID NO: 326823 - RNA, 19 nt, Homo sapiens
gaauacaucuugacccuuu

SEQ ID NO: 326824 - RNA, 19 nt, Homo sapiens
ggagauauguuuccucuga

SEQ ID NO: 326825 - RNA, 19 nt, Homo sapiens
ccagauagcuccagaguau

SEQ ID NO: 326826 - RNA, 19 nt, Homo sapiens
caaagaagauggaagauag

SEQ ID NO: 326827 - RNA, 19 nt, Homo sapiens
gaagagagguuagguaaag

SEQ ID NO: 326828 - RNA, 19 nt, Homo sapiens
gagaagagagaacuauuua

SEQ ID NO: 326829 - RNA, 19 nt, Homo sapiens
gcagagagauuuacuuucu

SEQ ID NO: 326830 - RNA, 19 nt, Homo sapiens
gaacagcacuuggcuuuca

SEQ ID NO: 326831 - RNA, 19 nt, Homo sapiens
cagaaaggauucagcauuu

SEQ ID NO: 326832 - RNA, 19 nt, Homo sapiens
ccaguaaucucccuaacua

SEQ ID NO: 326833 - RNA, 19 nt, Homo sapiens
ggaggaaggugaagaugaa

SEQ ID NO: 326834 - RNA, 19 nt, Homo sapiens
caagaaauuugcaagcuuu

SEQ ID NO: 326835 - RNA, 19 nt, Homo sapiens
gaacagagccaauguaaac

SEQ ID NO: 326836 - RNA, 19 nt, Homo sapiens
gcucaggucugucacuuaa

SEQ ID NO: 326837 - RNA, 19 nt, Homo sapiens
gaaacccaaucucuacuaa

SEQ ID NO: 326838 - RNA, 19 nt, Homo sapiens
aaucagaggucguguaauu

SEQ ID NO: 326839 - RNA, 19 nt, Homo sapiens
ggacaaaggaugaggauga

SEQ ID NO: 326840 - RNA, 19 nt, Homo sapiens
ccaaagcaguguuuacaaa

SEQ ID NO: 326841 - RNA, 19 nt, Homo sapiens
gaagaagccuggagaagag

SEQ ID NO: 326842 - RNA, 19 nt, Homo sapiens
ccagugauauucaguguuu

SEQ ID NO: 326843 - RNA, 19 nt, Homo sapiens
ggaaauggcacuuaauaga

SEQ ID NO: 326844 - RNA, 19 nt, Homo sapiens
auaaauagcugcagacaug

SEQ ID NO: 326845 - RNA, 19 nt, Homo sapiens
ccaccuauguaucaacuua

SEQ ID NO: 326846 - RNA, 19 nt, Homo sapiens
caagauuccuguagaaguu

SEQ ID NO: 326847 - RNA, 19 nt, Homo sapiens
ggaagagaguuucacagaa

SEQ ID NO: 326848 - RNA, 19 nt, Homo sapiens
gaaaguguguguaaacuac

SEQ ID NO: 326849 - RNA, 19 nt, Homo sapiens
cauaagguguugacuaauu

SEQ ID NO: 326850 - RNA, 19 nt, Homo sapiens
agaaucagcuguuaaucua

SEQ ID NO: 326851 - RNA, 19 nt, Homo sapiens
aaagaaacguggcaugaaa

SEQ ID NO: 326852 - RNA, 19 nt, Homo sapiens
caacaaagauaaggagaga

SEQ ID NO: 326853 - RNA, 19 nt, Homo sapiens
gaaguaggagguucugaua

SEQ ID NO: 326854 - RNA, 19 nt, Homo sapiens
gaaaggauucagcauuuaa

SEQ ID NO: 326855 - RNA, 19 nt, Homo sapiens
cagaagagcccaaagauga

SEQ ID NO: 326856 - RNA, 19 nt, Homo sapiens
ucagcaaacuguccaagua

SEQ ID NO: 326857 - RNA, 19 nt, Homo sapiens
gcaggagucuggaugaaga

SEQ ID NO: 326858 - RNA, 19 nt, Homo sapiens
gaaccucccugucuuccaa

SEQ ID NO: 326859 - RNA, 19 nt, Homo sapiens
gccaagaacucaugaaagu

SEQ ID NO: 326860 - RNA, 19 nt, Homo sapiens
gaugauaaccuagcauuaa

SEQ ID NO: 326861 - RNA, 19 nt, Homo sapiens
caagaacucaugaaaguaa

SEQ ID NO: 326862 - RNA, 19 nt, Homo sapiens
uaacggcacuugagauaug

SEQ ID NO: 326863 - RNA, 19 nt, Homo sapiens
gaagcaggcuggaaagaca

SEQ ID NO: 326864 - RNA, 19 nt, Homo sapiens
gaagacagcaacagagauu

SEQ ID NO: 326865 - RNA, 19 nt, Homo sapiens
gcgaaaggguuaugcaaau

SEQ ID NO: 326866 - RNA, 19 nt, Homo sapiens
gaauacaaauccagugcaa

SEQ ID NO: 326867 - RNA, 19 nt, Homo sapiens
gagcaaggauucaggaaag

SEQ ID NO: 326868 - RNA, 19 nt, Homo sapiens
ggagaagagagaacuauuu

SEQ ID NO: 326869 - RNA, 19 nt, Homo sapiens
caaagaugauggaagaaga

SEQ ID NO: 326870 - RNA, 19 nt, Homo sapiens
gaaguacuuucaacccauu

SEQ ID NO: 326871 - RNA, 19 nt, Homo sapiens
cuacugggcugugagaaua

SEQ ID NO: 326872 - RNA, 19 nt, Homo sapiens
aggcuaggcuccagauuua

SEQ ID NO: 326873 - RNA, 19 nt, Homo sapiens
gaugagcaguccucuaaga

SEQ ID NO: 326874 - RNA, 19 nt, Homo sapiens
gagaacagagccaauguaa

SEQ ID NO: 326875 - RNA, 19 nt, Homo sapiens
gcuacuaucuugagacuuc

SEQ ID NO: 326876 - RNA, 19 nt, Homo sapiens
gagcaagacuccaucucaa

SEQ ID NO: 326877 - RNA, 19 nt, Homo sapiens
gacuuuggcuuuaugguuu

SEQ ID NO: 326878 - RNA, 19 nt, Homo sapiens
cuaaauaucugugccuuug

SEQ ID NO: 326879 - RNA, 19 nt, Homo sapiens
gagaggaaaucaacauaag

SEQ ID NO: 326880 - RNA, 19 nt, Homo sapiens
ggucuaacccuucauaaga

SEQ ID NO: 326881 - RNA, 19 nt, Homo sapiens
gcagaaaggauucagcauu

SEQ ID NO: 326882 - RNA, 19 nt, Homo sapiens
ggaagaagaaacucucaaa

SEQ ID NO: 326883 - RNA, 19 nt, Homo sapiens
ugagaauaguggugaauuu

SEQ ID NO: 326884 - RNA, 19 nt, Homo sapiens
gaaagaaagggacagcauu

SEQ ID NO: 326885 - RNA, 19 nt, Homo sapiens
gcacaggcaucaauuucug

SEQ ID NO: 326886 - RNA, 19 nt, Homo sapiens
gcaaggaauugaucuagag

SEQ ID NO: 326887 - RNA, 19 nt, Homo sapiens
caacauagcagaguauuuc

SEQ ID NO: 326888 - RNA, 19 nt, Homo sapiens
cgaggacggugcugucuuu

SEQ ID NO: 326889 - RNA, 19 nt, Homo sapiens
guaauuggccuaaaucuag

SEQ ID NO: 326890 - RNA, 19 nt, Homo sapiens
cagcaguucucucuggaua

SEQ ID NO: 326891 - RNA, 19 nt, Homo sapiens
gaauaguggugaauuugau

SEQ ID NO: 326892 - RNA, 19 nt, Homo sapiens
gaaugaagaagcagauuug

SEQ ID NO: 326893 - RNA, 19 nt, Homo sapiens
ggagaggaaaucaacauaa

SEQ ID NO: 326894 - RNA, 19 nt, Homo sapiens
caaauccagugcaaaauua

SEQ ID NO: 326895 - RNA, 19 nt, Homo sapiens
gaccagccguguagaagaa

SEQ ID NO: 326896 - RNA, 19 nt, Homo sapiens
ugagugagguggccaauuc

SEQ ID NO: 326897 - RNA, 19 nt, Homo sapiens
aaagaaagcagaaaggauu

SEQ ID NO: 326898 - RNA, 19 nt, Homo sapiens
guugagagauggacuagga

SEQ ID NO: 326899 - RNA, 19 nt, Homo sapiens
aaaugaagguguuaacaga

SEQ ID NO: 326900 - RNA, 19 nt, Homo sapiens
caccugcuauggacaaaua

SEQ ID NO: 326901 - RNA, 19 nt, Homo sapiens
gaaagcaagaguaguauca

SEQ ID NO: 326902 - RNA, 19 nt, Homo sapiens
ggucacagcuacuaggaau

SEQ ID NO: 326903 - RNA, 19 nt, Homo sapiens
ggacagcuauugaucuuuu

SEQ ID NO: 326904 - RNA, 19 nt, Homo sapiens
caagagaagcugcuacuau

SEQ ID NO: 326905 - RNA, 19 nt, Homo sapiens
ugacauggauauucgaaau

SEQ ID NO: 326906 - RNA, 19 nt, Homo sapiens
gcccagagcuuuuaaaaug

SEQ ID NO: 326907 - RNA, 19 nt, Homo sapiens
gagcuuaucagugaaguaa

SEQ ID NO: 326908 - RNA, 19 nt, Homo sapiens
agaaaggauucagcauuua

SEQ ID NO: 326909 - RNA, 19 nt, Homo sapiens
gauauucaguguuuagagu

SEQ ID NO: 326910 - RNA, 19 nt, Homo sapiens
ugagagucauggaaguuua

SEQ ID NO: 326911 - RNA, 19 nt, Homo sapiens
guucagagacuaccacaaa

SEQ ID NO: 326912 - RNA, 19 nt, Homo sapiens
cagcacaagugauauugaa

SEQ ID NO: 326913 - RNA, 19 nt, Homo sapiens
cagcugaguuguauggauu

SEQ ID NO: 326914 - RNA, 19 nt, Homo sapiens
gauaagacccuagaaguca

SEQ ID NO: 326915 - RNA, 19 nt, Homo sapiens
aaagggaaauucuacucua

SEQ ID NO: 326916 - RNA, 19 nt, Homo sapiens
ggacggugcugucuuucug

SEQ ID NO: 326917 - RNA, 19 nt, Homo sapiens
ggcaagaggugcugauauc

SEQ ID NO: 326918 - RNA, 19 nt, Homo sapiens
gaucaucagugcuggagau

SEQ ID NO: 326919 - RNA, 19 nt, Homo sapiens
gaagguggcccagcagaaa

SEQ ID NO: 326920 - RNA, 19 nt, Homo sapiens
uagcuugacucucgccuaa

SEQ ID NO: 326921 - RNA, 19 nt, Homo sapiens
gaaaguugcugcacaagug

SEQ ID NO: 326922 - RNA, 19 nt, Homo sapiens
ggacaaaggaugaggauga

SEQ ID NO: 326923 - RNA, 19 nt, Homo sapiens
aaagaaacguggcaugaaa

SEQ ID NO: 326924 - RNA, 19 nt, Homo sapiens
ucagcaaacuguccaagua

SEQ ID NO: 326925 - RNA, 19 nt, Homo sapiens
gcaggagucuggaugaaga

SEQ ID NO: 326926 - RNA, 19 nt, Homo sapiens
gaagacagcaacagagauu

SEQ ID NO: 326927 - RNA, 19 nt, Homo sapiens
gagacaagccucugccaua

SEQ ID NO: 326928 - RNA, 19 nt, Homo sapiens
gauuugaucuggcaauaga

SEQ ID NO: 326929 - RNA, 19 nt, Homo sapiens
aggcuaggcuccagauuua

SEQ ID NO: 326930 - RNA, 19 nt, Homo sapiens
gaugagcaguccucuaaga

SEQ ID NO: 326931 - RNA, 19 nt, Homo sapiens
gaaagaaagggacagcauu

SEQ ID NO: 326932 - RNA, 19 nt, Homo sapiens
gcacaggcaucaauuucug

SEQ ID NO: 326933 - RNA, 19 nt, Homo sapiens
gaaugaagaagcagauuug

SEQ ID NO: 326934 - RNA, 19 nt, Homo sapiens
gaccagccguguagaagaa

SEQ ID NO: 326935 - RNA, 19 nt, Homo sapiens
aaaugaagguguuaacaga

SEQ ID NO: 326936 - RNA, 19 nt, Homo sapiens
caccugcuauggacaaaua

SEQ ID NO: 326937 - RNA, 19 nt, Homo sapiens
gaaaucagaggcacaggaa

SEQ ID NO: 326938 - RNA, 19 nt, Homo sapiens
guucagagacuaccacaaa

SEQ ID NO: 326939 - RNA, 19 nt, Homo sapiens
gaucaucagugcuggagau

SEQ ID NO: 326940 - RNA, 19 nt, Homo sapiens
gaagguggcccagcagaaa

SEQ ID NO: 326941 - RNA, 19 nt, Homo sapiens
gacaaaggaugaggaugaa

SEQ ID NO: 326942 - RNA, 19 nt, Homo sapiens
aaaaugggcuccaguguuu

SEQ ID NO: 326943 - RNA, 19 nt, Homo sapiens
aaauugggcuucugggaaa

SEQ ID NO: 326944 - RNA, 19 nt, Homo sapiens
gcauugaggcgcucuauuc

SEQ ID NO: 326945 - RNA, 19 nt, Homo sapiens
cuacaaccagugauucuua

SEQ ID NO: 326946 - RNA, 19 nt, Homo sapiens
ccucugccauaguuuguua

SEQ ID NO: 326947 - RNA, 19 nt, Homo sapiens
gcuuucaccuggaaugauu

SEQ ID NO: 326948 - RNA, 19 nt, Homo sapiens
uguaagacuucuacccuaa

SEQ ID NO: 326949 - RNA, 19 nt, Homo sapiens
ugaccgggcuucagcaaga

SEQ ID NO: 326950 - RNA, 19 nt, Homo sapiens
gaagcaugauugugguaau

SEQ ID NO: 326951 - RNA, 19 nt, Homo sapiens
gaagaaaugaagguguuaa

SEQ ID NO: 326952 - RNA, 19 nt, Homo sapiens
ugucagaaauggaggaaga

SEQ ID NO: 326953 - RNA, 19 nt, Homo sapiens
aaagaaagggacagcauuu

SEQ ID NO: 326954 - RNA, 19 nt, Homo sapiens
acacgaaggucuacucaag

SEQ ID NO: 326955 - RNA, 19 nt, Homo sapiens
gguguuaacagaacugaaa

SEQ ID NO: 326956 - RNA, 19 nt, Homo sapiens
gaaaugaagguguuaacag

SEQ ID NO: 326957 - RNA, 19 nt, Homo sapiens
ggaagaaaugaagguguua

SEQ ID NO: 326958 - RNA, 19 nt, Homo sapiens
aaagaccucugaccgauca

SEQ ID NO: 326959 - RNA, 19 nt, Homo sapiens
gagacuaccacaaacacua

SEQ ID NO: 326960 - RNA, 19 nt, Homo sapiens
gaaagcacgcuccagacaa

SEQ ID NO: 326961 - RNA, 19 nt, Homo sapiens
acagcaggauguugaauug

SEQ ID NO: 326962 - RNA, 19 nt, Homo sapiens
uagcagauauaaaguccaa

SEQ ID NO: 326963 - RNA, 19 nt, Homo sapiens
acaagccucugccauaguu

SEQ ID NO: 326964 - RNA, 19 nt, Homo sapiens
guccaaacauguaagacuu

SEQ ID NO: 326965 - RNA, 19 nt, Homo sapiens
gguacaaucucauaaaaug

SEQ ID NO: 326966 - RNA, 19 nt, Homo sapiens
ggaaagcacgcuccagaca

SEQ ID NO: 326967 - RNA, 19 nt, Homo sapiens
ugaggaagcagagucuuua

SEQ ID NO: 326968 - RNA, 19 nt, Homo sapiens
gaaauggaggaagaaauga

SEQ ID NO: 326969 - RNA, 19 nt, Homo sapiens
ggaugaggaugaaacugau

SEQ ID NO: 326970 - RNA, 19 nt, Homo sapiens
gcaggauguugaauugauc

SEQ ID NO: 326971 - RNA, 19 nt, Homo sapiens
caaagaaacguggcaugaa

SEQ ID NO: 326972 - RNA, 19 nt, Homo sapiens
uggaugagcaguccucuaa

SEQ ID NO: 326973 - RNA, 19 nt, Homo sapiens
ugaagaagcagauuuggau

SEQ ID NO: 326974 - RNA, 19 nt, Homo sapiens
ggaaguugaucuggguguu

SEQ ID NO: 326975 - RNA, 19 nt, Homo sapiens
cagcuacuuuguccacauu

SEQ ID NO: 326976 - RNA, 19 nt, Homo sapiens
gaggaguggccaccuguuu

SEQ ID NO: 326977 - RNA, 19 nt, Homo sapiens
ccuaacagaccuucaagaa

SEQ ID NO: 326978 - RNA, 19 nt, Homo sapiens
ggaaagaaagggacagcau

SEQ ID NO: 326979 - RNA, 19 nt, Homo sapiens
agaaauggaggaagaaaug

SEQ ID NO: 326980 - RNA, 19 nt, Homo sapiens
ucaaagaaacguggcauga

SEQ ID NO: 326981 - RNA, 19 nt, Homo sapiens
ucaagacccucacucuaca

SEQ ID NO: 326982 - RNA, 19 nt, Homo sapiens
ggagcagccucgugagaag

SEQ ID NO: 326983 - RNA, 19 nt, Homo sapiens
ccagauuuaugaggaaaga

SEQ ID NO: 326984 - RNA, 19 nt, Homo sapiens
accagaggcugaaagauga

SEQ ID NO: 326985 - RNA, 19 nt, Homo sapiens
gcaucaauuucuggacaaa

SEQ ID NO: 326986 - RNA, 19 nt, Homo sapiens
aggaagaaaugaagguguu

SEQ ID NO: 326987 - RNA, 19 nt, Homo sapiens
gacagcaacagagauuaua

SEQ ID NO: 326988 - RNA, 19 nt, Homo sapiens
ggaugaagagccuaucugu

SEQ ID NO: 326989 - RNA, 19 nt, Homo sapiens
agacaagccucugccauag

SEQ ID NO: 326990 - RNA, 19 nt, Homo sapiens
gaugcccucuggaaugguu

SEQ ID NO: 326991 - RNA, 19 nt, Homo sapiens
uaagacuucuacccuaauc

SEQ ID NO: 326992 - RNA, 19 nt, Homo sapiens
ccucuucagucaccucuau

SEQ ID NO: 326993 - RNA, 19 nt, Homo sapiens
cagcaacagagauuauaaa

SEQ ID NO: 326994 - RNA, 19 nt, Homo sapiens
ugaaacugauggcucugaa

SEQ ID NO: 326995 - RNA, 19 nt, Homo sapiens
gggcuccaguguuuagaga

SEQ ID NO: 326996 - RNA, 19 nt, Homo sapiens
cacuacaacugcaaaggaa

SEQ ID NO: 326997 - RNA, 19 nt, Homo sapiens
gggcaggagucuggaugaa

SEQ ID NO: 326998 - RNA, 19 nt, Homo sapiens
uugaggcgcucuauucuuc

SEQ ID NO: 326999 - RNA, 19 nt, Homo sapiens
gcaaggugugucugaggua

SEQ ID NO: 327000 - RNA, 19 nt, Homo sapiens
ugauauaggugagucuugu

SEQ ID NO: 327001 - RNA, 19 nt, Homo sapiens
ggacacuucuuucuaucac

SEQ ID NO: 327002 - RNA, 19 nt, Homo sapiens
gaccugcuuucaccuggaa

SEQ ID NO: 327003 - RNA, 19 nt, Homo sapiens
cugaagaggucaaagaaac

SEQ ID NO: 327004 - RNA, 19 nt, Homo sapiens
aaagcacgcuccagacaag

SEQ ID NO: 327005 - RNA, 19 nt, Homo sapiens
ccagugugcugaguugaga

SEQ ID NO: 327006 - RNA, 19 nt, Homo sapiens
aagcaugauugugguaauu

SEQ ID NO: 327007 - RNA, 19 nt, Homo sapiens
caucagagucaucagcaaa

SEQ ID NO: 327008 - RNA, 19 nt, Homo sapiens
gaaaacaaaacuucaggaa

SEQ ID NO: 327009 - RNA, 19 nt, Homo sapiens
gcugguacaaucucauaaa

SEQ ID NO: 327010 - RNA, 19 nt, Homo sapiens
auaggugagucuuguggua

SEQ ID NO: 327011 - RNA, 19 nt, Homo sapiens
ggaaaguugcugcacaagu

SEQ ID NO: 327012 - RNA, 19 nt, Homo sapiens
ucaaugcccuguucuucca

SEQ ID NO: 327013 - RNA, 19 nt, Homo sapiens
gcuccagauuuaugaggaa

SEQ ID NO: 327014 - RNA, 19 nt, Homo sapiens
aaacugauggcucugaaga

SEQ ID NO: 327015 - RNA, 19 nt, Homo sapiens
cagacaagcucggcagaca

SEQ ID NO: 327016 - RNA, 19 nt, Homo sapiens
guugagacaucagcaagug

SEQ ID NO: 327017 - RNA, 19 nt, Homo sapiens
cuucuacccuaaucaguau

SEQ ID NO: 327018 - RNA, 19 nt, Homo sapiens
agaagaagacagcaacaga

SEQ ID NO: 327019 - RNA, 19 nt, Homo sapiens
agaaugaagaagcagauuu

SEQ ID NO: 327020 - RNA, 19 nt, Homo sapiens
gugcugaguugagacauca

SEQ ID NO: 327021 - RNA, 19 nt, Homo sapiens
gaaaguugcugcacaagug

SEQ ID NO: 327022 - RNA, 19 nt, Homo sapiens
ggacaaaggaugaggauga

SEQ ID NO: 327023 - RNA, 19 nt, Homo sapiens
aaagaaacguggcaugaaa

SEQ ID NO: 327024 - RNA, 19 nt, Homo sapiens
ucagcaaacuguccaagua

SEQ ID NO: 327025 - RNA, 19 nt, Homo sapiens
gcaggagucuggaugaaga

SEQ ID NO: 327026 - RNA, 19 nt, Homo sapiens
gaagacagcaacagagauu

SEQ ID NO: 327027 - RNA, 19 nt, Homo sapiens
gagacaagccucugccaua

SEQ ID NO: 327028 - RNA, 19 nt, Homo sapiens
gauuugaucuggcaauaga

SEQ ID NO: 327029 - RNA, 19 nt, Homo sapiens
aggcuaggcuccagauuua

SEQ ID NO: 327030 - RNA, 19 nt, Homo sapiens
gaugagcaguccucuaaga

SEQ ID NO: 327031 - RNA, 19 nt, Homo sapiens
gaaagaaagggacagcauu

SEQ ID NO: 327032 - RNA, 19 nt, Homo sapiens
gcacaggcaucaauuucug

SEQ ID NO: 327033 - RNA, 19 nt, Homo sapiens
gaaugaagaagcagauuug

SEQ ID NO: 327034 - RNA, 19 nt, Homo sapiens
gaccagccguguagaagaa

SEQ ID NO: 327035 - RNA, 19 nt, Homo sapiens
caccugcuauggacaaaua

SEQ ID NO: 327036 - RNA, 19 nt, Homo sapiens
gaaaucagaggcacaggaa

SEQ ID NO: 327037 - RNA, 19 nt, Homo sapiens
ucacuucccuccuccacua

SEQ ID NO: 327038 - RNA, 19 nt, Homo sapiens
guucagagacuaccacaaa

SEQ ID NO: 327039 - RNA, 19 nt, Homo sapiens
gaucaucagugcuggagau

SEQ ID NO: 327040 - RNA, 19 nt, Homo sapiens
gaagguggcccagcagaaa

SEQ ID NO: 327041 - RNA, 19 nt, Homo sapiens
gacaaaggaugaggaugaa

SEQ ID NO: 327042 - RNA, 19 nt, Homo sapiens
aaaaugggcuccaguguuu

SEQ ID NO: 327043 - RNA, 19 nt, Homo sapiens
aaauugggcuucugggaaa

SEQ ID NO: 327044 - RNA, 19 nt, Homo sapiens
gcauugaggcgcucuauuc

SEQ ID NO: 327045 - RNA, 19 nt, Homo sapiens
cuacaaccagugauucuua

SEQ ID NO: 327046 - RNA, 19 nt, Homo sapiens
ccucugccauaguuuguua

SEQ ID NO: 327047 - RNA, 19 nt, Homo sapiens
gcuuucaccuggaaugauu

SEQ ID NO: 327048 - RNA, 19 nt, Homo sapiens
uguaagacuucuacccuaa

SEQ ID NO: 327049 - RNA, 19 nt, Homo sapiens
ugaccgggcuucagcaaga

SEQ ID NO: 327050 - RNA, 19 nt, Homo sapiens
gaagcaugauugugguaau

SEQ ID NO: 327051 - RNA, 19 nt, Homo sapiens
ugucagaaauggaggaaga

SEQ ID NO: 327052 - RNA, 19 nt, Homo sapiens
aaagaaagggacagcauuu

SEQ ID NO: 327053 - RNA, 19 nt, Homo sapiens
gaagaaccuccaccagcua

SEQ ID NO: 327054 - RNA, 19 nt, Homo sapiens
acacgaaggucuacucaag

SEQ ID NO: 327055 - RNA, 19 nt, Homo sapiens
gguguuaacagaacugaaa

SEQ ID NO: 327056 - RNA, 19 nt, Homo sapiens
aaagaccucugaccgauca

SEQ ID NO: 327057 - RNA, 19 nt, Homo sapiens
gagacuaccacaaacacua

SEQ ID NO: 327058 - RNA, 19 nt, Homo sapiens
gaaagcacgcuccagacaa

SEQ ID NO: 327059 - RNA, 19 nt, Homo sapiens
acagcaggauguugaauug

SEQ ID NO: 327060 - RNA, 19 nt, Homo sapiens
uagcagauauaaaguccaa

SEQ ID NO: 327061 - RNA, 19 nt, Homo sapiens
acaagccucugccauaguu

SEQ ID NO: 327062 - RNA, 19 nt, Homo sapiens
guccaaacauguaagacuu

SEQ ID NO: 327063 - RNA, 19 nt, Homo sapiens
gguacaaucucauaaaaug

SEQ ID NO: 327064 - RNA, 19 nt, Homo sapiens
ggaaagcacgcuccagaca

SEQ ID NO: 327065 - RNA, 19 nt, Homo sapiens
ugaggaagcagagucuuua

SEQ ID NO: 327066 - RNA, 19 nt, Homo sapiens
gaaauggaggaagaaauga

SEQ ID NO: 327067 - RNA, 19 nt, Homo sapiens
ggaugaggaugaaacugau

SEQ ID NO: 327068 - RNA, 19 nt, Homo sapiens
gcaggauguugaauugauc

SEQ ID NO: 327069 - RNA, 19 nt, Homo sapiens
cccaggagcucuaguucuu

SEQ ID NO: 327070 - RNA, 19 nt, Homo sapiens
caaagaaacguggcaugaa

SEQ ID NO: 327071 - RNA, 19 nt, Homo sapiens
uggaugagcaguccucuaa

SEQ ID NO: 327072 - RNA, 19 nt, Homo sapiens
ugaagaagcagauuuggau

SEQ ID NO: 327073 - RNA, 19 nt, Homo sapiens
ggaaguugaucuggguguu

SEQ ID NO: 327074 - RNA, 19 nt, Homo sapiens
cagcuacuuuguccacauu

SEQ ID NO: 327075 - RNA, 19 nt, Homo sapiens
gaggaguggccaccuguuu

SEQ ID NO: 327076 - RNA, 19 nt, Homo sapiens
ggaaagaaagggacagcau

SEQ ID NO: 327077 - RNA, 19 nt, Homo sapiens
agaaauggaggaagaaaug

SEQ ID NO: 327078 - RNA, 19 nt, Homo sapiens
ucaaagaaacguggcauga

SEQ ID NO: 327079 - RNA, 19 nt, Homo sapiens
ucaagacccucacucuaca

SEQ ID NO: 327080 - RNA, 19 nt, Homo sapiens
ggagcagccucgugagaag

SEQ ID NO: 327081 - RNA, 19 nt, Homo sapiens
ccagauuuaugaggaaaga

SEQ ID NO: 327082 - RNA, 19 nt, Homo sapiens
accagaggcugaaagauga

SEQ ID NO: 327083 - RNA, 19 nt, Homo sapiens
gcaucaauuucuggacaaa

SEQ ID NO: 327084 - RNA, 19 nt, Homo sapiens
gacagcaacagagauuaua

SEQ ID NO: 327085 - RNA, 19 nt, Homo sapiens
ggaugaagagccuaucugu

SEQ ID NO: 327086 - RNA, 19 nt, Homo sapiens
agacaagccucugccauag

SEQ ID NO: 327087 - RNA, 19 nt, Homo sapiens
gaugcccucuggaaugguu

SEQ ID NO: 327088 - RNA, 19 nt, Homo sapiens
uaagacuucuacccuaauc

SEQ ID NO: 327089 - RNA, 19 nt, Homo sapiens
ccucuucagucaccucuau

SEQ ID NO: 327090 - RNA, 19 nt, Homo sapiens
cagcaacagagauuauaaa

SEQ ID NO: 327091 - RNA, 19 nt, Homo sapiens
ugaaacugauggcucugaa

SEQ ID NO: 327092 - RNA, 19 nt, Homo sapiens
gggcuccaguguuuagaga

SEQ ID NO: 327093 - RNA, 19 nt, Homo sapiens
cacuacaacugcaaaggaa

SEQ ID NO: 327094 - RNA, 19 nt, Homo sapiens
gggcaggagucuggaugaa

SEQ ID NO: 327095 - RNA, 19 nt, Homo sapiens
uugaggcgcucuauucuuc

SEQ ID NO: 327096 - RNA, 19 nt, Homo sapiens
ugauauaggugagucuugu

SEQ ID NO: 327097 - RNA, 19 nt, Homo sapiens
ggacacuucuuucuaucac

SEQ ID NO: 327098 - RNA, 19 nt, Homo sapiens
gcaaggugugucugaggua

SEQ ID NO: 327099 - RNA, 19 nt, Homo sapiens
gaccugcuuucaccuggaa

SEQ ID NO: 327100 - RNA, 19 nt, Homo sapiens
cugaagaggucaaagaaac

SEQ ID NO: 327101 - RNA, 19 nt, Homo sapiens
aaagcacgcuccagacaag

SEQ ID NO: 327102 - RNA, 19 nt, Homo sapiens
ccagugugcugaguugaga

SEQ ID NO: 327103 - RNA, 19 nt, Homo sapiens
aagcaugauugugguaauu

SEQ ID NO: 327104 - RNA, 19 nt, Homo sapiens
caucagagucaucagcaaa

SEQ ID NO: 327105 - RNA, 19 nt, Homo sapiens
gaaaacaaaacuucaggaa

SEQ ID NO: 327106 - RNA, 19 nt, Homo sapiens
gcugguacaaucucauaaa

SEQ ID NO: 327107 - RNA, 19 nt, Homo sapiens
auaggugagucuuguggua

SEQ ID NO: 327108 - RNA, 19 nt, Homo sapiens
ucaaugcccuguucuucca

SEQ ID NO: 327109 - RNA, 19 nt, Homo sapiens
gcuccagauuuaugaggaa

SEQ ID NO: 327110 - RNA, 19 nt, Homo sapiens
aaacugauggcucugaaga

SEQ ID NO: 327111 - RNA, 19 nt, Homo sapiens
cagacaagcucggcagaca

SEQ ID NO: 327112 - RNA, 19 nt, Homo sapiens
ggaaaguugcugcacaagu

SEQ ID NO: 327113 - RNA, 19 nt, Homo sapiens
guugagacaucagcaagug

SEQ ID NO: 327114 - RNA, 19 nt, Homo sapiens
cuucuacccuaaucaguau

SEQ ID NO: 327115 - RNA, 19 nt, Homo sapiens
agaagaagacagcaacaga

SEQ ID NO: 327116 - RNA, 19 nt, Homo sapiens
agaaugaagaagcagauuu

SEQ ID NO: 327117 - RNA, 19 nt, Homo sapiens
gugcugaguugagacauca

SEQ ID NO: 327118 - RNA, 19 nt, Homo sapiens
gaggcgcucuauucuucuu

SEQ ID NO: 327119 - RNA, 19 nt, Homo sapiens
ccaguguccucugauauag

SEQ ID NO: 327120 - RNA, 19 nt, Homo sapiens
cccaguguccucugauaua

SEQ ID NO: 327121 - RNA, 19 nt, Homo sapiens
gcacaaaccuaaucaauca

SEQ ID NO: 327122 - RNA, 19 nt, Homo sapiens
ggaaugaggugauuucuga

SEQ ID NO: 327123 - RNA, 19 nt, Homo sapiens
gaauacaucuugacccuuu

SEQ ID NO: 327124 - RNA, 19 nt, Homo sapiens
ggagauauguuuccucuga

SEQ ID NO: 327125 - RNA, 19 nt, Homo sapiens
ccagauagcuccagaguau

SEQ ID NO: 327126 - RNA, 19 nt, Homo sapiens
caaagaagauggaagauag

SEQ ID NO: 327127 - RNA, 19 nt, Homo sapiens
gaagagagguuagguaaag

SEQ ID NO: 327128 - RNA, 19 nt, Homo sapiens
gagaagagagaacuauuua

SEQ ID NO: 327129 - RNA, 19 nt, Homo sapiens
gcagagagauuuacuuucu

SEQ ID NO: 327130 - RNA, 19 nt, Homo sapiens
gaacagcacuuggcuuuca

SEQ ID NO: 327131 - RNA, 19 nt, Homo sapiens
cagaaaggauucagcauuu

SEQ ID NO: 327132 - RNA, 19 nt, Homo sapiens
ccaguaaucucccuaacua

SEQ ID NO: 327133 - RNA, 19 nt, Homo sapiens
ggaggaaggugaagaugaa

SEQ ID NO: 327134 - RNA, 19 nt, Homo sapiens
caagaaauuugcaagcuuu

SEQ ID NO: 327135 - RNA, 19 nt, Homo sapiens
gaacagagccaauguaaac

SEQ ID NO: 327136 - RNA, 19 nt, Homo sapiens
gcucaggucugucacuuaa

SEQ ID NO: 327137 - RNA, 19 nt, Homo sapiens
gaaacccaaucucuacuaa

SEQ ID NO: 327138 - RNA, 19 nt, Homo sapiens
aaucagaggucguguaauu

SEQ ID NO: 327139 - RNA, 19 nt, Homo sapiens
ggacaaaggaugaggauga

SEQ ID NO: 327140 - RNA, 19 nt, Homo sapiens
ccaaagcaguguuuacaaa

SEQ ID NO: 327141 - RNA, 19 nt, Homo sapiens
gaagaagccuggagaagag

SEQ ID NO: 327142 - RNA, 19 nt, Homo sapiens
ccagugauauucaguguuu

SEQ ID NO: 327143 - RNA, 19 nt, Homo sapiens
ggaaauggcacuuaauaga

SEQ ID NO: 327144 - RNA, 19 nt, Homo sapiens
auaaauagcugcagacaug

SEQ ID NO: 327145 - RNA, 19 nt, Homo sapiens
ccaccuauguaucaacuua

SEQ ID NO: 327146 - RNA, 19 nt, Homo sapiens
caagauuccuguagaaguu

SEQ ID NO: 327147 - RNA, 19 nt, Homo sapiens
ggaagagaguuucacagaa

SEQ ID NO: 327148 - RNA, 19 nt, Homo sapiens
gaaaguguguguaaacuac

SEQ ID NO: 327149 - RNA, 19 nt, Homo sapiens
cauaagguguugacuaauu

SEQ ID NO: 327150 - RNA, 19 nt, Homo sapiens
agaaucagcuguuaaucua

SEQ ID NO: 327151 - RNA, 19 nt, Homo sapiens
aaagaaacguggcaugaaa

SEQ ID NO: 327152 - RNA, 19 nt, Homo sapiens
caacaaagauaaggagaga

SEQ ID NO: 327153 - RNA, 19 nt, Homo sapiens
gaaguaggagguucugaua

SEQ ID NO: 327154 - RNA, 19 nt, Homo sapiens
gaaaggauucagcauuuaa

SEQ ID NO: 327155 - RNA, 19 nt, Homo sapiens
cagaagagcccaaagauga

SEQ ID NO: 327156 - RNA, 19 nt, Homo sapiens
ucagcaaacuguccaagua

SEQ ID NO: 327157 - RNA, 19 nt, Homo sapiens
gcaggagucuggaugaaga

SEQ ID NO: 327158 - RNA, 19 nt, Homo sapiens
gaaccucccugucuuccaa

SEQ ID NO: 327159 - RNA, 19 nt, Homo sapiens
gccaagaacucaugaaagu

SEQ ID NO: 327160 - RNA, 19 nt, Homo sapiens
gaugauaaccuagcauuaa

SEQ ID NO: 327161 - RNA, 19 nt, Homo sapiens
caagaacucaugaaaguaa

SEQ ID NO: 327162 - RNA, 19 nt, Homo sapiens
uaacggcacuugagauaug

SEQ ID NO: 327163 - RNA, 19 nt, Homo sapiens
gaagcaggcuggaaagaca

SEQ ID NO: 327164 - RNA, 19 nt, Homo sapiens
gaagacagcaacagagauu

SEQ ID NO: 327165 - RNA, 19 nt, Homo sapiens
gcgaaaggguuaugcaaau

SEQ ID NO: 327166 - RNA, 19 nt, Homo sapiens
gaauacaaauccagugcaa

SEQ ID NO: 327167 - RNA, 19 nt, Homo sapiens
gagcaaggauucaggaaag

SEQ ID NO: 327168 - RNA, 19 nt, Homo sapiens
ggagaagagagaacuauuu

SEQ ID NO: 327169 - RNA, 19 nt, Homo sapiens
caaagaugauggaagaaga

SEQ ID NO: 327170 - RNA, 19 nt, Homo sapiens
gaaguacuuucaacccauu

SEQ ID NO: 327171 - RNA, 19 nt, Homo sapiens
cuacugggcugugagaaua

SEQ ID NO: 327172 - RNA, 19 nt, Homo sapiens
aggcuaggcuccagauuua

SEQ ID NO: 327173 - RNA, 19 nt, Homo sapiens
gaugagcaguccucuaaga

SEQ ID NO: 327174 - RNA, 19 nt, Homo sapiens
gagaacagagccaauguaa

SEQ ID NO: 327175 - RNA, 19 nt, Homo sapiens
gcuacuaucuugagacuuc

SEQ ID NO: 327176 - RNA, 19 nt, Homo sapiens
gagcaagacuccaucucaa

SEQ ID NO: 327177 - RNA, 19 nt, Homo sapiens
gacuuuggcuuuaugguuu

SEQ ID NO: 327178 - RNA, 19 nt, Homo sapiens
cuaaauaucugugccuuug

SEQ ID NO: 327179 - RNA, 19 nt, Homo sapiens
gagaggaaaucaacauaag

SEQ ID NO: 327180 - RNA, 19 nt, Homo sapiens
ggucuaacccuucauaaga

SEQ ID NO: 327181 - RNA, 19 nt, Homo sapiens
gcagaaaggauucagcauu

SEQ ID NO: 327182 - RNA, 19 nt, Homo sapiens
ggaagaagaaacucucaaa

SEQ ID NO: 327183 - RNA, 19 nt, Homo sapiens
ugagaauaguggugaauuu

SEQ ID NO: 327184 - RNA, 19 nt, Homo sapiens
gaaagaaagggacagcauu

SEQ ID NO: 327185 - RNA, 19 nt, Homo sapiens
gcacaggcaucaauuucug

SEQ ID NO: 327186 - RNA, 19 nt, Homo sapiens
gcaaggaauugaucuagag

SEQ ID NO: 327187 - RNA, 19 nt, Homo sapiens
caacauagcagaguauuuc

SEQ ID NO: 327188 - RNA, 19 nt, Homo sapiens
cgaggacggugcugucuuu

SEQ ID NO: 327189 - RNA, 19 nt, Homo sapiens
guaauuggccuaaaucuag

SEQ ID NO: 327190 - RNA, 19 nt, Homo sapiens
cagcaguucucucuggaua

SEQ ID NO: 327191 - RNA, 19 nt, Homo sapiens
gaauaguggugaauuugau

SEQ ID NO: 327192 - RNA, 19 nt, Homo sapiens
gaaugaagaagcagauuug

SEQ ID NO: 327193 - RNA, 19 nt, Homo sapiens
ggagaggaaaucaacauaa

SEQ ID NO: 327194 - RNA, 19 nt, Homo sapiens
caaauccagugcaaaauua

SEQ ID NO: 327195 - RNA, 19 nt, Homo sapiens
gaccagccguguagaagaa

SEQ ID NO: 327196 - RNA, 19 nt, Homo sapiens
ugagugagguggccaauuc

SEQ ID NO: 327197 - RNA, 19 nt, Homo sapiens
aaagaaagcagaaaggauu

SEQ ID NO: 327198 - RNA, 19 nt, Homo sapiens
guugagagauggacuagga

SEQ ID NO: 327199 - RNA, 19 nt, Homo sapiens
caccugcuauggacaaaua

SEQ ID NO: 327200 - RNA, 19 nt, Homo sapiens
gaaagcaagaguaguauca

SEQ ID NO: 327201 - RNA, 19 nt, Homo sapiens
ggucacagcuacuaggaau

SEQ ID NO: 327202 - RNA, 19 nt, Homo sapiens
ggacagcuauugaucuuuu

SEQ ID NO: 327203 - RNA, 19 nt, Homo sapiens
caagagaagcugcuacuau

SEQ ID NO: 327204 - RNA, 19 nt, Homo sapiens
ucacuucccuccuccacua

SEQ ID NO: 327205 - RNA, 19 nt, Homo sapiens
ugacauggauauucgaaau

SEQ ID NO: 327206 - RNA, 19 nt, Homo sapiens
gcccagagcuuuuaaaaug

SEQ ID NO: 327207 - RNA, 19 nt, Homo sapiens
gagcuuaucagugaaguaa

SEQ ID NO: 327208 - RNA, 19 nt, Homo sapiens
agaaaggauucagcauuua

SEQ ID NO: 327209 - RNA, 19 nt, Homo sapiens
gauauucaguguuuagagu

SEQ ID NO: 327210 - RNA, 19 nt, Homo sapiens
ugagagucauggaaguuua

SEQ ID NO: 327211 - RNA, 19 nt, Homo sapiens
guucagagacuaccacaaa

SEQ ID NO: 327212 - RNA, 19 nt, Homo sapiens
cagcacaagugauauugaa

SEQ ID NO: 327213 - RNA, 19 nt, Homo sapiens
cagcugaguuguauggauu

SEQ ID NO: 327214 - RNA, 19 nt, Homo sapiens
gauaagacccuagaaguca

SEQ ID NO: 327215 - RNA, 19 nt, Homo sapiens
aaagggaaauucuacucua

SEQ ID NO: 327216 - RNA, 19 nt, Homo sapiens
ggacggugcugucuuucug

SEQ ID NO: 327217 - RNA, 19 nt, Homo sapiens
ggcaagaggugcugauauc

SEQ ID NO: 327218 - RNA, 19 nt, Homo sapiens
gaucaucagugcuggagau

SEQ ID NO: 327219 - RNA, 19 nt, Homo sapiens
gaagguggcccagcagaaa

SEQ ID NO: 327220 - RNA, 19 nt, Homo sapiens
uagcuugacucucgccuaa

SEQ ID NO: 327221 - RNA, 19 nt, Homo sapiens
ggaagucccugaagaauga

SEQ ID NO: 327222 - RNA, 19 nt, Homo sapiens
gaggugagcuguuaaauca

SEQ ID NO: 327223 - RNA, 19 nt, Homo sapiens
ccaaggagcuggagaaguu

SEQ ID NO: 327224 - RNA, 19 nt, Homo sapiens
gcagggugauuuccuaaua

SEQ ID NO: 327225 - RNA, 19 nt, Homo sapiens
gggagaagauauuuaauug

SEQ ID NO: 327226 - RNA, 19 nt, Homo sapiens
ugacugcaauuccaaguua

SEQ ID NO: 327227 - RNA, 19 nt, Homo sapiens
caacuucucuccugaacuu

SEQ ID NO: 327228 - RNA, 19 nt, Homo sapiens
ggagauccuuccaagagua

SEQ ID NO: 327229 - RNA, 19 nt, Homo sapiens
ugagagcagucauuaagua

SEQ ID NO: 327230 - RNA, 19 nt, Homo sapiens
ccaaagggauggcuggaaa

SEQ ID NO: 327231 - RNA, 19 nt, Homo sapiens
gcaaauggaauucuguauu

SEQ ID NO: 327232 - RNA, 19 nt, Homo sapiens
gagcagucauuaaguaaau

SEQ ID NO: 327233 - RNA, 19 nt, Homo sapiens
guaaauagaauccaaguca

SEQ ID NO: 327234 - RNA, 19 nt, Homo sapiens
ccacaaagguuucacuucu

SEQ ID NO: 327235 - RNA, 19 nt, Homo sapiens
uaaaugagacgucgccuuu

SEQ ID NO: 327236 - RNA, 19 nt, Homo sapiens
gauaacagcaaauggaauu

SEQ ID NO: 327237 - RNA, 19 nt, Homo sapiens
gaauuucgaugccuaugug

SEQ ID NO: 327238 - RNA, 19 nt, Homo sapiens
gagaagaaccugaagaaca

SEQ ID NO: 327239 - RNA, 19 nt, Homo sapiens
gaauccaagucaauuguga

SEQ ID NO: 327240 - RNA, 19 nt, Homo sapiens
gaacuugggucaaauugcu

SEQ ID NO: 327241 - RNA, 19 nt, Homo sapiens
gaaagaggacagacaauag

SEQ ID NO: 327242 - RNA, 19 nt, Homo sapiens
ggaccacucuggcuucugu

SEQ ID NO: 327243 - RNA, 19 nt, Homo sapiens
ggaggaaccugaggaguca

SEQ ID NO: 327244 - RNA, 19 nt, Homo sapiens
caguaaagauccuucaaga

SEQ ID NO: 327245 - RNA, 19 nt, Homo sapiens
caaugucccuaccguguaa

SEQ ID NO: 327246 - RNA, 19 nt, Homo sapiens
gcacaaacaccgcaaacga

SEQ ID NO: 327247 - RNA, 19 nt, Homo sapiens
ccaaggacauaaagaagga

SEQ ID NO: 327248 - RNA, 19 nt, Homo sapiens
agaagaaccugaagaacau

SEQ ID NO: 327249 - RNA, 19 nt, Homo sapiens
ugaagcagaugaccaggaa

SEQ ID NO: 327250 - RNA, 19 nt, Homo sapiens
gcugggagaugccugagaa

SEQ ID NO: 327251 - RNA, 19 nt, Homo sapiens
ggaggaggaugaagaagag

SEQ ID NO: 327252 - RNA, 19 nt, Homo sapiens
gcaagucuguggauaucga

SEQ ID NO: 327253 - RNA, 19 nt, Homo sapiens
guuccgaggugagcuguua

SEQ ID NO: 327254 - RNA, 19 nt, Homo sapiens
ggugagcuguuaaaucaga

SEQ ID NO: 327255 - RNA, 19 nt, Homo sapiens
ugaaagaggacagacaaua

SEQ ID NO: 327256 - RNA, 19 nt, Homo sapiens
cagggugauuuccuaauaa

SEQ ID NO: 327257 - RNA, 19 nt, Homo sapiens
gagggaaaguuaggaauag

SEQ ID NO: 327258 - RNA, 19 nt, Homo sapiens
ccucuuauguuaacguuug

SEQ ID NO: 327259 - RNA, 19 nt, Homo sapiens
ggucugggauccacgucua

SEQ ID NO: 327260 - RNA, 19 nt, Homo sapiens
gcagaaugaagcccuguuu

SEQ ID NO: 327261 - RNA, 19 nt, Homo sapiens
gccuuuagcuggcuuagga

SEQ ID NO: 327262 - RNA, 19 nt, Homo sapiens
ggaggaagaggaagaggaa

SEQ ID NO: 327263 - RNA, 19 nt, Homo sapiens
uccaaagucucgccaauau

SEQ ID NO: 327264 - RNA, 19 nt, Homo sapiens
ugaaguuucucuccaagga

SEQ ID NO: 327265 - RNA, 19 nt, Homo sapiens
gcaacacgcacagaaguuu

SEQ ID NO: 327266 - RNA, 19 nt, Homo sapiens
gagagcagucauuaaguaa

SEQ ID NO: 327267 - RNA, 19 nt, Homo sapiens
gcaauuccaaguuaguauu

SEQ ID NO: 327268 - RNA, 19 nt, Homo sapiens
gaggagaacaagcucauug

SEQ ID NO: 327269 - RNA, 19 nt, Homo sapiens
ggaagugucggaagagaau

SEQ ID NO: 327270 - RNA, 19 nt, Homo sapiens
ugaguacucuguuauugug

SEQ ID NO: 327271 - RNA, 19 nt, Homo sapiens
guccaaaguucaagacuag

SEQ ID NO: 327272 - RNA, 19 nt, Homo sapiens
gaacaggugcgcacagucu

SEQ ID NO: 327273 - RNA, 19 nt, Homo sapiens
agaaaggcauccugaguca

SEQ ID NO: 327274 - RNA, 19 nt, Homo sapiens
gaggguaaauuccuaacag

SEQ ID NO: 327275 - RNA, 19 nt, Homo sapiens
ggaggaggaggaugaagaa

SEQ ID NO: 327276 - RNA, 19 nt, Homo sapiens
ggcccuaucugugugcaua

SEQ ID NO: 327277 - RNA, 19 nt, Homo sapiens
gagccaauaugcgaacaga

SEQ ID NO: 327278 - RNA, 19 nt, Homo sapiens
gcacauggagccaauaugc

SEQ ID NO: 327279 - RNA, 19 nt, Homo sapiens
cagcgaaaccucaccuaaa

SEQ ID NO: 327280 - RNA, 19 nt, Homo sapiens
acacugugcggaagaguua

SEQ ID NO: 327281 - RNA, 19 nt, Homo sapiens
gcagaaaggcauccugagu

SEQ ID NO: 327282 - RNA, 19 nt, Homo sapiens
caaccacaguauuccuuug

SEQ ID NO: 327283 - RNA, 19 nt, Homo sapiens
ggagaaugaugaggagauc

SEQ ID NO: 327284 - RNA, 19 nt, Homo sapiens
gaaggacgccucuguuucg

SEQ ID NO: 327285 - RNA, 19 nt, Homo sapiens
caagacaccugggcagaca

SEQ ID NO: 327286 - RNA, 19 nt, Homo sapiens
caggagaccacaaagguuu

SEQ ID NO: 327287 - RNA, 19 nt, Homo sapiens
gcgugucugugcucaauga

SEQ ID NO: 327288 - RNA, 19 nt, Homo sapiens
gacaauagcuguggggaaa

SEQ ID NO: 327289 - RNA, 19 nt, Homo sapiens
gcacggauaacagcaaaug

SEQ ID NO: 327290 - RNA, 19 nt, Homo sapiens
uaggggcacugaagaauua

SEQ ID NO: 327291 - RNA, 19 nt, Homo sapiens
ccucauggcugcccacucu

SEQ ID NO: 327292 - RNA, 19 nt, Homo sapiens
ugaagaagaggaagaggaa

SEQ ID NO: 327293 - RNA, 19 nt, Homo sapiens
uaauaaaaguccacucuga

SEQ ID NO: 327294 - RNA, 19 nt, Homo sapiens
gcaaccacaguauuccuuu

SEQ ID NO: 327295 - RNA, 19 nt, Homo sapiens
ggaguuugcaaccacagua

SEQ ID NO: 327296 - RNA, 19 nt, Homo sapiens
cacagugacuucccguuug

SEQ ID NO: 327297 - RNA, 19 nt, Homo sapiens
caauaugcgaacagaauuu

SEQ ID NO: 327298 - RNA, 19 nt, Homo sapiens
gaaugaagcccuguuucug

SEQ ID NO: 327299 - RNA, 19 nt, Homo sapiens
ugacggcucuggccacauc

SEQ ID NO: 327300 - RNA, 19 nt, Homo sapiens
ggauaucgagguagacgaa

SEQ ID NO: 327301 - RNA, 19 nt, Homo sapiens
gugaaggacgccucuguuu

SEQ ID NO: 327302 - RNA, 19 nt, Homo sapiens
cugaagaauuacaaaguga

SEQ ID NO: 327303 - RNA, 19 nt, Homo sapiens
ucaccgacauguacuccaa

SEQ ID NO: 327304 - RNA, 19 nt, Homo sapiens
cagcaagucuguggauauc

SEQ ID NO: 327305 - RNA, 19 nt, Homo sapiens
gcggaagaguuacuacagu

SEQ ID NO: 327306 - RNA, 19 nt, Homo sapiens
ggacaggacgagauucauc

SEQ ID NO: 327307 - RNA, 19 nt, Homo sapiens
ucacagccucuuauguuaa

SEQ ID NO: 327308 - RNA, 19 nt, Homo sapiens
cacaaagguuucacuucuu

SEQ ID NO: 327309 - RNA, 19 nt, Homo sapiens
gcgacguguuggagaauga

SEQ ID NO: 327310 - RNA, 19 nt, Homo sapiens
gcucgucauucuccuggaa

SEQ ID NO: 327311 - RNA, 19 nt, Homo sapiens
aagagacccugguggaaga

SEQ ID NO: 327312 - RNA, 19 nt, Homo sapiens
uucacagccucuuauguua

SEQ ID NO: 327313 - RNA, 19 nt, Homo sapiens
cuuaggaguucgcacacua

SEQ ID NO: 327314 - RNA, 19 nt, Homo sapiens
agagggaaaguuaggaaua

SEQ ID NO: 327315 - RNA, 19 nt, Homo sapiens
aguggaagcucauggacaa

SEQ ID NO: 327316 - RNA, 19 nt, Homo sapiens
gccaauaugcgaacagaau

SEQ ID NO: 327317 - RNA, 19 nt, Homo sapiens
gacaagagccucagaaacc

SEQ ID NO: 327318 - RNA, 19 nt, Homo sapiens
aaacaccgcaaacgagaaa

SEQ ID NO: 327319 - RNA, 19 nt, Homo sapiens
ggagaugcaggacaugaug

SEQ ID NO: 327320 - RNA, 19 nt, Homo sapiens
gguccucaguccaaaguuc

SEQ ID NO: 327321 - RNA, 19 nt, Homo sapiens
gaagauaacugacagcuuu

SEQ ID NO: 327322 - RNA, 19 nt, Homo sapiens
ggacagagaacuugaaaua

SEQ ID NO: 327323 - RNA, 19 nt, Homo sapiens
ggagugugcuuacauguua

SEQ ID NO: 327324 - RNA, 19 nt, Homo sapiens
caacauacaucugccaaua

SEQ ID NO: 327325 - RNA, 19 nt, Homo sapiens
aaagaaagcuuaagugaug

SEQ ID NO: 327326 - RNA, 19 nt, Homo sapiens
gcaguaaucuuccaacuuc

SEQ ID NO: 327327 - RNA, 19 nt, Homo sapiens
ggaaauacagugcaauaua

SEQ ID NO: 327328 - RNA, 19 nt, Homo sapiens
gaacaaggucaauugguua

SEQ ID NO: 327329 - RNA, 19 nt, Homo sapiens
gcagcuguauagaauauua

SEQ ID NO: 327330 - RNA, 19 nt, Homo sapiens
ggaauauccugcaguaguu

SEQ ID NO: 327331 - RNA, 19 nt, Homo sapiens
gaaagcgaauacucaguuu

SEQ ID NO: 327332 - RNA, 19 nt, Homo sapiens
gaggauggguuuccagauu

SEQ ID NO: 327333 - RNA, 19 nt, Homo sapiens
caagauagcugugauuucu

SEQ ID NO: 327334 - RNA, 19 nt, Homo sapiens
aaacagagccugaagauuc

SEQ ID NO: 327335 - RNA, 19 nt, Homo sapiens
gaaguuuaauugacagcua

SEQ ID NO: 327336 - RNA, 19 nt, Homo sapiens
gcauacccaucuauaaauu

SEQ ID NO: 327337 - RNA, 19 nt, Homo sapiens
uggaaaggcuuacaaauca

SEQ ID NO: 327338 - RNA, 19 nt, Homo sapiens
uaacucagauggacaagga

SEQ ID NO: 327339 - RNA, 19 nt, Homo sapiens
gagaagucaccuauaaaua

SEQ ID NO: 327340 - RNA, 19 nt, Homo sapiens
caacauggcugggaauauc

SEQ ID NO: 327341 - RNA, 19 nt, Homo sapiens
ccgagucucuuacacuuua

SEQ ID NO: 327342 - RNA, 19 nt, Homo sapiens
acauacaucugccaauaua

SEQ ID NO: 327343 - RNA, 19 nt, Homo sapiens
ggcaucagauuuaaggaua

SEQ ID NO: 327344 - RNA, 19 nt, Homo sapiens
ugaaaugucugcacuguag

SEQ ID NO: 327345 - RNA, 19 nt, Homo sapiens
aagccaaucuacuuucuua

SEQ ID NO: 327346 - RNA, 19 nt, Homo sapiens
uaaguggacccauguauaa

SEQ ID NO: 327347 - RNA, 19 nt, Homo sapiens
gucauaaucuguuacacua

SEQ ID NO: 327348 - RNA, 19 nt, Homo sapiens
gguuaucaaugcacguuua

SEQ ID NO: 327349 - RNA, 19 nt, Homo sapiens
ugaacaaggucaauugguu

SEQ ID NO: 327350 - RNA, 19 nt, Homo sapiens
gaaauaguaugaguacgau

SEQ ID NO: 327351 - RNA, 19 nt, Homo sapiens
gauggcgacuguuaacaaa

SEQ ID NO: 327352 - RNA, 19 nt, Homo sapiens
gaugagcaauagaguagaa

SEQ ID NO: 327353 - RNA, 19 nt, Homo sapiens
caaccaagcuggcuaugag

SEQ ID NO: 327354 - RNA, 19 nt, Homo sapiens
ccauagcacugguuaguau

SEQ ID NO: 327355 - RNA, 19 nt, Homo sapiens
guucugcucuagaucauaa

SEQ ID NO: 327356 - RNA, 19 nt, Homo sapiens
ggauaauacuccaucauag

SEQ ID NO: 327357 - RNA, 19 nt, Homo sapiens
gaaauaaguggacccaugu

SEQ ID NO: 327358 - RNA, 19 nt, Homo sapiens
acagagaacuugaaauaag

SEQ ID NO: 327359 - RNA, 19 nt, Homo sapiens
caagaguguugcaaucuau

SEQ ID NO: 327360 - RNA, 19 nt, Homo sapiens
ugcaauauauggcagauuu

SEQ ID NO: 327361 - RNA, 19 nt, Homo sapiens
uuauggaccuugcaacuuu

SEQ ID NO: 327362 - RNA, 19 nt, Homo sapiens
ucagaucacugucacguau

SEQ ID NO: 327363 - RNA, 19 nt, Homo sapiens
gauaauacuccaucauaga

SEQ ID NO: 327364 - RNA, 19 nt, Homo sapiens
agaaagagaugaauuaucc

SEQ ID NO: 327365 - RNA, 19 nt, Homo sapiens
ugaguacgauuucaauaga

SEQ ID NO: 327366 - RNA, 19 nt, Homo sapiens
uaaguuaacccuacauguu

SEQ ID NO: 327367 - RNA, 19 nt, Homo sapiens
ggaaaggcuuacaaaucaa

SEQ ID NO: 327368 - RNA, 19 nt, Homo sapiens
ucagagagccuugggauuu

SEQ ID NO: 327369 - RNA, 19 nt, Homo sapiens
gcacuguagucucagauca

SEQ ID NO: 327370 - RNA, 19 nt, Homo sapiens
ucaagaguguugcaaucua

SEQ ID NO: 327371 - RNA, 19 nt, Homo sapiens
gaugaaaugucugcacugu

SEQ ID NO: 327372 - RNA, 19 nt, Homo sapiens
cagagagacuagaugcuuu

SEQ ID NO: 327373 - RNA, 19 nt, Homo sapiens
gcaucagauuuaaggauaa

SEQ ID NO: 327374 - RNA, 19 nt, Homo sapiens
ucaauugguuaccucagua

SEQ ID NO: 327375 - RNA, 19 nt, Homo sapiens
uaauagauguggauacagu

SEQ ID NO: 327376 - RNA, 19 nt, Homo sapiens
uaaccaguguugccucauu

SEQ ID NO: 327377 - RNA, 19 nt, Homo sapiens
guugcuagcuugagguuga

SEQ ID NO: 327378 - RNA, 19 nt, Homo sapiens
guugcaaucuauaacagua

SEQ ID NO: 327379 - RNA, 19 nt, Homo sapiens
gauaaugcccugcugacaa

SEQ ID NO: 327380 - RNA, 19 nt, Homo sapiens
gaagugaaagagcugcuaa

SEQ ID NO: 327381 - RNA, 19 nt, Homo sapiens
ccaacaagguggugaugau

SEQ ID NO: 327382 - RNA, 19 nt, Homo sapiens
aguaauggcugcggccuua

SEQ ID NO: 327383 - RNA, 19 nt, Homo sapiens
gagacuagaugcuuucacu

SEQ ID NO: 327384 - RNA, 19 nt, Homo sapiens
gaaagucuucucuauguag

SEQ ID NO: 327385 - RNA, 19 nt, Homo sapiens
uagcauacccaucuauaaa

SEQ ID NO: 327386 - RNA, 19 nt, Homo sapiens
uguaagagaguauguguuu

SEQ ID NO: 327387 - RNA, 19 nt, Homo sapiens
auaaagauggcgacuguua

SEQ ID NO: 327388 - RNA, 19 nt, Homo sapiens
uucaugagcucacuguuaa

SEQ ID NO: 327389 - RNA, 19 nt, Homo sapiens
guggaaaccaggaagauaa

SEQ ID NO: 327390 - RNA, 19 nt, Homo sapiens
uggagaaagagaugaauua

SEQ ID NO: 327391 - RNA, 19 nt, Homo sapiens
aaugauuggucacaucuuu

SEQ ID NO: 327392 - RNA, 19 nt, Homo sapiens
ccagagggaucaccaacau

SEQ ID NO: 327393 - RNA, 19 nt, Homo sapiens
cagucaaguuuguagauuu

SEQ ID NO: 327394 - RNA, 19 nt, Homo sapiens
uaacugacagcuuuaccua

SEQ ID NO: 327395 - RNA, 19 nt, Homo sapiens
uuauaaagauggcgacugu

SEQ ID NO: 327396 - RNA, 19 nt, Homo sapiens
cagaagagcacaguccuaa

SEQ ID NO: 327397 - RNA, 19 nt, Homo sapiens
ggagaaagagaugaauuau

SEQ ID NO: 327398 - RNA, 19 nt, Homo sapiens
cucgagaagucaccuauaa

SEQ ID NO: 327399 - RNA, 19 nt, Homo sapiens
aagcuuaagugaugcaguu

SEQ ID NO: 327400 - RNA, 19 nt, Homo sapiens
uaaaguggaggauggguuu

SEQ ID NO: 327401 - RNA, 19 nt, Homo sapiens
gaauauccugcaguaguua

SEQ ID NO: 327402 - RNA, 19 nt, Homo sapiens
ccuuugagauuuaugaaug

SEQ ID NO: 327403 - RNA, 19 nt, Homo sapiens
ccacaucuguaggcauauu

SEQ ID NO: 327404 - RNA, 19 nt, Homo sapiens
uaaagauggcgacuguuaa

SEQ ID NO: 327405 - RNA, 19 nt, Homo sapiens
caaugcacguuuacacaau

SEQ ID NO: 327406 - RNA, 19 nt, Homo sapiens
ucauucagcuuuuaccuua

SEQ ID NO: 327407 - RNA, 19 nt, Homo sapiens
caaagucccacucaucaga

SEQ ID NO: 327408 - RNA, 19 nt, Homo sapiens
ggaguuccuuugcaaccaa

SEQ ID NO: 327409 - RNA, 19 nt, Homo sapiens
ugagcucacuguuaaugaa

SEQ ID NO: 327410 - RNA, 19 nt, Homo sapiens
guagcauacccaucuauaa

SEQ ID NO: 327411 - RNA, 19 nt, Homo sapiens
gacagagaacuugaaauaa

SEQ ID NO: 327412 - RNA, 19 nt, Homo sapiens
gaaaggcuuacaaaucaau

SEQ ID NO: 327413 - RNA, 19 nt, Homo sapiens
ucauucagcucaaacagau

SEQ ID NO: 327414 - RNA, 19 nt, Homo sapiens
cgagaagucaccuauaaau

SEQ ID NO: 327415 - RNA, 19 nt, Homo sapiens
cuuccaacuuccaauauuu

SEQ ID NO: 327416 - RNA, 19 nt, Homo sapiens
aagcgaauacucaguuuaa

SEQ ID NO: 327417 - RNA, 19 nt, Homo sapiens
cuuaagugaugcaguuauu

SEQ ID NO: 327418 - RNA, 19 nt, Homo sapiens
gccaaucuacuuucuuauu

SEQ ID NO: 327419 - RNA, 19 nt, Homo sapiens
gggaauauccugcaguagu

SEQ ID NO: 327420 - RNA, 19 nt, Homo sapiens
ucagccaaauguuagauga

SEQ ID NO: 327421 - RNA, 19 nt, Homo sapiens
ggacaacacgcucuuauua

SEQ ID NO: 327422 - RNA, 19 nt, Homo sapiens
ugaagaagcugaaacaaga

SEQ ID NO: 327423 - RNA, 19 nt, Homo sapiens
gaguggagcucuucucuuu

SEQ ID NO: 327424 - RNA, 19 nt, Homo sapiens
gaacagagucacccugaaa

SEQ ID NO: 327425 - RNA, 19 nt, Homo sapiens
gcaaauacagcaucaucua

SEQ ID NO: 327426 - RNA, 19 nt, Homo sapiens
gaaacaagagguuggagaa

SEQ ID NO: 327427 - RNA, 19 nt, Homo sapiens
aagaggagauccgcaaaua

SEQ ID NO: 327428 - RNA, 19 nt, Homo sapiens
gcgccaaccuccuuuccua

SEQ ID NO: 327429 - RNA, 19 nt, Homo sapiens
gaggucacaucccugcuaa

SEQ ID NO: 327430 - RNA, 19 nt, Homo sapiens
ugcuaaagcugaauaagaa

SEQ ID NO: 327431 - RNA, 19 nt, Homo sapiens
ucuuugagauggaugauaa

SEQ ID NO: 327432 - RNA, 19 nt, Homo sapiens
gaggagauccgcaaauaca

SEQ ID NO: 327433 - RNA, 19 nt, Homo sapiens
gcaccuacuuguccuccuu

SEQ ID NO: 327434 - RNA, 19 nt, Homo sapiens
ggaaagggagcaugagcaa

SEQ ID NO: 327435 - RNA, 19 nt, Homo sapiens
caaccuccuuuccuacuau

SEQ ID NO: 327436 - RNA, 19 nt, Homo sapiens
gaacuuggagagaagcuau

SEQ ID NO: 327437 - RNA, 19 nt, Homo sapiens
guggagcucuucucuuugu

SEQ ID NO: 327438 - RNA, 19 nt, Homo sapiens
ucacaucccugcuaaagcu

SEQ ID NO: 327439 - RNA, 19 nt, Homo sapiens
gagucuggauggacauuug

SEQ ID NO: 327440 - RNA, 19 nt, Homo sapiens
caucaucuauggccguuuc

SEQ ID NO: 327441 - RNA, 19 nt, Homo sapiens
caaauacagcaucaucuau

SEQ ID NO: 327442 - RNA, 19 nt, Homo sapiens
gaagaggagauccgcaaau

SEQ ID NO: 327443 - RNA, 19 nt, Homo sapiens
cgagagagcaccuacuugu

SEQ ID NO: 327444 - RNA, 19 nt, Homo sapiens
ccaaccuccuuuccuacua

SEQ ID NO: 327445 - RNA, 19 nt, Homo sapiens
aaagggagcaugagcaaug

SEQ ID NO: 327446 - RNA, 19 nt, Homo sapiens
ggaggucacaucccugcua

SEQ ID NO: 327447 - RNA, 19 nt, Homo sapiens
gcauggugguggaaagugu

SEQ ID NO: 327448 - RNA, 19 nt, Homo sapiens
ggaagaggagauccgcaaa

SEQ ID NO: 327449 - RNA, 19 nt, Homo sapiens
gagcguugggcacaucuuu

SEQ ID NO: 327450 - RNA, 19 nt, Homo sapiens
ugagauggaugauaaugac

SEQ ID NO: 327451 - RNA, 19 nt, Homo sapiens
gggacaacacgcucuuauu

SEQ ID NO: 327452 - RNA, 19 nt, Homo sapiens
gaagcugaaacaagagguu

SEQ ID NO: 327453 - RNA, 19 nt, Homo sapiens
ccagggcucuucagucaac

SEQ ID NO: 327454 - RNA, 19 nt, Homo sapiens
aaauacagcaucaucuaug

SEQ ID NO: 327455 - RNA, 19 nt, Homo sapiens
gacaacacgcucuuauuac

SEQ ID NO: 327456 - RNA, 19 nt, Homo sapiens
ggucacaucccugcuaaag

SEQ ID NO: 327457 - RNA, 19 nt, Homo sapiens
aacaagagguuggagaaca

SEQ ID NO: 327458 - RNA, 19 nt, Homo sapiens
gagggacaacacgcucuua

SEQ ID NO: 327459 - RNA, 19 nt, Homo sapiens
ugcacgagcucaccaucaa

SEQ ID NO: 327460 - RNA, 19 nt, Homo sapiens
gcguugggcacaucuuuga

SEQ ID NO: 327461 - RNA, 19 nt, Homo sapiens
cugcuaaagcugaauaaga

SEQ ID NO: 327462 - RNA, 19 nt, Homo sapiens
acaacacgcucuuauuacg

SEQ ID NO: 327463 - RNA, 19 nt, Homo sapiens
ggaggaguuucuggagauc

SEQ ID NO: 327464 - RNA, 19 nt, Homo sapiens
gaaaguguggagaggaucu

SEQ ID NO: 327465 - RNA, 19 nt, Homo sapiens
uggaaaguguggagaggau

SEQ ID NO: 327466 - RNA, 19 nt, Homo sapiens
auccagggcucuucaguca

SEQ ID NO: 327467 - RNA, 19 nt, Homo sapiens
agaacagagucacccugaa

SEQ ID NO: 327468 - RNA, 19 nt, Homo sapiens
cuacuuguccuccuugaag

SEQ ID NO: 327469 - RNA, 19 nt, Homo sapiens
gcugcccaguucugcauga

SEQ ID NO: 327470 - RNA, 19 nt, Homo sapiens
gcaggagcagcgugaaagu

SEQ ID NO: 327471 - RNA, 19 nt, Homo sapiens
acaagagguuggagaacag

SEQ ID NO: 327472 - RNA, 19 nt, Homo sapiens
gaagaagcugaaacaagag

SEQ ID NO: 327473 - RNA, 19 nt, Homo sapiens
aauacagcaucaucuaugg

SEQ ID NO: 327474 - RNA, 19 nt, Homo sapiens
gaaagggagcaugagcaau

SEQ ID NO: 327475 - RNA, 19 nt, Homo sapiens
gagagagcaccuacuuguc

SEQ ID NO: 327476 - RNA, 19 nt, Homo sapiens
ggagaucauggcacuugug

SEQ ID NO: 327477 - RNA, 19 nt, Homo sapiens
aggaggaguuucuggagau

SEQ ID NO: 327478 - RNA, 19 nt, Homo sapiens
gaagggcugcuggacagau

SEQ ID NO: 327479 - RNA, 19 nt, Homo sapiens
cagcaucccgcucuucaag

SEQ ID NO: 327480 - RNA, 19 nt, Homo sapiens
cagaaggcacugagagagu

SEQ ID NO: 327481 - RNA, 19 nt, Homo sapiens
gcuauggagccgacacauc

SEQ ID NO: 327482 - RNA, 19 nt, Homo sapiens
ccgcaaauacagcaucauc

SEQ ID NO: 327483 - RNA, 19 nt, Homo sapiens
ugaaacagguguagaaguu

SEQ ID NO: 327484 - RNA, 19 nt, Homo sapiens
gaagcugucucaaacauuc

SEQ ID NO: 327485 - RNA, 19 nt, Homo sapiens
gcugagaaauucaaaguuc

SEQ ID NO: 327486 - RNA, 19 nt, Homo sapiens
aaacagguguagaaguuaa

SEQ ID NO: 327487 - RNA, 19 nt, Homo sapiens
caagagcccugcuucagau

SEQ ID NO: 327488 - RNA, 19 nt, Homo sapiens
uaccagagcuugaagaaca

SEQ ID NO: 327489 - RNA, 19 nt, Homo sapiens
gcagcuugguuugaaauuu

SEQ ID NO: 327490 - RNA, 19 nt, Homo sapiens
aagccaagaucgaagauuu

SEQ ID NO: 327491 - RNA, 19 nt, Homo sapiens
aaacagagucggagugaaa

SEQ ID NO: 327492 - RNA, 19 nt, Homo sapiens
cagcuugguuugaaauuug

SEQ ID NO: 327493 - RNA, 19 nt, Homo sapiens
gaaacagguguagaaguua

SEQ ID NO: 327494 - RNA, 19 nt, Homo sapiens
ggaaggcuauguccaaacu

SEQ ID NO: 327495 - RNA, 19 nt, Homo sapiens
gaagaaccagucaguaaag

SEQ ID NO: 327496 - RNA, 19 nt, Homo sapiens
ggaagaggucgaugaaaca

SEQ ID NO: 327497 - RNA, 19 nt, Homo sapiens
gaaauucaaaguucaaggu

SEQ ID NO: 327498 - RNA, 19 nt, Homo sapiens
gaaguuaaggacauugaau

SEQ ID NO: 327499 - RNA, 19 nt, Homo sapiens
gaaccagucaguaaagcaa

SEQ ID NO: 327500 - RNA, 19 nt, Homo sapiens
gaagaacaacaguaaugau

SEQ ID NO: 327501 - RNA, 19 nt, Homo sapiens
ugaagaaccagucaguaaa

SEQ ID NO: 327502 - RNA, 19 nt, Homo sapiens
uagagucacuauccggaaa

SEQ ID NO: 327503 - RNA, 19 nt, Homo sapiens
gugaagcugucucaaacau

SEQ ID NO: 327504 - RNA, 19 nt, Homo sapiens
uuacaggaguuacuagagu

SEQ ID NO: 327505 - RNA, 19 nt, Homo sapiens
gaugaagaaccagucagua

SEQ ID NO: 327506 - RNA, 19 nt, Homo sapiens
cgaugaaacagguguagaa

SEQ ID NO: 327507 - RNA, 19 nt, Homo sapiens
ucacuauccggaaaucuaa

SEQ ID NO: 327508 - RNA, 19 nt, Homo sapiens
ugaagaacaacaguaauga

SEQ ID NO: 327509 - RNA, 19 nt, Homo sapiens
uuaaggacauugaauuggu

SEQ ID NO: 327510 - RNA, 19 nt, Homo sapiens
auccggaaaucuaagaaua

SEQ ID NO: 327511 - RNA, 19 nt, Homo sapiens
guaaaugcgauuauggaau

SEQ ID NO: 327512 - RNA, 19 nt, Homo sapiens
acagaaaccgucccugcua

SEQ ID NO: 327513 - RNA, 19 nt, Homo sapiens
gguuugaaauuuguacugu

SEQ ID NO: 327514 - RNA, 19 nt, Homo sapiens
gaauuggucaugucacaag

SEQ ID NO: 327515 - RNA, 19 nt, Homo sapiens
ggacauugaauuggucaug

SEQ ID NO: 327516 - RNA, 19 nt, Homo sapiens
agaggagagugaagaggaa

SEQ ID NO: 327517 - RNA, 19 nt, Homo sapiens
gcgauuauggaauuaacaa

SEQ ID NO: 327518 - RNA, 19 nt, Homo sapiens
aggaagaggucgaugaaac

SEQ ID NO: 327519 - RNA, 19 nt, Homo sapiens
uaacugcagcuugguuuga

SEQ ID NO: 327520 - RNA, 19 nt, Homo sapiens
ggaauuaacaauguaacca

SEQ ID NO: 327521 - RNA, 19 nt, Homo sapiens
augaagaaccagucaguaa

SEQ ID NO: 327522 - RNA, 19 nt, Homo sapiens
aaccagaugucuacaagag

SEQ ID NO: 327523 - RNA, 19 nt, Homo sapiens
acaagagcccugcuucaga

SEQ ID NO: 327524 - RNA, 19 nt, Homo sapiens
uguagaaguuaaggacauu

SEQ ID NO: 327525 - RNA, 19 nt, Homo sapiens
caagaucgaagauuuaucc

SEQ ID NO: 327526 - RNA, 19 nt, Homo sapiens
guguagaaguuaaggacau

SEQ ID NO: 327527 - RNA, 19 nt, Homo sapiens
gggaagccaagaucgaaga

SEQ ID NO: 327528 - RNA, 19 nt, Homo sapiens
cugaagaacaacaguaaug

SEQ ID NO: 327529 - RNA, 19 nt, Homo sapiens
gucacuauccggaaaucua

SEQ ID NO: 327530 - RNA, 19 nt, Homo sapiens
uccgagcccugaagaacaa

SEQ ID NO: 327531 - RNA, 19 nt, Homo sapiens
cugagaaauucaaaguuca

SEQ ID NO: 327532 - RNA, 19 nt, Homo sapiens
ccagcaagcacaacuagca

SEQ ID NO: 327533 - RNA, 19 nt, Homo sapiens
gccaagaucgaagauuuau

SEQ ID NO: 327534 - RNA, 19 nt, Homo sapiens
gcccugcuucagauacuua

SEQ ID NO: 327535 - RNA, 19 nt, Homo sapiens
ggaguuacuagagucacua

SEQ ID NO: 327536 - RNA, 19 nt, Homo sapiens
gaagccaagaucgaagauu

SEQ ID NO: 327537 - RNA, 19 nt, Homo sapiens
ugcuucagauacuuacaua

SEQ ID NO: 327538 - RNA, 19 nt, Homo sapiens
ccaggcaaccacacaacaa

SEQ ID NO: 327539 - RNA, 19 nt, Homo sapiens
gagcuugaagaacaggauu

SEQ ID NO: 327540 - RNA, 19 nt, Homo sapiens
gcaguccgagcccugaaga

SEQ ID NO: 327541 - RNA, 19 nt, Homo sapiens
gaggaagaggucgaugaaa

SEQ ID NO: 327542 - RNA, 19 nt, Homo sapiens
agaggaagaggucgaugaa

SEQ ID NO: 327543 - RNA, 19 nt, Homo sapiens
gcccugaagaacaacagua

SEQ ID NO: 327544 - RNA, 19 nt, Homo sapiens
aaggugaagcugucucaaa

SEQ ID NO: 327545 - RNA, 19 nt, Homo sapiens
gagcccugcuucagauacu

SEQ ID NO: 327546 - RNA, 19 nt, Homo sapiens
gaaaacacacagacuccaa

SEQ ID NO: 327547 - RNA, 19 nt, Homo sapiens
gacuccaacuguacaagag

SEQ ID NO: 327548 - RNA, 19 nt, Homo sapiens
agccaagaucgaagauuua

SEQ ID NO: 327549 - RNA, 19 nt, Homo sapiens
cuucagauacuuacauagu

SEQ ID NO: 327550 - RNA, 19 nt, Homo sapiens
guaacugcagcuugguuug

SEQ ID NO: 327551 - RNA, 19 nt, Homo sapiens
uugaauuggucaugucaca

SEQ ID NO: 327552 - RNA, 19 nt, Homo sapiens
uagaaguuaaggacauuga

SEQ ID NO: 327553 - RNA, 19 nt, Homo sapiens
gaugaaacagguguagaag

SEQ ID NO: 327554 - RNA, 19 nt, Homo sapiens
aagaggaagaggucgauga

SEQ ID NO: 327555 - RNA, 19 nt, Homo sapiens
cuacaagagcccugcuuca

SEQ ID NO: 327556 - RNA, 19 nt, Homo sapiens
gaguaacugcagcuugguu

SEQ ID NO: 327557 - RNA, 19 nt, Homo sapiens
acaauguaaccauauggaa

SEQ ID NO: 327558 - RNA, 19 nt, Homo sapiens
gaagaggucgaugaaacag

SEQ ID NO: 327559 - RNA, 19 nt, Homo sapiens
gaaucugacagugaugaau

SEQ ID NO: 327560 - RNA, 19 nt, Homo sapiens
acggaaggcuauguccaaa

SEQ ID NO: 327561 - RNA, 19 nt, Homo sapiens
ucacaaaaccagaugucua

SEQ ID NO: 327562 - RNA, 19 nt, Homo sapiens
uaacaauguaaccauaugg

SEQ ID NO: 327563 - RNA, 19 nt, Homo sapiens
agaaggcacggaaggcuau

SEQ ID NO: 327564 - RNA, 19 nt, Homo sapiens
gguuacaggaguuacuaga

SEQ ID NO: 327565 - RNA, 19 nt, Homo sapiens
guacaagaggagagugaag

SEQ ID NO: 327566 - RNA, 19 nt, Homo sapiens
uguaaaugcgauuauggaa

SEQ ID NO: 327567 - RNA, 19 nt, Homo sapiens
ugaagcugucucaaacauu

SEQ ID NO: 327568 - RNA, 19 nt, Homo sapiens
aggugaagcugucucaaac

SEQ ID NO: 327569 - RNA, 19 nt, Homo sapiens
ggaagccaagaucgaagau

SEQ ID NO: 327570 - RNA, 19 nt, Homo sapiens
cagguuacaggaguuacua

SEQ ID NO: 327571 - RNA, 19 nt, Homo sapiens
gaacuuuggucucagcuua

SEQ ID NO: 327572 - RNA, 19 nt, Homo sapiens
caacaaacaugccaucuau

SEQ ID NO: 327573 - RNA, 19 nt, Homo sapiens
ccaaagaacugcauaagug

SEQ ID NO: 327574 - RNA, 19 nt, Homo sapiens
gauugaagcuuuacugguu

SEQ ID NO: 327575 - RNA, 19 nt, Homo sapiens
acacauaccuaaacauuga

SEQ ID NO: 327576 - RNA, 19 nt, Homo sapiens
caagacacguuguuucgua

SEQ ID NO: 327577 - RNA, 19 nt, Homo sapiens
ggacauuuauucccuucua

SEQ ID NO: 327578 - RNA, 19 nt, Homo sapiens
ggacuugaccaauuaauuc

SEQ ID NO: 327579 - RNA, 19 nt, Homo sapiens
ggaaaugaguugagaccau

SEQ ID NO: 327580 - RNA, 19 nt, Homo sapiens
ucaaguaguuguaauaugg

SEQ ID NO: 327581 - RNA, 19 nt, Homo sapiens
guccaggaguugugucuua

SEQ ID NO: 327582 - RNA, 19 nt, Homo sapiens
gugcauagcucugccuuug

SEQ ID NO: 327583 - RNA, 19 nt, Homo sapiens
guucugagguccuuguauu

SEQ ID NO: 327584 - RNA, 19 nt, Homo sapiens
gcgcuucccucauggcauu

SEQ ID NO: 327585 - RNA, 19 nt, Homo sapiens
ucaguuaaauacagacuug

SEQ ID NO: 327586 - RNA, 19 nt, Homo sapiens
ccucugaccuugcuguuga

SEQ ID NO: 327587 - RNA, 19 nt, Homo sapiens
uuaauucccuuaccuuuca

SEQ ID NO: 327588 - RNA, 19 nt, Homo sapiens
gccuggacuugaccaauua

SEQ ID NO: 327589 - RNA, 19 nt, Homo sapiens
ggaacaccuucucuugcua

SEQ ID NO: 327590 - RNA, 19 nt, Homo sapiens
caaagugaccagaagauug

SEQ ID NO: 327591 - RNA, 19 nt, Homo sapiens
ucaagaaccuggagauguc

SEQ ID NO: 327592 - RNA, 19 nt, Homo sapiens
gcaccacacuggacaaggu

SEQ ID NO: 327593 - RNA, 19 nt, Homo sapiens
ggacaugggcuacacauac

SEQ ID NO: 327594 - RNA, 19 nt, Homo sapiens
gcugcaacauuaacuguga

SEQ ID NO: 327595 - RNA, 19 nt, Homo sapiens
auucaaaucucaccucuau

SEQ ID NO: 327596 - RNA, 19 nt, Homo sapiens
ggaguugugucuuaaaauu

SEQ ID NO: 327597 - RNA, 19 nt, Homo sapiens
gacacguuguuucguauuu

SEQ ID NO: 327598 - RNA, 19 nt, Homo sapiens
ccagagcgaugcugcugaa

SEQ ID NO: 327599 - RNA, 19 nt, Homo sapiens
gacagaagccuaccucauc

SEQ ID NO: 327600 - RNA, 19 nt, Homo sapiens
caaagaacugcauaaguga

SEQ ID NO: 327601 - RNA, 19 nt, Homo sapiens
ccaguuaggaaugcaauua

SEQ ID NO: 327602 - RNA, 19 nt, Homo sapiens
cgaauuaggaguagagaga

SEQ ID NO: 327603 - RNA, 19 nt, Homo sapiens
ggagaugucccagcaguga

SEQ ID NO: 327604 - RNA, 19 nt, Homo sapiens
ucccucaggucaccaauaa

SEQ ID NO: 327605 - RNA, 19 nt, Homo sapiens
gcuguugacucugaaauca

SEQ ID NO: 327606 - RNA, 19 nt, Homo sapiens
gcaggaccgauaugccuua

SEQ ID NO: 327607 - RNA, 19 nt, Homo sapiens
gauccacgccuaagguuga

SEQ ID NO: 327608 - RNA, 19 nt, Homo sapiens
ugucuuuacuugcuguaua

SEQ ID NO: 327609 - RNA, 19 nt, Homo sapiens
ggucucagcuuagagcaau

SEQ ID NO: 327610 - RNA, 19 nt, Homo sapiens
cuacacauaccuaaacauu

SEQ ID NO: 327611 - RNA, 19 nt, Homo sapiens
ccacagaccugcguaccau

SEQ ID NO: 327612 - RNA, 19 nt, Homo sapiens
cuacucaggugacaucauc

SEQ ID NO: 327613 - RNA, 19 nt, Homo sapiens
cccaagcgcuucccucaug

SEQ ID NO: 327614 - RNA, 19 nt, Homo sapiens
guucuugccugucuugcuu

SEQ ID NO: 327615 - RNA, 19 nt, Homo sapiens
gcguaaacccucuuggaaa

SEQ ID NO: 327616 - RNA, 19 nt, Homo sapiens
gagcgaugcugcugaagac

SEQ ID NO: 327617 - RNA, 19 nt, Homo sapiens
uuccagagcccaacacaua

SEQ ID NO: 327618 - RNA, 19 nt, Homo sapiens
gucuuuacuugcuguauaa

SEQ ID NO: 327619 - RNA, 19 nt, Homo sapiens
cuacaugucuuuacuugcu

SEQ ID NO: 327620 - RNA, 19 nt, Homo sapiens
ggaaggcuuugugggaaau

SEQ ID NO: 327621 - RNA, 19 nt, Homo sapiens
guauuuaggguauggugua

SEQ ID NO: 327622 - RNA, 19 nt, Homo sapiens
ccgggucugugauauauga

SEQ ID NO: 327623 - RNA, 19 nt, Homo sapiens
ggaaugacccugacaugcu

SEQ ID NO: 327624 - RNA, 19 nt, Homo sapiens
gggaacaccuucucuugcu

SEQ ID NO: 327625 - RNA, 19 nt, Homo sapiens
ggacagaagccuaccucau

SEQ ID NO: 327626 - RNA, 19 nt, Homo sapiens
ucuugaggcuguugagaaa

SEQ ID NO: 327627 - RNA, 19 nt, Homo sapiens
gauggugacaacacaauga

SEQ ID NO: 327628 - RNA, 19 nt, Homo sapiens
caucauacccaaagugcaa

SEQ ID NO: 327629 - RNA, 19 nt, Homo sapiens
agaauccacucaugaucaa

SEQ ID NO: 327630 - RNA, 19 nt, Homo sapiens
gacauuuauucccuucuau

SEQ ID NO: 327631 - RNA, 19 nt, Homo sapiens
cuacagggcacuugucuuc

SEQ ID NO: 327632 - RNA, 19 nt, Homo sapiens
caccgggucugugauauau

SEQ ID NO: 327633 - RNA, 19 nt, Homo sapiens
ucaacaaacaugccaucua

SEQ ID NO: 327634 - RNA, 19 nt, Homo sapiens
gauggcugcugcccugaau

SEQ ID NO: 327635 - RNA, 19 nt, Homo sapiens
cgcuuccgcugcaacauua

SEQ ID NO: 327636 - RNA, 19 nt, Homo sapiens
ggguaacagucaaagugaa

SEQ ID NO: 327637 - RNA, 19 nt, Homo sapiens
gauuguacuuccuagagau

SEQ ID NO: 327638 - RNA, 19 nt, Homo sapiens
ucaaaucucaccucuaugg

SEQ ID NO: 327639 - RNA, 19 nt, Homo sapiens
cguaaacccucuuggaaac

SEQ ID NO: 327640 - RNA, 19 nt, Homo sapiens
guaccuguaucccaucaag

SEQ ID NO: 327641 - RNA, 19 nt, Homo sapiens
ucaguggccuccgagauga

SEQ ID NO: 327642 - RNA, 19 nt, Homo sapiens
gacgcaggauucacaagga

SEQ ID NO: 327643 - RNA, 19 nt, Homo sapiens
gugaugaggacccaaagaa

SEQ ID NO: 327644 - RNA, 19 nt, Homo sapiens
ugauugauccuaucucuuc

SEQ ID NO: 327645 - RNA, 19 nt, Homo sapiens
ucaccucuauggaugaugu

SEQ ID NO: 327646 - RNA, 19 nt, Homo sapiens
uaaacccucuuggaaacuu

SEQ ID NO: 327647 - RNA, 19 nt, Homo sapiens
gaguugagccuggacuuga

SEQ ID NO: 327648 - RNA, 19 nt, Homo sapiens
ucugagguccuuguauuua

SEQ ID NO: 327649 - RNA, 19 nt, Homo sapiens
aaagugaccagaagauugu

SEQ ID NO: 327650 - RNA, 19 nt, Homo sapiens
ccaauuaauucccuuaccu

SEQ ID NO: 327651 - RNA, 19 nt, Homo sapiens
gagagcuaguggcagagaa

SEQ ID NO: 327652 - RNA, 19 nt, Homo sapiens
cccaagcccuccucuuuua

SEQ ID NO: 327653 - RNA, 19 nt, Homo sapiens
gauggguucuugccugucu

SEQ ID NO: 327654 - RNA, 19 nt, Homo sapiens
ccaaagugaccagaagauu

SEQ ID NO: 327655 - RNA, 19 nt, Homo sapiens
ggacucugguggcacuaca

SEQ ID NO: 327656 - RNA, 19 nt, Homo sapiens
ccuguucuuuaaucaagua

SEQ ID NO: 327657 - RNA, 19 nt, Homo sapiens
ggucaccaauaaaccuguu

SEQ ID NO: 327658 - RNA, 19 nt, Homo sapiens
cagaauccacucaugauca

SEQ ID NO: 327659 - RNA, 19 nt, Homo sapiens
gaagguagacaugcucaag

SEQ ID NO: 327660 - RNA, 19 nt, Homo sapiens
gaguugagaccauggacuu

SEQ ID NO: 327661 - RNA, 19 nt, Homo sapiens
ggguggaucucccauacuc

SEQ ID NO: 327662 - RNA, 19 nt, Homo sapiens
caacacauacagcugauac

SEQ ID NO: 327663 - RNA, 19 nt, Homo sapiens
ugugaggucugacauccaa

SEQ ID NO: 327664 - RNA, 19 nt, Homo sapiens
guccuuguauuuaggguau

SEQ ID NO: 327665 - RNA, 19 nt, Homo sapiens
acaaugaggccaaguagca

SEQ ID NO: 327666 - RNA, 19 nt, Homo sapiens
ugaccuugcuguugacucu

SEQ ID NO: 327667 - RNA, 19 nt, Homo sapiens
aaucaaccaggaucccuua

SEQ ID NO: 327668 - RNA, 19 nt, Homo sapiens
gcagaauccacucaugauc

SEQ ID NO: 327669 - RNA, 19 nt, Homo sapiens
ggacccaaagaacugcaua

SEQ ID NO: 327670 - RNA, 19 nt, Homo sapiens
gaacgcuuccgcugcaaca

SEQ ID NO: 327671 - RNA, 19 nt, Homo sapiens
ggacagacaucacaggaua

SEQ ID NO: 327672 - RNA, 19 nt, Homo sapiens
caaccgaucugauguguuu

SEQ ID NO: 327673 - RNA, 19 nt, Homo sapiens
gcacagaccacaucuaugg

SEQ ID NO: 327674 - RNA, 19 nt, Homo sapiens
gagcuggccucccuguuga

SEQ ID NO: 327675 - RNA, 19 nt, Homo sapiens
ggaaguuauuugcguguga

SEQ ID NO: 327676 - RNA, 19 nt, Homo sapiens
gagcaggccuucguucuca

SEQ ID NO: 327677 - RNA, 19 nt, Homo sapiens
ugcgagagcugaucaaaga

SEQ ID NO: 327678 - RNA, 19 nt, Homo sapiens
ucacgaagaugggcaguug

SEQ ID NO: 327679 - RNA, 19 nt, Homo sapiens
gaaguuauuugcgugugaa

SEQ ID NO: 327680 - RNA, 19 nt, Homo sapiens
aggcagagaucaaugaguu

SEQ ID NO: 327681 - RNA, 19 nt, Homo sapiens
cagaaugugugcacgcaaa

SEQ ID NO: 327682 - RNA, 19 nt, Homo sapiens
ccaagggaguauccuggua

SEQ ID NO: 327683 - RNA, 19 nt, Homo sapiens
agaacgaaguggucuauuc

SEQ ID NO: 327684 - RNA, 19 nt, Homo sapiens
gaacggaggcccagaagcu

SEQ ID NO: 327685 - RNA, 19 nt, Homo sapiens
gagagcugaucaaagaguu

SEQ ID NO: 327686 - RNA, 19 nt, Homo sapiens
agagaucaaugaguucuuu

SEQ ID NO: 327687 - RNA, 19 nt, Homo sapiens
gcuaccagcugaccuugug

SEQ ID NO: 327688 - RNA, 19 nt, Homo sapiens
gggcaucccuuuccaacag

SEQ ID NO: 327689 - RNA, 19 nt, Homo sapiens
guaccgcuauuaccagaau

SEQ ID NO: 327690 - RNA, 19 nt, Homo sapiens
gagcagcggcagucaguga

SEQ ID NO: 327691 - RNA, 19 nt, Homo sapiens
gcaacauccuggacuaugc

SEQ ID NO: 327692 - RNA, 19 nt, Homo sapiens
caacagcaccaguuugaca

SEQ ID NO: 327693 - RNA, 19 nt, Homo sapiens
ggccaugacugcaguggau

SEQ ID NO: 327694 - RNA, 19 nt, Homo sapiens
gggccgacacuuucaauga

SEQ ID NO: 327695 - RNA, 19 nt, Homo sapiens
gcgccuaccugagcaagga

SEQ ID NO: 327696 - RNA, 19 nt, Homo sapiens
caacagguaccgcuauuac

SEQ ID NO: 327697 - RNA, 19 nt, Homo sapiens
gagaucaaugaguucuuua

SEQ ID NO: 327698 - RNA, 19 nt, Homo sapiens
caaagugugggauuaaagu

SEQ ID NO: 327699 - RNA, 19 nt, Homo sapiens
ggccgucccuacagaugaa

SEQ ID NO: 327700 - RNA, 19 nt, Homo sapiens
gaacgaaguggucuauucc

SEQ ID NO: 327701 - RNA, 19 nt, Homo sapiens
acgaggugcuggcuaguga

SEQ ID NO: 327702 - RNA, 19 nt, Homo sapiens
gaugguuggauggaaguua

SEQ ID NO: 327703 - RNA, 19 nt, Homo sapiens
ccaccacugccgucuauga

SEQ ID NO: 327704 - RNA, 19 nt, Homo sapiens
gccgacacuuucaaugaga

SEQ ID NO: 327705 - RNA, 19 nt, Homo sapiens
gguguucccucaggucaau

SEQ ID NO: 327706 - RNA, 19 nt, Homo sapiens
ggacccagugccagauuug

SEQ ID NO: 327707 - RNA, 19 nt, Homo sapiens
ggccgacacuuucaaugag

SEQ ID NO: 327708 - RNA, 19 nt, Homo sapiens
gcacgcaaagcuacuccuu

SEQ ID NO: 327709 - RNA, 19 nt, Homo sapiens
ccaacagguaccgcuauua

SEQ ID NO: 327710 - RNA, 19 nt, Homo sapiens
gagcuggacagacaucaca

SEQ ID NO: 327711 - RNA, 19 nt, Homo sapiens
guacaaccgaucugaugug

SEQ ID NO: 327712 - RNA, 19 nt, Homo sapiens
cuggucagcuuguacuaug

SEQ ID NO: 327713 - RNA, 19 nt, Homo sapiens
uggcacagaccacaucuau

SEQ ID NO: 327714 - RNA, 19 nt, Homo sapiens
gcugggagcgagagauaga

SEQ ID NO: 327715 - RNA, 19 nt, Homo sapiens
ggauuaaaguacuguuuuc

SEQ ID NO: 327716 - RNA, 19 nt, Homo sapiens
cuguggaccuggccaagaa

SEQ ID NO: 327717 - RNA, 19 nt, Homo sapiens
cccaacagguaccgcuauu

SEQ ID NO: 327718 - RNA, 19 nt, Homo sapiens
gacagacaucacaggauaa

SEQ ID NO: 327719 - RNA, 19 nt, Homo sapiens
aaagugugggauuaaagua

SEQ ID NO: 327720 - RNA, 19 nt, Homo sapiens
aaggcaacauccuggacua

SEQ ID NO: 327721 - RNA, 19 nt, Homo sapiens
uagacuggauggcgcugaa

SEQ ID NO: 327722 - RNA, 19 nt, Homo sapiens
uccaacagcaccaguuuga

SEQ ID NO: 327723 - RNA, 19 nt, Homo sapiens
cuacugcuccggagugugu

SEQ ID NO: 327724 - RNA, 19 nt, Homo sapiens
gaucaaugaguucuuuacu

SEQ ID NO: 327725 - RNA, 19 nt, Homo sapiens
ccaccacugggccuuguuu

SEQ ID NO: 327726 - RNA, 19 nt, Homo sapiens
ccagaacgaaguggucuau

SEQ ID NO: 327727 - RNA, 19 nt, Homo sapiens
ggaccuggccaagaagauc

SEQ ID NO: 327728 - RNA, 19 nt, Homo sapiens
gagagccagccuguguaua

SEQ ID NO: 327729 - RNA, 19 nt, Homo sapiens
gcaguuggggccacuuuaa

SEQ ID NO: 327730 - RNA, 19 nt, Homo sapiens
ccaaagugugggauuaaag

SEQ ID NO: 327731 - RNA, 19 nt, Homo sapiens
gcuaauuccagggcagauu

SEQ ID NO: 327732 - RNA, 19 nt, Homo sapiens
ggagcaggccuucguucuc

SEQ ID NO: 327733 - RNA, 19 nt, Homo sapiens
gguacaaccgaucugaugu

SEQ ID NO: 327734 - RNA, 19 nt, Homo sapiens
gcagagaucaaugaguucu

SEQ ID NO: 327735 - RNA, 19 nt, Homo sapiens
gcaggacugagaccaugga

SEQ ID NO: 327736 - RNA, 19 nt, Homo sapiens
gggcaucagccagaacgaa

SEQ ID NO: 327737 - RNA, 19 nt, Homo sapiens
uacaaccgaucugaugugu

SEQ ID NO: 327738 - RNA, 19 nt, Homo sapiens
ugagagccagccuguguau

SEQ ID NO: 327739 - RNA, 19 nt, Homo sapiens
ccucagagcccuccuaccu

SEQ ID NO: 327740 - RNA, 19 nt, Homo sapiens
gggauuaaaguacuguuuu

SEQ ID NO: 327741 - RNA, 19 nt, Homo sapiens
gaucuuccucaaauauuac

SEQ ID NO: 327742 - RNA, 19 nt, Homo sapiens
agccaccacugccgucuau

SEQ ID NO: 327743 - RNA, 19 nt, Homo sapiens
gcuccaaggcuggcucuuc

SEQ ID NO: 327744 - RNA, 19 nt, Homo sapiens
caucaucgggagccucuuc

SEQ ID NO: 327745 - RNA, 19 nt, Homo sapiens
ggaagaaacugaaggaagu

SEQ ID NO: 327746 - RNA, 19 nt, Homo sapiens
gaggagagaucauugcaaa

SEQ ID NO: 327747 - RNA, 19 nt, Homo sapiens
uagaaacgcuuaagcaguu

SEQ ID NO: 327748 - RNA, 19 nt, Homo sapiens
ggaggaagcuucgcagguu

SEQ ID NO: 327749 - RNA, 19 nt, Homo sapiens
gagagagccugccggauga

SEQ ID NO: 327750 - RNA, 19 nt, Homo sapiens
cgagaccucugaauuugua

SEQ ID NO: 327751 - RNA, 19 nt, Homo sapiens
gaaacugaaggaaguauuu

SEQ ID NO: 327752 - RNA, 19 nt, Homo sapiens
gaagaccacugaaagucaa

SEQ ID NO: 327753 - RNA, 19 nt, Homo sapiens
gaauaggcacuguuacuuu

SEQ ID NO: 327754 - RNA, 19 nt, Homo sapiens
caaagaagauccugauggu

SEQ ID NO: 327755 - RNA, 19 nt, Homo sapiens
ggaagaugcuaaaggacaa

SEQ ID NO: 327756 - RNA, 19 nt, Homo sapiens
gaagagaggagagaucauu

SEQ ID NO: 327757 - RNA, 19 nt, Homo sapiens
aaacaugggucgauuugga

SEQ ID NO: 327758 - RNA, 19 nt, Homo sapiens
gaugugcuguuguugaauu

SEQ ID NO: 327759 - RNA, 19 nt, Homo sapiens
ggcauaggauuuggaauaa

SEQ ID NO: 327760 - RNA, 19 nt, Homo sapiens
uaacauacguggagcucuu

SEQ ID NO: 327761 - RNA, 19 nt, Homo sapiens
gaaauggcagucacuuaaa

SEQ ID NO: 327762 - RNA, 19 nt, Homo sapiens
gcaaucgcuuugagccaua

SEQ ID NO: 327763 - RNA, 19 nt, Homo sapiens
gaauaaaggcaucggaaug

SEQ ID NO: 327764 - RNA, 19 nt, Homo sapiens
ugaaauggcagucacuuaa

SEQ ID NO: 327765 - RNA, 19 nt, Homo sapiens
gaauugauagaaacgcuua

SEQ ID NO: 327766 - RNA, 19 nt, Homo sapiens
gagauugacguucgaauug

SEQ ID NO: 327767 - RNA, 19 nt, Homo sapiens
cauggaagaugcuaaagga

SEQ ID NO: 327768 - RNA, 19 nt, Homo sapiens
gaacaugccaggagagcaa

SEQ ID NO: 327769 - RNA, 19 nt, Homo sapiens
gggaugugcuguuguugaa

SEQ ID NO: 327770 - RNA, 19 nt, Homo sapiens
ugacaucgaauaugacuuu

SEQ ID NO: 327771 - RNA, 19 nt, Homo sapiens
gauacgagaccucugaauu

SEQ ID NO: 327772 - RNA, 19 nt, Homo sapiens
ugagaaaucugccauucga

SEQ ID NO: 327773 - RNA, 19 nt, Homo sapiens
ccaaucaccugaauaaagg

SEQ ID NO: 327774 - RNA, 19 nt, Homo sapiens
ccacauggccuccagcauu

SEQ ID NO: 327775 - RNA, 19 nt, Homo sapiens
gaacaugggcaggauaaau

SEQ ID NO: 327776 - RNA, 19 nt, Homo sapiens
caagcuauaucuauguuca

SEQ ID NO: 327777 - RNA, 19 nt, Homo sapiens
caacaucccaaaugagauu

SEQ ID NO: 327778 - RNA, 19 nt, Homo sapiens
gcccaggaaugauuacuau

SEQ ID NO: 327779 - RNA, 19 nt, Homo sapiens
ccauuugacuguuugcauu

SEQ ID NO: 327780 - RNA, 19 nt, Homo sapiens
gaaggaaguauuuaguaug

SEQ ID NO: 327781 - RNA, 19 nt, Homo sapiens
caucgaauaugacuuugau

SEQ ID NO: 327782 - RNA, 19 nt, Homo sapiens
gaugaugaauggcaugaag

SEQ ID NO: 327783 - RNA, 19 nt, Homo sapiens
gcauaggauuuggaauaaa

SEQ ID NO: 327784 - RNA, 19 nt, Homo sapiens
gaagaaacugaaggaagua

SEQ ID NO: 327785 - RNA, 19 nt, Homo sapiens
cacccaguauccuaaauaa

SEQ ID NO: 327786 - RNA, 19 nt, Homo sapiens
ggaauaggcacuguuacuu

SEQ ID NO: 327787 - RNA, 19 nt, Homo sapiens
ggaagaccacugaaaguca

SEQ ID NO: 327788 - RNA, 19 nt, Homo sapiens
agaacgaccugcucagaau

SEQ ID NO: 327789 - RNA, 19 nt, Homo sapiens
auacgagaccucugaauuu

SEQ ID NO: 327790 - RNA, 19 nt, Homo sapiens
ggccagcugcuauuugaua

SEQ ID NO: 327791 - RNA, 19 nt, Homo sapiens
aaaguuggcuggaagaaac

SEQ ID NO: 327792 - RNA, 19 nt, Homo sapiens
gagaacgaccugcucagaa

SEQ ID NO: 327793 - RNA, 19 nt, Homo sapiens
uuuguuggcuggauguaua

SEQ ID NO: 327794 - RNA, 19 nt, Homo sapiens
cacauggccuccagcauug

SEQ ID NO: 327795 - RNA, 19 nt, Homo sapiens
gaaggcauaggauuuggaa

SEQ ID NO: 327796 - RNA, 19 nt, Homo sapiens
auacagagccuucauuaca

SEQ ID NO: 327797 - RNA, 19 nt, Homo sapiens
gaaggccugccagauauuu

SEQ ID NO: 327798 - RNA, 19 nt, Homo sapiens
gauggagcguggcaacuuc

SEQ ID NO: 327799 - RNA, 19 nt, Homo sapiens
aggcauaggauuuggaaua

SEQ ID NO: 327800 - RNA, 19 nt, Homo sapiens
gaauggaaggcauaggauu

SEQ ID NO: 327801 - RNA, 19 nt, Homo sapiens
gagcggaagaccacugaaa

SEQ ID NO: 327802 - RNA, 19 nt, Homo sapiens
acagagccuucauuacaaa

SEQ ID NO: 327803 - RNA, 19 nt, Homo sapiens
ucacuuaaagaccugguua

SEQ ID NO: 327804 - RNA, 19 nt, Homo sapiens
uacagagccuucauuacaa

SEQ ID NO: 327805 - RNA, 19 nt, Homo sapiens
uacgagaccucugaauuug

SEQ ID NO: 327806 - RNA, 19 nt, Homo sapiens
gauggaagagagcaugaaa

SEQ ID NO: 327807 - RNA, 19 nt, Homo sapiens
agauacagagccuucauua

SEQ ID NO: 327808 - RNA, 19 nt, Homo sapiens
ucacauggaagaugcuaaa

SEQ ID NO: 327809 - RNA, 19 nt, Homo sapiens
aggaaggccugccagauau

SEQ ID NO: 327810 - RNA, 19 nt, Homo sapiens
gagagaucauugcaaagca

SEQ ID NO: 327811 - RNA, 19 nt, Homo sapiens
gaugagagggccuuaccaa

SEQ ID NO: 327812 - RNA, 19 nt, Homo sapiens
ggaagcacaguauuuguag

SEQ ID NO: 327813 - RNA, 19 nt, Homo sapiens
ccacccaguauccuaaaua

SEQ ID NO: 327814 - RNA, 19 nt, Homo sapiens
uaaauaccgguuccugaaa

SEQ ID NO: 327815 - RNA, 19 nt, Homo sapiens
gccaaucaccugaauaaag

SEQ ID NO: 327816 - RNA, 19 nt, Homo sapiens
ggagaacgaccugcucaga

SEQ ID NO: 327817 - RNA, 19 nt, Homo sapiens
ugagauuauccaugcauua

SEQ ID NO: 327818 - RNA, 19 nt, Homo sapiens
cgauuuggaucugggauga

SEQ ID NO: 327819 - RNA, 19 nt, Homo sapiens
cuauaucuauguucaaugg

SEQ ID NO: 327820 - RNA, 19 nt, Homo sapiens
gggaauggaaggcauagga

SEQ ID NO: 327821 - RNA, 19 nt, Homo sapiens
caucggaaugggaaacaua

SEQ ID NO: 327822 - RNA, 19 nt, Homo sapiens
caaugcacgucaagaugga

SEQ ID NO: 327823 - RNA, 19 nt, Homo sapiens
gauuauccaugcauuacag

SEQ ID NO: 327824 - RNA, 19 nt, Homo sapiens
ccagguggcccaggaauga

SEQ ID NO: 327825 - RNA, 19 nt, Homo sapiens
gaacgaccugcucagaaug

SEQ ID NO: 327826 - RNA, 19 nt, Homo sapiens
gaaguccuaaacaagcaua

SEQ ID NO: 327827 - RNA, 19 nt, Homo sapiens
gaaaacaugggucgauuug

SEQ ID NO: 327828 - RNA, 19 nt, Homo sapiens
aaggaaguauuuaguaugg

SEQ ID NO: 327829 - RNA, 19 nt, Homo sapiens
cgacggagaucaaaaugga

SEQ ID NO: 327830 - RNA, 19 nt, Homo sapiens
agaagauccugauggugaa

SEQ ID NO: 327831 - RNA, 19 nt, Homo sapiens
gaccucugaauuuguauuu

SEQ ID NO: 327832 - RNA, 19 nt, Homo sapiens
gauugacguucgaauugau

SEQ ID NO: 327833 - RNA, 19 nt, Homo sapiens
gaugcuaaaggacaaauuc

SEQ ID NO: 327834 - RNA, 19 nt, Homo sapiens
cauaugccaauccaacuaa

SEQ ID NO: 327835 - RNA, 19 nt, Homo sapiens
ggagggcaacccauugaug

SEQ ID NO: 327836 - RNA, 19 nt, Homo sapiens
uggaagcacaguauuugua

SEQ ID NO: 327837 - RNA, 19 nt, Homo sapiens
cuaaacaagcauagucuga

SEQ ID NO: 327838 - RNA, 19 nt, Homo sapiens
ggaaggccugccagauauu

SEQ ID NO: 327839 - RNA, 19 nt, Homo sapiens
gcacugaagagaggagaga

SEQ ID NO: 327840 - RNA, 19 nt, Homo sapiens
cguggaauaggcacuguua

SEQ ID NO: 327841 - RNA, 19 nt, Homo sapiens
cugcggaaguccuaaacaa

SEQ ID NO: 327842 - RNA, 19 nt, Homo sapiens
uaaagaccugguuaaagaa

SEQ ID NO: 327843 - RNA, 19 nt, Homo sapiens
gaugaacaugggcaggaua

SEQ ID NO: 327844 - RNA, 19 nt, Homo sapiens
ggaugaacaugggcaggau

SEQ ID NO: 327845 - RNA, 19 nt, Homo sapiens
ggaagaaacugaaggaagu

SEQ ID NO: 327846 - RNA, 19 nt, Homo sapiens
gaggagagaucauugcaaa

SEQ ID NO: 327847 - RNA, 19 nt, Homo sapiens
uagaaacgcuuaagcaguu

SEQ ID NO: 327848 - RNA, 19 nt, Homo sapiens
ggaggaagcuucgcagguu

SEQ ID NO: 327849 - RNA, 19 nt, Homo sapiens
gagagagccugccggauga

SEQ ID NO: 327850 - RNA, 19 nt, Homo sapiens
cgagaccucugaauuugua

SEQ ID NO: 327851 - RNA, 19 nt, Homo sapiens
gaaacugaaggaaguauuu

SEQ ID NO: 327852 - RNA, 19 nt, Homo sapiens
gaauaggcacuguuacuuu

SEQ ID NO: 327853 - RNA, 19 nt, Homo sapiens
caaagaagauccugauggu

SEQ ID NO: 327854 - RNA, 19 nt, Homo sapiens
ggaagaugcuaaaggacaa

SEQ ID NO: 327855 - RNA, 19 nt, Homo sapiens
gaagagaggagagaucauu

SEQ ID NO: 327856 - RNA, 19 nt, Homo sapiens
aaacaugggucgauuugga

SEQ ID NO: 327857 - RNA, 19 nt, Homo sapiens
gaugugcuguuguugaauu

SEQ ID NO: 327858 - RNA, 19 nt, Homo sapiens
ggcauaggauuuggaauaa

SEQ ID NO: 327859 - RNA, 19 nt, Homo sapiens
uaacauacguggagcucuu

SEQ ID NO: 327860 - RNA, 19 nt, Homo sapiens
gaaauggcagucacuuaaa

SEQ ID NO: 327861 - RNA, 19 nt, Homo sapiens
gcaaucgcuuugagccaua

SEQ ID NO: 327862 - RNA, 19 nt, Homo sapiens
gaauaaaggcaucggaaug

SEQ ID NO: 327863 - RNA, 19 nt, Homo sapiens
gcaaaaggcuggaagacuu

SEQ ID NO: 327864 - RNA, 19 nt, Homo sapiens
ugaaauggcagucacuuaa

SEQ ID NO: 327865 - RNA, 19 nt, Homo sapiens
gaauugauagaaacgcuua

SEQ ID NO: 327866 - RNA, 19 nt, Homo sapiens
gagauugacguucgaauug

SEQ ID NO: 327867 - RNA, 19 nt, Homo sapiens
cauggaagaugcuaaagga

SEQ ID NO: 327868 - RNA, 19 nt, Homo sapiens
gggaugugcuguuguugaa

SEQ ID NO: 327869 - RNA, 19 nt, Homo sapiens
ugacaucgaauaugacuuu

SEQ ID NO: 327870 - RNA, 19 nt, Homo sapiens
gauacgagaccucugaauu

SEQ ID NO: 327871 - RNA, 19 nt, Homo sapiens
ugagaaaucugccauucga

SEQ ID NO: 327872 - RNA, 19 nt, Homo sapiens
ccaaucaccugaauaaagg

SEQ ID NO: 327873 - RNA, 19 nt, Homo sapiens
ccacauggccuccagcauu

SEQ ID NO: 327874 - RNA, 19 nt, Homo sapiens
gaacaugggcaggauaaau

SEQ ID NO: 327875 - RNA, 19 nt, Homo sapiens
caagcuauaucuauguuca

SEQ ID NO: 327876 - RNA, 19 nt, Homo sapiens
ccauuugacuguuugcauu

SEQ ID NO: 327877 - RNA, 19 nt, Homo sapiens
gaaggaaguauuuaguaug

SEQ ID NO: 327878 - RNA, 19 nt, Homo sapiens
caucgaauaugacuuugau

SEQ ID NO: 327879 - RNA, 19 nt, Homo sapiens
gaugaugaauggcaugaag

SEQ ID NO: 327880 - RNA, 19 nt, Homo sapiens
gcauaggauuuggaauaaa

SEQ ID NO: 327881 - RNA, 19 nt, Homo sapiens
gaagaaacugaaggaagua

SEQ ID NO: 327882 - RNA, 19 nt, Homo sapiens
ggaauaggcacuguuacuu

SEQ ID NO: 327883 - RNA, 19 nt, Homo sapiens
agaacgaccugcucagaau

SEQ ID NO: 327884 - RNA, 19 nt, Homo sapiens
auacgagaccucugaauuu

SEQ ID NO: 327885 - RNA, 19 nt, Homo sapiens
ggccagcugcuauuugaua

SEQ ID NO: 327886 - RNA, 19 nt, Homo sapiens
gagaacgaccugcucagaa

SEQ ID NO: 327887 - RNA, 19 nt, Homo sapiens
aaaguuggcuggaagaaac

SEQ ID NO: 327888 - RNA, 19 nt, Homo sapiens
uuuguuggcuggauguaua

SEQ ID NO: 327889 - RNA, 19 nt, Homo sapiens
cacauggccuccagcauug

SEQ ID NO: 327890 - RNA, 19 nt, Homo sapiens
gaaggcauaggauuuggaa

SEQ ID NO: 327891 - RNA, 19 nt, Homo sapiens
auacagagccuucauuaca

SEQ ID NO: 327892 - RNA, 19 nt, Homo sapiens
gaaggccugccagauauuu

SEQ ID NO: 327893 - RNA, 19 nt, Homo sapiens
gauggagcguggcaacuuc

SEQ ID NO: 327894 - RNA, 19 nt, Homo sapiens
aggcauaggauuuggaaua

SEQ ID NO: 327895 - RNA, 19 nt, Homo sapiens
gaauggaaggcauaggauu

SEQ ID NO: 327896 - RNA, 19 nt, Homo sapiens
acagagccuucauuacaaa

SEQ ID NO: 327897 - RNA, 19 nt, Homo sapiens
ucacuuaaagaccugguua

SEQ ID NO: 327898 - RNA, 19 nt, Homo sapiens
uacagagccuucauuacaa

SEQ ID NO: 327899 - RNA, 19 nt, Homo sapiens
uacgagaccucugaauuug

SEQ ID NO: 327900 - RNA, 19 nt, Homo sapiens
gauggaagagagcaugaaa

SEQ ID NO: 327901 - RNA, 19 nt, Homo sapiens
agauacagagccuucauua

SEQ ID NO: 327902 - RNA, 19 nt, Homo sapiens
ucacauggaagaugcuaaa

SEQ ID NO: 327903 - RNA, 19 nt, Homo sapiens
aggaaggccugccagauau

SEQ ID NO: 327904 - RNA, 19 nt, Homo sapiens
gagagaucauugcaaagca

SEQ ID NO: 327905 - RNA, 19 nt, Homo sapiens
gaugagagggccuuaccaa

SEQ ID NO: 327906 - RNA, 19 nt, Homo sapiens
ggaagcacaguauuuguag

SEQ ID NO: 327907 - RNA, 19 nt, Homo sapiens
uaaauaccgguuccugaaa

SEQ ID NO: 327908 - RNA, 19 nt, Homo sapiens
ggagaacgaccugcucaga

SEQ ID NO: 327909 - RNA, 19 nt, Homo sapiens
gccaaucaccugaauaaag

SEQ ID NO: 327910 - RNA, 19 nt, Homo sapiens
cgauuuggaucugggauga

SEQ ID NO: 327911 - RNA, 19 nt, Homo sapiens
cuauaucuauguucaaugg

SEQ ID NO: 327912 - RNA, 19 nt, Homo sapiens
cacugaaggucaaagaaga

SEQ ID NO: 327913 - RNA, 19 nt, Homo sapiens
gggaauggaaggcauagga

SEQ ID NO: 327914 - RNA, 19 nt, Homo sapiens
caucggaaugggaaacaua

SEQ ID NO: 327915 - RNA, 19 nt, Homo sapiens
caaugcacgucaagaugga

SEQ ID NO: 327916 - RNA, 19 nt, Homo sapiens
gaacgaccugcucagaaug

SEQ ID NO: 327917 - RNA, 19 nt, Homo sapiens
gaaguccuaaacaagcaua

SEQ ID NO: 327918 - RNA, 19 nt, Homo sapiens
gaaaacaugggucgauuug

SEQ ID NO: 327919 - RNA, 19 nt, Homo sapiens
aaggaaguauuuaguaugg

SEQ ID NO: 327920 - RNA, 19 nt, Homo sapiens
cgacggagaucaaaaugga

SEQ ID NO: 327921 - RNA, 19 nt, Homo sapiens
agaagauccugauggugaa

SEQ ID NO: 327922 - RNA, 19 nt, Homo sapiens
gaccucugaauuuguauuu

SEQ ID NO: 327923 - RNA, 19 nt, Homo sapiens
cauaugccaauccaacuaa

SEQ ID NO: 327924 - RNA, 19 nt, Homo sapiens
gauugacguucgaauugau

SEQ ID NO: 327925 - RNA, 19 nt, Homo sapiens
gaugcuaaaggacaaauuc

SEQ ID NO: 327926 - RNA, 19 nt, Homo sapiens
ggagggcaacccauugaug

SEQ ID NO: 327927 - RNA, 19 nt, Homo sapiens
uggaagcacaguauuugua

SEQ ID NO: 327928 - RNA, 19 nt, Homo sapiens
ggucaaagaagauccugau

SEQ ID NO: 327929 - RNA, 19 nt, Homo sapiens
cuaaacaagcauagucuga

SEQ ID NO: 327930 - RNA, 19 nt, Homo sapiens
ggaaggccugccagauauu

SEQ ID NO: 327931 - RNA, 19 nt, Homo sapiens
gcacugaagagaggagaga

SEQ ID NO: 327932 - RNA, 19 nt, Homo sapiens
cguggaauaggcacuguua

SEQ ID NO: 327933 - RNA, 19 nt, Homo sapiens
cugcggaaguccuaaacaa

SEQ ID NO: 327934 - RNA, 19 nt, Homo sapiens
uaaagaccugguuaaagaa

SEQ ID NO: 327935 - RNA, 19 nt, Homo sapiens
gaugaacaugggcaggaua

SEQ ID NO: 327936 - RNA, 19 nt, Homo sapiens
ggaugaacaugggcaggau

SEQ ID NO: 327937 - RNA, 19 nt, Homo sapiens
uuguugacaucgaauauga

SEQ ID NO: 327938 - RNA, 19 nt, Homo sapiens
gcaucuuguugacaucgaa

SEQ ID NO: 327939 - RNA, 19 nt, Homo sapiens
ugacugggguuccauuuga

SEQ ID NO: 327940 - RNA, 19 nt, Homo sapiens
aaauggcagucacuuaaag

SEQ ID NO: 327941 - RNA, 19 nt, Homo sapiens
gccagauauuugugagaaa

SEQ ID NO: 327942 - RNA, 19 nt, Homo sapiens
gagagggccuuaccaaaag

SEQ ID NO: 327943 - RNA, 19 nt, Homo sapiens
gaccaaugcacgucaagau

SEQ ID NO: 327944 - RNA, 19 nt, Homo sapiens
gaaugugccaggagagcaa

SEQ ID NO: 327945 - RNA, 19 nt, Homo sapiens
guaaagagcuauauggaua

SEQ ID NO: 327946 - RNA, 19 nt, Homo sapiens
ccaccaagcucaagaaaua

SEQ ID NO: 327947 - RNA, 19 nt, Homo sapiens
gaaaguauauguacaccaa

SEQ ID NO: 327948 - RNA, 19 nt, Homo sapiens
ggaaggugaugacccauua

SEQ ID NO: 327949 - RNA, 19 nt, Homo sapiens
ggacaggucugccaaucua

SEQ ID NO: 327950 - RNA, 19 nt, Homo sapiens
guaagaaacucacagaaau

SEQ ID NO: 327951 - RNA, 19 nt, Homo sapiens
ggacuaugcuucugccuuu

SEQ ID NO: 327952 - RNA, 19 nt, Homo sapiens
caaaucaacucacccauga

SEQ ID NO: 327953 - RNA, 19 nt, Homo sapiens
gaaauuacccaguauauuc

SEQ ID NO: 327954 - RNA, 19 nt, Homo sapiens
gaccaaaucuuuccuaauc

SEQ ID NO: 327955 - RNA, 19 nt, Homo sapiens
ccagaaagcuugucauugu

SEQ ID NO: 327956 - RNA, 19 nt, Homo sapiens
gcaggaacaucaagauuug

SEQ ID NO: 327957 - RNA, 19 nt, Homo sapiens
caaaggaacuagaagaaga

SEQ ID NO: 327958 - RNA, 19 nt, Homo sapiens
gccaagagauguuccuuaa

SEQ ID NO: 327959 - RNA, 19 nt, Homo sapiens
ccacaacagucaagucuuu

SEQ ID NO: 327960 - RNA, 19 nt, Homo sapiens
caagggauuuguugacaua

SEQ ID NO: 327961 - RNA, 19 nt, Homo sapiens
caagagauguuccuuaauc

SEQ ID NO: 327962 - RNA, 19 nt, Homo sapiens
gaucugugcucauugguuu

SEQ ID NO: 327963 - RNA, 19 nt, Homo sapiens
gaaagacgguccuccugaa

SEQ ID NO: 327964 - RNA, 19 nt, Homo sapiens
gaggaaggauacagaaauu

SEQ ID NO: 327965 - RNA, 19 nt, Homo sapiens
gaaggaacaugccaaaugg

SEQ ID NO: 327966 - RNA, 19 nt, Homo sapiens
ccacuuauauugcuagcua

SEQ ID NO: 327967 - RNA, 19 nt, Homo sapiens
gcaucgaacuccauuuaaa

SEQ ID NO: 327968 - RNA, 19 nt, Homo sapiens
ggacagagcauuuguucuu

SEQ ID NO: 327969 - RNA, 19 nt, Homo sapiens
gaacaaagcgacagcugaa

SEQ ID NO: 327970 - RNA, 19 nt, Homo sapiens
ggaaucagcugugggaguu

SEQ ID NO: 327971 - RNA, 19 nt, Homo sapiens
gguguggucucauuuguuu

SEQ ID NO: 327972 - RNA, 19 nt, Homo sapiens
gagaaagaaggaucuguua

SEQ ID NO: 327973 - RNA, 19 nt, Homo sapiens
ggaagugacuccagaccuu

SEQ ID NO: 327974 - RNA, 19 nt, Homo sapiens
cagaggaaauuacccagua

SEQ ID NO: 327975 - RNA, 19 nt, Homo sapiens
ggaaggaacaugccaaaug

SEQ ID NO: 327976 - RNA, 19 nt, Homo sapiens
ccagcauucuccucuauua

SEQ ID NO: 327977 - RNA, 19 nt, Homo sapiens
aaucaggucuuauuccuuu

SEQ ID NO: 327978 - RNA, 19 nt, Homo sapiens
cagcaaaccugugcaagaa

SEQ ID NO: 327979 - RNA, 19 nt, Homo sapiens
gaacaggaacugcuucuca

SEQ ID NO: 327980 - RNA, 19 nt, Homo sapiens
aaagacauccucaaucuaa

SEQ ID NO: 327981 - RNA, 19 nt, Homo sapiens
gguggaaauugccaaagua

SEQ ID NO: 327982 - RNA, 19 nt, Homo sapiens
uuaguaaccuggaagaauu

SEQ ID NO: 327983 - RNA, 19 nt, Homo sapiens
gaggcuggcuuugucuuua

SEQ ID NO: 327984 - RNA, 19 nt, Homo sapiens
cagaagaccauucgaaauu

SEQ ID NO: 327985 - RNA, 19 nt, Homo sapiens
uaacuuaacgguugaauca

SEQ ID NO: 327986 - RNA, 19 nt, Homo sapiens
gcgcaucgaacuccauuua

SEQ ID NO: 327987 - RNA, 19 nt, Homo sapiens
gaagaccauucgaaauuca

SEQ ID NO: 327988 - RNA, 19 nt, Homo sapiens
cagcagaggcuuuauagaa

SEQ ID NO: 327989 - RNA, 19 nt, Homo sapiens
gaaagcuugucauuguuga

SEQ ID NO: 327990 - RNA, 19 nt, Homo sapiens
agaaggaucuguuacugaa

SEQ ID NO: 327991 - RNA, 19 nt, Homo sapiens
gaacauuauccagcaguua

SEQ ID NO: 327992 - RNA, 19 nt, Homo sapiens
gaugauauugcauugcuua

SEQ ID NO: 327993 - RNA, 19 nt, Homo sapiens
gcuuugaguuuaaugauga

SEQ ID NO: 327994 - RNA, 19 nt, Homo sapiens
guacaguagaguuaacuua

SEQ ID NO: 327995 - RNA, 19 nt, Homo sapiens
agaaagacauccucaaucu

SEQ ID NO: 327996 - RNA, 19 nt, Homo sapiens
gagcgaaauuuagcugaaa

SEQ ID NO: 327997 - RNA, 19 nt, Homo sapiens
ggucucauuuguuuagaaa

SEQ ID NO: 327998 - RNA, 19 nt, Homo sapiens
gcccaaguaugaaauauag

SEQ ID NO: 327999 - RNA, 19 nt, Homo sapiens
gaaagacauccucaaucua

SEQ ID NO: 328000 - RNA, 19 nt, Homo sapiens
ggagcgaaauuuagcugaa

SEQ ID NO: 328001 - RNA, 19 nt, Homo sapiens
ugaaugggagcgaaauuua

SEQ ID NO: 328002 - RNA, 19 nt, Homo sapiens
guaagcgccuacaacaauu

SEQ ID NO: 328003 - RNA, 19 nt, Homo sapiens
caacaaugccacuucauau

SEQ ID NO: 328004 - RNA, 19 nt, Homo sapiens
gacuagaacuguggauaaa

SEQ ID NO: 328005 - RNA, 19 nt, Homo sapiens
gaauugauccuuccuacug

SEQ ID NO: 328006 - RNA, 19 nt, Homo sapiens
guacaagauucccugucua

SEQ ID NO: 328007 - RNA, 19 nt, Homo sapiens
ggaaauuacccaguauauu

SEQ ID NO: 328008 - RNA, 19 nt, Homo sapiens
gcagaaaggcuacaacucu

SEQ ID NO: 328009 - RNA, 19 nt, Homo sapiens
uggaagccauucuuacuuu

SEQ ID NO: 328010 - RNA, 19 nt, Homo sapiens
ggagggcaauauaaauguu

SEQ ID NO: 328011 - RNA, 19 nt, Homo sapiens
gaucuaaccaugugcuuga

SEQ ID NO: 328012 - RNA, 19 nt, Homo sapiens
guggugagcuggccuugaa

SEQ ID NO: 328013 - RNA, 19 nt, Homo sapiens
ggacauccgccgauaccua

SEQ ID NO: 328014 - RNA, 19 nt, Homo sapiens
ggaaggauacagaaauuuc

SEQ ID NO: 328015 - RNA, 19 nt, Homo sapiens
guaugauccuuccaaacua

SEQ ID NO: 328016 - RNA, 19 nt, Homo sapiens
gaucuggagggcaauauaa

SEQ ID NO: 328017 - RNA, 19 nt, Homo sapiens
ccaaagcaguacaagauuc

SEQ ID NO: 328018 - RNA, 19 nt, Homo sapiens
ugcgaaaguuuaugguuua

SEQ ID NO: 328019 - RNA, 19 nt, Homo sapiens
ccaguuugaucacaauuug

SEQ ID NO: 328020 - RNA, 19 nt, Homo sapiens
uuucgugccugcauuauuu

SEQ ID NO: 328021 - RNA, 19 nt, Homo sapiens
gacugaacauguuaaguug

SEQ ID NO: 328022 - RNA, 19 nt, Homo sapiens
aaucacaggugccaacuau

SEQ ID NO: 328023 - RNA, 19 nt, Homo sapiens
gggacuguaucauuugaaa

SEQ ID NO: 328024 - RNA, 19 nt, Homo sapiens
gaaagaaggaucuguuacu

SEQ ID NO: 328025 - RNA, 19 nt, Homo sapiens
ggcaucagcuuauugcaau

SEQ ID NO: 328026 - RNA, 19 nt, Homo sapiens
gaagaggaggcuagacuug

SEQ ID NO: 328027 - RNA, 19 nt, Homo sapiens
gagauucuaaugacaguuu

SEQ ID NO: 328028 - RNA, 19 nt, Homo sapiens
ugauugaacuccuggauuc

SEQ ID NO: 328029 - RNA, 19 nt, Homo sapiens
gugaauuucuucggaguaa

SEQ ID NO: 328030 - RNA, 19 nt, Homo sapiens
ucucagaguucaacauaug

SEQ ID NO: 328031 - RNA, 19 nt, Homo sapiens
gaaagaaagacauccucaa

SEQ ID NO: 328032 - RNA, 19 nt, Homo sapiens
caagauucccugucuagaa

SEQ ID NO: 328033 - RNA, 19 nt, Homo sapiens
ggaugaggcugauugaacu

SEQ ID NO: 328034 - RNA, 19 nt, Homo sapiens
ucucacugcuuccuacuaa

SEQ ID NO: 328035 - RNA, 19 nt, Homo sapiens
gcaaacccuucaaucaagu

SEQ ID NO: 328036 - RNA, 19 nt, Homo sapiens
ggaaauugccaaaguagca

SEQ ID NO: 328037 - RNA, 19 nt, Homo sapiens
ccacaugucuuugcuugau

SEQ ID NO: 328038 - RNA, 19 nt, Homo sapiens
uggugaacuuugugaauua

SEQ ID NO: 328039 - RNA, 19 nt, Homo sapiens
guggugaacuuugugaauu

SEQ ID NO: 328040 - RNA, 19 nt, Homo sapiens
ugaaauauagggacaguau

SEQ ID NO: 328041 - RNA, 19 nt, Homo sapiens
gaaccuguuuucuauauug

SEQ ID NO: 328042 - RNA, 19 nt, Homo sapiens
ggcaaacccuucaaucaag

SEQ ID NO: 328043 - RNA, 19 nt, Homo sapiens
gccguucucuccaaucauu

SEQ ID NO: 328044 - RNA, 19 nt, Homo sapiens
cgacuaccaaggcucauua

SEQ ID NO: 328045 - RNA, 19 nt, Homo sapiens
ggaaauccuuaaccaauua

SEQ ID NO: 328046 - RNA, 19 nt, Homo sapiens
ggaacgagaugcuauacua

SEQ ID NO: 328047 - RNA, 19 nt, Homo sapiens
gauaauaccuagucuuguu

SEQ ID NO: 328048 - RNA, 19 nt, Homo sapiens
gaaguaugcuguucucuau

SEQ ID NO: 328049 - RNA, 19 nt, Homo sapiens
caaaugaagugcugacaaa

SEQ ID NO: 328050 - RNA, 19 nt, Homo sapiens
gagaagcuauugaagauga

SEQ ID NO: 328051 - RNA, 19 nt, Homo sapiens
gaaaccagaugaagaagau

SEQ ID NO: 328052 - RNA, 19 nt, Homo sapiens
guuaaggcauauugaguua

SEQ ID NO: 328053 - RNA, 19 nt, Homo sapiens
ggaacacgaugaaccuauu

SEQ ID NO: 328054 - RNA, 19 nt, Homo sapiens
guggagaucuggaugauga

SEQ ID NO: 328055 - RNA, 19 nt, Homo sapiens
guggagggaugcacuauuu

SEQ ID NO: 328056 - RNA, 19 nt, Homo sapiens
cugaagcacuugaaagaua

SEQ ID NO: 328057 - RNA, 19 nt, Homo sapiens
gaaaggaaguaugcuguuc

SEQ ID NO: 328058 - RNA, 19 nt, Homo sapiens
ggaaacuggugaagaaaca

SEQ ID NO: 328059 - RNA, 19 nt, Homo sapiens
uaccuagucuuguuacaua

SEQ ID NO: 328060 - RNA, 19 nt, Homo sapiens
uccaaugacucuuucuuua

SEQ ID NO: 328061 - RNA, 19 nt, Homo sapiens
agaggaaacuggugaagaa

SEQ ID NO: 328062 - RNA, 19 nt, Homo sapiens
ugaaguauguaaccugaaa

SEQ ID NO: 328063 - RNA, 19 nt, Homo sapiens
uaagggacgucaguguuua

SEQ ID NO: 328064 - RNA, 19 nt, Homo sapiens
gaggguggauuauuggauu

SEQ ID NO: 328065 - RNA, 19 nt, Homo sapiens
acaaagacauacaggauga

SEQ ID NO: 328066 - RNA, 19 nt, Homo sapiens
caaauucuaugaggaaguu

SEQ ID NO: 328067 - RNA, 19 nt, Homo sapiens
ggaugauguugaagaagua

SEQ ID NO: 328068 - RNA, 19 nt, Homo sapiens
caauaccucaggcuaauua

SEQ ID NO: 328069 - RNA, 19 nt, Homo sapiens
gacaaaagaugccauuaaa

SEQ ID NO: 328070 - RNA, 19 nt, Homo sapiens
gaacgagaugcuauacuaa

SEQ ID NO: 328071 - RNA, 19 nt, Homo sapiens
ggaaguaugcuguucucua

SEQ ID NO: 328072 - RNA, 19 nt, Homo sapiens
gaauuaaggguuauacuca

SEQ ID NO: 328073 - RNA, 19 nt, Homo sapiens
uuaaugaacugaaguagca

SEQ ID NO: 328074 - RNA, 19 nt, Homo sapiens
ccaaugacucuuucuuuaa

SEQ ID NO: 328075 - RNA, 19 nt, Homo sapiens
uauguggccuugaggauaa

SEQ ID NO: 328076 - RNA, 19 nt, Homo sapiens
aaagugaaguucucagaug

SEQ ID NO: 328077 - RNA, 19 nt, Homo sapiens
caaguuaaaugugcacaga

SEQ ID NO: 328078 - RNA, 19 nt, Homo sapiens
ccaacaggauacauugaaa

SEQ ID NO: 328079 - RNA, 19 nt, Homo sapiens
agaggaaggucuagauuuc

SEQ ID NO: 328080 - RNA, 19 nt, Homo sapiens
cuaacuaccucauggaugu

SEQ ID NO: 328081 - RNA, 19 nt, Homo sapiens
acgagaugcuauacuaaua

SEQ ID NO: 328082 - RNA, 19 nt, Homo sapiens
ggaaaaugauccagacuau

SEQ ID NO: 328083 - RNA, 19 nt, Homo sapiens
ucagcuaacuguucagaug

SEQ ID NO: 328084 - RNA, 19 nt, Homo sapiens
uauguaaccugaaauccuu

SEQ ID NO: 328085 - RNA, 19 nt, Homo sapiens
gaugugguuugcagaagaa

SEQ ID NO: 328086 - RNA, 19 nt, Homo sapiens
ggaugugguuugcagaaga

SEQ ID NO: 328087 - RNA, 19 nt, Homo sapiens
gaacuucaaagauagaauc

SEQ ID NO: 328088 - RNA, 19 nt, Homo sapiens
uggaaauccuuaaccaauu

SEQ ID NO: 328089 - RNA, 19 nt, Homo sapiens
gguuagagcuagagagaag

SEQ ID NO: 328090 - RNA, 19 nt, Homo sapiens
ugaagaagcggaugaggaa

SEQ ID NO: 328091 - RNA, 19 nt, Homo sapiens
uggagaagcuauugaagau

SEQ ID NO: 328092 - RNA, 19 nt, Homo sapiens
ggucagaaccagaugauuc

SEQ ID NO: 328093 - RNA, 19 nt, Homo sapiens
caaagaacagucugaacuu

SEQ ID NO: 328094 - RNA, 19 nt, Homo sapiens
ugaagcacuugaaagauau

SEQ ID NO: 328095 - RNA, 19 nt, Homo sapiens
uggcagacauugacaacaa

SEQ ID NO: 328096 - RNA, 19 nt, Homo sapiens
ugacagugaggguggauua

SEQ ID NO: 328097 - RNA, 19 nt, Homo sapiens
gacuguagagccacauuua

SEQ ID NO: 328098 - RNA, 19 nt, Homo sapiens
gggaugcacuauuucacaa

SEQ ID NO: 328099 - RNA, 19 nt, Homo sapiens
gaaauuauggguuguacag

SEQ ID NO: 328100 - RNA, 19 nt, Homo sapiens
aguuaaaugugcacagaua

SEQ ID NO: 328101 - RNA, 19 nt, Homo sapiens
cagugaggguggauuauug

SEQ ID NO: 328102 - RNA, 19 nt, Homo sapiens
aaagaacagucugaacuug

SEQ ID NO: 328103 - RNA, 19 nt, Homo sapiens
aaagugaagguguagauaa

SEQ ID NO: 328104 - RNA, 19 nt, Homo sapiens
caacaaagaacagucugaa

SEQ ID NO: 328105 - RNA, 19 nt, Homo sapiens
gagaugcuauacuaauaag

SEQ ID NO: 328106 - RNA, 19 nt, Homo sapiens
uaaggguuauacucaguuu

SEQ ID NO: 328107 - RNA, 19 nt, Homo sapiens
caagauugaagaugagaaa

SEQ ID NO: 328108 - RNA, 19 nt, Homo sapiens
ucacaccacgcuuugauaa

SEQ ID NO: 328109 - RNA, 19 nt, Homo sapiens
cgagaugcuauacuaauaa

SEQ ID NO: 328110 - RNA, 19 nt, Homo sapiens
caaugacucuuucuuuaac

SEQ ID NO: 328111 - RNA, 19 nt, Homo sapiens
caagguccaagauuuguuu

SEQ ID NO: 328112 - RNA, 19 nt, Homo sapiens
ucacaagguccaagauuug

SEQ ID NO: 328113 - RNA, 19 nt, Homo sapiens
cuucuaugguuucuucuaa

SEQ ID NO: 328114 - RNA, 19 nt, Homo sapiens
cuucgaaauuggucacuuu

SEQ ID NO: 328115 - RNA, 19 nt, Homo sapiens
uagauaauaccuagucuug

SEQ ID NO: 328116 - RNA, 19 nt, Homo sapiens
caaagugaagguguagaua

SEQ ID NO: 328117 - RNA, 19 nt, Homo sapiens
aaccauaguucaucgaaau

SEQ ID NO: 328118 - RNA, 19 nt, Homo sapiens
guguuaaggucuuggaaug

SEQ ID NO: 328119 - RNA, 19 nt, Homo sapiens
caagggacgugggacaguu

SEQ ID NO: 328120 - RNA, 19 nt, Homo sapiens
acagauagaagccaaauuc

SEQ ID NO: 328121 - RNA, 19 nt, Homo sapiens
uagaaacaccaacaggaua

SEQ ID NO: 328122 - RNA, 19 nt, Homo sapiens
uaaccauaguucaucgaaa

SEQ ID NO: 328123 - RNA, 19 nt, Homo sapiens
ccauuaaauuucagacugu

SEQ ID NO: 328124 - RNA, 19 nt, Homo sapiens
caauucagguagaaguaga

SEQ ID NO: 328125 - RNA, 19 nt, Homo sapiens
ggaagaagaaggagaugag

SEQ ID NO: 328126 - RNA, 19 nt, Homo sapiens
gcugcagacuucgaaauug

SEQ ID NO: 328127 - RNA, 19 nt, Homo sapiens
agaagaagcagaaacacaa

SEQ ID NO: 328128 - RNA, 19 nt, Homo sapiens
aggccaagauugaagauga

SEQ ID NO: 328129 - RNA, 19 nt, Homo sapiens
ggaaaccagaugaagaaga

SEQ ID NO: 328130 - RNA, 19 nt, Homo sapiens
ucuaucagccucuauuuga

SEQ ID NO: 328131 - RNA, 19 nt, Homo sapiens
guuguuuguuugcuuguuu

SEQ ID NO: 328132 - RNA, 19 nt, Homo sapiens
ugaagaugaugaugaugau

SEQ ID NO: 328133 - RNA, 19 nt, Homo sapiens
gaaagaaaaggccaagauu

SEQ ID NO: 328134 - RNA, 19 nt, Homo sapiens
ucggaggaauugaaagaaa

SEQ ID NO: 328135 - RNA, 19 nt, Homo sapiens
ggcagacauugacaacaaa

SEQ ID NO: 328136 - RNA, 19 nt, Homo sapiens
guagaaacaccaacaggau

SEQ ID NO: 328137 - RNA, 19 nt, Homo sapiens
guuaaggucuuggaaugug

SEQ ID NO: 328138 - RNA, 19 nt, Homo sapiens
ucugagaaguuaguguuaa

SEQ ID NO: 328139 - RNA, 19 nt, Homo sapiens
gauuuccugcucuuaauaa

SEQ ID NO: 328140 - RNA, 19 nt, Homo sapiens
gauugaugcuguuuucuuu

SEQ ID NO: 328141 - RNA, 19 nt, Homo sapiens
ggauguauguggccuugag

SEQ ID NO: 328142 - RNA, 19 nt, Homo sapiens
ggacgugggacaguucgua

SEQ ID NO: 328143 - RNA, 19 nt, Homo sapiens
agauuuggaugauguugaa

SEQ ID NO: 328144 - RNA, 19 nt, Homo sapiens
ugacaaagacauacaggau

SEQ ID NO: 328145 - RNA, 19 nt, Homo sapiens
gaaguuagccugaauuuaa

SEQ ID NO: 328146 - RNA, 19 nt, Homo sapiens
ggaaauccuuaaccaauua

SEQ ID NO: 328147 - RNA, 19 nt, Homo sapiens
ggaacgagaugcuauacua

SEQ ID NO: 328148 - RNA, 19 nt, Homo sapiens
caagacaacuauaugguua

SEQ ID NO: 328149 - RNA, 19 nt, Homo sapiens
gauaauaccuagucuuguu

SEQ ID NO: 328150 - RNA, 19 nt, Homo sapiens
gaaguaugcuguucucuau

SEQ ID NO: 328151 - RNA, 19 nt, Homo sapiens
caaaugaagugcugacaaa

SEQ ID NO: 328152 - RNA, 19 nt, Homo sapiens
gagaagcuauugaagauga

SEQ ID NO: 328153 - RNA, 19 nt, Homo sapiens
gaaaugcagugacuuauac

SEQ ID NO: 328154 - RNA, 19 nt, Homo sapiens
gaaaccagaugaagaagau

SEQ ID NO: 328155 - RNA, 19 nt, Homo sapiens
guuaaggcauauugaguua

SEQ ID NO: 328156 - RNA, 19 nt, Homo sapiens
ggaacacgaugaaccuauu

SEQ ID NO: 328157 - RNA, 19 nt, Homo sapiens
guggagaucuggaugauga

SEQ ID NO: 328158 - RNA, 19 nt, Homo sapiens
guggagggaugcacuauuu

SEQ ID NO: 328159 - RNA, 19 nt, Homo sapiens
cugaagcacuugaaagaua

SEQ ID NO: 328160 - RNA, 19 nt, Homo sapiens
gaaaggaaguaugcuguuc

SEQ ID NO: 328161 - RNA, 19 nt, Homo sapiens
uuauguagcucuuggagua

SEQ ID NO: 328162 - RNA, 19 nt, Homo sapiens
gaggauaaccugcacugua

SEQ ID NO: 328163 - RNA, 19 nt, Homo sapiens
ggaaacuggugaagaaaca

SEQ ID NO: 328164 - RNA, 19 nt, Homo sapiens
uaccuagucuuguuacaua

SEQ ID NO: 328165 - RNA, 19 nt, Homo sapiens
uccaaugacucuuucuuua

SEQ ID NO: 328166 - RNA, 19 nt, Homo sapiens
agaggaaacuggugaagaa

SEQ ID NO: 328167 - RNA, 19 nt, Homo sapiens
ugaaguauguaaccugaaa

SEQ ID NO: 328168 - RNA, 19 nt, Homo sapiens
uaagggacgucaguguuua

SEQ ID NO: 328169 - RNA, 19 nt, Homo sapiens
gaggguggauuauuggauu

SEQ ID NO: 328170 - RNA, 19 nt, Homo sapiens
acaaagacauacaggauga

SEQ ID NO: 328171 - RNA, 19 nt, Homo sapiens
caaauucuaugaggaaguu

SEQ ID NO: 328172 - RNA, 19 nt, Homo sapiens
guucauucauugcuacaua

SEQ ID NO: 328173 - RNA, 19 nt, Homo sapiens
caaauucugucacgcaugu

SEQ ID NO: 328174 - RNA, 19 nt, Homo sapiens
ggaugauguugaagaagua

SEQ ID NO: 328175 - RNA, 19 nt, Homo sapiens
caauaccucaggcuaauua

SEQ ID NO: 328176 - RNA, 19 nt, Homo sapiens
gacaaaagaugccauuaaa

SEQ ID NO: 328177 - RNA, 19 nt, Homo sapiens
gaacgagaugcuauacuaa

SEQ ID NO: 328178 - RNA, 19 nt, Homo sapiens
aggauaaccugcacuguaa

SEQ ID NO: 328179 - RNA, 19 nt, Homo sapiens
ggacaggaaacugauauuu

SEQ ID NO: 328180 - RNA, 19 nt, Homo sapiens
ggaaguaugcuguucucua

SEQ ID NO: 328181 - RNA, 19 nt, Homo sapiens
gaauuaaggguuauacuca

SEQ ID NO: 328182 - RNA, 19 nt, Homo sapiens
ucacgcauguucauucauu

SEQ ID NO: 328183 - RNA, 19 nt, Homo sapiens
uuaaugaacugaaguagca

SEQ ID NO: 328184 - RNA, 19 nt, Homo sapiens
ccaaugacucuuucuuuaa

SEQ ID NO: 328185 - RNA, 19 nt, Homo sapiens
gauaaccugcacuguaaua

SEQ ID NO: 328186 - RNA, 19 nt, Homo sapiens
uauguggccuugaggauaa

SEQ ID NO: 328187 - RNA, 19 nt, Homo sapiens
aaagugaaguucucagaug

SEQ ID NO: 328188 - RNA, 19 nt, Homo sapiens
caaguuaaaugugcacaga

SEQ ID NO: 328189 - RNA, 19 nt, Homo sapiens
gcaagacaacuauaugguu

SEQ ID NO: 328190 - RNA, 19 nt, Homo sapiens
ccaacaggauacauugaaa

SEQ ID NO: 328191 - RNA, 19 nt, Homo sapiens
agaggaaggucuagauuuc

SEQ ID NO: 328192 - RNA, 19 nt, Homo sapiens
cuaacuaccucauggaugu

SEQ ID NO: 328193 - RNA, 19 nt, Homo sapiens
acgagaugcuauacuaaua

SEQ ID NO: 328194 - RNA, 19 nt, Homo sapiens
gguuaagaauuuccaguau

SEQ ID NO: 328195 - RNA, 19 nt, Homo sapiens
ggaaaaugauccagacuau

SEQ ID NO: 328196 - RNA, 19 nt, Homo sapiens
ucagcuaacuguucagaug

SEQ ID NO: 328197 - RNA, 19 nt, Homo sapiens
uauguaaccugaaauccuu

SEQ ID NO: 328198 - RNA, 19 nt, Homo sapiens
gaugugguuugcagaagaa

SEQ ID NO: 328199 - RNA, 19 nt, Homo sapiens
ggaugugguuugcagaaga

SEQ ID NO: 328200 - RNA, 19 nt, Homo sapiens
acagaaaugcagugacuua

SEQ ID NO: 328201 - RNA, 19 nt, Homo sapiens
gaacuucaaagauagaauc

SEQ ID NO: 328202 - RNA, 19 nt, Homo sapiens
uggaaauccuuaaccaauu

SEQ ID NO: 328203 - RNA, 19 nt, Homo sapiens
gguuagagcuagagagaag

SEQ ID NO: 328204 - RNA, 19 nt, Homo sapiens
guuaagaauuuccaguaug

SEQ ID NO: 328205 - RNA, 19 nt, Homo sapiens
uguaauagccuaaacacaa

SEQ ID NO: 328206 - RNA, 19 nt, Homo sapiens
ugaagaagcggaugaggaa

SEQ ID NO: 328207 - RNA, 19 nt, Homo sapiens
uggagaagcuauugaagau

SEQ ID NO: 328208 - RNA, 19 nt, Homo sapiens
ggucagaaccagaugauuc

SEQ ID NO: 328209 - RNA, 19 nt, Homo sapiens
caaagaacagucugaacuu

SEQ ID NO: 328210 - RNA, 19 nt, Homo sapiens
uggcagacauugacaacaa

SEQ ID NO: 328211 - RNA, 19 nt, Homo sapiens
ugaagcacuugaaagauau

SEQ ID NO: 328212 - RNA, 19 nt, Homo sapiens
ugacagugaggguggauua

SEQ ID NO: 328213 - RNA, 19 nt, Homo sapiens
gacuguagagccacauuua

SEQ ID NO: 328214 - RNA, 19 nt, Homo sapiens
gggaugcacuauuucacaa

SEQ ID NO: 328215 - RNA, 19 nt, Homo sapiens
gcauguucauucauugcua

SEQ ID NO: 328216 - RNA, 19 nt, Homo sapiens
gaaauuauggguuguacag

SEQ ID NO: 328217 - RNA, 19 nt, Homo sapiens
aguuaaaugugcacagaua

SEQ ID NO: 328218 - RNA, 19 nt, Homo sapiens
cagugaggguggauuauug

SEQ ID NO: 328219 - RNA, 19 nt, Homo sapiens
aaagaacagucugaacuug

SEQ ID NO: 328220 - RNA, 19 nt, Homo sapiens
guaauagccuaaacacaac

SEQ ID NO: 328221 - RNA, 19 nt, Homo sapiens
aaagugaagguguagauaa

SEQ ID NO: 328222 - RNA, 19 nt, Homo sapiens
gagaugcuauacuaauaag

SEQ ID NO: 328223 - RNA, 19 nt, Homo sapiens
uaaggguuauacucaguuu

SEQ ID NO: 328224 - RNA, 19 nt, Homo sapiens
agaaaugcagugacuuaua

SEQ ID NO: 328225 - RNA, 19 nt, Homo sapiens
guuaaguccgcuuggauua

SEQ ID NO: 328226 - RNA, 19 nt, Homo sapiens
uaauuugguucuucuggaa

SEQ ID NO: 328227 - RNA, 19 nt, Homo sapiens
cuacauaauuugguucuuc

SEQ ID NO: 328228 - RNA, 19 nt, Homo sapiens
caagauugaagaugagaaa

SEQ ID NO: 328229 - RNA, 19 nt, Homo sapiens
caacaaagaacagucugaa

SEQ ID NO: 328230 - RNA, 19 nt, Homo sapiens
ucacaccacgcuuugauaa

SEQ ID NO: 328231 - RNA, 19 nt, Homo sapiens
cgagaugcuauacuaauaa

SEQ ID NO: 328232 - RNA, 19 nt, Homo sapiens
caaugacucuuucuuuaac

SEQ ID NO: 328233 - RNA, 19 nt, Homo sapiens
caagguccaagauuuguuu

SEQ ID NO: 328234 - RNA, 19 nt, Homo sapiens
ucacaagguccaagauuug

SEQ ID NO: 328235 - RNA, 19 nt, Homo sapiens
cuucuaugguuucuucuaa

SEQ ID NO: 328236 - RNA, 19 nt, Homo sapiens
cuucgaaauuggucacuuu

SEQ ID NO: 328237 - RNA, 19 nt, Homo sapiens
uagauaauaccuagucuug

SEQ ID NO: 328238 - RNA, 19 nt, Homo sapiens
caaagugaagguguagaua

SEQ ID NO: 328239 - RNA, 19 nt, Homo sapiens
aaccauaguucaucgaaau

SEQ ID NO: 328240 - RNA, 19 nt, Homo sapiens
guguuaaggucuuggaaug

SEQ ID NO: 328241 - RNA, 19 nt, Homo sapiens
caagggacgugggacaguu

SEQ ID NO: 328242 - RNA, 19 nt, Homo sapiens
acagauagaagccaaauuc

SEQ ID NO: 328243 - RNA, 19 nt, Homo sapiens
uagaaacaccaacaggaua

SEQ ID NO: 328244 - RNA, 19 nt, Homo sapiens
uaaccauaguucaucgaaa

SEQ ID NO: 328245 - RNA, 19 nt, Homo sapiens
gaaauuaacugcccuagau

SEQ ID NO: 328246 - RNA, 19 nt, Homo sapiens
gaacugcgauugaguauuc

SEQ ID NO: 328247 - RNA, 19 nt, Homo sapiens
gaucagaaaugcuaaguga

SEQ ID NO: 328248 - RNA, 19 nt, Homo sapiens
agucaaagcuagcauauua

SEQ ID NO: 328249 - RNA, 19 nt, Homo sapiens
gaaagaaaguuugcugaaa

SEQ ID NO: 328250 - RNA, 19 nt, Homo sapiens
gcaaggagcugucagaauc

SEQ ID NO: 328251 - RNA, 19 nt, Homo sapiens
gaagaggaaugugaauaua

SEQ ID NO: 328252 - RNA, 19 nt, Homo sapiens
ggaaucaccucaaauggaa

SEQ ID NO: 328253 - RNA, 19 nt, Homo sapiens
gaaaugaucagaaaugcua

SEQ ID NO: 328254 - RNA, 19 nt, Homo sapiens
uagaagacauugaucguua

SEQ ID NO: 328255 - RNA, 19 nt, Homo sapiens
ggacuuaucgguuauguuu

SEQ ID NO: 328256 - RNA, 19 nt, Homo sapiens
gaucaucaaugcaaucuau

SEQ ID NO: 328257 - RNA, 19 nt, Homo sapiens
gauaagaauuucaggcaaa

SEQ ID NO: 328258 - RNA, 19 nt, Homo sapiens
ggaacaauccgaacuguaa

SEQ ID NO: 328259 - RNA, 19 nt, Homo sapiens
gcuaugaaaugaucagaaa

SEQ ID NO: 328260 - RNA, 19 nt, Homo sapiens
gaagagauguaugguaaug

SEQ ID NO: 328261 - RNA, 19 nt, Homo sapiens
caaaaggacuuaucgguua

SEQ ID NO: 328262 - RNA, 19 nt, Homo sapiens
ggaaaugugucaugaagag

SEQ ID NO: 328263 - RNA, 19 nt, Homo sapiens
uaagaggccugcauauaga

SEQ ID NO: 328264 - RNA, 19 nt, Homo sapiens
caauaacaaugcaguagaa

SEQ ID NO: 328265 - RNA, 19 nt, Homo sapiens
gaacuguaacugaagauuu

SEQ ID NO: 328266 - RNA, 19 nt, Homo sapiens
gagaagagaauaaagaaga

SEQ ID NO: 328267 - RNA, 19 nt, Homo sapiens
ggacugugaugaugaggaa

SEQ ID NO: 328268 - RNA, 19 nt, Homo sapiens
gaaaguuugcugaaaugua

SEQ ID NO: 328269 - RNA, 19 nt, Homo sapiens
gagggaauuucaugacauu

SEQ ID NO: 328270 - RNA, 19 nt, Homo sapiens
ccuauuacaucauucauug

SEQ ID NO: 328271 - RNA, 19 nt, Homo sapiens
cuaagggaauuccugauuu

SEQ ID NO: 328272 - RNA, 19 nt, Homo sapiens
gaggaaaugugucaugaag

SEQ ID NO: 328273 - RNA, 19 nt, Homo sapiens
gauacagacuuuguugaaa

SEQ ID NO: 328274 - RNA, 19 nt, Homo sapiens
auacauggcccugaaauua

SEQ ID NO: 328275 - RNA, 19 nt, Homo sapiens
ugagauagauuggaaugaa

SEQ ID NO: 328276 - RNA, 19 nt, Homo sapiens
ugaaauguaccaacccuua

SEQ ID NO: 328277 - RNA, 19 nt, Homo sapiens
guuugucggugaaguguua

SEQ ID NO: 328278 - RNA, 19 nt, Homo sapiens
guaauuguguaagccauaa

SEQ ID NO: 328279 - RNA, 19 nt, Homo sapiens
cauaggcucuuguauuuua

SEQ ID NO: 328280 - RNA, 19 nt, Homo sapiens
uucauaggcucuuguauuu

SEQ ID NO: 328281 - RNA, 19 nt, Homo sapiens
gcugugagauagauuggaa

SEQ ID NO: 328282 - RNA, 19 nt, Homo sapiens
augaagagauguaugguaa

SEQ ID NO: 328283 - RNA, 19 nt, Homo sapiens
gaagugcggugaagaagcu

SEQ ID NO: 328284 - RNA, 19 nt, Homo sapiens
ggucacaauuuacguacuu

SEQ ID NO: 328285 - RNA, 19 nt, Homo sapiens
gauauuucguguucuuuca

SEQ ID NO: 328286 - RNA, 19 nt, Homo sapiens
aaacuuggaugcuuaagag

SEQ ID NO: 328287 - RNA, 19 nt, Homo sapiens
ccuaugugcugaagucaaa

SEQ ID NO: 328288 - RNA, 19 nt, Homo sapiens
guucauaggcucuuguauu

SEQ ID NO: 328289 - RNA, 19 nt, Homo sapiens
gaguauacauggcccugaa

SEQ ID NO: 328290 - RNA, 19 nt, Homo sapiens
gaagggauggaaaugauga

SEQ ID NO: 328291 - RNA, 19 nt, Homo sapiens
aaacuagagcggccaauuu

SEQ ID NO: 328292 - RNA, 19 nt, Homo sapiens
gcaauaacaaugcaguaga

SEQ ID NO: 328293 - RNA, 19 nt, Homo sapiens
uaacugcccuagauauagu

SEQ ID NO: 328294 - RNA, 19 nt, Homo sapiens
ggaaugaaggaaagaaugu

SEQ ID NO: 328295 - RNA, 19 nt, Homo sapiens
gaagucaaagcuagcauau

SEQ ID NO: 328296 - RNA, 19 nt, Homo sapiens
guaccaacccuuacuggaa

SEQ ID NO: 328297 - RNA, 19 nt, Homo sapiens
gugaugcacuggaaucuca

SEQ ID NO: 328298 - RNA, 19 nt, Homo sapiens
caaacccaaugaauauuuc

SEQ ID NO: 328299 - RNA, 19 nt, Homo sapiens
ccugacagauauuaaaguu

SEQ ID NO: 328300 - RNA, 19 nt, Homo sapiens
uaccaacccuuacuggaaa

SEQ ID NO: 328301 - RNA, 19 nt, Homo sapiens
gaaauguacacugugguaa

SEQ ID NO: 328302 - RNA, 19 nt, Homo sapiens
aaaguuugcugaaauguac

SEQ ID NO: 328303 - RNA, 19 nt, Homo sapiens
gagauagauuggaaugaag

SEQ ID NO: 328304 - RNA, 19 nt, Homo sapiens
gcuaguggauuuaauuuug

SEQ ID NO: 328305 - RNA, 19 nt, Homo sapiens
ucagaaaugcuaagugaga

SEQ ID NO: 328306 - RNA, 19 nt, Homo sapiens
aagaaaguuugcugaaaug

SEQ ID NO: 328307 - RNA, 19 nt, Homo sapiens
ucauguagcuauuaaucug

SEQ ID NO: 328308 - RNA, 19 nt, Homo sapiens
cguguacgguccuuugaaa

SEQ ID NO: 328309 - RNA, 19 nt, Homo sapiens
ucacuccuuugauuaagaa

SEQ ID NO: 328310 - RNA, 19 nt, Homo sapiens
cuacagaagaggaauguga

SEQ ID NO: 328311 - RNA, 19 nt, Homo sapiens
aaaguuaaguaccgugugu

SEQ ID NO: 328312 - RNA, 19 nt, Homo sapiens
uuaagaggccugcauauag

SEQ ID NO: 328313 - RNA, 19 nt, Homo sapiens
gaagccuuguguucuguau

SEQ ID NO: 328314 - RNA, 19 nt, Homo sapiens
acacucacuccuuugauua

SEQ ID NO: 328315 - RNA, 19 nt, Homo sapiens
ggaggaggaggacgacauu

SEQ ID NO: 328316 - RNA, 19 nt, Homo sapiens
gggaauuucaugacauuga

SEQ ID NO: 328317 - RNA, 19 nt, Homo sapiens
uauaagaagccuuguguuc

SEQ ID NO: 328318 - RNA, 19 nt, Homo sapiens
gguauaagaagccuugugu

SEQ ID NO: 328319 - RNA, 19 nt, Homo sapiens
gauauaguuacucaaggua

SEQ ID NO: 328320 - RNA, 19 nt, Homo sapiens
aauccgaacuguaacugaa

SEQ ID NO: 328321 - RNA, 19 nt, Homo sapiens
acacuagaauuucacuuca

SEQ ID NO: 328322 - RNA, 19 nt, Homo sapiens
ugaagcuccugacagauau

SEQ ID NO: 328323 - RNA, 19 nt, Homo sapiens
cugaagcuccugacagaua

SEQ ID NO: 328324 - RNA, 19 nt, Homo sapiens
gauacacucacuccuuuga

SEQ ID NO: 328325 - RNA, 19 nt, Homo sapiens
gaagaggcugguaaucaga

SEQ ID NO: 328326 - RNA, 19 nt, Homo sapiens
uugauacacucacuccuuu

SEQ ID NO: 328327 - RNA, 19 nt, Homo sapiens
ggaggauccuaagggaauu

SEQ ID NO: 328328 - RNA, 19 nt, Homo sapiens
cagaagaggaaugugaaua

SEQ ID NO: 328329 - RNA, 19 nt, Homo sapiens
guugaaagucuaccuguga

SEQ ID NO: 328330 - RNA, 19 nt, Homo sapiens
ugaaaaccaucaagaagaa

SEQ ID NO: 328331 - RNA, 19 nt, Homo sapiens
ugaaagaaaguuugcugaa

SEQ ID NO: 328332 - RNA, 19 nt, Homo sapiens
uccuuuagcuaguggauuu

SEQ ID NO: 328333 - RNA, 19 nt, Homo sapiens
uuacuuaguccuuuagcua

SEQ ID NO: 328334 - RNA, 19 nt, Homo sapiens
gaaaugcuaagugagauca

SEQ ID NO: 328335 - RNA, 19 nt, Homo sapiens
uacacucacuccuuugauu

SEQ ID NO: 328336 - RNA, 19 nt, Homo sapiens
gaauaaagaagaggaggau

SEQ ID NO: 328337 - RNA, 19 nt, Homo sapiens
agaagaggaaugugaauau

SEQ ID NO: 328338 - RNA, 19 nt, Homo sapiens
gacgucagaucaucaaugc

SEQ ID NO: 328339 - RNA, 19 nt, Homo sapiens
aacuagagcggccaauuua

SEQ ID NO: 328340 - RNA, 19 nt, Homo sapiens
gaaguguuagucacaguau

SEQ ID NO: 328341 - RNA, 19 nt, Homo sapiens
uguacacugugguaaauga

SEQ ID NO: 328342 - RNA, 19 nt, Homo sapiens
caaauggaagggauggaaa

SEQ ID NO: 328343 - RNA, 19 nt, Homo sapiens
gauauuucggugagucuuu

SEQ ID NO: 328344 - RNA, 19 nt, Homo sapiens
uaagggaauuccugauuuu

SEQ ID NO: 328345 - RNA, 19 nt, Homo sapiens
ccacugagguguuaauaua

SEQ ID NO: 328346 - RNA, 19 nt, Homo sapiens
gaaaugaggugcuggugaa

SEQ ID NO: 328347 - RNA, 19 nt, Homo sapiens
gaacaaauuucguggauag

SEQ ID NO: 328348 - RNA, 19 nt, Homo sapiens
gaaacugucagaauuguua

SEQ ID NO: 328349 - RNA, 19 nt, Homo sapiens
uaucuaggcuguuguagua

SEQ ID NO: 328350 - RNA, 19 nt, Homo sapiens
uguaagcuguugucaauua

SEQ ID NO: 328351 - RNA, 19 nt, Homo sapiens
uaaagaaauuccugaggua

SEQ ID NO: 328352 - RNA, 19 nt, Homo sapiens
gauaggcgguuucaaauca

SEQ ID NO: 328353 - RNA, 19 nt, Homo sapiens
gaugaggacuuugaaauug

SEQ ID NO: 328354 - RNA, 19 nt, Homo sapiens
gaugggaaauugaagauug

SEQ ID NO: 328355 - RNA, 19 nt, Homo sapiens
guagauacccuguucuuaa

SEQ ID NO: 328356 - RNA, 19 nt, Homo sapiens
ucacaaugaucccuucuuu

SEQ ID NO: 328357 - RNA, 19 nt, Homo sapiens
ggugaaagcugaagagaag

SEQ ID NO: 328358 - RNA, 19 nt, Homo sapiens
ggcaagggcugcaguaaga

SEQ ID NO: 328359 - RNA, 19 nt, Homo sapiens
caacugagaccuuguguau

SEQ ID NO: 328360 - RNA, 19 nt, Homo sapiens
aaaggcagaugauaaagaa

SEQ ID NO: 328361 - RNA, 19 nt, Homo sapiens
gaagaaaacccuaaagaaa

SEQ ID NO: 328362 - RNA, 19 nt, Homo sapiens
ucaacaagccucuguauga

SEQ ID NO: 328363 - RNA, 19 nt, Homo sapiens
uauguaagcuguugucaau

SEQ ID NO: 328364 - RNA, 19 nt, Homo sapiens
guaaaacccugaccuguaa

SEQ ID NO: 328365 - RNA, 19 nt, Homo sapiens
gaaaagaccacauuugauu

SEQ ID NO: 328366 - RNA, 19 nt, Homo sapiens
gcaguaagagagacucaua

SEQ ID NO: 328367 - RNA, 19 nt, Homo sapiens
gguaaaggcagaugauaaa

SEQ ID NO: 328368 - RNA, 19 nt, Homo sapiens
gaagaagaaugugaaugga

SEQ ID NO: 328369 - RNA, 19 nt, Homo sapiens
uagauacccuguucuuaaa

SEQ ID NO: 328370 - RNA, 19 nt, Homo sapiens
ggaacaaauuucguggaua

SEQ ID NO: 328371 - RNA, 19 nt, Homo sapiens
gaaguuugacugcuugaaa

SEQ ID NO: 328372 - RNA, 19 nt, Homo sapiens
ggaugaggacuuugaaauu

SEQ ID NO: 328373 - RNA, 19 nt, Homo sapiens
caacaagccucuguaugau

SEQ ID NO: 328374 - RNA, 19 nt, Homo sapiens
ggccuaugauucagaagua

SEQ ID NO: 328375 - RNA, 19 nt, Homo sapiens
cuaaaggcauuccugacua

SEQ ID NO: 328376 - RNA, 19 nt, Homo sapiens
ggaaauugaagauugcaaa

SEQ ID NO: 328377 - RNA, 19 nt, Homo sapiens
ugaaaugccucccuuagag

SEQ ID NO: 328378 - RNA, 19 nt, Homo sapiens
gaaauccaguacuuauagu

SEQ ID NO: 328379 - RNA, 19 nt, Homo sapiens
ccuguaaccugaacacuau

SEQ ID NO: 328380 - RNA, 19 nt, Homo sapiens
gauaaugucauccugaaau

SEQ ID NO: 328381 - RNA, 19 nt, Homo sapiens
gaaguaugaugagcccauu

SEQ ID NO: 328382 - RNA, 19 nt, Homo sapiens
uaaagaauguugacaagcu

SEQ ID NO: 328383 - RNA, 19 nt, Homo sapiens
uaaaggcauuccugacuau

SEQ ID NO: 328384 - RNA, 19 nt, Homo sapiens
ccauaagacuaaggguuua

SEQ ID NO: 328385 - RNA, 19 nt, Homo sapiens
gggcagauuuuacaugaua

SEQ ID NO: 328386 - RNA, 19 nt, Homo sapiens
gggaacaaauuucguggau

SEQ ID NO: 328387 - RNA, 19 nt, Homo sapiens
cuauagaaauccaguacuu

SEQ ID NO: 328388 - RNA, 19 nt, Homo sapiens
guucuuguauugcaaccua

SEQ ID NO: 328389 - RNA, 19 nt, Homo sapiens
acugagaccuuguguaugu

SEQ ID NO: 328390 - RNA, 19 nt, Homo sapiens
gcugugccuucauuaguuu

SEQ ID NO: 328391 - RNA, 19 nt, Homo sapiens
agaagaaugugaauggaau

SEQ ID NO: 328392 - RNA, 19 nt, Homo sapiens
uaugauaggcgguuucaaa

SEQ ID NO: 328393 - RNA, 19 nt, Homo sapiens
agaugaaugugacaaggua

SEQ ID NO: 328394 - RNA, 19 nt, Homo sapiens
ggaaacaagaaauacagaa

SEQ ID NO: 328395 - RNA, 19 nt, Homo sapiens
caagagugguuccuaaugc

SEQ ID NO: 328396 - RNA, 19 nt, Homo sapiens
gacaagcucgggccuauga

SEQ ID NO: 328397 - RNA, 19 nt, Homo sapiens
ggacaguguagaucuuaaa

SEQ ID NO: 328398 - RNA, 19 nt, Homo sapiens
gcaagcgcuuagaaacauu

SEQ ID NO: 328399 - RNA, 19 nt, Homo sapiens
guaagcuguugucaauuau

SEQ ID NO: 328400 - RNA, 19 nt, Homo sapiens
gaacucaacaagccucugu

SEQ ID NO: 328401 - RNA, 19 nt, Homo sapiens
gauguuagccugaaguucu

SEQ ID NO: 328402 - RNA, 19 nt, Homo sapiens
ucuaggcuguuguaguaua

SEQ ID NO: 328403 - RNA, 19 nt, Homo sapiens
agaagacccuaaaggcauu

SEQ ID NO: 328404 - RNA, 19 nt, Homo sapiens
augaggaggugcaggauaa

SEQ ID NO: 328405 - RNA, 19 nt, Homo sapiens
ucacuucauuugauacugu

SEQ ID NO: 328406 - RNA, 19 nt, Homo sapiens
guuuaccacugagguguua

SEQ ID NO: 328407 - RNA, 19 nt, Homo sapiens
aaucaucaaugcagaauac

SEQ ID NO: 328408 - RNA, 19 nt, Homo sapiens
caagauggcagaagcagau

SEQ ID NO: 328409 - RNA, 19 nt, Homo sapiens
guacaucucggcacucuag

SEQ ID NO: 328410 - RNA, 19 nt, Homo sapiens
uaaaggcagaugauaaaga

SEQ ID NO: 328411 - RNA, 19 nt, Homo sapiens
gaagaaugugaauggaauu

SEQ ID NO: 328412 - RNA, 19 nt, Homo sapiens
aacuaaagauaccguguuu

SEQ ID NO: 328413 - RNA, 19 nt, Homo sapiens
caaaauauguaagcuguug

SEQ ID NO: 328414 - RNA, 19 nt, Homo sapiens
gugucuaagugccaguuua

SEQ ID NO: 328415 - RNA, 19 nt, Homo sapiens
acaagccucuguaugauag

SEQ ID NO: 328416 - RNA, 19 nt, Homo sapiens
gaaaauaugcugaacucaa

SEQ ID NO: 328417 - RNA, 19 nt, Homo sapiens
gaaguaccaaugcaagugu

SEQ ID NO: 328418 - RNA, 19 nt, Homo sapiens
aagcauccgugagucauuu

SEQ ID NO: 328419 - RNA, 19 nt, Homo sapiens
gauguuacugugacaacua

SEQ ID NO: 328420 - RNA, 19 nt, Homo sapiens
gcaaaggcugcaagauaga

SEQ ID NO: 328421 - RNA, 19 nt, Homo sapiens
aaaccuggccagccuguaa

SEQ ID NO: 328422 - RNA, 19 nt, Homo sapiens
ggaaaggcuucaggacagu

SEQ ID NO: 328423 - RNA, 19 nt, Homo sapiens
auacgagccuacagaagaa

SEQ ID NO: 328424 - RNA, 19 nt, Homo sapiens
gaaugugacaagguagaua

SEQ ID NO: 328425 - RNA, 19 nt, Homo sapiens
gacuaaggguuuaaaucug

SEQ ID NO: 328426 - RNA, 19 nt, Homo sapiens
cugugaaacugucagaauu

SEQ ID NO: 328427 - RNA, 19 nt, Homo sapiens
gacuguagcugugaaacug

SEQ ID NO: 328428 - RNA, 19 nt, Homo sapiens
gauaaagaacagccuaaag

SEQ ID NO: 328429 - RNA, 19 nt, Homo sapiens
cgcagccgcuuguauagaa

SEQ ID NO: 328430 - RNA, 19 nt, Homo sapiens
aagaagauccuaaagaagu

SEQ ID NO: 328431 - RNA, 19 nt, Homo sapiens
gaugaggaggugcaggaua

SEQ ID NO: 328432 - RNA, 19 nt, Homo sapiens
gcuguugucaauuaucuaa

SEQ ID NO: 328433 - RNA, 19 nt, Homo sapiens
cuaggcuguuguaguauaa

SEQ ID NO: 328434 - RNA, 19 nt, Homo sapiens
caaacauuauggaaacaag

SEQ ID NO: 328435 - RNA, 19 nt, Homo sapiens
aaugguaccuacuaucaau

SEQ ID NO: 328436 - RNA, 19 nt, Homo sapiens
ucaaugguaccuacuauca

SEQ ID NO: 328437 - RNA, 19 nt, Homo sapiens
gaaauugaagauugcaaag

SEQ ID NO: 328438 - RNA, 19 nt, Homo sapiens
gauaacaccccuagugaaa

SEQ ID NO: 328439 - RNA, 19 nt, Homo sapiens
gcagccgcuuguauagaaa

SEQ ID NO: 328440 - RNA, 19 nt, Homo sapiens
gaagcuggaaccacgagaa

SEQ ID NO: 328441 - RNA, 19 nt, Homo sapiens
cagagucgcacaacugcua

SEQ ID NO: 328442 - RNA, 19 nt, Homo sapiens
gugaaaugccucccuuaga

SEQ ID NO: 328443 - RNA, 19 nt, Homo sapiens
cuacagaagaagaauguga

SEQ ID NO: 328444 - RNA, 19 nt, Homo sapiens
agacuaaggguuuaaaucu

SEQ ID NO: 328445 - RNA, 19 nt, Homo sapiens
gaaauuggcuggagacaug

SEQ ID NO: 328446 - RNA, 19 nt, Homo sapiens
gaaagaauguuacugucaa

SEQ ID NO: 328447 - RNA, 19 nt, Homo sapiens
ggacugaauucuucccuuu

SEQ ID NO: 328448 - RNA, 19 nt, Homo sapiens
guacaugacuuggaaagaa

SEQ ID NO: 328449 - RNA, 19 nt, Homo sapiens
gaaaguaugcagcgcuaua

SEQ ID NO: 328450 - RNA, 19 nt, Homo sapiens
caaguucuaugaagaggua

SEQ ID NO: 328451 - RNA, 19 nt, Homo sapiens
ugaagaaggugaagaagga

SEQ ID NO: 328452 - RNA, 19 nt, Homo sapiens
cgaaacaaguacccaauga

SEQ ID NO: 328453 - RNA, 19 nt, Homo sapiens
cauagaagaugaugacaau

SEQ ID NO: 328454 - RNA, 19 nt, Homo sapiens
caaaggaauuccagaguuc

SEQ ID NO: 328455 - RNA, 19 nt, Homo sapiens
gacaagagaagagaauuua

SEQ ID NO: 328456 - RNA, 19 nt, Homo sapiens
ggaauaugaugaaccaauc

SEQ ID NO: 328457 - RNA, 19 nt, Homo sapiens
ccaaaggaauuccagaguu

SEQ ID NO: 328458 - RNA, 19 nt, Homo sapiens
ccagcuacaucgaaacuuu

SEQ ID NO: 328459 - RNA, 19 nt, Homo sapiens
gagaagaggaggaauuaga

SEQ ID NO: 328460 - RNA, 19 nt, Homo sapiens
ggucaccucauauuuauuu

SEQ ID NO: 328461 - RNA, 19 nt, Homo sapiens
gugaauuaguccaggaaua

SEQ ID NO: 328462 - RNA, 19 nt, Homo sapiens
gcgggucaccucauauuua

SEQ ID NO: 328463 - RNA, 19 nt, Homo sapiens
guaaaguagucgucacaga

SEQ ID NO: 328464 - RNA, 19 nt, Homo sapiens
gaaacaacuucaggugaga

SEQ ID NO: 328465 - RNA, 19 nt, Homo sapiens
uuaaaguggugaaacauug

SEQ ID NO: 328466 - RNA, 19 nt, Homo sapiens
gcaggaagaugugccacuu

SEQ ID NO: 328467 - RNA, 19 nt, Homo sapiens
ggaaagaauguuacuguca

SEQ ID NO: 328468 - RNA, 19 nt, Homo sapiens
gcugggaaguccugcguuu

SEQ ID NO: 328469 - RNA, 19 nt, Homo sapiens
cagaaaagcucacagauca

SEQ ID NO: 328470 - RNA, 19 nt, Homo sapiens
gaacaauuacgaaacaagu

SEQ ID NO: 328471 - RNA, 19 nt, Homo sapiens
gaaaucagaaccagauaag

SEQ ID NO: 328472 - RNA, 19 nt, Homo sapiens
uaaaguagucgucacagaa

SEQ ID NO: 328473 - RNA, 19 nt, Homo sapiens
gaaagggcuguguagagua

SEQ ID NO: 328474 - RNA, 19 nt, Homo sapiens
gaagaaaggaaagaauguu

SEQ ID NO: 328475 - RNA, 19 nt, Homo sapiens
ccuacaagaugaaaucaga

SEQ ID NO: 328476 - RNA, 19 nt, Homo sapiens
gaagccaaguucuaugaag

SEQ ID NO: 328477 - RNA, 19 nt, Homo sapiens
ggaagaaaggaaagaaugu

SEQ ID NO: 328478 - RNA, 19 nt, Homo sapiens
ggacuucccugggccuuuc

SEQ ID NO: 328479 - RNA, 19 nt, Homo sapiens
ucacauagaagccaaguuc

SEQ ID NO: 328480 - RNA, 19 nt, Homo sapiens
guagggcccuguucuccuu

SEQ ID NO: 328481 - RNA, 19 nt, Homo sapiens
gaugaaaucagaaccagau

SEQ ID NO: 328482 - RNA, 19 nt, Homo sapiens
gguguacuauugacuggaa

SEQ ID NO: 328483 - RNA, 19 nt, Homo sapiens
agagguacaugacuuggaa

SEQ ID NO: 328484 - RNA, 19 nt, Homo sapiens
gggaggccauagaagauga

SEQ ID NO: 328485 - RNA, 19 nt, Homo sapiens
gguuuaccaucuucagaaa

SEQ ID NO: 328486 - RNA, 19 nt, Homo sapiens
agaaagggcuguguagagu

SEQ ID NO: 328487 - RNA, 19 nt, Homo sapiens
caagagaagagaauuuauc

SEQ ID NO: 328488 - RNA, 19 nt, Homo sapiens
ugacaagagaagagaauuu

SEQ ID NO: 328489 - RNA, 19 nt, Homo sapiens
cgggucaccucauauuuau

SEQ ID NO: 328490 - RNA, 19 nt, Homo sapiens
ccaggaauaugaugaacca

SEQ ID NO: 328491 - RNA, 19 nt, Homo sapiens
uacaugacuuggaaagaaa

SEQ ID NO: 328492 - RNA, 19 nt, Homo sapiens
ucacauuagccucugauuu

SEQ ID NO: 328493 - RNA, 19 nt, Homo sapiens
cuauuaaaguggugaaaca

SEQ ID NO: 328494 - RNA, 19 nt, Homo sapiens
gaggaugaugcggaaauua

SEQ ID NO: 328495 - RNA, 19 nt, Homo sapiens
ugaauuaguccaggaauau

SEQ ID NO: 328496 - RNA, 19 nt, Homo sapiens
cgaggaugaugcggaaauu

SEQ ID NO: 328497 - RNA, 19 nt, Homo sapiens
ugugacggguguacuauug

SEQ ID NO: 328498 - RNA, 19 nt, Homo sapiens
gaugcagaauccucgaguu

SEQ ID NO: 328499 - RNA, 19 nt, Homo sapiens
guaugccgaucaucucaga

SEQ ID NO: 328500 - RNA, 19 nt, Homo sapiens
ugaaaucagaaccagauaa

SEQ ID NO: 328501 - RNA, 19 nt, Homo sapiens
gaaaggaaagaauguuacu

SEQ ID NO: 328502 - RNA, 19 nt, Homo sapiens
aaaugaagaggaagagaaa

SEQ ID NO: 328503 - RNA, 19 nt, Homo sapiens
gauggcagaucacaguuuu

SEQ ID NO: 328504 - RNA, 19 nt, Homo sapiens
cagcuacaucgaaacuuua

SEQ ID NO: 328505 - RNA, 19 nt, Homo sapiens
gguccuggguuugguguga

SEQ ID NO: 328506 - RNA, 19 nt, Homo sapiens
caccauucauccugucuga

SEQ ID NO: 328507 - RNA, 19 nt, Homo sapiens
aaagggcuguguagaguag

SEQ ID NO: 328508 - RNA, 19 nt, Homo sapiens
gcacaaucccguggacaga

SEQ ID NO: 328509 - RNA, 19 nt, Homo sapiens
aaaguagucgucacagaaa

SEQ ID NO: 328510 - RNA, 19 nt, Homo sapiens
uauaccagccucucuuuga

SEQ ID NO: 328511 - RNA, 19 nt, Homo sapiens
aagccaaguucuaugaaga

SEQ ID NO: 328512 - RNA, 19 nt, Homo sapiens
gcuauaccagccucucuuu

SEQ ID NO: 328513 - RNA, 19 nt, Homo sapiens
gagcgucaaguccugcuuu

SEQ ID NO: 328514 - RNA, 19 nt, Homo sapiens
gccgaggucuggugaugug

SEQ ID NO: 328515 - RNA, 19 nt, Homo sapiens
ggagggagaagacgaggau

SEQ ID NO: 328516 - RNA, 19 nt, Homo sapiens
agaagaggaggaauuagaa

SEQ ID NO: 328517 - RNA, 19 nt, Homo sapiens
gucugaagguccuggguuu

SEQ ID NO: 328518 - RNA, 19 nt, Homo sapiens
gaggucuggugaugugguu

SEQ ID NO: 328519 - RNA, 19 nt, Homo sapiens
gaaacaaguacccaaugag

SEQ ID NO: 328520 - RNA, 19 nt, Homo sapiens
uaaaguggugaaacauuga

SEQ ID NO: 328521 - RNA, 19 nt, Homo sapiens
acauucagauggcagauca

SEQ ID NO: 328522 - RNA, 19 nt, Homo sapiens
aggagaagaggaggaauua

SEQ ID NO: 328523 - RNA, 19 nt, Homo sapiens
aaacaaguacccaaugagu

SEQ ID NO: 328524 - RNA, 19 nt, Homo sapiens
uuuaccaucuucagaaaug

SEQ ID NO: 328525 - RNA, 19 nt, Homo sapiens
gccuguagcucuggacuuc

SEQ ID NO: 328526 - RNA, 19 nt, Homo sapiens
aggaugaugcggaaauuaa

SEQ ID NO: 328527 - RNA, 19 nt, Homo sapiens
gaagaggaggaauuagaag

SEQ ID NO: 328528 - RNA, 19 nt, Homo sapiens
cacauuagccucugauuuu

SEQ ID NO: 328529 - RNA, 19 nt, Homo sapiens
ggucgaggcacuguuagaa

SEQ ID NO: 328530 - RNA, 19 nt, Homo sapiens
gaagaggaagagaaauugg

SEQ ID NO: 328531 - RNA, 19 nt, Homo sapiens
ugaagaggaagagaaauug

SEQ ID NO: 328532 - RNA, 19 nt, Homo sapiens
ugcaggauauuaaagugaa

SEQ ID NO: 328533 - RNA, 19 nt, Homo sapiens
gaauuaguccaggaauaug

SEQ ID NO: 328534 - RNA, 19 nt, Homo sapiens
caaggccugugcggaagaa

SEQ ID NO: 328535 - RNA, 19 nt, Homo sapiens
gagcuuacuccaucuaacu

SEQ ID NO: 328536 - RNA, 19 nt, Homo sapiens
aaaugcaaguaacacagaa

SEQ ID NO: 328537 - RNA, 19 nt, Homo sapiens
ugaagagccagaucccaaa

SEQ ID NO: 328538 - RNA, 19 nt, Homo sapiens
acuauugacuggaagaaag

SEQ ID NO: 328539 - RNA, 19 nt, Homo sapiens
agagccagaucccaaagga

SEQ ID NO: 328540 - RNA, 19 nt, Homo sapiens
cgcuguggcucguccuuaa

SEQ ID NO: 328541 - RNA, 19 nt, Homo sapiens
cagaaagggcuguguagag

SEQ ID NO: 328542 - RNA, 19 nt, Homo sapiens
gcuaggagccucggccaau

SEQ ID NO: 328543 - RNA, 19 nt, Homo sapiens
auucauacguuucuagaag

SEQ ID NO: 328544 - RNA, 19 nt, Homo sapiens
ugaagagguacaugacuug

SEQ ID NO: 328545 - RNA, 19 nt, Homo sapiens
gcaaagaagauuaccauua

SEQ ID NO: 328546 - RNA, 19 nt, Homo sapiens
gaaggcaccuggcugagua

SEQ ID NO: 328547 - RNA, 19 nt, Homo sapiens
gaagauaguuuacgaagag

SEQ ID NO: 328548 - RNA, 19 nt, Homo sapiens
aaugagagguggaauguua

SEQ ID NO: 328549 - RNA, 19 nt, Homo sapiens
aauuguagcuggaaucuua

SEQ ID NO: 328550 - RNA, 19 nt, Homo sapiens
gguggaauguuauuucuaa

SEQ ID NO: 328551 - RNA, 19 nt, Homo sapiens
gaggaaagauuaugaaagg

SEQ ID NO: 328552 - RNA, 19 nt, Homo sapiens
gcuggaaucuuaauaacaa

SEQ ID NO: 328553 - RNA, 19 nt, Homo sapiens
caaaucaccugaacaucaa

SEQ ID NO: 328554 - RNA, 19 nt, Homo sapiens
gaagaagcaaagaagauua

SEQ ID NO: 328555 - RNA, 19 nt, Homo sapiens
gaagauuggugcguuagaa

SEQ ID NO: 328556 - RNA, 19 nt, Homo sapiens
gggaacaaaugaagaguga

SEQ ID NO: 328557 - RNA, 19 nt, Homo sapiens
uaaagaggcagauugauuu

SEQ ID NO: 328558 - RNA, 19 nt, Homo sapiens
aaucugugcuaccuuauua

SEQ ID NO: 328559 - RNA, 19 nt, Homo sapiens
guaaagaggcagauugauu

SEQ ID NO: 328560 - RNA, 19 nt, Homo sapiens
ugacagacaccauuaauga

SEQ ID NO: 328561 - RNA, 19 nt, Homo sapiens
ucaaacggaugaacuauuc

SEQ ID NO: 328562 - RNA, 19 nt, Homo sapiens
caagugauauuaagguugu

SEQ ID NO: 328563 - RNA, 19 nt, Homo sapiens
cuaauaauccugaggcaua

SEQ ID NO: 328564 - RNA, 19 nt, Homo sapiens
aagaaauacuggcagguua

SEQ ID NO: 328565 - RNA, 19 nt, Homo sapiens
gaucaaguccuucuacaug

SEQ ID NO: 328566 - RNA, 19 nt, Homo sapiens
ggacuugguuugugaugug

SEQ ID NO: 328567 - RNA, 19 nt, Homo sapiens
gccaugagcugaguuguga

SEQ ID NO: 328568 - RNA, 19 nt, Homo sapiens
gaacaaaugaagagugaau

SEQ ID NO: 328569 - RNA, 19 nt, Homo sapiens
gggauacauuucagcauuu

SEQ ID NO: 328570 - RNA, 19 nt, Homo sapiens
gaaagaggcagaagauagu

SEQ ID NO: 328571 - RNA, 19 nt, Homo sapiens
gaaccaaggagaaaccauu

SEQ ID NO: 328572 - RNA, 19 nt, Homo sapiens
gugaguggcuguuugaguu

SEQ ID NO: 328573 - RNA, 19 nt, Homo sapiens
ggaaagauuaugaaaggaa

SEQ ID NO: 328574 - RNA, 19 nt, Homo sapiens
ugugguagaucgaauauug

SEQ ID NO: 328575 - RNA, 19 nt, Homo sapiens
ggaagaagcaaagaagauu

SEQ ID NO: 328576 - RNA, 19 nt, Homo sapiens
gaaauacuggcagguuaua

SEQ ID NO: 328577 - RNA, 19 nt, Homo sapiens
gagaaaacauguccaaaau

SEQ ID NO: 328578 - RNA, 19 nt, Homo sapiens
gagcaguguugcaguguau

SEQ ID NO: 328579 - RNA, 19 nt, Homo sapiens
gaagaaauacuggcagguu

SEQ ID NO: 328580 - RNA, 19 nt, Homo sapiens
gauggaacuuucuaugaau

SEQ ID NO: 328581 - RNA, 19 nt, Homo sapiens
gaagauggaacuuucuaug

SEQ ID NO: 328582 - RNA, 19 nt, Homo sapiens
cagguuaucuucagugugu

SEQ ID NO: 328583 - RNA, 19 nt, Homo sapiens
gcaaggaaagaauuuaaug

SEQ ID NO: 328584 - RNA, 19 nt, Homo sapiens
gggcuuggaacgauucuua

SEQ ID NO: 328585 - RNA, 19 nt, Homo sapiens
caacauuagugcaaacaca

SEQ ID NO: 328586 - RNA, 19 nt, Homo sapiens
cuuuagagaucacuucuuu

SEQ ID NO: 328587 - RNA, 19 nt, Homo sapiens
ccaaggagaaaccauuuaa

SEQ ID NO: 328588 - RNA, 19 nt, Homo sapiens
agauggaacuuucuaugaa

SEQ ID NO: 328589 - RNA, 19 nt, Homo sapiens
cugacaaccugaucaauga

SEQ ID NO: 328590 - RNA, 19 nt, Homo sapiens
uggcuucauuucagauuua

SEQ ID NO: 328591 - RNA, 19 nt, Homo sapiens
ucaaaucaccugaacauca

SEQ ID NO: 328592 - RNA, 19 nt, Homo sapiens
cccagaagcuccugagaga

SEQ ID NO: 328593 - RNA, 19 nt, Homo sapiens
guagcuggaaucuuaauaa

SEQ ID NO: 328594 - RNA, 19 nt, Homo sapiens
cuaaaucacaguugaagaa

SEQ ID NO: 328595 - RNA, 19 nt, Homo sapiens
ccugguaauuccuaaguaa

SEQ ID NO: 328596 - RNA, 19 nt, Homo sapiens
ggaacuuucuaugaauuug

SEQ ID NO: 328597 - RNA, 19 nt, Homo sapiens
caguaucccucuuagcauu

SEQ ID NO: 328598 - RNA, 19 nt, Homo sapiens
ccugaggauucccgucuua

SEQ ID NO: 328599 - RNA, 19 nt, Homo sapiens
uauagaggccaaagaguaa

SEQ ID NO: 328600 - RNA, 19 nt, Homo sapiens
gugcuuauacccucgauuu

SEQ ID NO: 328601 - RNA, 19 nt, Homo sapiens
gagaucaaguccuucuaca

SEQ ID NO: 328602 - RNA, 19 nt, Homo sapiens
ggcagaagauaguuuacga

SEQ ID NO: 328603 - RNA, 19 nt, Homo sapiens
gaaccauuuccuaccauuu

SEQ ID NO: 328604 - RNA, 19 nt, Homo sapiens
gaugcuaucguuuggcuaa

SEQ ID NO: 328605 - RNA, 19 nt, Homo sapiens
gcaggcaaggaaagaauuu

SEQ ID NO: 328606 - RNA, 19 nt, Homo sapiens
uuagagaucacuucuuuga

SEQ ID NO: 328607 - RNA, 19 nt, Homo sapiens
ggagaaaacauguccaaaa

SEQ ID NO: 328608 - RNA, 19 nt, Homo sapiens
caacaacagacacaugaug

SEQ ID NO: 328609 - RNA, 19 nt, Homo sapiens
caguauaauucagcaguaa

SEQ ID NO: 328610 - RNA, 19 nt, Homo sapiens
gauaguuuacgaagagaaa

SEQ ID NO: 328611 - RNA, 19 nt, Homo sapiens
gagguggaauguuauuucu

SEQ ID NO: 328612 - RNA, 19 nt, Homo sapiens
acagcaggcuuacugaaug

SEQ ID NO: 328613 - RNA, 19 nt, Homo sapiens
gaaguuacuccuccaacau

SEQ ID NO: 328614 - RNA, 19 nt, Homo sapiens
gcugacaaccugaucaaug

SEQ ID NO: 328615 - RNA, 19 nt, Homo sapiens
aaagaaagaggcagaagau

SEQ ID NO: 328616 - RNA, 19 nt, Homo sapiens
ugaauagccuuuuguauca

SEQ ID NO: 328617 - RNA, 19 nt, Homo sapiens
ccuggaauucuuugauuua

SEQ ID NO: 328618 - RNA, 19 nt, Homo sapiens
uaccuggaauucuuugauu

SEQ ID NO: 328619 - RNA, 19 nt, Homo sapiens
gguauacggaucagagaaa

SEQ ID NO: 328620 - RNA, 19 nt, Homo sapiens
uggagaagauaucccagaa

SEQ ID NO: 328621 - RNA, 19 nt, Homo sapiens
gcaaacacaaguagaaggu

SEQ ID NO: 328622 - RNA, 19 nt, Homo sapiens
gaaaacauguccaaaaucc

SEQ ID NO: 328623 - RNA, 19 nt, Homo sapiens
aaccauuuccuaccauuua

SEQ ID NO: 328624 - RNA, 19 nt, Homo sapiens
acaguauaauucagcagua

SEQ ID NO: 328625 - RNA, 19 nt, Homo sapiens
gagcucaacccgaacuuuc

SEQ ID NO: 328626 - RNA, 19 nt, Homo sapiens
ugaaguuacuccuccaaca

SEQ ID NO: 328627 - RNA, 19 nt, Homo sapiens
caaggagaaaccauuuaaa

SEQ ID NO: 328628 - RNA, 19 nt, Homo sapiens
gagauggaaccaaggagaa

SEQ ID NO: 328629 - RNA, 19 nt, Homo sapiens
ggauauagaggccaaagag

SEQ ID NO: 328630 - RNA, 19 nt, Homo sapiens
ugugaagauuggugcguua

SEQ ID NO: 328631 - RNA, 19 nt, Homo sapiens
uaaaugaacacccguaaaa

SEQ ID NO: 328632 - RNA, 19 nt, Homo sapiens
aaagaaccauuuccuacca

SEQ ID NO: 328633 - RNA, 19 nt, Homo sapiens
aagcguggaggaaagauua

SEQ ID NO: 328634 - RNA, 19 nt, Homo sapiens
gaugacagacaccauuaau

SEQ ID NO: 328635 - RNA, 19 nt, Homo sapiens
cuauucagaugcuaucguu

SEQ ID NO: 328636 - RNA, 19 nt, Homo sapiens
gaacuauucagaugcuauc

SEQ ID NO: 328637 - RNA, 19 nt, Homo sapiens
gcaccuggcugaguacacu

SEQ ID NO: 328638 - RNA, 19 nt, Homo sapiens
agggauacauuucagcauu

SEQ ID NO: 328639 - RNA, 19 nt, Homo sapiens
ggaggaaagauuaugaaag

SEQ ID NO: 328640 - RNA, 19 nt, Homo sapiens
ggagaaaccauuuaaaaca

SEQ ID NO: 328641 - RNA, 19 nt, Homo sapiens
gcagagcaguccagaacac

SEQ ID NO: 328642 - RNA, 19 nt, Homo sapiens
ugaggagucugacguugau

SEQ ID NO: 328643 - RNA, 19 nt, Homo sapiens
ccaaagaguaaagguguuu

SEQ ID NO: 328644 - RNA, 19 nt, Homo sapiens
agaagauaguuuacgaaga

SEQ ID NO: 328645 - RNA, 19 nt, Homo sapiens
gaaaucaccugaagacaaa

SEQ ID NO: 328646 - RNA, 19 nt, Homo sapiens
gaacugauguccaagaaga

SEQ ID NO: 328647 - RNA, 19 nt, Homo sapiens
ggaaaucacuucuggaguu

SEQ ID NO: 328648 - RNA, 19 nt, Homo sapiens
gaaagaugaugcaaagaaa

SEQ ID NO: 328649 - RNA, 19 nt, Homo sapiens
gaaagaaauugaggaacua

SEQ ID NO: 328650 - RNA, 19 nt, Homo sapiens
gaagaaaugccaaaugauu

SEQ ID NO: 328651 - RNA, 19 nt, Homo sapiens
ugaaagcacugcauguuaa

SEQ ID NO: 328652 - RNA, 19 nt, Homo sapiens
gaacccagcugucuugcaa

SEQ ID NO: 328653 - RNA, 19 nt, Homo sapiens
gaacugcuacccgaaauua

SEQ ID NO: 328654 - RNA, 19 nt, Homo sapiens
gaaagagggugaagaaacu

SEQ ID NO: 328655 - RNA, 19 nt, Homo sapiens
ggagaaggguggaagagaa

SEQ ID NO: 328656 - RNA, 19 nt, Homo sapiens
ggaagcagcuagucuuuua

SEQ ID NO: 328657 - RNA, 19 nt, Homo sapiens
caaauugugugacugauau

SEQ ID NO: 328658 - RNA, 19 nt, Homo sapiens
ugagauauaucaacacuug

SEQ ID NO: 328659 - RNA, 19 nt, Homo sapiens
gagaagaacagaugaaaga

SEQ ID NO: 328660 - RNA, 19 nt, Homo sapiens
ggaaagaugaugcaaagaa

SEQ ID NO: 328661 - RNA, 19 nt, Homo sapiens
caagaagagugcagagaaa

SEQ ID NO: 328662 - RNA, 19 nt, Homo sapiens
ccgaagaaaugccaaauga

SEQ ID NO: 328663 - RNA, 19 nt, Homo sapiens
ccagggagcuacugagaaa

SEQ ID NO: 328664 - RNA, 19 nt, Homo sapiens
agaagaggaugauaaagaa

SEQ ID NO: 328665 - RNA, 19 nt, Homo sapiens
uaacauagaugaggaagca

SEQ ID NO: 328666 - RNA, 19 nt, Homo sapiens
gaaauuagagagaagauag

SEQ ID NO: 328667 - RNA, 19 nt, Homo sapiens
gaagauagaagaugcaaag

SEQ ID NO: 328668 - RNA, 19 nt, Homo sapiens
cagaauggcuguacuaaac

SEQ ID NO: 328669 - RNA, 19 nt, Homo sapiens
gaaaucacuucuggaguug

SEQ ID NO: 328670 - RNA, 19 nt, Homo sapiens
ggaugguucuuguccuaua

SEQ ID NO: 328671 - RNA, 19 nt, Homo sapiens
gaaaauggaugauggacuu

SEQ ID NO: 328672 - RNA, 19 nt, Homo sapiens
ggaggaggcucuucagucu

SEQ ID NO: 328673 - RNA, 19 nt, Homo sapiens
gcaaaucuauugaagucau

SEQ ID NO: 328674 - RNA, 19 nt, Homo sapiens
cagcaaaucuauugaaguc

SEQ ID NO: 328675 - RNA, 19 nt, Homo sapiens
gaugaaagagggugaagaa

SEQ ID NO: 328676 - RNA, 19 nt, Homo sapiens
caaagaaagccaaacaaga

SEQ ID NO: 328677 - RNA, 19 nt, Homo sapiens
caaaagaaguuucagaaga

SEQ ID NO: 328678 - RNA, 19 nt, Homo sapiens
ugagagaacagguuuauga

SEQ ID NO: 328679 - RNA, 19 nt, Homo sapiens
gagaucagacuccuauuga

SEQ ID NO: 328680 - RNA, 19 nt, Homo sapiens
gguagaagcagagucuuua

SEQ ID NO: 328681 - RNA, 19 nt, Homo sapiens
guacaacucucaguaugau

SEQ ID NO: 328682 - RNA, 19 nt, Homo sapiens
gcucagaagaggaugauaa

SEQ ID NO: 328683 - RNA, 19 nt, Homo sapiens
gcucaggacuagaggagaa

SEQ ID NO: 328684 - RNA, 19 nt, Homo sapiens
gaacaggaaguaccagaug

SEQ ID NO: 328685 - RNA, 19 nt, Homo sapiens
guauagaaagguugagaua

SEQ ID NO: 328686 - RNA, 19 nt, Homo sapiens
gccugaaacugauaaagaa

SEQ ID NO: 328687 - RNA, 19 nt, Homo sapiens
cagaagaggaugauaaaga

SEQ ID NO: 328688 - RNA, 19 nt, Homo sapiens
gaaugaagcugaggucacu

SEQ ID NO: 328689 - RNA, 19 nt, Homo sapiens
cuagauugguuaacugaaa

SEQ ID NO: 328690 - RNA, 19 nt, Homo sapiens
uggcaaagccugaaacuga

SEQ ID NO: 328691 - RNA, 19 nt, Homo sapiens
gaggcuggcugguugaguu

SEQ ID NO: 328692 - RNA, 19 nt, Homo sapiens
gcacaguucagcaaaucua

SEQ ID NO: 328693 - RNA, 19 nt, Homo sapiens
gcagaggccucagcuguag

SEQ ID NO: 328694 - RNA, 19 nt, Homo sapiens
acugguaggucaagaagua

SEQ ID NO: 328695 - RNA, 19 nt, Homo sapiens
uuacccaucugcagaauug

SEQ ID NO: 328696 - RNA, 19 nt, Homo sapiens
aaacaagaauuggugaaga

SEQ ID NO: 328697 - RNA, 19 nt, Homo sapiens
gauccuaauuccuaucugu

SEQ ID NO: 328698 - RNA, 19 nt, Homo sapiens
gcaaagaaagccaaacaag

SEQ ID NO: 328699 - RNA, 19 nt, Homo sapiens
gaacuggcucugaaagcua

SEQ ID NO: 328700 - RNA, 19 nt, Homo sapiens
caagaaagaaauugaggaa

SEQ ID NO: 328701 - RNA, 19 nt, Homo sapiens
gaagacaaaguucagauag

SEQ ID NO: 328702 - RNA, 19 nt, Homo sapiens
uaacugaaaccucugaaga

SEQ ID NO: 328703 - RNA, 19 nt, Homo sapiens
uaagaaguauggagagaca

SEQ ID NO: 328704 - RNA, 19 nt, Homo sapiens
uagcugaacuggcucugaa

SEQ ID NO: 328705 - RNA, 19 nt, Homo sapiens
aaagauggcucaggacuag

SEQ ID NO: 328706 - RNA, 19 nt, Homo sapiens
gaaagguugagauauauca

SEQ ID NO: 328707 - RNA, 19 nt, Homo sapiens
ccugggauaugcuggauuu

SEQ ID NO: 328708 - RNA, 19 nt, Homo sapiens
gaaaacaagucucuucaag

SEQ ID NO: 328709 - RNA, 19 nt, Homo sapiens
gcauagaggagaagccaaa

SEQ ID NO: 328710 - RNA, 19 nt, Homo sapiens
ugacuugacucuagauugg

SEQ ID NO: 328711 - RNA, 19 nt, Homo sapiens
gaacaggacagugaaaugg

SEQ ID NO: 328712 - RNA, 19 nt, Homo sapiens
gcaaagccugaaacugaua

SEQ ID NO: 328713 - RNA, 19 nt, Homo sapiens
ggaagaggaagaaggagaa

SEQ ID NO: 328714 - RNA, 19 nt, Homo sapiens
agagacagcuaaugagugu

SEQ ID NO: 328715 - RNA, 19 nt, Homo sapiens
gaagaggaaaccagaggaa

SEQ ID NO: 328716 - RNA, 19 nt, Homo sapiens
uguagaggcuggaucagaa

SEQ ID NO: 328717 - RNA, 19 nt, Homo sapiens
ggaacuaaaggaacugcua

SEQ ID NO: 328718 - RNA, 19 nt, Homo sapiens
agaaagaaauugaggaacu

SEQ ID NO: 328719 - RNA, 19 nt, Homo sapiens
gagagaagaacagaugaaa

SEQ ID NO: 328720 - RNA, 19 nt, Homo sapiens
ggaagagaagauauggaua

SEQ ID NO: 328721 - RNA, 19 nt, Homo sapiens
gguaagaaguauggagaga

SEQ ID NO: 328722 - RNA, 19 nt, Homo sapiens
ggaaaacggucugcauuug

SEQ ID NO: 328723 - RNA, 19 nt, Homo sapiens
uaaacgagcaggugaagga

SEQ ID NO: 328724 - RNA, 19 nt, Homo sapiens
caaagcugguuccuaguca

SEQ ID NO: 328725 - RNA, 19 nt, Homo sapiens
caauggaccgucaguugua

SEQ ID NO: 328726 - RNA, 19 nt, Homo sapiens
uaucaacacuuggaauugu

SEQ ID NO: 328727 - RNA, 19 nt, Homo sapiens
ggugcuuccucaucaaauu

SEQ ID NO: 328728 - RNA, 19 nt, Homo sapiens
gaagaggaugauaaagaaa

SEQ ID NO: 328729 - RNA, 19 nt, Homo sapiens
ggagaagcagggagaggua

SEQ ID NO: 328730 - RNA, 19 nt, Homo sapiens
ccaagaagagugcagagaa

SEQ ID NO: 328731 - RNA, 19 nt, Homo sapiens
gggaagaguugagagaaca

SEQ ID NO: 328732 - RNA, 19 nt, Homo sapiens
ccagcugucuugcaaacuu

SEQ ID NO: 328733 - RNA, 19 nt, Homo sapiens
aaagaaagccaaacaagag

SEQ ID NO: 328734 - RNA, 19 nt, Homo sapiens
gaauggcuguacuaaacga

SEQ ID NO: 328735 - RNA, 19 nt, Homo sapiens
gaguuccaguccugccuua

SEQ ID NO: 328736 - RNA, 19 nt, Homo sapiens
auagaaagacugacagaaa

SEQ ID NO: 328737 - RNA, 19 nt, Homo sapiens
ggaagcaagggaagaguug

SEQ ID NO: 328738 - RNA, 19 nt, Homo sapiens
gcugguuucugccgacaaa

SEQ ID NO: 328739 - RNA, 19 nt, Homo sapiens
gaugguucuuguccuauau

SEQ ID NO: 328740 - RNA, 19 nt, Homo sapiens
caauggugcuauauucugu

SEQ ID NO: 328741 - RNA, 19 nt, Homo sapiens
ccggaaagaugaugcaaag

SEQ ID NO: 328742 - RNA, 19 nt, Homo sapiens
agacggugcuuccucauca

SEQ ID NO: 328743 - RNA, 19 nt, Homo sapiens
cuauugaagucauugagaa

SEQ ID NO: 328744 - RNA, 19 nt, Homo sapiens
ggguacaacucucaguaug

SEQ ID NO: 328745 - RNA, 19 nt, Homo sapiens
ggaaaucacuucuggaguu

SEQ ID NO: 328746 - RNA, 19 nt, Homo sapiens
gaaagaugaugcaaagaaa

SEQ ID NO: 328747 - RNA, 19 nt, Homo sapiens
gaaagaaauugaggaacua

SEQ ID NO: 328748 - RNA, 19 nt, Homo sapiens
gaagaaaugccaaaugauu

SEQ ID NO: 328749 - RNA, 19 nt, Homo sapiens
ugaaagcacugcauguuaa

SEQ ID NO: 328750 - RNA, 19 nt, Homo sapiens
gaacccagcugucuugcaa

SEQ ID NO: 328751 - RNA, 19 nt, Homo sapiens
gaacugcuacccgaaauua

SEQ ID NO: 328752 - RNA, 19 nt, Homo sapiens
ggaagcagcuagucuuuua

SEQ ID NO: 328753 - RNA, 19 nt, Homo sapiens
caaauugugugacugauau

SEQ ID NO: 328754 - RNA, 19 nt, Homo sapiens
ugagauauaucaacacuug

SEQ ID NO: 328755 - RNA, 19 nt, Homo sapiens
ggaaagaugaugcaaagaa

SEQ ID NO: 328756 - RNA, 19 nt, Homo sapiens
ccgaagaaaugccaaauga

SEQ ID NO: 328757 - RNA, 19 nt, Homo sapiens
agaagaggaugauaaagaa

SEQ ID NO: 328758 - RNA, 19 nt, Homo sapiens
gaaauuagagagaagauag

SEQ ID NO: 328759 - RNA, 19 nt, Homo sapiens
gaagauagaagaugcaaag

SEQ ID NO: 328760 - RNA, 19 nt, Homo sapiens
cagaauggcuguacuaaac

SEQ ID NO: 328761 - RNA, 19 nt, Homo sapiens
gaaaucacuucuggaguug

SEQ ID NO: 328762 - RNA, 19 nt, Homo sapiens
ggaugguucuuguccuaua

SEQ ID NO: 328763 - RNA, 19 nt, Homo sapiens
gaaaauggaugauggacuu

SEQ ID NO: 328764 - RNA, 19 nt, Homo sapiens
ggaggaggcucuucagucu

SEQ ID NO: 328765 - RNA, 19 nt, Homo sapiens
gcaaaucuauugaagucau

SEQ ID NO: 328766 - RNA, 19 nt, Homo sapiens
cagcaaaucuauugaaguc

SEQ ID NO: 328767 - RNA, 19 nt, Homo sapiens
caaagaaagccaaacaaga

SEQ ID NO: 328768 - RNA, 19 nt, Homo sapiens
guacaacucucaguaugau

SEQ ID NO: 328769 - RNA, 19 nt, Homo sapiens
gcucagaagaggaugauaa

SEQ ID NO: 328770 - RNA, 19 nt, Homo sapiens
guauagaaagguugagaua

SEQ ID NO: 328771 - RNA, 19 nt, Homo sapiens
cagaagaggaugauaaaga

SEQ ID NO: 328772 - RNA, 19 nt, Homo sapiens
gaggcuggcugguugaguu

SEQ ID NO: 328773 - RNA, 19 nt, Homo sapiens
gcacaguucagcaaaucua

SEQ ID NO: 328774 - RNA, 19 nt, Homo sapiens
uuacccaucugcagaauug

SEQ ID NO: 328775 - RNA, 19 nt, Homo sapiens
aaacaagaauuggugaaga

SEQ ID NO: 328776 - RNA, 19 nt, Homo sapiens
gauccuaauuccuaucugu

SEQ ID NO: 328777 - RNA, 19 nt, Homo sapiens
gcaaagaaagccaaacaag

SEQ ID NO: 328778 - RNA, 19 nt, Homo sapiens
gaacuggcucugaaagcua

SEQ ID NO: 328779 - RNA, 19 nt, Homo sapiens
caagaaagaaauugaggaa

SEQ ID NO: 328780 - RNA, 19 nt, Homo sapiens
uaagaaguauggagagaca

SEQ ID NO: 328781 - RNA, 19 nt, Homo sapiens
uagcugaacuggcucugaa

SEQ ID NO: 328782 - RNA, 19 nt, Homo sapiens
gaaagguugagauauauca

SEQ ID NO: 328783 - RNA, 19 nt, Homo sapiens
ccugggauaugcuggauuu

SEQ ID NO: 328784 - RNA, 19 nt, Homo sapiens
gaaaacaagucucuucaag

SEQ ID NO: 328785 - RNA, 19 nt, Homo sapiens
ggaagaggaagaaggagaa

SEQ ID NO: 328786 - RNA, 19 nt, Homo sapiens
agagacagcuaaugagugu

SEQ ID NO: 328787 - RNA, 19 nt, Homo sapiens
gaagaggaaaccagaggaa

SEQ ID NO: 328788 - RNA, 19 nt, Homo sapiens
ggaacuaaaggaacugcua

SEQ ID NO: 328789 - RNA, 19 nt, Homo sapiens
agaaagaaauugaggaacu

SEQ ID NO: 328790 - RNA, 19 nt, Homo sapiens
gguaagaaguauggagaga

SEQ ID NO: 328791 - RNA, 19 nt, Homo sapiens
ggaaaacggucugcauuug

SEQ ID NO: 328792 - RNA, 19 nt, Homo sapiens
uaaacgagcaggugaagga

SEQ ID NO: 328793 - RNA, 19 nt, Homo sapiens
uaucaacacuuggaauugu

SEQ ID NO: 328794 - RNA, 19 nt, Homo sapiens
ggugcuuccucaucaaauu

SEQ ID NO: 328795 - RNA, 19 nt, Homo sapiens
gaagaggaugauaaagaaa

SEQ ID NO: 328796 - RNA, 19 nt, Homo sapiens
ccagcugucuugcaaacuu

SEQ ID NO: 328797 - RNA, 19 nt, Homo sapiens
aaagaaagccaaacaagag

SEQ ID NO: 328798 - RNA, 19 nt, Homo sapiens
gaauggcuguacuaaacga

SEQ ID NO: 328799 - RNA, 19 nt, Homo sapiens
gcugguuucugccgacaaa

SEQ ID NO: 328800 - RNA, 19 nt, Homo sapiens
gaguuccaguccugccuua

SEQ ID NO: 328801 - RNA, 19 nt, Homo sapiens
gaugguucuuguccuauau

SEQ ID NO: 328802 - RNA, 19 nt, Homo sapiens
caauggugcuauauucugu

SEQ ID NO: 328803 - RNA, 19 nt, Homo sapiens
ccggaaagaugaugcaaag

SEQ ID NO: 328804 - RNA, 19 nt, Homo sapiens
agacggugcuuccucauca

SEQ ID NO: 328805 - RNA, 19 nt, Homo sapiens
cagauaaaguggagagucu

SEQ ID NO: 328806 - RNA, 19 nt, Homo sapiens
cuauugaagucauugagaa

SEQ ID NO: 328807 - RNA, 19 nt, Homo sapiens
ggguacaacucucaguaug

SEQ ID NO: 328808 - RNA, 19 nt, Homo sapiens
agaaugguguguugggaaa

SEQ ID NO: 328809 - RNA, 19 nt, Homo sapiens
ggauuuagcaaagaucauu

SEQ ID NO: 328810 - RNA, 19 nt, Homo sapiens
gaucgucugcugaauacaa

SEQ ID NO: 328811 - RNA, 19 nt, Homo sapiens
cagcugggcuuggcuuaug

SEQ ID NO: 328812 - RNA, 19 nt, Homo sapiens
ucaaauugugugacugaua

SEQ ID NO: 328813 - RNA, 19 nt, Homo sapiens
gccaaaugauucaguccuu

SEQ ID NO: 328814 - RNA, 19 nt, Homo sapiens
ggagagacagcuaaugagu

SEQ ID NO: 328815 - RNA, 19 nt, Homo sapiens
guucuggccuucuguacug

SEQ ID NO: 328816 - RNA, 19 nt, Homo sapiens
guugaggcuuugaugguuu

SEQ ID NO: 328817 - RNA, 19 nt, Homo sapiens
ggauagugaagcuaagaaa

SEQ ID NO: 328818 - RNA, 19 nt, Homo sapiens
caaaugauucaguccuuga

SEQ ID NO: 328819 - RNA, 19 nt, Homo sapiens
ugauaagaccgaagaaaug

SEQ ID NO: 328820 - RNA, 19 nt, Homo sapiens
ggcuggagcuacaguugaa

SEQ ID NO: 328821 - RNA, 19 nt, Homo sapiens
caucaaauugugugacuga

SEQ ID NO: 328822 - RNA, 19 nt, Homo sapiens
gcucuucagucuccaugau

SEQ ID NO: 328823 - RNA, 19 nt, Homo sapiens
gguacaacucucaguauga

SEQ ID NO: 328824 - RNA, 19 nt, Homo sapiens
gagcuugccugggauaugc

SEQ ID NO: 328825 - RNA, 19 nt, Homo sapiens
cuauaauucuguccuggaa

SEQ ID NO: 328826 - RNA, 19 nt, Homo sapiens
cagcugucuugcaaacuuu

SEQ ID NO: 328827 - RNA, 19 nt, Homo sapiens
gguugaggcuuugaugguu

SEQ ID NO: 328828 - RNA, 19 nt, Homo sapiens
gaaaccagaggaagagagu

SEQ ID NO: 328829 - RNA, 19 nt, Homo sapiens
ucucuggcgucccaaauug

SEQ ID NO: 328830 - RNA, 19 nt, Homo sapiens
gaaggaucgucugcugaau

SEQ ID NO: 328831 - RNA, 19 nt, Homo sapiens
cggagaaguuaguguugaa

SEQ ID NO: 328832 - RNA, 19 nt, Homo sapiens
ggaggagauugggaaccua

SEQ ID NO: 328833 - RNA, 19 nt, Homo sapiens
cgucccaaauugccuguuu

SEQ ID NO: 328834 - RNA, 19 nt, Homo sapiens
cagcuagucuuuuagguaa

SEQ ID NO: 328835 - RNA, 19 nt, Homo sapiens
agaugugguuggaagcaua

SEQ ID NO: 328836 - RNA, 19 nt, Homo sapiens
ggccuaggaugguucuugu

SEQ ID NO: 328837 - RNA, 19 nt, Homo sapiens
uugaaagcacugcauguua

SEQ ID NO: 328838 - RNA, 19 nt, Homo sapiens
uuagagagaagauagaaga

SEQ ID NO: 328839 - RNA, 19 nt, Homo sapiens
gaaaacggucugcauuuga

SEQ ID NO: 328840 - RNA, 19 nt, Homo sapiens
ccuaauuccuaucugucua

SEQ ID NO: 328841 - RNA, 19 nt, Homo sapiens
gaaauugaggaacuaaagg

SEQ ID NO: 328842 - RNA, 19 nt, Homo sapiens
gaagaggaagaaggagaaa

SEQ ID NO: 328843 - RNA, 19 nt, Homo sapiens
gcuaaugaguguggagaag

SEQ ID NO: 328844 - RNA, 19 nt, Homo sapiens
ggacacuccagaugugguu

SEQ ID NO: 328845 - RNA, 19 nt, Homo sapiens
gaaaucaccugaagacaaa

SEQ ID NO: 328846 - RNA, 19 nt, Homo sapiens
gaacugauguccaagaaga

SEQ ID NO: 328847 - RNA, 19 nt, Homo sapiens
ggaaaucacuucuggaguu

SEQ ID NO: 328848 - RNA, 19 nt, Homo sapiens
gaaagaugaugcaaagaaa

SEQ ID NO: 328849 - RNA, 19 nt, Homo sapiens
gaaagaaauugaggaacua

SEQ ID NO: 328850 - RNA, 19 nt, Homo sapiens
gaagaaaugccaaaugauu

SEQ ID NO: 328851 - RNA, 19 nt, Homo sapiens
ugaaagcacugcauguuaa

SEQ ID NO: 328852 - RNA, 19 nt, Homo sapiens
gaacccagcugucuugcaa

SEQ ID NO: 328853 - RNA, 19 nt, Homo sapiens
gaacugcuacccgaaauua

SEQ ID NO: 328854 - RNA, 19 nt, Homo sapiens
gaaagagggugaagaaacu

SEQ ID NO: 328855 - RNA, 19 nt, Homo sapiens
ggagaaggguggaagagaa

SEQ ID NO: 328856 - RNA, 19 nt, Homo sapiens
ggaagcagcuagucuuuua

SEQ ID NO: 328857 - RNA, 19 nt, Homo sapiens
caaauugugugacugauau

SEQ ID NO: 328858 - RNA, 19 nt, Homo sapiens
ugagauauaucaacacuug

SEQ ID NO: 328859 - RNA, 19 nt, Homo sapiens
gagaagaacagaugaaaga

SEQ ID NO: 328860 - RNA, 19 nt, Homo sapiens
ggaaagaugaugcaaagaa

SEQ ID NO: 328861 - RNA, 19 nt, Homo sapiens
caagaagagugcagagaaa

SEQ ID NO: 328862 - RNA, 19 nt, Homo sapiens
ccgaagaaaugccaaauga

SEQ ID NO: 328863 - RNA, 19 nt, Homo sapiens
ccagggagcuacugagaaa

SEQ ID NO: 328864 - RNA, 19 nt, Homo sapiens
agaagaggaugauaaagaa

SEQ ID NO: 328865 - RNA, 19 nt, Homo sapiens
uaacauagaugaggaagca

SEQ ID NO: 328866 - RNA, 19 nt, Homo sapiens
gaaauuagagagaagauag

SEQ ID NO: 328867 - RNA, 19 nt, Homo sapiens
gaagauggguugcauuuug

SEQ ID NO: 328868 - RNA, 19 nt, Homo sapiens
gaagauagaagaugcaaag

SEQ ID NO: 328869 - RNA, 19 nt, Homo sapiens
cagaauggcuguacuaaac

SEQ ID NO: 328870 - RNA, 19 nt, Homo sapiens
gaaaucacuucuggaguug

SEQ ID NO: 328871 - RNA, 19 nt, Homo sapiens
ggaugguucuuguccuaua

SEQ ID NO: 328872 - RNA, 19 nt, Homo sapiens
gaaaauggaugauggacuu

SEQ ID NO: 328873 - RNA, 19 nt, Homo sapiens
ggaggaggcucuucagucu

SEQ ID NO: 328874 - RNA, 19 nt, Homo sapiens
gcaaaucuauugaagucau

SEQ ID NO: 328875 - RNA, 19 nt, Homo sapiens
cagcaaaucuauugaaguc

SEQ ID NO: 328876 - RNA, 19 nt, Homo sapiens
gaugaaagagggugaagaa

SEQ ID NO: 328877 - RNA, 19 nt, Homo sapiens
caaagaaagccaaacaaga

SEQ ID NO: 328878 - RNA, 19 nt, Homo sapiens
caaaagaaguuucagaaga

SEQ ID NO: 328879 - RNA, 19 nt, Homo sapiens
ugagagaacagguuuauga

SEQ ID NO: 328880 - RNA, 19 nt, Homo sapiens
ccauuaaucugcuuucugu

SEQ ID NO: 328881 - RNA, 19 nt, Homo sapiens
gagaucagacuccuauuga

SEQ ID NO: 328882 - RNA, 19 nt, Homo sapiens
gguagaagcagagucuuua

SEQ ID NO: 328883 - RNA, 19 nt, Homo sapiens
guacaacucucaguaugau

SEQ ID NO: 328884 - RNA, 19 nt, Homo sapiens
gcucagaagaggaugauaa

SEQ ID NO: 328885 - RNA, 19 nt, Homo sapiens
gcucaggacuagaggagaa

SEQ ID NO: 328886 - RNA, 19 nt, Homo sapiens
gaacaggaaguaccagaug

SEQ ID NO: 328887 - RNA, 19 nt, Homo sapiens
guauagaaagguugagaua

SEQ ID NO: 328888 - RNA, 19 nt, Homo sapiens
gccugaaacugauaaagaa

SEQ ID NO: 328889 - RNA, 19 nt, Homo sapiens
cagaagaggaugauaaaga

SEQ ID NO: 328890 - RNA, 19 nt, Homo sapiens
gaaugaagcugaggucacu

SEQ ID NO: 328891 - RNA, 19 nt, Homo sapiens
cuagauugguuaacugaaa

SEQ ID NO: 328892 - RNA, 19 nt, Homo sapiens
uggcaaagccugaaacuga

SEQ ID NO: 328893 - RNA, 19 nt, Homo sapiens
gaggcuggcugguugaguu

SEQ ID NO: 328894 - RNA, 19 nt, Homo sapiens
gcacaguucagcaaaucua

SEQ ID NO: 328895 - RNA, 19 nt, Homo sapiens
gcagaggccucagcuguag

SEQ ID NO: 328896 - RNA, 19 nt, Homo sapiens
acugguaggucaagaagua

SEQ ID NO: 328897 - RNA, 19 nt, Homo sapiens
uuacccaucugcagaauug

SEQ ID NO: 328898 - RNA, 19 nt, Homo sapiens
aaacaagaauuggugaaga

SEQ ID NO: 328899 - RNA, 19 nt, Homo sapiens
gauccuaauuccuaucugu

SEQ ID NO: 328900 - RNA, 19 nt, Homo sapiens
gcaaagaaagccaaacaag

SEQ ID NO: 328901 - RNA, 19 nt, Homo sapiens
gaacuggcucugaaagcua

SEQ ID NO: 328902 - RNA, 19 nt, Homo sapiens
caagaaagaaauugaggaa

SEQ ID NO: 328903 - RNA, 19 nt, Homo sapiens
gaagacaaaguucagauag

SEQ ID NO: 328904 - RNA, 19 nt, Homo sapiens
uaacugaaaccucugaaga

SEQ ID NO: 328905 - RNA, 19 nt, Homo sapiens
uaagaaguauggagagaca

SEQ ID NO: 328906 - RNA, 19 nt, Homo sapiens
uagcugaacuggcucugaa

SEQ ID NO: 328907 - RNA, 19 nt, Homo sapiens
aaagauggcucaggacuag

SEQ ID NO: 328908 - RNA, 19 nt, Homo sapiens
gaaagguugagauauauca

SEQ ID NO: 328909 - RNA, 19 nt, Homo sapiens
ccugggauaugcuggauuu

SEQ ID NO: 328910 - RNA, 19 nt, Homo sapiens
gaaaacaagucucuucaag

SEQ ID NO: 328911 - RNA, 19 nt, Homo sapiens
cagauaaaguggagagcaa

SEQ ID NO: 328912 - RNA, 19 nt, Homo sapiens
gcauagaggagaagccaaa

SEQ ID NO: 328913 - RNA, 19 nt, Homo sapiens
ugacuugacucuagauugg

SEQ ID NO: 328914 - RNA, 19 nt, Homo sapiens
gaacaggacagugaaaugg

SEQ ID NO: 328915 - RNA, 19 nt, Homo sapiens
gcaaagccugaaacugaua

SEQ ID NO: 328916 - RNA, 19 nt, Homo sapiens
ggaagaggaagaaggagaa

SEQ ID NO: 328917 - RNA, 19 nt, Homo sapiens
agagacagcuaaugagugu

SEQ ID NO: 328918 - RNA, 19 nt, Homo sapiens
gaagaggaaaccagaggaa

SEQ ID NO: 328919 - RNA, 19 nt, Homo sapiens
uguagaggcuggaucagaa

SEQ ID NO: 328920 - RNA, 19 nt, Homo sapiens
ggaacuaaaggaacugcua

SEQ ID NO: 328921 - RNA, 19 nt, Homo sapiens
agaaagaaauugaggaacu

SEQ ID NO: 328922 - RNA, 19 nt, Homo sapiens
gagagaagaacagaugaaa

SEQ ID NO: 328923 - RNA, 19 nt, Homo sapiens
ggaagagaagauauggaua

SEQ ID NO: 328924 - RNA, 19 nt, Homo sapiens
gguaagaaguauggagaga

SEQ ID NO: 328925 - RNA, 19 nt, Homo sapiens
ggaaaacggucugcauuug

SEQ ID NO: 328926 - RNA, 19 nt, Homo sapiens
uaaacgagcaggugaagga

SEQ ID NO: 328927 - RNA, 19 nt, Homo sapiens
caaagcugguuccuaguca

SEQ ID NO: 328928 - RNA, 19 nt, Homo sapiens
caauggaccgucaguugua

SEQ ID NO: 328929 - RNA, 19 nt, Homo sapiens
uaucaacacuuggaauugu

SEQ ID NO: 328930 - RNA, 19 nt, Homo sapiens
ggugcuuccucaucaaauu

SEQ ID NO: 328931 - RNA, 19 nt, Homo sapiens
gaagaggaugauaaagaaa

SEQ ID NO: 328932 - RNA, 19 nt, Homo sapiens
ggagaagcagggagaggua

SEQ ID NO: 328933 - RNA, 19 nt, Homo sapiens
ccaagaagagugcagagaa

SEQ ID NO: 328934 - RNA, 19 nt, Homo sapiens
ggagagcaaccauuaaucu

SEQ ID NO: 328935 - RNA, 19 nt, Homo sapiens
gggaagaguugagagaaca

SEQ ID NO: 328936 - RNA, 19 nt, Homo sapiens
ccagcugucuugcaaacuu

SEQ ID NO: 328937 - RNA, 19 nt, Homo sapiens
aaagaaagccaaacaagag

SEQ ID NO: 328938 - RNA, 19 nt, Homo sapiens
gaauggcuguacuaaacga

SEQ ID NO: 328939 - RNA, 19 nt, Homo sapiens
gaguuccaguccugccuua

SEQ ID NO: 328940 - RNA, 19 nt, Homo sapiens
auagaaagacugacagaaa

SEQ ID NO: 328941 - RNA, 19 nt, Homo sapiens
ggaagcaagggaagaguug

SEQ ID NO: 328942 - RNA, 19 nt, Homo sapiens
gcugguuucugccgacaaa

SEQ ID NO: 328943 - RNA, 19 nt, Homo sapiens
gaugguucuuguccuauau

SEQ ID NO: 328944 - RNA, 19 nt, Homo sapiens
caauggugcuauauucugu

SEQ ID NO: 328945 - RNA, 19 nt, Homo sapiens
gaacauggcuaaauacaau

SEQ ID NO: 328946 - RNA, 19 nt, Homo sapiens
gcacaguacucuugguuua

SEQ ID NO: 328947 - RNA, 19 nt, Homo sapiens
caaaugugcugcuugguua

SEQ ID NO: 328948 - RNA, 19 nt, Homo sapiens
ggaagaagauagauccaaa

SEQ ID NO: 328949 - RNA, 19 nt, Homo sapiens
caacugaaauguuaaggaa

SEQ ID NO: 328950 - RNA, 19 nt, Homo sapiens
gcacuaaugcuuuaagauu

SEQ ID NO: 328951 - RNA, 19 nt, Homo sapiens
uagcagcccugguguauuu

SEQ ID NO: 328952 - RNA, 19 nt, Homo sapiens
gacauuagcagcaucuuua

SEQ ID NO: 328953 - RNA, 19 nt, Homo sapiens
agucagaucuugugaauga

SEQ ID NO: 328954 - RNA, 19 nt, Homo sapiens
acaaagagguggacagaga

SEQ ID NO: 328955 - RNA, 19 nt, Homo sapiens
ggaggagucugugcaguuu

SEQ ID NO: 328956 - RNA, 19 nt, Homo sapiens
aauaagagauccuuuagug

SEQ ID NO: 328957 - RNA, 19 nt, Homo sapiens
gaggguaacuuaacagagu

SEQ ID NO: 328958 - RNA, 19 nt, Homo sapiens
gagacuaaguuguagaaau

SEQ ID NO: 328959 - RNA, 19 nt, Homo sapiens
gccaugcaaugccaaauaa

SEQ ID NO: 328960 - RNA, 19 nt, Homo sapiens
cauaacccaugaaggauaa

SEQ ID NO: 328961 - RNA, 19 nt, Homo sapiens
gcucacagccucacuucua

SEQ ID NO: 328962 - RNA, 19 nt, Homo sapiens
caggaagacuggcagauug

SEQ ID NO: 328963 - RNA, 19 nt, Homo sapiens
caacaugacccucacucua

SEQ ID NO: 328964 - RNA, 19 nt, Homo sapiens
caaauggugguaacugaua

SEQ ID NO: 328965 - RNA, 19 nt, Homo sapiens
ggugagaaauugacgacuu

SEQ ID NO: 328966 - RNA, 19 nt, Homo sapiens
ucaucugacucauucuuua

SEQ ID NO: 328967 - RNA, 19 nt, Homo sapiens
aaacaagacuccucaucau

SEQ ID NO: 328968 - RNA, 19 nt, Homo sapiens
acacucaucugacucauuc

SEQ ID NO: 328969 - RNA, 19 nt, Homo sapiens
aaagucagaucuugugaau

SEQ ID NO: 328970 - RNA, 19 nt, Homo sapiens
gaacgaugcaggauccuau

SEQ ID NO: 328971 - RNA, 19 nt, Homo sapiens
gguguaguguauucucuaa

SEQ ID NO: 328972 - RNA, 19 nt, Homo sapiens
uggcaacagucuaauugua

SEQ ID NO: 328973 - RNA, 19 nt, Homo sapiens
gaugcugucauuaguauuu

SEQ ID NO: 328974 - RNA, 19 nt, Homo sapiens
cugccaagcucacuauuga

SEQ ID NO: 328975 - RNA, 19 nt, Homo sapiens
gaccagacccugaauucuu

SEQ ID NO: 328976 - RNA, 19 nt, Homo sapiens
gguuacagcugguacaaag

SEQ ID NO: 328977 - RNA, 19 nt, Homo sapiens
ggucugcucugcuccugaa

SEQ ID NO: 328978 - RNA, 19 nt, Homo sapiens
gauggcaacagucuaauug

SEQ ID NO: 328979 - RNA, 19 nt, Homo sapiens
caugcaaugccaaauaaua

SEQ ID NO: 328980 - RNA, 19 nt, Homo sapiens
gagauggacaacucaauga

SEQ ID NO: 328981 - RNA, 19 nt, Homo sapiens
ggagauggacaacucaaug

SEQ ID NO: 328982 - RNA, 19 nt, Homo sapiens
gaugcaggauccuaugaau

SEQ ID NO: 328983 - RNA, 19 nt, Homo sapiens
uguaggauauguaauagga

SEQ ID NO: 328984 - RNA, 19 nt, Homo sapiens
ucagagaaaugugucauca

SEQ ID NO: 328985 - RNA, 19 nt, Homo sapiens
gaaauguuaaggaagaaga

SEQ ID NO: 328986 - RNA, 19 nt, Homo sapiens
gcaaugccaaauaauagaa

SEQ ID NO: 328987 - RNA, 19 nt, Homo sapiens
cuacauacuccaacugaaa

SEQ ID NO: 328988 - RNA, 19 nt, Homo sapiens
uuucagaguuggacuucua

SEQ ID NO: 328989 - RNA, 19 nt, Homo sapiens
gauggacaacucaaugaaa

SEQ ID NO: 328990 - RNA, 19 nt, Homo sapiens
ggaccacagucacgaugau

SEQ ID NO: 328991 - RNA, 19 nt, Homo sapiens
uuaguugguuuguaucuug

SEQ ID NO: 328992 - RNA, 19 nt, Homo sapiens
gugagaaauugacgacuuc

SEQ ID NO: 328993 - RNA, 19 nt, Homo sapiens
acugaaauguuaaggaaga

SEQ ID NO: 328994 - RNA, 19 nt, Homo sapiens
uacuccaacugaaauguua

SEQ ID NO: 328995 - RNA, 19 nt, Homo sapiens
ggugguaacugauaauagc

SEQ ID NO: 328996 - RNA, 19 nt, Homo sapiens
caaaccauggugagaaauu

SEQ ID NO: 328997 - RNA, 19 nt, Homo sapiens
uaacccaccugcacaguac

SEQ ID NO: 328998 - RNA, 19 nt, Homo sapiens
gcagccagccaucaaauag

SEQ ID NO: 328999 - RNA, 19 nt, Homo sapiens
cauacucccugguguagug

SEQ ID NO: 329000 - RNA, 19 nt, Homo sapiens
uaaaauggcuacacucauc

SEQ ID NO: 329001 - RNA, 19 nt, Homo sapiens
ucgcugagacuaaguugua

SEQ ID NO: 329002 - RNA, 19 nt, Homo sapiens
gcuuaugccugccucuuuc

SEQ ID NO: 329003 - RNA, 19 nt, Homo sapiens
acucagagacuucaccuaa

SEQ ID NO: 329004 - RNA, 19 nt, Homo sapiens
caggguggcucugauauag

SEQ ID NO: 329005 - RNA, 19 nt, Homo sapiens
aaauggugguaacugauaa

SEQ ID NO: 329006 - RNA, 19 nt, Homo sapiens
aaaccauggugagaaauug

SEQ ID NO: 329007 - RNA, 19 nt, Homo sapiens
ucaccuaacuagagacagu

SEQ ID NO: 329008 - RNA, 19 nt, Homo sapiens
cccagaaucguauugguua

SEQ ID NO: 329009 - RNA, 19 nt, Homo sapiens
cccaaauggugguaacuga

SEQ ID NO: 329010 - RNA, 19 nt, Homo sapiens
gucauaaagucagaucuug

SEQ ID NO: 329011 - RNA, 19 nt, Homo sapiens
aauaggaacucaacaagcu

SEQ ID NO: 329012 - RNA, 19 nt, Homo sapiens
cagccucacuucuaaccuu

SEQ ID NO: 329013 - RNA, 19 nt, Homo sapiens
ucagagacuucaccuaacu

SEQ ID NO: 329014 - RNA, 19 nt, Homo sapiens
ccuauaugcuggagaugga

SEQ ID NO: 329015 - RNA, 19 nt, Homo sapiens
gaucacagucucuggaagu

SEQ ID NO: 329016 - RNA, 19 nt, Homo sapiens
gcuacauacuccaacugaa

SEQ ID NO: 329017 - RNA, 19 nt, Homo sapiens
ugcaaaccauggugagaaa

SEQ ID NO: 329018 - RNA, 19 nt, Homo sapiens
ccaggguggcucugauaua

SEQ ID NO: 329019 - RNA, 19 nt, Homo sapiens
gugccaagcccauaacuca

SEQ ID NO: 329020 - RNA, 19 nt, Homo sapiens
ggauggcaacagucuaauu

SEQ ID NO: 329021 - RNA, 19 nt, Homo sapiens
ggugcuaaaugcuacauac

SEQ ID NO: 329022 - RNA, 19 nt, Homo sapiens
gcuuuaagauuuggucaca

SEQ ID NO: 329023 - RNA, 19 nt, Homo sapiens
guuuguaucuugccuaagg

SEQ ID NO: 329024 - RNA, 19 nt, Homo sapiens
caaagagguggacagagaa

SEQ ID NO: 329025 - RNA, 19 nt, Homo sapiens
gggaggagucugugcaguu

SEQ ID NO: 329026 - RNA, 19 nt, Homo sapiens
guggauggcaacagucuaa

SEQ ID NO: 329027 - RNA, 19 nt, Homo sapiens
cuucuagacucaccuguuc

SEQ ID NO: 329028 - RNA, 19 nt, Homo sapiens
gacuucaccuaacuagaga

SEQ ID NO: 329029 - RNA, 19 nt, Homo sapiens
gugcguaguccaacucuug

SEQ ID NO: 329030 - RNA, 19 nt, Homo sapiens
guaauaggaacucaacaag

SEQ ID NO: 329031 - RNA, 19 nt, Homo sapiens
gauaaaagccccaaauggu

SEQ ID NO: 329032 - RNA, 19 nt, Homo sapiens
caucaggagaacaucauaa

SEQ ID NO: 329033 - RNA, 19 nt, Homo sapiens
ggacagcuuuucccaagau

SEQ ID NO: 329034 - RNA, 19 nt, Homo sapiens
cauaaagucagaucuugug

SEQ ID NO: 329035 - RNA, 19 nt, Homo sapiens
acaaaugugcugcuugguu

SEQ ID NO: 329036 - RNA, 19 nt, Homo sapiens
agacucaccuguucucacu

SEQ ID NO: 329037 - RNA, 19 nt, Homo sapiens
ugacauuagcagcaucuuu

SEQ ID NO: 329038 - RNA, 19 nt, Homo sapiens
ggguggcucugauauagca

SEQ ID NO: 329039 - RNA, 19 nt, Homo sapiens
ccaguggugcuaaaugcua

SEQ ID NO: 329040 - RNA, 19 nt, Homo sapiens
gccaagcucacuauugaau

SEQ ID NO: 329041 - RNA, 19 nt, Homo sapiens
ucaggaagacuggcagauu

SEQ ID NO: 329042 - RNA, 19 nt, Homo sapiens
ggcugcagcuguccaaugg

SEQ ID NO: 329043 - RNA, 19 nt, Homo sapiens
acagucuaauuguaggaua

SEQ ID NO: 329044 - RNA, 19 nt, Homo sapiens
gauauguaauaggaacuca

SEQ ID NO: 329045 - RNA, 19 nt, Homo sapiens
gagccaagcugcacaauuu

SEQ ID NO: 329046 - RNA, 19 nt, Homo sapiens
gggaugcucuuuguaaaua

SEQ ID NO: 329047 - RNA, 19 nt, Homo sapiens
gagaagauccugcacugua

SEQ ID NO: 329048 - RNA, 19 nt, Homo sapiens
gaacagggcgugccuagga

SEQ ID NO: 329049 - RNA, 19 nt, Homo sapiens
ggacagugcuucagcuaca

SEQ ID NO: 329050 - RNA, 19 nt, Homo sapiens
ucagucuucucaugaauaa

SEQ ID NO: 329051 - RNA, 19 nt, Homo sapiens
ccucccagcugcacuuuaa

SEQ ID NO: 329052 - RNA, 19 nt, Homo sapiens
ccaagaacaucacccagau

SEQ ID NO: 329053 - RNA, 19 nt, Homo sapiens
ccaagaccaucccugaaga

SEQ ID NO: 329054 - RNA, 19 nt, Homo sapiens
ccagggaugcucuuuguaa

SEQ ID NO: 329055 - RNA, 19 nt, Homo sapiens
gaaagaccacuggcagaaa

SEQ ID NO: 329056 - RNA, 19 nt, Homo sapiens
ggauggacuuggcuucaga

SEQ ID NO: 329057 - RNA, 19 nt, Homo sapiens
cagggaugcucuuuguaaa

SEQ ID NO: 329058 - RNA, 19 nt, Homo sapiens
caagcugcacaauuuaaua

SEQ ID NO: 329059 - RNA, 19 nt, Homo sapiens
uggacaagcugguggagaa

SEQ ID NO: 329060 - RNA, 19 nt, Homo sapiens
gcacuguucccagauaaga

SEQ ID NO: 329061 - RNA, 19 nt, Homo sapiens
gaaggaaagggaagagucu

SEQ ID NO: 329062 - RNA, 19 nt, Homo sapiens
ccacagagucccugguuca

SEQ ID NO: 329063 - RNA, 19 nt, Homo sapiens
ggaugcucuuuguaaauau

SEQ ID NO: 329064 - RNA, 19 nt, Homo sapiens
ggaagaaggaaagggaaga

SEQ ID NO: 329065 - RNA, 19 nt, Homo sapiens
agaagauccugcacuguag

SEQ ID NO: 329066 - RNA, 19 nt, Homo sapiens
gacccucagucuucucaug

SEQ ID NO: 329067 - RNA, 19 nt, Homo sapiens
gccaagcugcacaauuuaa

SEQ ID NO: 329068 - RNA, 19 nt, Homo sapiens
ccaaguccauccagaacag

SEQ ID NO: 329069 - RNA, 19 nt, Homo sapiens
gaugcucuuuguaaauauc

SEQ ID NO: 329070 - RNA, 19 nt, Homo sapiens
aaagaccacuggcagaaac

SEQ ID NO: 329071 - RNA, 19 nt, Homo sapiens
gcaugaaucgggcuaaggu

SEQ ID NO: 329072 - RNA, 19 nt, Homo sapiens
ucacuugggcucucucuag

SEQ ID NO: 329073 - RNA, 19 nt, Homo sapiens
gaggaggacaugggacuug

SEQ ID NO: 329074 - RNA, 19 nt, Homo sapiens
uggcacuguucccagauaa

SEQ ID NO: 329075 - RNA, 19 nt, Homo sapiens
agaaagaccacuggcagaa

SEQ ID NO: 329076 - RNA, 19 nt, Homo sapiens
cccaacaccuucccacagu

SEQ ID NO: 329077 - RNA, 19 nt, Homo sapiens
ugauggacccucagucuuc

SEQ ID NO: 329078 - RNA, 19 nt, Homo sapiens
ggacagucaggguucacuu

SEQ ID NO: 329079 - RNA, 19 nt, Homo sapiens
uguccucccugccaugcua

SEQ ID NO: 329080 - RNA, 19 nt, Homo sapiens
agggagggcugggcuagaa

SEQ ID NO: 329081 - RNA, 19 nt, Homo sapiens
gauggacccucagucuucu

SEQ ID NO: 329082 - RNA, 19 nt, Homo sapiens
gacagucaggguucacuug

SEQ ID NO: 329083 - RNA, 19 nt, Homo sapiens
ggacagucucccugaugga

SEQ ID NO: 329084 - RNA, 19 nt, Homo sapiens
ccaagcugcacaauuuaau

SEQ ID NO: 329085 - RNA, 19 nt, Homo sapiens
gaagaaggaaagggaagag

SEQ ID NO: 329086 - RNA, 19 nt, Homo sapiens
gccuuucucuggcuuccuu

SEQ ID NO: 329087 - RNA, 19 nt, Homo sapiens
acaagcugguggagaagau

SEQ ID NO: 329088 - RNA, 19 nt, Homo sapiens
ccucagucuucucaugaau

SEQ ID NO: 329089 - RNA, 19 nt, Homo sapiens
ggagaagauccugcacugu

SEQ ID NO: 329090 - RNA, 19 nt, Homo sapiens
gcugugaggccaaguccau

SEQ ID NO: 329091 - RNA, 19 nt, Homo sapiens
ugucuggcuucuagagaug

SEQ ID NO: 329092 - RNA, 19 nt, Homo sapiens
cuuccugucuggcuucuag

SEQ ID NO: 329093 - RNA, 19 nt, Homo sapiens
gggcuuagugugagcaucu

SEQ ID NO: 329094 - RNA, 19 nt, Homo sapiens
gcuucagacucggacuuga

SEQ ID NO: 329095 - RNA, 19 nt, Homo sapiens
gaaaggcgguguugggaaa

SEQ ID NO: 329096 - RNA, 19 nt, Homo sapiens
gaagagaaccucaucaguu

SEQ ID NO: 329097 - RNA, 19 nt, Homo sapiens
ggacacggcuauagaggaa

SEQ ID NO: 329098 - RNA, 19 nt, Homo sapiens
uaaagggcauucucuacaa

SEQ ID NO: 329099 - RNA, 19 nt, Homo sapiens
cuacaaaugugccguuuua

SEQ ID NO: 329100 - RNA, 19 nt, Homo sapiens
uagaggaaaucaaagagaa

SEQ ID NO: 329101 - RNA, 19 nt, Homo sapiens
gcucauagguaagaauugu

SEQ ID NO: 329102 - RNA, 19 nt, Homo sapiens
ggccaucgauucccaagau

SEQ ID NO: 329103 - RNA, 19 nt, Homo sapiens
ucagagaauccaagaguuu

SEQ ID NO: 329104 - RNA, 19 nt, Homo sapiens
uggauccgcucauagguaa

SEQ ID NO: 329105 - RNA, 19 nt, Homo sapiens
aaagggcauucucuacaaa

SEQ ID NO: 329106 - RNA, 19 nt, Homo sapiens
caggauguccggaaagaaa

SEQ ID NO: 329107 - RNA, 19 nt, Homo sapiens
caagauaaugggauuggaa

SEQ ID NO: 329108 - RNA, 19 nt, Homo sapiens
acacacagauugcucuucu

SEQ ID NO: 329109 - RNA, 19 nt, Homo sapiens
guucaggaccaagcaguua

SEQ ID NO: 329110 - RNA, 19 nt, Homo sapiens
gccaucgauucccaagaua

SEQ ID NO: 329111 - RNA, 19 nt, Homo sapiens
gauaaugggauuggaagga

SEQ ID NO: 329112 - RNA, 19 nt, Homo sapiens
cuacagaaguauaauucag

SEQ ID NO: 329113 - RNA, 19 nt, Homo sapiens
ggcuauagaggaaaucaaa

SEQ ID NO: 329114 - RNA, 19 nt, Homo sapiens
acagauugcucuucuagac

SEQ ID NO: 329115 - RNA, 19 nt, Homo sapiens
gaugaaaacacacagauug

SEQ ID NO: 329116 - RNA, 19 nt, Homo sapiens
caaaugugccguuuuaaga

SEQ ID NO: 329117 - RNA, 19 nt, Homo sapiens
guaaucuccaucagucaaa

SEQ ID NO: 329118 - RNA, 19 nt, Homo sapiens
gagaaaaugaagacuguaa

SEQ ID NO: 329119 - RNA, 19 nt, Homo sapiens
cuauagaggaaaucaaaga

SEQ ID NO: 329120 - RNA, 19 nt, Homo sapiens
acacggcuauagaggaaau

SEQ ID NO: 329121 - RNA, 19 nt, Homo sapiens
caguguacguggaagacaa

SEQ ID NO: 329122 - RNA, 19 nt, Homo sapiens
gcucuucuagacaucgaua

SEQ ID NO: 329123 - RNA, 19 nt, Homo sapiens
guccgaagccacuuucuca

SEQ ID NO: 329124 - RNA, 19 nt, Homo sapiens
cacguuagccuacagaagu

SEQ ID NO: 329125 - RNA, 19 nt, Homo sapiens
gcucaugugccaggacuug

SEQ ID NO: 329126 - RNA, 19 nt, Homo sapiens
acguuagccuacagaagua

SEQ ID NO: 329127 - RNA, 19 nt, Homo sapiens
ucauagguaagaauuguga

SEQ ID NO: 329128 - RNA, 19 nt, Homo sapiens
gauccgcucauagguaaga

SEQ ID NO: 329129 - RNA, 19 nt, Homo sapiens
ccguucaucuguccuaagu

SEQ ID NO: 329130 - RNA, 19 nt, Homo sapiens
ggccacagcacacaucgau

SEQ ID NO: 329131 - RNA, 19 nt, Homo sapiens
caucgauucccaagauaau

SEQ ID NO: 329132 - RNA, 19 nt, Homo sapiens
ccaucgauucccaagauaa

SEQ ID NO: 329133 - RNA, 19 nt, Homo sapiens
gccuacagaaguauaauuc

SEQ ID NO: 329134 - RNA, 19 nt, Homo sapiens
ccgaagccacuuucucaga

SEQ ID NO: 329135 - RNA, 19 nt, Homo sapiens
guccuaagugcaagaaaga

SEQ ID NO: 329136 - RNA, 19 nt, Homo sapiens
caccugggacgucggauga

SEQ ID NO: 329137 - RNA, 19 nt, Homo sapiens
agauugcucuucuagacau

SEQ ID NO: 329138 - RNA, 19 nt, Homo sapiens
acacagauugcucuucuag

SEQ ID NO: 329139 - RNA, 19 nt, Homo sapiens
gcagaggggcuucauguca

SEQ ID NO: 329140 - RNA, 19 nt, Homo sapiens
uguccuaagugcaagaaag

SEQ ID NO: 329141 - RNA, 19 nt, Homo sapiens
ggucgacuaccucauugug

SEQ ID NO: 329142 - RNA, 19 nt, Homo sapiens
agaggaaaucaaagagaaa

SEQ ID NO: 329143 - RNA, 19 nt, Homo sapiens
auaaagggcauucucuaca

SEQ ID NO: 329144 - RNA, 19 nt, Homo sapiens
uauaaagggcauucucuac

SEQ ID NO: 329145 - RNA, 19 nt, Homo sapiens
cacacagauugcucuucua

SEQ ID NO: 329146 - RNA, 19 nt, Homo sapiens
ggaaaucaaagagaaaaug

SEQ ID NO: 329147 - RNA, 19 nt, Homo sapiens
ccggaaagaaaucaacuuc

SEQ ID NO: 329148 - RNA, 19 nt, Homo sapiens
acuccaggauguccggaaa

SEQ ID NO: 329149 - RNA, 19 nt, Homo sapiens
gcaguuccuccgagaugug

SEQ ID NO: 329150 - RNA, 19 nt, Homo sapiens
uccaggauguccggaaaga

SEQ ID NO: 329151 - RNA, 19 nt, Homo sapiens
auauaaagggcauucucua

SEQ ID NO: 329152 - RNA, 19 nt, Homo sapiens
ccgcucauagguaagaauu

SEQ ID NO: 329153 - RNA, 19 nt, Homo sapiens
cagauauucccucccacaa

SEQ ID NO: 329154 - RNA, 19 nt, Homo sapiens
cauagaagaugaaguauug

SEQ ID NO: 329155 - RNA, 19 nt, Homo sapiens
ggaggaagaugucaauguu

SEQ ID NO: 329156 - RNA, 19 nt, Homo sapiens
gaagcagccuccacaaauu

SEQ ID NO: 329157 - RNA, 19 nt, Homo sapiens
gaagaaacgugaacucaag

SEQ ID NO: 329158 - RNA, 19 nt, Homo sapiens
gaaauggauucagucaaua

SEQ ID NO: 329159 - RNA, 19 nt, Homo sapiens
gaaauugaguuccgcaguu

SEQ ID NO: 329160 - RNA, 19 nt, Homo sapiens
gaauugacagggcauauua

SEQ ID NO: 329161 - RNA, 19 nt, Homo sapiens
ccaacuaaauugccaagua

SEQ ID NO: 329162 - RNA, 19 nt, Homo sapiens
gaucuaccuugaauugaua

SEQ ID NO: 329163 - RNA, 19 nt, Homo sapiens
gaagauaacugaggauuuu

SEQ ID NO: 329164 - RNA, 19 nt, Homo sapiens
caacuaaauugccaaguau

SEQ ID NO: 329165 - RNA, 19 nt, Homo sapiens
gcagauacaugggauuuga

SEQ ID NO: 329166 - RNA, 19 nt, Homo sapiens
ccaaacagcauaagaaauu

SEQ ID NO: 329167 - RNA, 19 nt, Homo sapiens
ggagaaccauacagacuuu

SEQ ID NO: 329168 - RNA, 19 nt, Homo sapiens
ccauuaugcuguagucuua

SEQ ID NO: 329169 - RNA, 19 nt, Homo sapiens
gaauuauccuuuccucauu

SEQ ID NO: 329170 - RNA, 19 nt, Homo sapiens
aaagggagaugguaagaaa

SEQ ID NO: 329171 - RNA, 19 nt, Homo sapiens
gaacaaacacaaccugcua

SEQ ID NO: 329172 - RNA, 19 nt, Homo sapiens
ggaauauaauggacagauu

SEQ ID NO: 329173 - RNA, 19 nt, Homo sapiens
gaacaugggauacuuuaga

SEQ ID NO: 329174 - RNA, 19 nt, Homo sapiens
cuacacaaaugauagcaua

SEQ ID NO: 329175 - RNA, 19 nt, Homo sapiens
agaaaugucuucaugcaaa

SEQ ID NO: 329176 - RNA, 19 nt, Homo sapiens
gaacguguguuguugauac

SEQ ID NO: 329177 - RNA, 19 nt, Homo sapiens
gacacaaacucagacaaua

SEQ ID NO: 329178 - RNA, 19 nt, Homo sapiens
ccaacaagguuauaugaau

SEQ ID NO: 329179 - RNA, 19 nt, Homo sapiens
ggauggauauagaaacaaa

SEQ ID NO: 329180 - RNA, 19 nt, Homo sapiens
ccuccugucuuuacaaaua

SEQ ID NO: 329181 - RNA, 19 nt, Homo sapiens
gaagggaguuccagucaag

SEQ ID NO: 329182 - RNA, 19 nt, Homo sapiens
gaaacgucuuguucucuuu

SEQ ID NO: 329183 - RNA, 19 nt, Homo sapiens
gaauagaaacgucuuguuc

SEQ ID NO: 329184 - RNA, 19 nt, Homo sapiens
ggaaagggaugaagaaaau

SEQ ID NO: 329185 - RNA, 19 nt, Homo sapiens
auacguagcugacacagaa

SEQ ID NO: 329186 - RNA, 19 nt, Homo sapiens
gaagcuagguugauaacag

SEQ ID NO: 329187 - RNA, 19 nt, Homo sapiens
ugaaaucccuguauugaca

SEQ ID NO: 329188 - RNA, 19 nt, Homo sapiens
agaaauggauucagucaau

SEQ ID NO: 329189 - RNA, 19 nt, Homo sapiens
agagaguuaugaacacuua

SEQ ID NO: 329190 - RNA, 19 nt, Homo sapiens
ucagaaugcuuucacaaga

SEQ ID NO: 329191 - RNA, 19 nt, Homo sapiens
gaauagaguaugagccuuu

SEQ ID NO: 329192 - RNA, 19 nt, Homo sapiens
gaaagaauacagaacuaga

SEQ ID NO: 329193 - RNA, 19 nt, Homo sapiens
gaaaugucuucaugcaaau

SEQ ID NO: 329194 - RNA, 19 nt, Homo sapiens
ggaagacugcccuacuaua

SEQ ID NO: 329195 - RNA, 19 nt, Homo sapiens
gauagaacaugggauacuu

SEQ ID NO: 329196 - RNA, 19 nt, Homo sapiens
gguaugacauuggauagaa

SEQ ID NO: 329197 - RNA, 19 nt, Homo sapiens
gagccaaucugcaauuucu

SEQ ID NO: 329198 - RNA, 19 nt, Homo sapiens
gagcuuauuuagaguccua

SEQ ID NO: 329199 - RNA, 19 nt, Homo sapiens
ggccauagaagaugaagua

SEQ ID NO: 329200 - RNA, 19 nt, Homo sapiens
caaaucagcaagaauagaa

SEQ ID NO: 329201 - RNA, 19 nt, Homo sapiens
gcacucaccuugucauggu

SEQ ID NO: 329202 - RNA, 19 nt, Homo sapiens
gaugaaaucccuguauuga

SEQ ID NO: 329203 - RNA, 19 nt, Homo sapiens
gaagacugcccuacuauag

SEQ ID NO: 329204 - RNA, 19 nt, Homo sapiens
ucaccuacauguuauucua

SEQ ID NO: 329205 - RNA, 19 nt, Homo sapiens
cuacaaagaauuacuguga

SEQ ID NO: 329206 - RNA, 19 nt, Homo sapiens
cagaugaaaucccuguauu

SEQ ID NO: 329207 - RNA, 19 nt, Homo sapiens
ccgaaaucaugcuguguua

SEQ ID NO: 329208 - RNA, 19 nt, Homo sapiens
gagaccaguuagauuauug

SEQ ID NO: 329209 - RNA, 19 nt, Homo sapiens
ggccaaggauggauauaga

SEQ ID NO: 329210 - RNA, 19 nt, Homo sapiens
cagaagaaauggauucagu

SEQ ID NO: 329211 - RNA, 19 nt, Homo sapiens
cagugaaaguuaccauuaa

SEQ ID NO: 329212 - RNA, 19 nt, Homo sapiens
ugacagggcauauuaguug

SEQ ID NO: 329213 - RNA, 19 nt, Homo sapiens
ggacacaaacucagacaau

SEQ ID NO: 329214 - RNA, 19 nt, Homo sapiens
ggaccaagccuuucacaag

SEQ ID NO: 329215 - RNA, 19 nt, Homo sapiens
agaagagaaugaagaagaa

SEQ ID NO: 329216 - RNA, 19 nt, Homo sapiens
uuacaaauauuggguguug

SEQ ID NO: 329217 - RNA, 19 nt, Homo sapiens
ucugguaccuccugucuuu

SEQ ID NO: 329218 - RNA, 19 nt, Homo sapiens
gaagaaauggauucaguca

SEQ ID NO: 329219 - RNA, 19 nt, Homo sapiens
uaacagaagagaaugaaga

SEQ ID NO: 329220 - RNA, 19 nt, Homo sapiens
ucagugaaaguuaccauua

SEQ ID NO: 329221 - RNA, 19 nt, Homo sapiens
guaaacagaagcaacagaa

SEQ ID NO: 329222 - RNA, 19 nt, Homo sapiens
ugaaguauuggaacaguua

SEQ ID NO: 329223 - RNA, 19 nt, Homo sapiens
aaagggaaauggaugaugu

SEQ ID NO: 329224 - RNA, 19 nt, Homo sapiens
gaaaacaaaucuucaaagg

SEQ ID NO: 329225 - RNA, 19 nt, Homo sapiens
aacaauaugugcacucauu

SEQ ID NO: 329226 - RNA, 19 nt, Homo sapiens
gauauuacaccuagucugu

SEQ ID NO: 329227 - RNA, 19 nt, Homo sapiens
ggaagaaacgugaacucaa

SEQ ID NO: 329228 - RNA, 19 nt, Homo sapiens
gaggaagaugucaauguua

SEQ ID NO: 329229 - RNA, 19 nt, Homo sapiens
gaacacuacaacauacgua

SEQ ID NO: 329230 - RNA, 19 nt, Homo sapiens
guaaacaauuggacagaag

SEQ ID NO: 329231 - RNA, 19 nt, Homo sapiens
ugcaugcucuucuuguuua

SEQ ID NO: 329232 - RNA, 19 nt, Homo sapiens
ugaaugaggaguucuggua

SEQ ID NO: 329233 - RNA, 19 nt, Homo sapiens
aaggaagacugcccuacua

SEQ ID NO: 329234 - RNA, 19 nt, Homo sapiens
gaaauggaacagugaggaa

SEQ ID NO: 329235 - RNA, 19 nt, Homo sapiens
gguaagaaacaaugaaugu

SEQ ID NO: 329236 - RNA, 19 nt, Homo sapiens
agaaauccgucuggcauaa

SEQ ID NO: 329237 - RNA, 19 nt, Homo sapiens
gaagaugucaauguuagaa

SEQ ID NO: 329238 - RNA, 19 nt, Homo sapiens
uaucagcuuucaccaacua

SEQ ID NO: 329239 - RNA, 19 nt, Homo sapiens
ucacaaggcgugucaguug

SEQ ID NO: 329240 - RNA, 19 nt, Homo sapiens
gcaagggaguuagggaaau

SEQ ID NO: 329241 - RNA, 19 nt, Homo sapiens
uacguaagguaaagacuaa

SEQ ID NO: 329242 - RNA, 19 nt, Homo sapiens
guacguaagguaaagacua

SEQ ID NO: 329243 - RNA, 19 nt, Homo sapiens
gaacuagaagaguggcuaa

SEQ ID NO: 329244 - RNA, 19 nt, Homo sapiens
caaggaagacucacuaugg

SEQ ID NO: 329245 - RNA, 19 nt, Homo sapiens
guaaagauagggcuucuca

SEQ ID NO: 329246 - RNA, 19 nt, Homo sapiens
uaugguaccuuuguuaaug

SEQ ID NO: 329247 - RNA, 19 nt, Homo sapiens
guaaccaaccugagucaaa

SEQ ID NO: 329248 - RNA, 19 nt, Homo sapiens
gaaauugaugugaaaguuc

SEQ ID NO: 329249 - RNA, 19 nt, Homo sapiens
acacaaacucagacaauaa

SEQ ID NO: 329250 - RNA, 19 nt, Homo sapiens
gaugagaaucccaaacuau

SEQ ID NO: 329251 - RNA, 19 nt, Homo sapiens
guacguuguuggaaggaaa

SEQ ID NO: 329252 - RNA, 19 nt, Homo sapiens
gaccuuaauuccugacugu

SEQ ID NO: 329253 - RNA, 19 nt, Homo sapiens
cagaagagaaugaagaaga

SEQ ID NO: 329254 - RNA, 19 nt, Homo sapiens
gauggaaacucuauuaaag

SEQ ID NO: 329255 - RNA, 19 nt, Homo sapiens
gaaccagacugccauggaa

SEQ ID NO: 329256 - RNA, 19 nt, Homo sapiens
uuacaaugcugcaaacuaa

SEQ ID NO: 329257 - RNA, 19 nt, Homo sapiens
gaagagaaccgagcaaaga

SEQ ID NO: 329258 - RNA, 19 nt, Homo sapiens
ggacuggaaugcugaguau

SEQ ID NO: 329259 - RNA, 19 nt, Homo sapiens
gacacuaucuggucaggua

SEQ ID NO: 329260 - RNA, 19 nt, Homo sapiens
gaucucaucuggacuuugu

SEQ ID NO: 329261 - RNA, 19 nt, Homo sapiens
gagaaaagcucaccccaaa

SEQ ID NO: 329262 - RNA, 19 nt, Homo sapiens
gcaaagggcugggugagau

SEQ ID NO: 329263 - RNA, 19 nt, Homo sapiens
ggacaucaccugcuacuuc

SEQ ID NO: 329264 - RNA, 19 nt, Homo sapiens
gaggauggaaacucuauua

SEQ ID NO: 329265 - RNA, 19 nt, Homo sapiens
gagagcaguuggugaagaa

SEQ ID NO: 329266 - RNA, 19 nt, Homo sapiens
gaacaucagcagcgaagaa

SEQ ID NO: 329267 - RNA, 19 nt, Homo sapiens
gggaacagauagagcaaga

SEQ ID NO: 329268 - RNA, 19 nt, Homo sapiens
gaagaaguauggcauucca

SEQ ID NO: 329269 - RNA, 19 nt, Homo sapiens
gaagaugccgugauugugu

SEQ ID NO: 329270 - RNA, 19 nt, Homo sapiens
ggauggaaacucuauuaaa

SEQ ID NO: 329271 - RNA, 19 nt, Homo sapiens
gaacgagagcaaagcauga

SEQ ID NO: 329272 - RNA, 19 nt, Homo sapiens
gaaccgagcaaagaucaaa

SEQ ID NO: 329273 - RNA, 19 nt, Homo sapiens
gcacacacacacacaauuc

SEQ ID NO: 329274 - RNA, 19 nt, Homo sapiens
ggaagacgaugagaaguac

SEQ ID NO: 329275 - RNA, 19 nt, Homo sapiens
auaaagacaucuccugguu

SEQ ID NO: 329276 - RNA, 19 nt, Homo sapiens
ggagagcaguuggugaaga

SEQ ID NO: 329277 - RNA, 19 nt, Homo sapiens
gaggagcaggucacucuua

SEQ ID NO: 329278 - RNA, 19 nt, Homo sapiens
aaacagaugagggcacuua

SEQ ID NO: 329279 - RNA, 19 nt, Homo sapiens
caggagaugccaaagauaa

SEQ ID NO: 329280 - RNA, 19 nt, Homo sapiens
guacccggauccucgaauu

SEQ ID NO: 329281 - RNA, 19 nt, Homo sapiens
caaaggagaacgagagcaa

SEQ ID NO: 329282 - RNA, 19 nt, Homo sapiens
uggaaacucuauuaaagug

SEQ ID NO: 329283 - RNA, 19 nt, Homo sapiens
cgacgaggcugaguacauc

SEQ ID NO: 329284 - RNA, 19 nt, Homo sapiens
ucacauauguagagaacca

SEQ ID NO: 329285 - RNA, 19 nt, Homo sapiens
uuucuggucuuaucauuga

SEQ ID NO: 329286 - RNA, 19 nt, Homo sapiens
gcuaguuucuggucuuauc

SEQ ID NO: 329287 - RNA, 19 nt, Homo sapiens
cgaaagaugaguccaagga

SEQ ID NO: 329288 - RNA, 19 nt, Homo sapiens
acagcaauaucaagaucua

SEQ ID NO: 329289 - RNA, 19 nt, Homo sapiens
cagcccaggugcaguuuga

SEQ ID NO: 329290 - RNA, 19 nt, Homo sapiens
agacugccauggaauuaga

SEQ ID NO: 329291 - RNA, 19 nt, Homo sapiens
ggcagaauauugugaaugc

SEQ ID NO: 329292 - RNA, 19 nt, Homo sapiens
aaagauguccgauucauag

SEQ ID NO: 329293 - RNA, 19 nt, Homo sapiens
aaagacaucuccugguucu

SEQ ID NO: 329294 - RNA, 19 nt, Homo sapiens
ccacacagacaaaggagaa

SEQ ID NO: 329295 - RNA, 19 nt, Homo sapiens
gggugcccauccucaaaua

SEQ ID NO: 329296 - RNA, 19 nt, Homo sapiens
gaacgacgaggcugaguac

SEQ ID NO: 329297 - RNA, 19 nt, Homo sapiens
caccaaccaucaucuggaa

SEQ ID NO: 329298 - RNA, 19 nt, Homo sapiens
gggaagaugccgugauugu

SEQ ID NO: 329299 - RNA, 19 nt, Homo sapiens
gccacgaucucaugguuuc

SEQ ID NO: 329300 - RNA, 19 nt, Homo sapiens
gcaggagaugccaaagaua

SEQ ID NO: 329301 - RNA, 19 nt, Homo sapiens
ggaauucauccuuguucaa

SEQ ID NO: 329302 - RNA, 19 nt, Homo sapiens
guucccagcugaccaucaa

SEQ ID NO: 329303 - RNA, 19 nt, Homo sapiens
caaggacauucaggucauu

SEQ ID NO: 329304 - RNA, 19 nt, Homo sapiens
cagcuucaccagagcauuu

SEQ ID NO: 329305 - RNA, 19 nt, Homo sapiens
ccaauuacagcaauaucaa

SEQ ID NO: 329306 - RNA, 19 nt, Homo sapiens
ccagacugccauggaauua

SEQ ID NO: 329307 - RNA, 19 nt, Homo sapiens
ucauaguccuguccaacaa

SEQ ID NO: 329308 - RNA, 19 nt, Homo sapiens
cagaagcucauguucaaga

SEQ ID NO: 329309 - RNA, 19 nt, Homo sapiens
ucagugguguggaaugaug

SEQ ID NO: 329310 - RNA, 19 nt, Homo sapiens
ggaucucagugguguggaa

SEQ ID NO: 329311 - RNA, 19 nt, Homo sapiens
gagaaccgagcaaagauca

SEQ ID NO: 329312 - RNA, 19 nt, Homo sapiens
gcaauaucaagaucuacaa

SEQ ID NO: 329313 - RNA, 19 nt, Homo sapiens
ucaagacgguccccaauga

SEQ ID NO: 329314 - RNA, 19 nt, Homo sapiens
gugaagaaguauggcauuc

SEQ ID NO: 329315 - RNA, 19 nt, Homo sapiens
ugucgucgcugacccugaa

SEQ ID NO: 329316 - RNA, 19 nt, Homo sapiens
acagauagagcaagaggaa

SEQ ID NO: 329317 - RNA, 19 nt, Homo sapiens
aagcucauguucaagaaug

SEQ ID NO: 329318 - RNA, 19 nt, Homo sapiens
uucagaagcucauguucaa

SEQ ID NO: 329319 - RNA, 19 nt, Homo sapiens
caccagagcauuuccaaca

SEQ ID NO: 329320 - RNA, 19 nt, Homo sapiens
caugaugggugaagagaac

SEQ ID NO: 329321 - RNA, 19 nt, Homo sapiens
uuacagcaauaucaagauc

SEQ ID NO: 329322 - RNA, 19 nt, Homo sapiens
cugccaagcuccaauuaca

SEQ ID NO: 329323 - RNA, 19 nt, Homo sapiens
gugccacgaucucaugguu

SEQ ID NO: 329324 - RNA, 19 nt, Homo sapiens
ucaaggacauucaggucau

SEQ ID NO: 329325 - RNA, 19 nt, Homo sapiens
gaguccaaauucuucuuau

SEQ ID NO: 329326 - RNA, 19 nt, Homo sapiens
ggaaacucuauuaaaguga

SEQ ID NO: 329327 - RNA, 19 nt, Homo sapiens
ccucccagccagcagauua

SEQ ID NO: 329328 - RNA, 19 nt, Homo sapiens
ugccaaagauaaagacauc

SEQ ID NO: 329329 - RNA, 19 nt, Homo sapiens
aauccaaggcggcucauuu

SEQ ID NO: 329330 - RNA, 19 nt, Homo sapiens
gagaugccaaagauaaaga

SEQ ID NO: 329331 - RNA, 19 nt, Homo sapiens
ggaagaugccgugauugug

SEQ ID NO: 329332 - RNA, 19 nt, Homo sapiens
ccuccacccucaccaucua

SEQ ID NO: 329333 - RNA, 19 nt, Homo sapiens
ucucagugguguggaauga

SEQ ID NO: 329334 - RNA, 19 nt, Homo sapiens
aguuacagcuuagugauga

SEQ ID NO: 329335 - RNA, 19 nt, Homo sapiens
caggaaacaauucugcaaa

SEQ ID NO: 329336 - RNA, 19 nt, Homo sapiens
cagauuacaaugcugcaaa

SEQ ID NO: 329337 - RNA, 19 nt, Homo sapiens
guggagagcaguuggugaa

SEQ ID NO: 329338 - RNA, 19 nt, Homo sapiens
ucgaccagguggagccaua

SEQ ID NO: 329339 - RNA, 19 nt, Homo sapiens
aggaagacgaugagaagua

SEQ ID NO: 329340 - RNA, 19 nt, Homo sapiens
gacauucaggucauuguga

SEQ ID NO: 329341 - RNA, 19 nt, Homo sapiens
gcaauaugccccaaagcua

SEQ ID NO: 329342 - RNA, 19 nt, Homo sapiens
acacaaaggccgagauguc

SEQ ID NO: 329343 - RNA, 19 nt, Homo sapiens
aaacuaaggaucucaucug

SEQ ID NO: 329344 - RNA, 19 nt, Homo sapiens
agaagcucauguucaagaa

SEQ ID NO: 329345 - RNA, 19 nt, Homo sapiens
aaucacauauguagagaac

SEQ ID NO: 329346 - RNA, 19 nt, Homo sapiens
ggacauucaggucauugug

SEQ ID NO: 329347 - RNA, 19 nt, Homo sapiens
ggagaacgagagcaaagca

SEQ ID NO: 329348 - RNA, 19 nt, Homo sapiens
gcggucaaccuguguggaa

SEQ ID NO: 329349 - RNA, 19 nt, Homo sapiens
gugguaugaugccaaggaa

SEQ ID NO: 329350 - RNA, 19 nt, Homo sapiens
gaaguauggcauuccaagu

SEQ ID NO: 329351 - RNA, 19 nt, Homo sapiens
agcaguuggugaagaagua

SEQ ID NO: 329352 - RNA, 19 nt, Homo sapiens
gcaagaggaagacgaugag

SEQ ID NO: 329353 - RNA, 19 nt, Homo sapiens
auacucagccuggcaauug

SEQ ID NO: 329354 - RNA, 19 nt, Homo sapiens
gaaauugacuuccgugaua

SEQ ID NO: 329355 - RNA, 19 nt, Homo sapiens
gaaagaagcucuaaaucca

SEQ ID NO: 329356 - RNA, 19 nt, Homo sapiens
gcucaucacugcauauuaa

SEQ ID NO: 329357 - RNA, 19 nt, Homo sapiens
gcauguaccuugauauuga

SEQ ID NO: 329358 - RNA, 19 nt, Homo sapiens
ggaagaagaugggaaagaa

SEQ ID NO: 329359 - RNA, 19 nt, Homo sapiens
gaagugguuugccgaguua

SEQ ID NO: 329360 - RNA, 19 nt, Homo sapiens
ggaauagcuuguacacaua

SEQ ID NO: 329361 - RNA, 19 nt, Homo sapiens
ggaacaagauuucaagaau

SEQ ID NO: 329362 - RNA, 19 nt, Homo sapiens
ugaaggagcuuaauaaugg

SEQ ID NO: 329363 - RNA, 19 nt, Homo sapiens
gagaauguguggaaagaaa

SEQ ID NO: 329364 - RNA, 19 nt, Homo sapiens
gacgucagcugcuucuuua

SEQ ID NO: 329365 - RNA, 19 nt, Homo sapiens
gagaagagauaaauuaguc

SEQ ID NO: 329366 - RNA, 19 nt, Homo sapiens
uaaggcaacucaugaauau

SEQ ID NO: 329367 - RNA, 19 nt, Homo sapiens
agagauaaccugaugauua

SEQ ID NO: 329368 - RNA, 19 nt, Homo sapiens
uauagaagaugcagggaua

SEQ ID NO: 329369 - RNA, 19 nt, Homo sapiens
gaaccuagaaguauugauu

SEQ ID NO: 329370 - RNA, 19 nt, Homo sapiens
gaauuugaguagugucuaa

SEQ ID NO: 329371 - RNA, 19 nt, Homo sapiens
guaauagagugacacauga

SEQ ID NO: 329372 - RNA, 19 nt, Homo sapiens
uguuauagguucaccauua

SEQ ID NO: 329373 - RNA, 19 nt, Homo sapiens
ccaaagcccaacauuauua

SEQ ID NO: 329374 - RNA, 19 nt, Homo sapiens
gcccucagcuucaaauaaa

SEQ ID NO: 329375 - RNA, 19 nt, Homo sapiens
gccauaaguugcaggguua

SEQ ID NO: 329376 - RNA, 19 nt, Homo sapiens
gaacagaggaugaaagagu

SEQ ID NO: 329377 - RNA, 19 nt, Homo sapiens
gguguuaggucacgguuaa

SEQ ID NO: 329378 - RNA, 19 nt, Homo sapiens
gaagaccaauggcuagaga

SEQ ID NO: 329379 - RNA, 19 nt, Homo sapiens
cgaccaauuuaaagacuua

SEQ ID NO: 329380 - RNA, 19 nt, Homo sapiens
gaagguauauacagaugug

SEQ ID NO: 329381 - RNA, 19 nt, Homo sapiens
gaacaacacuacgaagagu

SEQ ID NO: 329382 - RNA, 19 nt, Homo sapiens
uggcuaaagugcucuauuu

SEQ ID NO: 329383 - RNA, 19 nt, Homo sapiens
gcacagccacuaaucauau

SEQ ID NO: 329384 - RNA, 19 nt, Homo sapiens
caauauaaguugugaugug

SEQ ID NO: 329385 - RNA, 19 nt, Homo sapiens
gggcuggacuuaauaacuu

SEQ ID NO: 329386 - RNA, 19 nt, Homo sapiens
ggaacauaaucaauaguga

SEQ ID NO: 329387 - RNA, 19 nt, Homo sapiens
gaggaagucaccacuauuu

SEQ ID NO: 329388 - RNA, 19 nt, Homo sapiens
gaucauccaguuugcuuua

SEQ ID NO: 329389 - RNA, 19 nt, Homo sapiens
guaaaugagccaaaugaaa

SEQ ID NO: 329390 - RNA, 19 nt, Homo sapiens
cuagaaguauugauuggua

SEQ ID NO: 329391 - RNA, 19 nt, Homo sapiens
acaaagugcuugaaacuca

SEQ ID NO: 329392 - RNA, 19 nt, Homo sapiens
guuauagguucaccauuaa

SEQ ID NO: 329393 - RNA, 19 nt, Homo sapiens
ugaacaaccuggaaccaaa

SEQ ID NO: 329394 - RNA, 19 nt, Homo sapiens
gaaacuacauaugagaaug

SEQ ID NO: 329395 - RNA, 19 nt, Homo sapiens
gaaguaaagauaaggaaga

SEQ ID NO: 329396 - RNA, 19 nt, Homo sapiens
gaaaugggaacaauaucaa

SEQ ID NO: 329397 - RNA, 19 nt, Homo sapiens
ggaaacuucuagcuuggaa

SEQ ID NO: 329398 - RNA, 19 nt, Homo sapiens
cagcaaagcauaacaacaa

SEQ ID NO: 329399 - RNA, 19 nt, Homo sapiens
ggacaaggagacuacagua

SEQ ID NO: 329400 - RNA, 19 nt, Homo sapiens
gagagaagauaauuucaac

SEQ ID NO: 329401 - RNA, 19 nt, Homo sapiens
ugacugaaguacuggaauu

SEQ ID NO: 329402 - RNA, 19 nt, Homo sapiens
gaugaaagaguuacuaauc

SEQ ID NO: 329403 - RNA, 19 nt, Homo sapiens
gagaacagaggaugaaaga

SEQ ID NO: 329404 - RNA, 19 nt, Homo sapiens
ccaccaaagcccaacauua

SEQ ID NO: 329405 - RNA, 19 nt, Homo sapiens
ucaaagaaguagcgucaga

SEQ ID NO: 329406 - RNA, 19 nt, Homo sapiens
gagcauguaccuugauauu

SEQ ID NO: 329407 - RNA, 19 nt, Homo sapiens
uguacagccucacauaaua

SEQ ID NO: 329408 - RNA, 19 nt, Homo sapiens
ugacuuccgugauaucauu

SEQ ID NO: 329409 - RNA, 19 nt, Homo sapiens
gcuuucaacuucaagauga

SEQ ID NO: 329410 - RNA, 19 nt, Homo sapiens
ccauugaccuuaauuucuu

SEQ ID NO: 329411 - RNA, 19 nt, Homo sapiens
caccaaagcccaacauuau

SEQ ID NO: 329412 - RNA, 19 nt, Homo sapiens
ucagguggaugucaaagaa

SEQ ID NO: 329413 - RNA, 19 nt, Homo sapiens
ggaagcucaucacugcaua

SEQ ID NO: 329414 - RNA, 19 nt, Homo sapiens
ccacaagaauucaaacaag

SEQ ID NO: 329415 - RNA, 19 nt, Homo sapiens
caaagcaguuaggucauuu

SEQ ID NO: 329416 - RNA, 19 nt, Homo sapiens
gcacugcugcuaauucuug

SEQ ID NO: 329417 - RNA, 19 nt, Homo sapiens
aaacauacauaccauuugg

SEQ ID NO: 329418 - RNA, 19 nt, Homo sapiens
uggaauagcuuguacacau

SEQ ID NO: 329419 - RNA, 19 nt, Homo sapiens
gcaaagcauaacaacaaua

SEQ ID NO: 329420 - RNA, 19 nt, Homo sapiens
ggaagaaagaugauauuag

SEQ ID NO: 329421 - RNA, 19 nt, Homo sapiens
ugaguagugucuaaacaaa

SEQ ID NO: 329422 - RNA, 19 nt, Homo sapiens
gacagaauaugaccaccuu

SEQ ID NO: 329423 - RNA, 19 nt, Homo sapiens
ggaaauaaagaccacauca

SEQ ID NO: 329424 - RNA, 19 nt, Homo sapiens
gcaccuacaucugacaaug

SEQ ID NO: 329425 - RNA, 19 nt, Homo sapiens
aaauuagucuuaccugcua

SEQ ID NO: 329426 - RNA, 19 nt, Homo sapiens
auacagaugugaaggaaga

SEQ ID NO: 329427 - RNA, 19 nt, Homo sapiens
acaauaaccugcagauucu

SEQ ID NO: 329428 - RNA, 19 nt, Homo sapiens
gguaauagagugacacaug

SEQ ID NO: 329429 - RNA, 19 nt, Homo sapiens
gaacuaauuuuaccacugu

SEQ ID NO: 329430 - RNA, 19 nt, Homo sapiens
ggaaccaaauacaacuuau

SEQ ID NO: 329431 - RNA, 19 nt, Homo sapiens
gcagagagaggagaagaaa

SEQ ID NO: 329432 - RNA, 19 nt, Homo sapiens
cauccaguuugcuuuauuu

SEQ ID NO: 329433 - RNA, 19 nt, Homo sapiens
agaaggcccugcaugugua

SEQ ID NO: 329434 - RNA, 19 nt, Homo sapiens
caaaguagagcuuaguguu

SEQ ID NO: 329435 - RNA, 19 nt, Homo sapiens
ggagagaagauaauuucaa

SEQ ID NO: 329436 - RNA, 19 nt, Homo sapiens
caacuggucuuugacagau

SEQ ID NO: 329437 - RNA, 19 nt, Homo sapiens
gaauaugaccaccuucguu

SEQ ID NO: 329438 - RNA, 19 nt, Homo sapiens
uagagugacacaugauuua

SEQ ID NO: 329439 - RNA, 19 nt, Homo sapiens
guaagaaggcccugcaugu

SEQ ID NO: 329440 - RNA, 19 nt, Homo sapiens
ggaaagaagcucuaaaucc

SEQ ID NO: 329441 - RNA, 19 nt, Homo sapiens
uaacagacgucagcugcuu

SEQ ID NO: 329442 - RNA, 19 nt, Homo sapiens
gaaccgacaguuuaugaau

SEQ ID NO: 329443 - RNA, 19 nt, Homo sapiens
gaaguagcgucagaaaucu

SEQ ID NO: 329444 - RNA, 19 nt, Homo sapiens
gaaagggagcaauacagaa

SEQ ID NO: 329445 - RNA, 19 nt, Homo sapiens
ccuaagaauuugaguagug

SEQ ID NO: 329446 - RNA, 19 nt, Homo sapiens
gaccaaaacuauuccauug

SEQ ID NO: 329447 - RNA, 19 nt, Homo sapiens
ucaauucacuggagaagag

SEQ ID NO: 329448 - RNA, 19 nt, Homo sapiens
ucaggaacauaaucaauag

SEQ ID NO: 329449 - RNA, 19 nt, Homo sapiens
ggacaaacacaagaagcua

SEQ ID NO: 329450 - RNA, 19 nt, Homo sapiens
gccacuauguguucuauuc

SEQ ID NO: 329451 - RNA, 19 nt, Homo sapiens
agacugaagugccagauca

SEQ ID NO: 329452 - RNA, 19 nt, Homo sapiens
caauguggguugcugaugu

SEQ ID NO: 329453 - RNA, 19 nt, Homo sapiens
gaaauaaagaccacaucau

SEQ ID NO: 329454 - RNA, 19 nt, Homo sapiens
ggaagaagcuaaagagaaa

SEQ ID NO: 329455 - RNA, 19 nt, Homo sapiens
gaacaaacauguccugaag

SEQ ID NO: 329456 - RNA, 19 nt, Homo sapiens
cugagaagcugacaauuua

SEQ ID NO: 329457 - RNA, 19 nt, Homo sapiens
ggaaaggaguuguacgaaa

SEQ ID NO: 329458 - RNA, 19 nt, Homo sapiens
gaccuuaucuugccuuuga

SEQ ID NO: 329459 - RNA, 19 nt, Homo sapiens
uaucugaucuugugaauug

SEQ ID NO: 329460 - RNA, 19 nt, Homo sapiens
gaacauggcauuacuuuua

SEQ ID NO: 329461 - RNA, 19 nt, Homo sapiens
caaauuggaucuucucuuc

SEQ ID NO: 329462 - RNA, 19 nt, Homo sapiens
gaaaguagcaauucucuuc

SEQ ID NO: 329463 - RNA, 19 nt, Homo sapiens
caaccugcauuuacaagua

SEQ ID NO: 329464 - RNA, 19 nt, Homo sapiens
aaucuucacugcaucauua

SEQ ID NO: 329465 - RNA, 19 nt, Homo sapiens
gaauuaacauggcugaaau

SEQ ID NO: 329466 - RNA, 19 nt, Homo sapiens
aaagaaagaugcagagaug

SEQ ID NO: 329467 - RNA, 19 nt, Homo sapiens
guacacaaauaguugauug

SEQ ID NO: 329468 - RNA, 19 nt, Homo sapiens
agaacuaucucgugacuuu

SEQ ID NO: 329469 - RNA, 19 nt, Homo sapiens
gguauggacugcugauaaa

SEQ ID NO: 329470 - RNA, 19 nt, Homo sapiens
gaugauugcuguacuagug

SEQ ID NO: 329471 - RNA, 19 nt, Homo sapiens
caacugaaaugcuauacau

SEQ ID NO: 329472 - RNA, 19 nt, Homo sapiens
acacaacacuccucauuga

SEQ ID NO: 329473 - RNA, 19 nt, Homo sapiens
gaaaggaguuguacgaaaa

SEQ ID NO: 329474 - RNA, 19 nt, Homo sapiens
gaugauucguacacaaaua

SEQ ID NO: 329475 - RNA, 19 nt, Homo sapiens
gcagagcuguuucaacuuc

SEQ ID NO: 329476 - RNA, 19 nt, Homo sapiens
aagcugaucuuccuaacua

SEQ ID NO: 329477 - RNA, 19 nt, Homo sapiens
gaacaaauagaacgacuuc

SEQ ID NO: 329478 - RNA, 19 nt, Homo sapiens
gagaagcugacaauuuaua

SEQ ID NO: 329479 - RNA, 19 nt, Homo sapiens
ggaagaggacagugaauga

SEQ ID NO: 329480 - RNA, 19 nt, Homo sapiens
gggcccagauucagaaauu

SEQ ID NO: 329481 - RNA, 19 nt, Homo sapiens
caaaugaaacugaagauca

SEQ ID NO: 329482 - RNA, 19 nt, Homo sapiens
ugagguaugugaaacacua

SEQ ID NO: 329483 - RNA, 19 nt, Homo sapiens
ucagugcucuugcaaaguu

SEQ ID NO: 329484 - RNA, 19 nt, Homo sapiens
ggaaggaaaggaagacuug

SEQ ID NO: 329485 - RNA, 19 nt, Homo sapiens
uuacaugugcuaagaguua

SEQ ID NO: 329486 - RNA, 19 nt, Homo sapiens
guacacaacacuccucauu

SEQ ID NO: 329487 - RNA, 19 nt, Homo sapiens
uaaaccacauccacaagaa

SEQ ID NO: 329488 - RNA, 19 nt, Homo sapiens
auauagaacugauggguuu

SEQ ID NO: 329489 - RNA, 19 nt, Homo sapiens
guggaaagauuuguaauag

SEQ ID NO: 329490 - RNA, 19 nt, Homo sapiens
gcacgccuauuaccugaga

SEQ ID NO: 329491 - RNA, 19 nt, Homo sapiens
ugacgacgaugaaggauuc

SEQ ID NO: 329492 - RNA, 19 nt, Homo sapiens
caaauucucugugaucagu

SEQ ID NO: 329493 - RNA, 19 nt, Homo sapiens
caucaaugguugcuauguu

SEQ ID NO: 329494 - RNA, 19 nt, Homo sapiens
cagaagcagugacaggaaa

SEQ ID NO: 329495 - RNA, 19 nt, Homo sapiens
agaaagaccucugaugcaa

SEQ ID NO: 329496 - RNA, 19 nt, Homo sapiens
aaaguuacaugugcuaaga

SEQ ID NO: 329497 - RNA, 19 nt, Homo sapiens
ucugaaagauguaccaaau

SEQ ID NO: 329498 - RNA, 19 nt, Homo sapiens
ggagaugaaaguagcaauu

SEQ ID NO: 329499 - RNA, 19 nt, Homo sapiens
uuacaaguauggagaugaa

SEQ ID NO: 329500 - RNA, 19 nt, Homo sapiens
gaaagaccucugaugcaaa

SEQ ID NO: 329501 - RNA, 19 nt, Homo sapiens
ccuacagcaucaccaaaua

SEQ ID NO: 329502 - RNA, 19 nt, Homo sapiens
gcaaacccaaccugcauuu

SEQ ID NO: 329503 - RNA, 19 nt, Homo sapiens
aaagaccucugaugcaaau

SEQ ID NO: 329504 - RNA, 19 nt, Homo sapiens
gaauuagacccucauaucu

SEQ ID NO: 329505 - RNA, 19 nt, Homo sapiens
acaaacauguccugaagau

SEQ ID NO: 329506 - RNA, 19 nt, Homo sapiens
aaaguaaggcaaccaauga

SEQ ID NO: 329507 - RNA, 19 nt, Homo sapiens
acaggcaacugaaaugcua

SEQ ID NO: 329508 - RNA, 19 nt, Homo sapiens
ccacauaguugaggugauc

SEQ ID NO: 329509 - RNA, 19 nt, Homo sapiens
ugacuaugaccaugauaua

SEQ ID NO: 329510 - RNA, 19 nt, Homo sapiens
gcaguaaugugacuaugac

SEQ ID NO: 329511 - RNA, 19 nt, Homo sapiens
guauuaacaccaugguaua

SEQ ID NO: 329512 - RNA, 19 nt, Homo sapiens
guaaggcaaccaaugauga

SEQ ID NO: 329513 - RNA, 19 nt, Homo sapiens
caucagcguauauuagaua

SEQ ID NO: 329514 - RNA, 19 nt, Homo sapiens
gugaagcacugcagcacaa

SEQ ID NO: 329515 - RNA, 19 nt, Homo sapiens
gccaugauucgucaacuua

SEQ ID NO: 329516 - RNA, 19 nt, Homo sapiens
ggucaaccuuacauaguau

SEQ ID NO: 329517 - RNA, 19 nt, Homo sapiens
gaagaggacagugaaugaa

SEQ ID NO: 329518 - RNA, 19 nt, Homo sapiens
uuucagcgguuuaucauga

SEQ ID NO: 329519 - RNA, 19 nt, Homo sapiens
uaagaugauucguacacaa

SEQ ID NO: 329520 - RNA, 19 nt, Homo sapiens
guuuagcuguugccuuuaa

SEQ ID NO: 329521 - RNA, 19 nt, Homo sapiens
gaagauuggucagauuguc

SEQ ID NO: 329522 - RNA, 19 nt, Homo sapiens
auaaugaagccguguauuu

SEQ ID NO: 329523 - RNA, 19 nt, Homo sapiens
ccugagaagcugacaauuu

SEQ ID NO: 329524 - RNA, 19 nt, Homo sapiens
agauacaaauucucuguga

SEQ ID NO: 329525 - RNA, 19 nt, Homo sapiens
caacacaaacggcgaagug

SEQ ID NO: 329526 - RNA, 19 nt, Homo sapiens
ugaaagugaugaaggaaag

SEQ ID NO: 329527 - RNA, 19 nt, Homo sapiens
aagcguaacucaggaagaa

SEQ ID NO: 329528 - RNA, 19 nt, Homo sapiens
cuguuuagcuguugccuuu

SEQ ID NO: 329529 - RNA, 19 nt, Homo sapiens
caugauucgucaacuuaaa

SEQ ID NO: 329530 - RNA, 19 nt, Homo sapiens
gaugggaccaguguauuaa

SEQ ID NO: 329531 - RNA, 19 nt, Homo sapiens
gaacuaucucgugacuuua

SEQ ID NO: 329532 - RNA, 19 nt, Homo sapiens
uaaugaagccguguauuug

SEQ ID NO: 329533 - RNA, 19 nt, Homo sapiens
ugaauuagacccucauauc

SEQ ID NO: 329534 - RNA, 19 nt, Homo sapiens
caaauaauccagcaguaca

SEQ ID NO: 329535 - RNA, 19 nt, Homo sapiens
gaagcuaaagagaaacuug

SEQ ID NO: 329536 - RNA, 19 nt, Homo sapiens
gaucuuaaggcuucuuugu

SEQ ID NO: 329537 - RNA, 19 nt, Homo sapiens
ugaugggaccaguguauua

SEQ ID NO: 329538 - RNA, 19 nt, Homo sapiens
cagaauguuugauuacaca

SEQ ID NO: 329539 - RNA, 19 nt, Homo sapiens
gagaaagaccucugaugca

SEQ ID NO: 329540 - RNA, 19 nt, Homo sapiens
aaagauguaccaaauccua

SEQ ID NO: 329541 - RNA, 19 nt, Homo sapiens
uguguagacagguuuauua

SEQ ID NO: 329542 - RNA, 19 nt, Homo sapiens
caacacuccucauugaacu

SEQ ID NO: 329543 - RNA, 19 nt, Homo sapiens
gcugacaauuuauacaaca

SEQ ID NO: 329544 - RNA, 19 nt, Homo sapiens
ugaauuaacauggcugaaa

SEQ ID NO: 329545 - RNA, 19 nt, Homo sapiens
gauacaaauucucugugau

SEQ ID NO: 329546 - RNA, 19 nt, Homo sapiens
uuaacaccaugguauaaga

SEQ ID NO: 329547 - RNA, 19 nt, Homo sapiens
ugaaagauguaccaaaucc

SEQ ID NO: 329548 - RNA, 19 nt, Homo sapiens
gucauucaguggaaagauu

SEQ ID NO: 329549 - RNA, 19 nt, Homo sapiens
cgacgagauugguaugugu

SEQ ID NO: 329550 - RNA, 19 nt, Homo sapiens
ggaggaaccauccacagau

SEQ ID NO: 329551 - RNA, 19 nt, Homo sapiens
ggcaaccaaugaugaaauc

SEQ ID NO: 329552 - RNA, 19 nt, Homo sapiens
gaucuuugcagagcuguuu

SEQ ID NO: 329553 - RNA, 19 nt, Homo sapiens
caagggucaucuucagaau

SEQ ID NO: 329554 - RNA, 19 nt, Homo sapiens
aaagaaauguucccuauug

SEQ ID NO: 329555 - RNA, 19 nt, Homo sapiens
ucaccgagaucuacgaguu

SEQ ID NO: 329556 - RNA, 19 nt, Homo sapiens
gcccaaagauggcaagagu

SEQ ID NO: 329557 - RNA, 19 nt, Homo sapiens
gaucuacgaguuccauaaa

SEQ ID NO: 329558 - RNA, 19 nt, Homo sapiens
gcgccgaccucauccugaa

SEQ ID NO: 329559 - RNA, 19 nt, Homo sapiens
gcuggugggucaucaggaa

SEQ ID NO: 329560 - RNA, 19 nt, Homo sapiens
gcucgagggugaagcuguu

SEQ ID NO: 329561 - RNA, 19 nt, Homo sapiens
gcaagaguaccgcgacaga

SEQ ID NO: 329562 - RNA, 19 nt, Homo sapiens
aagaaauguucccuauuga

SEQ ID NO: 329563 - RNA, 19 nt, Homo sapiens
cauacuugaugcccaaaga

SEQ ID NO: 329564 - RNA, 19 nt, Homo sapiens
ccgccacccucaauaaaug

SEQ ID NO: 329565 - RNA, 19 nt, Homo sapiens
ccaaagauggcaagaguac

SEQ ID NO: 329566 - RNA, 19 nt, Homo sapiens
guacauguuccuggugaaa

SEQ ID NO: 329567 - RNA, 19 nt, Homo sapiens
ccaucauccugcagacgua

SEQ ID NO: 329568 - RNA, 19 nt, Homo sapiens
gcuacuuuccguccaugua

SEQ ID NO: 329569 - RNA, 19 nt, Homo sapiens
acauguuccuggugaaaug

SEQ ID NO: 329570 - RNA, 19 nt, Homo sapiens
ucaaggugcgcccugauga

SEQ ID NO: 329571 - RNA, 19 nt, Homo sapiens
cgaguuccauaaaaccuua

SEQ ID NO: 329572 - RNA, 19 nt, Homo sapiens
ccagccagcacuaugugua

SEQ ID NO: 329573 - RNA, 19 nt, Homo sapiens
ucaugagccugcccaccaa

SEQ ID NO: 329574 - RNA, 19 nt, Homo sapiens
guacccagccagcacuaug

SEQ ID NO: 329575 - RNA, 19 nt, Homo sapiens
gcacacuuaccgaguacug

SEQ ID NO: 329576 - RNA, 19 nt, Homo sapiens
gagaucuacgaguuccaua

SEQ ID NO: 329577 - RNA, 19 nt, Homo sapiens
gugaagcuguugaggucau

SEQ ID NO: 329578 - RNA, 19 nt, Homo sapiens
gagagcgguuggugguucu

SEQ ID NO: 329579 - RNA, 19 nt, Homo sapiens
gccagagacauacuugaug

SEQ ID NO: 329580 - RNA, 19 nt, Homo sapiens
gggcacacuuaccgaguac

SEQ ID NO: 329581 - RNA, 19 nt, Homo sapiens
agggcacacuuaccgagua

SEQ ID NO: 329582 - RNA, 19 nt, Homo sapiens
cuguugaggucauucacaa

SEQ ID NO: 329583 - RNA, 19 nt, Homo sapiens
gcucccgccacccucaaua

SEQ ID NO: 329584 - RNA, 19 nt, Homo sapiens
ggugggucaucaggaaaga

SEQ ID NO: 329585 - RNA, 19 nt, Homo sapiens
agccauacgucgccaucaa

SEQ ID NO: 329586 - RNA, 19 nt, Homo sapiens
ggcgaucaauccagagaac

SEQ ID NO: 329587 - RNA, 19 nt, Homo sapiens
ccauguaccugcaaaaguc

SEQ ID NO: 329588 - RNA, 19 nt, Homo sapiens
ugaagcuguugaggucauu

SEQ ID NO: 329589 - RNA, 19 nt, Homo sapiens
ggaaccagcugauagacua

SEQ ID NO: 329590 - RNA, 19 nt, Homo sapiens
caacagaaccucagcuuaa

SEQ ID NO: 329591 - RNA, 19 nt, Homo sapiens
gagaaggccuuuaccagaa

SEQ ID NO: 329592 - RNA, 19 nt, Homo sapiens
guacaaauauuccuguuuc

SEQ ID NO: 329593 - RNA, 19 nt, Homo sapiens
ggagagaagucuaggaugu

SEQ ID NO: 329594 - RNA, 19 nt, Homo sapiens
uaucaaaggugaaugaaga

SEQ ID NO: 329595 - RNA, 19 nt, Homo sapiens
gaccaaggcuuuccagaug

SEQ ID NO: 329596 - RNA, 19 nt, Homo sapiens
ccugugagguguuauauaa

SEQ ID NO: 329597 - RNA, 19 nt, Homo sapiens
ggaaagcacucggagagaa

SEQ ID NO: 329598 - RNA, 19 nt, Homo sapiens
guacugauccuguuucuug

SEQ ID NO: 329599 - RNA, 19 nt, Homo sapiens
gaagcccuauuacuuguuu

SEQ ID NO: 329600 - RNA, 19 nt, Homo sapiens
gaacauugucuuugucuug

SEQ ID NO: 329601 - RNA, 19 nt, Homo sapiens
ggaagcagaagcuauauga

SEQ ID NO: 329602 - RNA, 19 nt, Homo sapiens
uggaggcacucuucaguua

SEQ ID NO: 329603 - RNA, 19 nt, Homo sapiens
ggauggaagugucuggaaa

SEQ ID NO: 329604 - RNA, 19 nt, Homo sapiens
cuacaaagcugaagaaaau

SEQ ID NO: 329605 - RNA, 19 nt, Homo sapiens
ucaucaagcuguacauuug

SEQ ID NO: 329606 - RNA, 19 nt, Homo sapiens
cagaggaccuggaguuuca

SEQ ID NO: 329607 - RNA, 19 nt, Homo sapiens
gaagugaagcucaguguuc

SEQ ID NO: 329608 - RNA, 19 nt, Homo sapiens
caaauauuccuguuucuga

SEQ ID NO: 329609 - RNA, 19 nt, Homo sapiens
ugaagaagggcaaugauaa

SEQ ID NO: 329610 - RNA, 19 nt, Homo sapiens
ccacgagcaugaagucuga

SEQ ID NO: 329611 - RNA, 19 nt, Homo sapiens
ggaguaaguacaaauauuc

SEQ ID NO: 329612 - RNA, 19 nt, Homo sapiens
caaggaguaaguacaaaua

SEQ ID NO: 329613 - RNA, 19 nt, Homo sapiens
aaacauucaucaagcugua

SEQ ID NO: 329614 - RNA, 19 nt, Homo sapiens
gaagaacaguuagcauugg

SEQ ID NO: 329615 - RNA, 19 nt, Homo sapiens
gcucuuaaggcuugaagua

SEQ ID NO: 329616 - RNA, 19 nt, Homo sapiens
cggauuugcuucaacauug

SEQ ID NO: 329617 - RNA, 19 nt, Homo sapiens
cgagagagucuuccaggua

SEQ ID NO: 329618 - RNA, 19 nt, Homo sapiens
ggaaagggcacgagagagu

SEQ ID NO: 329619 - RNA, 19 nt, Homo sapiens
ggcaguggcuuacuuccaa

SEQ ID NO: 329620 - RNA, 19 nt, Homo sapiens
gaggcacucuucaguuaug

SEQ ID NO: 329621 - RNA, 19 nt, Homo sapiens
aaaugaagcccuauuacuu

SEQ ID NO: 329622 - RNA, 19 nt, Homo sapiens
gaacacagugggugaccaa

SEQ ID NO: 329623 - RNA, 19 nt, Homo sapiens
auacuguacugagacauua

SEQ ID NO: 329624 - RNA, 19 nt, Homo sapiens
caagaaggaggaauggaaa

SEQ ID NO: 329625 - RNA, 19 nt, Homo sapiens
ccuccuaguuucuaccuaa

SEQ ID NO: 329626 - RNA, 19 nt, Homo sapiens
agagaagucuaggauguuu

SEQ ID NO: 329627 - RNA, 19 nt, Homo sapiens
ucaaggugcacuacaagua

SEQ ID NO: 329628 - RNA, 19 nt, Homo sapiens
gcuguauacuguacugaga

SEQ ID NO: 329629 - RNA, 19 nt, Homo sapiens
ccaagaaggaggaauggaa

SEQ ID NO: 329630 - RNA, 19 nt, Homo sapiens
ggcuugaaguaaccuuaua

SEQ ID NO: 329631 - RNA, 19 nt, Homo sapiens
uaagaaaggcagccaagug

SEQ ID NO: 329632 - RNA, 19 nt, Homo sapiens
ccaaggcuuuccagaugaa

SEQ ID NO: 329633 - RNA, 19 nt, Homo sapiens
cagggaacauugucuuugu

SEQ ID NO: 329634 - RNA, 19 nt, Homo sapiens
aagaagagcuccaggucau

SEQ ID NO: 329635 - RNA, 19 nt, Homo sapiens
guuuggaaguguuaacuau

SEQ ID NO: 329636 - RNA, 19 nt, Homo sapiens
aaaggugaaugaagaaugg

SEQ ID NO: 329637 - RNA, 19 nt, Homo sapiens
acaaggcgauggagugugu

SEQ ID NO: 329638 - RNA, 19 nt, Homo sapiens
ucucuuggccuccuaguuu

SEQ ID NO: 329639 - RNA, 19 nt, Homo sapiens
cuaauaaccagacaacaga

SEQ ID NO: 329640 - RNA, 19 nt, Homo sapiens
aagaagagccuaaggaagu

SEQ ID NO: 329641 - RNA, 19 nt, Homo sapiens
ugaagaacaguuagcauug

SEQ ID NO: 329642 - RNA, 19 nt, Homo sapiens
gccuuuaccagaagcauua

SEQ ID NO: 329643 - RNA, 19 nt, Homo sapiens
gaagaagggcaaugauaac

SEQ ID NO: 329644 - RNA, 19 nt, Homo sapiens
caucugugguggaucaaga

SEQ ID NO: 329645 - RNA, 19 nt, Homo sapiens
uuaaagaagccuugauuca

SEQ ID NO: 329646 - RNA, 19 nt, Homo sapiens
gcacccuucugcuguauac

SEQ ID NO: 329647 - RNA, 19 nt, Homo sapiens
gaaccucagcuuaagaaag

SEQ ID NO: 329648 - RNA, 19 nt, Homo sapiens
gagggaaccagcugauaga

SEQ ID NO: 329649 - RNA, 19 nt, Homo sapiens
gagggaugcucuacuacca

SEQ ID NO: 329650 - RNA, 19 nt, Homo sapiens
gaaugaagaauggcuggaa

SEQ ID NO: 329651 - RNA, 19 nt, Homo sapiens
gaacccaaggaaagugaaa

SEQ ID NO: 329652 - RNA, 19 nt, Homo sapiens
ggcaagcuguuucgaccaa

SEQ ID NO: 329653 - RNA, 19 nt, Homo sapiens
aacgagggaugcucuacua

SEQ ID NO: 329654 - RNA, 19 nt, Homo sapiens
gcauguacacuauccugaa

SEQ ID NO: 329655 - RNA, 19 nt, Homo sapiens
gcaacuacagauuuggaaa

SEQ ID NO: 329656 - RNA, 19 nt, Homo sapiens
ggaacauugucuuugucuu

SEQ ID NO: 329657 - RNA, 19 nt, Homo sapiens
ugaguacccaggaugauuu

SEQ ID NO: 329658 - RNA, 19 nt, Homo sapiens
gagagaagucuaggauguu

SEQ ID NO: 329659 - RNA, 19 nt, Homo sapiens
caaguacacgguagucaug

SEQ ID NO: 329660 - RNA, 19 nt, Homo sapiens
aaacuacaaagcugaagaa

SEQ ID NO: 329661 - RNA, 19 nt, Homo sapiens
caaaggugaaugaagaaug

SEQ ID NO: 329662 - RNA, 19 nt, Homo sapiens
gcuaauaaccagacaacag

SEQ ID NO: 329663 - RNA, 19 nt, Homo sapiens
gggccacggucauguucaa

SEQ ID NO: 329664 - RNA, 19 nt, Homo sapiens
aaugaagcccuauuacuug

SEQ ID NO: 329665 - RNA, 19 nt, Homo sapiens
gaaagcacucggagagaag

SEQ ID NO: 329666 - RNA, 19 nt, Homo sapiens
ccuaguuucuaccuaauca

SEQ ID NO: 329667 - RNA, 19 nt, Homo sapiens
cagaugaacccaaggaaag

SEQ ID NO: 329668 - RNA, 19 nt, Homo sapiens
ccagaugaacccaaggaaa

SEQ ID NO: 329669 - RNA, 19 nt, Homo sapiens
cagaagacagcaugaagga

SEQ ID NO: 329670 - RNA, 19 nt, Homo sapiens
gccaucagccucuggaaug

SEQ ID NO: 329671 - RNA, 19 nt, Homo sapiens
gcauuggccacgagcauga

SEQ ID NO: 329672 - RNA, 19 nt, Homo sapiens
ccuaucaucaucuuacaaa

SEQ ID NO: 329673 - RNA, 19 nt, Homo sapiens
cagaaccucagcuuaagaa

SEQ ID NO: 329674 - RNA, 19 nt, Homo sapiens
ggauuugcuucaacauugg

SEQ ID NO: 329675 - RNA, 19 nt, Homo sapiens
ggaagugaagcucaguguu

SEQ ID NO: 329676 - RNA, 19 nt, Homo sapiens
ucaccaggccagaaacaaa

SEQ ID NO: 329677 - RNA, 19 nt, Homo sapiens
acacuauccugaagaacau

SEQ ID NO: 329678 - RNA, 19 nt, Homo sapiens
gcagagaaggccuuuacca

SEQ ID NO: 329679 - RNA, 19 nt, Homo sapiens
aaccucagcuuaagaaagg

SEQ ID NO: 329680 - RNA, 19 nt, Homo sapiens
gacaguuucucuggguuug

SEQ ID NO: 329681 - RNA, 19 nt, Homo sapiens
caagcuguuucgaccaaau

SEQ ID NO: 329682 - RNA, 19 nt, Homo sapiens
gcaagcuguuucgaccaaa

SEQ ID NO: 329683 - RNA, 19 nt, Homo sapiens
ccaucagccucuggaauga

SEQ ID NO: 329684 - RNA, 19 nt, Homo sapiens
uaaagaagccuugauucag

SEQ ID NO: 329685 - RNA, 19 nt, Homo sapiens
acaggugaauggaggaguu

SEQ ID NO: 329686 - RNA, 19 nt, Homo sapiens
acaacagaaccucagcuua

SEQ ID NO: 329687 - RNA, 19 nt, Homo sapiens
uggcaucugugguggauca

SEQ ID NO: 329688 - RNA, 19 nt, Homo sapiens
ucaagcuguuugccuguga

SEQ ID NO: 329689 - RNA, 19 nt, Homo sapiens
ggacauagcucugaauuac

SEQ ID NO: 329690 - RNA, 19 nt, Homo sapiens
gcaaacuggagcugaauuu

SEQ ID NO: 329691 - RNA, 19 nt, Homo sapiens
uugaacagcuuccggauga

SEQ ID NO: 329692 - RNA, 19 nt, Homo sapiens
uuucaaagcuggagaugug

SEQ ID NO: 329693 - RNA, 19 nt, Homo sapiens
ggacaucgcgguggaggaa

SEQ ID NO: 329694 - RNA, 19 nt, Homo sapiens
ucagucggaucaacaaaga

SEQ ID NO: 329695 - RNA, 19 nt, Homo sapiens
ucaucgaggugaagacaaa

SEQ ID NO: 329696 - RNA, 19 nt, Homo sapiens
gcggauaccugcccucaac

SEQ ID NO: 329697 - RNA, 19 nt, Homo sapiens
ugaagauccucaaagacuu

SEQ ID NO: 329698 - RNA, 19 nt, Homo sapiens
cuauuugacuucacuggaa

SEQ ID NO: 329699 - RNA, 19 nt, Homo sapiens
ggacguccggaucuucuuu

SEQ ID NO: 329700 - RNA, 19 nt, Homo sapiens
gaggacauagcucugaauu

SEQ ID NO: 329701 - RNA, 19 nt, Homo sapiens
cagcagcacuccccuauug

SEQ ID NO: 329702 - RNA, 19 nt, Homo sapiens
ucgugaagauccucaaaga

SEQ ID NO: 329703 - RNA, 19 nt, Homo sapiens
gaacagcuuccggaugaug

SEQ ID NO: 329704 - RNA, 19 nt, Homo sapiens
ucacgcagaaggacaacua

SEQ ID NO: 329705 - RNA, 19 nt, Homo sapiens
ggccgagagugacuuugaa

SEQ ID NO: 329706 - RNA, 19 nt, Homo sapiens
gcacuccccuauugaaaga

SEQ ID NO: 329707 - RNA, 19 nt, Homo sapiens
caggguggcuggaggaagu

SEQ ID NO: 329708 - RNA, 19 nt, Homo sapiens
gauccaaguaccucaucua

SEQ ID NO: 329709 - RNA, 19 nt, Homo sapiens
ggcgggaguuccagagaga

SEQ ID NO: 329710 - RNA, 19 nt, Homo sapiens
gugaagauccucaaagacu

SEQ ID NO: 329711 - RNA, 19 nt, Homo sapiens
gggccgagagugacuuuga

SEQ ID NO: 329712 - RNA, 19 nt, Homo sapiens
ucugggugcugauggauga

SEQ ID NO: 329713 - RNA, 19 nt, Homo sapiens
gcugucggaugaggacgua

SEQ ID NO: 329714 - RNA, 19 nt, Homo sapiens
ccucaacgccuacaugaag

SEQ ID NO: 329715 - RNA, 19 nt, Homo sapiens
uauuugacuucacuggaaa

SEQ ID NO: 329716 - RNA, 19 nt, Homo sapiens
ggccaacauugcugacauc

SEQ ID NO: 329717 - RNA, 19 nt, Homo sapiens
uugcugacaucgaggagaa

SEQ ID NO: 329718 - RNA, 19 nt, Homo sapiens
gagugacuuugaacagcuu

SEQ ID NO: 329719 - RNA, 19 nt, Homo sapiens
ggagauugggaccaggaaa

SEQ ID NO: 329720 - RNA, 19 nt, Homo sapiens
gaauuucaaagcuggagau

SEQ ID NO: 329721 - RNA, 19 nt, Homo sapiens
gcccucaacgccuacauga

SEQ ID NO: 329722 - RNA, 19 nt, Homo sapiens
aacaggagaucgccgagau

SEQ ID NO: 329723 - RNA, 19 nt, Homo sapiens
ggaggaagugagaggugaa

SEQ ID NO: 329724 - RNA, 19 nt, Homo sapiens
gaugaggacguccggaucu

SEQ ID NO: 329725 - RNA, 19 nt, Homo sapiens
ccagagagaggacauagcu

SEQ ID NO: 329726 - RNA, 19 nt, Homo sapiens
ggaagugagaggugaacuc

SEQ ID NO: 329727 - RNA, 19 nt, Homo sapiens
ugacaucgaggagaagaga

SEQ ID NO: 329728 - RNA, 19 nt, Homo sapiens
caaaaggaggauccaagua

SEQ ID NO: 329729 - RNA, 19 nt, Homo sapiens
caaacuggagcugaauuuc

SEQ ID NO: 329730 - RNA, 19 nt, Homo sapiens
gaggcucuauuugacuuca

SEQ ID NO: 329731 - RNA, 19 nt, Homo sapiens
ggacaacuacagggucuac

SEQ ID NO: 329732 - RNA, 19 nt, Homo sapiens
ccuggaagcugcacaucac

SEQ ID NO: 329733 - RNA, 19 nt, Homo sapiens
ucacaaggcgggaguucca

SEQ ID NO: 329734 - RNA, 19 nt, Homo sapiens
cuacaacacgaugccauga

SEQ ID NO: 329735 - RNA, 19 nt, Homo sapiens
ggauccaaguaccucaucu

SEQ ID NO: 329736 - RNA, 19 nt, Homo sapiens
caacuacagggucuacaac

SEQ ID NO: 329737 - RNA, 19 nt, Homo sapiens
aggacauagcucugaauua

SEQ ID NO: 329738 - RNA, 19 nt, Homo sapiens
gacaccaucagcaccauca

SEQ ID NO: 329739 - RNA, 19 nt, Homo sapiens
cuacgugggugugaaacag

SEQ ID NO: 329740 - RNA, 19 nt, Homo sapiens
ggacauagcucugaauuac

SEQ ID NO: 329741 - RNA, 19 nt, Homo sapiens
gcaaacuggagcugaauuu

SEQ ID NO: 329742 - RNA, 19 nt, Homo sapiens
uugaacagcuuccggauga

SEQ ID NO: 329743 - RNA, 19 nt, Homo sapiens
uuucaaagcuggagaugug

SEQ ID NO: 329744 - RNA, 19 nt, Homo sapiens
ggacaucgcgguggaggaa

SEQ ID NO: 329745 - RNA, 19 nt, Homo sapiens
ucagucggaucaacaaaga

SEQ ID NO: 329746 - RNA, 19 nt, Homo sapiens
ucaucgaggugaagacaaa

SEQ ID NO: 329747 - RNA, 19 nt, Homo sapiens
gagccacaaugcuguaaca

SEQ ID NO: 329748 - RNA, 19 nt, Homo sapiens
gcggauaccugcccucaac

SEQ ID NO: 329749 - RNA, 19 nt, Homo sapiens
cccaguggcucccagauga

SEQ ID NO: 329750 - RNA, 19 nt, Homo sapiens
ugaagauccucaaagacuu

SEQ ID NO: 329751 - RNA, 19 nt, Homo sapiens
cuauuugacuucacuggaa

SEQ ID NO: 329752 - RNA, 19 nt, Homo sapiens
ggacguccggaucuucuuu

SEQ ID NO: 329753 - RNA, 19 nt, Homo sapiens
gaggacauagcucugaauu

SEQ ID NO: 329754 - RNA, 19 nt, Homo sapiens
cagcagcacuccccuauug

SEQ ID NO: 329755 - RNA, 19 nt, Homo sapiens
ucgugaagauccucaaaga

SEQ ID NO: 329756 - RNA, 19 nt, Homo sapiens
gaacagcuuccggaugaug

SEQ ID NO: 329757 - RNA, 19 nt, Homo sapiens
ucacgcagaaggacaacua

SEQ ID NO: 329758 - RNA, 19 nt, Homo sapiens
ggccgagagugacuuugaa

SEQ ID NO: 329759 - RNA, 19 nt, Homo sapiens
gcacuccccuauugaaaga

SEQ ID NO: 329760 - RNA, 19 nt, Homo sapiens
caggguggcuggaggaagu

SEQ ID NO: 329761 - RNA, 19 nt, Homo sapiens
gauccaaguaccucaucua

SEQ ID NO: 329762 - RNA, 19 nt, Homo sapiens
ggcgggaguuccagagaga

SEQ ID NO: 329763 - RNA, 19 nt, Homo sapiens
ccagccugaugccuccuua

SEQ ID NO: 329764 - RNA, 19 nt, Homo sapiens
gaugagccacaaugcugua

SEQ ID NO: 329765 - RNA, 19 nt, Homo sapiens
gggccgagagugacuuuga

SEQ ID NO: 329766 - RNA, 19 nt, Homo sapiens
gugaagauccucaaagacu

SEQ ID NO: 329767 - RNA, 19 nt, Homo sapiens
ucugggugcugauggauga

SEQ ID NO: 329768 - RNA, 19 nt, Homo sapiens
gcugucggaugaggacgua

SEQ ID NO: 329769 - RNA, 19 nt, Homo sapiens
ccucaacgccuacaugaag

SEQ ID NO: 329770 - RNA, 19 nt, Homo sapiens
uauuugacuucacuggaaa

SEQ ID NO: 329771 - RNA, 19 nt, Homo sapiens
ggccaacauugcugacauc

SEQ ID NO: 329772 - RNA, 19 nt, Homo sapiens
uugcugacaucgaggagaa

SEQ ID NO: 329773 - RNA, 19 nt, Homo sapiens
gagugacuuugaacagcuu

SEQ ID NO: 329774 - RNA, 19 nt, Homo sapiens
gaauuucaaagcuggagau

SEQ ID NO: 329775 - RNA, 19 nt, Homo sapiens
gcccucaacgccuacauga

SEQ ID NO: 329776 - RNA, 19 nt, Homo sapiens
aacaggagaucgccgagau

SEQ ID NO: 329777 - RNA, 19 nt, Homo sapiens
ucagcaccaucaagucugu

SEQ ID NO: 329778 - RNA, 19 nt, Homo sapiens
ggaggaagugagaggugaa

SEQ ID NO: 329779 - RNA, 19 nt, Homo sapiens
gaugaggacguccggaucu

SEQ ID NO: 329780 - RNA, 19 nt, Homo sapiens
ccagagagaggacauagcu

SEQ ID NO: 329781 - RNA, 19 nt, Homo sapiens
ugacaucgaggagaagaga

SEQ ID NO: 329782 - RNA, 19 nt, Homo sapiens
ggaagugagaggugaacuc

SEQ ID NO: 329783 - RNA, 19 nt, Homo sapiens
caaaaggaggauccaagua

SEQ ID NO: 329784 - RNA, 19 nt, Homo sapiens
caucagcaccaucaagucu

SEQ ID NO: 329785 - RNA, 19 nt, Homo sapiens
caaacuggagcugaauuuc

SEQ ID NO: 329786 - RNA, 19 nt, Homo sapiens
gaggcucuauuugacuuca

SEQ ID NO: 329787 - RNA, 19 nt, Homo sapiens
ggacaacuacagggucuac

SEQ ID NO: 329788 - RNA, 19 nt, Homo sapiens
ccuggaagcugcacaucac

SEQ ID NO: 329789 - RNA, 19 nt, Homo sapiens
ucacaaggcgggaguucca

SEQ ID NO: 329790 - RNA, 19 nt, Homo sapiens
cuacaacacgaugccauga

SEQ ID NO: 329791 - RNA, 19 nt, Homo sapiens
ggauccaaguaccucaucu

SEQ ID NO: 329792 - RNA, 19 nt, Homo sapiens
caacuacagggucuacaac

SEQ ID NO: 329793 - RNA, 19 nt, Homo sapiens
aggacauagcucugaauua

SEQ ID NO: 329794 - RNA, 19 nt, Homo sapiens
gacaccaucagcaccauca

SEQ ID NO: 329795 - RNA, 19 nt, Homo sapiens
cuacgugggugugaaacag

SEQ ID NO: 329796 - RNA, 19 nt, Homo sapiens
gaaagcaucuauugugaaa

SEQ ID NO: 329797 - RNA, 19 nt, Homo sapiens
gaaaggagauguaauggau

SEQ ID NO: 329798 - RNA, 19 nt, Homo sapiens
gaagaucaaugguaugguu

SEQ ID NO: 329799 - RNA, 19 nt, Homo sapiens
caagaagaaugagagauua

SEQ ID NO: 329800 - RNA, 19 nt, Homo sapiens
gcaggaagaucaaugguau

SEQ ID NO: 329801 - RNA, 19 nt, Homo sapiens
gauuauggcuucuggauga

SEQ ID NO: 329802 - RNA, 19 nt, Homo sapiens
gagagaggaugaauuauca

SEQ ID NO: 329803 - RNA, 19 nt, Homo sapiens
ugagagagaggaugaauua

SEQ ID NO: 329804 - RNA, 19 nt, Homo sapiens
gaacaagaguuggacauca

SEQ ID NO: 329805 - RNA, 19 nt, Homo sapiens
gcaagacacaugagacaua

SEQ ID NO: 329806 - RNA, 19 nt, Homo sapiens
ggacaaaggugaucgucau

SEQ ID NO: 329807 - RNA, 19 nt, Homo sapiens
gcugaaagauggcagaaga

SEQ ID NO: 329808 - RNA, 19 nt, Homo sapiens
uggaagaaauccuuuauug

SEQ ID NO: 329809 - RNA, 19 nt, Homo sapiens
uagcagcagucgucaauaa

SEQ ID NO: 329810 - RNA, 19 nt, Homo sapiens
ccgcuuaugugaaauuuaa

SEQ ID NO: 329811 - RNA, 19 nt, Homo sapiens
gcuguaauuugucauguaa

SEQ ID NO: 329812 - RNA, 19 nt, Homo sapiens
uaacucagcccauacauau

SEQ ID NO: 329813 - RNA, 19 nt, Homo sapiens
ggaagaacuuguagaacau

SEQ ID NO: 329814 - RNA, 19 nt, Homo sapiens
gaaauccuuuauugccuuu

SEQ ID NO: 329815 - RNA, 19 nt, Homo sapiens
caaacuauguaacugaaga

SEQ ID NO: 329816 - RNA, 19 nt, Homo sapiens
gcccauacauauauacuau

SEQ ID NO: 329817 - RNA, 19 nt, Homo sapiens
caugagacauagauuagaa

SEQ ID NO: 329818 - RNA, 19 nt, Homo sapiens
ggagauguaauggauguua

SEQ ID NO: 329819 - RNA, 19 nt, Homo sapiens
uggaagaacuuguagaaca

SEQ ID NO: 329820 - RNA, 19 nt, Homo sapiens
cggaaagcaucuauuguga

SEQ ID NO: 329821 - RNA, 19 nt, Homo sapiens
acacaugagacauagauua

SEQ ID NO: 329822 - RNA, 19 nt, Homo sapiens
uauuauaacucagcccaua

SEQ ID NO: 329823 - RNA, 19 nt, Homo sapiens
ugucaagcauuuaucauga

SEQ ID NO: 329824 - RNA, 19 nt, Homo sapiens
cgagaaaggagauguaaug

SEQ ID NO: 329825 - RNA, 19 nt, Homo sapiens
ucacaggccauuguaaaua

SEQ ID NO: 329826 - RNA, 19 nt, Homo sapiens
caaaggugaucgucaugga

SEQ ID NO: 329827 - RNA, 19 nt, Homo sapiens
ucaagaagaaugagagauu

SEQ ID NO: 329828 - RNA, 19 nt, Homo sapiens
gagauguaauggauguuau

SEQ ID NO: 329829 - RNA, 19 nt, Homo sapiens
uauugugucugccauaauu

SEQ ID NO: 329830 - RNA, 19 nt, Homo sapiens
ugacugcuguguagcugua

SEQ ID NO: 329831 - RNA, 19 nt, Homo sapiens
ggccuucacucacuggaaa

SEQ ID NO: 329832 - RNA, 19 nt, Homo sapiens
gaugggugguggcguggua

SEQ ID NO: 329833 - RNA, 19 nt, Homo sapiens
cuaacuauguggaaaggaa

SEQ ID NO: 329834 - RNA, 19 nt, Homo sapiens
agaagugacugcuguguag

SEQ ID NO: 329835 - RNA, 19 nt, Homo sapiens
uagcuacaauggacaaguu

SEQ ID NO: 329836 - RNA, 19 nt, Homo sapiens
ggaaagcaucuauugugaa

SEQ ID NO: 329837 - RNA, 19 nt, Homo sapiens
caagacacaugagacauag

SEQ ID NO: 329838 - RNA, 19 nt, Homo sapiens
aaggcacccuguucuguua

SEQ ID NO: 329839 - RNA, 19 nt, Homo sapiens
ucauguaauugaagacuga

SEQ ID NO: 329840 - RNA, 19 nt, Homo sapiens
gguaguagccaaauuugau

SEQ ID NO: 329841 - RNA, 19 nt, Homo sapiens
ggugguaguagccaaauuu

SEQ ID NO: 329842 - RNA, 19 nt, Homo sapiens
gcucggaaagcaucuauug

SEQ ID NO: 329843 - RNA, 19 nt, Homo sapiens
uauauugugucugccauaa

SEQ ID NO: 329844 - RNA, 19 nt, Homo sapiens
uccauuaacuucagguuug

SEQ ID NO: 329845 - RNA, 19 nt, Homo sapiens
ggaaaugcaggaagaucaa

SEQ ID NO: 329846 - RNA, 19 nt, Homo sapiens
uucauugucuucagucaua

SEQ ID NO: 329847 - RNA, 19 nt, Homo sapiens
cagaagaaguggugguagu

SEQ ID NO: 329848 - RNA, 19 nt, Homo sapiens
gaugguucccuucaaacua

SEQ ID NO: 329849 - RNA, 19 nt, Homo sapiens
aaagauggcagaagaagug

SEQ ID NO: 329850 - RNA, 19 nt, Homo sapiens
caugcccgcuuaugugaaa

SEQ ID NO: 329851 - RNA, 19 nt, Homo sapiens
gaagaacuuguagaacauu

SEQ ID NO: 329852 - RNA, 19 nt, Homo sapiens
ggcaauccuugguauuaug

SEQ ID NO: 329853 - RNA, 19 nt, Homo sapiens
gucaauaaccuaaauacug

SEQ ID NO: 329854 - RNA, 19 nt, Homo sapiens
cuauguaacugaagaaggu

SEQ ID NO: 329855 - RNA, 19 nt, Homo sapiens
ucccuuugcuucuaauauu

SEQ ID NO: 329856 - RNA, 19 nt, Homo sapiens
gcauugggcagcguaaauu

SEQ ID NO: 329857 - RNA, 19 nt, Homo sapiens
uacaggcucuuuacccauu

SEQ ID NO: 329858 - RNA, 19 nt, Homo sapiens
ccauguggguucucuguca

SEQ ID NO: 329859 - RNA, 19 nt, Homo sapiens
ggaagaaauccuuuauugc

SEQ ID NO: 329860 - RNA, 19 nt, Homo sapiens
cauggaagaacuuguagaa

SEQ ID NO: 329861 - RNA, 19 nt, Homo sapiens
gaagaaugagagauuaugg

SEQ ID NO: 329862 - RNA, 19 nt, Homo sapiens
caccaggcaucaagcagaa

SEQ ID NO: 329863 - RNA, 19 nt, Homo sapiens
cuguguagcuguaauuugu

SEQ ID NO: 329864 - RNA, 19 nt, Homo sapiens
ugguaugguuggucuagua

SEQ ID NO: 329865 - RNA, 19 nt, Homo sapiens
cccuuugcuucuaauauua

SEQ ID NO: 329866 - RNA, 19 nt, Homo sapiens
aacaagaguuggacaucaa

SEQ ID NO: 329867 - RNA, 19 nt, Homo sapiens
guaguagccaaauuugauu

SEQ ID NO: 329868 - RNA, 19 nt, Homo sapiens
ugcugaagcugcugaaaga

SEQ ID NO: 329869 - RNA, 19 nt, Homo sapiens
gaaagauggcagaagaagu

SEQ ID NO: 329870 - RNA, 19 nt, Homo sapiens
guaauugaagacugagaaa

SEQ ID NO: 329871 - RNA, 19 nt, Homo sapiens
gugaaucuucgccaaauga

SEQ ID NO: 329872 - RNA, 19 nt, Homo sapiens
gauuuccucauucgugaua

SEQ ID NO: 329873 - RNA, 19 nt, Homo sapiens
caccauggaagaacuugua

SEQ ID NO: 329874 - RNA, 19 nt, Homo sapiens
gagauuauggcuucuggau

SEQ ID NO: 329875 - RNA, 19 nt, Homo sapiens
ugaaggggauuuccucauu

SEQ ID NO: 329876 - RNA, 19 nt, Homo sapiens
aaacuauguuaccguuaug

SEQ ID NO: 329877 - RNA, 19 nt, Homo sapiens
gcagucgucaauaaccuaa

SEQ ID NO: 329878 - RNA, 19 nt, Homo sapiens
uuuauugccuuuccuuugu

SEQ ID NO: 329879 - RNA, 19 nt, Homo sapiens
gcaucugcauagaacaguu

SEQ ID NO: 329880 - RNA, 19 nt, Homo sapiens
cagaagugacugcugugua

SEQ ID NO: 329881 - RNA, 19 nt, Homo sapiens
aaggagauguaauggaugu

SEQ ID NO: 329882 - RNA, 19 nt, Homo sapiens
guagccaaauuugauuaug

SEQ ID NO: 329883 - RNA, 19 nt, Homo sapiens
cacaggccauuguaaauac

SEQ ID NO: 329884 - RNA, 19 nt, Homo sapiens
gugcuugauuggaaauugu

SEQ ID NO: 329885 - RNA, 19 nt, Homo sapiens
gaagaaguggugguaguag

SEQ ID NO: 329886 - RNA, 19 nt, Homo sapiens
uaaauucagcaccauggaa

SEQ ID NO: 329887 - RNA, 19 nt, Homo sapiens
ccagagugguggaaaugca

SEQ ID NO: 329888 - RNA, 19 nt, Homo sapiens
gacccagagugguggaaau

SEQ ID NO: 329889 - RNA, 19 nt, Homo sapiens
gauguaauggauguuauug

SEQ ID NO: 329890 - RNA, 19 nt, Homo sapiens
uaaaugaaagaggacauga

SEQ ID NO: 329891 - RNA, 19 nt, Homo sapiens
aaaccuagugugccagauu

SEQ ID NO: 329892 - RNA, 19 nt, Homo sapiens
ugucacaggccauuguaaa

SEQ ID NO: 329893 - RNA, 19 nt, Homo sapiens
guguuaaucuuuucuguga

SEQ ID NO: 329894 - RNA, 19 nt, Homo sapiens
uaaaggcacccuguucugu

SEQ ID NO: 329895 - RNA, 19 nt, Homo sapiens
guaaaggcacccuguucug

SEQ ID NO: 329896 - RNA, 19 nt, Homo sapiens
caaaucugcuccugaauua

SEQ ID NO: 329897 - RNA, 19 nt, Homo sapiens
guaaagggauugcuuauau

SEQ ID NO: 329898 - RNA, 19 nt, Homo sapiens
gaaagaagacgaaguuuga

SEQ ID NO: 329899 - RNA, 19 nt, Homo sapiens
gaaauaaaguuaccuugga

SEQ ID NO: 329900 - RNA, 19 nt, Homo sapiens
ggaagagccugucaaagaa

SEQ ID NO: 329901 - RNA, 19 nt, Homo sapiens
uaacaaaucugcuccugaa

SEQ ID NO: 329902 - RNA, 19 nt, Homo sapiens
ggaacucacugguuugaaa

SEQ ID NO: 329903 - RNA, 19 nt, Homo sapiens
gaacguggcugaggaugaa

SEQ ID NO: 329904 - RNA, 19 nt, Homo sapiens
ggaugaagaugaaauugaa

SEQ ID NO: 329905 - RNA, 19 nt, Homo sapiens
ggaaauggccaaacagaaa

SEQ ID NO: 329906 - RNA, 19 nt, Homo sapiens
ugaaagaaguguuugaaga

SEQ ID NO: 329907 - RNA, 19 nt, Homo sapiens
caaaggagguagaagaaga

SEQ ID NO: 329908 - RNA, 19 nt, Homo sapiens
caaagaagguggucguuuc

SEQ ID NO: 329909 - RNA, 19 nt, Homo sapiens
gaaauuugguuauguggau

SEQ ID NO: 329910 - RNA, 19 nt, Homo sapiens
cgacgaagaugaugaagau

SEQ ID NO: 329911 - RNA, 19 nt, Homo sapiens
ggaagacggugaaauugau

SEQ ID NO: 329912 - RNA, 19 nt, Homo sapiens
guacuauacuggagagaaa

SEQ ID NO: 329913 - RNA, 19 nt, Homo sapiens
gagcuaacccuuaucugua

SEQ ID NO: 329914 - RNA, 19 nt, Homo sapiens
gaagaugacucugaagaag

SEQ ID NO: 329915 - RNA, 19 nt, Homo sapiens
gggcaaggauaguuacuga

SEQ ID NO: 329916 - RNA, 19 nt, Homo sapiens
gaauugguaugacuaggaa

SEQ ID NO: 329917 - RNA, 19 nt, Homo sapiens
ggaaaugucagaagaugaa

SEQ ID NO: 329918 - RNA, 19 nt, Homo sapiens
gaaagaaguguuugaagau

SEQ ID NO: 329919 - RNA, 19 nt, Homo sapiens
aaagaaagcugcaaaaguu

SEQ ID NO: 329920 - RNA, 19 nt, Homo sapiens
gaaacuggguccuccaaag

SEQ ID NO: 329921 - RNA, 19 nt, Homo sapiens
ggaugaagaugaagaagag

SEQ ID NO: 329922 - RNA, 19 nt, Homo sapiens
ggaugaggaugaagaugaa

SEQ ID NO: 329923 - RNA, 19 nt, Homo sapiens
ggaaauccgucuaguuaac

SEQ ID NO: 329924 - RNA, 19 nt, Homo sapiens
ggaaagaagacgaaguuug

SEQ ID NO: 329925 - RNA, 19 nt, Homo sapiens
caaagucacucaggaugaa

SEQ ID NO: 329926 - RNA, 19 nt, Homo sapiens
gaaggaagacagugaugaa

SEQ ID NO: 329927 - RNA, 19 nt, Homo sapiens
ggacgaggaugaggaugaa

SEQ ID NO: 329928 - RNA, 19 nt, Homo sapiens
gcaagaaugccaagaagga

SEQ ID NO: 329929 - RNA, 19 nt, Homo sapiens
cgucauaccucagaagaaa

SEQ ID NO: 329930 - RNA, 19 nt, Homo sapiens
gagaaaaccuuugaagaaa

SEQ ID NO: 329931 - RNA, 19 nt, Homo sapiens
ugauagagcuaacccuuau

SEQ ID NO: 329932 - RNA, 19 nt, Homo sapiens
gaaaguggaaggcacagaa

SEQ ID NO: 329933 - RNA, 19 nt, Homo sapiens
ugacgaagaugaugaggau

SEQ ID NO: 329934 - RNA, 19 nt, Homo sapiens
ggaagacagugaugaagag

SEQ ID NO: 329935 - RNA, 19 nt, Homo sapiens
gaggaaaugucagaagaug

SEQ ID NO: 329936 - RNA, 19 nt, Homo sapiens
ggaggaagagccugucaaa

SEQ ID NO: 329937 - RNA, 19 nt, Homo sapiens
ggaagaugacucugaagaa

SEQ ID NO: 329938 - RNA, 19 nt, Homo sapiens
acuguuaccugaucaauga

SEQ ID NO: 329939 - RNA, 19 nt, Homo sapiens
ugaggaagaugacucugaa

SEQ ID NO: 329940 - RNA, 19 nt, Homo sapiens
agaagaagauagugaagau

SEQ ID NO: 329941 - RNA, 19 nt, Homo sapiens
ggaaguauuugagaaagca

SEQ ID NO: 329942 - RNA, 19 nt, Homo sapiens
cuauagagguggaaagaau

SEQ ID NO: 329943 - RNA, 19 nt, Homo sapiens
gaaaagacaguaagaaaga

SEQ ID NO: 329944 - RNA, 19 nt, Homo sapiens
gcaaagaauggcaagaaug

SEQ ID NO: 329945 - RNA, 19 nt, Homo sapiens
ggacucaucugcgccacuu

SEQ ID NO: 329946 - RNA, 19 nt, Homo sapiens
ugaagaugaugaugaugaa

SEQ ID NO: 329947 - RNA, 19 nt, Homo sapiens
gcaaagaagguggucguuu

SEQ ID NO: 329948 - RNA, 19 nt, Homo sapiens
ggauaccacugaagagaca

SEQ ID NO: 329949 - RNA, 19 nt, Homo sapiens
gagaaagcguuggaacuca

SEQ ID NO: 329950 - RNA, 19 nt, Homo sapiens
agaaggaaauggccaaaca

SEQ ID NO: 329951 - RNA, 19 nt, Homo sapiens
gaagaugaagaagaugaua

SEQ ID NO: 329952 - RNA, 19 nt, Homo sapiens
cauggaagacggugaaauu

SEQ ID NO: 329953 - RNA, 19 nt, Homo sapiens
gguaugcauuuauagaguu

SEQ ID NO: 329954 - RNA, 19 nt, Homo sapiens
uggcaaaucuaaaggguau

SEQ ID NO: 329955 - RNA, 19 nt, Homo sapiens
aaaguaaagggauugcuua

SEQ ID NO: 329956 - RNA, 19 nt, Homo sapiens
gucagaagaugaagaagau

SEQ ID NO: 329957 - RNA, 19 nt, Homo sapiens
ggcaauaccguguugguuu

SEQ ID NO: 329958 - RNA, 19 nt, Homo sapiens
uuggaaauccgucuaguua

SEQ ID NO: 329959 - RNA, 19 nt, Homo sapiens
gagaagaggucgucauacc

SEQ ID NO: 329960 - RNA, 19 nt, Homo sapiens
gaagacgaaguuugaauag

SEQ ID NO: 329961 - RNA, 19 nt, Homo sapiens
ccaaggaggccauggaaga

SEQ ID NO: 329962 - RNA, 19 nt, Homo sapiens
aggaagagccugucaaaga

SEQ ID NO: 329963 - RNA, 19 nt, Homo sapiens
gcaauaccguguugguuuu

SEQ ID NO: 329964 - RNA, 19 nt, Homo sapiens
caagggcaauaccguguug

SEQ ID NO: 329965 - RNA, 19 nt, Homo sapiens
agaagacgaaguuugaaua

SEQ ID NO: 329966 - RNA, 19 nt, Homo sapiens
ccacugaagagacauuaaa

SEQ ID NO: 329967 - RNA, 19 nt, Homo sapiens
agaguuugcuucauucgaa

SEQ ID NO: 329968 - RNA, 19 nt, Homo sapiens
ggcaaagaauggcaagaau

SEQ ID NO: 329969 - RNA, 19 nt, Homo sapiens
cagcaacaccugccaagaa

SEQ ID NO: 329970 - RNA, 19 nt, Homo sapiens
gaaccaaaauggcaaaucu

SEQ ID NO: 329971 - RNA, 19 nt, Homo sapiens
ggaaagaauagcacuugga

SEQ ID NO: 329972 - RNA, 19 nt, Homo sapiens
agaugacucugaagaagaa

SEQ ID NO: 329973 - RNA, 19 nt, Homo sapiens
uuaaagaguugagugauag

SEQ ID NO: 329974 - RNA, 19 nt, Homo sapiens
cgagaacacuuuuggcuaa

SEQ ID NO: 329975 - RNA, 19 nt, Homo sapiens
cguuggaacucacugguuu

SEQ ID NO: 329976 - RNA, 19 nt, Homo sapiens
ugaugaagaugaugaugau

SEQ ID NO: 329977 - RNA, 19 nt, Homo sapiens
cgaagaugaugaagaugau

SEQ ID NO: 329978 - RNA, 19 nt, Homo sapiens
cgaagacgcuaaagaagcu

SEQ ID NO: 329979 - RNA, 19 nt, Homo sapiens
ggcgaucuauuucccugua

SEQ ID NO: 329980 - RNA, 19 nt, Homo sapiens
ugacuaggaaauuugguua

SEQ ID NO: 329981 - RNA, 19 nt, Homo sapiens
ggaagaagaggaggaggaa

SEQ ID NO: 329982 - RNA, 19 nt, Homo sapiens
caagaaagcagcugucacu

SEQ ID NO: 329983 - RNA, 19 nt, Homo sapiens
ggacauuccaagacaguau

SEQ ID NO: 329984 - RNA, 19 nt, Homo sapiens
gaaauugagggcagagcaa

SEQ ID NO: 329985 - RNA, 19 nt, Homo sapiens
aaagaaguguuugaagaug

SEQ ID NO: 329986 - RNA, 19 nt, Homo sapiens
caaagaagcaccuggaaaa

SEQ ID NO: 329987 - RNA, 19 nt, Homo sapiens
ggagguagaagaagauagu

SEQ ID NO: 329988 - RNA, 19 nt, Homo sapiens
gcggagaucagauuaguca

SEQ ID NO: 329989 - RNA, 19 nt, Homo sapiens
gaaauggccaaacagaaag

SEQ ID NO: 329990 - RNA, 19 nt, Homo sapiens
ccaagaaggaagacaguga

SEQ ID NO: 329991 - RNA, 19 nt, Homo sapiens
gggcaaagaauggcaagaa

SEQ ID NO: 329992 - RNA, 19 nt, Homo sapiens
gugauagagcuaacccuua

SEQ ID NO: 329993 - RNA, 19 nt, Homo sapiens
gguagaagaagauagugaa

SEQ ID NO: 329994 - RNA, 19 nt, Homo sapiens
acaaaucugcuccugaauu

SEQ ID NO: 329995 - RNA, 19 nt, Homo sapiens
caagaaacagaaaguggaa

SEQ ID NO: 329996 - RNA, 19 nt, Homo sapiens
gugcuaaacugaugaaaua

SEQ ID NO: 329997 - RNA, 19 nt, Homo sapiens
ggaggcagaugaaugguuu

SEQ ID NO: 329998 - RNA, 19 nt, Homo sapiens
gcagacaugucagaacaaa

SEQ ID NO: 329999 - RNA, 19 nt, Homo sapiens
ggaagaagcacuccaccuu

SEQ ID NO: 330000 - RNA, 19 nt, Homo sapiens
gagaugugcuaaacugaug

SEQ ID NO: 330001 - RNA, 19 nt, Homo sapiens
ugaauuaccugaaguacca

SEQ ID NO: 330002 - RNA, 19 nt, Homo sapiens
gcaguaugguugggaauga

SEQ ID NO: 330003 - RNA, 19 nt, Homo sapiens
ggacugaugauguguguug

SEQ ID NO: 330004 - RNA, 19 nt, Homo sapiens
ccaaaugaauuaccugaag

SEQ ID NO: 330005 - RNA, 19 nt, Homo sapiens
gcgcagacaugucagaaca

SEQ ID NO: 330006 - RNA, 19 nt, Homo sapiens
ccagagaugugcuaaacug

SEQ ID NO: 330007 - RNA, 19 nt, Homo sapiens
gaaaucaccaagaugcaaa

SEQ ID NO: 330008 - RNA, 19 nt, Homo sapiens
gaacaaaguaaggaucuga

SEQ ID NO: 330009 - RNA, 19 nt, Homo sapiens
gauguaugcauguuuguuu

SEQ ID NO: 330010 - RNA, 19 nt, Homo sapiens
gauuuacagugcaguauuc

SEQ ID NO: 330011 - RNA, 19 nt, Homo sapiens
caaaugaauuaccugaagu

SEQ ID NO: 330012 - RNA, 19 nt, Homo sapiens
ggaguacacuaauuugaac

SEQ ID NO: 330013 - RNA, 19 nt, Homo sapiens
ggaagaagucaccagcaaa

SEQ ID NO: 330014 - RNA, 19 nt, Homo sapiens
cgcacgagcucauguggua

SEQ ID NO: 330015 - RNA, 19 nt, Homo sapiens
caccgugagucaacuuuaa

SEQ ID NO: 330016 - RNA, 19 nt, Homo sapiens
gaagaagucaccagcaaag

SEQ ID NO: 330017 - RNA, 19 nt, Homo sapiens
ugcggaagcucaucacuga

SEQ ID NO: 330018 - RNA, 19 nt, Homo sapiens
gaggaguucguccaaauga

SEQ ID NO: 330019 - RNA, 19 nt, Homo sapiens
gugcaguauucacguguaa

SEQ ID NO: 330020 - RNA, 19 nt, Homo sapiens
ucaccaagaugcaaaucau

SEQ ID NO: 330021 - RNA, 19 nt, Homo sapiens
gguacgugcuggucaagga

SEQ ID NO: 330022 - RNA, 19 nt, Homo sapiens
ugucuguaaucacaucaua

SEQ ID NO: 330023 - RNA, 19 nt, Homo sapiens
uaggauguaugcauguuug

SEQ ID NO: 330024 - RNA, 19 nt, Homo sapiens
gggcugcaccugaggcuaa

SEQ ID NO: 330025 - RNA, 19 nt, Homo sapiens
gagcgacccuaacuuugca

SEQ ID NO: 330026 - RNA, 19 nt, Homo sapiens
gcacuuggcacacuuuacu

SEQ ID NO: 330027 - RNA, 19 nt, Homo sapiens
uggaagaagucaccagcaa

SEQ ID NO: 330028 - RNA, 19 nt, Homo sapiens
ggaguucguccaaaugaau

SEQ ID NO: 330029 - RNA, 19 nt, Homo sapiens
ggauuuacagugcaguauu

SEQ ID NO: 330030 - RNA, 19 nt, Homo sapiens
ucaaggaccagaagaagau

SEQ ID NO: 330031 - RNA, 19 nt, Homo sapiens
ggugggucauuauaguauu

SEQ ID NO: 330032 - RNA, 19 nt, Homo sapiens
gaucugagcgacccuaacu

SEQ ID NO: 330033 - RNA, 19 nt, Homo sapiens
uaaccagccugcacaccau

SEQ ID NO: 330034 - RNA, 19 nt, Homo sapiens
uuccagacauggugaaaga

SEQ ID NO: 330035 - RNA, 19 nt, Homo sapiens
cacaucauaugggaauaaa

SEQ ID NO: 330036 - RNA, 19 nt, Homo sapiens
gagcacuuggcacacuuua

SEQ ID NO: 330037 - RNA, 19 nt, Homo sapiens
cugaugaaauacauugaga

SEQ ID NO: 330038 - RNA, 19 nt, Homo sapiens
gugcuaccuuucuuggauu

SEQ ID NO: 330039 - RNA, 19 nt, Homo sapiens
ucaguacagugcuuuuaua

SEQ ID NO: 330040 - RNA, 19 nt, Homo sapiens
agacaugucagaacaaagu

SEQ ID NO: 330041 - RNA, 19 nt, Homo sapiens
ucacaucauaugggaauaa

SEQ ID NO: 330042 - RNA, 19 nt, Homo sapiens
ucugagcgacccuaacuuu

SEQ ID NO: 330043 - RNA, 19 nt, Homo sapiens
uaccagagaugugcuaaac

SEQ ID NO: 330044 - RNA, 19 nt, Homo sapiens
gagagagcgccgucuggaa

SEQ ID NO: 330045 - RNA, 19 nt, Homo sapiens
cuccuaaauuugugaaguu

SEQ ID NO: 330046 - RNA, 19 nt, Homo sapiens
ccaccgugagucaacuuua

SEQ ID NO: 330047 - RNA, 19 nt, Homo sapiens
aaaacacccucguggagua

SEQ ID NO: 330048 - RNA, 19 nt, Homo sapiens
gcuaaacugaugaaauaca

SEQ ID NO: 330049 - RNA, 19 nt, Homo sapiens
gaccagaagaagaugauca

SEQ ID NO: 330050 - RNA, 19 nt, Homo sapiens
uaccuuuaaugcaauguug

SEQ ID NO: 330051 - RNA, 19 nt, Homo sapiens
gcccgaauacgaguucuuu

SEQ ID NO: 330052 - RNA, 19 nt, Homo sapiens
cugaggaguucguccaaau

SEQ ID NO: 330053 - RNA, 19 nt, Homo sapiens
gauuacuccuaaauuugug

SEQ ID NO: 330054 - RNA, 19 nt, Homo sapiens
uauaugggacugaugaugu

SEQ ID NO: 330055 - RNA, 19 nt, Homo sapiens
uggaguacacuaauuugaa

SEQ ID NO: 330056 - RNA, 19 nt, Homo sapiens
guauucauuuggguacuau

SEQ ID NO: 330057 - RNA, 19 nt, Homo sapiens
aguauucacguguaacuuu

SEQ ID NO: 330058 - RNA, 19 nt, Homo sapiens
gagcucugcgggaggcuaa

SEQ ID NO: 330059 - RNA, 19 nt, Homo sapiens
agaugcaaaucauggaguu

SEQ ID NO: 330060 - RNA, 19 nt, Homo sapiens
gguugggaaugagacaauu

SEQ ID NO: 330061 - RNA, 19 nt, Homo sapiens
ccagacauggugaaagaug

SEQ ID NO: 330062 - RNA, 19 nt, Homo sapiens
uguguaguauuuaggaugu

SEQ ID NO: 330063 - RNA, 19 nt, Homo sapiens
ucauuuggguacuauugug

SEQ ID NO: 330064 - RNA, 19 nt, Homo sapiens
cgaaaucaccaagaugcaa

SEQ ID NO: 330065 - RNA, 19 nt, Homo sapiens
ugaccuugcugggcacaga

SEQ ID NO: 330066 - RNA, 19 nt, Homo sapiens
agacggcgcagacauguca

SEQ ID NO: 330067 - RNA, 19 nt, Homo sapiens
gccgcgaaaucaccaagau

SEQ ID NO: 330068 - RNA, 19 nt, Homo sapiens
cuacucaugauuacuccua

SEQ ID NO: 330069 - RNA, 19 nt, Homo sapiens
auacaacuauuuccccuaa

SEQ ID NO: 330070 - RNA, 19 nt, Homo sapiens
ugugcuaccuuucuuggau

SEQ ID NO: 330071 - RNA, 19 nt, Homo sapiens
uguauucauuuggguacua

SEQ ID NO: 330072 - RNA, 19 nt, Homo sapiens
guauucacguguaacuuuu

SEQ ID NO: 330073 - RNA, 19 nt, Homo sapiens
gugggucauuauaguauuc

SEQ ID NO: 330074 - RNA, 19 nt, Homo sapiens
gaguucguccaaaugaauu

SEQ ID NO: 330075 - RNA, 19 nt, Homo sapiens
guggaguacacuaauuuga

SEQ ID NO: 330076 - RNA, 19 nt, Homo sapiens
guacagugcuuuuauaccu

SEQ ID NO: 330077 - RNA, 19 nt, Homo sapiens
caguaagauugucuguaau

SEQ ID NO: 330078 - RNA, 19 nt, Homo sapiens
guaccagagaugugcuaaa

SEQ ID NO: 330079 - RNA, 19 nt, Homo sapiens
gacaugucagaacaaagua

SEQ ID NO: 330080 - RNA, 19 nt, Homo sapiens
ggauguaugcauguuuguu

SEQ ID NO: 330081 - RNA, 19 nt, Homo sapiens
guauuuaggauguaugcau

SEQ ID NO: 330082 - RNA, 19 nt, Homo sapiens
ucuguaaucacaucauaug

SEQ ID NO: 330083 - RNA, 19 nt, Homo sapiens
gcaguauucacguguaacu

SEQ ID NO: 330084 - RNA, 19 nt, Homo sapiens
gggugggucauuauaguau

SEQ ID NO: 330085 - RNA, 19 nt, Homo sapiens
gcagugucucugaggacua

SEQ ID NO: 330086 - RNA, 19 nt, Homo sapiens
aaucacaucauaugggaau

SEQ ID NO: 330087 - RNA, 19 nt, Homo sapiens
acucaugauuacuccuaaa

SEQ ID NO: 330088 - RNA, 19 nt, Homo sapiens
gugagcacuuggcacacuu

SEQ ID NO: 330089 - RNA, 19 nt, Homo sapiens
gucaaggaccagaagaaga

SEQ ID NO: 330090 - RNA, 19 nt, Homo sapiens
ccaagaugcaaaucaugga

SEQ ID NO: 330091 - RNA, 19 nt, Homo sapiens
cagaacaaaguaaggaucu

SEQ ID NO: 330092 - RNA, 19 nt, Homo sapiens
cugcagaguuuggaagaag

SEQ ID NO: 330093 - RNA, 19 nt, Homo sapiens
auaugggacugaugaugug

SEQ ID NO: 330094 - RNA, 19 nt, Homo sapiens
gaugugcuaaacugaugaa

SEQ ID NO: 330095 - RNA, 19 nt, Homo sapiens
ucguggaguacacuaauuu

SEQ ID NO: 330096 - RNA, 19 nt, Homo sapiens
ggaaggcugucucagauaa

SEQ ID NO: 330097 - RNA, 19 nt, Homo sapiens
aaacaacaguccuaacuuu

SEQ ID NO: 330098 - RNA, 19 nt, Homo sapiens
caaauuagacaaccaagua

SEQ ID NO: 330099 - RNA, 19 nt, Homo sapiens
gggaaagacuggcaagaaa

SEQ ID NO: 330100 - RNA, 19 nt, Homo sapiens
gugaagccauuuccaauuu

SEQ ID NO: 330101 - RNA, 19 nt, Homo sapiens
ggaagaauuuacuuuggaa

SEQ ID NO: 330102 - RNA, 19 nt, Homo sapiens
gaaguaacaggaccucuuu

SEQ ID NO: 330103 - RNA, 19 nt, Homo sapiens
ccagcgaacugacauuaaa

SEQ ID NO: 330104 - RNA, 19 nt, Homo sapiens
gggcaucauucucuaauau

SEQ ID NO: 330105 - RNA, 19 nt, Homo sapiens
ccugggacaucuucuguua

SEQ ID NO: 330106 - RNA, 19 nt, Homo sapiens
gggaagaauuuacuuugga

SEQ ID NO: 330107 - RNA, 19 nt, Homo sapiens
acggacagcucauucauaa

SEQ ID NO: 330108 - RNA, 19 nt, Homo sapiens
uguacuagcugcauccuuu

SEQ ID NO: 330109 - RNA, 19 nt, Homo sapiens
gaaaagaguuaaggcaaaa

SEQ ID NO: 330110 - RNA, 19 nt, Homo sapiens
ccaagcauguggauauguu

SEQ ID NO: 330111 - RNA, 19 nt, Homo sapiens
gagauacucugggaacuuc

SEQ ID NO: 330112 - RNA, 19 nt, Homo sapiens
ggacaaugacaaccagaaa

SEQ ID NO: 330113 - RNA, 19 nt, Homo sapiens
uaacaggaccucuuucuag

SEQ ID NO: 330114 - RNA, 19 nt, Homo sapiens
caucuucuguuauuguuga

SEQ ID NO: 330115 - RNA, 19 nt, Homo sapiens
gugcaaagaguaagacaaa

SEQ ID NO: 330116 - RNA, 19 nt, Homo sapiens
gaaaguaaaagcagcauaa

SEQ ID NO: 330117 - RNA, 19 nt, Homo sapiens
ccuaggaggugaagccauu

SEQ ID NO: 330118 - RNA, 19 nt, Homo sapiens
caggaaggcugucucagau

SEQ ID NO: 330119 - RNA, 19 nt, Homo sapiens
gcauaaagaauuugucaca

SEQ ID NO: 330120 - RNA, 19 nt, Homo sapiens
gcuaaagguuaccgauuuc

SEQ ID NO: 330121 - RNA, 19 nt, Homo sapiens
ggacaucuucuguuauugu

SEQ ID NO: 330122 - RNA, 19 nt, Homo sapiens
ugggacaucuucuguuauu

SEQ ID NO: 330123 - RNA, 19 nt, Homo sapiens
ggucuaagguugccauugc

SEQ ID NO: 330124 - RNA, 19 nt, Homo sapiens
uuccaacaauucagcauua

SEQ ID NO: 330125 - RNA, 19 nt, Homo sapiens
guaauaaagacucuacaug

SEQ ID NO: 330126 - RNA, 19 nt, Homo sapiens
ggagaaugcaccauacuca

SEQ ID NO: 330127 - RNA, 19 nt, Homo sapiens
ggaaguaacaggaccucuu

SEQ ID NO: 330128 - RNA, 19 nt, Homo sapiens
aggcauauauguacuagug

SEQ ID NO: 330129 - RNA, 19 nt, Homo sapiens
ugcuaaagguuaccgauuu

SEQ ID NO: 330130 - RNA, 19 nt, Homo sapiens
caacaauucagcauuagug

SEQ ID NO: 330131 - RNA, 19 nt, Homo sapiens
ugugaaacauguugccaaa

SEQ ID NO: 330132 - RNA, 19 nt, Homo sapiens
caaccaaguaugaaucuau

SEQ ID NO: 330133 - RNA, 19 nt, Homo sapiens
ggauauguuuagcuacguu

SEQ ID NO: 330134 - RNA, 19 nt, Homo sapiens
gacaucuucuguuauuguu

SEQ ID NO: 330135 - RNA, 19 nt, Homo sapiens
cuacaugcuuguugacaga

SEQ ID NO: 330136 - RNA, 19 nt, Homo sapiens
guucagcacuguccucaag

SEQ ID NO: 330137 - RNA, 19 nt, Homo sapiens
ucacgggcaucauucucua

SEQ ID NO: 330138 - RNA, 19 nt, Homo sapiens
guaacaggaccucuuucua

SEQ ID NO: 330139 - RNA, 19 nt, Homo sapiens
ugacagagggacagaagaa

SEQ ID NO: 330140 - RNA, 19 nt, Homo sapiens
gcaugaggcaccacuaugu

SEQ ID NO: 330141 - RNA, 19 nt, Homo sapiens
ggugaagccauuuccaauu

SEQ ID NO: 330142 - RNA, 19 nt, Homo sapiens
ggcugucucagauaaauua

SEQ ID NO: 330143 - RNA, 19 nt, Homo sapiens
ccaaguaugaaucuauuug

SEQ ID NO: 330144 - RNA, 19 nt, Homo sapiens
gcaagugcaaagaguaaga

SEQ ID NO: 330145 - RNA, 19 nt, Homo sapiens
cagauacugugaugaugga

SEQ ID NO: 330146 - RNA, 19 nt, Homo sapiens
cuggaacucuugacagcua

SEQ ID NO: 330147 - RNA, 19 nt, Homo sapiens
auacugugaugauggauug

SEQ ID NO: 330148 - RNA, 19 nt, Homo sapiens
ugggugugcuauagcuuua

SEQ ID NO: 330149 - RNA, 19 nt, Homo sapiens
gaacucuugacagcuauaa

SEQ ID NO: 330150 - RNA, 19 nt, Homo sapiens
gauccugcccuuuccuuga

SEQ ID NO: 330151 - RNA, 19 nt, Homo sapiens
gcacauaaaggacaaugac

SEQ ID NO: 330152 - RNA, 19 nt, Homo sapiens
uaagggagcagacuuuuaa

SEQ ID NO: 330153 - RNA, 19 nt, Homo sapiens
ccauugcugcuaaagguua

SEQ ID NO: 330154 - RNA, 19 nt, Homo sapiens
gaaacauguugccaaaaug

SEQ ID NO: 330155 - RNA, 19 nt, Homo sapiens
gaaggcugucucagauaaa

SEQ ID NO: 330156 - RNA, 19 nt, Homo sapiens
aaagguuaccgauuucaaa

SEQ ID NO: 330157 - RNA, 19 nt, Homo sapiens
ugaaacauguugccaaaau

SEQ ID NO: 330158 - RNA, 19 nt, Homo sapiens
uaaacaacaguccuaacuu

SEQ ID NO: 330159 - RNA, 19 nt, Homo sapiens
gguuaccgauuucaaaguc

SEQ ID NO: 330160 - RNA, 19 nt, Homo sapiens
gguacauccucuccuguca

SEQ ID NO: 330161 - RNA, 19 nt, Homo sapiens
gaggugaagccauuuccaa

SEQ ID NO: 330162 - RNA, 19 nt, Homo sapiens
aauauccacuuguccaugu

SEQ ID NO: 330163 - RNA, 19 nt, Homo sapiens
ggaaaaggcauauauguac

SEQ ID NO: 330164 - RNA, 19 nt, Homo sapiens
gacucuacaugcuuguuga

SEQ ID NO: 330165 - RNA, 19 nt, Homo sapiens
cagcagauacugugaugau

SEQ ID NO: 330166 - RNA, 19 nt, Homo sapiens
ggccuggcuugucuucuga

SEQ ID NO: 330167 - RNA, 19 nt, Homo sapiens
gcaguucccaucuccuuuc

SEQ ID NO: 330168 - RNA, 19 nt, Homo sapiens
gacucugcauauucuagua

SEQ ID NO: 330169 - RNA, 19 nt, Homo sapiens
gagaaaacauguacuagcu

SEQ ID NO: 330170 - RNA, 19 nt, Homo sapiens
gcaaauuagacaaccaagu

SEQ ID NO: 330171 - RNA, 19 nt, Homo sapiens
acucaugcaugcaaauuag

SEQ ID NO: 330172 - RNA, 19 nt, Homo sapiens
cagcauaaagaauuuguca

SEQ ID NO: 330173 - RNA, 19 nt, Homo sapiens
aauaaagacucuacaugcu

SEQ ID NO: 330174 - RNA, 19 nt, Homo sapiens
gguccuggaggcucaaauu

SEQ ID NO: 330175 - RNA, 19 nt, Homo sapiens
agaaaagucugagaagaaa

SEQ ID NO: 330176 - RNA, 19 nt, Homo sapiens
cgggcaucauucucuaaua

SEQ ID NO: 330177 - RNA, 19 nt, Homo sapiens
guacuaguggcauggagaa

SEQ ID NO: 330178 - RNA, 19 nt, Homo sapiens
ucucuaauauccacuuguc

SEQ ID NO: 330179 - RNA, 19 nt, Homo sapiens
auaccaagcauguggauau

SEQ ID NO: 330180 - RNA, 19 nt, Homo sapiens
cgauuucaaaguccagaua

SEQ ID NO: 330181 - RNA, 19 nt, Homo sapiens
caacaguccuaacuuuugu

SEQ ID NO: 330182 - RNA, 19 nt, Homo sapiens
ggaaagacuggcaagaaaa

SEQ ID NO: 330183 - RNA, 19 nt, Homo sapiens
ggagauacagacaguaaaa

SEQ ID NO: 330184 - RNA, 19 nt, Homo sapiens
cuauguggauucuaucagu

SEQ ID NO: 330185 - RNA, 19 nt, Homo sapiens
ccucugcuguucuucuaga

SEQ ID NO: 330186 - RNA, 19 nt, Homo sapiens
ucaaugcuguuuggguuuc

SEQ ID NO: 330187 - RNA, 19 nt, Homo sapiens
guucccaucuccuuucucu

SEQ ID NO: 330188 - RNA, 19 nt, Homo sapiens
agaaaagaguuaaggcaaa

SEQ ID NO: 330189 - RNA, 19 nt, Homo sapiens
gaaaaggcauauauguacu

SEQ ID NO: 330190 - RNA, 19 nt, Homo sapiens
aagcauguggauauguuua

SEQ ID NO: 330191 - RNA, 19 nt, Homo sapiens
ccaucuccuuucucuggua

SEQ ID NO: 330192 - RNA, 19 nt, Homo sapiens
gacccucgacgcugcauga

SEQ ID NO: 330193 - RNA, 19 nt, Homo sapiens
uaaaggacaaugacaacca

SEQ ID NO: 330194 - RNA, 19 nt, Homo sapiens
gcaucauucucuaauaucc

SEQ ID NO: 330195 - RNA, 19 nt, Homo sapiens
cagagggacagaagaacaa

SEQ ID NO: 330196 - RNA, 19 nt, Homo sapiens
gcaaauguguuuauguagu

SEQ ID NO: 330197 - RNA, 19 nt, Homo sapiens
caaauguguuuauguagug

SEQ ID NO: 330198 - RNA, 19 nt, Homo sapiens
ggguaucacuggagucuga

SEQ ID NO: 330199 - RNA, 19 nt, Homo sapiens
gcgcaucucuggaguugau

SEQ ID NO: 330200 - RNA, 19 nt, Homo sapiens
ucucuggaguugaucguua

SEQ ID NO: 330201 - RNA, 19 nt, Homo sapiens
ggagucugauggaaagaga

SEQ ID NO: 330202 - RNA, 19 nt, Homo sapiens
guguuuauguaguggcuua

SEQ ID NO: 330203 - RNA, 19 nt, Homo sapiens
gggcagagaugugguucga

SEQ ID NO: 330204 - RNA, 19 nt, Homo sapiens
gaguugaucguuacuaugu

SEQ ID NO: 330205 - RNA, 19 nt, Homo sapiens
gcaugcaaauguguuuaug

SEQ ID NO: 330206 - RNA, 19 nt, Homo sapiens
gagaugugguucgagauuc

SEQ ID NO: 330207 - RNA, 19 nt, Homo sapiens
ggcgugugcuuguugauuc

SEQ ID NO: 330208 - RNA, 19 nt, Homo sapiens
uuucaaggacccagaagua

SEQ ID NO: 330209 - RNA, 19 nt, Homo sapiens
uggaguugaucguuacuau

SEQ ID NO: 330210 - RNA, 19 nt, Homo sapiens
gcauuuuccugauugauga

SEQ ID NO: 330211 - RNA, 19 nt, Homo sapiens
ucacuggagucugauggaa

SEQ ID NO: 330212 - RNA, 19 nt, Homo sapiens
guugaucguuacuaugugu

SEQ ID NO: 330213 - RNA, 19 nt, Homo sapiens
uuauguagcaugcaaaugu

SEQ ID NO: 330214 - RNA, 19 nt, Homo sapiens
uguauuauguagcaugcaa

SEQ ID NO: 330215 - RNA, 19 nt, Homo sapiens
cugcguacauccacagguu

SEQ ID NO: 330216 - RNA, 19 nt, Homo sapiens
gagaacauugauuaaggaa

SEQ ID NO: 330217 - RNA, 19 nt, Homo sapiens
guagcaugcaaauguguuu

SEQ ID NO: 330218 - RNA, 19 nt, Homo sapiens
ggaguugaucguuacuaug

SEQ ID NO: 330219 - RNA, 19 nt, Homo sapiens
uauguagcaugcaaaugug

SEQ ID NO: 330220 - RNA, 19 nt, Homo sapiens
gaucguuacuaugugucaa

SEQ ID NO: 330221 - RNA, 19 nt, Homo sapiens
acucaguuauggccaucua

SEQ ID NO: 330222 - RNA, 19 nt, Homo sapiens
agagaugugguucgagauu

SEQ ID NO: 330223 - RNA, 19 nt, Homo sapiens
gggcgugugcuuguugauu

SEQ ID NO: 330224 - RNA, 19 nt, Homo sapiens
gaagcauuuuccugauuga

SEQ ID NO: 330225 - RNA, 19 nt, Homo sapiens
aggcgcaucucuggaguug

SEQ ID NO: 330226 - RNA, 19 nt, Homo sapiens
uagcaugcaaauguguuua

SEQ ID NO: 330227 - RNA, 19 nt, Homo sapiens
agucugauggaaagagaua

SEQ ID NO: 330228 - RNA, 19 nt, Homo sapiens
ucauaaagcuugugcugua

SEQ ID NO: 330229 - RNA, 19 nt, Homo sapiens
gaggcaaaguagcuuaaua

SEQ ID NO: 330230 - RNA, 19 nt, Homo sapiens
ggaauuggcgacuucgaua

SEQ ID NO: 330231 - RNA, 19 nt, Homo sapiens
gaaggcgaaucccgaccua

SEQ ID NO: 330232 - RNA, 19 nt, Homo sapiens
ggacuuaguauaaugugaa

SEQ ID NO: 330233 - RNA, 19 nt, Homo sapiens
agacgaaugucccuuugaa

SEQ ID NO: 330234 - RNA, 19 nt, Homo sapiens
guucuccuauuccucauaa

SEQ ID NO: 330235 - RNA, 19 nt, Homo sapiens
gagauucgcauccacuuau

SEQ ID NO: 330236 - RNA, 19 nt, Homo sapiens
cauaaagcuugugcuguaa

SEQ ID NO: 330237 - RNA, 19 nt, Homo sapiens
cgacuucgauauuaacaag

SEQ ID NO: 330238 - RNA, 19 nt, Homo sapiens
ggcaaaguagcuuaauaua

SEQ ID NO: 330239 - RNA, 19 nt, Homo sapiens
guccucaucuacccucuaa

SEQ ID NO: 330240 - RNA, 19 nt, Homo sapiens
ucagggacuucauugagaa

SEQ ID NO: 330241 - RNA, 19 nt, Homo sapiens
gaaugucccuuugaacaac

SEQ ID NO: 330242 - RNA, 19 nt, Homo sapiens
gucagggacuucauugaga

SEQ ID NO: 330243 - RNA, 19 nt, Homo sapiens
caaccacugaggcaaagua

SEQ ID NO: 330244 - RNA, 19 nt, Homo sapiens
gaauuggcgacuucgauau

SEQ ID NO: 330245 - RNA, 19 nt, Homo sapiens
cgaaugucccuuugaacaa

SEQ ID NO: 330246 - RNA, 19 nt, Homo sapiens
ugagauucgcauccacuua

SEQ ID NO: 330247 - RNA, 19 nt, Homo sapiens
gggcucugcuggacuuagu

SEQ ID NO: 330248 - RNA, 19 nt, Homo sapiens
cgaccuacccauccuaauc

SEQ ID NO: 330249 - RNA, 19 nt, Homo sapiens
aggcaaaguagcuuaauau

SEQ ID NO: 330250 - RNA, 19 nt, Homo sapiens
agagacgaaugucccuuug

SEQ ID NO: 330251 - RNA, 19 nt, Homo sapiens
gagacgaaugucccuuuga

SEQ ID NO: 330252 - RNA, 19 nt, Homo sapiens
gugcaaccacugaggcaaa

SEQ ID NO: 330253 - RNA, 19 nt, Homo sapiens
ucugcuggacuuaguauaa

SEQ ID NO: 330254 - RNA, 19 nt, Homo sapiens
auuggcgacuucgauauua

SEQ ID NO: 330255 - RNA, 19 nt, Homo sapiens
uaaagcuugugcuguaaaa

SEQ ID NO: 330256 - RNA, 19 nt, Homo sapiens
gaacguucuaagugguaaa

SEQ ID NO: 330257 - RNA, 19 nt, Homo sapiens
gggcgucagggacuucauu

SEQ ID NO: 330258 - RNA, 19 nt, Homo sapiens
aagcugggccugcgugaga

SEQ ID NO: 330259 - RNA, 19 nt, Homo sapiens
cugcuggacuuaguauaau

SEQ ID NO: 330260 - RNA, 19 nt, Homo sapiens
ccugggcucugcuggacuu

SEQ ID NO: 330261 - RNA, 19 nt, Homo sapiens
ccacugaggcaaaguagcu

SEQ ID NO: 330262 - RNA, 19 nt, Homo sapiens
aaaauguguucuccuauuc

SEQ ID NO: 330263 - RNA, 19 nt, Homo sapiens
cacugaggauuaagagcaa

SEQ ID NO: 330264 - RNA, 19 nt, Homo sapiens
aagagacgaaugucccuuu

SEQ ID NO: 330265 - RNA, 19 nt, Homo sapiens
gcuguaaaauacuuucuca

SEQ ID NO: 330266 - RNA, 19 nt, Homo sapiens
cuacgcauuuggccaagag

SEQ ID NO: 330267 - RNA, 19 nt, Homo sapiens
uuggcgacuucgauauuaa

SEQ ID NO: 330268 - RNA, 19 nt, Homo sapiens
acgaaugucccuuugaaca

SEQ ID NO: 330269 - RNA, 19 nt, Homo sapiens
ucccacggcucccaauaaa

SEQ ID NO: 330270 - RNA, 19 nt, Homo sapiens
caaguacuccgucaugauc

SEQ ID NO: 330271 - RNA, 19 nt, Homo sapiens
gugagcaccuccacugaca

SEQ ID NO: 330272 - RNA, 19 nt, Homo sapiens
gagcaccuccacugacaga

SEQ ID NO: 330273 - RNA, 19 nt, Homo sapiens
caaagauggcugcgagagu

SEQ ID NO: 330274 - RNA, 19 nt, Homo sapiens
caagaaugccugggacaag

SEQ ID NO: 330275 - RNA, 19 nt, Homo sapiens
gcgccuuccucaagaaugc

SEQ ID NO: 330276 - RNA, 19 nt, Homo sapiens
ucaaguacuccgucaugau

SEQ ID NO: 330277 - RNA, 19 nt, Homo sapiens
ucaagaaugccugggacaa

SEQ ID NO: 330278 - RNA, 19 nt, Homo sapiens
aggccacgcccuacaacua

SEQ ID NO: 330279 - RNA, 19 nt, Homo sapiens
uaacgcugcuuuagaauga

SEQ ID NO: 330280 - RNA, 19 nt, Homo sapiens
gagcaacacuguaucucuu

SEQ ID NO: 330281 - RNA, 19 nt, Homo sapiens
gaaaucauguuggagaucu

SEQ ID NO: 330282 - RNA, 19 nt, Homo sapiens
ccaaugaucaauacaaguu

SEQ ID NO: 330283 - RNA, 19 nt, Homo sapiens
ggaacguccagauuucuaa

SEQ ID NO: 330284 - RNA, 19 nt, Homo sapiens
gaacguccagauuucuaaa

SEQ ID NO: 330285 - RNA, 19 nt, Homo sapiens
ggagaccucugccgcaaac

SEQ ID NO: 330286 - RNA, 19 nt, Homo sapiens
gaagccacauccgcacaau

SEQ ID NO: 330287 - RNA, 19 nt, Homo sapiens
uacaaguucuacucaguga

SEQ ID NO: 330288 - RNA, 19 nt, Homo sapiens
caaguucuacucagugaau

SEQ ID NO: 330289 - RNA, 19 nt, Homo sapiens
caaacaugcuccgccagau

SEQ ID NO: 330290 - RNA, 19 nt, Homo sapiens
ccgcacaauuuuccacuua

SEQ ID NO: 330291 - RNA, 19 nt, Homo sapiens
agccacauccgcacaauuu

SEQ ID NO: 330292 - RNA, 19 nt, Homo sapiens
acucagugaauguggauua

SEQ ID NO: 330293 - RNA, 19 nt, Homo sapiens
aauacaaguucuacucagu

SEQ ID NO: 330294 - RNA, 19 nt, Homo sapiens
ggagcaacacuguaucucu

SEQ ID NO: 330295 - RNA, 19 nt, Homo sapiens
gauguuuguugggacagaa

SEQ ID NO: 330296 - RNA, 19 nt, Homo sapiens
ucaauacaaguucuacuca

SEQ ID NO: 330297 - RNA, 19 nt, Homo sapiens
gcuuuagaaugaaggucuu

SEQ ID NO: 330298 - RNA, 19 nt, Homo sapiens
gaccucugccgcaaacaug

SEQ ID NO: 330299 - RNA, 19 nt, Homo sapiens
cagugaauguggauuacag

SEQ ID NO: 330300 - RNA, 19 nt, Homo sapiens
ucaauccagauguuuguug

SEQ ID NO: 330301 - RNA, 19 nt, Homo sapiens
guucaauccagauguuugu

SEQ ID NO: 330302 - RNA, 19 nt, Homo sapiens
ucccaaugaucaauacaag

SEQ ID NO: 330303 - RNA, 19 nt, Homo sapiens
aaacaugcuccgccagauc

SEQ ID NO: 330304 - RNA, 19 nt, Homo sapiens
ucucuugcgucuggcauug

SEQ ID NO: 330305 - RNA, 19 nt, Homo sapiens
cuacuggagcaacacugua

SEQ ID NO: 330306 - RNA, 19 nt, Homo sapiens
gaaauugacuugguacuua

SEQ ID NO: 330307 - RNA, 19 nt, Homo sapiens
gaagagacauuaagaguuc

SEQ ID NO: 330308 - RNA, 19 nt, Homo sapiens
ggaaauggccaauauaauu

SEQ ID NO: 330309 - RNA, 19 nt, Homo sapiens
gaaagaaguuggcaagcuu

SEQ ID NO: 330310 - RNA, 19 nt, Homo sapiens
gcugugaucuuauguaugu

SEQ ID NO: 330311 - RNA, 19 nt, Homo sapiens
acaaguggcuggugauaaa

SEQ ID NO: 330312 - RNA, 19 nt, Homo sapiens
caaaugcuguucagggaaa

SEQ ID NO: 330313 - RNA, 19 nt, Homo sapiens
ucaaggcggucaauuagaa

SEQ ID NO: 330314 - RNA, 19 nt, Homo sapiens
gaagaccacuggccuugug

SEQ ID NO: 330315 - RNA, 19 nt, Homo sapiens
gaagcuggcuaugguuaaa

SEQ ID NO: 330316 - RNA, 19 nt, Homo sapiens
caaguuguuucaaagauga

SEQ ID NO: 330317 - RNA, 19 nt, Homo sapiens
guaauauggucaugugaau

SEQ ID NO: 330318 - RNA, 19 nt, Homo sapiens
gagcaggucugagaauugu

SEQ ID NO: 330319 - RNA, 19 nt, Homo sapiens
gucauacgaccauaaauua

SEQ ID NO: 330320 - RNA, 19 nt, Homo sapiens
ggauagagguagaguuucu

SEQ ID NO: 330321 - RNA, 19 nt, Homo sapiens
gaacuaaaucuggcaagaa

SEQ ID NO: 330322 - RNA, 19 nt, Homo sapiens
gagguagaguuucuguaaa

SEQ ID NO: 330323 - RNA, 19 nt, Homo sapiens
gaaaguauacagaacagau

SEQ ID NO: 330324 - RNA, 19 nt, Homo sapiens
ggaaagaaguuggcaagcu

SEQ ID NO: 330325 - RNA, 19 nt, Homo sapiens
aaccucagcugugaucuua

SEQ ID NO: 330326 - RNA, 19 nt, Homo sapiens
gggaaacugauguaauuaa

SEQ ID NO: 330327 - RNA, 19 nt, Homo sapiens
caggauagagguagaguuu

SEQ ID NO: 330328 - RNA, 19 nt, Homo sapiens
guaggagacuguuaaaauu

SEQ ID NO: 330329 - RNA, 19 nt, Homo sapiens
cagcugugaucuuauguau

SEQ ID NO: 330330 - RNA, 19 nt, Homo sapiens
gcacaaguggcuggugaua

SEQ ID NO: 330331 - RNA, 19 nt, Homo sapiens
aaagauuucccauugcaua

SEQ ID NO: 330332 - RNA, 19 nt, Homo sapiens
guggaaauggccaauauaa

SEQ ID NO: 330333 - RNA, 19 nt, Homo sapiens
cuaauuacaucaggauaga

SEQ ID NO: 330334 - RNA, 19 nt, Homo sapiens
gagaggccaugggaagauu

SEQ ID NO: 330335 - RNA, 19 nt, Homo sapiens
caguggaaauggccaauau

SEQ ID NO: 330336 - RNA, 19 nt, Homo sapiens
aacuaaaucuggcaagaaa

SEQ ID NO: 330337 - RNA, 19 nt, Homo sapiens
gaugauauuucugugaaca

SEQ ID NO: 330338 - RNA, 19 nt, Homo sapiens
augggaaacugauguaauu

SEQ ID NO: 330339 - RNA, 19 nt, Homo sapiens
cacgagaggcuaagaauau

SEQ ID NO: 330340 - RNA, 19 nt, Homo sapiens
agagguagaguuucuguaa

SEQ ID NO: 330341 - RNA, 19 nt, Homo sapiens
caaaauccauagugucauu

SEQ ID NO: 330342 - RNA, 19 nt, Homo sapiens
gcagagaccauaaucaaaa

SEQ ID NO: 330343 - RNA, 19 nt, Homo sapiens
ccucagcugugaucuuaug

SEQ ID NO: 330344 - RNA, 19 nt, Homo sapiens
uaaaguacucacacaaguu

SEQ ID NO: 330345 - RNA, 19 nt, Homo sapiens
gguaauauggucaugugaa

SEQ ID NO: 330346 - RNA, 19 nt, Homo sapiens
gaaguuggcaagcuuaagg

SEQ ID NO: 330347 - RNA, 19 nt, Homo sapiens
caagacaaaugcuguucag

SEQ ID NO: 330348 - RNA, 19 nt, Homo sapiens
ggcugaacaugaacuaaau

SEQ ID NO: 330349 - RNA, 19 nt, Homo sapiens
ucacgagaggcuaagaaua

SEQ ID NO: 330350 - RNA, 19 nt, Homo sapiens
ugaacuaaaucuggcaaga

SEQ ID NO: 330351 - RNA, 19 nt, Homo sapiens
cauuaagaguuccugaaau

SEQ ID NO: 330352 - RNA, 19 nt, Homo sapiens
ucaauuagaagaggugauu

SEQ ID NO: 330353 - RNA, 19 nt, Homo sapiens
uaaauaguuugcaguacgu

SEQ ID NO: 330354 - RNA, 19 nt, Homo sapiens
aaagaaguuggcaagcuua

SEQ ID NO: 330355 - RNA, 19 nt, Homo sapiens
aaaguacucacacaaguug

SEQ ID NO: 330356 - RNA, 19 nt, Homo sapiens
ucugagaauuguucccaaa

SEQ ID NO: 330357 - RNA, 19 nt, Homo sapiens
cgauugagcaggucugaga

SEQ ID NO: 330358 - RNA, 19 nt, Homo sapiens
auaaaguacucacacaagu

SEQ ID NO: 330359 - RNA, 19 nt, Homo sapiens
guuggcaagcuuaagguua

SEQ ID NO: 330360 - RNA, 19 nt, Homo sapiens
agucauacgaccauaaauu

SEQ ID NO: 330361 - RNA, 19 nt, Homo sapiens
gagaggcuaagaauauugu

SEQ ID NO: 330362 - RNA, 19 nt, Homo sapiens
agaagagacauuaagaguu

SEQ ID NO: 330363 - RNA, 19 nt, Homo sapiens
acagguuauuggagaaauu

SEQ ID NO: 330364 - RNA, 19 nt, Homo sapiens
gcaggucugagaauuguuc

SEQ ID NO: 330365 - RNA, 19 nt, Homo sapiens
ugacuuugguguguucaug

SEQ ID NO: 330366 - RNA, 19 nt, Homo sapiens
aagcggaaccagauguuaa

SEQ ID NO: 330367 - RNA, 19 nt, Homo sapiens
gccaugggaagauuugaaa

SEQ ID NO: 330368 - RNA, 19 nt, Homo sapiens
acauuaagaguuccugaaa

SEQ ID NO: 330369 - RNA, 19 nt, Homo sapiens
gacauuaagaguuccugaa

SEQ ID NO: 330370 - RNA, 19 nt, Homo sapiens
cauacagguuauuggagaa

SEQ ID NO: 330371 - RNA, 19 nt, Homo sapiens
uggcgggugugcugaagaa

SEQ ID NO: 330372 - RNA, 19 nt, Homo sapiens
acgagaggcuaagaauauu

SEQ ID NO: 330373 - RNA, 19 nt, Homo sapiens
aagaagagacauuaagagu

SEQ ID NO: 330374 - RNA, 19 nt, Homo sapiens
ugagaauuguucccaaagg

SEQ ID NO: 330375 - RNA, 19 nt, Homo sapiens
uaaagcggaaccagauguu

SEQ ID NO: 330376 - RNA, 19 nt, Homo sapiens
ucccauugcauacagguua

SEQ ID NO: 330377 - RNA, 19 nt, Homo sapiens
aauauggucaugugaauca

SEQ ID NO: 330378 - RNA, 19 nt, Homo sapiens
acuucaaggcggucaauua

SEQ ID NO: 330379 - RNA, 19 nt, Homo sapiens
uagaaaguauacagaacag

SEQ ID NO: 330380 - RNA, 19 nt, Homo sapiens
gagcguguucuuauuacug

SEQ ID NO: 330381 - RNA, 19 nt, Homo sapiens
ugguuaaccucagcuguga

SEQ ID NO: 330382 - RNA, 19 nt, Homo sapiens
aaagcggaaccagauguua

SEQ ID NO: 330383 - RNA, 19 nt, Homo sapiens
uauaaaguacucacacaag

SEQ ID NO: 330384 - RNA, 19 nt, Homo sapiens
uuagucauacgaccauaaa

SEQ ID NO: 330385 - RNA, 19 nt, Homo sapiens
uuacaucaggauagaggua

SEQ ID NO: 330386 - RNA, 19 nt, Homo sapiens
gcccguggccuuuaauuuu

SEQ ID NO: 330387 - RNA, 19 nt, Homo sapiens
cagguuauuggagaaauuu

SEQ ID NO: 330388 - RNA, 19 nt, Homo sapiens
cgagaggcuaagaauauug

SEQ ID NO: 330389 - RNA, 19 nt, Homo sapiens
ugagcaggucugagaauug

SEQ ID NO: 330390 - RNA, 19 nt, Homo sapiens
uugauguucuugaggaaau

SEQ ID NO: 330391 - RNA, 19 nt, Homo sapiens
uugagcaggucugagaauu

SEQ ID NO: 330392 - RNA, 19 nt, Homo sapiens
cuucaaggcggucaauuag

SEQ ID NO: 330393 - RNA, 19 nt, Homo sapiens
caugggaaacugauguaau

SEQ ID NO: 330394 - RNA, 19 nt, Homo sapiens
aggcugaacaugaacuaaa

SEQ ID NO: 330395 - RNA, 19 nt, Homo sapiens
ugcagcauauagaaaguau

SEQ ID NO: 330396 - RNA, 19 nt, Homo sapiens
agaaauugacuugguacuu

SEQ ID NO: 330397 - RNA, 19 nt, Homo sapiens
uaaccucagcugugaucuu

SEQ ID NO: 330398 - RNA, 19 nt, Homo sapiens
gagggaauggaaacuaugg

SEQ ID NO: 330399 - RNA, 19 nt, Homo sapiens
augagggaauggaaacuau

SEQ ID NO: 330400 - RNA, 19 nt, Homo sapiens
guagguggguaucaaaaca

SEQ ID NO: 330401 - RNA, 19 nt, Homo sapiens
aaagaagagacauuaagag

SEQ ID NO: 330402 - RNA, 19 nt, Homo sapiens
cacaaguggcuggugauaa

SEQ ID NO: 330403 - RNA, 19 nt, Homo sapiens
ucaaugcagagaccauaau

SEQ ID NO: 330404 - RNA, 19 nt, Homo sapiens
ggccaugggaagauuugaa

SEQ ID NO: 330405 - RNA, 19 nt, Homo sapiens
gggagccauuaguggaaga

SEQ ID NO: 330406 - RNA, 19 nt, Homo sapiens
gaaauuaacuuccuacuca

SEQ ID NO: 330407 - RNA, 19 nt, Homo sapiens
gugcacagcuguucaauau

SEQ ID NO: 330408 - RNA, 19 nt, Homo sapiens
gaacuggaagaaacaauua

SEQ ID NO: 330409 - RNA, 19 nt, Homo sapiens
gcacagcuguucaauauac

SEQ ID NO: 330410 - RNA, 19 nt, Homo sapiens
cgagaaauguuuaugaaga

SEQ ID NO: 330411 - RNA, 19 nt, Homo sapiens
gaacagaaauauuccuacu

SEQ ID NO: 330412 - RNA, 19 nt, Homo sapiens
ggaaagaugcacguugaua

SEQ ID NO: 330413 - RNA, 19 nt, Homo sapiens
ggaaggaggccaucuguuc

SEQ ID NO: 330414 - RNA, 19 nt, Homo sapiens
gcacaaauaaacucacuau

SEQ ID NO: 330415 - RNA, 19 nt, Homo sapiens
guggaaagaugcacguuga

SEQ ID NO: 330416 - RNA, 19 nt, Homo sapiens
ggauaaaguccgagaaaug

SEQ ID NO: 330417 - RNA, 19 nt, Homo sapiens
gcaugaggcuggacgacuu

SEQ ID NO: 330418 - RNA, 19 nt, Homo sapiens
gcacguugauacuauuuua

SEQ ID NO: 330419 - RNA, 19 nt, Homo sapiens
gaagaaugcccaugucaca

SEQ ID NO: 330420 - RNA, 19 nt, Homo sapiens
aaguagagcugucaagaug

SEQ ID NO: 330421 - RNA, 19 nt, Homo sapiens
gaucagggcagcacuaaca

SEQ ID NO: 330422 - RNA, 19 nt, Homo sapiens
gauaaaguccgagaaaugu

SEQ ID NO: 330423 - RNA, 19 nt, Homo sapiens
ggaagcagcggacacaugu

SEQ ID NO: 330424 - RNA, 19 nt, Homo sapiens
gaaauauuccuacugucuu

SEQ ID NO: 330425 - RNA, 19 nt, Homo sapiens
gaggcuggacgacuuguua

SEQ ID NO: 330426 - RNA, 19 nt, Homo sapiens
uaaacucacuauacaaugg

SEQ ID NO: 330427 - RNA, 19 nt, Homo sapiens
gagaacagaaauauuccua

SEQ ID NO: 330428 - RNA, 19 nt, Homo sapiens
guauacacaucaccuguuc

SEQ ID NO: 330429 - RNA, 19 nt, Homo sapiens
cgaacacugugcaccaauu

SEQ ID NO: 330430 - RNA, 19 nt, Homo sapiens
gaaagaugcacguugauac

SEQ ID NO: 330431 - RNA, 19 nt, Homo sapiens
acagagaacagaaauauuc

SEQ ID NO: 330432 - RNA, 19 nt, Homo sapiens
gaaggaggccaucuguuca

SEQ ID NO: 330433 - RNA, 19 nt, Homo sapiens
gcuguaaauuggauugaau

SEQ ID NO: 330434 - RNA, 19 nt, Homo sapiens
uaaaguccgagaaauguuu

SEQ ID NO: 330435 - RNA, 19 nt, Homo sapiens
ugauagaauuccauugaug

SEQ ID NO: 330436 - RNA, 19 nt, Homo sapiens
gggauaaaguccgagaaau

SEQ ID NO: 330437 - RNA, 19 nt, Homo sapiens
gaugcacguugauacuauu

SEQ ID NO: 330438 - RNA, 19 nt, Homo sapiens
gcaugucaguaaacaggaa

SEQ ID NO: 330439 - RNA, 19 nt, Homo sapiens
acuauacaauggucacuuu

SEQ ID NO: 330440 - RNA, 19 nt, Homo sapiens
acacagagaacagaaauau

SEQ ID NO: 330441 - RNA, 19 nt, Homo sapiens
gguguuugcuguaaauugg

SEQ ID NO: 330442 - RNA, 19 nt, Homo sapiens
gagcacaaauaaacucacu

SEQ ID NO: 330443 - RNA, 19 nt, Homo sapiens
aagcagcggacacauguua

SEQ ID NO: 330444 - RNA, 19 nt, Homo sapiens
gaaaauggaugugcaaagg

SEQ ID NO: 330445 - RNA, 19 nt, Homo sapiens
gagccuugcaugucaguaa

SEQ ID NO: 330446 - RNA, 19 nt, Homo sapiens
gaacacugugcaccaauuc

SEQ ID NO: 330447 - RNA, 19 nt, Homo sapiens
gaaggaaggaggccaucug

SEQ ID NO: 330448 - RNA, 19 nt, Homo sapiens
caucaacacagguucaaga

SEQ ID NO: 330449 - RNA, 19 nt, Homo sapiens
uaacaagcuccagcccuua

SEQ ID NO: 330450 - RNA, 19 nt, Homo sapiens
ggaccuugguauacacauc

SEQ ID NO: 330451 - RNA, 19 nt, Homo sapiens
uccgagaaauguuuaugaa

SEQ ID NO: 330452 - RNA, 19 nt, Homo sapiens
gugauagaauuccauugau

SEQ ID NO: 330453 - RNA, 19 nt, Homo sapiens
acacaucaccuguucuuuc

SEQ ID NO: 330454 - RNA, 19 nt, Homo sapiens
cgaacuggaagaaacaauu

SEQ ID NO: 330455 - RNA, 19 nt, Homo sapiens
uggacgacuuguuaaugua

SEQ ID NO: 330456 - RNA, 19 nt, Homo sapiens
ugugauagaauuccauuga

SEQ ID NO: 330457 - RNA, 19 nt, Homo sapiens
cgccaaggccaaaggauuu

SEQ ID NO: 330458 - RNA, 19 nt, Homo sapiens
gcgccaaggccaaaggauu

SEQ ID NO: 330459 - RNA, 19 nt, Homo sapiens
cagaauaaacaucaacaca

SEQ ID NO: 330460 - RNA, 19 nt, Homo sapiens
gaucgaacuggaagaaaca

SEQ ID NO: 330461 - RNA, 19 nt, Homo sapiens
ggacgacuuguuaauguag

SEQ ID NO: 330462 - RNA, 19 nt, Homo sapiens
gucauucaguggaaagaug

SEQ ID NO: 330463 - RNA, 19 nt, Homo sapiens
cuggacgacuuguuaaugu

SEQ ID NO: 330464 - RNA, 19 nt, Homo sapiens
agaugcacguugauacuau

SEQ ID NO: 330465 - RNA, 19 nt, Homo sapiens
gggaaagaucgaacuggaa

SEQ ID NO: 330466 - RNA, 19 nt, Homo sapiens
ggugcacagcuguucaaua

SEQ ID NO: 330467 - RNA, 19 nt, Homo sapiens
gaaaaugggacgggauaaa

SEQ ID NO: 330468 - RNA, 19 nt, Homo sapiens
caauuaaaguauggaagca

SEQ ID NO: 330469 - RNA, 19 nt, Homo sapiens
gaaagaucgaacuggaaga

SEQ ID NO: 330470 - RNA, 19 nt, Homo sapiens
gguauacacaucaccuguu

SEQ ID NO: 330471 - RNA, 19 nt, Homo sapiens
gcagcggacacauguuaug

SEQ ID NO: 330472 - RNA, 19 nt, Homo sapiens
ccucucaguggcagaauaa

SEQ ID NO: 330473 - RNA, 19 nt, Homo sapiens
aaugugguguuugcuguaa

SEQ ID NO: 330474 - RNA, 19 nt, Homo sapiens
aaagaucgaacuggaagaa

SEQ ID NO: 330475 - RNA, 19 nt, Homo sapiens
uugaucuucuggucauuaa

SEQ ID NO: 330476 - RNA, 19 nt, Homo sapiens
aaaguccgagaaauguuua

SEQ ID NO: 330477 - RNA, 19 nt, Homo sapiens
agaaauauuccuacugucu

SEQ ID NO: 330478 - RNA, 19 nt, Homo sapiens
guugaucuucuggucauua

SEQ ID NO: 330479 - RNA, 19 nt, Homo sapiens
gggaggugccgaacacugu

SEQ ID NO: 330480 - RNA, 19 nt, Homo sapiens
cuauccaaguucuauguug

SEQ ID NO: 330481 - RNA, 19 nt, Homo sapiens
gggaucagggcagcacuaa

SEQ ID NO: 330482 - RNA, 19 nt, Homo sapiens
aaacaucaacacagguuca

SEQ ID NO: 330483 - RNA, 19 nt, Homo sapiens
cgggauaaaguccgagaaa

SEQ ID NO: 330484 - RNA, 19 nt, Homo sapiens
uaugaagaaugcccauguc

SEQ ID NO: 330485 - RNA, 19 nt, Homo sapiens
gccgaacacugugcaccaa

SEQ ID NO: 330486 - RNA, 19 nt, Homo sapiens
agaaugcccaugucacaga

SEQ ID NO: 330487 - RNA, 19 nt, Homo sapiens
gcuggacgacuuguuaaug

SEQ ID NO: 330488 - RNA, 19 nt, Homo sapiens
gaucuucuggucauuaagg

SEQ ID NO: 330489 - RNA, 19 nt, Homo sapiens
aaaguagagcugucaagau

SEQ ID NO: 330490 - RNA, 19 nt, Homo sapiens
gaagucauucaguggaaag

SEQ ID NO: 330491 - RNA, 19 nt, Homo sapiens
cagaagcgccaaggccaaa

SEQ ID NO: 330492 - RNA, 19 nt, Homo sapiens
gaccuugguauacacauca

SEQ ID NO: 330493 - RNA, 19 nt, Homo sapiens
guccgagaaauguuuauga

SEQ ID NO: 330494 - RNA, 19 nt, Homo sapiens
caauauacacagagaacag

SEQ ID NO: 330495 - RNA, 19 nt, Homo sapiens
aggcuuggcuccgcuacuu

SEQ ID NO: 330496 - RNA, 19 nt, Homo sapiens
cucagagccuugcauguca

SEQ ID NO: 330497 - RNA, 19 nt, Homo sapiens
gaagaaaauggaugugcaa

SEQ ID NO: 330498 - RNA, 19 nt, Homo sapiens
agugucagggcacagauua

SEQ ID NO: 330499 - RNA, 19 nt, Homo sapiens
augcgguucuuccaugaaa

SEQ ID NO: 330500 - RNA, 19 nt, Homo sapiens
ccagggugguugaucuucu

SEQ ID NO: 330501 - RNA, 19 nt, Homo sapiens
cuugaaaugugguguuugc

SEQ ID NO: 330502 - RNA, 19 nt, Homo sapiens
auaaacaucaacacagguu

SEQ ID NO: 330503 - RNA, 19 nt, Homo sapiens
agaucgaacuggaagaaac

SEQ ID NO: 330504 - RNA, 19 nt, Homo sapiens
ugugguguuugcuguaaau

SEQ ID NO: 330505 - RNA, 19 nt, Homo sapiens
uggaaacccugguguaccu

SEQ ID NO: 330506 - RNA, 19 nt, Homo sapiens
gggagaaugugaccuaauu

SEQ ID NO: 330507 - RNA, 19 nt, Homo sapiens
ggaccagccuuaccuguga

SEQ ID NO: 330508 - RNA, 19 nt, Homo sapiens
gagaaugugaccuaauuua

SEQ ID NO: 330509 - RNA, 19 nt, Homo sapiens
cacaagcucuccaacaauu

SEQ ID NO: 330510 - RNA, 19 nt, Homo sapiens
gaaugugaccuaauuuaug

SEQ ID NO: 330511 - RNA, 19 nt, Homo sapiens
gccacaagcucuccaacaa

SEQ ID NO: 330512 - RNA, 19 nt, Homo sapiens
gcucagguaucacuucuag

SEQ ID NO: 330513 - RNA, 19 nt, Homo sapiens
ggagaaugugaccuaauuu

SEQ ID NO: 330514 - RNA, 19 nt, Homo sapiens
gguaucacuucuaguuuua

SEQ ID NO: 330515 - RNA, 19 nt, Homo sapiens
ucagguaucacuucuaguu

SEQ ID NO: 330516 - RNA, 19 nt, Homo sapiens
gagcucagguaucacuucu

SEQ ID NO: 330517 - RNA, 19 nt, Homo sapiens
ccagggagaaugugaccua

SEQ ID NO: 330518 - RNA, 19 nt, Homo sapiens
gcagaaggcgcugguguca

SEQ ID NO: 330519 - RNA, 19 nt, Homo sapiens
acguagagcucagguauca

SEQ ID NO: 330520 - RNA, 19 nt, Homo sapiens
cagggagaaugugaccuaa

SEQ ID NO: 330521 - RNA, 19 nt, Homo sapiens
ccacaagcucuccaacaau

SEQ ID NO: 330522 - RNA, 19 nt, Homo sapiens
acaagcucuccaacaauua

SEQ ID NO: 330523 - RNA, 19 nt, Homo sapiens
uagcugccacugagaagaa

SEQ ID NO: 330524 - RNA, 19 nt, Homo sapiens
cagguaucacuucuaguuu

SEQ ID NO: 330525 - RNA, 19 nt, Homo sapiens
uacuuugccuccuuggauu

SEQ ID NO: 330526 - RNA, 19 nt, Homo sapiens
guagagcucagguaucacu

SEQ ID NO: 330527 - RNA, 19 nt, Homo sapiens
cuacuuugccuccuuggau

SEQ ID NO: 330528 - RNA, 19 nt, Homo sapiens
gcucuccaacaauuacuau

SEQ ID NO: 330529 - RNA, 19 nt, Homo sapiens
caagcucuccaacaauuac

SEQ ID NO: 330530 - RNA, 19 nt, Homo sapiens
gaaaguagaugaggugaaa

SEQ ID NO: 330531 - RNA, 19 nt, Homo sapiens
gaaaacagaucgaccuuua

SEQ ID NO: 330532 - RNA, 19 nt, Homo sapiens
gcaaacagcaggcaaaguu

SEQ ID NO: 330533 - RNA, 19 nt, Homo sapiens
ggacuugcauugauuauac

SEQ ID NO: 330534 - RNA, 19 nt, Homo sapiens
gcaaacuggucaacaagug

SEQ ID NO: 330535 - RNA, 19 nt, Homo sapiens
uagaggagcugaaaguaga

SEQ ID NO: 330536 - RNA, 19 nt, Homo sapiens
gagaaucccuaucacucaa

SEQ ID NO: 330537 - RNA, 19 nt, Homo sapiens
ggacuucuuuaggcagaua

SEQ ID NO: 330538 - RNA, 19 nt, Homo sapiens
ugucaaaggucaccaaagu

SEQ ID NO: 330539 - RNA, 19 nt, Homo sapiens
gugauaagcccaacaagga

SEQ ID NO: 330540 - RNA, 19 nt, Homo sapiens
gaauauuggacuugcauug

SEQ ID NO: 330541 - RNA, 19 nt, Homo sapiens
ggagaaucccuaucacuca

SEQ ID NO: 330542 - RNA, 19 nt, Homo sapiens
gaaucccuaucacucaaga

SEQ ID NO: 330543 - RNA, 19 nt, Homo sapiens
cuauggagcucaaugugau

SEQ ID NO: 330544 - RNA, 19 nt, Homo sapiens
ugggagaacugucaaaggu

SEQ ID NO: 330545 - RNA, 19 nt, Homo sapiens
guagaugaggugaaaauua

SEQ ID NO: 330546 - RNA, 19 nt, Homo sapiens
gaggcgguguuuagaggaa

SEQ ID NO: 330547 - RNA, 19 nt, Homo sapiens
gauccgaggcgguguuuag

SEQ ID NO: 330548 - RNA, 19 nt, Homo sapiens
aaggcaaacuggucaacaa

SEQ ID NO: 330549 - RNA, 19 nt, Homo sapiens
uauuggacuugcauugauu

SEQ ID NO: 330550 - RNA, 19 nt, Homo sapiens
cgacugauaguguguucuu

SEQ ID NO: 330551 - RNA, 19 nt, Homo sapiens
ggucaacaagugugcuuug

SEQ ID NO: 330552 - RNA, 19 nt, Homo sapiens
uccgggaucacaaacauua

SEQ ID NO: 330553 - RNA, 19 nt, Homo sapiens
uagaugaggugaaaauuag

SEQ ID NO: 330554 - RNA, 19 nt, Homo sapiens
gugcagagccuuuuacaga

SEQ ID NO: 330555 - RNA, 19 nt, Homo sapiens
gcagagccuuuuacagaau

SEQ ID NO: 330556 - RNA, 19 nt, Homo sapiens
gaaggcaaacuggucaaca

SEQ ID NO: 330557 - RNA, 19 nt, Homo sapiens
gacugauaguguguucuuu

SEQ ID NO: 330558 - RNA, 19 nt, Homo sapiens
cagcaguuauuucgucacu

SEQ ID NO: 330559 - RNA, 19 nt, Homo sapiens
uaccggagaaucccuauca

SEQ ID NO: 330560 - RNA, 19 nt, Homo sapiens
aauauuggacuugcauuga

SEQ ID NO: 330561 - RNA, 19 nt, Homo sapiens
caaacuggucaacaagugu

SEQ ID NO: 330562 - RNA, 19 nt, Homo sapiens
ggaucacaaacauuaacaa

SEQ ID NO: 330563 - RNA, 19 nt, Homo sapiens
ucacuauggagcucaaugu

SEQ ID NO: 330564 - RNA, 19 nt, Homo sapiens
uuaguucugcugugcuuaa

SEQ ID NO: 330565 - RNA, 19 nt, Homo sapiens
agacaacgacugaugaaaa

SEQ ID NO: 330566 - RNA, 19 nt, Homo sapiens
cccuaucacucaagaccaa

SEQ ID NO: 330567 - RNA, 19 nt, Homo sapiens
auauuggacuugcauugau

SEQ ID NO: 330568 - RNA, 19 nt, Homo sapiens
gcagauaaaacgucacugu

SEQ ID NO: 330569 - RNA, 19 nt, Homo sapiens
cuagaggagcugaaaguag

SEQ ID NO: 330570 - RNA, 19 nt, Homo sapiens
gacaacgacugaugaaaac

SEQ ID NO: 330571 - RNA, 19 nt, Homo sapiens
ggucaugugcucagacaac

SEQ ID NO: 330572 - RNA, 19 nt, Homo sapiens
ggccugaccugggagaacu

SEQ ID NO: 330573 - RNA, 19 nt, Homo sapiens
ggagcucaaugugauaagc

SEQ ID NO: 330574 - RNA, 19 nt, Homo sapiens
uuacagaauauuggacuug

SEQ ID NO: 330575 - RNA, 19 nt, Homo sapiens
aauuaguucugcugugcuu

SEQ ID NO: 330576 - RNA, 19 nt, Homo sapiens
cagagccuuuuacagaaua

SEQ ID NO: 330577 - RNA, 19 nt, Homo sapiens
guguuuagaggaaggcaaa

SEQ ID NO: 330578 - RNA, 19 nt, Homo sapiens
caagagagcuggagaauua

SEQ ID NO: 330579 - RNA, 19 nt, Homo sapiens
caagagagcugcugaaaua

SEQ ID NO: 330580 - RNA, 19 nt, Homo sapiens
gaagagagcuggagaaauc

SEQ ID NO: 330581 - RNA, 19 nt, Homo sapiens
gcaagaaacuguacacuga

SEQ ID NO: 330582 - RNA, 19 nt, Homo sapiens
gaacgaacaucucuacaaa

SEQ ID NO: 330583 - RNA, 19 nt, Homo sapiens
gcaagucagugauaucuua

SEQ ID NO: 330584 - RNA, 19 nt, Homo sapiens
gaacaaugcucucaauaug

SEQ ID NO: 330585 - RNA, 19 nt, Homo sapiens
ggaagaagcuuugaagaaa

SEQ ID NO: 330586 - RNA, 19 nt, Homo sapiens
gaacaaugcucucaacaug

SEQ ID NO: 330587 - RNA, 19 nt, Homo sapiens
gaccauaacucaagaauau

SEQ ID NO: 330588 - RNA, 19 nt, Homo sapiens
gaccauaacucaagaauau

SEQ ID NO: 330589 - RNA, 19 nt, Homo sapiens
ccagacagauucaaauuua

SEQ ID NO: 330590 - RNA, 19 nt, Homo sapiens
gcaauuaccugcaugaaug

SEQ ID NO: 330591 - RNA, 19 nt, Homo sapiens
guauaaagcucacauguug

SEQ ID NO: 330592 - RNA, 19 nt, Homo sapiens
cgaauaaacuacagugaua

SEQ ID NO: 330593 - RNA, 19 nt, Homo sapiens
gaaagcaggcgaugcauua

SEQ ID NO: 330594 - RNA, 19 nt, Homo sapiens
gcacagggcucauacacaa

SEQ ID NO: 330595 - RNA, 19 nt, Homo sapiens
gcaaugacguucagaguga

SEQ ID NO: 330596 - RNA, 19 nt, Homo sapiens
gaaagaaggcuaugacuug

SEQ ID NO: 330597 - RNA, 19 nt, Homo sapiens
gaucacagcugcaaagaug

SEQ ID NO: 330598 - RNA, 19 nt, Homo sapiens
caagagauauugcuaguga

SEQ ID NO: 330599 - RNA, 19 nt, Homo sapiens
ccaagaaguuugacauuaa

SEQ ID NO: 330600 - RNA, 19 nt, Homo sapiens
caggagaucuugagugaua

SEQ ID NO: 330601 - RNA, 19 nt, Homo sapiens
ccagucagauuaaguauaa

SEQ ID NO: 330602 - RNA, 19 nt, Homo sapiens
ggacaugucugccugauca

SEQ ID NO: 330603 - RNA, 19 nt, Homo sapiens
gaucauaccuacaaaguuc

SEQ ID NO: 330604 - RNA, 19 nt, Homo sapiens
gcaguaaccuguacaagga

SEQ ID NO: 330605 - RNA, 19 nt, Homo sapiens
ggaagaacccaauguuaua

SEQ ID NO: 330606 - RNA, 19 nt, Homo sapiens
caagagacauugcuaguga

SEQ ID NO: 330607 - RNA, 19 nt, Homo sapiens
caagugagguuaaauacaa

SEQ ID NO: 330608 - RNA, 19 nt, Homo sapiens
gaucuacgcuacaaagaaa

SEQ ID NO: 330609 - RNA, 19 nt, Homo sapiens
gaacaucucuacaaacaag

SEQ ID NO: 330610 - RNA, 19 nt, Homo sapiens
gaacuucaguagugauaaa

SEQ ID NO: 330611 - RNA, 19 nt, Homo sapiens
ggaaagaucuagaggaaag

SEQ ID NO: 330612 - RNA, 19 nt, Homo sapiens
cuaauaaucuugcaaguga

SEQ ID NO: 330613 - RNA, 19 nt, Homo sapiens
gaggaaagguuaugacaug

SEQ ID NO: 330614 - RNA, 19 nt, Homo sapiens
gaaaggcuaugaucucaga

SEQ ID NO: 330615 - RNA, 19 nt, Homo sapiens
guacaaagcagacuugaaa

SEQ ID NO: 330616 - RNA, 19 nt, Homo sapiens
gaaacuagaucaguguaaa

SEQ ID NO: 330617 - RNA, 19 nt, Homo sapiens
ccaaagagaaccugcauua

SEQ ID NO: 330618 - RNA, 19 nt, Homo sapiens
ggauuggcaugacuuaaua

SEQ ID NO: 330619 - RNA, 19 nt, Homo sapiens
gaagggauaugaccugaga

SEQ ID NO: 330620 - RNA, 19 nt, Homo sapiens
gaagaugaucccaagauua

SEQ ID NO: 330621 - RNA, 19 nt, Homo sapiens
caagaaagccuaugaacaa

SEQ ID NO: 330622 - RNA, 19 nt, Homo sapiens
gaaaguggauccuucaaag

SEQ ID NO: 330623 - RNA, 19 nt, Homo sapiens
ccacagagcucccacaaca

SEQ ID NO: 330624 - RNA, 19 nt, Homo sapiens
acaccaaucuggacuauaa

SEQ ID NO: 330625 - RNA, 19 nt, Homo sapiens
aauauaagcuugaccauga

SEQ ID NO: 330626 - RNA, 19 nt, Homo sapiens
caaggaauauugcuaguga

SEQ ID NO: 330627 - RNA, 19 nt, Homo sapiens
agaaguccaugucguauua

SEQ ID NO: 330628 - RNA, 19 nt, Homo sapiens
gagagaaacugaagcacaa

SEQ ID NO: 330629 - RNA, 19 nt, Homo sapiens
caaagcagcuaagugauuu

SEQ ID NO: 330630 - RNA, 19 nt, Homo sapiens
caaggaagcuuaugagaag

SEQ ID NO: 330631 - RNA, 19 nt, Homo sapiens
gauaugaccugagaacuga

SEQ ID NO: 330632 - RNA, 19 nt, Homo sapiens
uaagaaaucucaggcaauu

SEQ ID NO: 330633 - RNA, 19 nt, Homo sapiens
caacucaauugaugaauga

SEQ ID NO: 330634 - RNA, 19 nt, Homo sapiens
gaaggaaggcuaugacuug

SEQ ID NO: 330635 - RNA, 19 nt, Homo sapiens
gaaagaugcccuagacauu

SEQ ID NO: 330636 - RNA, 19 nt, Homo sapiens
aagcagaagucaaucuuua

SEQ ID NO: 330637 - RNA, 19 nt, Homo sapiens
ucaaauaucgggaagaaua

SEQ ID NO: 330638 - RNA, 19 nt, Homo sapiens
caaggaagccuaugagaaa

SEQ ID NO: 330639 - RNA, 19 nt, Homo sapiens
ccagagauauugcaaguga

SEQ ID NO: 330640 - RNA, 19 nt, Homo sapiens
ccagagauauugcaaguga

SEQ ID NO: 330641 - RNA, 19 nt, Homo sapiens
gccaagaaguuugacauua

SEQ ID NO: 330642 - RNA, 19 nt, Homo sapiens
gccuauaacuugagugaua

SEQ ID NO: 330643 - RNA, 19 nt, Homo sapiens
gaaaguaaccaaucaagug

SEQ ID NO: 330644 - RNA, 19 nt, Homo sapiens
ccagaaacgcugaaauuua

SEQ ID NO: 330645 - RNA, 19 nt, Homo sapiens
caggagagauucuuaguga

SEQ ID NO: 330646 - RNA, 19 nt, Homo sapiens
ggagugauaucgcuuacaa

SEQ ID NO: 330647 - RNA, 19 nt, Homo sapiens
gcagagcgauguugaauac

SEQ ID NO: 330648 - RNA, 19 nt, Homo sapiens
gaauaugccaaacacauua

SEQ ID NO: 330649 - RNA, 19 nt, Homo sapiens
ggaagggccucacugaaau

SEQ ID NO: 330650 - RNA, 19 nt, Homo sapiens
caagaaguguugacgauga

SEQ ID NO: 330651 - RNA, 19 nt, Homo sapiens
gauccucgaugauauuaaa

SEQ ID NO: 330652 - RNA, 19 nt, Homo sapiens
gaaggacuaugaucugaga

SEQ ID NO: 330653 - RNA, 19 nt, Homo sapiens
gcaguugggucaccacauu

SEQ ID NO: 330654 - RNA, 19 nt, Homo sapiens
gcuaugaucucccaguuga

SEQ ID NO: 330655 - RNA, 19 nt, Homo sapiens
auacaaagcugacuacaau

SEQ ID NO: 330656 - RNA, 19 nt, Homo sapiens
ccaaacacauuaaaggaaa

SEQ ID NO: 330657 - RNA, 19 nt, Homo sapiens
gaugaaggcuggauguaug

SEQ ID NO: 330658 - RNA, 19 nt, Homo sapiens
gauauugccagucagauua

SEQ ID NO: 330659 - RNA, 19 nt, Homo sapiens
caagagggcuuacuggaau

SEQ ID NO: 330660 - RNA, 19 nt, Homo sapiens
ccagaaaccugaagaaucu

SEQ ID NO: 330661 - RNA, 19 nt, Homo sapiens
guauaaagaugaccugaau

SEQ ID NO: 330662 - RNA, 19 nt, Homo sapiens
acagugagcuuaaauacaa

SEQ ID NO: 330663 - RNA, 19 nt, Homo sapiens
caacaugaauaagcguuua

SEQ ID NO: 330664 - RNA, 19 nt, Homo sapiens
uuaagaagcugacugauuc

SEQ ID NO: 330665 - RNA, 19 nt, Homo sapiens
caagaaagcaacugaauau

SEQ ID NO: 330666 - RNA, 19 nt, Homo sapiens
uggcaaagcugcagucuga

SEQ ID NO: 330667 - RNA, 19 nt, Homo sapiens
cgagaaacauugccaguga

SEQ ID NO: 330668 - RNA, 19 nt, Homo sapiens
uaagugacgucuguuauaa

SEQ ID NO: 330669 - RNA, 19 nt, Homo sapiens
gugcaaugcuuacaguaua

SEQ ID NO: 330670 - RNA, 19 nt, Homo sapiens
ccagacacccucaaauuua

SEQ ID NO: 330671 - RNA, 19 nt, Homo sapiens
gagaggaaauuauucacaa

SEQ ID NO: 330672 - RNA, 19 nt, Homo sapiens
aaaccagagugauagauua

SEQ ID NO: 330673 - RNA, 19 nt, Homo sapiens
ccacucaaauccucaauga

SEQ ID NO: 330674 - RNA, 19 nt, Homo sapiens
cuaauuaccuauacacuga

SEQ ID NO: 330675 - RNA, 19 nt, Homo sapiens
gcaguuauuucaaguacaa

SEQ ID NO: 330676 - RNA, 19 nt, Homo sapiens
ccaggaggcugcuaggaua

SEQ ID NO: 330677 - RNA, 19 nt, Homo sapiens
aaucaaagaugaaggacua

SEQ ID NO: 330678 - RNA, 19 nt, Homo sapiens
caaggaagcuggaguugaa

SEQ ID NO: 330679 - RNA, 19 nt, Homo sapiens
ccaagaccgucaacauuua

SEQ ID NO: 330680 - RNA, 19 nt, Homo sapiens
guagauguauccaaaggaa

SEQ ID NO: 330681 - RNA, 19 nt, Homo sapiens
gagagaaaguagugagaga

SEQ ID NO: 330682 - RNA, 19 nt, Homo sapiens
gcaauguggucaucaaucu

SEQ ID NO: 330683 - RNA, 19 nt, Homo sapiens
caacaccacuggaacucaa

SEQ ID NO: 330684 - RNA, 19 nt, Homo sapiens
ccaaaggaauuguuaaugc

SEQ ID NO: 330685 - RNA, 19 nt, Homo sapiens
gaagacaguuaaacaacca

SEQ ID NO: 330686 - RNA, 19 nt, Homo sapiens
caaaggaauuguuaaugca

SEQ ID NO: 330687 - RNA, 19 nt, Homo sapiens
caucugaaugcgaauauua

SEQ ID NO: 330688 - RNA, 19 nt, Homo sapiens
gaaugggacgcgagagaua

SEQ ID NO: 330689 - RNA, 19 nt, Homo sapiens
gccaagaccgucaacauuu

SEQ ID NO: 330690 - RNA, 19 nt, Homo sapiens
uagaagaccuugguauuca

SEQ ID NO: 330691 - RNA, 19 nt, Homo sapiens
ugucguagauguauccaaa

SEQ ID NO: 330692 - RNA, 19 nt, Homo sapiens
gcaaguaugcaucgguuug

SEQ ID NO: 330693 - RNA, 19 nt, Homo sapiens
caguauaugucguagaugu

SEQ ID NO: 330694 - RNA, 19 nt, Homo sapiens
cggaagccauuaucguaaa

SEQ ID NO: 330695 - RNA, 19 nt, Homo sapiens
ggacgagacugggaaacca

SEQ ID NO: 330696 - RNA, 19 nt, Homo sapiens
gauuguggccacuguguuu

SEQ ID NO: 330697 - RNA, 19 nt, Homo sapiens
ggccaagaccgucaacauu

SEQ ID NO: 330698 - RNA, 19 nt, Homo sapiens
gagaaaguagugagagaug

SEQ ID NO: 330699 - RNA, 19 nt, Homo sapiens
gcaucgguuugguccuaua

SEQ ID NO: 330700 - RNA, 19 nt, Homo sapiens
ggaauuguuaaugcaguua

SEQ ID NO: 330701 - RNA, 19 nt, Homo sapiens
uaaggauccugaugccaau

SEQ ID NO: 330702 - RNA, 19 nt, Homo sapiens
ggaagccauuaucguaaag

SEQ ID NO: 330703 - RNA, 19 nt, Homo sapiens
aauguggucaucaaucuua

SEQ ID NO: 330704 - RNA, 19 nt, Homo sapiens
gaaaguagugagagaugca

SEQ ID NO: 330705 - RNA, 19 nt, Homo sapiens
cgagagauaaagauucuau

SEQ ID NO: 330706 - RNA, 19 nt, Homo sapiens
ggauagauuccuuaauucu

SEQ ID NO: 330707 - RNA, 19 nt, Homo sapiens
guaaagccgucggacaucu

SEQ ID NO: 330708 - RNA, 19 nt, Homo sapiens
cagcuucuguuucuggaau

SEQ ID NO: 330709 - RNA, 19 nt, Homo sapiens
guauccaaaggaauuguua

SEQ ID NO: 330710 - RNA, 19 nt, Homo sapiens
gaagauuccccaagcaauu

SEQ ID NO: 330711 - RNA, 19 nt, Homo sapiens
gguggacguuccucaguca

SEQ ID NO: 330712 - RNA, 19 nt, Homo sapiens
cugcugaaauugaggaugu

SEQ ID NO: 330713 - RNA, 19 nt, Homo sapiens
uaaggcuguuggagagaaa

SEQ ID NO: 330714 - RNA, 19 nt, Homo sapiens
gcaguuaaggauccugaug

SEQ ID NO: 330715 - RNA, 19 nt, Homo sapiens
gcuggaagacaguuaaaca

SEQ ID NO: 330716 - RNA, 19 nt, Homo sapiens
uaaacaaccaguauauguc

SEQ ID NO: 330717 - RNA, 19 nt, Homo sapiens
guucugccauuacugcaau

SEQ ID NO: 330718 - RNA, 19 nt, Homo sapiens
acagauuguuccucccauu

SEQ ID NO: 330719 - RNA, 19 nt, Homo sapiens
aaugggaaauccuuugcuu

SEQ ID NO: 330720 - RNA, 19 nt, Homo sapiens
uggaagagaggauagauuc

SEQ ID NO: 330721 - RNA, 19 nt, Homo sapiens
cuggcugucugcugaaauu

SEQ ID NO: 330722 - RNA, 19 nt, Homo sapiens
cuuagaagaccuugguauu

SEQ ID NO: 330723 - RNA, 19 nt, Homo sapiens
agauguauccaaaggaauu

SEQ ID NO: 330724 - RNA, 19 nt, Homo sapiens
guauaugucguagauguau

SEQ ID NO: 330725 - RNA, 19 nt, Homo sapiens
uugcucaacuguccaagga

SEQ ID NO: 330726 - RNA, 19 nt, Homo sapiens
gauucuauccgacgaguag

SEQ ID NO: 330727 - RNA, 19 nt, Homo sapiens
ccaaggaagcuggaguuga

SEQ ID NO: 330728 - RNA, 19 nt, Homo sapiens
acagcaauguggucaucaa

SEQ ID NO: 330729 - RNA, 19 nt, Homo sapiens
ggaaugggacgcgagagau

SEQ ID NO: 330730 - RNA, 19 nt, Homo sapiens
caguuaaacaaccaguaua

SEQ ID NO: 330731 - RNA, 19 nt, Homo sapiens
ccggaagccauuaucguaa

SEQ ID NO: 330732 - RNA, 19 nt, Homo sapiens
ggacgcgagagauaaagau

SEQ ID NO: 330733 - RNA, 19 nt, Homo sapiens
uuagaagaccuugguauuc

SEQ ID NO: 330734 - RNA, 19 nt, Homo sapiens
cccagucgguaccuccuuu

SEQ ID NO: 330735 - RNA, 19 nt, Homo sapiens
acaguuaaacaaccaguau

SEQ ID NO: 330736 - RNA, 19 nt, Homo sapiens
gacaguuaaacaaccagua

SEQ ID NO: 330737 - RNA, 19 nt, Homo sapiens
ucacaucugaaugcgaaua

SEQ ID NO: 330738 - RNA, 19 nt, Homo sapiens
accaguauaugucguagau

SEQ ID NO: 330739 - RNA, 19 nt, Homo sapiens
gagaaauaaggcuguugga

SEQ ID NO: 330740 - RNA, 19 nt, Homo sapiens
aagcucuucuagauauuug

SEQ ID NO: 330741 - RNA, 19 nt, Homo sapiens
cgcgagagauaaagauucu

SEQ ID NO: 330742 - RNA, 19 nt, Homo sapiens
gcugucugcugaaauugag

SEQ ID NO: 330743 - RNA, 19 nt, Homo sapiens
gcauuuccggaagccauua

SEQ ID NO: 330744 - RNA, 19 nt, Homo sapiens
guaguacaacacagcaaug

SEQ ID NO: 330745 - RNA, 19 nt, Homo sapiens
gcuuagaagaccuugguau

SEQ ID NO: 330746 - RNA, 19 nt, Homo sapiens
guuaaacaaccaguauaug

SEQ ID NO: 330747 - RNA, 19 nt, Homo sapiens
uccggaagccauuaucgua

SEQ ID NO: 330748 - RNA, 19 nt, Homo sapiens
caagaccgucaacauuuag

SEQ ID NO: 330749 - RNA, 19 nt, Homo sapiens
gcaacaccacuggaacuca

SEQ ID NO: 330750 - RNA, 19 nt, Homo sapiens
uuacugcaauagccacauc

SEQ ID NO: 330751 - RNA, 19 nt, Homo sapiens
gacgcgagagauaaagauu

SEQ ID NO: 330752 - RNA, 19 nt, Homo sapiens
ugaaauugaggaugugaag

SEQ ID NO: 330753 - RNA, 19 nt, Homo sapiens
ucaggcaacaccacuggaa

SEQ ID NO: 330754 - RNA, 19 nt, Homo sapiens
cuggugaaguacaucuuug

SEQ ID NO: 330755 - RNA, 19 nt, Homo sapiens
gccaaugggaaauccuuug

SEQ ID NO: 330756 - RNA, 19 nt, Homo sapiens
acaaccaguauaugucgua

SEQ ID NO: 330757 - RNA, 19 nt, Homo sapiens
gggcuggaagacaguuaaa

SEQ ID NO: 330758 - RNA, 19 nt, Homo sapiens
guagugagagaugcauuuc

SEQ ID NO: 330759 - RNA, 19 nt, Homo sapiens
auaaggcuguuggagagaa

SEQ ID NO: 330760 - RNA, 19 nt, Homo sapiens
guccggguccugucaaugu

SEQ ID NO: 330761 - RNA, 19 nt, Homo sapiens
augcaucgguuugguccua

SEQ ID NO: 330762 - RNA, 19 nt, Homo sapiens
ggauuguggccacuguguu

SEQ ID NO: 330763 - RNA, 19 nt, Homo sapiens
cgacgaguaguacaacaca

SEQ ID NO: 330764 - RNA, 19 nt, Homo sapiens
aggaauuguuaaugcaguu

SEQ ID NO: 330765 - RNA, 19 nt, Homo sapiens
uaaagccgucggacaucuu

SEQ ID NO: 330766 - RNA, 19 nt, Homo sapiens
gaaaggagauccacaugaa

SEQ ID NO: 330767 - RNA, 19 nt, Homo sapiens
gcaaugauggcaacaguua

SEQ ID NO: 330768 - RNA, 19 nt, Homo sapiens
gcaggacaaucgcacuuua

SEQ ID NO: 330769 - RNA, 19 nt, Homo sapiens
gaucaccucugccuaucua

SEQ ID NO: 330770 - RNA, 19 nt, Homo sapiens
gaacgcagcagagugauaa

SEQ ID NO: 330771 - RNA, 19 nt, Homo sapiens
gaagaucaccucugccuau

SEQ ID NO: 330772 - RNA, 19 nt, Homo sapiens
ggcaauauauguacuggaa

SEQ ID NO: 330773 - RNA, 19 nt, Homo sapiens
aguuugaggugcugaauua

SEQ ID NO: 330774 - RNA, 19 nt, Homo sapiens
guagauggcaauauaugua

SEQ ID NO: 330775 - RNA, 19 nt, Homo sapiens
gauuacugguucaggauaa

SEQ ID NO: 330776 - RNA, 19 nt, Homo sapiens
agaaauagcagagaaacua

SEQ ID NO: 330777 - RNA, 19 nt, Homo sapiens
aagggaagcucaagauuca

SEQ ID NO: 330778 - RNA, 19 nt, Homo sapiens
gagaaugccuauaagaaaa

SEQ ID NO: 330779 - RNA, 19 nt, Homo sapiens
gaagaaaggagauccacau

SEQ ID NO: 330780 - RNA, 19 nt, Homo sapiens
gcagagugauaacuguaga

SEQ ID NO: 330781 - RNA, 19 nt, Homo sapiens
cacaagcauuccuaucuuu

SEQ ID NO: 330782 - RNA, 19 nt, Homo sapiens
ugagaaugccuauaagaaa

SEQ ID NO: 330783 - RNA, 19 nt, Homo sapiens
gaccgugucuuacaucagu

SEQ ID NO: 330784 - RNA, 19 nt, Homo sapiens
caaaagaaauagcagagaa

SEQ ID NO: 330785 - RNA, 19 nt, Homo sapiens
gcaagggaagcucaagauu

SEQ ID NO: 330786 - RNA, 19 nt, Homo sapiens
gcagcagagugauaacugu

SEQ ID NO: 330787 - RNA, 19 nt, Homo sapiens
acacaagcauuccuaucuu

SEQ ID NO: 330788 - RNA, 19 nt, Homo sapiens
aacuguagauggcaauaua

SEQ ID NO: 330789 - RNA, 19 nt, Homo sapiens
uaguauagguaauggaguu

SEQ ID NO: 330790 - RNA, 19 nt, Homo sapiens
caagggaagcucaagauuc

SEQ ID NO: 330791 - RNA, 19 nt, Homo sapiens
ccaccauucucacuggaaa

SEQ ID NO: 330792 - RNA, 19 nt, Homo sapiens
ggagauccacaugaaauga

SEQ ID NO: 330793 - RNA, 19 nt, Homo sapiens
gaaauagcagagaaacuag

SEQ ID NO: 330794 - RNA, 19 nt, Homo sapiens
caauccauccuguaguaua

SEQ ID NO: 330795 - RNA, 19 nt, Homo sapiens
gggaagcucaagauucaaa

SEQ ID NO: 330796 - RNA, 19 nt, Homo sapiens
cgacuauaauggcaacugu

SEQ ID NO: 330797 - RNA, 19 nt, Homo sapiens
agcaauccauccuguagua

SEQ ID NO: 330798 - RNA, 19 nt, Homo sapiens
ggaucuggcugaagugaac

SEQ ID NO: 330799 - RNA, 19 nt, Homo sapiens
uugaauaccugaaguucga

SEQ ID NO: 330800 - RNA, 19 nt, Homo sapiens
caucuucagugacuuugug

SEQ ID NO: 330801 - RNA, 19 nt, Homo sapiens
gauccgagaagcaaugaug

SEQ ID NO: 330802 - RNA, 19 nt, Homo sapiens
ggacauugaauaccugaag

SEQ ID NO: 330803 - RNA, 19 nt, Homo sapiens
ccacaugaaaugaagauca

SEQ ID NO: 330804 - RNA, 19 nt, Homo sapiens
agaggcggauucagaagaa

SEQ ID NO: 330805 - RNA, 19 nt, Homo sapiens
gagauccacaugaaaugaa

SEQ ID NO: 330806 - RNA, 19 nt, Homo sapiens
ggagaaauuuuacgaugau

SEQ ID NO: 330807 - RNA, 19 nt, Homo sapiens
gcagagaaacuaggcuuca

SEQ ID NO: 330808 - RNA, 19 nt, Homo sapiens
acagaacgcagcagaguga

SEQ ID NO: 330809 - RNA, 19 nt, Homo sapiens
gaggguaaauaaugcaaaa

SEQ ID NO: 330810 - RNA, 19 nt, Homo sapiens
cauuggagcucaucagacu

SEQ ID NO: 330811 - RNA, 19 nt, Homo sapiens
cagagaaacuaggcuucaa

SEQ ID NO: 330812 - RNA, 19 nt, Homo sapiens
gaagaaggggucucacaaa

SEQ ID NO: 330813 - RNA, 19 nt, Homo sapiens
gaauaccugaaguucgaua

SEQ ID NO: 330814 - RNA, 19 nt, Homo sapiens
ggacaaucgcacuuuauac

SEQ ID NO: 330815 - RNA, 19 nt, Homo sapiens
gacauugaauaccugaagu

SEQ ID NO: 330816 - RNA, 19 nt, Homo sapiens
ggugguagaggacauugaa

SEQ ID NO: 330817 - RNA, 19 nt, Homo sapiens
ggauaaagcaagcaaaaga

SEQ ID NO: 330818 - RNA, 19 nt, Homo sapiens
ugguagaggacauugaaua

SEQ ID NO: 330819 - RNA, 19 nt, Homo sapiens
guccagaggcggauucaga

SEQ ID NO: 330820 - RNA, 19 nt, Homo sapiens
ggaacccuuuagcuuuguu

SEQ ID NO: 330821 - RNA, 19 nt, Homo sapiens
uuggaacccuuuagcuuug

SEQ ID NO: 330822 - RNA, 19 nt, Homo sapiens
ugucuuacaucaguucaga

SEQ ID NO: 330823 - RNA, 19 nt, Homo sapiens
cagcagagugauaacugua

SEQ ID NO: 330824 - RNA, 19 nt, Homo sapiens
agaaaggagauccacauga

SEQ ID NO: 330825 - RNA, 19 nt, Homo sapiens
guacaaccagggauucauc

SEQ ID NO: 330826 - RNA, 19 nt, Homo sapiens
gaugauccgagaagcaaug

SEQ ID NO: 330827 - RNA, 19 nt, Homo sapiens
gcaauauauguacuggaaa

SEQ ID NO: 330828 - RNA, 19 nt, Homo sapiens
acaaguggaucuggcugaa

SEQ ID NO: 330829 - RNA, 19 nt, Homo sapiens
gguagaggacauugaauac

SEQ ID NO: 330830 - RNA, 19 nt, Homo sapiens
gcgucaccaucugcgauua

SEQ ID NO: 330831 - RNA, 19 nt, Homo sapiens
ugaagagcgucaccaucug

SEQ ID NO: 330832 - RNA, 19 nt, Homo sapiens
aagcugcgcuauggaaugu

SEQ ID NO: 330833 - RNA, 19 nt, Homo sapiens
aauccauccuguaguauag

SEQ ID NO: 330834 - RNA, 19 nt, Homo sapiens
uggacgccauauagcuuua

SEQ ID NO: 330835 - RNA, 19 nt, Homo sapiens
aggacaaucgcacuuuaua

SEQ ID NO: 330836 - RNA, 19 nt, Homo sapiens
aagcaaugauggcaacagu

SEQ ID NO: 330837 - RNA, 19 nt, Homo sapiens
aagaaggggucucacaaaa

SEQ ID NO: 330838 - RNA, 19 nt, Homo sapiens
ggaggguaaauaaugcaaa

SEQ ID NO: 330839 - RNA, 19 nt, Homo sapiens
gaccacaggacaagguguu

SEQ ID NO: 330840 - RNA, 19 nt, Homo sapiens
gaacccuuuagcuuuguuu

SEQ ID NO: 330841 - RNA, 19 nt, Homo sapiens
cgcgugagaggaauucaua

SEQ ID NO: 330842 - RNA, 19 nt, Homo sapiens
uagaggacauugaauaccu

SEQ ID NO: 330843 - RNA, 19 nt, Homo sapiens
gcaagcugcgcuauggaau

SEQ ID NO: 330844 - RNA, 19 nt, Homo sapiens
acuguaguuuggagaaauu

SEQ ID NO: 330845 - RNA, 19 nt, Homo sapiens
aaaggagauccacaugaaa

SEQ ID NO: 330846 - RNA, 19 nt, Homo sapiens
uuuggaacccuuuagcuuu

SEQ ID NO: 330847 - RNA, 19 nt, Homo sapiens
uaccugaaguucgauaaag

SEQ ID NO: 330848 - RNA, 19 nt, Homo sapiens
uugagaaugccuauaagaa

SEQ ID NO: 330849 - RNA, 19 nt, Homo sapiens
aaggagauccacaugaaau

SEQ ID NO: 330850 - RNA, 19 nt, Homo sapiens
gaggcggauucagaagaaa

SEQ ID NO: 330851 - RNA, 19 nt, Homo sapiens
cagaugccuuggagcacuu

SEQ ID NO: 330852 - RNA, 19 nt, Homo sapiens
gacaguaccacaggagaug

SEQ ID NO: 330853 - RNA, 19 nt, Homo sapiens
ucauucagguugugcacau

SEQ ID NO: 330854 - RNA, 19 nt, Homo sapiens
ggacgccauauagcuuuaa

SEQ ID NO: 330855 - RNA, 19 nt, Homo sapiens
aaguggaucuggcugaagu

SEQ ID NO: 330856 - RNA, 19 nt, Homo sapiens
cagguugugcacauuguuu

SEQ ID NO: 330857 - RNA, 19 nt, Homo sapiens
gcaauccauccuguaguau

SEQ ID NO: 330858 - RNA, 19 nt, Homo sapiens
aaagcaauccauccuguag

SEQ ID NO: 330859 - RNA, 19 nt, Homo sapiens
cgauuacugguucaggaua

SEQ ID NO: 330860 - RNA, 19 nt, Homo sapiens
cagaggcggauucagaaga

SEQ ID NO: 330861 - RNA, 19 nt, Homo sapiens
gacuauaauggcaacugua

SEQ ID NO: 330862 - RNA, 19 nt, Homo sapiens
ggauguuuggaacccuuua

SEQ ID NO: 330863 - RNA, 19 nt, Homo sapiens
ggaagaaggggucucacaa

SEQ ID NO: 330864 - RNA, 19 nt, Homo sapiens
caagcugcgcuauggaaug

SEQ ID NO: 330865 - RNA, 19 nt, Homo sapiens
ugacagaacgcagcagagu

SEQ ID NO: 330866 - RNA, 19 nt, Homo sapiens
gaaacucuaugacaagauu

SEQ ID NO: 330867 - RNA, 19 nt, Homo sapiens
cagagaagcuuucaguaaa

SEQ ID NO: 330868 - RNA, 19 nt, Homo sapiens
gagaagcuuucaguaaauu

SEQ ID NO: 330869 - RNA, 19 nt, Homo sapiens
ugaaagaccugggcuuaga

SEQ ID NO: 330870 - RNA, 19 nt, Homo sapiens
ccagagaagcuuucaguaa

SEQ ID NO: 330871 - RNA, 19 nt, Homo sapiens
ggaagacgaauuuggguuu

SEQ ID NO: 330872 - RNA, 19 nt, Homo sapiens
cugauggacuuguauuuaa

SEQ ID NO: 330873 - RNA, 19 nt, Homo sapiens
agagaggacucagaugaua

SEQ ID NO: 330874 - RNA, 19 nt, Homo sapiens
ggaccguguucuuuacgua

SEQ ID NO: 330875 - RNA, 19 nt, Homo sapiens
gaagacgaauuuggguuug

SEQ ID NO: 330876 - RNA, 19 nt, Homo sapiens
gguuugaaauuccugauau

SEQ ID NO: 330877 - RNA, 19 nt, Homo sapiens
gaccugggcuuagacaguu

SEQ ID NO: 330878 - RNA, 19 nt, Homo sapiens
ggccauggaagacgaauuu

SEQ ID NO: 330879 - RNA, 19 nt, Homo sapiens
uaugaaagaccugggcuua

SEQ ID NO: 330880 - RNA, 19 nt, Homo sapiens
agagaagcuuucaguaaau

SEQ ID NO: 330881 - RNA, 19 nt, Homo sapiens
guagauuacauugcagaua

SEQ ID NO: 330882 - RNA, 19 nt, Homo sapiens
gaaauuccugauauagaug

SEQ ID NO: 330883 - RNA, 19 nt, Homo sapiens
gagagaggacucagaugau

SEQ ID NO: 330884 - RNA, 19 nt, Homo sapiens
ucugauggacuuguauuua

SEQ ID NO: 330885 - RNA, 19 nt, Homo sapiens
gagugauucugauggacuu

SEQ ID NO: 330886 - RNA, 19 nt, Homo sapiens
agacgaauuuggguuugaa

SEQ ID NO: 330887 - RNA, 19 nt, Homo sapiens
ugauucugauggacuugua

SEQ ID NO: 330888 - RNA, 19 nt, Homo sapiens
gaggacacauuuuggcauu

SEQ ID NO: 330889 - RNA, 19 nt, Homo sapiens
guauugaaacucuaugaca

SEQ ID NO: 330890 - RNA, 19 nt, Homo sapiens
ccaggaccguguucuuuac

SEQ ID NO: 330891 - RNA, 19 nt, Homo sapiens
cagaugauagugacgaaug

SEQ ID NO: 330892 - RNA, 19 nt, Homo sapiens
caagauugacccagagaag

SEQ ID NO: 330893 - RNA, 19 nt, Homo sapiens
uccaggaccguguucuuua

SEQ ID NO: 330894 - RNA, 19 nt, Homo sapiens
ugguagaguuacacaguug

SEQ ID NO: 330895 - RNA, 19 nt, Homo sapiens
ccaaguggagauuaucaug

SEQ ID NO: 330896 - RNA, 19 nt, Homo sapiens
auagcgacaugccuccuuu

SEQ ID NO: 330897 - RNA, 19 nt, Homo sapiens
gcagugaggacacauuuug

SEQ ID NO: 330898 - RNA, 19 nt, Homo sapiens
gagaggacucagaugauag

SEQ ID NO: 330899 - RNA, 19 nt, Homo sapiens
ggguuugaaauuccugaua

SEQ ID NO: 330900 - RNA, 19 nt, Homo sapiens
gaccaaguggagauuauca

SEQ ID NO: 330901 - RNA, 19 nt, Homo sapiens
gaagcuuucaguaaauucu

SEQ ID NO: 330902 - RNA, 19 nt, Homo sapiens
uggaccaaguggagauuau

SEQ ID NO: 330903 - RNA, 19 nt, Homo sapiens
cauggcgucucguguccuu

SEQ ID NO: 330904 - RNA, 19 nt, Homo sapiens
uugaaacucuaugacaaga

SEQ ID NO: 330905 - RNA, 19 nt, Homo sapiens
caguugugccgccaguaua

SEQ ID NO: 330906 - RNA, 19 nt, Homo sapiens
gacaagauugacccagaga

SEQ ID NO: 330907 - RNA, 19 nt, Homo sapiens
aagacgaauuuggguuuga

SEQ ID NO: 330908 - RNA, 19 nt, Homo sapiens
gaaagaccugggcuuagac

SEQ ID NO: 330909 - RNA, 19 nt, Homo sapiens
gaccguguucuuuacguau

SEQ ID NO: 330910 - RNA, 19 nt, Homo sapiens
uggcagugaggacacauuu

SEQ ID NO: 330911 - RNA, 19 nt, Homo sapiens
agaugauagugacgaaugu

SEQ ID NO: 330912 - RNA, 19 nt, Homo sapiens
cugguagaguuacacaguu

SEQ ID NO: 330913 - RNA, 19 nt, Homo sapiens
ggaccaaguggagauuauc

SEQ ID NO: 330914 - RNA, 19 nt, Homo sapiens
caugccuccuuugacguua

SEQ ID NO: 330915 - RNA, 19 nt, Homo sapiens
gcauucuugcugacucuga

SEQ ID NO: 330916 - RNA, 19 nt, Homo sapiens
guaaagacuggcuagauua

SEQ ID NO: 330917 - RNA, 19 nt, Homo sapiens
gaacuuacuucagauugug

SEQ ID NO: 330918 - RNA, 19 nt, Homo sapiens
gugaagaaguuaccuggaa

SEQ ID NO: 330919 - RNA, 19 nt, Homo sapiens
gcaacccagugaagaaguu

SEQ ID NO: 330920 - RNA, 19 nt, Homo sapiens
aguaaagacuggcuagauu

SEQ ID NO: 330921 - RNA, 19 nt, Homo sapiens
gauuugucauuggauguua

SEQ ID NO: 330922 - RNA, 19 nt, Homo sapiens
ccacuggguucauguucuu

SEQ ID NO: 330923 - RNA, 19 nt, Homo sapiens
gcuagauuaucgaauguuc

SEQ ID NO: 330924 - RNA, 19 nt, Homo sapiens
gucauuggauguuauuuag

SEQ ID NO: 330925 - RNA, 19 nt, Homo sapiens
ccuaugggauuugucauug

SEQ ID NO: 330926 - RNA, 19 nt, Homo sapiens
uaaagacuggcuagauuau

SEQ ID NO: 330927 - RNA, 19 nt, Homo sapiens
ggaauugcaacccagugaa

SEQ ID NO: 330928 - RNA, 19 nt, Homo sapiens
gaaguaaagacuggcuaga

SEQ ID NO: 330929 - RNA, 19 nt, Homo sapiens
gggaauugcaacccaguga

SEQ ID NO: 330930 - RNA, 19 nt, Homo sapiens
cagcuaucauggugaacuu

SEQ ID NO: 330931 - RNA, 19 nt, Homo sapiens
gaagaaguuaccuggaagu

SEQ ID NO: 330932 - RNA, 19 nt, Homo sapiens
cuaacugccuuccggaaca

SEQ ID NO: 330933 - RNA, 19 nt, Homo sapiens
uaacugccuuccggaacaa

SEQ ID NO: 330934 - RNA, 19 nt, Homo sapiens
gaauugcaacccagugaag

SEQ ID NO: 330935 - RNA, 19 nt, Homo sapiens
uaugggauuugucauugga

SEQ ID NO: 330936 - RNA, 19 nt, Homo sapiens
cuggcuagauuaucgaaug

SEQ ID NO: 330937 - RNA, 19 nt, Homo sapiens
caacccagugaagaaguua

SEQ ID NO: 330938 - RNA, 19 nt, Homo sapiens
ggaccacuggguucauguu

SEQ ID NO: 330939 - RNA, 19 nt, Homo sapiens
agacagaaagagugaugaa

SEQ ID NO: 330940 - RNA, 19 nt, Homo sapiens
cauuggauguuauuuagac

SEQ ID NO: 330941 - RNA, 19 nt, Homo sapiens
cugcagcuaucauggugaa

SEQ ID NO: 330942 - RNA, 19 nt, Homo sapiens
uggauguuauuuagacaga

SEQ ID NO: 330943 - RNA, 19 nt, Homo sapiens
ggauguuauuuagacagaa

SEQ ID NO: 330944 - RNA, 19 nt, Homo sapiens
ggauuugucauuggauguu

SEQ ID NO: 330945 - RNA, 19 nt, Homo sapiens
aagacuggcuagauuaucg

SEQ ID NO: 330946 - RNA, 19 nt, Homo sapiens
uggcuagauuaucgaaugu

SEQ ID NO: 330947 - RNA, 19 nt, Homo sapiens
guggacagaugaagaauua

SEQ ID NO: 330948 - RNA, 19 nt, Homo sapiens
gaugaagacugaaggugua

SEQ ID NO: 330949 - RNA, 19 nt, Homo sapiens
gugagaauuucaaggauua

SEQ ID NO: 330950 - RNA, 19 nt, Homo sapiens
gacuucauauugcacauua

SEQ ID NO: 330951 - RNA, 19 nt, Homo sapiens
ugacucggcuggcgucuuu

SEQ ID NO: 330952 - RNA, 19 nt, Homo sapiens
gauuaucgacuucauauug

SEQ ID NO: 330953 - RNA, 19 nt, Homo sapiens
ggugagaauuucaaggauu

SEQ ID NO: 330954 - RNA, 19 nt, Homo sapiens
gcgaguauguccgcucuga

SEQ ID NO: 330955 - RNA, 19 nt, Homo sapiens
gacugaagguguagacuca

SEQ ID NO: 330956 - RNA, 19 nt, Homo sapiens
gaccagaucccagguguuc

SEQ ID NO: 330957 - RNA, 19 nt, Homo sapiens
uuucaaggauuaucgacuu

SEQ ID NO: 330958 - RNA, 19 nt, Homo sapiens
ucagcggacucaugugguu

SEQ ID NO: 330959 - RNA, 19 nt, Homo sapiens
agacucagccucacucugu

SEQ ID NO: 330960 - RNA, 19 nt, Homo sapiens
ccaguggacagaugaagaa

SEQ ID NO: 330961 - RNA, 19 nt, Homo sapiens
gugguggugugcacauuga

SEQ ID NO: 330962 - RNA, 19 nt, Homo sapiens
ggacagaugaagaauuagg

SEQ ID NO: 330963 - RNA, 19 nt, Homo sapiens
gacucagccucacucugua

SEQ ID NO: 330964 - RNA, 19 nt, Homo sapiens
gaugaagaauuagguaucc

SEQ ID NO: 330965 - RNA, 19 nt, Homo sapiens
caggugagaauuucaagga

SEQ ID NO: 330966 - RNA, 19 nt, Homo sapiens
guacaagagccaggugaga

SEQ ID NO: 330967 - RNA, 19 nt, Homo sapiens
caaggauuaucgacuucau

SEQ ID NO: 330968 - RNA, 19 nt, Homo sapiens
uuagguaucccuccugaug

SEQ ID NO: 330969 - RNA, 19 nt, Homo sapiens
gaauuucaaggauuaucga

SEQ ID NO: 330970 - RNA, 19 nt, Homo sapiens
caagagccaggugagaauu

SEQ ID NO: 330971 - RNA, 19 nt, Homo sapiens
gaugguggaguccgucaug

SEQ ID NO: 330972 - RNA, 19 nt, Homo sapiens
ggauuaucgacuucauauu

SEQ ID NO: 330973 - RNA, 19 nt, Homo sapiens
acagaugaagaauuaggua

SEQ ID NO: 330974 - RNA, 19 nt, Homo sapiens
uacaagagccaggugagaa

SEQ ID NO: 330975 - RNA, 19 nt, Homo sapiens
cagaugaagaauuagguau

SEQ ID NO: 330976 - RNA, 19 nt, Homo sapiens
caaauuaaaguggcuuggu

SEQ ID NO: 330977 - RNA, 19 nt, Homo sapiens
gcacggacugcuggagaug

SEQ ID NO: 330978 - RNA, 19 nt, Homo sapiens
acaagagccaggugagaau

SEQ ID NO: 330979 - RNA, 19 nt, Homo sapiens
gucuuucgcucgcguugga

SEQ ID NO: 330980 - RNA, 19 nt, Homo sapiens
guaucccuccugaugauga

SEQ ID NO: 330981 - RNA, 19 nt, Homo sapiens
gaguauguccgcucugacu

SEQ ID NO: 330982 - RNA, 19 nt, Homo sapiens
aggauuaucgacuucauau

SEQ ID NO: 330983 - RNA, 19 nt, Homo sapiens
gaagacugaagguguagac

SEQ ID NO: 330984 - RNA, 19 nt, Homo sapiens
uaucccuccugaugaugaa

SEQ ID NO: 330985 - RNA, 19 nt, Homo sapiens
guucuucagcggacucaug

SEQ ID NO: 330986 - RNA, 19 nt, Homo sapiens
cagccucacucuguacaag

SEQ ID NO: 330987 - RNA, 19 nt, Homo sapiens
agaagaagcuggcugcaaa

SEQ ID NO: 330988 - RNA, 19 nt, Homo sapiens
gauugaggaugcacauaua

SEQ ID NO: 330989 - RNA, 19 nt, Homo sapiens
gaagggacaccauuagaaa

SEQ ID NO: 330990 - RNA, 19 nt, Homo sapiens
gauagaagggacaccauua

SEQ ID NO: 330991 - RNA, 19 nt, Homo sapiens
guuuaucccuuacagaaua

SEQ ID NO: 330992 - RNA, 19 nt, Homo sapiens
gcaaugaagcuuggagaua

SEQ ID NO: 330993 - RNA, 19 nt, Homo sapiens
uaagaagcaucacugaaga

SEQ ID NO: 330994 - RNA, 19 nt, Homo sapiens
uagaaacuauccagaagaa

SEQ ID NO: 330995 - RNA, 19 nt, Homo sapiens
gcaucauagugguuucuua

SEQ ID NO: 330996 - RNA, 19 nt, Homo sapiens
ggacaccauuagaaacuau

SEQ ID NO: 330997 - RNA, 19 nt, Homo sapiens
aagcaucacugaagauaau

SEQ ID NO: 330998 - RNA, 19 nt, Homo sapiens
uguaggagcugaauauuac

SEQ ID NO: 330999 - RNA, 19 nt, Homo sapiens
caaugaagcuuggagauac

SEQ ID NO: 331000 - RNA, 19 nt, Homo sapiens
gggauuugcugcauuugug

SEQ ID NO: 331001 - RNA, 19 nt, Homo sapiens
caucauagugguuucuuaa

SEQ ID NO: 331002 - RNA, 19 nt, Homo sapiens
uggagucccugaauaaaga

SEQ ID NO: 331003 - RNA, 19 nt, Homo sapiens
gauuauagacaauggaaga

SEQ ID NO: 331004 - RNA, 19 nt, Homo sapiens
ggaagcaucauagugguuu

SEQ ID NO: 331005 - RNA, 19 nt, Homo sapiens
gaagcaucacugaagauaa

SEQ ID NO: 331006 - RNA, 19 nt, Homo sapiens
gauaagaagcaucacugaa

SEQ ID NO: 331007 - RNA, 19 nt, Homo sapiens
aggaaucucuaacccagua

SEQ ID NO: 331008 - RNA, 19 nt, Homo sapiens
uaccuggagucccugaaua

SEQ ID NO: 331009 - RNA, 19 nt, Homo sapiens
uauagacaauggaagauag

SEQ ID NO: 331010 - RNA, 19 nt, Homo sapiens
gcauggacaucauaaaaug

SEQ ID NO: 331011 - RNA, 19 nt, Homo sapiens
cagcgucccucauguaguc

SEQ ID NO: 331012 - RNA, 19 nt, Homo sapiens
gggacaccauuagaaacua

SEQ ID NO: 331013 - RNA, 19 nt, Homo sapiens
cuacuugucugguuuaucc

SEQ ID NO: 331014 - RNA, 19 nt, Homo sapiens
uagccuacuugucugguuu

SEQ ID NO: 331015 - RNA, 19 nt, Homo sapiens
cauagugguuucuuaacuc

SEQ ID NO: 331016 - RNA, 19 nt, Homo sapiens
gagcauggacaucauaaaa

SEQ ID NO: 331017 - RNA, 19 nt, Homo sapiens
cauuagaaacuauccagaa

SEQ ID NO: 331018 - RNA, 19 nt, Homo sapiens
agaagggacaccauuagaa

SEQ ID NO: 331019 - RNA, 19 nt, Homo sapiens
agaguugaguguccugaga

SEQ ID NO: 331020 - RNA, 19 nt, Homo sapiens
gaagcaucauagugguuuc

SEQ ID NO: 331021 - RNA, 19 nt, Homo sapiens
agaagcaucacugaagaua

SEQ ID NO: 331022 - RNA, 19 nt, Homo sapiens
cuguaggagcugaauauua

SEQ ID NO: 331023 - RNA, 19 nt, Homo sapiens
auacauggguggcuuugca

SEQ ID NO: 331024 - RNA, 19 nt, Homo sapiens
gcacauauacugggaaaau

SEQ ID NO: 331025 - RNA, 19 nt, Homo sapiens
ucauagugguuucuuaacu

SEQ ID NO: 331026 - RNA, 19 nt, Homo sapiens
gagauacauggguggcuuu

SEQ ID NO: 331027 - RNA, 19 nt, Homo sapiens
gaacuuccagauuauagac

SEQ ID NO: 331028 - RNA, 19 nt, Homo sapiens
auaagaagcaucacugaag

SEQ ID NO: 331029 - RNA, 19 nt, Homo sapiens
uagaagggacaccauuaga

SEQ ID NO: 331030 - RNA, 19 nt, Homo sapiens
caguaucuguuaccucagu

SEQ ID NO: 331031 - RNA, 19 nt, Homo sapiens
cagauuauagacaauggaa

SEQ ID NO: 331032 - RNA, 19 nt, Homo sapiens
ccgcuuuccugccgugaga

SEQ ID NO: 331033 - RNA, 19 nt, Homo sapiens
cccaguaucggaacguuaa

SEQ ID NO: 331034 - RNA, 19 nt, Homo sapiens
agauugaggaugcacauau

SEQ ID NO: 331035 - RNA, 19 nt, Homo sapiens
cugaagauaauaccuggaa

SEQ ID NO: 331036 - RNA, 19 nt, Homo sapiens
auuagaaacuauccagaag

SEQ ID NO: 331037 - RNA, 19 nt, Homo sapiens
uggcuccgguugcagaguu

SEQ ID NO: 331038 - RNA, 19 nt, Homo sapiens
cacauauacugggaaaaua

SEQ ID NO: 331039 - RNA, 19 nt, Homo sapiens
ugguuuaucccuuacagaa

SEQ ID NO: 331040 - RNA, 19 nt, Homo sapiens
cagaagaagcuggcugcaa

SEQ ID NO: 331041 - RNA, 19 nt, Homo sapiens
gcuguaggagcugaauauu

SEQ ID NO: 331042 - RNA, 19 nt, Homo sapiens
aaugaagcuuggagauaca

SEQ ID NO: 331043 - RNA, 19 nt, Homo sapiens
uuagaaacuauccagaaga

SEQ ID NO: 331044 - RNA, 19 nt, Homo sapiens
agauaagaagcaucacuga

SEQ ID NO: 331045 - RNA, 19 nt, Homo sapiens
gaagaagcuggcugcaaaa

SEQ ID NO: 331046 - RNA, 19 nt, Homo sapiens
gagaguaccugcuucagua

SEQ ID NO: 331047 - RNA, 19 nt, Homo sapiens
gaacauuucaccucucaua

SEQ ID NO: 331048 - RNA, 19 nt, Homo sapiens
cauuucaccucucauauua

SEQ ID NO: 331049 - RNA, 19 nt, Homo sapiens
gcaaugaugacuauaugua

SEQ ID NO: 331050 - RNA, 19 nt, Homo sapiens
cauaagagcccagcugaaa

SEQ ID NO: 331051 - RNA, 19 nt, Homo sapiens
gaaacgagaguaccugcuu

SEQ ID NO: 331052 - RNA, 19 nt, Homo sapiens
caacauaucuccggaaacc

SEQ ID NO: 331053 - RNA, 19 nt, Homo sapiens
gcaagaacaauaaaugucu

SEQ ID NO: 331054 - RNA, 19 nt, Homo sapiens
cauauuaagucuggcaaug

SEQ ID NO: 331055 - RNA, 19 nt, Homo sapiens
aaacugagagggauaggaa

SEQ ID NO: 331056 - RNA, 19 nt, Homo sapiens
agaugucguucccaaagua

SEQ ID NO: 331057 - RNA, 19 nt, Homo sapiens
gaaggaaaauuggaucgaa

SEQ ID NO: 331058 - RNA, 19 nt, Homo sapiens
ugagagggauaggaaagaa

SEQ ID NO: 331059 - RNA, 19 nt, Homo sapiens
uacaacauaucuccggaaa

SEQ ID NO: 331060 - RNA, 19 nt, Homo sapiens
gccgagcgguuggccauaa

SEQ ID NO: 331061 - RNA, 19 nt, Homo sapiens
ggagcucuguguggauuug

SEQ ID NO: 331062 - RNA, 19 nt, Homo sapiens
uggcaaugaugacuauaug

SEQ ID NO: 331063 - RNA, 19 nt, Homo sapiens
uauuaagucuggcaaugau

SEQ ID NO: 331064 - RNA, 19 nt, Homo sapiens
caagaugucguucccaaag

SEQ ID NO: 331065 - RNA, 19 nt, Homo sapiens
gaacaauaaaugucuaucc

SEQ ID NO: 331066 - RNA, 19 nt, Homo sapiens
aaacuuauccaggaaggaa

SEQ ID NO: 331067 - RNA, 19 nt, Homo sapiens
gagagggauaggaaagaaa

SEQ ID NO: 331068 - RNA, 19 nt, Homo sapiens
aauccugccuugcuucguu

SEQ ID NO: 331069 - RNA, 19 nt, Homo sapiens
gccgagggcucaucgaaaa

SEQ ID NO: 331070 - RNA, 19 nt, Homo sapiens
ggccuaugcaagaacaaua

SEQ ID NO: 331071 - RNA, 19 nt, Homo sapiens
ucgaacauuucaccucuca

SEQ ID NO: 331072 - RNA, 19 nt, Homo sapiens
acauuucaccucucauauu

SEQ ID NO: 331073 - RNA, 19 nt, Homo sapiens
gccuaugcaagaacaauaa

SEQ ID NO: 331074 - RNA, 19 nt, Homo sapiens
ugucuauccuaauuucaga

SEQ ID NO: 331075 - RNA, 19 nt, Homo sapiens
uuucaccucucauauuaag

SEQ ID NO: 331076 - RNA, 19 nt, Homo sapiens
ugucguucccaaaguauaa

SEQ ID NO: 331077 - RNA, 19 nt, Homo sapiens
gaaaauuggaucgaacauu

SEQ ID NO: 331078 - RNA, 19 nt, Homo sapiens
cgaaaauccugccuugcuu

SEQ ID NO: 331079 - RNA, 19 nt, Homo sapiens
ccaagaugucguucccaaa

SEQ ID NO: 331080 - RNA, 19 nt, Homo sapiens
uuaagucuggcaaugauga

SEQ ID NO: 331081 - RNA, 19 nt, Homo sapiens
ugggagcucuguguggauu

SEQ ID NO: 331082 - RNA, 19 nt, Homo sapiens
cgacccagccgaauacaac

SEQ ID NO: 331083 - RNA, 19 nt, Homo sapiens
ccagccgaauacaacauau

SEQ ID NO: 331084 - RNA, 19 nt, Homo sapiens
uuucagacccacuccuaaa

SEQ ID NO: 331085 - RNA, 19 nt, Homo sapiens
cgagaguaccugcuucagu

SEQ ID NO: 331086 - RNA, 19 nt, Homo sapiens
ucaccucucauauuaaguc

SEQ ID NO: 331087 - RNA, 19 nt, Homo sapiens
gaugucguucccaaaguau

SEQ ID NO: 331088 - RNA, 19 nt, Homo sapiens
gucuggcaaugaugacuau

SEQ ID NO: 331089 - RNA, 19 nt, Homo sapiens
aagaugucguucccaaagu

SEQ ID NO: 331090 - RNA, 19 nt, Homo sapiens
ccccucaucuucauuuauu

SEQ ID NO: 331091 - RNA, 19 nt, Homo sapiens
guagaugucuguauuauug

SEQ ID NO: 331092 - RNA, 19 nt, Homo sapiens
gaaagcaacuccugacaau

SEQ ID NO: 331093 - RNA, 19 nt, Homo sapiens
caagauggauugcccguaa

SEQ ID NO: 331094 - RNA, 19 nt, Homo sapiens
caucagaccuucuagauuc

SEQ ID NO: 331095 - RNA, 19 nt, Homo sapiens
acaaggaacuuauugauca

SEQ ID NO: 331096 - RNA, 19 nt, Homo sapiens
aagcaacuccugacaauua

SEQ ID NO: 331097 - RNA, 19 nt, Homo sapiens
gagauggacccugguauua

SEQ ID NO: 331098 - RNA, 19 nt, Homo sapiens
gcccguaauuucuaugaua

SEQ ID NO: 331099 - RNA, 19 nt, Homo sapiens
acaaaugccuguacuguag

SEQ ID NO: 331100 - RNA, 19 nt, Homo sapiens
gaacacugggaauauuaua

SEQ ID NO: 331101 - RNA, 19 nt, Homo sapiens
ucauaacucuggugaaugu

SEQ ID NO: 331102 - RNA, 19 nt, Homo sapiens
ggagauggacccugguauu

SEQ ID NO: 331103 - RNA, 19 nt, Homo sapiens
gaaggcugcugcuccuguu

SEQ ID NO: 331104 - RNA, 19 nt, Homo sapiens
gaacaauggccguccuuca

SEQ ID NO: 331105 - RNA, 19 nt, Homo sapiens
cagaacacugggaauauua

SEQ ID NO: 331106 - RNA, 19 nt, Homo sapiens
uaacucuggugaauguauu

SEQ ID NO: 331107 - RNA, 19 nt, Homo sapiens
ugagacaauugacaaggaa

SEQ ID NO: 331108 - RNA, 19 nt, Homo sapiens
gauugaggcuuuuguuuga

SEQ ID NO: 331109 - RNA, 19 nt, Homo sapiens
aagcugaacuagcagaaau

SEQ ID NO: 331110 - RNA, 19 nt, Homo sapiens
cagauucucaguaaacaaa

SEQ ID NO: 331111 - RNA, 19 nt, Homo sapiens
gcaccaguaauuauaguau

SEQ ID NO: 331112 - RNA, 19 nt, Homo sapiens
gagauucuacauugcauug

SEQ ID NO: 331113 - RNA, 19 nt, Homo sapiens
gauggacccugguauuacu

SEQ ID NO: 331114 - RNA, 19 nt, Homo sapiens
agaaggcuaugucccagaa

SEQ ID NO: 331115 - RNA, 19 nt, Homo sapiens
guauugaaccaacucuaaa

SEQ ID NO: 331116 - RNA, 19 nt, Homo sapiens
guuaagcaccaguaauuau

SEQ ID NO: 331117 - RNA, 19 nt, Homo sapiens
ggauugcccguaauuucua

SEQ ID NO: 331118 - RNA, 19 nt, Homo sapiens
ccugacaaauggaaguuau

SEQ ID NO: 331119 - RNA, 19 nt, Homo sapiens
aaacagauucucaguaaac

SEQ ID NO: 331120 - RNA, 19 nt, Homo sapiens
cgaaagcaacuccugacaa

SEQ ID NO: 331121 - RNA, 19 nt, Homo sapiens
gcacucgccucggauuugg

SEQ ID NO: 331122 - RNA, 19 nt, Homo sapiens
gacaaggaacuuauugauc

SEQ ID NO: 331123 - RNA, 19 nt, Homo sapiens
gaggagauggacccuggua

SEQ ID NO: 331124 - RNA, 19 nt, Homo sapiens
uacuguagaugucuguauu

SEQ ID NO: 331125 - RNA, 19 nt, Homo sapiens
caaggaacuuauugaucau

SEQ ID NO: 331126 - RNA, 19 nt, Homo sapiens
caaauggaaguuauagaag

SEQ ID NO: 331127 - RNA, 19 nt, Homo sapiens
ggaacuuauugaucauucu

SEQ ID NO: 331128 - RNA, 19 nt, Homo sapiens
ugacaaggaacuuauugau

SEQ ID NO: 331129 - RNA, 19 nt, Homo sapiens
gggaaaagacuauuuguca

SEQ ID NO: 331130 - RNA, 19 nt, Homo sapiens
ggaaaagacuauuugucau

SEQ ID NO: 331131 - RNA, 19 nt, Homo sapiens
caguguugguucagauuga

SEQ ID NO: 331132 - RNA, 19 nt, Homo sapiens
acaauugacaaggaacuua

SEQ ID NO: 331133 - RNA, 19 nt, Homo sapiens
aagacuauuugucaucaga

SEQ ID NO: 331134 - RNA, 19 nt, Homo sapiens
ugauaguccugaaaagaua

SEQ ID NO: 331135 - RNA, 19 nt, Homo sapiens
gggauuccaguagcaauuu

SEQ ID NO: 331136 - RNA, 19 nt, Homo sapiens
caauugacaaggaacuuau

SEQ ID NO: 331137 - RNA, 19 nt, Homo sapiens
caauggccguccuucagau

SEQ ID NO: 331138 - RNA, 19 nt, Homo sapiens
gaaaagacuauuugucauc

SEQ ID NO: 331139 - RNA, 19 nt, Homo sapiens
ugaaccaacucuaaaaugu

SEQ ID NO: 331140 - RNA, 19 nt, Homo sapiens
ccaaagaagguuuaaaaug

SEQ ID NO: 331141 - RNA, 19 nt, Homo sapiens
ugguucagauugaggcuuu

SEQ ID NO: 331142 - RNA, 19 nt, Homo sapiens
cuuccucacucguggcuuu

SEQ ID NO: 331143 - RNA, 19 nt, Homo sapiens
gauugcccguaauuucuau

SEQ ID NO: 331144 - RNA, 19 nt, Homo sapiens
agcaacuccugacaauuaa

SEQ ID NO: 331145 - RNA, 19 nt, Homo sapiens
gaacuuauugaucauucuc

SEQ ID NO: 331146 - RNA, 19 nt, Homo sapiens
gguauuacuaugagacaau

SEQ ID NO: 331147 - RNA, 19 nt, Homo sapiens
ggacccugguauuacuaug

SEQ ID NO: 331148 - RNA, 19 nt, Homo sapiens
gggcaacucaggauuuuaa

SEQ ID NO: 331149 - RNA, 19 nt, Homo sapiens
gacccugguauuacuauga

SEQ ID NO: 331150 - RNA, 19 nt, Homo sapiens
gauggauugcccguaauuu

SEQ ID NO: 331151 - RNA, 19 nt, Homo sapiens
gaaccaacucuaaaauguu

SEQ ID NO: 331152 - RNA, 19 nt, Homo sapiens
aguauugaaccaacucuaa

SEQ ID NO: 331153 - RNA, 19 nt, Homo sapiens
guacuguagaugucuguau

SEQ ID NO: 331154 - RNA, 19 nt, Homo sapiens
ugacaaauggaaguuauag

SEQ ID NO: 331155 - RNA, 19 nt, Homo sapiens
uguuaagcaccaguaauua

SEQ ID NO: 331156 - RNA, 19 nt, Homo sapiens
aauggaaguuauagaaguc

SEQ ID NO: 331157 - RNA, 19 nt, Homo sapiens
gacaaauggaaguuauaga

SEQ ID NO: 331158 - RNA, 19 nt, Homo sapiens
gaucauucuccgaaagcaa

SEQ ID NO: 331159 - RNA, 19 nt, Homo sapiens
gguaaaggagcuggaagug

SEQ ID NO: 331160 - RNA, 19 nt, Homo sapiens
caguggagaccaugggaaa

SEQ ID NO: 331161 - RNA, 19 nt, Homo sapiens
gauucuacauugcauugac

SEQ ID NO: 331162 - RNA, 19 nt, Homo sapiens
caaaugccuguacuguaga

SEQ ID NO: 331163 - RNA, 19 nt, Homo sapiens
ucaucagaccuucuagauu

SEQ ID NO: 331164 - RNA, 19 nt, Homo sapiens
uggucaagcugaacuagca

SEQ ID NO: 331165 - RNA, 19 nt, Homo sapiens
acaauggccguccuucaga

SEQ ID NO: 331166 - RNA, 19 nt, Homo sapiens
agaaauuccagaaggcuau

SEQ ID NO: 331167 - RNA, 19 nt, Homo sapiens
ugaacuagcagaaauucca

SEQ ID NO: 331168 - RNA, 19 nt, Homo sapiens
cuguagaugucuguauuau

SEQ ID NO: 331169 - RNA, 19 nt, Homo sapiens
uaagcaccaguaauuauag

SEQ ID NO: 331170 - RNA, 19 nt, Homo sapiens
uggccguccuucagauuga

SEQ ID NO: 331171 - RNA, 19 nt, Homo sapiens
gaaauuccagaaggcuaug

SEQ ID NO: 331172 - RNA, 19 nt, Homo sapiens
uaauguuaagcaccaguaa

SEQ ID NO: 331173 - RNA, 19 nt, Homo sapiens
caagcugaacuagcagaaa

SEQ ID NO: 331174 - RNA, 19 nt, Homo sapiens
gcugaacuagcagaaauuc

SEQ ID NO: 331175 - RNA, 19 nt, Homo sapiens
gucaucagaccuucuagau

SEQ ID NO: 331176 - RNA, 19 nt, Homo sapiens
augagacaauugacaagga

SEQ ID NO: 331177 - RNA, 19 nt, Homo sapiens
ggauuccaguagcaauuuu

SEQ ID NO: 331178 - RNA, 19 nt, Homo sapiens
ggguaaaggagcuggaagu

SEQ ID NO: 331179 - RNA, 19 nt, Homo sapiens
acuguagaugucuguauua

SEQ ID NO: 331180 - RNA, 19 nt, Homo sapiens
ucucaguguugguucagau

SEQ ID NO: 331181 - RNA, 19 nt, Homo sapiens
gagccucugacauuacugu

SEQ ID NO: 331182 - RNA, 19 nt, Homo sapiens
aggaacuuauugaucauuc

SEQ ID NO: 331183 - RNA, 19 nt, Homo sapiens
gaaaagaaguccagaauau

SEQ ID NO: 331184 - RNA, 19 nt, Homo sapiens
gaaguaauuccaccaauga

SEQ ID NO: 331185 - RNA, 19 nt, Homo sapiens
guaccugucuggauuauuc

SEQ ID NO: 331186 - RNA, 19 nt, Homo sapiens
gaaguaucauguuucugaa

SEQ ID NO: 331187 - RNA, 19 nt, Homo sapiens
ugaaguaucauguuucuga

SEQ ID NO: 331188 - RNA, 19 nt, Homo sapiens
ggagcgcgcuuaaguaacu

SEQ ID NO: 331189 - RNA, 19 nt, Homo sapiens
gagccuaaguuuguuccua

SEQ ID NO: 331190 - RNA, 19 nt, Homo sapiens
gagaaguaauuccaccaau

SEQ ID NO: 331191 - RNA, 19 nt, Homo sapiens
ucuggagacuggagaagua

SEQ ID NO: 331192 - RNA, 19 nt, Homo sapiens
agaaguaauuccaccaaug

SEQ ID NO: 331193 - RNA, 19 nt, Homo sapiens
aaagaaguccagaauauuc

SEQ ID NO: 331194 - RNA, 19 nt, Homo sapiens
ggagacuggagaaguaauu

SEQ ID NO: 331195 - RNA, 19 nt, Homo sapiens
aauauucccuggugauaca

SEQ ID NO: 331196 - RNA, 19 nt, Homo sapiens
cugucuggauuauucauua

SEQ ID NO: 331197 - RNA, 19 nt, Homo sapiens
gccuaaguuuguuccuaua

SEQ ID NO: 331198 - RNA, 19 nt, Homo sapiens
agaauuuccugaucaacau

SEQ ID NO: 331199 - RNA, 19 nt, Homo sapiens
ggagaaguaauuccaccaa

SEQ ID NO: 331200 - RNA, 19 nt, Homo sapiens
cgggagcgcgcuuaaguaa

SEQ ID NO: 331201 - RNA, 19 nt, Homo sapiens
guaauuccaccaaugaaag

SEQ ID NO: 331202 - RNA, 19 nt, Homo sapiens
guacacuccggaugagaaa

SEQ ID NO: 331203 - RNA, 19 nt, Homo sapiens
gcgggagcgcgcuuaagua

SEQ ID NO: 331204 - RNA, 19 nt, Homo sapiens
gguacacuccggaugagaa

SEQ ID NO: 331205 - RNA, 19 nt, Homo sapiens
agaauauucccuggugaua

SEQ ID NO: 331206 - RNA, 19 nt, Homo sapiens
acuuguaccugucuggauu

SEQ ID NO: 331207 - RNA, 19 nt, Homo sapiens
agccuaaguuuguuccuau

SEQ ID NO: 331208 - RNA, 19 nt, Homo sapiens
gagcgcgcuuaaguaacua

SEQ ID NO: 331209 - RNA, 19 nt, Homo sapiens
gaauauucccuggugauac

SEQ ID NO: 331210 - RNA, 19 nt, Homo sapiens
uaauuccaccaaugaaaga

SEQ ID NO: 331211 - RNA, 19 nt, Homo sapiens
ugaaaagaaguccagaaua

SEQ ID NO: 331212 - RNA, 19 nt, Homo sapiens
uuucacucauguacuugua

SEQ ID NO: 331213 - RNA, 19 nt, Homo sapiens
uuccaccaaugaaagaauu

SEQ ID NO: 331214 - RNA, 19 nt, Homo sapiens
aagaauuuccugaucaaca

SEQ ID NO: 331215 - RNA, 19 nt, Homo sapiens
cagaauauucccuggugau

SEQ ID NO: 331216 - RNA, 19 nt, Homo sapiens
gguaccagcggcgacauga

SEQ ID NO: 331217 - RNA, 19 nt, Homo sapiens
aguaauuccaccaaugaaa

SEQ ID NO: 331218 - RNA, 19 nt, Homo sapiens
gaaggcgauggcugaagga

SEQ ID NO: 331219 - RNA, 19 nt, Homo sapiens
gcaaggagcgcgagauggu

SEQ ID NO: 331220 - RNA, 19 nt, Homo sapiens
cuauggaccagucaaauaa

SEQ ID NO: 331221 - RNA, 19 nt, Homo sapiens
ccuauggaccagucaaaua

SEQ ID NO: 331222 - RNA, 19 nt, Homo sapiens
gcaccgcgacuaugugaug

SEQ ID NO: 331223 - RNA, 19 nt, Homo sapiens
gagcaccgcgacuauguga

SEQ ID NO: 331224 - RNA, 19 nt, Homo sapiens
ccacacagcaggagaugau

SEQ ID NO: 331225 - RNA, 19 nt, Homo sapiens
ccaacuuccuggccugcaa

SEQ ID NO: 331226 - RNA, 19 nt, Homo sapiens
gcgagaugguggccacaca

SEQ ID NO: 331227 - RNA, 19 nt, Homo sapiens
caaccuucccgccagacua

SEQ ID NO: 331228 - RNA, 19 nt, Homo sapiens
gcgagcaccgcgacuaugu

SEQ ID NO: 331229 - RNA, 19 nt, Homo sapiens
ucauccggcugcucaagug

SEQ ID NO: 331230 - RNA, 19 nt, Homo sapiens
ugaugcgcaugaaggaguu

SEQ ID NO: 331231 - RNA, 19 nt, Homo sapiens
gacuaugugaugcgcauga

SEQ ID NO: 331232 - RNA, 19 nt, Homo sapiens
gaccaaagcaguauccuua

SEQ ID NO: 331233 - RNA, 19 nt, Homo sapiens
guaugcagcucuucgguuu

SEQ ID NO: 331234 - RNA, 19 nt, Homo sapiens
ugagagagauccaugguau

SEQ ID NO: 331235 - RNA, 19 nt, Homo sapiens
ccucauuccuagaaauuua

SEQ ID NO: 331236 - RNA, 19 nt, Homo sapiens
gcaguauccuuacaauaau

SEQ ID NO: 331237 - RNA, 19 nt, Homo sapiens
uaacuaggacucccucauu

SEQ ID NO: 331238 - RNA, 19 nt, Homo sapiens
uuuccuggcuuucaugaua

SEQ ID NO: 331239 - RNA, 19 nt, Homo sapiens
gcggugaucccuccaaaga

SEQ ID NO: 331240 - RNA, 19 nt, Homo sapiens
ccaaagcaguauccuuaca

SEQ ID NO: 331241 - RNA, 19 nt, Homo sapiens
ggaguccaguggcugcaaa

SEQ ID NO: 331242 - RNA, 19 nt, Homo sapiens
gccaagaaguauaauaugc

SEQ ID NO: 331243 - RNA, 19 nt, Homo sapiens
agcaguauccuuacaauaa

SEQ ID NO: 331244 - RNA, 19 nt, Homo sapiens
gcacuggcaccuagacaug

SEQ ID NO: 331245 - RNA, 19 nt, Homo sapiens
gagagagauccaugguaua

SEQ ID NO: 331246 - RNA, 19 nt, Homo sapiens
ggugaucccuccaaagaac

SEQ ID NO: 331247 - RNA, 19 nt, Homo sapiens
cagagcgggugguucacua

SEQ ID NO: 331248 - RNA, 19 nt, Homo sapiens
caaagcaguauccuuacaa

SEQ ID NO: 331249 - RNA, 19 nt, Homo sapiens
aaaacucagugcuguguua

SEQ ID NO: 331250 - RNA, 19 nt, Homo sapiens
ggaaccguguggauacauc

SEQ ID NO: 331251 - RNA, 19 nt, Homo sapiens
caacaggaaccguguggau

SEQ ID NO: 331252 - RNA, 19 nt, Homo sapiens
aaagcaguauccuuacaau

SEQ ID NO: 331253 - RNA, 19 nt, Homo sapiens
cggacagccucccacauga

SEQ ID NO: 331254 - RNA, 19 nt, Homo sapiens
ggacguguacccugucuac

SEQ ID NO: 331255 - RNA, 19 nt, Homo sapiens
ggaccaaagcaguauccuu

SEQ ID NO: 331256 - RNA, 19 nt, Homo sapiens
ggaagacuacgaaccuuac

SEQ ID NO: 331257 - RNA, 19 nt, Homo sapiens
ccgccaagaaguauaauau

SEQ ID NO: 331258 - RNA, 19 nt, Homo sapiens
uggaagacuacgaaccuua

SEQ ID NO: 331259 - RNA, 19 nt, Homo sapiens
gaaccuuacccggaugaug

SEQ ID NO: 331260 - RNA, 19 nt, Homo sapiens
gcauguggaagaaggugaa

SEQ ID NO: 331261 - RNA, 19 nt, Homo sapiens
acuggcaccuagacaugua

SEQ ID NO: 331262 - RNA, 19 nt, Homo sapiens
aagcaguauccuuacaaua

SEQ ID NO: 331263 - RNA, 19 nt, Homo sapiens
agagauccaugguauagcu

SEQ ID NO: 331264 - RNA, 19 nt, Homo sapiens
agagagauccaugguauag

SEQ ID NO: 331265 - RNA, 19 nt, Homo sapiens
caguauccuuacaauaauc

SEQ ID NO: 331266 - RNA, 19 nt, Homo sapiens
aacuaggacucccucauuc

SEQ ID NO: 331267 - RNA, 19 nt, Homo sapiens
aaacucagugcuguguuaa

SEQ ID NO: 331268 - RNA, 19 nt, Homo sapiens
ccucccacaugaccaagga

SEQ ID NO: 331269 - RNA, 19 nt, Homo sapiens
gguucacuaugagaucuga

SEQ ID NO: 331270 - RNA, 19 nt, Homo sapiens
gcgggugguucacuaugag

SEQ ID NO: 331271 - RNA, 19 nt, Homo sapiens
guggaagacuacgaaccuu

SEQ ID NO: 331272 - RNA, 19 nt, Homo sapiens
aacaggaaccguguggaua

SEQ ID NO: 331273 - RNA, 19 nt, Homo sapiens
gagcgggugguucacuaug

SEQ ID NO: 331274 - RNA, 19 nt, Homo sapiens
auaauaugcguguggaaga

SEQ ID NO: 331275 - RNA, 19 nt, Homo sapiens
ucauguguaugcagcucuu

SEQ ID NO: 331276 - RNA, 19 nt, Homo sapiens
caggaaccguguggauaca

SEQ ID NO: 331277 - RNA, 19 nt, Homo sapiens
gcaccuagacauguacaac

SEQ ID NO: 331278 - RNA, 19 nt, Homo sapiens
agagagaccucaucuuuca

SEQ ID NO: 331279 - RNA, 19 nt, Homo sapiens
agacaaauaccgauacuuu

SEQ ID NO: 331280 - RNA, 19 nt, Homo sapiens
gagauacgauugcuacaag

SEQ ID NO: 331281 - RNA, 19 nt, Homo sapiens
gaacaugcacuugcccuaa

SEQ ID NO: 331282 - RNA, 19 nt, Homo sapiens
agagagagaccucaucuuu

SEQ ID NO: 331283 - RNA, 19 nt, Homo sapiens
gcuacaaggucccagaaug

SEQ ID NO: 331284 - RNA, 19 nt, Homo sapiens
gaaggaggccgaggaagaa

SEQ ID NO: 331285 - RNA, 19 nt, Homo sapiens
gaccucaucuuucaugcuu

SEQ ID NO: 331286 - RNA, 19 nt, Homo sapiens
caauguauccugauuacuu

SEQ ID NO: 331287 - RNA, 19 nt, Homo sapiens
gacccuaccugacccauca

SEQ ID NO: 331288 - RNA, 19 nt, Homo sapiens
gaugagagcccgguuugaa

SEQ ID NO: 331289 - RNA, 19 nt, Homo sapiens
ccagaauggugcuuagaug

SEQ ID NO: 331290 - RNA, 19 nt, Homo sapiens
gaaggucagcgccguaaug

SEQ ID NO: 331291 - RNA, 19 nt, Homo sapiens
auacuuugcuuguuugaug

SEQ ID NO: 331292 - RNA, 19 nt, Homo sapiens
gagagagaccucaucuuuc

SEQ ID NO: 331293 - RNA, 19 nt, Homo sapiens
gcuugcaagugaaauaugu

SEQ ID NO: 331294 - RNA, 19 nt, Homo sapiens
gaaagagagagaccucauc

SEQ ID NO: 331295 - RNA, 19 nt, Homo sapiens
ugaaggaggccgaggaaga

SEQ ID NO: 331296 - RNA, 19 nt, Homo sapiens
gcaagugaaauauguuaca

SEQ ID NO: 331297 - RNA, 19 nt, Homo sapiens
ggcaauguauccugauuac

SEQ ID NO: 331298 - RNA, 19 nt, Homo sapiens
acaugcacuugcccuaaua

SEQ ID NO: 331299 - RNA, 19 nt, Homo sapiens
gcaccuccuaugagagaua

SEQ ID NO: 331300 - RNA, 19 nt, Homo sapiens
gagagaacaguggaagaaa

SEQ ID NO: 331301 - RNA, 19 nt, Homo sapiens
gaauggugcuuagaugacu

SEQ ID NO: 331302 - RNA, 19 nt, Homo sapiens
cagaauggugcuuagauga

SEQ ID NO: 331303 - RNA, 19 nt, Homo sapiens
gggcaccuccuaugagaga

SEQ ID NO: 331304 - RNA, 19 nt, Homo sapiens
ccauacaucuucccugacu

SEQ ID NO: 331305 - RNA, 19 nt, Homo sapiens
ggaggccgaggaagaauuc

SEQ ID NO: 331306 - RNA, 19 nt, Homo sapiens
accgauacuuugcuuguuu

SEQ ID NO: 331307 - RNA, 19 nt, Homo sapiens
caagugaaauauguuacag

SEQ ID NO: 331308 - RNA, 19 nt, Homo sapiens
ccgaaaggaaggugauuug

SEQ ID NO: 331309 - RNA, 19 nt, Homo sapiens
gcugggaacgagagguuaa

SEQ ID NO: 331310 - RNA, 19 nt, Homo sapiens
aaauaccgauacuuugcuu

SEQ ID NO: 331311 - RNA, 19 nt, Homo sapiens
ccgauacuuugcuuguuug

SEQ ID NO: 331312 - RNA, 19 nt, Homo sapiens
gagaacaguggaagaaacu

SEQ ID NO: 331313 - RNA, 19 nt, Homo sapiens
agagagaacaguggaagaa

SEQ ID NO: 331314 - RNA, 19 nt, Homo sapiens
agagagacaaauaccgaua

SEQ ID NO: 331315 - RNA, 19 nt, Homo sapiens
ugagagcccgguuugaaga

SEQ ID NO: 331316 - RNA, 19 nt, Homo sapiens
uccuuuaacugaagcuuug

SEQ ID NO: 331317 - RNA, 19 nt, Homo sapiens
ccuaugagagauacgauug

SEQ ID NO: 331318 - RNA, 19 nt, Homo sapiens
gcagcaggcgugcaguuuc

SEQ ID NO: 331319 - RNA, 19 nt, Homo sapiens
gagcccgguuugaagaaca

SEQ ID NO: 331320 - RNA, 19 nt, Homo sapiens
gggaaggucagcgccguaa

SEQ ID NO: 331321 - RNA, 19 nt, Homo sapiens
agagaacaguggaagaaac

SEQ ID NO: 331322 - RNA, 19 nt, Homo sapiens
ugauuacuuugccaagaga

SEQ ID NO: 331323 - RNA, 19 nt, Homo sapiens
cuacaaggucccagaaugg

SEQ ID NO: 331324 - RNA, 19 nt, Homo sapiens
gagagcccgguuugaagaa

SEQ ID NO: 331325 - RNA, 19 nt, Homo sapiens
caugcuugcaagugaaaua

SEQ ID NO: 331326 - RNA, 19 nt, Homo sapiens
ccugauuacuuugccaaga

SEQ ID NO: 331327 - RNA, 19 nt, Homo sapiens
aaggcaauguauccugauu

SEQ ID NO: 331328 - RNA, 19 nt, Homo sapiens
gcugaaggaggccgaggaa

SEQ ID NO: 331329 - RNA, 19 nt, Homo sapiens
aacaugcacuugcccuaau

SEQ ID NO: 331330 - RNA, 19 nt, Homo sapiens
ggugguccuuuaacugaag

SEQ ID NO: 331331 - RNA, 19 nt, Homo sapiens
gagagacaaauaccgauac

SEQ ID NO: 331332 - RNA, 19 nt, Homo sapiens
ggucccagaauggugcuua

SEQ ID NO: 331333 - RNA, 19 nt, Homo sapiens
aaagagagagaccucaucu

SEQ ID NO: 331334 - RNA, 19 nt, Homo sapiens
ccauguagaaagagagaga

SEQ ID NO: 331335 - RNA, 19 nt, Homo sapiens
aagaaacugcggagggaaa

SEQ ID NO: 331336 - RNA, 19 nt, Homo sapiens
aggcaauguauccugauua

SEQ ID NO: 331337 - RNA, 19 nt, Homo sapiens
gguuugaagaacauaagaa

SEQ ID NO: 331338 - RNA, 19 nt, Homo sapiens
cguggugcguccagagaga

SEQ ID NO: 331339 - RNA, 19 nt, Homo sapiens
gucagcauccacagccaua

SEQ ID NO: 331340 - RNA, 19 nt, Homo sapiens
cugauuacuuugccaagag

SEQ ID NO: 331341 - RNA, 19 nt, Homo sapiens
gaaggcaauguauccugau

SEQ ID NO: 331342 - RNA, 19 nt, Homo sapiens
ccgaggaagaauucuggua

SEQ ID NO: 331343 - RNA, 19 nt, Homo sapiens
gcguccagagagacaaaua

SEQ ID NO: 331344 - RNA, 19 nt, Homo sapiens
gaacagguauuacuacuac

SEQ ID NO: 331345 - RNA, 19 nt, Homo sapiens
ggaagugccuggccaaaca

SEQ ID NO: 331346 - RNA, 19 nt, Homo sapiens
caaagucgaccaagaaauu

SEQ ID NO: 331347 - RNA, 19 nt, Homo sapiens
gacuguugcugaaauauaa

SEQ ID NO: 331348 - RNA, 19 nt, Homo sapiens
caaagaacagguauuacua

SEQ ID NO: 331349 - RNA, 19 nt, Homo sapiens
gcagaacuguaucaaggaa

SEQ ID NO: 331350 - RNA, 19 nt, Homo sapiens
gagaaaagcugcaaaagag

SEQ ID NO: 331351 - RNA, 19 nt, Homo sapiens
ucaaggaaguggagcaguu

SEQ ID NO: 331352 - RNA, 19 nt, Homo sapiens
gcaaagaacagguauuacu

SEQ ID NO: 331353 - RNA, 19 nt, Homo sapiens
cuacaaagucgaccaagaa

SEQ ID NO: 331354 - RNA, 19 nt, Homo sapiens
uaugacuguugcugaaaua

SEQ ID NO: 331355 - RNA, 19 nt, Homo sapiens
ggaagagggacuacaaagu

SEQ ID NO: 331356 - RNA, 19 nt, Homo sapiens
acgcaaagaacagguauua

SEQ ID NO: 331357 - RNA, 19 nt, Homo sapiens
guaugacuguugcugaaau

SEQ ID NO: 331358 - RNA, 19 nt, Homo sapiens
ugacuguugcugaaauaua

SEQ ID NO: 331359 - RNA, 19 nt, Homo sapiens
gcaaggaggaggacaucau

SEQ ID NO: 331360 - RNA, 19 nt, Homo sapiens
aaagucgaccaagaaauua

SEQ ID NO: 331361 - RNA, 19 nt, Homo sapiens
gaaauauaaagcccugcaa

SEQ ID NO: 331362 - RNA, 19 nt, Homo sapiens
ggacagcugggacaaggau

SEQ ID NO: 331363 - RNA, 19 nt, Homo sapiens
cagaggaugcugcaagaga

SEQ ID NO: 331364 - RNA, 19 nt, Homo sapiens
gaacuaccagcagaacugu

SEQ ID NO: 331365 - RNA, 19 nt, Homo sapiens
caaggaggaggacaucaug

SEQ ID NO: 331366 - RNA, 19 nt, Homo sapiens
gcuguguggcucuguauga

SEQ ID NO: 331367 - RNA, 19 nt, Homo sapiens
aagccgaaaugcaguggaa

SEQ ID NO: 331368 - RNA, 19 nt, Homo sapiens
ccaaacagaggcagaggau

SEQ ID NO: 331369 - RNA, 19 nt, Homo sapiens
ugaaagcguucgaccucau

SEQ ID NO: 331370 - RNA, 19 nt, Homo sapiens
ccucgugagagaauuuaua

SEQ ID NO: 331371 - RNA, 19 nt, Homo sapiens
gaccaagaaauuaucaaca

SEQ ID NO: 331372 - RNA, 19 nt, Homo sapiens
gaaagcguucgaccucauc

SEQ ID NO: 331373 - RNA, 19 nt, Homo sapiens
gcacgcaaagaacagguau

SEQ ID NO: 331374 - RNA, 19 nt, Homo sapiens
agaacuguaucaaggaagu

SEQ ID NO: 331375 - RNA, 19 nt, Homo sapiens
gcagagggaaggacagaac

SEQ ID NO: 331376 - RNA, 19 nt, Homo sapiens
acuacaaagucgaccaaga

SEQ ID NO: 331377 - RNA, 19 nt, Homo sapiens
gcugggacaaggaugugua

SEQ ID NO: 331378 - RNA, 19 nt, Homo sapiens
gggaaggacagaacuacca

SEQ ID NO: 331379 - RNA, 19 nt, Homo sapiens
cuguaugacuguugcugaa

SEQ ID NO: 331380 - RNA, 19 nt, Homo sapiens
gacagaacuaccagcagaa

SEQ ID NO: 331381 - RNA, 19 nt, Homo sapiens
cgugagagaauuuauagag

SEQ ID NO: 331382 - RNA, 19 nt, Homo sapiens
uacaaagucgaccaagaaa

SEQ ID NO: 331383 - RNA, 19 nt, Homo sapiens
gcauguaugaagccgaaau

SEQ ID NO: 331384 - RNA, 19 nt, Homo sapiens
agaacagguauuacuacua

SEQ ID NO: 331385 - RNA, 19 nt, Homo sapiens
gacccucgugagagaauuu

SEQ ID NO: 331386 - RNA, 19 nt, Homo sapiens
ccgugacccucgugagaga

SEQ ID NO: 331387 - RNA, 19 nt, Homo sapiens
gaggaugcugcaagagaga

SEQ ID NO: 331388 - RNA, 19 nt, Homo sapiens
uaugcaggaucggcucaaa

SEQ ID NO: 331389 - RNA, 19 nt, Homo sapiens
aaagaacagguauuacuac

SEQ ID NO: 331390 - RNA, 19 nt, Homo sapiens
aagaacagguauuacuacu

SEQ ID NO: 331391 - RNA, 19 nt, Homo sapiens
caaggaaguggagcaguuc

SEQ ID NO: 331392 - RNA, 19 nt, Homo sapiens
guggaagagggacuacaaa

SEQ ID NO: 331393 - RNA, 19 nt, Homo sapiens
gccgaaaugcaguggaaga

SEQ ID NO: 331394 - RNA, 19 nt, Homo sapiens
ggaugcugcaagagagaaa

SEQ ID NO: 331395 - RNA, 19 nt, Homo sapiens
gaaaugggcuggaauaaac

SEQ ID NO: 331396 - RNA, 19 nt, Homo sapiens
gaagaaaugggcuggaaua

SEQ ID NO: 331397 - RNA, 19 nt, Homo sapiens
ggaucuaucucaucaaaca

SEQ ID NO: 331398 - RNA, 19 nt, Homo sapiens
caagccagcauuuguauuu

SEQ ID NO: 331399 - RNA, 19 nt, Homo sapiens
gggcaccacugucuucuug

SEQ ID NO: 331400 - RNA, 19 nt, Homo sapiens
caccaucuguugaguugua

SEQ ID NO: 331401 - RNA, 19 nt, Homo sapiens
ccaaggaauucgcaagaug

SEQ ID NO: 331402 - RNA, 19 nt, Homo sapiens
guggaucuaucucaucaaa

SEQ ID NO: 331403 - RNA, 19 nt, Homo sapiens
gcaccacugucuucuugug

SEQ ID NO: 331404 - RNA, 19 nt, Homo sapiens
ucaaacaacacaaugaaga

SEQ ID NO: 331405 - RNA, 19 nt, Homo sapiens
uaucaagccagcauuugua

SEQ ID NO: 331406 - RNA, 19 nt, Homo sapiens
caucaaacaacacaaugaa

SEQ ID NO: 331407 - RNA, 19 nt, Homo sapiens
aaaccugacuggcugaaag

SEQ ID NO: 331408 - RNA, 19 nt, Homo sapiens
aagaagaaaugggcuggaa

SEQ ID NO: 331409 - RNA, 19 nt, Homo sapiens
caaacaacacaaugaagau

SEQ ID NO: 331410 - RNA, 19 nt, Homo sapiens
agaaaugggcuggaauaaa

SEQ ID NO: 331411 - RNA, 19 nt, Homo sapiens
ucuguugaguuguaaaugu

SEQ ID NO: 331412 - RNA, 19 nt, Homo sapiens
ucagugcgaucaaaguucu

SEQ ID NO: 331413 - RNA, 19 nt, Homo sapiens
gcccuucagugcgaucaaa

SEQ ID NO: 331414 - RNA, 19 nt, Homo sapiens
uauagugauuguagcuguu

SEQ ID NO: 331415 - RNA, 19 nt, Homo sapiens
gcauuuguauuuugcauca

SEQ ID NO: 331416 - RNA, 19 nt, Homo sapiens
gcccaaggaauucgcaaga

SEQ ID NO: 331417 - RNA, 19 nt, Homo sapiens
guuguaaaugugagagaaa

SEQ ID NO: 331418 - RNA, 19 nt, Homo sapiens
aagaaaugggcuggaauaa

SEQ ID NO: 331419 - RNA, 19 nt, Homo sapiens
gggcuggaauaaacuuuug

SEQ ID NO: 331420 - RNA, 19 nt, Homo sapiens
uucaccaucuguugaguug

SEQ ID NO: 331421 - RNA, 19 nt, Homo sapiens
gaucuaucucaucaaacaa

SEQ ID NO: 331422 - RNA, 19 nt, Homo sapiens
caaauuagguggccuuaua

SEQ ID NO: 331423 - RNA, 19 nt, Homo sapiens
gaaauuagguugaggaaag

SEQ ID NO: 331424 - RNA, 19 nt, Homo sapiens
gaaacacugucucuacaua

SEQ ID NO: 331425 - RNA, 19 nt, Homo sapiens
caaguugucuuugcucuua

SEQ ID NO: 331426 - RNA, 19 nt, Homo sapiens
caaagugaauuuagaguga

SEQ ID NO: 331427 - RNA, 19 nt, Homo sapiens
gagguugaauucuaguuua

SEQ ID NO: 331428 - RNA, 19 nt, Homo sapiens
gaacauguuucuuaugaca

SEQ ID NO: 331429 - RNA, 19 nt, Homo sapiens
cugcaaagccuaauuaaua

SEQ ID NO: 331430 - RNA, 19 nt, Homo sapiens
gaacacagccaugcucauu

SEQ ID NO: 331431 - RNA, 19 nt, Homo sapiens
gaauugaguaguugugaua

SEQ ID NO: 331432 - RNA, 19 nt, Homo sapiens
gauggaacauguuucuuau

SEQ ID NO: 331433 - RNA, 19 nt, Homo sapiens
gagcagaauugaguaguug

SEQ ID NO: 331434 - RNA, 19 nt, Homo sapiens
gagggaccgugaaauguuu

SEQ ID NO: 331435 - RNA, 19 nt, Homo sapiens
uauagaaggugguuucgaa

SEQ ID NO: 331436 - RNA, 19 nt, Homo sapiens
gcuccggccugauugauaa

SEQ ID NO: 331437 - RNA, 19 nt, Homo sapiens
gaccaggccucaaguggaa

SEQ ID NO: 331438 - RNA, 19 nt, Homo sapiens
aagaugagguugaauucua

SEQ ID NO: 331439 - RNA, 19 nt, Homo sapiens
ggaaacggcgucaccauga

SEQ ID NO: 331440 - RNA, 19 nt, Homo sapiens
uuagguggccuuauaaaua

SEQ ID NO: 331441 - RNA, 19 nt, Homo sapiens
ggagugcaguggcgcaauu

SEQ ID NO: 331442 - RNA, 19 nt, Homo sapiens
uggaacauguuucuuauga

SEQ ID NO: 331443 - RNA, 19 nt, Homo sapiens
uagguggccuuauaaauau

SEQ ID NO: 331444 - RNA, 19 nt, Homo sapiens
cagccaugcucauuuguuu

SEQ ID NO: 331445 - RNA, 19 nt, Homo sapiens
cgugaaauguuuggauaua

SEQ ID NO: 331446 - RNA, 19 nt, Homo sapiens
aaucuuauguugccaaguu

SEQ ID NO: 331447 - RNA, 19 nt, Homo sapiens
gcucauuuguuuacauguu

SEQ ID NO: 331448 - RNA, 19 nt, Homo sapiens
acacagccaugcucauuug

SEQ ID NO: 331449 - RNA, 19 nt, Homo sapiens
ugauggaacauguuucuua

SEQ ID NO: 331450 - RNA, 19 nt, Homo sapiens
gaaacggcgucaccaugau

SEQ ID NO: 331451 - RNA, 19 nt, Homo sapiens
uuucugagcugucuauaau

SEQ ID NO: 331452 - RNA, 19 nt, Homo sapiens
ugaauuugauggaacaugu

SEQ ID NO: 331453 - RNA, 19 nt, Homo sapiens
gcaaucccagcuacucaua

SEQ ID NO: 331454 - RNA, 19 nt, Homo sapiens
ucugagcugucuauaauga

SEQ ID NO: 331455 - RNA, 19 nt, Homo sapiens
cgacugccaugcugcaaga

SEQ ID NO: 331456 - RNA, 19 nt, Homo sapiens
ggagcuuggugcaauuaga

SEQ ID NO: 331457 - RNA, 19 nt, Homo sapiens
gugaaacacugucucuaca

SEQ ID NO: 331458 - RNA, 19 nt, Homo sapiens
gcggaacccagaacccuua

SEQ ID NO: 331459 - RNA, 19 nt, Homo sapiens
gcaagagcagaauugagua

SEQ ID NO: 331460 - RNA, 19 nt, Homo sapiens
guacucugacucuuuauug

SEQ ID NO: 331461 - RNA, 19 nt, Homo sapiens
uuaugacaguugaagcuua

SEQ ID NO: 331462 - RNA, 19 nt, Homo sapiens
cugugacucuugccaaaua

SEQ ID NO: 331463 - RNA, 19 nt, Homo sapiens
gauaccugcuguuucugaa

SEQ ID NO: 331464 - RNA, 19 nt, Homo sapiens
gaggugggaggaucuauug

SEQ ID NO: 331465 - RNA, 19 nt, Homo sapiens
ggccugcaaagccuaauua

SEQ ID NO: 331466 - RNA, 19 nt, Homo sapiens
gcgcagaggaggaggagaa

SEQ ID NO: 331467 - RNA, 19 nt, Homo sapiens
gagcuuggugcaauuagaa

SEQ ID NO: 331468 - RNA, 19 nt, Homo sapiens
uaugacaguugaagcuuau

SEQ ID NO: 331469 - RNA, 19 nt, Homo sapiens
cgccagcuucuauauauua

SEQ ID NO: 331470 - RNA, 19 nt, Homo sapiens
guuuagaguuagcagacua

SEQ ID NO: 331471 - RNA, 19 nt, Homo sapiens
ucacugauaccugcuguuu

SEQ ID NO: 331472 - RNA, 19 nt, Homo sapiens
aaacacugucucuacauaa

SEQ ID NO: 331473 - RNA, 19 nt, Homo sapiens
agaaggugguuucgaagga

SEQ ID NO: 331474 - RNA, 19 nt, Homo sapiens
uaccugcuguuucugaauu

SEQ ID NO: 331475 - RNA, 19 nt, Homo sapiens
ccacgacgcccagcugauu

SEQ ID NO: 331476 - RNA, 19 nt, Homo sapiens
cagccugggugacaaagga

SEQ ID NO: 331477 - RNA, 19 nt, Homo sapiens
gcaaagccuaauuaauaug

SEQ ID NO: 331478 - RNA, 19 nt, Homo sapiens
aaacugaaauuagguugag

SEQ ID NO: 331479 - RNA, 19 nt, Homo sapiens
aacacugucucuacauaaa

SEQ ID NO: 331480 - RNA, 19 nt, Homo sapiens
gcaaaagacuguaccuaac

SEQ ID NO: 331481 - RNA, 19 nt, Homo sapiens
aaaaguacuugucccaaaa

SEQ ID NO: 331482 - RNA, 19 nt, Homo sapiens
caaaggagaccccgucaaa

SEQ ID NO: 331483 - RNA, 19 nt, Homo sapiens
guuuacauguuguuuaugg

SEQ ID NO: 331484 - RNA, 19 nt, Homo sapiens
aauauaagcagaugguuuc

SEQ ID NO: 331485 - RNA, 19 nt, Homo sapiens
gacuguaccuaacuggaau

SEQ ID NO: 331486 - RNA, 19 nt, Homo sapiens
ugagcugucuauaaugaau

SEQ ID NO: 331487 - RNA, 19 nt, Homo sapiens
uaaaucauacagucagguu

SEQ ID NO: 331488 - RNA, 19 nt, Homo sapiens
cuacugcuccggccugauu

SEQ ID NO: 331489 - RNA, 19 nt, Homo sapiens
agagcagaauugaguaguu

SEQ ID NO: 331490 - RNA, 19 nt, Homo sapiens
aagcuuaugcuaaucugua

SEQ ID NO: 331491 - RNA, 19 nt, Homo sapiens
caucgccagcuucuauaua

SEQ ID NO: 331492 - RNA, 19 nt, Homo sapiens
uggccaagauggucucaau

SEQ ID NO: 331493 - RNA, 19 nt, Homo sapiens
gcucuuagguggguuaucc

SEQ ID NO: 331494 - RNA, 19 nt, Homo sapiens
acugauaccugcuguuucu

SEQ ID NO: 331495 - RNA, 19 nt, Homo sapiens
caaaaugcuugcuccaguu

SEQ ID NO: 331496 - RNA, 19 nt, Homo sapiens
aaauuagguggccuuauaa

SEQ ID NO: 331497 - RNA, 19 nt, Homo sapiens
caacauggugaaacacugu

SEQ ID NO: 331498 - RNA, 19 nt, Homo sapiens
acagucagguuuguauuuc

SEQ ID NO: 331499 - RNA, 19 nt, Homo sapiens
aguugaagcuuaugcuaau

SEQ ID NO: 331500 - RNA, 19 nt, Homo sapiens
ggugaaacacugucucuac

SEQ ID NO: 331501 - RNA, 19 nt, Homo sapiens
ggaggauucugugacucuu

SEQ ID NO: 331502 - RNA, 19 nt, Homo sapiens
caucagagaauggucaguu

SEQ ID NO: 331503 - RNA, 19 nt, Homo sapiens
uaaaauacguaccaugagu

SEQ ID NO: 331504 - RNA, 19 nt, Homo sapiens
accgugaaauguuuggaua

SEQ ID NO: 331505 - RNA, 19 nt, Homo sapiens
ugagggaccgugaaauguu

SEQ ID NO: 331506 - RNA, 19 nt, Homo sapiens
agagugagccagauuaugg

SEQ ID NO: 331507 - RNA, 19 nt, Homo sapiens
caguugaagcuuaugcuaa

SEQ ID NO: 331508 - RNA, 19 nt, Homo sapiens
gaauuugauggaacauguu

SEQ ID NO: 331509 - RNA, 19 nt, Homo sapiens
uguaaucccagcacuuuga

SEQ ID NO: 331510 - RNA, 19 nt, Homo sapiens
ggacucaggagcuaauacu

SEQ ID NO: 331511 - RNA, 19 nt, Homo sapiens
cuguagguauuaagucauu

SEQ ID NO: 331512 - RNA, 19 nt, Homo sapiens
auauguagcccuuucagaa

SEQ ID NO: 331513 - RNA, 19 nt, Homo sapiens
ugagguugaauucuaguuu

SEQ ID NO: 331514 - RNA, 19 nt, Homo sapiens
cgugaagacuaccuguaug

SEQ ID NO: 331515 - RNA, 19 nt, Homo sapiens
ccuguaaucccagcacuuu

SEQ ID NO: 331516 - RNA, 19 nt, Homo sapiens
caguggagcuuggugcaau

SEQ ID NO: 331517 - RNA, 19 nt, Homo sapiens
gguggguuauccuggagaa

SEQ ID NO: 331518 - RNA, 19 nt, Homo sapiens
gccagauuauggaggauuc

SEQ ID NO: 331519 - RNA, 19 nt, Homo sapiens
guuagcagacuacccaaau

SEQ ID NO: 331520 - RNA, 19 nt, Homo sapiens
aauaguucaucaucagaga

SEQ ID NO: 331521 - RNA, 19 nt, Homo sapiens
ggaacauguuucuuaugac

SEQ ID NO: 331522 - RNA, 19 nt, Homo sapiens
cgaaagagcuggcugcaua

SEQ ID NO: 331523 - RNA, 19 nt, Homo sapiens
gaaugacucuuccauauga

SEQ ID NO: 331524 - RNA, 19 nt, Homo sapiens
ccaaaggauuguuucauua

SEQ ID NO: 331525 - RNA, 19 nt, Homo sapiens
gaaguaauauugugguuag

SEQ ID NO: 331526 - RNA, 19 nt, Homo sapiens
gcaaagauguggcagcaau

SEQ ID NO: 331527 - RNA, 19 nt, Homo sapiens
ggaccucacuuacacauau

SEQ ID NO: 331528 - RNA, 19 nt, Homo sapiens
cuacauaugucaacacuga

SEQ ID NO: 331529 - RNA, 19 nt, Homo sapiens
caugaaagguugucuguug

SEQ ID NO: 331530 - RNA, 19 nt, Homo sapiens
guagugcagugauccuuua

SEQ ID NO: 331531 - RNA, 19 nt, Homo sapiens
gccaaaggauuguuucauu

SEQ ID NO: 331532 - RNA, 19 nt, Homo sapiens
ucccauagcugauguuauu

SEQ ID NO: 331533 - RNA, 19 nt, Homo sapiens
gaagcaauauguuaaggau

SEQ ID NO: 331534 - RNA, 19 nt, Homo sapiens
gaacauugggccauuggua

SEQ ID NO: 331535 - RNA, 19 nt, Homo sapiens
guaaugaaggguuggaaua

SEQ ID NO: 331536 - RNA, 19 nt, Homo sapiens
gcagauaauuaauggacaa

SEQ ID NO: 331537 - RNA, 19 nt, Homo sapiens
cacaagaacuggagaagug

SEQ ID NO: 331538 - RNA, 19 nt, Homo sapiens
gcacauacauugaaaagau

SEQ ID NO: 331539 - RNA, 19 nt, Homo sapiens
agagaagacuggaaaauua

SEQ ID NO: 331540 - RNA, 19 nt, Homo sapiens
agagaagucugcuacauau

SEQ ID NO: 331541 - RNA, 19 nt, Homo sapiens
cagauuugcguuccaauua

SEQ ID NO: 331542 - RNA, 19 nt, Homo sapiens
ggaugugccuuguugaaau

SEQ ID NO: 331543 - RNA, 19 nt, Homo sapiens
ggaagaggcagauguuguu

SEQ ID NO: 331544 - RNA, 19 nt, Homo sapiens
gacaagauguauacagugu

SEQ ID NO: 331545 - RNA, 19 nt, Homo sapiens
gaugugccuuguugaaauu

SEQ ID NO: 331546 - RNA, 19 nt, Homo sapiens
guaaagaccaucaugacaa

SEQ ID NO: 331547 - RNA, 19 nt, Homo sapiens
gcacagauuugcguuccaa

SEQ ID NO: 331548 - RNA, 19 nt, Homo sapiens
guuggaauauccuaacaaa

SEQ ID NO: 331549 - RNA, 19 nt, Homo sapiens
gcuggaaacugcaggaugu

SEQ ID NO: 331550 - RNA, 19 nt, Homo sapiens
gauaauuaauggacaacug

SEQ ID NO: 331551 - RNA, 19 nt, Homo sapiens
agagcuggcugcauaauga

SEQ ID NO: 331552 - RNA, 19 nt, Homo sapiens
ggagaagugaugaggauuu

SEQ ID NO: 331553 - RNA, 19 nt, Homo sapiens
gacagaauccauugaugua

SEQ ID NO: 331554 - RNA, 19 nt, Homo sapiens
gcaugcagaucccucgauu

SEQ ID NO: 331555 - RNA, 19 nt, Homo sapiens
gcagauggagguuguauca

SEQ ID NO: 331556 - RNA, 19 nt, Homo sapiens
gggagaagcaauauguuaa

SEQ ID NO: 331557 - RNA, 19 nt, Homo sapiens
caaguuggcacauacauug

SEQ ID NO: 331558 - RNA, 19 nt, Homo sapiens
gggaaggugugauggaguu

SEQ ID NO: 331559 - RNA, 19 nt, Homo sapiens
guagagcucagcagacuaa

SEQ ID NO: 331560 - RNA, 19 nt, Homo sapiens
ggaagaacccucccaaggu

SEQ ID NO: 331561 - RNA, 19 nt, Homo sapiens
gaaagagcuggcugcauaa

SEQ ID NO: 331562 - RNA, 19 nt, Homo sapiens
ggaaguaauauugugguua

SEQ ID NO: 331563 - RNA, 19 nt, Homo sapiens
caagucaaguagcugcuuu

SEQ ID NO: 331564 - RNA, 19 nt, Homo sapiens
ccugguagcucucaaagau

SEQ ID NO: 331565 - RNA, 19 nt, Homo sapiens
cagaggaaaugauaugcaa

SEQ ID NO: 331566 - RNA, 19 nt, Homo sapiens
cuccuaaucuuguucgaua

SEQ ID NO: 331567 - RNA, 19 nt, Homo sapiens
gcuggaauguugcagaguu

SEQ ID NO: 331568 - RNA, 19 nt, Homo sapiens
gaaacaagaaagacagaau

SEQ ID NO: 331569 - RNA, 19 nt, Homo sapiens
ggaaaugauaugcaaguug

SEQ ID NO: 331570 - RNA, 19 nt, Homo sapiens
gaaagacagaauccauuga

SEQ ID NO: 331571 - RNA, 19 nt, Homo sapiens
uaaagaccaucaugacaag

SEQ ID NO: 331572 - RNA, 19 nt, Homo sapiens
ccaauggucagaaaugaaa

SEQ ID NO: 331573 - RNA, 19 nt, Homo sapiens
aaaccagauuugccuauga

SEQ ID NO: 331574 - RNA, 19 nt, Homo sapiens
cagaauccauugauguaau

SEQ ID NO: 331575 - RNA, 19 nt, Homo sapiens
ugugauggaguucuuauua

SEQ ID NO: 331576 - RNA, 19 nt, Homo sapiens
ggaauauccuaacaaacuc

SEQ ID NO: 331577 - RNA, 19 nt, Homo sapiens
gcagcuguuucuagcauug

SEQ ID NO: 331578 - RNA, 19 nt, Homo sapiens
ugguagcucucaaagauuu

SEQ ID NO: 331579 - RNA, 19 nt, Homo sapiens
gcaucagguuugcaaguga

SEQ ID NO: 331580 - RNA, 19 nt, Homo sapiens
gaaaugauaggagccgauu

SEQ ID NO: 331581 - RNA, 19 nt, Homo sapiens
uacaauugcugguguggaa

SEQ ID NO: 331582 - RNA, 19 nt, Homo sapiens
gaagucugcuacauauguc

SEQ ID NO: 331583 - RNA, 19 nt, Homo sapiens
gcaaguuggcacauacauu

SEQ ID NO: 331584 - RNA, 19 nt, Homo sapiens
caagaacauugggccauug

SEQ ID NO: 331585 - RNA, 19 nt, Homo sapiens
guagaggaaccauccauau

SEQ ID NO: 331586 - RNA, 19 nt, Homo sapiens
uagcagagccucacagaca

SEQ ID NO: 331587 - RNA, 19 nt, Homo sapiens
ucucaaagcuagugaacca

SEQ ID NO: 331588 - RNA, 19 nt, Homo sapiens
gaacaacaggcagaggaaa

SEQ ID NO: 331589 - RNA, 19 nt, Homo sapiens
ccagggaggugaaugugau

SEQ ID NO: 331590 - RNA, 19 nt, Homo sapiens
gggagcagauggagguugu

SEQ ID NO: 331591 - RNA, 19 nt, Homo sapiens
aguggacucugacaccuua

SEQ ID NO: 331592 - RNA, 19 nt, Homo sapiens
ucuaagcccuaugccuuua

SEQ ID NO: 331593 - RNA, 19 nt, Homo sapiens
gcugaagcuucuacuagga

SEQ ID NO: 331594 - RNA, 19 nt, Homo sapiens
gaaaugauggagcagcaau

SEQ ID NO: 331595 - RNA, 19 nt, Homo sapiens
ccuccaagcuugugagaag

SEQ ID NO: 331596 - RNA, 19 nt, Homo sapiens
ccuaaaggauguguucgaa

SEQ ID NO: 331597 - RNA, 19 nt, Homo sapiens
cccaggagcugcuuacaca

SEQ ID NO: 331598 - RNA, 19 nt, Homo sapiens
gugauggaguucuuauuag

SEQ ID NO: 331599 - RNA, 19 nt, Homo sapiens
ggcaagagaagacuggaaa

SEQ ID NO: 331600 - RNA, 19 nt, Homo sapiens
ggaaaguuaugaauauccu

SEQ ID NO: 331601 - RNA, 19 nt, Homo sapiens
caagaaagacagaauccau

SEQ ID NO: 331602 - RNA, 19 nt, Homo sapiens
guagaugauuugggaacaa

SEQ ID NO: 331603 - RNA, 19 nt, Homo sapiens
ggccaaaugugucaaagcu

SEQ ID NO: 331604 - RNA, 19 nt, Homo sapiens
cacagacaauggccaaaug

SEQ ID NO: 331605 - RNA, 19 nt, Homo sapiens
ugaaguauuuguugauggu

SEQ ID NO: 331606 - RNA, 19 nt, Homo sapiens
gcacaaaagauucggauga

SEQ ID NO: 331607 - RNA, 19 nt, Homo sapiens
gcgguuggaaguaauauug

SEQ ID NO: 331608 - RNA, 19 nt, Homo sapiens
ggaacaacaggcagaggaa

SEQ ID NO: 331609 - RNA, 19 nt, Homo sapiens
acaagaacauugggccauu

SEQ ID NO: 331610 - RNA, 19 nt, Homo sapiens
ugagauugcuggaaugacu

SEQ ID NO: 331611 - RNA, 19 nt, Homo sapiens
gagaagcaauauguuaagg

SEQ ID NO: 331612 - RNA, 19 nt, Homo sapiens
gauuugcguuccaauuauc

SEQ ID NO: 331613 - RNA, 19 nt, Homo sapiens
gagcucagcagacuaaggu

SEQ ID NO: 331614 - RNA, 19 nt, Homo sapiens
gcagacaguuuagcagaac

SEQ ID NO: 331615 - RNA, 19 nt, Homo sapiens
ucgauucuguuaucaugaa

SEQ ID NO: 331616 - RNA, 19 nt, Homo sapiens
gagccaauggucagaaaug

SEQ ID NO: 331617 - RNA, 19 nt, Homo sapiens
gcuaaaacgucaaagacuu

SEQ ID NO: 331618 - RNA, 19 nt, Homo sapiens
gagaagugaugaggauuuu

SEQ ID NO: 331619 - RNA, 19 nt, Homo sapiens
uggaugcgguuggaaguaa

SEQ ID NO: 331620 - RNA, 19 nt, Homo sapiens
ccucgauucuguuaucaug

SEQ ID NO: 331621 - RNA, 19 nt, Homo sapiens
agauggagguuguaucaca

SEQ ID NO: 331622 - RNA, 19 nt, Homo sapiens
gagaauuccugcucuuaua

SEQ ID NO: 331623 - RNA, 19 nt, Homo sapiens
gaacaggccuauucucuag

SEQ ID NO: 331624 - RNA, 19 nt, Homo sapiens
gaaauuggccucugugugu

SEQ ID NO: 331625 - RNA, 19 nt, Homo sapiens
gggagaagauguuugaguu

SEQ ID NO: 331626 - RNA, 19 nt, Homo sapiens
gaaacgcccucaguaaaga

SEQ ID NO: 331627 - RNA, 19 nt, Homo sapiens
gaacauuacccugaacuuu

SEQ ID NO: 331628 - RNA, 19 nt, Homo sapiens
gcacuuaacuaugguuuua

SEQ ID NO: 331629 - RNA, 19 nt, Homo sapiens
ugagugagcugccugagaa

SEQ ID NO: 331630 - RNA, 19 nt, Homo sapiens
gaaaucacacguuuguuga

SEQ ID NO: 331631 - RNA, 19 nt, Homo sapiens
ggaugacauuuaucaguuu

SEQ ID NO: 331632 - RNA, 19 nt, Homo sapiens
gaucaaggcuccugguuuu

SEQ ID NO: 331633 - RNA, 19 nt, Homo sapiens
ccacauauacugccauuga

SEQ ID NO: 331634 - RNA, 19 nt, Homo sapiens
gcuuauggaugacauuuau

SEQ ID NO: 331635 - RNA, 19 nt, Homo sapiens
ggagaaaucacacguuugu

SEQ ID NO: 331636 - RNA, 19 nt, Homo sapiens
caucauagguacccaagau

SEQ ID NO: 331637 - RNA, 19 nt, Homo sapiens
ggacacauguuggcagaug

SEQ ID NO: 331638 - RNA, 19 nt, Homo sapiens
ggaagacccagcccuauga

SEQ ID NO: 331639 - RNA, 19 nt, Homo sapiens
gaagaaagggagaagaugu

SEQ ID NO: 331640 - RNA, 19 nt, Homo sapiens
gaagaagcacuuaacuaug

SEQ ID NO: 331641 - RNA, 19 nt, Homo sapiens
ugaagaacauuacccugaa

SEQ ID NO: 331642 - RNA, 19 nt, Homo sapiens
ggaaugggcacagcaguuu

SEQ ID NO: 331643 - RNA, 19 nt, Homo sapiens
ggguguaccuggugucuga

SEQ ID NO: 331644 - RNA, 19 nt, Homo sapiens
caaagugucuccaccuaag

SEQ ID NO: 331645 - RNA, 19 nt, Homo sapiens
caagguugaugaugccaaa

SEQ ID NO: 331646 - RNA, 19 nt, Homo sapiens
agaagaagcacuuaacuau

SEQ ID NO: 331647 - RNA, 19 nt, Homo sapiens
gaaugcaugcugcuuauau

SEQ ID NO: 331648 - RNA, 19 nt, Homo sapiens
aauaggaucuggcgaaauc

SEQ ID NO: 331649 - RNA, 19 nt, Homo sapiens
ggaguccgauugccgauuc

SEQ ID NO: 331650 - RNA, 19 nt, Homo sapiens
aagaagcacuuaacuaugg

SEQ ID NO: 331651 - RNA, 19 nt, Homo sapiens
ggaaacgcccucaguaaag

SEQ ID NO: 331652 - RNA, 19 nt, Homo sapiens
guggagaaguugcuaaaca

SEQ ID NO: 331653 - RNA, 19 nt, Homo sapiens
gccaaagugucuccaccua

SEQ ID NO: 331654 - RNA, 19 nt, Homo sapiens
gcacagugucuaaacaaga

SEQ ID NO: 331655 - RNA, 19 nt, Homo sapiens
gaagauguuugaguucuac

SEQ ID NO: 331656 - RNA, 19 nt, Homo sapiens
cagaagaagcacuuaacua

SEQ ID NO: 331657 - RNA, 19 nt, Homo sapiens
uggaugacauuuaucaguu

SEQ ID NO: 331658 - RNA, 19 nt, Homo sapiens
ggagaauuccugcucuuau

SEQ ID NO: 331659 - RNA, 19 nt, Homo sapiens
guaacgaacaggccuauuc

SEQ ID NO: 331660 - RNA, 19 nt, Homo sapiens
cggcuucacugugcgaaua

SEQ ID NO: 331661 - RNA, 19 nt, Homo sapiens
gaagcucauugaauacaag

SEQ ID NO: 331662 - RNA, 19 nt, Homo sapiens
aaagggagaagauguuuga

SEQ ID NO: 331663 - RNA, 19 nt, Homo sapiens
agaaaucacacguuuguug

SEQ ID NO: 331664 - RNA, 19 nt, Homo sapiens
gauauuguauuuggagaag

SEQ ID NO: 331665 - RNA, 19 nt, Homo sapiens
gcucuuauagucuaaccua

SEQ ID NO: 331666 - RNA, 19 nt, Homo sapiens
gaagaacauuacccugaac

SEQ ID NO: 331667 - RNA, 19 nt, Homo sapiens
gggagaauuccugcucuua

SEQ ID NO: 331668 - RNA, 19 nt, Homo sapiens
cgcggucacuguuaucuaa

SEQ ID NO: 331669 - RNA, 19 nt, Homo sapiens
ggcgaaaucggacaauuga

SEQ ID NO: 331670 - RNA, 19 nt, Homo sapiens
gaaagggagaagauguuug

SEQ ID NO: 331671 - RNA, 19 nt, Homo sapiens
cgaacaggccuauucucua

SEQ ID NO: 331672 - RNA, 19 nt, Homo sapiens
ggacccggauguugucagu

SEQ ID NO: 331673 - RNA, 19 nt, Homo sapiens
cgccagucccugagaauua

SEQ ID NO: 331674 - RNA, 19 nt, Homo sapiens
cgaggggacugcuaugaua

SEQ ID NO: 331675 - RNA, 19 nt, Homo sapiens
uuggagaaaucacacguuu

SEQ ID NO: 331676 - RNA, 19 nt, Homo sapiens
gccagucccugagaauuau

SEQ ID NO: 331677 - RNA, 19 nt, Homo sapiens
acaauaggaucuggcgaaa

SEQ ID NO: 331678 - RNA, 19 nt, Homo sapiens
ccgaaugcaugcugcuuau

SEQ ID NO: 331679 - RNA, 19 nt, Homo sapiens
ggugagaagccaagaagga

SEQ ID NO: 331680 - RNA, 19 nt, Homo sapiens
guugucaguucgacgguaa

SEQ ID NO: 331681 - RNA, 19 nt, Homo sapiens
ccaaagugucuccaccuaa

SEQ ID NO: 331682 - RNA, 19 nt, Homo sapiens
cgagugcuguuuggagaaa

SEQ ID NO: 331683 - RNA, 19 nt, Homo sapiens
gacuauguguccaugaugu

SEQ ID NO: 331684 - RNA, 19 nt, Homo sapiens
cgaaaucggacaauugaca

SEQ ID NO: 331685 - RNA, 19 nt, Homo sapiens
ccuuaucgaugcaagauca

SEQ ID NO: 331686 - RNA, 19 nt, Homo sapiens
cacagugucuaaacaagau

SEQ ID NO: 331687 - RNA, 19 nt, Homo sapiens
gcagccagauguggaaugg

SEQ ID NO: 331688 - RNA, 19 nt, Homo sapiens
uaaacgacccugccagcuu

SEQ ID NO: 331689 - RNA, 19 nt, Homo sapiens
gguuguaacagcagaagaa

SEQ ID NO: 331690 - RNA, 19 nt, Homo sapiens
gaaaucggacaauugacau

SEQ ID NO: 331691 - RNA, 19 nt, Homo sapiens
ggagaagauguuugaguuc

SEQ ID NO: 331692 - RNA, 19 nt, Homo sapiens
caggagaggcagagaguga

SEQ ID NO: 331693 - RNA, 19 nt, Homo sapiens
cauagguacccaagauauu

SEQ ID NO: 331694 - RNA, 19 nt, Homo sapiens
ugaguuugauguuccuguu

SEQ ID NO: 331695 - RNA, 19 nt, Homo sapiens
gcuguuauguacccaagca

SEQ ID NO: 331696 - RNA, 19 nt, Homo sapiens
cagcagaagaagcacuuaa

SEQ ID NO: 331697 - RNA, 19 nt, Homo sapiens
uggagaaguugcuaaacau

SEQ ID NO: 331698 - RNA, 19 nt, Homo sapiens
ucacaggacccggauguug

SEQ ID NO: 331699 - RNA, 19 nt, Homo sapiens
cccuugggcuuauggauga

SEQ ID NO: 331700 - RNA, 19 nt, Homo sapiens
ucaggcccuuccauacuuu

SEQ ID NO: 331701 - RNA, 19 nt, Homo sapiens
gagaagcucauugaauaca

SEQ ID NO: 331702 - RNA, 19 nt, Homo sapiens
aggaaacgcccucaguaaa

SEQ ID NO: 331703 - RNA, 19 nt, Homo sapiens
gcagaagaagcacuuaacu

SEQ ID NO: 331704 - RNA, 19 nt, Homo sapiens
uagacuauguguccaugau

SEQ ID NO: 331705 - RNA, 19 nt, Homo sapiens
uugaugaguuggaggaguu

SEQ ID NO: 331706 - RNA, 19 nt, Homo sapiens
acugagggcuaccaaguuc

SEQ ID NO: 331707 - RNA, 19 nt, Homo sapiens
gguugaugaugccaaagug

SEQ ID NO: 331708 - RNA, 19 nt, Homo sapiens
uggaggaguugcugaccaa

SEQ ID NO: 331709 - RNA, 19 nt, Homo sapiens
gcaccgaggcacugagaag

SEQ ID NO: 331710 - RNA, 19 nt, Homo sapiens
acgaccagguugaguuuga

SEQ ID NO: 331711 - RNA, 19 nt, Homo sapiens
ggagaaguugcuaaacauc

SEQ ID NO: 331712 - RNA, 19 nt, Homo sapiens
aacauuacccugaacuuug

SEQ ID NO: 331713 - RNA, 19 nt, Homo sapiens
guacccaagauauuguauu

SEQ ID NO: 331714 - RNA, 19 nt, Homo sapiens
cauguuggcagaugucguu

SEQ ID NO: 331715 - RNA, 19 nt, Homo sapiens
uaacgaacaggccuauucu

SEQ ID NO: 331716 - RNA, 19 nt, Homo sapiens
agaagcucauugaauacaa

SEQ ID NO: 331717 - RNA, 19 nt, Homo sapiens
ucauagguacccaagauau

SEQ ID NO: 331718 - RNA, 19 nt, Homo sapiens
uaccauggcuucucuuuuc

SEQ ID NO: 331719 - RNA, 19 nt, Homo sapiens
gagaauuaucgcacagugu

SEQ ID NO: 331720 - RNA, 19 nt, Homo sapiens
gacccagcccuaugauguu

SEQ ID NO: 331721 - RNA, 19 nt, Homo sapiens
uaucuaaacgcaagugaag

SEQ ID NO: 331722 - RNA, 19 nt, Homo sapiens
gaaggauccugacagauua

SEQ ID NO: 331723 - RNA, 19 nt, Homo sapiens
guauguggcugaaaucuug

SEQ ID NO: 331724 - RNA, 19 nt, Homo sapiens
gcagccaacugguaugaaa

SEQ ID NO: 331725 - RNA, 19 nt, Homo sapiens
uaagaaggauccugacaga

SEQ ID NO: 331726 - RNA, 19 nt, Homo sapiens
gagaguauguggcugaaau

SEQ ID NO: 331727 - RNA, 19 nt, Homo sapiens
uaaccacccugaucuaaga

SEQ ID NO: 331728 - RNA, 19 nt, Homo sapiens
gacagcgccuuaucuauga

SEQ ID NO: 331729 - RNA, 19 nt, Homo sapiens
gugaagaccuacacagaug

SEQ ID NO: 331730 - RNA, 19 nt, Homo sapiens
ccaaguauguccaacaagu

SEQ ID NO: 331731 - RNA, 19 nt, Homo sapiens
gauccuagacagcgccuua

SEQ ID NO: 331732 - RNA, 19 nt, Homo sapiens
gaguguccguguaaauaaa

SEQ ID NO: 331733 - RNA, 19 nt, Homo sapiens
agaaggauccugacagauu

SEQ ID NO: 331734 - RNA, 19 nt, Homo sapiens
caagaguuccgcaaauuug

SEQ ID NO: 331735 - RNA, 19 nt, Homo sapiens
gcccaaguauguccaacaa

SEQ ID NO: 331736 - RNA, 19 nt, Homo sapiens
ccaagaguuccgcaaauuu

SEQ ID NO: 331737 - RNA, 19 nt, Homo sapiens
ugaguuacguuaugaugau

SEQ ID NO: 331738 - RNA, 19 nt, Homo sapiens
ucacaccaaugcacaguuc

SEQ ID NO: 331739 - RNA, 19 nt, Homo sapiens
agacagcgccuuaucuaug

SEQ ID NO: 331740 - RNA, 19 nt, Homo sapiens
cccaagaguuccgcaaauu

SEQ ID NO: 331741 - RNA, 19 nt, Homo sapiens
gcccaagaguuccgcaaau

SEQ ID NO: 331742 - RNA, 19 nt, Homo sapiens
gcuaaccacccugaucuaa

SEQ ID NO: 331743 - RNA, 19 nt, Homo sapiens
gaagccugaugccaaguag

SEQ ID NO: 331744 - RNA, 19 nt, Homo sapiens
ccucagggaucacaccaau

SEQ ID NO: 331745 - RNA, 19 nt, Homo sapiens
uggcagagccgguggaguu

SEQ ID NO: 331746 - RNA, 19 nt, Homo sapiens
caaggcagccaacugguau

SEQ ID NO: 331747 - RNA, 19 nt, Homo sapiens
ccaaugcacaguucaaauc

SEQ ID NO: 331748 - RNA, 19 nt, Homo sapiens
ugaguguccguguaaauaa

SEQ ID NO: 331749 - RNA, 19 nt, Homo sapiens
uauguugaguuacguuaug

SEQ ID NO: 331750 - RNA, 19 nt, Homo sapiens
ucaaggcagccaacuggua

SEQ ID NO: 331751 - RNA, 19 nt, Homo sapiens
caaguauguccaacaaguu

SEQ ID NO: 331752 - RNA, 19 nt, Homo sapiens
gcuauguugaguuacguua

SEQ ID NO: 331753 - RNA, 19 nt, Homo sapiens
gagcugacgcccauugagu

SEQ ID NO: 331754 - RNA, 19 nt, Homo sapiens
gaugagcugacgcccauug

SEQ ID NO: 331755 - RNA, 19 nt, Homo sapiens
ggauccgugugaagaccua

SEQ ID NO: 331756 - RNA, 19 nt, Homo sapiens
ccguguaaauaaauuccua

SEQ ID NO: 331757 - RNA, 19 nt, Homo sapiens
uuuggagucuucuuugcua

SEQ ID NO: 331758 - RNA, 19 nt, Homo sapiens
ugacuuuccucagggauca

SEQ ID NO: 331759 - RNA, 19 nt, Homo sapiens
gauugaguguccguguaaa

SEQ ID NO: 331760 - RNA, 19 nt, Homo sapiens
ugauugaguguccguguaa

SEQ ID NO: 331761 - RNA, 19 nt, Homo sapiens
ggagacaagaagccugaug

SEQ ID NO: 331762 - RNA, 19 nt, Homo sapiens
ccgcaaauuugaccugaac

SEQ ID NO: 331763 - RNA, 19 nt, Homo sapiens
guuacguuaugaugaugaa

SEQ ID NO: 331764 - RNA, 19 nt, Homo sapiens
uugaguguccguguaaaua

SEQ ID NO: 331765 - RNA, 19 nt, Homo sapiens
guuaugaugaugaagugaa

SEQ ID NO: 331766 - RNA, 19 nt, Homo sapiens
cauugagucugcugucucu

SEQ ID NO: 331767 - RNA, 19 nt, Homo sapiens
ccagggaacgcauguggau

SEQ ID NO: 331768 - RNA, 19 nt, Homo sapiens
cauguuuggagucuucuuu

SEQ ID NO: 331769 - RNA, 19 nt, Homo sapiens
gcaaauuugaccugaacag

SEQ ID NO: 331770 - RNA, 19 nt, Homo sapiens
gaguuacguuaugaugaug

SEQ ID NO: 331771 - RNA, 19 nt, Homo sapiens
ucaucccagugcugacuuu

SEQ ID NO: 331772 - RNA, 19 nt, Homo sapiens
gcaguggacgucccaacuc

SEQ ID NO: 331773 - RNA, 19 nt, Homo sapiens
gcgacccuccguucuguug

SEQ ID NO: 331774 - RNA, 19 nt, Homo sapiens
gaagaccuacacagaugag

SEQ ID NO: 331775 - RNA, 19 nt, Homo sapiens
ugaagaccuacacagauga

SEQ ID NO: 331776 - RNA, 19 nt, Homo sapiens
agaagccugaugccaagua

SEQ ID NO: 331777 - RNA, 19 nt, Homo sapiens
ugaguuagaggucuguauc

SEQ ID NO: 331778 - RNA, 19 nt, Homo sapiens
gguaugaaagggagaucug

SEQ ID NO: 331779 - RNA, 19 nt, Homo sapiens
guccugcuucaaugaguua

SEQ ID NO: 331780 - RNA, 19 nt, Homo sapiens
ucagggaucacaccaaugc

SEQ ID NO: 331781 - RNA, 19 nt, Homo sapiens
augauugaguguccgugua

SEQ ID NO: 331782 - RNA, 19 nt, Homo sapiens
ggcccaagaguuccgcaaa

SEQ ID NO: 331783 - RNA, 19 nt, Homo sapiens
ucagaccacggaaugaugu

SEQ ID NO: 331784 - RNA, 19 nt, Homo sapiens
caccaaugcacaguucaaa

SEQ ID NO: 331785 - RNA, 19 nt, Homo sapiens
ugaaagaacugauugagaa

SEQ ID NO: 331786 - RNA, 19 nt, Homo sapiens
guggaaugcuggacaauaa

SEQ ID NO: 331787 - RNA, 19 nt, Homo sapiens
ccaaguaucugguggugaa

SEQ ID NO: 331788 - RNA, 19 nt, Homo sapiens
aaguggagcuucaugaaua

SEQ ID NO: 331789 - RNA, 19 nt, Homo sapiens
gauagaaggccauacgauu

SEQ ID NO: 331790 - RNA, 19 nt, Homo sapiens
gcugaaagguucccugagu

SEQ ID NO: 331791 - RNA, 19 nt, Homo sapiens
cgaggugacugguacaaga

SEQ ID NO: 331792 - RNA, 19 nt, Homo sapiens
caacucaggcaccaaacua

SEQ ID NO: 331793 - RNA, 19 nt, Homo sapiens
gcaaggaccgggagaucuu

SEQ ID NO: 331794 - RNA, 19 nt, Homo sapiens
acaaggugauggcacguuu

SEQ ID NO: 331795 - RNA, 19 nt, Homo sapiens
ggagaucagcaagcagaua

SEQ ID NO: 331796 - RNA, 19 nt, Homo sapiens
gguguggacuggaugaaca

SEQ ID NO: 331797 - RNA, 19 nt, Homo sapiens
cgagagcuguggccagugu

SEQ ID NO: 331798 - RNA, 19 nt, Homo sapiens
auagaaggccauacgauuu

SEQ ID NO: 331799 - RNA, 19 nt, Homo sapiens
ucauugaguucuauaagca

SEQ ID NO: 331800 - RNA, 19 nt, Homo sapiens
agacggugcugauggacuu

SEQ ID NO: 331801 - RNA, 19 nt, Homo sapiens
gaggggaauucuacaauga

SEQ ID NO: 331802 - RNA, 19 nt, Homo sapiens
gagaucagcaagcagauag

SEQ ID NO: 331803 - RNA, 19 nt, Homo sapiens
gaaggaugaagaccggauu

SEQ ID NO: 331804 - RNA, 19 nt, Homo sapiens
uagaaggccauacgauuug

SEQ ID NO: 331805 - RNA, 19 nt, Homo sapiens
gcggguaucugugcguuuc

SEQ ID NO: 331806 - RNA, 19 nt, Homo sapiens
gugagacggugcugaugga

SEQ ID NO: 331807 - RNA, 19 nt, Homo sapiens
gaaagaacugauugagaag

SEQ ID NO: 331808 - RNA, 19 nt, Homo sapiens
gaucagcaagcagauagaa

SEQ ID NO: 331809 - RNA, 19 nt, Homo sapiens
gaucaagacaucggguuug

SEQ ID NO: 331810 - RNA, 19 nt, Homo sapiens
acaaugaggccuccaaucu

SEQ ID NO: 331811 - RNA, 19 nt, Homo sapiens
caaggaccgggagaucuua

SEQ ID NO: 331812 - RNA, 19 nt, Homo sapiens
caaguggagcuucaugaau

SEQ ID NO: 331813 - RNA, 19 nt, Homo sapiens
caaccuccuugcugugauc

SEQ ID NO: 331814 - RNA, 19 nt, Homo sapiens
aguggagcuucaugaauaa

SEQ ID NO: 331815 - RNA, 19 nt, Homo sapiens
ucaaguggagcuucaugaa

SEQ ID NO: 331816 - RNA, 19 nt, Homo sapiens
ggaaugcuggacaauaaag

SEQ ID NO: 331817 - RNA, 19 nt, Homo sapiens
gagcggaugcagcgguuug

SEQ ID NO: 331818 - RNA, 19 nt, Homo sapiens
gcagauagaaggccauacg

SEQ ID NO: 331819 - RNA, 19 nt, Homo sapiens
cauguggaaugcuggacaa

SEQ ID NO: 331820 - RNA, 19 nt, Homo sapiens
cacgacagcacccaagaaa

SEQ ID NO: 331821 - RNA, 19 nt, Homo sapiens
gacaaccuccuugcuguga

SEQ ID NO: 331822 - RNA, 19 nt, Homo sapiens
ccguggagguaccugguuu

SEQ ID NO: 331823 - RNA, 19 nt, Homo sapiens
caaugaggccuccaaucug

SEQ ID NO: 331824 - RNA, 19 nt, Homo sapiens
cagauggcaggcccaagua

SEQ ID NO: 331825 - RNA, 19 nt, Homo sapiens
gacuggaggcugaaagguu

SEQ ID NO: 331826 - RNA, 19 nt, Homo sapiens
ggccucaaguggagcuuca

SEQ ID NO: 331827 - RNA, 19 nt, Homo sapiens
gcgcucaucgaguccauug

SEQ ID NO: 331828 - RNA, 19 nt, Homo sapiens
gcuuguggcucuggcuaug

SEQ ID NO: 331829 - RNA, 19 nt, Homo sapiens
gcacagcugcggugaucgu

SEQ ID NO: 331830 - RNA, 19 nt, Homo sapiens
ugucugugcccuugaaaga

SEQ ID NO: 331831 - RNA, 19 nt, Homo sapiens
uaccugguuugcuggcuuu

SEQ ID NO: 331832 - RNA, 19 nt, Homo sapiens
ggucugauuggcaagaaug

SEQ ID NO: 331833 - RNA, 19 nt, Homo sapiens
uuggcucgcugaaggauga

SEQ ID NO: 331834 - RNA, 19 nt, Homo sapiens
gugaggguguggacuggau

SEQ ID NO: 331835 - RNA, 19 nt, Homo sapiens
aagaacugauugagaagca

SEQ ID NO: 331836 - RNA, 19 nt, Homo sapiens
uggcagagaacgcaacuca

SEQ ID NO: 331837 - RNA, 19 nt, Homo sapiens
gguacaagacaaaggagau

SEQ ID NO: 331838 - RNA, 19 nt, Homo sapiens
cagcugcggugaucgucau

SEQ ID NO: 331839 - RNA, 19 nt, Homo sapiens
agaugucugugcccuugaa

SEQ ID NO: 331840 - RNA, 19 nt, Homo sapiens
cuaugaggcaggucugauu

SEQ ID NO: 331841 - RNA, 19 nt, Homo sapiens
ucagauggcaggcccaagu

SEQ ID NO: 331842 - RNA, 19 nt, Homo sapiens
ggugacugguacaagacaa

SEQ ID NO: 331843 - RNA, 19 nt, Homo sapiens
gcccuugaaagaacugauu

SEQ ID NO: 331844 - RNA, 19 nt, Homo sapiens
gcacuguggaggaggagau

SEQ ID NO: 331845 - RNA, 19 nt, Homo sapiens
cagccucagugcuaugaag

SEQ ID NO: 331846 - RNA, 19 nt, Homo sapiens
guacaagacaaaggagauc

SEQ ID NO: 331847 - RNA, 19 nt, Homo sapiens
gcuaugauuuugacguguu

SEQ ID NO: 331848 - RNA, 19 nt, Homo sapiens
gccaugauccucacaagcu

SEQ ID NO: 331849 - RNA, 19 nt, Homo sapiens
ggagaucuuacgccaugau

SEQ ID NO: 331850 - RNA, 19 nt, Homo sapiens
gauggcaggcccaaguauc

SEQ ID NO: 331851 - RNA, 19 nt, Homo sapiens
gcucgacggacaucgugaa

SEQ ID NO: 331852 - RNA, 19 nt, Homo sapiens
ugggcgagaucaagacauc

SEQ ID NO: 331853 - RNA, 19 nt, Homo sapiens
gagaggagacagcgcucau

SEQ ID NO: 331854 - RNA, 19 nt, Homo sapiens
uguggaaugcuggacaaua

SEQ ID NO: 331855 - RNA, 19 nt, Homo sapiens
uggacuggaugaacaaggu

SEQ ID NO: 331856 - RNA, 19 nt, Homo sapiens
guucuaaccuucaguacua

SEQ ID NO: 331857 - RNA, 19 nt, Homo sapiens
ggauggagcuaugacauug

SEQ ID NO: 331858 - RNA, 19 nt, Homo sapiens
ggaccagacucaagacaca

SEQ ID NO: 331859 - RNA, 19 nt, Homo sapiens
ggaguaaacaacacaaaga

SEQ ID NO: 331860 - RNA, 19 nt, Homo sapiens
ccuaauaaauuggaccuuu

SEQ ID NO: 331861 - RNA, 19 nt, Homo sapiens
agucagcuaugcaguauuu

SEQ ID NO: 331862 - RNA, 19 nt, Homo sapiens
caaaauagguuggcacuga

SEQ ID NO: 331863 - RNA, 19 nt, Homo sapiens
ggauaucacuacuuuaacu

SEQ ID NO: 331864 - RNA, 19 nt, Homo sapiens
acacacaacucauaacagu

SEQ ID NO: 331865 - RNA, 19 nt, Homo sapiens
aauggaagauggaguuuga

SEQ ID NO: 331866 - RNA, 19 nt, Homo sapiens
uaaagaagaugcaguuucc

SEQ ID NO: 331867 - RNA, 19 nt, Homo sapiens
gcugaucccuuauccaaca

SEQ ID NO: 331868 - RNA, 19 nt, Homo sapiens
uaaagucagcuaugcagua

SEQ ID NO: 331869 - RNA, 19 nt, Homo sapiens
caagacacacaacucauaa

SEQ ID NO: 331870 - RNA, 19 nt, Homo sapiens
ucaagacacacaacucaua

SEQ ID NO: 331871 - RNA, 19 nt, Homo sapiens
uaacaugcagucuggagua

SEQ ID NO: 331872 - RNA, 19 nt, Homo sapiens
cagcuaugcaguauuuaua

SEQ ID NO: 331873 - RNA, 19 nt, Homo sapiens
gaacaaaagaacaagagua

SEQ ID NO: 331874 - RNA, 19 nt, Homo sapiens
gaguaaacaacacaaagaa

SEQ ID NO: 331875 - RNA, 19 nt, Homo sapiens
aaagucagcuaugcaguau

SEQ ID NO: 331876 - RNA, 19 nt, Homo sapiens
uaucucugcuugacuguga

SEQ ID NO: 331877 - RNA, 19 nt, Homo sapiens
gaaauggaagauggaguuu

SEQ ID NO: 331878 - RNA, 19 nt, Homo sapiens
gagaagggcaguggcugua

SEQ ID NO: 331879 - RNA, 19 nt, Homo sapiens
gcacaggaccagacucaag

SEQ ID NO: 331880 - RNA, 19 nt, Homo sapiens
gaauaaagucagcuaugca

SEQ ID NO: 331881 - RNA, 19 nt, Homo sapiens
ugaauaaagucagcuaugc

SEQ ID NO: 331882 - RNA, 19 nt, Homo sapiens
uagcugcccuuuccguuuc

SEQ ID NO: 331883 - RNA, 19 nt, Homo sapiens
ggagcuaugacauugaaga

SEQ ID NO: 331884 - RNA, 19 nt, Homo sapiens
gguuggcacugacuauauc

SEQ ID NO: 331885 - RNA, 19 nt, Homo sapiens
agaaauggaagauggaguu

SEQ ID NO: 331886 - RNA, 19 nt, Homo sapiens
caaagaaauggaagaugga

SEQ ID NO: 331887 - RNA, 19 nt, Homo sapiens
guagcugcccuuuccguuu

SEQ ID NO: 331888 - RNA, 19 nt, Homo sapiens
guacugaggcagacguugu

SEQ ID NO: 331889 - RNA, 19 nt, Homo sapiens
gcuugacugugaauaaagu

SEQ ID NO: 331890 - RNA, 19 nt, Homo sapiens
cugcuugacugugaauaaa

SEQ ID NO: 331891 - RNA, 19 nt, Homo sapiens
agaagaugcaguuuccuuu

SEQ ID NO: 331892 - RNA, 19 nt, Homo sapiens
aauuggaccuuuaaacuac

SEQ ID NO: 331893 - RNA, 19 nt, Homo sapiens
uggaagauggaguuugaua

SEQ ID NO: 331894 - RNA, 19 nt, Homo sapiens
cuaaagaagaugcaguuuc

SEQ ID NO: 331895 - RNA, 19 nt, Homo sapiens
ggaagauggaguuugauac

SEQ ID NO: 331896 - RNA, 19 nt, Homo sapiens
gugaauaaagucagcuaug

SEQ ID NO: 331897 - RNA, 19 nt, Homo sapiens
aacccaaguccaagucuua

SEQ ID NO: 331898 - RNA, 19 nt, Homo sapiens
cggcugaucccuuauccaa

SEQ ID NO: 331899 - RNA, 19 nt, Homo sapiens
gaagauggaguuugauacc

SEQ ID NO: 331900 - RNA, 19 nt, Homo sapiens
gucuuauggugcaaacuuu

SEQ ID NO: 331901 - RNA, 19 nt, Homo sapiens
aaacccaaguccaagucuu

SEQ ID NO: 331902 - RNA, 19 nt, Homo sapiens
aaccuucaguacuaaagaa

SEQ ID NO: 331903 - RNA, 19 nt, Homo sapiens
ccaggucguugaggacuuc

SEQ ID NO: 331904 - RNA, 19 nt, Homo sapiens
gugcaaacuuuucuuggaa

SEQ ID NO: 331905 - RNA, 19 nt, Homo sapiens
ggucucaaugucaguggua

SEQ ID NO: 331906 - RNA, 19 nt, Homo sapiens
caugcagucuggaguaaac

SEQ ID NO: 331907 - RNA, 19 nt, Homo sapiens
gacuauaucucugcuugac

SEQ ID NO: 331908 - RNA, 19 nt, Homo sapiens
agacacacaacucauaaca

SEQ ID NO: 331909 - RNA, 19 nt, Homo sapiens
cacaggaccagacucaaga

SEQ ID NO: 331910 - RNA, 19 nt, Homo sapiens
gauggagcuaugacauuga

SEQ ID NO: 331911 - RNA, 19 nt, Homo sapiens
gauaucacuacuuuaacug

SEQ ID NO: 331912 - RNA, 19 nt, Homo sapiens
aacaugcagucuggaguaa

SEQ ID NO: 331913 - RNA, 19 nt, Homo sapiens
ccaaguccaagucuuaugg

SEQ ID NO: 331914 - RNA, 19 nt, Homo sapiens
caacggcugaucccuuauc

SEQ ID NO: 331915 - RNA, 19 nt, Homo sapiens
uaaccuucaguacuaaaga

SEQ ID NO: 331916 - RNA, 19 nt, Homo sapiens
aaacaacacaaagaaaugg

SEQ ID NO: 331917 - RNA, 19 nt, Homo sapiens
ucagcuaugcaguauuuau

SEQ ID NO: 331918 - RNA, 19 nt, Homo sapiens
ggugcaaacuuuucuugga

SEQ ID NO: 331919 - RNA, 19 nt, Homo sapiens
acacaaagaaauggaagau

SEQ ID NO: 331920 - RNA, 19 nt, Homo sapiens
uagguuggcacugacuaua

SEQ ID NO: 331921 - RNA, 19 nt, Homo sapiens
gagcuaugacauugaagag

SEQ ID NO: 331922 - RNA, 19 nt, Homo sapiens
guuccagaagagcauauaa

SEQ ID NO: 331923 - RNA, 19 nt, Homo sapiens
uggauggagcuaugacauu

SEQ ID NO: 331924 - RNA, 19 nt, Homo sapiens
aagaagaugcaguuuccuu

SEQ ID NO: 331925 - RNA, 19 nt, Homo sapiens
uauccaacaugguucuaac

SEQ ID NO: 331926 - RNA, 19 nt, Homo sapiens
caguauuuauaguccaugu

SEQ ID NO: 331927 - RNA, 19 nt, Homo sapiens
caagucuuauggugcaaac

SEQ ID NO: 331928 - RNA, 19 nt, Homo sapiens
auggagcuaugacauugaa

SEQ ID NO: 331929 - RNA, 19 nt, Homo sapiens
ggcuguagcugcccuuucc

SEQ ID NO: 331930 - RNA, 19 nt, Homo sapiens
gggauaagcugauaaagga

SEQ ID NO: 331931 - RNA, 19 nt, Homo sapiens
gagaaagagugcaagauag

SEQ ID NO: 331932 - RNA, 19 nt, Homo sapiens
gcacauggaaucgguuaua

SEQ ID NO: 331933 - RNA, 19 nt, Homo sapiens
agagaaagagugcaagaua

SEQ ID NO: 331934 - RNA, 19 nt, Homo sapiens
gaaagagugcaagauagaa

SEQ ID NO: 331935 - RNA, 19 nt, Homo sapiens
ccacuggaaagguuguuua

SEQ ID NO: 331936 - RNA, 19 nt, Homo sapiens
gugaacagcccuacaagau

SEQ ID NO: 331937 - RNA, 19 nt, Homo sapiens
gauaaaggaaggaaaguac

SEQ ID NO: 331938 - RNA, 19 nt, Homo sapiens
gcagagaaagagugcaaga

SEQ ID NO: 331939 - RNA, 19 nt, Homo sapiens
cuggaaagguuguuuacga

SEQ ID NO: 331940 - RNA, 19 nt, Homo sapiens
caaaccuccuugucaaagu

SEQ ID NO: 331941 - RNA, 19 nt, Homo sapiens
gcuggucgaugccaugcuu

SEQ ID NO: 331942 - RNA, 19 nt, Homo sapiens
auagaucgaugguugacaa

SEQ ID NO: 331943 - RNA, 19 nt, Homo sapiens
ucaggaagcagcgggauaa

SEQ ID NO: 331944 - RNA, 19 nt, Homo sapiens
agaaagagugcaagauaga

SEQ ID NO: 331945 - RNA, 19 nt, Homo sapiens
ggaagcagcgggauaagcu

SEQ ID NO: 331946 - RNA, 19 nt, Homo sapiens
agugcaagauagaauauga

SEQ ID NO: 331947 - RNA, 19 nt, Homo sapiens
gaucgaugguugacaaucc

SEQ ID NO: 331948 - RNA, 19 nt, Homo sapiens
gcaagauagaauaugauga

SEQ ID NO: 331949 - RNA, 19 nt, Homo sapiens
gguucggccuuaacauaga

SEQ ID NO: 331950 - RNA, 19 nt, Homo sapiens
aaaccuccuugucaaagug

SEQ ID NO: 331951 - RNA, 19 nt, Homo sapiens
gggcagagaaagagugcaa

SEQ ID NO: 331952 - RNA, 19 nt, Homo sapiens
ugauaaaggaaggaaagua

SEQ ID NO: 331953 - RNA, 19 nt, Homo sapiens
ggugaacagcccuacaaga

SEQ ID NO: 331954 - RNA, 19 nt, Homo sapiens
ggguagccaugccuuucuu

SEQ ID NO: 331955 - RNA, 19 nt, Homo sapiens
aagagugcaagauagaaua

SEQ ID NO: 331956 - RNA, 19 nt, Homo sapiens
gugcacauggaaucgguua

SEQ ID NO: 331957 - RNA, 19 nt, Homo sapiens
ugaacagcccuacaagaug

SEQ ID NO: 331958 - RNA, 19 nt, Homo sapiens
gcugauaaaggaaggaaag

SEQ ID NO: 331959 - RNA, 19 nt, Homo sapiens
gugcagguaccaucaggaa

SEQ ID NO: 331960 - RNA, 19 nt, Homo sapiens
guuauacucgggcagagaa

SEQ ID NO: 331961 - RNA, 19 nt, Homo sapiens
aaagagugcaagauagaau

SEQ ID NO: 331962 - RNA, 19 nt, Homo sapiens
gcuagcuagucguucugaa

SEQ ID NO: 331963 - RNA, 19 nt, Homo sapiens
guggugaacagcccuacaa

SEQ ID NO: 331964 - RNA, 19 nt, Homo sapiens
ggauaagcugauaaaggaa

SEQ ID NO: 331965 - RNA, 19 nt, Homo sapiens
guucggccuuaacauagau

SEQ ID NO: 331966 - RNA, 19 nt, Homo sapiens
cauggaaucgguuauacuc

SEQ ID NO: 331967 - RNA, 19 nt, Homo sapiens
cacauggaaucgguuauac

SEQ ID NO: 331968 - RNA, 19 nt, Homo sapiens
gauaaagacuacaggagaa

SEQ ID NO: 331969 - RNA, 19 nt, Homo sapiens
agaaagaggugaaugaaaa

SEQ ID NO: 331970 - RNA, 19 nt, Homo sapiens
gguggagacucgggugaua

SEQ ID NO: 331971 - RNA, 19 nt, Homo sapiens
guuuguaggucgucagaaa

SEQ ID NO: 331972 - RNA, 19 nt, Homo sapiens
caggagaauucgguuugua

SEQ ID NO: 331973 - RNA, 19 nt, Homo sapiens
aaacuuugccauugauuug

SEQ ID NO: 331974 - RNA, 19 nt, Homo sapiens
cagaaagaggugaaugaaa

SEQ ID NO: 331975 - RNA, 19 nt, Homo sapiens
acacuggccagguuuauga

SEQ ID NO: 331976 - RNA, 19 nt, Homo sapiens
aaacuuggacaaagaaaca

SEQ ID NO: 331977 - RNA, 19 nt, Homo sapiens
ggccagguuuaugaugaua

SEQ ID NO: 331978 - RNA, 19 nt, Homo sapiens
ggguauuccuggugcugaa

SEQ ID NO: 331979 - RNA, 19 nt, Homo sapiens
ucagaaagaggugaaugaa

SEQ ID NO: 331980 - RNA, 19 nt, Homo sapiens
gcacacuggccagguuuau

SEQ ID NO: 331981 - RNA, 19 nt, Homo sapiens
cagcauccugugagcauuu

SEQ ID NO: 331982 - RNA, 19 nt, Homo sapiens
gucagaaagaggugaauga

SEQ ID NO: 331983 - RNA, 19 nt, Homo sapiens
uaaagacuacaggagaauu

SEQ ID NO: 331984 - RNA, 19 nt, Homo sapiens
agaggugaaugaaaacuuu

SEQ ID NO: 331985 - RNA, 19 nt, Homo sapiens
cuggccagguuuaugauga

SEQ ID NO: 331986 - RNA, 19 nt, Homo sapiens
cuacaggagaauucgguuu

SEQ ID NO: 331987 - RNA, 19 nt, Homo sapiens
aaagacuacaggagaauuc

SEQ ID NO: 331988 - RNA, 19 nt, Homo sapiens
gagaauucgguuuguaggu

SEQ ID NO: 331989 - RNA, 19 nt, Homo sapiens
uacaggagaauucgguuug

SEQ ID NO: 331990 - RNA, 19 nt, Homo sapiens
gggaagcugagcacgugaa

SEQ ID NO: 331991 - RNA, 19 nt, Homo sapiens
acaggagaauucgguuugu

SEQ ID NO: 331992 - RNA, 19 nt, Homo sapiens
cacgcacacuggccagguu

SEQ ID NO: 331993 - RNA, 19 nt, Homo sapiens
cccgugagguugucaauaa

SEQ ID NO: 331994 - RNA, 19 nt, Homo sapiens
gcuacuaccacuauuccua

SEQ ID NO: 331995 - RNA, 19 nt, Homo sapiens
ggaggcuacuaccacuauu

SEQ ID NO: 331996 - RNA, 19 nt, Homo sapiens
gagcggaggcugcagaucu

SEQ ID NO: 331997 - RNA, 19 nt, Homo sapiens
caacggaggaggcuacuac

SEQ ID NO: 331998 - RNA, 19 nt, Homo sapiens
gcacgagguguccaucaga

SEQ ID NO: 331999 - RNA, 19 nt, Homo sapiens
ggaggcugcagaucuggua

SEQ ID NO: 332000 - RNA, 19 nt, Homo sapiens
gcacacucaccaacaagau

SEQ ID NO: 332001 - RNA, 19 nt, Homo sapiens
ccgugagguugucaauaaa

SEQ ID NO: 332002 - RNA, 19 nt, Homo sapiens
gaggaggcuacuaccacua

SEQ ID NO: 332003 - RNA, 19 nt, Homo sapiens
ccggcacacucaccaacaa

SEQ ID NO: 332004 - RNA, 19 nt, Homo sapiens
gaggcuacuaccacuauuc

SEQ ID NO: 332005 - RNA, 19 nt, Homo sapiens
gcuugugucccgugagguu

SEQ ID NO: 332006 - RNA, 19 nt, Homo sapiens
cauccaggcugacuacuug

SEQ ID NO: 332007 - RNA, 19 nt, Homo sapiens
augaggagcugcuguacaa

SEQ ID NO: 332008 - RNA, 19 nt, Homo sapiens
gcacccugcuguggacuga

SEQ ID NO: 332009 - RNA, 19 nt, Homo sapiens
gcagccaccuacaaguaug

SEQ ID NO: 332010 - RNA, 19 nt, Homo sapiens
ucaacuacccguucgagaa

SEQ ID NO: 332011 - RNA, 19 nt, Homo sapiens
gcuaugacaucgacaugac

SEQ ID NO: 332012 - RNA, 19 nt, Homo sapiens
gcuguggacugagcucuuc

SEQ ID NO: 332013 - RNA, 19 nt, Homo sapiens
caacuacccguucgagaag

SEQ ID NO: 332014 - RNA, 19 nt, Homo sapiens
caacauccaggcugacuac

SEQ ID NO: 332015 - RNA, 19 nt, Homo sapiens
gaggagcugcuguacaaca

SEQ ID NO: 332016 - RNA, 19 nt, Homo sapiens
caugcaggaucccgagaug

SEQ ID NO: 332017 - RNA, 19 nt, Homo sapiens
agauggacaugaagucagu

SEQ ID NO: 332018 - RNA, 19 nt, Homo sapiens
gaaccggccaccaucaacu

SEQ ID NO: 332019 - RNA, 19 nt, Homo sapiens
ggcagccaccuacaaguau

SEQ ID NO: 332020 - RNA, 19 nt, Homo sapiens
acaucgacaugaccaagug

SEQ ID NO: 332021 - RNA, 19 nt, Homo sapiens
ccaccuacaaguaugugaa

SEQ ID NO: 332022 - RNA, 19 nt, Homo sapiens
gggaaccggccaccaucaa

SEQ ID NO: 332023 - RNA, 19 nt, Homo sapiens
acaaggagaaguugcucaa

SEQ ID NO: 332024 - RNA, 19 nt, Homo sapiens
aggagcugcuguacaacaa

SEQ ID NO: 332025 - RNA, 19 nt, Homo sapiens
gacaugaccaagugcaucu

SEQ ID NO: 332026 - RNA, 19 nt, Homo sapiens
ggaccacccgcuaugacau

SEQ ID NO: 332027 - RNA, 19 nt, Homo sapiens
cgagauggacaugaaguca

SEQ ID NO: 332028 - RNA, 19 nt, Homo sapiens
gaacaagguugcagaaguu

SEQ ID NO: 332029 - RNA, 19 nt, Homo sapiens
guaaauaugucacuagaga

SEQ ID NO: 332030 - RNA, 19 nt, Homo sapiens
gaagacauguaaggaauuu

SEQ ID NO: 332031 - RNA, 19 nt, Homo sapiens
gagauacuccugagaauaa

SEQ ID NO: 332032 - RNA, 19 nt, Homo sapiens
guaaggaauuugcauaaga

SEQ ID NO: 332033 - RNA, 19 nt, Homo sapiens
caagcaggccuuuaauuua

SEQ ID NO: 332034 - RNA, 19 nt, Homo sapiens
gaaagccaguuggaaagua

SEQ ID NO: 332035 - RNA, 19 nt, Homo sapiens
gagaguauaugaaguagca

SEQ ID NO: 332036 - RNA, 19 nt, Homo sapiens
acaaguaccuccaaugaga

SEQ ID NO: 332037 - RNA, 19 nt, Homo sapiens
ucgaaacucugacagcaua

SEQ ID NO: 332038 - RNA, 19 nt, Homo sapiens
gggaagacauguaaggaau

SEQ ID NO: 332039 - RNA, 19 nt, Homo sapiens
aagcaggccuuuaauuuau

SEQ ID NO: 332040 - RNA, 19 nt, Homo sapiens
acaagcaggccuuuaauuu

SEQ ID NO: 332041 - RNA, 19 nt, Homo sapiens
caagggaccuggauuuggu

SEQ ID NO: 332042 - RNA, 19 nt, Homo sapiens
uggaggagcuuuauuugug

SEQ ID NO: 332043 - RNA, 19 nt, Homo sapiens
gacaaacuuuucacucuua

SEQ ID NO: 332044 - RNA, 19 nt, Homo sapiens
gcaggccuuuaauuuauau

SEQ ID NO: 332045 - RNA, 19 nt, Homo sapiens
ugaacaagguugcagaagu

SEQ ID NO: 332046 - RNA, 19 nt, Homo sapiens
gcucaaggcuggcaaaauc

SEQ ID NO: 332047 - RNA, 19 nt, Homo sapiens
caauuacuaugaggauuug

SEQ ID NO: 332048 - RNA, 19 nt, Homo sapiens
ggaagacauguaaggaauu

SEQ ID NO: 332049 - RNA, 19 nt, Homo sapiens
uuacaaguaccuccaauga

SEQ ID NO: 332050 - RNA, 19 nt, Homo sapiens
auucaggucugcacuacua

SEQ ID NO: 332051 - RNA, 19 nt, Homo sapiens
gagaauaacccugauacuc

SEQ ID NO: 332052 - RNA, 19 nt, Homo sapiens
ccaaugagaguauaugaag

SEQ ID NO: 332053 - RNA, 19 nt, Homo sapiens
gauacuccauuugauuuca

SEQ ID NO: 332054 - RNA, 19 nt, Homo sapiens
cagagauacuccugagaau

SEQ ID NO: 332055 - RNA, 19 nt, Homo sapiens
ggaccuggauuugguguac

SEQ ID NO: 332056 - RNA, 19 nt, Homo sapiens
gacaauuacuaugaggauu

SEQ ID NO: 332057 - RNA, 19 nt, Homo sapiens
uaacccugauacuccauuu

SEQ ID NO: 332058 - RNA, 19 nt, Homo sapiens
uaaggaauuugcauaagac

SEQ ID NO: 332059 - RNA, 19 nt, Homo sapiens
aaagccaguuggaaaguau

SEQ ID NO: 332060 - RNA, 19 nt, Homo sapiens
gcccaucucugcuaugaac

SEQ ID NO: 332061 - RNA, 19 nt, Homo sapiens
uaugaggauuugacagcua

SEQ ID NO: 332062 - RNA, 19 nt, Homo sapiens
guuggaaaguaucacauuc

SEQ ID NO: 332063 - RNA, 19 nt, Homo sapiens
guacaagcaggccuuuaau

SEQ ID NO: 332064 - RNA, 19 nt, Homo sapiens
uguacaagcaggccuuuaa

SEQ ID NO: 332065 - RNA, 19 nt, Homo sapiens
cauguaaggaauuugcaua

SEQ ID NO: 332066 - RNA, 19 nt, Homo sapiens
acagagauacuccugagaa

SEQ ID NO: 332067 - RNA, 19 nt, Homo sapiens
caaugagaguauaugaagu

SEQ ID NO: 332068 - RNA, 19 nt, Homo sapiens
caagguugcagaaguuuua

SEQ ID NO: 332069 - RNA, 19 nt, Homo sapiens
agagauacuccugagaaua

SEQ ID NO: 332070 - RNA, 19 nt, Homo sapiens
uaagacagcuaugcaaaau

SEQ ID NO: 332071 - RNA, 19 nt, Homo sapiens
ccaaugguucaaauaaaug

SEQ ID NO: 332072 - RNA, 19 nt, Homo sapiens
gcuggaggagcuuuauuug

SEQ ID NO: 332073 - RNA, 19 nt, Homo sapiens
ccugauacuccauuugauu

SEQ ID NO: 332074 - RNA, 19 nt, Homo sapiens
agcaggccuuuaauuuaua

SEQ ID NO: 332075 - RNA, 19 nt, Homo sapiens
ugagccagcuggaggucuu

SEQ ID NO: 332076 - RNA, 19 nt, Homo sapiens
uauaaucgaaagccaguug

SEQ ID NO: 332077 - RNA, 19 nt, Homo sapiens
cugauacuccauuugauuu

SEQ ID NO: 332078 - RNA, 19 nt, Homo sapiens
cuguaaauaugucacuaga

SEQ ID NO: 332079 - RNA, 19 nt, Homo sapiens
gaacuguaaauaugucacu

SEQ ID NO: 332080 - RNA, 19 nt, Homo sapiens
uacaagcaggccuuuaauu

SEQ ID NO: 332081 - RNA, 19 nt, Homo sapiens
guaccuccaaugagaguau

SEQ ID NO: 332082 - RNA, 19 nt, Homo sapiens
gcagaaguuuuacaaguac

SEQ ID NO: 332083 - RNA, 19 nt, Homo sapiens
ugcagaaguuuuacaagua

SEQ ID NO: 332084 - RNA, 19 nt, Homo sapiens
auaagaggauagaggcaau

SEQ ID NO: 332085 - RNA, 19 nt, Homo sapiens
ugacaauuacuaugaggau

SEQ ID NO: 332086 - RNA, 19 nt, Homo sapiens
cacccugcaugcuucgaaa

SEQ ID NO: 332087 - RNA, 19 nt, Homo sapiens
ucucugcuaugaacaaggu

SEQ ID NO: 332088 - RNA, 19 nt, Homo sapiens
uggauuugguguacaagca

SEQ ID NO: 332089 - RNA, 19 nt, Homo sapiens
uguaaggaauuugcauaag

SEQ ID NO: 332090 - RNA, 19 nt, Homo sapiens
ugacaaacuuuucacucuu

SEQ ID NO: 332091 - RNA, 19 nt, Homo sapiens
gcacuacuacacccugcau

SEQ ID NO: 332092 - RNA, 19 nt, Homo sapiens
agacagcuaugcaaaaugg

SEQ ID NO: 332093 - RNA, 19 nt, Homo sapiens
ccugagaauaacccugaua

SEQ ID NO: 332094 - RNA, 19 nt, Homo sapiens
uggaaaguaucacauucag

SEQ ID NO: 332095 - RNA, 19 nt, Homo sapiens
uaccuccaaugagaguaua

SEQ ID NO: 332096 - RNA, 19 nt, Homo sapiens
uugcccaucucugcuauga

SEQ ID NO: 332097 - RNA, 19 nt, Homo sapiens
ucaaguagaugaagaguuu

SEQ ID NO: 332098 - RNA, 19 nt, Homo sapiens
gaagcaaaguuuaaaggaa

SEQ ID NO: 332099 - RNA, 19 nt, Homo sapiens
ggagucaccucgacacuga

SEQ ID NO: 332100 - RNA, 19 nt, Homo sapiens
ggacuugcuucuacgguuu

SEQ ID NO: 332101 - RNA, 19 nt, Homo sapiens
acaagaaccugcagcauca

SEQ ID NO: 332102 - RNA, 19 nt, Homo sapiens
gcuacuagaugccugagaa

SEQ ID NO: 332103 - RNA, 19 nt, Homo sapiens
gcacguacaccuucuuaga

SEQ ID NO: 332104 - RNA, 19 nt, Homo sapiens
ggccauaauucaaggauug

SEQ ID NO: 332105 - RNA, 19 nt, Homo sapiens
gaagacagaaacagagauu

SEQ ID NO: 332106 - RNA, 19 nt, Homo sapiens
gaaagaugaggaagaauuc

SEQ ID NO: 332107 - RNA, 19 nt, Homo sapiens
agagaaagaugaggaagaa

SEQ ID NO: 332108 - RNA, 19 nt, Homo sapiens
gcaguucacucaccaaggu

SEQ ID NO: 332109 - RNA, 19 nt, Homo sapiens
gaaacagagauugaaguua

SEQ ID NO: 332110 - RNA, 19 nt, Homo sapiens
gggcccagcuuccaacaga

SEQ ID NO: 332111 - RNA, 19 nt, Homo sapiens
gcacuucgcacgauuccaa

SEQ ID NO: 332112 - RNA, 19 nt, Homo sapiens
gagcagaaagggaagagaa

SEQ ID NO: 332113 - RNA, 19 nt, Homo sapiens
gaucagauaccaccaagca

SEQ ID NO: 332114 - RNA, 19 nt, Homo sapiens
ccaggaagcccagguguuu

SEQ ID NO: 332115 - RNA, 19 nt, Homo sapiens
ugacaacacuaccuacaag

SEQ ID NO: 332116 - RNA, 19 nt, Homo sapiens
gaagcaaaguccaccaaaa

SEQ ID NO: 332117 - RNA, 19 nt, Homo sapiens
ggagaaugccagaugaaga

SEQ ID NO: 332118 - RNA, 19 nt, Homo sapiens
gacaggcaaucguggaaga

SEQ ID NO: 332119 - RNA, 19 nt, Homo sapiens
ugaugaggcugacguuuca

SEQ ID NO: 332120 - RNA, 19 nt, Homo sapiens
gcagcgugcuauucacaga

SEQ ID NO: 332121 - RNA, 19 nt, Homo sapiens
guacuugccuaauguucau

SEQ ID NO: 332122 - RNA, 19 nt, Homo sapiens
gaagaucagauaccaccaa

SEQ ID NO: 332123 - RNA, 19 nt, Homo sapiens
agaaagaugaggaagaauu

SEQ ID NO: 332124 - RNA, 19 nt, Homo sapiens
aaaguucugucuccauuca

SEQ ID NO: 332125 - RNA, 19 nt, Homo sapiens
uaucuucacccaguucuua

SEQ ID NO: 332126 - RNA, 19 nt, Homo sapiens
gaauagaaggccaccugaa

SEQ ID NO: 332127 - RNA, 19 nt, Homo sapiens
gaauaagggcaggaaggua

SEQ ID NO: 332128 - RNA, 19 nt, Homo sapiens
agacagaaacagagauuga

SEQ ID NO: 332129 - RNA, 19 nt, Homo sapiens
caguuccuguugagaauaa

SEQ ID NO: 332130 - RNA, 19 nt, Homo sapiens
ugccuaauguucauccuuu

SEQ ID NO: 332131 - RNA, 19 nt, Homo sapiens
gaagccaagagaaagauga

SEQ ID NO: 332132 - RNA, 19 nt, Homo sapiens
agaggagaaugccagauga

SEQ ID NO: 332133 - RNA, 19 nt, Homo sapiens
gcagcugaauugucuaaaa

SEQ ID NO: 332134 - RNA, 19 nt, Homo sapiens
caccagaagccaagagaaa

SEQ ID NO: 332135 - RNA, 19 nt, Homo sapiens
cagcuccucugauucugaa

SEQ ID NO: 332136 - RNA, 19 nt, Homo sapiens
gggagaagacagaggagaa

SEQ ID NO: 332137 - RNA, 19 nt, Homo sapiens
caagcaauuuggagacagu

SEQ ID NO: 332138 - RNA, 19 nt, Homo sapiens
gaguuacaguaucagcaaa

SEQ ID NO: 332139 - RNA, 19 nt, Homo sapiens
gaaagccuggugagcagaa

SEQ ID NO: 332140 - RNA, 19 nt, Homo sapiens
cagcacguacaccuucuua

SEQ ID NO: 332141 - RNA, 19 nt, Homo sapiens
gaaaacagggcucugauuc

SEQ ID NO: 332142 - RNA, 19 nt, Homo sapiens
ucacugguaggauguguuu

SEQ ID NO: 332143 - RNA, 19 nt, Homo sapiens
agaaacagagauugaaguu

SEQ ID NO: 332144 - RNA, 19 nt, Homo sapiens
guucauccuuuccucuaga

SEQ ID NO: 332145 - RNA, 19 nt, Homo sapiens
aaucguggaagaucagaua

SEQ ID NO: 332146 - RNA, 19 nt, Homo sapiens
cagauaccaccaagcaauu

SEQ ID NO: 332147 - RNA, 19 nt, Homo sapiens
ccagaagccaagagaaaga

SEQ ID NO: 332148 - RNA, 19 nt, Homo sapiens
gacagaaacagagauugaa

SEQ ID NO: 332149 - RNA, 19 nt, Homo sapiens
ggagaagacagaggagaau

SEQ ID NO: 332150 - RNA, 19 nt, Homo sapiens
ucagauaccaccaagcaau

SEQ ID NO: 332151 - RNA, 19 nt, Homo sapiens
ccacaaugcccagaucuca

SEQ ID NO: 332152 - RNA, 19 nt, Homo sapiens
ugguagaguuuccacagaa

SEQ ID NO: 332153 - RNA, 19 nt, Homo sapiens
gaaagggaagagaaacaag

SEQ ID NO: 332154 - RNA, 19 nt, Homo sapiens
gagaaugccagaugaagac

SEQ ID NO: 332155 - RNA, 19 nt, Homo sapiens
gaggagaaugccagaugaa

SEQ ID NO: 332156 - RNA, 19 nt, Homo sapiens
aaaccacaaugcccagauc

SEQ ID NO: 332157 - RNA, 19 nt, Homo sapiens
gaaaguucugucuccauuc

SEQ ID NO: 332158 - RNA, 19 nt, Homo sapiens
ggguguucauucacuggua

SEQ ID NO: 332159 - RNA, 19 nt, Homo sapiens
cagaggagaaugccagaug

SEQ ID NO: 332160 - RNA, 19 nt, Homo sapiens
gauaccaccaagcaauuug

SEQ ID NO: 332161 - RNA, 19 nt, Homo sapiens
ugaagcaaaguuuaaagga

SEQ ID NO: 332162 - RNA, 19 nt, Homo sapiens
gaaucagggaagagugaaa

SEQ ID NO: 332163 - RNA, 19 nt, Homo sapiens
ccaagagaaagaugaggaa

SEQ ID NO: 332164 - RNA, 19 nt, Homo sapiens
gaagaauucuccccuagac

SEQ ID NO: 332165 - RNA, 19 nt, Homo sapiens
ugagaagggagaagacaga

SEQ ID NO: 332166 - RNA, 19 nt, Homo sapiens
gcugguggccuucgguguu

SEQ ID NO: 332167 - RNA, 19 nt, Homo sapiens
ggaaaaugcgagaccaaaa

SEQ ID NO: 332168 - RNA, 19 nt, Homo sapiens
ucaggugggucggaaagug

SEQ ID NO: 332169 - RNA, 19 nt, Homo sapiens
cugcugagccguuugacaa

SEQ ID NO: 332170 - RNA, 19 nt, Homo sapiens
gaccugaugauggcuacua

SEQ ID NO: 332171 - RNA, 19 nt, Homo sapiens
gccacaggauuccaagaag

SEQ ID NO: 332172 - RNA, 19 nt, Homo sapiens
ccagguguuucgaggacuu

SEQ ID NO: 332173 - RNA, 19 nt, Homo sapiens
caacacuaccuacaagaac

SEQ ID NO: 332174 - RNA, 19 nt, Homo sapiens
gcugagccguuugacaaca

SEQ ID NO: 332175 - RNA, 19 nt, Homo sapiens
gagaagacagaggagaaug

SEQ ID NO: 332176 - RNA, 19 nt, Homo sapiens
aaugccagaugaagacaga

SEQ ID NO: 332177 - RNA, 19 nt, Homo sapiens
acaacacuaccuacaagaa

SEQ ID NO: 332178 - RNA, 19 nt, Homo sapiens
gaugaugaggcugacguuu

SEQ ID NO: 332179 - RNA, 19 nt, Homo sapiens
gcuccuagccacccagaca

SEQ ID NO: 332180 - RNA, 19 nt, Homo sapiens
acaaggguguucauucacu

SEQ ID NO: 332181 - RNA, 19 nt, Homo sapiens
gaucugauggagugcacuu

SEQ ID NO: 332182 - RNA, 19 nt, Homo sapiens
gacaacacuaccuacaaga

SEQ ID NO: 332183 - RNA, 19 nt, Homo sapiens
aaagugacgucgccuucgu

SEQ ID NO: 332184 - RNA, 19 nt, Homo sapiens
cagaaagggaagagaaaca

SEQ ID NO: 332185 - RNA, 19 nt, Homo sapiens
ccuuaccuguccacacaaa

SEQ ID NO: 332186 - RNA, 19 nt, Homo sapiens
acccuuaccuguccacaca

SEQ ID NO: 332187 - RNA, 19 nt, Homo sapiens
cuucuacgguuucuuuguc

SEQ ID NO: 332188 - RNA, 19 nt, Homo sapiens
cggaaucagggaagaguga

SEQ ID NO: 332189 - RNA, 19 nt, Homo sapiens
agaaagggaagagaaacaa

SEQ ID NO: 332190 - RNA, 19 nt, Homo sapiens
aauagaaggccaccugaag

SEQ ID NO: 332191 - RNA, 19 nt, Homo sapiens
cugguggccuucgguguuu

SEQ ID NO: 332192 - RNA, 19 nt, Homo sapiens
ggaaucagggaagagugaa

SEQ ID NO: 332193 - RNA, 19 nt, Homo sapiens
ggguuuggcaguucacuca

SEQ ID NO: 332194 - RNA, 19 nt, Homo sapiens
agacguaggaccugaugau

SEQ ID NO: 332195 - RNA, 19 nt, Homo sapiens
agaugaagacagaaacaga

SEQ ID NO: 332196 - RNA, 19 nt, Homo sapiens
cagaaacagagauugaagu

SEQ ID NO: 332197 - RNA, 19 nt, Homo sapiens
gaaacacaauccucagaaa

SEQ ID NO: 332198 - RNA, 19 nt, Homo sapiens
ggaauuggauaucaucuau
